United States Patent 11,369,692 (MATERIALS AND METHODS FOR TREATMENT OF DUCHENNE MUSCULAR DYSTROPHY) - sequence listing, part 7

SEQ ID NO: 203423 - DNA, 20 bp, Artificial Sequence
  chemically synthesized
ttttgaattaaggggtgata

SEQ ID NO: 203424 - DNA, 20 bp, Artificial Sequence
  chemically synthesized
attttgaattaaggggtgat

SEQ ID NO: 203425 - DNA, 20 bp, Artificial Sequence
  chemically synthesized
acaatcaattttgaattaag

SEQ ID NO: 203426 - DNA, 20 bp, Artificial Sequence
  chemically synthesized
cacaatcaattttgaattaa

SEQ ID NO: 203427 - DNA, 20 bp, Artificial Sequence
  chemically synthesized
gcacaatcaattttgaatta

SEQ ID NO: 203428 - DNA, 20 bp, Artificial Sequence
  chemically synthesized
agcacaatcaattttgaatt

SEQ ID NO: 203429 - DNA, 20 bp, Artificial Sequence
  chemically synthesized
attgattgtgctctctattc

SEQ ID NO: 203430 - DNA, 20 bp, Artificial Sequence
  chemically synthesized
cactcgaagtctagaataga

SEQ ID NO: 203431 - DNA, 20 bp, Artificial Sequence
  chemically synthesized
gtcactcgaagtctagaata

SEQ ID NO: 203432 - DNA, 20 bp, Artificial Sequence
  chemically synthesized
gggtcactcgaagtctagaa

SEQ ID NO: 203433 - DNA, 20 bp, Artificial Sequence
  chemically synthesized
tgctctctattctagacttc

SEQ ID NO: 203434 - DNA, 20 bp, Artificial Sequence
  chemically synthesized
aatatgggtcactcgaagtc

SEQ ID NO: 203435 - DNA, 20 bp, Artificial Sequence
  chemically synthesized
caaaaaatatgggtcactcg

SEQ ID NO: 203436 - DNA, 20 bp, Artificial Sequence
  chemically synthesized
atacaaatggcaaaaaatat

SEQ ID NO: 203437 - DNA, 20 bp, Artificial Sequence
  chemically synthesized
aatacaaatggcaaaaaata

SEQ ID NO: 203438 - DNA, 20 bp, Artificial Sequence
  chemically synthesized
aaattaaagaaaaatacaaa

SEQ ID NO: 203439 - DNA, 20 bp, Artificial Sequence
  chemically synthesized
taaagtgggctaggaaatta

SEQ ID NO: 203440 - DNA, 20 bp, Artificial Sequence
  chemically synthesized
tgtatttttctttaatttcc

SEQ ID NO: 203441 - DNA, 20 bp, Artificial Sequence
  chemically synthesized
gaagaccggtaaagtgggct

SEQ ID NO: 203442 - DNA, 20 bp, Artificial Sequence
  chemically synthesized
agaagaccggtaaagtgggc

SEQ ID NO: 203443 - DNA, 20 bp, Artificial Sequence
  chemically synthesized
aatttcctagcccactttac

SEQ ID NO: 203444 - DNA, 20 bp, Artificial Sequence
  chemically synthesized
aatgagaagaccggtaaagt

SEQ ID NO: 203445 - DNA, 20 bp, Artificial Sequence
  chemically synthesized
caatgagaagaccggtaaag

SEQ ID NO: 203446 - DNA, 20 bp, Artificial Sequence
  chemically synthesized
atacaatgagaagaccggta

SEQ ID NO: 203447 - DNA, 20 bp, Artificial Sequence
  chemically synthesized
tgaacatacaatgagaagac

SEQ ID NO: 203448 - DNA, 20 bp, Artificial Sequence
  chemically synthesized
tattctgaacatacaatgag

SEQ ID NO: 203449 - DNA, 20 bp, Artificial Sequence
  chemically synthesized
ttttattctgaacatacaat

SEQ ID NO: 203450 - DNA, 20 bp, Artificial Sequence
  chemically synthesized
cggtcttctcattgtatgtt

SEQ ID NO: 203451 - DNA, 20 bp, Artificial Sequence
  chemically synthesized
tcattgtatgttcagaataa

SEQ ID NO: 203452 - DNA, 20 bp, Artificial Sequence
  chemically synthesized
gtatgttcagaataaaagaa

SEQ ID NO: 203453 - DNA, 20 bp, Artificial Sequence
  chemically synthesized
tatgttcagaataaaagaaa

SEQ ID NO: 203454 - DNA, 20 bp, Artificial Sequence
  chemically synthesized
gaataaaagaaaaggaccac

SEQ ID NO: 203455 - DNA, 20 bp, Artificial Sequence
  chemically synthesized
taaaagaaaaggaccacgag

SEQ ID NO: 203456 - DNA, 20 bp, Artificial Sequence
  chemically synthesized
cataaaggatattcttctcg

SEQ ID NO: 203457 - DNA, 20 bp, Artificial Sequence
  chemically synthesized
cacgagaagaatatccttta

SEQ ID NO: 203458 - DNA, 20 bp, Artificial Sequence
  chemically synthesized
gttttcatatagtaccataa

SEQ ID NO: 203459 - DNA, 20 bp, Artificial Sequence
  chemically synthesized
cgttttcatatagtaccata

SEQ ID NO: 203460 - DNA, 20 bp, Artificial Sequence
  chemically synthesized
attcatgccacgttttcata

SEQ ID NO: 203461 - DNA, 20 bp, Artificial Sequence
  chemically synthesized
tatggtactatatgaaaacg

SEQ ID NO: 203462 - DNA, 20 bp, Artificial Sequence
  chemically synthesized
tgatttttgtatgattagtc

SEQ ID NO: 203463 - DNA, 20 bp, Artificial Sequence
  chemically synthesized
gttactgatttttgtatgat

SEQ ID NO: 203464 - DNA, 20 bp, Artificial Sequence
  chemically synthesized
ttgactaatcatacaaaaat

SEQ ID NO: 203465 - DNA, 20 bp, Artificial Sequence
  chemically synthesized
taacatcacactactgtcca

SEQ ID NO: 203466 - DNA, 20 bp, Artificial Sequence
  chemically synthesized
aacccaatatctgtggacag

SEQ ID NO: 203467 - DNA, 20 bp, Artificial Sequence
  chemically synthesized
actaacccaatatctgtgga

SEQ ID NO: 203468 - DNA, 20 bp, Artificial Sequence
  chemically synthesized
acactactgtccacagatat

SEQ ID NO: 203469 - DNA, 20 bp, Artificial Sequence
  chemically synthesized
tctgactaacccaatatctg

SEQ ID NO: 203470 - DNA, 20 bp, Artificial Sequence
  chemically synthesized
cactactgtccacagatatt

SEQ ID NO: 203471 - DNA, 20 bp, Artificial Sequence
  chemically synthesized
actgtccacagatattgggt

SEQ ID NO: 203472 - DNA, 20 bp, Artificial Sequence
  chemically synthesized
tccacagatattgggttagt

SEQ ID NO: 203473 - DNA, 20 bp, Artificial Sequence
  chemically synthesized
ttgggttagtcagatttcat

SEQ ID NO: 203474 - DNA, 20 bp, Artificial Sequence
  chemically synthesized
ttagtcagatttcattagtt

SEQ ID NO: 203475 - DNA, 20 bp, Artificial Sequence
  chemically synthesized
tcagatttcattagtttagt

SEQ ID NO: 203476 - DNA, 20 bp, Artificial Sequence
  chemically synthesized
cagatttcattagtttagtc

SEQ ID NO: 203477 - DNA, 20 bp, Artificial Sequence
  chemically synthesized
attagtttagtcaggtaatc

SEQ ID NO: 203478 - DNA, 20 bp, Artificial Sequence
  chemically synthesized
cttcccacttaatttcaagc

SEQ ID NO: 203479 - DNA, 20 bp, Artificial Sequence
  chemically synthesized
ccttcccacttaatttcaag

SEQ ID NO: 203480 - DNA, 20 bp, Artificial Sequence
  chemically synthesized
cgagaaacctgcttgaaatt

SEQ ID NO: 203481 - DNA, 20 bp, Artificial Sequence
  chemically synthesized
ccaccttcccacttaatttc

SEQ ID NO: 203482 - DNA, 20 bp, Artificial Sequence
  chemically synthesized
gaaacctgcttgaaattaag

SEQ ID NO: 203483 - DNA, 20 bp, Artificial Sequence
  chemically synthesized
aaacctgcttgaaattaagt

SEQ ID NO: 203484 - DNA, 20 bp, Artificial Sequence
  chemically synthesized
cctgcttgaaattaagtggg

SEQ ID NO: 203485 - DNA, 20 bp, Artificial Sequence
  chemically synthesized
ctgcttgaaattaagtggga

SEQ ID NO: 203486 - DNA, 20 bp, Artificial Sequence
  chemically synthesized
cttgaaattaagtgggaagg

SEQ ID NO: 203487 - DNA, 20 bp, Artificial Sequence
  chemically synthesized
ttgaaattaagtgggaaggt

SEQ ID NO: 203488 - DNA, 20 bp, Artificial Sequence
  chemically synthesized
gataatcaaattttataaca

SEQ ID NO: 203489 - DNA, 20 bp, Artificial Sequence
  chemically synthesized
ttttataacatagcatactg

SEQ ID NO: 203490 - DNA, 20 bp, Artificial Sequence
  chemically synthesized
tttataacatagcatactga

SEQ ID NO: 203491 - DNA, 20 bp, Artificial Sequence
  chemically synthesized
tgtcagctttagatttcctt

SEQ ID NO: 203492 - DNA, 20 bp, Artificial Sequence
  chemically synthesized
agcatactgaaggaaatcta

SEQ ID NO: 203493 - DNA, 20 bp, Artificial Sequence
  chemically synthesized
tttccaattaatgtcagctt

SEQ ID NO: 203494 - DNA, 20 bp, Artificial Sequence
  chemically synthesized
cattcatttccaattaatgt

SEQ ID NO: 203495 - DNA, 20 bp, Artificial Sequence
  chemically synthesized
aatctaaagctgacattaat

SEQ ID NO: 203496 - DNA, 20 bp, Artificial Sequence
  chemically synthesized
gacattaattggaaatgaat

SEQ ID NO: 203497 - DNA, 20 bp, Artificial Sequence
  chemically synthesized
cattaattggaaatgaatga

SEQ ID NO: 203498 - DNA, 20 bp, Artificial Sequence
  chemically synthesized
taattggaaatgaatgagag

SEQ ID NO: 203499 - DNA, 20 bp, Artificial Sequence
  chemically synthesized
ttggaaatgaatgagagtag

SEQ ID NO: 203500 - DNA, 20 bp, Artificial Sequence
  chemically synthesized
ctcaaggtactgcagatatt

SEQ ID NO: 203501 - DNA, 20 bp, Artificial Sequence
  chemically synthesized
gtagtagatccaaatatctg

SEQ ID NO: 203502 - DNA, 20 bp, Artificial Sequence
  chemically synthesized
tcctgctgctcaaggtactg

SEQ ID NO: 203503 - DNA, 20 bp, Artificial Sequence
  chemically synthesized
ccaaatatctgcagtacctt

SEQ ID NO: 203504 - DNA, 20 bp, Artificial Sequence
  chemically synthesized
aatatctgcagtaccttgag

SEQ ID NO: 203505 - DNA, 20 bp, Artificial Sequence
  chemically synthesized
atctgcagtaccttgagcag

SEQ ID NO: 203506 - DNA, 20 bp, Artificial Sequence
  chemically synthesized
agttcatctcctgctgctca

SEQ ID NO: 203507 - DNA, 20 bp, Artificial Sequence
  chemically synthesized
tctgcagtaccttgagcagc

SEQ ID NO: 203508 - DNA, 20 bp, Artificial Sequence
  chemically synthesized
cagttcatctcctgctgctc

SEQ ID NO: 203509 - DNA, 20 bp, Artificial Sequence
  chemically synthesized
tgcagtaccttgagcagcag

SEQ ID NO: 203510 - DNA, 20 bp, Artificial Sequence
  chemically synthesized
taaagggcctatgacaatta

SEQ ID NO: 203511 - DNA, 20 bp, Artificial Sequence
  chemically synthesized
gagatgaactgtaattgtca

SEQ ID NO: 203512 - DNA, 20 bp, Artificial Sequence
  chemically synthesized
agatgaactgtaattgtcat

SEQ ID NO: 203513 - DNA, 20 bp, Artificial Sequence
  chemically synthesized
ttcctcagtgcgtaattaaa

SEQ ID NO: 203514 - DNA, 20 bp, Artificial Sequence
  chemically synthesized
gttcctcagtgcgtaattaa

SEQ ID NO: 203515 - DNA, 20 bp, Artificial Sequence
  chemically synthesized
tgttcctcagtgcgtaatta

SEQ ID NO: 203516 - DNA, 20 bp, Artificial Sequence
  chemically synthesized
aggccctttaattacgcact

SEQ ID NO: 203517 - DNA, 20 bp, Artificial Sequence
  chemically synthesized
ggccctttaattacgcactg

SEQ ID NO: 203518 - DNA, 20 bp, Artificial Sequence
  chemically synthesized
gttttggtggagttgttcct

SEQ ID NO: 203519 - DNA, 20 bp, Artificial Sequence
  chemically synthesized
ggagcagtgatgttttggtg

SEQ ID NO: 203520 - DNA, 20 bp, Artificial Sequence
  chemically synthesized
ctggagcagtgatgttttgg

SEQ ID NO: 203521 - DNA, 20 bp, Artificial Sequence
  chemically synthesized
attctggagcagtgatgttt

SEQ ID NO: 203522 - DNA, 20 bp, Artificial Sequence
  chemically synthesized
ccaccaaaacatcactgctc

SEQ ID NO: 203523 - DNA, 20 bp, Artificial Sequence
  chemically synthesized
agtttgtttttattctggag

SEQ ID NO: 203524 - DNA, 20 bp, Artificial Sequence
  chemically synthesized
tatagtttgtttttattctg

SEQ ID NO: 203525 - DNA, 20 bp, Artificial Sequence
  chemically synthesized
tttatagtttgtttttattc

SEQ ID NO: 203526 - DNA, 20 bp, Artificial Sequence
  chemically synthesized
agaataaaaacaaactataa

SEQ ID NO: 203527 - DNA, 20 bp, Artificial Sequence
  chemically synthesized
gaataaaaacaaactataaa

SEQ ID NO: 203528 - DNA, 20 bp, Artificial Sequence
  chemically synthesized
ataaaaacaaactataaaag

SEQ ID NO: 203529 - DNA, 20 bp, Artificial Sequence
  chemically synthesized
gcattgcaactctcctttta

SEQ ID NO: 203530 - DNA, 20 bp, Artificial Sequence
  chemically synthesized
aaaaacaaactataaaagga

SEQ ID NO: 203531 - DNA, 20 bp, Artificial Sequence
  chemically synthesized
aaagtctttcatcaagaaag

SEQ ID NO: 203532 - DNA, 20 bp, Artificial Sequence
  chemically synthesized
caaagtctttcatcaagaaa

SEQ ID NO: 203533 - DNA, 20 bp, Artificial Sequence
  chemically synthesized
cccaaagtctttcatcaaga

SEQ ID NO: 203534 - DNA, 20 bp, Artificial Sequence
  chemically synthesized
caatgcctctttcttgatga

SEQ ID NO: 203535 - DNA, 20 bp, Artificial Sequence
  chemically synthesized
tcttcccaaagtctttcatc

SEQ ID NO: 203536 - DNA, 20 bp, Artificial Sequence
  chemically synthesized
tctttcttgatgaaagactt

SEQ ID NO: 203537 - DNA, 20 bp, Artificial Sequence
  chemically synthesized
ctttcttgatgaaagacttt

SEQ ID NO: 203538 - DNA, 20 bp, Artificial Sequence
  chemically synthesized
tcttgatgaaagactttggg

SEQ ID NO: 203539 - DNA, 20 bp, Artificial Sequence
  chemically synthesized
ttattgcccaagtcttccca

SEQ ID NO: 203540 - DNA, 20 bp, Artificial Sequence
  chemically synthesized
tgaaagactttgggaagact

SEQ ID NO: 203541 - DNA, 20 bp, Artificial Sequence
  chemically synthesized
gaaagactttgggaagactt

SEQ ID NO: 203542 - DNA, 20 bp, Artificial Sequence
  chemically synthesized
atgagtattctttattgccc

SEQ ID NO: 203543 - DNA, 20 bp, Artificial Sequence
  chemically synthesized
ttgggaagacttgggcaata

SEQ ID NO: 203544 - DNA, 20 bp, Artificial Sequence
  chemically synthesized
aaactaaactcacaatttat

SEQ ID NO: 203545 - DNA, 20 bp, Artificial Sequence
  chemically synthesized
aaagaatactcataaattgt

SEQ ID NO: 203546 - DNA, 20 bp, Artificial Sequence
  chemically synthesized
atactcataaattgtgagtt

SEQ ID NO: 203547 - DNA, 20 bp, Artificial Sequence
  chemically synthesized
attgtgagtttagtttcctg

SEQ ID NO: 203548 - DNA, 20 bp, Artificial Sequence
  chemically synthesized
tgtgagtttagtttcctgaa

SEQ ID NO: 203549 - DNA, 20 bp, Artificial Sequence
  chemically synthesized
gagaaggggaaagactcttc

SEQ ID NO: 203550 - DNA, 20 bp, Artificial Sequence
  chemically synthesized
agagaaggggaaagactctt

SEQ ID NO: 203551 - DNA, 20 bp, Artificial Sequence
  chemically synthesized
atagacaagagagaagggga

SEQ ID NO: 203552 - DNA, 20 bp, Artificial Sequence
  chemically synthesized
gggaatagacaagagagaag

SEQ ID NO: 203553 - DNA, 20 bp, Artificial Sequence
  chemically synthesized
tgggaatagacaagagagaa

SEQ ID NO: 203554 - DNA, 20 bp, Artificial Sequence
  chemically synthesized
gtgggaatagacaagagaga

SEQ ID NO: 203555 - DNA, 20 bp, Artificial Sequence
  chemically synthesized
tgtgggaatagacaagagag

SEQ ID NO: 203556 - DNA, 20 bp, Artificial Sequence
  chemically synthesized
tggtgtgggaatagacaaga

SEQ ID NO: 203557 - DNA, 20 bp, Artificial Sequence
  chemically synthesized
agtggtgtgggaatagacaa

SEQ ID NO: 203558 - DNA, 20 bp, Artificial Sequence
  chemically synthesized
gcagtggtgtgggaatagac

SEQ ID NO: 203559 - DNA, 20 bp, Artificial Sequence
  chemically synthesized
atctagcagtggtgtgggaa

SEQ ID NO: 203560 - DNA, 20 bp, Artificial Sequence
  chemically synthesized
gataaatctagcagtggtgt

SEQ ID NO: 203561 - DNA, 20 bp, Artificial Sequence
  chemically synthesized
agataaatctagcagtggtg

SEQ ID NO: 203562 - DNA, 20 bp, Artificial Sequence
  chemically synthesized
gtctattcccacaccactgc

SEQ ID NO: 203563 - DNA, 20 bp, Artificial Sequence
  chemically synthesized
taggaagataaatctagcag

SEQ ID NO: 203564 - DNA, 20 bp, Artificial Sequence
  chemically synthesized
ttttaggaagataaatctag

SEQ ID NO: 203565 - DNA, 20 bp, Artificial Sequence
  chemically synthesized
ctattttaggaagataaatc

SEQ ID NO: 203566 - DNA, 20 bp, Artificial Sequence
  chemically synthesized
ctagatttatcttcctaaaa

SEQ ID NO: 203567 - DNA, 20 bp, Artificial Sequence
  chemically synthesized
gtttctaaaactattttagg

SEQ ID NO: 203568 - DNA, 20 bp, Artificial Sequence
  chemically synthesized
caagtttctaaaactatttt

SEQ ID NO: 203569 - DNA, 20 bp, Artificial Sequence
  chemically synthesized
gcaagtttctaaaactattt

SEQ ID NO: 203570 - DNA, 20 bp, Artificial Sequence
  chemically synthesized
ttatcttcctaaaatagttt

SEQ ID NO: 203571 - DNA, 20 bp, Artificial Sequence
  chemically synthesized
ttttgtattttcaattgtgc

SEQ ID NO: 203572 - DNA, 20 bp, Artificial Sequence
  chemically synthesized
gaaaatacaaaattgacaat

SEQ ID NO: 203573 - DNA, 20 bp, Artificial Sequence
  chemically synthesized
aaaattgacaatcagactaa

SEQ ID NO: 203574 - DNA, 20 bp, Artificial Sequence
  chemically synthesized
attgacaatcagactaaaag

SEQ ID NO: 203575 - DNA, 20 bp, Artificial Sequence
  chemically synthesized
ttgacaatcagactaaaaga

SEQ ID NO: 203576 - DNA, 20 bp, Artificial Sequence
  chemically synthesized
ctaactattacaccttcttt

SEQ ID NO: 203577 - DNA, 20 bp, Artificial Sequence
  chemically synthesized
cagactaaaagaaggtgtaa

SEQ ID NO: 203578 - DNA, 20 bp, Artificial Sequence
  chemically synthesized
ctaaaagaaggtgtaatagt

SEQ ID NO: 203579 - DNA, 20 bp, Artificial Sequence
  chemically synthesized
taaaagaaggtgtaatagtt

SEQ ID NO: 203580 - DNA, 20 bp, Artificial Sequence
  chemically synthesized
atagttaggtcacgcattca

SEQ ID NO: 203581 - DNA, 20 bp, Artificial Sequence
  chemically synthesized
ggtcacgcattcatggatct

SEQ ID NO: 203582 - DNA, 20 bp, Artificial Sequence
  chemically synthesized
cgcattcatggatcttagaa

SEQ ID NO: 203583 - DNA, 20 bp, Artificial Sequence
  chemically synthesized
gcattcatggatcttagaat

SEQ ID NO: 203584 - DNA, 20 bp, Artificial Sequence
  chemically synthesized
tgaccactatgtcccattct

SEQ ID NO: 203585 - DNA, 20 bp, Artificial Sequence
  chemically synthesized
atggatcttagaatgggaca

SEQ ID NO: 203586 - DNA, 20 bp, Artificial Sequence
  chemically synthesized
gatcttagaatgggacatag

SEQ ID NO: 203587 - DNA, 20 bp, Artificial Sequence
  chemically synthesized
acatagtggtcaatgaatct

SEQ ID NO: 203588 - DNA, 20 bp, Artificial Sequence
  chemically synthesized
tagtggtcaatgaatctaag

SEQ ID NO: 203589 - DNA, 20 bp, Artificial Sequence
  chemically synthesized
ttctacatttgagagcttct

SEQ ID NO: 203590 - DNA, 20 bp, Artificial Sequence
  chemically synthesized
atctaagaagctctcaaatg

SEQ ID NO: 203591 - DNA, 20 bp, Artificial Sequence
  chemically synthesized
gatgagaattctacatttga

SEQ ID NO: 203592 - DNA, 20 bp, Artificial Sequence
  chemically synthesized
tagatgagaattctacattt

SEQ ID NO: 203593 - DNA, 20 bp, Artificial Sequence
  chemically synthesized
caaatgtagaattctcatct

SEQ ID NO: 203594 - DNA, 20 bp, Artificial Sequence
  chemically synthesized
tctgttagggatgcttagat

SEQ ID NO: 203595 - DNA, 20 bp, Artificial Sequence
  chemically synthesized
tgtcatctgttagggatgct

SEQ ID NO: 203596 - DNA, 20 bp, Artificial Sequence
  chemically synthesized
tctcatctaagcatccctaa

SEQ ID NO: 203597 - DNA, 20 bp, Artificial Sequence
  chemically synthesized
aattgacttgtcatctgtta

SEQ ID NO: 203598 - DNA, 20 bp, Artificial Sequence
  chemically synthesized
aaattgacttgtcatctgtt

SEQ ID NO: 203599 - DNA, 20 bp, Artificial Sequence
  chemically synthesized
aaaattgacttgtcatctgt

SEQ ID NO: 203600 - DNA, 20 bp, Artificial Sequence
  chemically synthesized
aagcatccctaacagatgac

SEQ ID NO: 203601 - DNA, 20 bp, Artificial Sequence
  chemically synthesized
aacagatgacaagtcaattt

SEQ ID NO: 203602 - DNA, 20 bp, Artificial Sequence
  chemically synthesized
atgacaagtcaattttggct

SEQ ID NO: 203603 - DNA, 20 bp, Artificial Sequence
  chemically synthesized
caagtcaattttggcttaga

SEQ ID NO: 203604 - DNA, 20 bp, Artificial Sequence
  chemically synthesized
gcaatgagctgaaactgtct

SEQ ID NO: 203605 - DNA, 20 bp, Artificial Sequence
  chemically synthesized
aattttggcttagacagttt

SEQ ID NO: 203606 - DNA, 20 bp, Artificial Sequence
  chemically synthesized
tttgagcatcacaaagcaat

SEQ ID NO: 203607 - DNA, 20 bp, Artificial Sequence
  chemically synthesized
atagtattttgagcatcaca

SEQ ID NO: 203608 - DNA, 20 bp, Artificial Sequence
  chemically synthesized
gctattctccatagtatttt

SEQ ID NO: 203609 - DNA, 20 bp, Artificial Sequence
  chemically synthesized
ttgtgatgctcaaaatacta

SEQ ID NO: 203610 - DNA, 20 bp, Artificial Sequence
  chemically synthesized
gtgatgctcaaaatactatg

SEQ ID NO: 203611 - DNA, 20 bp, Artificial Sequence
  chemically synthesized
gctcaaaatactatggagaa

SEQ ID NO: 203612 - DNA, 20 bp, Artificial Sequence
  chemically synthesized
ttccttgtagctattctcca

SEQ ID NO: 203613 - DNA, 20 bp, Artificial Sequence
  chemically synthesized
atactatggagaatagctac

SEQ ID NO: 203614 - DNA, 20 bp, Artificial Sequence
  chemically synthesized
tactatggagaatagctaca

SEQ ID NO: 203615 - DNA, 20 bp, Artificial Sequence
  chemically synthesized
tatggagaatagctacaagg

SEQ ID NO: 203616 - DNA, 20 bp, Artificial Sequence
  chemically synthesized
tttacgagataacttccttg

SEQ ID NO: 203617 - DNA, 20 bp, Artificial Sequence
  chemically synthesized
tacaaggaagttatctcgta

SEQ ID NO: 203618 - DNA, 20 bp, Artificial Sequence
  chemically synthesized
aatgtttcagcatactttac

SEQ ID NO: 203619 - DNA, 20 bp, Artificial Sequence
  chemically synthesized
aagtataggaaagaatgttt

SEQ ID NO: 203620 - DNA, 20 bp, Artificial Sequence
  chemically synthesized
tgataaaaagaagtatagga

SEQ ID NO: 203621 - DNA, 20 bp, Artificial Sequence
  chemically synthesized
caaatgataaaaagaagtat

SEQ ID NO: 203622 - DNA, 20 bp, Artificial Sequence
  chemically synthesized
ccaaatgataaaaagaagta

SEQ ID NO: 203623 - DNA, 20 bp, Artificial Sequence
  chemically synthesized
caggaccaaatgataaaaag

SEQ ID NO: 203624 - DNA, 20 bp, Artificial Sequence
  chemically synthesized
ctacaggaccaaatgataaa

SEQ ID NO: 203625 - DNA, 20 bp, Artificial Sequence
  chemically synthesized
ctatacttctttttatcatt

SEQ ID NO: 203626 - DNA, 20 bp, Artificial Sequence
  chemically synthesized
ctttttatcatttggtcctg

SEQ ID NO: 203627 - DNA, 20 bp, Artificial Sequence
  chemically synthesized
tttatcatttggtcctgtag

SEQ ID NO: 203628 - DNA, 20 bp, Artificial Sequence
  chemically synthesized
ttgatctagtaaactactac

SEQ ID NO: 203629 - DNA, 20 bp, Artificial Sequence
  chemically synthesized
gttgatctagtaaactacta

SEQ ID NO: 203630 - DNA, 20 bp, Artificial Sequence
  chemically synthesized
ttggtcctgtagtagtttac

SEQ ID NO: 203631 - DNA, 20 bp, Artificial Sequence
  chemically synthesized
aaattcattctgtgttgatc

SEQ ID NO: 203632 - DNA, 20 bp, Artificial Sequence
  chemically synthesized
agtagtttactagatcaaca

SEQ ID NO: 203633 - DNA, 20 bp, Artificial Sequence
  chemically synthesized
acagaatgaatttccccctc

SEQ ID NO: 203634 - DNA, 20 bp, Artificial Sequence
  chemically synthesized
gaatgaatttccccctcaag

SEQ ID NO: 203635 - DNA, 20 bp, Artificial Sequence
  chemically synthesized
tattcatatacttcttgagg

SEQ ID NO: 203636 - DNA, 20 bp, Artificial Sequence
  chemically synthesized
ttattcatatacttcttgag

SEQ ID NO: 203637 - DNA, 20 bp, Artificial Sequence
  chemically synthesized
cttattcatatacttcttga

SEQ ID NO: 203638 - DNA, 20 bp, Artificial Sequence
  chemically synthesized
ccttattcatatacttcttg

SEQ ID NO: 203639 - DNA, 20 bp, Artificial Sequence
  chemically synthesized
cccttattcatatacttctt

SEQ ID NO: 203640 - DNA, 20 bp, Artificial Sequence
  chemically synthesized
ccctcaagaagtatatgaat

SEQ ID NO: 203641 - DNA, 20 bp, Artificial Sequence
  chemically synthesized
cctcaagaagtatatgaata

SEQ ID NO: 203642 - DNA, 20 bp, Artificial Sequence
  chemically synthesized
ctcaagaagtatatgaataa

SEQ ID NO: 203643 - DNA, 20 bp, Artificial Sequence
  chemically synthesized
aataagggaatgatacacat

SEQ ID NO: 203644 - DNA, 20 bp, Artificial Sequence
  chemically synthesized
gggaatgatacacatcagaa

SEQ ID NO: 203645 - DNA, 20 bp, Artificial Sequence
  chemically synthesized
ggaatgatacacatcagaaa

SEQ ID NO: 203646 - DNA, 20 bp, Artificial Sequence
  chemically synthesized
gaacaagagctaacaaagtg

SEQ ID NO: 203647 - DNA, 20 bp, Artificial Sequence
  chemically synthesized
ggtacatttcttcactttgt

SEQ ID NO: 203648 - DNA, 20 bp, Artificial Sequence
  chemically synthesized
gtagtgaacaagagctaaca

SEQ ID NO: 203649 - DNA, 20 bp, Artificial Sequence
  chemically synthesized
gtgctaaaagtagtgaacaa

SEQ ID NO: 203650 - DNA, 20 bp, Artificial Sequence
  chemically synthesized
ctgtgctaaaagtagtgaac

SEQ ID NO: 203651 - DNA, 20 bp, Artificial Sequence
  chemically synthesized
tagctcttgttcactacttt

SEQ ID NO: 203652 - DNA, 20 bp, Artificial Sequence
  chemically synthesized
tttgccagctgtgctaaaag

SEQ ID NO: 203653 - DNA, 20 bp, Artificial Sequence
  chemically synthesized
cttgttcactacttttagca

SEQ ID NO: 203654 - DNA, 20 bp, Artificial Sequence
  chemically synthesized
agctttgccagctgtgctaa

SEQ ID NO: 203655 - DNA, 20 bp, Artificial Sequence
  chemically synthesized
ttcactacttttagcacagc

SEQ ID NO: 203656 - DNA, 20 bp, Artificial Sequence
  chemically synthesized
tacttttagcacagctggca

SEQ ID NO: 203657 - DNA, 20 bp, Artificial Sequence
  chemically synthesized
catgacattaagagctttgc

SEQ ID NO: 203658 - DNA, 20 bp, Artificial Sequence
  chemically synthesized
agacagaggcatgacattaa

SEQ ID NO: 203659 - DNA, 20 bp, Artificial Sequence
  chemically synthesized
gtagacagaggcatgacatt

SEQ ID NO: 203660 - DNA, 20 bp, Artificial Sequence
  chemically synthesized
tgtaataggaaagtagacag

SEQ ID NO: 203661 - DNA, 20 bp, Artificial Sequence
  chemically synthesized
ctgtaataggaaagtagaca

SEQ ID NO: 203662 - DNA, 20 bp, Artificial Sequence
  chemically synthesized
ctctgtaataggaaagtaga

SEQ ID NO: 203663 - DNA, 20 bp, Artificial Sequence
  chemically synthesized
atgcctctgtaataggaaag

SEQ ID NO: 203664 - DNA, 20 bp, Artificial Sequence
  chemically synthesized
acaatgcctctgtaatagga

SEQ ID NO: 203665 - DNA, 20 bp, Artificial Sequence
  chemically synthesized
ctctgtctactttcctatta

SEQ ID NO: 203666 - DNA, 20 bp, Artificial Sequence
  chemically synthesized
ctgtctactttcctattaca

SEQ ID NO: 203667 - DNA, 20 bp, Artificial Sequence
  chemically synthesized
tgtctactttcctattacag

SEQ ID NO: 203668 - DNA, 20 bp, Artificial Sequence
  chemically synthesized
aacaacaatgcctctgtaat

SEQ ID NO: 203669 - DNA, 20 bp, Artificial Sequence
  chemically synthesized
aaacaacaatgcctctgtaa

SEQ ID NO: 203670 - DNA, 20 bp, Artificial Sequence
  chemically synthesized
tgtgtggcttgagagtgggc

SEQ ID NO: 203671 - DNA, 20 bp, Artificial Sequence
  chemically synthesized
gttttttctcgcccactctc

SEQ ID NO: 203672 - DNA, 20 bp, Artificial Sequence
  chemically synthesized
ggtatgtgtggcttgagagt

SEQ ID NO: 203673 - DNA, 20 bp, Artificial Sequence
  chemically synthesized
tggtatgtgtggcttgagag

SEQ ID NO: 203674 - DNA, 20 bp, Artificial Sequence
  chemically synthesized
gagtggtatgtgtggcttga

SEQ ID NO: 203675 - DNA, 20 bp, Artificial Sequence
  chemically synthesized
gagagtggtatgtgtggctt

SEQ ID NO: 203676 - DNA, 20 bp, Artificial Sequence
  chemically synthesized
ggactggagagtggtatgtg

SEQ ID NO: 203677 - DNA, 20 bp, Artificial Sequence
  chemically synthesized
aagccacacataccactctc

SEQ ID NO: 203678 - DNA, 20 bp, Artificial Sequence
  chemically synthesized
gcatatttaggactggagag

SEQ ID NO: 203679 - DNA, 20 bp, Artificial Sequence
  chemically synthesized
agggcatatttaggactgga

SEQ ID NO: 203680 - DNA, 20 bp, Artificial Sequence
  chemically synthesized
caagggcatatttaggactg

SEQ ID NO: 203681 - DNA, 20 bp, Artificial Sequence
  chemically synthesized
gtcaagggcatatttaggac

SEQ ID NO: 203682 - DNA, 20 bp, Artificial Sequence
  chemically synthesized
caaaagtcaagggcatattt

SEQ ID NO: 203683 - DNA, 20 bp, Artificial Sequence
  chemically synthesized
acaaaagtcaagggcatatt

SEQ ID NO: 203684 - DNA, 20 bp, Artificial Sequence
  chemically synthesized
ggcatagtgacaaaagtcaa

SEQ ID NO: 203685 - DNA, 20 bp, Artificial Sequence
  chemically synthesized
aggcatagtgacaaaagtca

SEQ ID NO: 203686 - DNA, 20 bp, Artificial Sequence
  chemically synthesized
aaggcatagtgacaaaagtc

SEQ ID NO: 203687 - DNA, 20 bp, Artificial Sequence
  chemically synthesized
gaacaaaggcatagtgacaa

SEQ ID NO: 203688 - DNA, 20 bp, Artificial Sequence
  chemically synthesized
tgacagagggaacaaaggca

SEQ ID NO: 203689 - DNA, 20 bp, Artificial Sequence
  chemically synthesized
atctctgacagagggaacaa

SEQ ID NO: 203690 - DNA, 20 bp, Artificial Sequence
  chemically synthesized
gatctctgacagagggaaca

SEQ ID NO: 203691 - DNA, 20 bp, Artificial Sequence
  chemically synthesized
tatgcctttgttccctctgt

SEQ ID NO: 203692 - DNA, 20 bp, Artificial Sequence
  chemically synthesized
tgcctttgttccctctgtca

SEQ ID NO: 203693 - DNA, 20 bp, Artificial Sequence
  chemically synthesized
catggaagatctctgacaga

SEQ ID NO: 203694 - DNA, 20 bp, Artificial Sequence
  chemically synthesized
acatggaagatctctgacag

SEQ ID NO: 203695 - DNA, 20 bp, Artificial Sequence
  chemically synthesized
aacatggaagatctctgaca

SEQ ID NO: 203696 - DNA, 20 bp, Artificial Sequence
  chemically synthesized
agaacatggaagatctctga

SEQ ID NO: 203697 - DNA, 20 bp, Artificial Sequence
  chemically synthesized
tgaagacatttagaacatgg

SEQ ID NO: 203698 - DNA, 20 bp, Artificial Sequence
  chemically synthesized
ctttgaagacatttagaaca

SEQ ID NO: 203699 - DNA, 20 bp, Artificial Sequence
  chemically synthesized
gagaagtctttgaagacatt

SEQ ID NO: 203700 - DNA, 20 bp, Artificial Sequence
  chemically synthesized
ccatgttctaaatgtcttca

SEQ ID NO: 203701 - DNA, 20 bp, Artificial Sequence
  chemically synthesized
taacgggtgagaagtctttg

SEQ ID NO: 203702 - DNA, 20 bp, Artificial Sequence
  chemically synthesized
aaccaaccttaacgggtgag

SEQ ID NO: 203703 - DNA, 20 bp, Artificial Sequence
  chemically synthesized
tcaaagacttctcacccgtt

SEQ ID NO: 203704 - DNA, 20 bp, Artificial Sequence
  chemically synthesized
tagaaccaaccttaacgggt

SEQ ID NO: 203705 - DNA, 20 bp, Artificial Sequence
  chemically synthesized
caaagacttctcacccgtta

SEQ ID NO: 203706 - DNA, 20 bp, Artificial Sequence
  chemically synthesized
tcattagaaccaaccttaac

SEQ ID NO: 203707 - DNA, 20 bp, Artificial Sequence
  chemically synthesized
gacttctcacccgttaaggt

SEQ ID NO: 203708 - DNA, 20 bp, Artificial Sequence
  chemically synthesized
gtcattagaaccaaccttaa

SEQ ID NO: 203709 - DNA, 20 bp, Artificial Sequence
  chemically synthesized
attgcacagggagatgtcat

SEQ ID NO: 203710 - DNA, 20 bp, Artificial Sequence
  chemically synthesized
caattaggagattgcacagg

SEQ ID NO: 203711 - DNA, 20 bp, Artificial Sequence
  chemically synthesized
tgcaattaggagattgcaca

SEQ ID NO: 203712 - DNA, 20 bp, Artificial Sequence
  chemically synthesized
atgcaattaggagattgcac

SEQ ID NO: 203713 - DNA, 20 bp, Artificial Sequence
  chemically synthesized
gatgcaattaggagattgca

SEQ ID NO: 203714 - DNA, 20 bp, Artificial Sequence
  chemically synthesized
gccaacaaagatgcaattag

SEQ ID NO: 203715 - DNA, 20 bp, Artificial Sequence
  chemically synthesized
gtgccaacaaagatgcaatt

SEQ ID NO: 203716 - DNA, 20 bp, Artificial Sequence
  chemically synthesized
tgtgccaacaaagatgcaat

SEQ ID NO: 203717 - DNA, 20 bp, Artificial Sequence
  chemically synthesized
tctcctaattgcatctttgt

SEQ ID NO: 203718 - DNA, 20 bp, Artificial Sequence
  chemically synthesized
cgtatgtgtgtgtgccaaca

SEQ ID NO: 203719 - DNA, 20 bp, Artificial Sequence
  chemically synthesized
taaaatgtgatttatgaaca

SEQ ID NO: 203720 - DNA, 20 bp, Artificial Sequence
  chemically synthesized
acattttattctgcttaaaa

SEQ ID NO: 203721 - DNA, 20 bp, Artificial Sequence
  chemically synthesized
atttaaagaactattttaag

SEQ ID NO: 203722 - DNA, 20 bp, Artificial Sequence
  chemically synthesized
aagatttaaagaactatttt

SEQ ID NO: 203723 - DNA, 20 bp, Artificial Sequence
  chemically synthesized
aggaacatggacaagattta

SEQ ID NO: 203724 - DNA, 20 bp, Artificial Sequence
  chemically synthesized
ctagggagaggaacatggac

SEQ ID NO: 203725 - DNA, 20 bp, Artificial Sequence
  chemically synthesized
cagaactagggagaggaaca

SEQ ID NO: 203726 - DNA, 20 bp, Artificial Sequence
  chemically synthesized
cttgtccatgttcctctccc

SEQ ID NO: 203727 - DNA, 20 bp, Artificial Sequence
  chemically synthesized
aggtttacagaactagggag

SEQ ID NO: 203728 - DNA, 20 bp, Artificial Sequence
  chemically synthesized
aaggtttacagaactaggga

SEQ ID NO: 203729 - DNA, 20 bp, Artificial Sequence
  chemically synthesized
aaaaggtttacagaactagg

SEQ ID NO: 203730 - DNA, 20 bp, Artificial Sequence
  chemically synthesized
tcaaaaggtttacagaacta

SEQ ID NO: 203731 - DNA, 20 bp, Artificial Sequence
  chemically synthesized
ttcaaaaggtttacagaact

SEQ ID NO: 203732 - DNA, 20 bp, Artificial Sequence
  chemically synthesized
tttcaaaaggtttacagaac

SEQ ID NO: 203733 - DNA, 20 bp, Artificial Sequence
  chemically synthesized
tcctactttcaaaaggttta

SEQ ID NO: 203734 - DNA, 20 bp, Artificial Sequence
  chemically synthesized
tagttctgtaaaccttttga

SEQ ID NO: 203735 - DNA, 20 bp, Artificial Sequence
  chemically synthesized
gtatagatcctactttcaaa

SEQ ID NO: 203736 - DNA, 20 bp, Artificial Sequence
  chemically synthesized
ttctgtaaaccttttgaaag

SEQ ID NO: 203737 - DNA, 20 bp, Artificial Sequence
  chemically synthesized
ggtatagatcctactttcaa

SEQ ID NO: 203738 - DNA, 20 bp, Artificial Sequence
  chemically synthesized
tctgtaaaccttttgaaagt

SEQ ID NO: 203739 - DNA, 20 bp, Artificial Sequence
  chemically synthesized
gaaagtaggatctatacctt

SEQ ID NO: 203740 - DNA, 20 bp, Artificial Sequence
  chemically synthesized
aaagtaggatctatacctta

SEQ ID NO: 203741 - DNA, 20 bp, Artificial Sequence
  chemically synthesized
aattaggtgaccttaaggta

SEQ ID NO: 203742 - DNA, 20 bp, Artificial Sequence
  chemically synthesized
aaaaaaattaggtgacctta

SEQ ID NO: 203743 - DNA, 20 bp, Artificial Sequence
  chemically synthesized
aaaaaaaattaggtgacctt

SEQ ID NO: 203744 - DNA, 20 bp, Artificial Sequence
  chemically synthesized
taaaaaagagaaaaaaaatt

SEQ ID NO: 203745 - DNA, 20 bp, Artificial Sequence
  chemically synthesized
ttaaaaaagagaaaaaaaat

SEQ ID NO: 203746 - DNA, 20 bp, Artificial Sequence
  chemically synthesized
tatagtctttttttaaaaaa

SEQ ID NO: 203747 - DNA, 20 bp, Artificial Sequence
  chemically synthesized
tatatagtctttttttaaaa

SEQ ID NO: 203748 - DNA, 20 bp, Artificial Sequence
  chemically synthesized
ttttttctcttttttaaaaa

SEQ ID NO: 203749 - DNA, 20 bp, Artificial Sequence
  chemically synthesized
ccccctttgatttaggtata

SEQ ID NO: 203750 - DNA, 20 bp, Artificial Sequence
  chemically synthesized
aagactatatacctaaatca

SEQ ID NO: 203751 - DNA, 20 bp, Artificial Sequence
  chemically synthesized
agactatatacctaaatcaa

SEQ ID NO: 203752 - DNA, 20 bp, Artificial Sequence
  chemically synthesized
ttaattcccccctttgattt

SEQ ID NO: 203753 - DNA, 20 bp, Artificial Sequence
  chemically synthesized
gactatatacctaaatcaaa

SEQ ID NO: 203754 - DNA, 20 bp, Artificial Sequence
  chemically synthesized
tttaattcccccctttgatt

SEQ ID NO: 203755 - DNA, 20 bp, Artificial Sequence
  chemically synthesized
actatatacctaaatcaaag

SEQ ID NO: 203756 - DNA, 20 bp, Artificial Sequence
  chemically synthesized
ctatatacctaaatcaaagg

SEQ ID NO: 203757 - DNA, 20 bp, Artificial Sequence
  chemically synthesized
tatatacctaaatcaaaggg

SEQ ID NO: 203758 - DNA, 20 bp, Artificial Sequence
  chemically synthesized
aggggggaattaaatgcaca

SEQ ID NO: 203759 - DNA, 20 bp, Artificial Sequence
  chemically synthesized
ggggggaattaaatgcacat

SEQ ID NO: 203760 - DNA, 20 bp, Artificial Sequence
  chemically synthesized
aaaatattgattttgtccat

SEQ ID NO: 203761 - DNA, 20 bp, Artificial Sequence
  chemically synthesized
gtatagatttagaagtctaa

SEQ ID NO: 203762 - DNA, 20 bp, Artificial Sequence
  chemically synthesized
cttcttgtgtatagatttag

SEQ ID NO: 203763 - DNA, 20 bp, Artificial Sequence
  chemically synthesized
aagcttcttgtgtatagatt

SEQ ID NO: 203764 - DNA, 20 bp, Artificial Sequence
  chemically synthesized
agacttctaaatctatacac

SEQ ID NO: 203765 - DNA, 20 bp, Artificial Sequence
  chemically synthesized
taatgaaagcttcttgtgta

SEQ ID NO: 203766 - DNA, 20 bp, Artificial Sequence
  chemically synthesized
cttctaaatctatacacaag

SEQ ID NO: 203767 - DNA, 20 bp, Artificial Sequence
  chemically synthesized
aggatatatgtgaataatga

SEQ ID NO: 203768 - DNA, 20 bp, Artificial Sequence
  chemically synthesized
ccacatatacaatatgatta

SEQ ID NO: 203769 - DNA, 20 bp, Artificial Sequence
  chemically synthesized
cccacatatacaatatgatt

SEQ ID NO: 203770 - DNA, 20 bp, Artificial Sequence
  chemically synthesized
ccttaatcatattgtatatg

SEQ ID NO: 203771 - DNA, 20 bp, Artificial Sequence
  chemically synthesized
cttaatcatattgtatatgt

SEQ ID NO: 203772 - DNA, 20 bp, Artificial Sequence
  chemically synthesized
ttaatcatattgtatatgtg

SEQ ID NO: 203773 - DNA, 20 bp, Artificial Sequence
  chemically synthesized
gtatgtgtgtgtgtgtgtgt

SEQ ID NO: 203774 - DNA, 20 bp, Artificial Sequence
  chemically synthesized
atgtgtgtgtgtgtgtgtga

SEQ ID NO: 203775 - DNA, 20 bp, Artificial Sequence
  chemically synthesized
gtgtgtgtgtgtgtgtgaga

SEQ ID NO: 203776 - DNA, 20 bp, Artificial Sequence
  chemically synthesized
gtgtgtgtgtgtgtgagaga

SEQ ID NO: 203777 - DNA, 20 bp, Artificial Sequence
  chemically synthesized
gtgtgtgtgtgtgagagaga

SEQ ID NO: 203778 - DNA, 20 bp, Artificial Sequence
  chemically synthesized
gtgtgtgtgtgagagagaga

SEQ ID NO: 203779 - DNA, 20 bp, Artificial Sequence
  chemically synthesized
gtgtgtgtgagagagagaga

SEQ ID NO: 203780 - DNA, 20 bp, Artificial Sequence
  chemically synthesized
gtgtgtgagagagagagaga

SEQ ID NO: 203781 - DNA, 20 bp, Artificial Sequence
  chemically synthesized
gtgtgagagagagagagaga

SEQ ID NO: 203782 - DNA, 20 bp, Artificial Sequence
  chemically synthesized
gtgagagagagagagagaga

SEQ ID NO: 203783 - DNA, 20 bp, Artificial Sequence
  chemically synthesized
gagagagagagagagagaga

SEQ ID NO: 203784 - DNA, 20 bp, Artificial Sequence
  chemically synthesized
gagagagagagagagagaga

SEQ ID NO: 203785 - DNA, 20 bp, Artificial Sequence
  chemically synthesized
gagagagagagagagagaga

SEQ ID NO: 203786 - DNA, 20 bp, Artificial Sequence
  chemically synthesized
gagagagagagagagagaga

SEQ ID NO: 203787 - DNA, 20 bp, Artificial Sequence
  chemically synthesized
gagagagagagagagagaga

SEQ ID NO: 203788 - DNA, 20 bp, Artificial Sequence
  chemically synthesized
gagagagagagagagagaga

SEQ ID NO: 203789 - DNA, 20 bp, Artificial Sequence
  chemically synthesized
gagagagagagagagagaga

SEQ ID NO: 203790 - DNA, 20 bp, Artificial Sequence
  chemically synthesized
gagagagagagagagagaga

SEQ ID NO: 203791 - DNA, 20 bp, Artificial Sequence
  chemically synthesized
gagagagagagagagagaga

SEQ ID NO: 203792 - DNA, 20 bp, Artificial Sequence
  chemically synthesized
gagagagagagagagagaga

SEQ ID NO: 203793 - DNA, 20 bp, Artificial Sequence
  chemically synthesized
gagagagagagagagagaga

SEQ ID NO: 203794 - DNA, 20 bp, Artificial Sequence
  chemically synthesized
gagagagagagagagagaga

SEQ ID NO: 203795 - DNA, 20 bp, Artificial Sequence
  chemically synthesized
gagagagagagagagagaga

SEQ ID NO: 203796 - DNA, 20 bp, Artificial Sequence
  chemically synthesized
agagagagagagagagagag

SEQ ID NO: 203797 - DNA, 20 bp, Artificial Sequence
  chemically synthesized
agagagagagagagagagaa

SEQ ID NO: 203798 - DNA, 20 bp, Artificial Sequence
  chemically synthesized
gagagagagagagagagaag

SEQ ID NO: 203799 - DNA, 20 bp, Artificial Sequence
  chemically synthesized
gagagagagagaagaggact

SEQ ID NO: 203800 - DNA, 20 bp, Artificial Sequence
  chemically synthesized
agagagagagaagaggactg

SEQ ID NO: 203801 - DNA, 20 bp, Artificial Sequence
  chemically synthesized
ttattttctttttggttcct

SEQ ID NO: 203802 - DNA, 20 bp, Artificial Sequence
  chemically synthesized
aagaggactgaggaaccaaa

SEQ ID NO: 203803 - DNA, 20 bp, Artificial Sequence
  chemically synthesized
ctcctgacttattttctttt

SEQ ID NO: 203804 - DNA, 20 bp, Artificial Sequence
  chemically synthesized
tgaggaaccaaaaagaaaat

SEQ ID NO: 203805 - DNA, 20 bp, Artificial Sequence
  chemically synthesized
gaaccaaaaagaaaataagt

SEQ ID NO: 203806 - DNA, 20 bp, Artificial Sequence
  chemically synthesized
aaccaaaaagaaaataagtc

SEQ ID NO: 203807 - DNA, 20 bp, Artificial Sequence
  chemically synthesized
ccaaaaagaaaataagtcag

SEQ ID NO: 203808 - DNA, 20 bp, Artificial Sequence
  chemically synthesized
agaaaataagtcaggagcat

SEQ ID NO: 203809 - DNA, 20 bp, Artificial Sequence
  chemically synthesized
gaaaataagtcaggagcata

SEQ ID NO: 203810 - DNA, 20 bp, Artificial Sequence
  chemically synthesized
aaataagtcaggagcataag

SEQ ID NO: 203811 - DNA, 20 bp, Artificial Sequence
  chemically synthesized
aataagtcaggagcataagg

SEQ ID NO: 203812 - DNA, 20 bp, Artificial Sequence
  chemically synthesized
gtataataaaaaaaaaaaag

SEQ ID NO: 203813 - DNA, 20 bp, Artificial Sequence
  chemically synthesized
aaagtataataaaaaaaaaa

SEQ ID NO: 203814 - DNA, 20 bp, Artificial Sequence
  chemically synthesized
ttttttttttattatacttt

SEQ ID NO: 203815 - DNA, 20 bp, Artificial Sequence
  chemically synthesized
ttttattatactttaagttt

SEQ ID NO: 203816 - DNA, 20 bp, Artificial Sequence
  chemically synthesized
cacatgtaccctaaaactta

SEQ ID NO: 203817 - DNA, 20 bp, Artificial Sequence
  chemically synthesized
tttattatactttaagtttt

SEQ ID NO: 203818 - DNA, 20 bp, Artificial Sequence
  chemically synthesized
ttattatactttaagtttta

SEQ ID NO: 203819 - DNA, 20 bp, Artificial Sequence
  chemically synthesized
gggtacatgtgcacaacgtg

SEQ ID NO: 203820 - DNA, 20 bp, Artificial Sequence
  chemically synthesized
ggtacatgtgcacaacgtgc

SEQ ID NO: 203821 - DNA, 20 bp, Artificial Sequence
  chemically synthesized
tatgtatacatgtgccatgt

SEQ ID NO: 203822 - DNA, 20 bp, Artificial Sequence
  chemically synthesized
atgggtgcaggacaccaaca

SEQ ID NO: 203823 - DNA, 20 bp, Artificial Sequence
  chemically synthesized
aatgaccagttaatgggtgc

SEQ ID NO: 203824 - DNA, 20 bp, Artificial Sequence
  chemically synthesized
aaatgaccagttaatgggtg

SEQ ID NO: 203825 - DNA, 20 bp, Artificial Sequence
  chemically synthesized
ggtgtcctgcacccattaac

SEQ ID NO: 203826 - DNA, 20 bp, Artificial Sequence
  chemically synthesized
atgctaaatgaccagttaat

SEQ ID NO: 203827 - DNA, 20 bp, Artificial Sequence
  chemically synthesized
aatgctaaatgaccagttaa

SEQ ID NO: 203828 - DNA, 20 bp, Artificial Sequence
  chemically synthesized
gcacccattaactggtcatt

SEQ ID NO: 203829 - DNA, 20 bp, Artificial Sequence
  chemically synthesized
tatacttaatgctaaatgac

SEQ ID NO: 203830 - DNA, 20 bp, Artificial Sequence
  chemically synthesized
ttaactggtcatttagcatt

SEQ ID NO: 203831 - DNA, 20 bp, Artificial Sequence
  chemically synthesized
gggtggagggatagcattag

SEQ ID NO: 203832 - DNA, 20 bp, Artificial Sequence
  chemically synthesized
gagggtggagggatagcatt

SEQ ID NO: 203833 - DNA, 20 bp, Artificial Sequence
  chemically synthesized
ggagggtggagggatagcat

SEQ ID NO: 203834 - DNA, 20 bp, Artificial Sequence
  chemically synthesized
gtggggggagggtggaggga

SEQ ID NO: 203835 - DNA, 20 bp, Artificial Sequence
  chemically synthesized
tggggtggggggagggtgga

SEQ ID NO: 203836 - DNA, 20 bp, Artificial Sequence
  chemically synthesized
gtggggtggggggagggtgg

SEQ ID NO: 203837 - DNA, 20 bp, Artificial Sequence
  chemically synthesized
tgtggggtggggggagggtg

SEQ ID NO: 203838 - DNA, 20 bp, Artificial Sequence
  chemically synthesized
gttgtggggtggggggaggg

SEQ ID NO: 203839 - DNA, 20 bp, Artificial Sequence
  chemically synthesized
cctgttgtggggtgggggga

SEQ ID NO: 203840 - DNA, 20 bp, Artificial Sequence
  chemically synthesized
gcctgttgtggggtgggggg

SEQ ID NO: 203841 - DNA, 20 bp, Artificial Sequence
  chemically synthesized
ggcctgttgtggggtggggg

SEQ ID NO: 203842 - DNA, 20 bp, Artificial Sequence
  chemically synthesized
ggggcctgttgtggggtggg

SEQ ID NO: 203843 - DNA, 20 bp, Artificial Sequence
  chemically synthesized
cggggcctgttgtggggtgg

SEQ ID NO: 203844 - DNA, 20 bp, Artificial Sequence
  chemically synthesized
ccggggcctgttgtggggtg

SEQ ID NO: 203845 - DNA, 20 bp, Artificial Sequence
  chemically synthesized
accggggcctgttgtggggt

SEQ ID NO: 203846 - DNA, 20 bp, Artificial Sequence
  chemically synthesized
caccggggcctgttgtgggg

SEQ ID NO: 203847 - DNA, 20 bp, Artificial Sequence
  chemically synthesized
accctccccccaccccacaa

SEQ ID NO: 203848 - DNA, 20 bp, Artificial Sequence
  chemically synthesized
ccctccccccaccccacaac

SEQ ID NO: 203849 - DNA, 20 bp, Artificial Sequence
  chemically synthesized
acacaccggggcctgttgtg

SEQ ID NO: 203850 - DNA, 20 bp, Artificial Sequence
  chemically synthesized
cacacaccggggcctgttgt

SEQ ID NO: 203851 - DNA, 20 bp, Artificial Sequence
  chemically synthesized
tcacacaccggggcctgttg

SEQ ID NO: 203852 - DNA, 20 bp, Artificial Sequence
  chemically synthesized
ccccaccccacaacaggccc

SEQ ID NO: 203853 - DNA, 20 bp, Artificial Sequence
  chemically synthesized
aaggggaacatcacacaccg

SEQ ID NO: 203854 - DNA, 20 bp, Artificial Sequence
  chemically synthesized
gaaggggaacatcacacacc

SEQ ID NO: 203855 - DNA, 20 bp, Artificial Sequence
  chemically synthesized
ggaaggggaacatcacacac

SEQ ID NO: 203856 - DNA, 20 bp, Artificial Sequence
  chemically synthesized
gaacacatggacacaggaag

SEQ ID NO: 203857 - DNA, 20 bp, Artificial Sequence
  chemically synthesized
agaacacatggacacaggaa

SEQ ID NO: 203858 - DNA, 20 bp, Artificial Sequence
  chemically synthesized
gagaacacatggacacagga

SEQ ID NO: 203859 - DNA, 20 bp, Artificial Sequence
  chemically synthesized
tgagaacacatggacacagg

SEQ ID NO: 203860 - DNA, 20 bp, Artificial Sequence
  chemically synthesized
caatgagaacacatggacac

SEQ ID NO: 203861 - DNA, 20 bp, Artificial Sequence
  chemically synthesized
acaatgagaacacatggaca

SEQ ID NO: 203862 - DNA, 20 bp, Artificial Sequence
  chemically synthesized
aattgaacaatgagaacaca

SEQ ID NO: 203863 - DNA, 20 bp, Artificial Sequence
  chemically synthesized
ataggtgggaattgaacaat

SEQ ID NO: 203864 - DNA, 20 bp, Artificial Sequence
  chemically synthesized
attgttcaattcccacctat

SEQ ID NO: 203865 - DNA, 20 bp, Artificial Sequence
  chemically synthesized
gcatgttctcactcataggt

SEQ ID NO: 203866 - DNA, 20 bp, Artificial Sequence
  chemically synthesized
cgcatgttctcactcatagg

SEQ ID NO: 203867 - DNA, 20 bp, Artificial Sequence
  chemically synthesized
ttcaattcccacctatgagt

SEQ ID NO: 203868 - DNA, 20 bp, Artificial Sequence
  chemically synthesized
caccgcatgttctcactcat

SEQ ID NO: 203869 - DNA, 20 bp, Artificial Sequence
  chemically synthesized
acaccgcatgttctcactca

SEQ ID NO: 203870 - DNA, 20 bp, Artificial Sequence
  chemically synthesized
cacctatgagtgagaacatg

SEQ ID NO: 203871 - DNA, 20 bp, Artificial Sequence
  chemically synthesized
gagtgagaacatgcggtgtt

SEQ ID NO: 203872 - DNA, 20 bp, Artificial Sequence
  chemically synthesized
ttggttttttgtccttgcaa

SEQ ID NO: 203873 - DNA, 20 bp, Artificial Sequence
  chemically synthesized
gttctcagcaaactattgca

SEQ ID NO: 203874 - DNA, 20 bp, Artificial Sequence
  chemically synthesized
cgttctcagcaaactattgc

SEQ ID NO: 203875 - DNA, 20 bp, Artificial Sequence
  chemically synthesized
tgtccttgcaatagtttgct

SEQ ID NO: 203876 - DNA, 20 bp, Artificial Sequence
  chemically synthesized
caatagtttgctgagaacga

SEQ ID NO: 203877 - DNA, 20 bp, Artificial Sequence
  chemically synthesized
aatctggaaaccatcgttct

SEQ ID NO: 203878 - DNA, 20 bp, Artificial Sequence
  chemically synthesized
ttgctgagaacgatggtttc

SEQ ID NO: 203879 - DNA, 20 bp, Artificial Sequence
  chemically synthesized
tgtagggacatggatgaatc

SEQ ID NO: 203880 - DNA, 20 bp, Artificial Sequence
  chemically synthesized
gaaaatactttgtagggaca

SEQ ID NO: 203881 - DNA, 20 bp, Artificial Sequence
  chemically synthesized
gattcatccatgtccctaca

SEQ ID NO: 203882 - DNA, 20 bp, Artificial Sequence
  chemically synthesized
gaaaaggaaaatactttgta

SEQ ID NO: 203883 - DNA, 20 bp, Artificial Sequence
  chemically synthesized
agaaaaggaaaatactttgt

SEQ ID NO: 203884 - DNA, 20 bp, Artificial Sequence
  chemically synthesized
tagaaaaggaaaatactttg

SEQ ID NO: 203885 - DNA, 20 bp, Artificial Sequence
  chemically synthesized
ttagaatttttttgtagaaa

SEQ ID NO: 203886 - DNA, 20 bp, Artificial Sequence
  chemically synthesized
attagaatttttttgtagaa

SEQ ID NO: 203887 - DNA, 20 bp, Artificial Sequence
  chemically synthesized
ggtcaattagaatttttttg

SEQ ID NO: 203888 - DNA, 20 bp, Artificial Sequence
  chemically synthesized
aataatgtgcacaggtcaat

SEQ ID NO: 203889 - DNA, 20 bp, Artificial Sequence
  chemically synthesized
aaagtgaaaataatgtgcac

SEQ ID NO: 203890 - DNA, 20 bp, Artificial Sequence
  chemically synthesized
caaagtgaaaataatgtgca

SEQ ID NO: 203891 - DNA, 20 bp, Artificial Sequence
  chemically synthesized
tgtgcacattattttcactt

SEQ ID NO: 203892 - DNA, 20 bp, Artificial Sequence
  chemically synthesized
tgcacattattttcactttg

SEQ ID NO: 203893 - DNA, 20 bp, Artificial Sequence
  chemically synthesized
acattattttcactttggag

SEQ ID NO: 203894 - DNA, 20 bp, Artificial Sequence
  chemically synthesized
gaggagaagtcacttctcca

SEQ ID NO: 203895 - DNA, 20 bp, Artificial Sequence
  chemically synthesized
tggagaagtgacttctcctc

SEQ ID NO: 203896 - DNA, 20 bp, Artificial Sequence
  chemically synthesized
gttatggcttacttgaggag

SEQ ID NO: 203897 - DNA, 20 bp, Artificial Sequence
  chemically synthesized
gaagtgacttctcctcaagt

SEQ ID NO: 203898 - DNA, 20 bp, Artificial Sequence
  chemically synthesized
cttgttatggcttacttgag

SEQ ID NO: 203899 - DNA, 20 bp, Artificial Sequence
  chemically synthesized
cacttgttatggcttacttg

SEQ ID NO: 203900 - DNA, 20 bp, Artificial Sequence
  chemically synthesized
acacttgttatggcttactt

SEQ ID NO: 203901 - DNA, 20 bp, Artificial Sequence
  chemically synthesized
ctcctcaagtaagccataac

SEQ ID NO: 203902 - DNA, 20 bp, Artificial Sequence
  chemically synthesized
gctttggcaaacacttgtta

SEQ ID NO: 203903 - DNA, 20 bp, Artificial Sequence
  chemically synthesized
gccataacaagtgtttgcca

SEQ ID NO: 203904 - DNA, 20 bp, Artificial Sequence
  chemically synthesized
taacaagtgtttgccaaagc

SEQ ID NO: 203905 - DNA, 20 bp, Artificial Sequence
  chemically synthesized
tggttagctaattctagctt

SEQ ID NO: 203906 - DNA, 20 bp, Artificial Sequence
  chemically synthesized
gtgtttgccaaagctagaat

SEQ ID NO: 203907 - DNA, 20 bp, Artificial Sequence
  chemically synthesized
agcaagtggttagctaattc

SEQ ID NO: 203908 - DNA, 20 bp, Artificial Sequence
  chemically synthesized
taagcaaatgagcaagtggt

SEQ ID NO: 203909 - DNA, 20 bp, Artificial Sequence
  chemically synthesized
tatgtaagcaaatgagcaag

SEQ ID NO: 203910 - DNA, 20 bp, Artificial Sequence
  chemically synthesized
ggatatgtaagcaaatgagc

SEQ ID NO: 203911 - DNA, 20 bp, Artificial Sequence
  chemically synthesized
tcggggatatgtaagcaaat

SEQ ID NO: 203912 - DNA, 20 bp, Artificial Sequence
  chemically synthesized
atggtgcctcggggatatgt

SEQ ID NO: 203913 - DNA, 20 bp, Artificial Sequence
  chemically synthesized
tcatttgcttacatatcccc

SEQ ID NO: 203914 - DNA, 20 bp, Artificial Sequence
  chemically synthesized
catttgcttacatatccccg

SEQ ID NO: 203915 - DNA, 20 bp, Artificial Sequence
  chemically synthesized
atgtcctgtatggtgcctcg

SEQ ID NO: 203916 - DNA, 20 bp, Artificial Sequence
  chemically synthesized
aatgtcctgtatggtgcctc

SEQ ID NO: 203917 - DNA, 20 bp, Artificial Sequence
  chemically synthesized
caatgtcctgtatggtgcct

SEQ ID NO: 203918 - DNA, 20 bp, Artificial Sequence
  chemically synthesized
catatccccgaggcaccata

SEQ ID NO: 203919 - DNA, 20 bp, Artificial Sequence
  chemically synthesized
atatccccgaggcaccatac

SEQ ID NO: 203920 - DNA, 20 bp, Artificial Sequence
  chemically synthesized
agtatcagcaatgtcctgta

SEQ ID NO: 203921 - DNA, 20 bp, Artificial Sequence
  chemically synthesized
acaggacattgctgatacta

SEQ ID NO: 203922 - DNA, 20 bp, Artificial Sequence
  chemically synthesized
gtaggtcatttccatagtat

SEQ ID NO: 203923 - DNA, 20 bp, Artificial Sequence
  chemically synthesized
acttctgtaggtcatttcca

SEQ ID NO: 203924 - DNA, 20 bp, Artificial Sequence
  chemically synthesized
gatactatggaaatgaccta

SEQ ID NO: 203925 - DNA, 20 bp, Artificial Sequence
  chemically synthesized
actatggaaatgacctacag

SEQ ID NO: 203926 - DNA, 20 bp, Artificial Sequence
  chemically synthesized
ccaaatgtccaaacttctgt

SEQ ID NO: 203927 - DNA, 20 bp, Artificial Sequence
  chemically synthesized
accaaatgtccaaacttctg

SEQ ID NO: 203928 - DNA, 20 bp, Artificial Sequence
  chemically synthesized
ggaaatgacctacagaagtt

SEQ ID NO: 203929 - DNA, 20 bp, Artificial Sequence
  chemically synthesized
cctacagaagtttggacatt

SEQ ID NO: 203930 - DNA, 20 bp, Artificial Sequence
  chemically synthesized
cagaagtttggacatttggt

SEQ ID NO: 203931 - DNA, 20 bp, Artificial Sequence
  chemically synthesized
agaagtttggacatttggtg

SEQ ID NO: 203932 - DNA, 20 bp, Artificial Sequence
  chemically synthesized
gaatgaaaaaaagtgaaaaa

SEQ ID NO: 203933 - DNA, 20 bp, Artificial Sequence
  chemically synthesized
atagagaaaggaatgaaaaa

SEQ ID NO: 203934 - DNA, 20 bp, Artificial Sequence
  chemically synthesized
aatttccttcacatagagaa

SEQ ID NO: 203935 - DNA, 20 bp, Artificial Sequence
  chemically synthesized
aaatttccttcacatagaga

SEQ ID NO: 203936 - DNA, 20 bp, Artificial Sequence
  chemically synthesized
ttcattcctttctctatgtg

SEQ ID NO: 203937 - DNA, 20 bp, Artificial Sequence
  chemically synthesized
tcattcctttctctatgtga

SEQ ID NO: 203938 - DNA, 20 bp, Artificial Sequence
  chemically synthesized
tattaaatttccttcacata

SEQ ID NO: 203939 - DNA, 20 bp, Artificial Sequence
  chemically synthesized
actattaaatttccttcaca

SEQ ID NO: 203940 - DNA, 20 bp, Artificial Sequence
  chemically synthesized
tctatgtgaaggaaatttaa

SEQ ID NO: 203941 - DNA, 20 bp, Artificial Sequence
  chemically synthesized
gagaaagagttaaggtatta

SEQ ID NO: 203942 - DNA, 20 bp, Artificial Sequence
  chemically synthesized
acacattagagaaagagtta

SEQ ID NO: 203943 - DNA, 20 bp, Artificial Sequence
  chemically synthesized
cacacattagagaaagagtt

SEQ ID NO: 203944 - DNA, 20 bp, Artificial Sequence
  chemically synthesized
tctctcacacattagagaaa

SEQ ID NO: 203945 - DNA, 20 bp, Artificial Sequence
  chemically synthesized
cctctctcacacattagaga

SEQ ID NO: 203946 - DNA, 20 bp, Artificial Sequence
  chemically synthesized
ctcccctctctcacacatta

SEQ ID NO: 203947 - DNA, 20 bp, Artificial Sequence
  chemically synthesized
taactctttctctaatgtgt

SEQ ID NO: 203948 - DNA, 20 bp, Artificial Sequence
  chemically synthesized
ccctcccctctctcacacat

SEQ ID NO: 203949 - DNA, 20 bp, Artificial Sequence
  chemically synthesized
actctttctctaatgtgtga

SEQ ID NO: 203950 - DNA, 20 bp, Artificial Sequence
  chemically synthesized
tctttctctaatgtgtgaga

SEQ ID NO: 203951 - DNA, 20 bp, Artificial Sequence
  chemically synthesized
ctttctctaatgtgtgagag

SEQ ID NO: 203952 - DNA, 20 bp, Artificial Sequence
  chemically synthesized
tttctctaatgtgtgagaga

SEQ ID NO: 203953 - DNA, 20 bp, Artificial Sequence
  chemically synthesized
ttctctaatgtgtgagagag

SEQ ID NO: 203954 - DNA, 20 bp, Artificial Sequence
  chemically synthesized
ctctaatgtgtgagagaggg

SEQ ID NO: 203955 - DNA, 20 bp, Artificial Sequence
  chemically synthesized
tctaatgtgtgagagagggg

SEQ ID NO: 203956 - DNA, 20 bp, Artificial Sequence
  chemically synthesized
ctaatgtgtgagagagggga

SEQ ID NO: 203957 - DNA, 20 bp, Artificial Sequence
  chemically synthesized
atgtgtgagagaggggaggg

SEQ ID NO: 203958 - DNA, 20 bp, Artificial Sequence
  chemically synthesized
tgtgtgagagaggggaggga

SEQ ID NO: 203959 - DNA, 20 bp, Artificial Sequence
  chemically synthesized
gtgtgagagaggggagggaa

SEQ ID NO: 203960 - DNA, 20 bp, Artificial Sequence
  chemically synthesized
tgagagaggggagggaaggg

SEQ ID NO: 203961 - DNA, 20 bp, Artificial Sequence
  chemically synthesized
gagagaggggagggaaggga

SEQ ID NO: 203962 - DNA, 20 bp, Artificial Sequence
  chemically synthesized
agagaggggagggaagggaa

SEQ ID NO: 203963 - DNA, 20 bp, Artificial Sequence
  chemically synthesized
gaggggagggaagggaaggg

SEQ ID NO: 203964 - DNA, 20 bp, Artificial Sequence
  chemically synthesized
aggggagggaagggaaggga

SEQ ID NO: 203965 - DNA, 20 bp, Artificial Sequence
  chemically synthesized
ggggagggaagggaagggaa

SEQ ID NO: 203966 - DNA, 20 bp, Artificial Sequence
  chemically synthesized
gagggaagggaagggaaggg

SEQ ID NO: 203967 - DNA, 20 bp, Artificial Sequence
  chemically synthesized
agggaagggaagggaaggga

SEQ ID NO: 203968 - DNA, 20 bp, Artificial Sequence
  chemically synthesized
ggaagggaagggaagggaag

SEQ ID NO: 203969 - DNA, 20 bp, Artificial Sequence
  chemically synthesized
aagggaagggaagggaagga

SEQ ID NO: 203970 - DNA, 20 bp, Artificial Sequence
  chemically synthesized
agggaagggaagggaaggag

SEQ ID NO: 203971 - DNA, 20 bp, Artificial Sequence
  chemically synthesized
gggaagggaagggaaggaga

SEQ ID NO: 203972 - DNA, 20 bp, Artificial Sequence
  chemically synthesized
ggaagggaagggaaggagag

SEQ ID NO: 203973 - DNA, 20 bp, Artificial Sequence
  chemically synthesized
aagggaagggaaggagaggg

SEQ ID NO: 203974 - DNA, 20 bp, Artificial Sequence
  chemically synthesized
agggaagggaaggagagggg

SEQ ID NO: 203975 - DNA, 20 bp, Artificial Sequence
  chemically synthesized
gggaagggaaggagagggga

SEQ ID NO: 203976 - DNA, 20 bp, Artificial Sequence
  chemically synthesized
aagggaaggagaggggaggg

SEQ ID NO: 203977 - DNA, 20 bp, Artificial Sequence
  chemically synthesized
agggaaggagaggggaggga

SEQ ID NO: 203978 - DNA, 20 bp, Artificial Sequence
  chemically synthesized
gggaaggagaggggagggaa

SEQ ID NO: 203979 - DNA, 20 bp, Artificial Sequence
  chemically synthesized
aaggagaggggagggaaggg

SEQ ID NO: 203980 - DNA, 20 bp, Artificial Sequence
  chemically synthesized
aggagaggggagggaaggga

SEQ ID NO: 203981 - DNA, 20 bp, Artificial Sequence
  chemically synthesized
ggagaggggagggaagggaa

SEQ ID NO: 203982 - DNA, 20 bp, Artificial Sequence
  chemically synthesized
gagaggggagggaagggaag

SEQ ID NO: 203983 - DNA, 20 bp, Artificial Sequence
  chemically synthesized
gaggggagggaagggaaggg

SEQ ID NO: 203984 - DNA, 20 bp, Artificial Sequence
  chemically synthesized
aggggagggaagggaagggg

SEQ ID NO: 203985 - DNA, 20 bp, Artificial Sequence
  chemically synthesized
ggggagggaagggaagggga

SEQ ID NO: 203986 - DNA, 20 bp, Artificial Sequence
  chemically synthesized
gggagggaagggaaggggag

SEQ ID NO: 203987 - DNA, 20 bp, Artificial Sequence
  chemically synthesized
gagggaagggaaggggaggg

SEQ ID NO: 203988 - DNA, 20 bp, Artificial Sequence
  chemically synthesized
agggaagggaaggggagggg

SEQ ID NO: 203989 - DNA, 20 bp, Artificial Sequence
  chemically synthesized
gggaagggaaggggagggga

SEQ ID NO: 203990 - DNA, 20 bp, Artificial Sequence
  chemically synthesized
ggaagggaaggggaggggag

SEQ ID NO: 203991 - DNA, 20 bp, Artificial Sequence
  chemically synthesized
aagggaaggggaggggaggg

SEQ ID NO: 203992 - DNA, 20 bp, Artificial Sequence
  chemically synthesized
agggaaggggaggggagggg

SEQ ID NO: 203993 - DNA, 20 bp, Artificial Sequence
  chemically synthesized
gggaaggggaggggagggga

SEQ ID NO: 203994 - DNA, 20 bp, Artificial Sequence
  chemically synthesized
ggaaggggaggggaggggag

SEQ ID NO: 203995 - DNA, 20 bp, Artificial Sequence
  chemically synthesized
aaggggaggggaggggaggg

SEQ ID NO: 203996 - DNA, 20 bp, Artificial Sequence
  chemically synthesized
aggggaggggaggggagggg

SEQ ID NO: 203997 - DNA, 20 bp, Artificial Sequence
  chemically synthesized
ggggaggggaggggagggga

SEQ ID NO: 203998 - DNA, 20 bp, Artificial Sequence
  chemically synthesized
gggaggggaggggaggggag

SEQ ID NO: 203999 - DNA, 20 bp, Artificial Sequence
  chemically synthesized
gaggggaggggaggggaggg

SEQ ID NO: 204000 - DNA, 20 bp, Artificial Sequence
  chemically synthesized
aggggaggggaggggagggg

SEQ ID NO: 204001 - DNA, 20 bp, Artificial Sequence
  chemically synthesized
gggaggggaggggaggggag

SEQ ID NO: 204002 - DNA, 20 bp, Artificial Sequence
  chemically synthesized
gaggggaggggaggggagga

SEQ ID NO: 204003 - DNA, 20 bp, Artificial Sequence
  chemically synthesized
ggggaggggaggggaggaga

SEQ ID NO: 204004 - DNA, 20 bp, Artificial Sequence
  chemically synthesized
ggaggggaggggaggagaga

SEQ ID NO: 204005 - DNA, 20 bp, Artificial Sequence
  chemically synthesized
aggggaggagagagagatca

SEQ ID NO: 204006 - DNA, 20 bp, Artificial Sequence
  chemically synthesized
ggggaggagagagagatcaa

SEQ ID NO: 204007 - DNA, 20 bp, Artificial Sequence
  chemically synthesized
gagagagagatcaaaggaca

SEQ ID NO: 204008 - DNA, 20 bp, Artificial Sequence
  chemically synthesized
caaaggacaaagaaaataac

SEQ ID NO: 204009 - DNA, 20 bp, Artificial Sequence
  chemically synthesized
aaggacaaagaaaataacca

SEQ ID NO: 204010 - DNA, 20 bp, Artificial Sequence
  chemically synthesized
aagaaaataaccagagatac

SEQ ID NO: 204011 - DNA, 20 bp, Artificial Sequence
  chemically synthesized
tctttgcatccttgtatctc

SEQ ID NO: 204012 - DNA, 20 bp, Artificial Sequence
  chemically synthesized
agaaaataaccagagataca

SEQ ID NO: 204013 - DNA, 20 bp, Artificial Sequence
  chemically synthesized
accagagatacaaggatgca

SEQ ID NO: 204014 - DNA, 20 bp, Artificial Sequence
  chemically synthesized
cagagatacaaggatgcaaa

SEQ ID NO: 204015 - DNA, 20 bp, Artificial Sequence
  chemically synthesized
tagattttggaagtagaaaa

SEQ ID NO: 204016 - DNA, 20 bp, Artificial Sequence
  chemically synthesized
ctagattttggaagtagaaa

SEQ ID NO: 204017 - DNA, 20 bp, Artificial Sequence
  chemically synthesized
gaataactagattttggaag

SEQ ID NO: 204018 - DNA, 20 bp, Artificial Sequence
  chemically synthesized
acagaataactagattttgg

SEQ ID NO: 204019 - DNA, 20 bp, Artificial Sequence
  chemically synthesized
ctttttctacttccaaaatc

SEQ ID NO: 204020 - DNA, 20 bp, Artificial Sequence
  chemically synthesized
tgcacagaataactagattt

SEQ ID NO: 204021 - DNA, 20 bp, Artificial Sequence
  chemically synthesized
acgtttttgcacagaataac

SEQ ID NO: 204022 - DNA, 20 bp, Artificial Sequence
  chemically synthesized
tcgttcttaacgtttttgca

SEQ ID NO: 204023 - DNA, 20 bp, Artificial Sequence
  chemically synthesized
ttattctgtgcaaaaacgtt

SEQ ID NO: 204024 - DNA, 20 bp, Artificial Sequence
  chemically synthesized
aaaacgttaagaacgaactt

SEQ ID NO: 204025 - DNA, 20 bp, Artificial Sequence
  chemically synthesized
acgttaagaacgaactttgg

SEQ ID NO: 204026 - DNA, 20 bp, Artificial Sequence
  chemically synthesized
ccatgcatagttttcttcca

SEQ ID NO: 204027 - DNA, 20 bp, Artificial Sequence
  chemically synthesized
ctttggaagaaaactatgca

SEQ ID NO: 204028 - DNA, 20 bp, Artificial Sequence
  chemically synthesized
agcagcattttcaccatgca

SEQ ID NO: 204029 - DNA, 20 bp, Artificial Sequence
  chemically synthesized
ttgttgtagtttttaaacag

SEQ ID NO: 204030 - DNA, 20 bp, Artificial Sequence
  chemically synthesized
gttttgttgtagtttttaaa

SEQ ID NO: 204031 - DNA, 20 bp, Artificial Sequence
  chemically synthesized
tatgatgggctgttttgttg

SEQ ID NO: 204032 - DNA, 20 bp, Artificial Sequence
  chemically synthesized
gtttaaaaactacaacaaaa

SEQ ID NO: 204033 - DNA, 20 bp, Artificial Sequence
  chemically synthesized
tacaacaaaacagcccatca

SEQ ID NO: 204034 - DNA, 20 bp, Artificial Sequence
  chemically synthesized
caacaaaacagcccatcata

SEQ ID NO: 204035 - DNA, 20 bp, Artificial Sequence
  chemically synthesized
tgtttcttctactctatgat

SEQ ID NO: 204036 - DNA, 20 bp, Artificial Sequence
  chemically synthesized
gtgtttcttctactctatga

SEQ ID NO: 204037 - DNA, 20 bp, Artificial Sequence
  chemically synthesized
caaaacagcccatcatagag

SEQ ID NO: 204038 - DNA, 20 bp, Artificial Sequence
  chemically synthesized
aacagcccatcatagagtag

SEQ ID NO: 204039 - DNA, 20 bp, Artificial Sequence
  chemically synthesized
tcatagagtagaagaaacac

SEQ ID NO: 204040 - DNA, 20 bp, Artificial Sequence
  chemically synthesized
gagtagaagaaacaccggcc

SEQ ID NO: 204041 - DNA, 20 bp, Artificial Sequence
  chemically synthesized
agtagaagaaacaccggcct

SEQ ID NO: 204042 - DNA, 20 bp, Artificial Sequence
  chemically synthesized
tagaagaaacaccggcctgg

SEQ ID NO: 204043 - DNA, 20 bp, Artificial Sequence
  chemically synthesized
agaagaaacaccggcctggg

SEQ ID NO: 204044 - DNA, 20 bp, Artificial Sequence
  chemically synthesized
aggcacttgtcctcccaggc

SEQ ID NO: 204045 - DNA, 20 bp, Artificial Sequence
  chemically synthesized
acacaggcacttgtcctccc

SEQ ID NO: 204046 - DNA, 20 bp, Artificial Sequence
  chemically synthesized
aaacaccggcctgggaggac

SEQ ID NO: 204047 - DNA, 20 bp, Artificial Sequence
  chemically synthesized
aacacaggcacttgtcctcc

SEQ ID NO: 204048 - DNA, 20 bp, Artificial Sequence
  chemically synthesized
ttagctctgtgatagaacac

SEQ ID NO: 204049 - DNA, 20 bp, Artificial Sequence
  chemically synthesized
attagctctgtgatagaaca

SEQ ID NO: 204050 - DNA, 20 bp, Artificial Sequence
  chemically synthesized
caagtgcctgtgttctatca

SEQ ID NO: 204051 - DNA, 20 bp, Artificial Sequence
  chemically synthesized
agtgcctgtgttctatcaca

SEQ ID NO: 204052 - DNA, 20 bp, Artificial Sequence
  chemically synthesized
tgttaacattagctctgtga

SEQ ID NO: 204053 - DNA, 20 bp, Artificial Sequence
  chemically synthesized
aatgagcagcttgttaacat

SEQ ID NO: 204054 - DNA, 20 bp, Artificial Sequence
  chemically synthesized
atcacagagctaatgttaac

SEQ ID NO: 204055 - DNA, 20 bp, Artificial Sequence
  chemically synthesized
acgagattttcgtcaatgag

SEQ ID NO: 204056 - DNA, 20 bp, Artificial Sequence
  chemically synthesized
gggacgagattttcgtcaat

SEQ ID NO: 204057 - DNA, 20 bp, Artificial Sequence
  chemically synthesized
ttgagtctgatataagggac

SEQ ID NO: 204058 - DNA, 20 bp, Artificial Sequence
  chemically synthesized
gaaaatctcgtcccttatat

SEQ ID NO: 204059 - DNA, 20 bp, Artificial Sequence
  chemically synthesized
ggagattgagtctgatataa

SEQ ID NO: 204060 - DNA, 20 bp, Artificial Sequence
  chemically synthesized
aggagattgagtctgatata

SEQ ID NO: 204061 - DNA, 20 bp, Artificial Sequence
  chemically synthesized
gaggagattgagtctgatat

SEQ ID NO: 204062 - DNA, 20 bp, Artificial Sequence
  chemically synthesized
atcttatgaatgaggagatt

SEQ ID NO: 204063 - DNA, 20 bp, Artificial Sequence
  chemically synthesized
tttctcatcttatgaatgag

SEQ ID NO: 204064 - DNA, 20 bp, Artificial Sequence
  chemically synthesized
gactcaatctcctcattcat

SEQ ID NO: 204065 - DNA, 20 bp, Artificial Sequence
  chemically synthesized
aatttctcatcttatgaatg

SEQ ID NO: 204066 - DNA, 20 bp, Artificial Sequence
  chemically synthesized
aaatttctcatcttatgaat

SEQ ID NO: 204067 - DNA, 20 bp, Artificial Sequence
  chemically synthesized
aatctcctcattcataagat

SEQ ID NO: 204068 - DNA, 20 bp, Artificial Sequence
  chemically synthesized
ataagatgagaaatttgcac

SEQ ID NO: 204069 - DNA, 20 bp, Artificial Sequence
  chemically synthesized
agcaaatttcagtgataatc

SEQ ID NO: 204070 - DNA, 20 bp, Artificial Sequence
  chemically synthesized
tttagaggtggagcaaattt

SEQ ID NO: 204071 - DNA, 20 bp, Artificial Sequence
  chemically synthesized
ccctagtcattttagaggtg

SEQ ID NO: 204072 - DNA, 20 bp, Artificial Sequence
  chemically synthesized
aaccctagtcattttagagg

SEQ ID NO: 204073 - DNA, 20 bp, Artificial Sequence
  chemically synthesized
tggaaccctagtcattttag

SEQ ID NO: 204074 - DNA, 20 bp, Artificial Sequence
  chemically synthesized
atggaaccctagtcatttta

SEQ ID NO: 204075 - DNA, 20 bp, Artificial Sequence
  chemically synthesized
tgctccacctctaaaatgac

SEQ ID NO: 204076 - DNA, 20 bp, Artificial Sequence
  chemically synthesized
atatggaaccctagtcattt

SEQ ID NO: 204077 - DNA, 20 bp, Artificial Sequence
  chemically synthesized
gctccacctctaaaatgact

SEQ ID NO: 204078 - DNA, 20 bp, Artificial Sequence
  chemically synthesized
ctccacctctaaaatgacta

SEQ ID NO: 204079 - DNA, 20 bp, Artificial Sequence
  chemically synthesized
tttaccagaatatggaaccc

SEQ ID NO: 204080 - DNA, 20 bp, Artificial Sequence
  chemically synthesized
atgactagggttccatattc

SEQ ID NO: 204081 - DNA, 20 bp, Artificial Sequence
  chemically synthesized
ctgtttaatttaccagaata

SEQ ID NO: 204082 - DNA, 20 bp, Artificial Sequence
  chemically synthesized
cattactctgtttaatttac

SEQ ID NO: 204083 - DNA, 20 bp, Artificial Sequence
  chemically synthesized
ccatattctggtaaattaaa

SEQ ID NO: 204084 - DNA, 20 bp, Artificial Sequence
  chemically synthesized
atattctggtaaattaaaca

SEQ ID NO: 204085 - DNA, 20 bp, Artificial Sequence
  chemically synthesized
cagagtaatgttttaaatta

SEQ ID NO: 204086 - DNA, 20 bp, Artificial Sequence
  chemically synthesized
ttaaattaaagatattatca

SEQ ID NO: 204087 - DNA, 20 bp, Artificial Sequence
  chemically synthesized
taaattaaagatattatcac

SEQ ID NO: 204088 - DNA, 20 bp, Artificial Sequence
  chemically synthesized
ggtgtgtaatcttgcctgtt

SEQ ID NO: 204089 - DNA, 20 bp, Artificial Sequence
  chemically synthesized
ttaatttatgctcaacaggc

SEQ ID NO: 204090 - DNA, 20 bp, Artificial Sequence
  chemically synthesized
attcttaatttatgctcaac

SEQ ID NO: 204091 - DNA, 20 bp, Artificial Sequence
  chemically synthesized
tattcttaatttatgctcaa

SEQ ID NO: 204092 - DNA, 20 bp, Artificial Sequence
  chemically synthesized
ttgcctgttgagcataaatt

SEQ ID NO: 204093 - DNA, 20 bp, Artificial Sequence
  chemically synthesized
acgatgtgacattcaattta

SEQ ID NO: 204094 - DNA, 20 bp, Artificial Sequence
  chemically synthesized
tgacattcaatttatagtaa

SEQ ID NO: 204095 - DNA, 20 bp, Artificial Sequence
  chemically synthesized
tttatagtaacagattcaaa

SEQ ID NO: 204096 - DNA, 20 bp, Artificial Sequence
  chemically synthesized
gcatatttaaaaataaatta

SEQ ID NO: 204097 - DNA, 20 bp, Artificial Sequence
  chemically synthesized
atttaaaaataaattatagc

SEQ ID NO: 204098 - DNA, 20 bp, Artificial Sequence
  chemically synthesized
aaaaataaattatagctaga

SEQ ID NO: 204099 - DNA, 20 bp, Artificial Sequence
  chemically synthesized
aaaataaattatagctagat

SEQ ID NO: 204100 - DNA, 20 bp, Artificial Sequence
  chemically synthesized
aataaattatagctagatag

SEQ ID NO: 204101 - DNA, 20 bp, Artificial Sequence
  chemically synthesized
tagaacttatttctcctatc

SEQ ID NO: 204102 - DNA, 20 bp, Artificial Sequence
  chemically synthesized
tatagctagataggagaaat

SEQ ID NO: 204103 - DNA, 20 bp, Artificial Sequence
  chemically synthesized
tagataggagaaataagttc

SEQ ID NO: 204104 - DNA, 20 bp, Artificial Sequence
  chemically synthesized
cattcagtcgtatagagcac

SEQ ID NO: 204105 - DNA, 20 bp, Artificial Sequence
  chemically synthesized
agtcaccattcagtcgtata

SEQ ID NO: 204106 - DNA, 20 bp, Artificial Sequence
  chemically synthesized
atagtcaccattcagtcgta

SEQ ID NO: 204107 - DNA, 20 bp, Artificial Sequence
  chemically synthesized
tagtgctctatacgactgaa

SEQ ID NO: 204108 - DNA, 20 bp, Artificial Sequence
  chemically synthesized
tgctaactatagtcaccatt

SEQ ID NO: 204109 - DNA, 20 bp, Artificial Sequence
  chemically synthesized
atacgactgaatggtgacta

SEQ ID NO: 204110 - DNA, 20 bp, Artificial Sequence
  chemically synthesized
gactgaatggtgactatagt

SEQ ID NO: 204111 - DNA, 20 bp, Artificial Sequence
  chemically synthesized
ttctatattattgctaacta

SEQ ID NO: 204112 - DNA, 20 bp, Artificial Sequence
  chemically synthesized
gactatagttagcaataata

SEQ ID NO: 204113 - DNA, 20 bp, Artificial Sequence
  chemically synthesized
tatagttagcaataatatag

SEQ ID NO: 204114 - DNA, 20 bp, Artificial Sequence
  chemically synthesized
aataatatagaagtttcaaa

SEQ ID NO: 204115 - DNA, 20 bp, Artificial Sequence
  chemically synthesized
atatagaagtttcaaatggc

SEQ ID NO: 204116 - DNA, 20 bp, Artificial Sequence
  chemically synthesized
tagaagtttcaaatggctag

SEQ ID NO: 204117 - DNA, 20 bp, Artificial Sequence
  chemically synthesized
agaagtttcaaatggctaga

SEQ ID NO: 204118 - DNA, 20 bp, Artificial Sequence
  chemically synthesized
aagtttcaaatggctagaag

SEQ ID NO: 204119 - DNA, 20 bp, Artificial Sequence
  chemically synthesized
aacattcaacgttctccttc

SEQ ID NO: 204120 - DNA, 20 bp, Artificial Sequence
  chemically synthesized
attggtcatttatttgtgtt

SEQ ID NO: 204121 - DNA, 20 bp, Artificial Sequence
  chemically synthesized
cattggtcatttatttgtgt

SEQ ID NO: 204122 - DNA, 20 bp, Artificial Sequence
  chemically synthesized
caaataaatgaccaatgttt

SEQ ID NO: 204123 - DNA, 20 bp, Artificial Sequence
  chemically synthesized
atatccattatctcaaacat

SEQ ID NO: 204124 - DNA, 20 bp, Artificial Sequence
  chemically synthesized
atgaccaatgtttgagataa

SEQ ID NO: 204125 - DNA, 20 bp, Artificial Sequence
  chemically synthesized
agtgatcagatcagggtaat

SEQ ID NO: 204126 - DNA, 20 bp, Artificial Sequence
  chemically synthesized
aatgtatagtgatcagatca

SEQ ID NO: 204127 - DNA, 20 bp, Artificial Sequence
  chemically synthesized
taatgtatagtgatcagatc

SEQ ID NO: 204128 - DNA, 20 bp, Artificial Sequence
  chemically synthesized
gtaatgtatagtgatcagat

SEQ ID NO: 204129 - DNA, 20 bp, Artificial Sequence
  chemically synthesized
tatatgtaatgtatagtgat

SEQ ID NO: 204130 - DNA, 20 bp, Artificial Sequence
  chemically synthesized
gtttttatatatgtaatgta

SEQ ID NO: 204131 - DNA, 20 bp, Artificial Sequence
  chemically synthesized
tacatatataaaaacatcac

SEQ ID NO: 204132 - DNA, 20 bp, Artificial Sequence
  chemically synthesized
acatatataaaaacatcact

SEQ ID NO: 204133 - DNA, 20 bp, Artificial Sequence
  chemically synthesized
gtacatattcatggagaacc

SEQ ID NO: 204134 - DNA, 20 bp, Artificial Sequence
  chemically synthesized
aataattgtacatattcatg

SEQ ID NO: 204135 - DNA, 20 bp, Artificial Sequence
  chemically synthesized
ataataattgtacatattca

SEQ ID NO: 204136 - DNA, 20 bp, Artificial Sequence
  chemically synthesized
caattaaaaaaattcttcaa

SEQ ID NO: 204137 - DNA, 20 bp, Artificial Sequence
  chemically synthesized
ttttacattgtttacttttg

SEQ ID NO: 204138 - DNA, 20 bp, Artificial Sequence
  chemically synthesized
caaaagtaaacaatgtaaaa

SEQ ID NO: 204139 - DNA, 20 bp, Artificial Sequence
  chemically synthesized
aagtaaacaatgtaaaatag

SEQ ID NO: 204140 - DNA, 20 bp, Artificial Sequence
  chemically synthesized
taaaatagtagacgtgatgt

SEQ ID NO: 204141 - DNA, 20 bp, Artificial Sequence
  chemically synthesized
aaaatagtagacgtgatgtg

SEQ ID NO: 204142 - DNA, 20 bp, Artificial Sequence
  chemically synthesized
gtagacgtgatgtgaggtat

SEQ ID NO: 204143 - DNA, 20 bp, Artificial Sequence
  chemically synthesized
tagacgtgatgtgaggtata

SEQ ID NO: 204144 - DNA, 20 bp, Artificial Sequence
  chemically synthesized
gacgtgatgtgaggtataag

SEQ ID NO: 204145 - DNA, 20 bp, Artificial Sequence
  chemically synthesized
atgttccaaaattgattggg

SEQ ID NO: 204146 - DNA, 20 bp, Artificial Sequence
  chemically synthesized
tttatgttccaaaattgatt

SEQ ID NO: 204147 - DNA, 20 bp, Artificial Sequence
  chemically synthesized
ttttatgttccaaaattgat

SEQ ID NO: 204148 - DNA, 20 bp, Artificial Sequence
  chemically synthesized
gagaacttcccaatcaattt

SEQ ID NO: 204149 - DNA, 20 bp, Artificial Sequence
  chemically synthesized
gaacataaaacttcatttct

SEQ ID NO: 204150 - DNA, 20 bp, Artificial Sequence
  chemically synthesized
cttcctttgcctcagaaatg

SEQ ID NO: 204151 - DNA, 20 bp, Artificial Sequence
  chemically synthesized
aacataaaacttcatttctg

SEQ ID NO: 204152 - DNA, 20 bp, Artificial Sequence
  chemically synthesized
aaaacttcatttctgaggca

SEQ ID NO: 204153 - DNA, 20 bp, Artificial Sequence
  chemically synthesized
aaacttcatttctgaggcaa

SEQ ID NO: 204154 - DNA, 20 bp, Artificial Sequence
  chemically synthesized
gtcaagttcttcctttgcct

SEQ ID NO: 204155 - DNA, 20 bp, Artificial Sequence
  chemically synthesized
cttcatttctgaggcaaagg

SEQ ID NO: 204156 - DNA, 20 bp, Artificial Sequence
  chemically synthesized
aagaagttatataaaatgtc

SEQ ID NO: 204157 - DNA, 20 bp, Artificial Sequence
  chemically synthesized
attttatataacttctttgc

SEQ ID NO: 204158 - DNA, 20 bp, Artificial Sequence
  chemically synthesized
gccactggattctggcaaag

SEQ ID NO: 204159 - DNA, 20 bp, Artificial Sequence
  chemically synthesized
agagccactggattctggca

SEQ ID NO: 204160 - DNA, 20 bp, Artificial Sequence
  chemically synthesized
ataacttctttgccagaatc

SEQ ID NO: 204161 - DNA, 20 bp, Artificial Sequence
  chemically synthesized
atagtagagccactggattc

SEQ ID NO: 204162 - DNA, 20 bp, Artificial Sequence
  chemically synthesized
acttctttgccagaatccag

SEQ ID NO: 204163 - DNA, 20 bp, Artificial Sequence
  chemically synthesized
cagaaaaatagtagagccac

SEQ ID NO: 204164 - DNA, 20 bp, Artificial Sequence
  chemically synthesized
cattcttcagaaaaatagta

SEQ ID NO: 204165 - DNA, 20 bp, Artificial Sequence
  chemically synthesized
tgcattcttcagaaaaatag

SEQ ID NO: 204166 - DNA, 20 bp, Artificial Sequence
  chemically synthesized
ttatgcattcttcagaaaaa

SEQ ID NO: 204167 - DNA, 20 bp, Artificial Sequence
  chemically synthesized
gtggctctactatttttctg

SEQ ID NO: 204168 - DNA, 20 bp, Artificial Sequence
  chemically synthesized
ctgtgattttatgcattctt

SEQ ID NO: 204169 - DNA, 20 bp, Artificial Sequence
  chemically synthesized
ctgaagaatgcataaaatca

SEQ ID NO: 204170 - DNA, 20 bp, Artificial Sequence
  chemically synthesized
atcacagtatcatgatactt

SEQ ID NO: 204171 - DNA, 20 bp, Artificial Sequence
  chemically synthesized
tatcatgatactttggaatt

SEQ ID NO: 204172 - DNA, 20 bp, Artificial Sequence
  chemically synthesized
tagcagcctcctaaattcca

SEQ ID NO: 204173 - DNA, 20 bp, Artificial Sequence
  chemically synthesized
atcatgatactttggaattt

SEQ ID NO: 204174 - DNA, 20 bp, Artificial Sequence
  chemically synthesized
catgatactttggaatttag

SEQ ID NO: 204175 - DNA, 20 bp, Artificial Sequence
  chemically synthesized
atgatactttggaatttagg

SEQ ID NO: 204176 - DNA, 20 bp, Artificial Sequence
  chemically synthesized
atttaggaggctgctatact

SEQ ID NO: 204177 - DNA, 20 bp, Artificial Sequence
  chemically synthesized
caggactaaactcagtatag

SEQ ID NO: 204178 - DNA, 20 bp, Artificial Sequence
  chemically synthesized
agacaggactaaactcagta

SEQ ID NO: 204179 - DNA, 20 bp, Artificial Sequence
  chemically synthesized
ggaggctgctatactgagtt

SEQ ID NO: 204180 - DNA, 20 bp, Artificial Sequence
  chemically synthesized
caaacagacaggactaaact

SEQ ID NO: 204181 - DNA, 20 bp, Artificial Sequence
  chemically synthesized
tttgttagatacaaacagac

SEQ ID NO: 204182 - DNA, 20 bp, Artificial Sequence
  chemically synthesized
ctttgttagatacaaacaga

SEQ ID NO: 204183 - DNA, 20 bp, Artificial Sequence
  chemically synthesized
atttctttgttagatacaaa

SEQ ID NO: 204184 - DNA, 20 bp, Artificial Sequence
  chemically synthesized
ctgtctgtttgtatctaaca

SEQ ID NO: 204185 - DNA, 20 bp, Artificial Sequence
  chemically synthesized
aaaaagaaagatttctttgt

SEQ ID NO: 204186 - DNA, 20 bp, Artificial Sequence
  chemically synthesized
ctgagggttggagaaaaaga

SEQ ID NO: 204187 - DNA, 20 bp, Artificial Sequence
  chemically synthesized
gaaactgagggttggagaaa

SEQ ID NO: 204188 - DNA, 20 bp, Artificial Sequence
  chemically synthesized
ctttctttttctccaaccct

SEQ ID NO: 204189 - DNA, 20 bp, Artificial Sequence
  chemically synthesized
gatggagaaactgagggttg

SEQ ID NO: 204190 - DNA, 20 bp, Artificial Sequence
  chemically synthesized
aagatggagaaactgagggt

SEQ ID NO: 204191 - DNA, 20 bp, Artificial Sequence
  chemically synthesized
ttccaagatggagaaactga

SEQ ID NO: 204192 - DNA, 20 bp, Artificial Sequence
  chemically synthesized
tttccaagatggagaaactg

SEQ ID NO: 204193 - DNA, 20 bp, Artificial Sequence
  chemically synthesized
atttccaagatggagaaact

SEQ ID NO: 204194 - DNA, 20 bp, Artificial Sequence
  chemically synthesized
aaccctcagtttctccatct

SEQ ID NO: 204195 - DNA, 20 bp, Artificial Sequence
  chemically synthesized
actttcttatttccaagatg

SEQ ID NO: 204196 - DNA, 20 bp, Artificial Sequence
  chemically synthesized
taactttcttatttccaaga

SEQ ID NO: 204197 - DNA, 20 bp, Artificial Sequence
  chemically synthesized
agtttctccatcttggaaat

SEQ ID NO: 204198 - DNA, 20 bp, Artificial Sequence
  chemically synthesized
catctaactttcttatttcc

SEQ ID NO: 204199 - DNA, 20 bp, Artificial Sequence
  chemically synthesized
tctccatcttggaaataaga

SEQ ID NO: 204200 - DNA, 20 bp, Artificial Sequence
  chemically synthesized
catcttggaaataagaaagt

SEQ ID NO: 204201 - DNA, 20 bp, Artificial Sequence
  chemically synthesized
aactgaaagattaagaggta

SEQ ID NO: 204202 - DNA, 20 bp, Artificial Sequence
  chemically synthesized
aaactgaaagattaagaggt

SEQ ID NO: 204203 - DNA, 20 bp, Artificial Sequence
  chemically synthesized
cataaaactgaaagattaag

SEQ ID NO: 204204 - DNA, 20 bp, Artificial Sequence
  chemically synthesized
acataaaactgaaagattaa

SEQ ID NO: 204205 - DNA, 20 bp, Artificial Sequence
  chemically synthesized
gtccttacctcttaatcttt

SEQ ID NO: 204206 - DNA, 20 bp, Artificial Sequence
  chemically synthesized
tcacataaaactgaaagatt

SEQ ID NO: 204207 - DNA, 20 bp, Artificial Sequence
  chemically synthesized
atatgatcacataaaactga

SEQ ID NO: 204208 - DNA, 20 bp, Artificial Sequence
  chemically synthesized
tcagttttatgtgatcatat

SEQ ID NO: 204209 - DNA, 20 bp, Artificial Sequence
  chemically synthesized
cagactgcttgatcagagag

SEQ ID NO: 204210 - DNA, 20 bp, Artificial Sequence
  chemically synthesized
tgagtatcttctctctgatc

SEQ ID NO: 204211 - DNA, 20 bp, Artificial Sequence
  chemically synthesized
aagcagactgcttgatcaga

SEQ ID NO: 204212 - DNA, 20 bp, Artificial Sequence
  chemically synthesized
ctaagcagactgcttgatca

SEQ ID NO: 204213 - DNA, 20 bp, Artificial Sequence
  chemically synthesized
gtatcttctctctgatcaag

SEQ ID NO: 204214 - DNA, 20 bp, Artificial Sequence
  chemically synthesized
cactaagcagactgcttgat

SEQ ID NO: 204215 - DNA, 20 bp, Artificial Sequence
  chemically synthesized
ctctgatcaagcagtctgct

SEQ ID NO: 204216 - DNA, 20 bp, Artificial Sequence
  chemically synthesized
taatttatcaaatcactaag

SEQ ID NO: 204217 - DNA, 20 bp, Artificial Sequence
  chemically synthesized
atttaatttatcaaatcact

SEQ ID NO: 204218 - DNA, 20 bp, Artificial Sequence
  chemically synthesized
aaacacttcaaagcaaatga

SEQ ID NO: 204219 - DNA, 20 bp, Artificial Sequence
  chemically synthesized
ataaactttcatttgctttg

SEQ ID NO: 204220 - DNA, 20 bp, Artificial Sequence
  chemically synthesized
acaaaataaaaaacacttca

SEQ ID NO: 204221 - DNA, 20 bp, Artificial Sequence
  chemically synthesized
tcaaaaattaattattttta

SEQ ID NO: 204222 - DNA, 20 bp, Artificial Sequence
  chemically synthesized
tataaaaataattaattttt

SEQ ID NO: 204223 - DNA, 20 bp, Artificial Sequence
  chemically synthesized
aattaatttttgagtattta

SEQ ID NO: 204224 - DNA, 20 bp, Artificial Sequence
  chemically synthesized
gactttctttagcagttgga

SEQ ID NO: 204225 - DNA, 20 bp, Artificial Sequence
  chemically synthesized
tgactttctttagcagttgg

SEQ ID NO: 204226 - DNA, 20 bp, Artificial Sequence
  chemically synthesized
cattgtccttccaactgcta

SEQ ID NO: 204227 - DNA, 20 bp, Artificial Sequence
  chemically synthesized
acatgactttctttagcagt

SEQ ID NO: 204228 - DNA, 20 bp, Artificial Sequence
  chemically synthesized
gtccttccaactgctaaaga

SEQ ID NO: 204229 - DNA, 20 bp, Artificial Sequence
  chemically synthesized
aaggacatgactttctttag

SEQ ID NO: 204230 - DNA, 20 bp, Artificial Sequence
  chemically synthesized
ggcaaggacatgactttctt

SEQ ID NO: 204231 - DNA, 20 bp, Artificial Sequence
  chemically synthesized
ctttgaggaagaaaatggca

SEQ ID NO: 204232 - DNA, 20 bp, Artificial Sequence
  chemically synthesized
tctttgaggaagaaaatggc

SEQ ID NO: 204233 - DNA, 20 bp, Artificial Sequence
  chemically synthesized
taagtctttgaggaagaaaa

SEQ ID NO: 204234 - DNA, 20 bp, Artificial Sequence
  chemically synthesized
ccttgccattttcttcctca

SEQ ID NO: 204235 - DNA, 20 bp, Artificial Sequence
  chemically synthesized
ctttttctaagtctttgagg

SEQ ID NO: 204236 - DNA, 20 bp, Artificial Sequence
  chemically synthesized
cttctttttctaagtctttg

SEQ ID NO: 204237 - DNA, 20 bp, Artificial Sequence
  chemically synthesized
cattttcttcctcaaagact

SEQ ID NO: 204238 - DNA, 20 bp, Artificial Sequence
  chemically synthesized
ccttctttttctaagtcttt

SEQ ID NO: 204239 - DNA, 20 bp, Artificial Sequence
  chemically synthesized
cttcctcaaagacttagaaa

SEQ ID NO: 204240 - DNA, 20 bp, Artificial Sequence
  chemically synthesized
tagtttgtccttctttttct

SEQ ID NO: 204241 - DNA, 20 bp, Artificial Sequence
  chemically synthesized
cctcaaagacttagaaaaag

SEQ ID NO: 204242 - DNA, 20 bp, Artificial Sequence
  chemically synthesized
ctcaaagacttagaaaaaga

SEQ ID NO: 204243 - DNA, 20 bp, Artificial Sequence
  chemically synthesized
tagaaaaagaaggacaaact

SEQ ID NO: 204244 - DNA, 20 bp, Artificial Sequence
  chemically synthesized
agaaggacaaactaagccca

SEQ ID NO: 204245 - DNA, 20 bp, Artificial Sequence
  chemically synthesized
ccctctgctaactttgggct

SEQ ID NO: 204246 - DNA, 20 bp, Artificial Sequence
  chemically synthesized
ggacaaactaagcccaaagt

SEQ ID NO: 204247 - DNA, 20 bp, Artificial Sequence
  chemically synthesized
tccttccctctgctaacttt

SEQ ID NO: 204248 - DNA, 20 bp, Artificial Sequence
  chemically synthesized
caaactaagcccaaagttag

SEQ ID NO: 204249 - DNA, 20 bp, Artificial Sequence
  chemically synthesized
ttccttccctctgctaactt

SEQ ID NO: 204250 - DNA, 20 bp, Artificial Sequence
  chemically synthesized
aactaagcccaaagttagca

SEQ ID NO: 204251 - DNA, 20 bp, Artificial Sequence
  chemically synthesized
actaagcccaaagttagcag

SEQ ID NO: 204252 - DNA, 20 bp, Artificial Sequence
  chemically synthesized
ctaagcccaaagttagcaga

SEQ ID NO: 204253 - DNA, 20 bp, Artificial Sequence
  chemically synthesized
agcccaaagttagcagaggg

SEQ ID NO: 204254 - DNA, 20 bp, Artificial Sequence
  chemically synthesized
gcccaaagttagcagaggga

SEQ ID NO: 204255 - DNA, 20 bp, Artificial Sequence
  chemically synthesized
agcagagggaaggaaatatt

SEQ ID NO: 204256 - DNA, 20 bp, Artificial Sequence
  chemically synthesized
agggaaggaaatattaagat

SEQ ID NO: 204257 - DNA, 20 bp, Artificial Sequence
  chemically synthesized
aggaaatattaagattagat

SEQ ID NO: 204258 - DNA, 20 bp, Artificial Sequence
  chemically synthesized
attaagattagatcagaaaa

SEQ ID NO: 204259 - DNA, 20 bp, Artificial Sequence
  chemically synthesized
attgttttctatttcaattt

SEQ ID NO: 204260 - DNA, 20 bp, Artificial Sequence
  chemically synthesized
gaaaaaagccaaaattgaaa

SEQ ID NO: 204261 - DNA, 20 bp, Artificial Sequence
  chemically synthesized
aaaattgaaatagaaaacaa

SEQ ID NO: 204262 - DNA, 20 bp, Artificial Sequence
  chemically synthesized
aaacaatagaaaaatcaaca

SEQ ID NO: 204263 - DNA, 20 bp, Artificial Sequence
  chemically synthesized
atagaaaaatcaacaaagct

SEQ ID NO: 204264 - DNA, 20 bp, Artificial Sequence
  chemically synthesized
agaaaaatcaacaaagctaa

SEQ ID NO: 204265 - DNA, 20 bp, Artificial Sequence
  chemically synthesized
tttgtttttaaaaaaactct

SEQ ID NO: 204266 - DNA, 20 bp, Artificial Sequence
  chemically synthesized
caataaaattgacaaatctt

SEQ ID NO: 204267 - DNA, 20 bp, Artificial Sequence
  chemically synthesized
aataaaattgacaaatcttt

SEQ ID NO: 204268 - DNA, 20 bp, Artificial Sequence
  chemically synthesized
aaaattgacaaatctttagg

SEQ ID NO: 204269 - DNA, 20 bp, Artificial Sequence
  chemically synthesized
ttttttacttaatctaccta

SEQ ID NO: 204270 - DNA, 20 bp, Artificial Sequence
  chemically synthesized
gacaaatctttaggtagatt

SEQ ID NO: 204271 - DNA, 20 bp, Artificial Sequence
  chemically synthesized
agtaaaaaaaaaaaaaaaaa

SEQ ID NO: 204272 - DNA, 20 bp, Artificial Sequence
  chemically synthesized
gtaaaaaaaaaaaaaaaaaa

SEQ ID NO: 204273 - DNA, 20 bp, Artificial Sequence
  chemically synthesized
aaaaaaaggaaaattcaaat

SEQ ID NO: 204274 - DNA, 20 bp, Artificial Sequence
  chemically synthesized
aaaattcaaataagtaaaat

SEQ ID NO: 204275 - DNA, 20 bp, Artificial Sequence
  chemically synthesized
ataagtaaaatcagaaatga

SEQ ID NO: 204276 - DNA, 20 bp, Artificial Sequence
  chemically synthesized
aagtaaaatcagaaatgaaa

SEQ ID NO: 204277 - DNA, 20 bp, Artificial Sequence
  chemically synthesized
agtaaaatcagaaatgaaag

SEQ ID NO: 204278 - DNA, 20 bp, Artificial Sequence
  chemically synthesized
taaaatcagaaatgaaagag

SEQ ID NO: 204279 - DNA, 20 bp, Artificial Sequence
  chemically synthesized
gaaagaggagacattacaac

SEQ ID NO: 204280 - DNA, 20 bp, Artificial Sequence
  chemically synthesized
tttgcattctttttggatac

SEQ ID NO: 204281 - DNA, 20 bp, Artificial Sequence
  chemically synthesized
cattacaactggtatccaaa

SEQ ID NO: 204282 - DNA, 20 bp, Artificial Sequence
  chemically synthesized
ataatcatttgcattctttt

SEQ ID NO: 204283 - DNA, 20 bp, Artificial Sequence
  chemically synthesized
aaaagaatgcaaatgattat

SEQ ID NO: 204284 - DNA, 20 bp, Artificial Sequence
  chemically synthesized
taacatacagttgtttacag

SEQ ID NO: 204285 - DNA, 20 bp, Artificial Sequence
  chemically synthesized
ggttaacatacagttgttta

SEQ ID NO: 204286 - DNA, 20 bp, Artificial Sequence
  chemically synthesized
tttttttctaggttaacata

SEQ ID NO: 204287 - DNA, 20 bp, Artificial Sequence
  chemically synthesized
taaacaactgtatgttaacc

SEQ ID NO: 204288 - DNA, 20 bp, Artificial Sequence
  chemically synthesized
gaatttgttcatttttttct

SEQ ID NO: 204289 - DNA, 20 bp, Artificial Sequence
  chemically synthesized
ggaatttgttcatttttttc

SEQ ID NO: 204290 - DNA, 20 bp, Artificial Sequence
  chemically synthesized
ttggtagattgcatgtttca

SEQ ID NO: 204291 - DNA, 20 bp, Artificial Sequence
  chemically synthesized
attggtagattgcatgtttc

SEQ ID NO: 204292 - DNA, 20 bp, Artificial Sequence
  chemically synthesized
tcttcaagattcaatattgg

SEQ ID NO: 204293 - DNA, 20 bp, Artificial Sequence
  chemically synthesized
atttcttcaagattcaatat

SEQ ID NO: 204294 - DNA, 20 bp, Artificial Sequence
  chemically synthesized
tctaccaatattgaatcttg

SEQ ID NO: 204295 - DNA, 20 bp, Artificial Sequence
  chemically synthesized
aatattgaatcttgaagaaa

SEQ ID NO: 204296 - DNA, 20 bp, Artificial Sequence
  chemically synthesized
ctcagattttctatttcttc

SEQ ID NO: 204297 - DNA, 20 bp, Artificial Sequence
  chemically synthesized
cttgaagaaatagaaaatct

SEQ ID NO: 204298 - DNA, 20 bp, Artificial Sequence
  chemically synthesized
gaagaaatagaaaatctgag

SEQ ID NO: 204299 - DNA, 20 bp, Artificial Sequence
  chemically synthesized
aagaaatagaaaatctgagt

SEQ ID NO: 204300 - DNA, 20 bp, Artificial Sequence
  chemically synthesized
cttactagtttcggcctact

SEQ ID NO: 204301 - DNA, 20 bp, Artificial Sequence
  chemically synthesized
aaatctgagtaggccgaaac

SEQ ID NO: 204302 - DNA, 20 bp, Artificial Sequence
  chemically synthesized
ttcaatctccttactagttt

SEQ ID NO: 204303 - DNA, 20 bp, Artificial Sequence
  chemically synthesized
ctgagtaggccgaaactagt

SEQ ID NO: 204304 - DNA, 20 bp, Artificial Sequence
  chemically synthesized
tgagtaggccgaaactagta

SEQ ID NO: 204305 - DNA, 20 bp, Artificial Sequence
  chemically synthesized
agtaggccgaaactagtaag

SEQ ID NO: 204306 - DNA, 20 bp, Artificial Sequence
  chemically synthesized
tactgattcaatctccttac

SEQ ID NO: 204307 - DNA, 20 bp, Artificial Sequence
  chemically synthesized
aactagtaaggagattgaat

SEQ ID NO: 204308 - DNA, 20 bp, Artificial Sequence
  chemically synthesized
tagtaaggagattgaatcag

SEQ ID NO: 204309 - DNA, 20 bp, Artificial Sequence
  chemically synthesized
ttttctttgttggaaggttt

SEQ ID NO: 204310 - DNA, 20 bp, Artificial Sequence
  chemically synthesized
tagtccaaaaccttccaaca

SEQ ID NO: 204311 - DNA, 20 bp, Artificial Sequence
  chemically synthesized
ctgggcttttctttgttgga

SEQ ID NO: 204312 - DNA, 20 bp, Artificial Sequence
  chemically synthesized
cctgggcttttctttgttgg

SEQ ID NO: 204313 - DNA, 20 bp, Artificial Sequence
  chemically synthesized
ggtcctgggcttttctttgt

SEQ ID NO: 204314 - DNA, 20 bp, Artificial Sequence
  chemically synthesized
caaaaccttccaacaaagaa

SEQ ID NO: 204315 - DNA, 20 bp, Artificial Sequence
  chemically synthesized
ccttccaacaaagaaaagcc

SEQ ID NO: 204316 - DNA, 20 bp, Artificial Sequence
  chemically synthesized
cttccaacaaagaaaagccc

SEQ ID NO: 204317 - DNA, 20 bp, Artificial Sequence
  chemically synthesized
cagtgatgacatttggtcct

SEQ ID NO: 204318 - DNA, 20 bp, Artificial Sequence
  chemically synthesized
ccagtgatgacatttggtcc

SEQ ID NO: 204319 - DNA, 20 bp, Artificial Sequence
  chemically synthesized
atttcaccagtgatgacatt

SEQ ID NO: 204320 - DNA, 20 bp, Artificial Sequence
  chemically synthesized
ccaggaccaaatgtcatcac

SEQ ID NO: 204321 - DNA, 20 bp, Artificial Sequence
  chemically synthesized
aactgttcattagatttcac

SEQ ID NO: 204322 - DNA, 20 bp, Artificial Sequence
  chemically synthesized
cactggtgaaatctaatgaa

SEQ ID NO: 204323 - DNA, 20 bp, Artificial Sequence
  chemically synthesized
attcttctttaactgttcat

SEQ ID NO: 204324 - DNA, 20 bp, Artificial Sequence
  chemically synthesized
tgaaatctaatgaacagtta

SEQ ID NO: 204325 - DNA, 20 bp, Artificial Sequence
  chemically synthesized
aatctaatgaacagttaaag

SEQ ID NO: 204326 - DNA, 20 bp, Artificial Sequence
  chemically synthesized
ctgaagaatttgagaaggat

SEQ ID NO: 204327 - DNA, 20 bp, Artificial Sequence
  chemically synthesized
tttttctgaagaatttgaga

SEQ ID NO: 204328 - DNA, 20 bp, Artificial Sequence
  chemically synthesized
atttttctgaagaatttgag

SEQ ID NO: 204329 - DNA, 20 bp, Artificial Sequence
  chemically synthesized
ttaatttttctgaagaattt

SEQ ID NO: 204330 - DNA, 20 bp, Artificial Sequence
  chemically synthesized
ccaatccttctcaaattctt

SEQ ID NO: 204331 - DNA, 20 bp, Artificial Sequence
  chemically synthesized
tcttctctttaatttttctg

SEQ ID NO: 204332 - DNA, 20 bp, Artificial Sequence
  chemically synthesized
caaattcttcagaaaaatta

SEQ ID NO: 204333 - DNA, 20 bp, Artificial Sequence
  chemically synthesized
aattcttcagaaaaattaaa

SEQ ID NO: 204334 - DNA, 20 bp, Artificial Sequence
  chemically synthesized
tcttcagaaaaattaaagag

SEQ ID NO: 204335 - DNA, 20 bp, Artificial Sequence
  chemically synthesized
ttcagaaaaattaaagagaa

SEQ ID NO: 204336 - DNA, 20 bp, Artificial Sequence
  chemically synthesized
aaagagaagagaacacttcc

SEQ ID NO: 204337 - DNA, 20 bp, Artificial Sequence
  chemically synthesized
cccttgtagaatgagcttgg

SEQ ID NO: 204338 - DNA, 20 bp, Artificial Sequence
  chemically synthesized
tgccccttgtagaatgagct

SEQ ID NO: 204339 - DNA, 20 bp, Artificial Sequence
  chemically synthesized
cacttccaagctcattctac

SEQ ID NO: 204340 - DNA, 20 bp, Artificial Sequence
  chemically synthesized
actgatgccccttgtagaat

SEQ ID NO: 204341 - DNA, 20 bp, Artificial Sequence
  chemically synthesized
acttccaagctcattctaca

SEQ ID NO: 204342 - DNA, 20 bp, Artificial Sequence
  chemically synthesized
cttccaagctcattctacaa

SEQ ID NO: 204343 - DNA, 20 bp, Artificial Sequence
  chemically synthesized
ttccaagctcattctacaag

SEQ ID NO: 204344 - DNA, 20 bp, Artificial Sequence
  chemically synthesized
caggatactgatgccccttg

SEQ ID NO: 204345 - DNA, 20 bp, Artificial Sequence
  chemically synthesized
gctcattctacaaggggcat

SEQ ID NO: 204346 - DNA, 20 bp, Artificial Sequence
  chemically synthesized
gcatcagtatcctgatatca

SEQ ID NO: 204347 - DNA, 20 bp, Artificial Sequence
  chemically synthesized
cttttattgactttgatatc

SEQ ID NO: 204348 - DNA, 20 bp, Artificial Sequence
  chemically synthesized
tcttttattgactttgatat

SEQ ID NO: 204349 - DNA, 20 bp, Artificial Sequence
  chemically synthesized
cctgatatcaaagtcaataa

SEQ ID NO: 204350 - DNA, 20 bp, Artificial Sequence
  chemically synthesized
tcaaagtcaataaaagacac

SEQ ID NO: 204351 - DNA, 20 bp, Artificial Sequence
  chemically synthesized
caaagtcaataaaagacact

SEQ ID NO: 204352 - DNA, 20 bp, Artificial Sequence
  chemically synthesized
aagtcaataaaagacactag

SEQ ID NO: 204353 - DNA, 20 bp, Artificial Sequence
  chemically synthesized
aataaaagacactaggagaa

SEQ ID NO: 204354 - DNA, 20 bp, Artificial Sequence
  chemically synthesized
attgttctgtacttttctcc

SEQ ID NO: 204355 - DNA, 20 bp, Artificial Sequence
  chemically synthesized
aagacactaggagaaaagta

SEQ ID NO: 204356 - DNA, 20 bp, Artificial Sequence
  chemically synthesized
tttgcttctatatttatcag

SEQ ID NO: 204357 - DNA, 20 bp, Artificial Sequence
  chemically synthesized
aacaataccgctgataaata

SEQ ID NO: 204358 - DNA, 20 bp, Artificial Sequence
  chemically synthesized
tattttgcttctatatttat

SEQ ID NO: 204359 - DNA, 20 bp, Artificial Sequence
  chemically synthesized
aataccgctgataaatatag

SEQ ID NO: 204360 - DNA, 20 bp, Artificial Sequence
  chemically synthesized
cagtttgctagtattttaat

SEQ ID NO: 204361 - DNA, 20 bp, Artificial Sequence
  chemically synthesized
aaaataactcattaaaatac

SEQ ID NO: 204362 - DNA, 20 bp, Artificial Sequence
  chemically synthesized
tactgttgagttcagtttgc

SEQ ID NO: 204363 - DNA, 20 bp, Artificial Sequence
  chemically synthesized
tactagcaaactgaactcaa

SEQ ID NO: 204364 - DNA, 20 bp, Artificial Sequence
  chemically synthesized
tttcaatatactgttgagtt

SEQ ID NO: 204365 - DNA, 20 bp, Artificial Sequence
  chemically synthesized
aatcctttcaatatactgtt

SEQ ID NO: 204366 - DNA, 20 bp, Artificial Sequence
  chemically synthesized
tgaactcaacagtatattga

SEQ ID NO: 204367 - DNA, 20 bp, Artificial Sequence
  chemically synthesized
gaactcaacagtatattgaa

SEQ ID NO: 204368 - DNA, 20 bp, Artificial Sequence
  chemically synthesized
atattgaaaggattatacac

SEQ ID NO: 204369 - DNA, 20 bp, Artificial Sequence
  chemically synthesized
attgaaaggattatacacga

SEQ ID NO: 204370 - DNA, 20 bp, Artificial Sequence
  chemically synthesized
gattatacacgagagccata

SEQ ID NO: 204371 - DNA, 20 bp, Artificial Sequence
  chemically synthesized
attatacacgagagccatat

SEQ ID NO: 204372 - DNA, 20 bp, Artificial Sequence
  chemically synthesized
ttccaagaataaatcctata

SEQ ID NO: 204373 - DNA, 20 bp, Artificial Sequence
  chemically synthesized
agccatataggatttattct

SEQ ID NO: 204374 - DNA, 20 bp, Artificial Sequence
  chemically synthesized
ttgaaccatttttgcattcc

SEQ ID NO: 204375 - DNA, 20 bp, Artificial Sequence
  chemically synthesized
ttattcttggaatgcaaaaa

SEQ ID NO: 204376 - DNA, 20 bp, Artificial Sequence
  chemically synthesized
ttcaatttatgaaaactaat

SEQ ID NO: 204377 - DNA, 20 bp, Artificial Sequence
  chemically synthesized
atgttgtgtatcacactgat

SEQ ID NO: 204378 - DNA, 20 bp, Artificial Sequence
  chemically synthesized
agtgtgatacacaacattaa

SEQ ID NO: 204379 - DNA, 20 bp, Artificial Sequence
  chemically synthesized
tacacaacattaacagaaca

SEQ ID NO: 204380 - DNA, 20 bp, Artificial Sequence
  chemically synthesized
acacaacattaacagaacaa

SEQ ID NO: 204381 - DNA, 20 bp, Artificial Sequence
  chemically synthesized
ttgagatgaccatagatttt

SEQ ID NO: 204382 - DNA, 20 bp, Artificial Sequence
  chemically synthesized
gaacaaaggctaaaaatcta

SEQ ID NO: 204383 - DNA, 20 bp, Artificial Sequence
  chemically synthesized
tgcagctattgagatgacca

SEQ ID NO: 204384 - DNA, 20 bp, Artificial Sequence
  chemically synthesized
aaaatctatggtcatctcaa

SEQ ID NO: 204385 - DNA, 20 bp, Artificial Sequence
  chemically synthesized
gcgctttttctgcagctatt

SEQ ID NO: 204386 - DNA, 20 bp, Artificial Sequence
  chemically synthesized
tatggtcatctcaatagctg

SEQ ID NO: 204387 - DNA, 20 bp, Artificial Sequence
  chemically synthesized
catctcaatagctgcagaaa

SEQ ID NO: 204388 - DNA, 20 bp, Artificial Sequence
  chemically synthesized
cttgttaagcgctttttctg

SEQ ID NO: 204389 - DNA, 20 bp, Artificial Sequence
  chemically synthesized
ctgcagaaaaagcgcttaac

SEQ ID NO: 204390 - DNA, 20 bp, Artificial Sequence
  chemically synthesized
tgaaagtgttgaaacttgtt

SEQ ID NO: 204391 - DNA, 20 bp, Artificial Sequence
  chemically synthesized
gttgtgtgtttttatcatga

SEQ ID NO: 204392 - DNA, 20 bp, Artificial Sequence
  chemically synthesized
gataaaaacacacaacaaac

SEQ ID NO: 204393 - DNA, 20 bp, Artificial Sequence
  chemically synthesized
ataaaaacacacaacaaact

SEQ ID NO: 204394 - DNA, 20 bp, Artificial Sequence
  chemically synthesized
aacacacaacaaactaggaa

SEQ ID NO: 204395 - DNA, 20 bp, Artificial Sequence
  chemically synthesized
cggtaatttcgttctattcc

SEQ ID NO: 204396 - DNA, 20 bp, Artificial Sequence
  chemically synthesized
atacggtttttattatgttg

SEQ ID NO: 204397 - DNA, 20 bp, Artificial Sequence
  chemically synthesized
cactgtgggtttttcatata

SEQ ID NO: 204398 - DNA, 20 bp, Artificial Sequence
  chemically synthesized
aaccgtatatgaaaaaccca

SEQ ID NO: 204399 - DNA, 20 bp, Artificial Sequence
  chemically synthesized
ttaaatgtgatattcactgt

SEQ ID NO: 204400 - DNA, 20 bp, Artificial Sequence
  chemically synthesized
attaaatgtgatattcactg

SEQ ID NO: 204401 - DNA, 20 bp, Artificial Sequence
  chemically synthesized
acagtgaatatcacatttaa

SEQ ID NO: 204402 - DNA, 20 bp, Artificial Sequence
  chemically synthesized
aatatcacatttaatggcaa

SEQ ID NO: 204403 - DNA, 20 bp, Artificial Sequence
  chemically synthesized
atcttaagggaaaagatttt

SEQ ID NO: 204404 - DNA, 20 bp, Artificial Sequence
  chemically synthesized
gactgaaaatcttttccctt

SEQ ID NO: 204405 - DNA, 20 bp, Artificial Sequence
  chemically synthesized
tgtttctgatcttaagggaa

SEQ ID NO: 204406 - DNA, 20 bp, Artificial Sequence
  chemically synthesized
aaaatcttttcccttaagat

SEQ ID NO: 204407 - DNA, 20 bp, Artificial Sequence
  chemically synthesized
tgtcttgtttctgatcttaa

SEQ ID NO: 204408 - DNA, 20 bp, Artificial Sequence
  chemically synthesized
ttgtcttgtttctgatctta

SEQ ID NO: 204409 - DNA, 20 bp, Artificial Sequence
  chemically synthesized
cttgtcttgtttctgatctt

SEQ ID NO: 204410 - DNA, 20 bp, Artificial Sequence
  chemically synthesized
tttcccttaagatcagaaac

SEQ ID NO: 204411 - DNA, 20 bp, Artificial Sequence
  chemically synthesized
cttaagatcagaaacaagac

SEQ ID NO: 204412 - DNA, 20 bp, Artificial Sequence
  chemically synthesized
attttgaaaagaagtggcaa

SEQ ID NO: 204413 - DNA, 20 bp, Artificial Sequence
  chemically synthesized
ggtacgattttgaaaagaag

SEQ ID NO: 204414 - DNA, 20 bp, Artificial Sequence
  chemically synthesized
tctggtacgattttgaaaag

SEQ ID NO: 204415 - DNA, 20 bp, Artificial Sequence
  chemically synthesized
acttctggtacgattttgaa

SEQ ID NO: 204416 - DNA, 20 bp, Artificial Sequence
  chemically synthesized
acttcttttcaaaatcgtac

SEQ ID NO: 204417 - DNA, 20 bp, Artificial Sequence
  chemically synthesized
tcttttcaaaatcgtaccag

SEQ ID NO: 204418 - DNA, 20 bp, Artificial Sequence
  chemically synthesized
caaaatcgtaccagaagtac

SEQ ID NO: 204419 - DNA, 20 bp, Artificial Sequence
  chemically synthesized
attgttctggctagtacttc

SEQ ID NO: 204420 - DNA, 20 bp, Artificial Sequence
  chemically synthesized
atcgtaccagaagtactagc

SEQ ID NO: 204421 - DNA, 20 bp, Artificial Sequence
  chemically synthesized
tcttatctaattgttctggc

SEQ ID NO: 204422 - DNA, 20 bp, Artificial Sequence
  chemically synthesized
gaagtactagccagaacaat

SEQ ID NO: 204423 - DNA, 20 bp, Artificial Sequence
  chemically synthesized
tctttcttatctaattgttc

SEQ ID NO: 204424 - DNA, 20 bp, Artificial Sequence
  chemically synthesized
actagccagaacaattagat

SEQ ID NO: 204425 - DNA, 20 bp, Artificial Sequence
  chemically synthesized
gccagaacaattagataaga

SEQ ID NO: 204426 - DNA, 20 bp, Artificial Sequence
  chemically synthesized
cagaacaattagataagaaa

SEQ ID NO: 204427 - DNA, 20 bp, Artificial Sequence
  chemically synthesized
gaaataaaatacatcaaatt

SEQ ID NO: 204428 - DNA, 20 bp, Artificial Sequence
  chemically synthesized
taaaatacatcaaatttgga

SEQ ID NO: 204429 - DNA, 20 bp, Artificial Sequence
  chemically synthesized
aaaatacatcaaatttggaa

SEQ ID NO: 204430 - DNA, 20 bp, Artificial Sequence
  chemically synthesized
atacatcaaatttggaaagg

SEQ ID NO: 204431 - DNA, 20 bp, Artificial Sequence
  chemically synthesized
cagatcatctaatttgcaaa

SEQ ID NO: 204432 - DNA, 20 bp, Artificial Sequence
  chemically synthesized
aattatatctgtttgcaaat

SEQ ID NO: 204433 - DNA, 20 bp, Artificial Sequence
  chemically synthesized
aaattagatgatctgatacg

SEQ ID NO: 204434 - DNA, 20 bp, Artificial Sequence
  chemically synthesized
tcttaagattttctacgtat

SEQ ID NO: 204435 - DNA, 20 bp, Artificial Sequence
  chemically synthesized
tctgatacgtagaaaatctt

SEQ ID NO: 204436 - DNA, 20 bp, Artificial Sequence
  chemically synthesized
tgatacgtagaaaatcttaa

SEQ ID NO: 204437 - DNA, 20 bp, Artificial Sequence
  chemically synthesized
ctctgtgtggcgtcactctt

SEQ ID NO: 204438 - DNA, 20 bp, Artificial Sequence
  chemically synthesized
atcttaagagtgacgccaca

SEQ ID NO: 204439 - DNA, 20 bp, Artificial Sequence
  chemically synthesized
cttaagagtgacgccacaca

SEQ ID NO: 204440 - DNA, 20 bp, Artificial Sequence
  chemically synthesized
gttctaaccatgtctctgtg

SEQ ID NO: 204441 - DNA, 20 bp, Artificial Sequence
  chemically synthesized
agtgacgccacacagagaca

SEQ ID NO: 204442 - DNA, 20 bp, Artificial Sequence
  chemically synthesized
acgccacacagagacatggt

SEQ ID NO: 204443 - DNA, 20 bp, Artificial Sequence
  chemically synthesized
actttgctgaatttgtttat

SEQ ID NO: 204444 - DNA, 20 bp, Artificial Sequence
  chemically synthesized
ttagaaccaataaacaaatt

SEQ ID NO: 204445 - DNA, 20 bp, Artificial Sequence
  chemically synthesized
accaataaacaaattcagca

SEQ ID NO: 204446 - DNA, 20 bp, Artificial Sequence
  chemically synthesized
aaacaaattcagcaaagttg

SEQ ID NO: 204447 - DNA, 20 bp, Artificial Sequence
  chemically synthesized
aacaaattcagcaaagttgc

SEQ ID NO: 204448 - DNA, 20 bp, Artificial Sequence
  chemically synthesized
cagcaaagttgcaggataca

SEQ ID NO: 204449 - DNA, 20 bp, Artificial Sequence
  chemically synthesized
gatacaaagtcatcattcaa

SEQ ID NO: 204450 - DNA, 20 bp, Artificial Sequence
  chemically synthesized
acagttgcgtttctatacgc

SEQ ID NO: 204451 - DNA, 20 bp, Artificial Sequence
  chemically synthesized
gtttttatgttgctagcgta

SEQ ID NO: 204452 - DNA, 20 bp, Artificial Sequence
  chemically synthesized
atttcctgtttttatgttgc

SEQ ID NO: 204453 - DNA, 20 bp, Artificial Sequence
  chemically synthesized
atacgctagcaacataaaaa

SEQ ID NO: 204454 - DNA, 20 bp, Artificial Sequence
  chemically synthesized
tacgctagcaacataaaaac

SEQ ID NO: 204455 - DNA, 20 bp, Artificial Sequence
  chemically synthesized
caacataaaaacaggaaatt

SEQ ID NO: 204456 - DNA, 20 bp, Artificial Sequence
  chemically synthesized
tttttattgctattgtaaat

SEQ ID NO: 204457 - DNA, 20 bp, Artificial Sequence
  chemically synthesized
gaaaacaatctcatttacaa

SEQ ID NO: 204458 - DNA, 20 bp, Artificial Sequence
  chemically synthesized
tcatttacaatagcaataaa

SEQ ID NO: 204459 - DNA, 20 bp, Artificial Sequence
  chemically synthesized
aataaaaagaataaataact

SEQ ID NO: 204460 - DNA, 20 bp, Artificial Sequence
  chemically synthesized
ttcttggttgggtatttact

SEQ ID NO: 204461 - DNA, 20 bp, Artificial Sequence
  chemically synthesized
aacttagtaaatacccaacc

SEQ ID NO: 204462 - DNA, 20 bp, Artificial Sequence
  chemically synthesized
ttagtaaatacccaaccaag

SEQ ID NO: 204463 - DNA, 20 bp, Artificial Sequence
  chemically synthesized
catcttttaccttcttggtt

SEQ ID NO: 204464 - DNA, 20 bp, Artificial Sequence
  chemically synthesized
tagtaaatacccaaccaaga

SEQ ID NO: 204465 - DNA, 20 bp, Artificial Sequence
  chemically synthesized
acatcttttaccttcttggt

SEQ ID NO: 204466 - DNA, 20 bp, Artificial Sequence
  chemically synthesized
acacacatcttttaccttct

SEQ ID NO: 204467 - DNA, 20 bp, Artificial Sequence
  chemically synthesized
atacccaaccaagaaggtaa

SEQ ID NO: 204468 - DNA, 20 bp, Artificial Sequence
  chemically synthesized
gtaaaagatgtgtgtgctga

SEQ ID NO: 204469 - DNA, 20 bp, Artificial Sequence
  chemically synthesized
caacaatatttcatagcttt

SEQ ID NO: 204470 - DNA, 20 bp, Artificial Sequence
  chemically synthesized
tttctttcaacaatatttca

SEQ ID NO: 204471 - DNA, 20 bp, Artificial Sequence
  chemically synthesized
aagctatgaaatattgttga

SEQ ID NO: 204472 - DNA, 20 bp, Artificial Sequence
  chemically synthesized
aatattgttgaaagaaattg

SEQ ID NO: 204473 - DNA, 20 bp, Artificial Sequence
  chemically synthesized
ttgaagatgacaaaaataaa

SEQ ID NO: 204474 - DNA, 20 bp, Artificial Sequence
  chemically synthesized
tagacttttaaatgacacat

SEQ ID NO: 204475 - DNA, 20 bp, Artificial Sequence
  chemically synthesized
acatctgatgtgtcatttaa

SEQ ID NO: 204476 - DNA, 20 bp, Artificial Sequence
  chemically synthesized
ctgtagatggtttggatata

SEQ ID NO: 204477 - DNA, 20 bp, Artificial Sequence
  chemically synthesized
cactgtatctgtagatggtt

SEQ ID NO: 204478 - DNA, 20 bp, Artificial Sequence
  chemically synthesized
ctatatatccaaaccatcta

SEQ ID NO: 204479 - DNA, 20 bp, Artificial Sequence
  chemically synthesized
aattacactgtatctgtaga

SEQ ID NO: 204480 - DNA, 20 bp, Artificial Sequence
  chemically synthesized
atccaaaccatctacagata

SEQ ID NO: 204481 - DNA, 20 bp, Artificial Sequence
  chemically synthesized
taggaattacactgtatctg

SEQ ID NO: 204482 - DNA, 20 bp, Artificial Sequence
  chemically synthesized
aatgcgattgggattatgat

SEQ ID NO: 204483 - DNA, 20 bp, Artificial Sequence
  chemically synthesized
aaatgcgattgggattatga

SEQ ID NO: 204484 - DNA, 20 bp, Artificial Sequence
  chemically synthesized
tttctgtaaaaaatgcgatt

SEQ ID NO: 204485 - DNA, 20 bp, Artificial Sequence
  chemically synthesized
atttctgtaaaaaatgcgat

SEQ ID NO: 204486 - DNA, 20 bp, Artificial Sequence
  chemically synthesized
aatcccaatcgcatttttta

SEQ ID NO: 204487 - DNA, 20 bp, Artificial Sequence
  chemically synthesized
atcgcattttttacagaaat

SEQ ID NO: 204488 - DNA, 20 bp, Artificial Sequence
  chemically synthesized
tcgcattttttacagaaata

SEQ ID NO: 204489 - DNA, 20 bp, Artificial Sequence
  chemically synthesized
tgtggtttcatatgaatttt

SEQ ID NO: 204490 - DNA, 20 bp, Artificial Sequence
  chemically synthesized
ttgtggtttcatatgaattt

SEQ ID NO: 204491 - DNA, 20 bp, Artificial Sequence
  chemically synthesized
tggctatttggagtcgtttg

SEQ ID NO: 204492 - DNA, 20 bp, Artificial Sequence
  chemically synthesized
aaaccacaaacgactccaaa

SEQ ID NO: 204493 - DNA, 20 bp, Artificial Sequence
  chemically synthesized
aagactgttttggctatttg

SEQ ID NO: 204494 - DNA, 20 bp, Artificial Sequence
  chemically synthesized
tcaagactgttttggctatt

SEQ ID NO: 204495 - DNA, 20 bp, Artificial Sequence
  chemically synthesized
acgactccaaatagccaaaa

SEQ ID NO: 204496 - DNA, 20 bp, Artificial Sequence
  chemically synthesized
cttcttcctcaagactgttt

SEQ ID NO: 204497 - DNA, 20 bp, Artificial Sequence
  chemically synthesized
caaatagccaaaacagtctt

SEQ ID NO: 204498 - DNA, 20 bp, Artificial Sequence
  chemically synthesized
aaatagccaaaacagtcttg

SEQ ID NO: 204499 - DNA, 20 bp, Artificial Sequence
  chemically synthesized
tagccaaaacagtcttgagg

SEQ ID NO: 204500 - DNA, 20 bp, Artificial Sequence
  chemically synthesized
ccaaaacagtcttgaggaag

SEQ ID NO: 204501 - DNA, 20 bp, Artificial Sequence
  chemically synthesized
ccagtttattcttcttcctc

SEQ ID NO: 204502 - DNA, 20 bp, Artificial Sequence
  chemically synthesized
cttgaggaagaagaataaac

SEQ ID NO: 204503 - DNA, 20 bp, Artificial Sequence
  chemically synthesized
tgaggaagaagaataaactg

SEQ ID NO: 204504 - DNA, 20 bp, Artificial Sequence
  chemically synthesized
gaggaagaagaataaactgg

SEQ ID NO: 204505 - DNA, 20 bp, Artificial Sequence
  chemically synthesized
actagcaagtgtgatgcctc

SEQ ID NO: 204506 - DNA, 20 bp, Artificial Sequence
  chemically synthesized
actggaggcatcacacttgc

SEQ ID NO: 204507 - DNA, 20 bp, Artificial Sequence
  chemically synthesized
taattcattttgaaactagc

SEQ ID NO: 204508 - DNA, 20 bp, Artificial Sequence
  chemically synthesized
ttggtaattcattttgaaac

SEQ ID NO: 204509 - DNA, 20 bp, Artificial Sequence
  chemically synthesized
agtttcaaaatgaattacca

SEQ ID NO: 204510 - DNA, 20 bp, Artificial Sequence
  chemically synthesized
gctcttgactgaggtagctt

SEQ ID NO: 204511 - DNA, 20 bp, Artificial Sequence
  chemically synthesized
atgaattaccaaagctacct

SEQ ID NO: 204512 - DNA, 20 bp, Artificial Sequence
  chemically synthesized
tcgtgcgctcttgactgagg

SEQ ID NO: 204513 - DNA, 20 bp, Artificial Sequence
  chemically synthesized
ttaccaaagctacctcagtc

SEQ ID NO: 204514 - DNA, 20 bp, Artificial Sequence
  chemically synthesized
accaaagctacctcagtcaa

SEQ ID NO: 204515 - DNA, 20 bp, Artificial Sequence
  chemically synthesized
ctatcgtgcgctcttgactg

SEQ ID NO: 204516 - DNA, 20 bp, Artificial Sequence
  chemically synthesized
actatcgtgcgctcttgact

SEQ ID NO: 204517 - DNA, 20 bp, Artificial Sequence
  chemically synthesized
cctcagtcaagagcgcacga

SEQ ID NO: 204518 - DNA, 20 bp, Artificial Sequence
  chemically synthesized
gagcgcacgatagtgtcata

SEQ ID NO: 204519 - DNA, 20 bp, Artificial Sequence
  chemically synthesized
agcgcacgatagtgtcataa

SEQ ID NO: 204520 - DNA, 20 bp, Artificial Sequence
  chemically synthesized
gcacgatagtgtcataaagg

SEQ ID NO: 204521 - DNA, 20 bp, Artificial Sequence
  chemically synthesized
gtgtcataaaggcagacata

SEQ ID NO: 204522 - DNA, 20 bp, Artificial Sequence
  chemically synthesized
aaggcagacatatagaccaa

SEQ ID NO: 204523 - DNA, 20 bp, Artificial Sequence
  chemically synthesized
agacatatagaccaatggaa

SEQ ID NO: 204524 - DNA, 20 bp, Artificial Sequence
  chemically synthesized
ggatctctattctgttccat

SEQ ID NO: 204525 - DNA, 20 bp, Artificial Sequence
  chemically synthesized
tatagaccaatggaacagaa

SEQ ID NO: 204526 - DNA, 20 bp, Artificial Sequence
  chemically synthesized
tagaccaatggaacagaata

SEQ ID NO: 204527 - DNA, 20 bp, Artificial Sequence
  chemically synthesized
atggaacagaatagagatcc

SEQ ID NO: 204528 - DNA, 20 bp, Artificial Sequence
  chemically synthesized
gtgatgctaggtttatttct

SEQ ID NO: 204529 - DNA, 20 bp, Artificial Sequence
  chemically synthesized
ggtgatgctaggtttatttc

SEQ ID NO: 204530 - DNA, 20 bp, Artificial Sequence
  chemically synthesized
agagatcccagaaataaacc

SEQ ID NO: 204531 - DNA, 20 bp, Artificial Sequence
  chemically synthesized
cccctattgaaggtgatgct

SEQ ID NO: 204532 - DNA, 20 bp, Artificial Sequence
  chemically synthesized
acccctattgaaggtgatgc

SEQ ID NO: 204533 - DNA, 20 bp, Artificial Sequence
  chemically synthesized
aaacctagcatcaccttcaa

SEQ ID NO: 204534 - DNA, 20 bp, Artificial Sequence
  chemically synthesized
aacctagcatcaccttcaat

SEQ ID NO: 204535 - DNA, 20 bp, Artificial Sequence
  chemically synthesized
acctagcatcaccttcaata

SEQ ID NO: 204536 - DNA, 20 bp, Artificial Sequence
  chemically synthesized
cctagcatcaccttcaatag

SEQ ID NO: 204537 - DNA, 20 bp, Artificial Sequence
  chemically synthesized
attcttggcacccctattga

SEQ ID NO: 204538 - DNA, 20 bp, Artificial Sequence
  chemically synthesized
tattcttggcacccctattg

SEQ ID NO: 204539 - DNA, 20 bp, Artificial Sequence
  chemically synthesized
tcaccttcaataggggtgcc

SEQ ID NO: 204540 - DNA, 20 bp, Artificial Sequence
  chemically synthesized
ctttcccagttgtgtattct

SEQ ID NO: 204541 - DNA, 20 bp, Artificial Sequence
  chemically synthesized
gggtgccaagaatacacaac

SEQ ID NO: 204542 - DNA, 20 bp, Artificial Sequence
  chemically synthesized
ggtgccaagaatacacaact

SEQ ID NO: 204543 - DNA, 20 bp, Artificial Sequence
  chemically synthesized
ccaagaatacacaactggga

SEQ ID NO: 204544 - DNA, 20 bp, Artificial Sequence
  chemically synthesized
caagaatacacaactgggaa

SEQ ID NO: 204545 - DNA, 20 bp, Artificial Sequence
  chemically synthesized
ttgaagaggatatcctttcc

SEQ ID NO: 204546 - DNA, 20 bp, Artificial Sequence
  chemically synthesized
cccagcaccattggttgaag

SEQ ID NO: 204547 - DNA, 20 bp, Artificial Sequence
  chemically synthesized
tcccagcaccattggttgaa

SEQ ID NO: 204548 - DNA, 20 bp, Artificial Sequence
  chemically synthesized
aggatatcctcttcaaccaa

SEQ ID NO: 204549 - DNA, 20 bp, Artificial Sequence
  chemically synthesized
tttcccagcaccattggttg

SEQ ID NO: 204550 - DNA, 20 bp, Artificial Sequence
  chemically synthesized
tcctcttcaaccaatggtgc

SEQ ID NO: 204551 - DNA, 20 bp, Artificial Sequence
  chemically synthesized
tccagttttcccagcaccat

SEQ ID NO: 204552 - DNA, 20 bp, Artificial Sequence
  chemically synthesized
cctcttcaaccaatggtgct

SEQ ID NO: 204553 - DNA, 20 bp, Artificial Sequence
  chemically synthesized
accaatggtgctgggaaaac

SEQ ID NO: 204554 - DNA, 20 bp, Artificial Sequence
  chemically synthesized
atgtgtatatccagttttcc

SEQ ID NO: 204555 - DNA, 20 bp, Artificial Sequence
  chemically synthesized
ttctttgcaatgtgtatatc

SEQ ID NO: 204556 - DNA, 20 bp, Artificial Sequence
  chemically synthesized
aactggatatacacattgca

SEQ ID NO: 204557 - DNA, 20 bp, Artificial Sequence
  chemically synthesized
gatatacacattgcaaagaa

SEQ ID NO: 204558 - DNA, 20 bp, Artificial Sequence
  chemically synthesized
cacattgcaaagaatggaat

SEQ ID NO: 204559 - DNA, 20 bp, Artificial Sequence
  chemically synthesized
ttatgtatagtttaagttaa

SEQ ID NO: 204560 - DNA, 20 bp, Artificial Sequence
  chemically synthesized
tttatgtatagtttaagtta

SEQ ID NO: 204561 - DNA, 20 bp, Artificial Sequence
  chemically synthesized
ttgatttttatgtatagttt

SEQ ID NO: 204562 - DNA, 20 bp, Artificial Sequence
  chemically synthesized
tttgagttgatttttatgta

SEQ ID NO: 204563 - DNA, 20 bp, Artificial Sequence
  chemically synthesized
tctttactccatttcatttt

SEQ ID NO: 204564 - DNA, 20 bp, Artificial Sequence
  chemically synthesized
aaaatcaactcaaaatgaaa

SEQ ID NO: 204565 - DNA, 20 bp, Artificial Sequence
  chemically synthesized
aatcaactcaaaatgaaatg

SEQ ID NO: 204566 - DNA, 20 bp, Artificial Sequence
  chemically synthesized
actcaaaatgaaatggagta

SEQ ID NO: 204567 - DNA, 20 bp, Artificial Sequence
  chemically synthesized
tggagtaaagacttaaaaat

SEQ ID NO: 204568 - DNA, 20 bp, Artificial Sequence
  chemically synthesized
tagtttcagatcttattttt

SEQ ID NO: 204569 - DNA, 20 bp, Artificial Sequence
  chemically synthesized
ttctatgagtttcatagttt

SEQ ID NO: 204570 - DNA, 20 bp, Artificial Sequence
  chemically synthesized
gttttcttctatgagtttca

SEQ ID NO: 204571 - DNA, 20 bp, Artificial Sequence
  chemically synthesized
atctgaaactatgaaactca

SEQ ID NO: 204572 - DNA, 20 bp, Artificial Sequence
  chemically synthesized
tgaaactatgaaactcatag

SEQ ID NO: 204573 - DNA, 20 bp, Artificial Sequence
  chemically synthesized
tcccttatgttttcttctat

SEQ ID NO: 204574 - DNA, 20 bp, Artificial Sequence
  chemically synthesized
aaactcatagaagaaaacat

SEQ ID NO: 204575 - DNA, 20 bp, Artificial Sequence
  chemically synthesized
aactcatagaagaaaacata

SEQ ID NO: 204576 - DNA, 20 bp, Artificial Sequence
  chemically synthesized
actcatagaagaaaacataa

SEQ ID NO: 204577 - DNA, 20 bp, Artificial Sequence
  chemically synthesized
agggaaaaatttcctgacat

SEQ ID NO: 204578 - DNA, 20 bp, Artificial Sequence
  chemically synthesized
ttattgtgaagaccaatgtc

SEQ ID NO: 204579 - DNA, 20 bp, Artificial Sequence
  chemically synthesized
attattgtgaagaccaatgt

SEQ ID NO: 204580 - DNA, 20 bp, Artificial Sequence
  chemically synthesized
atccaaaaaaaattattgtg

SEQ ID NO: 204581 - DNA, 20 bp, Artificial Sequence
  chemically synthesized
gtcttcacaataattttttt

SEQ ID NO: 204582 - DNA, 20 bp, Artificial Sequence
  chemically synthesized
ttttttggatatgacgctaa

SEQ ID NO: 204583 - DNA, 20 bp, Artificial Sequence
  chemically synthesized
tttttggatatgacgctaaa

SEQ ID NO: 204584 - DNA, 20 bp, Artificial Sequence
  chemically synthesized
tggatatgacgctaaaagga

SEQ ID NO: 204585 - DNA, 20 bp, Artificial Sequence
  chemically synthesized
gtttttgttggctgtccttt

SEQ ID NO: 204586 - DNA, 20 bp, Artificial Sequence
  chemically synthesized
ttatctagttttgtttttgt

SEQ ID NO: 204587 - DNA, 20 bp, Artificial Sequence
  chemically synthesized
acagccaacaaaaacaaaac

SEQ ID NO: 204588 - DNA, 20 bp, Artificial Sequence
  chemically synthesized
caacaaaaacaaaactagat

SEQ ID NO: 204589 - DNA, 20 bp, Artificial Sequence
  chemically synthesized
caaaaacaaaactagataag

SEQ ID NO: 204590 - DNA, 20 bp, Artificial Sequence
  chemically synthesized
ttgatatatttctgcttatc

SEQ ID NO: 204591 - DNA, 20 bp, Artificial Sequence
  chemically synthesized
cagaaatatatcaaactaaa

SEQ ID NO: 204592 - DNA, 20 bp, Artificial Sequence
  chemically synthesized
cttgctttgtagaagctttt

SEQ ID NO: 204593 - DNA, 20 bp, Artificial Sequence
  chemically synthesized
caaactaaaaagcttctaca

SEQ ID NO: 204594 - DNA, 20 bp, Artificial Sequence
  chemically synthesized
ttgtttcccttgctttgtag

SEQ ID NO: 204595 - DNA, 20 bp, Artificial Sequence
  chemically synthesized
ctaaaaagcttctacaaagc

SEQ ID NO: 204596 - DNA, 20 bp, Artificial Sequence
  chemically synthesized
taaaaagcttctacaaagca

SEQ ID NO: 204597 - DNA, 20 bp, Artificial Sequence
  chemically synthesized
tgattgtttcccttgctttg

SEQ ID NO: 204598 - DNA, 20 bp, Artificial Sequence
  chemically synthesized
aaaaagcttctacaaagcaa

SEQ ID NO: 204599 - DNA, 20 bp, Artificial Sequence
  chemically synthesized
aaagcaagggaaacaatcaa

SEQ ID NO: 204600 - DNA, 20 bp, Artificial Sequence
  chemically synthesized
gaaacaatcaacagaattaa

SEQ ID NO: 204601 - DNA, 20 bp, Artificial Sequence
  chemically synthesized
acagaattaaaagcaaccta

SEQ ID NO: 204602 - DNA, 20 bp, Artificial Sequence
  chemically synthesized
ttaaaagcaacctatagaat

SEQ ID NO: 204603 - DNA, 20 bp, Artificial Sequence
  chemically synthesized
aaccttttctctcattctat

SEQ ID NO: 204604 - DNA, 20 bp, Artificial Sequence
  chemically synthesized
aaaccttttctctcattcta

SEQ ID NO: 204605 - DNA, 20 bp, Artificial Sequence
  chemically synthesized
aaaagcaacctatagaatga

SEQ ID NO: 204606 - DNA, 20 bp, Artificial Sequence
  chemically synthesized
caacctatagaatgagagaa

SEQ ID NO: 204607 - DNA, 20 bp, Artificial Sequence
  chemically synthesized
aacctatagaatgagagaaa

SEQ ID NO: 204608 - DNA, 20 bp, Artificial Sequence
  chemically synthesized
ttgacaccttatcagatata

SEQ ID NO: 204609 - DNA, 20 bp, Artificial Sequence
  chemically synthesized
ttgcaaaccatatatctgat

SEQ ID NO: 204610 - DNA, 20 bp, Artificial Sequence
  chemically synthesized
tgcaaaccatatatctgata

SEQ ID NO: 204611 - DNA, 20 bp, Artificial Sequence
  chemically synthesized
tttagatattgacaccttat

SEQ ID NO: 204612 - DNA, 20 bp, Artificial Sequence
  chemically synthesized
attacgttcctcatgtattt

SEQ ID NO: 204613 - DNA, 20 bp, Artificial Sequence
  chemically synthesized
tgtcaatatctaaaatacat

SEQ ID NO: 204614 - DNA, 20 bp, Artificial Sequence
  chemically synthesized
gtcaatatctaaaatacatg

SEQ ID NO: 204615 - DNA, 20 bp, Artificial Sequence
  chemically synthesized
ctttgttcactttaaaaatt

SEQ ID NO: 204616 - DNA, 20 bp, Artificial Sequence
  chemically synthesized
ttcgaacaacccaattttta

SEQ ID NO: 204617 - DNA, 20 bp, Artificial Sequence
  chemically synthesized
cctttgttcactttaaaaat

SEQ ID NO: 204618 - DNA, 20 bp, Artificial Sequence
  chemically synthesized
cccaatttttaaagtgaaca

SEQ ID NO: 204619 - DNA, 20 bp, Artificial Sequence
  chemically synthesized
ccaatttttaaagtgaacaa

SEQ ID NO: 204620 - DNA, 20 bp, Artificial Sequence
  chemically synthesized
aagtgaacaaaggaattgaa

SEQ ID NO: 204621 - DNA, 20 bp, Artificial Sequence
  chemically synthesized
attgaatagatatttctcca

SEQ ID NO: 204622 - DNA, 20 bp, Artificial Sequence
  chemically synthesized
gaatagatatttctccaaag

SEQ ID NO: 204623 - DNA, 20 bp, Artificial Sequence
  chemically synthesized
tcattttaatgtcttctttg

SEQ ID NO: 204624 - DNA, 20 bp, Artificial Sequence
  chemically synthesized
ggtcattttaatgtcttctt

SEQ ID NO: 204625 - DNA, 20 bp, Artificial Sequence
  chemically synthesized
gaagacattaaaatgaccaa

SEQ ID NO: 204626 - DNA, 20 bp, Artificial Sequence
  chemically synthesized
acatcttttcatataactgt

SEQ ID NO: 204627 - DNA, 20 bp, Artificial Sequence
  chemically synthesized
atgaccaacagttatatgaa

SEQ ID NO: 204628 - DNA, 20 bp, Artificial Sequence
  chemically synthesized
tgttcaacatcactaactac

SEQ ID NO: 204629 - DNA, 20 bp, Artificial Sequence
  chemically synthesized
gttcaacatcactaactacc

SEQ ID NO: 204630 - DNA, 20 bp, Artificial Sequence
  chemically synthesized
ttcaacatcactaactacca

SEQ ID NO: 204631 - DNA, 20 bp, Artificial Sequence
  chemically synthesized
atttgcatttccctggtagt

SEQ ID NO: 204632 - DNA, 20 bp, Artificial Sequence
  chemically synthesized
tttgatttgcatttccctgg

SEQ ID NO: 204633 - DNA, 20 bp, Artificial Sequence
  chemically synthesized
ggatttgatttgcatttccc

SEQ ID NO: 204634 - DNA, 20 bp, Artificial Sequence
  chemically synthesized
cgtgaggtagtatatcattg

SEQ ID NO: 204635 - DNA, 20 bp, Artificial Sequence
  chemically synthesized
cacaatgatatactacctca

SEQ ID NO: 204636 - DNA, 20 bp, Artificial Sequence
  chemically synthesized
ggttatcctaatccgtgagg

SEQ ID NO: 204637 - DNA, 20 bp, Artificial Sequence
  chemically synthesized
tgatatactacctcacggat

SEQ ID NO: 204638 - DNA, 20 bp, Artificial Sequence
  chemically synthesized
aatggttatcctaatccgtg

SEQ ID NO: 204639 - DNA, 20 bp, Artificial Sequence
  chemically synthesized
gatatactacctcacggatt

SEQ ID NO: 204640 - DNA, 20 bp, Artificial Sequence
  chemically synthesized
taatggttatcctaatccgt

SEQ ID NO: 204641 - DNA, 20 bp, Artificial Sequence
  chemically synthesized
tttttttttttttttaataa

SEQ ID NO: 204642 - DNA, 20 bp, Artificial Sequence
  chemically synthesized
attaaaaaaaaaaaaaaaaa

SEQ ID NO: 204643 - DNA, 20 bp, Artificial Sequence
  chemically synthesized
aaaaaaaaaaaaaaaagccc

SEQ ID NO: 204644 - DNA, 20 bp, Artificial Sequence
  chemically synthesized
ccaacacatgtaatgatctt

SEQ ID NO: 204645 - DNA, 20 bp, Artificial Sequence
  chemically synthesized
accaacacatgtaatgatct

SEQ ID NO: 204646 - DNA, 20 bp, Artificial Sequence
  chemically synthesized
cccaagatcattacatgtgt

SEQ ID NO: 204647 - DNA, 20 bp, Artificial Sequence
  chemically synthesized
gatcattacatgtgttggtg

SEQ ID NO: 204648 - DNA, 20 bp, Artificial Sequence
  chemically synthesized
atcattacatgtgttggtga

SEQ ID NO: 204649 - DNA, 20 bp, Artificial Sequence
  chemically synthesized
tacatgtgttggtgaaggtg

SEQ ID NO: 204650 - DNA, 20 bp, Artificial Sequence
  chemically synthesized
acatgtgttggtgaaggtgt

SEQ ID NO: 204651 - DNA, 20 bp, Artificial Sequence
  chemically synthesized
tggtgaaggtgtaggaaaat

SEQ ID NO: 204652 - DNA, 20 bp, Artificial Sequence
  chemically synthesized
gtgaaggtgtaggaaaattg

SEQ ID NO: 204653 - DNA, 20 bp, Artificial Sequence
  chemically synthesized
gtgtaggaaaattggagatg

SEQ ID NO: 204654 - DNA, 20 bp, Artificial Sequence
  chemically synthesized
aaattggagatgtagactgc

SEQ ID NO: 204655 - DNA, 20 bp, Artificial Sequence
  chemically synthesized
ttggagatgtagactgctgg

SEQ ID NO: 204656 - DNA, 20 bp, Artificial Sequence
  chemically synthesized
caattttatatttccaccag

SEQ ID NO: 204657 - DNA, 20 bp, Artificial Sequence
  chemically synthesized
gcacaattttatatttccac

SEQ ID NO: 204658 - DNA, 20 bp, Artificial Sequence
  chemically synthesized
ggtggaaatataaaattgtg

SEQ ID NO: 204659 - DNA, 20 bp, Artificial Sequence
  chemically synthesized
ataaaattgtgcagcttttg

SEQ ID NO: 204660 - DNA, 20 bp, Artificial Sequence
  chemically synthesized
ctccatattgttttccacaa

SEQ ID NO: 204661 - DNA, 20 bp, Artificial Sequence
  chemically synthesized
agcttttgtggaaaacaata

SEQ ID NO: 204662 - DNA, 20 bp, Artificial Sequence
  chemically synthesized
cttttgtggaaaacaatatg

SEQ ID NO: 204663 - DNA, 20 bp, Artificial Sequence
  chemically synthesized
ttatattttttatttttttg

SEQ ID NO: 204664 - DNA, 20 bp, Artificial Sequence
  chemically synthesized
gttatattttttattttttt

SEQ ID NO: 204665 - DNA, 20 bp, Artificial Sequence
  chemically synthesized
ataaaaaatataactaccat

SEQ ID NO: 204666 - DNA, 20 bp, Artificial Sequence
  chemically synthesized
gggattgctagatcttatgg

SEQ ID NO: 204667 - DNA, 20 bp, Artificial Sequence
  chemically synthesized
aatataactaccataagatc

SEQ ID NO: 204668 - DNA, 20 bp, Artificial Sequence
  chemically synthesized
tgcgggattgctagatctta

SEQ ID NO: 204669 - DNA, 20 bp, Artificial Sequence
  chemically synthesized
atatccagatgcgggattgc

SEQ ID NO: 204670 - DNA, 20 bp, Artificial Sequence
  chemically synthesized
agatctagcaatcccgcatc

SEQ ID NO: 204671 - DNA, 20 bp, Artificial Sequence
  chemically synthesized
ttagataaatatccagatgc

SEQ ID NO: 204672 - DNA, 20 bp, Artificial Sequence
  chemically synthesized
tttagataaatatccagatg

SEQ ID NO: 204673 - DNA, 20 bp, Artificial Sequence
  chemically synthesized
aattcgtttagataaatatc

SEQ ID NO: 204674 - DNA, 20 bp, Artificial Sequence
  chemically synthesized
gatcctaaattgaattcgtt

SEQ ID NO: 204675 - DNA, 20 bp, Artificial Sequence
  chemically synthesized
ttatctaaacgaattcaatt

SEQ ID NO: 204676 - DNA, 20 bp, Artificial Sequence
  chemically synthesized
tatctaaacgaattcaattt

SEQ ID NO: 204677 - DNA, 20 bp, Artificial Sequence
  chemically synthesized
gaattcaatttaggatcttg

SEQ ID NO: 204678 - DNA, 20 bp, Artificial Sequence
  chemically synthesized
attcaatttaggatcttgaa

SEQ ID NO: 204679 - DNA, 20 bp, Artificial Sequence
  chemically synthesized
gggaatgcagatatctcttc

SEQ ID NO: 204680 - DNA, 20 bp, Artificial Sequence
  chemically synthesized
ctacaataaacatgggaatg

SEQ ID NO: 204681 - DNA, 20 bp, Artificial Sequence
  chemically synthesized
aaaaatgctacaataaacat

SEQ ID NO: 204682 - DNA, 20 bp, Artificial Sequence
  chemically synthesized
taaaaatgctacaataaaca

SEQ ID NO: 204683 - DNA, 20 bp, Artificial Sequence
  chemically synthesized
ctgcattcccatgtttattg

SEQ ID NO: 204684 - DNA, 20 bp, Artificial Sequence
  chemically synthesized
tgtttattgtagcattttta

SEQ ID NO: 204685 - DNA, 20 bp, Artificial Sequence
  chemically synthesized
ttattgtagcatttttacag

SEQ ID NO: 204686 - DNA, 20 bp, Artificial Sequence
  chemically synthesized
gtagcatttttacagtagcc

SEQ ID NO: 204687 - DNA, 20 bp, Artificial Sequence
  chemically synthesized
agcatttttacagtagccaa

SEQ ID NO: 204688 - DNA, 20 bp, Artificial Sequence
  chemically synthesized
gcatttttacagtagccaag

SEQ ID NO: 204689 - DNA, 20 bp, Artificial Sequence
  chemically synthesized
tttagtttgttcacacctct

SEQ ID NO: 204690 - DNA, 20 bp, Artificial Sequence
  chemically synthesized
ttcccctgtcaatagacatt

SEQ ID NO: 204691 - DNA, 20 bp, Artificial Sequence
  chemically synthesized
acaaactaaatgtctattga

SEQ ID NO: 204692 - DNA, 20 bp, Artificial Sequence
  chemically synthesized
caaactaaatgtctattgac

SEQ ID NO: 204693 - DNA, 20 bp, Artificial Sequence
  chemically synthesized
aaactaaatgtctattgaca

SEQ ID NO: 204694 - DNA, 20 bp, Artificial Sequence
  chemically synthesized
aactaaatgtctattgacag

SEQ ID NO: 204695 - DNA, 20 bp, Artificial Sequence
  chemically synthesized
tttatacattcccctgtcaa

SEQ ID NO: 204696 - DNA, 20 bp, Artificial Sequence
  chemically synthesized
tattgacaggggaatgtata

SEQ ID NO: 204697 - DNA, 20 bp, Artificial Sequence
  chemically synthesized
tccattgtatgtatataaca

SEQ ID NO: 204698 - DNA, 20 bp, Artificial Sequence
  chemically synthesized
gctatgttatatacatacaa

SEQ ID NO: 204699 - DNA, 20 bp, Artificial Sequence
  chemically synthesized
gaatatcattctgccacaaa

SEQ ID NO: 204700 - DNA, 20 bp, Artificial Sequence
  chemically synthesized
gtaagatttcctttttgtgg

SEQ ID NO: 204701 - DNA, 20 bp, Artificial Sequence
  chemically synthesized
aatatcattctgccacaaaa

SEQ ID NO: 204702 - DNA, 20 bp, Artificial Sequence
  chemically synthesized
atggtaagatttcctttttg

SEQ ID NO: 204703 - DNA, 20 bp, Artificial Sequence
  chemically synthesized
tccacattgtagcatatggt

SEQ ID NO: 204704 - DNA, 20 bp, Artificial Sequence
  chemically synthesized
ttcatccacattgtagcata

SEQ ID NO: 204705 - DNA, 20 bp, Artificial Sequence
  chemically synthesized
tcttaccatatgctacaatg

SEQ ID NO: 204706 - DNA, 20 bp, Artificial Sequence
  chemically synthesized
tacaagattcatccacattg

SEQ ID NO: 204707 - DNA, 20 bp, Artificial Sequence
  chemically synthesized
tacaatgtggatgaatcttg

SEQ ID NO: 204708 - DNA, 20 bp, Artificial Sequence
  chemically synthesized
ttatttagcaaaatggctac

SEQ ID NO: 204709 - DNA, 20 bp, Artificial Sequence
  chemically synthesized
gcttattttatttagcaaaa

SEQ ID NO: 204710 - DNA, 20 bp, Artificial Sequence
  chemically synthesized
tacgacttgcttattttatt

SEQ ID NO: 204711 - DNA, 20 bp, Artificial Sequence
  chemically synthesized
gccattttgctaaataaaat

SEQ ID NO: 204712 - DNA, 20 bp, Artificial Sequence
  chemically synthesized
ttttgctaaataaaataagc

SEQ ID NO: 204713 - DNA, 20 bp, Artificial Sequence
  chemically synthesized
ataaaataagcaagtcgtaa

SEQ ID NO: 204714 - DNA, 20 bp, Artificial Sequence
  chemically synthesized
taaaataagcaagtcgtaaa

SEQ ID NO: 204715 - DNA, 20 bp, Artificial Sequence
  chemically synthesized
ctcatgtaagtggatgcgtg

SEQ ID NO: 204716 - DNA, 20 bp, Artificial Sequence
  chemically synthesized
ctgcacgcatccacttacat

SEQ ID NO: 204717 - DNA, 20 bp, Artificial Sequence
  chemically synthesized
ctttagatacctcatgtaag

SEQ ID NO: 204718 - DNA, 20 bp, Artificial Sequence
  chemically synthesized
tgcacgcatccacttacatg

SEQ ID NO: 204719 - DNA, 20 bp, Artificial Sequence
  chemically synthesized
ctactttagatacctcatgt

SEQ ID NO: 204720 - DNA, 20 bp, Artificial Sequence
  chemically synthesized
ccacttacatgaggtatcta

SEQ ID NO: 204721 - DNA, 20 bp, Artificial Sequence
  chemically synthesized
cttacatgaggtatctaaag

SEQ ID NO: 204722 - DNA, 20 bp, Artificial Sequence
  chemically synthesized
ttctataattttgactactt

SEQ ID NO: 204723 - DNA, 20 bp, Artificial Sequence
  chemically synthesized
atctaaagtagtcaaaatta

SEQ ID NO: 204724 - DNA, 20 bp, Artificial Sequence
  chemically synthesized
agtagtcaaaattatagaaa

SEQ ID NO: 204725 - DNA, 20 bp, Artificial Sequence
  chemically synthesized
gtcaaaattatagaaacaga

SEQ ID NO: 204726 - DNA, 20 bp, Artificial Sequence
  chemically synthesized
tatagaaacagaaagtacaa

SEQ ID NO: 204727 - DNA, 20 bp, Artificial Sequence
  chemically synthesized
agaaacagaaagtacaatgg

SEQ ID NO: 204728 - DNA, 20 bp, Artificial Sequence
  chemically synthesized
aaagtacaatggtggttgct

SEQ ID NO: 204729 - DNA, 20 bp, Artificial Sequence
  chemically synthesized
aagtacaatggtggttgcta

SEQ ID NO: 204730 - DNA, 20 bp, Artificial Sequence
  chemically synthesized
agtacaatggtggttgctaa

SEQ ID NO: 204731 - DNA, 20 bp, Artificial Sequence
  chemically synthesized
caatggtggttgctaagggc

SEQ ID NO: 204732 - DNA, 20 bp, Artificial Sequence
  chemically synthesized
atggtggttgctaagggctg

SEQ ID NO: 204733 - DNA, 20 bp, Artificial Sequence
  chemically synthesized
ttcttccctcctccagccct

SEQ ID NO: 204734 - DNA, 20 bp, Artificial Sequence
  chemically synthesized
tggtggttgctaagggctgg

SEQ ID NO: 204735 - DNA, 20 bp, Artificial Sequence
  chemically synthesized
gtggttgctaagggctggag

SEQ ID NO: 204736 - DNA, 20 bp, Artificial Sequence
  chemically synthesized
tggttgctaagggctggagg

SEQ ID NO: 204737 - DNA, 20 bp, Artificial Sequence
  chemically synthesized
ggttgctaagggctggagga

SEQ ID NO: 204738 - DNA, 20 bp, Artificial Sequence
  chemically synthesized
tcaccatttcttccctcctc

SEQ ID NO: 204739 - DNA, 20 bp, Artificial Sequence
  chemically synthesized
tgctaagggctggaggaggg

SEQ ID NO: 204740 - DNA, 20 bp, Artificial Sequence
  chemically synthesized
gggctggaggagggaagaaa

SEQ ID NO: 204741 - DNA, 20 bp, Artificial Sequence
  chemically synthesized
tggaggagggaagaaatggt

SEQ ID NO: 204742 - DNA, 20 bp, Artificial Sequence
  chemically synthesized
aatggtgagatgctgtgcaa

SEQ ID NO: 204743 - DNA, 20 bp, Artificial Sequence
  chemically synthesized
atggtgagatgctgtgcaat

SEQ ID NO: 204744 - DNA, 20 bp, Artificial Sequence
  chemically synthesized
gatagtctatacccattgca

SEQ ID NO: 204745 - DNA, 20 bp, Artificial Sequence
  chemically synthesized
gagatgctgtgcaatgggta

SEQ ID NO: 204746 - DNA, 20 bp, Artificial Sequence
  chemically synthesized
gtgcaatgggtatagactat

SEQ ID NO: 204747 - DNA, 20 bp, Artificial Sequence
  chemically synthesized
tgcaatgggtatagactatc

SEQ ID NO: 204748 - DNA, 20 bp, Artificial Sequence
  chemically synthesized
ttttaaccctacatgcctga

SEQ ID NO: 204749 - DNA, 20 bp, Artificial Sequence
  chemically synthesized
ggtatagactatcaggcatg

SEQ ID NO: 204750 - DNA, 20 bp, Artificial Sequence
  chemically synthesized
gtatagactatcaggcatgt

SEQ ID NO: 204751 - DNA, 20 bp, Artificial Sequence
  chemically synthesized
tatagactatcaggcatgta

SEQ ID NO: 204752 - DNA, 20 bp, Artificial Sequence
  chemically synthesized
gtagggttaaaaaaattata

SEQ ID NO: 204753 - DNA, 20 bp, Artificial Sequence
  chemically synthesized
ataagcaaaatgttgcatag

SEQ ID NO: 204754 - DNA, 20 bp, Artificial Sequence
  chemically synthesized
aatataagcaaaatgttgca

SEQ ID NO: 204755 - DNA, 20 bp, Artificial Sequence
  chemically synthesized
aatacagtattgttaaatat

SEQ ID NO: 204756 - DNA, 20 bp, Artificial Sequence
  chemically synthesized
taaattttaagtgcacaata

SEQ ID NO: 204757 - DNA, 20 bp, Artificial Sequence
  chemically synthesized
ccaccctcttaataaatttt

SEQ ID NO: 204758 - DNA, 20 bp, Artificial Sequence
  chemically synthesized
ttgtgcacttaaaatttatt

SEQ ID NO: 204759 - DNA, 20 bp, Artificial Sequence
  chemically synthesized
gtgcacttaaaatttattaa

SEQ ID NO: 204760 - DNA, 20 bp, Artificial Sequence
  chemically synthesized
tgcacttaaaatttattaag

SEQ ID NO: 204761 - DNA, 20 bp, Artificial Sequence
  chemically synthesized
gcacttaaaatttattaaga

SEQ ID NO: 204762 - DNA, 20 bp, Artificial Sequence
  chemically synthesized
cttaaaatttattaagaggg

SEQ ID NO: 204763 - DNA, 20 bp, Artificial Sequence
  chemically synthesized
ttcattaaaaaaataaaaac

SEQ ID NO: 204764 - DNA, 20 bp, Artificial Sequence
  chemically synthesized
ataaaaacaagtgcttcatt

SEQ ID NO: 204765 - DNA, 20 bp, Artificial Sequence
  chemically synthesized
aagatgtttttttcttaatg

SEQ ID NO: 204766 - DNA, 20 bp, Artificial Sequence
  chemically synthesized
aagaattgtatgtgttgaaa

SEQ ID NO: 204767 - DNA, 20 bp, Artificial Sequence
  chemically synthesized
aatgattaagttcattaaca

SEQ ID NO: 204768 - DNA, 20 bp, Artificial Sequence
  chemically synthesized
ccagttggcattcaatgatt

SEQ ID NO: 204769 - DNA, 20 bp, Artificial Sequence
  chemically synthesized
cttaatcattgaatgccaac

SEQ ID NO: 204770 - DNA, 20 bp, Artificial Sequence
  chemically synthesized
atcattgaatgccaactggt

SEQ ID NO: 204771 - DNA, 20 bp, Artificial Sequence
  chemically synthesized
tcattgaatgccaactggtt

SEQ ID NO: 204772 - DNA, 20 bp, Artificial Sequence
  chemically synthesized
tataccatttcccaaccagt

SEQ ID NO: 204773 - DNA, 20 bp, Artificial Sequence
  chemically synthesized
caggtataccatttcccaac

SEQ ID NO: 204774 - DNA, 20 bp, Artificial Sequence
  chemically synthesized
aatgccaactggttgggaaa

SEQ ID NO: 204775 - DNA, 20 bp, Artificial Sequence
  chemically synthesized
aaatggtatacctgacaaca

SEQ ID NO: 204776 - DNA, 20 bp, Artificial Sequence
  chemically synthesized
tgatggctttctatgttgtc

SEQ ID NO: 204777 - DNA, 20 bp, Artificial Sequence
  chemically synthesized
ctgatggctttctatgttgt

SEQ ID NO: 204778 - DNA, 20 bp, Artificial Sequence
  chemically synthesized
ggtatacctgacaacataga

SEQ ID NO: 204779 - DNA, 20 bp, Artificial Sequence
  chemically synthesized
ctgacaacatagaaagccat

SEQ ID NO: 204780 - DNA, 20 bp, Artificial Sequence
  chemically synthesized
caacatagaaagccatcaga

SEQ ID NO: 204781 - DNA, 20 bp, Artificial Sequence
  chemically synthesized
ataccatgttagctgtctga

SEQ ID NO: 204782 - DNA, 20 bp, Artificial Sequence
  chemically synthesized
aagccatcagacagctaaca

SEQ ID NO: 204783 - DNA, 20 bp, Artificial Sequence
  chemically synthesized
agaagttgcaaataccatgt

SEQ ID NO: 204784 - DNA, 20 bp, Artificial Sequence
  chemically synthesized
tggtatttgcaacttctcgt

SEQ ID NO: 204785 - DNA, 20 bp, Artificial Sequence
  chemically synthesized
ggtatttgcaacttctcgtg

SEQ ID NO: 204786 - DNA, 20 bp, Artificial Sequence
  chemically synthesized
gtatttgcaacttctcgtga

SEQ ID NO: 204787 - DNA, 20 bp, Artificial Sequence
  chemically synthesized
ggtgctcccaccctcacgag

SEQ ID NO: 204788 - DNA, 20 bp, Artificial Sequence
  chemically synthesized
tttgcaacttctcgtgaggg

SEQ ID NO: 204789 - DNA, 20 bp, Artificial Sequence
  chemically synthesized
tatggtgctcccaccctcac

SEQ ID NO: 204790 - DNA, 20 bp, Artificial Sequence
  chemically synthesized
ttgcaacttctcgtgagggt

SEQ ID NO: 204791 - DNA, 20 bp, Artificial Sequence
  chemically synthesized
gcaacttctcgtgagggtgg

SEQ ID NO: 204792 - DNA, 20 bp, Artificial Sequence
  chemically synthesized
tctcttcatatatgtgttta

SEQ ID NO: 204793 - DNA, 20 bp, Artificial Sequence
  chemically synthesized
gcaccataaacacatatatg

SEQ ID NO: 204794 - DNA, 20 bp, Artificial Sequence
  chemically synthesized
accataaacacatatatgaa

SEQ ID NO: 204795 - DNA, 20 bp, Artificial Sequence
  chemically synthesized
catatatgaagagataataa

SEQ ID NO: 204796 - DNA, 20 bp, Artificial Sequence
  chemically synthesized
tgaagagataataaaagtcc

SEQ ID NO: 204797 - DNA, 20 bp, Artificial Sequence
  chemically synthesized
gaagagataataaaagtcca

SEQ ID NO: 204798 - DNA, 20 bp, Artificial Sequence
  chemically synthesized
tacatcttatattgttgcct

SEQ ID NO: 204799 - DNA, 20 bp, Artificial Sequence
  chemically synthesized
aaagtccaaggcaacaatat

SEQ ID NO: 204800 - DNA, 20 bp, Artificial Sequence
  chemically synthesized
caaggcaacaatataagatg

SEQ ID NO: 204801 - DNA, 20 bp, Artificial Sequence
  chemically synthesized
aacaatataagatgtagcat

SEQ ID NO: 204802 - DNA, 20 bp, Artificial Sequence
  chemically synthesized
atctatttcagttcattacg

SEQ ID NO: 204803 - DNA, 20 bp, Artificial Sequence
  chemically synthesized
tatctatttcagttcattac

SEQ ID NO: 204804 - DNA, 20 bp, Artificial Sequence
  chemically synthesized
gacctcgtaatgaactgaaa

SEQ ID NO: 204805 - DNA, 20 bp, Artificial Sequence
  chemically synthesized
tatcaacttaatatctattt

SEQ ID NO: 204806 - DNA, 20 bp, Artificial Sequence
  chemically synthesized
aatgaactgaaatagatatt

SEQ ID NO: 204807 - DNA, 20 bp, Artificial Sequence
  chemically synthesized
tattaaatgttgtgtatcaa

SEQ ID NO: 204808 - DNA, 20 bp, Artificial Sequence
  chemically synthesized
taaatgttgtgtatcaacgg

SEQ ID NO: 204809 - DNA, 20 bp, Artificial Sequence
  chemically synthesized
ttgtgtatcaacggcagtgt

SEQ ID NO: 204810 - DNA, 20 bp, Artificial Sequence
  chemically synthesized
agtgtgagatcattgtgaac

SEQ ID NO: 204811 - DNA, 20 bp, Artificial Sequence
  chemically synthesized
gagatcattgtgaactagaa

SEQ ID NO: 204812 - DNA, 20 bp, Artificial Sequence
  chemically synthesized
aaagatatgctacactattc

SEQ ID NO: 204813 - DNA, 20 bp, Artificial Sequence
  chemically synthesized
cattgtgaactagaatagtg

SEQ ID NO: 204814 - DNA, 20 bp, Artificial Sequence
  chemically synthesized
gaatagtgtagcatatcttt

SEQ ID NO: 204815 - DNA, 20 bp, Artificial Sequence
  chemically synthesized
tgtagcatatcttttggact

SEQ ID NO: 204816 - DNA, 20 bp, Artificial Sequence
  chemically synthesized
aataatctaccttagtccaa

SEQ ID NO: 204817 - DNA, 20 bp, Artificial Sequence
  chemically synthesized
gtagcatatcttttggacta

SEQ ID NO: 204818 - DNA, 20 bp, Artificial Sequence
  chemically synthesized
gcatatcttttggactaagg

SEQ ID NO: 204819 - DNA, 20 bp, Artificial Sequence
  chemically synthesized
aagcctggaataatctacct

SEQ ID NO: 204820 - DNA, 20 bp, Artificial Sequence
  chemically synthesized
tggactaaggtagattattc

SEQ ID NO: 204821 - DNA, 20 bp, Artificial Sequence
  chemically synthesized
ggactaaggtagattattcc

SEQ ID NO: 204822 - DNA, 20 bp, Artificial Sequence
  chemically synthesized
atatttcggaatttaaagcc

SEQ ID NO: 204823 - DNA, 20 bp, Artificial Sequence
  chemically synthesized
tctaaatatttcggaattta

SEQ ID NO: 204824 - DNA, 20 bp, Artificial Sequence
  chemically synthesized
gctttaaattccgaaatatt

SEQ ID NO: 204825 - DNA, 20 bp, Artificial Sequence
  chemically synthesized
ttcttactctctaaatattt

SEQ ID NO: 204826 - DNA, 20 bp, Artificial Sequence
  chemically synthesized
tttaaattccgaaatattta

SEQ ID NO: 204827 - DNA, 20 bp, Artificial Sequence
  chemically synthesized
taaattccgaaatatttaga

SEQ ID NO: 204828 - DNA, 20 bp, Artificial Sequence
  chemically synthesized
ttccgaaatatttagagagt

SEQ ID NO: 204829 - DNA, 20 bp, Artificial Sequence
  chemically synthesized
cgaaatatttagagagtaag

SEQ ID NO: 204830 - DNA, 20 bp, Artificial Sequence
  chemically synthesized
gaaatatttagagagtaaga

SEQ ID NO: 204831 - DNA, 20 bp, Artificial Sequence
  chemically synthesized
tttagagagtaagaaggaca

SEQ ID NO: 204832 - DNA, 20 bp, Artificial Sequence
  chemically synthesized
tagagagtaagaaggacata

SEQ ID NO: 204833 - DNA, 20 bp, Artificial Sequence
  chemically synthesized
gagagtaagaaggacataga

SEQ ID NO: 204834 - DNA, 20 bp, Artificial Sequence
  chemically synthesized
aaggacatagagagaccatt

SEQ ID NO: 204835 - DNA, 20 bp, Artificial Sequence
  chemically synthesized
cgttgcaactgttgtctgaa

SEQ ID NO: 204836 - DNA, 20 bp, Artificial Sequence
  chemically synthesized
tagagagaccattcagacaa

SEQ ID NO: 204837 - DNA, 20 bp, Artificial Sequence
  chemically synthesized
cattcagacaacagttgcaa

SEQ ID NO: 204838 - DNA, 20 bp, Artificial Sequence
  chemically synthesized
tcagacaacagttgcaacgg

SEQ ID NO: 204839 - DNA, 20 bp, Artificial Sequence
  chemically synthesized
gacaacagttgcaacggaag

SEQ ID NO: 204840 - DNA, 20 bp, Artificial Sequence
  chemically synthesized
ttgcaacggaagtagacttg

SEQ ID NO: 204841 - DNA, 20 bp, Artificial Sequence
  chemically synthesized
tgcaacggaagtagacttga

SEQ ID NO: 204842 - DNA, 20 bp, Artificial Sequence
  chemically synthesized
acggaagtagacttgaaggc

SEQ ID NO: 204843 - DNA, 20 bp, Artificial Sequence
  chemically synthesized
ctgagctctttctggccttc

SEQ ID NO: 204844 - DNA, 20 bp, Artificial Sequence
  chemically synthesized
aagtagacttgaaggccaga

SEQ ID NO: 204845 - DNA, 20 bp, Artificial Sequence
  chemically synthesized
gtagacttgaaggccagaaa

SEQ ID NO: 204846 - DNA, 20 bp, Artificial Sequence
  chemically synthesized
tgtgcatgctgagctctttc

SEQ ID NO: 204847 - DNA, 20 bp, Artificial Sequence
  chemically synthesized
cttgaaggccagaaagagct

SEQ ID NO: 204848 - DNA, 20 bp, Artificial Sequence
  chemically synthesized
gttttatccctgtgcatgct

SEQ ID NO: 204849 - DNA, 20 bp, Artificial Sequence
  chemically synthesized
cagaaagagctcagcatgca

SEQ ID NO: 204850 - DNA, 20 bp, Artificial Sequence
  chemically synthesized
agaaagagctcagcatgcac

SEQ ID NO: 204851 - DNA, 20 bp, Artificial Sequence
  chemically synthesized
gaaagagctcagcatgcaca

SEQ ID NO: 204852 - DNA, 20 bp, Artificial Sequence
  chemically synthesized
cagcatgcacagggataaaa

SEQ ID NO: 204853 - DNA, 20 bp, Artificial Sequence
  chemically synthesized
agcatgcacagggataaaac

SEQ ID NO: 204854 - DNA, 20 bp, Artificial Sequence
  chemically synthesized
atgcacagggataaaacagg

SEQ ID NO: 204855 - DNA, 20 bp, Artificial Sequence
  chemically synthesized
gcacagggataaaacaggaa

SEQ ID NO: 204856 - DNA, 20 bp, Artificial Sequence
  chemically synthesized
gggataaaacaggaagagcc

SEQ ID NO: 204857 - DNA, 20 bp, Artificial Sequence
  chemically synthesized
aacaggaagagcccagtgct

SEQ ID NO: 204858 - DNA, 20 bp, Artificial Sequence
  chemically synthesized
acaggaagagcccagtgcta

SEQ ID NO: 204859 - DNA, 20 bp, Artificial Sequence
  chemically synthesized
ctgagtgaatccttagcact

SEQ ID NO: 204860 - DNA, 20 bp, Artificial Sequence
  chemically synthesized
cctgagtgaatccttagcac

SEQ ID NO: 204861 - DNA, 20 bp, Artificial Sequence
  chemically synthesized
ccttcccctgagtgaatcct

SEQ ID NO: 204862 - DNA, 20 bp, Artificial Sequence
  chemically synthesized
cccagtgctaaggattcact

SEQ ID NO: 204863 - DNA, 20 bp, Artificial Sequence
  chemically synthesized
ccagtgctaaggattcactc

SEQ ID NO: 204864 - DNA, 20 bp, Artificial Sequence
  chemically synthesized
cagtgctaaggattcactca

SEQ ID NO: 204865 - DNA, 20 bp, Artificial Sequence
  chemically synthesized
agtgctaaggattcactcag

SEQ ID NO: 204866 - DNA, 20 bp, Artificial Sequence
  chemically synthesized
gctaaggattcactcagggg

SEQ ID NO: 204867 - DNA, 20 bp, Artificial Sequence
  chemically synthesized
ctaaggattcactcagggga

SEQ ID NO: 204868 - DNA, 20 bp, Artificial Sequence
  chemically synthesized
taaggattcactcaggggaa

SEQ ID NO: 204869 - DNA, 20 bp, Artificial Sequence
  chemically synthesized
ttatcacccacccttcccct

SEQ ID NO: 204870 - DNA, 20 bp, Artificial Sequence
  chemically synthesized
ggattcactcaggggaaggg

SEQ ID NO: 204871 - DNA, 20 bp, Artificial Sequence
  chemically synthesized
gattcactcaggggaagggt

SEQ ID NO: 204872 - DNA, 20 bp, Artificial Sequence
  chemically synthesized
ggaagggtgggtgataatac

SEQ ID NO: 204873 - DNA, 20 bp, Artificial Sequence
  chemically synthesized
ggtgataatactggatgctt

SEQ ID NO: 204874 - DNA, 20 bp, Artificial Sequence
  chemically synthesized
cttataccaacttaagcatc

SEQ ID NO: 204875 - DNA, 20 bp, Artificial Sequence
  chemically synthesized
ataatactggatgcttaagt

SEQ ID NO: 204876 - DNA, 20 bp, Artificial Sequence
  chemically synthesized
ttactatcttataccaactt

SEQ ID NO: 204877 - DNA, 20 bp, Artificial Sequence
  chemically synthesized
ctggatgcttaagttggtat

SEQ ID NO: 204878 - DNA, 20 bp, Artificial Sequence
  chemically synthesized
atgcttaagttggtataaga

SEQ ID NO: 204879 - DNA, 20 bp, Artificial Sequence
  chemically synthesized
ttaagttggtataagatagt

SEQ ID NO: 204880 - DNA, 20 bp, Artificial Sequence
  chemically synthesized
aaacatcagattcatatttc

SEQ ID NO: 204881 - DNA, 20 bp, Artificial Sequence
  chemically synthesized
aaaacatcagattcatattt

SEQ ID NO: 204882 - DNA, 20 bp, Artificial Sequence
  chemically synthesized
gaaatatgaatctgatgttt

SEQ ID NO: 204883 - DNA, 20 bp, Artificial Sequence
  chemically synthesized
tctttaaaaaactaaaacat

SEQ ID NO: 204884 - DNA, 20 bp, Artificial Sequence
  chemically synthesized
tctgatgttttagtttttta

SEQ ID NO: 204885 - DNA, 20 bp, Artificial Sequence
  chemically synthesized
ttttaaagaattttacaaaa

SEQ ID NO: 204886 - DNA, 20 bp, Artificial Sequence
  chemically synthesized
ttacaaaacagatttttaaa

SEQ ID NO: 204887 - DNA, 20 bp, Artificial Sequence
  chemically synthesized
aacagatttttaaatagctg

SEQ ID NO: 204888 - DNA, 20 bp, Artificial Sequence
  chemically synthesized
cagatttttaaatagctgta

SEQ ID NO: 204889 - DNA, 20 bp, Artificial Sequence
  chemically synthesized
gtttctcttttgaatctcta

SEQ ID NO: 204890 - DNA, 20 bp, Artificial Sequence
  chemically synthesized
aaatagctgtagagattcaa

SEQ ID NO: 204891 - DNA, 20 bp, Artificial Sequence
  chemically synthesized
atagctgtagagattcaaaa

SEQ ID NO: 204892 - DNA, 20 bp, Artificial Sequence
  chemically synthesized
agagattcaaaagagaaacg

SEQ ID NO: 204893 - DNA, 20 bp, Artificial Sequence
  chemically synthesized
gattcaaaagagaaacgaag

SEQ ID NO: 204894 - DNA, 20 bp, Artificial Sequence
  chemically synthesized
aacgaagcagttgtacccaa

SEQ ID NO: 204895 - DNA, 20 bp, Artificial Sequence
  chemically synthesized
gaagcagttgtacccaaaag

SEQ ID NO: 204896 - DNA, 20 bp, Artificial Sequence
  chemically synthesized
aagcagttgtacccaaaagt

SEQ ID NO: 204897 - DNA, 20 bp, Artificial Sequence
  chemically synthesized
atctttattatcctactttt

SEQ ID NO: 204898 - DNA, 20 bp, Artificial Sequence
  chemically synthesized
gatctttattatcctacttt

SEQ ID NO: 204899 - DNA, 20 bp, Artificial Sequence
  chemically synthesized
tacccaaaagtaggataata

SEQ ID NO: 204900 - DNA, 20 bp, Artificial Sequence
  chemically synthesized
ttataatttaacacaatcaa

SEQ ID NO: 204901 - DNA, 20 bp, Artificial Sequence
  chemically synthesized
atttataatttaacacaatc

SEQ ID NO: 204902 - DNA, 20 bp, Artificial Sequence
  chemically synthesized
ataaatgcatactccatcca

SEQ ID NO: 204903 - DNA, 20 bp, Artificial Sequence
  chemically synthesized
taaatgcatactccatccat

SEQ ID NO: 204904 - DNA, 20 bp, Artificial Sequence
  chemically synthesized
ttggcatcaccctatggatg

SEQ ID NO: 204905 - DNA, 20 bp, Artificial Sequence
  chemically synthesized
aaatgcatactccatccata

SEQ ID NO: 204906 - DNA, 20 bp, Artificial Sequence
  chemically synthesized
ctttggcatcaccctatgga

SEQ ID NO: 204907 - DNA, 20 bp, Artificial Sequence
  chemically synthesized
ccttctttggcatcacccta

SEQ ID NO: 204908 - DNA, 20 bp, Artificial Sequence
  chemically synthesized
ccatccatagggtgatgcca

SEQ ID NO: 204909 - DNA, 20 bp, Artificial Sequence
  chemically synthesized
tccatagggtgatgccaaag

SEQ ID NO: 204910 - DNA, 20 bp, Artificial Sequence
  chemically synthesized
ccatagggtgatgccaaaga

SEQ ID NO: 204911 - DNA, 20 bp, Artificial Sequence
  chemically synthesized
atagggtgatgccaaagaag

SEQ ID NO: 204912 - DNA, 20 bp, Artificial Sequence
  chemically synthesized
tagggtgatgccaaagaagg

SEQ ID NO: 204913 - DNA, 20 bp, Artificial Sequence
  chemically synthesized
ctacttgtttcctccttctt

SEQ ID NO: 204914 - DNA, 20 bp, Artificial Sequence
  chemically synthesized
atgccaaagaaggaggaaac

SEQ ID NO: 204915 - DNA, 20 bp, Artificial Sequence
  chemically synthesized
ccaaagaaggaggaaacaag

SEQ ID NO: 204916 - DNA, 20 bp, Artificial Sequence
  chemically synthesized
aagaagcatagcataaattg

SEQ ID NO: 204917 - DNA, 20 bp, Artificial Sequence
  chemically synthesized
cttcaaacagagaagaagca

SEQ ID NO: 204918 - DNA, 20 bp, Artificial Sequence
  chemically synthesized
aacttcttcaaacagagaag

SEQ ID NO: 204919 - DNA, 20 bp, Artificial Sequence
  chemically synthesized
gtcaacttcttcaaacagag

SEQ ID NO: 204920 - DNA, 20 bp, Artificial Sequence
  chemically synthesized
ctatgcttcttctctgtttg

SEQ ID NO: 204921 - DNA, 20 bp, Artificial Sequence
  chemically synthesized
caggtcaacttcttcaaaca

SEQ ID NO: 204922 - DNA, 20 bp, Artificial Sequence
  chemically synthesized
tgcttcttctctgtttgaag

SEQ ID NO: 204923 - DNA, 20 bp, Artificial Sequence
  chemically synthesized
gacaggtcaacttcttcaaa

SEQ ID NO: 204924 - DNA, 20 bp, Artificial Sequence
  chemically synthesized
gatatggctttcgagcagac

SEQ ID NO: 204925 - DNA, 20 bp, Artificial Sequence
  chemically synthesized
ggatatggctttcgagcaga

SEQ ID NO: 204926 - DNA, 20 bp, Artificial Sequence
  chemically synthesized
aagttgacctgtctgctcga

SEQ ID NO: 204927 - DNA, 20 bp, Artificial Sequence
  chemically synthesized
tgctggatatggctttcgag

SEQ ID NO: 204928 - DNA, 20 bp, Artificial Sequence
  chemically synthesized
gtctgctggatatggctttc

SEQ ID NO: 204929 - DNA, 20 bp, Artificial Sequence
  chemically synthesized
gtctgctcgaaagccatatc

SEQ ID NO: 204930 - DNA, 20 bp, Artificial Sequence
  chemically synthesized
tgctcgaaagccatatccag

SEQ ID NO: 204931 - DNA, 20 bp, Artificial Sequence
  chemically synthesized
atcggtgggtctgctggata

SEQ ID NO: 204932 - DNA, 20 bp, Artificial Sequence
  chemically synthesized
caagtaatcggtgggtctgc

SEQ ID NO: 204933 - DNA, 20 bp, Artificial Sequence
  chemically synthesized
tcactgtgcaagtaatcggt

SEQ ID NO: 204934 - DNA, 20 bp, Artificial Sequence
  chemically synthesized
gtcactgtgcaagtaatcgg

SEQ ID NO: 204935 - DNA, 20 bp, Artificial Sequence
  chemically synthesized
tctgtcactgtgcaagtaat

SEQ ID NO: 204936 - DNA, 20 bp, Artificial Sequence
  chemically synthesized
agacccaccgattacttgca

SEQ ID NO: 204937 - DNA, 20 bp, Artificial Sequence
  chemically synthesized
cttaaattctgtcactgtgc

SEQ ID NO: 204938 - DNA, 20 bp, Artificial Sequence
  chemically synthesized
accgattacttgcacagtga

SEQ ID NO: 204939 - DNA, 20 bp, Artificial Sequence
  chemically synthesized
cttgcacagtgacagaattt

SEQ ID NO: 204940 - DNA, 20 bp, Artificial Sequence
  chemically synthesized
ttgcacagtgacagaattta

SEQ ID NO: 204941 - DNA, 20 bp, Artificial Sequence
  chemically synthesized
tgcacagtgacagaatttaa

SEQ ID NO: 204942 - DNA, 20 bp, Artificial Sequence
  chemically synthesized
taaactcagtggaaataaat

SEQ ID NO: 204943 - DNA, 20 bp, Artificial Sequence
  chemically synthesized
tgaactaatttatttccact

SEQ ID NO: 204944 - DNA, 20 bp, Artificial Sequence
  chemically synthesized
agggtcatcagtaaactcag

SEQ ID NO: 204945 - DNA, 20 bp, Artificial Sequence
  chemically synthesized
tctagggtcatcagtaaact

SEQ ID NO: 204946 - DNA, 20 bp, Artificial Sequence
  chemically synthesized
actgagtttactgatgaccc

SEQ ID NO: 204947 - DNA, 20 bp, Artificial Sequence
  chemically synthesized
cttaaattttctagggtcat

SEQ ID NO: 204948 - DNA, 20 bp, Artificial Sequence
  chemically synthesized
gtcaccgcttaaattttcta

SEQ ID NO: 204949 - DNA, 20 bp, Artificial Sequence
  chemically synthesized
tgtcaccgcttaaattttct

SEQ ID NO: 204950 - DNA, 20 bp, Artificial Sequence
  chemically synthesized
gtgtcaccgcttaaattttc

SEQ ID NO: 204951 - DNA, 20 bp, Artificial Sequence
  chemically synthesized
ctgatgaccctagaaaattt

SEQ ID NO: 204952 - DNA, 20 bp, Artificial Sequence
  chemically synthesized
atgaccctagaaaatttaag

SEQ ID NO: 204953 - DNA, 20 bp, Artificial Sequence
  chemically synthesized
agaaaatttaagcggtgaca

SEQ ID NO: 204954 - DNA, 20 bp, Artificial Sequence
  chemically synthesized
gaaaatttaagcggtgacac

SEQ ID NO: 204955 - DNA, 20 bp, Artificial Sequence
  chemically synthesized
ataatgcaacaaagaattta

SEQ ID NO: 204956 - DNA, 20 bp, Artificial Sequence
  chemically synthesized
aggagctttataatgcaaca

SEQ ID NO: 204957 - DNA, 20 bp, Artificial Sequence
  chemically synthesized
aaattctttgttgcattata

SEQ ID NO: 204958 - DNA, 20 bp, Artificial Sequence
  chemically synthesized
ttgcattataaagctccttc

SEQ ID NO: 204959 - DNA, 20 bp, Artificial Sequence
  chemically synthesized
agcattttaatttcttgaag

SEQ ID NO: 204960 - DNA, 20 bp, Artificial Sequence
  chemically synthesized
taagcattttaatttcttga

SEQ ID NO: 204961 - DNA, 20 bp, Artificial Sequence
  chemically synthesized
ttaagcattttaatttcttg

SEQ ID NO: 204962 - DNA, 20 bp, Artificial Sequence
  chemically synthesized
ttcaagaaattaaaatgctt

SEQ ID NO: 204963 - DNA, 20 bp, Artificial Sequence
  chemically synthesized
atagatcattattttcactt

SEQ ID NO: 204964 - DNA, 20 bp, Artificial Sequence
  chemically synthesized
ggaaaccactcaaagttgga

SEQ ID NO: 204965 - DNA, 20 bp, Artificial Sequence
  chemically synthesized
ataatgatctatccaacttt

SEQ ID NO: 204966 - DNA, 20 bp, Artificial Sequence
  chemically synthesized
gtagggaaaccactcaaagt

SEQ ID NO: 204967 - DNA, 20 bp, Artificial Sequence
  chemically synthesized
atgatctatccaactttgag

SEQ ID NO: 204968 - DNA, 20 bp, Artificial Sequence
  chemically synthesized
aagtgtagggaaaccactca

SEQ ID NO: 204969 - DNA, 20 bp, Artificial Sequence
  chemically synthesized
agtgatcactaaaaagtgta

SEQ ID NO: 204970 - DNA, 20 bp, Artificial Sequence
  chemically synthesized
aagtgatcactaaaaagtgt

SEQ ID NO: 204971 - DNA, 20 bp, Artificial Sequence
  chemically synthesized
agtggtttccctacactttt

SEQ ID NO: 204972 - DNA, 20 bp, Artificial Sequence
  chemically synthesized
aaagtgatcactaaaaagtg

SEQ ID NO: 204973 - DNA, 20 bp, Artificial Sequence
  chemically synthesized
accagaaagtgatcactaaa

SEQ ID NO: 204974 - DNA, 20 bp, Artificial Sequence
  chemically synthesized
actttttagtgatcactttc

SEQ ID NO: 204975 - DNA, 20 bp, Artificial Sequence
  chemically synthesized
tttagtgatcactttctggt

SEQ ID NO: 204976 - DNA, 20 bp, Artificial Sequence
  chemically synthesized
tttctaggtctcttaccaga

SEQ ID NO: 204977 - DNA, 20 bp, Artificial Sequence
  chemically synthesized
tagtgatcactttctggtaa

SEQ ID NO: 204978 - DNA, 20 bp, Artificial Sequence
  chemically synthesized
tttttttctaggtctcttac

SEQ ID NO: 204979 - DNA, 20 bp, Artificial Sequence
  chemically synthesized
tcactttctggtaagagacc

SEQ ID NO: 204980 - DNA, 20 bp, Artificial Sequence
  chemically synthesized
tcattcagcagtttttttct

SEQ ID NO: 204981 - DNA, 20 bp, Artificial Sequence
  chemically synthesized
ttcattcagcagtttttttc

SEQ ID NO: 204982 - DNA, 20 bp, Artificial Sequence
  chemically synthesized
caaattgaggattcattcag

SEQ ID NO: 204983 - DNA, 20 bp, Artificial Sequence
  chemically synthesized
tgacaaattgaggattcatt

SEQ ID NO: 204984 - DNA, 20 bp, Artificial Sequence
  chemically synthesized
tccaaaaaattgacaaattg

SEQ ID NO: 204985 - DNA, 20 bp, Artificial Sequence
  chemically synthesized
ttccaaaaaattgacaaatt

SEQ ID NO: 204986 - DNA, 20 bp, Artificial Sequence
  chemically synthesized
tcctcaatttgtcaattttt

SEQ ID NO: 204987 - DNA, 20 bp, Artificial Sequence
  chemically synthesized
tcaatagctgtagaaggtat

SEQ ID NO: 204988 - DNA, 20 bp, Artificial Sequence
  chemically synthesized
tggaaaaccaataccttcta

SEQ ID NO: 204989 - DNA, 20 bp, Artificial Sequence
  chemically synthesized
gaattttcaatagctgtaga

SEQ ID NO: 204990 - DNA, 20 bp, Artificial Sequence
  chemically synthesized
tgaattttcaatagctgtag

SEQ ID NO: 204991 - DNA, 20 bp, Artificial Sequence
  chemically synthesized
ctctgaattttcaatagctg

SEQ ID NO: 204992 - DNA, 20 bp, Artificial Sequence
  chemically synthesized
actgccctctgaattttcaa

SEQ ID NO: 204993 - DNA, 20 bp, Artificial Sequence
  chemically synthesized
ttctacagctattgaaaatt

SEQ ID NO: 204994 - DNA, 20 bp, Artificial Sequence
  chemically synthesized
ctacagctattgaaaattca

SEQ ID NO: 204995 - DNA, 20 bp, Artificial Sequence
  chemically synthesized
tacagctattgaaaattcag

SEQ ID NO: 204996 - DNA, 20 bp, Artificial Sequence
  chemically synthesized
acagctattgaaaattcaga

SEQ ID NO: 204997 - DNA, 20 bp, Artificial Sequence
  chemically synthesized
gctattgaaaattcagaggg

SEQ ID NO: 204998 - DNA, 20 bp, Artificial Sequence
  chemically synthesized
aaattcagagggcagtttgc

SEQ ID NO: 204999 - DNA, 20 bp, Artificial Sequence
  chemically synthesized
caggaaggatgatatagatt

SEQ ID NO: 205000 - DNA, 20 bp, Artificial Sequence
  chemically synthesized
aggttgcaggaaggatgata

SEQ ID NO: 205001 - DNA, 20 bp, Artificial Sequence
  chemically synthesized
gctgtggtaaggttgcagga

SEQ ID NO: 205002 - DNA, 20 bp, Artificial Sequence
  chemically synthesized
ggctgtggtaaggttgcagg

SEQ ID NO: 205003 - DNA, 20 bp, Artificial Sequence
  chemically synthesized
catggctgtggtaaggttgc

SEQ ID NO: 205004 - DNA, 20 bp, Artificial Sequence
  chemically synthesized
tcatggctgtggtaaggttg

SEQ ID NO: 205005 - DNA, 20 bp, Artificial Sequence
  chemically synthesized
tccttcctgcaaccttacca

SEQ ID NO: 205006 - DNA, 20 bp, Artificial Sequence
  chemically synthesized
ataaaatcatggctgtggta

SEQ ID NO: 205007 - DNA, 20 bp, Artificial Sequence
  chemically synthesized
gataaaatcatggctgtggt

SEQ ID NO: 205008 - DNA, 20 bp, Artificial Sequence
  chemically synthesized
tgaagataaaatcatggctg

SEQ ID NO: 205009 - DNA, 20 bp, Artificial Sequence
  chemically synthesized
tttaaatgaagataaaatca

SEQ ID NO: 205010 - DNA, 20 bp, Artificial Sequence
  chemically synthesized
catgattttatcttcattta

SEQ ID NO: 205011 - DNA, 20 bp, Artificial Sequence
  chemically synthesized
tcaatctcgtgctttaaatg

SEQ ID NO: 205012 - DNA, 20 bp, Artificial Sequence
  chemically synthesized
tttatcttcatttaaagcac

SEQ ID NO: 205013 - DNA, 20 bp, Artificial Sequence
  chemically synthesized
catttaaagcacgagattga

SEQ ID NO: 205014 - DNA, 20 bp, Artificial Sequence
  chemically synthesized
gagattgaaagatgcattgt

SEQ ID NO: 205015 - DNA, 20 bp, Artificial Sequence
  chemically synthesized
gattgaaagatgcattgtga

SEQ ID NO: 205016 - DNA, 20 bp, Artificial Sequence
  chemically synthesized
tgaaagatgcattgtgagag

SEQ ID NO: 205017 - DNA, 20 bp, Artificial Sequence
  chemically synthesized
atgcattgtgagagaagttc

SEQ ID NO: 205018 - DNA, 20 bp, Artificial Sequence
  chemically synthesized
caatgaaggaagtagcaaac

SEQ ID NO: 205019 - DNA, 20 bp, Artificial Sequence
  chemically synthesized
aaaaataacaatgaaggaag

SEQ ID NO: 205020 - DNA, 20 bp, Artificial Sequence
  chemically synthesized
attaaaaataacaatgaagg

SEQ ID NO: 205021 - DNA, 20 bp, Artificial Sequence
  chemically synthesized
aagattaaaaataacaatga

SEQ ID NO: 205022 - DNA, 20 bp, Artificial Sequence
  chemically synthesized
aaagattaaaaataacaatg

SEQ ID NO: 205023 - DNA, 20 bp, Artificial Sequence
  chemically synthesized
cattgttatttttaatcttt

SEQ ID NO: 205024 - DNA, 20 bp, Artificial Sequence
  chemically synthesized
atgctttattgtatatctca

SEQ ID NO: 205025 - DNA, 20 bp, Artificial Sequence
  chemically synthesized
aatctttgagatatacaata

SEQ ID NO: 205026 - DNA, 20 bp, Artificial Sequence
  chemically synthesized
ataaagcatcattaacctga

SEQ ID NO: 205027 - DNA, 20 bp, Artificial Sequence
  chemically synthesized
agcatcattaacctgaaaga

SEQ ID NO: 205028 - DNA, 20 bp, Artificial Sequence
  chemically synthesized
ggaggggtgttctttctttc

SEQ ID NO: 205029 - DNA, 20 bp, Artificial Sequence
  chemically synthesized
tggaggggtgttctttcttt

SEQ ID NO: 205030 - DNA, 20 bp, Artificial Sequence
  chemically synthesized
tgaaagaaagaacacccctc

SEQ ID NO: 205031 - DNA, 20 bp, Artificial Sequence
  chemically synthesized
gattactgtgtgttctggag

SEQ ID NO: 205032 - DNA, 20 bp, Artificial Sequence
  chemically synthesized
tgattactgtgtgttctgga

SEQ ID NO: 205033 - DNA, 20 bp, Artificial Sequence
  chemically synthesized
ttgattactgtgtgttctgg

SEQ ID NO: 205034 - DNA, 20 bp, Artificial Sequence
  chemically synthesized
attgattactgtgtgttctg

SEQ ID NO: 205035 - DNA, 20 bp, Artificial Sequence
  chemically synthesized
gaacacccctccagaacaca

SEQ ID NO: 205036 - DNA, 20 bp, Artificial Sequence
  chemically synthesized
ccattgattactgtgtgttc

SEQ ID NO: 205037 - DNA, 20 bp, Artificial Sequence
  chemically synthesized
ccagaacacacagtaatcaa

SEQ ID NO: 205038 - DNA, 20 bp, Artificial Sequence
  chemically synthesized
acacacagtaatcaatggca

SEQ ID NO: 205039 - DNA, 20 bp, Artificial Sequence
  chemically synthesized
taatcaatggcaaagttaat

SEQ ID NO: 205040 - DNA, 20 bp, Artificial Sequence
  chemically synthesized
tggcaaagttaattggaatt

SEQ ID NO: 205041 - DNA, 20 bp, Artificial Sequence
  chemically synthesized
tgctaaggtggaattgttaa

SEQ ID NO: 205042 - DNA, 20 bp, Artificial Sequence
  chemically synthesized
ttcttttaacaattccacct

SEQ ID NO: 205043 - DNA, 20 bp, Artificial Sequence
  chemically synthesized
acattgtagaattgctaagg

SEQ ID NO: 205044 - DNA, 20 bp, Artificial Sequence
  chemically synthesized
ggaacattgtagaattgcta

SEQ ID NO: 205045 - DNA, 20 bp, Artificial Sequence
  chemically synthesized
aggaacattgtagaattgct

SEQ ID NO: 205046 - DNA, 20 bp, Artificial Sequence
  chemically synthesized
gtctatcactaggaacattg

SEQ ID NO: 205047 - DNA, 20 bp, Artificial Sequence
  chemically synthesized
tagcaattctacaatgttcc

SEQ ID NO: 205048 - DNA, 20 bp, Artificial Sequence
  chemically synthesized
ttctacaatgttcctagtga

SEQ ID NO: 205049 - DNA, 20 bp, Artificial Sequence
  chemically synthesized
gattaaaactgtctatcact

SEQ ID NO: 205050 - DNA, 20 bp, Artificial Sequence
  chemically synthesized
tgattaaaactgtctatcac

SEQ ID NO: 205051 - DNA, 20 bp, Artificial Sequence
  chemically synthesized
acaatgttcctagtgataga

SEQ ID NO: 205052 - DNA, 20 bp, Artificial Sequence
  chemically synthesized
gtgatagacagttttaatca

SEQ ID NO: 205053 - DNA, 20 bp, Artificial Sequence
  chemically synthesized
agacagttttaatcaaagct

SEQ ID NO: 205054 - DNA, 20 bp, Artificial Sequence
  chemically synthesized
acagttttaatcaaagcttg

SEQ ID NO: 205055 - DNA, 20 bp, Artificial Sequence
  chemically synthesized
gtctctttttcaaatactcc

SEQ ID NO: 205056 - DNA, 20 bp, Artificial Sequence
  chemically synthesized
aaagcttggagtatttgaaa

SEQ ID NO: 205057 - DNA, 20 bp, Artificial Sequence
  chemically synthesized
agcttggagtatttgaaaaa

SEQ ID NO: 205058 - DNA, 20 bp, Artificial Sequence
  chemically synthesized
gaaaaagagacaaataatgt

SEQ ID NO: 205059 - DNA, 20 bp, Artificial Sequence
  chemically synthesized
aaaaagagacaaataatgta

SEQ ID NO: 205060 - DNA, 20 bp, Artificial Sequence
  chemically synthesized
aagagacaaataatgtaagg

SEQ ID NO: 205061 - DNA, 20 bp, Artificial Sequence
  chemically synthesized
agagacaaataatgtaagga

SEQ ID NO: 205062 - DNA, 20 bp, Artificial Sequence
  chemically synthesized
agacaaataatgtaaggaag

SEQ ID NO: 205063 - DNA, 20 bp, Artificial Sequence
  chemically synthesized
gataatttgtgactaaaacc

SEQ ID NO: 205064 - DNA, 20 bp, Artificial Sequence
  chemically synthesized
ttagtggaaagactaggttt

SEQ ID NO: 205065 - DNA, 20 bp, Artificial Sequence
  chemically synthesized
aaatccttagtggaaagact

SEQ ID NO: 205066 - DNA, 20 bp, Artificial Sequence
  chemically synthesized
gaaatccttagtggaaagac

SEQ ID NO: 205067 - DNA, 20 bp, Artificial Sequence
  chemically synthesized
taaaacctagtctttccact

SEQ ID NO: 205068 - DNA, 20 bp, Artificial Sequence
  chemically synthesized
aaaacctagtctttccacta

SEQ ID NO: 205069 - DNA, 20 bp, Artificial Sequence
  chemically synthesized
aaaaggaaatccttagtgga

SEQ ID NO: 205070 - DNA, 20 bp, Artificial Sequence
  chemically synthesized
aaagaaaaggaaatccttag

SEQ ID NO: 205071 - DNA, 20 bp, Artificial Sequence
  chemically synthesized
tttaaagaaaaggaaatcct

SEQ ID NO: 205072 - DNA, 20 bp, Artificial Sequence
  chemically synthesized
aacctgaaactttaaagaaa

SEQ ID NO: 205073 - DNA, 20 bp, Artificial Sequence
  chemically synthesized
taaggatttccttttcttta

SEQ ID NO: 205074 - DNA, 20 bp, Artificial Sequence
  chemically synthesized
aaacctgaaactttaaagaa

SEQ ID NO: 205075 - DNA, 20 bp, Artificial Sequence
  chemically synthesized
gctccaaacctgaaacttta

SEQ ID NO: 205076 - DNA, 20 bp, Artificial Sequence
  chemically synthesized
tttccttttctttaaagttt

SEQ ID NO: 205077 - DNA, 20 bp, Artificial Sequence
  chemically synthesized
ttccttttctttaaagtttc

SEQ ID NO: 205078 - DNA, 20 bp, Artificial Sequence
  chemically synthesized
tttctttaaagtttcaggtt

SEQ ID NO: 205079 - DNA, 20 bp, Artificial Sequence
  chemically synthesized
tctttaaagtttcaggtttg

SEQ ID NO: 205080 - DNA, 20 bp, Artificial Sequence
  chemically synthesized
tctctactcaaaaagtgttt

SEQ ID NO: 205081 - DNA, 20 bp, Artificial Sequence
  chemically synthesized
ttggagctgaaacacttttt

SEQ ID NO: 205082 - DNA, 20 bp, Artificial Sequence
  chemically synthesized
gagctgaaacactttttgag

SEQ ID NO: 205083 - DNA, 20 bp, Artificial Sequence
  chemically synthesized
ctgtgtcttctctactcaaa

SEQ ID NO: 205084 - DNA, 20 bp, Artificial Sequence
  chemically synthesized
gctgaaacactttttgagta

SEQ ID NO: 205085 - DNA, 20 bp, Artificial Sequence
  chemically synthesized
gaaacactttttgagtagag

SEQ ID NO: 205086 - DNA, 20 bp, Artificial Sequence
  chemically synthesized
ctttttgagtagagaagaca

SEQ ID NO: 205087 - DNA, 20 bp, Artificial Sequence
  chemically synthesized
tttttgagtagagaagacac

SEQ ID NO: 205088 - DNA, 20 bp, Artificial Sequence
  chemically synthesized
tgagtagagaagacacagga

SEQ ID NO: 205089 - DNA, 20 bp, Artificial Sequence
  chemically synthesized
gagtagagaagacacaggat

SEQ ID NO: 205090 - DNA, 20 bp, Artificial Sequence
  chemically synthesized
agagaagacacaggatggga

SEQ ID NO: 205091 - DNA, 20 bp, Artificial Sequence
  chemically synthesized
gaagacacaggatgggacag

SEQ ID NO: 205092 - DNA, 20 bp, Artificial Sequence
  chemically synthesized
aggatgggacagtggttgaa

SEQ ID NO: 205093 - DNA, 20 bp, Artificial Sequence
  chemically synthesized
atgggacagtggttgaaaag

SEQ ID NO: 205094 - DNA, 20 bp, Artificial Sequence
  chemically synthesized
gacagtggttgaaaagaagt

SEQ ID NO: 205095 - DNA, 20 bp, Artificial Sequence
  chemically synthesized
tggttgaaaagaagttggtc

SEQ ID NO: 205096 - DNA, 20 bp, Artificial Sequence
  chemically synthesized
ggttgaaaagaagttggtct

SEQ ID NO: 205097 - DNA, 20 bp, Artificial Sequence
  chemically synthesized
ctgcagttgggatttgcacc

SEQ ID NO: 205098 - DNA, 20 bp, Artificial Sequence
  chemically synthesized
ctgggtgcaaatcccaactg

SEQ ID NO: 205099 - DNA, 20 bp, Artificial Sequence
  chemically synthesized
tcagctaacatgctgcagtt

SEQ ID NO: 205100 - DNA, 20 bp, Artificial Sequence
  chemically synthesized
ctcagctaacatgctgcagt

SEQ ID NO: 205101 - DNA, 20 bp, Artificial Sequence
  chemically synthesized
atggctcagctaacatgctg

SEQ ID NO: 205102 - DNA, 20 bp, Artificial Sequence
  chemically synthesized
aaatcccaactgcagcatgt

SEQ ID NO: 205103 - DNA, 20 bp, Artificial Sequence
  chemically synthesized
ccaactgcagcatgttagct

SEQ ID NO: 205104 - DNA, 20 bp, Artificial Sequence
  chemically synthesized
gtgagttgtccaggatggct

SEQ ID NO: 205105 - DNA, 20 bp, Artificial Sequence
  chemically synthesized
gcatgttagctgagccatcc

SEQ ID NO: 205106 - DNA, 20 bp, Artificial Sequence
  chemically synthesized
gctaagtgagttgtccagga

SEQ ID NO: 205107 - DNA, 20 bp, Artificial Sequence
  chemically synthesized
agaggctaagtgagttgtcc

SEQ ID NO: 205108 - DNA, 20 bp, Artificial Sequence
  chemically synthesized
gagaggctaagtgagttgtc

SEQ ID NO: 205109 - DNA, 20 bp, Artificial Sequence
  chemically synthesized
gccatcctggacaactcact

SEQ ID NO: 205110 - DNA, 20 bp, Artificial Sequence
  chemically synthesized
ggagcacagagaggctaagt

SEQ ID NO: 205111 - DNA, 20 bp, Artificial Sequence
  chemically synthesized
agctggagcacagagaggct

SEQ ID NO: 205112 - DNA, 20 bp, Artificial Sequence
  chemically synthesized
aaagaagctggagcacagag

SEQ ID NO: 205113 - DNA, 20 bp, Artificial Sequence
  chemically synthesized
caaagaagctggagcacaga

SEQ ID NO: 205114 - DNA, 20 bp, Artificial Sequence
  chemically synthesized
cacttagcctctctgtgctc

SEQ ID NO: 205115 - DNA, 20 bp, Artificial Sequence
  chemically synthesized
ggcaaagaagctggagcaca

SEQ ID NO: 205116 - DNA, 20 bp, Artificial Sequence
  chemically synthesized
caggcaaagaagctggagca

SEQ ID NO: 205117 - DNA, 20 bp, Artificial Sequence
  chemically synthesized
ttttccaggcaaagaagctg

SEQ ID NO: 205118 - DNA, 20 bp, Artificial Sequence
  chemically synthesized
cattttccaggcaaagaagc

SEQ ID NO: 205119 - DNA, 20 bp, Artificial Sequence
  chemically synthesized
tgtgctccagcttctttgcc

SEQ ID NO: 205120 - DNA, 20 bp, Artificial Sequence
  chemically synthesized
ttcccattttccaggcaaag

SEQ ID NO: 205121 - DNA, 20 bp, Artificial Sequence
  chemically synthesized
tcgttcccattttccaggca

SEQ ID NO: 205122 - DNA, 20 bp, Artificial Sequence
  chemically synthesized
cagcttctttgcctggaaaa

SEQ ID NO: 205123 - DNA, 20 bp, Artificial Sequence
  chemically synthesized
agcttctttgcctggaaaat

SEQ ID NO: 205124 - DNA, 20 bp, Artificial Sequence
  chemically synthesized
tattatcgttcccattttcc

SEQ ID NO: 205125 - DNA, 20 bp, Artificial Sequence
  chemically synthesized
ttattatcgttcccattttc

SEQ ID NO: 205126 - DNA, 20 bp, Artificial Sequence
  chemically synthesized
aacgataataaaacgcactt

SEQ ID NO: 205127 - DNA, 20 bp, Artificial Sequence
  chemically synthesized
taataaaacgcactttggcc

SEQ ID NO: 205128 - DNA, 20 bp, Artificial Sequence
  chemically synthesized
gcttactatgtgccaggcca

SEQ ID NO: 205129 - DNA, 20 bp, Artificial Sequence
  chemically synthesized
acgcactttggcctggcaca

SEQ ID NO: 205130 - DNA, 20 bp, Artificial Sequence
  chemically synthesized
ttgaaggcttactatgtgcc

SEQ ID NO: 205131 - DNA, 20 bp, Artificial Sequence
  chemically synthesized
attgaaggcttactatgtgc

SEQ ID NO: 205132 - DNA, 20 bp, Artificial Sequence
  chemically synthesized
actttggcctggcacatagt

SEQ ID NO: 205133 - DNA, 20 bp, Artificial Sequence
  chemically synthesized
gatagtgatagttttattga

SEQ ID NO: 205134 - DNA, 20 bp, Artificial Sequence
  chemically synthesized
tgatagtgatagttttattg

SEQ ID NO: 205135 - DNA, 20 bp, Artificial Sequence
  chemically synthesized
cttcataaaaatgatagtga

SEQ ID NO: 205136 - DNA, 20 bp, Artificial Sequence
  chemically synthesized
atcttgcttcataaaaatga

SEQ ID NO: 205137 - DNA, 20 bp, Artificial Sequence
  chemically synthesized
ctatcactatcatttttatg

SEQ ID NO: 205138 - DNA, 20 bp, Artificial Sequence
  chemically synthesized
cactatcatttttatgaagc

SEQ ID NO: 205139 - DNA, 20 bp, Artificial Sequence
  chemically synthesized
catttttatgaagcaagata

SEQ ID NO: 205140 - DNA, 20 bp, Artificial Sequence
  chemically synthesized
atgtagagaagtggttcaag

SEQ ID NO: 205141 - DNA, 20 bp, Artificial Sequence
  chemically synthesized
aaaatgtagagaagtggttc

SEQ ID NO: 205142 - DNA, 20 bp, Artificial Sequence
  chemically synthesized
agaaaaaaaatgtagagaag

SEQ ID NO: 205143 - DNA, 20 bp, Artificial Sequence
  chemically synthesized
ttcagaaaaaaaatgtagag

SEQ ID NO: 205144 - DNA, 20 bp, Artificial Sequence
  chemically synthesized
cctttcagaaaaaaaatgta

SEQ ID NO: 205145 - DNA, 20 bp, Artificial Sequence
  chemically synthesized
aacctttcagaaaaaaaatg

SEQ ID NO: 205146 - DNA, 20 bp, Artificial Sequence
  chemically synthesized
tctctacattttttttctga

SEQ ID NO: 205147 - DNA, 20 bp, Artificial Sequence
  chemically synthesized
ctctacattttttttctgaa

SEQ ID NO: 205148 - DNA, 20 bp, Artificial Sequence
  chemically synthesized
acattttttttctgaaaggt

SEQ ID NO: 205149 - DNA, 20 bp, Artificial Sequence
  chemically synthesized
ctcattgagctctaaccttt

SEQ ID NO: 205150 - DNA, 20 bp, Artificial Sequence
  chemically synthesized
attttttttctgaaaggtta

SEQ ID NO: 205151 - DNA, 20 bp, Artificial Sequence
  chemically synthesized
ctgaaaggttagagctcaat

SEQ ID NO: 205152 - DNA, 20 bp, Artificial Sequence
  chemically synthesized
ctggggttatggttctcatt

SEQ ID NO: 205153 - DNA, 20 bp, Artificial Sequence
  chemically synthesized
ctcaatgagaaccataaccc

SEQ ID NO: 205154 - DNA, 20 bp, Artificial Sequence
  chemically synthesized
tcaatgagaaccataacccc

SEQ ID NO: 205155 - DNA, 20 bp, Artificial Sequence
  chemically synthesized
tctgccctggcctggggtta

SEQ ID NO: 205156 - DNA, 20 bp, Artificial Sequence
  chemically synthesized
tgagaaccataaccccaggc

SEQ ID NO: 205157 - DNA, 20 bp, Artificial Sequence
  chemically synthesized
gagaaccataaccccaggcc

SEQ ID NO: 205158 - DNA, 20 bp, Artificial Sequence
  chemically synthesized
agaaccataaccccaggcca

SEQ ID NO: 205159 - DNA, 20 bp, Artificial Sequence
  chemically synthesized
ctttactctgccctggcctg

SEQ ID NO: 205160 - DNA, 20 bp, Artificial Sequence
  chemically synthesized
tctttactctgccctggcct

SEQ ID NO: 205161 - DNA, 20 bp, Artificial Sequence
  chemically synthesized
ttctttactctgccctggcc

SEQ ID NO: 205162 - DNA, 20 bp, Artificial Sequence
  chemically synthesized
accataaccccaggccaggg

SEQ ID NO: 205163 - DNA, 20 bp, Artificial Sequence
  chemically synthesized
cataaccccaggccagggca

SEQ ID NO: 205164 - DNA, 20 bp, Artificial Sequence
  chemically synthesized
tatctttctttactctgccc

SEQ ID NO: 205165 - DNA, 20 bp, Artificial Sequence
  chemically synthesized
ccccaggccagggcagagta

SEQ ID NO: 205166 - DNA, 20 bp, Artificial Sequence
  chemically synthesized
aggccagggcagagtaaaga

SEQ ID NO: 205167 - DNA, 20 bp, Artificial Sequence
  chemically synthesized
aagaaagatatacaattctt

SEQ ID NO: 205168 - DNA, 20 bp, Artificial Sequence
  chemically synthesized
atatacaattcttcagatct

SEQ ID NO: 205169 - DNA, 20 bp, Artificial Sequence
  chemically synthesized
taaacaactgcttagatctg

SEQ ID NO: 205170 - DNA, 20 bp, Artificial Sequence
  chemically synthesized
tacaattcttcagatctaag

SEQ ID NO: 205171 - DNA, 20 bp, Artificial Sequence
  chemically synthesized
ggtatccataaacaactgct

SEQ ID NO: 205172 - DNA, 20 bp, Artificial Sequence
  chemically synthesized
cagatctaagcagttgttta

SEQ ID NO: 205173 - DNA, 20 bp, Artificial Sequence
  chemically synthesized
gtaatattacaatcattttg

SEQ ID NO: 205174 - DNA, 20 bp, Artificial Sequence
  chemically synthesized
ggtaatattacaatcatttt

SEQ ID NO: 205175 - DNA, 20 bp, Artificial Sequence
  chemically synthesized
gtcttttcttttaggtatgt

SEQ ID NO: 205176 - DNA, 20 bp, Artificial Sequence
  chemically synthesized
aatattaccaacatacctaa

SEQ ID NO: 205177 - DNA, 20 bp, Artificial Sequence
  chemically synthesized
taccaacatacctaaaagaa

SEQ ID NO: 205178 - DNA, 20 bp, Artificial Sequence
  chemically synthesized
acccacctgtcttttctttt

SEQ ID NO: 205179 - DNA, 20 bp, Artificial Sequence
  chemically synthesized
gacccacctgtcttttcttt

SEQ ID NO: 205180 - DNA, 20 bp, Artificial Sequence
  chemically synthesized
aacatacctaaaagaaaaga

SEQ ID NO: 205181 - DNA, 20 bp, Artificial Sequence
  chemically synthesized
acatacctaaaagaaaagac

SEQ ID NO: 205182 - DNA, 20 bp, Artificial Sequence
  chemically synthesized
tacctaaaagaaaagacagg

SEQ ID NO: 205183 - DNA, 20 bp, Artificial Sequence
  chemically synthesized
acctaaaagaaaagacaggt

SEQ ID NO: 205184 - DNA, 20 bp, Artificial Sequence
  chemically synthesized
aaaagaaaagacaggtgggt

SEQ ID NO: 205185 - DNA, 20 bp, Artificial Sequence
  chemically synthesized
aaagaaaagacaggtgggtc

SEQ ID NO: 205186 - DNA, 20 bp, Artificial Sequence
  chemically synthesized
aaaagacaggtgggtcaggc

SEQ ID NO: 205187 - DNA, 20 bp, Artificial Sequence
  chemically synthesized
tgtaggaagtaaacatgtac

SEQ ID NO: 205188 - DNA, 20 bp, Artificial Sequence
  chemically synthesized
caaaatgctttcagtgtagg

SEQ ID NO: 205189 - DNA, 20 bp, Artificial Sequence
  chemically synthesized
atgtttacttcctacactga

SEQ ID NO: 205190 - DNA, 20 bp, Artificial Sequence
  chemically synthesized
aatcaaaatgctttcagtgt

SEQ ID NO: 205191 - DNA, 20 bp, Artificial Sequence
  chemically synthesized
caatcaaaatgctttcagtg

SEQ ID NO: 205192 - DNA, 20 bp, Artificial Sequence
  chemically synthesized
agcatcaatcaaaatgcttt

SEQ ID NO: 205193 - DNA, 20 bp, Artificial Sequence
  chemically synthesized
aaaatttggaagagtcagaa

SEQ ID NO: 205194 - DNA, 20 bp, Artificial Sequence
  chemically synthesized
ccattaaaatttggaagagt

SEQ ID NO: 205195 - DNA, 20 bp, Artificial Sequence
  chemically synthesized
ggagccattaaaatttggaa

SEQ ID NO: 205196 - DNA, 20 bp, Artificial Sequence
  chemically synthesized
caggagccattaaaatttgg

SEQ ID NO: 205197 - DNA, 20 bp, Artificial Sequence
  chemically synthesized
taacaggagccattaaaatt

SEQ ID NO: 205198 - DNA, 20 bp, Artificial Sequence
  chemically synthesized
ctgactcttccaaattttaa

SEQ ID NO: 205199 - DNA, 20 bp, Artificial Sequence
  chemically synthesized
caggtgaaattggttaacag

SEQ ID NO: 205200 - DNA, 20 bp, Artificial Sequence
  chemically synthesized
tgcaggtgaaattggttaac

SEQ ID NO: 205201 - DNA, 20 bp, Artificial Sequence
  chemically synthesized
gtgcaggtgaaattggttaa

SEQ ID NO: 205202 - DNA, 20 bp, Artificial Sequence
  chemically synthesized
gcccagtgtgcaggtgaaat

SEQ ID NO: 205203 - DNA, 20 bp, Artificial Sequence
  chemically synthesized
aaccaatttcacctgcacac

SEQ ID NO: 205204 - DNA, 20 bp, Artificial Sequence
  chemically synthesized
accaatttcacctgcacact

SEQ ID NO: 205205 - DNA, 20 bp, Artificial Sequence
  chemically synthesized
ggaatacgagcccagtgtgc

SEQ ID NO: 205206 - DNA, 20 bp, Artificial Sequence
  chemically synthesized
aggaatacgagcccagtgtg

SEQ ID NO: 205207 - DNA, 20 bp, Artificial Sequence
  chemically synthesized
tgagatgaggaatacgagcc

SEQ ID NO: 205208 - DNA, 20 bp, Artificial Sequence
  chemically synthesized
ccagctgagatgaggaatac

SEQ ID NO: 205209 - DNA, 20 bp, Artificial Sequence
  chemically synthesized
tgggctcgtattcctcatct

SEQ ID NO: 205210 - DNA, 20 bp, Artificial Sequence
  chemically synthesized
atttcttaccagctgagatg

SEQ ID NO: 205211 - DNA, 20 bp, Artificial Sequence
  chemically synthesized
aatttcttaccagctgagat

SEQ ID NO: 205212 - DNA, 20 bp, Artificial Sequence
  chemically synthesized
ctcgtattcctcatctcagc

SEQ ID NO: 205213 - DNA, 20 bp, Artificial Sequence
  chemically synthesized
tattcctcatctcagctggt

SEQ ID NO: 205214 - DNA, 20 bp, Artificial Sequence
  chemically synthesized
actttaatttcttaccagct

SEQ ID NO: 205215 - DNA, 20 bp, Artificial Sequence
  chemically synthesized
gagacactttaatttcttac

SEQ ID NO: 205216 - DNA, 20 bp, Artificial Sequence
  chemically synthesized
tctcagctggtaagaaatta

SEQ ID NO: 205217 - DNA, 20 bp, Artificial Sequence
  chemically synthesized
ggtaagaaattaaagtgtct

SEQ ID NO: 205218 - DNA, 20 bp, Artificial Sequence
  chemically synthesized
tagtttcttgtcatcgtact

SEQ ID NO: 205219 - DNA, 20 bp, Artificial Sequence
  chemically synthesized
aagtgtctcagtacgatgac

SEQ ID NO: 205220 - DNA, 20 bp, Artificial Sequence
  chemically synthesized
tacgatgacaagaaactact

SEQ ID NO: 205221 - DNA, 20 bp, Artificial Sequence
  chemically synthesized
gatgacaagaaactactgag

SEQ ID NO: 205222 - DNA, 20 bp, Artificial Sequence
  chemically synthesized
atgacaagaaactactgagc

SEQ ID NO: 205223 - DNA, 20 bp, Artificial Sequence
  chemically synthesized
acgatgaatggcctgctcag

SEQ ID NO: 205224 - DNA, 20 bp, Artificial Sequence
  chemically synthesized
agaacgatgaatggcctgct

SEQ ID NO: 205225 - DNA, 20 bp, Artificial Sequence
  chemically synthesized
actgttttcagaacgatgaa

SEQ ID NO: 205226 - DNA, 20 bp, Artificial Sequence
  chemically synthesized
gccattcatcgttctgaaaa

SEQ ID NO: 205227 - DNA, 20 bp, Artificial Sequence
  chemically synthesized
tagctgtttcatactgtttt

SEQ ID NO: 205228 - DNA, 20 bp, Artificial Sequence
  chemically synthesized
gttctgaaaacagtatgaaa

SEQ ID NO: 205229 - DNA, 20 bp, Artificial Sequence
  chemically synthesized
aatttatagaggtatgatga

SEQ ID NO: 205230 - DNA, 20 bp, Artificial Sequence
  chemically synthesized
aataacattttaatttatag

SEQ ID NO: 205231 - DNA, 20 bp, Artificial Sequence
  chemically synthesized
aaataacattttaatttata

SEQ ID NO: 205232 - DNA, 20 bp, Artificial Sequence
  chemically synthesized
gaaaataacattttaattta

SEQ ID NO: 205233 - DNA, 20 bp, Artificial Sequence
  chemically synthesized
aaaatgttattttctttcta

SEQ ID NO: 205234 - DNA, 20 bp, Artificial Sequence
  chemically synthesized
agtcagagcacaactgtaga

SEQ ID NO: 205235 - DNA, 20 bp, Artificial Sequence
  chemically synthesized
ttgtagtcagagcacaactg

SEQ ID NO: 205236 - DNA, 20 bp, Artificial Sequence
  chemically synthesized
tacagttgtgctctgactac

SEQ ID NO: 205237 - DNA, 20 bp, Artificial Sequence
  chemically synthesized
ggccgatatgcttgtagtca

SEQ ID NO: 205238 - DNA, 20 bp, Artificial Sequence
  chemically synthesized
atggccgatatgcttgtagt

SEQ ID NO: 205239 - DNA, 20 bp, Artificial Sequence
  chemically synthesized
aggaatggccgatatgcttg

SEQ ID NO: 205240 - DNA, 20 bp, Artificial Sequence
  chemically synthesized
tgctctgactacaagcatat

SEQ ID NO: 205241 - DNA, 20 bp, Artificial Sequence
  chemically synthesized
acaagcatatcggccattcc

SEQ ID NO: 205242 - DNA, 20 bp, Artificial Sequence
  chemically synthesized
agcatatcggccattcctgg

SEQ ID NO: 205243 - DNA, 20 bp, Artificial Sequence
  chemically synthesized
gaactggaccccaccaggaa

SEQ ID NO: 205244 - DNA, 20 bp, Artificial Sequence
  chemically synthesized
gcatatcggccattcctggt

SEQ ID NO: 205245 - DNA, 20 bp, Artificial Sequence
  chemically synthesized
catatcggccattcctggtg

SEQ ID NO: 205246 - DNA, 20 bp, Artificial Sequence
  chemically synthesized
ataatgaactggaccccacc

SEQ ID NO: 205247 - DNA, 20 bp, Artificial Sequence
  chemically synthesized
aataatgaactggaccccac

SEQ ID NO: 205248 - DNA, 20 bp, Artificial Sequence
  chemically synthesized
cggccattcctggtggggtc

SEQ ID NO: 205249 - DNA, 20 bp, Artificial Sequence
  chemically synthesized
cgtctactgaaataatgaac

SEQ ID NO: 205250 - DNA, 20 bp, Artificial Sequence
  chemically synthesized
tggggtccagttcattattt

SEQ ID NO: 205251 - DNA, 20 bp, Artificial Sequence
  chemically synthesized
ggtccagttcattatttcag

SEQ ID NO: 205252 - DNA, 20 bp, Artificial Sequence
  chemically synthesized
cagtagacgtaaataatttt

SEQ ID NO: 205253 - DNA, 20 bp, Artificial Sequence
  chemically synthesized
gacgtaaataatttttagca

SEQ ID NO: 205254 - DNA, 20 bp, Artificial Sequence
  chemically synthesized
acgtaaataatttttagcac

SEQ ID NO: 205255 - DNA, 20 bp, Artificial Sequence
  chemically synthesized
ttagcacaggtatttgaaat

SEQ ID NO: 205256 - DNA, 20 bp, Artificial Sequence
  chemically synthesized
gcacaggtatttgaaattag

SEQ ID NO: 205257 - DNA, 20 bp, Artificial Sequence
  chemically synthesized
cacaggtatttgaaattaga

SEQ ID NO: 205258 - DNA, 20 bp, Artificial Sequence
  chemically synthesized
tttgaaattagaaggcgatt

SEQ ID NO: 205259 - DNA, 20 bp, Artificial Sequence
  chemically synthesized
attagaaggcgattcagcat

SEQ ID NO: 205260 - DNA, 20 bp, Artificial Sequence
  chemically synthesized
ggcgattcagcattggaatt

SEQ ID NO: 205261 - DNA, 20 bp, Artificial Sequence
  chemically synthesized
caaggttataagcagtggtg

SEQ ID NO: 205262 - DNA, 20 bp, Artificial Sequence
  chemically synthesized
aattccaaggttataagcag

SEQ ID NO: 205263 - DNA, 20 bp, Artificial Sequence
  chemically synthesized
cttaattccaaggttataag

SEQ ID NO: 205264 - DNA, 20 bp, Artificial Sequence
  chemically synthesized
cacaccactgcttataacct

SEQ ID NO: 205265 - DNA, 20 bp, Artificial Sequence
  chemically synthesized
tttcttaattccaaggttat

SEQ ID NO: 205266 - DNA, 20 bp, Artificial Sequence
  chemically synthesized
ctgcttataaccttggaatt

SEQ ID NO: 205267 - DNA, 20 bp, Artificial Sequence
  chemically synthesized
ctccacatttcttaattcca

SEQ ID NO: 205268 - DNA, 20 bp, Artificial Sequence
  chemically synthesized
cctccacatttcttaattcc

SEQ ID NO: 205269 - DNA, 20 bp, Artificial Sequence
  chemically synthesized
aaccttggaattaagaaatg

SEQ ID NO: 205270 - DNA, 20 bp, Artificial Sequence
  chemically synthesized
ccttggaattaagaaatgtg

SEQ ID NO: 205271 - DNA, 20 bp, Artificial Sequence
  chemically synthesized
cttggaattaagaaatgtgg

SEQ ID NO: 205272 - DNA, 20 bp, Artificial Sequence
  chemically synthesized
gaaatgaccccagggaacaa

SEQ ID NO: 205273 - DNA, 20 bp, Artificial Sequence
  chemically synthesized
gtggaggtgccattgttccc

SEQ ID NO: 205274 - DNA, 20 bp, Artificial Sequence
  chemically synthesized
tggaggtgccattgttccct

SEQ ID NO: 205275 - DNA, 20 bp, Artificial Sequence
  chemically synthesized
ggaggtgccattgttccctg

SEQ ID NO: 205276 - DNA, 20 bp, Artificial Sequence
  chemically synthesized
gaatgatggaaatgacccca

SEQ ID NO: 205277 - DNA, 20 bp, Artificial Sequence
  chemically synthesized
agaatgatggaaatgacccc

SEQ ID NO: 205278 - DNA, 20 bp, Artificial Sequence
  chemically synthesized
cagaatgatggaaatgaccc

SEQ ID NO: 205279 - DNA, 20 bp, Artificial Sequence
  chemically synthesized
aaagacctattacagaatga

SEQ ID NO: 205280 - DNA, 20 bp, Artificial Sequence
  chemically synthesized
tcatttccatcattctgtaa

SEQ ID NO: 205281 - DNA, 20 bp, Artificial Sequence
  chemically synthesized
catttccatcattctgtaat

SEQ ID NO: 205282 - DNA, 20 bp, Artificial Sequence
  chemically synthesized
caaaaacaaaagacctatta

SEQ ID NO: 205283 - DNA, 20 bp, Artificial Sequence
  chemically synthesized
aacagtcccaacaaaaacaa

SEQ ID NO: 205284 - DNA, 20 bp, Artificial Sequence
  chemically synthesized
aataggtcttttgtttttgt

SEQ ID NO: 205285 - DNA, 20 bp, Artificial Sequence
  chemically synthesized
ataggtcttttgtttttgtt

SEQ ID NO: 205286 - DNA, 20 bp, Artificial Sequence
  chemically synthesized
accaaaggtggcaaatacaa

SEQ ID NO: 205287 - DNA, 20 bp, Artificial Sequence
  chemically synthesized
actgttgtatttgccacctt

SEQ ID NO: 205288 - DNA, 20 bp, Artificial Sequence
  chemically synthesized
cagattcatttgaccaaagg

SEQ ID NO: 205289 - DNA, 20 bp, Artificial Sequence
  chemically synthesized
tttcagattcatttgaccaa

SEQ ID NO: 205290 - DNA, 20 bp, Artificial Sequence
  chemically synthesized
gtttcagattcatttgacca

SEQ ID NO: 205291 - DNA, 20 bp, Artificial Sequence
  chemically synthesized
ctctagctatagaattgttt

SEQ ID NO: 205292 - DNA, 20 bp, Artificial Sequence
  chemically synthesized
atgaatctgaaacaattcta

SEQ ID NO: 205293 - DNA, 20 bp, Artificial Sequence
  chemically synthesized
atctgaaacaattctatagc

SEQ ID NO: 205294 - DNA, 20 bp, Artificial Sequence
  chemically synthesized
ctgaaacaattctatagcta

SEQ ID NO: 205295 - DNA, 20 bp, Artificial Sequence
  chemically synthesized
tcgtggtgttgctctagcta

SEQ ID NO: 205296 - DNA, 20 bp, Artificial Sequence
  chemically synthesized
aatctttcgtggtgttgctc

SEQ ID NO: 205297 - DNA, 20 bp, Artificial Sequence
  chemically synthesized
tagctagagcaacaccacga

SEQ ID NO: 205298 - DNA, 20 bp, Artificial Sequence
  chemically synthesized
agtgacaaaacaatctttcg

SEQ ID NO: 205299 - DNA, 20 bp, Artificial Sequence
  chemically synthesized
tgttttgtcactaaaatgat

SEQ ID NO: 205300 - DNA, 20 bp, Artificial Sequence
  chemically synthesized
tcctttctagctcatcattt

SEQ ID NO: 205301 - DNA, 20 bp, Artificial Sequence
  chemically synthesized
ttgtcactaaaatgatgagc

SEQ ID NO: 205302 - DNA, 20 bp, Artificial Sequence
  chemically synthesized
cactaaaatgatgagctaga

SEQ ID NO: 205303 - DNA, 20 bp, Artificial Sequence
  chemically synthesized
actaaaatgatgagctagaa

SEQ ID NO: 205304 - DNA, 20 bp, Artificial Sequence
  chemically synthesized
tttcctatgcgtttcctttc

SEQ ID NO: 205305 - DNA, 20 bp, Artificial Sequence
  chemically synthesized
tgagctagaaaggaaacgca

SEQ ID NO: 205306 - DNA, 20 bp, Artificial Sequence
  chemically synthesized
gagctagaaaggaaacgcat

SEQ ID NO: 205307 - DNA, 20 bp, Artificial Sequence
  chemically synthesized
acgcataggaaaaacatgct

SEQ ID NO: 205308 - DNA, 20 bp, Artificial Sequence
  chemically synthesized
ttcttagctataggaaggct

SEQ ID NO: 205309 - DNA, 20 bp, Artificial Sequence
  chemically synthesized
aaacatgctcagccttccta

SEQ ID NO: 205310 - DNA, 20 bp, Artificial Sequence
  chemically synthesized
ttggtttcttagctatagga

SEQ ID NO: 205311 - DNA, 20 bp, Artificial Sequence
  chemically synthesized
attggtttcttagctatagg

SEQ ID NO: 205312 - DNA, 20 bp, Artificial Sequence
  chemically synthesized
tgctcagccttcctatagct

SEQ ID NO: 205313 - DNA, 20 bp, Artificial Sequence
  chemically synthesized
tacattggtttcttagctat

SEQ ID NO: 205314 - DNA, 20 bp, Artificial Sequence
  chemically synthesized
gtacattggtttcttagcta

SEQ ID NO: 205315 - DNA, 20 bp, Artificial Sequence
  chemically synthesized
gcctccgtacattggtttct

SEQ ID NO: 205316 - DNA, 20 bp, Artificial Sequence
  chemically synthesized
atagctaagaaaccaatgta

SEQ ID NO: 205317 - DNA, 20 bp, Artificial Sequence
  chemically synthesized
agctaagaaaccaatgtacg

SEQ ID NO: 205318 - DNA, 20 bp, Artificial Sequence
  chemically synthesized
ctcttctggcctccgtacat

SEQ ID NO: 205319 - DNA, 20 bp, Artificial Sequence
  chemically synthesized
gctaagaaaccaatgtacgg

SEQ ID NO: 205320 - DNA, 20 bp, Artificial Sequence
  chemically synthesized
agaaaccaatgtacggaggc

SEQ ID NO: 205321 - DNA, 20 bp, Artificial Sequence
  chemically synthesized
aaccaatgtacggaggccag

SEQ ID NO: 205322 - DNA, 20 bp, Artificial Sequence
  chemically synthesized
ccaatgtacggaggccagaa

SEQ ID NO: 205323 - DNA, 20 bp, Artificial Sequence
  chemically synthesized
atgtacggaggccagaagag

SEQ ID NO: 205324 - DNA, 20 bp, Artificial Sequence
  chemically synthesized
aagaacttgaactactcttc

SEQ ID NO: 205325 - DNA, 20 bp, Artificial Sequence
  chemically synthesized
ggaggccagaagagtagttc

SEQ ID NO: 205326 - DNA, 20 bp, Artificial Sequence
  chemically synthesized
gaagagtagttcaagttctt

SEQ ID NO: 205327 - DNA, 20 bp, Artificial Sequence
  chemically synthesized
gagtagttcaagttcttcag

SEQ ID NO: 205328 - DNA, 20 bp, Artificial Sequence
  chemically synthesized
aaagagttcatgtgcttctg

SEQ ID NO: 205329 - DNA, 20 bp, Artificial Sequence
  chemically synthesized
ctgtaatttattagaataaa

SEQ ID NO: 205330 - DNA, 20 bp, Artificial Sequence
  chemically synthesized
ctctgtaatttattagaata

SEQ ID NO: 205331 - DNA, 20 bp, Artificial Sequence
  chemically synthesized
atgtggactctgtaatttat

SEQ ID NO: 205332 - DNA, 20 bp, Artificial Sequence
  chemically synthesized
ctctttattctaataaatta

SEQ ID NO: 205333 - DNA, 20 bp, Artificial Sequence
  chemically synthesized
ctttattctaataaattaca

SEQ ID NO: 205334 - DNA, 20 bp, Artificial Sequence
  chemically synthesized
taaattacagagtccacatg

SEQ ID NO: 205335 - DNA, 20 bp, Artificial Sequence
  chemically synthesized
aaattacagagtccacatgt

SEQ ID NO: 205336 - DNA, 20 bp, Artificial Sequence
  chemically synthesized
attacagagtccacatgtgg

SEQ ID NO: 205337 - DNA, 20 bp, Artificial Sequence
  chemically synthesized
agtgaagcatctcccacatg

SEQ ID NO: 205338 - DNA, 20 bp, Artificial Sequence
  chemically synthesized
gtgggagatgcttcactatt

SEQ ID NO: 205339 - DNA, 20 bp, Artificial Sequence
  chemically synthesized
aatgatttcactaaatagtg

SEQ ID NO: 205340 - DNA, 20 bp, Artificial Sequence
  chemically synthesized
cgtgaaatgatttcactaaa

SEQ ID NO: 205341 - DNA, 20 bp, Artificial Sequence
  chemically synthesized
tatttagtgaaatcatttca

SEQ ID NO: 205342 - DNA, 20 bp, Artificial Sequence
  chemically synthesized
aatcatttcacggaataata

SEQ ID NO: 205343 - DNA, 20 bp, Artificial Sequence
  chemically synthesized
agacctggagaaatcagcat

SEQ ID NO: 205344 - DNA, 20 bp, Artificial Sequence
  chemically synthesized
gtttctcatgctgatttctc

SEQ ID NO: 205345 - DNA, 20 bp, Artificial Sequence
  chemically synthesized
tttctaagacctggagaaat

SEQ ID NO: 205346 - DNA, 20 bp, Artificial Sequence
  chemically synthesized
tttctcatgctgatttctcc

SEQ ID NO: 205347 - DNA, 20 bp, Artificial Sequence
  chemically synthesized
atgctgatttctccaggtct

SEQ ID NO: 205348 - DNA, 20 bp, Artificial Sequence
  chemically synthesized
cctcagatttctaagacctg

SEQ ID NO: 205349 - DNA, 20 bp, Artificial Sequence
  chemically synthesized
cacctcagatttctaagacc

SEQ ID NO: 205350 - DNA, 20 bp, Artificial Sequence
  chemically synthesized
aactgacacctcagatttct

SEQ ID NO: 205351 - DNA, 20 bp, Artificial Sequence
  chemically synthesized
tctccaggtcttagaaatct

SEQ ID NO: 205352 - DNA, 20 bp, Artificial Sequence
  chemically synthesized
ctccaggtcttagaaatctg

SEQ ID NO: 205353 - DNA, 20 bp, Artificial Sequence
  chemically synthesized
gtcttagaaatctgaggtgt

SEQ ID NO: 205354 - DNA, 20 bp, Artificial Sequence
  chemically synthesized
agattttaaaactgacacct

SEQ ID NO: 205355 - DNA, 20 bp, Artificial Sequence
  chemically synthesized
gtgtcagttttaaaatctcc

SEQ ID NO: 205356 - DNA, 20 bp, Artificial Sequence
  chemically synthesized
tgtgtacacatattttccag

SEQ ID NO: 205357 - DNA, 20 bp, Artificial Sequence
  chemically synthesized
tatgtgtacacatattttcc

SEQ ID NO: 205358 - DNA, 20 bp, Artificial Sequence
  chemically synthesized
atatgtgtacacatattttc

SEQ ID NO: 205359 - DNA, 20 bp, Artificial Sequence
  chemically synthesized
aaaatatgtgtacacatatt

SEQ ID NO: 205360 - DNA, 20 bp, Artificial Sequence
  chemically synthesized
aaatatgtgtacacatattc

SEQ ID NO: 205361 - DNA, 20 bp, Artificial Sequence
  chemically synthesized
aatatgtgtacacatattca

SEQ ID NO: 205362 - DNA, 20 bp, Artificial Sequence
  chemically synthesized
tacacatattcagggtcatt

SEQ ID NO: 205363 - DNA, 20 bp, Artificial Sequence
  chemically synthesized
atcagctatcagtttcagtt

SEQ ID NO: 205364 - DNA, 20 bp, Artificial Sequence
  chemically synthesized
ttcagctcaactgaaactga

SEQ ID NO: 205365 - DNA, 20 bp, Artificial Sequence
  chemically synthesized
ctgtaatcagctatcagttt

SEQ ID NO: 205366 - DNA, 20 bp, Artificial Sequence
  chemically synthesized
ggaacactgtaatcagctat

SEQ ID NO: 205367 - DNA, 20 bp, Artificial Sequence
  chemically synthesized
ctgaaactgatagctgatta

SEQ ID NO: 205368 - DNA, 20 bp, Artificial Sequence
  chemically synthesized
caaagcaggaacactgtaat

SEQ ID NO: 205369 - DNA, 20 bp, Artificial Sequence
  chemically synthesized
cttataaatatcaacaaagc

SEQ ID NO: 205370 - DNA, 20 bp, Artificial Sequence
  chemically synthesized
ccttataaatatcaacaaag

SEQ ID NO: 205371 - DNA, 20 bp, Artificial Sequence
  chemically synthesized
agaccttataaatatcaaca

SEQ ID NO: 205372 - DNA, 20 bp, Artificial Sequence
  chemically synthesized
cctgctttgttgatatttat

SEQ ID NO: 205373 - DNA, 20 bp, Artificial Sequence
  chemically synthesized
ctgctttgttgatatttata

SEQ ID NO: 205374 - DNA, 20 bp, Artificial Sequence
  chemically synthesized
ttgttgatatttataaggtc

SEQ ID NO: 205375 - DNA, 20 bp, Artificial Sequence
  chemically synthesized
ataactgcttgatacgaagc

SEQ ID NO: 205376 - DNA, 20 bp, Artificial Sequence
  chemically synthesized
ataaggtctggcttcgtatc

SEQ ID NO: 205377 - DNA, 20 bp, Artificial Sequence
  chemically synthesized
ttacataactgcttgatacg

SEQ ID NO: 205378 - DNA, 20 bp, Artificial Sequence
  chemically synthesized
aggtctggcttcgtatcaag

SEQ ID NO: 205379 - DNA, 20 bp, Artificial Sequence
  chemically synthesized
tcgtatcaagcagttatgta

SEQ ID NO: 205380 - DNA, 20 bp, Artificial Sequence
  chemically synthesized
aagcagttatgtaaagtgta

SEQ ID NO: 205381 - DNA, 20 bp, Artificial Sequence
  chemically synthesized
ttatgtaaagtgtaaagaat

SEQ ID NO: 205382 - DNA, 20 bp, Artificial Sequence
  chemically synthesized
gtaaagtgtaaagaattggt

SEQ ID NO: 205383 - DNA, 20 bp, Artificial Sequence
  chemically synthesized
acattatgcaccctccatga

SEQ ID NO: 205384 - DNA, 20 bp, Artificial Sequence
  chemically synthesized
atttggtcttctttcatgga

SEQ ID NO: 205385 - DNA, 20 bp, Artificial Sequence
  chemically synthesized
catttggtcttctttcatgg

SEQ ID NO: 205386 - DNA, 20 bp, Artificial Sequence
  chemically synthesized
tcatttggtcttctttcatg

SEQ ID NO: 205387 - DNA, 20 bp, Artificial Sequence
  chemically synthesized
ttatgcaccctccatgaaag

SEQ ID NO: 205388 - DNA, 20 bp, Artificial Sequence
  chemically synthesized
tgtcatttggtcttctttca

SEQ ID NO: 205389 - DNA, 20 bp, Artificial Sequence
  chemically synthesized
tcatacaattggttgtcatt

SEQ ID NO: 205390 - DNA, 20 bp, Artificial Sequence
  chemically synthesized
ttaacatttcttcatacaat

SEQ ID NO: 205391 - DNA, 20 bp, Artificial Sequence
  chemically synthesized
aaatgacaaccaattgtatg

SEQ ID NO: 205392 - DNA, 20 bp, Artificial Sequence
  chemically synthesized
gaagaaatgttaaacacaat

SEQ ID NO: 205393 - DNA, 20 bp, Artificial Sequence
  chemically synthesized
aatgttaaacacaattagaa

SEQ ID NO: 205394 - DNA, 20 bp, Artificial Sequence
  chemically synthesized
gttaaacacaattagaatgg

SEQ ID NO: 205395 - DNA, 20 bp, Artificial Sequence
  chemically synthesized
caattagaatggaagaaaac

SEQ ID NO: 205396 - DNA, 20 bp, Artificial Sequence
  chemically synthesized
ttagaatggaagaaaacaag

SEQ ID NO: 205397 - DNA, 20 bp, Artificial Sequence
  chemically synthesized
atggaagaaaacaagtagat

SEQ ID NO: 205398 - DNA, 20 bp, Artificial Sequence
  chemically synthesized
tggaagaaaacaagtagatg

SEQ ID NO: 205399 - DNA, 20 bp, Artificial Sequence
  chemically synthesized
gaagaaaacaagtagatgag

SEQ ID NO: 205400 - DNA, 20 bp, Artificial Sequence
  chemically synthesized
aaaacaagtagatgaggagt

SEQ ID NO: 205401 - DNA, 20 bp, Artificial Sequence
  chemically synthesized
ggagttagtgaatgctacct

SEQ ID NO: 205402 - DNA, 20 bp, Artificial Sequence
  chemically synthesized
ttaatatctgtattcttagg

SEQ ID NO: 205403 - DNA, 20 bp, Artificial Sequence
  chemically synthesized
gtgaatgctacctaagaata

SEQ ID NO: 205404 - DNA, 20 bp, Artificial Sequence
  chemically synthesized
aggttaatatctgtattctt

SEQ ID NO: 205405 - DNA, 20 bp, Artificial Sequence
  chemically synthesized
taggttaatatctgtattct

SEQ ID NO: 205406 - DNA, 20 bp, Artificial Sequence
  chemically synthesized
taagaatacagatattaacc

SEQ ID NO: 205407 - DNA, 20 bp, Artificial Sequence
  chemically synthesized
ttattcaagaacatatttct

SEQ ID NO: 205408 - DNA, 20 bp, Artificial Sequence
  chemically synthesized
attattcaagaacatatttc

SEQ ID NO: 205409 - DNA, 20 bp, Artificial Sequence
  chemically synthesized
ctcttgtcacgtaattattc

SEQ ID NO: 205410 - DNA, 20 bp, Artificial Sequence
  chemically synthesized
ttcttgaataattacgtgac

SEQ ID NO: 205411 - DNA, 20 bp, Artificial Sequence
  chemically synthesized
cttgaataattacgtgacaa

SEQ ID NO: 205412 - DNA, 20 bp, Artificial Sequence
  chemically synthesized
aataattacgtgacaagagc

SEQ ID NO: 205413 - DNA, 20 bp, Artificial Sequence
  chemically synthesized
tacgtgacaagagctagaca

SEQ ID NO: 205414 - DNA, 20 bp, Artificial Sequence
  chemically synthesized
tgatatatttattctgtgtc

SEQ ID NO: 205415 - DNA, 20 bp, Artificial Sequence
  chemically synthesized
taatttcatttctattttaa

SEQ ID NO: 205416 - DNA, 20 bp, Artificial Sequence
  chemically synthesized
aatttcatttctattttaaa

SEQ ID NO: 205417 - DNA, 20 bp, Artificial Sequence
  chemically synthesized
tataaactttccttttaaaa

SEQ ID NO: 205418 - DNA, 20 bp, Artificial Sequence
  chemically synthesized
tcatttctattttaaaagga

SEQ ID NO: 205419 - DNA, 20 bp, Artificial Sequence
  chemically synthesized
tttaatatatataacatata

SEQ ID NO: 205420 - DNA, 20 bp, Artificial Sequence
  chemically synthesized
aaaacacgttcatatgaata

SEQ ID NO: 205421 - DNA, 20 bp, Artificial Sequence
  chemically synthesized
gtgaatcatccattcacatc

SEQ ID NO: 205422 - DNA, 20 bp, Artificial Sequence
  chemically synthesized
gataaatgtcttgatgtgaa

SEQ ID NO: 205423 - DNA, 20 bp, Artificial Sequence
  chemically synthesized
gatgattcacatgaacactt

SEQ ID NO: 205424 - DNA, 20 bp, Artificial Sequence
  chemically synthesized
attcacatgaacacttaaga

SEQ ID NO: 205425 - DNA, 20 bp, Artificial Sequence
  chemically synthesized
ttgccccatttaactttctt

SEQ ID NO: 205426 - DNA, 20 bp, Artificial Sequence
  chemically synthesized
gaacacttaagaaagttaaa

SEQ ID NO: 205427 - DNA, 20 bp, Artificial Sequence
  chemically synthesized
aacacttaagaaagttaaat

SEQ ID NO: 205428 - DNA, 20 bp, Artificial Sequence
  chemically synthesized
acacttaagaaagttaaatg

SEQ ID NO: 205429 - DNA, 20 bp, Artificial Sequence
  chemically synthesized
ttaagaaagttaaatggggc

SEQ ID NO: 205430 - DNA, 20 bp, Artificial Sequence
  chemically synthesized
taagaaagttaaatggggca

SEQ ID NO: 205431 - DNA, 20 bp, Artificial Sequence
  chemically synthesized
gaaagttaaatggggcaagg

SEQ ID NO: 205432 - DNA, 20 bp, Artificial Sequence
  chemically synthesized
ggggcaaggcagaaatgtat

SEQ ID NO: 205433 - DNA, 20 bp, Artificial Sequence
  chemically synthesized
taaaaatagtattgtataaa

SEQ ID NO: 205434 - DNA, 20 bp, Artificial Sequence
  chemically synthesized
attaaaaatagtattgtata

SEQ ID NO: 205435 - DNA, 20 bp, Artificial Sequence
  chemically synthesized
tcattaaaacaaattaaaaa

SEQ ID NO: 205436 - DNA, 20 bp, Artificial Sequence
  chemically synthesized
tatttttaatttgttttaat

SEQ ID NO: 205437 - DNA, 20 bp, Artificial Sequence
  chemically synthesized
aacgtattcccgatatacaa

SEQ ID NO: 205438 - DNA, 20 bp, Artificial Sequence
  chemically synthesized
catgtgttacttttgtatat

SEQ ID NO: 205439 - DNA, 20 bp, Artificial Sequence
  chemically synthesized
atgtgttacttttgtatatc

SEQ ID NO: 205440 - DNA, 20 bp, Artificial Sequence
  chemically synthesized
tcgggaatacgtttcttaaa

SEQ ID NO: 205441 - DNA, 20 bp, Artificial Sequence
  chemically synthesized
cctttttacttatacttttt

SEQ ID NO: 205442 - DNA, 20 bp, Artificial Sequence
  chemically synthesized
atacgtttcttaaaaagtat

SEQ ID NO: 205443 - DNA, 20 bp, Artificial Sequence
  chemically synthesized
tcttaaaaagtataagtaaa

SEQ ID NO: 205444 - DNA, 20 bp, Artificial Sequence
  chemically synthesized
cttaaaaagtataagtaaaa

SEQ ID NO: 205445 - DNA, 20 bp, Artificial Sequence
  chemically synthesized
agtataagtaaaaaggattt

SEQ ID NO: 205446 - DNA, 20 bp, Artificial Sequence
  chemically synthesized
aaaaaggattttagaataaa

SEQ ID NO: 205447 - DNA, 20 bp, Artificial Sequence
  chemically synthesized
aaggattttagaataaatgg

SEQ ID NO: 205448 - DNA, 20 bp, Artificial Sequence
  chemically synthesized
ataaatggaagttttaaaac

SEQ ID NO: 205449 - DNA, 20 bp, Artificial Sequence
  chemically synthesized
aatggaagttttaaaacaag

SEQ ID NO: 205450 - DNA, 20 bp, Artificial Sequence
  chemically synthesized
gtatgaattcttcatatggc

SEQ ID NO: 205451 - DNA, 20 bp, Artificial Sequence
  chemically synthesized
aacaagcagcttgccatatg

SEQ ID NO: 205452 - DNA, 20 bp, Artificial Sequence
  chemically synthesized
actagtatgaattcttcata

SEQ ID NO: 205453 - DNA, 20 bp, Artificial Sequence
  chemically synthesized
gccatatgaagaattcatac

SEQ ID NO: 205454 - DNA, 20 bp, Artificial Sequence
  chemically synthesized
agaattcatactagtctttt

SEQ ID NO: 205455 - DNA, 20 bp, Artificial Sequence
  chemically synthesized
aaacattcatccaaaaagac

SEQ ID NO: 205456 - DNA, 20 bp, Artificial Sequence
  chemically synthesized
atttaaaacattcatccaaa

SEQ ID NO: 205457 - DNA, 20 bp, Artificial Sequence
  chemically synthesized
ttttggatgaatgttttaaa

SEQ ID NO: 205458 - DNA, 20 bp, Artificial Sequence
  chemically synthesized
tttggatgaatgttttaaat

SEQ ID NO: 205459 - DNA, 20 bp, Artificial Sequence
  chemically synthesized
tttaaataggttaacacgct

SEQ ID NO: 205460 - DNA, 20 bp, Artificial Sequence
  chemically synthesized
tgtgcagattaaattttact

SEQ ID NO: 205461 - DNA, 20 bp, Artificial Sequence
  chemically synthesized
taaaatttaatctgcacaaa

SEQ ID NO: 205462 - DNA, 20 bp, Artificial Sequence
  chemically synthesized
gtaagacaaagccatttgtg

SEQ ID NO: 205463 - DNA, 20 bp, Artificial Sequence
  chemically synthesized
gatcctctctgtgtaagaca

SEQ ID NO: 205464 - DNA, 20 bp, Artificial Sequence
  chemically synthesized
acaaatggctttgtcttaca

SEQ ID NO: 205465 - DNA, 20 bp, Artificial Sequence
  chemically synthesized
aaatggctttgtcttacaca

SEQ ID NO: 205466 - DNA, 20 bp, Artificial Sequence
  chemically synthesized
atggctttgtcttacacaga

SEQ ID NO: 205467 - DNA, 20 bp, Artificial Sequence
  chemically synthesized
cacatagatcctctctgtgt

SEQ ID NO: 205468 - DNA, 20 bp, Artificial Sequence
  chemically synthesized
tggctttgtcttacacagag

SEQ ID NO: 205469 - DNA, 20 bp, Artificial Sequence
  chemically synthesized
ttacacagagaggatctatg

SEQ ID NO: 205470 - DNA, 20 bp, Artificial Sequence
  chemically synthesized
ttttggttctgttttccaca

SEQ ID NO: 205471 - DNA, 20 bp, Artificial Sequence
  chemically synthesized
gagaggatctatgtggaaaa

SEQ ID NO: 205472 - DNA, 20 bp, Artificial Sequence
  chemically synthesized
tatgtggaaaacagaaccaa

SEQ ID NO: 205473 - DNA, 20 bp, Artificial Sequence
  chemically synthesized
tggaaaacagaaccaaaagc

SEQ ID NO: 205474 - DNA, 20 bp, Artificial Sequence
  chemically synthesized
tacttgtttggactggcttt

SEQ ID NO: 205475 - DNA, 20 bp, Artificial Sequence
  chemically synthesized
tctgttttacttgtttggac

SEQ ID NO: 205476 - DNA, 20 bp, Artificial Sequence
  chemically synthesized
aaccaaaagccagtccaaac

SEQ ID NO: 205477 - DNA, 20 bp, Artificial Sequence
  chemically synthesized
cagtttctgttttacttgtt

SEQ ID NO: 205478 - DNA, 20 bp, Artificial Sequence
  chemically synthesized
gccagtccaaacaagtaaaa

SEQ ID NO: 205479 - DNA, 20 bp, Artificial Sequence
  chemically synthesized
agtaaaacagaaactgaatg

SEQ ID NO: 205480 - DNA, 20 bp, Artificial Sequence
  chemically synthesized
taaaacagaaactgaatgta

SEQ ID NO: 205481 - DNA, 20 bp, Artificial Sequence
  chemically synthesized
atcagttccaactctacatt

SEQ ID NO: 205482 - DNA, 20 bp, Artificial Sequence
  chemically synthesized
acagaaactgaatgtagagt

SEQ ID NO: 205483 - DNA, 20 bp, Artificial Sequence
  chemically synthesized
tctaatccaaaattgaatat

SEQ ID NO: 205484 - DNA, 20 bp, Artificial Sequence
  chemically synthesized
ttggaactgatattcaattt

SEQ ID NO: 205485 - DNA, 20 bp, Artificial Sequence
  chemically synthesized
actgatattcaattttggat

SEQ ID NO: 205486 - DNA, 20 bp, Artificial Sequence
  chemically synthesized
ttttttttcctttcaataat

SEQ ID NO: 205487 - DNA, 20 bp, Artificial Sequence
  chemically synthesized
gattagaaactgattattga

SEQ ID NO: 205488 - DNA, 20 bp, Artificial Sequence
  chemically synthesized
attagaaactgattattgaa

SEQ ID NO: 205489 - DNA, 20 bp, Artificial Sequence
  chemically synthesized
attgaaaggaaaaaaaaaca

SEQ ID NO: 205490 - DNA, 20 bp, Artificial Sequence
  chemically synthesized
aaaaaaaaacacagtaattt

SEQ ID NO: 205491 - DNA, 20 bp, Artificial Sequence
  chemically synthesized
taatttcagatctgctgttt

SEQ ID NO: 205492 - DNA, 20 bp, Artificial Sequence
  chemically synthesized
tgtcaggtttactgaaacag

SEQ ID NO: 205493 - DNA, 20 bp, Artificial Sequence
  chemically synthesized
tagtgtcaggtttactgaaa

SEQ ID NO: 205494 - DNA, 20 bp, Artificial Sequence
  chemically synthesized
aaaaaactcagattagtgtc

SEQ ID NO: 205495 - DNA, 20 bp, Artificial Sequence
  chemically synthesized
taaaaaactcagattagtgt

SEQ ID NO: 205496 - DNA, 20 bp, Artificial Sequence
  chemically synthesized
agtaaacctgacactaatct

SEQ ID NO: 205497 - DNA, 20 bp, Artificial Sequence
  chemically synthesized
tttttttaaaaaactcagat

SEQ ID NO: 205498 - DNA, 20 bp, Artificial Sequence
  chemically synthesized
attaatttttttaaaaaact

SEQ ID NO: 205499 - DNA, 20 bp, Artificial Sequence
  chemically synthesized
taaaaaaattaattctgaca

SEQ ID NO: 205500 - DNA, 20 bp, Artificial Sequence
  chemically synthesized
aacattatctcaagctttgt

SEQ ID NO: 205501 - DNA, 20 bp, Artificial Sequence
  chemically synthesized
aattaattctgacaaagctt

SEQ ID NO: 205502 - DNA, 20 bp, Artificial Sequence
  chemically synthesized
cactattaaaacattatctc

SEQ ID NO: 205503 - DNA, 20 bp, Artificial Sequence
  chemically synthesized
agcttgagataatgttttaa

SEQ ID NO: 205504 - DNA, 20 bp, Artificial Sequence
  chemically synthesized
tgagataatgttttaatagt

SEQ ID NO: 205505 - DNA, 20 bp, Artificial Sequence
  chemically synthesized
tttaatagtgagtcactaca

SEQ ID NO: 205506 - DNA, 20 bp, Artificial Sequence
  chemically synthesized
aatacttaatagttactttg

SEQ ID NO: 205507 - DNA, 20 bp, Artificial Sequence
  chemically synthesized
gtcactacaaagtaactatt

SEQ ID NO: 205508 - DNA, 20 bp, Artificial Sequence
  chemically synthesized
attgaatgttgaatacttaa

SEQ ID NO: 205509 - DNA, 20 bp, Artificial Sequence
  chemically synthesized
taagtattcaacattcaatt

SEQ ID NO: 205510 - DNA, 20 bp, Artificial Sequence
  chemically synthesized
aacattcaattaagtcaatt

SEQ ID NO: 205511 - DNA, 20 bp, Artificial Sequence
  chemically synthesized
ttacctggctgaaacatcaa

SEQ ID NO: 205512 - DNA, 20 bp, Artificial Sequence
  chemically synthesized
caattcagcttttgatgttt

SEQ ID NO: 205513 - DNA, 20 bp, Artificial Sequence
  chemically synthesized
tcagcttttgatgtttcagc

SEQ ID NO: 205514 - DNA, 20 bp, Artificial Sequence
  chemically synthesized
cagcttttgatgtttcagcc

SEQ ID NO: 205515 - DNA, 20 bp, Artificial Sequence
  chemically synthesized
acacatgttgagcatttacc

SEQ ID NO: 205516 - DNA, 20 bp, Artificial Sequence
  chemically synthesized
gtgttatatccacacatgtt

SEQ ID NO: 205517 - DNA, 20 bp, Artificial Sequence
  chemically synthesized
aggtaaatgctcaacatgtg

SEQ ID NO: 205518 - DNA, 20 bp, Artificial Sequence
  chemically synthesized
aaaattctgcacaaatggaa

SEQ ID NO: 205519 - DNA, 20 bp, Artificial Sequence
  chemically synthesized
gttatacttttccatttgtg

SEQ ID NO: 205520 - DNA, 20 bp, Artificial Sequence
  chemically synthesized
agtagaaaattctgcacaaa

SEQ ID NO: 205521 - DNA, 20 bp, Artificial Sequence
  chemically synthesized
tacttaaaacattatttgag

SEQ ID NO: 205522 - DNA, 20 bp, Artificial Sequence
  chemically synthesized
acatacttaaaacattattt

SEQ ID NO: 205523 - DNA, 20 bp, Artificial Sequence
  chemically synthesized
ttctactcaaataatgtttt

SEQ ID NO: 205524 - DNA, 20 bp, Artificial Sequence
  chemically synthesized
gtgtgtgtgtgtgtgtgtgt

SEQ ID NO: 205525 - DNA, 20 bp, Artificial Sequence
  chemically synthesized
tcagattttgttgaaggata

SEQ ID NO: 205526 - DNA, 20 bp, Artificial Sequence
  chemically synthesized
gcatattcagattttgttga

SEQ ID NO: 205527 - DNA, 20 bp, Artificial Sequence
  chemically synthesized
ggcatattcagattttgttg

SEQ ID NO: 205528 - DNA, 20 bp, Artificial Sequence
  chemically synthesized
atttatagtgaaggcatatt

SEQ ID NO: 205529 - DNA, 20 bp, Artificial Sequence
  chemically synthesized
aatcaaaagatttatagtga

SEQ ID NO: 205530 - DNA, 20 bp, Artificial Sequence
  chemically synthesized
taatcaaaagatttatagtg

SEQ ID NO: 205531 - DNA, 20 bp, Artificial Sequence
  chemically synthesized
taacctaatcaaaagattta

SEQ ID NO: 205532 - DNA, 20 bp, Artificial Sequence
  chemically synthesized
ttcactataaatcttttgat

SEQ ID NO: 205533 - DNA, 20 bp, Artificial Sequence
  chemically synthesized
tcactataaatcttttgatt

SEQ ID NO: 205534 - DNA, 20 bp, Artificial Sequence
  chemically synthesized
gtcttttctaacctaatcaa

SEQ ID NO: 205535 - DNA, 20 bp, Artificial Sequence
  chemically synthesized
tataaatcttttgattaggt

SEQ ID NO: 205536 - DNA, 20 bp, Artificial Sequence
  chemically synthesized
atcttttgattaggttagaa

SEQ ID NO: 205537 - DNA, 20 bp, Artificial Sequence
  chemically synthesized
agaaaagacaatctatcctt

SEQ ID NO: 205538 - DNA, 20 bp, Artificial Sequence
  chemically synthesized
aaaagacaatctatcctttg

SEQ ID NO: 205539 - DNA, 20 bp, Artificial Sequence
  chemically synthesized
caattgatcactccaaagga

SEQ ID NO: 205540 - DNA, 20 bp, Artificial Sequence
  chemically synthesized
taggcaattgatcactccaa

SEQ ID NO: 205541 - DNA, 20 bp, Artificial Sequence
  chemically synthesized
ataggcaattgatcactcca

SEQ ID NO: 205542 - DNA, 20 bp, Artificial Sequence
  chemically synthesized
tggagtgatcaattgcctat

SEQ ID NO: 205543 - DNA, 20 bp, Artificial Sequence
  chemically synthesized
ttgagggggacaaaactcat

SEQ ID NO: 205544 - DNA, 20 bp, Artificial Sequence
  chemically synthesized
gttgagggggacaaaactca

SEQ ID NO: 205545 - DNA, 20 bp, Artificial Sequence
  chemically synthesized
ggactaagcagcagttgagg

SEQ ID NO: 205546 - DNA, 20 bp, Artificial Sequence
  chemically synthesized
tggactaagcagcagttgag

SEQ ID NO: 205547 - DNA, 20 bp, Artificial Sequence
  chemically synthesized
atggactaagcagcagttga

SEQ ID NO: 205548 - DNA, 20 bp, Artificial Sequence
  chemically synthesized
tatggactaagcagcagttg

SEQ ID NO: 205549 - DNA, 20 bp, Artificial Sequence
  chemically synthesized
ttatggactaagcagcagtt

SEQ ID NO: 205550 - DNA, 20 bp, Artificial Sequence
  chemically synthesized
tgtccccctcaactgctgct

SEQ ID NO: 205551 - DNA, 20 bp, Artificial Sequence
  chemically synthesized
tccgtttatggactaagcag

SEQ ID NO: 205552 - DNA, 20 bp, Artificial Sequence
  chemically synthesized
ggttccgtttatggactaag

SEQ ID NO: 205553 - DNA, 20 bp, Artificial Sequence
  chemically synthesized
tgaggttccgtttatggact

SEQ ID NO: 205554 - DNA, 20 bp, Artificial Sequence
  chemically synthesized
actgctgcttagtccataaa

SEQ ID NO: 205555 - DNA, 20 bp, Artificial Sequence
  chemically synthesized
aacttctgaggttccgttta

SEQ ID NO: 205556 - DNA, 20 bp, Artificial Sequence
  chemically synthesized
ttagtccataaacggaacct

SEQ ID NO: 205557 - DNA, 20 bp, Artificial Sequence
  chemically synthesized
gtccataaacggaacctcag

SEQ ID NO: 205558 - DNA, 20 bp, Artificial Sequence
  chemically synthesized
agcttccagcagaacttctg

SEQ ID NO: 205559 - DNA, 20 bp, Artificial Sequence
  chemically synthesized
tagcttccagcagaacttct

SEQ ID NO: 205560 - DNA, 20 bp, Artificial Sequence
  chemically synthesized
cggaacctcagaagttctgc

SEQ ID NO: 205561 - DNA, 20 bp, Artificial Sequence
  chemically synthesized
aacctcagaagttctgctgg

SEQ ID NO: 205562 - DNA, 20 bp, Artificial Sequence
  chemically synthesized
acttcaactgtagcttccag

SEQ ID NO: 205563 - DNA, 20 bp, Artificial Sequence
  chemically synthesized
agaagttctgctggaagcta

SEQ ID NO: 205564 - DNA, 20 bp, Artificial Sequence
  chemically synthesized
aagacttcaactgtagcttc

SEQ ID NO: 205565 - DNA, 20 bp, Artificial Sequence
  chemically synthesized
tctgctggaagctacagttg

SEQ ID NO: 205566 - DNA, 20 bp, Artificial Sequence
  chemically synthesized
ttatagaaagacttcaactg

SEQ ID NO: 205567 - DNA, 20 bp, Artificial Sequence
  chemically synthesized
agcaacgagaacattataga

SEQ ID NO: 205568 - DNA, 20 bp, Artificial Sequence
  chemically synthesized
tcttagcaacgagaacatta

SEQ ID NO: 205569 - DNA, 20 bp, Artificial Sequence
  chemically synthesized
tctataatgttctcgttgct

SEQ ID NO: 205570 - DNA, 20 bp, Artificial Sequence
  chemically synthesized
agctctaaagtcttagcaac

SEQ ID NO: 205571 - DNA, 20 bp, Artificial Sequence
  chemically synthesized
tgttctcgttgctaagactt

SEQ ID NO: 205572 - DNA, 20 bp, Artificial Sequence
  chemically synthesized
tatggctagctctaaagtct

SEQ ID NO: 205573 - DNA, 20 bp, Artificial Sequence
  chemically synthesized
ttctcgttgctaagacttta

SEQ ID NO: 205574 - DNA, 20 bp, Artificial Sequence
  chemically synthesized
cgttgctaagactttagagc

SEQ ID NO: 205575 - DNA, 20 bp, Artificial Sequence
  chemically synthesized
tgtttctatggctagctcta

SEQ ID NO: 205576 - DNA, 20 bp, Artificial Sequence
  chemically synthesized
taagactttagagctagcca

SEQ ID NO: 205577 - DNA, 20 bp, Artificial Sequence
  chemically synthesized
ttgcagtttgtttctatggc

SEQ ID NO: 205578 - DNA, 20 bp, Artificial Sequence
  chemically synthesized
acatttgcagtttgtttcta

SEQ ID NO: 205579 - DNA, 20 bp, Artificial Sequence
  chemically synthesized
taaagcataaataacatttg

SEQ ID NO: 205580 - DNA, 20 bp, Artificial Sequence
  chemically synthesized
aatgttatttatgctttatg

SEQ ID NO: 205581 - DNA, 20 bp, Artificial Sequence
  chemically synthesized
ggttatcattttactacata

SEQ ID NO: 205582 - DNA, 20 bp, Artificial Sequence
  chemically synthesized
taaaatgataacctgaatat

SEQ ID NO: 205583 - DNA, 20 bp, Artificial Sequence
  chemically synthesized
cgagacccagtcttatattc

SEQ ID NO: 205584 - DNA, 20 bp, Artificial Sequence
  chemically synthesized
tcgagacccagtcttatatt

SEQ ID NO: 205585 - DNA, 20 bp, Artificial Sequence
  chemically synthesized
tgataacctgaatataagac

SEQ ID NO: 205586 - DNA, 20 bp, Artificial Sequence
  chemically synthesized
gataacctgaatataagact

SEQ ID NO: 205587 - DNA, 20 bp, Artificial Sequence
  chemically synthesized
tgaaacaaataatcgagacc

SEQ ID NO: 205588 - DNA, 20 bp, Artificial Sequence
  chemically synthesized
aataaatgaaacaaataatc

SEQ ID NO: 205589 - DNA, 20 bp, Artificial Sequence
  chemically synthesized
gatctagactttttggagtg

SEQ ID NO: 205590 - DNA, 20 bp, Artificial Sequence
  chemically synthesized
atttatttccacactccaaa

SEQ ID NO: 205591 - DNA, 20 bp, Artificial Sequence
  chemically synthesized
ttgtggatctagactttttg

SEQ ID NO: 205592 - DNA, 20 bp, Artificial Sequence
  chemically synthesized
tttccacactccaaaaagtc

SEQ ID NO: 205593 - DNA, 20 bp, Artificial Sequence
  chemically synthesized
ttttgtggatctagactttt

SEQ ID NO: 205594 - DNA, 20 bp, Artificial Sequence
  chemically synthesized
aggtttgcattttgtggatc

SEQ ID NO: 205595 - DNA, 20 bp, Artificial Sequence
  chemically synthesized
aatcctaggtttgcattttg

SEQ ID NO: 205596 - DNA, 20 bp, Artificial Sequence
  chemically synthesized
agatccacaaaatgcaaacc

SEQ ID NO: 205597 - DNA, 20 bp, Artificial Sequence
  chemically synthesized
gatccacaaaatgcaaacct

SEQ ID NO: 205598 - DNA, 20 bp, Artificial Sequence
  chemically synthesized
ccttttgtgcgtggaatcct

SEQ ID NO: 205599 - DNA, 20 bp, Artificial Sequence
  chemically synthesized
cccttttgtgcgtggaatcc

SEQ ID NO: 205600 - DNA, 20 bp, Artificial Sequence
  chemically synthesized
acctaggattccacgcacaa

SEQ ID NO: 205601 - DNA, 20 bp, Artificial Sequence
  chemically synthesized
tgtttgcacccttttgtgcg

SEQ ID NO: 205602 - DNA, 20 bp, Artificial Sequence
  chemically synthesized
cctaggattccacgcacaaa

SEQ ID NO: 205603 - DNA, 20 bp, Artificial Sequence
  chemically synthesized
ctaggattccacgcacaaaa

SEQ ID NO: 205604 - DNA, 20 bp, Artificial Sequence
  chemically synthesized
gaaagatatgagaatcataa

SEQ ID NO: 205605 - DNA, 20 bp, Artificial Sequence
  chemically synthesized
taagtatatttgaaagatat

SEQ ID NO: 205606 - DNA, 20 bp, Artificial Sequence
  chemically synthesized
ctattcataagtatatttga

SEQ ID NO: 205607 - DNA, 20 bp, Artificial Sequence
  chemically synthesized
ctttcaaatatacttatgaa

SEQ ID NO: 205608 - DNA, 20 bp, Artificial Sequence
  chemically synthesized
catagtaataaactattcat

SEQ ID NO: 205609 - DNA, 20 bp, Artificial Sequence
  chemically synthesized
ttatgaatagtttattacta

SEQ ID NO: 205610 - DNA, 20 bp, Artificial Sequence
  chemically synthesized
tatgaatagtttattactat

SEQ ID NO: 205611 - DNA, 20 bp, Artificial Sequence
  chemically synthesized
aatagtttattactatggga

SEQ ID NO: 205612 - DNA, 20 bp, Artificial Sequence
  chemically synthesized
atagtttattactatgggac

SEQ ID NO: 205613 - DNA, 20 bp, Artificial Sequence
  chemically synthesized
acttatccatacctgtccca

SEQ ID NO: 205614 - DNA, 20 bp, Artificial Sequence
  chemically synthesized
ttattactatgggacaggta

SEQ ID NO: 205615 - DNA, 20 bp, Artificial Sequence
  chemically synthesized
actatgggacaggtatggat

SEQ ID NO: 205616 - DNA, 20 bp, Artificial Sequence
  chemically synthesized
acaaaaaataataaaaagta

SEQ ID NO: 205617 - DNA, 20 bp, Artificial Sequence
  chemically synthesized
tacctacaaaaaataataaa

SEQ ID NO: 205618 - DNA, 20 bp, Artificial Sequence
  chemically synthesized
ttactttttattattttttg

SEQ ID NO: 205619 - DNA, 20 bp, Artificial Sequence
  chemically synthesized
tactttttattattttttgt

SEQ ID NO: 205620 - DNA, 20 bp, Artificial Sequence
  chemically synthesized
tattattttttgtaggtaca

SEQ ID NO: 205621 - DNA, 20 bp, Artificial Sequence
  chemically synthesized
atagtatgtatatatatttg

SEQ ID NO: 205622 - DNA, 20 bp, Artificial Sequence
  chemically synthesized
tagtatgtatatatatttgt

SEQ ID NO: 205623 - DNA, 20 bp, Artificial Sequence
  chemically synthesized
atatttgtgggttacttatt

SEQ ID NO: 205624 - DNA, 20 bp, Artificial Sequence
  chemically synthesized
tcgttgaatggattctcaat

SEQ ID NO: 205625 - DNA, 20 bp, Artificial Sequence
  chemically synthesized
ttattgagaatccattcaac

SEQ ID NO: 205626 - DNA, 20 bp, Artificial Sequence
  chemically synthesized
atctttgtatactcgttgaa

SEQ ID NO: 205627 - DNA, 20 bp, Artificial Sequence
  chemically synthesized
atccattcaacgagtataca

SEQ ID NO: 205628 - DNA, 20 bp, Artificial Sequence
  chemically synthesized
caacgagtatacaaagatcg

SEQ ID NO: 205629 - DNA, 20 bp, Artificial Sequence
  chemically synthesized
tcgcggatattaaaactgaa

SEQ ID NO: 205630 - DNA, 20 bp, Artificial Sequence
  chemically synthesized
ggatattaaaactgaaaaga

SEQ ID NO: 205631 - DNA, 20 bp, Artificial Sequence
  chemically synthesized
ttccaggttgtctttctttt

SEQ ID NO: 205632 - DNA, 20 bp, Artificial Sequence
  chemically synthesized
aactgaaaagaaagacaacc

SEQ ID NO: 205633 - DNA, 20 bp, Artificial Sequence
  chemically synthesized
tgaaaagaaagacaacctgg

SEQ ID NO: 205634 - DNA, 20 bp, Artificial Sequence
  chemically synthesized
tgtcaaacattttaacttcc

SEQ ID NO: 205635 - DNA, 20 bp, Artificial Sequence
  chemically synthesized
atgtcaaacattttaacttc

SEQ ID NO: 205636 - DNA, 20 bp, Artificial Sequence
  chemically synthesized
aagttaaaatgtttgacatt

SEQ ID NO: 205637 - DNA, 20 bp, Artificial Sequence
  chemically synthesized
tgacattaagatttactaaa

SEQ ID NO: 205638 - DNA, 20 bp, Artificial Sequence
  chemically synthesized
attaagatttactaaacaga

SEQ ID NO: 205639 - DNA, 20 bp, Artificial Sequence
  chemically synthesized
aattttgcaaactttctgtt

SEQ ID NO: 205640 - DNA, 20 bp, Artificial Sequence
  chemically synthesized
caaaatttcacaaactatat

SEQ ID NO: 205641 - DNA, 20 bp, Artificial Sequence
  chemically synthesized
tcatatcagatgaacttata

SEQ ID NO: 205642 - DNA, 20 bp, Artificial Sequence
  chemically synthesized
tataagttcatctgatatga

SEQ ID NO: 205643 - DNA, 20 bp, Artificial Sequence
  chemically synthesized
attggaagcatccatcatat

SEQ ID NO: 205644 - DNA, 20 bp, Artificial Sequence
  chemically synthesized
atgatggatgcttccaattg

SEQ ID NO: 205645 - DNA, 20 bp, Artificial Sequence
  chemically synthesized
tttctgtattctacaattgg

SEQ ID NO: 205646 - DNA, 20 bp, Artificial Sequence
  chemically synthesized
taatttctgtattctacaat

SEQ ID NO: 205647 - DNA, 20 bp, Artificial Sequence
  chemically synthesized
atgcttccaattgtagaata

SEQ ID NO: 205648 - DNA, 20 bp, Artificial Sequence
  chemically synthesized
aatacagaaattatattctt

SEQ ID NO: 205649 - DNA, 20 bp, Artificial Sequence
  chemically synthesized
caagtttaaaatgtaaactc

SEQ ID NO: 205650 - DNA, 20 bp, Artificial Sequence
  chemically synthesized
agtttacattttaaacttgt

SEQ ID NO: 205651 - DNA, 20 bp, Artificial Sequence
  chemically synthesized
attcagtccaaacatctcac

SEQ ID NO: 205652 - DNA, 20 bp, Artificial Sequence
  chemically synthesized
ttttaaacttgtgagatgtt

SEQ ID NO: 205653 - DNA, 20 bp, Artificial Sequence
  chemically synthesized
gtcatttctatttatatatt

SEQ ID NO: 205654 - DNA, 20 bp, Artificial Sequence
  chemically synthesized
gtttggactgaatatataaa

SEQ ID NO: 205655 - DNA, 20 bp, Artificial Sequence
  chemically synthesized
aaatattcatgaaaattttt

SEQ ID NO: 205656 - DNA, 20 bp, Artificial Sequence
  chemically synthesized
aaaattttcatgaatatttt

SEQ ID NO: 205657 - DNA, 20 bp, Artificial Sequence
  chemically synthesized
attttcatgaatattttcag

SEQ ID NO: 205658 - DNA, 20 bp, Artificial Sequence
  chemically synthesized
tttcagtggatactattaca

SEQ ID NO: 205659 - DNA, 20 bp, Artificial Sequence
  chemically synthesized
ctccactttgagctttgtaa

SEQ ID NO: 205660 - DNA, 20 bp, Artificial Sequence
  chemically synthesized
ggatactattacaaagctca

SEQ ID NO: 205661 - DNA, 20 bp, Artificial Sequence
  chemically synthesized
tactattacaaagctcaaag

SEQ ID NO: 205662 - DNA, 20 bp, Artificial Sequence
  chemically synthesized
ctattacaaagctcaaagtg

SEQ ID NO: 205663 - DNA, 20 bp, Artificial Sequence
  chemically synthesized
tattacaaagctcaaagtgg

SEQ ID NO: 205664 - DNA, 20 bp, Artificial Sequence
  chemically synthesized
aaacttttaacctccacttt

SEQ ID NO: 205665 - DNA, 20 bp, Artificial Sequence
  chemically synthesized
aagctcaaagtggaggttaa

SEQ ID NO: 205666 - DNA, 20 bp, Artificial Sequence
  chemically synthesized
tcgttgagaataaatcgaat

SEQ ID NO: 205667 - DNA, 20 bp, Artificial Sequence
  chemically synthesized
tattagataattcattcgtt

SEQ ID NO: 205668 - DNA, 20 bp, Artificial Sequence
  chemically synthesized
tctcatatacattgaaatat

SEQ ID NO: 205669 - DNA, 20 bp, Artificial Sequence
  chemically synthesized
tctaatatttcaatgtatat

SEQ ID NO: 205670 - DNA, 20 bp, Artificial Sequence
  chemically synthesized
tgagataaacatgtttatat

SEQ ID NO: 205671 - DNA, 20 bp, Artificial Sequence
  chemically synthesized
ttatatattaaagagtcaat

SEQ ID NO: 205672 - DNA, 20 bp, Artificial Sequence
  chemically synthesized
ttaaggctttatatattaaa

SEQ ID NO: 205673 - DNA, 20 bp, Artificial Sequence
  chemically synthesized
aattaaggctttatatatta

SEQ ID NO: 205674 - DNA, 20 bp, Artificial Sequence
  chemically synthesized
aattgactctttaatatata

SEQ ID NO: 205675 - DNA, 20 bp, Artificial Sequence
  chemically synthesized
ttatagattaaacataatta

SEQ ID NO: 205676 - DNA, 20 bp, Artificial Sequence
  chemically synthesized
tttatagattaaacataatt

SEQ ID NO: 205677 - DNA, 20 bp, Artificial Sequence
  chemically synthesized
ctctaacattagtggtttta

SEQ ID NO: 205678 - DNA, 20 bp, Artificial Sequence
  chemically synthesized
atctataaaaccactaatgt

SEQ ID NO: 205679 - DNA, 20 bp, Artificial Sequence
  chemically synthesized
tgaatagtctctaacattag

SEQ ID NO: 205680 - DNA, 20 bp, Artificial Sequence
  chemically synthesized
ctataaaaccactaatgtta

SEQ ID NO: 205681 - DNA, 20 bp, Artificial Sequence
  chemically synthesized
tgatgaatagtctctaacat

SEQ ID NO: 205682 - DNA, 20 bp, Artificial Sequence
  chemically synthesized
tatagtgaatatgtgatgaa

SEQ ID NO: 205683 - DNA, 20 bp, Artificial Sequence
  chemically synthesized
attcatcacatattcactat

SEQ ID NO: 205684 - DNA, 20 bp, Artificial Sequence
  chemically synthesized
tctccatagtgtttatctta

SEQ ID NO: 205685 - DNA, 20 bp, Artificial Sequence
  chemically synthesized
tcactataagataaacacta

SEQ ID NO: 205686 - DNA, 20 bp, Artificial Sequence
  chemically synthesized
actataagataaacactatg

SEQ ID NO: 205687 - DNA, 20 bp, Artificial Sequence
  chemically synthesized
atttatgcataatttctcca

SEQ ID NO: 205688 - DNA, 20 bp, Artificial Sequence
  chemically synthesized
tacattaaaatactattaaa

SEQ ID NO: 205689 - DNA, 20 bp, Artificial Sequence
  chemically synthesized
catagaaattgtctttttaa

SEQ ID NO: 205690 - DNA, 20 bp, Artificial Sequence
  chemically synthesized
ttcacacatgcacacacaca

SEQ ID NO: 205691 - DNA, 20 bp, Artificial Sequence
  chemically synthesized
tatgtgtgtgtgcatgtgtg

SEQ ID NO: 205692 - DNA, 20 bp, Artificial Sequence
  chemically synthesized
gacaagtagtcaagtggata

SEQ ID NO: 205693 - DNA, 20 bp, Artificial Sequence
  chemically synthesized
atgacaagtagtcaagtgga

SEQ ID NO: 205694 - DNA, 20 bp, Artificial Sequence
  chemically synthesized
agaaatgacaagtagtcaag

SEQ ID NO: 205695 - DNA, 20 bp, Artificial Sequence
  chemically synthesized
cagagaaatgacaagtagtc

SEQ ID NO: 205696 - DNA, 20 bp, Artificial Sequence
  chemically synthesized
tataacagagaaatgacaag

SEQ ID NO: 205697 - DNA, 20 bp, Artificial Sequence
  chemically synthesized
agatataacagagaaatgac

SEQ ID NO: 205698 - DNA, 20 bp, Artificial Sequence
  chemically synthesized
ttttacacttagatataaca

SEQ ID NO: 205699 - DNA, 20 bp, Artificial Sequence
  chemically synthesized
cattttacacttagatataa

SEQ ID NO: 205700 - DNA, 20 bp, Artificial Sequence
  chemically synthesized
gtcatttctctgttatatct

SEQ ID NO: 205701 - DNA, 20 bp, Artificial Sequence
  chemically synthesized
gtatgtctgcattttacact

SEQ ID NO: 205702 - DNA, 20 bp, Artificial Sequence
  chemically synthesized
ttatatctaagtgtaaaatg

SEQ ID NO: 205703 - DNA, 20 bp, Artificial Sequence
  chemically synthesized
agtgtaaaatgcagacatac

SEQ ID NO: 205704 - DNA, 20 bp, Artificial Sequence
  chemically synthesized
aacccagcatgcaaaaattc

SEQ ID NO: 205705 - DNA, 20 bp, Artificial Sequence
  chemically synthesized
ataccagaatttttgcatgc

SEQ ID NO: 205706 - DNA, 20 bp, Artificial Sequence
  chemically synthesized
taccagaatttttgcatgct

SEQ ID NO: 205707 - DNA, 20 bp, Artificial Sequence
  chemically synthesized
atttttgcatgctgggtttc

SEQ ID NO: 205708 - DNA, 20 bp, Artificial Sequence
  chemically synthesized
tttttgcatgctgggtttct

SEQ ID NO: 205709 - DNA, 20 bp, Artificial Sequence
  chemically synthesized
acctagaaagcccagaaacc

SEQ ID NO: 205710 - DNA, 20 bp, Artificial Sequence
  chemically synthesized
tgctgggtttctgggctttc

SEQ ID NO: 205711 - DNA, 20 bp, Artificial Sequence
  chemically synthesized
cttttatcacctagaaagcc

SEQ ID NO: 205712 - DNA, 20 bp, Artificial Sequence
  chemically synthesized
gctgggtttctgggctttct

SEQ ID NO: 205713 - DNA, 20 bp, Artificial Sequence
  chemically synthesized
aggcacttttatcacctaga

SEQ ID NO: 205714 - DNA, 20 bp, Artificial Sequence
  chemically synthesized
aattaggcacttttatcacc

SEQ ID NO: 205715 - DNA, 20 bp, Artificial Sequence
  chemically synthesized
ctgggctttctaggtgataa

SEQ ID NO: 205716 - DNA, 20 bp, Artificial Sequence
  chemically synthesized
tctaacagtttggaataatt

SEQ ID NO: 205717 - DNA, 20 bp, Artificial Sequence
  chemically synthesized
atctaacagtttggaataat

SEQ ID NO: 205718 - DNA, 20 bp, Artificial Sequence
  chemically synthesized
gcctaattattccaaactgt

SEQ ID NO: 205719 - DNA, 20 bp, Artificial Sequence
  chemically synthesized
ggattaatgatctaacagtt

SEQ ID NO: 205720 - DNA, 20 bp, Artificial Sequence
  chemically synthesized
ggctaggattaatgatctaa

SEQ ID NO: 205721 - DNA, 20 bp, Artificial Sequence
  chemically synthesized
aactgttagatcattaatcc

SEQ ID NO: 205722 - DNA, 20 bp, Artificial Sequence
  chemically synthesized
atgtagatgtttttgtggct

SEQ ID NO: 205723 - DNA, 20 bp, Artificial Sequence
  chemically synthesized
aatgtagatgtttttgtggc

SEQ ID NO: 205724 - DNA, 20 bp, Artificial Sequence
  chemically synthesized
aattaatgtagatgtttttg

SEQ ID NO: 205725 - DNA, 20 bp, Artificial Sequence
  chemically synthesized
tgccaaggtttaaattaatg

SEQ ID NO: 205726 - DNA, 20 bp, Artificial Sequence
  chemically synthesized
atctacattaatttaaacct

SEQ ID NO: 205727 - DNA, 20 bp, Artificial Sequence
  chemically synthesized
tacttgtttaacgtttgcca

SEQ ID NO: 205728 - DNA, 20 bp, Artificial Sequence
  chemically synthesized
ttacttgtttaacgtttgcc

SEQ ID NO: 205729 - DNA, 20 bp, Artificial Sequence
  chemically synthesized
aaccttggcaaacgttaaac

SEQ ID NO: 205730 - DNA, 20 bp, Artificial Sequence
  chemically synthesized
gttaaacaagtaaattacga

SEQ ID NO: 205731 - DNA, 20 bp, Artificial Sequence
  chemically synthesized
caagtaaattacgaaagtat

SEQ ID NO: 205732 - DNA, 20 bp, Artificial Sequence
  chemically synthesized
ggaagagaagtaggacatga

SEQ ID NO: 205733 - DNA, 20 bp, Artificial Sequence
  chemically synthesized
agaaacaatggaagagaagt

SEQ ID NO: 205734 - DNA, 20 bp, Artificial Sequence
  chemically synthesized
gagaaacaatggaagagaag

SEQ ID NO: 205735 - DNA, 20 bp, Artificial Sequence
  chemically synthesized
gctgagaaacaatggaagag

SEQ ID NO: 205736 - DNA, 20 bp, Artificial Sequence
  chemically synthesized
gatgctgagaaacaatggaa

SEQ ID NO: 205737 - DNA, 20 bp, Artificial Sequence
  chemically synthesized
aagatgctgagaaacaatgg

SEQ ID NO: 205738 - DNA, 20 bp, Artificial Sequence
  chemically synthesized
tttaagatgctgagaaacaa

SEQ ID NO: 205739 - DNA, 20 bp, Artificial Sequence
  chemically synthesized
acttctcttccattgtttct

SEQ ID NO: 205740 - DNA, 20 bp, Artificial Sequence
  chemically synthesized
ataaaatcctttaagatgct

SEQ ID NO: 205741 - DNA, 20 bp, Artificial Sequence
  chemically synthesized
cattgtttctcagcatctta

SEQ ID NO: 205742 - DNA, 20 bp, Artificial Sequence
  chemically synthesized
attgtttctcagcatcttaa

SEQ ID NO: 205743 - DNA, 20 bp, Artificial Sequence
  chemically synthesized
ttttgtaaataaaatccttt

SEQ ID NO: 205744 - DNA, 20 bp, Artificial Sequence
  chemically synthesized
ggattttatttacaaaaact

SEQ ID NO: 205745 - DNA, 20 bp, Artificial Sequence
  chemically synthesized
aatgtatttaagggattact

SEQ ID NO: 205746 - DNA, 20 bp, Artificial Sequence
  chemically synthesized
tactgaagaaatgtatttaa

SEQ ID NO: 205747 - DNA, 20 bp, Artificial Sequence
  chemically synthesized
atactgaagaaatgtattta

SEQ ID NO: 205748 - DNA, 20 bp, Artificial Sequence
  chemically synthesized
tatactgaagaaatgtattt

SEQ ID NO: 205749 - DNA, 20 bp, Artificial Sequence
  chemically synthesized
atcccttaaatacatttctt

SEQ ID NO: 205750 - DNA, 20 bp, Artificial Sequence
  chemically synthesized
caggaaattcagatatactg

SEQ ID NO: 205751 - DNA, 20 bp, Artificial Sequence
  chemically synthesized
cacacaacaaacaggaaatt

SEQ ID NO: 205752 - DNA, 20 bp, Artificial Sequence
  chemically synthesized
atacaatacacacaacaaac

SEQ ID NO: 205753 - DNA, 20 bp, Artificial Sequence
  chemically synthesized
catacaatacacacaacaaa

SEQ ID NO: 205754 - DNA, 20 bp, Artificial Sequence
  chemically synthesized
tgggcatgcatgcatacaga

SEQ ID NO: 205755 - DNA, 20 bp, Artificial Sequence
  chemically synthesized
cacatgggcatgcatgcata

SEQ ID NO: 205756 - DNA, 20 bp, Artificial Sequence
  chemically synthesized
tgcatgcatgcccatgtgtg

SEQ ID NO: 205757 - DNA, 20 bp, Artificial Sequence
  chemically synthesized
caccatatacccacacacat

SEQ ID NO: 205758 - DNA, 20 bp, Artificial Sequence
  chemically synthesized
gcatgcatgcccatgtgtgt

SEQ ID NO: 205759 - DNA, 20 bp, Artificial Sequence
  chemically synthesized
tcaccatatacccacacaca

SEQ ID NO: 205760 - DNA, 20 bp, Artificial Sequence
  chemically synthesized
tgcccatgtgtgtgggtata

SEQ ID NO: 205761 - DNA, 20 bp, Artificial Sequence
  chemically synthesized
catgtgtgtgggtatatggt

SEQ ID NO: 205762 - DNA, 20 bp, Artificial Sequence
  chemically synthesized
tgtgggtatatggtgagcta

SEQ ID NO: 205763 - DNA, 20 bp, Artificial Sequence
  chemically synthesized
tgggtatatggtgagctaaa

SEQ ID NO: 205764 - DNA, 20 bp, Artificial Sequence
  chemically synthesized
gggtatatggtgagctaaag

SEQ ID NO: 205765 - DNA, 20 bp, Artificial Sequence
  chemically synthesized
gtatatactgtttgcctctt

SEQ ID NO: 205766 - DNA, 20 bp, Artificial Sequence
  chemically synthesized
tggtgagctaaagaggcaaa

SEQ ID NO: 205767 - DNA, 20 bp, Artificial Sequence
  chemically synthesized
gaggcaaacagtatatacat

SEQ ID NO: 205768 - DNA, 20 bp, Artificial Sequence
  chemically synthesized
tatatacattagctaactac

SEQ ID NO: 205769 - DNA, 20 bp, Artificial Sequence
  chemically synthesized
ttgggtagaaaacttgtagt

SEQ ID NO: 205770 - DNA, 20 bp, Artificial Sequence
  chemically synthesized
aaatttgggtagaaaacttg

SEQ ID NO: 205771 - DNA, 20 bp, Artificial Sequence
  chemically synthesized
ggcctgtgggaaaatttggg

SEQ ID NO: 205772 - DNA, 20 bp, Artificial Sequence
  chemically synthesized
tgtggcctgtgggaaaattt

SEQ ID NO: 205773 - DNA, 20 bp, Artificial Sequence
  chemically synthesized
gtgtggcctgtgggaaaatt

SEQ ID NO: 205774 - DNA, 20 bp, Artificial Sequence
  chemically synthesized
tttctacccaaattttccca

SEQ ID NO: 205775 - DNA, 20 bp, Artificial Sequence
  chemically synthesized
ttctacccaaattttcccac

SEQ ID NO: 205776 - DNA, 20 bp, Artificial Sequence
  chemically synthesized
atgggttgagtgtggcctgt

SEQ ID NO: 205777 - DNA, 20 bp, Artificial Sequence
  chemically synthesized
aatgggttgagtgtggcctg

SEQ ID NO: 205778 - DNA, 20 bp, Artificial Sequence
  chemically synthesized
ttttaagaatgggttgagtg

SEQ ID NO: 205779 - DNA, 20 bp, Artificial Sequence
  chemically synthesized
caacattttaagaatgggtt

SEQ ID NO: 205780 - DNA, 20 bp, Artificial Sequence
  chemically synthesized
ctaagcaacattttaagaat

SEQ ID NO: 205781 - DNA, 20 bp, Artificial Sequence
  chemically synthesized
cctaagcaacattttaagaa

SEQ ID NO: 205782 - DNA, 20 bp, Artificial Sequence
  chemically synthesized
gaatgcctaagcaacatttt

SEQ ID NO: 205783 - DNA, 20 bp, Artificial Sequence
  chemically synthesized
cccattcttaaaatgttgct

SEQ ID NO: 205784 - DNA, 20 bp, Artificial Sequence
  chemically synthesized
ccattcttaaaatgttgctt

SEQ ID NO: 205785 - DNA, 20 bp, Artificial Sequence
  chemically synthesized
gaaggagaagatgaatgcct

SEQ ID NO: 205786 - DNA, 20 bp, Artificial Sequence
  chemically synthesized
taggcattcatcttctcctt

SEQ ID NO: 205787 - DNA, 20 bp, Artificial Sequence
  chemically synthesized
aggcattcatcttctccttc

SEQ ID NO: 205788 - DNA, 20 bp, Artificial Sequence
  chemically synthesized
cccccattatcctgaaggag

SEQ ID NO: 205789 - DNA, 20 bp, Artificial Sequence
  chemically synthesized
tttcccccattatcctgaag

SEQ ID NO: 205790 - DNA, 20 bp, Artificial Sequence
  chemically synthesized
attttcccccattatcctga

SEQ ID NO: 205791 - DNA, 20 bp, Artificial Sequence
  chemically synthesized
cattttcccccattatcctg

SEQ ID NO: 205792 - DNA, 20 bp, Artificial Sequence
  chemically synthesized
catcttctccttcaggataa

SEQ ID NO: 205793 - DNA, 20 bp, Artificial Sequence
  chemically synthesized
atcttctccttcaggataat

SEQ ID NO: 205794 - DNA, 20 bp, Artificial Sequence
  chemically synthesized
tcttctccttcaggataatg

SEQ ID NO: 205795 - DNA, 20 bp, Artificial Sequence
  chemically synthesized
cttctccttcaggataatgg

SEQ ID NO: 205796 - DNA, 20 bp, Artificial Sequence
  chemically synthesized
aagaagcaaataaaaagcat

SEQ ID NO: 205797 - DNA, 20 bp, Artificial Sequence
  chemically synthesized
atctacaagaagcaaataaa

SEQ ID NO: 205798 - DNA, 20 bp, Artificial Sequence
  chemically synthesized
tgctttttatttgcttcttg

SEQ ID NO: 205799 - DNA, 20 bp, Artificial Sequence
  chemically synthesized
aaattttcattatctacaag

SEQ ID NO: 205800 - DNA, 20 bp, Artificial Sequence
  chemically synthesized
ataaaattttcattatctac

SEQ ID NO: 205801 - DNA, 20 bp, Artificial Sequence
  chemically synthesized
gaaaattttattattcaccc

SEQ ID NO: 205802 - DNA, 20 bp, Artificial Sequence
  chemically synthesized
gaagcatcgatagcatgcta

SEQ ID NO: 205803 - DNA, 20 bp, Artificial Sequence
  chemically synthesized
tgaagcatcgatagcatgct

SEQ ID NO: 205804 - DNA, 20 bp, Artificial Sequence
  chemically synthesized
ctgaagcatcgatagcatgc

SEQ ID NO: 205805 - DNA, 20 bp, Artificial Sequence
  chemically synthesized
aggatcagctgaagcatcga

SEQ ID NO: 205806 - DNA, 20 bp, Artificial Sequence
  chemically synthesized
ctagcatgctatcgatgctt

SEQ ID NO: 205807 - DNA, 20 bp, Artificial Sequence
  chemically synthesized
gatgtttaaaggatcagctg

SEQ ID NO: 205808 - DNA, 20 bp, Artificial Sequence
  chemically synthesized
aggccagatgtttaaaggat

SEQ ID NO: 205809 - DNA, 20 bp, Artificial Sequence
  chemically synthesized
acagtaggccagatgtttaa

SEQ ID NO: 205810 - DNA, 20 bp, Artificial Sequence
  chemically synthesized
aacagtaggccagatgttta

SEQ ID NO: 205811 - DNA, 20 bp, Artificial Sequence
  chemically synthesized
cagctgatcctttaaacatc

SEQ ID NO: 205812 - DNA, 20 bp, Artificial Sequence
  chemically synthesized
atgcattttaaacagtaggc

SEQ ID NO: 205813 - DNA, 20 bp, Artificial Sequence
  chemically synthesized
ctccatgcattttaaacagt

SEQ ID NO: 205814 - DNA, 20 bp, Artificial Sequence
  chemically synthesized
actccatgcattttaaacag

SEQ ID NO: 205815 - DNA, 20 bp, Artificial Sequence
  chemically synthesized
ttcactccatgcattttaaa

SEQ ID NO: 205816 - DNA, 20 bp, Artificial Sequence
  chemically synthesized
ggcctactgtttaaaatgca

SEQ ID NO: 205817 - DNA, 20 bp, Artificial Sequence
  chemically synthesized
cctactgtttaaaatgcatg

SEQ ID NO: 205818 - DNA, 20 bp, Artificial Sequence
  chemically synthesized
tgcatggagtgaactgatgt

SEQ ID NO: 205819 - DNA, 20 bp, Artificial Sequence
  chemically synthesized
ttatcagcacgggctgacat

SEQ ID NO: 205820 - DNA, 20 bp, Artificial Sequence
  chemically synthesized
ggtcctctgattatcagcac

SEQ ID NO: 205821 - DNA, 20 bp, Artificial Sequence
  chemically synthesized
aggtcctctgattatcagca

SEQ ID NO: 205822 - DNA, 20 bp, Artificial Sequence
  chemically synthesized
tgtcagcccgtgctgataat

SEQ ID NO: 205823 - DNA, 20 bp, Artificial Sequence
  chemically synthesized
tcagcccgtgctgataatca

SEQ ID NO: 205824 - DNA, 20 bp, Artificial Sequence
  chemically synthesized
attgaaggtcctctgattat

SEQ ID NO: 205825 - DNA, 20 bp, Artificial Sequence
  chemically synthesized
cagcccgtgctgataatcag

SEQ ID NO: 205826 - DNA, 20 bp, Artificial Sequence
  chemically synthesized
taatcagaggaccttcaatt

SEQ ID NO: 205827 - DNA, 20 bp, Artificial Sequence
  chemically synthesized
cttcgtaggtacttaattga

SEQ ID NO: 205828 - DNA, 20 bp, Artificial Sequence
  chemically synthesized
gcttcgtaggtacttaattg

SEQ ID NO: 205829 - DNA, 20 bp, Artificial Sequence
  chemically synthesized
ccttcaattaagtacctacg

SEQ ID NO: 205830 - DNA, 20 bp, Artificial Sequence
  chemically synthesized
tttatcattggttgcttcgt

SEQ ID NO: 205831 - DNA, 20 bp, Artificial Sequence
  chemically synthesized
ttttatcattggttgcttcg

SEQ ID NO: 205832 - DNA, 20 bp, Artificial Sequence
  chemically synthesized
tacgaagcaaccaatgataa

SEQ ID NO: 205833 - DNA, 20 bp, Artificial Sequence
  chemically synthesized
tgtcttttctcttttatcat

SEQ ID NO: 205834 - DNA, 20 bp, Artificial Sequence
  chemically synthesized
cgaagcaaccaatgataaaa

SEQ ID NO: 205835 - DNA, 20 bp, Artificial Sequence
  chemically synthesized
caaccaatgataaaagagaa

SEQ ID NO: 205836 - DNA, 20 bp, Artificial Sequence
  chemically synthesized
caatgataaaagagaaaaga

SEQ ID NO: 205837 - DNA, 20 bp, Artificial Sequence
  chemically synthesized
taaaagagaaaagacagtgc

SEQ ID NO: 205838 - DNA, 20 bp, Artificial Sequence
  chemically synthesized
aagacagtgcaagtttgcca

SEQ ID NO: 205839 - DNA, 20 bp, Artificial Sequence
  chemically synthesized
cagactatgaaagaattctt

SEQ ID NO: 205840 - DNA, 20 bp, Artificial Sequence
  chemically synthesized
tttgccaaagaattctttca

SEQ ID NO: 205841 - DNA, 20 bp, Artificial Sequence
  chemically synthesized
ttttgagaatcagactatga

SEQ ID NO: 205842 - DNA, 20 bp, Artificial Sequence
  chemically synthesized
ttctaattgcttttgagaat

SEQ ID NO: 205843 - DNA, 20 bp, Artificial Sequence
  chemically synthesized
tttcatagtctgattctcaa

SEQ ID NO: 205844 - DNA, 20 bp, Artificial Sequence
  chemically synthesized
aagtgattctaattgctttt

SEQ ID NO: 205845 - DNA, 20 bp, Artificial Sequence
  chemically synthesized
gtctgattctcaaaagcaat

SEQ ID NO: 205846 - DNA, 20 bp, Artificial Sequence
  chemically synthesized
gcaattagaatcacttcttt

SEQ ID NO: 205847 - DNA, 20 bp, Artificial Sequence
  chemically synthesized
attaattccaaggccaaaag

SEQ ID NO: 205848 - DNA, 20 bp, Artificial Sequence
  chemically synthesized
agaatcacttcttttggcct

SEQ ID NO: 205849 - DNA, 20 bp, Artificial Sequence
  chemically synthesized
ttcattaattccaaggccaa

SEQ ID NO: 205850 - DNA, 20 bp, Artificial Sequence
  chemically synthesized
atgaaaattcattaattcca

SEQ ID NO: 205851 - DNA, 20 bp, Artificial Sequence
  chemically synthesized
aatgaaaattcattaattcc

SEQ ID NO: 205852 - DNA, 20 bp, Artificial Sequence
  chemically synthesized
tttaaatttcaaatgattcc

SEQ ID NO: 205853 - DNA, 20 bp, Artificial Sequence
  chemically synthesized
ttaaatttcaaatgattcca

SEQ ID NO: 205854 - DNA, 20 bp, Artificial Sequence
  chemically synthesized
cttctcaagtttgatatcct

SEQ ID NO: 205855 - DNA, 20 bp, Artificial Sequence
  chemically synthesized
attccaaggatatcaaactt

SEQ ID NO: 205856 - DNA, 20 bp, Artificial Sequence
  chemically synthesized
ccaaggatatcaaacttgag

SEQ ID NO: 205857 - DNA, 20 bp, Artificial Sequence
  chemically synthesized
gacaatcagctcaacttctc

SEQ ID NO: 205858 - DNA, 20 bp, Artificial Sequence
  chemically synthesized
gatatcaaacttgagaagtt

SEQ ID NO: 205859 - DNA, 20 bp, Artificial Sequence
  chemically synthesized
tgatttattacgtagacaat

SEQ ID NO: 205860 - DNA, 20 bp, Artificial Sequence
  chemically synthesized
ctgtggtgtgatttattacg

SEQ ID NO: 205861 - DNA, 20 bp, Artificial Sequence
  chemically synthesized
ctacgtaataaatcacacca

SEQ ID NO: 205862 - DNA, 20 bp, Artificial Sequence
  chemically synthesized
tacgtaataaatcacaccac

SEQ ID NO: 205863 - DNA, 20 bp, Artificial Sequence
  chemically synthesized
gtctttttgacatgttcctg

SEQ ID NO: 205864 - DNA, 20 bp, Artificial Sequence
  chemically synthesized
caccacaggaacatgtcaaa

SEQ ID NO: 205865 - DNA, 20 bp, Artificial Sequence
  chemically synthesized
catgtcaaaaagactaatgc

SEQ ID NO: 205866 - DNA, 20 bp, Artificial Sequence
  chemically synthesized
ggacggcaaagaacttgcat

SEQ ID NO: 205867 - DNA, 20 bp, Artificial Sequence
  chemically synthesized
aaacaaaactttggacggca

SEQ ID NO: 205868 - DNA, 20 bp, Artificial Sequence
  chemically synthesized
tgcaagttctttgccgtcca

SEQ ID NO: 205869 - DNA, 20 bp, Artificial Sequence
  chemically synthesized
aggagaaacaaaactttgga

SEQ ID NO: 205870 - DNA, 20 bp, Artificial Sequence
  chemically synthesized
gacaaggagaaacaaaactt

SEQ ID NO: 205871 - DNA, 20 bp, Artificial Sequence
  chemically synthesized
aaagttttgtttctccttgt

SEQ ID NO: 205872 - DNA, 20 bp, Artificial Sequence
  chemically synthesized
gttcacatagcactgacaag

SEQ ID NO: 205873 - DNA, 20 bp, Artificial Sequence
  chemically synthesized
atgttcacatagcactgaca

SEQ ID NO: 205874 - DNA, 20 bp, Artificial Sequence
  chemically synthesized
tatgttcacatagcactgac

SEQ ID NO: 205875 - DNA, 20 bp, Artificial Sequence
  chemically synthesized
agcaattatatatgttcaca

SEQ ID NO: 205876 - DNA, 20 bp, Artificial Sequence
  chemically synthesized
aagctgcttccaggaaaaga

SEQ ID NO: 205877 - DNA, 20 bp, Artificial Sequence
  chemically synthesized
atataattgctttcttttcc

SEQ ID NO: 205878 - DNA, 20 bp, Artificial Sequence
  chemically synthesized
taattgctttcttttcctgg

SEQ ID NO: 205879 - DNA, 20 bp, Artificial Sequence
  chemically synthesized
gggtaagctgcttccaggaa

SEQ ID NO: 205880 - DNA, 20 bp, Artificial Sequence
  chemically synthesized
ttgctttcttttcctggaag

SEQ ID NO: 205881 - DNA, 20 bp, Artificial Sequence
  chemically synthesized
tctttgggtaagctgcttcc

SEQ ID NO: 205882 - DNA, 20 bp, Artificial Sequence
  chemically synthesized
gtctttgggtaagctgcttc

SEQ ID NO: 205883 - DNA, 20 bp, Artificial Sequence
  chemically synthesized
tcctggaagcagcttaccca

SEQ ID NO: 205884 - DNA, 20 bp, Artificial Sequence
  chemically synthesized
ataatggtaggtctttgggt

SEQ ID NO: 205885 - DNA, 20 bp, Artificial Sequence
  chemically synthesized
tgtaataatggtaggtcttt

SEQ ID NO: 205886 - DNA, 20 bp, Artificial Sequence
  chemically synthesized
gtgtaataatggtaggtctt

SEQ ID NO: 205887 - DNA, 20 bp, Artificial Sequence
  chemically synthesized
atacggagtgtaataatggt

SEQ ID NO: 205888 - DNA, 20 bp, Artificial Sequence
  chemically synthesized
aatacggagtgtaataatgg

SEQ ID NO: 205889 - DNA, 20 bp, Artificial Sequence
  chemically synthesized
agaaatacggagtgtaataa

SEQ ID NO: 205890 - DNA, 20 bp, Artificial Sequence
  chemically synthesized
tctaaacagagagaaatacg

SEQ ID NO: 205891 - DNA, 20 bp, Artificial Sequence
  chemically synthesized
attctaaacagagagaaata

SEQ ID NO: 205892 - DNA, 20 bp, Artificial Sequence
  chemically synthesized
actccgtatttctctctgtt

SEQ ID NO: 205893 - DNA, 20 bp, Artificial Sequence
  chemically synthesized
tttcaaaaattctaaacaga

SEQ ID NO: 205894 - DNA, 20 bp, Artificial Sequence
  chemically synthesized
catttcaaaaattctaaaca

SEQ ID NO: 205895 - DNA, 20 bp, Artificial Sequence
  chemically synthesized
atcatttcaaaaattctaaa

SEQ ID NO: 205896 - DNA, 20 bp, Artificial Sequence
  chemically synthesized
atttttgaaatgataactcc

SEQ ID NO: 205897 - DNA, 20 bp, Artificial Sequence
  chemically synthesized
actagtttcaattaatcttg

SEQ ID NO: 205898 - DNA, 20 bp, Artificial Sequence
  chemically synthesized
gaactagtttcaattaatct

SEQ ID NO: 205899 - DNA, 20 bp, Artificial Sequence
  chemically synthesized
actccaagattaattgaaac

SEQ ID NO: 205900 - DNA, 20 bp, Artificial Sequence
  chemically synthesized
agattaattgaaactagttc

SEQ ID NO: 205901 - DNA, 20 bp, Artificial Sequence
  chemically synthesized
cttgttttgtagacttgaac

SEQ ID NO: 205902 - DNA, 20 bp, Artificial Sequence
  chemically synthesized
ctagttcaagtctacaaaac

SEQ ID NO: 205903 - DNA, 20 bp, Artificial Sequence
  chemically synthesized
atgagagcaaacttgttttg

SEQ ID NO: 205904 - DNA, 20 bp, Artificial Sequence
  chemically synthesized
catatcacattcaattatga

SEQ ID NO: 205905 - DNA, 20 bp, Artificial Sequence
  chemically synthesized
atcatatcacattcaattat

SEQ ID NO: 205906 - DNA, 20 bp, Artificial Sequence
  chemically synthesized
atgatttttataaattgctg

SEQ ID NO: 205907 - DNA, 20 bp, Artificial Sequence
  chemically synthesized
cagtgtgaagaatgtaactg

SEQ ID NO: 205908 - DNA, 20 bp, Artificial Sequence
  chemically synthesized
tttaagcaaattacagtgtg

SEQ ID NO: 205909 - DNA, 20 bp, Artificial Sequence
  chemically synthesized
ttcctcatttaagcaaatta

SEQ ID NO: 205910 - DNA, 20 bp, Artificial Sequence
  chemically synthesized
acactgtaatttgcttaaat

SEQ ID NO: 205911 - DNA, 20 bp, Artificial Sequence
  chemically synthesized
cactgtaatttgcttaaatg

SEQ ID NO: 205912 - DNA, 20 bp, Artificial Sequence
  chemically synthesized
tcaactttatttcctcattt

SEQ ID NO: 205913 - DNA, 20 bp, Artificial Sequence
  chemically synthesized
tttgcttaaatgaggaaata

SEQ ID NO: 205914 - DNA, 20 bp, Artificial Sequence
  chemically synthesized
aatacaggatatgttgatat

SEQ ID NO: 205915 - DNA, 20 bp, Artificial Sequence
  chemically synthesized
taaatgtcactttcaaatac

SEQ ID NO: 205916 - DNA, 20 bp, Artificial Sequence
  chemically synthesized
tcaacatatcctgtatttga

SEQ ID NO: 205917 - DNA, 20 bp, Artificial Sequence
  chemically synthesized
ttaaatgtcactttcaaata

SEQ ID NO: 205918 - DNA, 20 bp, Artificial Sequence
  chemically synthesized
tgacatttaacttaataaca

SEQ ID NO: 205919 - DNA, 20 bp, Artificial Sequence
  chemically synthesized
aagacaatgtctgtgttatt

SEQ ID NO: 205920 - DNA, 20 bp, Artificial Sequence
  chemically synthesized
cagacattgtctttacttga

SEQ ID NO: 205921 - DNA, 20 bp, Artificial Sequence
  chemically synthesized
attttgttttctgtcaagta

SEQ ID NO: 205922 - DNA, 20 bp, Artificial Sequence
  chemically synthesized
aatgtattttgttttctgtc

SEQ ID NO: 205923 - DNA, 20 bp, Artificial Sequence
  chemically synthesized
tgacagaaaacaaaatacat

SEQ ID NO: 205924 - DNA, 20 bp, Artificial Sequence
  chemically synthesized
tggatgtttgtgtatgtgta

SEQ ID NO: 205925 - DNA, 20 bp, Artificial Sequence
  chemically synthesized
tgtttgtgtatgtgtaaagt

SEQ ID NO: 205926 - DNA, 20 bp, Artificial Sequence
  chemically synthesized
gtaaagtaagtgttgtattt

SEQ ID NO: 205927 - DNA, 20 bp, Artificial Sequence
  chemically synthesized
gtgttgtattttggactgta

SEQ ID NO: 205928 - DNA, 20 bp, Artificial Sequence
  chemically synthesized
ttgtattttggactgtacag

SEQ ID NO: 205929 - DNA, 20 bp, Artificial Sequence
  chemically synthesized
ttcatggttatacttctgta

SEQ ID NO: 205930 - DNA, 20 bp, Artificial Sequence
  chemically synthesized
tacagaagtataaccatgaa

SEQ ID NO: 205931 - DNA, 20 bp, Artificial Sequence
  chemically synthesized
aagatgtttagcacttttca

SEQ ID NO: 205932 - DNA, 20 bp, Artificial Sequence
  chemically synthesized
tttctatggccaaagatgtt

SEQ ID NO: 205933 - DNA, 20 bp, Artificial Sequence
  chemically synthesized
tgaaaagtgctaaacatctt

SEQ ID NO: 205934 - DNA, 20 bp, Artificial Sequence
  chemically synthesized
gtgctaaacatctttggcca

SEQ ID NO: 205935 - DNA, 20 bp, Artificial Sequence
  chemically synthesized
cgtgttgctttctatggcca

SEQ ID NO: 205936 - DNA, 20 bp, Artificial Sequence
  chemically synthesized
taaacatctttggccataga

SEQ ID NO: 205937 - DNA, 20 bp, Artificial Sequence
  chemically synthesized
aacacccgtgttgctttcta

SEQ ID NO: 205938 - DNA, 20 bp, Artificial Sequence
  chemically synthesized
tttggccatagaaagcaaca

SEQ ID NO: 205939 - DNA, 20 bp, Artificial Sequence
  chemically synthesized
ttggccatagaaagcaacac

SEQ ID NO: 205940 - DNA, 20 bp, Artificial Sequence
  chemically synthesized
gcaacacgggtgttttgaaa

SEQ ID NO: 205941 - DNA, 20 bp, Artificial Sequence
  chemically synthesized
tttgaaatggtaataaaatt

SEQ ID NO: 205942 - DNA, 20 bp, Artificial Sequence
  chemically synthesized
ggtaataaaattgagcaata

SEQ ID NO: 205943 - DNA, 20 bp, Artificial Sequence
  chemically synthesized
aataaaattgagcaataaag

SEQ ID NO: 205944 - DNA, 20 bp, Artificial Sequence
  chemically synthesized
gaaaaataatattcatataa

SEQ ID NO: 205945 - DNA, 20 bp, Artificial Sequence
  chemically synthesized
aaataatattcatataaaag

SEQ ID NO: 205946 - DNA, 20 bp, Artificial Sequence
  chemically synthesized
tataaaagtggtcttgtctg

SEQ ID NO: 205947 - DNA, 20 bp, Artificial Sequence
  chemically synthesized
aatatttaacgtccacagac

SEQ ID NO: 205948 - DNA, 20 bp, Artificial Sequence
  chemically synthesized
attaaaatatttaacgtcca

SEQ ID NO: 205949 - DNA, 20 bp, Artificial Sequence
  chemically synthesized
gtgttgtgctgttttaattc

SEQ ID NO: 205950 - DNA, 20 bp, Artificial Sequence
  chemically synthesized
attttaatcttgaattaaaa

SEQ ID NO: 205951 - DNA, 20 bp, Artificial Sequence
  chemically synthesized
attaaaacagcacaacacgt

SEQ ID NO: 205952 - DNA, 20 bp, Artificial Sequence
  chemically synthesized
acagcacaacacgtaagtaa

SEQ ID NO: 205953 - DNA, 20 bp, Artificial Sequence
  chemically synthesized
cagcacaacacgtaagtaat

SEQ ID NO: 205954 - DNA, 20 bp, Artificial Sequence
  chemically synthesized
ttttgtcagaatgagttaaa

SEQ ID NO: 205955 - DNA, 20 bp, Artificial Sequence
  chemically synthesized
acttttgtcagaatgagtta

SEQ ID NO: 205956 - DNA, 20 bp, Artificial Sequence
  chemically synthesized
gcacatacttttgtcagaat

SEQ ID NO: 205957 - DNA, 20 bp, Artificial Sequence
  chemically synthesized
tctttaactcattctgacaa

SEQ ID NO: 205958 - DNA, 20 bp, Artificial Sequence
  chemically synthesized
aaacatgcacatacttttgt

SEQ ID NO: 205959 - DNA, 20 bp, Artificial Sequence
  chemically synthesized
gttttcaataacaaatttca

SEQ ID NO: 205960 - DNA, 20 bp, Artificial Sequence
  chemically synthesized
tcactgtcgaggaaagaaag

SEQ ID NO: 205961 - DNA, 20 bp, Artificial Sequence
  chemically synthesized
ttcactgtcgaggaaagaaa

SEQ ID NO: 205962 - DNA, 20 bp, Artificial Sequence
  chemically synthesized
gattcactgtcgaggaaaga

SEQ ID NO: 205963 - DNA, 20 bp, Artificial Sequence
  chemically synthesized
gtacctctttctttcctcga

SEQ ID NO: 205964 - DNA, 20 bp, Artificial Sequence
  chemically synthesized
agaagattcactgtcgagga

SEQ ID NO: 205965 - DNA, 20 bp, Artificial Sequence
  chemically synthesized
acaaagaagattcactgtcg

SEQ ID NO: 205966 - DNA, 20 bp, Artificial Sequence
  chemically synthesized
gacaaagaagattcactgtc

SEQ ID NO: 205967 - DNA, 20 bp, Artificial Sequence
  chemically synthesized
cgacagtgaatcttctttgt

SEQ ID NO: 205968 - DNA, 20 bp, Artificial Sequence
  chemically synthesized
gacagtgaatcttctttgtc

SEQ ID NO: 205969 - DNA, 20 bp, Artificial Sequence
  chemically synthesized
gattttttttcctgacaaag

SEQ ID NO: 205970 - DNA, 20 bp, Artificial Sequence
  chemically synthesized
tgagattttttttcctgaca

SEQ ID NO: 205971 - DNA, 20 bp, Artificial Sequence
  chemically synthesized
gtcaggaaaaaaaatctcaa

SEQ ID NO: 205972 - DNA, 20 bp, Artificial Sequence
  chemically synthesized
aaattcttctttagactgtt

SEQ ID NO: 205973 - DNA, 20 bp, Artificial Sequence
  chemically synthesized
aaaaaaatctcaacagtcta

SEQ ID NO: 205974 - DNA, 20 bp, Artificial Sequence
  chemically synthesized
aaaatctcaacagtctaaag

SEQ ID NO: 205975 - DNA, 20 bp, Artificial Sequence
  chemically synthesized
tgtttaagaaaattcttctt

SEQ ID NO: 205976 - DNA, 20 bp, Artificial Sequence
  chemically synthesized
gatatggatatgtcatgttt

SEQ ID NO: 205977 - DNA, 20 bp, Artificial Sequence
  chemically synthesized
aaacatgacatatccatatc

SEQ ID NO: 205978 - DNA, 20 bp, Artificial Sequence
  chemically synthesized
catgacatatccatatcaag

SEQ ID NO: 205979 - DNA, 20 bp, Artificial Sequence
  chemically synthesized
tccttcatggctgcttgata

SEQ ID NO: 205980 - DNA, 20 bp, Artificial Sequence
  chemically synthesized
atccatatcaagcagccatg

SEQ ID NO: 205981 - DNA, 20 bp, Artificial Sequence
  chemically synthesized
tccatatcaagcagccatga

SEQ ID NO: 205982 - DNA, 20 bp, Artificial Sequence
  chemically synthesized
gaactagaaacattccttca

SEQ ID NO: 205983 - DNA, 20 bp, Artificial Sequence
  chemically synthesized
cagccatgaaggaatgtttc

SEQ ID NO: 205984 - DNA, 20 bp, Artificial Sequence
  chemically synthesized
aaaaatattacagtaagaac

SEQ ID NO: 205985 - DNA, 20 bp, Artificial Sequence
  chemically synthesized
ggcaagaaaaatattacagt

SEQ ID NO: 205986 - DNA, 20 bp, Artificial Sequence
  chemically synthesized
acatggcaagaaaaatatta

SEQ ID NO: 205987 - DNA, 20 bp, Artificial Sequence
  chemically synthesized
cctgtgaagagggacatggc

SEQ ID NO: 205988 - DNA, 20 bp, Artificial Sequence
  chemically synthesized
tacacctgtgaagagggaca

SEQ ID NO: 205989 - DNA, 20 bp, Artificial Sequence
  chemically synthesized
tcttgccatgtccctcttca

SEQ ID NO: 205990 - DNA, 20 bp, Artificial Sequence
  chemically synthesized
cttgccatgtccctcttcac

SEQ ID NO: 205991 - DNA, 20 bp, Artificial Sequence
  chemically synthesized
tcaaagtacacctgtgaaga

SEQ ID NO: 205992 - DNA, 20 bp, Artificial Sequence
  chemically synthesized
ttcaaagtacacctgtgaag

SEQ ID NO: 205993 - DNA, 20 bp, Artificial Sequence
  chemically synthesized
attcaaagtacacctgtgaa

SEQ ID NO: 205994 - DNA, 20 bp, Artificial Sequence
  chemically synthesized
tgattcaaagtacacctgtg

SEQ ID NO: 205995 - DNA, 20 bp, Artificial Sequence
  chemically synthesized
ttcacaggtgtactttgaat

SEQ ID NO: 205996 - DNA, 20 bp, Artificial Sequence
  chemically synthesized
aagttaatcaatctgattca

SEQ ID NO: 205997 - DNA, 20 bp, Artificial Sequence
  chemically synthesized
aatcagattgattaacttat

SEQ ID NO: 205998 - DNA, 20 bp, Artificial Sequence
  chemically synthesized
cagattgattaacttatcag

SEQ ID NO: 205999 - DNA, 20 bp, Artificial Sequence
  chemically synthesized
tgaacaattaaaccactgat

SEQ ID NO: 206000 - DNA, 20 bp, Artificial Sequence
  chemically synthesized
ctttataaaatattaataca

SEQ ID NO: 206001 - DNA, 20 bp, Artificial Sequence
  chemically synthesized
ccatgtattaatattttata

SEQ ID NO: 206002 - DNA, 20 bp, Artificial Sequence
  chemically synthesized
catgtattaatattttataa

SEQ ID NO: 206003 - DNA, 20 bp, Artificial Sequence
  chemically synthesized
tttataaaggattttgaacc

SEQ ID NO: 206004 - DNA, 20 bp, Artificial Sequence
  chemically synthesized
ttataaaggattttgaacct

SEQ ID NO: 206005 - DNA, 20 bp, Artificial Sequence
  chemically synthesized
tataaaggattttgaacctg

SEQ ID NO: 206006 - DNA, 20 bp, Artificial Sequence
  chemically synthesized
tagtgcagaggttttgcccc

SEQ ID NO: 206007 - DNA, 20 bp, Artificial Sequence
  chemically synthesized
ttagtgcagaggttttgccc

SEQ ID NO: 206008 - DNA, 20 bp, Artificial Sequence
  chemically synthesized
atgggggaaatttagtgcag

SEQ ID NO: 206009 - DNA, 20 bp, Artificial Sequence
  chemically synthesized
gatgggggaaatttagtgca

SEQ ID NO: 206010 - DNA, 20 bp, Artificial Sequence
  chemically synthesized
tggatgggggaaatttagtg

SEQ ID NO: 206011 - DNA, 20 bp, Artificial Sequence
  chemically synthesized
atcgatggatgggggaaatt

SEQ ID NO: 206012 - DNA, 20 bp, Artificial Sequence
  chemically synthesized
tggaaaagatcgatggatgg

SEQ ID NO: 206013 - DNA, 20 bp, Artificial Sequence
  chemically synthesized
ttggaaaagatcgatggatg

SEQ ID NO: 206014 - DNA, 20 bp, Artificial Sequence
  chemically synthesized
gttggaaaagatcgatggat

SEQ ID NO: 206015 - DNA, 20 bp, Artificial Sequence
  chemically synthesized
agttggaaaagatcgatgga

SEQ ID NO: 206016 - DNA, 20 bp, Artificial Sequence
  chemically synthesized
gctgagttggaaaagatcga

SEQ ID NO: 206017 - DNA, 20 bp, Artificial Sequence
  chemically synthesized
gttgaaatgctgagttggaa

SEQ ID NO: 206018 - DNA, 20 bp, Artificial Sequence
  chemically synthesized
tccatcgatcttttccaact

SEQ ID NO: 206019 - DNA, 20 bp, Artificial Sequence
  chemically synthesized
gttctgttgaaatgctgagt

SEQ ID NO: 206020 - DNA, 20 bp, Artificial Sequence
  chemically synthesized
ttaagttctgttgaaatgct

SEQ ID NO: 206021 - DNA, 20 bp, Artificial Sequence
  chemically synthesized
tttccaactcagcatttcaa

SEQ ID NO: 206022 - DNA, 20 bp, Artificial Sequence
  chemically synthesized
tttcaacagaacttaaatca

SEQ ID NO: 206023 - DNA, 20 bp, Artificial Sequence
  chemically synthesized
ttcaacagaacttaaatcac

SEQ ID NO: 206024 - DNA, 20 bp, Artificial Sequence
  chemically synthesized
agccagcacccctgtgattt

SEQ ID NO: 206025 - DNA, 20 bp, Artificial Sequence
  chemically synthesized
tcaacagaacttaaatcaca

SEQ ID NO: 206026 - DNA, 20 bp, Artificial Sequence
  chemically synthesized
caacagaacttaaatcacag

SEQ ID NO: 206027 - DNA, 20 bp, Artificial Sequence
  chemically synthesized
aacttaaatcacaggggtgc

SEQ ID NO: 206028 - DNA, 20 bp, Artificial Sequence
  chemically synthesized
ttatacatttatttataagc

SEQ ID NO: 206029 - DNA, 20 bp, Artificial Sequence
  chemically synthesized
attgttatacatttatttat

SEQ ID NO: 206030 - DNA, 20 bp, Artificial Sequence
  chemically synthesized
tgtataacaataaataaaaa

SEQ ID NO: 206031 - DNA, 20 bp, Artificial Sequence
  chemically synthesized
taaataaaaatagatgattg

SEQ ID NO: 206032 - DNA, 20 bp, Artificial Sequence
  chemically synthesized
aaatagatgattgtggcttt

SEQ ID NO: 206033 - DNA, 20 bp, Artificial Sequence
  chemically synthesized
cagtctctgaacatatctta

SEQ ID NO: 206034 - DNA, 20 bp, Artificial Sequence
  chemically synthesized
ttgtggctttaagatatgtt

SEQ ID NO: 206035 - DNA, 20 bp, Artificial Sequence
  chemically synthesized
gtggctttaagatatgttca

SEQ ID NO: 206036 - DNA, 20 bp, Artificial Sequence
  chemically synthesized
tttaagatatgttcagagac

SEQ ID NO: 206037 - DNA, 20 bp, Artificial Sequence
  chemically synthesized
aagatatgttcagagactgg

SEQ ID NO: 206038 - DNA, 20 bp, Artificial Sequence
  chemically synthesized
tatgttcagagactggaaga

SEQ ID NO: 206039 - DNA, 20 bp, Artificial Sequence
  chemically synthesized
tgttcagagactggaagaaa

SEQ ID NO: 206040 - DNA, 20 bp, Artificial Sequence
  chemically synthesized
gggacttctgctctttcttc

SEQ ID NO: 206041 - DNA, 20 bp, Artificial Sequence
  chemically synthesized
tcagagactggaagaaagag

SEQ ID NO: 206042 - DNA, 20 bp, Artificial Sequence
  chemically synthesized
gagactggaagaaagagcag

SEQ ID NO: 206043 - DNA, 20 bp, Artificial Sequence
  chemically synthesized
aacagttcgatggtcagttg

SEQ ID NO: 206044 - DNA, 20 bp, Artificial Sequence
  chemically synthesized
gaacagttcgatggtcagtt

SEQ ID NO: 206045 - DNA, 20 bp, Artificial Sequence
  chemically synthesized
agaacagttcgatggtcagt

SEQ ID NO: 206046 - DNA, 20 bp, Artificial Sequence
  chemically synthesized
cattagaacagttcgatggt

SEQ ID NO: 206047 - DNA, 20 bp, Artificial Sequence
  chemically synthesized
tggacattagaacagttcga

SEQ ID NO: 206048 - DNA, 20 bp, Artificial Sequence
  chemically synthesized
aaataaaatggacattagaa

SEQ ID NO: 206049 - DNA, 20 bp, Artificial Sequence
  chemically synthesized
ggggcaaataaaatggacat

SEQ ID NO: 206050 - DNA, 20 bp, Artificial Sequence
  chemically synthesized
actatgtggggcaaataaaa

SEQ ID NO: 206051 - DNA, 20 bp, Artificial Sequence
  chemically synthesized
tccattttatttgccccaca

SEQ ID NO: 206052 - DNA, 20 bp, Artificial Sequence
  chemically synthesized
aaatatttaaacactatgtg

SEQ ID NO: 206053 - DNA, 20 bp, Artificial Sequence
  chemically synthesized
gaaatatttaaacactatgt

SEQ ID NO: 206054 - DNA, 20 bp, Artificial Sequence
  chemically synthesized
tgaaatatttaaacactatg

SEQ ID NO: 206055 - DNA, 20 bp, Artificial Sequence
  chemically synthesized
cacatagtgtttaaatattt

SEQ ID NO: 206056 - DNA, 20 bp, Artificial Sequence
  chemically synthesized
tgtttaaatatttcagtata

SEQ ID NO: 206057 - DNA, 20 bp, Artificial Sequence
  chemically synthesized
taaatatttcagtatatagt

SEQ ID NO: 206058 - DNA, 20 bp, Artificial Sequence
  chemically synthesized
atttcagtatatagtcagct

SEQ ID NO: 206059 - DNA, 20 bp, Artificial Sequence
  chemically synthesized
ctatctatgcaagaggttcc

SEQ ID NO: 206060 - DNA, 20 bp, Artificial Sequence
  chemically synthesized
tcagcttggaacctcttgca

SEQ ID NO: 206061 - DNA, 20 bp, Artificial Sequence
  chemically synthesized
gtaagggctatctatgcaag

SEQ ID NO: 206062 - DNA, 20 bp, Artificial Sequence
  chemically synthesized
agtaagggctatctatgcaa

SEQ ID NO: 206063 - DNA, 20 bp, Artificial Sequence
  chemically synthesized
cttggaacctcttgcataga

SEQ ID NO: 206064 - DNA, 20 bp, Artificial Sequence
  chemically synthesized
gtagtaagggctatctatgc

SEQ ID NO: 206065 - DNA, 20 bp, Artificial Sequence
  chemically synthesized
agaaaagcatgaagtagtaa

SEQ ID NO: 206066 - DNA, 20 bp, Artificial Sequence
  chemically synthesized
cagaaaagcatgaagtagta

SEQ ID NO: 206067 - DNA, 20 bp, Artificial Sequence
  chemically synthesized
acagaaaagcatgaagtagt

SEQ ID NO: 206068 - DNA, 20 bp, Artificial Sequence
  chemically synthesized
ggtaacagaaaagcatgaag

SEQ ID NO: 206069 - DNA, 20 bp, Artificial Sequence
  chemically synthesized
tcaggtaacagaaaagcatg

SEQ ID NO: 206070 - DNA, 20 bp, Artificial Sequence
  chemically synthesized
tgggtagtcaggtaacagaa

SEQ ID NO: 206071 - DNA, 20 bp, Artificial Sequence
  chemically synthesized
acacatgggtagtcaggtaa

SEQ ID NO: 206072 - DNA, 20 bp, Artificial Sequence
  chemically synthesized
aaatgtacacatgggtagtc

SEQ ID NO: 206073 - DNA, 20 bp, Artificial Sequence
  chemically synthesized
aaaatgtacacatgggtagt

SEQ ID NO: 206074 - DNA, 20 bp, Artificial Sequence
  chemically synthesized
aaacaaaatgtacacatggg

SEQ ID NO: 206075 - DNA, 20 bp, Artificial Sequence
  chemically synthesized
gcaaaacaaaatgtacacat

SEQ ID NO: 206076 - DNA, 20 bp, Artificial Sequence
  chemically synthesized
tgcaaaacaaaatgtacaca

SEQ ID NO: 206077 - DNA, 20 bp, Artificial Sequence
  chemically synthesized
ttgttttgcaacacctgcat

SEQ ID NO: 206078 - DNA, 20 bp, Artificial Sequence
  chemically synthesized
aacatgtcagcatctaatgc

SEQ ID NO: 206079 - DNA, 20 bp, Artificial Sequence
  chemically synthesized
caacatgtcagcatctaatg

SEQ ID NO: 206080 - DNA, 20 bp, Artificial Sequence
  chemically synthesized
atacaatataatcaacatgt

SEQ ID NO: 206081 - DNA, 20 bp, Artificial Sequence
  chemically synthesized
tgaggctaggcatgcagtgt

SEQ ID NO: 206082 - DNA, 20 bp, Artificial Sequence
  chemically synthesized
ttatactgacactgcatgcc

SEQ ID NO: 206083 - DNA, 20 bp, Artificial Sequence
  chemically synthesized
acgagatgaggctaggcatg

SEQ ID NO: 206084 - DNA, 20 bp, Artificial Sequence
  chemically synthesized
agtagggacgagatgaggct

SEQ ID NO: 206085 - DNA, 20 bp, Artificial Sequence
  chemically synthesized
aagtagggacgagatgaggc

SEQ ID NO: 206086 - DNA, 20 bp, Artificial Sequence
  chemically synthesized
gtgaaagtagggacgagatg

SEQ ID NO: 206087 - DNA, 20 bp, Artificial Sequence
  chemically synthesized
tgtgaaagtagggacgagat

SEQ ID NO: 206088 - DNA, 20 bp, Artificial Sequence
  chemically synthesized
tcagctgtgaaagtagggac

SEQ ID NO: 206089 - DNA, 20 bp, Artificial Sequence
  chemically synthesized
agatctcagctgtgaaagta

SEQ ID NO: 206090 - DNA, 20 bp, Artificial Sequence
  chemically synthesized
tcatctcgtccctactttca

SEQ ID NO: 206091 - DNA, 20 bp, Artificial Sequence
  chemically synthesized
tagatctcagctgtgaaagt

SEQ ID NO: 206092 - DNA, 20 bp, Artificial Sequence
  chemically synthesized
ctagatctcagctgtgaaag

SEQ ID NO: 206093 - DNA, 20 bp, Artificial Sequence
  chemically synthesized
gctctagatctcagctgtga

SEQ ID NO: 206094 - DNA, 20 bp, Artificial Sequence
  chemically synthesized
tcgtccctactttcacagct

SEQ ID NO: 206095 - DNA, 20 bp, Artificial Sequence
  chemically synthesized
ctactttcacagctgagatc

SEQ ID NO: 206096 - DNA, 20 bp, Artificial Sequence
  chemically synthesized
actttcacagctgagatcta

SEQ ID NO: 206097 - DNA, 20 bp, Artificial Sequence
  chemically synthesized
tgcaacagggctctagatct

SEQ ID NO: 206098 - DNA, 20 bp, Artificial Sequence
  chemically synthesized
atgtttttgcaacagggctc

SEQ ID NO: 206099 - DNA, 20 bp, Artificial Sequence
  chemically synthesized
gttaaaatgtttttgcaaca

SEQ ID NO: 206100 - DNA, 20 bp, Artificial Sequence
  chemically synthesized
ggttaaaatgtttttgcaac

SEQ ID NO: 206101 - DNA, 20 bp, Artificial Sequence
  chemically synthesized
aggttaaaatgtttttgcaa

SEQ ID NO: 206102 - DNA, 20 bp, Artificial Sequence
  chemically synthesized
caaaaacattttaacctctg

SEQ ID NO: 206103 - DNA, 20 bp, Artificial Sequence
  chemically synthesized
aaaacattttaacctctgta

SEQ ID NO: 206104 - DNA, 20 bp, Artificial Sequence
  chemically synthesized
aacattttaacctctgtaga

SEQ ID NO: 206105 - DNA, 20 bp, Artificial Sequence
  chemically synthesized
aaacgccctgctctctacag

SEQ ID NO: 206106 - DNA, 20 bp, Artificial Sequence
  chemically synthesized
aaaacgccctgctctctaca

SEQ ID NO: 206107 - DNA, 20 bp, Artificial Sequence
  chemically synthesized
attttaacctctgtagagag

SEQ ID NO: 206108 - DNA, 20 bp, Artificial Sequence
  chemically synthesized
caaaaacgccctgctctcta

SEQ ID NO: 206109 - DNA, 20 bp, Artificial Sequence
  chemically synthesized
ttttaacctctgtagagagc

SEQ ID NO: 206110 - DNA, 20 bp, Artificial Sequence
  chemically synthesized
tttaacctctgtagagagca

SEQ ID NO: 206111 - DNA, 20 bp, Artificial Sequence
  chemically synthesized
atacctacaagtaaaaacgg

SEQ ID NO: 206112 - DNA, 20 bp, Artificial Sequence
  chemically synthesized
atgatacctacaagtaaaaa

SEQ ID NO: 206113 - DNA, 20 bp, Artificial Sequence
  chemically synthesized
ttgtcttccgtttttacttg

SEQ ID NO: 206114 - DNA, 20 bp, Artificial Sequence
  chemically synthesized
tgtcttccgtttttacttgt

SEQ ID NO: 206115 - DNA, 20 bp, Artificial Sequence
  chemically synthesized
ggggacttaatgatacctac

SEQ ID NO: 206116 - DNA, 20 bp, Artificial Sequence
  chemically synthesized
ttttacttgtaggtatcatt

SEQ ID NO: 206117 - DNA, 20 bp, Artificial Sequence
  chemically synthesized
ttcagcacccaaatatatag

SEQ ID NO: 206118 - DNA, 20 bp, Artificial Sequence
  chemically synthesized
cttcagcacccaaatatata

SEQ ID NO: 206119 - DNA, 20 bp, Artificial Sequence
  chemically synthesized
cattaagtcccctatatatt

SEQ ID NO: 206120 - DNA, 20 bp, Artificial Sequence
  chemically synthesized
tcttcagcacccaaatatat

SEQ ID NO: 206121 - DNA, 20 bp, Artificial Sequence
  chemically synthesized
attaagtcccctatatattt

SEQ ID NO: 206122 - DNA, 20 bp, Artificial Sequence
  chemically synthesized
ctcttcagcacccaaatata

SEQ ID NO: 206123 - DNA, 20 bp, Artificial Sequence
  chemically synthesized
ccctatatatttgggtgctg

SEQ ID NO: 206124 - DNA, 20 bp, Artificial Sequence
  chemically synthesized
ctatatatttgggtgctgaa

SEQ ID NO: 206125 - DNA, 20 bp, Artificial Sequence
  chemically synthesized
gttcattattattatctctt

SEQ ID NO: 206126 - DNA, 20 bp, Artificial Sequence
  chemically synthesized
agctgatttatttatttcgt

SEQ ID NO: 206127 - DNA, 20 bp, Artificial Sequence
  chemically synthesized
cacttacgaaataaataaat

SEQ ID NO: 206128 - DNA, 20 bp, Artificial Sequence
  chemically synthesized
aaataaatcagctcatcata

SEQ ID NO: 206129 - DNA, 20 bp, Artificial Sequence
  chemically synthesized
aattccagtcaccatatgat

SEQ ID NO: 206130 - DNA, 20 bp, Artificial Sequence
  chemically synthesized
tcagctcatcatatggtgac

SEQ ID NO: 206131 - DNA, 20 bp, Artificial Sequence
  chemically synthesized
tgtgcgcacagaagtaattc

SEQ ID NO: 206132 - DNA, 20 bp, Artificial Sequence
  chemically synthesized
gcattagtttgtgcgcacag

SEQ ID NO: 206133 - DNA, 20 bp, Artificial Sequence
  chemically synthesized
ttagcattagtttgtgcgca

SEQ ID NO: 206134 - DNA, 20 bp, Artificial Sequence
  chemically synthesized
catccgaaaaatgttagcat

SEQ ID NO: 206135 - DNA, 20 bp, Artificial Sequence
  chemically synthesized
tttgtgcatccgaaaaatgt

SEQ ID NO: 206136 - DNA, 20 bp, Artificial Sequence
  chemically synthesized
aaactaatgctaacattttt

SEQ ID NO: 206137 - DNA, 20 bp, Artificial Sequence
  chemically synthesized
ttcggatgcacaaaacatgt

SEQ ID NO: 206138 - DNA, 20 bp, Artificial Sequence
  chemically synthesized
gcacaaaacatgtcagtaca

SEQ ID NO: 206139 - DNA, 20 bp, Artificial Sequence
  chemically synthesized
cagtacatagttaccaacga

SEQ ID NO: 206140 - DNA, 20 bp, Artificial Sequence
  chemically synthesized
tatttctatccatccatcgt

SEQ ID NO: 206141 - DNA, 20 bp, Artificial Sequence
  chemically synthesized
acatagttaccaacgatgga

SEQ ID NO: 206142 - DNA, 20 bp, Artificial Sequence
  chemically synthesized
agttaccaacgatggatgga

SEQ ID NO: 206143 - DNA, 20 bp, Artificial Sequence
  chemically synthesized
gatggatagaaatattgttt

SEQ ID NO: 206144 - DNA, 20 bp, Artificial Sequence
  chemically synthesized
gatagaaatattgttttaga

SEQ ID NO: 206145 - DNA, 20 bp, Artificial Sequence
  chemically synthesized
aatattgttttagaaagtct

SEQ ID NO: 206146 - DNA, 20 bp, Artificial Sequence
  chemically synthesized
tccatttttatattaaaact

SEQ ID NO: 206147 - DNA, 20 bp, Artificial Sequence
  chemically synthesized
tctgagttttaatataaaaa

SEQ ID NO: 206148 - DNA, 20 bp, Artificial Sequence
  chemically synthesized
gttttaatataaaaatggat

SEQ ID NO: 206149 - DNA, 20 bp, Artificial Sequence
  chemically synthesized
tttaatataaaaatggatga

SEQ ID NO: 206150 - DNA, 20 bp, Artificial Sequence
  chemically synthesized
aatataaaaatggatgagag

SEQ ID NO: 206151 - DNA, 20 bp, Artificial Sequence
  chemically synthesized
atataaaaatggatgagaga

SEQ ID NO: 206152 - DNA, 20 bp, Artificial Sequence
  chemically synthesized
taaaaatggatgagagaagg

SEQ ID NO: 206153 - DNA, 20 bp, Artificial Sequence
  chemically synthesized
taggtgatttgtatgaattt

SEQ ID NO: 206154 - DNA, 20 bp, Artificial Sequence
  chemically synthesized
ataggtgatttgtatgaatt

SEQ ID NO: 206155 - DNA, 20 bp, Artificial Sequence
  chemically synthesized
aaattcatacaaatcaccta

SEQ ID NO: 206156 - DNA, 20 bp, Artificial Sequence
  chemically synthesized
ttcatacaaatcacctatag

SEQ ID NO: 206157 - DNA, 20 bp, Artificial Sequence
  chemically synthesized
catatccccatttccactat

SEQ ID NO: 206158 - DNA, 20 bp, Artificial Sequence
  chemically synthesized
acatatccccatttccacta

SEQ ID NO: 206159 - DNA, 20 bp, Artificial Sequence
  chemically synthesized
caaatcacctatagtggaaa

SEQ ID NO: 206160 - DNA, 20 bp, Artificial Sequence
  chemically synthesized
aaatcacctatagtggaaat

SEQ ID NO: 206161 - DNA, 20 bp, Artificial Sequence
  chemically synthesized
aatcacctatagtggaaatg

SEQ ID NO: 206162 - DNA, 20 bp, Artificial Sequence
  chemically synthesized
atagtggaaatggggatatg

SEQ ID NO: 206163 - DNA, 20 bp, Artificial Sequence
  chemically synthesized
atgtagaaataaaataaatt

SEQ ID NO: 206164 - DNA, 20 bp, Artificial Sequence
  chemically synthesized
aataaattaagcttaatatt

SEQ ID NO: 206165 - DNA, 20 bp, Artificial Sequence
  chemically synthesized
taactgtattactaaatatt

SEQ ID NO: 206166 - DNA, 20 bp, Artificial Sequence
  chemically synthesized
aagcttaatatttagtaata

SEQ ID NO: 206167 - DNA, 20 bp, Artificial Sequence
  chemically synthesized
atatttagtaatacagttaa

SEQ ID NO: 206168 - DNA, 20 bp, Artificial Sequence
  chemically synthesized
gcaattcaatatataaccca

SEQ ID NO: 206169 - DNA, 20 bp, Artificial Sequence
  chemically synthesized
tcaatatataacccatggat

SEQ ID NO: 206170 - DNA, 20 bp, Artificial Sequence
  chemically synthesized
caatatataacccatggatt

SEQ ID NO: 206171 - DNA, 20 bp, Artificial Sequence
  chemically synthesized
gaaaaatcatcccaatccat

SEQ ID NO: 206172 - DNA, 20 bp, Artificial Sequence
  chemically synthesized
tgaaaaatcatcccaatcca

SEQ ID NO: 206173 - DNA, 20 bp, Artificial Sequence
  chemically synthesized
catggattgggatgattttt

SEQ ID NO: 206174 - DNA, 20 bp, Artificial Sequence
  chemically synthesized
aatactgaaattgtaagcag

SEQ ID NO: 206175 - DNA, 20 bp, Artificial Sequence
  chemically synthesized
gttaatactgaaattgtaag

SEQ ID NO: 206176 - DNA, 20 bp, Artificial Sequence
  chemically synthesized
cagtctactgcttacaattt

SEQ ID NO: 206177 - DNA, 20 bp, Artificial Sequence
  chemically synthesized
catgttaatactgaaattgt

SEQ ID NO: 206178 - DNA, 20 bp, Artificial Sequence
  chemically synthesized
tctaatgttttaagtgagaa

SEQ ID NO: 206179 - DNA, 20 bp, Artificial Sequence
  chemically synthesized
tttctaatgttttaagtgag

SEQ ID NO: 206180 - DNA, 20 bp, Artificial Sequence
  chemically synthesized
atttttctaatgttttaagt

SEQ ID NO: 206181 - DNA, 20 bp, Artificial Sequence
  chemically synthesized
gctcttctcacttaaaacat

SEQ ID NO: 206182 - DNA, 20 bp, Artificial Sequence
  chemically synthesized
acctatttttctaatgtttt

SEQ ID NO: 206183 - DNA, 20 bp, Artificial Sequence
  chemically synthesized
cacttaaaacattagaaaaa

SEQ ID NO: 206184 - DNA, 20 bp, Artificial Sequence
  chemically synthesized
acttaaaacattagaaaaat

SEQ ID NO: 206185 - DNA, 20 bp, Artificial Sequence
  chemically synthesized
aaaaataggttaaaaatttt

SEQ ID NO: 206186 - DNA, 20 bp, Artificial Sequence
  chemically synthesized
gttaaaaattttcagacaca

SEQ ID NO: 206187 - DNA, 20 bp, Artificial Sequence
  chemically synthesized
aattttcagacacatggaca

SEQ ID NO: 206188 - DNA, 20 bp, Artificial Sequence
  chemically synthesized
gaatgtttttatctttctga

SEQ ID NO: 206189 - DNA, 20 bp, Artificial Sequence
  chemically synthesized
tattctgataatctgtcaga

SEQ ID NO: 206190 - DNA, 20 bp, Artificial Sequence
  chemically synthesized
tacatattctgataatctgt

SEQ ID NO: 206191 - DNA, 20 bp, Artificial Sequence
  chemically synthesized
ttatctttctgacagattat

SEQ ID NO: 206192 - DNA, 20 bp, Artificial Sequence
  chemically synthesized
ttatcagaatatgtaattat

SEQ ID NO: 206193 - DNA, 20 bp, Artificial Sequence
  chemically synthesized
aattattagttcaataaata

SEQ ID NO: 206194 - DNA, 20 bp, Artificial Sequence
  chemically synthesized
tattagttcaataaataaag

SEQ ID NO: 206195 - DNA, 20 bp, Artificial Sequence
  chemically synthesized
tcaataaataaagaagtgac

SEQ ID NO: 206196 - DNA, 20 bp, Artificial Sequence
  chemically synthesized
ttcttttgcatttttgttac

SEQ ID NO: 206197 - DNA, 20 bp, Artificial Sequence
  chemically synthesized
gactggtaacaaaaatgcaa

SEQ ID NO: 206198 - DNA, 20 bp, Artificial Sequence
  chemically synthesized
aagaattcacactgtgatca

SEQ ID NO: 206199 - DNA, 20 bp, Artificial Sequence
  chemically synthesized
atcctattctgctttgatca

SEQ ID NO: 206200 - DNA, 20 bp, Artificial Sequence
  chemically synthesized
aattcacactgtgatcaaag

SEQ ID NO: 206201 - DNA, 20 bp, Artificial Sequence
  chemically synthesized
acactgtgatcaaagcagaa

SEQ ID NO: 206202 - DNA, 20 bp, Artificial Sequence
  chemically synthesized
cactgtgatcaaagcagaat

SEQ ID NO: 206203 - DNA, 20 bp, Artificial Sequence
  chemically synthesized
ctttgtatcaagtcatgtcg

SEQ ID NO: 206204 - DNA, 20 bp, Artificial Sequence
  chemically synthesized
ttctttgtatcaagtcatgt

SEQ ID NO: 206205 - DNA, 20 bp, Artificial Sequence
  chemically synthesized
ctccgacatgacttgataca

SEQ ID NO: 206206 - DNA, 20 bp, Artificial Sequence
  chemically synthesized
ggaagtgtattctttgtatc

SEQ ID NO: 206207 - DNA, 20 bp, Artificial Sequence
  chemically synthesized
ataaaaattgggtgaattgg

SEQ ID NO: 206208 - DNA, 20 bp, Artificial Sequence
  chemically synthesized
aaaataaaaattgggtgaat

SEQ ID NO: 206209 - DNA, 20 bp, Artificial Sequence
  chemically synthesized
tatacataaaaataaaaatt

SEQ ID NO: 206210 - DNA, 20 bp, Artificial Sequence
  chemically synthesized
ttatacataaaaataaaaat

SEQ ID NO: 206211 - DNA, 20 bp, Artificial Sequence
  chemically synthesized
tatttttatgtataatacat

SEQ ID NO: 206212 - DNA, 20 bp, Artificial Sequence
  chemically synthesized
tataatacattagatacttt

SEQ ID NO: 206213 - DNA, 20 bp, Artificial Sequence
  chemically synthesized
taaatattcgtggtcactaa

SEQ ID NO: 206214 - DNA, 20 bp, Artificial Sequence
  chemically synthesized
agatgtcatataaatattcg

SEQ ID NO: 206215 - DNA, 20 bp, Artificial Sequence
  chemically synthesized
atcttaaaagttgaaaaaaa

SEQ ID NO: 206216 - DNA, 20 bp, Artificial Sequence
  chemically synthesized
atctttttttttcaactttt

SEQ ID NO: 206217 - DNA, 20 bp, Artificial Sequence
  chemically synthesized
atgtaccctctggatcttaa

SEQ ID NO: 206218 - DNA, 20 bp, Artificial Sequence
  chemically synthesized
ttttttcaacttttaagatc

SEQ ID NO: 206219 - DNA, 20 bp, Artificial Sequence
  chemically synthesized
ttttcaacttttaagatcca

SEQ ID NO: 206220 - DNA, 20 bp, Artificial Sequence
  chemically synthesized
tttcaacttttaagatccag

SEQ ID NO: 206221 - DNA, 20 bp, Artificial Sequence
  chemically synthesized
ttcaacttttaagatccaga

SEQ ID NO: 206222 - DNA, 20 bp, Artificial Sequence
  chemically synthesized
aaacctgaacatgtaccctc

SEQ ID NO: 206223 - DNA, 20 bp, Artificial Sequence
  chemically synthesized
agatccagagggtacatgtt

SEQ ID NO: 206224 - DNA, 20 bp, Artificial Sequence
  chemically synthesized
gatccagagggtacatgttc

SEQ ID NO: 206225 - DNA, 20 bp, Artificial Sequence
  chemically synthesized
acatgttcaggtttgttacc

SEQ ID NO: 206226 - DNA, 20 bp, Artificial Sequence
  chemically synthesized
aggtttgttacctggatata

SEQ ID NO: 206227 - DNA, 20 bp, Artificial Sequence
  chemically synthesized
cagcatcacgccatatatcc

SEQ ID NO: 206228 - DNA, 20 bp, Artificial Sequence
  chemically synthesized
tcagcatcacgccatatatc

SEQ ID NO: 206229 - DNA, 20 bp, Artificial Sequence
  chemically synthesized
tggatatatggcgtgatgct

SEQ ID NO: 206230 - DNA, 20 bp, Artificial Sequence
  chemically synthesized
ggatatatggcgtgatgctg

SEQ ID NO: 206231 - DNA, 20 bp, Artificial Sequence
  chemically synthesized
tatggcgtgatgctgaggtt

SEQ ID NO: 206232 - DNA, 20 bp, Artificial Sequence
  chemically synthesized
atggcgtgatgctgaggttt

SEQ ID NO: 206233 - DNA, 20 bp, Artificial Sequence
  chemically synthesized
atcatttgtatcccaaacct

SEQ ID NO: 206234 - DNA, 20 bp, Artificial Sequence
  chemically synthesized
atacaaatgatcccattaac

SEQ ID NO: 206235 - DNA, 20 bp, Artificial Sequence
  chemically synthesized
tacaaatgatcccattaacc

SEQ ID NO: 206236 - DNA, 20 bp, Artificial Sequence
  chemically synthesized
atgcttactacctggttaat

SEQ ID NO: 206237 - DNA, 20 bp, Artificial Sequence
  chemically synthesized
tatgcttactacctggttaa

SEQ ID NO: 206238 - DNA, 20 bp, Artificial Sequence
  chemically synthesized
aaatgatcccattaaccagg

SEQ ID NO: 206239 - DNA, 20 bp, Artificial Sequence
  chemically synthesized
gatcccattaaccaggtagt

SEQ ID NO: 206240 - DNA, 20 bp, Artificial Sequence
  chemically synthesized
tgtgtactatgcttactacc

SEQ ID NO: 206241 - DNA, 20 bp, Artificial Sequence
  chemically synthesized
cattaaccaggtagtaagca

SEQ ID NO: 206242 - DNA, 20 bp, Artificial Sequence
  chemically synthesized
gtagtaagcatagtacacaa

SEQ ID NO: 206243 - DNA, 20 bp, Artificial Sequence
  chemically synthesized
tagtaagcatagtacacaat

SEQ ID NO: 206244 - DNA, 20 bp, Artificial Sequence
  chemically synthesized
taagcatagtacacaatagg

SEQ ID NO: 206245 - DNA, 20 bp, Artificial Sequence
  chemically synthesized
agggggagacaagggttgaa

SEQ ID NO: 206246 - DNA, 20 bp, Artificial Sequence
  chemically synthesized
gaaaggaaagggggagacaa

SEQ ID NO: 206247 - DNA, 20 bp, Artificial Sequence
  chemically synthesized
ggaaaggaaagggggagaca

SEQ ID NO: 206248 - DNA, 20 bp, Artificial Sequence
  chemically synthesized
gggaaaggaaagggggagac

SEQ ID NO: 206249 - DNA, 20 bp, Artificial Sequence
  chemically synthesized
agaaggggaaaggaaagggg

SEQ ID NO: 206250 - DNA, 20 bp, Artificial Sequence
  chemically synthesized
atagaaggggaaaggaaagg

SEQ ID NO: 206251 - DNA, 20 bp, Artificial Sequence
  chemically synthesized
aatagaaggggaaaggaaag

SEQ ID NO: 206252 - DNA, 20 bp, Artificial Sequence
  chemically synthesized
taatagaaggggaaaggaaa

SEQ ID NO: 206253 - DNA, 20 bp, Artificial Sequence
  chemically synthesized
ctaatagaaggggaaaggaa

SEQ ID NO: 206254 - DNA, 20 bp, Artificial Sequence
  chemically synthesized
actaatagaaggggaaagga

SEQ ID NO: 206255 - DNA, 20 bp, Artificial Sequence
  chemically synthesized
agggactaatagaaggggaa

SEQ ID NO: 206256 - DNA, 20 bp, Artificial Sequence
  chemically synthesized
tagggactaatagaagggga

SEQ ID NO: 206257 - DNA, 20 bp, Artificial Sequence
  chemically synthesized
cctttcctttccccttctat

SEQ ID NO: 206258 - DNA, 20 bp, Artificial Sequence
  chemically synthesized
aaactagggactaatagaag

SEQ ID NO: 206259 - DNA, 20 bp, Artificial Sequence
  chemically synthesized
gaaactagggactaatagaa

SEQ ID NO: 206260 - DNA, 20 bp, Artificial Sequence
  chemically synthesized
agaaactagggactaataga

SEQ ID NO: 206261 - DNA, 20 bp, Artificial Sequence
  chemically synthesized
tagaaactagggactaatag

SEQ ID NO: 206262 - DNA, 20 bp, Artificial Sequence
  chemically synthesized
cagtagaaactagggactaa

SEQ ID NO: 206263 - DNA, 20 bp, Artificial Sequence
  chemically synthesized
tttccccttctattagtccc

SEQ ID NO: 206264 - DNA, 20 bp, Artificial Sequence
  chemically synthesized
gatggcaacagtagaaacta

SEQ ID NO: 206265 - DNA, 20 bp, Artificial Sequence
  chemically synthesized
agatggcaacagtagaaact

SEQ ID NO: 206266 - DNA, 20 bp, Artificial Sequence
  chemically synthesized
aagatggcaacagtagaaac

SEQ ID NO: 206267 - DNA, 20 bp, Artificial Sequence
  chemically synthesized
agaattgaagatggcaacag

SEQ ID NO: 206268 - DNA, 20 bp, Artificial Sequence
  chemically synthesized
tatagaattgaagatggcaa

SEQ ID NO: 206269 - DNA, 20 bp, Artificial Sequence
  chemically synthesized
ggtacttatagaattgaaga

SEQ ID NO: 206270 - DNA, 20 bp, Artificial Sequence
  chemically synthesized
gttaggtacttatagaattg

SEQ ID NO: 206271 - DNA, 20 bp, Artificial Sequence
  chemically synthesized
gttgccatcttcaattctat

SEQ ID NO: 206272 - DNA, 20 bp, Artificial Sequence
  chemically synthesized
agctaaatgttaggtactta

SEQ ID NO: 206273 - DNA, 20 bp, Artificial Sequence
  chemically synthesized
ttctataagtacctaacatt

SEQ ID NO: 206274 - DNA, 20 bp, Artificial Sequence
  chemically synthesized
atgagttggagctaaatgtt

SEQ ID NO: 206275 - DNA, 20 bp, Artificial Sequence
  chemically synthesized
tatgagttggagctaaatgt

SEQ ID NO: 206276 - DNA, 20 bp, Artificial Sequence
  chemically synthesized
atgtactcagttatgagttg

SEQ ID NO: 206277 - DNA, 20 bp, Artificial Sequence
  chemically synthesized
atatgtactcagttatgagt

SEQ ID NO: 206278 - DNA, 20 bp, Artificial Sequence
  chemically synthesized
tttagctccaactcataact

SEQ ID NO: 206279 - DNA, 20 bp, Artificial Sequence
  chemically synthesized
tactatatgtactcagttat

SEQ ID NO: 206280 - DNA, 20 bp, Artificial Sequence
  chemically synthesized
aaccaaatactatatgtact

SEQ ID NO: 206281 - DNA, 20 bp, Artificial Sequence
  chemically synthesized
aactcataactgagtacata

SEQ ID NO: 206282 - DNA, 20 bp, Artificial Sequence
  chemically synthesized
aactgagtacatatagtatt

SEQ ID NO: 206283 - DNA, 20 bp, Artificial Sequence
  chemically synthesized
taagcaaattaacataagaa

SEQ ID NO: 206284 - DNA, 20 bp, Artificial Sequence
  chemically synthesized
tatcctaagcaaattaacat

SEQ ID NO: 206285 - DNA, 20 bp, Artificial Sequence
  chemically synthesized
tgttcttatgttaatttgct

SEQ ID NO: 206286 - DNA, 20 bp, Artificial Sequence
  chemically synthesized
gttcttatgttaatttgctt

SEQ ID NO: 206287 - DNA, 20 bp, Artificial Sequence
  chemically synthesized
tgttaatttgcttaggataa

SEQ ID NO: 206288 - DNA, 20 bp, Artificial Sequence
  chemically synthesized
cagctagaggccattatcct

SEQ ID NO: 206289 - DNA, 20 bp, Artificial Sequence
  chemically synthesized
ttgcttaggataatggcctc

SEQ ID NO: 206290 - DNA, 20 bp, Artificial Sequence
  chemically synthesized
agcaacatagatgcagctag

SEQ ID NO: 206291 - DNA, 20 bp, Artificial Sequence
  chemically synthesized
cagcaacatagatgcagcta

SEQ ID NO: 206292 - DNA, 20 bp, Artificial Sequence
  chemically synthesized
tgcagcaacatagatgcagc

SEQ ID NO: 206293 - DNA, 20 bp, Artificial Sequence
  chemically synthesized
cctttgcagcaacatagatg

SEQ ID NO: 206294 - DNA, 20 bp, Artificial Sequence
  chemically synthesized
tcatatcctttgcagcaaca

SEQ ID NO: 206295 - DNA, 20 bp, Artificial Sequence
  chemically synthesized
gctgcatctatgttgctgca

SEQ ID NO: 206296 - DNA, 20 bp, Artificial Sequence
  chemically synthesized
ctgcatctatgttgctgcaa

SEQ ID NO: 206297 - DNA, 20 bp, Artificial Sequence
  chemically synthesized
gaagaaaatcatatcctttg

SEQ ID NO: 206298 - DNA, 20 bp, Artificial Sequence
  chemically synthesized
atatgattttcttcttttcg

SEQ ID NO: 206299 - DNA, 20 bp, Artificial Sequence
  chemically synthesized
tactatacagccacgaaaag

SEQ ID NO: 206300 - DNA, 20 bp, Artificial Sequence
  chemically synthesized
aaatactatacagccacgaa

SEQ ID NO: 206301 - DNA, 20 bp, Artificial Sequence
  chemically synthesized
ttcttcttttcgtggctgta

SEQ ID NO: 206302 - DNA, 20 bp, Artificial Sequence
  chemically synthesized
atacaccataaaatactata

SEQ ID NO: 206303 - DNA, 20 bp, Artificial Sequence
  chemically synthesized
cgtggctgtatagtatttta

SEQ ID NO: 206304 - DNA, 20 bp, Artificial Sequence
  chemically synthesized
cgtcaacgttggattggata

SEQ ID NO: 206305 - DNA, 20 bp, Artificial Sequence
  chemically synthesized
ggtgtccgtcaacgttggat

SEQ ID NO: 206306 - DNA, 20 bp, Artificial Sequence
  chemically synthesized
tttatccaatccaacgttga

SEQ ID NO: 206307 - DNA, 20 bp, Artificial Sequence
  chemically synthesized
acataggtgtccgtcaacgt

SEQ ID NO: 206308 - DNA, 20 bp, Artificial Sequence
  chemically synthesized
caaagtaatgggatcaacat

SEQ ID NO: 206309 - DNA, 20 bp, Artificial Sequence
  chemically synthesized
gcaaagtaatgggatcaaca

SEQ ID NO: 206310 - DNA, 20 bp, Artificial Sequence
  chemically synthesized
atgcacaatagcaaagtaat

SEQ ID NO: 206311 - DNA, 20 bp, Artificial Sequence
  chemically synthesized
tatgcacaatagcaaagtaa

SEQ ID NO: 206312 - DNA, 20 bp, Artificial Sequence
  chemically synthesized
cagcactatgcacaatagca

SEQ ID NO: 206313 - DNA, 20 bp, Artificial Sequence
  chemically synthesized
cattactttgctattgtgca

SEQ ID NO: 206314 - DNA, 20 bp, Artificial Sequence
  chemically synthesized
tgtcacagcactatgcacaa

SEQ ID NO: 206315 - DNA, 20 bp, Artificial Sequence
  chemically synthesized
atgcactcacatgtttgtca

SEQ ID NO: 206316 - DNA, 20 bp, Artificial Sequence
  chemically synthesized
tagtgctgtgacaaacatgt

SEQ ID NO: 206317 - DNA, 20 bp, Artificial Sequence
  chemically synthesized
tgtgagtgcatgtgtctttt

SEQ ID NO: 206318 - DNA, 20 bp, Artificial Sequence
  chemically synthesized
gagtgcatgtgtctttttgg

SEQ ID NO: 206319 - DNA, 20 bp, Artificial Sequence
  chemically synthesized
aaacaaatggttctaccaaa

SEQ ID NO: 206320 - DNA, 20 bp, Artificial Sequence
  chemically synthesized
gatatccaaaagaaaacaaa

SEQ ID NO: 206321 - DNA, 20 bp, Artificial Sequence
  chemically synthesized
tagaaccatttgttttcttt

SEQ ID NO: 206322 - DNA, 20 bp, Artificial Sequence
  chemically synthesized
attactgagtagatatccaa

SEQ ID NO: 206323 - DNA, 20 bp, Artificial Sequence
  chemically synthesized
ttttcttttggatatctact

SEQ ID NO: 206324 - DNA, 20 bp, Artificial Sequence
  chemically synthesized
ccatcaatcccattactgag

SEQ ID NO: 206325 - DNA, 20 bp, Artificial Sequence
  chemically synthesized
tttggatatctactcagtaa

SEQ ID NO: 206326 - DNA, 20 bp, Artificial Sequence
  chemically synthesized
ttggatatctactcagtaat

SEQ ID NO: 206327 - DNA, 20 bp, Artificial Sequence
  chemically synthesized
gacccatcaatcccattact

SEQ ID NO: 206328 - DNA, 20 bp, Artificial Sequence
  chemically synthesized
ctactcagtaatgggattga

SEQ ID NO: 206329 - DNA, 20 bp, Artificial Sequence
  chemically synthesized
tactcagtaatgggattgat

SEQ ID NO: 206330 - DNA, 20 bp, Artificial Sequence
  chemically synthesized
gggattgatgggtcaaatga

SEQ ID NO: 206331 - DNA, 20 bp, Artificial Sequence
  chemically synthesized
tcaaatgatagttctatttt

SEQ ID NO: 206332 - DNA, 20 bp, Artificial Sequence
  chemically synthesized
atttctcaaagaacttaaaa

SEQ ID NO: 206333 - DNA, 20 bp, Artificial Sequence
  chemically synthesized
agttctattttaagttcttt

SEQ ID NO: 206334 - DNA, 20 bp, Artificial Sequence
  chemically synthesized
agcagtttggacatttctca

SEQ ID NO: 206335 - DNA, 20 bp, Artificial Sequence
  chemically synthesized
agccactgtagaaagcagtt

SEQ ID NO: 206336 - DNA, 20 bp, Artificial Sequence
  chemically synthesized
aatgtccaaactgctttcta

SEQ ID NO: 206337 - DNA, 20 bp, Artificial Sequence
  chemically synthesized
agttcagccactgtagaaag

SEQ ID NO: 206338 - DNA, 20 bp, Artificial Sequence
  chemically synthesized
gtccaaactgctttctacag

SEQ ID NO: 206339 - DNA, 20 bp, Artificial Sequence
  chemically synthesized
attagttcagccactgtaga

SEQ ID NO: 206340 - DNA, 20 bp, Artificial Sequence
  chemically synthesized
gttaattagttcagccactg

SEQ ID NO: 206341 - DNA, 20 bp, Artificial Sequence
  chemically synthesized
gttgggaatgttaattagtt

SEQ ID NO: 206342 - DNA, 20 bp, Artificial Sequence
  chemically synthesized
ctgttgttgggaatgttaat

SEQ ID NO: 206343 - DNA, 20 bp, Artificial Sequence
  chemically synthesized
ctaattaacattcccaacaa

SEQ ID NO: 206344 - DNA, 20 bp, Artificial Sequence
  chemically synthesized
gatgcttatacactgttgtt

SEQ ID NO: 206345 - DNA, 20 bp, Artificial Sequence
  chemically synthesized
ggatgcttatacactgttgt

SEQ ID NO: 206346 - DNA, 20 bp, Artificial Sequence
  chemically synthesized
cattcccaacaacagtgtat

SEQ ID NO: 206347 - DNA, 20 bp, Artificial Sequence
  chemically synthesized
ggcaaggccgcagagacaag

SEQ ID NO: 206348 - DNA, 20 bp, Artificial Sequence
  chemically synthesized
tggcaaggccgcagagacaa

SEQ ID NO: 206349 - DNA, 20 bp, Artificial Sequence
  chemically synthesized
ctggcaaggccgcagagaca

SEQ ID NO: 206350 - DNA, 20 bp, Artificial Sequence
  chemically synthesized
taagcatccccttgtctctg

SEQ ID NO: 206351 - DNA, 20 bp, Artificial Sequence
  chemically synthesized
gctggcaaggccgcagagac

SEQ ID NO: 206352 - DNA, 20 bp, Artificial Sequence
  chemically synthesized
ccaatgctggcaaggccgca

SEQ ID NO: 206353 - DNA, 20 bp, Artificial Sequence
  chemically synthesized
acccaatgctggcaaggccg

SEQ ID NO: 206354 - DNA, 20 bp, Artificial Sequence
  chemically synthesized
ccttgtctctgcggccttgc

SEQ ID NO: 206355 - DNA, 20 bp, Artificial Sequence
  chemically synthesized
aaagacacccaatgctggca

SEQ ID NO: 206356 - DNA, 20 bp, Artificial Sequence
  chemically synthesized
aaaagacacccaatgctggc

SEQ ID NO: 206357 - DNA, 20 bp, Artificial Sequence
  chemically synthesized
ctctgcggccttgccagcat

SEQ ID NO: 206358 - DNA, 20 bp, Artificial Sequence
  chemically synthesized
tctgcggccttgccagcatt

SEQ ID NO: 206359 - DNA, 20 bp, Artificial Sequence
  chemically synthesized
agtcaaaagacacccaatgc

SEQ ID NO: 206360 - DNA, 20 bp, Artificial Sequence
  chemically synthesized
tggctttgttaaaaagtcaa

SEQ ID NO: 206361 - DNA, 20 bp, Artificial Sequence
  chemically synthesized
tgtcttttgactttttaaca

SEQ ID NO: 206362 - DNA, 20 bp, Artificial Sequence
  chemically synthesized
gtcagactggctttgttaaa

SEQ ID NO: 206363 - DNA, 20 bp, Artificial Sequence
  chemically synthesized
ttttgactttttaacaaagc

SEQ ID NO: 206364 - DNA, 20 bp, Artificial Sequence
  chemically synthesized
ttttaacaaagccagtctga

SEQ ID NO: 206365 - DNA, 20 bp, Artificial Sequence
  chemically synthesized
tttaacaaagccagtctgac

SEQ ID NO: 206366 - DNA, 20 bp, Artificial Sequence
  chemically synthesized
ccatctcacacccgtcagac

SEQ ID NO: 206367 - DNA, 20 bp, Artificial Sequence
  chemically synthesized
agataccatctcacacccgt

SEQ ID NO: 206368 - DNA, 20 bp, Artificial Sequence
  chemically synthesized
aaagccagtctgacgggtgt

SEQ ID NO: 206369 - DNA, 20 bp, Artificial Sequence
  chemically synthesized
ccagtctgacgggtgtgaga

SEQ ID NO: 206370 - DNA, 20 bp, Artificial Sequence
  chemically synthesized
tgtgagatggtatctccttg

SEQ ID NO: 206371 - DNA, 20 bp, Artificial Sequence
  chemically synthesized
atgcaaatcaaaaccgcaag

SEQ ID NO: 206372 - DNA, 20 bp, Artificial Sequence
  chemically synthesized
aaatgcaaatcaaaaccgca

SEQ ID NO: 206373 - DNA, 20 bp, Artificial Sequence
  chemically synthesized
gaaatgcaaatcaaaaccgc

SEQ ID NO: 206374 - DNA, 20 bp, Artificial Sequence
  chemically synthesized
atttgcatttctctgatgat

SEQ ID NO: 206375 - DNA, 20 bp, Artificial Sequence
  chemically synthesized
cgtcacatcactcatcatca

SEQ ID NO: 206376 - DNA, 20 bp, Artificial Sequence
  chemically synthesized
tgcgtcacatcactcatcat

SEQ ID NO: 206377 - DNA, 20 bp, Artificial Sequence
  chemically synthesized
gacgcatttttcatgtttat

SEQ ID NO: 206378 - DNA, 20 bp, Artificial Sequence
  chemically synthesized
ctcaaaagaagatatacacg

SEQ ID NO: 206379 - DNA, 20 bp, Artificial Sequence
  chemically synthesized
ctgcgtgtatatcttctttt

SEQ ID NO: 206380 - DNA, 20 bp, Artificial Sequence
  chemically synthesized
gaacagacatttctcaaaag

SEQ ID NO: 206381 - DNA, 20 bp, Artificial Sequence
  chemically synthesized
catgaacagacatttctcaa

SEQ ID NO: 206382 - DNA, 20 bp, Artificial Sequence
  chemically synthesized
aaatgggcaaaagacatgaa

SEQ ID NO: 206383 - DNA, 20 bp, Artificial Sequence
  chemically synthesized
atcatttaaaaaatgggcaa

SEQ ID NO: 206384 - DNA, 20 bp, Artificial Sequence
  chemically synthesized
taaaacatcatttaaaaaat

SEQ ID NO: 206385 - DNA, 20 bp, Artificial Sequence
  chemically synthesized
ataaaacatcatttaaaaaa

SEQ ID NO: 206386 - DNA, 20 bp, Artificial Sequence
  chemically synthesized
tttttgtttgttcaattgtt

SEQ ID NO: 206387 - DNA, 20 bp, Artificial Sequence
  chemically synthesized
ttttgtttgttcaattgttt

SEQ ID NO: 206388 - DNA, 20 bp, Artificial Sequence
  chemically synthesized
tcaattgtttaggttcctca

SEQ ID NO: 206389 - DNA, 20 bp, Artificial Sequence
  chemically synthesized
tgtaatatccagaatctatg

SEQ ID NO: 206390 - DNA, 20 bp, Artificial Sequence
  chemically synthesized
gtgtaatatccagaatctat

SEQ ID NO: 206391 - DNA, 20 bp, Artificial Sequence
  chemically synthesized
tttaggttcctcatagattc

SEQ ID NO: 206392 - DNA, 20 bp, Artificial Sequence
  chemically synthesized
tctgacggtggtgtaatatc

SEQ ID NO: 206393 - DNA, 20 bp, Artificial Sequence
  chemically synthesized
tctggatattacaccaccgt

SEQ ID NO: 206394 - DNA, 20 bp, Artificial Sequence
  chemically synthesized
gcaagttatgcatctgacgg

SEQ ID NO: 206395 - DNA, 20 bp, Artificial Sequence
  chemically synthesized
tttgcaagttatgcatctga

SEQ ID NO: 206396 - DNA, 20 bp, Artificial Sequence
  chemically synthesized
gtcagatgcataacttgcaa

SEQ ID NO: 206397 - DNA, 20 bp, Artificial Sequence
  chemically synthesized
aaatgggagaaaacttttgc

SEQ ID NO: 206398 - DNA, 20 bp, Artificial Sequence
  chemically synthesized
tgcaaaagttttctcccatt

SEQ ID NO: 206399 - DNA, 20 bp, Artificial Sequence
  chemically synthesized
aacagacaaacaccaaatgg

SEQ ID NO: 206400 - DNA, 20 bp, Artificial Sequence
  chemically synthesized
taaacagacaaacaccaaat

SEQ ID NO: 206401 - DNA, 20 bp, Artificial Sequence
  chemically synthesized
gtaaacagacaaacaccaaa

SEQ ID NO: 206402 - DNA, 20 bp, Artificial Sequence
  chemically synthesized
taaatgatcaacagagtaaa

SEQ ID NO: 206403 - DNA, 20 bp, Artificial Sequence
  chemically synthesized
ggcaaaataaatgatcaaca

SEQ ID NO: 206404 - DNA, 20 bp, Artificial Sequence
  chemically synthesized
atggcaaaataaatgatcaa

SEQ ID NO: 206405 - DNA, 20 bp, Artificial Sequence
  chemically synthesized
tgatcatttattttgccatg

SEQ ID NO: 206406 - DNA, 20 bp, Artificial Sequence
  chemically synthesized
tcatttattttgccatgcag

SEQ ID NO: 206407 - DNA, 20 bp, Artificial Sequence
  chemically synthesized
taaaataaagagcttctgca

SEQ ID NO: 206408 - DNA, 20 bp, Artificial Sequence
  chemically synthesized
catgcagaagctctttattt

SEQ ID NO: 206409 - DNA, 20 bp, Artificial Sequence
  chemically synthesized
caaggacttactaaaataaa

SEQ ID NO: 206410 - DNA, 20 bp, Artificial Sequence
  chemically synthesized
agcaaggacttactaaaata

SEQ ID NO: 206411 - DNA, 20 bp, Artificial Sequence
  chemically synthesized
cagaagctctttattttagt

SEQ ID NO: 206412 - DNA, 20 bp, Artificial Sequence
  chemically synthesized
aaaaaaaaaaatgacaagca

SEQ ID NO: 206413 - DNA, 20 bp, Artificial Sequence
  chemically synthesized
aaaaaaaaaaaatgacaagc

SEQ ID NO: 206414 - DNA, 20 bp, Artificial Sequence
  chemically synthesized
aaaaaaaaaaaaaaaatgac

SEQ ID NO: 206415 - DNA, 20 bp, Artificial Sequence
  chemically synthesized
ttttttttgcaattgctttt

SEQ ID NO: 206416 - DNA, 20 bp, Artificial Sequence
  chemically synthesized
tttttttgcaattgctttta

SEQ ID NO: 206417 - DNA, 20 bp, Artificial Sequence
  chemically synthesized
atttttgactaagtccttaa

SEQ ID NO: 206418 - DNA, 20 bp, Artificial Sequence
  chemically synthesized
tgcaattgcttttaaggact

SEQ ID NO: 206419 - DNA, 20 bp, Artificial Sequence
  chemically synthesized
ttgggaaagaatttttgact

SEQ ID NO: 206420 - DNA, 20 bp, Artificial Sequence
  chemically synthesized
ttagtcaaaaattctttccc

SEQ ID NO: 206421 - DNA, 20 bp, Artificial Sequence
  chemically synthesized
ttctggacattggcttggga

SEQ ID NO: 206422 - DNA, 20 bp, Artificial Sequence
  chemically synthesized
accattctggacattggctt

SEQ ID NO: 206423 - DNA, 20 bp, Artificial Sequence
  chemically synthesized
taccattctggacattggct

SEQ ID NO: 206424 - DNA, 20 bp, Artificial Sequence
  chemically synthesized
ttctttcccaagccaatgtc

SEQ ID NO: 206425 - DNA, 20 bp, Artificial Sequence
  chemically synthesized
ggaaataccattctggacat

SEQ ID NO: 206426 - DNA, 20 bp, Artificial Sequence
  chemically synthesized
tcccaagccaatgtccagaa

SEQ ID NO: 206427 - DNA, 20 bp, Artificial Sequence
  chemically synthesized
aaatctgggaaataccattc

SEQ ID NO: 206428 - DNA, 20 bp, Artificial Sequence
  chemically synthesized
atgtccagaatggtatttcc

SEQ ID NO: 206429 - DNA, 20 bp, Artificial Sequence
  chemically synthesized
agaatcctagaataaaatct

SEQ ID NO: 206430 - DNA, 20 bp, Artificial Sequence
  chemically synthesized
aagaatcctagaataaaatc

SEQ ID NO: 206431 - DNA, 20 bp, Artificial Sequence
  chemically synthesized
gtatttcccagattttattc

SEQ ID NO: 206432 - DNA, 20 bp, Artificial Sequence
  chemically synthesized
tatttcccagattttattct

SEQ ID NO: 206433 - DNA, 20 bp, Artificial Sequence
  chemically synthesized
acttcaagctataagaatcc

SEQ ID NO: 206434 - DNA, 20 bp, Artificial Sequence
  chemically synthesized
attttattctaggattctta

SEQ ID NO: 206435 - DNA, 20 bp, Artificial Sequence
  chemically synthesized
aatgtaagacttcaagctat

SEQ ID NO: 206436 - DNA, 20 bp, Artificial Sequence
  chemically synthesized
tctaggattcttatagcttg

SEQ ID NO: 206437 - DNA, 20 bp, Artificial Sequence
  chemically synthesized
agatttaaatgtaagacttc

SEQ ID NO: 206438 - DNA, 20 bp, Artificial Sequence
  chemically synthesized
tggattaaagatttaaatgt

SEQ ID NO: 206439 - DNA, 20 bp, Artificial Sequence
  chemically synthesized
aagcattgggaaatggatta

SEQ ID NO: 206440 - DNA, 20 bp, Artificial Sequence
  chemically synthesized
aaaaaataagcattgggaaa

SEQ ID NO: 206441 - DNA, 20 bp, Artificial Sequence
  chemically synthesized
tcaacaaaaaaataagcatt

SEQ ID NO: 206442 - DNA, 20 bp, Artificial Sequence
  chemically synthesized
gtcaacaaaaaaataagcat

SEQ ID NO: 206443 - DNA, 20 bp, Artificial Sequence
  chemically synthesized
gacaaagtcaacaaaaaaat

SEQ ID NO: 206444 - DNA, 20 bp, Artificial Sequence
  chemically synthesized
cagccaactgttcgtcgaca

SEQ ID NO: 206445 - DNA, 20 bp, Artificial Sequence
  chemically synthesized
ttgttgactttgtcgacgaa

SEQ ID NO: 206446 - DNA, 20 bp, Artificial Sequence
  chemically synthesized
tgactttgtcgacgaacagt

SEQ ID NO: 206447 - DNA, 20 bp, Artificial Sequence
  chemically synthesized
tgtcgacgaacagttggctg

SEQ ID NO: 206448 - DNA, 20 bp, Artificial Sequence
  chemically synthesized
taaataaaactgcacagcta

SEQ ID NO: 206449 - DNA, 20 bp, Artificial Sequence
  chemically synthesized
aacagttggctgtagctgtg

SEQ ID NO: 206450 - DNA, 20 bp, Artificial Sequence
  chemically synthesized
aacacataaataaaactgca

SEQ ID NO: 206451 - DNA, 20 bp, Artificial Sequence
  chemically synthesized
tagaccaatagaacagaata

SEQ ID NO: 206452 - DNA, 20 bp, Artificial Sequence
  chemically synthesized
catagaccaatagaacagaa

SEQ ID NO: 206453 - DNA, 20 bp, Artificial Sequence
  chemically synthesized
tgttctctattctgttctat

SEQ ID NO: 206454 - DNA, 20 bp, Artificial Sequence
  chemically synthesized
gtacacatagaccaatagaa

SEQ ID NO: 206455 - DNA, 20 bp, Artificial Sequence
  chemically synthesized
gtcatgtacacatagaccaa

SEQ ID NO: 206456 - DNA, 20 bp, Artificial Sequence
  chemically synthesized
accaagatgtcatgtacaca

SEQ ID NO: 206457 - DNA, 20 bp, Artificial Sequence
  chemically synthesized
tctatgtgtacatgacatct

SEQ ID NO: 206458 - DNA, 20 bp, Artificial Sequence
  chemically synthesized
atgtgtacatgacatcttgg

SEQ ID NO: 206459 - DNA, 20 bp, Artificial Sequence
  chemically synthesized
tgtgtacatgacatcttggt

SEQ ID NO: 206460 - DNA, 20 bp, Artificial Sequence
  chemically synthesized
aacaggtttgaaatcctacc

SEQ ID NO: 206461 - DNA, 20 bp, Artificial Sequence
  chemically synthesized
atttttttagggcattgaac

SEQ ID NO: 206462 - DNA, 20 bp, Artificial Sequence
  chemically synthesized
tatttttttagggcattgaa

SEQ ID NO: 206463 - DNA, 20 bp, Artificial Sequence
  chemically synthesized
ttaaaagttatattttttta

SEQ ID NO: 206464 - DNA, 20 bp, Artificial Sequence
  chemically synthesized
cttaaaagttatattttttt

SEQ ID NO: 206465 - DNA, 20 bp, Artificial Sequence
  chemically synthesized
acttaaaagttatatttttt

SEQ ID NO: 206466 - DNA, 20 bp, Artificial Sequence
  chemically synthesized
cctaaaaaaatataactttt

SEQ ID NO: 206467 - DNA, 20 bp, Artificial Sequence
  chemically synthesized
gtttttttcaaatcacttaa

SEQ ID NO: 206468 - DNA, 20 bp, Artificial Sequence
  chemically synthesized
ccaagtttagatttagcagg

SEQ ID NO: 206469 - DNA, 20 bp, Artificial Sequence
  chemically synthesized
tttccaagtttagatttagc

SEQ ID NO: 206470 - DNA, 20 bp, Artificial Sequence
  chemically synthesized
gtttccaagtttagatttag

SEQ ID NO: 206471 - DNA, 20 bp, Artificial Sequence
  chemically synthesized
gcagtttccaagtttagatt

SEQ ID NO: 206472 - DNA, 20 bp, Artificial Sequence
  chemically synthesized
ctgcctgctaaatctaaact

SEQ ID NO: 206473 - DNA, 20 bp, Artificial Sequence
  chemically synthesized
aagtaggcagtttccaagtt

SEQ ID NO: 206474 - DNA, 20 bp, Artificial Sequence
  chemically synthesized
gaattaagtaggcagtttcc

SEQ ID NO: 206475 - DNA, 20 bp, Artificial Sequence
  chemically synthesized
tcattatagaattaagtagg

SEQ ID NO: 206476 - DNA, 20 bp, Artificial Sequence
  chemically synthesized
ttctcattatagaattaagt

SEQ ID NO: 206477 - DNA, 20 bp, Artificial Sequence
  chemically synthesized
cttctcattatagaattaag

SEQ ID NO: 206478 - DNA, 20 bp, Artificial Sequence
  chemically synthesized
acccttctcattatagaatt

SEQ ID NO: 206479 - DNA, 20 bp, Artificial Sequence
  chemically synthesized
tgcctacttaattctataat

SEQ ID NO: 206480 - DNA, 20 bp, Artificial Sequence
  chemically synthesized
ctacttaattctataatgag

SEQ ID NO: 206481 - DNA, 20 bp, Artificial Sequence
  chemically synthesized
tgagattacccttctcatta

SEQ ID NO: 206482 - DNA, 20 bp, Artificial Sequence
  chemically synthesized
tacttaattctataatgaga

SEQ ID NO: 206483 - DNA, 20 bp, Artificial Sequence
  chemically synthesized
acttaattctataatgagaa

SEQ ID NO: 206484 - DNA, 20 bp, Artificial Sequence
  chemically synthesized
tataatgagaagggtaatct

SEQ ID NO: 206485 - DNA, 20 bp, Artificial Sequence
  chemically synthesized
taacttttgaaatttatgct

SEQ ID NO: 206486 - DNA, 20 bp, Artificial Sequence
  chemically synthesized
aatctcagcataaatttcaa

SEQ ID NO: 206487 - DNA, 20 bp, Artificial Sequence
  chemically synthesized
tcagcataaatttcaaaagt

SEQ ID NO: 206488 - DNA, 20 bp, Artificial Sequence
  chemically synthesized
cagcataaatttcaaaagtt

SEQ ID NO: 206489 - DNA, 20 bp, Artificial Sequence
  chemically synthesized
tgtcaagtagatatggagtt

SEQ ID NO: 206490 - DNA, 20 bp, Artificial Sequence
  chemically synthesized
ttacttgtcaagtagatatg

SEQ ID NO: 206491 - DNA, 20 bp, Artificial Sequence
  chemically synthesized
ggttacttgtcaagtagata

SEQ ID NO: 206492 - DNA, 20 bp, Artificial Sequence
  chemically synthesized
aaactccatatctacttgac

SEQ ID NO: 206493 - DNA, 20 bp, Artificial Sequence
  chemically synthesized
gctcatggttacttgtcaag

SEQ ID NO: 206494 - DNA, 20 bp, Artificial Sequence
  chemically synthesized
taagctcatggttacttgtc

SEQ ID NO: 206495 - DNA, 20 bp, Artificial Sequence
  chemically synthesized
tctacttgacaagtaaccat

SEQ ID NO: 206496 - DNA, 20 bp, Artificial Sequence
  chemically synthesized
tcagattatatttaagctca

SEQ ID NO: 206497 - DNA, 20 bp, Artificial Sequence
  chemically synthesized
ggtgatctcagattatattt

SEQ ID NO: 206498 - DNA, 20 bp, Artificial Sequence
  chemically synthesized
catgagcttaaatataatct

SEQ ID NO: 206499 - DNA, 20 bp, Artificial Sequence
  chemically synthesized
catattatggtgggtgatct

SEQ ID NO: 206500 - DNA, 20 bp, Artificial Sequence
  chemically synthesized
cctcacttccatattatggt

SEQ ID NO: 206501 - DNA, 20 bp, Artificial Sequence
  chemically synthesized
acctcacttccatattatgg

SEQ ID NO: 206502 - DNA, 20 bp, Artificial Sequence
  chemically synthesized
tgagatcacccaccataata

SEQ ID NO: 206503 - DNA, 20 bp, Artificial Sequence
  chemically synthesized
cctacctcacttccatatta

SEQ ID NO: 206504 - DNA, 20 bp, Artificial Sequence
  chemically synthesized
gatcacccaccataatatgg

SEQ ID NO: 206505 - DNA, 20 bp, Artificial Sequence
  chemically synthesized
acccaccataatatggaagt

SEQ ID NO: 206506 - DNA, 20 bp, Artificial Sequence
  chemically synthesized
cccaccataatatggaagtg

SEQ ID NO: 206507 - DNA, 20 bp, Artificial Sequence
  chemically synthesized
accataatatggaagtgagg

SEQ ID NO: 206508 - DNA, 20 bp, Artificial Sequence
  chemically synthesized
ccataatatggaagtgaggt

SEQ ID NO: 206509 - DNA, 20 bp, Artificial Sequence
  chemically synthesized
aatatggaagtgaggtaggt

SEQ ID NO: 206510 - DNA, 20 bp, Artificial Sequence
  chemically synthesized
ggaagtgaggtaggtgagat

SEQ ID NO: 206511 - DNA, 20 bp, Artificial Sequence
  chemically synthesized
gtgaggtaggtgagattgga

SEQ ID NO: 206512 - DNA, 20 bp, Artificial Sequence
  chemically synthesized
gtaggtgagattggatggtt

SEQ ID NO: 206513 - DNA, 20 bp, Artificial Sequence
  chemically synthesized
taggtgagattggatggttt

SEQ ID NO: 206514 - DNA, 20 bp, Artificial Sequence
  chemically synthesized
ggtgagattggatggtttgg

SEQ ID NO: 206515 - DNA, 20 bp, Artificial Sequence
  chemically synthesized
gagattggatggtttgggag

SEQ ID NO: 206516 - DNA, 20 bp, Artificial Sequence
  chemically synthesized
gattggatggtttgggagta

SEQ ID NO: 206517 - DNA, 20 bp, Artificial Sequence
  chemically synthesized
caatgttataaattccgaat

SEQ ID NO: 206518 - DNA, 20 bp, Artificial Sequence
  chemically synthesized
caggtcaatatgttccaatt

SEQ ID NO: 206519 - DNA, 20 bp, Artificial Sequence
  chemically synthesized
gaacatattgacctgacaac

SEQ ID NO: 206520 - DNA, 20 bp, Artificial Sequence
  chemically synthesized
aacatattgacctgacaact

SEQ ID NO: 206521 - DNA, 20 bp, Artificial Sequence
  chemically synthesized
aaatattctacccagttgtc

SEQ ID NO: 206522 - DNA, 20 bp, Artificial Sequence
  chemically synthesized
caaatattctacccagttgt

SEQ ID NO: 206523 - DNA, 20 bp, Artificial Sequence
  chemically synthesized
atattgacctgacaactggg

SEQ ID NO: 206524 - DNA, 20 bp, Artificial Sequence
  chemically synthesized
ttgattgcaaatattctacc

SEQ ID NO: 206525 - DNA, 20 bp, Artificial Sequence
  chemically synthesized
tatttgcaatcaatattgtt

SEQ ID NO: 206526 - DNA, 20 bp, Artificial Sequence
  chemically synthesized
tttgcaatcaatattgttca

SEQ ID NO: 206527 - DNA, 20 bp, Artificial Sequence
  chemically synthesized
aatattgttcagagacattt

SEQ ID NO: 206528 - DNA, 20 bp, Artificial Sequence
  chemically synthesized
tcagagacattttagtcatt

SEQ ID NO: 206529 - DNA, 20 bp, Artificial Sequence
  chemically synthesized
gctatgactctgttacagaa

SEQ ID NO: 206530 - DNA, 20 bp, Artificial Sequence
  chemically synthesized
gtcatttggcccttctgtaa

SEQ ID NO: 206531 - DNA, 20 bp, Artificial Sequence
  chemically synthesized
ggctatgactctgttacaga

SEQ ID NO: 206532 - DNA, 20 bp, Artificial Sequence
  chemically synthesized
gggctatgactctgttacag

SEQ ID NO: 206533 - DNA, 20 bp, Artificial Sequence
  chemically synthesized
catttggcccttctgtaaca

SEQ ID NO: 206534 - DNA, 20 bp, Artificial Sequence
  chemically synthesized
attgggctatgactctgtta

SEQ ID NO: 206535 - DNA, 20 bp, Artificial Sequence
  chemically synthesized
gcccttctgtaacagagtca

SEQ ID NO: 206536 - DNA, 20 bp, Artificial Sequence
  chemically synthesized
ggtatttcatgataaggatt

SEQ ID NO: 206537 - DNA, 20 bp, Artificial Sequence
  chemically synthesized
aggtatttcatgataaggat

SEQ ID NO: 206538 - DNA, 20 bp, Artificial Sequence
  chemically synthesized
gtcccaggtatttcatgata

SEQ ID NO: 206539 - DNA, 20 bp, Artificial Sequence
  chemically synthesized
tgtcccaggtatttcatgat

SEQ ID NO: 206540 - DNA, 20 bp, Artificial Sequence
  chemically synthesized
aatccttatcatgaaatacc

SEQ ID NO: 206541 - DNA, 20 bp, Artificial Sequence
  chemically synthesized
atccttatcatgaaatacct

SEQ ID NO: 206542 - DNA, 20 bp, Artificial Sequence
  chemically synthesized
atcatgaaatacctgggaca

SEQ ID NO: 206543 - DNA, 20 bp, Artificial Sequence
  chemically synthesized
catttcagatactttgtccc

SEQ ID NO: 206544 - DNA, 20 bp, Artificial Sequence
  chemically synthesized
acatttcagatactttgtcc

SEQ ID NO: 206545 - DNA, 20 bp, Artificial Sequence
  chemically synthesized
cccccaaacttttaacattt

SEQ ID NO: 206546 - DNA, 20 bp, Artificial Sequence
  chemically synthesized
caaagtatctgaaatgttaa

SEQ ID NO: 206547 - DNA, 20 bp, Artificial Sequence
  chemically synthesized
tatctgaaatgttaaaagtt

SEQ ID NO: 206548 - DNA, 20 bp, Artificial Sequence
  chemically synthesized
atctgaaatgttaaaagttt

SEQ ID NO: 206549 - DNA, 20 bp, Artificial Sequence
  chemically synthesized
tctgaaatgttaaaagtttg

SEQ ID NO: 206550 - DNA, 20 bp, Artificial Sequence
  chemically synthesized
ctgaaatgttaaaagtttgg

SEQ ID NO: 206551 - DNA, 20 bp, Artificial Sequence
  chemically synthesized
aagtttgggggacgtaatta

SEQ ID NO: 206552 - DNA, 20 bp, Artificial Sequence
  chemically synthesized
ggggacgtaattatggtttg

SEQ ID NO: 206553 - DNA, 20 bp, Artificial Sequence
  chemically synthesized
gacgtaattatggtttgtgg

SEQ ID NO: 206554 - DNA, 20 bp, Artificial Sequence
  chemically synthesized
tatggtttgtggtggaatcg

SEQ ID NO: 206555 - DNA, 20 bp, Artificial Sequence
  chemically synthesized
atggtttgtggtggaatcgt

SEQ ID NO: 206556 - DNA, 20 bp, Artificial Sequence
  chemically synthesized
taggcatgtatgtaaaatca

SEQ ID NO: 206557 - DNA, 20 bp, Artificial Sequence
  chemically synthesized
tagaatttcaaatataagga

SEQ ID NO: 206558 - DNA, 20 bp, Artificial Sequence
  chemically synthesized
taaatagaatttcaaatata

SEQ ID NO: 206559 - DNA, 20 bp, Artificial Sequence
  chemically synthesized
gtaaatagaatttcaaatat

SEQ ID NO: 206560 - DNA, 20 bp, Artificial Sequence
  chemically synthesized
tcataccaaaaggaagtaaa

SEQ ID NO: 206561 - DNA, 20 bp, Artificial Sequence
  chemically synthesized
aaattctatttacttccttt

SEQ ID NO: 206562 - DNA, 20 bp, Artificial Sequence
  chemically synthesized
aatgccatcataccaaaagg

SEQ ID NO: 206563 - DNA, 20 bp, Artificial Sequence
  chemically synthesized
ttcaatgccatcataccaaa

SEQ ID NO: 206564 - DNA, 20 bp, Artificial Sequence
  chemically synthesized
tttcaatgccatcataccaa

SEQ ID NO: 206565 - DNA, 20 bp, Artificial Sequence
  chemically synthesized
tttacttccttttggtatga

SEQ ID NO: 206566 - DNA, 20 bp, Artificial Sequence
  chemically synthesized
tttggtatgatggcattgaa

SEQ ID NO: 206567 - DNA, 20 bp, Artificial Sequence
  chemically synthesized
ggtatgatggcattgaaaag

SEQ ID NO: 206568 - DNA, 20 bp, Artificial Sequence
  chemically synthesized
cattgaaaagaagaaatgat

SEQ ID NO: 206569 - DNA, 20 bp, Artificial Sequence
  chemically synthesized
agaagaaatgataagtgttt

SEQ ID NO: 206570 - DNA, 20 bp, Artificial Sequence
  chemically synthesized
gaaatgataagtgtttcaga

SEQ ID NO: 206571 - DNA, 20 bp, Artificial Sequence
  chemically synthesized
atgataagtgtttcagatgg

SEQ ID NO: 206572 - DNA, 20 bp, Artificial Sequence
  chemically synthesized
atgatcaaatcagggtaatt

SEQ ID NO: 206573 - DNA, 20 bp, Artificial Sequence
  chemically synthesized
aatgatcaaatcagggtaat

SEQ ID NO: 206574 - DNA, 20 bp, Artificial Sequence
  chemically synthesized
aatgtgtaatgatcaaatca

SEQ ID NO: 206575 - DNA, 20 bp, Artificial Sequence
  chemically synthesized
taatgtgtaatgatcaaatc

SEQ ID NO: 206576 - DNA, 20 bp, Artificial Sequence
  chemically synthesized
ataatgtgtaatgatcaaat

SEQ ID NO: 206577 - DNA, 20 bp, Artificial Sequence
  chemically synthesized
ttctagtgatattttgatac

SEQ ID NO: 206578 - DNA, 20 bp, Artificial Sequence
  chemically synthesized
cgcttgtatcaaaatatcac

SEQ ID NO: 206579 - DNA, 20 bp, Artificial Sequence
  chemically synthesized
tcaaaatatcactagaatct

SEQ ID NO: 206580 - DNA, 20 bp, Artificial Sequence
  chemically synthesized
tgtacatatttctaagattc

SEQ ID NO: 206581 - DNA, 20 bp, Artificial Sequence
  chemically synthesized
tagagattgtacatatttct

SEQ ID NO: 206582 - DNA, 20 bp, Artificial Sequence
  chemically synthesized
tatttttgtgttgatacata

SEQ ID NO: 206583 - DNA, 20 bp, Artificial Sequence
  chemically synthesized
tttatttttgtgttgataca

SEQ ID NO: 206584 - DNA, 20 bp, Artificial Sequence
  chemically synthesized
tcaacacaaaaataaaataa

SEQ ID NO: 206585 - DNA, 20 bp, Artificial Sequence
  chemically synthesized
taaagaaacatatttagatt

SEQ ID NO: 206586 - DNA, 20 bp, Artificial Sequence
  chemically synthesized
tttttctaaagaaacatatt

SEQ ID NO: 206587 - DNA, 20 bp, Artificial Sequence
  chemically synthesized
taaatctaaatatgtttctt

SEQ ID NO: 206588 - DNA, 20 bp, Artificial Sequence
  chemically synthesized
aaatatgtttctttagaaaa

SEQ ID NO: 206589 - DNA, 20 bp, Artificial Sequence
  chemically synthesized
gacattcttccttttttcta

SEQ ID NO: 206590 - DNA, 20 bp, Artificial Sequence
  chemically synthesized
aatatgtttctttagaaaaa

SEQ ID NO: 206591 - DNA, 20 bp, Artificial Sequence
  chemically synthesized
atgtttctttagaaaaaagg

SEQ ID NO: 206592 - DNA, 20 bp, Artificial Sequence
  chemically synthesized
ttagaaaaaaggaagaatgt

SEQ ID NO: 206593 - DNA, 20 bp, Artificial Sequence
  chemically synthesized
gaagaatgtcagatttttaa

SEQ ID NO: 206594 - DNA, 20 bp, Artificial Sequence
  chemically synthesized
aagaatgtcagatttttaaa

SEQ ID NO: 206595 - DNA, 20 bp, Artificial Sequence
  chemically synthesized
aggtaataataattatttta

SEQ ID NO: 206596 - DNA, 20 bp, Artificial Sequence
  chemically synthesized
ggtaataataattattttat

SEQ ID NO: 206597 - DNA, 20 bp, Artificial Sequence
  chemically synthesized
tctaccataattatgtatat

SEQ ID NO: 206598 - DNA, 20 bp, Artificial Sequence
  chemically synthesized
ttttctcatatacataatta

SEQ ID NO: 206599 - DNA, 20 bp, Artificial Sequence
  chemically synthesized
tctcatatacataattatgg

SEQ ID NO: 206600 - DNA, 20 bp, Artificial Sequence
  chemically synthesized
tacataattatggtagaatt

SEQ ID NO: 206601 - DNA, 20 bp, Artificial Sequence
  chemically synthesized
aatacaataaaatattctaa

SEQ ID NO: 206602 - DNA, 20 bp, Artificial Sequence
  chemically synthesized
ataaaatattctaatagcaa

SEQ ID NO: 206603 - DNA, 20 bp, Artificial Sequence
  chemically synthesized
gcccacaaatctattgctat

SEQ ID NO: 206604 - DNA, 20 bp, Artificial Sequence
  chemically synthesized
ttctaatagcaatagatttg

SEQ ID NO: 206605 - DNA, 20 bp, Artificial Sequence
  chemically synthesized
tctaatagcaatagatttgt

SEQ ID NO: 206606 - DNA, 20 bp, Artificial Sequence
  chemically synthesized
ctgctgcttcgagaaagtta

SEQ ID NO: 206607 - DNA, 20 bp, Artificial Sequence
  chemically synthesized
tgggcactgtaactttctcg

SEQ ID NO: 206608 - DNA, 20 bp, Artificial Sequence
  chemically synthesized
ctttctctgctgcttcgaga

SEQ ID NO: 206609 - DNA, 20 bp, Artificial Sequence
  chemically synthesized
gcactgtaactttctcgaag

SEQ ID NO: 206610 - DNA, 20 bp, Artificial Sequence
  chemically synthesized
ctgtaactttctcgaagcag

SEQ ID NO: 206611 - DNA, 20 bp, Artificial Sequence
  chemically synthesized
agaactttctctgctgcttc

SEQ ID NO: 206612 - DNA, 20 bp, Artificial Sequence
  chemically synthesized
gtaactttctcgaagcagca

SEQ ID NO: 206613 - DNA, 20 bp, Artificial Sequence
  chemically synthesized
ctttctcgaagcagcagaga

SEQ ID NO: 206614 - DNA, 20 bp, Artificial Sequence
  chemically synthesized
agcagcagagaaagttctgt

SEQ ID NO: 206615 - DNA, 20 bp, Artificial Sequence
  chemically synthesized
aaaacttggttggagactta

SEQ ID NO: 206616 - DNA, 20 bp, Artificial Sequence
  chemically synthesized
agttctgtaagtctccaacc

SEQ ID NO: 206617 - DNA, 20 bp, Artificial Sequence
  chemically synthesized
acatagataaaacttggttg

SEQ ID NO: 206618 - DNA, 20 bp, Artificial Sequence
  chemically synthesized
taacatagataaaacttggt

SEQ ID NO: 206619 - DNA, 20 bp, Artificial Sequence
  chemically synthesized
tacataacatagataaaact

SEQ ID NO: 206620 - DNA, 20 bp, Artificial Sequence
  chemically synthesized
ttcaaaacccttacataaca

SEQ ID NO: 206621 - DNA, 20 bp, Artificial Sequence
  chemically synthesized
aagttttatctatgttatgt

SEQ ID NO: 206622 - DNA, 20 bp, Artificial Sequence
  chemically synthesized
agttttatctatgttatgta

SEQ ID NO: 206623 - DNA, 20 bp, Artificial Sequence
  chemically synthesized
gttttatctatgttatgtaa

SEQ ID NO: 206624 - DNA, 20 bp, Artificial Sequence
  chemically synthesized
gatcaaactatgttatagaa

SEQ ID NO: 206625 - DNA, 20 bp, Artificial Sequence
  chemically synthesized
ttgaatgcttttctataaca

SEQ ID NO: 206626 - DNA, 20 bp, Artificial Sequence
  chemically synthesized
aaaaagatcaaactatgtta

SEQ ID NO: 206627 - DNA, 20 bp, Artificial Sequence
  chemically synthesized
tttactgcttcaaatgaaaa

SEQ ID NO: 206628 - DNA, 20 bp, Artificial Sequence
  chemically synthesized
gtttgatcttttttcatttg

SEQ ID NO: 206629 - DNA, 20 bp, Artificial Sequence
  chemically synthesized
tgatcttttttcatttgaag

SEQ ID NO: 206630 - DNA, 20 bp, Artificial Sequence
  chemically synthesized
tttttcatttgaagcagtaa

SEQ ID NO: 206631 - DNA, 20 bp, Artificial Sequence
  chemically synthesized
cagtaaaagaaatttcaatg

SEQ ID NO: 206632 - DNA, 20 bp, Artificial Sequence
  chemically synthesized
aaatttcaatgaagcatttt

SEQ ID NO: 206633 - DNA, 20 bp, Artificial Sequence
  chemically synthesized
tcaatgaagcattttaagta

SEQ ID NO: 206634 - DNA, 20 bp, Artificial Sequence
  chemically synthesized
aagcattttaagtatggtga

SEQ ID NO: 206635 - DNA, 20 bp, Artificial Sequence
  chemically synthesized
taaatgagtgaaattgtatg

SEQ ID NO: 206636 - DNA, 20 bp, Artificial Sequence
  chemically synthesized
ttggtgaaataaaattaaat

SEQ ID NO: 206637 - DNA, 20 bp, Artificial Sequence
  chemically synthesized
ttaattttatttcaccaaat

SEQ ID NO: 206638 - DNA, 20 bp, Artificial Sequence
  chemically synthesized
taattttatttcaccaaatt

SEQ ID NO: 206639 - DNA, 20 bp, Artificial Sequence
  chemically synthesized
ggaggatttgaagcctaatt

SEQ ID NO: 206640 - DNA, 20 bp, Artificial Sequence
  chemically synthesized
cagatggtctggaggatttg

SEQ ID NO: 206641 - DNA, 20 bp, Artificial Sequence
  chemically synthesized
aaattaggcttcaaatcctc

SEQ ID NO: 206642 - DNA, 20 bp, Artificial Sequence
  chemically synthesized
gatattcacagatggtctgg

SEQ ID NO: 206643 - DNA, 20 bp, Artificial Sequence
  chemically synthesized
agatattcacagatggtctg

SEQ ID NO: 206644 - DNA, 20 bp, Artificial Sequence
  chemically synthesized
ccagatattcacagatggtc

SEQ ID NO: 206645 - DNA, 20 bp, Artificial Sequence
  chemically synthesized
gtcaaccagatattcacaga

SEQ ID NO: 206646 - DNA, 20 bp, Artificial Sequence
  chemically synthesized
acaagtcaaccagatattca

SEQ ID NO: 206647 - DNA, 20 bp, Artificial Sequence
  chemically synthesized
ccagaccatctgtgaatatc

SEQ ID NO: 206648 - DNA, 20 bp, Artificial Sequence
  chemically synthesized
atgcactctgacaagtcaac

SEQ ID NO: 206649 - DNA, 20 bp, Artificial Sequence
  chemically synthesized
tgaatatctggttgacttgt

SEQ ID NO: 206650 - DNA, 20 bp, Artificial Sequence
  chemically synthesized
aatatctggttgacttgtca

SEQ ID NO: 206651 - DNA, 20 bp, Artificial Sequence
  chemically synthesized
caggcaaaatgcactctgac

SEQ ID NO: 206652 - DNA, 20 bp, Artificial Sequence
  chemically synthesized
tgtcagagtgcattttgcct

SEQ ID NO: 206653 - DNA, 20 bp, Artificial Sequence
  chemically synthesized
gagtgcattttgcctgagtt

SEQ ID NO: 206654 - DNA, 20 bp, Artificial Sequence
  chemically synthesized
agtgcattttgcctgagttc

SEQ ID NO: 206655 - DNA, 20 bp, Artificial Sequence
  chemically synthesized
gtgcattttgcctgagttca

SEQ ID NO: 206656 - DNA, 20 bp, Artificial Sequence
  chemically synthesized
ttcacagcgcccctgaactc

SEQ ID NO: 206657 - DNA, 20 bp, Artificial Sequence
  chemically synthesized
tgcattttgcctgagttcag

SEQ ID NO: 206658 - DNA, 20 bp, Artificial Sequence
  chemically synthesized
attcacagcgcccctgaact

SEQ ID NO: 206659 - DNA, 20 bp, Artificial Sequence
  chemically synthesized
aaattggagtgagaaattca

SEQ ID NO: 206660 - DNA, 20 bp, Artificial Sequence
  chemically synthesized
tcctaaatttaaattggagt

SEQ ID NO: 206661 - DNA, 20 bp, Artificial Sequence
  chemically synthesized
gaggtcctaaatttaaattg

SEQ ID NO: 206662 - DNA, 20 bp, Artificial Sequence
  chemically synthesized
cagaggtcctaaatttaaat

SEQ ID NO: 206663 - DNA, 20 bp, Artificial Sequence
  chemically synthesized
ttctcactccaatttaaatt

SEQ ID NO: 206664 - DNA, 20 bp, Artificial Sequence
  chemically synthesized
tctcactccaatttaaattt

SEQ ID NO: 206665 - DNA, 20 bp, Artificial Sequence
  chemically synthesized
tatagaagaacagtgttcag

SEQ ID NO: 206666 - DNA, 20 bp, Artificial Sequence
  chemically synthesized
atatagaagaacagtgttca

SEQ ID NO: 206667 - DNA, 20 bp, Artificial Sequence
  chemically synthesized
aaatatagaagaacagtgtt

SEQ ID NO: 206668 - DNA, 20 bp, Artificial Sequence
  chemically synthesized
agatgtcaaatatagaagaa

SEQ ID NO: 206669 - DNA, 20 bp, Artificial Sequence
  chemically synthesized
ccatcagatgtcaaatatag

SEQ ID NO: 206670 - DNA, 20 bp, Artificial Sequence
  chemically synthesized
ttcccatcagatgtcaaata

SEQ ID NO: 206671 - DNA, 20 bp, Artificial Sequence
  chemically synthesized
cttctatatttgacatctga

SEQ ID NO: 206672 - DNA, 20 bp, Artificial Sequence
  chemically synthesized
ttctatatttgacatctgat

SEQ ID NO: 206673 - DNA, 20 bp, Artificial Sequence
  chemically synthesized
tatatttgacatctgatggg

SEQ ID NO: 206674 - DNA, 20 bp, Artificial Sequence
  chemically synthesized
gcttatccaagtcttcccat

SEQ ID NO: 206675 - DNA, 20 bp, Artificial Sequence
  chemically synthesized
tgacatctgatgggaagact

SEQ ID NO: 206676 - DNA, 20 bp, Artificial Sequence
  chemically synthesized
tctgatgggaagacttggat

SEQ ID NO: 206677 - DNA, 20 bp, Artificial Sequence
  chemically synthesized
gaatgtgtttttgcttatcc

SEQ ID NO: 206678 - DNA, 20 bp, Artificial Sequence
  chemically synthesized
cacattcattacctgcattc

SEQ ID NO: 206679 - DNA, 20 bp, Artificial Sequence
  chemically synthesized
tggtttaatttctggaatgc

SEQ ID NO: 206680 - DNA, 20 bp, Artificial Sequence
  chemically synthesized
atggtttaatttctggaatg

SEQ ID NO: 206681 - DNA, 20 bp, Artificial Sequence
  chemically synthesized
gttgctgatggtttaatttc

SEQ ID NO: 206682 - DNA, 20 bp, Artificial Sequence
  chemically synthesized
cattccagaaattaaaccat

SEQ ID NO: 206683 - DNA, 20 bp, Artificial Sequence
  chemically synthesized
atgtagcaacacgttgctga

SEQ ID NO: 206684 - DNA, 20 bp, Artificial Sequence
  chemically synthesized
gtcaatttagggtgaaaatg

SEQ ID NO: 206685 - DNA, 20 bp, Artificial Sequence
  chemically synthesized
atgtcctccttgtcaattta

SEQ ID NO: 206686 - DNA, 20 bp, Artificial Sequence
  chemically synthesized
aatgtcctccttgtcaattt

SEQ ID NO: 206687 - DNA, 20 bp, Artificial Sequence
  chemically synthesized
cattttcaccctaaattgac

SEQ ID NO: 206688 - DNA, 20 bp, Artificial Sequence
  chemically synthesized
taatgtcctccttgtcaatt

SEQ ID NO: 206689 - DNA, 20 bp, Artificial Sequence
  chemically synthesized
attttcaccctaaattgaca

SEQ ID NO: 206690 - DNA, 20 bp, Artificial Sequence
  chemically synthesized
tttcaccctaaattgacaag

SEQ ID NO: 206691 - DNA, 20 bp, Artificial Sequence
  chemically synthesized
ttcaccctaaattgacaagg

SEQ ID NO: 206692 - DNA, 20 bp, Artificial Sequence
  chemically synthesized
aggaggacattataccacga

SEQ ID NO: 206693 - DNA, 20 bp, Artificial Sequence
  chemically synthesized
ctcatgtgttttttccatcg

SEQ ID NO: 206694 - DNA, 20 bp, Artificial Sequence
  chemically synthesized
ccacgatggaaaaaacacat

SEQ ID NO: 206695 - DNA, 20 bp, Artificial Sequence
  chemically synthesized
ggaaaaaacacatgagcaaa

SEQ ID NO: 206696 - DNA, 20 bp, Artificial Sequence
  chemically synthesized
gaaaaaacacatgagcaaat

SEQ ID NO: 206697 - DNA, 20 bp, Artificial Sequence
  chemically synthesized
acatgagcaaataggctaat

SEQ ID NO: 206698 - DNA, 20 bp, Artificial Sequence
  chemically synthesized
catgagcaaataggctaatt

SEQ ID NO: 206699 - DNA, 20 bp, Artificial Sequence
  chemically synthesized
ctaaaccaatagcacctaat

SEQ ID NO: 206700 - DNA, 20 bp, Artificial Sequence
  chemically synthesized
ataggctaattaggtgctat

SEQ ID NO: 206701 - DNA, 20 bp, Artificial Sequence
  chemically synthesized
ctaattaggtgctattggtt

SEQ ID NO: 206702 - DNA, 20 bp, Artificial Sequence
  chemically synthesized
tgacagataatctaaaccaa

SEQ ID NO: 206703 - DNA, 20 bp, Artificial Sequence
  chemically synthesized
tattggtttagattatctgt

SEQ ID NO: 206704 - DNA, 20 bp, Artificial Sequence
  chemically synthesized
tggtttagattatctgtcag

SEQ ID NO: 206705 - DNA, 20 bp, Artificial Sequence
  chemically synthesized
tttagattatctgtcagcag

SEQ ID NO: 206706 - DNA, 20 bp, Artificial Sequence
  chemically synthesized
acctacagtcctgctgctga

SEQ ID NO: 206707 - DNA, 20 bp, Artificial Sequence
  chemically synthesized
ttagattatctgtcagcagc

SEQ ID NO: 206708 - DNA, 20 bp, Artificial Sequence
  chemically synthesized
atctgtcagcagcaggactg

SEQ ID NO: 206709 - DNA, 20 bp, Artificial Sequence
  chemically synthesized
tctgtcagcagcaggactgt

SEQ ID NO: 206710 - DNA, 20 bp, Artificial Sequence
  chemically synthesized
gtcagcagcaggactgtagg

SEQ ID NO: 206711 - DNA, 20 bp, Artificial Sequence
  chemically synthesized
gtactccctgtggctaccta

SEQ ID NO: 206712 - DNA, 20 bp, Artificial Sequence
  chemically synthesized
agcaggactgtaggtagcca

SEQ ID NO: 206713 - DNA, 20 bp, Artificial Sequence
  chemically synthesized
gcaggactgtaggtagccac

SEQ ID NO: 206714 - DNA, 20 bp, Artificial Sequence
  chemically synthesized
caggactgtaggtagccaca

SEQ ID NO: 206715 - DNA, 20 bp, Artificial Sequence
  chemically synthesized
ggactgtaggtagccacagg

SEQ ID NO: 206716 - DNA, 20 bp, Artificial Sequence
  chemically synthesized
tcccctgcctgtactccctg

SEQ ID NO: 206717 - DNA, 20 bp, Artificial Sequence
  chemically synthesized
gtaggtagccacagggagta

SEQ ID NO: 206718 - DNA, 20 bp, Artificial Sequence
  chemically synthesized
taggtagccacagggagtac

SEQ ID NO: 206719 - DNA, 20 bp, Artificial Sequence
  chemically synthesized
gtagccacagggagtacagg

SEQ ID NO: 206720 - DNA, 20 bp, Artificial Sequence
  chemically synthesized
tagccacagggagtacaggc

SEQ ID NO: 206721 - DNA, 20 bp, Artificial Sequence
  chemically synthesized
agccacagggagtacaggca

SEQ ID NO: 206722 - DNA, 20 bp, Artificial Sequence
  chemically synthesized
gccacagggagtacaggcag

SEQ ID NO: 206723 - DNA, 20 bp, Artificial Sequence
  chemically synthesized
cacagggagtacaggcaggg

SEQ ID NO: 206724 - DNA, 20 bp, Artificial Sequence
  chemically synthesized
acagggagtacaggcagggg

SEQ ID NO: 206725 - DNA, 20 bp, Artificial Sequence
  chemically synthesized
ggagtacaggcaggggagga

SEQ ID NO: 206726 - DNA, 20 bp, Artificial Sequence
  chemically synthesized
gtacaggcaggggaggaaag

SEQ ID NO: 206727 - DNA, 20 bp, Artificial Sequence
  chemically synthesized
tacaggcaggggaggaaagc

SEQ ID NO: 206728 - DNA, 20 bp, Artificial Sequence
  chemically synthesized
ggaggaaagcaggcttgatc

SEQ ID NO: 206729 - DNA, 20 bp, Artificial Sequence
  chemically synthesized
ttcatgcttgaatctagatc

SEQ ID NO: 206730 - DNA, 20 bp, Artificial Sequence
  chemically synthesized
agcaggcttgatctagattc

SEQ ID NO: 206731 - DNA, 20 bp, Artificial Sequence
  chemically synthesized
gctggtttcatgcttgaatc

SEQ ID NO: 206732 - DNA, 20 bp, Artificial Sequence
  chemically synthesized
tctagattcaagcatgaaac

SEQ ID NO: 206733 - DNA, 20 bp, Artificial Sequence
  chemically synthesized
caagcatgaaaccagcactc

SEQ ID NO: 206734 - DNA, 20 bp, Artificial Sequence
  chemically synthesized
cccatcatgttctagagtgc

SEQ ID NO: 206735 - DNA, 20 bp, Artificial Sequence
  chemically synthesized
attacacccatcatgttcta

SEQ ID NO: 206736 - DNA, 20 bp, Artificial Sequence
  chemically synthesized
agattacacccatcatgttc

SEQ ID NO: 206737 - DNA, 20 bp, Artificial Sequence
  chemically synthesized
accagcactctagaacatga

SEQ ID NO: 206738 - DNA, 20 bp, Artificial Sequence
  chemically synthesized
ccagcactctagaacatgat

SEQ ID NO: 206739 - DNA, 20 bp, Artificial Sequence
  chemically synthesized
agaacatgatgggtgtaatc

SEQ ID NO: 206740 - DNA, 20 bp, Artificial Sequence
  chemically synthesized
aacatgatgggtgtaatctg

SEQ ID NO: 206741 - DNA, 20 bp, Artificial Sequence
  chemically synthesized
atgatgggtgtaatctggag

SEQ ID NO: 206742 - DNA, 20 bp, Artificial Sequence
  chemically synthesized
caggttctgtttatctgctc

SEQ ID NO: 206743 - DNA, 20 bp, Artificial Sequence
  chemically synthesized
tgtaatctggagcagataaa

SEQ ID NO: 206744 - DNA, 20 bp, Artificial Sequence
  chemically synthesized
caaaaatgctatcatgaaac

SEQ ID NO: 206745 - DNA, 20 bp, Artificial Sequence
  chemically synthesized
tcaaaaatgctatcatgaaa

SEQ ID NO: 206746 - DNA, 20 bp, Artificial Sequence
  chemically synthesized
aaacagaacctgtttcatga

SEQ ID NO: 206747 - DNA, 20 bp, Artificial Sequence
  chemically synthesized
tgatagcatttttgatgatt

SEQ ID NO: 206748 - DNA, 20 bp, Artificial Sequence
  chemically synthesized
gatagcatttttgatgattc

SEQ ID NO: 206749 - DNA, 20 bp, Artificial Sequence
  chemically synthesized
ttttgatgattcaggccaat

SEQ ID NO: 206750 - DNA, 20 bp, Artificial Sequence
  chemically synthesized
gatgattcaggccaatcgga

SEQ ID NO: 206751 - DNA, 20 bp, Artificial Sequence
  chemically synthesized
ctgcttcctagccatccgat

SEQ ID NO: 206752 - DNA, 20 bp, Artificial Sequence
  chemically synthesized
attcaggccaatcggatggc

SEQ ID NO: 206753 - DNA, 20 bp, Artificial Sequence
  chemically synthesized
ttcaggccaatcggatggct

SEQ ID NO: 206754 - DNA, 20 bp, Artificial Sequence
  chemically synthesized
aggccaatcggatggctagg

SEQ ID NO: 206755 - DNA, 20 bp, Artificial Sequence
  chemically synthesized
ccaatcggatggctaggaag

SEQ ID NO: 206756 - DNA, 20 bp, Artificial Sequence
  chemically synthesized
caatcggatggctaggaagc

SEQ ID NO: 206757 - DNA, 20 bp, Artificial Sequence
  chemically synthesized
tggggagagcgcctgcttcc

SEQ ID NO: 206758 - DNA, 20 bp, Artificial Sequence
  chemically synthesized
cagtttgagcggggtgggga

SEQ ID NO: 206759 - DNA, 20 bp, Artificial Sequence
  chemically synthesized
agcagtttgagcggggtggg

SEQ ID NO: 206760 - DNA, 20 bp, Artificial Sequence
  chemically synthesized
tcagcagtttgagcggggtg

SEQ ID NO: 206761 - DNA, 20 bp, Artificial Sequence
  chemically synthesized
ctcagcagtttgagcggggt

SEQ ID NO: 206762 - DNA, 20 bp, Artificial Sequence
  chemically synthesized
cctcagcagtttgagcgggg

SEQ ID NO: 206763 - DNA, 20 bp, Artificial Sequence
  chemically synthesized
cttcctcagcagtttgagcg

SEQ ID NO: 206764 - DNA, 20 bp, Artificial Sequence
  chemically synthesized
ccttcctcagcagtttgagc

SEQ ID NO: 206765 - DNA, 20 bp, Artificial Sequence
  chemically synthesized
accttcctcagcagtttgag

SEQ ID NO: 206766 - DNA, 20 bp, Artificial Sequence
  chemically synthesized
ttcaccttcctcagcagttt

SEQ ID NO: 206767 - DNA, 20 bp, Artificial Sequence
  chemically synthesized
cccaccccgctcaaactgct

SEQ ID NO: 206768 - DNA, 20 bp, Artificial Sequence
  chemically synthesized
ccaccccgctcaaactgctg

SEQ ID NO: 206769 - DNA, 20 bp, Artificial Sequence
  chemically synthesized
ccccgctcaaactgctgagg

SEQ ID NO: 206770 - DNA, 20 bp, Artificial Sequence
  chemically synthesized
cccgctcaaactgctgagga

SEQ ID NO: 206771 - DNA, 20 bp, Artificial Sequence
  chemically synthesized
gcatggttcaccttcctcag

SEQ ID NO: 206772 - DNA, 20 bp, Artificial Sequence
  chemically synthesized
actgcatggttcaccttcct

SEQ ID NO: 206773 - DNA, 20 bp, Artificial Sequence
  chemically synthesized
gctgaggaaggtgaaccatg

SEQ ID NO: 206774 - DNA, 20 bp, Artificial Sequence
  chemically synthesized
tagccctctgatgaactgca

SEQ ID NO: 206775 - DNA, 20 bp, Artificial Sequence
  chemically synthesized
aggtgaaccatgcagttcat

SEQ ID NO: 206776 - DNA, 20 bp, Artificial Sequence
  chemically synthesized
gtgaaccatgcagttcatca

SEQ ID NO: 206777 - DNA, 20 bp, Artificial Sequence
  chemically synthesized
tgaaccatgcagttcatcag

SEQ ID NO: 206778 - DNA, 20 bp, Artificial Sequence
  chemically synthesized
gaaccatgcagttcatcaga

SEQ ID NO: 206779 - DNA, 20 bp, Artificial Sequence
  chemically synthesized
cagttcatcagagggctaca

SEQ ID NO: 206780 - DNA, 20 bp, Artificial Sequence
  chemically synthesized
gttcatcagagggctacaaa

SEQ ID NO: 206781 - DNA, 20 bp, Artificial Sequence
  chemically synthesized
ttcatcagagggctacaaag

SEQ ID NO: 206782 - DNA, 20 bp, Artificial Sequence
  chemically synthesized
gaagtgttgatacctctttg

SEQ ID NO: 206783 - DNA, 20 bp, Artificial Sequence
  chemically synthesized
acaaagaggtatcaacactt

SEQ ID NO: 206784 - DNA, 20 bp, Artificial Sequence
  chemically synthesized
gatgcccatatggaaaactg

SEQ ID NO: 206785 - DNA, 20 bp, Artificial Sequence
  chemically synthesized
caacacttcagttttccata

SEQ ID NO: 206786 - DNA, 20 bp, Artificial Sequence
  chemically synthesized
aacacttcagttttccatat

SEQ ID NO: 206787 - DNA, 20 bp, Artificial Sequence
  chemically synthesized
gtgagccccagatgcccata

SEQ ID NO: 206788 - DNA, 20 bp, Artificial Sequence
  chemically synthesized
cagttttccatatgggcatc

SEQ ID NO: 206789 - DNA, 20 bp, Artificial Sequence
  chemically synthesized
agttttccatatgggcatct

SEQ ID NO: 206790 - DNA, 20 bp, Artificial Sequence
  chemically synthesized
gttttccatatgggcatctg

SEQ ID NO: 206791 - DNA, 20 bp, Artificial Sequence
  chemically synthesized
ctgtttggttttgtgagccc

SEQ ID NO: 206792 - DNA, 20 bp, Artificial Sequence
  chemically synthesized
aaaaatctgtttggttttgt

SEQ ID NO: 206793 - DNA, 20 bp, Artificial Sequence
  chemically synthesized
ctggggctcacaaaaccaaa

SEQ ID NO: 206794 - DNA, 20 bp, Artificial Sequence
  chemically synthesized
tttgataccaaaaatctgtt

SEQ ID NO: 206795 - DNA, 20 bp, Artificial Sequence
  chemically synthesized
cacaaaaccaaacagatttt

SEQ ID NO: 206796 - DNA, 20 bp, Artificial Sequence
  chemically synthesized
cagatttttggtatcaaaaa

SEQ ID NO: 206797 - DNA, 20 bp, Artificial Sequence
  chemically synthesized
tggtatcaaaaatagtattg

SEQ ID NO: 206798 - DNA, 20 bp, Artificial Sequence
  chemically synthesized
aaatagtattgcagcctctg

SEQ ID NO: 206799 - DNA, 20 bp, Artificial Sequence
  chemically synthesized
cccatgggtggtttccacag

SEQ ID NO: 206800 - DNA, 20 bp, Artificial Sequence
  chemically synthesized
ccccatgggtggtttccaca

SEQ ID NO: 206801 - DNA, 20 bp, Artificial Sequence
  chemically synthesized
aaccccatgggtggtttcca

SEQ ID NO: 206802 - DNA, 20 bp, Artificial Sequence
  chemically synthesized
gcctctgtggaaaccaccca

SEQ ID NO: 206803 - DNA, 20 bp, Artificial Sequence
  chemically synthesized
cctctgtggaaaccacccat

SEQ ID NO: 206804 - DNA, 20 bp, Artificial Sequence
  chemically synthesized
ctctgtggaaaccacccatg

SEQ ID NO: 206805 - DNA, 20 bp, Artificial Sequence
  chemically synthesized
tagatgagaaaccccatggg

SEQ ID NO: 206806 - DNA, 20 bp, Artificial Sequence
  chemically synthesized
acatagatgagaaaccccat

SEQ ID NO: 206807 - DNA, 20 bp, Artificial Sequence
  chemically synthesized
tacatagatgagaaacccca

SEQ ID NO: 206808 - DNA, 20 bp, Artificial Sequence
  chemically synthesized
tatgtcagtgttacatagat

SEQ ID NO: 206809 - DNA, 20 bp, Artificial Sequence
  chemically synthesized
tctactatgtcagtgttaca

SEQ ID NO: 206810 - DNA, 20 bp, Artificial Sequence
  chemically synthesized
tcatctatgtaacactgaca

SEQ ID NO: 206811 - DNA, 20 bp, Artificial Sequence
  chemically synthesized
tctatgtaacactgacatag

SEQ ID NO: 206812 - DNA, 20 bp, Artificial Sequence
  chemically synthesized
agcctgagtttctactatgt

SEQ ID NO: 206813 - DNA, 20 bp, Artificial Sequence
  chemically synthesized
acactgacatagtagaaact

SEQ ID NO: 206814 - DNA, 20 bp, Artificial Sequence
  chemically synthesized
cactgacatagtagaaactc

SEQ ID NO: 206815 - DNA, 20 bp, Artificial Sequence
  chemically synthesized
gaatgtgctctaggcagcct

SEQ ID NO: 206816 - DNA, 20 bp, Artificial Sequence
  chemically synthesized
tagtagaaactcaggctgcc

SEQ ID NO: 206817 - DNA, 20 bp, Artificial Sequence
  chemically synthesized
gtagaaactcaggctgccta

SEQ ID NO: 206818 - DNA, 20 bp, Artificial Sequence
  chemically synthesized
ttctctgaatgtgctctagg

SEQ ID NO: 206819 - DNA, 20 bp, Artificial Sequence
  chemically synthesized
ttgttctctgaatgtgctct

SEQ ID NO: 206820 - DNA, 20 bp, Artificial Sequence
  chemically synthesized
cttgttctctgaatgtgctc

SEQ ID NO: 206821 - DNA, 20 bp, Artificial Sequence
  chemically synthesized
caggctgcctagagcacatt

SEQ ID NO: 206822 - DNA, 20 bp, Artificial Sequence
  chemically synthesized
ggctgcctagagcacattca

SEQ ID NO: 206823 - DNA, 20 bp, Artificial Sequence
  chemically synthesized
ctagagcacattcagagaac

SEQ ID NO: 206824 - DNA, 20 bp, Artificial Sequence
  chemically synthesized
cattcagagaacaagtgaat

SEQ ID NO: 206825 - DNA, 20 bp, Artificial Sequence
  chemically synthesized
agagaacaagtgaatgagtg

SEQ ID NO: 206826 - DNA, 20 bp, Artificial Sequence
  chemically synthesized
gtgaatgagtgcagtctaca

SEQ ID NO: 206827 - DNA, 20 bp, Artificial Sequence
  chemically synthesized
atgagtgcagtctacaaagt

SEQ ID NO: 206828 - DNA, 20 bp, Artificial Sequence
  chemically synthesized
agtgacagagacttactttg

SEQ ID NO: 206829 - DNA, 20 bp, Artificial Sequence
  chemically synthesized
gaagcatgatgtaagtgaca

SEQ ID NO: 206830 - DNA, 20 bp, Artificial Sequence
  chemically synthesized
aggaagcatgatgtaagtga

SEQ ID NO: 206831 - DNA, 20 bp, Artificial Sequence
  chemically synthesized
attctcaggaagcatgatgt

SEQ ID NO: 206832 - DNA, 20 bp, Artificial Sequence
  chemically synthesized
tcacttacatcatgcttcct

SEQ ID NO: 206833 - DNA, 20 bp, Artificial Sequence
  chemically synthesized
ttgcaagtgatattctcagg

SEQ ID NO: 206834 - DNA, 20 bp, Artificial Sequence
  chemically synthesized
caattgcaagtgatattctc

SEQ ID NO: 206835 - DNA, 20 bp, Artificial Sequence
  chemically synthesized
acaattgcaagtgatattct

SEQ ID NO: 206836 - DNA, 20 bp, Artificial Sequence
  chemically synthesized
gcagcataattcacaattgc

SEQ ID NO: 206837 - DNA, 20 bp, Artificial Sequence
  chemically synthesized
ttgcacacacatgtttatag

SEQ ID NO: 206838 - DNA, 20 bp, Artificial Sequence
  chemically synthesized
tacttgcacacacatgttta

SEQ ID NO: 206839 - DNA, 20 bp, Artificial Sequence
  chemically synthesized
tgctataaacatgtgtgtgc

SEQ ID NO: 206840 - DNA, 20 bp, Artificial Sequence
  chemically synthesized
ttgtcgattgatgggcattt

SEQ ID NO: 206841 - DNA, 20 bp, Artificial Sequence
  chemically synthesized
cttgtcgattgatgggcatt

SEQ ID NO: 206842 - DNA, 20 bp, Artificial Sequence
  chemically synthesized
ttatctacttgtcgattgat

SEQ ID NO: 206843 - DNA, 20 bp, Artificial Sequence
  chemically synthesized
tttatctacttgtcgattga

SEQ ID NO: 206844 - DNA, 20 bp, Artificial Sequence
  chemically synthesized
ccaaatgcccatcaatcgac

SEQ ID NO: 206845 - DNA, 20 bp, Artificial Sequence
  chemically synthesized
aatgcccatcaatcgacaag

SEQ ID NO: 206846 - DNA, 20 bp, Artificial Sequence
  chemically synthesized
catcaatcgacaagtagata

SEQ ID NO: 206847 - DNA, 20 bp, Artificial Sequence
  chemically synthesized
acaagtagataaagaaactg

SEQ ID NO: 206848 - DNA, 20 bp, Artificial Sequence
  chemically synthesized
atacatatgtatatataccg

SEQ ID NO: 206849 - DNA, 20 bp, Artificial Sequence
  chemically synthesized
agtattcatatatatatata

SEQ ID NO: 206850 - DNA, 20 bp, Artificial Sequence
  chemically synthesized
atatatatatgaatactact

SEQ ID NO: 206851 - DNA, 20 bp, Artificial Sequence
  chemically synthesized
cattcctttttatggctgag

SEQ ID NO: 206852 - DNA, 20 bp, Artificial Sequence
  chemically synthesized
attcattcctttttatggct

SEQ ID NO: 206853 - DNA, 20 bp, Artificial Sequence
  chemically synthesized
gaatactactcagccataaa

SEQ ID NO: 206854 - DNA, 20 bp, Artificial Sequence
  chemically synthesized
aatactactcagccataaaa

SEQ ID NO: 206855 - DNA, 20 bp, Artificial Sequence
  chemically synthesized
tgttaattcattccttttta

SEQ ID NO: 206856 - DNA, 20 bp, Artificial Sequence
  chemically synthesized
cataaaaaggaatgaattaa

SEQ ID NO: 206857 - DNA, 20 bp, Artificial Sequence
  chemically synthesized
taacagcatttgcaatgacc

SEQ ID NO: 206858 - DNA, 20 bp, Artificial Sequence
  chemically synthesized
gatagtctccaatcgcatcc

SEQ ID NO: 206859 - DNA, 20 bp, Artificial Sequence
  chemically synthesized
tgatagtctccaatcgcatc

SEQ ID NO: 206860 - DNA, 20 bp, Artificial Sequence
  chemically synthesized
tgcaatgacctggatgcgat

SEQ ID NO: 206861 - DNA, 20 bp, Artificial Sequence
  chemically synthesized
caatgacctggatgcgattg

SEQ ID NO: 206862 - DNA, 20 bp, Artificial Sequence
  chemically synthesized
cgattggagactatcattgt

SEQ ID NO: 206863 - DNA, 20 bp, Artificial Sequence
  chemically synthesized
agttacttcacttacaatga

SEQ ID NO: 206864 - DNA, 20 bp, Artificial Sequence
  chemically synthesized
ggagactatcattgtaagtg

SEQ ID NO: 206865 - DNA, 20 bp, Artificial Sequence
  chemically synthesized
tcattgtaagtgaagtaact

SEQ ID NO: 206866 - DNA, 20 bp, Artificial Sequence
  chemically synthesized
cattgtaagtgaagtaactc

SEQ ID NO: 206867 - DNA, 20 bp, Artificial Sequence
  chemically synthesized
taagtgaagtaactcaggaa

SEQ ID NO: 206868 - DNA, 20 bp, Artificial Sequence
  chemically synthesized
ctgtttggttttccattcct

SEQ ID NO: 206869 - DNA, 20 bp, Artificial Sequence
  chemically synthesized
ctcaggaatggaaaaccaaa

SEQ ID NO: 206870 - DNA, 20 bp, Artificial Sequence
  chemically synthesized
cagtgagaacatatgctgtt

SEQ ID NO: 206871 - DNA, 20 bp, Artificial Sequence
  chemically synthesized
cttagctcccacgtatcagt

SEQ ID NO: 206872 - DNA, 20 bp, Artificial Sequence
  chemically synthesized
catatgttctcactgatacg

SEQ ID NO: 206873 - DNA, 20 bp, Artificial Sequence
  chemically synthesized
atatgttctcactgatacgt

SEQ ID NO: 206874 - DNA, 20 bp, Artificial Sequence
  chemically synthesized
atagcttagctcccacgtat

SEQ ID NO: 206875 - DNA, 20 bp, Artificial Sequence
  chemically synthesized
atgttctcactgatacgtgg

SEQ ID NO: 206876 - DNA, 20 bp, Artificial Sequence
  chemically synthesized
ctcactgatacgtgggagct

SEQ ID NO: 206877 - DNA, 20 bp, Artificial Sequence
  chemically synthesized
atacgtgggagctaagctat

SEQ ID NO: 206878 - DNA, 20 bp, Artificial Sequence
  chemically synthesized
tacgtgggagctaagctatg

SEQ ID NO: 206879 - DNA, 20 bp, Artificial Sequence
  chemically synthesized
gcctttgcatcctcatagct

SEQ ID NO: 206880 - DNA, 20 bp, Artificial Sequence
  chemically synthesized
cttatgcctttgcatcctca

SEQ ID NO: 206881 - DNA, 20 bp, Artificial Sequence
  chemically synthesized
agctaagctatgaggatgca

SEQ ID NO: 206882 - DNA, 20 bp, Artificial Sequence
  chemically synthesized
gctaagctatgaggatgcaa

SEQ ID NO: 206883 - DNA, 20 bp, Artificial Sequence
  chemically synthesized
ctatgaggatgcaaaggcat

SEQ ID NO: 206884 - DNA, 20 bp, Artificial Sequence
  chemically synthesized
aaggcataagaatgatacaa

SEQ ID NO: 206885 - DNA, 20 bp, Artificial Sequence
  chemically synthesized
aggcataagaatgatacaat

SEQ ID NO: 206886 - DNA, 20 bp, Artificial Sequence
  chemically synthesized
aagaatgatacaatgggctt

SEQ ID NO: 206887 - DNA, 20 bp, Artificial Sequence
  chemically synthesized
gaatgatacaatgggctttg

SEQ ID NO: 206888 - DNA, 20 bp, Artificial Sequence
  chemically synthesized
ttctaccccccaagtctcca

SEQ ID NO: 206889 - DNA, 20 bp, Artificial Sequence
  chemically synthesized
tacaatgggctttggagact

SEQ ID NO: 206890 - DNA, 20 bp, Artificial Sequence
  chemically synthesized
acaatgggctttggagactt

SEQ ID NO: 206891 - DNA, 20 bp, Artificial Sequence
  chemically synthesized
caatgggctttggagacttg

SEQ ID NO: 206892 - DNA, 20 bp, Artificial Sequence
  chemically synthesized
aatgggctttggagacttgg

SEQ ID NO: 206893 - DNA, 20 bp, Artificial Sequence
  chemically synthesized
atgggctttggagacttggg

SEQ ID NO: 206894 - DNA, 20 bp, Artificial Sequence
  chemically synthesized
ggctttggagacttgggggg

SEQ ID NO: 206895 - DNA, 20 bp, Artificial Sequence
  chemically synthesized
gcaccccttttctacccccc

SEQ ID NO: 206896 - DNA, 20 bp, Artificial Sequence
  chemically synthesized
tggagacttggggggtagaa

SEQ ID NO: 206897 - DNA, 20 bp, Artificial Sequence
  chemically synthesized
ggagacttggggggtagaaa

SEQ ID NO: 206898 - DNA, 20 bp, Artificial Sequence
  chemically synthesized
gagacttggggggtagaaaa

SEQ ID NO: 206899 - DNA, 20 bp, Artificial Sequence
  chemically synthesized
agacttggggggtagaaaag

SEQ ID NO: 206900 - DNA, 20 bp, Artificial Sequence
  chemically synthesized
gggggtagaaaaggggtgcc

SEQ ID NO: 206901 - DNA, 20 bp, Artificial Sequence
  chemically synthesized
ggggtagaaaaggggtgccg

SEQ ID NO: 206902 - DNA, 20 bp, Artificial Sequence
  chemically synthesized
gggtagaaaaggggtgccga

SEQ ID NO: 206903 - DNA, 20 bp, Artificial Sequence
  chemically synthesized
atatgttatcttttgtccct

SEQ ID NO: 206904 - DNA, 20 bp, Artificial Sequence
  chemically synthesized
aaaggggtgccgagggacaa

SEQ ID NO: 206905 - DNA, 20 bp, Artificial Sequence
  chemically synthesized
gggacaaaagataacatata

SEQ ID NO: 206906 - DNA, 20 bp, Artificial Sequence
  chemically synthesized
aaaagataacatatatggtg

SEQ ID NO: 206907 - DNA, 20 bp, Artificial Sequence
  chemically synthesized
tggtgcacccatcacacgag

SEQ ID NO: 206908 - DNA, 20 bp, Artificial Sequence
  chemically synthesized
agtgtatactactcgtgtga

SEQ ID NO: 206909 - DNA, 20 bp, Artificial Sequence
  chemically synthesized
gtgtatactactcgtgtgat

SEQ ID NO: 206910 - DNA, 20 bp, Artificial Sequence
  chemically synthesized
tcctggtgcacccatcacac

SEQ ID NO: 206911 - DNA, 20 bp, Artificial Sequence
  chemically synthesized
tactcgtgtgatgggtgcac

SEQ ID NO: 206912 - DNA, 20 bp, Artificial Sequence
  chemically synthesized
actcgtgtgatgggtgcacc

SEQ ID NO: 206913 - DNA, 20 bp, Artificial Sequence
  chemically synthesized
agtggtaatttgtgagatcc

SEQ ID NO: 206914 - DNA, 20 bp, Artificial Sequence
  chemically synthesized
gttctttagtggtaatttgt

SEQ ID NO: 206915 - DNA, 20 bp, Artificial Sequence
  chemically synthesized
gatctcacaaattaccacta

SEQ ID NO: 206916 - DNA, 20 bp, Artificial Sequence
  chemically synthesized
gcaatgagtaagttctttag

SEQ ID NO: 206917 - DNA, 20 bp, Artificial Sequence
  chemically synthesized
attgcaatgagtaagttctt

SEQ ID NO: 206918 - DNA, 20 bp, Artificial Sequence
  chemically synthesized
agcaaactattgcaatgagt

SEQ ID NO: 206919 - DNA, 20 bp, Artificial Sequence
  chemically synthesized
aaagaacttactcattgcaa

SEQ ID NO: 206920 - DNA, 20 bp, Artificial Sequence
  chemically synthesized
tctcagcaaactattgcaat

SEQ ID NO: 206921 - DNA, 20 bp, Artificial Sequence
  chemically synthesized
actcattgcaatagtttgct

SEQ ID NO: 206922 - DNA, 20 bp, Artificial Sequence
  chemically synthesized
caatagtttgctgagaatga

SEQ ID NO: 206923 - DNA, 20 bp, Artificial Sequence
  chemically synthesized
aagctggaaaccatcattct

SEQ ID NO: 206924 - DNA, 20 bp, Artificial Sequence
  chemically synthesized
ttgctgagaatgatggtttc

SEQ ID NO: 206925 - DNA, 20 bp, Artificial Sequence
  chemically synthesized
tgtagggacatggatgaagc

SEQ ID NO: 206926 - DNA, 20 bp, Artificial Sequence
  chemically synthesized
cctttgtagggacatggatg

SEQ ID NO: 206927 - DNA, 20 bp, Artificial Sequence
  chemically synthesized
tcacgtcctttgtagggaca

SEQ ID NO: 206928 - DNA, 20 bp, Artificial Sequence
  chemically synthesized
gcttcatccatgtccctaca

SEQ ID NO: 206929 - DNA, 20 bp, Artificial Sequence
  chemically synthesized
cttcatccatgtccctacaa

SEQ ID NO: 206930 - DNA, 20 bp, Artificial Sequence
  chemically synthesized
atgagttcacgtcctttgta

SEQ ID NO: 206931 - DNA, 20 bp, Artificial Sequence
  chemically synthesized
gatgagttcacgtcctttgt

SEQ ID NO: 206932 - DNA, 20 bp, Artificial Sequence
  chemically synthesized
ggatgagttcacgtcctttg

SEQ ID NO: 206933 - DNA, 20 bp, Artificial Sequence
  chemically synthesized
gtgcagccataaaaaaggat

SEQ ID NO: 206934 - DNA, 20 bp, Artificial Sequence
  chemically synthesized
cgtgaactcatcctttttta

SEQ ID NO: 206935 - DNA, 20 bp, Artificial Sequence
  chemically synthesized
atactgtgcagccataaaaa

SEQ ID NO: 206936 - DNA, 20 bp, Artificial Sequence
  chemically synthesized
aatactgtgcagccataaaa

SEQ ID NO: 206937 - DNA, 20 bp, Artificial Sequence
  chemically synthesized
catccttttttatggctgca

SEQ ID NO: 206938 - DNA, 20 bp, Artificial Sequence
  chemically synthesized
atacaccatggaatactgtg

SEQ ID NO: 206939 - DNA, 20 bp, Artificial Sequence
  chemically synthesized
tatggctgcacagtattcca

SEQ ID NO: 206940 - DNA, 20 bp, Artificial Sequence
  chemically synthesized
aatgtggcacatatacacca

SEQ ID NO: 206941 - DNA, 20 bp, Artificial Sequence
  chemically synthesized
tagactggattaagaaaatg

SEQ ID NO: 206942 - DNA, 20 bp, Artificial Sequence
  chemically synthesized
tgtgccacattttcttaatc

SEQ ID NO: 206943 - DNA, 20 bp, Artificial Sequence
  chemically synthesized
cgacaatgatagactggatt

SEQ ID NO: 206944 - DNA, 20 bp, Artificial Sequence
  chemically synthesized
aatgtccgacaatgatagac

SEQ ID NO: 206945 - DNA, 20 bp, Artificial Sequence
  chemically synthesized
ttaatccagtctatcattgt

SEQ ID NO: 206946 - DNA, 20 bp, Artificial Sequence
  chemically synthesized
acccaaatgtccgacaatga

SEQ ID NO: 206947 - DNA, 20 bp, Artificial Sequence
  chemically synthesized
gtctatcattgtcggacatt

SEQ ID NO: 206948 - DNA, 20 bp, Artificial Sequence
  chemically synthesized
tctatcattgtcggacattt

SEQ ID NO: 206949 - DNA, 20 bp, Artificial Sequence
  chemically synthesized
tcattgtcggacatttgggt

SEQ ID NO: 206950 - DNA, 20 bp, Artificial Sequence
  chemically synthesized
cggacatttgggttggttcc

SEQ ID NO: 206951 - DNA, 20 bp, Artificial Sequence
  chemically synthesized
tattcacaatagcaaagact

SEQ ID NO: 206952 - DNA, 20 bp, Artificial Sequence
  chemically synthesized
cggcactattcacaatagca

SEQ ID NO: 206953 - DNA, 20 bp, Artificial Sequence
  chemically synthesized
caagtctttgctattgtgaa

SEQ ID NO: 206954 - DNA, 20 bp, Artificial Sequence
  chemically synthesized
tattgcggcactattcacaa

SEQ ID NO: 206955 - DNA, 20 bp, Artificial Sequence
  chemically synthesized
atgcacatgtatgtttattg

SEQ ID NO: 206956 - DNA, 20 bp, Artificial Sequence
  chemically synthesized
tacatgtgcatgtgtcttta

SEQ ID NO: 206957 - DNA, 20 bp, Artificial Sequence
  chemically synthesized
atgtgcatgtgtctttacag

SEQ ID NO: 206958 - DNA, 20 bp, Artificial Sequence
  chemically synthesized
ttataaatcatgctgctgta

SEQ ID NO: 206959 - DNA, 20 bp, Artificial Sequence
  chemically synthesized
cagcatgatttataatcctt

SEQ ID NO: 206960 - DNA, 20 bp, Artificial Sequence
  chemically synthesized
agcatgatttataatccttt

SEQ ID NO: 206961 - DNA, 20 bp, Artificial Sequence
  chemically synthesized
attactgggtatatacccaa

SEQ ID NO: 206962 - DNA, 20 bp, Artificial Sequence
  chemically synthesized
cattactgggtatataccca

SEQ ID NO: 206963 - DNA, 20 bp, Artificial Sequence
  chemically synthesized
taatcctttgggtatatacc

SEQ ID NO: 206964 - DNA, 20 bp, Artificial Sequence
  chemically synthesized
tttgggtatatacccagtaa

SEQ ID NO: 206965 - DNA, 20 bp, Artificial Sequence
  chemically synthesized
ttgggtatatacccagtaat

SEQ ID NO: 206966 - DNA, 20 bp, Artificial Sequence
  chemically synthesized
gacccagccatcccattact

SEQ ID NO: 206967 - DNA, 20 bp, Artificial Sequence
  chemically synthesized
tgacccagccatcccattac

SEQ ID NO: 206968 - DNA, 20 bp, Artificial Sequence
  chemically synthesized
gtatatacccagtaatggga

SEQ ID NO: 206969 - DNA, 20 bp, Artificial Sequence
  chemically synthesized
atacccagtaatgggatggc

SEQ ID NO: 206970 - DNA, 20 bp, Artificial Sequence
  chemically synthesized
tacccagtaatgggatggct

SEQ ID NO: 206971 - DNA, 20 bp, Artificial Sequence
  chemically synthesized
aatgggatggctgggtcaaa

SEQ ID NO: 206972 - DNA, 20 bp, Artificial Sequence
  chemically synthesized
actagaattaccatttgacc

SEQ ID NO: 206973 - DNA, 20 bp, Artificial Sequence
  chemically synthesized
gctgggtcaaatggtaattc

SEQ ID NO: 206974 - DNA, 20 bp, Artificial Sequence
  chemically synthesized
tcaaatggtaattctagttc

SEQ ID NO: 206975 - DNA, 20 bp, Artificial Sequence
  chemically synthesized
attcctcaggcatctagaac

SEQ ID NO: 206976 - DNA, 20 bp, Artificial Sequence
  chemically synthesized
aattctagttctagatgcct

SEQ ID NO: 206977 - DNA, 20 bp, Artificial Sequence
  chemically synthesized
gtggcgattcctcaggcatc

SEQ ID NO: 206978 - DNA, 20 bp, Artificial Sequence
  chemically synthesized
attctagttctagatgcctg

SEQ ID NO: 206979 - DNA, 20 bp, Artificial Sequence
  chemically synthesized
agtcagtgtggcgattcctc

SEQ ID NO: 206980 - DNA, 20 bp, Artificial Sequence
  chemically synthesized
aagtcagtgtggcgattcct

SEQ ID NO: 206981 - DNA, 20 bp, Artificial Sequence
  chemically synthesized
aaccattgtggaagtcagtg

SEQ ID NO: 206982 - DNA, 20 bp, Artificial Sequence
  chemically synthesized
agttcaaccattgtggaagt

SEQ ID NO: 206983 - DNA, 20 bp, Artificial Sequence
  chemically synthesized
cgccacactgacttccacaa

SEQ ID NO: 206984 - DNA, 20 bp, Artificial Sequence
  chemically synthesized
aactagttcaaccattgtgg

SEQ ID NO: 206985 - DNA, 20 bp, Artificial Sequence
  chemically synthesized
gtaaactagttcaaccattg

SEQ ID NO: 206986 - DNA, 20 bp, Artificial Sequence
  chemically synthesized
gacttccacaatggttgaac

SEQ ID NO: 206987 - DNA, 20 bp, Artificial Sequence
  chemically synthesized
acaatggttgaactagttta

SEQ ID NO: 206988 - DNA, 20 bp, Artificial Sequence
  chemically synthesized
ctgttggtgggactgtaaac

SEQ ID NO: 206989 - DNA, 20 bp, Artificial Sequence
  chemically synthesized
ctagtttacagtcccaccaa

SEQ ID NO: 206990 - DNA, 20 bp, Artificial Sequence
  chemically synthesized
aacacttttacactgttggt

SEQ ID NO: 206991 - DNA, 20 bp, Artificial Sequence
  chemically synthesized
gaacacttttacactgttgg

SEQ ID NO: 206992 - DNA, 20 bp, Artificial Sequence
  chemically synthesized
caggaacacttttacactgt

SEQ ID NO: 206993 - DNA, 20 bp, Artificial Sequence
  chemically synthesized
cagtcccaccaacagtgtaa

SEQ ID NO: 206994 - DNA, 20 bp, Artificial Sequence
  chemically synthesized
tggtgaggatgtggagaaac

SEQ ID NO: 206995 - DNA, 20 bp, Artificial Sequence
  chemically synthesized
ctggtgaggatgtggagaaa

SEQ ID NO: 206996 - DNA, 20 bp, Artificial Sequence
  chemically synthesized
caggtgctggtgaggatgtg

SEQ ID NO: 206997 - DNA, 20 bp, Artificial Sequence
  chemically synthesized
aacaggtgctggtgaggatg

SEQ ID NO: 206998 - DNA, 20 bp, Artificial Sequence
  chemically synthesized
ctgtttctccacatcctcac

SEQ ID NO: 206999 - DNA, 20 bp, Artificial Sequence
  chemically synthesized
ggaaacaacaggtgctggtg

SEQ ID NO: 207000 - DNA, 20 bp, Artificial Sequence
  chemically synthesized
aggaaacaacaggtgctggt

SEQ ID NO: 207001 - DNA, 20 bp, Artificial Sequence
  chemically synthesized
aatcaggaaacaacaggtgc

SEQ ID NO: 207002 - DNA, 20 bp, Artificial Sequence
  chemically synthesized
attaaaaatcaggaaacaac

SEQ ID NO: 207003 - DNA, 20 bp, Artificial Sequence
  chemically synthesized
cattaaaaatcaggaaacaa

SEQ ID NO: 207004 - DNA, 20 bp, Artificial Sequence
  chemically synthesized
aatggcgatcattaaaaatc

SEQ ID NO: 207005 - DNA, 20 bp, Artificial Sequence
  chemically synthesized
gaatggcgatcattaaaaat

SEQ ID NO: 207006 - DNA, 20 bp, Artificial Sequence
  chemically synthesized
ttaatgatcgccattctaac

SEQ ID NO: 207007 - DNA, 20 bp, Artificial Sequence
  chemically synthesized
ccatctcacgccagttagaa

SEQ ID NO: 207008 - DNA, 20 bp, Artificial Sequence
  chemically synthesized
aggtaccatctcacgccagt

SEQ ID NO: 207009 - DNA, 20 bp, Artificial Sequence
  chemically synthesized
atcgccattctaactggcgt

SEQ ID NO: 207010 - DNA, 20 bp, Artificial Sequence
  chemically synthesized
cacgaggtaccatctcacgc

SEQ ID NO: 207011 - DNA, 20 bp, Artificial Sequence
  chemically synthesized
ccattctaactggcgtgaga

SEQ ID NO: 207012 - DNA, 20 bp, Artificial Sequence
  chemically synthesized
tggcgtgagatggtacctcg

SEQ ID NO: 207013 - DNA, 20 bp, Artificial Sequence
  chemically synthesized
agtttgctgagaaaaccacg

SEQ ID NO: 207014 - DNA, 20 bp, Artificial Sequence
  chemically synthesized
tagtttgctgagaaaaccac

SEQ ID NO: 207015 - DNA, 20 bp, Artificial Sequence
  chemically synthesized
atggtacctcgtggttttct

SEQ ID NO: 207016 - DNA, 20 bp, Artificial Sequence
  chemically synthesized
tgtccttgcgatagtttgct

SEQ ID NO: 207017 - DNA, 20 bp, Artificial Sequence
  chemically synthesized
ttttctcagcaaactatcgc

SEQ ID NO: 207018 - DNA, 20 bp, Artificial Sequence
  chemically synthesized
tttctcagcaaactatcgca

SEQ ID NO: 207019 - DNA, 20 bp, Artificial Sequence
  chemically synthesized
ttggttttttgtccttgcga

SEQ ID NO: 207020 - DNA, 20 bp, Artificial Sequence
  chemically synthesized
gagcgagaacatgcggtgtt

SEQ ID NO: 207021 - DNA, 20 bp, Artificial Sequence
  chemically synthesized
cacctatgagcgagaacatg

SEQ ID NO: 207022 - DNA, 20 bp, Artificial Sequence
  chemically synthesized
acaccgcatgttctcgctca

SEQ ID NO: 207023 - DNA, 20 bp, Artificial Sequence
  chemically synthesized
caccgcatgttctcgctcat

SEQ ID NO: 207024 - DNA, 20 bp, Artificial Sequence
  chemically synthesized
ttcaattcccacctatgagc

SEQ ID NO: 207025 - DNA, 20 bp, Artificial Sequence
  chemically synthesized
cgcatgttctcgctcatagg

SEQ ID NO: 207026 - DNA, 20 bp, Artificial Sequence
  chemically synthesized
gcatgttctcgctcataggt

SEQ ID NO: 207027 - DNA, 20 bp, Artificial Sequence
  chemically synthesized
attgttcaattcccacctat

SEQ ID NO: 207028 - DNA, 20 bp, Artificial Sequence
  chemically synthesized
ataggtgggaattgaacaat

SEQ ID NO: 207029 - DNA, 20 bp, Artificial Sequence
  chemically synthesized
aattgaacaatgagaacaca

SEQ ID NO: 207030 - DNA, 20 bp, Artificial Sequence
  chemically synthesized
acaatgagaacacatggaca

SEQ ID NO: 207031 - DNA, 20 bp, Artificial Sequence
  chemically synthesized
caatgagaacacatggacac

SEQ ID NO: 207032 - DNA, 20 bp, Artificial Sequence
  chemically synthesized
tgagaacacatggacacagg

SEQ ID NO: 207033 - DNA, 20 bp, Artificial Sequence
  chemically synthesized
gagaacacatggacacagga

SEQ ID NO: 207034 - DNA, 20 bp, Artificial Sequence
  chemically synthesized
agaacacatggacacaggaa

SEQ ID NO: 207035 - DNA, 20 bp, Artificial Sequence
  chemically synthesized
gaacacatggacacaggaag

SEQ ID NO: 207036 - DNA, 20 bp, Artificial Sequence
  chemically synthesized
ggaaggggaacatcacacac

SEQ ID NO: 207037 - DNA, 20 bp, Artificial Sequence
  chemically synthesized
gaaggggaacatcacacacc

SEQ ID NO: 207038 - DNA, 20 bp, Artificial Sequence
  chemically synthesized
aaggggaacatcacacaccg

SEQ ID NO: 207039 - DNA, 20 bp, Artificial Sequence
  chemically synthesized
ccccaccccacaacaggccc

SEQ ID NO: 207040 - DNA, 20 bp, Artificial Sequence
  chemically synthesized
tcacacaccggggcctgttg

SEQ ID NO: 207041 - DNA, 20 bp, Artificial Sequence
  chemically synthesized
cacacaccggggcctgttgt

SEQ ID NO: 207042 - DNA, 20 bp, Artificial Sequence
  chemically synthesized
acacaccggggcctgttgtg

SEQ ID NO: 207043 - DNA, 20 bp, Artificial Sequence
  chemically synthesized
ccctccccccaccccacaac

SEQ ID NO: 207044 - DNA, 20 bp, Artificial Sequence
  chemically synthesized
cccctccccccaccccacaa

SEQ ID NO: 207045 - DNA, 20 bp, Artificial Sequence
  chemically synthesized
caccggggcctgttgtgggg

SEQ ID NO: 207046 - DNA, 20 bp, Artificial Sequence
  chemically synthesized
accggggcctgttgtggggt

SEQ ID NO: 207047 - DNA, 20 bp, Artificial Sequence
  chemically synthesized
ccggggcctgttgtggggtg

SEQ ID NO: 207048 - DNA, 20 bp, Artificial Sequence
  chemically synthesized
cggggcctgttgtggggtgg

SEQ ID NO: 207049 - DNA, 20 bp, Artificial Sequence
  chemically synthesized
ggggcctgttgtggggtggg

SEQ ID NO: 207050 - DNA, 20 bp, Artificial Sequence
  chemically synthesized
ggcctgttgtggggtggggg

SEQ ID NO: 207051 - DNA, 20 bp, Artificial Sequence
  chemically synthesized
gcctgttgtggggtgggggg

SEQ ID NO: 207052 - DNA, 20 bp, Artificial Sequence
  chemically synthesized
cctgttgtggggtgggggga

SEQ ID NO: 207053 - DNA, 20 bp, Artificial Sequence
  chemically synthesized
ctgttgtggggtggggggag

SEQ ID NO: 207054 - DNA, 20 bp, Artificial Sequence
  chemically synthesized
tgttgtggggtggggggagg

SEQ ID NO: 207055 - DNA, 20 bp, Artificial Sequence
  chemically synthesized
gttgtggggtggggggaggg

SEQ ID NO: 207056 - DNA, 20 bp, Artificial Sequence
  chemically synthesized
tgtggggtggggggaggggg

SEQ ID NO: 207057 - DNA, 20 bp, Artificial Sequence
  chemically synthesized
gtggggtggggggagggggg

SEQ ID NO: 207058 - DNA, 20 bp, Artificial Sequence
  chemically synthesized
tggggtggggggagggggga

SEQ ID NO: 207059 - DNA, 20 bp, Artificial Sequence
  chemically synthesized
gtggggggaggggggaggga

SEQ ID NO: 207060 - DNA, 20 bp, Artificial Sequence
  chemically synthesized
ggaggggggagggatagcat

SEQ ID NO: 207061 - DNA, 20 bp, Artificial Sequence
  chemically synthesized
gaggggggagggatagcatt

SEQ ID NO: 207062 - DNA, 20 bp, Artificial Sequence
  chemically synthesized
ggggggagggatagcattag

SEQ ID NO: 207063 - DNA, 20 bp, Artificial Sequence
  chemically synthesized
ttaactcgtcatttagcatt

SEQ ID NO: 207064 - DNA, 20 bp, Artificial Sequence
  chemically synthesized
attaactcgtcatttagcat

SEQ ID NO: 207065 - DNA, 20 bp, Artificial Sequence
  chemically synthesized
tatacctaatgctaaatgac

SEQ ID NO: 207066 - DNA, 20 bp, Artificial Sequence
  chemically synthesized
gcacccattaactcgtcatt

SEQ ID NO: 207067 - DNA, 20 bp, Artificial Sequence
  chemically synthesized
aatgctaaatgacgagttaa

SEQ ID NO: 207068 - DNA, 20 bp, Artificial Sequence
  chemically synthesized
atgctaaatgacgagttaat

SEQ ID NO: 207069 - DNA, 20 bp, Artificial Sequence
  chemically synthesized
aaatgacgagttaatgggtg

SEQ ID NO: 207070 - DNA, 20 bp, Artificial Sequence
  chemically synthesized
atgggtgcagcacaccaaca

SEQ ID NO: 207071 - DNA, 20 bp, Artificial Sequence
  chemically synthesized
tatgtatacatgtgccatgt

SEQ ID NO: 207072 - DNA, 20 bp, Artificial Sequence
  chemically synthesized
ggtacatgtgcacaacgtgc

SEQ ID NO: 207073 - DNA, 20 bp, Artificial Sequence
  chemically synthesized
gggtacatgtgcacaacgtg

SEQ ID NO: 207074 - DNA, 20 bp, Artificial Sequence
  chemically synthesized
ttattctactttaagtttta

SEQ ID NO: 207075 - DNA, 20 bp, Artificial Sequence
  chemically synthesized
tttattctactttaagtttt

SEQ ID NO: 207076 - DNA, 20 bp, Artificial Sequence
  chemically synthesized
cacatgtaccctaaaactta

SEQ ID NO: 207077 - DNA, 20 bp, Artificial Sequence
  chemically synthesized
ttttattctactttaagttt

SEQ ID NO: 207078 - DNA, 20 bp, Artificial Sequence
  chemically synthesized
atgtaccctaaaacttaaag

SEQ ID NO: 207079 - DNA, 20 bp, Artificial Sequence
  chemically synthesized
ttttttttttattctacttt

SEQ ID NO: 207080 - DNA, 20 bp, Artificial Sequence
  chemically synthesized
gtagaataaaaaaaaaatct

SEQ ID NO: 207081 - DNA, 20 bp, Artificial Sequence
  chemically synthesized
ttcttttttttgatatttct

SEQ ID NO: 207082 - DNA, 20 bp, Artificial Sequence
  chemically synthesized
atctcagaaatatcaaaaaa

SEQ ID NO: 207083 - DNA, 20 bp, Artificial Sequence
  chemically synthesized
tggtatttggttacatgagt

SEQ ID NO: 207084 - DNA, 20 bp, Artificial Sequence
  chemically synthesized
caggtggtatttggttacat

SEQ ID NO: 207085 - DNA, 20 bp, Artificial Sequence
  chemically synthesized
attggggtacaggtggtatt

SEQ ID NO: 207086 - DNA, 20 bp, Artificial Sequence
  chemically synthesized
gtaaattattggggtacagg

SEQ ID NO: 207087 - DNA, 20 bp, Artificial Sequence
  chemically synthesized
tctgtaaattattggggtac

SEQ ID NO: 207088 - DNA, 20 bp, Artificial Sequence
  chemically synthesized
ttctgtaaattattggggta

SEQ ID NO: 207089 - DNA, 20 bp, Artificial Sequence
  chemically synthesized
tatttttctgtaaattattg

SEQ ID NO: 207090 - DNA, 20 bp, Artificial Sequence
  chemically synthesized
ttatttttctgtaaattatt

SEQ ID NO: 207091 - DNA, 20 bp, Artificial Sequence
  chemically synthesized
tttatttttctgtaaattat

SEQ ID NO: 207092 - DNA, 20 bp, Artificial Sequence
  chemically synthesized
acctgtaccccaataattta

SEQ ID NO: 207093 - DNA, 20 bp, Artificial Sequence
  chemically synthesized
aatgatattcttttttattt

SEQ ID NO: 207094 - DNA, 20 bp, Artificial Sequence
  chemically synthesized
taataaaaactaaaataaaa

SEQ ID NO: 207095 - DNA, 20 bp, Artificial Sequence
  chemically synthesized
taaaaaagaatatcatttgc

SEQ ID NO: 207096 - DNA, 20 bp, Artificial Sequence
  chemically synthesized
aaaaaagaatatcatttgct

SEQ ID NO: 207097 - DNA, 20 bp, Artificial Sequence
  chemically synthesized
aaaagaatatcatttgctag

SEQ ID NO: 207098 - DNA, 20 bp, Artificial Sequence
  chemically synthesized
gaagttttattttttactcc

SEQ ID NO: 207099 - DNA, 20 bp, Artificial Sequence
  chemically synthesized
aaaaataaaacttcatcttg

SEQ ID NO: 207100 - DNA, 20 bp, Artificial Sequence
  chemically synthesized
ttgttatgatcttcaagatg

SEQ ID NO: 207101 - DNA, 20 bp, Artificial Sequence
  chemically synthesized
ctagggttgttatgatcttc

SEQ ID NO: 207102 - DNA, 20 bp, Artificial Sequence
  chemically synthesized
cttgaagatcataacaaccc

SEQ ID NO: 207103 - DNA, 20 bp, Artificial Sequence
  chemically synthesized
agatcataacaaccctagat

SEQ ID NO: 207104 - DNA, 20 bp, Artificial Sequence
  chemically synthesized
tatatttgctttctcatcta

SEQ ID NO: 207105 - DNA, 20 bp, Artificial Sequence
  chemically synthesized
atatatttgctttctcatct

SEQ ID NO: 207106 - DNA, 20 bp, Artificial Sequence
  chemically synthesized
cataacaaccctagatgaga

SEQ ID NO: 207107 - DNA, 20 bp, Artificial Sequence
  chemically synthesized
aatatatttgctttctcatc

SEQ ID NO: 207108 - DNA, 20 bp, Artificial Sequence
  chemically synthesized
ggatggaaaataaaaagatc

SEQ ID NO: 207109 - DNA, 20 bp, Artificial Sequence
  chemically synthesized
aggatggaaaataaaaagat

SEQ ID NO: 207110 - DNA, 20 bp, Artificial Sequence
  chemically synthesized
aaatgaggatggaaaataaa

SEQ ID NO: 207111 - DNA, 20 bp, Artificial Sequence
  chemically synthesized
cattgaagagaaaatgagga

SEQ ID NO: 207112 - DNA, 20 bp, Artificial Sequence
  chemically synthesized
atatcattgaagagaaaatg

SEQ ID NO: 207113 - DNA, 20 bp, Artificial Sequence
  chemically synthesized
catatcattgaagagaaaat

SEQ ID NO: 207114 - DNA, 20 bp, Artificial Sequence
  chemically synthesized
tcttcatacatatcattgaa

SEQ ID NO: 207115 - DNA, 20 bp, Artificial Sequence
  chemically synthesized
tctcttcatacatatcattg

SEQ ID NO: 207116 - DNA, 20 bp, Artificial Sequence
  chemically synthesized
tctcttcaatgatatgtatg

SEQ ID NO: 207117 - DNA, 20 bp, Artificial Sequence
  chemically synthesized
tcttcaatgatatgtatgaa

SEQ ID NO: 207118 - DNA, 20 bp, Artificial Sequence
  chemically synthesized
atgaagagaaatattaatgt

SEQ ID NO: 207119 - DNA, 20 bp, Artificial Sequence
  chemically synthesized
agagaaatattaatgttaga

SEQ ID NO: 207120 - DNA, 20 bp, Artificial Sequence
  chemically synthesized
gagaaatattaatgttagaa

SEQ ID NO: 207121 - DNA, 20 bp, Artificial Sequence
  chemically synthesized
agaaaggtaatgcaacgtgt

SEQ ID NO: 207122 - DNA, 20 bp, Artificial Sequence
  chemically synthesized
caacgtgttagtaattgctc

SEQ ID NO: 207123 - DNA, 20 bp, Artificial Sequence
  chemically synthesized
gaatagagaaatcaattcca

SEQ ID NO: 207124 - DNA, 20 bp, Artificial Sequence
  chemically synthesized
cagaatagagaaatcaattc

SEQ ID NO: 207125 - DNA, 20 bp, Artificial Sequence
  chemically synthesized
tgataaatgccaacagaata

SEQ ID NO: 207126 - DNA, 20 bp, Artificial Sequence
  chemically synthesized
aattgatttctctattctgt

SEQ ID NO: 207127 - DNA, 20 bp, Artificial Sequence
  chemically synthesized
tctgataaatgccaacagaa

SEQ ID NO: 207128 - DNA, 20 bp, Artificial Sequence
  chemically synthesized
ataattctgataaatgccaa

SEQ ID NO: 207129 - DNA, 20 bp, Artificial Sequence
  chemically synthesized
tctattctgttggcatttat

SEQ ID NO: 207130 - DNA, 20 bp, Artificial Sequence
  chemically synthesized
tcagaattatttaaatttca

SEQ ID NO: 207131 - DNA, 20 bp, Artificial Sequence
  chemically synthesized
attatttaaatttcaaagca

SEQ ID NO: 207132 - DNA, 20 bp, Artificial Sequence
  chemically synthesized
taaatttcaaagcacagtct

SEQ ID NO: 207133 - DNA, 20 bp, Artificial Sequence
  chemically synthesized
gatttatctcatggaattct

SEQ ID NO: 207134 - DNA, 20 bp, Artificial Sequence
  chemically synthesized
gcacagtctaagaattccat

SEQ ID NO: 207135 - DNA, 20 bp, Artificial Sequence
  chemically synthesized
ttacaataagatttatctca

SEQ ID NO: 207136 - DNA, 20 bp, Artificial Sequence
  chemically synthesized
taatataattcatttacaat

SEQ ID NO: 207137 - DNA, 20 bp, Artificial Sequence
  chemically synthesized
gtaaatgaattatattacca

SEQ ID NO: 207138 - DNA, 20 bp, Artificial Sequence
  chemically synthesized
taaatgaattatattaccat

SEQ ID NO: 207139 - DNA, 20 bp, Artificial Sequence
  chemically synthesized
acaaataatgagcaagccca

SEQ ID NO: 207140 - DNA, 20 bp, Artificial Sequence
  chemically synthesized
cactttcacaaataatgagc

SEQ ID NO: 207141 - DNA, 20 bp, Artificial Sequence
  chemically synthesized
aagtcactttcacaaataat

SEQ ID NO: 207142 - DNA, 20 bp, Artificial Sequence
  chemically synthesized
ggcttgctcattatttgtga

SEQ ID NO: 207143 - DNA, 20 bp, Artificial Sequence
  chemically synthesized
aataataagccaggcagata

SEQ ID NO: 207144 - DNA, 20 bp, Artificial Sequence
  chemically synthesized
tgaaagtgactttatctgcc

SEQ ID NO: 207145 - DNA, 20 bp, Artificial Sequence
  chemically synthesized
atatttaataataagccagg

SEQ ID NO: 207146 - DNA, 20 bp, Artificial Sequence
  chemically synthesized
actatatttaataataagcc

SEQ ID NO: 207147 - DNA, 20 bp, Artificial Sequence
  chemically synthesized
aactatatttaataataagc

SEQ ID NO: 207148 - DNA, 20 bp, Artificial Sequence
  chemically synthesized
cataaactatatttaataat

SEQ ID NO: 207149 - DNA, 20 bp, Artificial Sequence
  chemically synthesized
gcctggcttattattaaata

SEQ ID NO: 207150 - DNA, 20 bp, Artificial Sequence
  chemically synthesized
attaaatatagtttatgaac

SEQ ID NO: 207151 - DNA, 20 bp, Artificial Sequence
  chemically synthesized
ttaaatatagtttatgaaca

SEQ ID NO: 207152 - DNA, 20 bp, Artificial Sequence
  chemically synthesized
aatatagtttatgaacaagg

SEQ ID NO: 207153 - DNA, 20 bp, Artificial Sequence
  chemically synthesized
ctttacaaaaatcaaacaga

SEQ ID NO: 207154 - DNA, 20 bp, Artificial Sequence
  chemically synthesized
tctttacaaaaatcaaacag

SEQ ID NO: 207155 - DNA, 20 bp, Artificial Sequence
  chemically synthesized
agttctttacaaaaatcaaa

SEQ ID NO: 207156 - DNA, 20 bp, Artificial Sequence
  chemically synthesized
ccttctgtttgatttttgta

SEQ ID NO: 207157 - DNA, 20 bp, Artificial Sequence
  chemically synthesized
acccaaccgctcaagataca

SEQ ID NO: 207158 - DNA, 20 bp, Artificial Sequence
  chemically synthesized
tgtaaagaactctgtatctt

SEQ ID NO: 207159 - DNA, 20 bp, Artificial Sequence
  chemically synthesized
gcacccaaccgctcaagata

SEQ ID NO: 207160 - DNA, 20 bp, Artificial Sequence
  chemically synthesized
aaagaactctgtatcttgag

SEQ ID NO: 207161 - DNA, 20 bp, Artificial Sequence
  chemically synthesized
aactctgtatcttgagcggt

SEQ ID NO: 207162 - DNA, 20 bp, Artificial Sequence
  chemically synthesized
atatcagcacccaaccgctc

SEQ ID NO: 207163 - DNA, 20 bp, Artificial Sequence
  chemically synthesized
actctgtatcttgagcggtt

SEQ ID NO: 207164 - DNA, 20 bp, Artificial Sequence
  chemically synthesized
acatatcgtggcacgtatat

SEQ ID NO: 207165 - DNA, 20 bp, Artificial Sequence
  chemically synthesized
gtttttaatattacatatcg

SEQ ID NO: 207166 - DNA, 20 bp, Artificial Sequence
  chemically synthesized
gaatgtcattggagagcaaa

SEQ ID NO: 207167 - DNA, 20 bp, Artificial Sequence
  chemically synthesized
agaatgtcattggagagcaa

SEQ ID NO: 207168 - DNA, 20 bp, Artificial Sequence
  chemically synthesized
aagaatgtcattggagagca

SEQ ID NO: 207169 - DNA, 20 bp, Artificial Sequence
  chemically synthesized
atgataagaatgtcattgga

SEQ ID NO: 207170 - DNA, 20 bp, Artificial Sequence
  chemically synthesized
aaatgataagaatgtcattg

SEQ ID NO: 207171 - DNA, 20 bp, Artificial Sequence
  chemically synthesized
tcaaatgataagaatgtcat

SEQ ID NO: 207172 - DNA, 20 bp, Artificial Sequence
  chemically synthesized
aagaaatgacttcaaatgat

SEQ ID NO: 207173 - DNA, 20 bp, Artificial Sequence
  chemically synthesized
aatgacattcttatcatttg

SEQ ID NO: 207174 - DNA, 20 bp, Artificial Sequence
  chemically synthesized
aaaaataatgtagaaacatt

SEQ ID NO: 207175 - DNA, 20 bp, Artificial Sequence
  chemically synthesized
gcagtgttttaaaaataatg

SEQ ID NO: 207176 - DNA, 20 bp, Artificial Sequence
  chemically synthesized
ttttaaaacactgctctttt

SEQ ID NO: 207177 - DNA, 20 bp, Artificial Sequence
  chemically synthesized
attttaaaatctcaaaagag

SEQ ID NO: 207178 - DNA, 20 bp, Artificial Sequence
  chemically synthesized
acaattttaaaatctcaaaa

SEQ ID NO: 207179 - DNA, 20 bp, Artificial Sequence
  chemically synthesized
taacaattttaaaatctcaa

SEQ ID NO: 207180 - DNA, 20 bp, Artificial Sequence
  chemically synthesized
atataaattaatttactcct

SEQ ID NO: 207181 - DNA, 20 bp, Artificial Sequence
  chemically synthesized
tataaattaatttactcctt

SEQ ID NO: 207182 - DNA, 20 bp, Artificial Sequence
  chemically synthesized
taaattaatttactccttag

SEQ ID NO: 207183 - DNA, 20 bp, Artificial Sequence
  chemically synthesized
aaattaatttactccttagg

SEQ ID NO: 207184 - DNA, 20 bp, Artificial Sequence
  chemically synthesized
ctatatagtttcctcctaag

SEQ ID NO: 207185 - DNA, 20 bp, Artificial Sequence
  chemically synthesized
cactatatagtttcctccta

SEQ ID NO: 207186 - DNA, 20 bp, Artificial Sequence
  chemically synthesized
tcactatatagtttcctcct

SEQ ID NO: 207187 - DNA, 20 bp, Artificial Sequence
  chemically synthesized
ctccttaggaggaaactata

SEQ ID NO: 207188 - DNA, 20 bp, Artificial Sequence
  chemically synthesized
aaaaatctttgttcactata

SEQ ID NO: 207189 - DNA, 20 bp, Artificial Sequence
  chemically synthesized
aggaaactatatagtgaaca

SEQ ID NO: 207190 - DNA, 20 bp, Artificial Sequence
  chemically synthesized
agaagatattatttttgaaa

SEQ ID NO: 207191 - DNA, 20 bp, Artificial Sequence
  chemically synthesized
tagaagatattatttttgaa

SEQ ID NO: 207192 - DNA, 20 bp, Artificial Sequence
  chemically synthesized
caaaaataatatcttctatt

SEQ ID NO: 207193 - DNA, 20 bp, Artificial Sequence
  chemically synthesized
aaaaataatatcttctattt

SEQ ID NO: 207194 - DNA, 20 bp, Artificial Sequence
  chemically synthesized
tttttttttttcccaaatag

SEQ ID NO: 207195 - DNA, 20 bp, Artificial Sequence
  chemically synthesized
gcatttttttttttcccaaa

SEQ ID NO: 207196 - DNA, 20 bp, Artificial Sequence
  chemically synthesized
aaaaaaaaaatgctttacaa

SEQ ID NO: 207197 - DNA, 20 bp, Artificial Sequence
  chemically synthesized
aaaaaaaatgctttacaaaa

SEQ ID NO: 207198 - DNA, 20 bp, Artificial Sequence
  chemically synthesized
gttttggaacctcttttgta

SEQ ID NO: 207199 - DNA, 20 bp, Artificial Sequence
  chemically synthesized
aaaaaaatgctttacaaaag

SEQ ID NO: 207200 - DNA, 20 bp, Artificial Sequence
  chemically synthesized
acaaaagaggttccaaaacc

SEQ ID NO: 207201 - DNA, 20 bp, Artificial Sequence
  chemically synthesized
aaaagaggttccaaaaccca

SEQ ID NO: 207202 - DNA, 20 bp, Artificial Sequence
  chemically synthesized
ctgtgggcccctctgggttt

SEQ ID NO: 207203 - DNA, 20 bp, Artificial Sequence
  chemically synthesized
aaagaggttccaaaacccag

SEQ ID NO: 207204 - DNA, 20 bp, Artificial Sequence
  chemically synthesized
aagaggttccaaaacccaga

SEQ ID NO: 207205 - DNA, 20 bp, Artificial Sequence
  chemically synthesized
agaggttccaaaacccagag

SEQ ID NO: 207206 - DNA, 20 bp, Artificial Sequence
  chemically synthesized
caatgactgtgggcccctct

SEQ ID NO: 207207 - DNA, 20 bp, Artificial Sequence
  chemically synthesized
acaatgactgtgggcccctc

SEQ ID NO: 207208 - DNA, 20 bp, Artificial Sequence
  chemically synthesized
ccaaaacccagaggggccca

SEQ ID NO: 207209 - DNA, 20 bp, Artificial Sequence
  chemically synthesized
agaaagaacacaatgactgt

SEQ ID NO: 207210 - DNA, 20 bp, Artificial Sequence
  chemically synthesized
aagaaagaacacaatgactg

SEQ ID NO: 207211 - DNA, 20 bp, Artificial Sequence
  chemically synthesized
aaggaattcgttagtcaaga

SEQ ID NO: 207212 - DNA, 20 bp, Artificial Sequence
  chemically synthesized
actcaaggaattcgttagtc

SEQ ID NO: 207213 - DNA, 20 bp, Artificial Sequence
  chemically synthesized
actgcactcaaggaattcgt

SEQ ID NO: 207214 - DNA, 20 bp, Artificial Sequence
  chemically synthesized
tcttgactaacgaattcctt

SEQ ID NO: 207215 - DNA, 20 bp, Artificial Sequence
  chemically synthesized
actaacgaattccttgagtg

SEQ ID NO: 207216 - DNA, 20 bp, Artificial Sequence
  chemically synthesized
tgtacttgaaactgcactca

SEQ ID NO: 207217 - DNA, 20 bp, Artificial Sequence
  chemically synthesized
ctgtacttgaaactgcactc

SEQ ID NO: 207218 - DNA, 20 bp, Artificial Sequence
  chemically synthesized
aattccttgagtgcagtttc

SEQ ID NO: 207219 - DNA, 20 bp, Artificial Sequence
  chemically synthesized
cttgagtgcagtttcaagta

SEQ ID NO: 207220 - DNA, 20 bp, Artificial Sequence
  chemically synthesized
gcagtttcaagtacagattg

SEQ ID NO: 207221 - DNA, 20 bp, Artificial Sequence
  chemically synthesized
aaaattgggtaagacattga

SEQ ID NO: 207222 - DNA, 20 bp, Artificial Sequence
  chemically synthesized
actgacagggaaaattgggt

SEQ ID NO: 207223 - DNA, 20 bp, Artificial Sequence
  chemically synthesized
aaacactgacagggaaaatt

SEQ ID NO: 207224 - DNA, 20 bp, Artificial Sequence
  chemically synthesized
gaaacactgacagggaaaat

SEQ ID NO: 207225 - DNA, 20 bp, Artificial Sequence
  chemically synthesized
tcttacccaattttccctgt

SEQ ID NO: 207226 - DNA, 20 bp, Artificial Sequence
  chemically synthesized
atatatttgaaacactgaca

SEQ ID NO: 207227 - DNA, 20 bp, Artificial Sequence
  chemically synthesized
aatatatttgaaacactgac

SEQ ID NO: 207228 - DNA, 20 bp, Artificial Sequence
  chemically synthesized
aaatatatttgaaacactga

SEQ ID NO: 207229 - DNA, 20 bp, Artificial Sequence
  chemically synthesized
cacatcccagattattttac

SEQ ID NO: 207230 - DNA, 20 bp, Artificial Sequence
  chemically synthesized
ccacatcccagattatttta

SEQ ID NO: 207231 - DNA, 20 bp, Artificial Sequence
  chemically synthesized
ttaattcctgtaaaataatc

SEQ ID NO: 207232 - DNA, 20 bp, Artificial Sequence
  chemically synthesized
taattcctgtaaaataatct

SEQ ID NO: 207233 - DNA, 20 bp, Artificial Sequence
  chemically synthesized
ctgtaaaataatctgggatg

SEQ ID NO: 207234 - DNA, 20 bp, Artificial Sequence
  chemically synthesized
gataatttgttaccacatcc

SEQ ID NO: 207235 - DNA, 20 bp, Artificial Sequence
  chemically synthesized
caaattatcatatatacatt

SEQ ID NO: 207236 - DNA, 20 bp, Artificial Sequence
  chemically synthesized
atatatacattaagaaaatt

SEQ ID NO: 207237 - DNA, 20 bp, Artificial Sequence
  chemically synthesized
tacattaagaaaatttggtt

SEQ ID NO: 207238 - DNA, 20 bp, Artificial Sequence
  chemically synthesized
acattaagaaaatttggttc

SEQ ID NO: 207239 - DNA, 20 bp, Artificial Sequence
  chemically synthesized
taagaaaatttggttcagga

SEQ ID NO: 207240 - DNA, 20 bp, Artificial Sequence
  chemically synthesized
aagaaaatttggttcaggac

SEQ ID NO: 207241 - DNA, 20 bp, Artificial Sequence
  chemically synthesized
tcaggacaggtccactgata

SEQ ID NO: 207242 - DNA, 20 bp, Artificial Sequence
  chemically synthesized
acaccaggaaactttatcag

SEQ ID NO: 207243 - DNA, 20 bp, Artificial Sequence
  chemically synthesized
ggcacaccaggaaactttat

SEQ ID NO: 207244 - DNA, 20 bp, Artificial Sequence
  chemically synthesized
ggtccactgataaagtttcc

SEQ ID NO: 207245 - DNA, 20 bp, Artificial Sequence
  chemically synthesized
actagaatatcgggcacacc

SEQ ID NO: 207246 - DNA, 20 bp, Artificial Sequence
  chemically synthesized
tactagaatatcgggcacac

SEQ ID NO: 207247 - DNA, 20 bp, Artificial Sequence
  chemically synthesized
tcctggtgtgcccgatattc

SEQ ID NO: 207248 - DNA, 20 bp, Artificial Sequence
  chemically synthesized
taaggaattactagaatatc

SEQ ID NO: 207249 - DNA, 20 bp, Artificial Sequence
  chemically synthesized
ttaaggaattactagaatat

SEQ ID NO: 207250 - DNA, 20 bp, Artificial Sequence
  chemically synthesized
ggtttctattaaggaattac

SEQ ID NO: 207251 - DNA, 20 bp, Artificial Sequence
  chemically synthesized
atattctagtaattccttaa

SEQ ID NO: 207252 - DNA, 20 bp, Artificial Sequence
  chemically synthesized
tttctcttaggtttctatta

SEQ ID NO: 207253 - DNA, 20 bp, Artificial Sequence
  chemically synthesized
atttctcttaggtttctatt

SEQ ID NO: 207254 - DNA, 20 bp, Artificial Sequence
  chemically synthesized
taattccttaatagaaacct

SEQ ID NO: 207255 - DNA, 20 bp, Artificial Sequence
  chemically synthesized
attccttaatagaaacctaa

SEQ ID NO: 207256 - DNA, 20 bp, Artificial Sequence
  chemically synthesized
aaaaagagctaatttctctt

SEQ ID NO: 207257 - DNA, 20 bp, Artificial Sequence
  chemically synthesized
aaaaaagagctaatttctct

SEQ ID NO: 207258 - DNA, 20 bp, Artificial Sequence
  chemically synthesized
aatagaaacctaagagaaat

SEQ ID NO: 207259 - DNA, 20 bp, Artificial Sequence
  chemically synthesized
tacctaagatgatcaaaaaa

SEQ ID NO: 207260 - DNA, 20 bp, Artificial Sequence
  chemically synthesized
gctacctaagatgatcaaaa

SEQ ID NO: 207261 - DNA, 20 bp, Artificial Sequence
  chemically synthesized
tagctcttttttgatcatct

SEQ ID NO: 207262 - DNA, 20 bp, Artificial Sequence
  chemically synthesized
agctcttttttgatcatctt

SEQ ID NO: 207263 - DNA, 20 bp, Artificial Sequence
  chemically synthesized
tcttttttgatcatcttagg

SEQ ID NO: 207264 - DNA, 20 bp, Artificial Sequence
  chemically synthesized
tttttttccccaggctacct

SEQ ID NO: 207265 - DNA, 20 bp, Artificial Sequence
  chemically synthesized
tttgatcatcttaggtagcc

SEQ ID NO: 207266 - DNA, 20 bp, Artificial Sequence
  chemically synthesized
ttgatcatcttaggtagcct

SEQ ID NO: 207267 - DNA, 20 bp, Artificial Sequence
  chemically synthesized
tgatcatcttaggtagcctg

SEQ ID NO: 207268 - DNA, 20 bp, Artificial Sequence
  chemically synthesized
tggagtgattttttttcccc

SEQ ID NO: 207269 - DNA, 20 bp, Artificial Sequence
  chemically synthesized
ctggagtgattttttttccc

SEQ ID NO: 207270 - DNA, 20 bp, Artificial Sequence
  chemically synthesized
ctggggaaaaaaaatcactc

SEQ ID NO: 207271 - DNA, 20 bp, Artificial Sequence
  chemically synthesized
tggggaaaaaaaatcactcc

SEQ ID NO: 207272 - DNA, 20 bp, Artificial Sequence
  chemically synthesized
aaaaaaaatcactccaggta

SEQ ID NO: 207273 - DNA, 20 bp, Artificial Sequence
  chemically synthesized
aggaaaggatgctgtacctg

SEQ ID NO: 207274 - DNA, 20 bp, Artificial Sequence
  chemically synthesized
ataggaaaggatgctgtacc

SEQ ID NO: 207275 - DNA, 20 bp, Artificial Sequence
  chemically synthesized
aggaaatgagaaaataggaa

SEQ ID NO: 207276 - DNA, 20 bp, Artificial Sequence
  chemically synthesized
aaggaaatgagaaaatagga

SEQ ID NO: 207277 - DNA, 20 bp, Artificial Sequence
  chemically synthesized
gttaaaggaaatgagaaaat

SEQ ID NO: 207278 - DNA, 20 bp, Artificial Sequence
  chemically synthesized
tgttaaaggaaatgagaaaa

SEQ ID NO: 207279 - DNA, 20 bp, Artificial Sequence
  chemically synthesized
aactagatgttaaaggaaat

SEQ ID NO: 207280 - DNA, 20 bp, Artificial Sequence
  chemically synthesized
aaaataaaactagatgttaa

SEQ ID NO: 207281 - DNA, 20 bp, Artificial Sequence
  chemically synthesized
ttctcatttcctttaacatc

SEQ ID NO: 207282 - DNA, 20 bp, Artificial Sequence
  chemically synthesized
gaaaataaaactagatgtta

SEQ ID NO: 207283 - DNA, 20 bp, Artificial Sequence
  chemically synthesized
aagcattaagaaaataaaac

SEQ ID NO: 207284 - DNA, 20 bp, Artificial Sequence
  chemically synthesized
taacaaaatgacaaagcatt

SEQ ID NO: 207285 - DNA, 20 bp, Artificial Sequence
  chemically synthesized
aaaatactaacaaaatgaca

SEQ ID NO: 207286 - DNA, 20 bp, Artificial Sequence
  chemically synthesized
ttaatgctttgtcattttgt

SEQ ID NO: 207287 - DNA, 20 bp, Artificial Sequence
  chemically synthesized
ttaaacactaaaaaaaaatt

SEQ ID NO: 207288 - DNA, 20 bp, Artificial Sequence
  chemically synthesized
gtattttcttaatttttttt

SEQ ID NO: 207289 - DNA, 20 bp, Artificial Sequence
  chemically synthesized
tttttttagtgtttaatact

SEQ ID NO: 207290 - DNA, 20 bp, Artificial Sequence
  chemically synthesized
ttagtgtttaatactcggca

SEQ ID NO: 207291 - DNA, 20 bp, Artificial Sequence
  chemically synthesized
tagtgtttaatactcggcaa

SEQ ID NO: 207292 - DNA, 20 bp, Artificial Sequence
  chemically synthesized
ggctatgtctgtcctttgcc

SEQ ID NO: 207293 - DNA, 20 bp, Artificial Sequence
  chemically synthesized
gtttaatactcggcaaagga

SEQ ID NO: 207294 - DNA, 20 bp, Artificial Sequence
  chemically synthesized
tactcggcaaaggacagaca

SEQ ID NO: 207295 - DNA, 20 bp, Artificial Sequence
  chemically synthesized
gacagacatagcctgcgatg

SEQ ID NO: 207296 - DNA, 20 bp, Artificial Sequence
  chemically synthesized
acagacatagcctgcgatgc

SEQ ID NO: 207297 - DNA, 20 bp, Artificial Sequence
  chemically synthesized
agcagccctgcctgcatcgc

SEQ ID NO: 207298 - DNA, 20 bp, Artificial Sequence
  chemically synthesized
aagcagccctgcctgcatcg

SEQ ID NO: 207299 - DNA, 20 bp, Artificial Sequence
  chemically synthesized
gacatagcctgcgatgcagg

SEQ ID NO: 207300 - DNA, 20 bp, Artificial Sequence
  chemically synthesized
acatagcctgcgatgcaggc

SEQ ID NO: 207301 - DNA, 20 bp, Artificial Sequence
  chemically synthesized
catagcctgcgatgcaggca

SEQ ID NO: 207302 - DNA, 20 bp, Artificial Sequence
  chemically synthesized
caaaagaacattaagagaag

SEQ ID NO: 207303 - DNA, 20 bp, Artificial Sequence
  chemically synthesized
tgtcaaaagaacattaagag

SEQ ID NO: 207304 - DNA, 20 bp, Artificial Sequence
  chemically synthesized
tactgtcaaaagaacattaa

SEQ ID NO: 207305 - DNA, 20 bp, Artificial Sequence
  chemically synthesized
tttactgtcaaaagaacatt

SEQ ID NO: 207306 - DNA, 20 bp, Artificial Sequence
  chemically synthesized
ttctcttaatgttcttttga

SEQ ID NO: 207307 - DNA, 20 bp, Artificial Sequence
  chemically synthesized
ttttgaatctttactgtcaa

SEQ ID NO: 207308 - DNA, 20 bp, Artificial Sequence
  chemically synthesized
ttaatgttcttttgacagta

SEQ ID NO: 207309 - DNA, 20 bp, Artificial Sequence
  chemically synthesized
tgacagtaaagattcaaaat

SEQ ID NO: 207310 - DNA, 20 bp, Artificial Sequence
  chemically synthesized
tttatttgttggttgataat

SEQ ID NO: 207311 - DNA, 20 bp, Artificial Sequence
  chemically synthesized
ctttatttgttggttgataa

SEQ ID NO: 207312 - DNA, 20 bp, Artificial Sequence
  chemically synthesized
ccattatcaaccaacaaata

SEQ ID NO: 207313 - DNA, 20 bp, Artificial Sequence
  chemically synthesized
caaccctctcctttatttgt

SEQ ID NO: 207314 - DNA, 20 bp, Artificial Sequence
  chemically synthesized
cattatcaaccaacaaataa

SEQ ID NO: 207315 - DNA, 20 bp, Artificial Sequence
  chemically synthesized
ttatcaaccaacaaataaag

SEQ ID NO: 207316 - DNA, 20 bp, Artificial Sequence
  chemically synthesized
atcaaccaacaaataaagga

SEQ ID NO: 207317 - DNA, 20 bp, Artificial Sequence
  chemically synthesized
tcaaccaacaaataaaggag

SEQ ID NO: 207318 - DNA, 20 bp, Artificial Sequence
  chemically synthesized
caaccaacaaataaaggaga

SEQ ID NO: 207319 - DNA, 20 bp, Artificial Sequence
  chemically synthesized
caacaaataaaggagagggt

SEQ ID NO: 207320 - DNA, 20 bp, Artificial Sequence
  chemically synthesized
taaaggagagggttggaaat

SEQ ID NO: 207321 - DNA, 20 bp, Artificial Sequence
  chemically synthesized
agggttggaaataagtgtaa

SEQ ID NO: 207322 - DNA, 20 bp, Artificial Sequence
  chemically synthesized
ggaaataagtgtaatggttc

SEQ ID NO: 207323 - DNA, 20 bp, Artificial Sequence
  chemically synthesized
gccttgtgtttatttttggc

SEQ ID NO: 207324 - DNA, 20 bp, Artificial Sequence
  chemically synthesized
actggccttgtgtttatttt

SEQ ID NO: 207325 - DNA, 20 bp, Artificial Sequence
  chemically synthesized
ttccggccaaaaataaacac

SEQ ID NO: 207326 - DNA, 20 bp, Artificial Sequence
  chemically synthesized
tccggccaaaaataaacaca

SEQ ID NO: 207327 - DNA, 20 bp, Artificial Sequence
  chemically synthesized
gccaaaaataaacacaaggc

SEQ ID NO: 207328 - DNA, 20 bp, Artificial Sequence
  chemically synthesized
aacatacgaatttagcagac

SEQ ID NO: 207329 - DNA, 20 bp, Artificial Sequence
  chemically synthesized
tttgcaacatacgaatttag

SEQ ID NO: 207330 - DNA, 20 bp, Artificial Sequence
  chemically synthesized
gtttttgcaacatacgaatt

SEQ ID NO: 207331 - DNA, 20 bp, Artificial Sequence
  chemically synthesized
taaaggctaagtgaagtagt

SEQ ID NO: 207332 - DNA, 20 bp, Artificial Sequence
  chemically synthesized
aacgtacttactacttcact

SEQ ID NO: 207333 - DNA, 20 bp, Artificial Sequence
  chemically synthesized
ttcttaaaggctaagtgaag

SEQ ID NO: 207334 - DNA, 20 bp, Artificial Sequence
  chemically synthesized
tctttcttaaaggctaagtg

SEQ ID NO: 207335 - DNA, 20 bp, Artificial Sequence
  chemically synthesized
tactacttcacttagccttt

SEQ ID NO: 207336 - DNA, 20 bp, Artificial Sequence
  chemically synthesized
ccatgtctttcttaaaggct

SEQ ID NO: 207337 - DNA, 20 bp, Artificial Sequence
  chemically synthesized
acttcacttagcctttaaga

SEQ ID NO: 207338 - DNA, 20 bp, Artificial Sequence
  chemically synthesized
tcatcccatgtctttcttaa

SEQ ID NO: 207339 - DNA, 20 bp, Artificial Sequence
  chemically synthesized
ttcatcccatgtctttctta

SEQ ID NO: 207340 - DNA, 20 bp, Artificial Sequence
  chemically synthesized
cttagcctttaagaaagaca

SEQ ID NO: 207341 - DNA, 20 bp, Artificial Sequence
  chemically synthesized
ttagcctttaagaaagacat

SEQ ID NO: 207342 - DNA, 20 bp, Artificial Sequence
  chemically synthesized
aagaaagacatgggatgaat

SEQ ID NO: 207343 - DNA, 20 bp, Artificial Sequence
  chemically synthesized
agaaagacatgggatgaatt

SEQ ID NO: 207344 - DNA, 20 bp, Artificial Sequence
  chemically synthesized
gggatgaattgggattttta

SEQ ID NO: 207345 - DNA, 20 bp, Artificial Sequence
  chemically synthesized
tgaattgggatttttaaagt

SEQ ID NO: 207346 - DNA, 20 bp, Artificial Sequence
  chemically synthesized
attgggatttttaaagtaag

SEQ ID NO: 207347 - DNA, 20 bp, Artificial Sequence
  chemically synthesized
ttgggatttttaaagtaaga

SEQ ID NO: 207348 - DNA, 20 bp, Artificial Sequence
  chemically synthesized
tgggatttttaaagtaagaa

SEQ ID NO: 207349 - DNA, 20 bp, Artificial Sequence
  chemically synthesized
gggatttttaaagtaagaag

SEQ ID NO: 207350 - DNA, 20 bp, Artificial Sequence
  chemically synthesized
taaagtaagaaggggaaaaa

SEQ ID NO: 207351 - DNA, 20 bp, Artificial Sequence
  chemically synthesized
gggaaaaaaagcaacactct

SEQ ID NO: 207352 - DNA, 20 bp, Artificial Sequence
  chemically synthesized
gtactggataaaggagctaa

SEQ ID NO: 207353 - DNA, 20 bp, Artificial Sequence
  chemically synthesized
gagtactggataaaggagct

SEQ ID NO: 207354 - DNA, 20 bp, Artificial Sequence
  chemically synthesized
acactcttagctcctttatc

SEQ ID NO: 207355 - DNA, 20 bp, Artificial Sequence
  chemically synthesized
gtcaggagtactggataaag

SEQ ID NO: 207356 - DNA, 20 bp, Artificial Sequence
  chemically synthesized
gagtcaggagtactggataa

SEQ ID NO: 207357 - DNA, 20 bp, Artificial Sequence
  chemically synthesized
agagtcaggagtactggata

SEQ ID NO: 207358 - DNA, 20 bp, Artificial Sequence
  chemically synthesized
ccttgcagagtcaggagtac

SEQ ID NO: 207359 - DNA, 20 bp, Artificial Sequence
  chemically synthesized
aatctaccttgcagagtcag

SEQ ID NO: 207360 - DNA, 20 bp, Artificial Sequence
  chemically synthesized
acaatctaccttgcagagtc

SEQ ID NO: 207361 - DNA, 20 bp, Artificial Sequence
  chemically synthesized
tccagtactcctgactctgc

SEQ ID NO: 207362 - DNA, 20 bp, Artificial Sequence
  chemically synthesized
aacaatctaccttgcagagt

SEQ ID NO: 207363 - DNA, 20 bp, Artificial Sequence
  chemically synthesized
ccagtactcctgactctgca

SEQ ID NO: 207364 - DNA, 20 bp, Artificial Sequence
  chemically synthesized
gtactcctgactctgcaagg

SEQ ID NO: 207365 - DNA, 20 bp, Artificial Sequence
  chemically synthesized
aggaaacaatctaccttgca

SEQ ID NO: 207366 - DNA, 20 bp, Artificial Sequence
  chemically synthesized
ggaggaaacaatctaccttg

SEQ ID NO: 207367 - DNA, 20 bp, Artificial Sequence
  chemically synthesized
agcattttgccaattagagg

SEQ ID NO: 207368 - DNA, 20 bp, Artificial Sequence
  chemically synthesized
agattgtttcctcctctaat

SEQ ID NO: 207369 - DNA, 20 bp, Artificial Sequence
  chemically synthesized
cagcattttgccaattagag

SEQ ID NO: 207370 - DNA, 20 bp, Artificial Sequence
  chemically synthesized
tgcagcattttgccaattag

SEQ ID NO: 207371 - DNA, 20 bp, Artificial Sequence
  chemically synthesized
ctgcagcattttgccaatta

SEQ ID NO: 207372 - DNA, 20 bp, Artificial Sequence
  chemically synthesized
acctgcagcattttgccaat

SEQ ID NO: 207373 - DNA, 20 bp, Artificial Sequence
  chemically synthesized
ctctaattggcaaaatgctg

SEQ ID NO: 207374 - DNA, 20 bp, Artificial Sequence
  chemically synthesized
tctaattggcaaaatgctgc

SEQ ID NO: 207375 - DNA, 20 bp, Artificial Sequence
  chemically synthesized
accgagggactgaaaacctg

SEQ ID NO: 207376 - DNA, 20 bp, Artificial Sequence
  chemically synthesized
ggcaaaatgctgcaggtttt

SEQ ID NO: 207377 - DNA, 20 bp, Artificial Sequence
  chemically synthesized
gctgcaggttttcagtccct

SEQ ID NO: 207378 - DNA, 20 bp, Artificial Sequence
  chemically synthesized
ggttttcagtccctcggtga

SEQ ID NO: 207379 - DNA, 20 bp, Artificial Sequence
  chemically synthesized
tcctaagtcactttcaccga

SEQ ID NO: 207380 - DNA, 20 bp, Artificial Sequence
  chemically synthesized
gtcctaagtcactttcaccg

SEQ ID NO: 207381 - DNA, 20 bp, Artificial Sequence
  chemically synthesized
cgtcctaagtcactttcacc

SEQ ID NO: 207382 - DNA, 20 bp, Artificial Sequence
  chemically synthesized
gtccctcggtgaaagtgact

SEQ ID NO: 207383 - DNA, 20 bp, Artificial Sequence
  chemically synthesized
tccctcggtgaaagtgactt

SEQ ID NO: 207384 - DNA, 20 bp, Artificial Sequence
  chemically synthesized
tcggtgaaagtgacttagga

SEQ ID NO: 207385 - DNA, 20 bp, Artificial Sequence
  chemically synthesized
cggtgaaagtgacttaggac

SEQ ID NO: 207386 - DNA, 20 bp, Artificial Sequence
  chemically synthesized
ggtgaaagtgacttaggacg

SEQ ID NO: 207387 - DNA, 20 bp, Artificial Sequence
  chemically synthesized
aagaattaatgccccgtcct

SEQ ID NO: 207388 - DNA, 20 bp, Artificial Sequence
  chemically synthesized
ggacggggcattaattcttt

SEQ ID NO: 207389 - DNA, 20 bp, Artificial Sequence
  chemically synthesized
atgacgccctagtgaactga

SEQ ID NO: 207390 - DNA, 20 bp, Artificial Sequence
  chemically synthesized
cattaattctttcagttcac

SEQ ID NO: 207391 - DNA, 20 bp, Artificial Sequence
  chemically synthesized
attaattctttcagttcact

SEQ ID NO: 207392 - DNA, 20 bp, Artificial Sequence
  chemically synthesized
ttaattctttcagttcacta

SEQ ID NO: 207393 - DNA, 20 bp, Artificial Sequence
  chemically synthesized
taatttgccaaatgacgccc

SEQ ID NO: 207394 - DNA, 20 bp, Artificial Sequence
  chemically synthesized
cagttcactagggcgtcatt

SEQ ID NO: 207395 - DNA, 20 bp, Artificial Sequence
  chemically synthesized
tttggcaaattactatatgt

SEQ ID NO: 207396 - DNA, 20 bp, Artificial Sequence
  chemically synthesized
tttgatttattgctcacata

SEQ ID NO: 207397 - DNA, 20 bp, Artificial Sequence
  chemically synthesized
tatatgtgagcaataaatca

SEQ ID NO: 207398 - DNA, 20 bp, Artificial Sequence
  chemically synthesized
tatgtgagcaataaatcaaa

SEQ ID NO: 207399 - DNA, 20 bp, Artificial Sequence
  chemically synthesized
gcaataaatcaaagagttcg

SEQ ID NO: 207400 - DNA, 20 bp, Artificial Sequence
  chemically synthesized
aaagagttcgaagatgcctt

SEQ ID NO: 207401 - DNA, 20 bp, Artificial Sequence
  chemically synthesized
taatcctggagaatttctca

SEQ ID NO: 207402 - DNA, 20 bp, Artificial Sequence
  chemically synthesized
ataatcctggagaatttctc

SEQ ID NO: 207403 - DNA, 20 bp, Artificial Sequence
  chemically synthesized
agatgccttgagaaattctc

SEQ ID NO: 207404 - DNA, 20 bp, Artificial Sequence
  chemically synthesized
gatgccttgagaaattctcc

SEQ ID NO: 207405 - DNA, 20 bp, Artificial Sequence
  chemically synthesized
aaggcaagagaataatcctg

SEQ ID NO: 207406 - DNA, 20 bp, Artificial Sequence
  chemically synthesized
agaaggcaagagaataatcc

SEQ ID NO: 207407 - DNA, 20 bp, Artificial Sequence
  chemically synthesized
tctaatttaccagaaggcaa

SEQ ID NO: 207408 - DNA, 20 bp, Artificial Sequence
  chemically synthesized
aggattattctcttgccttc

SEQ ID NO: 207409 - DNA, 20 bp, Artificial Sequence
  chemically synthesized
tttctaatttaccagaaggc

SEQ ID NO: 207410 - DNA, 20 bp, Artificial Sequence
  chemically synthesized
tatgtttctaatttaccaga

SEQ ID NO: 207411 - DNA, 20 bp, Artificial Sequence
  chemically synthesized
gtatgtttctaatttaccag

SEQ ID NO: 207412 - DNA, 20 bp, Artificial Sequence
  chemically synthesized
tctcttgccttctggtaaat

SEQ ID NO: 207413 - DNA, 20 bp, Artificial Sequence
  chemically synthesized
gtagtatgtttctaatttac

SEQ ID NO: 207414 - DNA, 20 bp, Artificial Sequence
  chemically synthesized
tatactcttgttattgaatg

SEQ ID NO: 207415 - DNA, 20 bp, Artificial Sequence
  chemically synthesized
aacatactacattcaataac

SEQ ID NO: 207416 - DNA, 20 bp, Artificial Sequence
  chemically synthesized
catactacattcaataacaa

SEQ ID NO: 207417 - DNA, 20 bp, Artificial Sequence
  chemically synthesized
attttatattataaacatta

SEQ ID NO: 207418 - DNA, 20 bp, Artificial Sequence
  chemically synthesized
atagttcttccatgattttt

SEQ ID NO: 207419 - DNA, 20 bp, Artificial Sequence
  chemically synthesized
acattatggctaaaaaatca

SEQ ID NO: 207420 - DNA, 20 bp, Artificial Sequence
  chemically synthesized
ttatggctaaaaaatcatgg

SEQ ID NO: 207421 - DNA, 20 bp, Artificial Sequence
  chemically synthesized
agggggttgtaaaataataa

SEQ ID NO: 207422 - DNA, 20 bp, Artificial Sequence
  chemically synthesized
ggaaaacatttaaaaagagg

SEQ ID NO: 207423 - DNA, 20 bp, Artificial Sequence
  chemically synthesized
aggaaaacatttaaaaagag

SEQ ID NO: 207424 - DNA, 20 bp, Artificial Sequence
  chemically synthesized
taggaaaacatttaaaaaga

SEQ ID NO: 207425 - DNA, 20 bp, Artificial Sequence
  chemically synthesized
ttaggaaaacatttaaaaag

SEQ ID NO: 207426 - DNA, 20 bp, Artificial Sequence
  chemically synthesized
tttaggaaaacatttaaaaa

SEQ ID NO: 207427 - DNA, 20 bp, Artificial Sequence
  chemically synthesized
tgtttaggaaaacatttaaa

SEQ ID NO: 207428 - DNA, 20 bp, Artificial Sequence
  chemically synthesized
catacataccatgtatgttt

SEQ ID NO: 207429 - DNA, 20 bp, Artificial Sequence
  chemically synthesized
acatacataccatgtatgtt

SEQ ID NO: 207430 - DNA, 20 bp, Artificial Sequence
  chemically synthesized
aatgttttcctaaacataca

SEQ ID NO: 207431 - DNA, 20 bp, Artificial Sequence
  chemically synthesized
tgcaatccagggatttttga

SEQ ID NO: 207432 - DNA, 20 bp, Artificial Sequence
  chemically synthesized
ttcaaactgtcaaaaatccc

SEQ ID NO: 207433 - DNA, 20 bp, Artificial Sequence
  chemically synthesized
tgaattttacttgcaatcca

SEQ ID NO: 207434 - DNA, 20 bp, Artificial Sequence
  chemically synthesized
gtcaaaaatccctggattgc

SEQ ID NO: 207435 - DNA, 20 bp, Artificial Sequence
  chemically synthesized
ttgaattttacttgcaatcc

SEQ ID NO: 207436 - DNA, 20 bp, Artificial Sequence
  chemically synthesized
gttgaattttacttgcaatc

SEQ ID NO: 207437 - DNA, 20 bp, Artificial Sequence
  chemically synthesized
cattcattttgcaagtggga

SEQ ID NO: 207438 - DNA, 20 bp, Artificial Sequence
  chemically synthesized
aacccattcattttgcaagt

SEQ ID NO: 207439 - DNA, 20 bp, Artificial Sequence
  chemically synthesized
taacccattcattttgcaag

SEQ ID NO: 207440 - DNA, 20 bp, Artificial Sequence
  chemically synthesized
aattaacccattcattttgc

SEQ ID NO: 207441 - DNA, 20 bp, Artificial Sequence
  chemically synthesized
tatcccacttgcaaaatgaa

SEQ ID NO: 207442 - DNA, 20 bp, Artificial Sequence
  chemically synthesized
atcccacttgcaaaatgaat

SEQ ID NO: 207443 - DNA, 20 bp, Artificial Sequence
  chemically synthesized
tgggttaattgttcttactt

SEQ ID NO: 207444 - DNA, 20 bp, Artificial Sequence
  chemically synthesized
aaaacttatgagtctaaagt

SEQ ID NO: 207445 - DNA, 20 bp, Artificial Sequence
  chemically synthesized
tttgaaaacttatgagtcta

SEQ ID NO: 207446 - DNA, 20 bp, Artificial Sequence
  chemically synthesized
tgttcttactttagactcat

SEQ ID NO: 207447 - DNA, 20 bp, Artificial Sequence
  chemically synthesized
attattctttgaaaacttat

SEQ ID NO: 207448 - DNA, 20 bp, Artificial Sequence
  chemically synthesized
tttagactcataagttttca

SEQ ID NO: 207449 - DNA, 20 bp, Artificial Sequence
  chemically synthesized
tatttgttttaaatatttaa

SEQ ID NO: 207450 - DNA, 20 bp, Artificial Sequence
  chemically synthesized
taaaacaaatatactttatt

SEQ ID NO: 207451 - DNA, 20 bp, Artificial Sequence
  chemically synthesized
atctattaagtcaccaaata

SEQ ID NO: 207452 - DNA, 20 bp, Artificial Sequence
  chemically synthesized
tactttatttggtgacttaa

SEQ ID NO: 207453 - DNA, 20 bp, Artificial Sequence
  chemically synthesized
tatttggtgacttaatagat

SEQ ID NO: 207454 - DNA, 20 bp, Artificial Sequence
  chemically synthesized
attctattctcttatctatt

SEQ ID NO: 207455 - DNA, 20 bp, Artificial Sequence
  chemically synthesized
tttggtgacttaatagataa

SEQ ID NO: 207456 - DNA, 20 bp, Artificial Sequence
  chemically synthesized
tgacttaatagataagagaa

SEQ ID NO: 207457 - DNA, 20 bp, Artificial Sequence
  chemically synthesized
aatagataagagaatagaat

SEQ ID NO: 207458 - DNA, 20 bp, Artificial Sequence
  chemically synthesized
cagtagttcattattttgat

SEQ ID NO: 207459 - DNA, 20 bp, Artificial Sequence
  chemically synthesized
gtgtcaattcaaaatgacag

SEQ ID NO: 207460 - DNA, 20 bp, Artificial Sequence
  chemically synthesized
taggtgtcaattcaaaatga

SEQ ID NO: 207461 - DNA, 20 bp, Artificial Sequence
  chemically synthesized
gtttaaatcagaatttatat

SEQ ID NO: 207462 - DNA, 20 bp, Artificial Sequence
  chemically synthesized
tgtttaaatcagaatttata

SEQ ID NO: 207463 - DNA, 20 bp, Artificial Sequence
  chemically synthesized
atgtaaaaatatgtttaaat

SEQ ID NO: 207464 - DNA, 20 bp, Artificial Sequence
  chemically synthesized
ttaaacatatttttacatct

SEQ ID NO: 207465 - DNA, 20 bp, Artificial Sequence
  chemically synthesized
aacatatttttacatctcag

SEQ ID NO: 207466 - DNA, 20 bp, Artificial Sequence
  chemically synthesized
tatttttacatctcagaaga

SEQ ID NO: 207467 - DNA, 20 bp, Artificial Sequence
  chemically synthesized
aacgctatgctctttcttct

SEQ ID NO: 207468 - DNA, 20 bp, Artificial Sequence
  chemically synthesized
tttttacatctcagaagaaa

SEQ ID NO: 207469 - DNA, 20 bp, Artificial Sequence
  chemically synthesized
acatctcagaagaaagagca

SEQ ID NO: 207470 - DNA, 20 bp, Artificial Sequence
  chemically synthesized
agaagaaagagcatagcgtt

SEQ ID NO: 207471 - DNA, 20 bp, Artificial Sequence
  chemically synthesized
aagagcatagcgttaagtat

SEQ ID NO: 207472 - DNA, 20 bp, Artificial Sequence
  chemically synthesized
tgccaatctatggttgaaat

SEQ ID NO: 207473 - DNA, 20 bp, Artificial Sequence
  chemically synthesized
atgccaatctatggttgaaa

SEQ ID NO: 207474 - DNA, 20 bp, Artificial Sequence
  chemically synthesized
ataagaacccatttcaacca

SEQ ID NO: 207475 - DNA, 20 bp, Artificial Sequence
  chemically synthesized
aacccatttcaaccatagat

SEQ ID NO: 207476 - DNA, 20 bp, Artificial Sequence
  chemically synthesized
ataattgctatgccaatcta

SEQ ID NO: 207477 - DNA, 20 bp, Artificial Sequence
  chemically synthesized
atttcaaccatagattggca

SEQ ID NO: 207478 - DNA, 20 bp, Artificial Sequence
  chemically synthesized
tagcaattatctgatcttat

SEQ ID NO: 207479 - DNA, 20 bp, Artificial Sequence
  chemically synthesized
tatttttaaccttataagat

SEQ ID NO: 207480 - DNA, 20 bp, Artificial Sequence
  chemically synthesized
agcaattatctgatcttata

SEQ ID NO: 207481 - DNA, 20 bp, Artificial Sequence
  chemically synthesized
tctcatatttttaaccttat

SEQ ID NO: 207482 - DNA, 20 bp, Artificial Sequence
  chemically synthesized
tcttataaggttaaaaatat

SEQ ID NO: 207483 - DNA, 20 bp, Artificial Sequence
  chemically synthesized
acattttcataatgatatta

SEQ ID NO: 207484 - DNA, 20 bp, Artificial Sequence
  chemically synthesized
aatgatattaaagtattaat

SEQ ID NO: 207485 - DNA, 20 bp, Artificial Sequence
  chemically synthesized
taaagtattaattagtaaaa

SEQ ID NO: 207486 - DNA, 20 bp, Artificial Sequence
  chemically synthesized
tatttttatggaatataatc

SEQ ID NO: 207487 - DNA, 20 bp, Artificial Sequence
  chemically synthesized
tcgattatattccataaaaa

SEQ ID NO: 207488 - DNA, 20 bp, Artificial Sequence
  chemically synthesized
tctttgtctatctattttta

SEQ ID NO: 207489 - DNA, 20 bp, Artificial Sequence
  chemically synthesized
ttatattccataaaaataga

SEQ ID NO: 207490 - DNA, 20 bp, Artificial Sequence
  chemically synthesized
tccataaaaatagatagaca

SEQ ID NO: 207491 - DNA, 20 bp, Artificial Sequence
  chemically synthesized
agatagacaaagaaaatttt

SEQ ID NO: 207492 - DNA, 20 bp, Artificial Sequence
  chemically synthesized
ttttaagataaattcctatg

SEQ ID NO: 207493 - DNA, 20 bp, Artificial Sequence
  chemically synthesized
taagataaattcctatgtag

SEQ ID NO: 207494 - DNA, 20 bp, Artificial Sequence
  chemically synthesized
aagataaattcctatgtagt

SEQ ID NO: 207495 - DNA, 20 bp, Artificial Sequence
  chemically synthesized
aaagtatttacctactacat

SEQ ID NO: 207496 - DNA, 20 bp, Artificial Sequence
  chemically synthesized
aaaagtatttacctactaca

SEQ ID NO: 207497 - DNA, 20 bp, Artificial Sequence
  chemically synthesized
tattcccttatttgagggaa

SEQ ID NO: 207498 - DNA, 20 bp, Artificial Sequence
  chemically synthesized
taaatacttttccctcaaat

SEQ ID NO: 207499 - DNA, 20 bp, Artificial Sequence
  chemically synthesized
aaatacttttccctcaaata

SEQ ID NO: 207500 - DNA, 20 bp, Artificial Sequence
  chemically synthesized
taatgtattcccttatttga

SEQ ID NO: 207501 - DNA, 20 bp, Artificial Sequence
  chemically synthesized
aatacttttccctcaaataa

SEQ ID NO: 207502 - DNA, 20 bp, Artificial Sequence
  chemically synthesized
ttaatgtattcccttatttg

SEQ ID NO: 207503 - DNA, 20 bp, Artificial Sequence
  chemically synthesized
cttaatgtattcccttattt

SEQ ID NO: 207504 - DNA, 20 bp, Artificial Sequence
  chemically synthesized
ctcaaataagggaatacatt

SEQ ID NO: 207505 - DNA, 20 bp, Artificial Sequence
  chemically synthesized
tcaaataagggaatacatta

SEQ ID NO: 207506 - DNA, 20 bp, Artificial Sequence
  chemically synthesized
aaataagggaatacattaag

SEQ ID NO: 207507 - DNA, 20 bp, Artificial Sequence
  chemically synthesized
tttataaaatgaaaaagttt

SEQ ID NO: 207508 - DNA, 20 bp, Artificial Sequence
  chemically synthesized
ttcttatttataaaatgaaa

SEQ ID NO: 207509 - DNA, 20 bp, Artificial Sequence
  chemically synthesized
aactttttcattttataaat

SEQ ID NO: 207510 - DNA, 20 bp, Artificial Sequence
  chemically synthesized
gatgtcatgtggtttttata

SEQ ID NO: 207511 - DNA, 20 bp, Artificial Sequence
  chemically synthesized
ctatagcttttgatgtcatg

SEQ ID NO: 207512 - DNA, 20 bp, Artificial Sequence
  chemically synthesized
taaaaaccacatgacatcaa

SEQ ID NO: 207513 - DNA, 20 bp, Artificial Sequence
  chemically synthesized
ccacatgacatcaaaagcta

SEQ ID NO: 207514 - DNA, 20 bp, Artificial Sequence
  chemically synthesized
atggctagcatttagaacta

SEQ ID NO: 207515 - DNA, 20 bp, Artificial Sequence
  chemically synthesized
aaagctatagttctaaatgc

SEQ ID NO: 207516 - DNA, 20 bp, Artificial Sequence
  chemically synthesized
gcatttctatggctagcatt

SEQ ID NO: 207517 - DNA, 20 bp, Artificial Sequence
  chemically synthesized
atagttctaaatgctagcca

SEQ ID NO: 207518 - DNA, 20 bp, Artificial Sequence
  chemically synthesized
taatcatgcatttctatggc

SEQ ID NO: 207519 - DNA, 20 bp, Artificial Sequence
  chemically synthesized
aatataatcatgcatttcta

SEQ ID NO: 207520 - DNA, 20 bp, Artificial Sequence
  chemically synthesized
catgtttatgaacagataaa

SEQ ID NO: 207521 - DNA, 20 bp, Artificial Sequence
  chemically synthesized
aggcaggtcatgtttatgaa

SEQ ID NO: 207522 - DNA, 20 bp, Artificial Sequence
  chemically synthesized
ataaacatgacctgcctccc

SEQ ID NO: 207523 - DNA, 20 bp, Artificial Sequence
  chemically synthesized
taaaattgcactggggaggc

SEQ ID NO: 207524 - DNA, 20 bp, Artificial Sequence
  chemically synthesized
ctaaaattgcactggggagg

SEQ ID NO: 207525 - DNA, 20 bp, Artificial Sequence
  chemically synthesized
gtcctaaaattgcactgggg

SEQ ID NO: 207526 - DNA, 20 bp, Artificial Sequence
  chemically synthesized
ggtcctaaaattgcactggg

SEQ ID NO: 207527 - DNA, 20 bp, Artificial Sequence
  chemically synthesized
ttggtcctaaaattgcactg

SEQ ID NO: 207528 - DNA, 20 bp, Artificial Sequence
  chemically synthesized
attggtcctaaaattgcact

SEQ ID NO: 207529 - DNA, 20 bp, Artificial Sequence
  chemically synthesized
cattggtcctaaaattgcac

SEQ ID NO: 207530 - DNA, 20 bp, Artificial Sequence
  chemically synthesized
ctgcctccccagtgcaattt

SEQ ID NO: 207531 - DNA, 20 bp, Artificial Sequence
  chemically synthesized
tgcctccccagtgcaatttt

SEQ ID NO: 207532 - DNA, 20 bp, Artificial Sequence
  chemically synthesized
gcaattttaggaccaatgaa

SEQ ID NO: 207533 - DNA, 20 bp, Artificial Sequence
  chemically synthesized
caattttaggaccaatgaaa

SEQ ID NO: 207534 - DNA, 20 bp, Artificial Sequence
  chemically synthesized
atgtaggatctccttttcat

SEQ ID NO: 207535 - DNA, 20 bp, Artificial Sequence
  chemically synthesized
attttaggaccaatgaaaag

SEQ ID NO: 207536 - DNA, 20 bp, Artificial Sequence
  chemically synthesized
ggggaaatttaaaaggatgt

SEQ ID NO: 207537 - DNA, 20 bp, Artificial Sequence
  chemically synthesized
cggggaaatttaaaaggatg

SEQ ID NO: 207538 - DNA, 20 bp, Artificial Sequence
  chemically synthesized
agggttcggggaaatttaaa

SEQ ID NO: 207539 - DNA, 20 bp, Artificial Sequence
  chemically synthesized
tagggttcggggaaatttaa

SEQ ID NO: 207540 - DNA, 20 bp, Artificial Sequence
  chemically synthesized
ttttaaatttccccgaaccc

SEQ ID NO: 207541 - DNA, 20 bp, Artificial Sequence
  chemically synthesized
ttcccatgcactagggttcg

SEQ ID NO: 207542 - DNA, 20 bp, Artificial Sequence
  chemically synthesized
gttcccatgcactagggttc

SEQ ID NO: 207543 - DNA, 20 bp, Artificial Sequence
  chemically synthesized
tgttcccatgcactagggtt

SEQ ID NO: 207544 - DNA, 20 bp, Artificial Sequence
  chemically synthesized
tttccccgaaccctagtgca

SEQ ID NO: 207545 - DNA, 20 bp, Artificial Sequence
  chemically synthesized
tatattgttcccatgcacta

SEQ ID NO: 207546 - DNA, 20 bp, Artificial Sequence
  chemically synthesized
ttccccgaaccctagtgcat

SEQ ID NO: 207547 - DNA, 20 bp, Artificial Sequence
  chemically synthesized
gtatattgttcccatgcact

SEQ ID NO: 207548 - DNA, 20 bp, Artificial Sequence
  chemically synthesized
tgtatattgttcccatgcac

SEQ ID NO: 207549 - DNA, 20 bp, Artificial Sequence
  chemically synthesized
tagtgcatgggaacaatata

SEQ ID NO: 207550 - DNA, 20 bp, Artificial Sequence
  chemically synthesized
aacaatatacagtattttct

SEQ ID NO: 207551 - DNA, 20 bp, Artificial Sequence
  chemically synthesized
atcatcctgatttttattct

SEQ ID NO: 207552 - DNA, 20 bp, Artificial Sequence
  chemically synthesized
tattttctcagaataaaaat

SEQ ID NO: 207553 - DNA, 20 bp, Artificial Sequence
  chemically synthesized
attttctcagaataaaaatc

SEQ ID NO: 207554 - DNA, 20 bp, Artificial Sequence
  chemically synthesized
gaataaaaatcaggatgatg

SEQ ID NO: 207555 - DNA, 20 bp, Artificial Sequence
  chemically synthesized
aaatcaggatgatgaagaaa

SEQ ID NO: 207556 - DNA, 20 bp, Artificial Sequence
  chemically synthesized
agaaacggcgtttactatgc

SEQ ID NO: 207557 - DNA, 20 bp, Artificial Sequence
  chemically synthesized
gaaacggcgtttactatgca

SEQ ID NO: 207558 - DNA, 20 bp, Artificial Sequence
  chemically synthesized
aaacggcgtttactatgcaa

SEQ ID NO: 207559 - DNA, 20 bp, Artificial Sequence
  chemically synthesized
ctttgtattcagcccttgca

SEQ ID NO: 207560 - DNA, 20 bp, Artificial Sequence
  chemically synthesized
ctatgcaagggctgaataca

SEQ ID NO: 207561 - DNA, 20 bp, Artificial Sequence
  chemically synthesized
tatgcaagggctgaatacaa

SEQ ID NO: 207562 - DNA, 20 bp, Artificial Sequence
  chemically synthesized
cactaatctccctttgtatt

SEQ ID NO: 207563 - DNA, 20 bp, Artificial Sequence
  chemically synthesized
atgcaagggctgaatacaaa

SEQ ID NO: 207564 - DNA, 20 bp, Artificial Sequence
  chemically synthesized
gcaagggctgaatacaaagg

SEQ ID NO: 207565 - DNA, 20 bp, Artificial Sequence
  chemically synthesized
ggctgaatacaaagggagat

SEQ ID NO: 207566 - DNA, 20 bp, Artificial Sequence
  chemically synthesized
tgaatacaaagggagattag

SEQ ID NO: 207567 - DNA, 20 bp, Artificial Sequence
  chemically synthesized
agggagattagtggactgtt

SEQ ID NO: 207568 - DNA, 20 bp, Artificial Sequence
  chemically synthesized
aatcattctctttttccaaa

SEQ ID NO: 207569 - DNA, 20 bp, Artificial Sequence
  chemically synthesized
attagtggactgtttggaaa

SEQ ID NO: 207570 - DNA, 20 bp, Artificial Sequence
  chemically synthesized
tagtggactgtttggaaaaa

SEQ ID NO: 207571 - DNA, 20 bp, Artificial Sequence
  chemically synthesized
actttatgtcttaaagtaaa

SEQ ID NO: 207572 - DNA, 20 bp, Artificial Sequence
  chemically synthesized
tgattattactgtttacttt

SEQ ID NO: 207573 - DNA, 20 bp, Artificial Sequence
  chemically synthesized
gtttctgactttatgtctta

SEQ ID NO: 207574 - DNA, 20 bp, Artificial Sequence
  chemically synthesized
actgtttactttaagacata

SEQ ID NO: 207575 - DNA, 20 bp, Artificial Sequence
  chemically synthesized
tttactttaagacataaagt

SEQ ID NO: 207576 - DNA, 20 bp, Artificial Sequence
  chemically synthesized
agacataaagtcagaaacta

SEQ ID NO: 207577 - DNA, 20 bp, Artificial Sequence
  chemically synthesized
gcgagttgtcacacaggcta

SEQ ID NO: 207578 - DNA, 20 bp, Artificial Sequence
  chemically synthesized
gcaaatgcgagttgtcacac

SEQ ID NO: 207579 - DNA, 20 bp, Artificial Sequence
  chemically synthesized
agcaaatgcgagttgtcaca

SEQ ID NO: 207580 - DNA, 20 bp, Artificial Sequence
  chemically synthesized
cgcacacaggcagcaaatgc

SEQ ID NO: 207581 - DNA, 20 bp, Artificial Sequence
  chemically synthesized
gtgtgccatacgcacacagg

SEQ ID NO: 207582 - DNA, 20 bp, Artificial Sequence
  chemically synthesized
cttgtgtgccatacgcacac

SEQ ID NO: 207583 - DNA, 20 bp, Artificial Sequence
  chemically synthesized
gcttgtgtgccatacgcaca

SEQ ID NO: 207584 - DNA, 20 bp, Artificial Sequence
  chemically synthesized
atttgctgcctgtgtgcgta

SEQ ID NO: 207585 - DNA, 20 bp, Artificial Sequence
  chemically synthesized
cctgtgtgcgtatggcacac

SEQ ID NO: 207586 - DNA, 20 bp, Artificial Sequence
  chemically synthesized
gtgcgtatggcacacaagct

SEQ ID NO: 207587 - DNA, 20 bp, Artificial Sequence
  chemically synthesized
tatggcacacaagctaagaa

SEQ ID NO: 207588 - DNA, 20 bp, Artificial Sequence
  chemically synthesized
atggcacacaagctaagaat

SEQ ID NO: 207589 - DNA, 20 bp, Artificial Sequence
  chemically synthesized
taatatgtaaatcccattct

SEQ ID NO: 207590 - DNA, 20 bp, Artificial Sequence
  chemically synthesized
aatgggatttacatattaaa

SEQ ID NO: 207591 - DNA, 20 bp, Artificial Sequence
  chemically synthesized
ggatttacatattaaatggt

SEQ ID NO: 207592 - DNA, 20 bp, Artificial Sequence
  chemically synthesized
gatttacatattaaatggtt

SEQ ID NO: 207593 - DNA, 20 bp, Artificial Sequence
  chemically synthesized
atttacatattaaatggttg

SEQ ID NO: 207594 - DNA, 20 bp, Artificial Sequence
  chemically synthesized
ttacatattaaatggttggg

SEQ ID NO: 207595 - DNA, 20 bp, Artificial Sequence
  chemically synthesized
aatggttggggagaaatcaa

SEQ ID NO: 207596 - DNA, 20 bp, Artificial Sequence
  chemically synthesized
tataatttttatgtgttgca

SEQ ID NO: 207597 - DNA, 20 bp, Artificial Sequence
  chemically synthesized
actttacgcacagagaaatt

SEQ ID NO: 207598 - DNA, 20 bp, Artificial Sequence
  chemically synthesized
cctagcaaactttacgcaca

SEQ ID NO: 207599 - DNA, 20 bp, Artificial Sequence
  chemically synthesized
tccaaatttctctgtgcgta

SEQ ID NO: 207600 - DNA, 20 bp, Artificial Sequence
  chemically synthesized
ttcctagcaaactttacgca

SEQ ID NO: 207601 - DNA, 20 bp, Artificial Sequence
  chemically synthesized
tctctgtgcgtaaagtttgc

SEQ ID NO: 207602 - DNA, 20 bp, Artificial Sequence
  chemically synthesized
ctctgtgcgtaaagtttgct

SEQ ID NO: 207603 - DNA, 20 bp, Artificial Sequence
  chemically synthesized
aatgagcatggttttgttcc

SEQ ID NO: 207604 - DNA, 20 bp, Artificial Sequence
  chemically synthesized
aatacatacctgaatgagca

SEQ ID NO: 207605 - DNA, 20 bp, Artificial Sequence
  chemically synthesized
ggaacaaaaccatgctcatt

SEQ ID NO: 207606 - DNA, 20 bp, Artificial Sequence
  chemically synthesized
gaacaaaaccatgctcattc

SEQ ID NO: 207607 - DNA, 20 bp, Artificial Sequence
  chemically synthesized
cagacaatacatacctgaat

SEQ ID NO: 207608 - DNA, 20 bp, Artificial Sequence
  chemically synthesized
acgctgttgtagtatgaaag

SEQ ID NO: 207609 - DNA, 20 bp, Artificial Sequence
  chemically synthesized
actacgctgttgtagtatga

SEQ ID NO: 207610 - DNA, 20 bp, Artificial Sequence
  chemically synthesized
tgtctgctttcatactacaa

SEQ ID NO: 207611 - DNA, 20 bp, Artificial Sequence
  chemically synthesized
attactcaactacgctgttg

SEQ ID NO: 207612 - DNA, 20 bp, Artificial Sequence
  chemically synthesized
gctttcatactacaacagcg

SEQ ID NO: 207613 - DNA, 20 bp, Artificial Sequence
  chemically synthesized
catactacaacagcgtagtt

SEQ ID NO: 207614 - DNA, 20 bp, Artificial Sequence
  chemically synthesized
gtagttgagtaattgcgaca

SEQ ID NO: 207615 - DNA, 20 bp, Artificial Sequence
  chemically synthesized
gtaattgcgacaaagacgac

SEQ ID NO: 207616 - DNA, 20 bp, Artificial Sequence
  chemically synthesized
ggctagttagtaaatatttt

SEQ ID NO: 207617 - DNA, 20 bp, Artificial Sequence
  chemically synthesized
gggctagttagtaaatattt

SEQ ID NO: 207618 - DNA, 20 bp, Artificial Sequence
  chemically synthesized
agcctaaaatatttactaac

SEQ ID NO: 207619 - DNA, 20 bp, Artificial Sequence
  chemically synthesized
tttttctttgaagggctagt

SEQ ID NO: 207620 - DNA, 20 bp, Artificial Sequence
  chemically synthesized
gccttttttctttgaagggc

SEQ ID NO: 207621 - DNA, 20 bp, Artificial Sequence
  chemically synthesized
atttactaactagcccttca

SEQ ID NO: 207622 - DNA, 20 bp, Artificial Sequence
  chemically synthesized
agaagccttttttctttgaa

SEQ ID NO: 207623 - DNA, 20 bp, Artificial Sequence
  chemically synthesized
cagaagccttttttctttga

SEQ ID NO: 207624 - DNA, 20 bp, Artificial Sequence
  chemically synthesized
tcagaagccttttttctttg

SEQ ID NO: 207625 - DNA, 20 bp, Artificial Sequence
  chemically synthesized
aactagcccttcaaagaaaa

SEQ ID NO: 207626 - DNA, 20 bp, Artificial Sequence
  chemically synthesized
actagcccttcaaagaaaaa

SEQ ID NO: 207627 - DNA, 20 bp, Artificial Sequence
  chemically synthesized
tctcctaaagcaggagtcag

SEQ ID NO: 207628 - DNA, 20 bp, Artificial Sequence
  chemically synthesized
ctttctcctaaagcaggagt

SEQ ID NO: 207629 - DNA, 20 bp, Artificial Sequence
  chemically synthesized
aaggcttctgactcctgctt

SEQ ID NO: 207630 - DNA, 20 bp, Artificial Sequence
  chemically synthesized
aggcttctgactcctgcttt

SEQ ID NO: 207631 - DNA, 20 bp, Artificial Sequence
  chemically synthesized
cgtgctttctcctaaagcag

SEQ ID NO: 207632 - DNA, 20 bp, Artificial Sequence
  chemically synthesized
gcttctgactcctgctttag

SEQ ID NO: 207633 - DNA, 20 bp, Artificial Sequence
  chemically synthesized
tacgtgctttctcctaaagc

SEQ ID NO: 207634 - DNA, 20 bp, Artificial Sequence
  chemically synthesized
gtacgtgctttctcctaaag

SEQ ID NO: 207635 - DNA, 20 bp, Artificial Sequence
  chemically synthesized
ctgactcctgctttaggaga

SEQ ID NO: 207636 - DNA, 20 bp, Artificial Sequence
  chemically synthesized
cttgtacgtgctttctccta

SEQ ID NO: 207637 - DNA, 20 bp, Artificial Sequence
  chemically synthesized
ctttaggagaaagcacgtac

SEQ ID NO: 207638 - DNA, 20 bp, Artificial Sequence
  chemically synthesized
tttaggagaaagcacgtaca

SEQ ID NO: 207639 - DNA, 20 bp, Artificial Sequence
  chemically synthesized
taggagaaagcacgtacaag

SEQ ID NO: 207640 - DNA, 20 bp, Artificial Sequence
  chemically synthesized
aggagaaagcacgtacaagg

SEQ ID NO: 207641 - DNA, 20 bp, Artificial Sequence
  chemically synthesized
gattgcaattaaaaaaaaaa

SEQ ID NO: 207642 - DNA, 20 bp, Artificial Sequence
  chemically synthesized
tttttttttttaattgcaat

SEQ ID NO: 207643 - DNA, 20 bp, Artificial Sequence
  chemically synthesized
ttttaattgcaatcagattc

SEQ ID NO: 207644 - DNA, 20 bp, Artificial Sequence
  chemically synthesized
aattgcaatcagattccaga

SEQ ID NO: 207645 - DNA, 20 bp, Artificial Sequence
  chemically synthesized
ctgagctcttagggtccatc

SEQ ID NO: 207646 - DNA, 20 bp, Artificial Sequence
  chemically synthesized
tcagattccagatggaccct

SEQ ID NO: 207647 - DNA, 20 bp, Artificial Sequence
  chemically synthesized
agattccagatggaccctaa

SEQ ID NO: 207648 - DNA, 20 bp, Artificial Sequence
  chemically synthesized
cttccgtaactgagctctta

SEQ ID NO: 207649 - DNA, 20 bp, Artificial Sequence
  chemically synthesized
ccagatggaccctaagagct

SEQ ID NO: 207650 - DNA, 20 bp, Artificial Sequence
  chemically synthesized
acttccgtaactgagctctt

SEQ ID NO: 207651 - DNA, 20 bp, Artificial Sequence
  chemically synthesized
cacttccgtaactgagctct

SEQ ID NO: 207652 - DNA, 20 bp, Artificial Sequence
  chemically synthesized
ggaccctaagagctcagtta

SEQ ID NO: 207653 - DNA, 20 bp, Artificial Sequence
  chemically synthesized
ccccttccacttccgtaact

SEQ ID NO: 207654 - DNA, 20 bp, Artificial Sequence
  chemically synthesized
ccctaagagctcagttacgg

SEQ ID NO: 207655 - DNA, 20 bp, Artificial Sequence
  chemically synthesized
taagagctcagttacggaag

SEQ ID NO: 207656 - DNA, 20 bp, Artificial Sequence
  chemically synthesized
gagctcagttacggaagtgg

SEQ ID NO: 207657 - DNA, 20 bp, Artificial Sequence
  chemically synthesized
agctcagttacggaagtgga

SEQ ID NO: 207658 - DNA, 20 bp, Artificial Sequence
  chemically synthesized
gctcagttacggaagtggaa

SEQ ID NO: 207659 - DNA, 20 bp, Artificial Sequence
  chemically synthesized
ctcagttacggaagtggaag

SEQ ID NO: 207660 - DNA, 20 bp, Artificial Sequence
  chemically synthesized
cggaagtggaaggggaaaaa

SEQ ID NO: 207661 - DNA, 20 bp, Artificial Sequence
  chemically synthesized
aagtggaaggggaaaaacag

SEQ ID NO: 207662 - DNA, 20 bp, Artificial Sequence
  chemically synthesized
tggaaggggaaaaacagcag

SEQ ID NO: 207663 - DNA, 20 bp, Artificial Sequence
  chemically synthesized
aaggggaaaaacagcagcag

SEQ ID NO: 207664 - DNA, 20 bp, Artificial Sequence
  chemically synthesized
gggaaaaacagcagcagcag

SEQ ID NO: 207665 - DNA, 20 bp, Artificial Sequence
  chemically synthesized
acaacgacaacaacaaaccg

SEQ ID NO: 207666 - DNA, 20 bp, Artificial Sequence
  chemically synthesized
aacgacaacaacaaaccgaa

SEQ ID NO: 207667 - DNA, 20 bp, Artificial Sequence
  chemically synthesized
acgacaacaacaaaccgaag

SEQ ID NO: 207668 - DNA, 20 bp, Artificial Sequence
  chemically synthesized
ctcagctctcttttcctctt

SEQ ID NO: 207669 - DNA, 20 bp, Artificial Sequence
  chemically synthesized
aacaacaaaccgaagaggaa

SEQ ID NO: 207670 - DNA, 20 bp, Artificial Sequence
  chemically synthesized
caacaaaccgaagaggaaaa

SEQ ID NO: 207671 - DNA, 20 bp, Artificial Sequence
  chemically synthesized
acaaaccgaagaggaaaaga

SEQ ID NO: 207672 - DNA, 20 bp, Artificial Sequence
  chemically synthesized
ccgaagaggaaaagagagct

SEQ ID NO: 207673 - DNA, 20 bp, Artificial Sequence
  chemically synthesized
aagaggaaaagagagctgag

SEQ ID NO: 207674 - DNA, 20 bp, Artificial Sequence
  chemically synthesized
tttcaaagactttttccact

SEQ ID NO: 207675 - DNA, 20 bp, Artificial Sequence
  chemically synthesized
aaaagagagctgagtggaaa

SEQ ID NO: 207676 - DNA, 20 bp, Artificial Sequence
  chemically synthesized
gttttaggactaaattttca

SEQ ID NO: 207677 - DNA, 20 bp, Artificial Sequence
  chemically synthesized
ggaaaaagtctttgaaaatt

SEQ ID NO: 207678 - DNA, 20 bp, Artificial Sequence
  chemically synthesized
agaatgtaaatataagtttt

SEQ ID NO: 207679 - DNA, 20 bp, Artificial Sequence
  chemically synthesized
gagaatgtaaatataagttt

SEQ ID NO: 207680 - DNA, 20 bp, Artificial Sequence
  chemically synthesized
gagcatgagaatgtaaatat

SEQ ID NO: 207681 - DNA, 20 bp, Artificial Sequence
  chemically synthesized
ctgtgacttcaggagagcat

SEQ ID NO: 207682 - DNA, 20 bp, Artificial Sequence
  chemically synthesized
tacattctcatgctctcctg

SEQ ID NO: 207683 - DNA, 20 bp, Artificial Sequence
  chemically synthesized
ctctttctgtgacttcagga

SEQ ID NO: 207684 - DNA, 20 bp, Artificial Sequence
  chemically synthesized
acctctttctgtgacttcag

SEQ ID NO: 207685 - DNA, 20 bp, Artificial Sequence
  chemically synthesized
ctcatgctctcctgaagtca

SEQ ID NO: 207686 - DNA, 20 bp, Artificial Sequence
  chemically synthesized
gaacctctttctgtgacttc

SEQ ID NO: 207687 - DNA, 20 bp, Artificial Sequence
  chemically synthesized
cgaacctctttctgtgactt

SEQ ID NO: 207688 - DNA, 20 bp, Artificial Sequence
  chemically synthesized
tgctctcctgaagtcacaga

SEQ ID NO: 207689 - DNA, 20 bp, Artificial Sequence
  chemically synthesized
ctctcctgaagtcacagaaa

SEQ ID NO: 207690 - DNA, 20 bp, Artificial Sequence
  chemically synthesized
tctcctgaagtcacagaaag

SEQ ID NO: 207691 - DNA, 20 bp, Artificial Sequence
  chemically synthesized
tgaagtcacagaaagaggtt

SEQ ID NO: 207692 - DNA, 20 bp, Artificial Sequence
  chemically synthesized
aggttcggaacttctgcttt

SEQ ID NO: 207693 - DNA, 20 bp, Artificial Sequence
  chemically synthesized
caaatgtcctcttaaagcag

SEQ ID NO: 207694 - DNA, 20 bp, Artificial Sequence
  chemically synthesized
gttcggaacttctgctttaa

SEQ ID NO: 207695 - DNA, 20 bp, Artificial Sequence
  chemically synthesized
ttcggaacttctgctttaag

SEQ ID NO: 207696 - DNA, 20 bp, Artificial Sequence
  chemically synthesized
attcaaatgtcctcttaaag

SEQ ID NO: 207697 - DNA, 20 bp, Artificial Sequence
  chemically synthesized
tcgattcaaatgtcctctta

SEQ ID NO: 207698 - DNA, 20 bp, Artificial Sequence
  chemically synthesized
aagaggacatttgaatcgac

SEQ ID NO: 207699 - DNA, 20 bp, Artificial Sequence
  chemically synthesized
gaggacatttgaatcgactg

SEQ ID NO: 207700 - DNA, 20 bp, Artificial Sequence
  chemically synthesized
ggacatttgaatcgactgga

SEQ ID NO: 207701 - DNA, 20 bp, Artificial Sequence
  chemically synthesized
gacatttgaatcgactggag

SEQ ID NO: 207702 - DNA, 20 bp, Artificial Sequence
  chemically synthesized
ttcaatgctttgttcctctc

SEQ ID NO: 207703 - DNA, 20 bp, Artificial Sequence
  chemically synthesized
gaatcgactggagaggaaca

SEQ ID NO: 207704 - DNA, 20 bp, Artificial Sequence
  chemically synthesized
tggagaggaacaaagcattg

SEQ ID NO: 207705 - DNA, 20 bp, Artificial Sequence
  chemically synthesized
gagaggaacaaagcattgaa

SEQ ID NO: 207706 - DNA, 20 bp, Artificial Sequence
  chemically synthesized
gaggaacaaagcattgaaga

SEQ ID NO: 207707 - DNA, 20 bp, Artificial Sequence
  chemically synthesized
ggaacaaagcattgaagaga

SEQ ID NO: 207708 - DNA, 20 bp, Artificial Sequence
  chemically synthesized
gaacaaagcattgaagagag

SEQ ID NO: 207709 - DNA, 20 bp, Artificial Sequence
  chemically synthesized
caaagcattgaagagagagg

SEQ ID NO: 207710 - DNA, 20 bp, Artificial Sequence
  chemically synthesized
gagagaggaagtgaactcct

SEQ ID NO: 207711 - DNA, 20 bp, Artificial Sequence
  chemically synthesized
atattagagctttatctgag

SEQ ID NO: 207712 - DNA, 20 bp, Artificial Sequence
  chemically synthesized
ggaagtgaactcctcagata

SEQ ID NO: 207713 - DNA, 20 bp, Artificial Sequence
  chemically synthesized
tcatattagagctttatctg

SEQ ID NO: 207714 - DNA, 20 bp, Artificial Sequence
  chemically synthesized
ctcatattagagctttatct

SEQ ID NO: 207715 - DNA, 20 bp, Artificial Sequence
  chemically synthesized
ctcagataaagctctaatat

SEQ ID NO: 207716 - DNA, 20 bp, Artificial Sequence
  chemically synthesized
gaactatgtttctcatatta

SEQ ID NO: 207717 - DNA, 20 bp, Artificial Sequence
  chemically synthesized
tggaactatgtttctcatat

SEQ ID NO: 207718 - DNA, 20 bp, Artificial Sequence
  chemically synthesized
aagctctaatatgagaaaca

SEQ ID NO: 207719 - DNA, 20 bp, Artificial Sequence
  chemically synthesized
taatatgagaaacatagttc

SEQ ID NO: 207720 - DNA, 20 bp, Artificial Sequence
  chemically synthesized
atatgagaaacatagttcca

SEQ ID NO: 207721 - DNA, 20 bp, Artificial Sequence
  chemically synthesized
atgagaaacatagttccaga

SEQ ID NO: 207722 - DNA, 20 bp, Artificial Sequence
  chemically synthesized
agaaacatagttccagagag

SEQ ID NO: 207723 - DNA, 20 bp, Artificial Sequence
  chemically synthesized
aagtaacattaacttctctc

SEQ ID NO: 207724 - DNA, 20 bp, Artificial Sequence
  chemically synthesized
ggaaatgagacagaaaaatg

SEQ ID NO: 207725 - DNA, 20 bp, Artificial Sequence
  chemically synthesized
tgagcttgaaggaaatgaga

SEQ ID NO: 207726 - DNA, 20 bp, Artificial Sequence
  chemically synthesized
gctttgagcttgaaggaaat

SEQ ID NO: 207727 - DNA, 20 bp, Artificial Sequence
  chemically synthesized
ttttctgtctcatttccttc

SEQ ID NO: 207728 - DNA, 20 bp, Artificial Sequence
  chemically synthesized
tactcatgctttgagcttga

SEQ ID NO: 207729 - DNA, 20 bp, Artificial Sequence
  chemically synthesized
ttactcatgctttgagcttg

SEQ ID NO: 207730 - DNA, 20 bp, Artificial Sequence
  chemically synthesized
tctcatttccttcaagctca

SEQ ID NO: 207731 - DNA, 20 bp, Artificial Sequence
  chemically synthesized
ttccttcaagctcaaagcat

SEQ ID NO: 207732 - DNA, 20 bp, Artificial Sequence
  chemically synthesized
ttatcacttactcatgcttt

SEQ ID NO: 207733 - DNA, 20 bp, Artificial Sequence
  chemically synthesized
ttcaagctcaaagcatgagt

SEQ ID NO: 207734 - DNA, 20 bp, Artificial Sequence
  chemically synthesized
aaagcatgagtaagtgataa

SEQ ID NO: 207735 - DNA, 20 bp, Artificial Sequence
  chemically synthesized
catgagtaagtgataatggt

SEQ ID NO: 207736 - DNA, 20 bp, Artificial Sequence
  chemically synthesized
tctgtttttaggatggcaga

SEQ ID NO: 207737 - DNA, 20 bp, Artificial Sequence
  chemically synthesized
cttctgtttttaggatggca

SEQ ID NO: 207738 - DNA, 20 bp, Artificial Sequence
  chemically synthesized
tccttctgtttttaggatgg

SEQ ID NO: 207739 - DNA, 20 bp, Artificial Sequence
  chemically synthesized
ccctccttctgtttttagga

SEQ ID NO: 207740 - DNA, 20 bp, Artificial Sequence
  chemically synthesized
tctctctgccatcctaaaaa

SEQ ID NO: 207741 - DNA, 20 bp, Artificial Sequence
  chemically synthesized
gtccccctccttctgttttt

SEQ ID NO: 207742 - DNA, 20 bp, Artificial Sequence
  chemically synthesized
ctctgccatcctaaaaacag

SEQ ID NO: 207743 - DNA, 20 bp, Artificial Sequence
  chemically synthesized
ggtccccctccttctgtttt

SEQ ID NO: 207744 - DNA, 20 bp, Artificial Sequence
  chemically synthesized
tctgccatcctaaaaacaga

SEQ ID NO: 207745 - DNA, 20 bp, Artificial Sequence
  chemically synthesized
tgccatcctaaaaacagaag

SEQ ID NO: 207746 - DNA, 20 bp, Artificial Sequence
  chemically synthesized
gccatcctaaaaacagaagg

SEQ ID NO: 207747 - DNA, 20 bp, Artificial Sequence
  chemically synthesized
ccatcctaaaaacagaagga

SEQ ID NO: 207748 - DNA, 20 bp, Artificial Sequence
  chemically synthesized
catcctaaaaacagaaggag

SEQ ID NO: 207749 - DNA, 20 bp, Artificial Sequence
  chemically synthesized
atcctaaaaacagaaggagg

SEQ ID NO: 207750 - DNA, 20 bp, Artificial Sequence
  chemically synthesized
ccagtgtttaattttacaag

SEQ ID NO: 207751 - DNA, 20 bp, Artificial Sequence
  chemically synthesized
cagccagtgtttaattttac

SEQ ID NO: 207752 - DNA, 20 bp, Artificial Sequence
  chemically synthesized
ccacttgtaaaattaaacac

SEQ ID NO: 207753 - DNA, 20 bp, Artificial Sequence
  chemically synthesized
ggataaattatttttacagc

SEQ ID NO: 207754 - DNA, 20 bp, Artificial Sequence
  chemically synthesized
atatggataaattattttta

SEQ ID NO: 207755 - DNA, 20 bp, Artificial Sequence
  chemically synthesized
aaaaataatttatccatatg

SEQ ID NO: 207756 - DNA, 20 bp, Artificial Sequence
  chemically synthesized
aaaataatttatccatatgt

SEQ ID NO: 207757 - DNA, 20 bp, Artificial Sequence
  chemically synthesized
actgaaaaaaatcctacata

SEQ ID NO: 207758 - DNA, 20 bp, Artificial Sequence
  chemically synthesized
tccatatgtaggattttttt

SEQ ID NO: 207759 - DNA, 20 bp, Artificial Sequence
  chemically synthesized
tatgtaggatttttttcagt

SEQ ID NO: 207760 - DNA, 20 bp, Artificial Sequence
  chemically synthesized
tgtaggatttttttcagttg

SEQ ID NO: 207761 - DNA, 20 bp, Artificial Sequence
  chemically synthesized
ggatttttttcagttggaga

SEQ ID NO: 207762 - DNA, 20 bp, Artificial Sequence
  chemically synthesized
ttcagttggagaaagcaccc

SEQ ID NO: 207763 - DNA, 20 bp, Artificial Sequence
  chemically synthesized
ggagaaagcacccaagccta

SEQ ID NO: 207764 - DNA, 20 bp, Artificial Sequence
  chemically synthesized
ggcacgcactctgtaggctt

SEQ ID NO: 207765 - DNA, 20 bp, Artificial Sequence
  chemically synthesized
aggcacgcactctgtaggct

SEQ ID NO: 207766 - DNA, 20 bp, Artificial Sequence
  chemically synthesized
agaaagcacccaagcctaca

SEQ ID NO: 207767 - DNA, 20 bp, Artificial Sequence
  chemically synthesized
aacctaggcacgcactctgt

SEQ ID NO: 207768 - DNA, 20 bp, Artificial Sequence
  chemically synthesized
gaacctaggcacgcactctg

SEQ ID NO: 207769 - DNA, 20 bp, Artificial Sequence
  chemically synthesized
aagcctacagagtgcgtgcc

SEQ ID NO: 207770 - DNA, 20 bp, Artificial Sequence
  chemically synthesized
agcctacagagtgcgtgcct

SEQ ID NO: 207771 - DNA, 20 bp, Artificial Sequence
  chemically synthesized
gcattgttattgcagaacct

SEQ ID NO: 207772 - DNA, 20 bp, Artificial Sequence
  chemically synthesized
tgcattgttattgcagaacc

SEQ ID NO: 207773 - DNA, 20 bp, Artificial Sequence
  chemically synthesized
tttctattgcattgttattg

SEQ ID NO: 207774 - DNA, 20 bp, Artificial Sequence
  chemically synthesized
gttctgcaataacaatgcaa

SEQ ID NO: 207775 - DNA, 20 bp, Artificial Sequence
  chemically synthesized
caataacaatgcaatagaaa

SEQ ID NO: 207776 - DNA, 20 bp, Artificial Sequence
  chemically synthesized
aaacagtcacaattaacata

SEQ ID NO: 207777 - DNA, 20 bp, Artificial Sequence
  chemically synthesized
aacagtcacaattaacatac

SEQ ID NO: 207778 - DNA, 20 bp, Artificial Sequence
  chemically synthesized
aacatacaggcacacaaaca

SEQ ID NO: 207779 - DNA, 20 bp, Artificial Sequence
  chemically synthesized
acattttcgtgctttcacta

SEQ ID NO: 207780 - DNA, 20 bp, Artificial Sequence
  chemically synthesized
cccataagtaactatagtga

SEQ ID NO: 207781 - DNA, 20 bp, Artificial Sequence
  chemically synthesized
ttttttcccataagtaacta

SEQ ID NO: 207782 - DNA, 20 bp, Artificial Sequence
  chemically synthesized
gctttcactatagttactta

SEQ ID NO: 207783 - DNA, 20 bp, Artificial Sequence
  chemically synthesized
ctttcactatagttacttat

SEQ ID NO: 207784 - DNA, 20 bp, Artificial Sequence
  chemically synthesized
tttatttgattttttcccat

SEQ ID NO: 207785 - DNA, 20 bp, Artificial Sequence
  chemically synthesized
gggaaaaaatcaaataaaat

SEQ ID NO: 207786 - DNA, 20 bp, Artificial Sequence
  chemically synthesized
ggaaaaaatcaaataaaatg

SEQ ID NO: 207787 - DNA, 20 bp, Artificial Sequence
  chemically synthesized
gaaaaaatcaaataaaatga

SEQ ID NO: 207788 - DNA, 20 bp, Artificial Sequence
  chemically synthesized
atcaaataaaatgagggcat

SEQ ID NO: 207789 - DNA, 20 bp, Artificial Sequence
  chemically synthesized
aaataaaatgagggcattgg

SEQ ID NO: 207790 - DNA, 20 bp, Artificial Sequence
  chemically synthesized
aataaaatgagggcattgga

SEQ ID NO: 207791 - DNA, 20 bp, Artificial Sequence
  chemically synthesized
tggaaggcaaacaaaacatg

SEQ ID NO: 207792 - DNA, 20 bp, Artificial Sequence
  chemically synthesized
ttaaagttttgtcaaaaaat

SEQ ID NO: 207793 - DNA, 20 bp, Artificial Sequence
  chemically synthesized
tttgacaaaactttaatgtg

SEQ ID NO: 207794 - DNA, 20 bp, Artificial Sequence
  chemically synthesized
gttgtaataacttcacatta

SEQ ID NO: 207795 - DNA, 20 bp, Artificial Sequence
  chemically synthesized
tggagagttaaattttcaga

SEQ ID NO: 207796 - DNA, 20 bp, Artificial Sequence
  chemically synthesized
ttgttggagagttaaatttt

SEQ ID NO: 207797 - DNA, 20 bp, Artificial Sequence
  chemically synthesized
tgaaaatttaactctccaac

SEQ ID NO: 207798 - DNA, 20 bp, Artificial Sequence
  chemically synthesized
gaaaatttaactctccaaca

SEQ ID NO: 207799 - DNA, 20 bp, Artificial Sequence
  chemically synthesized
acaagaaagaccttgttgga

SEQ ID NO: 207800 - DNA, 20 bp, Artificial Sequence
  chemically synthesized
tcacaagaaagaccttgttg

SEQ ID NO: 207801 - DNA, 20 bp, Artificial Sequence
  chemically synthesized
tttcacaagaaagaccttgt

SEQ ID NO: 207802 - DNA, 20 bp, Artificial Sequence
  chemically synthesized
taaacaacggtttcacaaga

SEQ ID NO: 207803 - DNA, 20 bp, Artificial Sequence
  chemically synthesized
aagataaacaacggtttcac

SEQ ID NO: 207804 - DNA, 20 bp, Artificial Sequence
  chemically synthesized
ggaacttgcaagataaacaa

SEQ ID NO: 207805 - DNA, 20 bp, Artificial Sequence
  chemically synthesized
gaaaccgttgtttatcttgc

SEQ ID NO: 207806 - DNA, 20 bp, Artificial Sequence
  chemically synthesized
gagaatctgtaggaacttgc

SEQ ID NO: 207807 - DNA, 20 bp, Artificial Sequence
  chemically synthesized
gtttatcttgcaagttccta

SEQ ID NO: 207808 - DNA, 20 bp, Artificial Sequence
  chemically synthesized
gtacagaattgagaatctgt

SEQ ID NO: 207809 - DNA, 20 bp, Artificial Sequence
  chemically synthesized
ggtacagaattgagaatctg

SEQ ID NO: 207810 - DNA, 20 bp, Artificial Sequence
  chemically synthesized
aaaattatgggtacagaatt

SEQ ID NO: 207811 - DNA, 20 bp, Artificial Sequence
  chemically synthesized
ggataggaaaattatgggta

SEQ ID NO: 207812 - DNA, 20 bp, Artificial Sequence
  chemically synthesized
tcaagggataggaaaattat

SEQ ID NO: 207813 - DNA, 20 bp, Artificial Sequence
  chemically synthesized
ctcaagggataggaaaatta

SEQ ID NO: 207814 - DNA, 20 bp, Artificial Sequence
  chemically synthesized
ccataattttcctatccctt

SEQ ID NO: 207815 - DNA, 20 bp, Artificial Sequence
  chemically synthesized
tttaccaggcctcaagggat

SEQ ID NO: 207816 - DNA, 20 bp, Artificial Sequence
  chemically synthesized
cataattttcctatcccttg

SEQ ID NO: 207817 - DNA, 20 bp, Artificial Sequence
  chemically synthesized
ctttaccaggcctcaaggga

SEQ ID NO: 207818 - DNA, 20 bp, Artificial Sequence
  chemically synthesized
aaaactttaccaggcctcaa

SEQ ID NO: 207819 - DNA, 20 bp, Artificial Sequence
  chemically synthesized
ttttcctatcccttgaggcc

SEQ ID NO: 207820 - DNA, 20 bp, Artificial Sequence
  chemically synthesized
gaaaactttaccaggcctca

SEQ ID NO: 207821 - DNA, 20 bp, Artificial Sequence
  chemically synthesized
tgaaaactttaccaggcctc

SEQ ID NO: 207822 - DNA, 20 bp, Artificial Sequence
  chemically synthesized
ctatcccttgaggcctggta

SEQ ID NO: 207823 - DNA, 20 bp, Artificial Sequence
  chemically synthesized
ttttccatgaaaactttacc

SEQ ID NO: 207824 - DNA, 20 bp, Artificial Sequence
  chemically synthesized
tttttccatgaaaactttac

SEQ ID NO: 207825 - DNA, 20 bp, Artificial Sequence
  chemically synthesized
gaggcctggtaaagttttca

SEQ ID NO: 207826 - DNA, 20 bp, Artificial Sequence
  chemically synthesized
ggaaaaaaatgaatgttttt

SEQ ID NO: 207827 - DNA, 20 bp, Artificial Sequence
  chemically synthesized
aataattaagagattaaatg

SEQ ID NO: 207828 - DNA, 20 bp, Artificial Sequence
  chemically synthesized
tattgccttagaataattaa

SEQ ID NO: 207829 - DNA, 20 bp, Artificial Sequence
  chemically synthesized
gttattgccttagaataatt

SEQ ID NO: 207830 - DNA, 20 bp, Artificial Sequence
  chemically synthesized
tttaatctcttaattattct

SEQ ID NO: 207831 - DNA, 20 bp, Artificial Sequence
  chemically synthesized
ttaatctcttaattattcta

SEQ ID NO: 207832 - DNA, 20 bp, Artificial Sequence
  chemically synthesized
ctggaaagatgttattgcct

SEQ ID NO: 207833 - DNA, 20 bp, Artificial Sequence
  chemically synthesized
ctaaggcaataacatctttc

SEQ ID NO: 207834 - DNA, 20 bp, Artificial Sequence
  chemically synthesized
atgaaatctgtaacactgga

SEQ ID NO: 207835 - DNA, 20 bp, Artificial Sequence
  chemically synthesized
ataacatctttccagtgtta

SEQ ID NO: 207836 - DNA, 20 bp, Artificial Sequence
  chemically synthesized
tggcatgaaatctgtaacac

SEQ ID NO: 207837 - DNA, 20 bp, Artificial Sequence
  chemically synthesized
taaataaacttttttttttt

SEQ ID NO: 207838 - DNA, 20 bp, Artificial Sequence
  chemically synthesized
atttcatgccaaaaaaaaaa

SEQ ID NO: 207839 - DNA, 20 bp, Artificial Sequence
  chemically synthesized
caaaaaaaaaaaagtttatt

SEQ ID NO: 207840 - DNA, 20 bp, Artificial Sequence
  chemically synthesized
aaaaaaaaaaaagtttattt

SEQ ID NO: 207841 - DNA, 20 bp, Artificial Sequence
  chemically synthesized
aaaaaaaaaaagtttattta

SEQ ID NO: 207842 - DNA, 20 bp, Artificial Sequence
  chemically synthesized
agtttatttagggatgcgcg

SEQ ID NO: 207843 - DNA, 20 bp, Artificial Sequence
  chemically synthesized
ttatttagggatgcgcgcag

SEQ ID NO: 207844 - DNA, 20 bp, Artificial Sequence
  chemically synthesized
agtgctgagattacaggcgt

SEQ ID NO: 207845 - DNA, 20 bp, Artificial Sequence
  chemically synthesized
gcagctgacgcctgtaatct

SEQ ID NO: 207846 - DNA, 20 bp, Artificial Sequence
  chemically synthesized
tcccaaagtgctgagattac

SEQ ID NO: 207847 - DNA, 20 bp, Artificial Sequence
  chemically synthesized
ctcccaaagtgctgagatta

SEQ ID NO: 207848 - DNA, 20 bp, Artificial Sequence
  chemically synthesized
cgcctgtaatctcagcactt

SEQ ID NO: 207849 - DNA, 20 bp, Artificial Sequence
  chemically synthesized
actcggcctcccaaagtgct

SEQ ID NO: 207850 - DNA, 20 bp, Artificial Sequence
  chemically synthesized
gcctgtaatctcagcacttt

SEQ ID NO: 207851 - DNA, 20 bp, Artificial Sequence
  chemically synthesized
ctgtaatctcagcactttgg

SEQ ID NO: 207852 - DNA, 20 bp, Artificial Sequence
  chemically synthesized
tgtaatctcagcactttggg

SEQ ID NO: 207853 - DNA, 20 bp, Artificial Sequence
  chemically synthesized
ctgccctactcggcctccca

SEQ ID NO: 207854 - DNA, 20 bp, Artificial Sequence
  chemically synthesized
tctcagcactttgggaggcc

SEQ ID NO: 207855 - DNA, 20 bp, Artificial Sequence
  chemically synthesized
cagcactttgggaggccgag

SEQ ID NO: 207856 - DNA, 20 bp, Artificial Sequence
  chemically synthesized
agcactttgggaggccgagt

SEQ ID NO: 207857 - DNA, 20 bp, Artificial Sequence
  chemically synthesized
gcactttgggaggccgagta

SEQ ID NO: 207858 - DNA, 20 bp, Artificial Sequence
  chemically synthesized
ctttgggaggccgagtaggg

SEQ ID NO: 207859 - DNA, 20 bp, Artificial Sequence
  chemically synthesized
ctcaagcagtctgccctact

SEQ ID NO: 207860 - DNA, 20 bp, Artificial Sequence
  chemically synthesized
ccgagtagggcagactgctt

SEQ ID NO: 207861 - DNA, 20 bp, Artificial Sequence
  chemically synthesized
ctcgaactcctggtctcaag

SEQ ID NO: 207862 - DNA, 20 bp, Artificial Sequence
  chemically synthesized
tagggcagactgcttgagac

SEQ ID NO: 207863 - DNA, 20 bp, Artificial Sequence
  chemically synthesized
agggcagactgcttgagacc

SEQ ID NO: 207864 - DNA, 20 bp, Artificial Sequence
  chemically synthesized
ggtctcgaactcctggtctc

SEQ ID NO: 207865 - DNA, 20 bp, Artificial Sequence
  chemically synthesized
ggcagactgcttgagaccag

SEQ ID NO: 207866 - DNA, 20 bp, Artificial Sequence
  chemically synthesized
ctgcttgagaccaggagttc

SEQ ID NO: 207867 - DNA, 20 bp, Artificial Sequence
  chemically synthesized
ccaggctggtctcgaactcc

SEQ ID NO: 207868 - DNA, 20 bp, Artificial Sequence
  chemically synthesized
tgagaccaggagttcgagac

SEQ ID NO: 207869 - DNA, 20 bp, Artificial Sequence
  chemically synthesized
ccaggagttcgagaccagcc

SEQ ID NO: 207870 - DNA, 20 bp, Artificial Sequence
  chemically synthesized
caggagttcgagaccagcct

SEQ ID NO: 207871 - DNA, 20 bp, Artificial Sequence
  chemically synthesized
tttcaccatgttgcccaggc

SEQ ID NO: 207872 - DNA, 20 bp, Artificial Sequence
  chemically synthesized
ggggtttcaccatgttgccc

SEQ ID NO: 207873 - DNA, 20 bp, Artificial Sequence
  chemically synthesized
cgagaccagcctgggcaaca

SEQ ID NO: 207874 - DNA, 20 bp, Artificial Sequence
  chemically synthesized
cggggtttcaccatgttgcc

SEQ ID NO: 207875 - DNA, 20 bp, Artificial Sequence
  chemically synthesized
ttgtatctttagtggagacg

SEQ ID NO: 207876 - DNA, 20 bp, Artificial Sequence
  chemically synthesized
tttgtatctttagtggagac

SEQ ID NO: 207877 - DNA, 20 bp, Artificial Sequence
  chemically synthesized
ttttgtatctttagtggaga

SEQ ID NO: 207878 - DNA, 20 bp, Artificial Sequence
  chemically synthesized
gtgaaaccccgtctccacta

SEQ ID NO: 207879 - DNA, 20 bp, Artificial Sequence
  chemically synthesized
taatttttgtatctttagtg

SEQ ID NO: 207880 - DNA, 20 bp, Artificial Sequence
  chemically synthesized
gctaatttttgtatctttag

SEQ ID NO: 207881 - DNA, 20 bp, Artificial Sequence
  chemically synthesized
ctggctaatttttgtatctt

SEQ ID NO: 207882 - DNA, 20 bp, Artificial Sequence
  chemically synthesized
tccactaaagatacaaaaat

SEQ ID NO: 207883 - DNA, 20 bp, Artificial Sequence
  chemically synthesized
ctaaagatacaaaaattagc

SEQ ID NO: 207884 - DNA, 20 bp, Artificial Sequence
  chemically synthesized
taaagatacaaaaattagcc

SEQ ID NO: 207885 - DNA, 20 bp, Artificial Sequence
  chemically synthesized
atacaaaaattagccaggcg

SEQ ID NO: 207886 - DNA, 20 bp, Artificial Sequence
  chemically synthesized
caaaaattagccaggcgtgg

SEQ ID NO: 207887 - DNA, 20 bp, Artificial Sequence
  chemically synthesized
taagtgtctgccaccacgcc

SEQ ID NO: 207888 - DNA, 20 bp, Artificial Sequence
  chemically synthesized
aaattagccaggcgtggtgg

SEQ ID NO: 207889 - DNA, 20 bp, Artificial Sequence
  chemically synthesized
gtggcagacacttataatcc

SEQ ID NO: 207890 - DNA, 20 bp, Artificial Sequence
  chemically synthesized
cttccagtagctgggattat

SEQ ID NO: 207891 - DNA, 20 bp, Artificial Sequence
  chemically synthesized
acacttataatcccagctac

SEQ ID NO: 207892 - DNA, 20 bp, Artificial Sequence
  chemically synthesized
gcctctgtcttccagtagct

SEQ ID NO: 207893 - DNA, 20 bp, Artificial Sequence
  chemically synthesized
tgcctctgtcttccagtagc

SEQ ID NO: 207894 - DNA, 20 bp, Artificial Sequence
  chemically synthesized
cttataatcccagctactgg

SEQ ID NO: 207895 - DNA, 20 bp, Artificial Sequence
  chemically synthesized
ctcctgcctctgtcttccag

SEQ ID NO: 207896 - DNA, 20 bp, Artificial Sequence
  chemically synthesized
taatcccagctactggaaga

SEQ ID NO: 207897 - DNA, 20 bp, Artificial Sequence
  chemically synthesized
atcccagctactggaagaca

SEQ ID NO: 207898 - DNA, 20 bp, Artificial Sequence
  chemically synthesized
attctcctgcctctgtcttc

SEQ ID NO: 207899 - DNA, 20 bp, Artificial Sequence
  chemically synthesized
tcccagctactggaagacag

SEQ ID NO: 207900 - DNA, 20 bp, Artificial Sequence
  chemically synthesized
cagctactggaagacagagg

SEQ ID NO: 207901 - DNA, 20 bp, Artificial Sequence
  chemically synthesized
agctactggaagacagaggc

SEQ ID NO: 207902 - DNA, 20 bp, Artificial Sequence
  chemically synthesized
ctactggaagacagaggcag

SEQ ID NO: 207903 - DNA, 20 bp, Artificial Sequence
  chemically synthesized
cagaggcaggagaatcattt

SEQ ID NO: 207904 - DNA, 20 bp, Artificial Sequence
  chemically synthesized
agaatcatttgagcccacga

SEQ ID NO: 207905 - DNA, 20 bp, Artificial Sequence
  chemically synthesized
gaatcatttgagcccacgat

SEQ ID NO: 207906 - DNA, 20 bp, Artificial Sequence
  chemically synthesized
aatcatttgagcccacgatg

SEQ ID NO: 207907 - DNA, 20 bp, Artificial Sequence
  chemically synthesized
cactgcaacctccccatcgt

SEQ ID NO: 207908 - DNA, 20 bp, Artificial Sequence
  chemically synthesized
tcatttgagcccacgatggg

SEQ ID NO: 207909 - DNA, 20 bp, Artificial Sequence
  chemically synthesized
tcactgcaacctccccatcg

SEQ ID NO: 207910 - DNA, 20 bp, Artificial Sequence
  chemically synthesized
catttgagcccacgatgggg

SEQ ID NO: 207911 - DNA, 20 bp, Artificial Sequence
  chemically synthesized
agcccacgatggggaggttg

SEQ ID NO: 207912 - DNA, 20 bp, Artificial Sequence
  chemically synthesized
cacgatggggaggttgcagt

SEQ ID NO: 207913 - DNA, 20 bp, Artificial Sequence
  chemically synthesized
gcagtgcaatggcatggtca

SEQ ID NO: 207914 - DNA, 20 bp, Artificial Sequence
  chemically synthesized
tggagtgcagtgcaatggca

SEQ ID NO: 207915 - DNA, 20 bp, Artificial Sequence
  chemically synthesized
caggctggagtgcagtgcaa

SEQ ID NO: 207916 - DNA, 20 bp, Artificial Sequence
  chemically synthesized
catgccattgcactgcactc

SEQ ID NO: 207917 - DNA, 20 bp, Artificial Sequence
  chemically synthesized
ctgtcacccaggctggagtg

SEQ ID NO: 207918 - DNA, 20 bp, Artificial Sequence
  chemically synthesized
cattgcactgcactccagcc

SEQ ID NO: 207919 - DNA, 20 bp, Artificial Sequence
  chemically synthesized
attgcactgcactccagcct

SEQ ID NO: 207920 - DNA, 20 bp, Artificial Sequence
  chemically synthesized
tcgttctgtcacccaggctg

SEQ ID NO: 207921 - DNA, 20 bp, Artificial Sequence
  chemically synthesized
tctcgttctgtcacccaggc

SEQ ID NO: 207922 - DNA, 20 bp, Artificial Sequence
  chemically synthesized
ctgcactccagcctgggtga

SEQ ID NO: 207923 - DNA, 20 bp, Artificial Sequence
  chemically synthesized
agagtctcgttctgtcaccc

SEQ ID NO: 207924 - DNA, 20 bp, Artificial Sequence
  chemically synthesized
cagagtctcgttctgtcacc

SEQ ID NO: 207925 - DNA, 20 bp, Artificial Sequence
  chemically synthesized
tccagcctgggtgacagaac

SEQ ID NO: 207926 - DNA, 20 bp, Artificial Sequence
  chemically synthesized
ttttttttttttttgagaca

SEQ ID NO: 207927 - DNA, 20 bp, Artificial Sequence
  chemically synthesized
ttttttttttttttttgaga

SEQ ID NO: 207928 - DNA, 20 bp, Artificial Sequence
  chemically synthesized
tttttttttttttttttttt

SEQ ID NO: 207929 - DNA, 20 bp, Artificial Sequence
  chemically synthesized
aaaaaaaaaaaaaaaaaaaa

SEQ ID NO: 207930 - DNA, 20 bp, Artificial Sequence
  chemically synthesized
aaaaaaaaaaaaaaaaaaaa

SEQ ID NO: 207931 - DNA, 20 bp, Artificial Sequence
  chemically synthesized
aaaaaaaaaaaaaaaaaaga

SEQ ID NO: 207932 - DNA, 20 bp, Artificial Sequence
  chemically synthesized
aaaaaaaaaaaaaaaagaga

SEQ ID NO: 207933 - DNA, 20 bp, Artificial Sequence
  chemically synthesized
aaaaaaaaaaaaaagagaga

SEQ ID NO: 207934 - DNA, 20 bp, Artificial Sequence
  chemically synthesized
aaaaaaaaaaaagagagaga

SEQ ID NO: 207935 - DNA, 20 bp, Artificial Sequence
  chemically synthesized
aaaaaaaaaagagagagaga

SEQ ID NO: 207936 - DNA, 20 bp, Artificial Sequence
  chemically synthesized
aaaaaaaagagagagagaga

SEQ ID NO: 207937 - DNA, 20 bp, Artificial Sequence
  chemically synthesized
aaaaaagagagagagagaga

SEQ ID NO: 207938 - DNA, 20 bp, Artificial Sequence
  chemically synthesized
aaaagagagagagagagaga

SEQ ID NO: 207939 - DNA, 20 bp, Artificial Sequence
  chemically synthesized
agagagagagagagagagag

SEQ ID NO: 207940 - DNA, 20 bp, Artificial Sequence
  chemically synthesized
agagagagagagaagttatt

SEQ ID NO: 207941 - DNA, 20 bp, Artificial Sequence
  chemically synthesized
gagaagttatttagaactaa

SEQ ID NO: 207942 - DNA, 20 bp, Artificial Sequence
  chemically synthesized
cacagtgccttgcatactgt

SEQ ID NO: 207943 - DNA, 20 bp, Artificial Sequence
  chemically synthesized
atttagaactaacagtatgc

SEQ ID NO: 207944 - DNA, 20 bp, Artificial Sequence
  chemically synthesized
tttagaactaacagtatgca

SEQ ID NO: 207945 - DNA, 20 bp, Artificial Sequence
  chemically synthesized
cagtatgcaaggcactgtgc

SEQ ID NO: 207946 - DNA, 20 bp, Artificial Sequence
  chemically synthesized
tctcccattagcagccagca

SEQ ID NO: 207947 - DNA, 20 bp, Artificial Sequence
  chemically synthesized
ttgtgtctcccattagcagc

SEQ ID NO: 207948 - DNA, 20 bp, Artificial Sequence
  chemically synthesized
ggcactgtgctggctgctaa

SEQ ID NO: 207949 - DNA, 20 bp, Artificial Sequence
  chemically synthesized
gcactgtgctggctgctaat

SEQ ID NO: 207950 - DNA, 20 bp, Artificial Sequence
  chemically synthesized
actgtgctggctgctaatgg

SEQ ID NO: 207951 - DNA, 20 bp, Artificial Sequence
  chemically synthesized
tcctttgtgtctcccattag

SEQ ID NO: 207952 - DNA, 20 bp, Artificial Sequence
  chemically synthesized
cattcctttgtgtctcccat

SEQ ID NO: 207953 - DNA, 20 bp, Artificial Sequence
  chemically synthesized
ggctgctaatgggagacaca

SEQ ID NO: 207954 - DNA, 20 bp, Artificial Sequence
  chemically synthesized
gctgctaatgggagacacaa

SEQ ID NO: 207955 - DNA, 20 bp, Artificial Sequence
  chemically synthesized
gggagacacaaaggaatgca

SEQ ID NO: 207956 - DNA, 20 bp, Artificial Sequence
  chemically synthesized
aatgcaaagtcatgaccctc

SEQ ID NO: 207957 - DNA, 20 bp, Artificial Sequence
  chemically synthesized
tgcaaagtcatgaccctcca

SEQ ID NO: 207958 - DNA, 20 bp, Artificial Sequence
  chemically synthesized
gcaaagtcatgaccctccag

SEQ ID NO: 207959 - DNA, 20 bp, Artificial Sequence
  chemically synthesized
tgaggttataatcctctgga

SEQ ID NO: 207960 - DNA, 20 bp, Artificial Sequence
  chemically synthesized
ctgaggttataatcctctgg

SEQ ID NO: 207961 - DNA, 20 bp, Artificial Sequence
  chemically synthesized
gctgaggttataatcctctg

SEQ ID NO: 207962 - DNA, 20 bp, Artificial Sequence
  chemically synthesized
ccgctgaggttataatcctc

SEQ ID NO: 207963 - DNA, 20 bp, Artificial Sequence
  chemically synthesized
cctccagaggattataacct

SEQ ID NO: 207964 - DNA, 20 bp, Artificial Sequence
  chemically synthesized
ccagaggattataacctcag

SEQ ID NO: 207965 - DNA, 20 bp, Artificial Sequence
  chemically synthesized
aggattataacctcagcgga

SEQ ID NO: 207966 - DNA, 20 bp, Artificial Sequence
  chemically synthesized
acctgtctgtctttccgctg

SEQ ID NO: 207967 - DNA, 20 bp, Artificial Sequence
  chemically synthesized
cacctgtctgtctttccgct

SEQ ID NO: 207968 - DNA, 20 bp, Artificial Sequence
  chemically synthesized
ttataacctcagcggaaaga

SEQ ID NO: 207969 - DNA, 20 bp, Artificial Sequence
  chemically synthesized
aacctcagcggaaagacaga

SEQ ID NO: 207970 - DNA, 20 bp, Artificial Sequence
  chemically synthesized
acctcagcggaaagacagac

SEQ ID NO: 207971 - DNA, 20 bp, Artificial Sequence
  chemically synthesized
ggaaagacagacaggtgtac

SEQ ID NO: 207972 - DNA, 20 bp, Artificial Sequence
  chemically synthesized
aagacagacaggtgtacaag

SEQ ID NO: 207973 - DNA, 20 bp, Artificial Sequence
  chemically synthesized
tgtacaagcagctatgatac

SEQ ID NO: 207974 - DNA, 20 bp, Artificial Sequence
  chemically synthesized
gtacaagcagctatgataca

SEQ ID NO: 207975 - DNA, 20 bp, Artificial Sequence
  chemically synthesized
cctccatttgccttgtatca

SEQ ID NO: 207976 - DNA, 20 bp, Artificial Sequence
  chemically synthesized
cagctatgatacaaggcaaa

SEQ ID NO: 207977 - DNA, 20 bp, Artificial Sequence
  chemically synthesized
gctatgatacaaggcaaatg

SEQ ID NO: 207978 - DNA, 20 bp, Artificial Sequence
  chemically synthesized
ctatgatacaaggcaaatgg

SEQ ID NO: 207979 - DNA, 20 bp, Artificial Sequence
  chemically synthesized
aaatggaggtaatgctttaa

SEQ ID NO: 207980 - DNA, 20 bp, Artificial Sequence
  chemically synthesized
atggaggtaatgctttaaaa

SEQ ID NO: 207981 - DNA, 20 bp, Artificial Sequence
  chemically synthesized
tcccctgtctagctctttta

SEQ ID NO: 207982 - DNA, 20 bp, Artificial Sequence
  chemically synthesized
aggtaatgctttaaaagagc

SEQ ID NO: 207983 - DNA, 20 bp, Artificial Sequence
  chemically synthesized
aatgctttaaaagagctaga

SEQ ID NO: 207984 - DNA, 20 bp, Artificial Sequence
  chemically synthesized
atgctttaaaagagctagac

SEQ ID NO: 207985 - DNA, 20 bp, Artificial Sequence
  chemically synthesized
tgctttaaaagagctagaca

SEQ ID NO: 207986 - DNA, 20 bp, Artificial Sequence
  chemically synthesized
gctttaaaagagctagacag

SEQ ID NO: 207987 - DNA, 20 bp, Artificial Sequence
  chemically synthesized
taacatctccttcccctgtc

SEQ ID NO: 207988 - DNA, 20 bp, Artificial Sequence
  chemically synthesized
ttaaaagagctagacagggg

SEQ ID NO: 207989 - DNA, 20 bp, Artificial Sequence
  chemically synthesized
taaaagagctagacagggga

SEQ ID NO: 207990 - DNA, 20 bp, Artificial Sequence
  chemically synthesized
aaagagctagacaggggaag

SEQ ID NO: 207991 - DNA, 20 bp, Artificial Sequence
  chemically synthesized
ggggaaggagatgttacctc

SEQ ID NO: 207992 - DNA, 20 bp, Artificial Sequence
  chemically synthesized
gaaggagatgttacctctag

SEQ ID NO: 207993 - DNA, 20 bp, Artificial Sequence
  chemically synthesized
aaggagatgttacctctagt

SEQ ID NO: 207994 - DNA, 20 bp, Artificial Sequence
  chemically synthesized
catctaaaatttcccactag

SEQ ID NO: 207995 - DNA, 20 bp, Artificial Sequence
  chemically synthesized
tcatctaaaatttcccacta

SEQ ID NO: 207996 - DNA, 20 bp, Artificial Sequence
  chemically synthesized
agtcatctaaaatttcccac

SEQ ID NO: 207997 - DNA, 20 bp, Artificial Sequence
  chemically synthesized
ttacctctagtgggaaattt

SEQ ID NO: 207998 - DNA, 20 bp, Artificial Sequence
  chemically synthesized
cagagcacaacattgtcatg

SEQ ID NO: 207999 - DNA, 20 bp, Artificial Sequence
  chemically synthesized
ttcatgacaatgttgtgctc

SEQ ID NO: 208000 - DNA, 20 bp, Artificial Sequence
  chemically synthesized
ttatgtttcctttatggcca

SEQ ID NO: 208001 - DNA, 20 bp, Artificial Sequence
  chemically synthesized
aatgttgtgctctggccata

SEQ ID NO: 208002 - DNA, 20 bp, Artificial Sequence
  chemically synthesized
atgttgtgctctggccataa

SEQ ID NO: 208003 - DNA, 20 bp, Artificial Sequence
  chemically synthesized
tcttatgtttcctttatggc

SEQ ID NO: 208004 - DNA, 20 bp, Artificial Sequence
  chemically synthesized
gaagtcttatgtttccttta

SEQ ID NO: 208005 - DNA, 20 bp, Artificial Sequence
  chemically synthesized
tctggccataaaggaaacat

SEQ ID NO: 208006 - DNA, 20 bp, Artificial Sequence
  chemically synthesized
aaagaaagaaagaaaaaaag

SEQ ID NO: 208007 - DNA, 20 bp, Artificial Sequence
  chemically synthesized
aaaaaagaaagaaagaaaaa

SEQ ID NO: 208008 - DNA, 20 bp, Artificial Sequence
  chemically synthesized
aaaaaaaaaaaaaagaaaga

SEQ ID NO: 208009 - DNA, 20 bp, Artificial Sequence
  chemically synthesized
tctcaaaaaaaaaaaaaaga

SEQ ID NO: 208010 - DNA, 20 bp, Artificial Sequence
  chemically synthesized
tctgtctcaaaaaaaaaaaa

SEQ ID NO: 208011 - DNA, 20 bp, Artificial Sequence
  chemically synthesized
tctttctttttttttttttt

SEQ ID NO: 208012 - DNA, 20 bp, Artificial Sequence
  chemically synthesized
tcttttttttttttttgaga

SEQ ID NO: 208013 - DNA, 20 bp, Artificial Sequence
  chemically synthesized
ttttttttttttttgagaca

SEQ ID NO: 208014 - DNA, 20 bp, Artificial Sequence
  chemically synthesized
tccagcctgggtgacagagc

SEQ ID NO: 208015 - DNA, 20 bp, Artificial Sequence
  chemically synthesized
cagagtctcgctctgtcacc

SEQ ID NO: 208016 - DNA, 20 bp, Artificial Sequence
  chemically synthesized
ccactccagcctgggtgaca

SEQ ID NO: 208017 - DNA, 20 bp, Artificial Sequence
  chemically synthesized
agagtctcgctctgtcaccc

SEQ ID NO: 208018 - DNA, 20 bp, Artificial Sequence
  chemically synthesized
ctccactccagcctgggtga

SEQ ID NO: 208019 - DNA, 20 bp, Artificial Sequence
  chemically synthesized
tctcgctctgtcacccaggc

SEQ ID NO: 208020 - DNA, 20 bp, Artificial Sequence
  chemically synthesized
tcgctctgtcacccaggctg

SEQ ID NO: 208021 - DNA, 20 bp, Artificial Sequence
  chemically synthesized
acgacactccactccagcct

SEQ ID NO: 208022 - DNA, 20 bp, Artificial Sequence
  chemically synthesized
cacgacactccactccagcc

SEQ ID NO: 208023 - DNA, 20 bp, Artificial Sequence
  chemically synthesized
ctctgtcacccaggctggag

SEQ ID NO: 208024 - DNA, 20 bp, Artificial Sequence
  chemically synthesized
ctgtcacccaggctggagtg

SEQ ID NO: 208025 - DNA, 20 bp, Artificial Sequence
  chemically synthesized
gagatcacgacactccactc

SEQ ID NO: 208026 - DNA, 20 bp, Artificial Sequence
  chemically synthesized
ggagtggagtgtcgtgatct

SEQ ID NO: 208027 - DNA, 20 bp, Artificial Sequence
  chemically synthesized
ggtggagcttgcagtgagct

SEQ ID NO: 208028 - DNA, 20 bp, Artificial Sequence
  chemically synthesized
tcgtgatctcagctcactgc

SEQ ID NO: 208029 - DNA, 20 bp, Artificial Sequence
  chemically synthesized
cgggaggtggagcttgcagt

SEQ ID NO: 208030 - DNA, 20 bp, Artificial Sequence
  chemically synthesized
aacccgggaggtggagcttg

SEQ ID NO: 208031 - DNA, 20 bp, Artificial Sequence
  chemically synthesized
tcactgcaagctccacctcc

SEQ ID NO: 208032 - DNA, 20 bp, Artificial Sequence
  chemically synthesized
tggtgtgaacccgggaggtg

SEQ ID NO: 208033 - DNA, 20 bp, Artificial Sequence
  chemically synthesized
cactgcaagctccacctccc

SEQ ID NO: 208034 - DNA, 20 bp, Artificial Sequence
  chemically synthesized
aatggtgtgaacccgggagg

SEQ ID NO: 208035 - DNA, 20 bp, Artificial Sequence
  chemically synthesized
gaaaatggtgtgaacccggg

SEQ ID NO: 208036 - DNA, 20 bp, Artificial Sequence
  chemically synthesized
ggaaaatggtgtgaacccgg

SEQ ID NO: 208037 - DNA, 20 bp, Artificial Sequence
  chemically synthesized
caggaaaatggtgtgaaccc

SEQ ID NO: 208038 - DNA, 20 bp, Artificial Sequence
  chemically synthesized
gcaggaaaatggtgtgaacc

SEQ ID NO: 208039 - DNA, 20 bp, Artificial Sequence
  chemically synthesized
gggaggctgaggcaggaaaa

SEQ ID NO: 208040 - DNA, 20 bp, Artificial Sequence
  chemically synthesized
ttcacaccattttcctgcct

SEQ ID NO: 208041 - DNA, 20 bp, Artificial Sequence
  chemically synthesized
gctactcgggaggctgaggc

SEQ ID NO: 208042 - DNA, 20 bp, Artificial Sequence
  chemically synthesized
agctactcgggaggctgagg

SEQ ID NO: 208043 - DNA, 20 bp, Artificial Sequence
  chemically synthesized
cccagctactcgggaggctg

SEQ ID NO: 208044 - DNA, 20 bp, Artificial Sequence
  chemically synthesized
tcccagctactcgggaggct

SEQ ID NO: 208045 - DNA, 20 bp, Artificial Sequence
  chemically synthesized
ttttcctgcctcagcctccc

SEQ ID NO: 208046 - DNA, 20 bp, Artificial Sequence
  chemically synthesized
tcctgcctcagcctcccgag

SEQ ID NO: 208047 - DNA, 20 bp, Artificial Sequence
  chemically synthesized
tgtagtcccagctactcggg

SEQ ID NO: 208048 - DNA, 20 bp, Artificial Sequence
  chemically synthesized
ctgtagtcccagctactcgg

SEQ ID NO: 208049 - DNA, 20 bp, Artificial Sequence
  chemically synthesized
gcctcagcctcccgagtagc

SEQ ID NO: 208050 - DNA, 20 bp, Artificial Sequence
  chemically synthesized
gcctgtagtcccagctactc

SEQ ID NO: 208051 - DNA, 20 bp, Artificial Sequence
  chemically synthesized
cctcagcctcccgagtagct

SEQ ID NO: 208052 - DNA, 20 bp, Artificial Sequence
  chemically synthesized
cgcctgtagtcccagctact

SEQ ID NO: 208053 - DNA, 20 bp, Artificial Sequence
  chemically synthesized
ctcccgagtagctgggacta

SEQ ID NO: 208054 - DNA, 20 bp, Artificial Sequence
  chemically synthesized
tcccgagtagctgggactac

SEQ ID NO: 208055 - DNA, 20 bp, Artificial Sequence
  chemically synthesized
ctggcaggcgcctgtagtcc

SEQ ID NO: 208056 - DNA, 20 bp, Artificial Sequence
  chemically synthesized
ggcgtgctggcaggcgcctg

SEQ ID NO: 208057 - DNA, 20 bp, Artificial Sequence
  chemically synthesized
ctgggactacaggcgcctgc

SEQ ID NO: 208058 - DNA, 20 bp, Artificial Sequence
  chemically synthesized
aattagccgggcgtgctggc

SEQ ID NO: 208059 - DNA, 20 bp, Artificial Sequence
  chemically synthesized
aaattagccgggcgtgctgg

SEQ ID NO: 208060 - DNA, 20 bp, Artificial Sequence
  chemically synthesized
caggcgcctgccagcacgcc

SEQ ID NO: 208061 - DNA, 20 bp, Artificial Sequence
  chemically synthesized
aaaaaattagccgggcgtgc

SEQ ID NO: 208062 - DNA, 20 bp, Artificial Sequence
  chemically synthesized
aaaaatataaaaaattagcc

SEQ ID NO: 208063 - DNA, 20 bp, Artificial Sequence
  chemically synthesized
taaaaatataaaaaattagc

SEQ ID NO: 208064 - DNA, 20 bp, Artificial Sequence
  chemically synthesized
ctactaaaaatataaaaaat

SEQ ID NO: 208065 - DNA, 20 bp, Artificial Sequence
  chemically synthesized
cggctaattttttatatttt

SEQ ID NO: 208066 - DNA, 20 bp, Artificial Sequence
  chemically synthesized
ctaattttttatatttttag

SEQ ID NO: 208067 - DNA, 20 bp, Artificial Sequence
  chemically synthesized
aattttttatatttttagta

SEQ ID NO: 208068 - DNA, 20 bp, Artificial Sequence
  chemically synthesized
ttttatatttttagtagaga

SEQ ID NO: 208069 - DNA, 20 bp, Artificial Sequence
  chemically synthesized
tttatatttttagtagagat

SEQ ID NO: 208070 - DNA, 20 bp, Artificial Sequence
  chemically synthesized
ttatatttttagtagagatg

SEQ ID NO: 208071 - DNA, 20 bp, Artificial Sequence
  chemically synthesized
gagatggggtttcaccgtgt

SEQ ID NO: 208072 - DNA, 20 bp, Artificial Sequence
  chemically synthesized
tggggtttcaccgtgttagc

SEQ ID NO: 208073 - DNA, 20 bp, Artificial Sequence
  chemically synthesized
cgagaccatcctggctaaca

SEQ ID NO: 208074 - DNA, 20 bp, Artificial Sequence
  chemically synthesized
ggggtttcaccgtgttagcc

SEQ ID NO: 208075 - DNA, 20 bp, Artificial Sequence
  chemically synthesized
tttcaccgtgttagccagga

SEQ ID NO: 208076 - DNA, 20 bp, Artificial Sequence
  chemically synthesized
tcaagagatcgagaccatcc

SEQ ID NO: 208077 - DNA, 20 bp, Artificial Sequence
  chemically synthesized
gatcacatggtcaagagatc

SEQ ID NO: 208078 - DNA, 20 bp, Artificial Sequence
  chemically synthesized
cgggcggatcacatggtcaa

SEQ ID NO: 208079 - DNA, 20 bp, Artificial Sequence
  chemically synthesized
ggcgggcggatcacatggtc

SEQ ID NO: 208080 - DNA, 20 bp, Artificial Sequence
  chemically synthesized
cctgaggcgggcggatcaca

SEQ ID NO: 208081 - DNA, 20 bp, Artificial Sequence
  chemically synthesized
accatgtgatccgcccgcct

SEQ ID NO: 208082 - DNA, 20 bp, Artificial Sequence
  chemically synthesized
ctttgggagcctgaggcggg

SEQ ID NO: 208083 - DNA, 20 bp, Artificial Sequence
  chemically synthesized
ccatgtgatccgcccgcctc

SEQ ID NO: 208084 - DNA, 20 bp, Artificial Sequence
  chemically synthesized
gcactttgggagcctgaggc

SEQ ID NO: 208085 - DNA, 20 bp, Artificial Sequence
  chemically synthesized
agcactttgggagcctgagg

SEQ ID NO: 208086 - DNA, 20 bp, Artificial Sequence
  chemically synthesized
cccagcactttgggagcctg

SEQ ID NO: 208087 - DNA, 20 bp, Artificial Sequence
  chemically synthesized
tcccagcactttgggagcct

SEQ ID NO: 208088 - DNA, 20 bp, Artificial Sequence
  chemically synthesized
ccgcccgcctcaggctccca

SEQ ID NO: 208089 - DNA, 20 bp, Artificial Sequence
  chemically synthesized
ctgtaatcccagcactttgg

SEQ ID NO: 208090 - DNA, 20 bp, Artificial Sequence
  chemically synthesized
gcctcaggctcccaaagtgc

SEQ ID NO: 208091 - DNA, 20 bp, Artificial Sequence
  chemically synthesized
gcctgtaatcccagcacttt

SEQ ID NO: 208092 - DNA, 20 bp, Artificial Sequence
  chemically synthesized
cctcaggctcccaaagtgct

SEQ ID NO: 208093 - DNA, 20 bp, Artificial Sequence
  chemically synthesized
cgcctgtaatcccagcactt

SEQ ID NO: 208094 - DNA, 20 bp, Artificial Sequence
  chemically synthesized
ctcccaaagtgctgggatta

SEQ ID NO: 208095 - DNA, 20 bp, Artificial Sequence
  chemically synthesized
tcccaaagtgctgggattac

SEQ ID NO: 208096 - DNA, 20 bp, Artificial Sequence
  chemically synthesized
gtggctcacgcctgtaatcc

SEQ ID NO: 208097 - DNA, 20 bp, Artificial Sequence
  chemically synthesized
agtgctgggattacaggcgt

SEQ ID NO: 208098 - DNA, 20 bp, Artificial Sequence
  chemically synthesized
caggcgtgagccaccctgcc

SEQ ID NO: 208099 - DNA, 20 bp, Artificial Sequence
  chemically synthesized
atcttatgggccgggcaggg

SEQ ID NO: 208100 - DNA, 20 bp, Artificial Sequence
  chemically synthesized
gaaatcttatgggccgggca

SEQ ID NO: 208101 - DNA, 20 bp, Artificial Sequence
  chemically synthesized
agaaatcttatgggccgggc

SEQ ID NO: 208102 - DNA, 20 bp, Artificial Sequence
  chemically synthesized
aagaaatcttatgggccggg

SEQ ID NO: 208103 - DNA, 20 bp, Artificial Sequence
  chemically synthesized
agccaccctgcccggcccat

SEQ ID NO: 208104 - DNA, 20 bp, Artificial Sequence
  chemically synthesized
ttaaagaaatcttatgggcc

SEQ ID NO: 208105 - DNA, 20 bp, Artificial Sequence
  chemically synthesized
attaaagaaatcttatgggc

SEQ ID NO: 208106 - DNA, 20 bp, Artificial Sequence
  chemically synthesized
tcttattaaagaaatcttat

SEQ ID NO: 208107 - DNA, 20 bp, Artificial Sequence
  chemically synthesized
ctcttattaaagaaatctta

SEQ ID NO: 208108 - DNA, 20 bp, Artificial Sequence
  chemically synthesized
gcccataagatttctttaat

SEQ ID NO: 208109 - DNA, 20 bp, Artificial Sequence
  chemically synthesized
ccataagatttctttaataa

SEQ ID NO: 208110 - DNA, 20 bp, Artificial Sequence
  chemically synthesized
ctttgctgcatctcttatta

SEQ ID NO: 208111 - DNA, 20 bp, Artificial Sequence
  chemically synthesized
gatttctttaataagagatg

SEQ ID NO: 208112 - DNA, 20 bp, Artificial Sequence
  chemically synthesized
ctttaataagagatgcagca

SEQ ID NO: 208113 - DNA, 20 bp, Artificial Sequence
  chemically synthesized
agatgcagcaaagaacattc

SEQ ID NO: 208114 - DNA, 20 bp, Artificial Sequence
  chemically synthesized
gatgcagcaaagaacattct

SEQ ID NO: 208115 - DNA, 20 bp, Artificial Sequence
  chemically synthesized
gcagcaaagaacattctagg

SEQ ID NO: 208116 - DNA, 20 bp, Artificial Sequence
  chemically synthesized
ataatgtaataatgtcttcc

SEQ ID NO: 208117 - DNA, 20 bp, Artificial Sequence
  chemically synthesized
aggaagacattattacatta

SEQ ID NO: 208118 - DNA, 20 bp, Artificial Sequence
  chemically synthesized
gaagacattattacattata

SEQ ID NO: 208119 - DNA, 20 bp, Artificial Sequence
  chemically synthesized
aagacattattacattatag

SEQ ID NO: 208120 - DNA, 20 bp, Artificial Sequence
  chemically synthesized
ttattacattatagaggcat

SEQ ID NO: 208121 - DNA, 20 bp, Artificial Sequence
  chemically synthesized
attacattatagaggcatga

SEQ ID NO: 208122 - DNA, 20 bp, Artificial Sequence
  chemically synthesized
ttacattatagaggcatgag

SEQ ID NO: 208123 - DNA, 20 bp, Artificial Sequence
  chemically synthesized
tacattatagaggcatgaga

SEQ ID NO: 208124 - DNA, 20 bp, Artificial Sequence
  chemically synthesized
tatagaggcatgagagggta

SEQ ID NO: 208125 - DNA, 20 bp, Artificial Sequence
  chemically synthesized
aatctgagagtgaggcagac

SEQ ID NO: 208126 - DNA, 20 bp, Artificial Sequence
  chemically synthesized
ttatgaatctgagagtgagg

SEQ ID NO: 208127 - DNA, 20 bp, Artificial Sequence
  chemically synthesized
agtcttgtctgcctcactct

SEQ ID NO: 208128 - DNA, 20 bp, Artificial Sequence
  chemically synthesized
ggtttatgaatctgagagtg

SEQ ID NO: 208129 - DNA, 20 bp, Artificial Sequence
  chemically synthesized
tggtttatgaatctgagagt

SEQ ID NO: 208130 - DNA, 20 bp, Artificial Sequence
  chemically synthesized
cccatggtttatgaatctga

SEQ ID NO: 208131 - DNA, 20 bp, Artificial Sequence
  chemically synthesized
ctcccatggtttatgaatct

SEQ ID NO: 208132 - DNA, 20 bp, Artificial Sequence
  chemically synthesized
actctcagattcataaacca

SEQ ID NO: 208133 - DNA, 20 bp, Artificial Sequence
  chemically synthesized
ctctcagattcataaaccat

SEQ ID NO: 208134 - DNA, 20 bp, Artificial Sequence
  chemically synthesized
ctcagattcataaaccatgg

SEQ ID NO: 208135 - DNA, 20 bp, Artificial Sequence
  chemically synthesized
tcagattcataaaccatggg

SEQ ID NO: 208136 - DNA, 20 bp, Artificial Sequence
  chemically synthesized
cagattcataaaccatggga

SEQ ID NO: 208137 - DNA, 20 bp, Artificial Sequence
  chemically synthesized
agattcataaaccatgggag

SEQ ID NO: 208138 - DNA, 20 bp, Artificial Sequence
  chemically synthesized
agattcctaggcccctccca

SEQ ID NO: 208139 - DNA, 20 bp, Artificial Sequence
  chemically synthesized
cataaaccatgggaggggcc

SEQ ID NO: 208140 - DNA, 20 bp, Artificial Sequence
  chemically synthesized
ataaaccatgggaggggcct

SEQ ID NO: 208141 - DNA, 20 bp, Artificial Sequence
  chemically synthesized
tgttaataatgcagattcct

SEQ ID NO: 208142 - DNA, 20 bp, Artificial Sequence
  chemically synthesized
ttgttaataatgcagattcc

SEQ ID NO: 208143 - DNA, 20 bp, Artificial Sequence
  chemically synthesized
tagggagcttgttaataatg

SEQ ID NO: 208144 - DNA, 20 bp, Artificial Sequence
  chemically synthesized
taggaatctgcattattaac

SEQ ID NO: 208145 - DNA, 20 bp, Artificial Sequence
  chemically synthesized
tgcattattaacaagctccc

SEQ ID NO: 208146 - DNA, 20 bp, Artificial Sequence
  chemically synthesized
gcattattaacaagctccct

SEQ ID NO: 208147 - DNA, 20 bp, Artificial Sequence
  chemically synthesized
attattaacaagctccctag

SEQ ID NO: 208148 - DNA, 20 bp, Artificial Sequence
  chemically synthesized
ctccatcagaatctcctagg

SEQ ID NO: 208149 - DNA, 20 bp, Artificial Sequence
  chemically synthesized
ccctccatcagaatctccta

SEQ ID NO: 208150 - DNA, 20 bp, Artificial Sequence
  chemically synthesized
cccctccatcagaatctcct

SEQ ID NO: 208151 - DNA, 20 bp, Artificial Sequence
  chemically synthesized
acccctccatcagaatctcc

SEQ ID NO: 208152 - DNA, 20 bp, Artificial Sequence
  chemically synthesized
agctccctaggagattctga

SEQ ID NO: 208153 - DNA, 20 bp, Artificial Sequence
  chemically synthesized
ctccctaggagattctgatg

SEQ ID NO: 208154 - DNA, 20 bp, Artificial Sequence
  chemically synthesized
tccctaggagattctgatgg

SEQ ID NO: 208155 - DNA, 20 bp, Artificial Sequence
  chemically synthesized
ccctaggagattctgatgga

SEQ ID NO: 208156 - DNA, 20 bp, Artificial Sequence
  chemically synthesized
cctaggagattctgatggag

SEQ ID NO: 208157 - DNA, 20 bp, Artificial Sequence
  chemically synthesized
agtttgcagaacccctccat

SEQ ID NO: 208158 - DNA, 20 bp, Artificial Sequence
  chemically synthesized
cagtcttagagtgcagtttg

SEQ ID NO: 208159 - DNA, 20 bp, Artificial Sequence
  chemically synthesized
ggttctgcaaactgcactct

SEQ ID NO: 208160 - DNA, 20 bp, Artificial Sequence
  chemically synthesized
tctatatcagtcttagagtg

SEQ ID NO: 208161 - DNA, 20 bp, Artificial Sequence
  chemically synthesized
gatattctatatcagtctta

SEQ ID NO: 208162 - DNA, 20 bp, Artificial Sequence
  chemically synthesized
tagatattctatatcagtct

SEQ ID NO: 208163 - DNA, 20 bp, Artificial Sequence
  chemically synthesized
actgcactctaagactgata

SEQ ID NO: 208164 - DNA, 20 bp, Artificial Sequence
  chemically synthesized
tcttggtagatattctatat

SEQ ID NO: 208165 - DNA, 20 bp, Artificial Sequence
  chemically synthesized
actgatatagaatatctacc

SEQ ID NO: 208166 - DNA, 20 bp, Artificial Sequence
  chemically synthesized
ttccctactctatttcttgg

SEQ ID NO: 208167 - DNA, 20 bp, Artificial Sequence
  chemically synthesized
atagaatatctaccaagaaa

SEQ ID NO: 208168 - DNA, 20 bp, Artificial Sequence
  chemically synthesized
agaatatctaccaagaaata

SEQ ID NO: 208169 - DNA, 20 bp, Artificial Sequence
  chemically synthesized
ctcttccctactctatttct

SEQ ID NO: 208170 - DNA, 20 bp, Artificial Sequence
  chemically synthesized
atatctaccaagaaatagag

SEQ ID NO: 208171 - DNA, 20 bp, Artificial Sequence
  chemically synthesized
tatctaccaagaaatagagt

SEQ ID NO: 208172 - DNA, 20 bp, Artificial Sequence
  chemically synthesized
atctaccaagaaatagagta

SEQ ID NO: 208173 - DNA, 20 bp, Artificial Sequence
  chemically synthesized
taccaagaaatagagtaggg

SEQ ID NO: 208174 - DNA, 20 bp, Artificial Sequence
  chemically synthesized
ccaagaaatagagtagggaa

SEQ ID NO: 208175 - DNA, 20 bp, Artificial Sequence
  chemically synthesized
agaaatagagtagggaagag

SEQ ID NO: 208176 - DNA, 20 bp, Artificial Sequence
  chemically synthesized
gaaatagagtagggaagagc

SEQ ID NO: 208177 - DNA, 20 bp, Artificial Sequence
  chemically synthesized
gagtagggaagagcaggaac

SEQ ID NO: 208178 - DNA, 20 bp, Artificial Sequence
  chemically synthesized
agtagggaagagcaggaaca

SEQ ID NO: 208179 - DNA, 20 bp, Artificial Sequence
  chemically synthesized
ggaagagcaggaacaaggta

SEQ ID NO: 208180 - DNA, 20 bp, Artificial Sequence
  chemically synthesized
aggaacaaggtatagtgtga

SEQ ID NO: 208181 - DNA, 20 bp, Artificial Sequence
  chemically synthesized
aaggtatagtgtgaaagcta

SEQ ID NO: 208182 - DNA, 20 bp, Artificial Sequence
  chemically synthesized
aggtatagtgtgaaagctat

SEQ ID NO: 208183 - DNA, 20 bp, Artificial Sequence
  chemically synthesized
ttttattatcatcaagccta

SEQ ID NO: 208184 - DNA, 20 bp, Artificial Sequence
  chemically synthesized
tttctcattttattatcatc

SEQ ID NO: 208185 - DNA, 20 bp, Artificial Sequence
  chemically synthesized
aggcttgatgataataaaat

SEQ ID NO: 208186 - DNA, 20 bp, Artificial Sequence
  chemically synthesized
ttgatgataataaaatgaga

SEQ ID NO: 208187 - DNA, 20 bp, Artificial Sequence
  chemically synthesized
tgataataaaatgagaaagc

SEQ ID NO: 208188 - DNA, 20 bp, Artificial Sequence
  chemically synthesized
taaaatgagaaagcaagtct

SEQ ID NO: 208189 - DNA, 20 bp, Artificial Sequence
  chemically synthesized
agaaagcaagtctaagcttg

SEQ ID NO: 208190 - DNA, 20 bp, Artificial Sequence
  chemically synthesized
ttgactctttgccacaagct

SEQ ID NO: 208191 - DNA, 20 bp, Artificial Sequence
  chemically synthesized
gcaagtctaagcttgtggca

SEQ ID NO: 208192 - DNA, 20 bp, Artificial Sequence
  chemically synthesized
ttacattgactctttgccac

SEQ ID NO: 208193 - DNA, 20 bp, Artificial Sequence
  chemically synthesized
aagtctaagcttgtggcaaa

SEQ ID NO: 208194 - DNA, 20 bp, Artificial Sequence
  chemically synthesized
caaagagtcaatgtaatttt

SEQ ID NO: 208195 - DNA, 20 bp, Artificial Sequence
  chemically synthesized
gtcaatgtaattttcagtgt

SEQ ID NO: 208196 - DNA, 20 bp, Artificial Sequence
  chemically synthesized
tcaatgtaattttcagtgta

SEQ ID NO: 208197 - DNA, 20 bp, Artificial Sequence
  chemically synthesized
aattttcagtgtaaggcaat

SEQ ID NO: 208198 - DNA, 20 bp, Artificial Sequence
  chemically synthesized
tatataacattgtcatagca

SEQ ID NO: 208199 - DNA, 20 bp, Artificial Sequence
  chemically synthesized
atatataacattgtcatagc

SEQ ID NO: 208200 - DNA, 20 bp, Artificial Sequence
  chemically synthesized
gtaaatatataacattgtca

SEQ ID NO: 208201 - DNA, 20 bp, Artificial Sequence
  chemically synthesized
caatgttatatatttacaat

SEQ ID NO: 208202 - DNA, 20 bp, Artificial Sequence
  chemically synthesized
aatgttatatatttacaatt

SEQ ID NO: 208203 - DNA, 20 bp, Artificial Sequence
  chemically synthesized
atatttacaattaggtgaaa

SEQ ID NO: 208204 - DNA, 20 bp, Artificial Sequence
  chemically synthesized
gtttttgaattttatgcaaa

SEQ ID NO: 208205 - DNA, 20 bp, Artificial Sequence
  chemically synthesized
tttgcataaaattcaaaaac

SEQ ID NO: 208206 - DNA, 20 bp, Artificial Sequence
  chemically synthesized
ataccatagattaattttgc

SEQ ID NO: 208207 - DNA, 20 bp, Artificial Sequence
  chemically synthesized
aaactggcaaaattaatcta

SEQ ID NO: 208208 - DNA, 20 bp, Artificial Sequence
  chemically synthesized
gcaaaattaatctatggtat

SEQ ID NO: 208209 - DNA, 20 bp, Artificial Sequence
  chemically synthesized
tatcgtgatttctaatacca

SEQ ID NO: 208210 - DNA, 20 bp, Artificial Sequence
  chemically synthesized
atcacgataatgcttatcca

SEQ ID NO: 208211 - DNA, 20 bp, Artificial Sequence
  chemically synthesized
tcacgataatgcttatccat

SEQ ID NO: 208212 - DNA, 20 bp, Artificial Sequence
  chemically synthesized
cacgataatgcttatccatg

SEQ ID NO: 208213 - DNA, 20 bp, Artificial Sequence
  chemically synthesized
tccgtgctacccccatggat

SEQ ID NO: 208214 - DNA, 20 bp, Artificial Sequence
  chemically synthesized
acgataatgcttatccatgg

SEQ ID NO: 208215 - DNA, 20 bp, Artificial Sequence
  chemically synthesized
ataatgcttatccatggggg

SEQ ID NO: 208216 - DNA, 20 bp, Artificial Sequence
  chemically synthesized
gtctctccgtgctaccccca

SEQ ID NO: 208217 - DNA, 20 bp, Artificial Sequence
  chemically synthesized
gcttatccatgggggtagca

SEQ ID NO: 208218 - DNA, 20 bp, Artificial Sequence
  chemically synthesized
ttatccatgggggtagcacg

SEQ ID NO: 208219 - DNA, 20 bp, Artificial Sequence
  chemically synthesized
atccatgggggtagcacgga

SEQ ID NO: 208220 - DNA, 20 bp, Artificial Sequence
  chemically synthesized
ggtagcacggagagactgaa

SEQ ID NO: 208221 - DNA, 20 bp, Artificial Sequence
  chemically synthesized
gtagcacggagagactgaaa

SEQ ID NO: 208222 - DNA, 20 bp, Artificial Sequence
  chemically synthesized
tagcacggagagactgaaaa

SEQ ID NO: 208223 - DNA, 20 bp, Artificial Sequence
  chemically synthesized
agcacggagagactgaaaag

SEQ ID NO: 208224 - DNA, 20 bp, Artificial Sequence
  chemically synthesized
ggcccccttctgcccctttt

SEQ ID NO: 208225 - DNA, 20 bp, Artificial Sequence
  chemically synthesized
acggagagactgaaaagggg

SEQ ID NO: 208226 - DNA, 20 bp, Artificial Sequence
  chemically synthesized
gagagactgaaaaggggcag

SEQ ID NO: 208227 - DNA, 20 bp, Artificial Sequence
  chemically synthesized
agagactgaaaaggggcaga

SEQ ID NO: 208228 - DNA, 20 bp, Artificial Sequence
  chemically synthesized
gagactgaaaaggggcagaa

SEQ ID NO: 208229 - DNA, 20 bp, Artificial Sequence
  chemically synthesized
agactgaaaaggggcagaag

SEQ ID NO: 208230 - DNA, 20 bp, Artificial Sequence
  chemically synthesized
gactgaaaaggggcagaagg

SEQ ID NO: 208231 - DNA, 20 bp, Artificial Sequence
  chemically synthesized
aggggcagaagggggcctct

SEQ ID NO: 208232 - DNA, 20 bp, Artificial Sequence
  chemically synthesized
ggggcagaagggggcctctg

SEQ ID NO: 208233 - DNA, 20 bp, Artificial Sequence
  chemically synthesized
gaaccttgatgatacctcag

SEQ ID NO: 208234 - DNA, 20 bp, Artificial Sequence
  chemically synthesized
agaaccttgatgatacctca

SEQ ID NO: 208235 - DNA, 20 bp, Artificial Sequence
  chemically synthesized
acagaaccttgatgatacct

SEQ ID NO: 208236 - DNA, 20 bp, Artificial Sequence
  chemically synthesized
ggggcctctgaggtatcatc

SEQ ID NO: 208237 - DNA, 20 bp, Artificial Sequence
  chemically synthesized
gggcctctgaggtatcatca

SEQ ID NO: 208238 - DNA, 20 bp, Artificial Sequence
  chemically synthesized
accagcacttagattaaaaa

SEQ ID NO: 208239 - DNA, 20 bp, Artificial Sequence
  chemically synthesized
caaggttctgtttttaatct

SEQ ID NO: 208240 - DNA, 20 bp, Artificial Sequence
  chemically synthesized
tctgtttttaatctaagtgc

SEQ ID NO: 208241 - DNA, 20 bp, Artificial Sequence
  chemically synthesized
acatccctttaaccagcact

SEQ ID NO: 208242 - DNA, 20 bp, Artificial Sequence
  chemically synthesized
tttaatctaagtgctggtta

SEQ ID NO: 208243 - DNA, 20 bp, Artificial Sequence
  chemically synthesized
ttaatctaagtgctggttaa

SEQ ID NO: 208244 - DNA, 20 bp, Artificial Sequence
  chemically synthesized
taatctaagtgctggttaaa

SEQ ID NO: 208245 - DNA, 20 bp, Artificial Sequence
  chemically synthesized
actgaacacatccctttaac

SEQ ID NO: 208246 - DNA, 20 bp, Artificial Sequence
  chemically synthesized
gctggttaaagggatgtgtt

SEQ ID NO: 208247 - DNA, 20 bp, Artificial Sequence
  chemically synthesized
tcagtttgtgcaaattcatc

SEQ ID NO: 208248 - DNA, 20 bp, Artificial Sequence
  chemically synthesized
gcctaatataaaggtgcagc

SEQ ID NO: 208249 - DNA, 20 bp, Artificial Sequence
  chemically synthesized
gcatgcctaatataaaggtg

SEQ ID NO: 208250 - DNA, 20 bp, Artificial Sequence
  chemically synthesized
atctagctgcacctttatat

SEQ ID NO: 208251 - DNA, 20 bp, Artificial Sequence
  chemically synthesized
tctagctgcacctttatatt

SEQ ID NO: 208252 - DNA, 20 bp, Artificial Sequence
  chemically synthesized
gaaaagcatgcctaatataa

SEQ ID NO: 208253 - DNA, 20 bp, Artificial Sequence
  chemically synthesized
agaaaagcatgcctaatata

SEQ ID NO: 208254 - DNA, 20 bp, Artificial Sequence
  chemically synthesized
tataatatacttcagtagaa

SEQ ID NO: 208255 - DNA, 20 bp, Artificial Sequence
  chemically synthesized
ttaggcatgcttttctactg

SEQ ID NO: 208256 - DNA, 20 bp, Artificial Sequence
  chemically synthesized
tgaagtataatatacttcag

SEQ ID NO: 208257 - DNA, 20 bp, Artificial Sequence
  chemically synthesized
tactgaagtataatatactt

SEQ ID NO: 208258 - DNA, 20 bp, Artificial Sequence
  chemically synthesized
tactgaagtatattatactt

SEQ ID NO: 208259 - DNA, 20 bp, Artificial Sequence
  chemically synthesized
gaagtatattatacttcagt

SEQ ID NO: 208260 - DNA, 20 bp, Artificial Sequence
  chemically synthesized
gtatattatacttcagtaag

SEQ ID NO: 208261 - DNA, 20 bp, Artificial Sequence
  chemically synthesized
atttttataacttcttactg

SEQ ID NO: 208262 - DNA, 20 bp, Artificial Sequence
  chemically synthesized
cagtaagaagttataaaaat

SEQ ID NO: 208263 - DNA, 20 bp, Artificial Sequence
  chemically synthesized
agtaagaagttataaaaatt

SEQ ID NO: 208264 - DNA, 20 bp, Artificial Sequence
  chemically synthesized
gaagttataaaaattaggct

SEQ ID NO: 208265 - DNA, 20 bp, Artificial Sequence
  chemically synthesized
gttataaaaattaggctgag

SEQ ID NO: 208266 - DNA, 20 bp, Artificial Sequence
  chemically synthesized
ttataaaaattaggctgagt

SEQ ID NO: 208267 - DNA, 20 bp, Artificial Sequence
  chemically synthesized
ttagttgaaatacacctact

SEQ ID NO: 208268 - DNA, 20 bp, Artificial Sequence
  chemically synthesized
agtaggtgtatttcaactaa

SEQ ID NO: 208269 - DNA, 20 bp, Artificial Sequence
  chemically synthesized
aattataggatgttttcttt

SEQ ID NO: 208270 - DNA, 20 bp, Artificial Sequence
  chemically synthesized
attaataagataacaattat

SEQ ID NO: 208271 - DNA, 20 bp, Artificial Sequence
  chemically synthesized
gattaataagataacaatta

SEQ ID NO: 208272 - DNA, 20 bp, Artificial Sequence
  chemically synthesized
tgaaattttctgagattaat

SEQ ID NO: 208273 - DNA, 20 bp, Artificial Sequence
  chemically synthesized
aattgttatcttattaatct

SEQ ID NO: 208274 - DNA, 20 bp, Artificial Sequence
  chemically synthesized
aagttattatgaaattttct

SEQ ID NO: 208275 - DNA, 20 bp, Artificial Sequence
  chemically synthesized
agagaattgaaagaggtatt

SEQ ID NO: 208276 - DNA, 20 bp, Artificial Sequence
  chemically synthesized
aactttcagagaattgaaag

SEQ ID NO: 208277 - DNA, 20 bp, Artificial Sequence
  chemically synthesized
taactttcagagaattgaaa

SEQ ID NO: 208278 - DNA, 20 bp, Artificial Sequence
  chemically synthesized
tataactttcagagaattga

SEQ ID NO: 208279 - DNA, 20 bp, Artificial Sequence
  chemically synthesized
tacctctttcaattctctga

SEQ ID NO: 208280 - DNA, 20 bp, Artificial Sequence
  chemically synthesized
tcacatttatataactttca

SEQ ID NO: 208281 - DNA, 20 bp, Artificial Sequence
  chemically synthesized
tatcacatttatataacttt

SEQ ID NO: 208282 - DNA, 20 bp, Artificial Sequence
  chemically synthesized
gttatataaatgtgataaaa

SEQ ID NO: 208283 - DNA, 20 bp, Artificial Sequence
  chemically synthesized
aatgtgataaaatagaatat

SEQ ID NO: 208284 - DNA, 20 bp, Artificial Sequence
  chemically synthesized
tgtgataaaatagaatataa

SEQ ID NO: 208285 - DNA, 20 bp, Artificial Sequence
  chemically synthesized
gtgataaaatagaatataag

SEQ ID NO: 208286 - DNA, 20 bp, Artificial Sequence
  chemically synthesized
gaatgatctgaaaaatgttt

SEQ ID NO: 208287 - DNA, 20 bp, Artificial Sequence
  chemically synthesized
gaatgttctaaaacattttt

SEQ ID NO: 208288 - DNA, 20 bp, Artificial Sequence
  chemically synthesized
catttttcagatcattctaa

SEQ ID NO: 208289 - DNA, 20 bp, Artificial Sequence
  chemically synthesized
atttttcagatcattctaat

SEQ ID NO: 208290 - DNA, 20 bp, Artificial Sequence
  chemically synthesized
tttttcagatcattctaatg

SEQ ID NO: 208291 - DNA, 20 bp, Artificial Sequence
  chemically synthesized
taagaagttattttccccat

SEQ ID NO: 208292 - DNA, 20 bp, Artificial Sequence
  chemically synthesized
atggggaaaataacttctta

SEQ ID NO: 208293 - DNA, 20 bp, Artificial Sequence
  chemically synthesized
gttagcaaggaagctttaag

SEQ ID NO: 208294 - DNA, 20 bp, Artificial Sequence
  chemically synthesized
agtgttagcaaggaagcttt

SEQ ID NO: 208295 - DNA, 20 bp, Artificial Sequence
  chemically synthesized
ggatttaagtgttagcaagg

SEQ ID NO: 208296 - DNA, 20 bp, Artificial Sequence
  chemically synthesized
atgggatttaagtgttagca

SEQ ID NO: 208297 - DNA, 20 bp, Artificial Sequence
  chemically synthesized
gatgggatttaagtgttagc

SEQ ID NO: 208298 - DNA, 20 bp, Artificial Sequence
  chemically synthesized
atctgatgggatttaagtgt

SEQ ID NO: 208299 - DNA, 20 bp, Artificial Sequence
  chemically synthesized
atttcaatctgatgggattt

SEQ ID NO: 208300 - DNA, 20 bp, Artificial Sequence
  chemically synthesized
tgctaacacttaaatcccat

SEQ ID NO: 208301 - DNA, 20 bp, Artificial Sequence
  chemically synthesized
ataagaaatttcaatctgat

SEQ ID NO: 208302 - DNA, 20 bp, Artificial Sequence
  chemically synthesized
aataagaaatttcaatctga

SEQ ID NO: 208303 - DNA, 20 bp, Artificial Sequence
  chemically synthesized
gattgaaatttcttattcta

SEQ ID NO: 208304 - DNA, 20 bp, Artificial Sequence
  chemically synthesized
aaggatggtaactttagaat

SEQ ID NO: 208305 - DNA, 20 bp, Artificial Sequence
  chemically synthesized
agactcaaggatggtaactt

SEQ ID NO: 208306 - DNA, 20 bp, Artificial Sequence
  chemically synthesized
attctaaagttaccatcctt

SEQ ID NO: 208307 - DNA, 20 bp, Artificial Sequence
  chemically synthesized
ataaataatagactcaagga

SEQ ID NO: 208308 - DNA, 20 bp, Artificial Sequence
  chemically synthesized
gaggataaataatagactca

SEQ ID NO: 208309 - DNA, 20 bp, Artificial Sequence
  chemically synthesized
tgaggataaataatagactc

SEQ ID NO: 208310 - DNA, 20 bp, Artificial Sequence
  chemically synthesized
gagacagtgaggataaataa

SEQ ID NO: 208311 - DNA, 20 bp, Artificial Sequence
  chemically synthesized
cacagcaagctgagacagtg

SEQ ID NO: 208312 - DNA, 20 bp, Artificial Sequence
  chemically synthesized
attatttatcctcactgtct

SEQ ID NO: 208313 - DNA, 20 bp, Artificial Sequence
  chemically synthesized
gcacagcaagctgagacagt

SEQ ID NO: 208314 - DNA, 20 bp, Artificial Sequence
  chemically synthesized
aggggcacagcaagctgaga

SEQ ID NO: 208315 - DNA, 20 bp, Artificial Sequence
  chemically synthesized
gtgaaggggcacagcaagct

SEQ ID NO: 208316 - DNA, 20 bp, Artificial Sequence
  chemically synthesized
ttactgtgaaggggcacagc

SEQ ID NO: 208317 - DNA, 20 bp, Artificial Sequence
  chemically synthesized
agttttactgtgaaggggca

SEQ ID NO: 208318 - DNA, 20 bp, Artificial Sequence
  chemically synthesized
cagcttgctgtgccccttca

SEQ ID NO: 208319 - DNA, 20 bp, Artificial Sequence
  chemically synthesized
caagaagttttactgtgaag

SEQ ID NO: 208320 - DNA, 20 bp, Artificial Sequence
  chemically synthesized
tcaagaagttttactgtgaa

SEQ ID NO: 208321 - DNA, 20 bp, Artificial Sequence
  chemically synthesized
ttcaagaagttttactgtga

SEQ ID NO: 208322 - DNA, 20 bp, Artificial Sequence
  chemically synthesized
tttcaagaagttttactgtg

SEQ ID NO: 208323 - DNA, 20 bp, Artificial Sequence
  chemically synthesized
cacagtaaaacttcttgaaa

SEQ ID NO: 208324 - DNA, 20 bp, Artificial Sequence
  chemically synthesized
ttatagacaactttttcaag

SEQ ID NO: 208325 - DNA, 20 bp, Artificial Sequence
  chemically synthesized
agattatagacaactttttc

SEQ ID NO: 208326 - DNA, 20 bp, Artificial Sequence
  chemically synthesized
gaaaatagatacaaagatta

SEQ ID NO: 208327 - DNA, 20 bp, Artificial Sequence
  chemically synthesized
aaggtgggaaaatagataca

SEQ ID NO: 208328 - DNA, 20 bp, Artificial Sequence
  chemically synthesized
aataatataaggtgggaaaa

SEQ ID NO: 208329 - DNA, 20 bp, Artificial Sequence
  chemically synthesized
ctgagtaaataatataaggt

SEQ ID NO: 208330 - DNA, 20 bp, Artificial Sequence
  chemically synthesized
gctgagtaaataatataagg

SEQ ID NO: 208331 - DNA, 20 bp, Artificial Sequence
  chemically synthesized
taggctgagtaaataatata

SEQ ID NO: 208332 - DNA, 20 bp, Artificial Sequence
  chemically synthesized
gtaggctgagtaaataatat

SEQ ID NO: 208333 - DNA, 20 bp, Artificial Sequence
  chemically synthesized
cccaccttatattatttact

SEQ ID NO: 208334 - DNA, 20 bp, Artificial Sequence
  chemically synthesized
aaggtccagaggagtaggct

SEQ ID NO: 208335 - DNA, 20 bp, Artificial Sequence
  chemically synthesized
atttactcagcctactcctc

SEQ ID NO: 208336 - DNA, 20 bp, Artificial Sequence
  chemically synthesized
tatggaaggtccagaggagt

SEQ ID NO: 208337 - DNA, 20 bp, Artificial Sequence
  chemically synthesized
atatggaaggtccagaggag

SEQ ID NO: 208338 - DNA, 20 bp, Artificial Sequence
  chemically synthesized
tggatatggaaggtccagag

SEQ ID NO: 208339 - DNA, 20 bp, Artificial Sequence
  chemically synthesized
gatggatatggaaggtccag

SEQ ID NO: 208340 - DNA, 20 bp, Artificial Sequence
  chemically synthesized
tgatggatatggaaggtcca

SEQ ID NO: 208341 - DNA, 20 bp, Artificial Sequence
  chemically synthesized
aatgatggatatggaaggtc

SEQ ID NO: 208342 - DNA, 20 bp, Artificial Sequence
  chemically synthesized
aacagaatgatggatatgga

SEQ ID NO: 208343 - DNA, 20 bp, Artificial Sequence
  chemically synthesized
gaacagaatgatggatatgg

SEQ ID NO: 208344 - DNA, 20 bp, Artificial Sequence
  chemically synthesized
tttgaacagaatgatggata

SEQ ID NO: 208345 - DNA, 20 bp, Artificial Sequence
  chemically synthesized
gagcaatttgaacagaatga

SEQ ID NO: 208346 - DNA, 20 bp, Artificial Sequence
  chemically synthesized
ctggacaagagcaatttgaa

SEQ ID NO: 208347 - DNA, 20 bp, Artificial Sequence
  chemically synthesized
ctgttcaaattgctcttgtc

SEQ ID NO: 208348 - DNA, 20 bp, Artificial Sequence
  chemically synthesized
ttttttggtgatctggacaa

SEQ ID NO: 208349 - DNA, 20 bp, Artificial Sequence
  chemically synthesized
aattttttggtgatctggac

SEQ ID NO: 208350 - DNA, 20 bp, Artificial Sequence
  chemically synthesized
catataattttttggtgatc

SEQ ID NO: 208351 - DNA, 20 bp, Artificial Sequence
  chemically synthesized
tttggcaacatataattttt

SEQ ID NO: 208352 - DNA, 20 bp, Artificial Sequence
  chemically synthesized
ttatatgttgccaaatccaa

SEQ ID NO: 208353 - DNA, 20 bp, Artificial Sequence
  chemically synthesized
agataagtgactattggatt

SEQ ID NO: 208354 - DNA, 20 bp, Artificial Sequence
  chemically synthesized
atgaaaagataagtgactat

SEQ ID NO: 208355 - DNA, 20 bp, Artificial Sequence
  chemically synthesized
gctcagtataatgaaaagat

SEQ ID NO: 208356 - DNA, 20 bp, Artificial Sequence
  chemically synthesized
gaggggctcagtataatgaa

SEQ ID NO: 208357 - DNA, 20 bp, Artificial Sequence
  chemically synthesized
acttatcttttcattatact

SEQ ID NO: 208358 - DNA, 20 bp, Artificial Sequence
  chemically synthesized
ccagcatgttatgaggggct

SEQ ID NO: 208359 - DNA, 20 bp, Artificial Sequence
  chemically synthesized
aataaccagcatgttatgag

SEQ ID NO: 208360 - DNA, 20 bp, Artificial Sequence
  chemically synthesized
taataaccagcatgttatga

SEQ ID NO: 208361 - DNA, 20 bp, Artificial Sequence
  chemically synthesized
ttaataaccagcatgttatg

SEQ ID NO: 208362 - DNA, 20 bp, Artificial Sequence
  chemically synthesized
attaataaccagcatgttat

SEQ ID NO: 208363 - DNA, 20 bp, Artificial Sequence
  chemically synthesized
ctgagcccctcataacatgc

SEQ ID NO: 208364 - DNA, 20 bp, Artificial Sequence
  chemically synthesized
gggagggagtaattaataac

SEQ ID NO: 208365 - DNA, 20 bp, Artificial Sequence
  chemically synthesized
aaaagagtgttgaagggagg

SEQ ID NO: 208366 - DNA, 20 bp, Artificial Sequence
  chemically synthesized
caaaaagagtgttgaaggga

SEQ ID NO: 208367 - DNA, 20 bp, Artificial Sequence
  chemically synthesized
acaaaaagagtgttgaaggg

SEQ ID NO: 208368 - DNA, 20 bp, Artificial Sequence
  chemically synthesized
tacaaaaagagtgttgaagg

SEQ ID NO: 208369 - DNA, 20 bp, Artificial Sequence
  chemically synthesized
gatacaaaaagagtgttgaa

SEQ ID NO: 208370 - DNA, 20 bp, Artificial Sequence
  chemically synthesized
agatacaaaaagagtgttga

SEQ ID NO: 208371 - DNA, 20 bp, Artificial Sequence
  chemically synthesized
aagatacaaaaagagtgttg

SEQ ID NO: 208372 - DNA, 20 bp, Artificial Sequence
  chemically synthesized
caatatgaaagatacaaaaa

SEQ ID NO: 208373 - DNA, 20 bp, Artificial Sequence
  chemically synthesized
ggcaatatgaaagatacaaa

SEQ ID NO: 208374 - DNA, 20 bp, Artificial Sequence
  chemically synthesized
aagagagtgtggcaatatga

SEQ ID NO: 208375 - DNA, 20 bp, Artificial Sequence
  chemically synthesized
ggaggggaatcaagagagtg

SEQ ID NO: 208376 - DNA, 20 bp, Artificial Sequence
  chemically synthesized
aattaggaggggaatcaaga

SEQ ID NO: 208377 - DNA, 20 bp, Artificial Sequence
  chemically synthesized
agaattaggaggggaatcaa

SEQ ID NO: 208378 - DNA, 20 bp, Artificial Sequence
  chemically synthesized
caagaattaggaggggaatc

SEQ ID NO: 208379 - DNA, 20 bp, Artificial Sequence
  chemically synthesized
agaataccaagaattaggag

SEQ ID NO: 208380 - DNA, 20 bp, Artificial Sequence
  chemically synthesized
tagaataccaagaattagga

SEQ ID NO: 208381 - DNA, 20 bp, Artificial Sequence
  chemically synthesized
atagaataccaagaattagg

SEQ ID NO: 208382 - DNA, 20 bp, Artificial Sequence
  chemically synthesized
tatagaataccaagaattag

SEQ ID NO: 208383 - DNA, 20 bp, Artificial Sequence
  chemically synthesized
ttgattcccctcctaattct

SEQ ID NO: 208384 - DNA, 20 bp, Artificial Sequence
  chemically synthesized
aatatagaataccaagaatt

SEQ ID NO: 208385 - DNA, 20 bp, Artificial Sequence
  chemically synthesized
caatatagaataccaagaat

SEQ ID NO: 208386 - DNA, 20 bp, Artificial Sequence
  chemically synthesized
gacatccaatatagaatacc

SEQ ID NO: 208387 - DNA, 20 bp, Artificial Sequence
  chemically synthesized
taattcttggtattctatat

SEQ ID NO: 208388 - DNA, 20 bp, Artificial Sequence
  chemically synthesized
cagaagagggacatccaata

SEQ ID NO: 208389 - DNA, 20 bp, Artificial Sequence
  chemically synthesized
tttagaagtggaacagaaga

SEQ ID NO: 208390 - DNA, 20 bp, Artificial Sequence
  chemically synthesized
gtttagaagtggaacagaag

SEQ ID NO: 208391 - DNA, 20 bp, Artificial Sequence
  chemically synthesized
tgtttagaagtggaacagaa

SEQ ID NO: 208392 - DNA, 20 bp, Artificial Sequence
  chemically synthesized
gatgtttagaagtggaacag

SEQ ID NO: 208393 - DNA, 20 bp, Artificial Sequence
  chemically synthesized
tcagatgtttagaagtggaa

SEQ ID NO: 208394 - DNA, 20 bp, Artificial Sequence
  chemically synthesized
gacactcagatgtttagaag

SEQ ID NO: 208395 - DNA, 20 bp, Artificial Sequence
  chemically synthesized
tgagacactcagatgtttag

SEQ ID NO: 208396 - DNA, 20 bp, Artificial Sequence
  chemically synthesized
tgttccacttctaaacatct

SEQ ID NO: 208397 - DNA, 20 bp, Artificial Sequence
  chemically synthesized
ccctgagacactcagatgtt

SEQ ID NO: 208398 - DNA, 20 bp, Artificial Sequence
  chemically synthesized
ttctaaacatctgagtgtct

SEQ ID NO: 208399 - DNA, 20 bp, Artificial Sequence
  chemically synthesized
agatcaagccctgagacact

SEQ ID NO: 208400 - DNA, 20 bp, Artificial Sequence
  chemically synthesized
tctaaacatctgagtgtctc

SEQ ID NO: 208401 - DNA, 20 bp, Artificial Sequence
  chemically synthesized
ctaaacatctgagtgtctca

SEQ ID NO: 208402 - DNA, 20 bp, Artificial Sequence
  chemically synthesized
tagtctcaagatcaagccct

SEQ ID NO: 208403 - DNA, 20 bp, Artificial Sequence
  chemically synthesized
gtgtctcagggcttgatctt

SEQ ID NO: 208404 - DNA, 20 bp, Artificial Sequence
  chemically synthesized
acataaatagtctcaagatc

SEQ ID NO: 208405 - DNA, 20 bp, Artificial Sequence
  chemically synthesized
aggagaacataaatagtctc

SEQ ID NO: 208406 - DNA, 20 bp, Artificial Sequence
  chemically synthesized
gacctccaggagaacataaa

SEQ ID NO: 208407 - DNA, 20 bp, Artificial Sequence
  chemically synthesized
tgagactatttatgttctcc

SEQ ID NO: 208408 - DNA, 20 bp, Artificial Sequence
  chemically synthesized
agactatttatgttctcctg

SEQ ID NO: 208409 - DNA, 20 bp, Artificial Sequence
  chemically synthesized
gactatttatgttctcctgg

SEQ ID NO: 208410 - DNA, 20 bp, Artificial Sequence
  chemically synthesized
atggcgctagagacctccag

SEQ ID NO: 208411 - DNA, 20 bp, Artificial Sequence
  chemically synthesized
ccatggcgctagagacctcc

SEQ ID NO: 208412 - DNA, 20 bp, Artificial Sequence
  chemically synthesized
gccatggcgctagagacctc

SEQ ID NO: 208413 - DNA, 20 bp, Artificial Sequence
  chemically synthesized
tatgttctcctggaggtctc

SEQ ID NO: 208414 - DNA, 20 bp, Artificial Sequence
  chemically synthesized
tgtctagagccatggcgcta

SEQ ID NO: 208415 - DNA, 20 bp, Artificial Sequence
  chemically synthesized
cctggaggtctctagcgcca

SEQ ID NO: 208416 - DNA, 20 bp, Artificial Sequence
  chemically synthesized
tctgtctagagccatggcgc

SEQ ID NO: 208417 - DNA, 20 bp, Artificial Sequence
  chemically synthesized
ggtctctagcgccatggctc

SEQ ID NO: 208418 - DNA, 20 bp, Artificial Sequence
  chemically synthesized
taaggatctgtctagagcca

SEQ ID NO: 208419 - DNA, 20 bp, Artificial Sequence
  chemically synthesized
tctagcgccatggctctaga

SEQ ID NO: 208420 - DNA, 20 bp, Artificial Sequence
  chemically synthesized
gcacattaaggatctgtcta

SEQ ID NO: 208421 - DNA, 20 bp, Artificial Sequence
  chemically synthesized
atgcacattaaggatctgtc

SEQ ID NO: 208422 - DNA, 20 bp, Artificial Sequence
  chemically synthesized
gggctggcagatgcacatta

SEQ ID NO: 208423 - DNA, 20 bp, Artificial Sequence
  chemically synthesized
agggctggcagatgcacatt

SEQ ID NO: 208424 - DNA, 20 bp, Artificial Sequence
  chemically synthesized
gatccttaatgtgcatctgc

SEQ ID NO: 208425 - DNA, 20 bp, Artificial Sequence
  chemically synthesized
agagaagagcttagggctgg

SEQ ID NO: 208426 - DNA, 20 bp, Artificial Sequence
  chemically synthesized
aatgtgcatctgccagccct

SEQ ID NO: 208427 - DNA, 20 bp, Artificial Sequence
  chemically synthesized
tttagagaagagcttagggc

SEQ ID NO: 208428 - DNA, 20 bp, Artificial Sequence
  chemically synthesized
ggattttagagaagagctta

SEQ ID NO: 208429 - DNA, 20 bp, Artificial Sequence
  chemically synthesized
tggattttagagaagagctt

SEQ ID NO: 208430 - DNA, 20 bp, Artificial Sequence
  chemically synthesized
gtggattttagagaagagct

SEQ ID NO: 208431 - DNA, 20 bp, Artificial Sequence
  chemically synthesized
taaatgtggattttagagaa

SEQ ID NO: 208432 - DNA, 20 bp, Artificial Sequence
  chemically synthesized
tataaatgtggattttagag

SEQ ID NO: 208433 - DNA, 20 bp, Artificial Sequence
  chemically synthesized
gaatataaatgtggatttta

SEQ ID NO: 208434 - DNA, 20 bp, Artificial Sequence
  chemically synthesized
ctgaatataaatgtggattt

SEQ ID NO: 208435 - DNA, 20 bp, Artificial Sequence
  chemically synthesized
taggaaactgaatataaatg

SEQ ID NO: 208436 - DNA, 20 bp, Artificial Sequence
  chemically synthesized
ctaaaatccacatttatatt

SEQ ID NO: 208437 - DNA, 20 bp, Artificial Sequence
  chemically synthesized
cacatttatattcagtttcc

SEQ ID NO: 208438 - DNA, 20 bp, Artificial Sequence
  chemically synthesized
acatttatattcagtttcct

SEQ ID NO: 208439 - DNA, 20 bp, Artificial Sequence
  chemically synthesized
catttatattcagtttccta

SEQ ID NO: 208440 - DNA, 20 bp, Artificial Sequence
  chemically synthesized
ggatgcttattagagaccct

SEQ ID NO: 208441 - DNA, 20 bp, Artificial Sequence
  chemically synthesized
gggatgcttattagagaccc

SEQ ID NO: 208442 - DNA, 20 bp, Artificial Sequence
  chemically synthesized
agtttcctagggtctctaat

SEQ ID NO: 208443 - DNA, 20 bp, Artificial Sequence
  chemically synthesized
tagtttggggatgcttatta

SEQ ID NO: 208444 - DNA, 20 bp, Artificial Sequence
  chemically synthesized
gctagtttggggatgcttat

SEQ ID NO: 208445 - DNA, 20 bp, Artificial Sequence
  chemically synthesized
tctaataagcatccccaaac

SEQ ID NO: 208446 - DNA, 20 bp, Artificial Sequence
  chemically synthesized
tatttggacatgctagtttg

SEQ ID NO: 208447 - DNA, 20 bp, Artificial Sequence
  chemically synthesized
ttatttggacatgctagttt

SEQ ID NO: 208448 - DNA, 20 bp, Artificial Sequence
  chemically synthesized
tttatttggacatgctagtt

SEQ ID NO: 208449 - DNA, 20 bp, Artificial Sequence
  chemically synthesized
gaatctttatttggacatgc

SEQ ID NO: 208450 - DNA, 20 bp, Artificial Sequence
  chemically synthesized
caaactagcatgtccaaata

SEQ ID NO: 208451 - DNA, 20 bp, Artificial Sequence
  chemically synthesized
aagtatcaagaatctttatt

SEQ ID NO: 208452 - DNA, 20 bp, Artificial Sequence
  chemically synthesized
agatttgttcaaaaagtatc

SEQ ID NO: 208453 - DNA, 20 bp, Artificial Sequence
  chemically synthesized
taagagcagatttgttcaaa

SEQ ID NO: 208454 - DNA, 20 bp, Artificial Sequence
  chemically synthesized
agaatattataaagtaagag

SEQ ID NO: 208455 - DNA, 20 bp, Artificial Sequence
  chemically synthesized
tgtagaatattataaagtaa

SEQ ID NO: 208456 - DNA, 20 bp, Artificial Sequence
  chemically synthesized
gatgtagaatattataaagt

SEQ ID NO: 208457 - DNA, 20 bp, Artificial Sequence
  chemically synthesized
ttgagatgtagaatattata

SEQ ID NO: 208458 - DNA, 20 bp, Artificial Sequence
  chemically synthesized
tattaccatttattgagatg

SEQ ID NO: 208459 - DNA, 20 bp, Artificial Sequence
  chemically synthesized
atattctacatctcaataaa

SEQ ID NO: 208460 - DNA, 20 bp, Artificial Sequence
  chemically synthesized
tgagggtattaccatttatt

SEQ ID NO: 208461 - DNA, 20 bp, Artificial Sequence
  chemically synthesized
aacttgaataattatgatga

SEQ ID NO: 208462 - DNA, 20 bp, Artificial Sequence
  chemically synthesized
taacttgaataattatgatg

SEQ ID NO: 208463 - DNA, 20 bp, Artificial Sequence
  chemically synthesized
ttaacttgaataattatgat

SEQ ID NO: 208464 - DNA, 20 bp, Artificial Sequence
  chemically synthesized
taccctcatcataattattc

SEQ ID NO: 208465 - DNA, 20 bp, Artificial Sequence
  chemically synthesized
attattcaagttaaacatta

SEQ ID NO: 208466 - DNA, 20 bp, Artificial Sequence
  chemically synthesized
tattcaagttaaacattaaa

SEQ ID NO: 208467 - DNA, 20 bp, Artificial Sequence
  chemically synthesized
ggtaggagaaaaaaataaat

SEQ ID NO: 208468 - DNA, 20 bp, Artificial Sequence
  chemically synthesized
caacaaggcttaattggtag

SEQ ID NO: 208469 - DNA, 20 bp, Artificial Sequence
  chemically synthesized
atttttttctcctaccaatt

SEQ ID NO: 208470 - DNA, 20 bp, Artificial Sequence
  chemically synthesized
gtcaacaaggcttaattggt

SEQ ID NO: 208471 - DNA, 20 bp, Artificial Sequence
  chemically synthesized
agtcaacaaggcttaattgg

SEQ ID NO: 208472 - DNA, 20 bp, Artificial Sequence
  chemically synthesized
tgtagtcaacaaggcttaat

SEQ ID NO: 208473 - DNA, 20 bp, Artificial Sequence
  chemically synthesized
tttcagatttgtagtcaaca

SEQ ID NO: 208474 - DNA, 20 bp, Artificial Sequence
  chemically synthesized
atttcagatttgtagtcaac

SEQ ID NO: 208475 - DNA, 20 bp, Artificial Sequence
  chemically synthesized
agcgactgatttcagatttg

SEQ ID NO: 208476 - DNA, 20 bp, Artificial Sequence
  chemically synthesized
gttgactacaaatctgaaat

SEQ ID NO: 208477 - DNA, 20 bp, Artificial Sequence
  chemically synthesized
gagattgaagcgactgattt

SEQ ID NO: 208478 - DNA, 20 bp, Artificial Sequence
  chemically synthesized
cgattgtactggagagattg

SEQ ID NO: 208479 - DNA, 20 bp, Artificial Sequence
  chemically synthesized
atcagtcgcttcaatctctc

SEQ ID NO: 208480 - DNA, 20 bp, Artificial Sequence
  chemically synthesized
acaaggacgattgtactgga

SEQ ID NO: 208481 - DNA, 20 bp, Artificial Sequence
  chemically synthesized
ggacaaggacgattgtactg

SEQ ID NO: 208482 - DNA, 20 bp, Artificial Sequence
  chemically synthesized
ttggacaaggacgattgtac

SEQ ID NO: 208483 - DNA, 20 bp, Artificial Sequence
  chemically synthesized
cagtacaatcgtccttgtcc

SEQ ID NO: 208484 - DNA, 20 bp, Artificial Sequence
  chemically synthesized
agatgatagtggcttggaca

SEQ ID NO: 208485 - DNA, 20 bp, Artificial Sequence
  chemically synthesized
gagatgatagtggcttggac

SEQ ID NO: 208486 - DNA, 20 bp, Artificial Sequence
  chemically synthesized
tgtgagagatgatagtggct

SEQ ID NO: 208487 - DNA, 20 bp, Artificial Sequence
  chemically synthesized
gtccgtgtgagagatgatag

SEQ ID NO: 208488 - DNA, 20 bp, Artificial Sequence
  chemically synthesized
gtagtccgtgtgagagatga

SEQ ID NO: 208489 - DNA, 20 bp, Artificial Sequence
  chemically synthesized
agccactatcatctctcaca

SEQ ID NO: 208490 - DNA, 20 bp, Artificial Sequence
  chemically synthesized
taattgagtagtccgtgtga

SEQ ID NO: 208491 - DNA, 20 bp, Artificial Sequence
  chemically synthesized
attaattgagtagtccgtgt

SEQ ID NO: 208492 - DNA, 20 bp, Artificial Sequence
  chemically synthesized
aagaccagtcattaattgag

SEQ ID NO: 208493 - DNA, 20 bp, Artificial Sequence
  chemically synthesized
aaaaagaccagtcattaatt

SEQ ID NO: 208494 - DNA, 20 bp, Artificial Sequence
  chemically synthesized
cggactactcaattaatgac

SEQ ID NO: 208495 - DNA, 20 bp, Artificial Sequence
  chemically synthesized
tgaaagtggaataaaaagac

SEQ ID NO: 208496 - DNA, 20 bp, Artificial Sequence
  chemically synthesized
gggggtgaaagtggaataaa

SEQ ID NO: 208497 - DNA, 20 bp, Artificial Sequence
  chemically synthesized
cggaatgtagggggtgaaag

SEQ ID NO: 208498 - DNA, 20 bp, Artificial Sequence
  chemically synthesized
aaacggaatgtagggggtga

SEQ ID NO: 208499 - DNA, 20 bp, Artificial Sequence
  chemically synthesized
tatcgaaaacggaatgtagg

SEQ ID NO: 208500 - DNA, 20 bp, Artificial Sequence
  chemically synthesized
ttatcgaaaacggaatgtag

SEQ ID NO: 208501 - DNA, 20 bp, Artificial Sequence
  chemically synthesized
cttatcgaaaacggaatgta

SEQ ID NO: 208502 - DNA, 20 bp, Artificial Sequence
  chemically synthesized
gcttatcgaaaacggaatgt

SEQ ID NO: 208503 - DNA, 20 bp, Artificial Sequence
  chemically synthesized
ggcttatcgaaaacggaatg

SEQ ID NO: 208504 - DNA, 20 bp, Artificial Sequence
  chemically synthesized
tttgactggcttatcgaaaa

SEQ ID NO: 208505 - DNA, 20 bp, Artificial Sequence
  chemically synthesized
ccctacattccgttttcgat

SEQ ID NO: 208506 - DNA, 20 bp, Artificial Sequence
  chemically synthesized
acattccgttttcgataagc

SEQ ID NO: 208507 - DNA, 20 bp, Artificial Sequence
  chemically synthesized
cgttttcgataagccagtca

SEQ ID NO: 208508 - DNA, 20 bp, Artificial Sequence
  chemically synthesized
agtattagcttcactttgac

SEQ ID NO: 208509 - DNA, 20 bp, Artificial Sequence
  chemically synthesized
tcgataagccagtcaaagtg

SEQ ID NO: 208510 - DNA, 20 bp, Artificial Sequence
  chemically synthesized
ggcaagtgattggagagtat

SEQ ID NO: 208511 - DNA, 20 bp, Artificial Sequence
  chemically synthesized
tatggtggcaagtgattgga

SEQ ID NO: 208512 - DNA, 20 bp, Artificial Sequence
  chemically synthesized
attatggtggcaagtgattg

SEQ ID NO: 208513 - DNA, 20 bp, Artificial Sequence
  chemically synthesized
taattatggtggcaagtgat

SEQ ID NO: 208514 - DNA, 20 bp, Artificial Sequence
  chemically synthesized
tttattgtaattatggtggc

SEQ ID NO: 208515 - DNA, 20 bp, Artificial Sequence
  chemically synthesized
agattttattgtaattatgg

SEQ ID NO: 208516 - DNA, 20 bp, Artificial Sequence
  chemically synthesized
tttagattttattgtaatta

SEQ ID NO: 208517 - DNA, 20 bp, Artificial Sequence
  chemically synthesized
gttcgtttttataaattgtt

SEQ ID NO: 208518 - DNA, 20 bp, Artificial Sequence
  chemically synthesized
aacaatttataaaaacgaac

SEQ ID NO: 208519 - DNA, 20 bp, Artificial Sequence
  chemically synthesized
aaacgaacaagtctttatat

SEQ ID NO: 208520 - DNA, 20 bp, Artificial Sequence
  chemically synthesized
ggcaatggccagctcatata

SEQ ID NO: 208521 - DNA, 20 bp, Artificial Sequence
  chemically synthesized
gaacaagtctttatatgagc

SEQ ID NO: 208522 - DNA, 20 bp, Artificial Sequence
  chemically synthesized
ttggagaagtaggcaatggc

SEQ ID NO: 208523 - DNA, 20 bp, Artificial Sequence
  chemically synthesized
tgagttggagaagtaggcaa

SEQ ID NO: 208524 - DNA, 20 bp, Artificial Sequence
  chemically synthesized
gatgagtgagttggagaagt

SEQ ID NO: 208525 - DNA, 20 bp, Artificial Sequence
  chemically synthesized
ggatgagtgagttggagaag

SEQ ID NO: 208526 - DNA, 20 bp, Artificial Sequence
  chemically synthesized
tgaggatgagtgagttggag

SEQ ID NO: 208527 - DNA, 20 bp, Artificial Sequence
  chemically synthesized
cattgaggatgagtgagttg

SEQ ID NO: 208528 - DNA, 20 bp, Artificial Sequence
  chemically synthesized
gacattgaggatgagtgagt

SEQ ID NO: 208529 - DNA, 20 bp, Artificial Sequence
  chemically synthesized
ctaagacattgaggatgagt

SEQ ID NO: 208530 - DNA, 20 bp, Artificial Sequence
  chemically synthesized
atggctaagacattgaggat

SEQ ID NO: 208531 - DNA, 20 bp, Artificial Sequence
  chemically synthesized
ccaatatggctaagacattg

SEQ ID NO: 208532 - DNA, 20 bp, Artificial Sequence
  chemically synthesized
ctcactcatcctcaatgtct

SEQ ID NO: 208533 - DNA, 20 bp, Artificial Sequence
  chemically synthesized
gccaatatggctaagacatt

SEQ ID NO: 208534 - DNA, 20 bp, Artificial Sequence
  chemically synthesized
aacaataagccaatatggct

SEQ ID NO: 208535 - DNA, 20 bp, Artificial Sequence
  chemically synthesized
cctcaatgtcttagccatat

SEQ ID NO: 208536 - DNA, 20 bp, Artificial Sequence
  chemically synthesized
acaacaacaataagccaata

SEQ ID NO: 208537 - DNA, 20 bp, Artificial Sequence
  chemically synthesized
catggggcaacaacaacaat

SEQ ID NO: 208538 - DNA, 20 bp, Artificial Sequence
  chemically synthesized
gacaagttaacatattcatg

SEQ ID NO: 208539 - DNA, 20 bp, Artificial Sequence
  chemically synthesized
agacaagttaacatattcat

SEQ ID NO: 208540 - DNA, 20 bp, Artificial Sequence
  chemically synthesized
aagacaagttaacatattca

SEQ ID NO: 208541 - DNA, 20 bp, Artificial Sequence
  chemically synthesized
atagtgtttggtgtaaagac

SEQ ID NO: 208542 - DNA, 20 bp, Artificial Sequence
  chemically synthesized
aatgcatagtgtttggtgta

SEQ ID NO: 208543 - DNA, 20 bp, Artificial Sequence
  chemically synthesized
taccactaatgcatagtgtt

SEQ ID NO: 208544 - DNA, 20 bp, Artificial Sequence
  chemically synthesized
ttacaccaaacactatgcat

SEQ ID NO: 208545 - DNA, 20 bp, Artificial Sequence
  chemically synthesized
gcaggagtaccactaatgca

SEQ ID NO: 208546 - DNA, 20 bp, Artificial Sequence
  chemically synthesized
caccaaacactatgcattag

SEQ ID NO: 208547 - DNA, 20 bp, Artificial Sequence
  chemically synthesized
gcattagtggtactcctgcc

SEQ ID NO: 208548 - DNA, 20 bp, Artificial Sequence
  chemically synthesized
aggaacagtattctaggcag

SEQ ID NO: 208549 - DNA, 20 bp, Artificial Sequence
  chemically synthesized
aaaggaacagtattctaggc

SEQ ID NO: 208550 - DNA, 20 bp, Artificial Sequence
  chemically synthesized
aaaaggaacagtattctagg

SEQ ID NO: 208551 - DNA, 20 bp, Artificial Sequence
  chemically synthesized
atcaaaaggaacagtattct

SEQ ID NO: 208552 - DNA, 20 bp, Artificial Sequence
  chemically synthesized
aatcaaaaggaacagtattc

SEQ ID NO: 208553 - DNA, 20 bp, Artificial Sequence
  chemically synthesized
ataataacaatcaaaaggaa

SEQ ID NO: 208554 - DNA, 20 bp, Artificial Sequence
  chemically synthesized
ctcctataataacaatcaaa

SEQ ID NO: 208555 - DNA, 20 bp, Artificial Sequence
  chemically synthesized
tctcctataataacaatcaa

SEQ ID NO: 208556 - DNA, 20 bp, Artificial Sequence
  chemically synthesized
gttccttttgattgttatta

SEQ ID NO: 208557 - DNA, 20 bp, Artificial Sequence
  chemically synthesized
ttccttttgattgttattat

SEQ ID NO: 208558 - DNA, 20 bp, Artificial Sequence
  chemically synthesized
ccttttgattgttattatag

SEQ ID NO: 208559 - DNA, 20 bp, Artificial Sequence
  chemically synthesized
caaagtgccatattttggag

SEQ ID NO: 208560 - DNA, 20 bp, Artificial Sequence
  chemically synthesized
atatataccactccaaaata

SEQ ID NO: 208561 - DNA, 20 bp, Artificial Sequence
  chemically synthesized
tgtcaaagtgccatattttg

SEQ ID NO: 208562 - DNA, 20 bp, Artificial Sequence
  chemically synthesized
tatgtcaaagtgccatattt

SEQ ID NO: 208563 - DNA, 20 bp, Artificial Sequence
  chemically synthesized
aaatatggcactttgacata

SEQ ID NO: 208564 - DNA, 20 bp, Artificial Sequence
  chemically synthesized
taaaagtaatctttatgtca

SEQ ID NO: 208565 - DNA, 20 bp, Artificial Sequence
  chemically synthesized
tttgacataaagattacttt

SEQ ID NO: 208566 - DNA, 20 bp, Artificial Sequence
  chemically synthesized
acataaagattacttttagt

SEQ ID NO: 208567 - DNA, 20 bp, Artificial Sequence
  chemically synthesized
ataaagattacttttagtta

SEQ ID NO: 208568 - DNA, 20 bp, Artificial Sequence
  chemically synthesized
tcttacttgcctctaactaa

SEQ ID NO: 208569 - DNA, 20 bp, Artificial Sequence
  chemically synthesized
taaagattacttttagttag

SEQ ID NO: 208570 - DNA, 20 bp, Artificial Sequence
  chemically synthesized
gattacttttagttagaggc

SEQ ID NO: 208571 - DNA, 20 bp, Artificial Sequence
  chemically synthesized
acttttagttagaggcaagt

SEQ ID NO: 208572 - DNA, 20 bp, Artificial Sequence
  chemically synthesized
aggcaagtaagaatcaatat

SEQ ID NO: 208573 - DNA, 20 bp, Artificial Sequence
  chemically synthesized
taagaatcaatataagcaaa

SEQ ID NO: 208574 - DNA, 20 bp, Artificial Sequence
  chemically synthesized
gaatcaatataagcaaaaag

SEQ ID NO: 208575 - DNA, 20 bp, Artificial Sequence
  chemically synthesized
taagcaaaaagaagccttcc

SEQ ID NO: 208576 - DNA, 20 bp, Artificial Sequence
  chemically synthesized
agacaagggaagcactggga

SEQ ID NO: 208577 - DNA, 20 bp, Artificial Sequence
  chemically synthesized
tagacaagggaagcactggg

SEQ ID NO: 208578 - DNA, 20 bp, Artificial Sequence
  chemically synthesized
atttagacaagggaagcact

SEQ ID NO: 208579 - DNA, 20 bp, Artificial Sequence
  chemically synthesized
tatttagacaagggaagcac

SEQ ID NO: 208580 - DNA, 20 bp, Artificial Sequence
  chemically synthesized
tgcttttatttagacaaggg

SEQ ID NO: 208581 - DNA, 20 bp, Artificial Sequence
  chemically synthesized
ttctgcttttatttagacaa

SEQ ID NO: 208582 - DNA, 20 bp, Artificial Sequence
  chemically synthesized
tttctgcttttatttagaca

SEQ ID NO: 208583 - DNA, 20 bp, Artificial Sequence
  chemically synthesized
gtttctgcttttatttagac

SEQ ID NO: 208584 - DNA, 20 bp, Artificial Sequence
  chemically synthesized
tgcttcccttgtctaaataa

SEQ ID NO: 208585 - DNA, 20 bp, Artificial Sequence
  chemically synthesized
cagaagtttctgcttttatt

SEQ ID NO: 208586 - DNA, 20 bp, Artificial Sequence
  chemically synthesized
ttcccttgtctaaataaaag

SEQ ID NO: 208587 - DNA, 20 bp, Artificial Sequence
  chemically synthesized
aaataaaagcagaaacttct

SEQ ID NO: 208588 - DNA, 20 bp, Artificial Sequence
  chemically synthesized
tagcagttatcatttctcag

SEQ ID NO: 208589 - DNA, 20 bp, Artificial Sequence
  chemically synthesized
ttatagcagttatcatttct

SEQ ID NO: 208590 - DNA, 20 bp, Artificial Sequence
  chemically synthesized
tgagaaatgataactgctat

SEQ ID NO: 208591 - DNA, 20 bp, Artificial Sequence
  chemically synthesized
ccaggagagagggcttatag

SEQ ID NO: 208592 - DNA, 20 bp, Artificial Sequence
  chemically synthesized
ttcccaggagagagggctta

SEQ ID NO: 208593 - DNA, 20 bp, Artificial Sequence
  chemically synthesized
ctgctataagccctctctcc

SEQ ID NO: 208594 - DNA, 20 bp, Artificial Sequence
  chemically synthesized
taacaatttcccaggagaga

SEQ ID NO: 208595 - DNA, 20 bp, Artificial Sequence
  chemically synthesized
tgctataagccctctctcct

SEQ ID NO: 208596 - DNA, 20 bp, Artificial Sequence
  chemically synthesized
ataacaatttcccaggagag

SEQ ID NO: 208597 - DNA, 20 bp, Artificial Sequence
  chemically synthesized
cataacaatttcccaggaga

SEQ ID NO: 208598 - DNA, 20 bp, Artificial Sequence
  chemically synthesized
gccataacaatttcccagga

SEQ ID NO: 208599 - DNA, 20 bp, Artificial Sequence
  chemically synthesized
tggccataacaatttcccag

SEQ ID NO: 208600 - DNA, 20 bp, Artificial Sequence
  chemically synthesized
catggccataacaatttccc

SEQ ID NO: 208601 - DNA, 20 bp, Artificial Sequence
  chemically synthesized
tcatggccataacaatttcc

SEQ ID NO: 208602 - DNA, 20 bp, Artificial Sequence
  chemically synthesized
tctctcctgggaaattgtta

SEQ ID NO: 208603 - DNA, 20 bp, Artificial Sequence
  chemically synthesized
gggaaattgttatggccatg

SEQ ID NO: 208604 - DNA, 20 bp, Artificial Sequence
  chemically synthesized
tcaacttttcgtattcttca

SEQ ID NO: 208605 - DNA, 20 bp, Artificial Sequence
  chemically synthesized
atggccatgaagaatacgaa

SEQ ID NO: 208606 - DNA, 20 bp, Artificial Sequence
  chemically synthesized
gaatacgaaaagttgatctc

SEQ ID NO: 208607 - DNA, 20 bp, Artificial Sequence
  chemically synthesized
acgaaaagttgatctcaaga

SEQ ID NO: 208608 - DNA, 20 bp, Artificial Sequence
  chemically synthesized
gtttatgccaagtctatctt

SEQ ID NO: 208609 - DNA, 20 bp, Artificial Sequence
  chemically synthesized
agttgatctcaagatagact

SEQ ID NO: 208610 - DNA, 20 bp, Artificial Sequence
  chemically synthesized
gagtatagtttgtttatgcc

SEQ ID NO: 208611 - DNA, 20 bp, Artificial Sequence
  chemically synthesized
tatgggagaaacatggagta

SEQ ID NO: 208612 - DNA, 20 bp, Artificial Sequence
  chemically synthesized
aaatatatgggagaaacatg

SEQ ID NO: 208613 - DNA, 20 bp, Artificial Sequence
  chemically synthesized
gtaaatatatgggagaaaca

SEQ ID NO: 208614 - DNA, 20 bp, Artificial Sequence
  chemically synthesized
gtaggaaggtaaatatatgg

SEQ ID NO: 208615 - DNA, 20 bp, Artificial Sequence
  chemically synthesized
ctgtaggaaggtaaatatat

SEQ ID NO: 208616 - DNA, 20 bp, Artificial Sequence
  chemically synthesized
actgtaggaaggtaaatata

SEQ ID NO: 208617 - DNA, 20 bp, Artificial Sequence
  chemically synthesized
cccatatatttaccttccta

SEQ ID NO: 208618 - DNA, 20 bp, Artificial Sequence
  chemically synthesized
agggttgccaaactgtagga

SEQ ID NO: 208619 - DNA, 20 bp, Artificial Sequence
  chemically synthesized
tagggttgccaaactgtagg

SEQ ID NO: 208620 - DNA, 20 bp, Artificial Sequence
  chemically synthesized
atatttaccttcctacagtt

SEQ ID NO: 208621 - DNA, 20 bp, Artificial Sequence
  chemically synthesized
atttagggttgccaaactgt

SEQ ID NO: 208622 - DNA, 20 bp, Artificial Sequence
  chemically synthesized
tatttagggttgccaaactg

SEQ ID NO: 208623 - DNA, 20 bp, Artificial Sequence
  chemically synthesized
aaaaggggtttaggtattta

SEQ ID NO: 208624 - DNA, 20 bp, Artificial Sequence
  chemically synthesized
aaaaaggggtttaggtattt

SEQ ID NO: 208625 - DNA, 20 bp, Artificial Sequence
  chemically synthesized
aaaaaaggggtttaggtatt

SEQ ID NO: 208626 - DNA, 20 bp, Artificial Sequence
  chemically synthesized
aacaaagaaaaaaggggttt

SEQ ID NO: 208627 - DNA, 20 bp, Artificial Sequence
  chemically synthesized
aaacaaagaaaaaaggggtt

SEQ ID NO: 208628 - DNA, 20 bp, Artificial Sequence
  chemically synthesized
tgacaaaacaaagaaaaaag

SEQ ID NO: 208629 - DNA, 20 bp, Artificial Sequence
  chemically synthesized
atgacaaaacaaagaaaaaa

SEQ ID NO: 208630 - DNA, 20 bp, Artificial Sequence
  chemically synthesized
aatgacaaaacaaagaaaaa

SEQ ID NO: 208631 - DNA, 20 bp, Artificial Sequence
  chemically synthesized
aaatgacaaaacaaagaaaa

SEQ ID NO: 208632 - DNA, 20 bp, Artificial Sequence
  chemically synthesized
tgtagagaaatgacaaaaca

SEQ ID NO: 208633 - DNA, 20 bp, Artificial Sequence
  chemically synthesized
ttgttttgtcatttctctac

SEQ ID NO: 208634 - DNA, 20 bp, Artificial Sequence
  chemically synthesized
caaagaacagtaaacttgta

SEQ ID NO: 208635 - DNA, 20 bp, Artificial Sequence
  chemically synthesized
aacaaagaacagtaaacttg

SEQ ID NO: 208636 - DNA, 20 bp, Artificial Sequence
  chemically synthesized
tatagcatctgaacaaagaa

SEQ ID NO: 208637 - DNA, 20 bp, Artificial Sequence
  chemically synthesized
caagtttactgttctttgtt

SEQ ID NO: 208638 - DNA, 20 bp, Artificial Sequence
  chemically synthesized
gtttatatagcatctgaaca

SEQ ID NO: 208639 - DNA, 20 bp, Artificial Sequence
  chemically synthesized
gttagaatgttgggtttata

SEQ ID NO: 208640 - DNA, 20 bp, Artificial Sequence
  chemically synthesized
aaaggggtggttagaatgtt

SEQ ID NO: 208641 - DNA, 20 bp, Artificial Sequence
  chemically synthesized
caaaggggtggttagaatgt

SEQ ID NO: 208642 - DNA, 20 bp, Artificial Sequence
  chemically synthesized
gagtaactcaaaggggtggt

SEQ ID NO: 208643 - DNA, 20 bp, Artificial Sequence
  chemically synthesized
aacattctaaccaccccttt

SEQ ID NO: 208644 - DNA, 20 bp, Artificial Sequence
  chemically synthesized
tgatgagtaactcaaagggg

SEQ ID NO: 208645 - DNA, 20 bp, Artificial Sequence
  chemically synthesized
cagtgatgagtaactcaaag

SEQ ID NO: 208646 - DNA, 20 bp, Artificial Sequence
  chemically synthesized
tcagtgatgagtaactcaaa

SEQ ID NO: 208647 - DNA, 20 bp, Artificial Sequence
  chemically synthesized
ctcagtgatgagtaactcaa

SEQ ID NO: 208648 - DNA, 20 bp, Artificial Sequence
  chemically synthesized
actcagtgatgagtaactca

SEQ ID NO: 208649 - DNA, 20 bp, Artificial Sequence
  chemically synthesized
cctttgagttactcatcact

SEQ ID NO: 208650 - DNA, 20 bp, Artificial Sequence
  chemically synthesized
cctggtagaaactcagtgat

SEQ ID NO: 208651 - DNA, 20 bp, Artificial Sequence
  chemically synthesized
acatacacctggtagaaact

SEQ ID NO: 208652 - DNA, 20 bp, Artificial Sequence
  chemically synthesized
actcatcactgagtttctac

SEQ ID NO: 208653 - DNA, 20 bp, Artificial Sequence
  chemically synthesized
ctcatcactgagtttctacc

SEQ ID NO: 208654 - DNA, 20 bp, Artificial Sequence
  chemically synthesized
ttcagtgcacatacacctgg

SEQ ID NO: 208655 - DNA, 20 bp, Artificial Sequence
  chemically synthesized
atattcagtgcacatacacc

SEQ ID NO: 208656 - DNA, 20 bp, Artificial Sequence
  chemically synthesized
tagaagtttattaaaatatt

SEQ ID NO: 208657 - DNA, 20 bp, Artificial Sequence
  chemically synthesized
tgaatattttaataaacttc

SEQ ID NO: 208658 - DNA, 20 bp, Artificial Sequence
  chemically synthesized
gaatattttaataaacttct

SEQ ID NO: 208659 - DNA, 20 bp, Artificial Sequence
  chemically synthesized
taacaagaggaaaagcctag

SEQ ID NO: 208660 - DNA, 20 bp, Artificial Sequence
  chemically synthesized
gattaacaagaggaaaagcc

SEQ ID NO: 208661 - DNA, 20 bp, Artificial Sequence
  chemically synthesized
agacagattaacaagaggaa

SEQ ID NO: 208662 - DNA, 20 bp, Artificial Sequence
  chemically synthesized
acaaaagacagattaacaag

SEQ ID NO: 208663 - DNA, 20 bp, Artificial Sequence
  chemically synthesized
gacaaaagacagattaacaa

SEQ ID NO: 208664 - DNA, 20 bp, Artificial Sequence
  chemically synthesized
gtgacaaaagacagattaac

SEQ ID NO: 208665 - DNA, 20 bp, Artificial Sequence
  chemically synthesized
aaagttagagtgacaaaaga

SEQ ID NO: 208666 - DNA, 20 bp, Artificial Sequence
  chemically synthesized
ctacaaagttagagtgacaa

SEQ ID NO: 208667 - DNA, 20 bp, Artificial Sequence
  chemically synthesized
gctggagtcctacaaagtta

SEQ ID NO: 208668 - DNA, 20 bp, Artificial Sequence
  chemically synthesized
cttttgtcactctaactttg

SEQ ID NO: 208669 - DNA, 20 bp, Artificial Sequence
  chemically synthesized
ttttgtcactctaactttgt

SEQ ID NO: 208670 - DNA, 20 bp, Artificial Sequence
  chemically synthesized
cagctggagtcctacaaagt

SEQ ID NO: 208671 - DNA, 20 bp, Artificial Sequence
  chemically synthesized
tgcccagctggagtcctaca

SEQ ID NO: 208672 - DNA, 20 bp, Artificial Sequence
  chemically synthesized
actctaactttgtaggactc

SEQ ID NO: 208673 - DNA, 20 bp, Artificial Sequence
  chemically synthesized
taactttgtaggactccagc

SEQ ID NO: 208674 - DNA, 20 bp, Artificial Sequence
  chemically synthesized
aactttgtaggactccagct

SEQ ID NO: 208675 - DNA, 20 bp, Artificial Sequence
  chemically synthesized
ccttctaggctgcccagctg

SEQ ID NO: 208676 - DNA, 20 bp, Artificial Sequence
  chemically synthesized
tttgtaggactccagctggg

SEQ ID NO: 208677 - DNA, 20 bp, Artificial Sequence
  chemically synthesized
acccttctaggctgcccagc

SEQ ID NO: 208678 - DNA, 20 bp, Artificial Sequence
  chemically synthesized
aggactccagctgggcagcc

SEQ ID NO: 208679 - DNA, 20 bp, Artificial Sequence
  chemically synthesized
ttctacccttctaggctgcc

SEQ ID NO: 208680 - DNA, 20 bp, Artificial Sequence
  chemically synthesized
actccagctgggcagcctag

SEQ ID NO: 208681 - DNA, 20 bp, Artificial Sequence
  chemically synthesized
ctccagctgggcagcctaga

SEQ ID NO: 208682 - DNA, 20 bp, Artificial Sequence
  chemically synthesized
tccagctgggcagcctagaa

SEQ ID NO: 208683 - DNA, 20 bp, Artificial Sequence
  chemically synthesized
agctgggcagcctagaaggg

SEQ ID NO: 208684 - DNA, 20 bp, Artificial Sequence
  chemically synthesized
tatgttccttctacccttct

SEQ ID NO: 208685 - DNA, 20 bp, Artificial Sequence
  chemically synthesized
atatgttccttctacccttc

SEQ ID NO: 208686 - DNA, 20 bp, Artificial Sequence
  chemically synthesized
tgggcagcctagaagggtag

SEQ ID NO: 208687 - DNA, 20 bp, Artificial Sequence
  chemically synthesized
gggcagcctagaagggtaga

SEQ ID NO: 208688 - DNA, 20 bp, Artificial Sequence
  chemically synthesized
ccagctctgtgatgtagggg

SEQ ID NO: 208689 - DNA, 20 bp, Artificial Sequence
  chemically synthesized
gggccagctctgtgatgtag

SEQ ID NO: 208690 - DNA, 20 bp, Artificial Sequence
  chemically synthesized
atttttcttcccctacatca

SEQ ID NO: 208691 - DNA, 20 bp, Artificial Sequence
  chemically synthesized
ggggccagctctgtgatgta

SEQ ID NO: 208692 - DNA, 20 bp, Artificial Sequence
  chemically synthesized
aggggccagctctgtgatgt

SEQ ID NO: 208693 - DNA, 20 bp, Artificial Sequence
  chemically synthesized
ttttcttcccctacatcaca

SEQ ID NO: 208694 - DNA, 20 bp, Artificial Sequence
  chemically synthesized
aaggggccagctctgtgatg

SEQ ID NO: 208695 - DNA, 20 bp, Artificial Sequence
  chemically synthesized
cttcccctacatcacagagc

SEQ ID NO: 208696 - DNA, 20 bp, Artificial Sequence
  chemically synthesized
tctgaatgacaagaaggggc

SEQ ID NO: 208697 - DNA, 20 bp, Artificial Sequence
  chemically synthesized
gagatctgaatgacaagaag

SEQ ID NO: 208698 - DNA, 20 bp, Artificial Sequence
  chemically synthesized
agagatctgaatgacaagaa

SEQ ID NO: 208699 - DNA, 20 bp, Artificial Sequence
  chemically synthesized
cagagatctgaatgacaaga

SEQ ID NO: 208700 - DNA, 20 bp, Artificial Sequence
  chemically synthesized
acagagatctgaatgacaag

SEQ ID NO: 208701 - DNA, 20 bp, Artificial Sequence
  chemically synthesized
gctggccccttcttgtcatt

SEQ ID NO: 208702 - DNA, 20 bp, Artificial Sequence
  chemically synthesized
taaacagagatctgaatgac

SEQ ID NO: 208703 - DNA, 20 bp, Artificial Sequence
  chemically synthesized
tgagccatgttatttaaaca

SEQ ID NO: 208704 - DNA, 20 bp, Artificial Sequence
  chemically synthesized
tctgagccatgttatttaaa

SEQ ID NO: 208705 - DNA, 20 bp, Artificial Sequence
  chemically synthesized
agatctctgtttaaataaca

SEQ ID NO: 208706 - DNA, 20 bp, Artificial Sequence
  chemically synthesized
tctgtttaaataacatggct

SEQ ID NO: 208707 - DNA, 20 bp, Artificial Sequence
  chemically synthesized
aagcaaggacatttttttct

SEQ ID NO: 208708 - DNA, 20 bp, Artificial Sequence
  chemically synthesized
cagaaaaaaatgtccttgct

SEQ ID NO: 208709 - DNA, 20 bp, Artificial Sequence
  chemically synthesized
agaaaaaaatgtccttgctt

SEQ ID NO: 208710 - DNA, 20 bp, Artificial Sequence
  chemically synthesized
tgacccaccaggcccaagca

SEQ ID NO: 208711 - DNA, 20 bp, Artificial Sequence
  chemically synthesized
gtgacccaccaggcccaagc

SEQ ID NO: 208712 - DNA, 20 bp, Artificial Sequence
  chemically synthesized
aaaatgtccttgcttgggcc

SEQ ID NO: 208713 - DNA, 20 bp, Artificial Sequence
  chemically synthesized
aggcgtgacccaccaggccc

SEQ ID NO: 208714 - DNA, 20 bp, Artificial Sequence
  chemically synthesized
atgtccttgcttgggcctgg

SEQ ID NO: 208715 - DNA, 20 bp, Artificial Sequence
  chemically synthesized
tgtccttgcttgggcctggt

SEQ ID NO: 208716 - DNA, 20 bp, Artificial Sequence
  chemically synthesized
atttacaggcgtgacccacc

SEQ ID NO: 208717 - DNA, 20 bp, Artificial Sequence
  chemically synthesized
gatttacaggcgtgacccac

SEQ ID NO: 208718 - DNA, 20 bp, Artificial Sequence
  chemically synthesized
cccaaagtgctgggatttac

SEQ ID NO: 208719 - DNA, 20 bp, Artificial Sequence
  chemically synthesized
tgggtcacgcctgtaaatcc

SEQ ID NO: 208720 - DNA, 20 bp, Artificial Sequence
  chemically synthesized
tcccaaagtgctgggattta

SEQ ID NO: 208721 - DNA, 20 bp, Artificial Sequence
  chemically synthesized
gcctgtaaatcccagcactt

SEQ ID NO: 208722 - DNA, 20 bp, Artificial Sequence
  chemically synthesized
cctcagcctcccaaagtgct

SEQ ID NO: 208723 - DNA, 20 bp, Artificial Sequence
  chemically synthesized
cctgtaaatcccagcacttt

SEQ ID NO: 208724 - DNA, 20 bp, Artificial Sequence
  chemically synthesized
gcctcagcctcccaaagtgc

SEQ ID NO: 208725 - DNA, 20 bp, Artificial Sequence
  chemically synthesized
tgtaaatcccagcactttgg

SEQ ID NO: 208726 - DNA, 20 bp, Artificial Sequence
  chemically synthesized
gtaaatcccagcactttggg

SEQ ID NO: 208727 - DNA, 20 bp, Artificial Sequence
  chemically synthesized
ccacccgcctcagcctccca

SEQ ID NO: 208728 - DNA, 20 bp, Artificial Sequence
  chemically synthesized
tcccagcactttgggaggct

SEQ ID NO: 208729 - DNA, 20 bp, Artificial Sequence
  chemically synthesized
cccagcactttgggaggctg

SEQ ID NO: 208730 - DNA, 20 bp, Artificial Sequence
  chemically synthesized
agcactttgggaggctgagg

SEQ ID NO: 208731 - DNA, 20 bp, Artificial Sequence
  chemically synthesized
gcactttgggaggctgaggc

SEQ ID NO: 208732 - DNA, 20 bp, Artificial Sequence
  chemically synthesized
ctttgggaggctgaggcggg

SEQ ID NO: 208733 - DNA, 20 bp, Artificial Sequence
  chemically synthesized
ctcaagcgatccacccgcct

SEQ ID NO: 208734 - DNA, 20 bp, Artificial Sequence
  chemically synthesized
ctgaggcgggtggatcgctt

SEQ ID NO: 208735 - DNA, 20 bp, Artificial Sequence
  chemically synthesized
tgaggcgggtggatcgcttg

SEQ ID NO: 208736 - DNA, 20 bp, Artificial Sequence
  chemically synthesized
gcgggtggatcgcttgaggt

SEQ ID NO: 208737 - DNA, 20 bp, Artificial Sequence
  chemically synthesized
ggtctcaaacttctgacctc

SEQ ID NO: 208738 - DNA, 20 bp, Artificial Sequence
  chemically synthesized
ggtggatcgcttgaggtcag

SEQ ID NO: 208739 - DNA, 20 bp, Artificial Sequence
  chemically synthesized
tcgcttgaggtcagaagttt

SEQ ID NO: 208740 - DNA, 20 bp, Artificial Sequence
  chemically synthesized
tgaggtcagaagtttgagac

SEQ ID NO: 208741 - DNA, 20 bp, Artificial Sequence
  chemically synthesized
tcagaagtttgagaccagcc

SEQ ID NO: 208742 - DNA, 20 bp, Artificial Sequence
  chemically synthesized
cagaagtttgagaccagcct

SEQ ID NO: 208743 - DNA, 20 bp, Artificial Sequence
  chemically synthesized
tttgaccatgttgcccaggc

SEQ ID NO: 208744 - DNA, 20 bp, Artificial Sequence
  chemically synthesized
ggggtttgaccatgttgccc

SEQ ID NO: 208745 - DNA, 20 bp, Artificial Sequence
  chemically synthesized
tgagaccagcctgggcaaca

SEQ ID NO: 208746 - DNA, 20 bp, Artificial Sequence
  chemically synthesized
tggggtttgaccatgttgcc

SEQ ID NO: 208747 - DNA, 20 bp, Artificial Sequence
  chemically synthesized
ttgtatttttagtagagatg

SEQ ID NO: 208748 - DNA, 20 bp, Artificial Sequence
  chemically synthesized
tttgtatttttagtagagat

SEQ ID NO: 208749 - DNA, 20 bp, Artificial Sequence
  chemically synthesized
ttttgtatttttagtagaga

SEQ ID NO: 208750 - DNA, 20 bp, Artificial Sequence
  chemically synthesized
tgatttttgtatttttagta

SEQ ID NO: 208751 - DNA, 20 bp, Artificial Sequence
  chemically synthesized
gctgatttttgtatttttag

SEQ ID NO: 208752 - DNA, 20 bp, Artificial Sequence
  chemically synthesized
ccagctgatttttgtatttt

SEQ ID NO: 208753 - DNA, 20 bp, Artificial Sequence
  chemically synthesized
tctactaaaaatacaaaaat

SEQ ID NO: 208754 - DNA, 20 bp, Artificial Sequence
  chemically synthesized
ctaaaaatacaaaaatcagc

SEQ ID NO: 208755 - DNA, 20 bp, Artificial Sequence
  chemically synthesized
taaaaatacaaaaatcagct

SEQ ID NO: 208756 - DNA, 20 bp, Artificial Sequence
  chemically synthesized
atacaaaaatcagctgggcc

SEQ ID NO: 208757 - DNA, 20 bp, Artificial Sequence
  chemically synthesized
caaaaatcagctgggcctgg

SEQ ID NO: 208758 - DNA, 20 bp, Artificial Sequence
  chemically synthesized
gaggcatgcaccaccaggcc

SEQ ID NO: 208759 - DNA, 20 bp, Artificial Sequence
  chemically synthesized
gactagaggcatgcaccacc

SEQ ID NO: 208760 - DNA, 20 bp, Artificial Sequence
  chemically synthesized
ggactagaggcatgcaccac

SEQ ID NO: 208761 - DNA, 20 bp, Artificial Sequence
  chemically synthesized
ggcctggtggtgcatgcctc

SEQ ID NO: 208762 - DNA, 20 bp, Artificial Sequence
  chemically synthesized
gtggtgcatgcctctagtcc

SEQ ID NO: 208763 - DNA, 20 bp, Artificial Sequence
  chemically synthesized
tcccaaataactgggactag

SEQ ID NO: 208764 - DNA, 20 bp, Artificial Sequence
  chemically synthesized
ctcccaaataactgggacta

SEQ ID NO: 208765 - DNA, 20 bp, Artificial Sequence
  chemically synthesized
gcctcccaaataactgggac

SEQ ID NO: 208766 - DNA, 20 bp, Artificial Sequence
  chemically synthesized
tgcctctagtcccagttatt

SEQ ID NO: 208767 - DNA, 20 bp, Artificial Sequence
  chemically synthesized
cctccgcctcccaaataact

SEQ ID NO: 208768 - DNA, 20 bp, Artificial Sequence
  chemically synthesized
gcctctagtcccagttattt

SEQ ID NO: 208769 - DNA, 20 bp, Artificial Sequence
  chemically synthesized
gcctccgcctcccaaataac

SEQ ID NO: 208770 - DNA, 20 bp, Artificial Sequence
  chemically synthesized
ctctagtcccagttatttgg

SEQ ID NO: 208771 - DNA, 20 bp, Artificial Sequence
  chemically synthesized
tctagtcccagttatttggg

SEQ ID NO: 208772 - DNA, 20 bp, Artificial Sequence
  chemically synthesized
agtcccagttatttgggagg

SEQ ID NO: 208773 - DNA, 20 bp, Artificial Sequence
  chemically synthesized
tcccagttatttgggaggcg

SEQ ID NO: 208774 - DNA, 20 bp, Artificial Sequence
  chemically synthesized
cccagttatttgggaggcgg

SEQ ID NO: 208775 - DNA, 20 bp, Artificial Sequence
  chemically synthesized
gggaggcggaggcacacgaa

SEQ ID NO: 208776 - DNA, 20 bp, Artificial Sequence
  chemically synthesized
gcacacgaaaagcttgaaca

SEQ ID NO: 208777 - DNA, 20 bp, Artificial Sequence
  chemically synthesized
cacacgaaaagcttgaacat

SEQ ID NO: 208778 - DNA, 20 bp, Artificial Sequence
  chemically synthesized
aacctctgcctcccatgttc

SEQ ID NO: 208779 - DNA, 20 bp, Artificial Sequence
  chemically synthesized
cacgaaaagcttgaacatgg

SEQ ID NO: 208780 - DNA, 20 bp, Artificial Sequence
  chemically synthesized
acgaaaagcttgaacatggg

SEQ ID NO: 208781 - DNA, 20 bp, Artificial Sequence
  chemically synthesized
aaaagcttgaacatgggagg

SEQ ID NO: 208782 - DNA, 20 bp, Artificial Sequence
  chemically synthesized
aagcttgaacatgggaggca

SEQ ID NO: 208783 - DNA, 20 bp, Artificial Sequence
  chemically synthesized
agcttgaacatgggaggcag

SEQ ID NO: 208784 - DNA, 20 bp, Artificial Sequence
  chemically synthesized
aacatgggaggcagaggttg

SEQ ID NO: 208785 - DNA, 20 bp, Artificial Sequence
  chemically synthesized
tgggaggcagaggttgcagt

SEQ ID NO: 208786 - DNA, 20 bp, Artificial Sequence
  chemically synthesized
ggcagaggttgcagtgagct

SEQ ID NO: 208787 - DNA, 20 bp, Artificial Sequence
  chemically synthesized
ggagcgcagtggtgcaatct

SEQ ID NO: 208788 - DNA, 20 bp, Artificial Sequence
  chemically synthesized
ttgcccaggctggagcgcag

SEQ ID NO: 208789 - DNA, 20 bp, Artificial Sequence
  chemically synthesized
gagattgcaccactgcgctc

SEQ ID NO: 208790 - DNA, 20 bp, Artificial Sequence
  chemically synthesized
ctgttgcccaggctggagcg

SEQ ID NO: 208791 - DNA, 20 bp, Artificial Sequence
  chemically synthesized
tgcaccactgcgctccagcc

SEQ ID NO: 208792 - DNA, 20 bp, Artificial Sequence
  chemically synthesized
gcaccactgcgctccagcct

SEQ ID NO: 208793 - DNA, 20 bp, Artificial Sequence
  chemically synthesized
ttgctctgttgcccaggctg

SEQ ID NO: 208794 - DNA, 20 bp, Artificial Sequence
  chemically synthesized
tcttgctctgttgcccaggc

SEQ ID NO: 208795 - DNA, 20 bp, Artificial Sequence
  chemically synthesized
ctgcgctccagcctgggcaa

SEQ ID NO: 208796 - DNA, 20 bp, Artificial Sequence
  chemically synthesized
ggagtcttgctctgttgccc

SEQ ID NO: 208797 - DNA, 20 bp, Artificial Sequence
  chemically synthesized
gcgctccagcctgggcaaca

SEQ ID NO: 208798 - DNA, 20 bp, Artificial Sequence
  chemically synthesized
cggagtcttgctctgttgcc

SEQ ID NO: 208799 - DNA, 20 bp, Artificial Sequence
  chemically synthesized
tccagcctgggcaacagagc

SEQ ID NO: 208800 - DNA, 20 bp, Artificial Sequence
  chemically synthesized
gcaacagagcaagactccga

SEQ ID NO: 208801 - DNA, 20 bp, Artificial Sequence
  chemically synthesized
caacagagcaagactccgaa

SEQ ID NO: 208802 - DNA, 20 bp, Artificial Sequence
  chemically synthesized
cagagcaagactccgaaagg

SEQ ID NO: 208803 - DNA, 20 bp, Artificial Sequence
  chemically synthesized
ctttttctttctgcctttcg

SEQ ID NO: 208804 - DNA, 20 bp, Artificial Sequence
  chemically synthesized
ttctttttctttctgccttt

SEQ ID NO: 208805 - DNA, 20 bp, Artificial Sequence
  chemically synthesized
gcaagactccgaaaggcaga

SEQ ID NO: 208806 - DNA, 20 bp, Artificial Sequence
  chemically synthesized
ctccgaaaggcagaaagaaa

SEQ ID NO: 208807 - DNA, 20 bp, Artificial Sequence
  chemically synthesized
gaaaggcagaaagaaaaaga

SEQ ID NO: 208808 - DNA, 20 bp, Artificial Sequence
  chemically synthesized
gcagaaagaaaaagaaagaa

SEQ ID NO: 208809 - DNA, 20 bp, Artificial Sequence
  chemically synthesized
aaagaaaaagaaagaaaaga

SEQ ID NO: 208810 - DNA, 20 bp, Artificial Sequence
  chemically synthesized
aaagaaagaaaagaaagaaa

SEQ ID NO: 208811 - DNA, 20 bp, Artificial Sequence
  chemically synthesized
agaaaagaaagaaaaagaaa

SEQ ID NO: 208812 - DNA, 20 bp, Artificial Sequence
  chemically synthesized
agaaaaagaaaaagaaaaaa

SEQ ID NO: 208813 - DNA, 20 bp, Artificial Sequence
  chemically synthesized
aaagaaaaagaaaaaaaaga

SEQ ID NO: 208814 - DNA, 20 bp, Artificial Sequence
  chemically synthesized
agaaaaagaaaaaaaagaaa

SEQ ID NO: 208815 - DNA, 20 bp, Artificial Sequence
  chemically synthesized
gaaaaagaaaaaaaagaaag

SEQ ID NO: 208816 - DNA, 20 bp, Artificial Sequence
  chemically synthesized
aaaaagaaaaaaaagaaaga

SEQ ID NO: 208817 - DNA, 20 bp, Artificial Sequence
  chemically synthesized
aaagaaaaaaaagaaagagg

SEQ ID NO: 208818 - DNA, 20 bp, Artificial Sequence
  chemically synthesized
aagaaaaaaaagaaagaggg

SEQ ID NO: 208819 - DNA, 20 bp, Artificial Sequence
  chemically synthesized
agaaaaaaaagaaagaggga

SEQ ID NO: 208820 - DNA, 20 bp, Artificial Sequence
  chemically synthesized
aaaaaaaagaaagagggagg

SEQ ID NO: 208821 - DNA, 20 bp, Artificial Sequence
  chemically synthesized
aaaaaaagaaagagggaggg

SEQ ID NO: 208822 - DNA, 20 bp, Artificial Sequence
  chemically synthesized
aaaaaagaaagagggaggga

SEQ ID NO: 208823 - DNA, 20 bp, Artificial Sequence
  chemically synthesized
aaaaagaaagagggagggag

SEQ ID NO: 208824 - DNA, 20 bp, Artificial Sequence
  chemically synthesized
agggagggaggggaaaaaaa

SEQ ID NO: 208825 - DNA, 20 bp, Artificial Sequence
  chemically synthesized
aaaaaaagaaaaaaatgtcc

SEQ ID NO: 208826 - DNA, 20 bp, Artificial Sequence
  chemically synthesized
cactttggttcagaatatct

SEQ ID NO: 208827 - DNA, 20 bp, Artificial Sequence
  chemically synthesized
ccactttggttcagaatatc

SEQ ID NO: 208828 - DNA, 20 bp, Artificial Sequence
  chemically synthesized
gtcctagatattctgaacca

SEQ ID NO: 208829 - DNA, 20 bp, Artificial Sequence
  chemically synthesized
acaggatgaccactttggtt

SEQ ID NO: 208830 - DNA, 20 bp, Artificial Sequence
  chemically synthesized
ctagatattctgaaccaaag

SEQ ID NO: 208831 - DNA, 20 bp, Artificial Sequence
  chemically synthesized
ttgtgacaggatgaccactt

SEQ ID NO: 208832 - DNA, 20 bp, Artificial Sequence
  chemically synthesized
gtaaaattacagattgtgac

SEQ ID NO: 208833 - DNA, 20 bp, Artificial Sequence
  chemically synthesized
ggtaaaattacagattgtga

SEQ ID NO: 208834 - DNA, 20 bp, Artificial Sequence
  chemically synthesized
tttaaaatggggtaaaatta

SEQ ID NO: 208835 - DNA, 20 bp, Artificial Sequence
  chemically synthesized
tgtaattttaccccatttta

SEQ ID NO: 208836 - DNA, 20 bp, Artificial Sequence
  chemically synthesized
cataaagagactttaaaatg

SEQ ID NO: 208837 - DNA, 20 bp, Artificial Sequence
  chemically synthesized
acataaagagactttaaaat

SEQ ID NO: 208838 - DNA, 20 bp, Artificial Sequence
  chemically synthesized
tacataaagagactttaaaa

SEQ ID NO: 208839 - DNA, 20 bp, Artificial Sequence
  chemically synthesized
aactagaaaatatacataaa

SEQ ID NO: 208840 - DNA, 20 bp, Artificial Sequence
  chemically synthesized
ataactagaaaatatacata

SEQ ID NO: 208841 - DNA, 20 bp, Artificial Sequence
  chemically synthesized
gtctctttatgtatattttc

SEQ ID NO: 208842 - DNA, 20 bp, Artificial Sequence
  chemically synthesized
gagacagaaaacaaaataac

SEQ ID NO: 208843 - DNA, 20 bp, Artificial Sequence
  chemically synthesized
ttacattctctcacaggaga

SEQ ID NO: 208844 - DNA, 20 bp, Artificial Sequence
  chemically synthesized
ttttgttttctgtctcctgt

SEQ ID NO: 208845 - DNA, 20 bp, Artificial Sequence
  chemically synthesized
ttgttttctgtctcctgtga

SEQ ID NO: 208846 - DNA, 20 bp, Artificial Sequence
  chemically synthesized
gatattacattctctcacag

SEQ ID NO: 208847 - DNA, 20 bp, Artificial Sequence
  chemically synthesized
tggatattacattctctcac

SEQ ID NO: 208848 - DNA, 20 bp, Artificial Sequence
  chemically synthesized
atggatattacattctctca

SEQ ID NO: 208849 - DNA, 20 bp, Artificial Sequence
  chemically synthesized
agatatgatttgtatcgaca

SEQ ID NO: 208850 - DNA, 20 bp, Artificial Sequence
  chemically synthesized
gatttcagcaattaacaatc

SEQ ID NO: 208851 - DNA, 20 bp, Artificial Sequence
  chemically synthesized
attgttaattgctgaaatcc

SEQ ID NO: 208852 - DNA, 20 bp, Artificial Sequence
  chemically synthesized
ttttgggcgcactgggattt

SEQ ID NO: 208853 - DNA, 20 bp, Artificial Sequence
  chemically synthesized
cgtgcaattttgggcgcact

SEQ ID NO: 208854 - DNA, 20 bp, Artificial Sequence
  chemically synthesized
acgtgcaattttgggcgcac

SEQ ID NO: 208855 - DNA, 20 bp, Artificial Sequence
  chemically synthesized
attacaggacgtgcaatttt

SEQ ID NO: 208856 - DNA, 20 bp, Artificial Sequence
  chemically synthesized
tattacaggacgtgcaattt

SEQ ID NO: 208857 - DNA, 20 bp, Artificial Sequence
  chemically synthesized
caaaattgcacgtcctgtaa

SEQ ID NO: 208858 - DNA, 20 bp, Artificial Sequence
  chemically synthesized
aaaattgcacgtcctgtaat

SEQ ID NO: 208859 - DNA, 20 bp, Artificial Sequence
  chemically synthesized
gtttatcaaacacctattac

SEQ ID NO: 208860 - DNA, 20 bp, Artificial Sequence
  chemically synthesized
agtttatcaaacacctatta

SEQ ID NO: 208861 - DNA, 20 bp, Artificial Sequence
  chemically synthesized
taacattcagaattcaacaa

SEQ ID NO: 208862 - DNA, 20 bp, Artificial Sequence
  chemically synthesized
ttgtcaaagggtttaacatt

SEQ ID NO: 208863 - DNA, 20 bp, Artificial Sequence
  chemically synthesized
tgaatgttaaaccctttgac

SEQ ID NO: 208864 - DNA, 20 bp, Artificial Sequence
  chemically synthesized
atgtcaggtcacttgtcaaa

SEQ ID NO: 208865 - DNA, 20 bp, Artificial Sequence
  chemically synthesized
catgtcaggtcacttgtcaa

SEQ ID NO: 208866 - DNA, 20 bp, Artificial Sequence
  chemically synthesized
tcatgtcaggtcacttgtca

SEQ ID NO: 208867 - DNA, 20 bp, Artificial Sequence
  chemically synthesized
aagtttttattcatcatgtc

SEQ ID NO: 208868 - DNA, 20 bp, Artificial Sequence
  chemically synthesized
taagtttttattcatcatgt

SEQ ID NO: 208869 - DNA, 20 bp, Artificial Sequence
  chemically synthesized
acatgatgaataaaaactta

SEQ ID NO: 208870 - DNA, 20 bp, Artificial Sequence
  chemically synthesized
catgatgaataaaaacttat

SEQ ID NO: 208871 - DNA, 20 bp, Artificial Sequence
  chemically synthesized
atgatgaataaaaacttata

SEQ ID NO: 208872 - DNA, 20 bp, Artificial Sequence
  chemically synthesized
ttttaatccttaaaccctat

SEQ ID NO: 208873 - DNA, 20 bp, Artificial Sequence
  chemically synthesized
aataaaaacttatagggttt

SEQ ID NO: 208874 - DNA, 20 bp, Artificial Sequence
  chemically synthesized
ataaaaacttatagggttta

SEQ ID NO: 208875 - DNA, 20 bp, Artificial Sequence
  chemically synthesized
aggattaaaaaatttccata

SEQ ID NO: 208876 - DNA, 20 bp, Artificial Sequence
  chemically synthesized
attaagtaaacaattcttta

SEQ ID NO: 208877 - DNA, 20 bp, Artificial Sequence
  chemically synthesized
agtcctagccattgtgaatt

SEQ ID NO: 208878 - DNA, 20 bp, Artificial Sequence
  chemically synthesized
attgtttacttaattcacaa

SEQ ID NO: 208879 - DNA, 20 bp, Artificial Sequence
  chemically synthesized
tttacttaattcacaatggc

SEQ ID NO: 208880 - DNA, 20 bp, Artificial Sequence
  chemically synthesized
ttacttaattcacaatggct

SEQ ID NO: 208881 - DNA, 20 bp, Artificial Sequence
  chemically synthesized
ctatacccattggcaagtcc

SEQ ID NO: 208882 - DNA, 20 bp, Artificial Sequence
  chemically synthesized
caatggctaggacttgccaa

SEQ ID NO: 208883 - DNA, 20 bp, Artificial Sequence
  chemically synthesized
aatggctaggacttgccaat

SEQ ID NO: 208884 - DNA, 20 bp, Artificial Sequence
  chemically synthesized
tggcctctatacccattggc

SEQ ID NO: 208885 - DNA, 20 bp, Artificial Sequence
  chemically synthesized
ctaggacttgccaatgggta

SEQ ID NO: 208886 - DNA, 20 bp, Artificial Sequence
  chemically synthesized
ctggtggcctctatacccat

SEQ ID NO: 208887 - DNA, 20 bp, Artificial Sequence
  chemically synthesized
aggacttgccaatgggtata

SEQ ID NO: 208888 - DNA, 20 bp, Artificial Sequence
  chemically synthesized
ggacttgccaatgggtatag

SEQ ID NO: 208889 - DNA, 20 bp, Artificial Sequence
  chemically synthesized
ccaatgggtatagaggccac

SEQ ID NO: 208890 - DNA, 20 bp, Artificial Sequence
  chemically synthesized
aatagttcaccagtttctgg

SEQ ID NO: 208891 - DNA, 20 bp, Artificial Sequence
  chemically synthesized
gtatagaggccaccagaaac

SEQ ID NO: 208892 - DNA, 20 bp, Artificial Sequence
  chemically synthesized
aaaaatagttcaccagtttc

SEQ ID NO: 208893 - DNA, 20 bp, Artificial Sequence
  chemically synthesized
gattttaaaaaatagttcac

SEQ ID NO: 208894 - DNA, 20 bp, Artificial Sequence
  chemically synthesized
tattatgagattttaaaaaa

SEQ ID NO: 208895 - DNA, 20 bp, Artificial Sequence
  chemically synthesized
tttttaaaatctcataatat

SEQ ID NO: 208896 - DNA, 20 bp, Artificial Sequence
  chemically synthesized
tatgattcctcttatattat

SEQ ID NO: 208897 - DNA, 20 bp, Artificial Sequence
  chemically synthesized
tttaaaatctcataatataa

SEQ ID NO: 208898 - DNA, 20 bp, Artificial Sequence
  chemically synthesized
ttaaaatctcataatataag

SEQ ID NO: 208899 - DNA, 20 bp, Artificial Sequence
  chemically synthesized
agaggaatcatattattaac

SEQ ID NO: 208900 - DNA, 20 bp, Artificial Sequence
  chemically synthesized
tcaaaactcagaatagtggc

SEQ ID NO: 208901 - DNA, 20 bp, Artificial Sequence
  chemically synthesized
tattaactggccactattct

SEQ ID NO: 208902 - DNA, 20 bp, Artificial Sequence
  chemically synthesized
tttttcaaaactcagaatag

SEQ ID NO: 208903 - DNA, 20 bp, Artificial Sequence
  chemically synthesized
atgtttttcaaaactcagaa

SEQ ID NO: 208904 - DNA, 20 bp, Artificial Sequence
  chemically synthesized
gtaaaatgtttttcaaaact

SEQ ID NO: 208905 - DNA, 20 bp, Artificial Sequence
  chemically synthesized
tttatttgaatcatttttta

SEQ ID NO: 208906 - DNA, 20 bp, Artificial Sequence
  chemically synthesized
tttaaaaaatgattcaaata

SEQ ID NO: 208907 - DNA, 20 bp, Artificial Sequence
  chemically synthesized
aaaaatgattcaaataaagc

SEQ ID NO: 208908 - DNA, 20 bp, Artificial Sequence
  chemically synthesized
aaaatgattcaaataaagca

SEQ ID NO: 208909 - DNA, 20 bp, Artificial Sequence
  chemically synthesized
aatgattcaaataaagcaag

SEQ ID NO: 208910 - DNA, 20 bp, Artificial Sequence
  chemically synthesized
ttcaaataaagcaaggagac

SEQ ID NO: 208911 - DNA, 20 bp, Artificial Sequence
  chemically synthesized
agcaaggagacgagtaatgc

SEQ ID NO: 208912 - DNA, 20 bp, Artificial Sequence
  chemically synthesized
cgagtaatgcaagtaatgcc

SEQ ID NO: 208913 - DNA, 20 bp, Artificial Sequence
  chemically synthesized
agataaacacaagtcatact

SEQ ID NO: 208914 - DNA, 20 bp, Artificial Sequence
  chemically synthesized
gtccattattagataaacac

SEQ ID NO: 208915 - DNA, 20 bp, Artificial Sequence
  chemically synthesized
gacttgtgtttatctaataa

SEQ ID NO: 208916 - DNA, 20 bp, Artificial Sequence
  chemically synthesized
taagtaacaaagtccattat

SEQ ID NO: 208917 - DNA, 20 bp, Artificial Sequence
  chemically synthesized
ccatgtggctataagtaaca

SEQ ID NO: 208918 - DNA, 20 bp, Artificial Sequence
  chemically synthesized
ataatggactttgttactta

SEQ ID NO: 208919 - DNA, 20 bp, Artificial Sequence
  chemically synthesized
ctaaaattccatgtggctat

SEQ ID NO: 208920 - DNA, 20 bp, Artificial Sequence
  chemically synthesized
ctttgttacttatagccaca

SEQ ID NO: 208921 - DNA, 20 bp, Artificial Sequence
  chemically synthesized
tgcagccctaaaattccatg

SEQ ID NO: 208922 - DNA, 20 bp, Artificial Sequence
  chemically synthesized
cttatagccacatggaattt

SEQ ID NO: 208923 - DNA, 20 bp, Artificial Sequence
  chemically synthesized
ttatagccacatggaatttt

SEQ ID NO: 208924 - DNA, 20 bp, Artificial Sequence
  chemically synthesized
tatagccacatggaatttta

SEQ ID NO: 208925 - DNA, 20 bp, Artificial Sequence
  chemically synthesized
gtgcctctccttgttgtttg

SEQ ID NO: 208926 - DNA, 20 bp, Artificial Sequence
  chemically synthesized
attttagggctgcaaacaac

SEQ ID NO: 208927 - DNA, 20 bp, Artificial Sequence
  chemically synthesized
ttttagggctgcaaacaaca

SEQ ID NO: 208928 - DNA, 20 bp, Artificial Sequence
  chemically synthesized
ttagggctgcaaacaacaag

SEQ ID NO: 208929 - DNA, 20 bp, Artificial Sequence
  chemically synthesized
agggctgcaaacaacaagga

SEQ ID NO: 208930 - DNA, 20 bp, Artificial Sequence
  chemically synthesized
gggctgcaaacaacaaggag

SEQ ID NO: 208931 - DNA, 20 bp, Artificial Sequence
  chemically synthesized
aacactgtgattacagaagg

SEQ ID NO: 208932 - DNA, 20 bp, Artificial Sequence
  chemically synthesized
caacactgtgattacagaag

SEQ ID NO: 208933 - DNA, 20 bp, Artificial Sequence
  chemically synthesized
agcaacactgtgattacaga

SEQ ID NO: 208934 - DNA, 20 bp, Artificial Sequence
  chemically synthesized
tagcaacactgtgattacag

SEQ ID NO: 208935 - DNA, 20 bp, Artificial Sequence
  chemically synthesized
ggcacctccttctgtaatca

SEQ ID NO: 208936 - DNA, 20 bp, Artificial Sequence
  chemically synthesized
ttatagcaacactgtgatta

SEQ ID NO: 208937 - DNA, 20 bp, Artificial Sequence
  chemically synthesized
tcacagtgttgctataatta

SEQ ID NO: 208938 - DNA, 20 bp, Artificial Sequence
  chemically synthesized
caaacctttgtctgtaatta

SEQ ID NO: 208939 - DNA, 20 bp, Artificial Sequence
  chemically synthesized
tgttgctataattacagaca

SEQ ID NO: 208940 - DNA, 20 bp, Artificial Sequence
  chemically synthesized
gttgctataattacagacaa

SEQ ID NO: 208941 - DNA, 20 bp, Artificial Sequence
  chemically synthesized
aattacagacaaaggtttgt

SEQ ID NO: 208942 - DNA, 20 bp, Artificial Sequence
  chemically synthesized
tttgtcagcatttccattaa

SEQ ID NO: 208943 - DNA, 20 bp, Artificial Sequence
  chemically synthesized
gcttagttaagttcttttaa

SEQ ID NO: 208944 - DNA, 20 bp, Artificial Sequence
  chemically synthesized
tccattaaaagaacttaact

SEQ ID NO: 208945 - DNA, 20 bp, Artificial Sequence
  chemically synthesized
ggacatttaacagcttagtt

SEQ ID NO: 208946 - DNA, 20 bp, Artificial Sequence
  chemically synthesized
ctaatggacatttaacagct

SEQ ID NO: 208947 - DNA, 20 bp, Artificial Sequence
  chemically synthesized
ttaggctaatggacatttaa

SEQ ID NO: 208948 - DNA, 20 bp, Artificial Sequence
  chemically synthesized
ctaagctgttaaatgtccat

SEQ ID NO: 208949 - DNA, 20 bp, Artificial Sequence
  chemically synthesized
taagccatatattaggctaa

SEQ ID NO: 208950 - DNA, 20 bp, Artificial Sequence
  chemically synthesized
atgtccattagcctaatata

SEQ ID NO: 208951 - DNA, 20 bp, Artificial Sequence
  chemically synthesized
gatattataagccatatatt

SEQ ID NO: 208952 - DNA, 20 bp, Artificial Sequence
  chemically synthesized
agatattataagccatatat

SEQ ID NO: 208953 - DNA, 20 bp, Artificial Sequence
  chemically synthesized
gcagttagctaagatattat

SEQ ID NO: 208954 - DNA, 20 bp, Artificial Sequence
  chemically synthesized
atatatggcttataatatct

SEQ ID NO: 208955 - DNA, 20 bp, Artificial Sequence
  chemically synthesized
tttttaatatgcagttagct

SEQ ID NO: 208956 - DNA, 20 bp, Artificial Sequence
  chemically synthesized
agctgtttttaatatgcagt

SEQ ID NO: 208957 - DNA, 20 bp, Artificial Sequence
  chemically synthesized
aattagctgtttttaatatg

SEQ ID NO: 208958 - DNA, 20 bp, Artificial Sequence
  chemically synthesized
agctaactgcatattaaaaa

SEQ ID NO: 208959 - DNA, 20 bp, Artificial Sequence
  chemically synthesized
aaaatccatccatttttaat

SEQ ID NO: 208960 - DNA, 20 bp, Artificial Sequence
  chemically synthesized
taaaaacagctaattaaaaa

SEQ ID NO: 208961 - DNA, 20 bp, Artificial Sequence
  chemically synthesized
aacagctaattaaaaatgga

SEQ ID NO: 208962 - DNA, 20 bp, Artificial Sequence
  chemically synthesized
aatggatggatttttaaata

SEQ ID NO: 208963 - DNA, 20 bp, Artificial Sequence
  chemically synthesized
aataaagttatgtaaatacc

SEQ ID NO: 208964 - DNA, 20 bp, Artificial Sequence
  chemically synthesized
aaagttatgtaaatacccag

SEQ ID NO: 208965 - DNA, 20 bp, Artificial Sequence
  chemically synthesized
ttaaagagctgatttcttct

SEQ ID NO: 208966 - DNA, 20 bp, Artificial Sequence
  chemically synthesized
cttaaagagctgatttcttc

SEQ ID NO: 208967 - DNA, 20 bp, Artificial Sequence
  chemically synthesized
tgtaaatacccagaagaaat

SEQ ID NO: 208968 - DNA, 20 bp, Artificial Sequence
  chemically synthesized
ccagaagaaatcagctcttt

SEQ ID NO: 208969 - DNA, 20 bp, Artificial Sequence
  chemically synthesized
tagaaatgtgcacacttaaa

SEQ ID NO: 208970 - DNA, 20 bp, Artificial Sequence
  chemically synthesized
tatagaaatgtgcacactta

SEQ ID NO: 208971 - DNA, 20 bp, Artificial Sequence
  chemically synthesized
agcttgcacttatattgtta

SEQ ID NO: 208972 - DNA, 20 bp, Artificial Sequence
  chemically synthesized
gcacatttctataacaatat

SEQ ID NO: 208973 - DNA, 20 bp, Artificial Sequence
  chemically synthesized
ttctataacaatataagtgc

SEQ ID NO: 208974 - DNA, 20 bp, Artificial Sequence
  chemically synthesized
attcaaatactggggaaaaa

SEQ ID NO: 208975 - DNA, 20 bp, Artificial Sequence
  chemically synthesized
aagtgcaagctttttttccc

SEQ ID NO: 208976 - DNA, 20 bp, Artificial Sequence
  chemically synthesized
aatagacaattcaaatactg

SEQ ID NO: 208977 - DNA, 20 bp, Artificial Sequence
  chemically synthesized
aaatagacaattcaaatact

SEQ ID NO: 208978 - DNA, 20 bp, Artificial Sequence
  chemically synthesized
taaatagacaattcaaatac

SEQ ID NO: 208979 - DNA, 20 bp, Artificial Sequence
  chemically synthesized
ttaaaaataatgcatataaa

SEQ ID NO: 208980 - DNA, 20 bp, Artificial Sequence
  chemically synthesized
tttccagaacattttaggtt

SEQ ID NO: 208981 - DNA, 20 bp, Artificial Sequence
  chemically synthesized
atccctttccagaacatttt

SEQ ID NO: 208982 - DNA, 20 bp, Artificial Sequence
  chemically synthesized
aatccctttccagaacattt

SEQ ID NO: 208983 - DNA, 20 bp, Artificial Sequence
  chemically synthesized
aaacttaacctaaaatgttc

SEQ ID NO: 208984 - DNA, 20 bp, Artificial Sequence
  chemically synthesized
ttaacctaaaatgttctgga

SEQ ID NO: 208985 - DNA, 20 bp, Artificial Sequence
  chemically synthesized
taacctaaaatgttctggaa

SEQ ID NO: 208986 - DNA, 20 bp, Artificial Sequence
  chemically synthesized
aacctaaaatgttctggaaa

SEQ ID NO: 208987 - DNA, 20 bp, Artificial Sequence
  chemically synthesized
attgttatgtaatccctttc

SEQ ID NO: 208988 - DNA, 20 bp, Artificial Sequence
  chemically synthesized
gaaagggattacataacaat

SEQ ID NO: 208989 - DNA, 20 bp, Artificial Sequence
  chemically synthesized
aataagcacaatgttgtcat

SEQ ID NO: 208990 - DNA, 20 bp, Artificial Sequence
  chemically synthesized
aagcacaatgttgtcataag

SEQ ID NO: 208991 - DNA, 20 bp, Artificial Sequence
  chemically synthesized
agcacaatgttgtcataaga

SEQ ID NO: 208992 - DNA, 20 bp, Artificial Sequence
  chemically synthesized
acaatgttgtcataagaagg

SEQ ID NO: 208993 - DNA, 20 bp, Artificial Sequence
  chemically synthesized
tcataagaaggaagaatgaa

SEQ ID NO: 208994 - DNA, 20 bp, Artificial Sequence
  chemically synthesized
cagcgtccatcacagtagtc

SEQ ID NO: 208995 - DNA, 20 bp, Artificial Sequence
  chemically synthesized
gaacggcttgactactgtga

SEQ ID NO: 208996 - DNA, 20 bp, Artificial Sequence
  chemically synthesized
ttcatcagcgtccatcacag

SEQ ID NO: 208997 - DNA, 20 bp, Artificial Sequence
  chemically synthesized
tagttcatcagcgtccatca

SEQ ID NO: 208998 - DNA, 20 bp, Artificial Sequence
  chemically synthesized
gggaaatctgagtagttcat

SEQ ID NO: 208999 - DNA, 20 bp, Artificial Sequence
  chemically synthesized
atggacgctgatgaactact

SEQ ID NO: 209000 - DNA, 20 bp, Artificial Sequence
  chemically synthesized
ttattgaagggaaatctgag

SEQ ID NO: 209001 - DNA, 20 bp, Artificial Sequence
  chemically synthesized
tctttattgaagggaaatct

SEQ ID NO: 209002 - DNA, 20 bp, Artificial Sequence
  chemically synthesized
actcagatttcccttcaata

SEQ ID NO: 209003 - DNA, 20 bp, Artificial Sequence
  chemically synthesized
gggacaagttctttattgaa

SEQ ID NO: 209004 - DNA, 20 bp, Artificial Sequence
  chemically synthesized
tgggacaagttctttattga

SEQ ID NO: 209005 - DNA, 20 bp, Artificial Sequence
  chemically synthesized
ctgggacaagttctttattg

SEQ ID NO: 209006 - DNA, 20 bp, Artificial Sequence
  chemically synthesized
cttcaataaagaacttgtcc

SEQ ID NO: 209007 - DNA, 20 bp, Artificial Sequence
  chemically synthesized
caataaagaacttgtcccag

SEQ ID NO: 209008 - DNA, 20 bp, Artificial Sequence
  chemically synthesized
gcccttccacctgctgggac

SEQ ID NO: 209009 - DNA, 20 bp, Artificial Sequence
  chemically synthesized
aataaagaacttgtcccagc

SEQ ID NO: 209010 - DNA, 20 bp, Artificial Sequence
  chemically synthesized
aaagaacttgtcccagcagg

SEQ ID NO: 209011 - DNA, 20 bp, Artificial Sequence
  chemically synthesized
caccagcccttccacctgct

SEQ ID NO: 209012 - DNA, 20 bp, Artificial Sequence
  chemically synthesized
ccaccagcccttccacctgc

SEQ ID NO: 209013 - DNA, 20 bp, Artificial Sequence
  chemically synthesized
gaacttgtcccagcaggtgg

SEQ ID NO: 209014 - DNA, 20 bp, Artificial Sequence
  chemically synthesized
aacttgtcccagcaggtgga

SEQ ID NO: 209015 - DNA, 20 bp, Artificial Sequence
  chemically synthesized
acttgtcccagcaggtggaa

SEQ ID NO: 209016 - DNA, 20 bp, Artificial Sequence
  chemically synthesized
gtcccagcaggtggaagggc

SEQ ID NO: 209017 - DNA, 20 bp, Artificial Sequence
  chemically synthesized
ccagcaggtggaagggctgg

SEQ ID NO: 209018 - DNA, 20 bp, Artificial Sequence
  chemically synthesized
gcaggtggaagggctggtgg

SEQ ID NO: 209019 - DNA, 20 bp, Artificial Sequence
  chemically synthesized
agctgaaggctgtctgccac

SEQ ID NO: 209020 - DNA, 20 bp, Artificial Sequence
  chemically synthesized
gtggaagggctggtggcaga

SEQ ID NO: 209021 - DNA, 20 bp, Artificial Sequence
  chemically synthesized
ggctggtggcagacagcctt

SEQ ID NO: 209022 - DNA, 20 bp, Artificial Sequence
  chemically synthesized
cccctaaaactgagagctga

SEQ ID NO: 209023 - DNA, 20 bp, Artificial Sequence
  chemically synthesized
ggcagacagccttcagctct

SEQ ID NO: 209024 - DNA, 20 bp, Artificial Sequence
  chemically synthesized
acccctaaaactgagagctg

SEQ ID NO: 209025 - DNA, 20 bp, Artificial Sequence
  chemically synthesized
cagccttcagctctcagttt

SEQ ID NO: 209026 - DNA, 20 bp, Artificial Sequence
  chemically synthesized
gggaccacccctaaaactga

SEQ ID NO: 209027 - DNA, 20 bp, Artificial Sequence
  chemically synthesized
agccttcagctctcagtttt

SEQ ID NO: 209028 - DNA, 20 bp, Artificial Sequence
  chemically synthesized
gccttcagctctcagtttta

SEQ ID NO: 209029 - DNA, 20 bp, Artificial Sequence
  chemically synthesized
ctgggaccacccctaaaact

SEQ ID NO: 209030 - DNA, 20 bp, Artificial Sequence
  chemically synthesized
ccttcagctctcagttttag

SEQ ID NO: 209031 - DNA, 20 bp, Artificial Sequence
  chemically synthesized
tcagctctcagttttagggg

SEQ ID NO: 209032 - DNA, 20 bp, Artificial Sequence
  chemically synthesized
ctcagttttaggggtggtcc

SEQ ID NO: 209033 - DNA, 20 bp, Artificial Sequence
  chemically synthesized
taggggtggtcccagccatg

SEQ ID NO: 209034 - DNA, 20 bp, Artificial Sequence
  chemically synthesized
caagggggctcttcatggct

SEQ ID NO: 209035 - DNA, 20 bp, Artificial Sequence
  chemically synthesized
gcaagggggctcttcatggc

SEQ ID NO: 209036 - DNA, 20 bp, Artificial Sequence
  chemically synthesized
ggggtggtcccagccatgaa

SEQ ID NO: 209037 - DNA, 20 bp, Artificial Sequence
  chemically synthesized
ttgtgcaagggggctcttca

SEQ ID NO: 209038 - DNA, 20 bp, Artificial Sequence
  chemically synthesized
agtcatgaccttgtgcaagg

SEQ ID NO: 209039 - DNA, 20 bp, Artificial Sequence
  chemically synthesized
catgaagagcccccttgcac

SEQ ID NO: 209040 - DNA, 20 bp, Artificial Sequence
  chemically synthesized
aagtcatgaccttgtgcaag

SEQ ID NO: 209041 - DNA, 20 bp, Artificial Sequence
  chemically synthesized
atgaagagcccccttgcaca

SEQ ID NO: 209042 - DNA, 20 bp, Artificial Sequence
  chemically synthesized
taagtcatgaccttgtgcaa

SEQ ID NO: 209043 - DNA, 20 bp, Artificial Sequence
  chemically synthesized
ataagtcatgaccttgtgca

SEQ ID NO: 209044 - DNA, 20 bp, Artificial Sequence
  chemically synthesized
aataagtcatgaccttgtgc

SEQ ID NO: 209045 - DNA, 20 bp, Artificial Sequence
  chemically synthesized
caaggtcatgacttatttct

SEQ ID NO: 209046 - DNA, 20 bp, Artificial Sequence
  chemically synthesized
atgatagccttctcagaaat

SEQ ID NO: 209047 - DNA, 20 bp, Artificial Sequence
  chemically synthesized
ggtcatgacttatttctgag

SEQ ID NO: 209048 - DNA, 20 bp, Artificial Sequence
  chemically synthesized
gtcatgacttatttctgaga

SEQ ID NO: 209049 - DNA, 20 bp, Artificial Sequence
  chemically synthesized
tcattggatgatagccttct

SEQ ID NO: 209050 - DNA, 20 bp, Artificial Sequence
  chemically synthesized
attaatcagtcattggatga

SEQ ID NO: 209051 - DNA, 20 bp, Artificial Sequence
  chemically synthesized
ctcctgcattaatcagtcat

SEQ ID NO: 209052 - DNA, 20 bp, Artificial Sequence
  chemically synthesized
catccaatgactgattaatg

SEQ ID NO: 209053 - DNA, 20 bp, Artificial Sequence
  chemically synthesized
cttactactcctgcattaat

SEQ ID NO: 209054 - DNA, 20 bp, Artificial Sequence
  chemically synthesized
atccaatgactgattaatgc

SEQ ID NO: 209055 - DNA, 20 bp, Artificial Sequence
  chemically synthesized
ccaatgactgattaatgcag

SEQ ID NO: 209056 - DNA, 20 bp, Artificial Sequence
  chemically synthesized
atgactgattaatgcaggag

SEQ ID NO: 209057 - DNA, 20 bp, Artificial Sequence
  chemically synthesized
ctgattaatgcaggagtagt

SEQ ID NO: 209058 - DNA, 20 bp, Artificial Sequence
  chemically synthesized
tgattaatgcaggagtagta

SEQ ID NO: 209059 - DNA, 20 bp, Artificial Sequence
  chemically synthesized
agagtagtcctgagaacagt

SEQ ID NO: 209060 - DNA, 20 bp, Artificial Sequence
  chemically synthesized
gtagtaaggctcactgttct

SEQ ID NO: 209061 - DNA, 20 bp, Artificial Sequence
  chemically synthesized
tagtaaggctcactgttctc

SEQ ID NO: 209062 - DNA, 20 bp, Artificial Sequence
  chemically synthesized
cttcagagtagtcctgagaa

SEQ ID NO: 209063 - DNA, 20 bp, Artificial Sequence
  chemically synthesized
tgacccttcagagtagtcct

SEQ ID NO: 209064 - DNA, 20 bp, Artificial Sequence
  chemically synthesized
ctgttctcaggactactctg

SEQ ID NO: 209065 - DNA, 20 bp, Artificial Sequence
  chemically synthesized
tgttctcaggactactctga

SEQ ID NO: 209066 - DNA, 20 bp, Artificial Sequence
  chemically synthesized
gttctcaggactactctgaa

SEQ ID NO: 209067 - DNA, 20 bp, Artificial Sequence
  chemically synthesized
cttcgaatgacccttcagag

SEQ ID NO: 209068 - DNA, 20 bp, Artificial Sequence
  chemically synthesized
gagcttcgaatgacccttca

SEQ ID NO: 209069 - DNA, 20 bp, Artificial Sequence
  chemically synthesized
cagagcttcgaatgaccctt

SEQ ID NO: 209070 - DNA, 20 bp, Artificial Sequence
  chemically synthesized
ctactctgaagggtcattcg

SEQ ID NO: 209071 - DNA, 20 bp, Artificial Sequence
  chemically synthesized
aagggtcattcgaagctctg

SEQ ID NO: 209072 - DNA, 20 bp, Artificial Sequence
  chemically synthesized
caaacatatgggaagcttca

SEQ ID NO: 209073 - DNA, 20 bp, Artificial Sequence
  chemically synthesized
accaaacatatgggaagctt

SEQ ID NO: 209074 - DNA, 20 bp, Artificial Sequence
  chemically synthesized
caattgaccaaacatatggg

SEQ ID NO: 209075 - DNA, 20 bp, Artificial Sequence
  chemically synthesized
tctgaagcttcccatatgtt

SEQ ID NO: 209076 - DNA, 20 bp, Artificial Sequence
  chemically synthesized
tcccaattgaccaaacatat

SEQ ID NO: 209077 - DNA, 20 bp, Artificial Sequence
  chemically synthesized
ttcccaattgaccaaacata

SEQ ID NO: 209078 - DNA, 20 bp, Artificial Sequence
  chemically synthesized
ttcccatatgtttggtcaat

SEQ ID NO: 209079 - DNA, 20 bp, Artificial Sequence
  chemically synthesized
tcccatatgtttggtcaatt

SEQ ID NO: 209080 - DNA, 20 bp, Artificial Sequence
  chemically synthesized
atgtttggtcaattgggaaa

SEQ ID NO: 209081 - DNA, 20 bp, Artificial Sequence
  chemically synthesized
tcaattgggaaacagctcta

SEQ ID NO: 209082 - DNA, 20 bp, Artificial Sequence
  chemically synthesized
aattgggaaacagctctatg

SEQ ID NO: 209083 - DNA, 20 bp, Artificial Sequence
  chemically synthesized
attgggaaacagctctatgg

SEQ ID NO: 209084 - DNA, 20 bp, Artificial Sequence
  chemically synthesized
tatcattgggcacctccata

SEQ ID NO: 209085 - DNA, 20 bp, Artificial Sequence
  chemically synthesized
aatatcattgggcacctcca

SEQ ID NO: 209086 - DNA, 20 bp, Artificial Sequence
  chemically synthesized
tggatacttataatatcatt

SEQ ID NO: 209087 - DNA, 20 bp, Artificial Sequence
  chemically synthesized
gtggatacttataatatcat

SEQ ID NO: 209088 - DNA, 20 bp, Artificial Sequence
  chemically synthesized
gaggtgcccaatgatattat

SEQ ID NO: 209089 - DNA, 20 bp, Artificial Sequence
  chemically synthesized
tgatattataagtatccaca

SEQ ID NO: 209090 - DNA, 20 bp, Artificial Sequence
  chemically synthesized
gatattataagtatccacat

SEQ ID NO: 209091 - DNA, 20 bp, Artificial Sequence
  chemically synthesized
ctttgtgtatgtggcctatg

SEQ ID NO: 209092 - DNA, 20 bp, Artificial Sequence
  chemically synthesized
gcagttgaactttgtgtatg

SEQ ID NO: 209093 - DNA, 20 bp, Artificial Sequence
  chemically synthesized
ccacataggccacatacaca

SEQ ID NO: 209094 - DNA, 20 bp, Artificial Sequence
  chemically synthesized
acatacacaaagttcaactg

SEQ ID NO: 209095 - DNA, 20 bp, Artificial Sequence
  chemically synthesized
tcaagacgtgggtcaatctg

SEQ ID NO: 209096 - DNA, 20 bp, Artificial Sequence
  chemically synthesized
cagagcatttgtcaagacgt

SEQ ID NO: 209097 - DNA, 20 bp, Artificial Sequence
  chemically synthesized
acagagcatttgtcaagacg

SEQ ID NO: 209098 - DNA, 20 bp, Artificial Sequence
  chemically synthesized
aggatcacagagcatttgtc

SEQ ID NO: 209099 - DNA, 20 bp, Artificial Sequence
  chemically synthesized
cccatgttggaaggatcaca

SEQ ID NO: 209100 - DNA, 20 bp, Artificial Sequence
  chemically synthesized
ttcccatgttggaaggatca

SEQ ID NO: 209101 - DNA, 20 bp, Artificial Sequence
  chemically synthesized
gctctgtgatccttccaaca

SEQ ID NO: 209102 - DNA, 20 bp, Artificial Sequence
  chemically synthesized
gcctatcttcccatgttgga

SEQ ID NO: 209103 - DNA, 20 bp, Artificial Sequence
  chemically synthesized
ctctgtgatccttccaacat

SEQ ID NO: 209104 - DNA, 20 bp, Artificial Sequence
  chemically synthesized
tgcctatcttcccatgttgg

SEQ ID NO: 209105 - DNA, 20 bp, Artificial Sequence
  chemically synthesized
tgtgatccttccaacatggg

SEQ ID NO: 209106 - DNA, 20 bp, Artificial Sequence
  chemically synthesized
gactgcctatcttcccatgt

SEQ ID NO: 209107 - DNA, 20 bp, Artificial Sequence
  chemically synthesized
atccttccaacatgggaaga

SEQ ID NO: 209108 - DNA, 20 bp, Artificial Sequence
  chemically synthesized
tccttccaacatgggaagat

SEQ ID NO: 209109 - DNA, 20 bp, Artificial Sequence
  chemically synthesized
ttccaacatgggaagatagg

SEQ ID NO: 209110 - DNA, 20 bp, Artificial Sequence
  chemically synthesized
atgggaagataggcagtctt

SEQ ID NO: 209111 - DNA, 20 bp, Artificial Sequence
  chemically synthesized
gggaagataggcagtcttga

SEQ ID NO: 209112 - DNA, 20 bp, Artificial Sequence
  chemically synthesized
ggaagataggcagtcttgag

SEQ ID NO: 209113 - DNA, 20 bp, Artificial Sequence
  chemically synthesized
agataggcagtcttgagagg

SEQ ID NO: 209114 - DNA, 20 bp, Artificial Sequence
  chemically synthesized
gccttggtagacttcctctc

SEQ ID NO: 209115 - DNA, 20 bp, Artificial Sequence
  chemically synthesized
gtcttgagaggaagtctacc

SEQ ID NO: 209116 - DNA, 20 bp, Artificial Sequence
  chemically synthesized
tcttgagaggaagtctacca

SEQ ID NO: 209117 - DNA, 20 bp, Artificial Sequence
  chemically synthesized
tgggtggaatattgccttgg

SEQ ID NO: 209118 - DNA, 20 bp, Artificial Sequence
  chemically synthesized
aggtgggtggaatattgcct

SEQ ID NO: 209119 - DNA, 20 bp, Artificial Sequence
  chemically synthesized
cctaaagatacagaggtggg

SEQ ID NO: 209120 - DNA, 20 bp, Artificial Sequence
  chemically synthesized
ttccctaaagatacagaggt

SEQ ID NO: 209121 - DNA, 20 bp, Artificial Sequence
  chemically synthesized
cttccctaaagatacagagg

SEQ ID NO: 209122 - DNA, 20 bp, Artificial Sequence
  chemically synthesized
ggacttccctaaagatacag

SEQ ID NO: 209123 - DNA, 20 bp, Artificial Sequence
  chemically synthesized
gggacttccctaaagataca

SEQ ID NO: 209124 - DNA, 20 bp, Artificial Sequence
  chemically synthesized
tccacccacctctgtatctt

SEQ ID NO: 209125 - DNA, 20 bp, Artificial Sequence
  chemically synthesized
ccacccacctctgtatcttt

SEQ ID NO: 209126 - DNA, 20 bp, Artificial Sequence
  chemically synthesized
aagggacttccctaaagata

SEQ ID NO: 209127 - DNA, 20 bp, Artificial Sequence
  chemically synthesized
cacccacctctgtatcttta

SEQ ID NO: 209128 - DNA, 20 bp, Artificial Sequence
  chemically synthesized
ccacctctgtatctttaggg

SEQ ID NO: 209129 - DNA, 20 bp, Artificial Sequence
  chemically synthesized
caaggtaagggacttcccta

SEQ ID NO: 209130 - DNA, 20 bp, Artificial Sequence
  chemically synthesized
cgccacctcccacaaggtaa

SEQ ID NO: 209131 - DNA, 20 bp, Artificial Sequence
  chemically synthesized
tagggaagtcccttaccttg

SEQ ID NO: 209132 - DNA, 20 bp, Artificial Sequence
  chemically synthesized
tcgccacctcccacaaggta

SEQ ID NO: 209133 - DNA, 20 bp, Artificial Sequence
  chemically synthesized
agggaagtcccttaccttgt

SEQ ID NO: 209134 - DNA, 20 bp, Artificial Sequence
  chemically synthesized
atcgccacctcccacaaggt

SEQ ID NO: 209135 - DNA, 20 bp, Artificial Sequence
  chemically synthesized
ggaagtcccttaccttgtgg

SEQ ID NO: 209136 - DNA, 20 bp, Artificial Sequence
  chemically synthesized
gaagtcccttaccttgtggg

SEQ ID NO: 209137 - DNA, 20 bp, Artificial Sequence
  chemically synthesized
ttctatcgccacctcccaca

SEQ ID NO: 209138 - DNA, 20 bp, Artificial Sequence
  chemically synthesized
gttctatcgccacctcccac

SEQ ID NO: 209139 - DNA, 20 bp, Artificial Sequence
  chemically synthesized
gtcccttaccttgtgggagg

SEQ ID NO: 209140 - DNA, 20 bp, Artificial Sequence
  chemically synthesized
taccttgtgggaggtggcga

SEQ ID NO: 209141 - DNA, 20 bp, Artificial Sequence
  chemically synthesized
ccataaccagaaaggcagat

SEQ ID NO: 209142 - DNA, 20 bp, Artificial Sequence
  chemically synthesized
acatttctcatctgcctttc

SEQ ID NO: 209143 - DNA, 20 bp, Artificial Sequence
  chemically synthesized
tctcaccataaccagaaagg

SEQ ID NO: 209144 - DNA, 20 bp, Artificial Sequence
  chemically synthesized
atgtctcaccataaccagaa

SEQ ID NO: 209145 - DNA, 20 bp, Artificial Sequence
  chemically synthesized
tatgtctcaccataaccaga

SEQ ID NO: 209146 - DNA, 20 bp, Artificial Sequence
  chemically synthesized
ctcatctgcctttctggtta

SEQ ID NO: 209147 - DNA, 20 bp, Artificial Sequence
  chemically synthesized
atcatatgtctcaccataac

SEQ ID NO: 209148 - DNA, 20 bp, Artificial Sequence
  chemically synthesized
tctgcctttctggttatggt

SEQ ID NO: 209149 - DNA, 20 bp, Artificial Sequence
  chemically synthesized
agacatatgatgttccatct

SEQ ID NO: 209150 - DNA, 20 bp, Artificial Sequence
  chemically synthesized
tactttaaggggagctgaga

SEQ ID NO: 209151 - DNA, 20 bp, Artificial Sequence
  chemically synthesized
gctgtactttaaggggagct

SEQ ID NO: 209152 - DNA, 20 bp, Artificial Sequence
  chemically synthesized
ttccatctcagctcccctta

SEQ ID NO: 209153 - DNA, 20 bp, Artificial Sequence
  chemically synthesized
ctgcagctgtactttaaggg

SEQ ID NO: 209154 - DNA, 20 bp, Artificial Sequence
  chemically synthesized
ctctgcagctgtactttaag

SEQ ID NO: 209155 - DNA, 20 bp, Artificial Sequence
  chemically synthesized
actctgcagctgtactttaa

SEQ ID NO: 209156 - DNA, 20 bp, Artificial Sequence
  chemically synthesized
tctcagctccccttaaagta

SEQ ID NO: 209157 - DNA, 20 bp, Artificial Sequence
  chemically synthesized
tactctgcagctgtacttta

SEQ ID NO: 209158 - DNA, 20 bp, Artificial Sequence
  chemically synthesized
atactctgcagctgtacttt

SEQ ID NO: 209159 - DNA, 20 bp, Artificial Sequence
  chemically synthesized
ctccccttaaagtacagctg

SEQ ID NO: 209160 - DNA, 20 bp, Artificial Sequence
  chemically synthesized
ccccttaaagtacagctgca

SEQ ID NO: 209161 - DNA, 20 bp, Artificial Sequence
  chemically synthesized
ttaagcagttttatactctg

SEQ ID NO: 209162 - DNA, 20 bp, Artificial Sequence
  chemically synthesized
aatttcgtcatgcaattaag

SEQ ID NO: 209163 - DNA, 20 bp, Artificial Sequence
  chemically synthesized
gccaatttcgtcatgcaatt

SEQ ID NO: 209164 - DNA, 20 bp, Artificial Sequence
  chemically synthesized
gcttaattgcatgacgaaat

SEQ ID NO: 209165 - DNA, 20 bp, Artificial Sequence
  chemically synthesized
gtgtgcactctgttgttgag

SEQ ID NO: 209166 - DNA, 20 bp, Artificial Sequence
  chemically synthesized
cgaaattggcttctcaacaa

SEQ ID NO: 209167 - DNA, 20 bp, Artificial Sequence
  chemically synthesized
aaattggcttctcaacaaca

SEQ ID NO: 209168 - DNA, 20 bp, Artificial Sequence
  chemically synthesized
gcagtgtgcactctgttgtt

SEQ ID NO: 209169 - DNA, 20 bp, Artificial Sequence
  chemically synthesized
cagatgacatgcaacacaag

SEQ ID NO: 209170 - DNA, 20 bp, Artificial Sequence
  chemically synthesized
gaccagatgacatgcaacac

SEQ ID NO: 209171 - DNA, 20 bp, Artificial Sequence
  chemically synthesized
tgcttgtgttgcatgtcatc

SEQ ID NO: 209172 - DNA, 20 bp, Artificial Sequence
  chemically synthesized
gataccaaaattaaagagac

SEQ ID NO: 209173 - DNA, 20 bp, Artificial Sequence
  chemically synthesized
agtatgataccaaaattaaa

SEQ ID NO: 209174 - DNA, 20 bp, Artificial Sequence
  chemically synthesized
tcatctggtctctttaattt

SEQ ID NO: 209175 - DNA, 20 bp, Artificial Sequence
  chemically synthesized
acagtatgataccaaaatta

SEQ ID NO: 209176 - DNA, 20 bp, Artificial Sequence
  chemically synthesized
ttaattttggtatcatactg

SEQ ID NO: 209177 - DNA, 20 bp, Artificial Sequence
  chemically synthesized
taattttggtatcatactgt

SEQ ID NO: 209178 - DNA, 20 bp, Artificial Sequence
  chemically synthesized
ttggtatcatactgtgggac

SEQ ID NO: 209179 - DNA, 20 bp, Artificial Sequence
  chemically synthesized
ttcctgtgtcacttgtccca

SEQ ID NO: 209180 - DNA, 20 bp, Artificial Sequence
  chemically synthesized
atactgtgggacaagtgaca

SEQ ID NO: 209181 - DNA, 20 bp, Artificial Sequence
  chemically synthesized
tactgtgggacaagtgacac

SEQ ID NO: 209182 - DNA, 20 bp, Artificial Sequence
  chemically synthesized
aagtatgatcagcatggtgt

SEQ ID NO: 209183 - DNA, 20 bp, Artificial Sequence
  chemically synthesized
catcaaaagtatgatcagca

SEQ ID NO: 209184 - DNA, 20 bp, Artificial Sequence
  chemically synthesized
ataggcatcaaaagtatgat

SEQ ID NO: 209185 - DNA, 20 bp, Artificial Sequence
  chemically synthesized
aacagttttataggcatcaa

SEQ ID NO: 209186 - DNA, 20 bp, Artificial Sequence
  chemically synthesized
gtcaacccaaacagttttat

SEQ ID NO: 209187 - DNA, 20 bp, Artificial Sequence
  chemically synthesized
agtcaacccaaacagtttta

SEQ ID NO: 209188 - DNA, 20 bp, Artificial Sequence
  chemically synthesized
ttgatgcctataaaactgtt

SEQ ID NO: 209189 - DNA, 20 bp, Artificial Sequence
  chemically synthesized
tgatgcctataaaactgttt

SEQ ID NO: 209190 - DNA, 20 bp, Artificial Sequence
  chemically synthesized
aatgagacagtcaacccaaa

SEQ ID NO: 209191 - DNA, 20 bp, Artificial Sequence
  chemically synthesized
agattcagcagttaatgaga

SEQ ID NO: 209192 - DNA, 20 bp, Artificial Sequence
  chemically synthesized
tgagagattcagcagttaat

SEQ ID NO: 209193 - DNA, 20 bp, Artificial Sequence
  chemically synthesized
aagcaggctgagagattcag

SEQ ID NO: 209194 - DNA, 20 bp, Artificial Sequence
  chemically synthesized
tcattaactgctgaatctct

SEQ ID NO: 209195 - DNA, 20 bp, Artificial Sequence
  chemically synthesized
gttaagcaggctgagagatt

SEQ ID NO: 209196 - DNA, 20 bp, Artificial Sequence
  chemically synthesized
cttagtgttaagcaggctga

SEQ ID NO: 209197 - DNA, 20 bp, Artificial Sequence
  chemically synthesized
gccttagtgttaagcaggct

SEQ ID NO: 209198 - DNA, 20 bp, Artificial Sequence
  chemically synthesized
taacagccttagtgttaagc

SEQ ID NO: 209199 - DNA, 20 bp, Artificial Sequence
  chemically synthesized
ataacagccttagtgttaag

SEQ ID NO: 209200 - DNA, 20 bp, Artificial Sequence
  chemically synthesized
ctctcagcctgcttaacact

SEQ ID NO: 209201 - DNA, 20 bp, Artificial Sequence
  chemically synthesized
tctcagcctgcttaacacta

SEQ ID NO: 209202 - DNA, 20 bp, Artificial Sequence
  chemically synthesized
ccaataacagccttagtgtt

SEQ ID NO: 209203 - DNA, 20 bp, Artificial Sequence
  chemically synthesized
tgcaggcccaataacagcct

SEQ ID NO: 209204 - DNA, 20 bp, Artificial Sequence
  chemically synthesized
cttaacactaaggctgttat

SEQ ID NO: 209205 - DNA, 20 bp, Artificial Sequence
  chemically synthesized
ttaacactaaggctgttatt

SEQ ID NO: 209206 - DNA, 20 bp, Artificial Sequence
  chemically synthesized
ctgtaatgcaggcccaataa

SEQ ID NO: 209207 - DNA, 20 bp, Artificial Sequence
  chemically synthesized
ctgttattgggcctgcatta

SEQ ID NO: 209208 - DNA, 20 bp, Artificial Sequence
  chemically synthesized
gagaagttgagctgtaatgc

SEQ ID NO: 209209 - DNA, 20 bp, Artificial Sequence
  chemically synthesized
agagaagttgagctgtaatg

SEQ ID NO: 209210 - DNA, 20 bp, Artificial Sequence
  chemically synthesized
attggacagaaagagaagtt

SEQ ID NO: 209211 - DNA, 20 bp, Artificial Sequence
  chemically synthesized
gcaggattggacagaaagag

SEQ ID NO: 209212 - DNA, 20 bp, Artificial Sequence
  chemically synthesized
gaagcaggattggacagaaa

SEQ ID NO: 209213 - DNA, 20 bp, Artificial Sequence
  chemically synthesized
tagaagcaggattggacaga

SEQ ID NO: 209214 - DNA, 20 bp, Artificial Sequence
  chemically synthesized
ggcttagaagcaggattgga

SEQ ID NO: 209215 - DNA, 20 bp, Artificial Sequence
  chemically synthesized
agagggcttagaagcaggat

SEQ ID NO: 209216 - DNA, 20 bp, Artificial Sequence
  chemically synthesized
ttctgtccaatcctgcttct

SEQ ID NO: 209217 - DNA, 20 bp, Artificial Sequence
  chemically synthesized
tcaagagagggcttagaagc

SEQ ID NO: 209218 - DNA, 20 bp, Artificial Sequence
  chemically synthesized
ttcaagagagggcttagaag

SEQ ID NO: 209219 - DNA, 20 bp, Artificial Sequence
  chemically synthesized
atattcaagagagggcttag

SEQ ID NO: 209220 - DNA, 20 bp, Artificial Sequence
  chemically synthesized
tacatattcaagagagggct

SEQ ID NO: 209221 - DNA, 20 bp, Artificial Sequence
  chemically synthesized
accaatacatattcaagaga

SEQ ID NO: 209222 - DNA, 20 bp, Artificial Sequence
  chemically synthesized
gaccaatacatattcaagag

SEQ ID NO: 209223 - DNA, 20 bp, Artificial Sequence
  chemically synthesized
ggaccaatacatattcaaga

SEQ ID NO: 209224 - DNA, 20 bp, Artificial Sequence
  chemically synthesized
ctggaccaatacatattcaa

SEQ ID NO: 209225 - DNA, 20 bp, Artificial Sequence
  chemically synthesized
cactggaccaatacatattc

SEQ ID NO: 209226 - DNA, 20 bp, Artificial Sequence
  chemically synthesized
gccctctcttgaatatgtat

SEQ ID NO: 209227 - DNA, 20 bp, Artificial Sequence
  chemically synthesized
ctcttgaatatgtattggtc

SEQ ID NO: 209228 - DNA, 20 bp, Artificial Sequence
  chemically synthesized
ttgaatatgtattggtccag

SEQ ID NO: 209229 - DNA, 20 bp, Artificial Sequence
  chemically synthesized
tgaatatgtattggtccagt

SEQ ID NO: 209230 - DNA, 20 bp, Artificial Sequence
  chemically synthesized
acttatcagggaatgcccac

SEQ ID NO: 209231 - DNA, 20 bp, Artificial Sequence
  chemically synthesized
tccagtgggcattccctgat

SEQ ID NO: 209232 - DNA, 20 bp, Artificial Sequence
  chemically synthesized
aatatgcagaatacttatca

SEQ ID NO: 209233 - DNA, 20 bp, Artificial Sequence
  chemically synthesized
taatatgcagaatacttatc

SEQ ID NO: 209234 - DNA, 20 bp, Artificial Sequence
  chemically synthesized
ttaatatgcagaatacttat

SEQ ID NO: 209235 - DNA, 20 bp, Artificial Sequence
  chemically synthesized
ctaaaataaagtttaatatg

SEQ ID NO: 209236 - DNA, 20 bp, Artificial Sequence
  chemically synthesized
ctgcatattaaactttattt

SEQ ID NO: 209237 - DNA, 20 bp, Artificial Sequence
  chemically synthesized
gcatattaaactttatttta

SEQ ID NO: 209238 - DNA, 20 bp, Artificial Sequence
  chemically synthesized
cccggccagactctaaaata

SEQ ID NO: 209239 - DNA, 20 bp, Artificial Sequence
  chemically synthesized
ttaaactttattttagagtc

SEQ ID NO: 209240 - DNA, 20 bp, Artificial Sequence
  chemically synthesized
actttattttagagtctggc

SEQ ID NO: 209241 - DNA, 20 bp, Artificial Sequence
  chemically synthesized
ctttattttagagtctggcc

SEQ ID NO: 209242 - DNA, 20 bp, Artificial Sequence
  chemically synthesized
cgtgagccactacgcccggc

SEQ ID NO: 209243 - DNA, 20 bp, Artificial Sequence
  chemically synthesized
ttttagagtctggccgggcg

SEQ ID NO: 209244 - DNA, 20 bp, Artificial Sequence
  chemically synthesized
tagagtctggccgggcgtag

SEQ ID NO: 209245 - DNA, 20 bp, Artificial Sequence
  chemically synthesized
caggcgtgagccactacgcc

SEQ ID NO: 209246 - DNA, 20 bp, Artificial Sequence
  chemically synthesized
agtgctgggattacaggcgt

SEQ ID NO: 209247 - DNA, 20 bp, Artificial Sequence
  chemically synthesized
gtggctcacgcctgtaatcc

SEQ ID NO: 209248 - DNA, 20 bp, Artificial Sequence
  chemically synthesized
tcccaaagtgctgggattac

SEQ ID NO: 209249 - DNA, 20 bp, Artificial Sequence
  chemically synthesized
ctcccaaagtgctgggatta

SEQ ID NO: 209250 - DNA, 20 bp, Artificial Sequence
  chemically synthesized
cgcctgtaatcccagcactt

SEQ ID NO: 209251 - DNA, 20 bp, Artificial Sequence
  chemically synthesized
cttctgcctcccaaagtgct

SEQ ID NO: 209252 - DNA, 20 bp, Artificial Sequence
  chemically synthesized
gcctgtaatcccagcacttt

SEQ ID NO: 209253 - DNA, 20 bp, Artificial Sequence
  chemically synthesized
acttctgcctcccaaagtgc

SEQ ID NO: 209254 - DNA, 20 bp, Artificial Sequence
  chemically synthesized
ctgtaatcccagcactttgg

SEQ ID NO: 209255 - DNA, 20 bp, Artificial Sequence
  chemically synthesized
tgtaatcccagcactttggg

SEQ ID NO: 209256 - DNA, 20 bp, Artificial Sequence
  chemically synthesized
aatcccagcactttgggagg

SEQ ID NO: 209257 - DNA, 20 bp, Artificial Sequence
  chemically synthesized
ccacccacttctgcctccca

SEQ ID NO: 209258 - DNA, 20 bp, Artificial Sequence
  chemically synthesized
cccagcactttgggaggcag

SEQ ID NO: 209259 - DNA, 20 bp, Artificial Sequence
  chemically synthesized
agcactttgggaggcagaag

SEQ ID NO: 209260 - DNA, 20 bp, Artificial Sequence
  chemically synthesized
gcactttgggaggcagaagt

SEQ ID NO: 209261 - DNA, 20 bp, Artificial Sequence
  chemically synthesized
ctttgggaggcagaagtggg

SEQ ID NO: 209262 - DNA, 20 bp, Artificial Sequence
  chemically synthesized
cagaagtgggtggatcacct

SEQ ID NO: 209263 - DNA, 20 bp, Artificial Sequence
  chemically synthesized
agaagtgggtggatcacctg

SEQ ID NO: 209264 - DNA, 20 bp, Artificial Sequence
  chemically synthesized
gtgggtggatcacctgaggt

SEQ ID NO: 209265 - DNA, 20 bp, Artificial Sequence
  chemically synthesized
tgggtggatcacctgaggtc

SEQ ID NO: 209266 - DNA, 20 bp, Artificial Sequence
  chemically synthesized
ggtctcaaacacccgacctc

SEQ ID NO: 209267 - DNA, 20 bp, Artificial Sequence
  chemically synthesized
tggtctcaaacacccgacct

SEQ ID NO: 209268 - DNA, 20 bp, Artificial Sequence
  chemically synthesized
tcacctgaggtcgggtgttt

SEQ ID NO: 209269 - DNA, 20 bp, Artificial Sequence
  chemically synthesized
tgaggtcgggtgtttgagac

SEQ ID NO: 209270 - DNA, 20 bp, Artificial Sequence
  chemically synthesized
tttcatcatgttggtcaggc

SEQ ID NO: 209271 - DNA, 20 bp, Artificial Sequence
  chemically synthesized
ggggtttcatcatgttggtc

SEQ ID NO: 209272 - DNA, 20 bp, Artificial Sequence
  chemically synthesized
cggggtttcatcatgttggt

SEQ ID NO: 209273 - DNA, 20 bp, Artificial Sequence
  chemically synthesized
gagacggggtttcatcatgt

SEQ ID NO: 209274 - DNA, 20 bp, Artificial Sequence
  chemically synthesized
ttgtatttttagtagagacg

SEQ ID NO: 209275 - DNA, 20 bp, Artificial Sequence
  chemically synthesized
tttgtatttttagtagagac

SEQ ID NO: 209276 - DNA, 20 bp, Artificial Sequence
  chemically synthesized
ttttgtatttttagtagaga

SEQ ID NO: 209277 - DNA, 20 bp, Artificial Sequence
  chemically synthesized
ctaattttgtatttttagta

SEQ ID NO: 209278 - DNA, 20 bp, Artificial Sequence
  chemically synthesized
ggctaattttgtatttttag

SEQ ID NO: 209279 - DNA, 20 bp, Artificial Sequence
  chemically synthesized
cctggctaattttgtatttt

SEQ ID NO: 209280 - DNA, 20 bp, Artificial Sequence
  chemically synthesized
ctctactaaaaatacaaaat

SEQ ID NO: 209281 - DNA, 20 bp, Artificial Sequence
  chemically synthesized
actaaaaatacaaaattagc

SEQ ID NO: 209282 - DNA, 20 bp, Artificial Sequence
  chemically synthesized
ctaaaaatacaaaattagcc

SEQ ID NO: 209283 - DNA, 20 bp, Artificial Sequence
  chemically synthesized
aatacaaaattagccaggcg

SEQ ID NO: 209284 - DNA, 20 bp, Artificial Sequence
  chemically synthesized
acaaaattagccaggcgtgg

SEQ ID NO: 209285 - DNA, 20 bp, Artificial Sequence
  chemically synthesized
caggcaagtactaccacgcc

SEQ ID NO: 209286 - DNA, 20 bp, Artificial Sequence
  chemically synthesized
aagtatctgggattacaggc

SEQ ID NO: 209287 - DNA, 20 bp, Artificial Sequence
  chemically synthesized
gtagtacttgcctgtaatcc

SEQ ID NO: 209288 - DNA, 20 bp, Artificial Sequence
  chemically synthesized
tcccaagtatctgggattac

SEQ ID NO: 209289 - DNA, 20 bp, Artificial Sequence
  chemically synthesized
ctcccaagtatctgggatta

SEQ ID NO: 209290 - DNA, 20 bp, Artificial Sequence
  chemically synthesized
tgcctgtaatcccagatact

SEQ ID NO: 209291 - DNA, 20 bp, Artificial Sequence
  chemically synthesized
cctcaaactcccaagtatct

SEQ ID NO: 209292 - DNA, 20 bp, Artificial Sequence
  chemically synthesized
gcctgtaatcccagatactt

SEQ ID NO: 209293 - DNA, 20 bp, Artificial Sequence
  chemically synthesized
gcctcaaactcccaagtatc

SEQ ID NO: 209294 - DNA, 20 bp, Artificial Sequence
  chemically synthesized
ctgtaatcccagatacttgg

SEQ ID NO: 209295 - DNA, 20 bp, Artificial Sequence
  chemically synthesized
ttcttctgcctcaaactccc

SEQ ID NO: 209296 - DNA, 20 bp, Artificial Sequence
  chemically synthesized
tcccagatacttgggagttt

SEQ ID NO: 209297 - DNA, 20 bp, Artificial Sequence
  chemically synthesized
cccagatacttgggagtttg

SEQ ID NO: 209298 - DNA, 20 bp, Artificial Sequence
  chemically synthesized
agatacttgggagtttgagg

SEQ ID NO: 209299 - DNA, 20 bp, Artificial Sequence
  chemically synthesized
tacttgggagtttgaggcag

SEQ ID NO: 209300 - DNA, 20 bp, Artificial Sequence
  chemically synthesized
aatttccgccttatgggttc

SEQ ID NO: 209301 - DNA, 20 bp, Artificial Sequence
  chemically synthesized
gaagaatcacttgaacccat

SEQ ID NO: 209302 - DNA, 20 bp, Artificial Sequence
  chemically synthesized
aagaatcacttgaacccata

SEQ ID NO: 209303 - DNA, 20 bp, Artificial Sequence
  chemically synthesized
aatcacttgaacccataagg

SEQ ID NO: 209304 - DNA, 20 bp, Artificial Sequence
  chemically synthesized
cactgtaatttccgccttat

SEQ ID NO: 209305 - DNA, 20 bp, Artificial Sequence
  chemically synthesized
tcactgtaatttccgcctta

SEQ ID NO: 209306 - DNA, 20 bp, Artificial Sequence
  chemically synthesized
aacccataaggcggaaatta

SEQ ID NO: 209307 - DNA, 20 bp, Artificial Sequence
  chemically synthesized
cataaggcggaaattacagt

SEQ ID NO: 209308 - DNA, 20 bp, Artificial Sequence
  chemically synthesized
ggcggaaattacagtgagac

SEQ ID NO: 209309 - DNA, 20 bp, Artificial Sequence
  chemically synthesized
ttgtccatgttggagtgtaa

SEQ ID NO: 209310 - DNA, 20 bp, Artificial Sequence
  chemically synthesized
tgtgccattacactccaaca

SEQ ID NO: 209311 - DNA, 20 bp, Artificial Sequence
  chemically synthesized
tgctctcgttgtccatgttg

SEQ ID NO: 209312 - DNA, 20 bp, Artificial Sequence
  chemically synthesized
tttgctctcgttgtccatgt

SEQ ID NO: 209313 - DNA, 20 bp, Artificial Sequence
  chemically synthesized
tacactccaacatggacaac

SEQ ID NO: 209314 - DNA, 20 bp, Artificial Sequence
  chemically synthesized
cactccaacatggacaacga

SEQ ID NO: 209315 - DNA, 20 bp, Artificial Sequence
  chemically synthesized
attattattattattttaga

SEQ ID NO: 209316 - DNA, 20 bp, Artificial Sequence
  chemically synthesized
tattattattattattattt

SEQ ID NO: 209317 - DNA, 20 bp, Artificial Sequence
  chemically synthesized
aataataataacaacaaata

SEQ ID NO: 209318 - DNA, 20 bp, Artificial Sequence
  chemically synthesized
aagtaaaaataaaaatgttt

SEQ ID NO: 209319 - DNA, 20 bp, Artificial Sequence
  chemically synthesized
gtaaaaataaaaatgtttta

SEQ ID NO: 209320 - DNA, 20 bp, Artificial Sequence
  chemically synthesized
atgttttagagtctgtttcc

SEQ ID NO: 209321 - DNA, 20 bp, Artificial Sequence
  chemically synthesized
gttttagagtctgtttccca

SEQ ID NO: 209322 - DNA, 20 bp, Artificial Sequence
  chemically synthesized
aggttgggttctctgggaaa

SEQ ID NO: 209323 - DNA, 20 bp, Artificial Sequence
  chemically synthesized
tgttacaggttgggttctct

SEQ ID NO: 209324 - DNA, 20 bp, Artificial Sequence
  chemically synthesized
gtgttacaggttgggttctc

SEQ ID NO: 209325 - DNA, 20 bp, Artificial Sequence
  chemically synthesized
ctaagtaggtgttacaggtt

SEQ ID NO: 209326 - DNA, 20 bp, Artificial Sequence
  chemically synthesized
actaagtaggtgttacaggt

SEQ ID NO: 209327 - DNA, 20 bp, Artificial Sequence
  chemically synthesized
acatactaagtaggtgttac

SEQ ID NO: 209328 - DNA, 20 bp, Artificial Sequence
  chemically synthesized
gacatactaagtaggtgtta

SEQ ID NO: 209329 - DNA, 20 bp, Artificial Sequence
  chemically synthesized
cccaacctgtaacacctact

SEQ ID NO: 209330 - DNA, 20 bp, Artificial Sequence
  chemically synthesized
gttgctttgacatactaagt

SEQ ID NO: 209331 - DNA, 20 bp, Artificial Sequence
  chemically synthesized
ggttgctttgacatactaag

SEQ ID NO: 209332 - DNA, 20 bp, Artificial Sequence
  chemically synthesized
cttggttgctttgacatact

SEQ ID NO: 209333 - DNA, 20 bp, Artificial Sequence
  chemically synthesized
aacacctacttagtatgtca

SEQ ID NO: 209334 - DNA, 20 bp, Artificial Sequence
  chemically synthesized
cttagtatgtcaaagcaacc

SEQ ID NO: 209335 - DNA, 20 bp, Artificial Sequence
  chemically synthesized
ttagtatgtcaaagcaacca

SEQ ID NO: 209336 - DNA, 20 bp, Artificial Sequence
  chemically synthesized
gtatgtcaaagcaaccaagg

SEQ ID NO: 209337 - DNA, 20 bp, Artificial Sequence
  chemically synthesized
aatacagcccttgacttcct

SEQ ID NO: 209338 - DNA, 20 bp, Artificial Sequence
  chemically synthesized
tcaaagcaaccaaggaagtc

SEQ ID NO: 209339 - DNA, 20 bp, Artificial Sequence
  chemically synthesized
caaagcaaccaaggaagtca

SEQ ID NO: 209340 - DNA, 20 bp, Artificial Sequence
  chemically synthesized
aaagcaaccaaggaagtcaa

SEQ ID NO: 209341 - DNA, 20 bp, Artificial Sequence
  chemically synthesized
aaataaaaagagaaataata

SEQ ID NO: 209342 - DNA, 20 bp, Artificial Sequence
  chemically synthesized
tcctgacagccaaataaaaa

SEQ ID NO: 209343 - DNA, 20 bp, Artificial Sequence
  chemically synthesized
gtattatttctctttttatt

SEQ ID NO: 209344 - DNA, 20 bp, Artificial Sequence
  chemically synthesized
actcctgacagccaaataaa

SEQ ID NO: 209345 - DNA, 20 bp, Artificial Sequence
  chemically synthesized
ttctctttttatttggctgt

SEQ ID NO: 209346 - DNA, 20 bp, Artificial Sequence
  chemically synthesized
tctctttttatttggctgtc

SEQ ID NO: 209347 - DNA, 20 bp, Artificial Sequence
  chemically synthesized
tctttttatttggctgtcag

SEQ ID NO: 209348 - DNA, 20 bp, Artificial Sequence
  chemically synthesized
gtaataaacacaactcctga

SEQ ID NO: 209349 - DNA, 20 bp, Artificial Sequence
  chemically synthesized
ttgtgtttattactctatct

SEQ ID NO: 209350 - DNA, 20 bp, Artificial Sequence
  chemically synthesized
tgtgtttattactctatctg

SEQ ID NO: 209351 - DNA, 20 bp, Artificial Sequence
  chemically synthesized
cactctgggctcctcagata

SEQ ID NO: 209352 - DNA, 20 bp, Artificial Sequence
  chemically synthesized
tgtttattactctatctgag

SEQ ID NO: 209353 - DNA, 20 bp, Artificial Sequence
  chemically synthesized
atcactctgggctcctcaga

SEQ ID NO: 209354 - DNA, 20 bp, Artificial Sequence
  chemically synthesized
attactctatctgaggagcc

SEQ ID NO: 209355 - DNA, 20 bp, Artificial Sequence
  chemically synthesized
taaaatcactctgggctcct

SEQ ID NO: 209356 - DNA, 20 bp, Artificial Sequence
  chemically synthesized
tactctatctgaggagccca

SEQ ID NO: 209357 - DNA, 20 bp, Artificial Sequence
  chemically synthesized
cgtgtacgtaaaatcactct

SEQ ID NO: 209358 - DNA, 20 bp, Artificial Sequence
  chemically synthesized
tcgtgtacgtaaaatcactc

SEQ ID NO: 209359 - DNA, 20 bp, Artificial Sequence
  chemically synthesized
acgtacacgatctctttttg

SEQ ID NO: 209360 - DNA, 20 bp, Artificial Sequence
  chemically synthesized
gtaatatgaaactgcaaaaa

SEQ ID NO: 209361 - DNA, 20 bp, Artificial Sequence
  chemically synthesized
atgtaatatgaaactgcaaa

SEQ ID NO: 209362 - DNA, 20 bp, Artificial Sequence
  chemically synthesized
agtttcatattacatgttct

SEQ ID NO: 209363 - DNA, 20 bp, Artificial Sequence
  chemically synthesized
gtcatctagttaaagcaact

SEQ ID NO: 209364 - DNA, 20 bp, Artificial Sequence
  chemically synthesized
atgttcttagttgctttaac

SEQ ID NO: 209365 - DNA, 20 bp, Artificial Sequence
  chemically synthesized
gctcagcagtcatctagtta

SEQ ID NO: 209366 - DNA, 20 bp, Artificial Sequence
  chemically synthesized
atgcctgctcagcagtcatc

SEQ ID NO: 209367 - DNA, 20 bp, Artificial Sequence
  chemically synthesized
gctttaactagatgactgct

SEQ ID NO: 209368 - DNA, 20 bp, Artificial Sequence
  chemically synthesized
ttaactagatgactgctgag

SEQ ID NO: 209369 - DNA, 20 bp, Artificial Sequence
  chemically synthesized
taactagatgactgctgagc

SEQ ID NO: 209370 - DNA, 20 bp, Artificial Sequence
  chemically synthesized
tggcctagatgcctgctcag

SEQ ID NO: 209371 - DNA, 20 bp, Artificial Sequence
  chemically synthesized
agatggcctagatgcctgct

SEQ ID NO: 209372 - DNA, 20 bp, Artificial Sequence
  chemically synthesized
atgactgctgagcaggcatc

SEQ ID NO: 209373 - DNA, 20 bp, Artificial Sequence
  chemically synthesized
tgactgctgagcaggcatct

SEQ ID NO: 209374 - DNA, 20 bp, Artificial Sequence
  chemically synthesized
cgacttcagtggagatggcc

SEQ ID NO: 209375 - DNA, 20 bp, Artificial Sequence
  chemically synthesized
ttgcacgacttcagtggaga

SEQ ID NO: 209376 - DNA, 20 bp, Artificial Sequence
  chemically synthesized
catctaggccatctccactg

SEQ ID NO: 209377 - DNA, 20 bp, Artificial Sequence
  chemically synthesized
gaggttgcacgacttcagtg

SEQ ID NO: 209378 - DNA, 20 bp, Artificial Sequence
  chemically synthesized
aagaggttgcacgacttcag

SEQ ID NO: 209379 - DNA, 20 bp, Artificial Sequence
  chemically synthesized
tggaagaggttgcacgactt

SEQ ID NO: 209380 - DNA, 20 bp, Artificial Sequence
  chemically synthesized
tgctggagttgtattggaag

SEQ ID NO: 209381 - DNA, 20 bp, Artificial Sequence
  chemically synthesized
ctgctggagttgtattggaa

SEQ ID NO: 209382 - DNA, 20 bp, Artificial Sequence
  chemically synthesized
gcctgctggagttgtattgg

SEQ ID NO: 209383 - DNA, 20 bp, Artificial Sequence
  chemically synthesized
gctgcctgctggagttgtat

SEQ ID NO: 209384 - DNA, 20 bp, Artificial Sequence
  chemically synthesized
aacctcttccaatacaactc

SEQ ID NO: 209385 - DNA, 20 bp, Artificial Sequence
  chemically synthesized
ctcttccaatacaactccag

SEQ ID NO: 209386 - DNA, 20 bp, Artificial Sequence
  chemically synthesized
tcttccaatacaactccagc

SEQ ID NO: 209387 - DNA, 20 bp, Artificial Sequence
  chemically synthesized
tccaatacaactccagcagg

SEQ ID NO: 209388 - DNA, 20 bp, Artificial Sequence
  chemically synthesized
ccaaacctggctgcctgctg

SEQ ID NO: 209389 - DNA, 20 bp, Artificial Sequence
  chemically synthesized
ttccaaacctggctgcctgc

SEQ ID NO: 209390 - DNA, 20 bp, Artificial Sequence
  chemically synthesized
atacaactccagcaggcagc

SEQ ID NO: 209391 - DNA, 20 bp, Artificial Sequence
  chemically synthesized
tacaactccagcaggcagcc

SEQ ID NO: 209392 - DNA, 20 bp, Artificial Sequence
  chemically synthesized
ctccagcaggcagccaggtt

SEQ ID NO: 209393 - DNA, 20 bp, Artificial Sequence
  chemically synthesized
cagcaggcagccaggtttgg

SEQ ID NO: 209394 - DNA, 20 bp, Artificial Sequence
  chemically synthesized
gaatagagtacttccaaacc

SEQ ID NO: 209395 - DNA, 20 bp, Artificial Sequence
  chemically synthesized
tttttagatgtaatggaata

SEQ ID NO: 209396 - DNA, 20 bp, Artificial Sequence
  chemically synthesized
actttttagatgtaatggaa

SEQ ID NO: 209397 - DNA, 20 bp, Artificial Sequence
  chemically synthesized
ggcatactttttagatgtaa

SEQ ID NO: 209398 - DNA, 20 bp, Artificial Sequence
  chemically synthesized
tctattccattacatctaaa

SEQ ID NO: 209399 - DNA, 20 bp, Artificial Sequence
  chemically synthesized
aaaacaaaaggcatactttt

SEQ ID NO: 209400 - DNA, 20 bp, Artificial Sequence
  chemically synthesized
gatcctgtctcgaaaacaaa

SEQ ID NO: 209401 - DNA, 20 bp, Artificial Sequence
  chemically synthesized
agatcctgtctcgaaaacaa

SEQ ID NO: 209402 - DNA, 20 bp, Artificial Sequence
  chemically synthesized
aaagtatgccttttgttttc

SEQ ID NO: 209403 - DNA, 20 bp, Artificial Sequence
  chemically synthesized
tatgccttttgttttcgaga

SEQ ID NO: 209404 - DNA, 20 bp, Artificial Sequence
  chemically synthesized
atgccttttgttttcgagac

SEQ ID NO: 209405 - DNA, 20 bp, Artificial Sequence
  chemically synthesized
tccagcctgggtgacagagt

SEQ ID NO: 209406 - DNA, 20 bp, Artificial Sequence
  chemically synthesized
caggatctcactctgtcacc

SEQ ID NO: 209407 - DNA, 20 bp, Artificial Sequence
  chemically synthesized
gcactccagcctgggtgaca

SEQ ID NO: 209408 - DNA, 20 bp, Artificial Sequence
  chemically synthesized
aggatctcactctgtcaccc

SEQ ID NO: 209409 - DNA, 20 bp, Artificial Sequence
  chemically synthesized
ctgcactccagcctgggtga

SEQ ID NO: 209410 - DNA, 20 bp, Artificial Sequence
  chemically synthesized
tctcactctgtcacccaggc

SEQ ID NO: 209411 - DNA, 20 bp, Artificial Sequence
  chemically synthesized
tcactctgtcacccaggctg

SEQ ID NO: 209412 - DNA, 20 bp, Artificial Sequence
  chemically synthesized
ctgccactgcactccagcct

SEQ ID NO: 209413 - DNA, 20 bp, Artificial Sequence
  chemically synthesized
cctgccactgcactccagcc

SEQ ID NO: 209414 - DNA, 20 bp, Artificial Sequence
  chemically synthesized
ctgtcacccaggctggagtg

SEQ ID NO: 209415 - DNA, 20 bp, Artificial Sequence
  chemically synthesized
tccctcctgccactgcactc

SEQ ID NO: 209416 - DNA, 20 bp, Artificial Sequence
  chemically synthesized
tcacccaggctggagtgcag

SEQ ID NO: 209417 - DNA, 20 bp, Artificial Sequence
  chemically synthesized
cccaggctggagtgcagtgg

SEQ ID NO: 209418 - DNA, 20 bp, Artificial Sequence
  chemically synthesized
ccaggctggagtgcagtggc

SEQ ID NO: 209419 - DNA, 20 bp, Artificial Sequence
  chemically synthesized
aggctggagtgcagtggcag

SEQ ID NO: 209420 - DNA, 20 bp, Artificial Sequence
  chemically synthesized
ggctggagtgcagtggcagg

SEQ ID NO: 209421 - DNA, 20 bp, Artificial Sequence
  chemically synthesized
gctggagtgcagtggcagga

SEQ ID NO: 209422 - DNA, 20 bp, Artificial Sequence
  chemically synthesized
tggagtgcagtggcaggagg

SEQ ID NO: 209423 - DNA, 20 bp, Artificial Sequence
  chemically synthesized
tgcagtggcaggagggagca

SEQ ID NO: 209424 - DNA, 20 bp, Artificial Sequence
  chemically synthesized
ggagggagcacagctcacca

SEQ ID NO: 209425 - DNA, 20 bp, Artificial Sequence
  chemically synthesized
catgaggtcaagtctatggt

SEQ ID NO: 209426 - DNA, 20 bp, Artificial Sequence
  chemically synthesized
agcccatgaggtcaagtcta

SEQ ID NO: 209427 - DNA, 20 bp, Artificial Sequence
  chemically synthesized
tcaccatagacttgacctca

SEQ ID NO: 209428 - DNA, 20 bp, Artificial Sequence
  chemically synthesized
tcgtttgagcccatgaggtc

SEQ ID NO: 209429 - DNA, 20 bp, Artificial Sequence
  chemically synthesized
caccatagacttgacctcat

SEQ ID NO: 209430 - DNA, 20 bp, Artificial Sequence
  chemically synthesized
gagaatcgtttgagcccatg

SEQ ID NO: 209431 - DNA, 20 bp, Artificial Sequence
  chemically synthesized
ggagaatcgtttgagcccat

SEQ ID NO: 209432 - DNA, 20 bp, Artificial Sequence
  chemically synthesized
ctgagatgggagaatcgttt

SEQ ID NO: 209433 - DNA, 20 bp, Artificial Sequence
  chemically synthesized
ctcaaacgattctcccatct

SEQ ID NO: 209434 - DNA, 20 bp, Artificial Sequence
  chemically synthesized
tactcaggaggctgagatgg

SEQ ID NO: 209435 - DNA, 20 bp, Artificial Sequence
  chemically synthesized
gctactcaggaggctgagat

SEQ ID NO: 209436 - DNA, 20 bp, Artificial Sequence
  chemically synthesized
agctactcaggaggctgaga

SEQ ID NO: 209437 - DNA, 20 bp, Artificial Sequence
  chemically synthesized
ccccagctactcaggaggct

SEQ ID NO: 209438 - DNA, 20 bp, Artificial Sequence
  chemically synthesized
ttctcccatctcagcctcct

SEQ ID NO: 209439 - DNA, 20 bp, Artificial Sequence
  chemically synthesized
tcccatctcagcctcctgag

SEQ ID NO: 209440 - DNA, 20 bp, Artificial Sequence
  chemically synthesized
tgtagccccagctactcagg

SEQ ID NO: 209441 - DNA, 20 bp, Artificial Sequence
  chemically synthesized
ctgtagccccagctactcag

SEQ ID NO: 209442 - DNA, 20 bp, Artificial Sequence
  chemically synthesized
atctcagcctcctgagtagc

SEQ ID NO: 209443 - DNA, 20 bp, Artificial Sequence
  chemically synthesized
ccctgtagccccagctactc

SEQ ID NO: 209444 - DNA, 20 bp, Artificial Sequence
  chemically synthesized
tctcagcctcctgagtagct

SEQ ID NO: 209445 - DNA, 20 bp, Artificial Sequence
  chemically synthesized
cccctgtagccccagctact

SEQ ID NO: 209446 - DNA, 20 bp, Artificial Sequence
  chemically synthesized
ctcagcctcctgagtagctg

SEQ ID NO: 209447 - DNA, 20 bp, Artificial Sequence
  chemically synthesized
ctcctgagtagctggggcta

SEQ ID NO: 209448 - DNA, 20 bp, Artificial Sequence
  chemically synthesized
tcctgagtagctggggctac

SEQ ID NO: 209449 - DNA, 20 bp, Artificial Sequence
  chemically synthesized
gtagtgtgcccctgtagccc

SEQ ID NO: 209450 - DNA, 20 bp, Artificial Sequence
  chemically synthesized
cctgagtagctggggctaca

SEQ ID NO: 209451 - DNA, 20 bp, Artificial Sequence
  chemically synthesized
ctgagtagctggggctacag

SEQ ID NO: 209452 - DNA, 20 bp, Artificial Sequence
  chemically synthesized
ggcgaggtagtgtgcccctg

SEQ ID NO: 209453 - DNA, 20 bp, Artificial Sequence
  chemically synthesized
caggggcacactacctcgcc

SEQ ID NO: 209454 - DNA, 20 bp, Artificial Sequence
  chemically synthesized
agatagatagccgggcgagg

SEQ ID NO: 209455 - DNA, 20 bp, Artificial Sequence
  chemically synthesized
gatagatagatagccgggcg

SEQ ID NO: 209456 - DNA, 20 bp, Artificial Sequence
  chemically synthesized
agatagatagatagccgggc

SEQ ID NO: 209457 - DNA, 20 bp, Artificial Sequence
  chemically synthesized
agatagatagatagatagcc

SEQ ID NO: 209458 - DNA, 20 bp, Artificial Sequence
  chemically synthesized
tagatagatagatagatagc

SEQ ID NO: 209459 - DNA, 20 bp, Artificial Sequence
  chemically synthesized
tagatagatagatagataga

SEQ ID NO: 209460 - DNA, 20 bp, Artificial Sequence
  chemically synthesized
tagatagatagatagataga

SEQ ID NO: 209461 - DNA, 20 bp, Artificial Sequence
  chemically synthesized
tagatagatagatagataga

SEQ ID NO: 209462 - DNA, 20 bp, Artificial Sequence
  chemically synthesized
tagatagatagatagataga

SEQ ID NO: 209463 - DNA, 20 bp, Artificial Sequence
  chemically synthesized
tagatagatagatagataga

SEQ ID NO: 209464 - DNA, 20 bp, Artificial Sequence
  chemically synthesized
tagatagatagatagataga

SEQ ID NO: 209465 - DNA, 20 bp, Artificial Sequence
  chemically synthesized
tagatagatagatagataga

SEQ ID NO: 209466 - DNA, 20 bp, Artificial Sequence
  chemically synthesized
aaaatagatagatagataga

SEQ ID NO: 209467 - DNA, 20 bp, Artificial Sequence
  chemically synthesized
ctacaaaatagatagataga

SEQ ID NO: 209468 - DNA, 20 bp, Artificial Sequence
  chemically synthesized
atctctacaaaatagataga

SEQ ID NO: 209469 - DNA, 20 bp, Artificial Sequence
  chemically synthesized
cctcatctctacaaaataga

SEQ ID NO: 209470 - DNA, 20 bp, Artificial Sequence
  chemically synthesized
ctatctatctatctattttg

SEQ ID NO: 209471 - DNA, 20 bp, Artificial Sequence
  chemically synthesized
atctatctatctattttgta

SEQ ID NO: 209472 - DNA, 20 bp, Artificial Sequence
  chemically synthesized
taggcctcatctctacaaaa

SEQ ID NO: 209473 - DNA, 20 bp, Artificial Sequence
  chemically synthesized
tctatctattttgtagagat

SEQ ID NO: 209474 - DNA, 20 bp, Artificial Sequence
  chemically synthesized
ctatctattttgtagagatg

SEQ ID NO: 209475 - DNA, 20 bp, Artificial Sequence
  chemically synthesized
aagaccagcctgagtaaaat

SEQ ID NO: 209476 - DNA, 20 bp, Artificial Sequence
  chemically synthesized
gagatgaggcctattttact

SEQ ID NO: 209477 - DNA, 20 bp, Artificial Sequence
  chemically synthesized
caagaccagcctgagtaaaa

SEQ ID NO: 209478 - DNA, 20 bp, Artificial Sequence
  chemically synthesized
agatgaggcctattttactc

SEQ ID NO: 209479 - DNA, 20 bp, Artificial Sequence
  chemically synthesized
gaggcctattttactcaggc

SEQ ID NO: 209480 - DNA, 20 bp, Artificial Sequence
  chemically synthesized
tagcagttcaagaccagcct

SEQ ID NO: 209481 - DNA, 20 bp, Artificial Sequence
  chemically synthesized
tgaggctagcagttcaagac

SEQ ID NO: 209482 - DNA, 20 bp, Artificial Sequence
  chemically synthesized
tcaggctggtcttgaactgc

SEQ ID NO: 209483 - DNA, 20 bp, Artificial Sequence
  chemically synthesized
tcgcttgaggctagcagttc

SEQ ID NO: 209484 - DNA, 20 bp, Artificial Sequence
  chemically synthesized
taaggatcgcttgaggctag

SEQ ID NO: 209485 - DNA, 20 bp, Artificial Sequence
  chemically synthesized
ggtcttgaactgctagcctc

SEQ ID NO: 209486 - DNA, 20 bp, Artificial Sequence
  chemically synthesized
gtgtaaggatcgcttgaggc

SEQ ID NO: 209487 - DNA, 20 bp, Artificial Sequence
  chemically synthesized
tgtggtgtaaggatcgcttg

SEQ ID NO: 209488 - DNA, 20 bp, Artificial Sequence
  chemically synthesized
ctgtggtgtaaggatcgctt

SEQ ID NO: 209489 - DNA, 20 bp, Artificial Sequence
  chemically synthesized
ctcaagcgatccttacacca

SEQ ID NO: 209490 - DNA, 20 bp, Artificial Sequence
  chemically synthesized
cactggggggctgtggtgta

SEQ ID NO: 209491 - DNA, 20 bp, Artificial Sequence
  chemically synthesized
acactggggggctgtggtgt

SEQ ID NO: 209492 - DNA, 20 bp, Artificial Sequence
  chemically synthesized
atcccaacactggggggctg

SEQ ID NO: 209493 - DNA, 20 bp, Artificial Sequence
  chemically synthesized
atccttacaccacagccccc

SEQ ID NO: 209494 - DNA, 20 bp, Artificial Sequence
  chemically synthesized
ctagtaatcccaacactggg

SEQ ID NO: 209495 - DNA, 20 bp, Artificial Sequence
  chemically synthesized
acaccacagccccccagtgt

SEQ ID NO: 209496 - DNA, 20 bp, Artificial Sequence
  chemically synthesized
actagtaatcccaacactgg

SEQ ID NO: 209497 - DNA, 20 bp, Artificial Sequence
  chemically synthesized
caccacagccccccagtgtt

SEQ ID NO: 209498 - DNA, 20 bp, Artificial Sequence
  chemically synthesized
cactagtaatcccaacactg

SEQ ID NO: 209499 - DNA, 20 bp, Artificial Sequence
  chemically synthesized
acactagtaatcccaacact

SEQ ID NO: 209500 - DNA, 20 bp, Artificial Sequence
  chemically synthesized
cacactagtaatcccaacac

SEQ ID NO: 209501 - DNA, 20 bp, Artificial Sequence
  chemically synthesized
ccccccagtgttgggattac

SEQ ID NO: 209502 - DNA, 20 bp, Artificial Sequence
  chemically synthesized
agtgttgggattactagtgt

SEQ ID NO: 209503 - DNA, 20 bp, Artificial Sequence
  chemically synthesized
gtgttgggattactagtgtg

SEQ ID NO: 209504 - DNA, 20 bp, Artificial Sequence
  chemically synthesized
ccaggtgcagtgcctcacac

SEQ ID NO: 209505 - DNA, 20 bp, Artificial Sequence
  chemically synthesized
ctagtgtgaggcactgcacc

SEQ ID NO: 209506 - DNA, 20 bp, Artificial Sequence
  chemically synthesized
aaggaaataatggccaggtg

SEQ ID NO: 209507 - DNA, 20 bp, Artificial Sequence
  chemically synthesized
aacaaaaggaaataatggcc

SEQ ID NO: 209508 - DNA, 20 bp, Artificial Sequence
  chemically synthesized
taacaaaaggaaataatggc

SEQ ID NO: 209509 - DNA, 20 bp, Artificial Sequence
  chemically synthesized
gaaataacaaaaggaaataa

SEQ ID NO: 209510 - DNA, 20 bp, Artificial Sequence
  chemically synthesized
aaatgagtggaaataacaaa

SEQ ID NO: 209511 - DNA, 20 bp, Artificial Sequence
  chemically synthesized
caaatgagtggaaataacaa

SEQ ID NO: 209512 - DNA, 20 bp, Artificial Sequence
  chemically synthesized
ggagcaataaaacaaatgag

SEQ ID NO: 209513 - DNA, 20 bp, Artificial Sequence
  chemically synthesized
aagggagcaataaaacaaat

SEQ ID NO: 209514 - DNA, 20 bp, Artificial Sequence
  chemically synthesized
tgttttattgctccctttct

SEQ ID NO: 209515 - DNA, 20 bp, Artificial Sequence
  chemically synthesized
atcatctttgctcagaaagg

SEQ ID NO: 209516 - DNA, 20 bp, Artificial Sequence
  chemically synthesized
gcatcatctttgctcagaaa

SEQ ID NO: 209517 - DNA, 20 bp, Artificial Sequence
  chemically synthesized
agcatcatctttgctcagaa

SEQ ID NO: 209518 - DNA, 20 bp, Artificial Sequence
  chemically synthesized
aagcatcatctttgctcaga

SEQ ID NO: 209519 - DNA, 20 bp, Artificial Sequence
  chemically synthesized
tattgctccctttctgagca

SEQ ID NO: 209520 - DNA, 20 bp, Artificial Sequence
  chemically synthesized
gttaaagcatcatctttgct

SEQ ID NO: 209521 - DNA, 20 bp, Artificial Sequence
  chemically synthesized
gttttttacaaaggatgtta

SEQ ID NO: 209522 - DNA, 20 bp, Artificial Sequence
  chemically synthesized
tcaaaggctgttttttacaa

SEQ ID NO: 209523 - DNA, 20 bp, Artificial Sequence
  chemically synthesized
ctcaaaggctgttttttaca

SEQ ID NO: 209524 - DNA, 20 bp, Artificial Sequence
  chemically synthesized
ttaacatcctttgtaaaaaa

SEQ ID NO: 209525 - DNA, 20 bp, Artificial Sequence
  chemically synthesized
ctttgtaaaaaacagccttt

SEQ ID NO: 209526 - DNA, 20 bp, Artificial Sequence
  chemically synthesized
tttgtaaaaaacagcctttg

SEQ ID NO: 209527 - DNA, 20 bp, Artificial Sequence
  chemically synthesized
tagatgtatgttaacctcaa

SEQ ID NO: 209528 - DNA, 20 bp, Artificial Sequence
  chemically synthesized
gtagatgtatgttaacctca

SEQ ID NO: 209529 - DNA, 20 bp, Artificial Sequence
  chemically synthesized
gttaacatacatctacttct

SEQ ID NO: 209530 - DNA, 20 bp, Artificial Sequence
  chemically synthesized
gttgtaggaaaactgagaag

SEQ ID NO: 209531 - DNA, 20 bp, Artificial Sequence
  chemically synthesized
ctagttgtaggaaaactgag

SEQ ID NO: 209532 - DNA, 20 bp, Artificial Sequence
  chemically synthesized
aatctagttgtaggaaaact

SEQ ID NO: 209533 - DNA, 20 bp, Artificial Sequence
  chemically synthesized
cttctcagttttcctacaac

SEQ ID NO: 209534 - DNA, 20 bp, Artificial Sequence
  chemically synthesized
gggtagaaaaatctagttgt

SEQ ID NO: 209535 - DNA, 20 bp, Artificial Sequence
  chemically synthesized
ggggtagaaaaatctagttg

SEQ ID NO: 209536 - DNA, 20 bp, Artificial Sequence
  chemically synthesized
ctccatggggtagaaaaatc

SEQ ID NO: 209537 - DNA, 20 bp, Artificial Sequence
  chemically synthesized
aactagatttttctacccca

SEQ ID NO: 209538 - DNA, 20 bp, Artificial Sequence
  chemically synthesized
ctagatttttctaccccatg

SEQ ID NO: 209539 - DNA, 20 bp, Artificial Sequence
  chemically synthesized
gagactatttctccatgggg

SEQ ID NO: 209540 - DNA, 20 bp, Artificial Sequence
  chemically synthesized
attgagactatttctccatg

SEQ ID NO: 209541 - DNA, 20 bp, Artificial Sequence
  chemically synthesized
aattgagactatttctccat

SEQ ID NO: 209542 - DNA, 20 bp, Artificial Sequence
  chemically synthesized
taattgagactatttctcca

SEQ ID NO: 209543 - DNA, 20 bp, Artificial Sequence
  chemically synthesized
ttttctaccccatggagaaa

SEQ ID NO: 209544 - DNA, 20 bp, Artificial Sequence
  chemically synthesized
tcttaggactagttgtaatt

SEQ ID NO: 209545 - DNA, 20 bp, Artificial Sequence
  chemically synthesized
gaaatagtctcaattacaac

SEQ ID NO: 209546 - DNA, 20 bp, Artificial Sequence
  chemically synthesized
tctcaattacaactagtcct

SEQ ID NO: 209547 - DNA, 20 bp, Artificial Sequence
  chemically synthesized
caaagagctgatcttaggac

SEQ ID NO: 209548 - DNA, 20 bp, Artificial Sequence
  chemically synthesized
attacaactagtcctaagat

SEQ ID NO: 209549 - DNA, 20 bp, Artificial Sequence
  chemically synthesized
agccccaaagagctgatctt

SEQ ID NO: 209550 - DNA, 20 bp, Artificial Sequence
  chemically synthesized
tagccccaaagagctgatct

SEQ ID NO: 209551 - DNA, 20 bp, Artificial Sequence
  chemically synthesized
tagtcctaagatcagctctt

SEQ ID NO: 209552 - DNA, 20 bp, Artificial Sequence
  chemically synthesized
agtcctaagatcagctcttt

SEQ ID NO: 209553 - DNA, 20 bp, Artificial Sequence
  chemically synthesized
gtcctaagatcagctctttg

SEQ ID NO: 209554 - DNA, 20 bp, Artificial Sequence
  chemically synthesized
aataatcaaatagccccaaa

SEQ ID NO: 209555 - DNA, 20 bp, Artificial Sequence
  chemically synthesized
tgaataatcaaatagcccca

SEQ ID NO: 209556 - DNA, 20 bp, Artificial Sequence
  chemically synthesized
aggacttttgaataatcaaa

SEQ ID NO: 209557 - DNA, 20 bp, Artificial Sequence
  chemically synthesized
ggggctatttgattattcaa

SEQ ID NO: 209558 - DNA, 20 bp, Artificial Sequence
  chemically synthesized
tttaggtcttcaatttacat

SEQ ID NO: 209559 - DNA, 20 bp, Artificial Sequence
  chemically synthesized
ctttaggtcttcaatttaca

SEQ ID NO: 209560 - DNA, 20 bp, Artificial Sequence
  chemically synthesized
caaaagtcctatgtaaattg

SEQ ID NO: 209561 - DNA, 20 bp, Artificial Sequence
  chemically synthesized
ctatgtaaattgaagaccta

SEQ ID NO: 209562 - DNA, 20 bp, Artificial Sequence
  chemically synthesized
tatgtaaattgaagacctaa

SEQ ID NO: 209563 - DNA, 20 bp, Artificial Sequence
  chemically synthesized
gagggatctttttatccttt

SEQ ID NO: 209564 - DNA, 20 bp, Artificial Sequence
  chemically synthesized
ggagggatctttttatcctt

SEQ ID NO: 209565 - DNA, 20 bp, Artificial Sequence
  chemically synthesized
ttgaagacctaaaggataaa

SEQ ID NO: 209566 - DNA, 20 bp, Artificial Sequence
  chemically synthesized
taggggaggtatggttggga

SEQ ID NO: 209567 - DNA, 20 bp, Artificial Sequence
  chemically synthesized
gtaggggaggtatggttggg

SEQ ID NO: 209568 - DNA, 20 bp, Artificial Sequence
  chemically synthesized
tgtaggggaggtatggttgg

SEQ ID NO: 209569 - DNA, 20 bp, Artificial Sequence
  chemically synthesized
catgtaggggaggtatggtt

SEQ ID NO: 209570 - DNA, 20 bp, Artificial Sequence
  chemically synthesized
acatgtaggggaggtatggt

SEQ ID NO: 209571 - DNA, 20 bp, Artificial Sequence
  chemically synthesized
tcacacatgtaggggaggta

SEQ ID NO: 209572 - DNA, 20 bp, Artificial Sequence
  chemically synthesized
tttcatcacacatgtagggg

SEQ ID NO: 209573 - DNA, 20 bp, Artificial Sequence
  chemically synthesized
ctttcatcacacatgtaggg

SEQ ID NO: 209574 - DNA, 20 bp, Artificial Sequence
  chemically synthesized
agctttcatcacacatgtag

SEQ ID NO: 209575 - DNA, 20 bp, Artificial Sequence
  chemically synthesized
aagctttcatcacacatgta

SEQ ID NO: 209576 - DNA, 20 bp, Artificial Sequence
  chemically synthesized
gaagctttcatcacacatgt

SEQ ID NO: 209577 - DNA, 20 bp, Artificial Sequence
  chemically synthesized
tgaagctttcatcacacatg

SEQ ID NO: 209578 - DNA, 20 bp, Artificial Sequence
  chemically synthesized
ctcccctacatgtgtgatga

SEQ ID NO: 209579 - DNA, 20 bp, Artificial Sequence
  chemically synthesized
tacatgtgtgatgaaagctt

SEQ ID NO: 209580 - DNA, 20 bp, Artificial Sequence
  chemically synthesized
gtgtgatgaaagcttcagct

SEQ ID NO: 209581 - DNA, 20 bp, Artificial Sequence
  chemically synthesized
ggggccatctagctcagctg

SEQ ID NO: 209582 - DNA, 20 bp, Artificial Sequence
  chemically synthesized
gatgaaagcttcagctgagc

SEQ ID NO: 209583 - DNA, 20 bp, Artificial Sequence
  chemically synthesized
aaagcttcagctgagctaga

SEQ ID NO: 209584 - DNA, 20 bp, Artificial Sequence
  chemically synthesized
attaaaggggccatctagct

SEQ ID NO: 209585 - DNA, 20 bp, Artificial Sequence
  chemically synthesized
acaccattaaaggggccatc

SEQ ID NO: 209586 - DNA, 20 bp, Artificial Sequence
  chemically synthesized
gagctagatggcccctttaa

SEQ ID NO: 209587 - DNA, 20 bp, Artificial Sequence
  chemically synthesized
aattaaaaacaccattaaag

SEQ ID NO: 209588 - DNA, 20 bp, Artificial Sequence
  chemically synthesized
aaattaaaaacaccattaaa

SEQ ID NO: 209589 - DNA, 20 bp, Artificial Sequence
  chemically synthesized
taaattaaaaacaccattaa

SEQ ID NO: 209590 - DNA, 20 bp, Artificial Sequence
  chemically synthesized
ataaattaaaaacaccatta

SEQ ID NO: 209591 - DNA, 20 bp, Artificial Sequence
  chemically synthesized
ttttctcttccatcaagagc

SEQ ID NO: 209592 - DNA, 20 bp, Artificial Sequence
  chemically synthesized
taatttatacctgctcttga

SEQ ID NO: 209593 - DNA, 20 bp, Artificial Sequence
  chemically synthesized
attttctcttccatcaagag

SEQ ID NO: 209594 - DNA, 20 bp, Artificial Sequence
  chemically synthesized
tttatacctgctcttgatgg

SEQ ID NO: 209595 - DNA, 20 bp, Artificial Sequence
  chemically synthesized
tttattttctcttccatcaa

SEQ ID NO: 209596 - DNA, 20 bp, Artificial Sequence
  chemically synthesized
tatacctgctcttgatggaa

SEQ ID NO: 209597 - DNA, 20 bp, Artificial Sequence
  chemically synthesized
cctttattttctcttccatc

SEQ ID NO: 209598 - DNA, 20 bp, Artificial Sequence
  chemically synthesized
tcttgatggaagagaaaata

SEQ ID NO: 209599 - DNA, 20 bp, Artificial Sequence
  chemically synthesized
cttgatggaagagaaaataa

SEQ ID NO: 209600 - DNA, 20 bp, Artificial Sequence
  chemically synthesized
tgatggaagagaaaataaag

SEQ ID NO: 209601 - DNA, 20 bp, Artificial Sequence
  chemically synthesized
gaaaataaaggagttctcca

SEQ ID NO: 209602 - DNA, 20 bp, Artificial Sequence
  chemically synthesized
aaaataaaggagttctccaa

SEQ ID NO: 209603 - DNA, 20 bp, Artificial Sequence
  chemically synthesized
aaataaaggagttctccaaa

SEQ ID NO: 209604 - DNA, 20 bp, Artificial Sequence
  chemically synthesized
cccacgcctaaatccctttg

SEQ ID NO: 209605 - DNA, 20 bp, Artificial Sequence
  chemically synthesized
ctcccacgcctaaatccctt

SEQ ID NO: 209606 - DNA, 20 bp, Artificial Sequence
  chemically synthesized
aggagttctccaaagggatt

SEQ ID NO: 209607 - DNA, 20 bp, Artificial Sequence
  chemically synthesized
ggagttctccaaagggattt

SEQ ID NO: 209608 - DNA, 20 bp, Artificial Sequence
  chemically synthesized
tctccaaagggatttaggcg

SEQ ID NO: 209609 - DNA, 20 bp, Artificial Sequence
  chemically synthesized
ctccaaagggatttaggcgt

SEQ ID NO: 209610 - DNA, 20 bp, Artificial Sequence
  chemically synthesized
ccaaagggatttaggcgtgg

SEQ ID NO: 209611 - DNA, 20 bp, Artificial Sequence
  chemically synthesized
ttaggcgtgggagtcaatat

SEQ ID NO: 209612 - DNA, 20 bp, Artificial Sequence
  chemically synthesized
gggagtcaatattagatcca

SEQ ID NO: 209613 - DNA, 20 bp, Artificial Sequence
  chemically synthesized
gtcaatattagatccaaagc

SEQ ID NO: 209614 - DNA, 20 bp, Artificial Sequence
  chemically synthesized
tcaatattagatccaaagca

SEQ ID NO: 209615 - DNA, 20 bp, Artificial Sequence
  chemically synthesized
caatattagatccaaagcaa

SEQ ID NO: 209616 - DNA, 20 bp, Artificial Sequence
  chemically synthesized
gaacagaatgacccttgctt

SEQ ID NO: 209617 - DNA, 20 bp, Artificial Sequence
  chemically synthesized
agcccttagaaacataggaa

SEQ ID NO: 209618 - DNA, 20 bp, Artificial Sequence
  chemically synthesized
gagaaagcccttagaaacat

SEQ ID NO: 209619 - DNA, 20 bp, Artificial Sequence
  chemically synthesized
cattctgttcctatgtttct

SEQ ID NO: 209620 - DNA, 20 bp, Artificial Sequence
  chemically synthesized
tgagaaagcccttagaaaca

SEQ ID NO: 209621 - DNA, 20 bp, Artificial Sequence
  chemically synthesized
attctgttcctatgtttcta

SEQ ID NO: 209622 - DNA, 20 bp, Artificial Sequence
  chemically synthesized
ttctgttcctatgtttctaa

SEQ ID NO: 209623 - DNA, 20 bp, Artificial Sequence
  chemically synthesized
tgagtaaatgagaaagccct

SEQ ID NO: 209624 - DNA, 20 bp, Artificial Sequence
  chemically synthesized
attagattgagtaaatgaga

SEQ ID NO: 209625 - DNA, 20 bp, Artificial Sequence
  chemically synthesized
aattattagattgagtaaat

SEQ ID NO: 209626 - DNA, 20 bp, Artificial Sequence
  chemically synthesized
tgcttaaaaattattagatt

SEQ ID NO: 209627 - DNA, 20 bp, Artificial Sequence
  chemically synthesized
aagaggtgcttaaaaattat

SEQ ID NO: 209628 - DNA, 20 bp, Artificial Sequence
  chemically synthesized
tactcaatctaataattttt

SEQ ID NO: 209629 - DNA, 20 bp, Artificial Sequence
  chemically synthesized
gtgttagctaggacaataag

SEQ ID NO: 209630 - DNA, 20 bp, Artificial Sequence
  chemically synthesized
ggtgttagctaggacaataa

SEQ ID NO: 209631 - DNA, 20 bp, Artificial Sequence
  chemically synthesized
ttaagcacctcttattgtcc

SEQ ID NO: 209632 - DNA, 20 bp, Artificial Sequence
  chemically synthesized
agggtgttagctaggacaat

SEQ ID NO: 209633 - DNA, 20 bp, Artificial Sequence
  chemically synthesized
tttcatccagggtgttagct

SEQ ID NO: 209634 - DNA, 20 bp, Artificial Sequence
  chemically synthesized
atttcatccagggtgttagc

SEQ ID NO: 209635 - DNA, 20 bp, Artificial Sequence
  chemically synthesized
tattgtcctagctaacaccc

SEQ ID NO: 209636 - DNA, 20 bp, Artificial Sequence
  chemically synthesized
gaccatttcatccagggtgt

SEQ ID NO: 209637 - DNA, 20 bp, Artificial Sequence
  chemically synthesized
ctttctgaccatttcatcca

SEQ ID NO: 209638 - DNA, 20 bp, Artificial Sequence
  chemically synthesized
gctttctgaccatttcatcc

SEQ ID NO: 209639 - DNA, 20 bp, Artificial Sequence
  chemically synthesized
agctaacaccctggatgaaa

SEQ ID NO: 209640 - DNA, 20 bp, Artificial Sequence
  chemically synthesized
tgctttctgaccatttcatc

SEQ ID NO: 209641 - DNA, 20 bp, Artificial Sequence
  chemically synthesized
aacaccctggatgaaatggt

SEQ ID NO: 209642 - DNA, 20 bp, Artificial Sequence
  chemically synthesized
ccctggatgaaatggtcaga

SEQ ID NO: 209643 - DNA, 20 bp, Artificial Sequence
  chemically synthesized
tgtctgaggtcaaatacatg

SEQ ID NO: 209644 - DNA, 20 bp, Artificial Sequence
  chemically synthesized
gcactacatgtatttgacct

SEQ ID NO: 209645 - DNA, 20 bp, Artificial Sequence
  chemically synthesized
acatgtatttgacctcagac

SEQ ID NO: 209646 - DNA, 20 bp, Artificial Sequence
  chemically synthesized
ggctttctattacttgtctg

SEQ ID NO: 209647 - DNA, 20 bp, Artificial Sequence
  chemically synthesized
aggctttctattacttgtct

SEQ ID NO: 209648 - DNA, 20 bp, Artificial Sequence
  chemically synthesized
atttgacctcagacaagtaa

SEQ ID NO: 209649 - DNA, 20 bp, Artificial Sequence
  chemically synthesized
gacctcagacaagtaataga

SEQ ID NO: 209650 - DNA, 20 bp, Artificial Sequence
  chemically synthesized
gttatttaaaaagtcagaat

SEQ ID NO: 209651 - DNA, 20 bp, Artificial Sequence
  chemically synthesized
tgttatttaaaaagtcagaa

SEQ ID NO: 209652 - DNA, 20 bp, Artificial Sequence
  chemically synthesized
tgaaatgttatttaaaaagt

SEQ ID NO: 209653 - DNA, 20 bp, Artificial Sequence
  chemically synthesized
ttcttgaaatgttatttaaa

SEQ ID NO: 209654 - DNA, 20 bp, Artificial Sequence
  chemically synthesized
gactttttaaataacatttc

SEQ ID NO: 209655 - DNA, 20 bp, Artificial Sequence
  chemically synthesized
tttttaaataacatttcaag

SEQ ID NO: 209656 - DNA, 20 bp, Artificial Sequence
  chemically synthesized
ataatagaaaggagttatgc

SEQ ID NO: 209657 - DNA, 20 bp, Artificial Sequence
  chemically synthesized
aataatagaaaggagttatg

SEQ ID NO: 209658 - DNA, 20 bp, Artificial Sequence
  chemically synthesized
gttcataaaataatagaaag

SEQ ID NO: 209659 - DNA, 20 bp, Artificial Sequence
  chemically synthesized
atgttcataaaataatagaa

SEQ ID NO: 209660 - DNA, 20 bp, Artificial Sequence
  chemically synthesized
tatgttcataaaataataga

SEQ ID NO: 209661 - DNA, 20 bp, Artificial Sequence
  chemically synthesized
ggactatgttcataaaataa

SEQ ID NO: 209662 - DNA, 20 bp, Artificial Sequence
  chemically synthesized
tttctattattttatgaaca

SEQ ID NO: 209663 - DNA, 20 bp, Artificial Sequence
  chemically synthesized
tattttatgaacatagtcca

SEQ ID NO: 209664 - DNA, 20 bp, Artificial Sequence
  chemically synthesized
ttttatgaacatagtccatg

SEQ ID NO: 209665 - DNA, 20 bp, Artificial Sequence
  chemically synthesized
tttatgaacatagtccatgg

SEQ ID NO: 209666 - DNA, 20 bp, Artificial Sequence
  chemically synthesized
ttgctagttggaagcctcca

SEQ ID NO: 209667 - DNA, 20 bp, Artificial Sequence
  chemically synthesized
agtccatggaggcttccaac

SEQ ID NO: 209668 - DNA, 20 bp, Artificial Sequence
  chemically synthesized
gttcacgggttgctagttgg

SEQ ID NO: 209669 - DNA, 20 bp, Artificial Sequence
  chemically synthesized
taagttcacgggttgctagt

SEQ ID NO: 209670 - DNA, 20 bp, Artificial Sequence
  chemically synthesized
aggttaagttcacgggttgc

SEQ ID NO: 209671 - DNA, 20 bp, Artificial Sequence
  chemically synthesized
aagccttaggttaagttcac

SEQ ID NO: 209672 - DNA, 20 bp, Artificial Sequence
  chemically synthesized
gaagccttaggttaagttca

SEQ ID NO: 209673 - DNA, 20 bp, Artificial Sequence
  chemically synthesized
gcaacccgtgaacttaacct

SEQ ID NO: 209674 - DNA, 20 bp, Artificial Sequence
  chemically synthesized
caacccgtgaacttaaccta

SEQ ID NO: 209675 - DNA, 20 bp, Artificial Sequence
  chemically synthesized
ttaaatagaagccttaggtt

SEQ ID NO: 209676 - DNA, 20 bp, Artificial Sequence
  chemically synthesized
actcattaaatagaagcctt

SEQ ID NO: 209677 - DNA, 20 bp, Artificial Sequence
  chemically synthesized
gactcattaaatagaagcct

SEQ ID NO: 209678 - DNA, 20 bp, Artificial Sequence
  chemically synthesized
ctatcagactcattaaatag

SEQ ID NO: 209679 - DNA, 20 bp, Artificial Sequence
  chemically synthesized
acctaaggcttctatttaat

SEQ ID NO: 209680 - DNA, 20 bp, Artificial Sequence
  chemically synthesized
tggctatcagactcattaaa

SEQ ID NO: 209681 - DNA, 20 bp, Artificial Sequence
  chemically synthesized
cttctatttaatgagtctga

SEQ ID NO: 209682 - DNA, 20 bp, Artificial Sequence
  chemically synthesized
ttttttattcaggtggctat

SEQ ID NO: 209683 - DNA, 20 bp, Artificial Sequence
  chemically synthesized
aaaaagattttttattcagg

SEQ ID NO: 209684 - DNA, 20 bp, Artificial Sequence
  chemically synthesized
aaaaaaaagattttttattc

SEQ ID NO: 209685 - DNA, 20 bp, Artificial Sequence
  chemically synthesized
aaaaaaaaagattttttatt

SEQ ID NO: 209686 - DNA, 20 bp, Artificial Sequence
  chemically synthesized
tcaaaaaaagaaaaaaaaaa

SEQ ID NO: 209687 - DNA, 20 bp, Artificial Sequence
  chemically synthesized
ttttttttttttcttttttt

SEQ ID NO: 209688 - DNA, 20 bp, Artificial Sequence
  chemically synthesized
gccagactccatctcaaaaa

SEQ ID NO: 209689 - DNA, 20 bp, Artificial Sequence
  chemically synthesized
ttttttttctttttttgaga

SEQ ID NO: 209690 - DNA, 20 bp, Artificial Sequence
  chemically synthesized
ttttttctttttttgagatg

SEQ ID NO: 209691 - DNA, 20 bp, Artificial Sequence
  chemically synthesized
tctttttttgagatggagtc

SEQ ID NO: 209692 - DNA, 20 bp, Artificial Sequence
  chemically synthesized
tccagcctgggcgacagagc

SEQ ID NO: 209693 - DNA, 20 bp, Artificial Sequence
  chemically synthesized
tggagtctggctctgtcgcc

SEQ ID NO: 209694 - DNA, 20 bp, Artificial Sequence
  chemically synthesized
ccactccagcctgggcgaca

SEQ ID NO: 209695 - DNA, 20 bp, Artificial Sequence
  chemically synthesized
ggagtctggctctgtcgccc

SEQ ID NO: 209696 - DNA, 20 bp, Artificial Sequence
  chemically synthesized
ctccactccagcctgggcga

SEQ ID NO: 209697 - DNA, 20 bp, Artificial Sequence
  chemically synthesized
tctggctctgtcgcccaggc

SEQ ID NO: 209698 - DNA, 20 bp, Artificial Sequence
  chemically synthesized
tggctctgtcgcccaggctg

SEQ ID NO: 209699 - DNA, 20 bp, Artificial Sequence
  chemically synthesized
ctgccactccactccagcct

SEQ ID NO: 209700 - DNA, 20 bp, Artificial Sequence
  chemically synthesized
cctgccactccactccagcc

SEQ ID NO: 209701 - DNA, 20 bp, Artificial Sequence
  chemically synthesized
ctctgtcgcccaggctggag

SEQ ID NO: 209702 - DNA, 20 bp, Artificial Sequence
  chemically synthesized
ctgtcgcccaggctggagtg

SEQ ID NO: 209703 - DNA, 20 bp, Artificial Sequence
  chemically synthesized
gagatcctgccactccactc

SEQ ID NO: 209704 - DNA, 20 bp, Artificial Sequence
  chemically synthesized
tcgcccaggctggagtggag

SEQ ID NO: 209705 - DNA, 20 bp, Artificial Sequence
  chemically synthesized
cccaggctggagtggagtgg

SEQ ID NO: 209706 - DNA, 20 bp, Artificial Sequence
  chemically synthesized
ccaggctggagtggagtggc

SEQ ID NO: 209707 - DNA, 20 bp, Artificial Sequence
  chemically synthesized
ggagtggagtggcaggatct

SEQ ID NO: 209708 - DNA, 20 bp, Artificial Sequence
  chemically synthesized
agtggcaggatctcggctac

SEQ ID NO: 209709 - DNA, 20 bp, Artificial Sequence
  chemically synthesized
gtggcaggatctcggctacc

SEQ ID NO: 209710 - DNA, 20 bp, Artificial Sequence
  chemically synthesized
atcacttgaacccggtagcc

SEQ ID NO: 209711 - DNA, 20 bp, Artificial Sequence
  chemically synthesized
ggagaatcacttgaacccgg

SEQ ID NO: 209712 - DNA, 20 bp, Artificial Sequence
  chemically synthesized
ggatctcggctaccgggttc

SEQ ID NO: 209713 - DNA, 20 bp, Artificial Sequence
  chemically synthesized
gcaggagaatcacttgaacc

SEQ ID NO: 209714 - DNA, 20 bp, Artificial Sequence
  chemically synthesized
ttcaagtgattctcctgcct

SEQ ID NO: 209715 - DNA, 20 bp, Artificial Sequence
  chemically synthesized
tactcgggaggctgaggcag

SEQ ID NO: 209716 - DNA, 20 bp, Artificial Sequence
  chemically synthesized
gctactcgggaggctgaggc

SEQ ID NO: 209717 - DNA, 20 bp, Artificial Sequence
  chemically synthesized
agctactcgggaggctgagg

SEQ ID NO: 209718 - DNA, 20 bp, Artificial Sequence
  chemically synthesized
cccagctactcgggaggctg

SEQ ID NO: 209719 - DNA, 20 bp, Artificial Sequence
  chemically synthesized
tcccagctactcgggaggct

SEQ ID NO: 209720 - DNA, 20 bp, Artificial Sequence
  chemically synthesized
ttctcctgcctcagcctccc

SEQ ID NO: 209721 - DNA, 20 bp, Artificial Sequence
  chemically synthesized
tcctgcctcagcctcccgag

SEQ ID NO: 209722 - DNA, 20 bp, Artificial Sequence
  chemically synthesized
ggtagtcccagctactcggg

SEQ ID NO: 209723 - DNA, 20 bp, Artificial Sequence
  chemically synthesized
cggtagtcccagctactcgg

SEQ ID NO: 209724 - DNA, 20 bp, Artificial Sequence
  chemically synthesized
gcctcagcctcccgagtagc

SEQ ID NO: 209725 - DNA, 20 bp, Artificial Sequence
  chemically synthesized
gccggtagtcccagctactc

SEQ ID NO: 209726 - DNA, 20 bp, Artificial Sequence
  chemically synthesized
cctcagcctcccgagtagct

SEQ ID NO: 209727 - DNA, 20 bp, Artificial Sequence
  chemically synthesized
tgccggtagtcccagctact

SEQ ID NO: 209728 - DNA, 20 bp, Artificial Sequence
  chemically synthesized
tcccgagtagctgggactac

SEQ ID NO: 209729 - DNA, 20 bp, Artificial Sequence
  chemically synthesized
gtggcatgtgccggtagtcc

SEQ ID NO: 209730 - DNA, 20 bp, Artificial Sequence
  chemically synthesized
ggcgtagtggcatgtgccgg

SEQ ID NO: 209731 - DNA, 20 bp, Artificial Sequence
  chemically synthesized
ccgggcgtagtggcatgtgc

SEQ ID NO: 209732 - DNA, 20 bp, Artificial Sequence
  chemically synthesized
ccggcacatgccactacgcc

SEQ ID NO: 209733 - DNA, 20 bp, Artificial Sequence
  chemically synthesized
aaaaaatcagccgggcgtag

SEQ ID NO: 209734 - DNA, 20 bp, Artificial Sequence
  chemically synthesized
tacaaaaaatcagccgggcg

SEQ ID NO: 209735 - DNA, 20 bp, Artificial Sequence
  chemically synthesized
acaaatacaaaaaatcagcc

SEQ ID NO: 209736 - DNA, 20 bp, Artificial Sequence
  chemically synthesized
tacaaatacaaaaaatcagc

SEQ ID NO: 209737 - DNA, 20 bp, Artificial Sequence
  chemically synthesized
ctactacaaatacaaaaaat

SEQ ID NO: 209738 - DNA, 20 bp, Artificial Sequence
  chemically synthesized
cggctgattttttgtatttg

SEQ ID NO: 209739 - DNA, 20 bp, Artificial Sequence
  chemically synthesized
ctgattttttgtatttgtag

SEQ ID NO: 209740 - DNA, 20 bp, Artificial Sequence
  chemically synthesized
gattttttgtatttgtagta

SEQ ID NO: 209741 - DNA, 20 bp, Artificial Sequence
  chemically synthesized
attttttgtatttgtagtag

SEQ ID NO: 209742 - DNA, 20 bp, Artificial Sequence
  chemically synthesized
ttttgtatttgtagtagagg

SEQ ID NO: 209743 - DNA, 20 bp, Artificial Sequence
  chemically synthesized
tttgtatttgtagtagaggt

SEQ ID NO: 209744 - DNA, 20 bp, Artificial Sequence
  chemically synthesized
gaggtgggttttcaccgtgt

SEQ ID NO: 209745 - DNA, 20 bp, Artificial Sequence
  chemically synthesized
tgggttttcaccgtgttagc

SEQ ID NO: 209746 - DNA, 20 bp, Artificial Sequence
  chemically synthesized
agagaccatcctggctaaca

SEQ ID NO: 209747 - DNA, 20 bp, Artificial Sequence
  chemically synthesized
gggttttcaccgtgttagcc

SEQ ID NO: 209748 - DNA, 20 bp, Artificial Sequence
  chemically synthesized
tttcaccgtgttagccagga

SEQ ID NO: 209749 - DNA, 20 bp, Artificial Sequence
  chemically synthesized
tcaggagatagagaccatcc

SEQ ID NO: 209750 - DNA, 20 bp, Artificial Sequence
  chemically synthesized
gatcatgaggtcaggagata

SEQ ID NO: 209751 - DNA, 20 bp, Artificial Sequence
  chemically synthesized
cggatcatgaggtcaggaga

SEQ ID NO: 209752 - DNA, 20 bp, Artificial Sequence
  chemically synthesized
caggcggatcatgaggtcag

SEQ ID NO: 209753 - DNA, 20 bp, Artificial Sequence
  chemically synthesized
ggcaggcggatcatgaggtc

SEQ ID NO: 209754 - DNA, 20 bp, Artificial Sequence
  chemically synthesized
aggcaggcggatcatgaggt

SEQ ID NO: 209755 - DNA, 20 bp, Artificial Sequence
  chemically synthesized
gccgaggcaggcggatcatg

SEQ ID NO: 209756 - DNA, 20 bp, Artificial Sequence
  chemically synthesized
ggccgaggcaggcggatcat

SEQ ID NO: 209757 - DNA, 20 bp, Artificial Sequence
  chemically synthesized
acctcatgatccgcctgcct

SEQ ID NO: 209758 - DNA, 20 bp, Artificial Sequence
  chemically synthesized
ctttgggaggccgaggcagg

SEQ ID NO: 209759 - DNA, 20 bp, Artificial Sequence
  chemically synthesized
gcactttgggaggccgaggc

SEQ ID NO: 209760 - DNA, 20 bp, Artificial Sequence
  chemically synthesized
agcactttgggaggccgagg

SEQ ID NO: 209761 - DNA, 20 bp, Artificial Sequence
  chemically synthesized
cccagcactttgggaggccg

SEQ ID NO: 209762 - DNA, 20 bp, Artificial Sequence
  chemically synthesized
tcccagcactttgggaggcc

SEQ ID NO: 209763 - DNA, 20 bp, Artificial Sequence
  chemically synthesized
ccgcctgcctcggcctccca

SEQ ID NO: 209764 - DNA, 20 bp, Artificial Sequence
  chemically synthesized
tgtaatcccagcactttggg

SEQ ID NO: 209765 - DNA, 20 bp, Artificial Sequence
  chemically synthesized
ctgtaatcccagcactttgg

SEQ ID NO: 209766 - DNA, 20 bp, Artificial Sequence
  chemically synthesized
gcctcggcctcccaaagtgc

SEQ ID NO: 209767 - DNA, 20 bp, Artificial Sequence
  chemically synthesized
gcctgtaatcccagcacttt

SEQ ID NO: 209768 - DNA, 20 bp, Artificial Sequence
  chemically synthesized
cctcggcctcccaaagtgct

SEQ ID NO: 209769 - DNA, 20 bp, Artificial Sequence
  chemically synthesized
cgcctgtaatcccagcactt

SEQ ID NO: 209770 - DNA, 20 bp, Artificial Sequence
  chemically synthesized
ctcccaaagtgctgggatta

SEQ ID NO: 209771 - DNA, 20 bp, Artificial Sequence
  chemically synthesized
tcccaaagtgctgggattac

SEQ ID NO: 209772 - DNA, 20 bp, Artificial Sequence
  chemically synthesized
gtggctcacgcctgtaatcc

SEQ ID NO: 209773 - DNA, 20 bp, Artificial Sequence
  chemically synthesized
agtgctgggattacaggcgt

SEQ ID NO: 209774 - DNA, 20 bp, Artificial Sequence
  chemically synthesized
caggcgtgagccaccatgcc

SEQ ID NO: 209775 - DNA, 20 bp, Artificial Sequence
  chemically synthesized
tgattcagggccaggcatgg

SEQ ID NO: 209776 - DNA, 20 bp, Artificial Sequence
  chemically synthesized
ttttgattcagggccaggca

SEQ ID NO: 209777 - DNA, 20 bp, Artificial Sequence
  chemically synthesized
aagatttttgattcagggcc

SEQ ID NO: 209778 - DNA, 20 bp, Artificial Sequence
  chemically synthesized
aaagatttttgattcagggc

SEQ ID NO: 209779 - DNA, 20 bp, Artificial Sequence
  chemically synthesized
cgcaaaagatttttgattca

SEQ ID NO: 209780 - DNA, 20 bp, Artificial Sequence
  chemically synthesized
acgcaaaagatttttgattc

SEQ ID NO: 209781 - DNA, 20 bp, Artificial Sequence
  chemically synthesized
tacgcaaaagatttttgatt

SEQ ID NO: 209782 - DNA, 20 bp, Artificial Sequence
  chemically synthesized
tgaatcaaaaatcttttgcg

SEQ ID NO: 209783 - DNA, 20 bp, Artificial Sequence
  chemically synthesized
ttttttccttatctacgcaa

SEQ ID NO: 209784 - DNA, 20 bp, Artificial Sequence
  chemically synthesized
caaaaatcttttgcgtagat

SEQ ID NO: 209785 - DNA, 20 bp, Artificial Sequence
  chemically synthesized
aaaaatcttttgcgtagata

SEQ ID NO: 209786 - DNA, 20 bp, Artificial Sequence
  chemically synthesized
gataaggaaaaaaaaatcaa

SEQ ID NO: 209787 - DNA, 20 bp, Artificial Sequence
  chemically synthesized
aaaaatcaacagtgttgtat

SEQ ID NO: 209788 - DNA, 20 bp, Artificial Sequence
  chemically synthesized
aaaatcaacagtgttgtata

SEQ ID NO: 209789 - DNA, 20 bp, Artificial Sequence
  chemically synthesized
aaatcaacagtgttgtataa

SEQ ID NO: 209790 - DNA, 20 bp, Artificial Sequence
  chemically synthesized
aatcaacagtgttgtataag

SEQ ID NO: 209791 - DNA, 20 bp, Artificial Sequence
  chemically synthesized
agtgttgtataaggggctca

SEQ ID NO: 209792 - DNA, 20 bp, Artificial Sequence
  chemically synthesized
tcaatccatgaagtggctat

SEQ ID NO: 209793 - DNA, 20 bp, Artificial Sequence
  chemically synthesized
aggggctcatagccacttca

SEQ ID NO: 209794 - DNA, 20 bp, Artificial Sequence
  chemically synthesized
agctacctcaatccatgaag

SEQ ID NO: 209795 - DNA, 20 bp, Artificial Sequence
  chemically synthesized
gtaagctacctcaatccatg

SEQ ID NO: 209796 - DNA, 20 bp, Artificial Sequence
  chemically synthesized
tcatagccacttcatggatt

SEQ ID NO: 209797 - DNA, 20 bp, Artificial Sequence
  chemically synthesized
catagccacttcatggattg

SEQ ID NO: 209798 - DNA, 20 bp, Artificial Sequence
  chemically synthesized
agccacttcatggattgagg

SEQ ID NO: 209799 - DNA, 20 bp, Artificial Sequence
  chemically synthesized
atggattgaggtagcttaca

SEQ ID NO: 209800 - DNA, 20 bp, Artificial Sequence
  chemically synthesized
tccctgttattttgctttgt

SEQ ID NO: 209801 - DNA, 20 bp, Artificial Sequence
  chemically synthesized
tagcttacaaagcaaaataa

SEQ ID NO: 209802 - DNA, 20 bp, Artificial Sequence
  chemically synthesized
agcttacaaagcaaaataac

SEQ ID NO: 209803 - DNA, 20 bp, Artificial Sequence
  chemically synthesized
gcttacaaagcaaaataaca

SEQ ID NO: 209804 - DNA, 20 bp, Artificial Sequence
  chemically synthesized
tacaaagcaaaataacaggg

SEQ ID NO: 209805 - DNA, 20 bp, Artificial Sequence
  chemically synthesized
tagtgtattgaattgttttg

SEQ ID NO: 209806 - DNA, 20 bp, Artificial Sequence
  chemically synthesized
aaaacaattcaatacactac

SEQ ID NO: 209807 - DNA, 20 bp, Artificial Sequence
  chemically synthesized
ttttggttcaaagaatccag

SEQ ID NO: 209808 - DNA, 20 bp, Artificial Sequence
  chemically synthesized
aggttttggttcaaagaatc

SEQ ID NO: 209809 - DNA, 20 bp, Artificial Sequence
  chemically synthesized
gttttcaaggttttggttca

SEQ ID NO: 209810 - DNA, 20 bp, Artificial Sequence
  chemically synthesized
ttgtgctgttttcaaggttt

SEQ ID NO: 209811 - DNA, 20 bp, Artificial Sequence
  chemically synthesized
ttgaaccaaaaccttgaaaa

SEQ ID NO: 209812 - DNA, 20 bp, Artificial Sequence
  chemically synthesized
acagatttgtgctgttttca

SEQ ID NO: 209813 - DNA, 20 bp, Artificial Sequence
  chemically synthesized
aacagatttgtgctgttttc

SEQ ID NO: 209814 - DNA, 20 bp, Artificial Sequence
  chemically synthesized
aaaacagcacaaatctgttc

SEQ ID NO: 209815 - DNA, 20 bp, Artificial Sequence
  chemically synthesized
tgatctcccaagtactggaa

SEQ ID NO: 209816 - DNA, 20 bp, Artificial Sequence
  chemically synthesized
cacaaatctgttccagtact

SEQ ID NO: 209817 - DNA, 20 bp, Artificial Sequence
  chemically synthesized
acaaatctgttccagtactt

SEQ ID NO: 209818 - DNA, 20 bp, Artificial Sequence
  chemically synthesized
atggttgatctcccaagtac

SEQ ID NO: 209819 - DNA, 20 bp, Artificial Sequence
  chemically synthesized
aaatctgttccagtacttgg

SEQ ID NO: 209820 - DNA, 20 bp, Artificial Sequence
  chemically synthesized
ttttcaatggttgatctccc

SEQ ID NO: 209821 - DNA, 20 bp, Artificial Sequence
  chemically synthesized
aatgaaatgttaattttcaa

SEQ ID NO: 209822 - DNA, 20 bp, Artificial Sequence
  chemically synthesized
tagaacagaagagcaggcag

SEQ ID NO: 209823 - DNA, 20 bp, Artificial Sequence
  chemically synthesized
ggctagaacagaagagcagg

SEQ ID NO: 209824 - DNA, 20 bp, Artificial Sequence
  chemically synthesized
ggaggctagaacagaagagc

SEQ ID NO: 209825 - DNA, 20 bp, Artificial Sequence
  chemically synthesized
aggaggctagaacagaagag

SEQ ID NO: 209826 - DNA, 20 bp, Artificial Sequence
  chemically synthesized
aagaggaggctagaacagaa

SEQ ID NO: 209827 - DNA, 20 bp, Artificial Sequence
  chemically synthesized
ttctgcctgctcttctgttc

SEQ ID NO: 209828 - DNA, 20 bp, Artificial Sequence
  chemically synthesized
agaagaggaggctagaacag

SEQ ID NO: 209829 - DNA, 20 bp, Artificial Sequence
  chemically synthesized
aacagaagaggaggctagaa

SEQ ID NO: 209830 - DNA, 20 bp, Artificial Sequence
  chemically synthesized
gctagaacagaagaggaggc

SEQ ID NO: 209831 - DNA, 20 bp, Artificial Sequence
  chemically synthesized
gcaggctagaacagaagagg

SEQ ID NO: 209832 - DNA, 20 bp, Artificial Sequence
  chemically synthesized
agcaggctagaacagaagag

SEQ ID NO: 209833 - DNA, 20 bp, Artificial Sequence
  chemically synthesized
agagcaggctagaacagaag

SEQ ID NO: 209834 - DNA, 20 bp, Artificial Sequence
  chemically synthesized
aagagcaggctagaacagaa

SEQ ID NO: 209835 - DNA, 20 bp, Artificial Sequence
  chemically synthesized
tctagcctcctcttctgttc

SEQ ID NO: 209836 - DNA, 20 bp, Artificial Sequence
  chemically synthesized
agaagagcaggctagaacag

SEQ ID NO: 209837 - DNA, 20 bp, Artificial Sequence
  chemically synthesized
cacagaagagcaggctagaa

SEQ ID NO: 209838 - DNA, 20 bp, Artificial Sequence
  chemically synthesized
acagccacagaagagcaggc

SEQ ID NO: 209839 - DNA, 20 bp, Artificial Sequence
  chemically synthesized
atgaacagccacagaagagc

SEQ ID NO: 209840 - DNA, 20 bp, Artificial Sequence
  chemically synthesized
gatgaacagccacagaagag

SEQ ID NO: 209841 - DNA, 20 bp, Artificial Sequence
  chemically synthesized
tgttctagcctgctcttctg

SEQ ID NO: 209842 - DNA, 20 bp, Artificial Sequence
  chemically synthesized
tgcgatgaacagccacagaa

SEQ ID NO: 209843 - DNA, 20 bp, Artificial Sequence
  chemically synthesized
gctgcgatgaacagccacag

SEQ ID NO: 209844 - DNA, 20 bp, Artificial Sequence
  chemically synthesized
gtggctgcgatgaacagcca

SEQ ID NO: 209845 - DNA, 20 bp, Artificial Sequence
  chemically synthesized
tcttctgtggctgttcatcg

SEQ ID NO: 209846 - DNA, 20 bp, Artificial Sequence
  chemically synthesized
acaaatgtggctgcgatgaa

SEQ ID NO: 209847 - DNA, 20 bp, Artificial Sequence
  chemically synthesized
gttcatcgcagccacatttg

SEQ ID NO: 209848 - DNA, 20 bp, Artificial Sequence
  chemically synthesized
ttcatcgcagccacatttgt

SEQ ID NO: 209849 - DNA, 20 bp, Artificial Sequence
  chemically synthesized
aacatttaaacctacaaatg

SEQ ID NO: 209850 - DNA, 20 bp, Artificial Sequence
  chemically synthesized
catttgtaggtttaaatgtt

SEQ ID NO: 209851 - DNA, 20 bp, Artificial Sequence
  chemically synthesized
gtttaaatgttcagattgcc

SEQ ID NO: 209852 - DNA, 20 bp, Artificial Sequence
  chemically synthesized
aaatgttcagattgcctaga

SEQ ID NO: 209853 - DNA, 20 bp, Artificial Sequence
  chemically synthesized
ttgcatatgcaaagctttct

SEQ ID NO: 209854 - DNA, 20 bp, Artificial Sequence
  chemically synthesized
tttgcatatgcaaagctttc

SEQ ID NO: 209855 - DNA, 20 bp, Artificial Sequence
  chemically synthesized
tgcatatatttgcatatgca

SEQ ID NO: 209856 - DNA, 20 bp, Artificial Sequence
  chemically synthesized
caaatatatgcataatcatc

SEQ ID NO: 209857 - DNA, 20 bp, Artificial Sequence
  chemically synthesized
agtctgatagaaagcataac

SEQ ID NO: 209858 - DNA, 20 bp, Artificial Sequence
  chemically synthesized
catctggttatgctttctat

SEQ ID NO: 209859 - DNA, 20 bp, Artificial Sequence
  chemically synthesized
aggtttatgagtctgataga

SEQ ID NO: 209860 - DNA, 20 bp, Artificial Sequence
  chemically synthesized
aagcaggtttatgagtctga

SEQ ID NO: 209861 - DNA, 20 bp, Artificial Sequence
  chemically synthesized
agagaataaagcaggtttat

SEQ ID NO: 209862 - DNA, 20 bp, Artificial Sequence
  chemically synthesized
aatgctggagagaataaagc

SEQ ID NO: 209863 - DNA, 20 bp, Artificial Sequence
  chemically synthesized
aaatgctggagagaataaag

SEQ ID NO: 209864 - DNA, 20 bp, Artificial Sequence
  chemically synthesized
gaaaaatgctggagagaata

SEQ ID NO: 209865 - DNA, 20 bp, Artificial Sequence
  chemically synthesized
taaacctgctttattctctc

SEQ ID NO: 209866 - DNA, 20 bp, Artificial Sequence
  chemically synthesized
attagaagaaaaatgctgga

SEQ ID NO: 209867 - DNA, 20 bp, Artificial Sequence
  chemically synthesized
atattagaagaaaaatgctg

SEQ ID NO: 209868 - DNA, 20 bp, Artificial Sequence
  chemically synthesized
aaatattagaagaaaaatgc

SEQ ID NO: 209869 - DNA, 20 bp, Artificial Sequence
  chemically synthesized
ccctatttatgaaatattag

SEQ ID NO: 209870 - DNA, 20 bp, Artificial Sequence
  chemically synthesized
cagccctatttatgaaatat

SEQ ID NO: 209871 - DNA, 20 bp, Artificial Sequence
  chemically synthesized
ttcttctaatatttcataaa

SEQ ID NO: 209872 - DNA, 20 bp, Artificial Sequence
  chemically synthesized
tcttctaatatttcataaat

SEQ ID NO: 209873 - DNA, 20 bp, Artificial Sequence
  chemically synthesized
cttctaatatttcataaata

SEQ ID NO: 209874 - DNA, 20 bp, Artificial Sequence
  chemically synthesized
ggaatttaaggttgaggtta

SEQ ID NO: 209875 - DNA, 20 bp, Artificial Sequence
  chemically synthesized
atatttggaatttaaggttg

SEQ ID NO: 209876 - DNA, 20 bp, Artificial Sequence
  chemically synthesized
aatatttggaatttaaggtt

SEQ ID NO: 209877 - DNA, 20 bp, Artificial Sequence
  chemically synthesized
ttcagaatatttggaattta

SEQ ID NO: 209878 - DNA, 20 bp, Artificial Sequence
  chemically synthesized
attcagaatatttggaattt

SEQ ID NO: 209879 - DNA, 20 bp, Artificial Sequence
  chemically synthesized
aaaagaaaattcagaatatt

SEQ ID NO: 209880 - DNA, 20 bp, Artificial Sequence
  chemically synthesized
ttatagacaaaaagaaaatt

SEQ ID NO: 209881 - DNA, 20 bp, Artificial Sequence
  chemically synthesized
aaaatacaattatagacaaa

SEQ ID NO: 209882 - DNA, 20 bp, Artificial Sequence
  chemically synthesized
atcttgacaaaatacaatta

SEQ ID NO: 209883 - DNA, 20 bp, Artificial Sequence
  chemically synthesized
gtctataattgtattttgtc

SEQ ID NO: 209884 - DNA, 20 bp, Artificial Sequence
  chemically synthesized
ttaaagttcattttaaatat

SEQ ID NO: 209885 - DNA, 20 bp, Artificial Sequence
  chemically synthesized
ttaaaattcagaaacattta

SEQ ID NO: 209886 - DNA, 20 bp, Artificial Sequence
  chemically synthesized
gaggtttcaatattaaaatt

SEQ ID NO: 209887 - DNA, 20 bp, Artificial Sequence
  chemically synthesized
ggtgagtgtgtgaggatttg

SEQ ID NO: 209888 - DNA, 20 bp, Artificial Sequence
  chemically synthesized
aggtgagtgtgtgaggattt

SEQ ID NO: 209889 - DNA, 20 bp, Artificial Sequence
  chemically synthesized
ttacctaaggtgagtgtgtg

SEQ ID NO: 209890 - DNA, 20 bp, Artificial Sequence
  chemically synthesized
cttacctaaggtgagtgtgt

SEQ ID NO: 209891 - DNA, 20 bp, Artificial Sequence
  chemically synthesized
aaatcctcacacactcacct

SEQ ID NO: 209892 - DNA, 20 bp, Artificial Sequence
  chemically synthesized
aatcctcacacactcacctt

SEQ ID NO: 209893 - DNA, 20 bp, Artificial Sequence
  chemically synthesized
cttttttacttacctaaggt

SEQ ID NO: 209894 - DNA, 20 bp, Artificial Sequence
  chemically synthesized
ctcacacactcaccttaggt

SEQ ID NO: 209895 - DNA, 20 bp, Artificial Sequence
  chemically synthesized
aaagcttttttacttaccta

SEQ ID NO: 209896 - DNA, 20 bp, Artificial Sequence
  chemically synthesized
taaagcttttttacttacct

SEQ ID NO: 209897 - DNA, 20 bp, Artificial Sequence
  chemically synthesized
ctcaccttaggtaagtaaaa

SEQ ID NO: 209898 - DNA, 20 bp, Artificial Sequence
  chemically synthesized
ttaggtaagtaaaaaagctt

SEQ ID NO: 209899 - DNA, 20 bp, Artificial Sequence
  chemically synthesized
aggtaagtaaaaaagcttta

SEQ ID NO: 209900 - DNA, 20 bp, Artificial Sequence
  chemically synthesized
tcttactaactcaagctcta

SEQ ID NO: 209901 - DNA, 20 bp, Artificial Sequence
  chemically synthesized
gtaaaaaagctttagagctt

SEQ ID NO: 209902 - DNA, 20 bp, Artificial Sequence
  chemically synthesized
aaaagctttagagcttgagt

SEQ ID NO: 209903 - DNA, 20 bp, Artificial Sequence
  chemically synthesized
taagtccttcttactaactc

SEQ ID NO: 209904 - DNA, 20 bp, Artificial Sequence
  chemically synthesized
gctttagagcttgagttagt

SEQ ID NO: 209905 - DNA, 20 bp, Artificial Sequence
  chemically synthesized
ttagagcttgagttagtaag

SEQ ID NO: 209906 - DNA, 20 bp, Artificial Sequence
  chemically synthesized
tagagcttgagttagtaaga

SEQ ID NO: 209907 - DNA, 20 bp, Artificial Sequence
  chemically synthesized
ttgagttagtaagaaggact

SEQ ID NO: 209908 - DNA, 20 bp, Artificial Sequence
  chemically synthesized
ttagtaagaaggacttagtc

SEQ ID NO: 209909 - DNA, 20 bp, Artificial Sequence
  chemically synthesized
tagtaagaaggacttagtca

SEQ ID NO: 209910 - DNA, 20 bp, Artificial Sequence
  chemically synthesized
tattgtctctttccttgact

SEQ ID NO: 209911 - DNA, 20 bp, Artificial Sequence
  chemically synthesized
aagaaggacttagtcaagga

SEQ ID NO: 209912 - DNA, 20 bp, Artificial Sequence
  chemically synthesized
gaaggacttagtcaaggaaa

SEQ ID NO: 209913 - DNA, 20 bp, Artificial Sequence
  chemically synthesized
agtcaaggaaagagacaata

SEQ ID NO: 209914 - DNA, 20 bp, Artificial Sequence
  chemically synthesized
aaggaaagagacaatacagt

SEQ ID NO: 209915 - DNA, 20 bp, Artificial Sequence
  chemically synthesized
aaagagacaatacagtgagt

SEQ ID NO: 209916 - DNA, 20 bp, Artificial Sequence
  chemically synthesized
agacaatacagtgagtgagt

SEQ ID NO: 209917 - DNA, 20 bp, Artificial Sequence
  chemically synthesized
tgacccctcaacacacacac

SEQ ID NO: 209918 - DNA, 20 bp, Artificial Sequence
  chemically synthesized
atgacccctcaacacacaca

SEQ ID NO: 209919 - DNA, 20 bp, Artificial Sequence
  chemically synthesized
tatgtgcctgtgtgtgtgtt

SEQ ID NO: 209920 - DNA, 20 bp, Artificial Sequence
  chemically synthesized
atgtgcctgtgtgtgtgttg

SEQ ID NO: 209921 - DNA, 20 bp, Artificial Sequence
  chemically synthesized
tgtgcctgtgtgtgtgttga

SEQ ID NO: 209922 - DNA, 20 bp, Artificial Sequence
  chemically synthesized
gtgcctgtgtgtgtgttgag

SEQ ID NO: 209923 - DNA, 20 bp, Artificial Sequence
  chemically synthesized
tgtgtattgcacatgacatc

SEQ ID NO: 209924 - DNA, 20 bp, Artificial Sequence
  chemically synthesized
gtattgcacatgacatcgag

SEQ ID NO: 209925 - DNA, 20 bp, Artificial Sequence
  chemically synthesized
tgcacatgacatcgagaagt

SEQ ID NO: 209926 - DNA, 20 bp, Artificial Sequence
  chemically synthesized
gcacatgacatcgagaagtg

SEQ ID NO: 209927 - DNA, 20 bp, Artificial Sequence
  chemically synthesized
cacatgacatcgagaagtga

SEQ ID NO: 209928 - DNA, 20 bp, Artificial Sequence
  chemically synthesized
aagtgagggatgtgaaaacc

SEQ ID NO: 209929 - DNA, 20 bp, Artificial Sequence
  chemically synthesized
gcctcaggaaggaaacatct

SEQ ID NO: 209930 - DNA, 20 bp, Artificial Sequence
  chemically synthesized
aaccaagatgtttccttcct

SEQ ID NO: 209931 - DNA, 20 bp, Artificial Sequence
  chemically synthesized
accaagatgtttccttcctg

SEQ ID NO: 209932 - DNA, 20 bp, Artificial Sequence
  chemically synthesized
caggtcacacggcctcagga

SEQ ID NO: 209933 - DNA, 20 bp, Artificial Sequence
  chemically synthesized
tcaggtcacacggcctcagg

SEQ ID NO: 209934 - DNA, 20 bp, Artificial Sequence
  chemically synthesized
gaatcaggtcacacggcctc

SEQ ID NO: 209935 - DNA, 20 bp, Artificial Sequence
  chemically synthesized
tgaatcaggtcacacggcct

SEQ ID NO: 209936 - DNA, 20 bp, Artificial Sequence
  chemically synthesized
cagctctgaatcaggtcaca

SEQ ID NO: 209937 - DNA, 20 bp, Artificial Sequence
  chemically synthesized
tgaggccgtgtgacctgatt

SEQ ID NO: 209938 - DNA, 20 bp, Artificial Sequence
  chemically synthesized
aggccgtgtgacctgattca

SEQ ID NO: 209939 - DNA, 20 bp, Artificial Sequence
  chemically synthesized
atgagatgcagctctgaatc

SEQ ID NO: 209940 - DNA, 20 bp, Artificial Sequence
  chemically synthesized
aatgagatgcagctctgaat

SEQ ID NO: 209941 - DNA, 20 bp, Artificial Sequence
  chemically synthesized
cctaagaggtgaatgagatg

SEQ ID NO: 209942 - DNA, 20 bp, Artificial Sequence
  chemically synthesized
cagggacctaagaggtgaat

SEQ ID NO: 209943 - DNA, 20 bp, Artificial Sequence
  chemically synthesized
gctgcatctcattcacctct

SEQ ID NO: 209944 - DNA, 20 bp, Artificial Sequence
  chemically synthesized
ctgcatctcattcacctctt

SEQ ID NO: 209945 - DNA, 20 bp, Artificial Sequence
  chemically synthesized
actccaaccagggacctaag

SEQ ID NO: 209946 - DNA, 20 bp, Artificial Sequence
  chemically synthesized
cactccaaccagggacctaa

SEQ ID NO: 209947 - DNA, 20 bp, Artificial Sequence
  chemically synthesized
tcattcacctcttaggtccc

SEQ ID NO: 209948 - DNA, 20 bp, Artificial Sequence
  chemically synthesized
ggcactccaaccagggacct

SEQ ID NO: 209949 - DNA, 20 bp, Artificial Sequence
  chemically synthesized
tcacctcttaggtccctggt

SEQ ID NO: 209950 - DNA, 20 bp, Artificial Sequence
  chemically synthesized
acctcttaggtccctggttg

SEQ ID NO: 209951 - DNA, 20 bp, Artificial Sequence
  chemically synthesized
tgaaaaaggcactccaacca

SEQ ID NO: 209952 - DNA, 20 bp, Artificial Sequence
  chemically synthesized
ttgaaaaaggcactccaacc

SEQ ID NO: 209953 - DNA, 20 bp, Artificial Sequence
  chemically synthesized
tttgaaaaaggcactccaac

SEQ ID NO: 209954 - DNA, 20 bp, Artificial Sequence
  chemically synthesized
tgggcagagacatttgaaaa

SEQ ID NO: 209955 - DNA, 20 bp, Artificial Sequence
  chemically synthesized
ttgggcagagacatttgaaa

SEQ ID NO: 209956 - DNA, 20 bp, Artificial Sequence
  chemically synthesized
ttttcaaatgtctctgccca

SEQ ID NO: 209957 - DNA, 20 bp, Artificial Sequence
  chemically synthesized
gatgtccctcactttgggca

SEQ ID NO: 209958 - DNA, 20 bp, Artificial Sequence
  chemically synthesized
aagatgtccctcactttggg

SEQ ID NO: 209959 - DNA, 20 bp, Artificial Sequence
  chemically synthesized
caaatgtctctgcccaaagt

SEQ ID NO: 209960 - DNA, 20 bp, Artificial Sequence
  chemically synthesized
aaatgtctctgcccaaagtg

SEQ ID NO: 209961 - DNA, 20 bp, Artificial Sequence
  chemically synthesized
aatgtctctgcccaaagtga

SEQ ID NO: 209962 - DNA, 20 bp, Artificial Sequence
  chemically synthesized
taaaagatgtccctcacttt

SEQ ID NO: 209963 - DNA, 20 bp, Artificial Sequence
  chemically synthesized
ataaaagatgtccctcactt

SEQ ID NO: 209964 - DNA, 20 bp, Artificial Sequence
  chemically synthesized
ttgacttgatggtttaataa

SEQ ID NO: 209965 - DNA, 20 bp, Artificial Sequence
  chemically synthesized
acatcttttattaaaccatc

SEQ ID NO: 209966 - DNA, 20 bp, Artificial Sequence
  chemically synthesized
gatcactcgttttgacttga

SEQ ID NO: 209967 - DNA, 20 bp, Artificial Sequence
  chemically synthesized
ttaaaccatcaagtcaaaac

SEQ ID NO: 209968 - DNA, 20 bp, Artificial Sequence
  chemically synthesized
gagtctttgtatgtattaga

SEQ ID NO: 209969 - DNA, 20 bp, Artificial Sequence
  chemically synthesized
tcctgagtctttgtatgtat

SEQ ID NO: 209970 - DNA, 20 bp, Artificial Sequence
  chemically synthesized
tgatctttctaatacataca

SEQ ID NO: 209971 - DNA, 20 bp, Artificial Sequence
  chemically synthesized
ttctaatacatacaaagact

SEQ ID NO: 209972 - DNA, 20 bp, Artificial Sequence
  chemically synthesized
tctaatacatacaaagactc

SEQ ID NO: 209973 - DNA, 20 bp, Artificial Sequence
  chemically synthesized
gtctgtatatggcatatcct

SEQ ID NO: 209974 - DNA, 20 bp, Artificial Sequence
  chemically synthesized
gactcaggatatgccatata

SEQ ID NO: 209975 - DNA, 20 bp, Artificial Sequence
  chemically synthesized
gtcatttgcatgtctgtata

SEQ ID NO: 209976 - DNA, 20 bp, Artificial Sequence
  chemically synthesized
atacagacatgcaaatgacc

SEQ ID NO: 209977 - DNA, 20 bp, Artificial Sequence
  chemically synthesized
tacagacatgcaaatgacca

SEQ ID NO: 209978 - DNA, 20 bp, Artificial Sequence
  chemically synthesized
taatgcttgaaaataggcct

SEQ ID NO: 209979 - DNA, 20 bp, Artificial Sequence
  chemically synthesized
aatgaccaaggcctattttc

SEQ ID NO: 209980 - DNA, 20 bp, Artificial Sequence
  chemically synthesized
tagtaataatgcttgaaaat

SEQ ID NO: 209981 - DNA, 20 bp, Artificial Sequence
  chemically synthesized
ttagtaataatgcttgaaaa

SEQ ID NO: 209982 - DNA, 20 bp, Artificial Sequence
  chemically synthesized
tttatcccaaataattattt

SEQ ID NO: 209983 - DNA, 20 bp, Artificial Sequence
  chemically synthesized
ttattactaaaataattatt

SEQ ID NO: 209984 - DNA, 20 bp, Artificial Sequence
  chemically synthesized
tattactaaaataattattt

SEQ ID NO: 209985 - DNA, 20 bp, Artificial Sequence
  chemically synthesized
agatactacttgtgtttatt

SEQ ID NO: 209986 - DNA, 20 bp, Artificial Sequence
  chemically synthesized
ggataaaacttaataaacac

SEQ ID NO: 209987 - DNA, 20 bp, Artificial Sequence
  chemically synthesized
taaaacttaataaacacaag

SEQ ID NO: 209988 - DNA, 20 bp, Artificial Sequence
  chemically synthesized
cacaagtagtatctgcttta

SEQ ID NO: 209989 - DNA, 20 bp, Artificial Sequence
  chemically synthesized
accatcatctatctataaag

SEQ ID NO: 209990 - DNA, 20 bp, Artificial Sequence
  chemically synthesized
agtagtatctgctttataga

SEQ ID NO: 209991 - DNA, 20 bp, Artificial Sequence
  chemically synthesized
ggcaccatcatctatctata

SEQ ID NO: 209992 - DNA, 20 bp, Artificial Sequence
  chemically synthesized
tctgctttatagatagatga

SEQ ID NO: 209993 - DNA, 20 bp, Artificial Sequence
  chemically synthesized
actgatattcatattcaatt

SEQ ID NO: 209994 - DNA, 20 bp, Artificial Sequence
  chemically synthesized
gccaaattgaatatgaatat

SEQ ID NO: 209995 - DNA, 20 bp, Artificial Sequence
  chemically synthesized
tgaatatcagttgtttgcaa

SEQ ID NO: 209996 - DNA, 20 bp, Artificial Sequence
  chemically synthesized
gaatatcagttgtttgcaat

SEQ ID NO: 209997 - DNA, 20 bp, Artificial Sequence
  chemically synthesized
aatatcagttgtttgcaata

SEQ ID NO: 209998 - DNA, 20 bp, Artificial Sequence
  chemically synthesized
agggaacatattttccacat

SEQ ID NO: 209999 - DNA, 20 bp, Artificial Sequence
  chemically synthesized
ctaagtatccaatgcttatg

SEQ ID NO: 210000 - DNA, 20 bp, Artificial Sequence
  chemically synthesized
catattttccacataagcat

SEQ ID NO: 210001 - DNA, 20 bp, Artificial Sequence
  chemically synthesized
ccacataagcattggatact

SEQ ID NO: 210002 - DNA, 20 bp, Artificial Sequence
  chemically synthesized
cataagcattggatacttag

SEQ ID NO: 210003 - DNA, 20 bp, Artificial Sequence
  chemically synthesized
gcattggatacttagtagct

SEQ ID NO: 210004 - DNA, 20 bp, Artificial Sequence
  chemically synthesized
taattggcaactgagctact

SEQ ID NO: 210005 - DNA, 20 bp, Artificial Sequence
  chemically synthesized
cggcagtgtaattggcaact

SEQ ID NO: 210006 - DNA, 20 bp, Artificial Sequence
  chemically synthesized
gttagagtcggcagtgtaat

SEQ ID NO: 210007 - DNA, 20 bp, Artificial Sequence
  chemically synthesized
atagcttaagttagagtcgg

SEQ ID NO: 210008 - DNA, 20 bp, Artificial Sequence
  chemically synthesized
tagatagcttaagttagagt

SEQ ID NO: 210009 - DNA, 20 bp, Artificial Sequence
  chemically synthesized
tacactgccgactctaactt

SEQ ID NO: 210010 - DNA, 20 bp, Artificial Sequence
  chemically synthesized
tcattagatagcttaagtta

SEQ ID NO: 210011 - DNA, 20 bp, Artificial Sequence
  chemically synthesized
cctcattagatagcttaagt

SEQ ID NO: 210012 - DNA, 20 bp, Artificial Sequence
  chemically synthesized
ttgtcctcattagatagctt

SEQ ID NO: 210013 - DNA, 20 bp, Artificial Sequence
  chemically synthesized
tctaacttaagctatctaat

SEQ ID NO: 210014 - DNA, 20 bp, Artificial Sequence
  chemically synthesized
ctaacttaagctatctaatg

SEQ ID NO: 210015 - DNA, 20 bp, Artificial Sequence
  chemically synthesized
ggtctgttgtcctcattaga

SEQ ID NO: 210016 - DNA, 20 bp, Artificial Sequence
  chemically synthesized
agcaggtctgttgtcctcat

SEQ ID NO: 210017 - DNA, 20 bp, Artificial Sequence
  chemically synthesized
aagctatctaatgaggacaa

SEQ ID NO: 210018 - DNA, 20 bp, Artificial Sequence
  chemically synthesized
gaggacaacagacctgctat

SEQ ID NO: 210019 - DNA, 20 bp, Artificial Sequence
  chemically synthesized
aggacaacagacctgctatt

SEQ ID NO: 210020 - DNA, 20 bp, Artificial Sequence
  chemically synthesized
aattccgtaatcccaatagc

SEQ ID NO: 210021 - DNA, 20 bp, Artificial Sequence
  chemically synthesized
gaattccgtaatcccaatag

SEQ ID NO: 210022 - DNA, 20 bp, Artificial Sequence
  chemically synthesized
cctgaattccgtaatcccaa

SEQ ID NO: 210023 - DNA, 20 bp, Artificial Sequence
  chemically synthesized
cagacctgctattgggatta

SEQ ID NO: 210024 - DNA, 20 bp, Artificial Sequence
  chemically synthesized
gctattgggattacggaatt

SEQ ID NO: 210025 - DNA, 20 bp, Artificial Sequence
  chemically synthesized
ctattgggattacggaattc

SEQ ID NO: 210026 - DNA, 20 bp, Artificial Sequence
  chemically synthesized
ggattacggaattcaggaaa

SEQ ID NO: 210027 - DNA, 20 bp, Artificial Sequence
  chemically synthesized
ggaaacagtaaattcactct

SEQ ID NO: 210028 - DNA, 20 bp, Artificial Sequence
  chemically synthesized
aaacagtaaattcactctga

SEQ ID NO: 210029 - DNA, 20 bp, Artificial Sequence
  chemically synthesized
gaggatctcaattgctctca

SEQ ID NO: 210030 - DNA, 20 bp, Artificial Sequence
  chemically synthesized
cagaggatctcaattgctct

SEQ ID NO: 210031 - DNA, 20 bp, Artificial Sequence
  chemically synthesized
aattcactctgagagcaatt

SEQ ID NO: 210032 - DNA, 20 bp, Artificial Sequence
  chemically synthesized
gcaattgagatcctctgaaa

SEQ ID NO: 210033 - DNA, 20 bp, Artificial Sequence
  chemically synthesized
caattgagatcctctgaaat

SEQ ID NO: 210034 - DNA, 20 bp, Artificial Sequence
  chemically synthesized
cttccgagaccccatttcag

SEQ ID NO: 210035 - DNA, 20 bp, Artificial Sequence
  chemically synthesized
aattgagatcctctgaaatg

SEQ ID NO: 210036 - DNA, 20 bp, Artificial Sequence
  chemically synthesized
ccttccgagaccccatttca

SEQ ID NO: 210037 - DNA, 20 bp, Artificial Sequence
  chemically synthesized
cgccttccgagaccccattt

SEQ ID NO: 210038 - DNA, 20 bp, Artificial Sequence
  chemically synthesized
gatcctctgaaatggggtct

SEQ ID NO: 210039 - DNA, 20 bp, Artificial Sequence
  chemically synthesized
cctctgaaatggggtctcgg

SEQ ID NO: 210040 - DNA, 20 bp, Artificial Sequence
  chemically synthesized
ctctgaaatggggtctcgga

SEQ ID NO: 210041 - DNA, 20 bp, Artificial Sequence
  chemically synthesized
tgaaatggggtctcggaagg

SEQ ID NO: 210042 - DNA, 20 bp, Artificial Sequence
  chemically synthesized
gaaatggggtctcggaaggc

SEQ ID NO: 210043 - DNA, 20 bp, Artificial Sequence
  chemically synthesized
ttattaattccccgccttcc

SEQ ID NO: 210044 - DNA, 20 bp, Artificial Sequence
  chemically synthesized
aaatggggtctcggaaggcg

SEQ ID NO: 210045 - DNA, 20 bp, Artificial Sequence
  chemically synthesized
ggaaggcggggaattaataa

SEQ ID NO: 210046 - DNA, 20 bp, Artificial Sequence
  chemically synthesized
gaaggcggggaattaataac

SEQ ID NO: 210047 - DNA, 20 bp, Artificial Sequence
  chemically synthesized
aaggcggggaattaataaca

SEQ ID NO: 210048 - DNA, 20 bp, Artificial Sequence
  chemically synthesized
gaattaataacagggccttt

SEQ ID NO: 210049 - DNA, 20 bp, Artificial Sequence
  chemically synthesized
aataacagggcctttgagta

SEQ ID NO: 210050 - DNA, 20 bp, Artificial Sequence
  chemically synthesized
acttgtgaggccatactcaa

SEQ ID NO: 210051 - DNA, 20 bp, Artificial Sequence
  chemically synthesized
aacttgtgaggccatactca

SEQ ID NO: 210052 - DNA, 20 bp, Artificial Sequence
  chemically synthesized
gcctttgagtatggcctcac

SEQ ID NO: 210053 - DNA, 20 bp, Artificial Sequence
  chemically synthesized
gaagcaatttacaacttgtg

SEQ ID NO: 210054 - DNA, 20 bp, Artificial Sequence
  chemically synthesized
ggaagcaatttacaacttgt

SEQ ID NO: 210055 - DNA, 20 bp, Artificial Sequence
  chemically synthesized
cacaagttgtaaattgcttc

SEQ ID NO: 210056 - DNA, 20 bp, Artificial Sequence
  chemically synthesized
caagttgtaaattgcttcca

SEQ ID NO: 210057 - DNA, 20 bp, Artificial Sequence
  chemically synthesized
aagttgtaaattgcttccag

SEQ ID NO: 210058 - DNA, 20 bp, Artificial Sequence
  chemically synthesized
tctcagctcagtgcctctgg

SEQ ID NO: 210059 - DNA, 20 bp, Artificial Sequence
  chemically synthesized
gcctctcagctcagtgcctc

SEQ ID NO: 210060 - DNA, 20 bp, Artificial Sequence
  chemically synthesized
aaattgcttccagaggcact

SEQ ID NO: 210061 - DNA, 20 bp, Artificial Sequence
  chemically synthesized
gcttccagaggcactgagct

SEQ ID NO: 210062 - DNA, 20 bp, Artificial Sequence
  chemically synthesized
ttccagaggcactgagctga

SEQ ID NO: 210063 - DNA, 20 bp, Artificial Sequence
  chemically synthesized
tccagaggcactgagctgag

SEQ ID NO: 210064 - DNA, 20 bp, Artificial Sequence
  chemically synthesized
cttctctgcgcctctcagct

SEQ ID NO: 210065 - DNA, 20 bp, Artificial Sequence
  chemically synthesized
aggcactgagctgagaggcg

SEQ ID NO: 210066 - DNA, 20 bp, Artificial Sequence
  chemically synthesized
ttcagcttctctgcgcctct

SEQ ID NO: 210067 - DNA, 20 bp, Artificial Sequence
  chemically synthesized
gcactgagctgagaggcgca

SEQ ID NO: 210068 - DNA, 20 bp, Artificial Sequence
  chemically synthesized
ctgagctgagaggcgcagag

SEQ ID NO: 210069 - DNA, 20 bp, Artificial Sequence
  chemically synthesized
gtttcgtggcttgaagattt

SEQ ID NO: 210070 - DNA, 20 bp, Artificial Sequence
  chemically synthesized
gcagagaagctgaaatcttc

SEQ ID NO: 210071 - DNA, 20 bp, Artificial Sequence
  chemically synthesized
gggccaggtttcgtggcttg

SEQ ID NO: 210072 - DNA, 20 bp, Artificial Sequence
  chemically synthesized
aatcttcaagccacgaaacc

SEQ ID NO: 210073 - DNA, 20 bp, Artificial Sequence
  chemically synthesized
gagcccggggccaggtttcg

SEQ ID NO: 210074 - DNA, 20 bp, Artificial Sequence
  chemically synthesized
caagccacgaaacctggccc

SEQ ID NO: 210075 - DNA, 20 bp, Artificial Sequence
  chemically synthesized
aagccacgaaacctggcccc

SEQ ID NO: 210076 - DNA, 20 bp, Artificial Sequence
  chemically synthesized
ggcagatagagcccggggcc

SEQ ID NO: 210077 - DNA, 20 bp, Artificial Sequence
  chemically synthesized
gggcagatagagcccggggc

SEQ ID NO: 210078 - DNA, 20 bp, Artificial Sequence
  chemically synthesized
tactgggcagatagagcccg

SEQ ID NO: 210079 - DNA, 20 bp, Artificial Sequence
  chemically synthesized
ttactgggcagatagagccc

SEQ ID NO: 210080 - DNA, 20 bp, Artificial Sequence
  chemically synthesized
tttactgggcagatagagcc

SEQ ID NO: 210081 - DNA, 20 bp, Artificial Sequence
  chemically synthesized
gtccttttactgggcagata

SEQ ID NO: 210082 - DNA, 20 bp, Artificial Sequence
  chemically synthesized
ggccccgggctctatctgcc

SEQ ID NO: 210083 - DNA, 20 bp, Artificial Sequence
  chemically synthesized
tggtccttttactgggcaga

SEQ ID NO: 210084 - DNA, 20 bp, Artificial Sequence
  chemically synthesized
acagtggtccttttactggg

SEQ ID NO: 210085 - DNA, 20 bp, Artificial Sequence
  chemically synthesized
gggctctatctgcccagtaa

SEQ ID NO: 210086 - DNA, 20 bp, Artificial Sequence
  chemically synthesized
ggctctatctgcccagtaaa

SEQ ID NO: 210087 - DNA, 20 bp, Artificial Sequence
  chemically synthesized
aaaacagtggtccttttact

SEQ ID NO: 210088 - DNA, 20 bp, Artificial Sequence
  chemically synthesized
gaaaacagtggtccttttac

SEQ ID NO: 210089 - DNA, 20 bp, Artificial Sequence
  chemically synthesized
ccttgagagaaggaaaacag

SEQ ID NO: 210090 - DNA, 20 bp, Artificial Sequence
  chemically synthesized
atcccttgagagaaggaaaa

SEQ ID NO: 210091 - DNA, 20 bp, Artificial Sequence
  chemically synthesized
accactgttttccttctctc

SEQ ID NO: 210092 - DNA, 20 bp, Artificial Sequence
  chemically synthesized
ccactgttttccttctctca

SEQ ID NO: 210093 - DNA, 20 bp, Artificial Sequence
  chemically synthesized
catgtggatcccttgagaga

SEQ ID NO: 210094 - DNA, 20 bp, Artificial Sequence
  chemically synthesized
cactgttttccttctctcaa

SEQ ID NO: 210095 - DNA, 20 bp, Artificial Sequence
  chemically synthesized
ccatgtggatcccttgagag

SEQ ID NO: 210096 - DNA, 20 bp, Artificial Sequence
  chemically synthesized
aacccatgtggatcccttga

SEQ ID NO: 210097 - DNA, 20 bp, Artificial Sequence
  chemically synthesized
ctaacccatgtggatccctt

SEQ ID NO: 210098 - DNA, 20 bp, Artificial Sequence
  chemically synthesized
cttctctcaagggatccaca

SEQ ID NO: 210099 - DNA, 20 bp, Artificial Sequence
  chemically synthesized
ttctctcaagggatccacat

SEQ ID NO: 210100 - DNA, 20 bp, Artificial Sequence
  chemically synthesized
ctcaagggatccacatgggt

SEQ ID NO: 210101 - DNA, 20 bp, Artificial Sequence
  chemically synthesized
aagacacgtgctaacccatg

SEQ ID NO: 210102 - DNA, 20 bp, Artificial Sequence
  chemically synthesized
catgggttagcacgtgtctt

SEQ ID NO: 210103 - DNA, 20 bp, Artificial Sequence
  chemically synthesized
tagcacgtgtcttaagtgtt

SEQ ID NO: 210104 - DNA, 20 bp, Artificial Sequence
  chemically synthesized
gcatgataacccaaacactt

SEQ ID NO: 210105 - DNA, 20 bp, Artificial Sequence
  chemically synthesized
agcacgtgtcttaagtgttt

SEQ ID NO: 210106 - DNA, 20 bp, Artificial Sequence
  chemically synthesized
gcctttcaagagtgtacagt

SEQ ID NO: 210107 - DNA, 20 bp, Artificial Sequence
  chemically synthesized
gcttgcctttcaagagtgta

SEQ ID NO: 210108 - DNA, 20 bp, Artificial Sequence
  chemically synthesized
tgctgactgtacactcttga

SEQ ID NO: 210109 - DNA, 20 bp, Artificial Sequence
  chemically synthesized
gctgactgtacactcttgaa

SEQ ID NO: 210110 - DNA, 20 bp, Artificial Sequence
  chemically synthesized
taatttggcttgcctttcaa

SEQ ID NO: 210111 - DNA, 20 bp, Artificial Sequence
  chemically synthesized
actgtacactcttgaaaggc

SEQ ID NO: 210112 - DNA, 20 bp, Artificial Sequence
  chemically synthesized
aataatttggcttgcctttc

SEQ ID NO: 210113 - DNA, 20 bp, Artificial Sequence
  chemically synthesized
ttgtctaggaaggaataatt

SEQ ID NO: 210114 - DNA, 20 bp, Artificial Sequence
  chemically synthesized
caagccaaattattccttcc

SEQ ID NO: 210115 - DNA, 20 bp, Artificial Sequence
  chemically synthesized
tttcttgcttttgtctagga

SEQ ID NO: 210116 - DNA, 20 bp, Artificial Sequence
  chemically synthesized
atttcttgcttttgtctagg

SEQ ID NO: 210117 - DNA, 20 bp, Artificial Sequence
  chemically synthesized
aattattccttcctagacaa

SEQ ID NO: 210118 - DNA, 20 bp, Artificial Sequence
  chemically synthesized
tatatttcttgcttttgtct

SEQ ID NO: 210119 - DNA, 20 bp, Artificial Sequence
  chemically synthesized
atatatttcttgcttttgtc

SEQ ID NO: 210120 - DNA, 20 bp, Artificial Sequence
  chemically synthesized
attccttcctagacaaaagc

SEQ ID NO: 210121 - DNA, 20 bp, Artificial Sequence
  chemically synthesized
acaaaagcaagaaatatatg

SEQ ID NO: 210122 - DNA, 20 bp, Artificial Sequence
  chemically synthesized
caagaaatatatgaagaaaa

SEQ ID NO: 210123 - DNA, 20 bp, Artificial Sequence
  chemically synthesized
aagaaaaaagaaaacaactt

SEQ ID NO: 210124 - DNA, 20 bp, Artificial Sequence
  chemically synthesized
gaaaaaagaaaacaacttga

SEQ ID NO: 210125 - DNA, 20 bp, Artificial Sequence
  chemically synthesized
aaaaaagaaaacaacttgag

SEQ ID NO: 210126 - DNA, 20 bp, Artificial Sequence
  chemically synthesized
aagaaaacaacttgagaggt

SEQ ID NO: 210127 - DNA, 20 bp, Artificial Sequence
  chemically synthesized
tggcaagtatctcacctctc

SEQ ID NO: 210128 - DNA, 20 bp, Artificial Sequence
  chemically synthesized
agaggtgagatacttgccac

SEQ ID NO: 210129 - DNA, 20 bp, Artificial Sequence
  chemically synthesized
tgtccatccaaacttgtggc

SEQ ID NO: 210130 - DNA, 20 bp, Artificial Sequence
  chemically synthesized
tgagatacttgccacaagtt

SEQ ID NO: 210131 - DNA, 20 bp, Artificial Sequence
  chemically synthesized
gggttgtccatccaaacttg

SEQ ID NO: 210132 - DNA, 20 bp, Artificial Sequence
  chemically synthesized
atacttgccacaagtttgga

SEQ ID NO: 210133 - DNA, 20 bp, Artificial Sequence
  chemically synthesized
aatgaatgctcaatttacaa

SEQ ID NO: 210134 - DNA, 20 bp, Artificial Sequence
  chemically synthesized
caatgaatgctcaatttaca

SEQ ID NO: 210135 - DNA, 20 bp, Artificial Sequence
  chemically synthesized
atggacaacccttgtaaatt

SEQ ID NO: 210136 - DNA, 20 bp, Artificial Sequence
  chemically synthesized
gcaatgaatgctcaatttac

SEQ ID NO: 210137 - DNA, 20 bp, Artificial Sequence
  chemically synthesized
tgtaaattgagcattcattg

SEQ ID NO: 210138 - DNA, 20 bp, Artificial Sequence
  chemically synthesized
acttacacttaaaataagca

SEQ ID NO: 210139 - DNA, 20 bp, Artificial Sequence
  chemically synthesized
gcagcatccatgcttatttt

SEQ ID NO: 210140 - DNA, 20 bp, Artificial Sequence
  chemically synthesized
atataacttacacttaaaat

SEQ ID NO: 210141 - DNA, 20 bp, Artificial Sequence
  chemically synthesized
tccatgcttattttaagtgt

SEQ ID NO: 210142 - DNA, 20 bp, Artificial Sequence
  chemically synthesized
ttttttatttgtatgaatgt

SEQ ID NO: 210143 - DNA, 20 bp, Artificial Sequence
  chemically synthesized
tttttatttgtatgaatgta

SEQ ID NO: 210144 - DNA, 20 bp, Artificial Sequence
  chemically synthesized
ttttatttgtatgaatgtaa

SEQ ID NO: 210145 - DNA, 20 bp, Artificial Sequence
  chemically synthesized
tttatttgtatgaatgtaag

SEQ ID NO: 210146 - DNA, 20 bp, Artificial Sequence
  chemically synthesized
tgtatgaatgtaaggggtac

SEQ ID NO: 210147 - DNA, 20 bp, Artificial Sequence
  chemically synthesized
caagtgcaattttattatgt

SEQ ID NO: 210148 - DNA, 20 bp, Artificial Sequence
  chemically synthesized
attttattatgtgagtatgt

SEQ ID NO: 210149 - DNA, 20 bp, Artificial Sequence
  chemically synthesized
tattatgtgagtatgttgga

SEQ ID NO: 210150 - DNA, 20 bp, Artificial Sequence
  chemically synthesized
tatgtgagtatgttggatag

SEQ ID NO: 210151 - DNA, 20 bp, Artificial Sequence
  chemically synthesized
tgttggatagtggtgaactt

SEQ ID NO: 210152 - DNA, 20 bp, Artificial Sequence
  chemically synthesized
atggatacactaaaaatcca

SEQ ID NO: 210153 - DNA, 20 bp, Artificial Sequence
  chemically synthesized
agtggtgaactttggatttt

SEQ ID NO: 210154 - DNA, 20 bp, Artificial Sequence
  chemically synthesized
aatgtacataatttgggtga

SEQ ID NO: 210155 - DNA, 20 bp, Artificial Sequence
  chemically synthesized
ggctacaatgtacataattt

SEQ ID NO: 210156 - DNA, 20 bp, Artificial Sequence
  chemically synthesized
tggctacaatgtacataatt

SEQ ID NO: 210157 - DNA, 20 bp, Artificial Sequence
  chemically synthesized
cacccaaattatgtacattg

SEQ ID NO: 210158 - DNA, 20 bp, Artificial Sequence
  chemically synthesized
gggaatcagtgataaattaa

SEQ ID NO: 210159 - DNA, 20 bp, Artificial Sequence
  chemically synthesized
gtgggggtgtgcaagggaat

SEQ ID NO: 210160 - DNA, 20 bp, Artificial Sequence
  chemically synthesized
tgaagtgtgggggtgtgcaa

SEQ ID NO: 210161 - DNA, 20 bp, Artificial Sequence
  chemically synthesized
ctgaagtgtgggggtgtgca

SEQ ID NO: 210162 - DNA, 20 bp, Artificial Sequence
  chemically synthesized
actgaagtgtgggggtgtgc

SEQ ID NO: 210163 - DNA, 20 bp, Artificial Sequence
  chemically synthesized
cattggagactgaagtgtgg

SEQ ID NO: 210164 - DNA, 20 bp, Artificial Sequence
  chemically synthesized
ccttgcacacccccacactt

SEQ ID NO: 210165 - DNA, 20 bp, Artificial Sequence
  chemically synthesized
gcattggagactgaagtgtg

SEQ ID NO: 210166 - DNA, 20 bp, Artificial Sequence
  chemically synthesized
agcattggagactgaagtgt

SEQ ID NO: 210167 - DNA, 20 bp, Artificial Sequence
  chemically synthesized
aagcattggagactgaagtg

SEQ ID NO: 210168 - DNA, 20 bp, Artificial Sequence
  chemically synthesized
gtgataagcattggagactg

SEQ ID NO: 210169 - DNA, 20 bp, Artificial Sequence
  chemically synthesized
gtgtgtagtgataagcattg

SEQ ID NO: 210170 - DNA, 20 bp, Artificial Sequence
  chemically synthesized
gagtgtgtagtgataagcat

SEQ ID NO: 210171 - DNA, 20 bp, Artificial Sequence
  chemically synthesized
gacatagagtgtgtagtgat

SEQ ID NO: 210172 - DNA, 20 bp, Artificial Sequence
  chemically synthesized
acacatggacatagagtgtg

SEQ ID NO: 210173 - DNA, 20 bp, Artificial Sequence
  chemically synthesized
aacatgtacacatggacata

SEQ ID NO: 210174 - DNA, 20 bp, Artificial Sequence
  chemically synthesized
taaacatgtacacatggaca

SEQ ID NO: 210175 - DNA, 20 bp, Artificial Sequence
  chemically synthesized
aatgtataaacatgtacaca

SEQ ID NO: 210176 - DNA, 20 bp, Artificial Sequence
  chemically synthesized
atgttctcacttataagtga

SEQ ID NO: 210177 - DNA, 20 bp, Artificial Sequence
  chemically synthesized
attatttgtctttcacttat

SEQ ID NO: 210178 - DNA, 20 bp, Artificial Sequence
  chemically synthesized
tttgtctttcacttataagt

SEQ ID NO: 210179 - DNA, 20 bp, Artificial Sequence
  chemically synthesized
taccccatgttctcacttat

SEQ ID NO: 210180 - DNA, 20 bp, Artificial Sequence
  chemically synthesized
ttcacttataagtgagaaca

SEQ ID NO: 210181 - DNA, 20 bp, Artificial Sequence
  chemically synthesized
tcacttataagtgagaacat

SEQ ID NO: 210182 - DNA, 20 bp, Artificial Sequence
  chemically synthesized
cacttataagtgagaacatg

SEQ ID NO: 210183 - DNA, 20 bp, Artificial Sequence
  chemically synthesized
tgaaacaactcagaagcaga

SEQ ID NO: 210184 - DNA, 20 bp, Artificial Sequence
  chemically synthesized
tggggtatctttctgcttct

SEQ ID NO: 210185 - DNA, 20 bp, Artificial Sequence
  chemically synthesized
tatatgaaacaactcagaag

SEQ ID NO: 210186 - DNA, 20 bp, Artificial Sequence
  chemically synthesized
atatatatgaaacaactcag

SEQ ID NO: 210187 - DNA, 20 bp, Artificial Sequence
  chemically synthesized
tatatatatatgaaacaact

SEQ ID NO: 210188 - DNA, 20 bp, Artificial Sequence
  chemically synthesized
tacacatacactgatattga

SEQ ID NO: 210189 - DNA, 20 bp, Artificial Sequence
  chemically synthesized
tagagaaaagccatcaatat

SEQ ID NO: 210190 - DNA, 20 bp, Artificial Sequence
  chemically synthesized
tgatattgatggcttttctc

SEQ ID NO: 210191 - DNA, 20 bp, Artificial Sequence
  chemically synthesized
tttatactttttctagagaa

SEQ ID NO: 210192 - DNA, 20 bp, Artificial Sequence
  chemically synthesized
tgatggcttttctctagaaa

SEQ ID NO: 210193 - DNA, 20 bp, Artificial Sequence
  chemically synthesized
agagatttatactttttcta

SEQ ID NO: 210194 - DNA, 20 bp, Artificial Sequence
  chemically synthesized
atagagatttatactttttc

SEQ ID NO: 210195 - DNA, 20 bp, Artificial Sequence
  chemically synthesized
tgcacagtttgataaatata

SEQ ID NO: 210196 - DNA, 20 bp, Artificial Sequence
  chemically synthesized
aatgcacagtttgataaata

SEQ ID NO: 210197 - DNA, 20 bp, Artificial Sequence
  chemically synthesized
tgccagatatcgtaaatgca

SEQ ID NO: 210198 - DNA, 20 bp, Artificial Sequence
  chemically synthesized
aactgtgcatttacgatatc

SEQ ID NO: 210199 - DNA, 20 bp, Artificial Sequence
  chemically synthesized
tttagtagataagatattgc

SEQ ID NO: 210200 - DNA, 20 bp, Artificial Sequence
  chemically synthesized
tacattttgatttagtagat

SEQ ID NO: 210201 - DNA, 20 bp, Artificial Sequence
  chemically synthesized
ttgtatacattttgatttag

SEQ ID NO: 210202 - DNA, 20 bp, Artificial Sequence
  chemically synthesized
acattgtatacattttgatt

SEQ ID NO: 210203 - DNA, 20 bp, Artificial Sequence
  chemically synthesized
atacaatgtgccccaatatt

SEQ ID NO: 210204 - DNA, 20 bp, Artificial Sequence
  chemically synthesized
actgagattgctaaatattg

SEQ ID NO: 210205 - DNA, 20 bp, Artificial Sequence
  chemically synthesized
aactgagattgctaaatatt

SEQ ID NO: 210206 - DNA, 20 bp, Artificial Sequence
  chemically synthesized
gaactgagattgctaaatat

SEQ ID NO: 210207 - DNA, 20 bp, Artificial Sequence
  chemically synthesized
gccccaatatttagcaatct

SEQ ID NO: 210208 - DNA, 20 bp, Artificial Sequence
  chemically synthesized
atatttagcaatctcagttc

SEQ ID NO: 210209 - DNA, 20 bp, Artificial Sequence
  chemically synthesized
tatttagcaatctcagttct

SEQ ID NO: 210210 - DNA, 20 bp, Artificial Sequence
  chemically synthesized
atgggtgtatacccagaact

SEQ ID NO: 210211 - DNA, 20 bp, Artificial Sequence
  chemically synthesized
atttcacatgggtgtatacc

SEQ ID NO: 210212 - DNA, 20 bp, Artificial Sequence
  chemically synthesized
agaatttacacatttcacat

SEQ ID NO: 210213 - DNA, 20 bp, Artificial Sequence
  chemically synthesized
aagaatttacacatttcaca

SEQ ID NO: 210214 - DNA, 20 bp, Artificial Sequence
  chemically synthesized
tgtgtaaattcttataccaa

SEQ ID NO: 210215 - DNA, 20 bp, Artificial Sequence
  chemically synthesized
tattacatgtcttttggtat

SEQ ID NO: 210216 - DNA, 20 bp, Artificial Sequence
  chemically synthesized
atattctattacatgtcttt

SEQ ID NO: 210217 - DNA, 20 bp, Artificial Sequence
  chemically synthesized
ttataccaaaagacatgtaa

SEQ ID NO: 210218 - DNA, 20 bp, Artificial Sequence
  chemically synthesized
aatagaatatatgtctgcaa

SEQ ID NO: 210219 - DNA, 20 bp, Artificial Sequence
  chemically synthesized
tattacaaatagtgctgttg

SEQ ID NO: 210220 - DNA, 20 bp, Artificial Sequence
  chemically synthesized
tgcaacagcactatttgtaa

SEQ ID NO: 210221 - DNA, 20 bp, Artificial Sequence
  chemically synthesized
gataacttagctattacaaa

SEQ ID NO: 210222 - DNA, 20 bp, Artificial Sequence
  chemically synthesized
cagcactatttgtaatagct

SEQ ID NO: 210223 - DNA, 20 bp, Artificial Sequence
  chemically synthesized
taacagttttattgataact

SEQ ID NO: 210224 - DNA, 20 bp, Artificial Sequence
  chemically synthesized
attccatagggtaaatataa

SEQ ID NO: 210225 - DNA, 20 bp, Artificial Sequence
  chemically synthesized
aaactgttatatttacccta

SEQ ID NO: 210226 - DNA, 20 bp, Artificial Sequence
  chemically synthesized
gggctgcataatattccata

SEQ ID NO: 210227 - DNA, 20 bp, Artificial Sequence
  chemically synthesized
tgggctgcataatattccat

SEQ ID NO: 210228 - DNA, 20 bp, Artificial Sequence
  chemically synthesized
atgggctgcataatattcca

SEQ ID NO: 210229 - DNA, 20 bp, Artificial Sequence
  chemically synthesized
ttaccctatggaatattatg

SEQ ID NO: 210230 - DNA, 20 bp, Artificial Sequence
  chemically synthesized
ttattaaacaatcattttat

SEQ ID NO: 210231 - DNA, 20 bp, Artificial Sequence
  chemically synthesized
gttattaaacaatcatttta

SEQ ID NO: 210232 - DNA, 20 bp, Artificial Sequence
  chemically synthesized
attgtttaataactacacac

SEQ ID NO: 210233 - DNA, 20 bp, Artificial Sequence
  chemically synthesized
tgtttaataactacacacaa

SEQ ID NO: 210234 - DNA, 20 bp, Artificial Sequence
  chemically synthesized
atcagctattctcttgtgtg

SEQ ID NO: 210235 - DNA, 20 bp, Artificial Sequence
  chemically synthesized
aataactacacacaagagaa

SEQ ID NO: 210236 - DNA, 20 bp, Artificial Sequence
  chemically synthesized
agtgcattgtatttgtgtat

SEQ ID NO: 210237 - DNA, 20 bp, Artificial Sequence
  chemically synthesized
atacacaaatacaatgcact

SEQ ID NO: 210238 - DNA, 20 bp, Artificial Sequence
  chemically synthesized
cacaaatacaatgcactaag

SEQ ID NO: 210239 - DNA, 20 bp, Artificial Sequence
  chemically synthesized
aatacaatgcactaagaagc

SEQ ID NO: 210240 - DNA, 20 bp, Artificial Sequence
  chemically synthesized
ctctttaatgtctggcttct

SEQ ID NO: 210241 - DNA, 20 bp, Artificial Sequence
  chemically synthesized
cactaagaagccagacatta

SEQ ID NO: 210242 - DNA, 20 bp, Artificial Sequence
  chemically synthesized
aatatatgctctttaatgtc

SEQ ID NO: 210243 - DNA, 20 bp, Artificial Sequence
  chemically synthesized
ctaagaagccagacattaaa

SEQ ID NO: 210244 - DNA, 20 bp, Artificial Sequence
  chemically synthesized
agagcatatattgtataatt

SEQ ID NO: 210245 - DNA, 20 bp, Artificial Sequence
  chemically synthesized
tgtataattcagcaaaaata

SEQ ID NO: 210246 - DNA, 20 bp, Artificial Sequence
  chemically synthesized
ataattcagcaaaaatatag

SEQ ID NO: 210247 - DNA, 20 bp, Artificial Sequence
  chemically synthesized
taattcagcaaaaatatagt

SEQ ID NO: 210248 - DNA, 20 bp, Artificial Sequence
  chemically synthesized
aattcagcaaaaatatagta

SEQ ID NO: 210249 - DNA, 20 bp, Artificial Sequence
  chemically synthesized
tgatctgtgacagcatagat

SEQ ID NO: 210250 - DNA, 20 bp, Artificial Sequence
  chemically synthesized
cgatctgatctgtgacagca

SEQ ID NO: 210251 - DNA, 20 bp, Artificial Sequence
  chemically synthesized
aaaaccaatctatgctgtca

SEQ ID NO: 210252 - DNA, 20 bp, Artificial Sequence
  chemically synthesized
atcaccgatctgatctgtga

SEQ ID NO: 210253 - DNA, 20 bp, Artificial Sequence
  chemically synthesized
caatctatgctgtcacagat

SEQ ID NO: 210254 - DNA, 20 bp, Artificial Sequence
  chemically synthesized
tatgctgtcacagatcagat

SEQ ID NO: 210255 - DNA, 20 bp, Artificial Sequence
  chemically synthesized
atcagatcggtgattactct

SEQ ID NO: 210256 - DNA, 20 bp, Artificial Sequence
  chemically synthesized
tcagatcggtgattactctt

SEQ ID NO: 210257 - DNA, 20 bp, Artificial Sequence
  chemically synthesized
agatcggtgattactcttgg

SEQ ID NO: 210258 - DNA, 20 bp, Artificial Sequence
  chemically synthesized
tgcaatcattagtctcccaa

SEQ ID NO: 210259 - DNA, 20 bp, Artificial Sequence
  chemically synthesized
tttgcaatcattagtctccc

SEQ ID NO: 210260 - DNA, 20 bp, Artificial Sequence
  chemically synthesized
tggttcctctttgcaatcat

SEQ ID NO: 210261 - DNA, 20 bp, Artificial Sequence
  chemically synthesized
ttgggagactaatgattgca

SEQ ID NO: 210262 - DNA, 20 bp, Artificial Sequence
  chemically synthesized
gggagactaatgattgcaaa

SEQ ID NO: 210263 - DNA, 20 bp, Artificial Sequence
  chemically synthesized
ggagactaatgattgcaaag

SEQ ID NO: 210264 - DNA, 20 bp, Artificial Sequence
  chemically synthesized
taatgattgcaaagaggaac

SEQ ID NO: 210265 - DNA, 20 bp, Artificial Sequence
  chemically synthesized
aatgattgcaaagaggaacc

SEQ ID NO: 210266 - DNA, 20 bp, Artificial Sequence
  chemically synthesized
atgattgcaaagaggaacca

SEQ ID NO: 210267 - DNA, 20 bp, Artificial Sequence
  chemically synthesized
tgattgcaaagaggaaccag

SEQ ID NO: 210268 - DNA, 20 bp, Artificial Sequence
  chemically synthesized
agaaaacaaaacagtacccc

SEQ ID NO: 210269 - DNA, 20 bp, Artificial Sequence
  chemically synthesized
cttcaagaaagaaaacaaaa

SEQ ID NO: 210270 - DNA, 20 bp, Artificial Sequence
  chemically synthesized
ctgttttgttttctttcttg

SEQ ID NO: 210271 - DNA, 20 bp, Artificial Sequence
  chemically synthesized
aatcagcatccacttcaaga

SEQ ID NO: 210272 - DNA, 20 bp, Artificial Sequence
  chemically synthesized
ttttgttttctttcttgaag

SEQ ID NO: 210273 - DNA, 20 bp, Artificial Sequence
  chemically synthesized
atgtaatcagcatccacttc

SEQ ID NO: 210274 - DNA, 20 bp, Artificial Sequence
  chemically synthesized
tctaaagccagtcatgtaat

SEQ ID NO: 210275 - DNA, 20 bp, Artificial Sequence
  chemically synthesized
gtggatgctgattacatgac

SEQ ID NO: 210276 - DNA, 20 bp, Artificial Sequence
  chemically synthesized
gctgattacatgactggctt

SEQ ID NO: 210277 - DNA, 20 bp, Artificial Sequence
  chemically synthesized
tatgcctcaaaatctaaagc

SEQ ID NO: 210278 - DNA, 20 bp, Artificial Sequence
  chemically synthesized
agtatatgcctcaaaatcta

SEQ ID NO: 210279 - DNA, 20 bp, Artificial Sequence
  chemically synthesized
catgactggctttagatttt

SEQ ID NO: 210280 - DNA, 20 bp, Artificial Sequence
  chemically synthesized
atgactggctttagattttg

SEQ ID NO: 210281 - DNA, 20 bp, Artificial Sequence
  chemically synthesized
ataaaaagtgcacgtatcac

SEQ ID NO: 210282 - DNA, 20 bp, Artificial Sequence
  chemically synthesized
aaaagtgcatatacaataaa

SEQ ID NO: 210283 - DNA, 20 bp, Artificial Sequence
  chemically synthesized
tattttaaataattttataa

SEQ ID NO: 210284 - DNA, 20 bp, Artificial Sequence
  chemically synthesized
ttttataaaattatttaaaa

SEQ ID NO: 210285 - DNA, 20 bp, Artificial Sequence
  chemically synthesized
ttataaaattatttaaaata

SEQ ID NO: 210286 - DNA, 20 bp, Artificial Sequence
  chemically synthesized
aaattatttaaaatagagta

SEQ ID NO: 210287 - DNA, 20 bp, Artificial Sequence
  chemically synthesized
tatggtatgctaacatttta

SEQ ID NO: 210288 - DNA, 20 bp, Artificial Sequence
  chemically synthesized
agtacagatctctaaaatgt

SEQ ID NO: 210289 - DNA, 20 bp, Artificial Sequence
  chemically synthesized
actatggtatgctaacattt

SEQ ID NO: 210290 - DNA, 20 bp, Artificial Sequence
  chemically synthesized
tctaaaatgttagcatacca

SEQ ID NO: 210291 - DNA, 20 bp, Artificial Sequence
  chemically synthesized
tagcaaaaagatgaaaacta

SEQ ID NO: 210292 - DNA, 20 bp, Artificial Sequence
  chemically synthesized
tggttcatagcagtagcaaa

SEQ ID NO: 210293 - DNA, 20 bp, Artificial Sequence
  chemically synthesized
ctggatgtggttcatagcag

SEQ ID NO: 210294 - DNA, 20 bp, Artificial Sequence
  chemically synthesized
actctggatgtggttcatag

SEQ ID NO: 210295 - DNA, 20 bp, Artificial Sequence
  chemically synthesized
cttactctggatgtggttca

SEQ ID NO: 210296 - DNA, 20 bp, Artificial Sequence
  chemically synthesized
ctactgctatgaaccacatc

SEQ ID NO: 210297 - DNA, 20 bp, Artificial Sequence
  chemically synthesized
actgctatgaaccacatcca

SEQ ID NO: 210298 - DNA, 20 bp, Artificial Sequence
  chemically synthesized
gaaacaccttactctggatg

SEQ ID NO: 210299 - DNA, 20 bp, Artificial Sequence
  chemically synthesized
ctatgaaccacatccagagt

SEQ ID NO: 210300 - DNA, 20 bp, Artificial Sequence
  chemically synthesized
tatgaaccacatccagagta

SEQ ID NO: 210301 - DNA, 20 bp, Artificial Sequence
  chemically synthesized
atgcgtgaaacaccttactc

SEQ ID NO: 210302 - DNA, 20 bp, Artificial Sequence
  chemically synthesized
aatccatattgtgtgaatta

SEQ ID NO: 210303 - DNA, 20 bp, Artificial Sequence
  chemically synthesized
tatctttaattcacacaata

SEQ ID NO: 210304 - DNA, 20 bp, Artificial Sequence
  chemically synthesized
ttcacacaatatggattgta

SEQ ID NO: 210305 - DNA, 20 bp, Artificial Sequence
  chemically synthesized
tatggattgtatggcctgtc

SEQ ID NO: 210306 - DNA, 20 bp, Artificial Sequence
  chemically synthesized
gattgtatggcctgtctggt

SEQ ID NO: 210307 - DNA, 20 bp, Artificial Sequence
  chemically synthesized
ggtaatcatcctgaccagac

SEQ ID NO: 210308 - DNA, 20 bp, Artificial Sequence
  chemically synthesized
attgtatggcctgtctggtc

SEQ ID NO: 210309 - DNA, 20 bp, Artificial Sequence
  chemically synthesized
gggtaatcatcctgaccaga

SEQ ID NO: 210310 - DNA, 20 bp, Artificial Sequence
  chemically synthesized
atgagggtaatcatcctgac

SEQ ID NO: 210311 - DNA, 20 bp, Artificial Sequence
  chemically synthesized
ctggatcacttgtgcaatga

SEQ ID NO: 210312 - DNA, 20 bp, Artificial Sequence
  chemically synthesized
gctggatcacttgtgcaatg

SEQ ID NO: 210313 - DNA, 20 bp, Artificial Sequence
  chemically synthesized
gatgattaccctcattgcac

SEQ ID NO: 210314 - DNA, 20 bp, Artificial Sequence
  chemically synthesized
ggctggatcacttgtgcaat

SEQ ID NO: 210315 - DNA, 20 bp, Artificial Sequence
  chemically synthesized
ccctcattgcacaagtgatc

SEQ ID NO: 210316 - DNA, 20 bp, Artificial Sequence
  chemically synthesized
cagttttttgcgtcaaaggc

SEQ ID NO: 210317 - DNA, 20 bp, Artificial Sequence
  chemically synthesized
tattcagttttttgcgtcaa

SEQ ID NO: 210318 - DNA, 20 bp, Artificial Sequence
  chemically synthesized
gtattcagttttttgcgtca

SEQ ID NO: 210319 - DNA, 20 bp, Artificial Sequence
  chemically synthesized
tgaatgccaattaatgtatt

SEQ ID NO: 210320 - DNA, 20 bp, Artificial Sequence
  chemically synthesized
aaaaaactgaatacattaat

SEQ ID NO: 210321 - DNA, 20 bp, Artificial Sequence
  chemically synthesized
tggcattcatcctttgttgt

SEQ ID NO: 210322 - DNA, 20 bp, Artificial Sequence
  chemically synthesized
tcccccccacccaacaacaa

SEQ ID NO: 210323 - DNA, 20 bp, Artificial Sequence
  chemically synthesized
ggcattcatcctttgttgtt

SEQ ID NO: 210324 - DNA, 20 bp, Artificial Sequence
  chemically synthesized
ttcccccccacccaacaaca

SEQ ID NO: 210325 - DNA, 20 bp, Artificial Sequence
  chemically synthesized
attcatcctttgttgttggg

SEQ ID NO: 210326 - DNA, 20 bp, Artificial Sequence
  chemically synthesized
ttcatcctttgttgttgggt

SEQ ID NO: 210327 - DNA, 20 bp, Artificial Sequence
  chemically synthesized
tcatcctttgttgttgggtg

SEQ ID NO: 210328 - DNA, 20 bp, Artificial Sequence
  chemically synthesized
catcctttgttgttgggtgg

SEQ ID NO: 210329 - DNA, 20 bp, Artificial Sequence
  chemically synthesized
atcctttgttgttgggtggg

SEQ ID NO: 210330 - DNA, 20 bp, Artificial Sequence
  chemically synthesized
tcctttgttgttgggtgggg

SEQ ID NO: 210331 - DNA, 20 bp, Artificial Sequence
  chemically synthesized
tttgttgttgggtggggggg

SEQ ID NO: 210332 - DNA, 20 bp, Artificial Sequence
  chemically synthesized
gttgttgggtgggggggaag

SEQ ID NO: 210333 - DNA, 20 bp, Artificial Sequence
  chemically synthesized
aagcacaatcatcatcactg

SEQ ID NO: 210334 - DNA, 20 bp, Artificial Sequence
  chemically synthesized
tcatatcatgaacacatcca

SEQ ID NO: 210335 - DNA, 20 bp, Artificial Sequence
  chemically synthesized
atgatatgaattgtcactcc

SEQ ID NO: 210336 - DNA, 20 bp, Artificial Sequence
  chemically synthesized
taaagcatcaaggaaacttg

SEQ ID NO: 210337 - DNA, 20 bp, Artificial Sequence
  chemically synthesized
cctaaagcatcaaggaaact

SEQ ID NO: 210338 - DNA, 20 bp, Artificial Sequence
  chemically synthesized
tttatactcctaaagcatca

SEQ ID NO: 210339 - DNA, 20 bp, Artificial Sequence
  chemically synthesized
tccaagtttccttgatgctt

SEQ ID NO: 210340 - DNA, 20 bp, Artificial Sequence
  chemically synthesized
ctttatactcctaaagcatc

SEQ ID NO: 210341 - DNA, 20 bp, Artificial Sequence
  chemically synthesized
ccaagtttccttgatgcttt

SEQ ID NO: 210342 - DNA, 20 bp, Artificial Sequence
  chemically synthesized
aagtttccttgatgctttag

SEQ ID NO: 210343 - DNA, 20 bp, Artificial Sequence
  chemically synthesized
acatcatctttatactccta

SEQ ID NO: 210344 - DNA, 20 bp, Artificial Sequence
  chemically synthesized
cttgatgctttaggagtata

SEQ ID NO: 210345 - DNA, 20 bp, Artificial Sequence
  chemically synthesized
ttaggagtataaagatgatg

SEQ ID NO: 210346 - DNA, 20 bp, Artificial Sequence
  chemically synthesized
taaagatgatgtagctgctt

SEQ ID NO: 210347 - DNA, 20 bp, Artificial Sequence
  chemically synthesized
aaagatgatgtagctgcttg

SEQ ID NO: 210348 - DNA, 20 bp, Artificial Sequence
  chemically synthesized
ctaggatgagtggcctcaag

SEQ ID NO: 210349 - DNA, 20 bp, Artificial Sequence
  chemically synthesized
cttctaggatgagtggcctc

SEQ ID NO: 210350 - DNA, 20 bp, Artificial Sequence
  chemically synthesized
ctgcttgaggccactcatcc

SEQ ID NO: 210351 - DNA, 20 bp, Artificial Sequence
  chemically synthesized
cagactgcttctaggatgag

SEQ ID NO: 210352 - DNA, 20 bp, Artificial Sequence
  chemically synthesized
cttgaggccactcatcctag

SEQ ID NO: 210353 - DNA, 20 bp, Artificial Sequence
  chemically synthesized
ctccagactgcttctaggat

SEQ ID NO: 210354 - DNA, 20 bp, Artificial Sequence
  chemically synthesized
gaggccactcatcctagaag

SEQ ID NO: 210355 - DNA, 20 bp, Artificial Sequence
  chemically synthesized
tgcctctccagactgcttct

SEQ ID NO: 210356 - DNA, 20 bp, Artificial Sequence
  chemically synthesized
atgcctctccagactgcttc

SEQ ID NO: 210357 - DNA, 20 bp, Artificial Sequence
  chemically synthesized
cactcatcctagaagcagtc

SEQ ID NO: 210358 - DNA, 20 bp, Artificial Sequence
  chemically synthesized
ctcatcctagaagcagtctg

SEQ ID NO: 210359 - DNA, 20 bp, Artificial Sequence
  chemically synthesized
catcctagaagcagtctgga

SEQ ID NO: 210360 - DNA, 20 bp, Artificial Sequence
  chemically synthesized
atcctagaagcagtctggag

SEQ ID NO: 210361 - DNA, 20 bp, Artificial Sequence
  chemically synthesized
tctactgtcacatgcctctc

SEQ ID NO: 210362 - DNA, 20 bp, Artificial Sequence
  chemically synthesized
cagtctggagaggcatgtga

SEQ ID NO: 210363 - DNA, 20 bp, Artificial Sequence
  chemically synthesized
tctggagaggcatgtgacag

SEQ ID NO: 210364 - DNA, 20 bp, Artificial Sequence
  chemically synthesized
agacaaataagaatgtcaat

SEQ ID NO: 210365 - DNA, 20 bp, Artificial Sequence
  chemically synthesized
gattgttgacacagacaaat

SEQ ID NO: 210366 - DNA, 20 bp, Artificial Sequence
  chemically synthesized
ccttaattagattgttgaca

SEQ ID NO: 210367 - DNA, 20 bp, Artificial Sequence
  chemically synthesized
tctgtgtcaacaatctaatt

SEQ ID NO: 210368 - DNA, 20 bp, Artificial Sequence
  chemically synthesized
ctgtgtcaacaatctaatta

SEQ ID NO: 210369 - DNA, 20 bp, Artificial Sequence
  chemically synthesized
aggcaggaaaaaaccttaat

SEQ ID NO: 210370 - DNA, 20 bp, Artificial Sequence
  chemically synthesized
aattaaggttttttcctgcc

SEQ ID NO: 210371 - DNA, 20 bp, Artificial Sequence
  chemically synthesized
taaggttttttcctgcctag

SEQ ID NO: 210372 - DNA, 20 bp, Artificial Sequence
  chemically synthesized
atgagaccaatctactaggc

SEQ ID NO: 210373 - DNA, 20 bp, Artificial Sequence
  chemically synthesized
aatgagaccaatctactagg

SEQ ID NO: 210374 - DNA, 20 bp, Artificial Sequence
  chemically synthesized
ttttttcctgcctagtagat

SEQ ID NO: 210375 - DNA, 20 bp, Artificial Sequence
  chemically synthesized
taaaatgagaccaatctact

SEQ ID NO: 210376 - DNA, 20 bp, Artificial Sequence
  chemically synthesized
ttaaaatgagaccaatctac

SEQ ID NO: 210377 - DNA, 20 bp, Artificial Sequence
  chemically synthesized
ttggtactgtgaattaaaat

SEQ ID NO: 210378 - DNA, 20 bp, Artificial Sequence
  chemically synthesized
attggtctcattttaattca

SEQ ID NO: 210379 - DNA, 20 bp, Artificial Sequence
  chemically synthesized
tttaattcacagtaccaaaa

SEQ ID NO: 210380 - DNA, 20 bp, Artificial Sequence
  chemically synthesized
acctggaagtgtttcttttt

SEQ ID NO: 210381 - DNA, 20 bp, Artificial Sequence
  chemically synthesized
taccaaaaaagaaacacttc

SEQ ID NO: 210382 - DNA, 20 bp, Artificial Sequence
  chemically synthesized
accaaaaaagaaacacttcc

SEQ ID NO: 210383 - DNA, 20 bp, Artificial Sequence
  chemically synthesized
tttttgttctatttacctgg

SEQ ID NO: 210384 - DNA, 20 bp, Artificial Sequence
  chemically synthesized
aagaaacacttccaggtaaa

SEQ ID NO: 210385 - DNA, 20 bp, Artificial Sequence
  chemically synthesized
ctttttttgttctatttacc

SEQ ID NO: 210386 - DNA, 20 bp, Artificial Sequence
  chemically synthesized
ccaggtaaatagaacaaaaa

SEQ ID NO: 210387 - DNA, 20 bp, Artificial Sequence
  chemically synthesized
agaacaaaaaaagtcttccg

SEQ ID NO: 210388 - DNA, 20 bp, Artificial Sequence
  chemically synthesized
tactttttctttttcttcgg

SEQ ID NO: 210389 - DNA, 20 bp, Artificial Sequence
  chemically synthesized
aaaaaagtcttccgaagaaa

SEQ ID NO: 210390 - DNA, 20 bp, Artificial Sequence
  chemically synthesized
ttgtactttttctttttctt

SEQ ID NO: 210391 - DNA, 20 bp, Artificial Sequence
  chemically synthesized
gtcttccgaagaaaaagaaa

SEQ ID NO: 210392 - DNA, 20 bp, Artificial Sequence
  chemically synthesized
agtacaaaaaccaacttaaa

SEQ ID NO: 210393 - DNA, 20 bp, Artificial Sequence
  chemically synthesized
gagctccaggccatttaagt

SEQ ID NO: 210394 - DNA, 20 bp, Artificial Sequence
  chemically synthesized
tttggagctccaggccattt

SEQ ID NO: 210395 - DNA, 20 bp, Artificial Sequence
  chemically synthesized
aaaaaccaacttaaatggcc

SEQ ID NO: 210396 - DNA, 20 bp, Artificial Sequence
  chemically synthesized
aaaccaacttaaatggcctg

SEQ ID NO: 210397 - DNA, 20 bp, Artificial Sequence
  chemically synthesized
caaagtacttttggagctcc

SEQ ID NO: 210398 - DNA, 20 bp, Artificial Sequence
  chemically synthesized
acaaagtacttttggagctc

SEQ ID NO: 210399 - DNA, 20 bp, Artificial Sequence
  chemically synthesized
taaatggcctggagctccaa

SEQ ID NO: 210400 - DNA, 20 bp, Artificial Sequence
  chemically synthesized
ttgtcaacaaagtacttttg

SEQ ID NO: 210401 - DNA, 20 bp, Artificial Sequence
  chemically synthesized
ctttgtcaacaaagtacttt

SEQ ID NO: 210402 - DNA, 20 bp, Artificial Sequence
  chemically synthesized
cacagaattctttgtcaaca

SEQ ID NO: 210403 - DNA, 20 bp, Artificial Sequence
  chemically synthesized
ccaaaagtactttgttgaca

SEQ ID NO: 210404 - DNA, 20 bp, Artificial Sequence
  chemically synthesized
taatatatatgacgtgttca

SEQ ID NO: 210405 - DNA, 20 bp, Artificial Sequence
  chemically synthesized
gctgaactttgcaggttttt

SEQ ID NO: 210406 - DNA, 20 bp, Artificial Sequence
  chemically synthesized
tattgactaaaaaacctgca

SEQ ID NO: 210407 - DNA, 20 bp, Artificial Sequence
  chemically synthesized
agcattgtgctgaactttgc

SEQ ID NO: 210408 - DNA, 20 bp, Artificial Sequence
  chemically synthesized
actaaaaaacctgcaaagtt

SEQ ID NO: 210409 - DNA, 20 bp, Artificial Sequence
  chemically synthesized
gagcattgtgctgaactttg

SEQ ID NO: 210410 - DNA, 20 bp, Artificial Sequence
  chemically synthesized
cagcacaatgctctgatccc

SEQ ID NO: 210411 - DNA, 20 bp, Artificial Sequence
  chemically synthesized
aataaaatatctagggatca

SEQ ID NO: 210412 - DNA, 20 bp, Artificial Sequence
  chemically synthesized
aaaataaaatatctagggat

SEQ ID NO: 210413 - DNA, 20 bp, Artificial Sequence
  chemically synthesized
actataaaataaaatatcta

SEQ ID NO: 210414 - DNA, 20 bp, Artificial Sequence
  chemically synthesized
gactataaaataaaatatct

SEQ ID NO: 210415 - DNA, 20 bp, Artificial Sequence
  chemically synthesized
agactataaaataaaatatc

SEQ ID NO: 210416 - DNA, 20 bp, Artificial Sequence
  chemically synthesized
tccctagatattttatttta

SEQ ID NO: 210417 - DNA, 20 bp, Artificial Sequence
  chemically synthesized
tcaaaaaccttaacagtgtg

SEQ ID NO: 210418 - DNA, 20 bp, Artificial Sequence
  chemically synthesized
tttatagtctacacactgtt

SEQ ID NO: 210419 - DNA, 20 bp, Artificial Sequence
  chemically synthesized
ttatagtctacacactgtta

SEQ ID NO: 210420 - DNA, 20 bp, Artificial Sequence
  chemically synthesized
cttaacatcaaaaaccttaa

SEQ ID NO: 210421 - DNA, 20 bp, Artificial Sequence
  chemically synthesized
ctgttaaggtttttgatgtt

SEQ ID NO: 210422 - DNA, 20 bp, Artificial Sequence
  chemically synthesized
ttgatgttaagaattgaaac

SEQ ID NO: 210423 - DNA, 20 bp, Artificial Sequence
  chemically synthesized
gatgttaagaattgaaacga

SEQ ID NO: 210424 - DNA, 20 bp, Artificial Sequence
  chemically synthesized
gttaagaattgaaacgagag

SEQ ID NO: 210425 - DNA, 20 bp, Artificial Sequence
  chemically synthesized
acgagagtagtatccttata

SEQ ID NO: 210426 - DNA, 20 bp, Artificial Sequence
  chemically synthesized
ataggcaagaatgctttata

SEQ ID NO: 210427 - DNA, 20 bp, Artificial Sequence
  chemically synthesized
gataggcaagaatgctttat

SEQ ID NO: 210428 - DNA, 20 bp, Artificial Sequence
  chemically synthesized
gagtggtggttaagataggc

SEQ ID NO: 210429 - DNA, 20 bp, Artificial Sequence
  chemically synthesized
aagggagtggtggttaagat

SEQ ID NO: 210430 - DNA, 20 bp, Artificial Sequence
  chemically synthesized
aaagggagtggtggttaaga

SEQ ID NO: 210431 - DNA, 20 bp, Artificial Sequence
  chemically synthesized
ttagaaagggagtggtggtt

SEQ ID NO: 210432 - DNA, 20 bp, Artificial Sequence
  chemically synthesized
agtcattagaaagggagtgg

SEQ ID NO: 210433 - DNA, 20 bp, Artificial Sequence
  chemically synthesized
cctagtcattagaaagggag

SEQ ID NO: 210434 - DNA, 20 bp, Artificial Sequence
  chemically synthesized
tttcctagtcattagaaagg

SEQ ID NO: 210435 - DNA, 20 bp, Artificial Sequence
  chemically synthesized
tctttcctagtcattagaaa

SEQ ID NO: 210436 - DNA, 20 bp, Artificial Sequence
  chemically synthesized
ctctttcctagtcattagaa

SEQ ID NO: 210437 - DNA, 20 bp, Artificial Sequence
  chemically synthesized
actctttcctagtcattaga

SEQ ID NO: 210438 - DNA, 20 bp, Artificial Sequence
  chemically synthesized
accactccctttctaatgac

SEQ ID NO: 210439 - DNA, 20 bp, Artificial Sequence
  chemically synthesized
ccactccctttctaatgact

SEQ ID NO: 210440 - DNA, 20 bp, Artificial Sequence
  chemically synthesized
ttatactctttcctagtcat

SEQ ID NO: 210441 - DNA, 20 bp, Artificial Sequence
  chemically synthesized
tccctttctaatgactagga

SEQ ID NO: 210442 - DNA, 20 bp, Artificial Sequence
  chemically synthesized
cctttctaatgactaggaaa

SEQ ID NO: 210443 - DNA, 20 bp, Artificial Sequence
  chemically synthesized
ttttacattatactctttcc

SEQ ID NO: 210444 - DNA, 20 bp, Artificial Sequence
  chemically synthesized
aaaattgattcaaaattttc

SEQ ID NO: 210445 - DNA, 20 bp, Artificial Sequence
  chemically synthesized
gagcatgaaaaaattatcat

SEQ ID NO: 210446 - DNA, 20 bp, Artificial Sequence
  chemically synthesized
agcatgaaaaaattatcatg

SEQ ID NO: 210447 - DNA, 20 bp, Artificial Sequence
  chemically synthesized
gcatgaaaaaattatcatga

SEQ ID NO: 210448 - DNA, 20 bp, Artificial Sequence
  chemically synthesized
tcagtggataagttaaggag

SEQ ID NO: 210449 - DNA, 20 bp, Artificial Sequence
  chemically synthesized
acatcagtggataagttaag

SEQ ID NO: 210450 - DNA, 20 bp, Artificial Sequence
  chemically synthesized
ctacatcagtggataagtta

SEQ ID NO: 210451 - DNA, 20 bp, Artificial Sequence
  chemically synthesized
tctacatcagtggataagtt

SEQ ID NO: 210452 - DNA, 20 bp, Artificial Sequence
  chemically synthesized
acgtttctacatcagtggat

SEQ ID NO: 210453 - DNA, 20 bp, Artificial Sequence
  chemically synthesized
ccttaacttatccactgatg

SEQ ID NO: 210454 - DNA, 20 bp, Artificial Sequence
  chemically synthesized
catgtacgtttctacatcag

SEQ ID NO: 210455 - DNA, 20 bp, Artificial Sequence
  chemically synthesized
ttacatgtacgtttctacat

SEQ ID NO: 210456 - DNA, 20 bp, Artificial Sequence
  chemically synthesized
gtagaaacgtacatgtaatt

SEQ ID NO: 210457 - DNA, 20 bp, Artificial Sequence
  chemically synthesized
aattgagaaaaataataaaa

SEQ ID NO: 210458 - DNA, 20 bp, Artificial Sequence
  chemically synthesized
aataataaaatggatgttga

SEQ ID NO: 210459 - DNA, 20 bp, Artificial Sequence
  chemically synthesized
tggatgttgacggtatttcc

SEQ ID NO: 210460 - DNA, 20 bp, Artificial Sequence
  chemically synthesized
atgttgacggtatttcccag

SEQ ID NO: 210461 - DNA, 20 bp, Artificial Sequence
  chemically synthesized
tcaaatttgttaattcttct

SEQ ID NO: 210462 - DNA, 20 bp, Artificial Sequence
  chemically synthesized
ttcaaatttgttaattcttc

SEQ ID NO: 210463 - DNA, 20 bp, Artificial Sequence
  chemically synthesized
gaattaacaaatttgaaatt

SEQ ID NO: 210464 - DNA, 20 bp, Artificial Sequence
  chemically synthesized
taacaaatttgaaattaagt

SEQ ID NO: 210465 - DNA, 20 bp, Artificial Sequence
  chemically synthesized
aatttgaaattaagtgagta

SEQ ID NO: 210466 - DNA, 20 bp, Artificial Sequence
  chemically synthesized
aagtgagtaaagctgttatt

SEQ ID NO: 210467 - DNA, 20 bp, Artificial Sequence
  chemically synthesized
ctgaaataatgactgaataa

SEQ ID NO: 210468 - DNA, 20 bp, Artificial Sequence
  chemically synthesized
ctgttattcagtcattattt

SEQ ID NO: 210469 - DNA, 20 bp, Artificial Sequence
  chemically synthesized
tgttattcagtcattatttc

SEQ ID NO: 210470 - DNA, 20 bp, Artificial Sequence
  chemically synthesized
gttattcagtcattatttca

SEQ ID NO: 210471 - DNA, 20 bp, Artificial Sequence
  chemically synthesized
ttatttcagggtcttttctc

SEQ ID NO: 210472 - DNA, 20 bp, Artificial Sequence
  chemically synthesized
gtacttcagaggcttgagaa

SEQ ID NO: 210473 - DNA, 20 bp, Artificial Sequence
  chemically synthesized
cacatgtacttcagaggctt

SEQ ID NO: 210474 - DNA, 20 bp, Artificial Sequence
  chemically synthesized
ggtcttttctcaagcctctg

SEQ ID NO: 210475 - DNA, 20 bp, Artificial Sequence
  chemically synthesized
ttttcccacatgtacttcag

SEQ ID NO: 210476 - DNA, 20 bp, Artificial Sequence
  chemically synthesized
attttcccacatgtacttca

SEQ ID NO: 210477 - DNA, 20 bp, Artificial Sequence
  chemically synthesized
gcattttcccacatgtactt

SEQ ID NO: 210478 - DNA, 20 bp, Artificial Sequence
  chemically synthesized
tcaagcctctgaagtacatg

SEQ ID NO: 210479 - DNA, 20 bp, Artificial Sequence
  chemically synthesized
caagcctctgaagtacatgt

SEQ ID NO: 210480 - DNA, 20 bp, Artificial Sequence
  chemically synthesized
acatttctgctacgtttatg

SEQ ID NO: 210481 - DNA, 20 bp, Artificial Sequence
  chemically synthesized
gggaaaatgctacataaacg

SEQ ID NO: 210482 - DNA, 20 bp, Artificial Sequence
  chemically synthesized
aaaatgctacataaacgtag

SEQ ID NO: 210483 - DNA, 20 bp, Artificial Sequence
  chemically synthesized
agcagaaatgttaatttctg

SEQ ID NO: 210484 - DNA, 20 bp, Artificial Sequence
  chemically synthesized
ataactaacttaataagctg

SEQ ID NO: 210485 - DNA, 20 bp, Artificial Sequence
  chemically synthesized
gttaatttctgcagcttatt

SEQ ID NO: 210486 - DNA, 20 bp, Artificial Sequence
  chemically synthesized
atttctgcagcttattaagt

SEQ ID NO: 210487 - DNA, 20 bp, Artificial Sequence
  chemically synthesized
aggctaataactaacttaat

SEQ ID NO: 210488 - DNA, 20 bp, Artificial Sequence
  chemically synthesized
cagcttattaagttagttat

SEQ ID NO: 210489 - DNA, 20 bp, Artificial Sequence
  chemically synthesized
tagttattagcctataattc

SEQ ID NO: 210490 - DNA, 20 bp, Artificial Sequence
  chemically synthesized
actcaaagatcttgaattat

SEQ ID NO: 210491 - DNA, 20 bp, Artificial Sequence
  chemically synthesized
tactcaaagatcttgaatta

SEQ ID NO: 210492 - DNA, 20 bp, Artificial Sequence
  chemically synthesized
gcctataattcaagatcttt

SEQ ID NO: 210493 - DNA, 20 bp, Artificial Sequence
  chemically synthesized
gggtcctttaatgatactca

SEQ ID NO: 210494 - DNA, 20 bp, Artificial Sequence
  chemically synthesized
aagatctttgagtatcatta

SEQ ID NO: 210495 - DNA, 20 bp, Artificial Sequence
  chemically synthesized
agatctttgagtatcattaa

SEQ ID NO: 210496 - DNA, 20 bp, Artificial Sequence
  chemically synthesized
gtatcattaaaggacccgca

SEQ ID NO: 210497 - DNA, 20 bp, Artificial Sequence
  chemically synthesized
tatcattaaaggacccgcac

SEQ ID NO: 210498 - DNA, 20 bp, Artificial Sequence
  chemically synthesized
ttaaaatgatgtacctgtgc

SEQ ID NO: 210499 - DNA, 20 bp, Artificial Sequence
  chemically synthesized
attaaaatgatgtacctgtg

SEQ ID NO: 210500 - DNA, 20 bp, Artificial Sequence
  chemically synthesized
atcattttaatgacttatgt

SEQ ID NO: 210501 - DNA, 20 bp, Artificial Sequence
  chemically synthesized
atatatctattttctcacat

SEQ ID NO: 210502 - DNA, 20 bp, Artificial Sequence
  chemically synthesized
taatgacttatgtgagaaaa

SEQ ID NO: 210503 - DNA, 20 bp, Artificial Sequence
  chemically synthesized
agaaaatagatatataaaaa

SEQ ID NO: 210504 - DNA, 20 bp, Artificial Sequence
  chemically synthesized
gaaaatagatatataaaaat

SEQ ID NO: 210505 - DNA, 20 bp, Artificial Sequence
  chemically synthesized
ataaaaataggaacatgatc

SEQ ID NO: 210506 - DNA, 20 bp, Artificial Sequence
  chemically synthesized
aggaacatgatctggacgtt

SEQ ID NO: 210507 - DNA, 20 bp, Artificial Sequence
  chemically synthesized
caaaattatttcttaacgtc

SEQ ID NO: 210508 - DNA, 20 bp, Artificial Sequence
  chemically synthesized
ggacgttaagaaataatttt

SEQ ID NO: 210509 - DNA, 20 bp, Artificial Sequence
  chemically synthesized
gacgttaagaaataattttg

SEQ ID NO: 210510 - DNA, 20 bp, Artificial Sequence
  chemically synthesized
caacacgatgtatcagtaag

SEQ ID NO: 210511 - DNA, 20 bp, Artificial Sequence
  chemically synthesized
cacaacacgatgtatcagta

SEQ ID NO: 210512 - DNA, 20 bp, Artificial Sequence
  chemically synthesized
gcacaacacgatgtatcagt

SEQ ID NO: 210513 - DNA, 20 bp, Artificial Sequence
  chemically synthesized
caacgcacaacacgatgtat

SEQ ID NO: 210514 - DNA, 20 bp, Artificial Sequence
  chemically synthesized
tgatacatcgtgttgtgcgt

SEQ ID NO: 210515 - DNA, 20 bp, Artificial Sequence
  chemically synthesized
ggactagcgggtcaatatca

SEQ ID NO: 210516 - DNA, 20 bp, Artificial Sequence
  chemically synthesized
cggactagcgggtcaatatc

SEQ ID NO: 210517 - DNA, 20 bp, Artificial Sequence
  chemically synthesized
tcggactagcgggtcaatat

SEQ ID NO: 210518 - DNA, 20 bp, Artificial Sequence
  chemically synthesized
ttgccctgatattgacccgc

SEQ ID NO: 210519 - DNA, 20 bp, Artificial Sequence
  chemically synthesized
tctgattgactcggactagc

SEQ ID NO: 210520 - DNA, 20 bp, Artificial Sequence
  chemically synthesized
tgatattgacccgctagtcc

SEQ ID NO: 210521 - DNA, 20 bp, Artificial Sequence
  chemically synthesized
gtctgattgactcggactag

SEQ ID NO: 210522 - DNA, 20 bp, Artificial Sequence
  chemically synthesized
caggtctgattgactcggac

SEQ ID NO: 210523 - DNA, 20 bp, Artificial Sequence
  chemically synthesized
acccgctagtccgagtcaat

SEQ ID NO: 210524 - DNA, 20 bp, Artificial Sequence
  chemically synthesized
aattccaggtctgattgact

SEQ ID NO: 210525 - DNA, 20 bp, Artificial Sequence
  chemically synthesized
tagtccgagtcaatcagacc

SEQ ID NO: 210526 - DNA, 20 bp, Artificial Sequence
  chemically synthesized
ccagtcatcaggagaattcc

SEQ ID NO: 210527 - DNA, 20 bp, Artificial Sequence
  chemically synthesized
accagtcatcaggagaattc

SEQ ID NO: 210528 - DNA, 20 bp, Artificial Sequence
  chemically synthesized
agtctagaaccagtcatcag

SEQ ID NO: 210529 - DNA, 20 bp, Artificial Sequence
  chemically synthesized
cctggaattctcctgatgac

SEQ ID NO: 210530 - DNA, 20 bp, Artificial Sequence
  chemically synthesized
ttagtctagaaccagtcatc

SEQ ID NO: 210531 - DNA, 20 bp, Artificial Sequence
  chemically synthesized
cttagtctagaaccagtcat

SEQ ID NO: 210532 - DNA, 20 bp, Artificial Sequence
  chemically synthesized
attctcctgatgactggttc

SEQ ID NO: 210533 - DNA, 20 bp, Artificial Sequence
  chemically synthesized
gactgctcttagtctagaac

SEQ ID NO: 210534 - DNA, 20 bp, Artificial Sequence
  chemically synthesized
ctgatgactggttctagact

SEQ ID NO: 210535 - DNA, 20 bp, Artificial Sequence
  chemically synthesized
gatgactggttctagactaa

SEQ ID NO: 210536 - DNA, 20 bp, Artificial Sequence
  chemically synthesized
acatgagactgctcttagtc

SEQ ID NO: 210537 - DNA, 20 bp, Artificial Sequence
  chemically synthesized
gactggttctagactaagag

SEQ ID NO: 210538 - DNA, 20 bp, Artificial Sequence
  chemically synthesized
ttaggacatgagactgctct

SEQ ID NO: 210539 - DNA, 20 bp, Artificial Sequence
  chemically synthesized
tttgagccaatttaggacat

SEQ ID NO: 210540 - DNA, 20 bp, Artificial Sequence
  chemically synthesized
agcagtctcatgtcctaaat

SEQ ID NO: 210541 - DNA, 20 bp, Artificial Sequence
  chemically synthesized
caatccatttgagccaattt

SEQ ID NO: 210542 - DNA, 20 bp, Artificial Sequence
  chemically synthesized
tcaatccatttgagccaatt

SEQ ID NO: 210543 - DNA, 20 bp, Artificial Sequence
  chemically synthesized
atgtcctaaattggctcaaa

SEQ ID NO: 210544 - DNA, 20 bp, Artificial Sequence
  chemically synthesized
tatgtctcttcaatccattt

SEQ ID NO: 210545 - DNA, 20 bp, Artificial Sequence
  chemically synthesized
aaattggctcaaatggattg

SEQ ID NO: 210546 - DNA, 20 bp, Artificial Sequence
  chemically synthesized
attggctcaaatggattgaa

SEQ ID NO: 210547 - DNA, 20 bp, Artificial Sequence
  chemically synthesized
ttgaagagacatattccaac

SEQ ID NO: 210548 - DNA, 20 bp, Artificial Sequence
  chemically synthesized
tgaagagacatattccaacg

SEQ ID NO: 210549 - DNA, 20 bp, Artificial Sequence
  chemically synthesized
agagacatattccaacgagg

SEQ ID NO: 210550 - DNA, 20 bp, Artificial Sequence
  chemically synthesized
gaaaacctcttccacctcgt

SEQ ID NO: 210551 - DNA, 20 bp, Artificial Sequence
  chemically synthesized
gacatattccaacgaggtgg

SEQ ID NO: 210552 - DNA, 20 bp, Artificial Sequence
  chemically synthesized
catattccaacgaggtggaa

SEQ ID NO: 210553 - DNA, 20 bp, Artificial Sequence
  chemically synthesized
atattccaacgaggtggaag

SEQ ID NO: 210554 - DNA, 20 bp, Artificial Sequence
  chemically synthesized
gaagaggttttctctctctt

SEQ ID NO: 210555 - DNA, 20 bp, Artificial Sequence
  chemically synthesized
taagctacaagctgaagaga

SEQ ID NO: 210556 - DNA, 20 bp, Artificial Sequence
  chemically synthesized
tttaagctacaagctgaaga

SEQ ID NO: 210557 - DNA, 20 bp, Artificial Sequence
  chemically synthesized
cttttaagctacaagctgaa

SEQ ID NO: 210558 - DNA, 20 bp, Artificial Sequence
  chemically synthesized
ttttctctctcttcagcttg

SEQ ID NO: 210559 - DNA, 20 bp, Artificial Sequence
  chemically synthesized
ggcttttaagctacaagctg

SEQ ID NO: 210560 - DNA, 20 bp, Artificial Sequence
  chemically synthesized
tagattggcttttaagctac

SEQ ID NO: 210561 - DNA, 20 bp, Artificial Sequence
  chemically synthesized
ctcttcagcttgtagcttaa

SEQ ID NO: 210562 - DNA, 20 bp, Artificial Sequence
  chemically synthesized
gtagtcatagattggctttt

SEQ ID NO: 210563 - DNA, 20 bp, Artificial Sequence
  chemically synthesized
ttcctcctgtagtcatagat

SEQ ID NO: 210564 - DNA, 20 bp, Artificial Sequence
  chemically synthesized
taaaagccaatctatgacta

SEQ ID NO: 210565 - DNA, 20 bp, Artificial Sequence
  chemically synthesized
aaaagccaatctatgactac

SEQ ID NO: 210566 - DNA, 20 bp, Artificial Sequence
  chemically synthesized
ttttattcctcctgtagtca

SEQ ID NO: 210567 - DNA, 20 bp, Artificial Sequence
  chemically synthesized
aagccaatctatgactacag

SEQ ID NO: 210568 - DNA, 20 bp, Artificial Sequence
  chemically synthesized
agccaatctatgactacagg

SEQ ID NO: 210569 - DNA, 20 bp, Artificial Sequence
  chemically synthesized
cctaagttttattcctcctg

SEQ ID NO: 210570 - DNA, 20 bp, Artificial Sequence
  chemically synthesized
actacaggaggaataaaact

SEQ ID NO: 210571 - DNA, 20 bp, Artificial Sequence
  chemically synthesized
ctacaggaggaataaaactt

SEQ ID NO: 210572 - DNA, 20 bp, Artificial Sequence
  chemically synthesized
ctttatgctcgtgaattcct

SEQ ID NO: 210573 - DNA, 20 bp, Artificial Sequence
  chemically synthesized
aataaaacttaggaattcac

SEQ ID NO: 210574 - DNA, 20 bp, Artificial Sequence
  chemically synthesized
cttaggaattcacgagcata

SEQ ID NO: 210575 - DNA, 20 bp, Artificial Sequence
  chemically synthesized
taggaattcacgagcataaa

SEQ ID NO: 210576 - DNA, 20 bp, Artificial Sequence
  chemically synthesized
aattcacgagcataaagagt

SEQ ID NO: 210577 - DNA, 20 bp, Artificial Sequence
  chemically synthesized
attcacgagcataaagagta

SEQ ID NO: 210578 - DNA, 20 bp, Artificial Sequence
  chemically synthesized
acgagcataaagagtaaggc

SEQ ID NO: 210579 - DNA, 20 bp, Artificial Sequence
  chemically synthesized
aaagagtaaggccagtaatc

SEQ ID NO: 210580 - DNA, 20 bp, Artificial Sequence
  chemically synthesized
aagagtaaggccagtaatca

SEQ ID NO: 210581 - DNA, 20 bp, Artificial Sequence
  chemically synthesized
tatagggatgccttgattac

SEQ ID NO: 210582 - DNA, 20 bp, Artificial Sequence
  chemically synthesized
aatcaaggcatccctatact

SEQ ID NO: 210583 - DNA, 20 bp, Artificial Sequence
  chemically synthesized
ggccaggtttgccaagtata

SEQ ID NO: 210584 - DNA, 20 bp, Artificial Sequence
  chemically synthesized
tggccaggtttgccaagtat

SEQ ID NO: 210585 - DNA, 20 bp, Artificial Sequence
  chemically synthesized
gtggccaggtttgccaagta

SEQ ID NO: 210586 - DNA, 20 bp, Artificial Sequence
  chemically synthesized
tcagagtggccaggtttgcc

SEQ ID NO: 210587 - DNA, 20 bp, Artificial Sequence
  chemically synthesized
atccctatacttggcaaacc

SEQ ID NO: 210588 - DNA, 20 bp, Artificial Sequence
  chemically synthesized
agagaagcctcagagtggcc

SEQ ID NO: 210589 - DNA, 20 bp, Artificial Sequence
  chemically synthesized
aagagaagcctcagagtggc

SEQ ID NO: 210590 - DNA, 20 bp, Artificial Sequence
  chemically synthesized
ttggcaaacctggccactct

SEQ ID NO: 210591 - DNA, 20 bp, Artificial Sequence
  chemically synthesized
tggcaaacctggccactctg

SEQ ID NO: 210592 - DNA, 20 bp, Artificial Sequence
  chemically synthesized
tccaaagagaagcctcagag

SEQ ID NO: 210593 - DNA, 20 bp, Artificial Sequence
  chemically synthesized
tcctccaaagagaagcctca

SEQ ID NO: 210594 - DNA, 20 bp, Artificial Sequence
  chemically synthesized
aatcctccaaagagaagcct

SEQ ID NO: 210595 - DNA, 20 bp, Artificial Sequence
  chemically synthesized
gccactctgaggcttctctt

SEQ ID NO: 210596 - DNA, 20 bp, Artificial Sequence
  chemically synthesized
cactctgaggcttctctttg

SEQ ID NO: 210597 - DNA, 20 bp, Artificial Sequence
  chemically synthesized
aggtggaatcctccaaagag

SEQ ID NO: 210598 - DNA, 20 bp, Artificial Sequence
  chemically synthesized
actctgaggcttctctttgg

SEQ ID NO: 210599 - DNA, 20 bp, Artificial Sequence
  chemically synthesized
cagaggtggaatcctccaaa

SEQ ID NO: 210600 - DNA, 20 bp, Artificial Sequence
  chemically synthesized
agcagaggtggaatcctcca

SEQ ID NO: 210601 - DNA, 20 bp, Artificial Sequence
  chemically synthesized
ttgtctagatgtagcagagg

SEQ ID NO: 210602 - DNA, 20 bp, Artificial Sequence
  chemically synthesized
tcattgtctagatgtagcag

SEQ ID NO: 210603 - DNA, 20 bp, Artificial Sequence
  chemically synthesized
gtcattgtctagatgtagca

SEQ ID NO: 210604 - DNA, 20 bp, Artificial Sequence
  chemically synthesized
gattccacctctgctacatc

SEQ ID NO: 210605 - DNA, 20 bp, Artificial Sequence
  chemically synthesized
gagtcattgtctagatgtag

SEQ ID NO: 210606 - DNA, 20 bp, Artificial Sequence
  chemically synthesized
actgagtcattgtctagatg

SEQ ID NO: 210607 - DNA, 20 bp, Artificial Sequence
  chemically synthesized
aataacactgagtcattgtc

SEQ ID NO: 210608 - DNA, 20 bp, Artificial Sequence
  chemically synthesized
gctacatctagacaatgact

SEQ ID NO: 210609 - DNA, 20 bp, Artificial Sequence
  chemically synthesized
ttatatccagaaataacact

SEQ ID NO: 210610 - DNA, 20 bp, Artificial Sequence
  chemically synthesized
caatgactcagtgttatttc

SEQ ID NO: 210611 - DNA, 20 bp, Artificial Sequence
  chemically synthesized
tcagtgttatttctggatat

SEQ ID NO: 210612 - DNA, 20 bp, Artificial Sequence
  chemically synthesized
cagtgttatttctggatata

SEQ ID NO: 210613 - DNA, 20 bp, Artificial Sequence
  chemically synthesized
tcccagcagtgccttatatc

SEQ ID NO: 210614 - DNA, 20 bp, Artificial Sequence
  chemically synthesized
ttctggatataaggcactgc

SEQ ID NO: 210615 - DNA, 20 bp, Artificial Sequence
  chemically synthesized
tctggatataaggcactgct

SEQ ID NO: 210616 - DNA, 20 bp, Artificial Sequence
  chemically synthesized
attcatctgtgtgttcccag

SEQ ID NO: 210617 - DNA, 20 bp, Artificial Sequence
  chemically synthesized
cagattcatctgtgtgttcc

SEQ ID NO: 210618 - DNA, 20 bp, Artificial Sequence
  chemically synthesized
aaggcactgctgggaacaca

SEQ ID NO: 210619 - DNA, 20 bp, Artificial Sequence
  chemically synthesized
actcattatagaattcatgt

SEQ ID NO: 210620 - DNA, 20 bp, Artificial Sequence
  chemically synthesized
tctgacatgaattctataat

SEQ ID NO: 210621 - DNA, 20 bp, Artificial Sequence
  chemically synthesized
ttctcctgagaaactcatta

SEQ ID NO: 210622 - DNA, 20 bp, Artificial Sequence
  chemically synthesized
gaattctataatgagtttct

SEQ ID NO: 210623 - DNA, 20 bp, Artificial Sequence
  chemically synthesized
aattctataatgagtttctc

SEQ ID NO: 210624 - DNA, 20 bp, Artificial Sequence
  chemically synthesized
ttctataatgagtttctcag

SEQ ID NO: 210625 - DNA, 20 bp, Artificial Sequence
  chemically synthesized
ccaaaattcattattctcct

SEQ ID NO: 210626 - DNA, 20 bp, Artificial Sequence
  chemically synthesized
ctcaggagaataatgaattt

SEQ ID NO: 210627 - DNA, 20 bp, Artificial Sequence
  chemically synthesized
agaataatgaattttggtaa

SEQ ID NO: 210628 - DNA, 20 bp, Artificial Sequence
  chemically synthesized
gaataatgaattttggtaat

SEQ ID NO: 210629 - DNA, 20 bp, Artificial Sequence
  chemically synthesized
attttggtaatgggaaatga

SEQ ID NO: 210630 - DNA, 20 bp, Artificial Sequence
  chemically synthesized
ttggtaatgggaaatgaaag

SEQ ID NO: 210631 - DNA, 20 bp, Artificial Sequence
  chemically synthesized
tggtaatgggaaatgaaagt

SEQ ID NO: 210632 - DNA, 20 bp, Artificial Sequence
  chemically synthesized
ggtaatgggaaatgaaagtg

SEQ ID NO: 210633 - DNA, 20 bp, Artificial Sequence
  chemically synthesized
gggaaatgtactgtatgtta

SEQ ID NO: 210634 - DNA, 20 bp, Artificial Sequence
  chemically synthesized
aaggtcaagtccataacata

SEQ ID NO: 210635 - DNA, 20 bp, Artificial Sequence
  chemically synthesized
ccatattatagacgaaggtc

SEQ ID NO: 210636 - DNA, 20 bp, Artificial Sequence
  chemically synthesized
gacacccatattatagacga

SEQ ID NO: 210637 - DNA, 20 bp, Artificial Sequence
  chemically synthesized
agacacccatattatagacg

SEQ ID NO: 210638 - DNA, 20 bp, Artificial Sequence
  chemically synthesized
cttgaccttcgtctataata

SEQ ID NO: 210639 - DNA, 20 bp, Artificial Sequence
  chemically synthesized
ttgaccttcgtctataatat

SEQ ID NO: 210640 - DNA, 20 bp, Artificial Sequence
  chemically synthesized
agtggcagacacccatatta

SEQ ID NO: 210641 - DNA, 20 bp, Artificial Sequence
  chemically synthesized
atggattgttgaacgagtgg

SEQ ID NO: 210642 - DNA, 20 bp, Artificial Sequence
  chemically synthesized
ctaatggattgttgaacgag

SEQ ID NO: 210643 - DNA, 20 bp, Artificial Sequence
  chemically synthesized
ttgctaatggattgttgaac

SEQ ID NO: 210644 - DNA, 20 bp, Artificial Sequence
  chemically synthesized
ccactcgttcaacaatccat

SEQ ID NO: 210645 - DNA, 20 bp, Artificial Sequence
  chemically synthesized
taagttaaatgatttgctaa

SEQ ID NO: 210646 - DNA, 20 bp, Artificial Sequence
  chemically synthesized
catatggataaaatattttt

SEQ ID NO: 210647 - DNA, 20 bp, Artificial Sequence
  chemically synthesized
tagtagcccaatttaacata

SEQ ID NO: 210648 - DNA, 20 bp, Artificial Sequence
  chemically synthesized
attttatccatatgttaaat

SEQ ID NO: 210649 - DNA, 20 bp, Artificial Sequence
  chemically synthesized
ttttatccatatgttaaatt

SEQ ID NO: 210650 - DNA, 20 bp, Artificial Sequence
  chemically synthesized
cctttcattatatgttttag

SEQ ID NO: 210651 - DNA, 20 bp, Artificial Sequence
  chemically synthesized
tgccctttcattatatgttt

SEQ ID NO: 210652 - DNA, 20 bp, Artificial Sequence
  chemically synthesized
gctactaaaacatataatga

SEQ ID NO: 210653 - DNA, 20 bp, Artificial Sequence
  chemically synthesized
ctactaaaacatataatgaa

SEQ ID NO: 210654 - DNA, 20 bp, Artificial Sequence
  chemically synthesized
tactaaaacatataatgaaa

SEQ ID NO: 210655 - DNA, 20 bp, Artificial Sequence
  chemically synthesized
acatataatgaaagggcata

SEQ ID NO: 210656 - DNA, 20 bp, Artificial Sequence
  chemically synthesized
atataatgaaagggcatata

SEQ ID NO: 210657 - DNA, 20 bp, Artificial Sequence
  chemically synthesized
tgaaagggcatatagagcta

SEQ ID NO: 210658 - DNA, 20 bp, Artificial Sequence
  chemically synthesized
gaaagggcatatagagctat

SEQ ID NO: 210659 - DNA, 20 bp, Artificial Sequence
  chemically synthesized
tatttccttaaagaagccca

SEQ ID NO: 210660 - DNA, 20 bp, Artificial Sequence
  chemically synthesized
atagagctatgggcttcttt

SEQ ID NO: 210661 - DNA, 20 bp, Artificial Sequence
  chemically synthesized
tagagctatgggcttcttta

SEQ ID NO: 210662 - DNA, 20 bp, Artificial Sequence
  chemically synthesized
gttattgtatttccttaaag

SEQ ID NO: 210663 - DNA, 20 bp, Artificial Sequence
  chemically synthesized
gctgttattgtatttcctta

SEQ ID NO: 210664 - DNA, 20 bp, Artificial Sequence
  chemically synthesized
tctttaaggaaatacaataa

SEQ ID NO: 210665 - DNA, 20 bp, Artificial Sequence
  chemically synthesized
acaataacagctaatattcc

SEQ ID NO: 210666 - DNA, 20 bp, Artificial Sequence
  chemically synthesized
cataaagctcctaggaatat

SEQ ID NO: 210667 - DNA, 20 bp, Artificial Sequence
  chemically synthesized
caataacagctaatattcct

SEQ ID NO: 210668 - DNA, 20 bp, Artificial Sequence
  chemically synthesized
ataacagctaatattcctag

SEQ ID NO: 210669 - DNA, 20 bp, Artificial Sequence
  chemically synthesized
ctgatatgcataaagctcct

SEQ ID NO: 210670 - DNA, 20 bp, Artificial Sequence
  chemically synthesized
cctgatatgcataaagctcc

SEQ ID NO: 210671 - DNA, 20 bp, Artificial Sequence
  chemically synthesized
cacagtgcctgatatgcata

SEQ ID NO: 210672 - DNA, 20 bp, Artificial Sequence
  chemically synthesized
cctaggagctttatgcatat

SEQ ID NO: 210673 - DNA, 20 bp, Artificial Sequence
  chemically synthesized
ctaggagctttatgcatatc

SEQ ID NO: 210674 - DNA, 20 bp, Artificial Sequence
  chemically synthesized
tgcttattcagtgtttagca

SEQ ID NO: 210675 - DNA, 20 bp, Artificial Sequence
  chemically synthesized
gaaattgcttattcagtgtt

SEQ ID NO: 210676 - DNA, 20 bp, Artificial Sequence
  chemically synthesized
cactgtgctaaacactgaat

SEQ ID NO: 210677 - DNA, 20 bp, Artificial Sequence
  chemically synthesized
aggttaagaaattgcttatt

SEQ ID NO: 210678 - DNA, 20 bp, Artificial Sequence
  chemically synthesized
atggggttcatgtgaaggtt

SEQ ID NO: 210679 - DNA, 20 bp, Artificial Sequence
  chemically synthesized
atctcatggggttcatgtga

SEQ ID NO: 210680 - DNA, 20 bp, Artificial Sequence
  chemically synthesized
tatctcatggggttcatgtg

SEQ ID NO: 210681 - DNA, 20 bp, Artificial Sequence
  chemically synthesized
aaccttcacatgaaccccat

SEQ ID NO: 210682 - DNA, 20 bp, Artificial Sequence
  chemically synthesized
ttcacatgaaccccatgaga

SEQ ID NO: 210683 - DNA, 20 bp, Artificial Sequence
  chemically synthesized
aaaaccatgtctatctcatg

SEQ ID NO: 210684 - DNA, 20 bp, Artificial Sequence
  chemically synthesized
gaaaaccatgtctatctcat

SEQ ID NO: 210685 - DNA, 20 bp, Artificial Sequence
  chemically synthesized
ggaaaaccatgtctatctca

SEQ ID NO: 210686 - DNA, 20 bp, Artificial Sequence
  chemically synthesized
tgaaccccatgagatagaca

SEQ ID NO: 210687 - DNA, 20 bp, Artificial Sequence
  chemically synthesized
tttcgtcaactgtaaaatgg

SEQ ID NO: 210688 - DNA, 20 bp, Artificial Sequence
  chemically synthesized
catggttttcccccatttta

SEQ ID NO: 210689 - DNA, 20 bp, Artificial Sequence
  chemically synthesized
atttcgtcaactgtaaaatg

SEQ ID NO: 210690 - DNA, 20 bp, Artificial Sequence
  chemically synthesized
tatttcgtcaactgtaaaat

SEQ ID NO: 210691 - DNA, 20 bp, Artificial Sequence
  chemically synthesized
ctatttcgtcaactgtaaaa

SEQ ID NO: 210692 - DNA, 20 bp, Artificial Sequence
  chemically synthesized
ccattttacagttgacgaaa

SEQ ID NO: 210693 - DNA, 20 bp, Artificial Sequence
  chemically synthesized
ttttacagttgacgaaatag

SEQ ID NO: 210694 - DNA, 20 bp, Artificial Sequence
  chemically synthesized
ttacagttgacgaaatagaa

SEQ ID NO: 210695 - DNA, 20 bp, Artificial Sequence
  chemically synthesized
tgacgaaatagaagagattt

SEQ ID NO: 210696 - DNA, 20 bp, Artificial Sequence
  chemically synthesized
gagatttcagccacttgttc

SEQ ID NO: 210697 - DNA, 20 bp, Artificial Sequence
  chemically synthesized
aacaaatgacctcgaacaag

SEQ ID NO: 210698 - DNA, 20 bp, Artificial Sequence
  chemically synthesized
agatttcagccacttgttcg

SEQ ID NO: 210699 - DNA, 20 bp, Artificial Sequence
  chemically synthesized
ttgaacaaatgacctcgaac

SEQ ID NO: 210700 - DNA, 20 bp, Artificial Sequence
  chemically synthesized
ttgttcgaggtcatttgttc

SEQ ID NO: 210701 - DNA, 20 bp, Artificial Sequence
  chemically synthesized
tgttcgaggtcatttgttca

SEQ ID NO: 210702 - DNA, 20 bp, Artificial Sequence
  chemically synthesized
cgaggtcatttgttcaaggt

SEQ ID NO: 210703 - DNA, 20 bp, Artificial Sequence
  chemically synthesized
gtcatttgttcaaggtcaga

SEQ ID NO: 210704 - DNA, 20 bp, Artificial Sequence
  chemically synthesized
tcatttgttcaaggtcagac

SEQ ID NO: 210705 - DNA, 20 bp, Artificial Sequence
  chemically synthesized
tcaaggtcagacaggttcca

SEQ ID NO: 210706 - DNA, 20 bp, Artificial Sequence
  chemically synthesized
aggtcagacaggttccacgg

SEQ ID NO: 210707 - DNA, 20 bp, Artificial Sequence
  chemically synthesized
ttactttccaggttccaccg

SEQ ID NO: 210708 - DNA, 20 bp, Artificial Sequence
  chemically synthesized
acaggttccacggtggaacc

SEQ ID NO: 210709 - DNA, 20 bp, Artificial Sequence
  chemically synthesized
gttccacggtggaacctgga

SEQ ID NO: 210710 - DNA, 20 bp, Artificial Sequence
  chemically synthesized
actatctgagattactttcc

SEQ ID NO: 210711 - DNA, 20 bp, Artificial Sequence
  chemically synthesized
aactatctgagattactttc

SEQ ID NO: 210712 - DNA, 20 bp, Artificial Sequence
  chemically synthesized
tggaacctggaaagtaatct

SEQ ID NO: 210713 - DNA, 20 bp, Artificial Sequence
  chemically synthesized
acctggaaagtaatctcaga

SEQ ID NO: 210714 - DNA, 20 bp, Artificial Sequence
  chemically synthesized
ttcaatttgagaaactatct

SEQ ID NO: 210715 - DNA, 20 bp, Artificial Sequence
  chemically synthesized
tcagatagtttctcaaattg

SEQ ID NO: 210716 - DNA, 20 bp, Artificial Sequence
  chemically synthesized
ctggttgagagcttcaattt

SEQ ID NO: 210717 - DNA, 20 bp, Artificial Sequence
  chemically synthesized
ctcaaattgaagctctcaac

SEQ ID NO: 210718 - DNA, 20 bp, Artificial Sequence
  chemically synthesized
tcaaattgaagctctcaacc

SEQ ID NO: 210719 - DNA, 20 bp, Artificial Sequence
  chemically synthesized
taaaaagagttcctggttga

SEQ ID NO: 210720 - DNA, 20 bp, Artificial Sequence
  chemically synthesized
ggtaaaaagagttcctggtt

SEQ ID NO: 210721 - DNA, 20 bp, Artificial Sequence
  chemically synthesized
ctggaggtaaaaagagttcc

SEQ ID NO: 210722 - DNA, 20 bp, Artificial Sequence
  chemically synthesized
atatatgctggaggtaaaaa

SEQ ID NO: 210723 - DNA, 20 bp, Artificial Sequence
  chemically synthesized
gaatatatgctggaggtaaa

SEQ ID NO: 210724 - DNA, 20 bp, Artificial Sequence
  chemically synthesized
ccaggaactctttttacctc

SEQ ID NO: 210725 - DNA, 20 bp, Artificial Sequence
  chemically synthesized
catgtctgaatatatgctgg

SEQ ID NO: 210726 - DNA, 20 bp, Artificial Sequence
  chemically synthesized
ccatgtctgaatatatgctg

SEQ ID NO: 210727 - DNA, 20 bp, Artificial Sequence
  chemically synthesized
tgccatgtctgaatatatgc

SEQ ID NO: 210728 - DNA, 20 bp, Artificial Sequence
  chemically synthesized
ttttacctccagcatatatt

SEQ ID NO: 210729 - DNA, 20 bp, Artificial Sequence
  chemically synthesized
ctccagcatatattcagaca

SEQ ID NO: 210730 - DNA, 20 bp, Artificial Sequence
  chemically synthesized
catatattcagacatggcat

SEQ ID NO: 210731 - DNA, 20 bp, Artificial Sequence
  chemically synthesized
atattcagacatggcataag

SEQ ID NO: 210732 - DNA, 20 bp, Artificial Sequence
  chemically synthesized
attcagacatggcataagca

SEQ ID NO: 210733 - DNA, 20 bp, Artificial Sequence
  chemically synthesized
ttcagacatggcataagcag

SEQ ID NO: 210734 - DNA, 20 bp, Artificial Sequence
  chemically synthesized
gacatggcataagcagagga

SEQ ID NO: 210735 - DNA, 20 bp, Artificial Sequence
  chemically synthesized
catggcataagcagaggaca

SEQ ID NO: 210736 - DNA, 20 bp, Artificial Sequence
  chemically synthesized
atggcataagcagaggacag

SEQ ID NO: 210737 - DNA, 20 bp, Artificial Sequence
  chemically synthesized
aggacagaggctgttctatg

SEQ ID NO: 210738 - DNA, 20 bp, Artificial Sequence
  chemically synthesized
ttagtcatcgcttcatagaa

SEQ ID NO: 210739 - DNA, 20 bp, Artificial Sequence
  chemically synthesized
tttttttagtcatcgcttca

SEQ ID NO: 210740 - DNA, 20 bp, Artificial Sequence
  chemically synthesized
tgtacttttttttttttttt

SEQ ID NO: 210741 - DNA, 20 bp, Artificial Sequence
  chemically synthesized
atgactaaaaaaaaaaaaaa

SEQ ID NO: 210742 - DNA, 20 bp, Artificial Sequence
  chemically synthesized
atatttatttttgccatcat

SEQ ID NO: 210743 - DNA, 20 bp, Artificial Sequence
  chemically synthesized
cccacttatttagcttatga

SEQ ID NO: 210744 - DNA, 20 bp, Artificial Sequence
  chemically synthesized
tttgccatcataagctaaat

SEQ ID NO: 210745 - DNA, 20 bp, Artificial Sequence
  chemically synthesized
gccatcataagctaaataag

SEQ ID NO: 210746 - DNA, 20 bp, Artificial Sequence
  chemically synthesized
ccatcataagctaaataagt

SEQ ID NO: 210747 - DNA, 20 bp, Artificial Sequence
  chemically synthesized
cttaggaaagcccacttatt

SEQ ID NO: 210748 - DNA, 20 bp, Artificial Sequence
  chemically synthesized
ctaaataagtgggctttcct

SEQ ID NO: 210749 - DNA, 20 bp, Artificial Sequence
  chemically synthesized
aataagtgggctttcctaag

SEQ ID NO: 210750 - DNA, 20 bp, Artificial Sequence
  chemically synthesized
tattacgaaactacttagga

SEQ ID NO: 210751 - DNA, 20 bp, Artificial Sequence
  chemically synthesized
ctcctattacgaaactactt

SEQ ID NO: 210752 - DNA, 20 bp, Artificial Sequence
  chemically synthesized
tctcctattacgaaactact

SEQ ID NO: 210753 - DNA, 20 bp, Artificial Sequence
  chemically synthesized
tttcctaagtagtttcgtaa

SEQ ID NO: 210754 - DNA, 20 bp, Artificial Sequence
  chemically synthesized
ttcctaagtagtttcgtaat

SEQ ID NO: 210755 - DNA, 20 bp, Artificial Sequence
  chemically synthesized
cctaagtagtttcgtaatag

SEQ ID NO: 210756 - DNA, 20 bp, Artificial Sequence
  chemically synthesized
gtagtttcgtaataggagaa

SEQ ID NO: 210757 - DNA, 20 bp, Artificial Sequence
  chemically synthesized
ccttctatctcattattcat

SEQ ID NO: 210758 - DNA, 20 bp, Artificial Sequence
  chemically synthesized
gagaaaagctgatgaataat

SEQ ID NO: 210759 - DNA, 20 bp, Artificial Sequence
  chemically synthesized
aaagctgatgaataatgaga

SEQ ID NO: 210760 - DNA, 20 bp, Artificial Sequence
  chemically synthesized
gctgatgaataatgagatag

SEQ ID NO: 210761 - DNA, 20 bp, Artificial Sequence
  chemically synthesized
ctgatgaataatgagataga

SEQ ID NO: 210762 - DNA, 20 bp, Artificial Sequence
  chemically synthesized
tgatgaataatgagatagaa

SEQ ID NO: 210763 - DNA, 20 bp, Artificial Sequence
  chemically synthesized
gaataatgagatagaagggt

SEQ ID NO: 210764 - DNA, 20 bp, Artificial Sequence
  chemically synthesized
gagatagaagggttggtgtt

SEQ ID NO: 210765 - DNA, 20 bp, Artificial Sequence
  chemically synthesized
agatagaagggttggtgttg

SEQ ID NO: 210766 - DNA, 20 bp, Artificial Sequence
  chemically synthesized
tagaagggttggtgttgagg

SEQ ID NO: 210767 - DNA, 20 bp, Artificial Sequence
  chemically synthesized
gaagggttggtgttgaggca

SEQ ID NO: 210768 - DNA, 20 bp, Artificial Sequence
  chemically synthesized
aagggttggtgttgaggcag

SEQ ID NO: 210769 - DNA, 20 bp, Artificial Sequence
  chemically synthesized
agggttggtgttgaggcaga

SEQ ID NO: 210770 - DNA, 20 bp, Artificial Sequence
  chemically synthesized
gggttggtgttgaggcagag

SEQ ID NO: 210771 - DNA, 20 bp, Artificial Sequence
  chemically synthesized
gtgttgaggcagaggggctt

SEQ ID NO: 210772 - DNA, 20 bp, Artificial Sequence
  chemically synthesized
gttgaggcagaggggctttg

SEQ ID NO: 210773 - DNA, 20 bp, Artificial Sequence
  chemically synthesized
aatatttgctttagtctcca

SEQ ID NO: 210774 - DNA, 20 bp, Artificial Sequence
  chemically synthesized
cagaggggctttggagacta

SEQ ID NO: 210775 - DNA, 20 bp, Artificial Sequence
  chemically synthesized
tttcatttaaatatttgctt

SEQ ID NO: 210776 - DNA, 20 bp, Artificial Sequence
  chemically synthesized
agcaaatatttaaatgaaaa

SEQ ID NO: 210777 - DNA, 20 bp, Artificial Sequence
  chemically synthesized
tttaaatgaaaatagctctg

SEQ ID NO: 210778 - DNA, 20 bp, Artificial Sequence
  chemically synthesized
acacacacacacacacttca

SEQ ID NO: 210779 - DNA, 20 bp, Artificial Sequence
  chemically synthesized
acacacacacacacacactt

SEQ ID NO: 210780 - DNA, 20 bp, Artificial Sequence
  chemically synthesized
tgtgtgtgtgtgtgtgaaaa

SEQ ID NO: 210781 - DNA, 20 bp, Artificial Sequence
  chemically synthesized
gtgtgtgtgtgtgaaaacag

SEQ ID NO: 210782 - DNA, 20 bp, Artificial Sequence
  chemically synthesized
acatagtagattattaatta

SEQ ID NO: 210783 - DNA, 20 bp, Artificial Sequence
  chemically synthesized
tggcagtatttggcacatag

SEQ ID NO: 210784 - DNA, 20 bp, Artificial Sequence
  chemically synthesized
gcatggcagtatttggcaca

SEQ ID NO: 210785 - DNA, 20 bp, Artificial Sequence
  chemically synthesized
tgattgtgcatggcagtatt

SEQ ID NO: 210786 - DNA, 20 bp, Artificial Sequence
  chemically synthesized
tttgtagtgattgtgcatgg

SEQ ID NO: 210787 - DNA, 20 bp, Artificial Sequence
  chemically synthesized
acttttgtagtgattgtgca

SEQ ID NO: 210788 - DNA, 20 bp, Artificial Sequence
  chemically synthesized
gccatgcacaatcactacaa

SEQ ID NO: 210789 - DNA, 20 bp, Artificial Sequence
  chemically synthesized
atcaaggccattcacttttg

SEQ ID NO: 210790 - DNA, 20 bp, Artificial Sequence
  chemically synthesized
acaatcactacaaaagtgaa

SEQ ID NO: 210791 - DNA, 20 bp, Artificial Sequence
  chemically synthesized
gtagtaaaaggaaaggatca

SEQ ID NO: 210792 - DNA, 20 bp, Artificial Sequence
  chemically synthesized
tgtagtaaaaggaaaggatc

SEQ ID NO: 210793 - DNA, 20 bp, Artificial Sequence
  chemically synthesized
attctctgtagtaaaaggaa

SEQ ID NO: 210794 - DNA, 20 bp, Artificial Sequence
  chemically synthesized
cattctctgtagtaaaagga

SEQ ID NO: 210795 - DNA, 20 bp, Artificial Sequence
  chemically synthesized
ttgatcctttccttttacta

SEQ ID NO: 210796 - DNA, 20 bp, Artificial Sequence
  chemically synthesized
gtgtcattctctgtagtaaa

SEQ ID NO: 210797 - DNA, 20 bp, Artificial Sequence
  chemically synthesized
tgtgtcattctctgtagtaa

SEQ ID NO: 210798 - DNA, 20 bp, Artificial Sequence
  chemically synthesized
gatcctttccttttactaca

SEQ ID NO: 210799 - DNA, 20 bp, Artificial Sequence
  chemically synthesized
tttatatgtgtcattctctg

SEQ ID NO: 210800 - DNA, 20 bp, Artificial Sequence
  chemically synthesized
cttgtcgtagcagattgaca

SEQ ID NO: 210801 - DNA, 20 bp, Artificial Sequence
  chemically synthesized
ccatgtcaatctgctacgac

SEQ ID NO: 210802 - DNA, 20 bp, Artificial Sequence
  chemically synthesized
aatcttagcgcttgtcgtag

SEQ ID NO: 210803 - DNA, 20 bp, Artificial Sequence
  chemically synthesized
ttcaatcttagcgcttgtcg

SEQ ID NO: 210804 - DNA, 20 bp, Artificial Sequence
  chemically synthesized
aatctgctacgacaagcgct

SEQ ID NO: 210805 - DNA, 20 bp, Artificial Sequence
  chemically synthesized
tacgacaagcgctaagattg

SEQ ID NO: 210806 - DNA, 20 bp, Artificial Sequence
  chemically synthesized
cactcaatgaacttcaatct

SEQ ID NO: 210807 - DNA, 20 bp, Artificial Sequence
  chemically synthesized
cgctaagattgaagttcatt

SEQ ID NO: 210808 - DNA, 20 bp, Artificial Sequence
  chemically synthesized
attgaagttcattgagtgtt

SEQ ID NO: 210809 - DNA, 20 bp, Artificial Sequence
  chemically synthesized
gttcattgagtgttcagtcc

SEQ ID NO: 210810 - DNA, 20 bp, Artificial Sequence
  chemically synthesized
cagtagtttcttttagggct

SEQ ID NO: 210811 - DNA, 20 bp, Artificial Sequence
  chemically synthesized
gtgttcagtccgagccctaa

SEQ ID NO: 210812 - DNA, 20 bp, Artificial Sequence
  chemically synthesized
gcaatcagtagtttctttta

SEQ ID NO: 210813 - DNA, 20 bp, Artificial Sequence
  chemically synthesized
ggcaatcagtagtttctttt

SEQ ID NO: 210814 - DNA, 20 bp, Artificial Sequence
  chemically synthesized
tggcaatcagtagtttcttt

SEQ ID NO: 210815 - DNA, 20 bp, Artificial Sequence
  chemically synthesized
tacatacatgtggcaatcag

SEQ ID NO: 210816 - DNA, 20 bp, Artificial Sequence
  chemically synthesized
ctttacatacatgtggcaat

SEQ ID NO: 210817 - DNA, 20 bp, Artificial Sequence
  chemically synthesized
tgcttgcctttacatacatg

SEQ ID NO: 210818 - DNA, 20 bp, Artificial Sequence
  chemically synthesized
ctgattgccacatgtatgta

SEQ ID NO: 210819 - DNA, 20 bp, Artificial Sequence
  chemically synthesized
tgattgccacatgtatgtaa

SEQ ID NO: 210820 - DNA, 20 bp, Artificial Sequence
  chemically synthesized
tgccacatgtatgtaaaggc

SEQ ID NO: 210821 - DNA, 20 bp, Artificial Sequence
  chemically synthesized
acatgtatgtaaaggcaagc

SEQ ID NO: 210822 - DNA, 20 bp, Artificial Sequence
  chemically synthesized
tatgtaaaggcaagcaagac

SEQ ID NO: 210823 - DNA, 20 bp, Artificial Sequence
  chemically synthesized
atgtaaaggcaagcaagaca

SEQ ID NO: 210824 - DNA, 20 bp, Artificial Sequence
  chemically synthesized
gcaagcaagacaaggtttcc

SEQ ID NO: 210825 - DNA, 20 bp, Artificial Sequence
  chemically synthesized
caagacaaggtttcctggat

SEQ ID NO: 210826 - DNA, 20 bp, Artificial Sequence
  chemically synthesized
gcctaggcctcatctcatcc

SEQ ID NO: 210827 - DNA, 20 bp, Artificial Sequence
  chemically synthesized
agcctaggcctcatctcatc

SEQ ID NO: 210828 - DNA, 20 bp, Artificial Sequence
  chemically synthesized
caaggtttcctggatgagat

SEQ ID NO: 210829 - DNA, 20 bp, Artificial Sequence
  chemically synthesized
aaggtttcctggatgagatg

SEQ ID NO: 210830 - DNA, 20 bp, Artificial Sequence
  chemically synthesized
ttcctggatgagatgaggcc

SEQ ID NO: 210831 - DNA, 20 bp, Artificial Sequence
  chemically synthesized
tcctggatgagatgaggcct

SEQ ID NO: 210832 - DNA, 20 bp, Artificial Sequence
  chemically synthesized
ttcagttcatgtttcagcct

SEQ ID NO: 210833 - DNA, 20 bp, Artificial Sequence
  chemically synthesized
tttcagttcatgtttcagcc

SEQ ID NO: 210834 - DNA, 20 bp, Artificial Sequence
  chemically synthesized
acatttttcagttcatgttt

SEQ ID NO: 210835 - DNA, 20 bp, Artificial Sequence
  chemically synthesized
ctccagaaaaacacattttt

SEQ ID NO: 210836 - DNA, 20 bp, Artificial Sequence
  chemically synthesized
aactgaaaaatgtgtttttc

SEQ ID NO: 210837 - DNA, 20 bp, Artificial Sequence
  chemically synthesized
ctgaaaaatgtgtttttctg

SEQ ID NO: 210838 - DNA, 20 bp, Artificial Sequence
  chemically synthesized
tagcgtattgaatggatctc

SEQ ID NO: 210839 - DNA, 20 bp, Artificial Sequence
  chemically synthesized
cctaaatatagcgtattgaa

SEQ ID NO: 210840 - DNA, 20 bp, Artificial Sequence
  chemically synthesized
tccattcaatacgctatatt

SEQ ID NO: 210841 - DNA, 20 bp, Artificial Sequence
  chemically synthesized
ccattcaatacgctatattt

SEQ ID NO: 210842 - DNA, 20 bp, Artificial Sequence
  chemically synthesized
agcaaagggatacctaaata

SEQ ID NO: 210843 - DNA, 20 bp, Artificial Sequence
  chemically synthesized
atactttgtctttaagcaaa

SEQ ID NO: 210844 - DNA, 20 bp, Artificial Sequence
  chemically synthesized
tttaggtatccctttgctta

SEQ ID NO: 210845 - DNA, 20 bp, Artificial Sequence
  chemically synthesized
aatactttgtctttaagcaa

SEQ ID NO: 210846 - DNA, 20 bp, Artificial Sequence
  chemically synthesized
aaatactttgtctttaagca

SEQ ID NO: 210847 - DNA, 20 bp, Artificial Sequence
  chemically synthesized
tatccctttgcttaaagaca

SEQ ID NO: 210848 - DNA, 20 bp, Artificial Sequence
  chemically synthesized
ataacaaatactttgtcttt

SEQ ID NO: 210849 - DNA, 20 bp, Artificial Sequence
  chemically synthesized
aaagacaaagtatttgttat

SEQ ID NO: 210850 - DNA, 20 bp, Artificial Sequence
  chemically synthesized
ttgttattggaattgatgtg

SEQ ID NO: 210851 - DNA, 20 bp, Artificial Sequence
  chemically synthesized
gaactttacttcaaaaggag

SEQ ID NO: 210852 - DNA, 20 bp, Artificial Sequence
  chemically synthesized
agtaaaatccgctccttttg

SEQ ID NO: 210853 - DNA, 20 bp, Artificial Sequence
  chemically synthesized
acagaactttacttcaaaag

SEQ ID NO: 210854 - DNA, 20 bp, Artificial Sequence
  chemically synthesized
tcacagaactttacttcaaa

SEQ ID NO: 210855 - DNA, 20 bp, Artificial Sequence
  chemically synthesized
ctcacagaactttacttcaa

SEQ ID NO: 210856 - DNA, 20 bp, Artificial Sequence
  chemically synthesized
aatccgctccttttgaagta

SEQ ID NO: 210857 - DNA, 20 bp, Artificial Sequence
  chemically synthesized
cttttgaagtaaagttctgt

SEQ ID NO: 210858 - DNA, 20 bp, Artificial Sequence
  chemically synthesized
taagcccttgtcagaactca

SEQ ID NO: 210859 - DNA, 20 bp, Artificial Sequence
  chemically synthesized
aaagttctgtgagttctgac

SEQ ID NO: 210860 - DNA, 20 bp, Artificial Sequence
  chemically synthesized
aagttctgtgagttctgaca

SEQ ID NO: 210861 - DNA, 20 bp, Artificial Sequence
  chemically synthesized
agttctgtgagttctgacaa

SEQ ID NO: 210862 - DNA, 20 bp, Artificial Sequence
  chemically synthesized
ctacacgactaagcccttgt

SEQ ID NO: 210863 - DNA, 20 bp, Artificial Sequence
  chemically synthesized
tgtgagttctgacaagggct

SEQ ID NO: 210864 - DNA, 20 bp, Artificial Sequence
  chemically synthesized
ctgacaagggcttagtcgtg

SEQ ID NO: 210865 - DNA, 20 bp, Artificial Sequence
  chemically synthesized
gcgatgatggctacacgact

SEQ ID NO: 210866 - DNA, 20 bp, Artificial Sequence
  chemically synthesized
tagtcgtgtagccatcatcg

SEQ ID NO: 210867 - DNA, 20 bp, Artificial Sequence
  chemically synthesized
agtcgtgtagccatcatcgc

SEQ ID NO: 210868 - DNA, 20 bp, Artificial Sequence
  chemically synthesized
ctgtgtcttgcctgcgatga

SEQ ID NO: 210869 - DNA, 20 bp, Artificial Sequence
  chemically synthesized
gtgtagccatcatcgcaggc

SEQ ID NO: 210870 - DNA, 20 bp, Artificial Sequence
  chemically synthesized
ccatcatcgcaggcaagaca

SEQ ID NO: 210871 - DNA, 20 bp, Artificial Sequence
  chemically synthesized
atcgcaggcaagacacagaa

SEQ ID NO: 210872 - DNA, 20 bp, Artificial Sequence
  chemically synthesized
gagcattttggggggtgatg

SEQ ID NO: 210873 - DNA, 20 bp, Artificial Sequence
  chemically synthesized
cagcacaagagcattttggg

SEQ ID NO: 210874 - DNA, 20 bp, Artificial Sequence
  chemically synthesized
acagcacaagagcattttgg

SEQ ID NO: 210875 - DNA, 20 bp, Artificial Sequence
  chemically synthesized
gacagcacaagagcattttg

SEQ ID NO: 210876 - DNA, 20 bp, Artificial Sequence
  chemically synthesized
ggacagcacaagagcatttt

SEQ ID NO: 210877 - DNA, 20 bp, Artificial Sequence
  chemically synthesized
aggacagcacaagagcattt

SEQ ID NO: 210878 - DNA, 20 bp, Artificial Sequence
  chemically synthesized
tgggggtaaggacagcacaa

SEQ ID NO: 210879 - DNA, 20 bp, Artificial Sequence
  chemically synthesized
gatgggggtaaggacagcac

SEQ ID NO: 210880 - DNA, 20 bp, Artificial Sequence
  chemically synthesized
aggtgagatgggggtaagga

SEQ ID NO: 210881 - DNA, 20 bp, Artificial Sequence
  chemically synthesized
gaggaggtgagatgggggta

SEQ ID NO: 210882 - DNA, 20 bp, Artificial Sequence
  chemically synthesized
tgaggaggtgagatgggggt

SEQ ID NO: 210883 - DNA, 20 bp, Artificial Sequence
  chemically synthesized
cttctgaggaggtgagatgg

SEQ ID NO: 210884 - DNA, 20 bp, Artificial Sequence
  chemically synthesized
gcttctgaggaggtgagatg

SEQ ID NO: 210885 - DNA, 20 bp, Artificial Sequence
  chemically synthesized
tgcttctgaggaggtgagat

SEQ ID NO: 210886 - DNA, 20 bp, Artificial Sequence
  chemically synthesized
ttgcttctgaggaggtgaga

SEQ ID NO: 210887 - DNA, 20 bp, Artificial Sequence
  chemically synthesized
ttacccccatctcacctcct

SEQ ID NO: 210888 - DNA, 20 bp, Artificial Sequence
  chemically synthesized
gagattgcttctgaggaggt

SEQ ID NO: 210889 - DNA, 20 bp, Artificial Sequence
  chemically synthesized
cccccatctcacctcctcag

SEQ ID NO: 210890 - DNA, 20 bp, Artificial Sequence
  chemically synthesized
aaaagagattgcttctgagg

SEQ ID NO: 210891 - DNA, 20 bp, Artificial Sequence
  chemically synthesized
taaaagagattgcttctgag

SEQ ID NO: 210892 - DNA, 20 bp, Artificial Sequence
  chemically synthesized
gttaaaagagattgcttctg

SEQ ID NO: 210893 - DNA, 20 bp, Artificial Sequence
  chemically synthesized
ggttaaaagagattgcttct

SEQ ID NO: 210894 - DNA, 20 bp, Artificial Sequence
  chemically synthesized
acagagtagaagggttaaaa

SEQ ID NO: 210895 - DNA, 20 bp, Artificial Sequence
  chemically synthesized
ccacagagtagaagggttaa

SEQ ID NO: 210896 - DNA, 20 bp, Artificial Sequence
  chemically synthesized
caatacaccacagagtagaa

SEQ ID NO: 210897 - DNA, 20 bp, Artificial Sequence
  chemically synthesized
acaatacaccacagagtaga

SEQ ID NO: 210898 - DNA, 20 bp, Artificial Sequence
  chemically synthesized
tacaatacaccacagagtag

SEQ ID NO: 210899 - DNA, 20 bp, Artificial Sequence
  chemically synthesized
cttttaacccttctactctg

SEQ ID NO: 210900 - DNA, 20 bp, Artificial Sequence
  chemically synthesized
cagtacaatacaccacagag

SEQ ID NO: 210901 - DNA, 20 bp, Artificial Sequence
  chemically synthesized
tttcagtacaatacaccaca

SEQ ID NO: 210902 - DNA, 20 bp, Artificial Sequence
  chemically synthesized
attttcagtacaatacacca

SEQ ID NO: 210903 - DNA, 20 bp, Artificial Sequence
  chemically synthesized
tggtgtattgtactgaaaat

SEQ ID NO: 210904 - DNA, 20 bp, Artificial Sequence
  chemically synthesized
aaataaacgtatcttatttt

SEQ ID NO: 210905 - DNA, 20 bp, Artificial Sequence
  chemically synthesized
ttattttataacttttaaat

SEQ ID NO: 210906 - DNA, 20 bp, Artificial Sequence
  chemically synthesized
tattttataacttttaaatt

SEQ ID NO: 210907 - DNA, 20 bp, Artificial Sequence
  chemically synthesized
tacccctgaacctaatttaa

SEQ ID NO: 210908 - DNA, 20 bp, Artificial Sequence
  chemically synthesized
tataacttttaaattaggtt

SEQ ID NO: 210909 - DNA, 20 bp, Artificial Sequence
  chemically synthesized
ataacttttaaattaggttc

SEQ ID NO: 210910 - DNA, 20 bp, Artificial Sequence
  chemically synthesized
taacttttaaattaggttca

SEQ ID NO: 210911 - DNA, 20 bp, Artificial Sequence
  chemically synthesized
aacttttaaattaggttcag

SEQ ID NO: 210912 - DNA, 20 bp, Artificial Sequence
  chemically synthesized
taggttcaggggtacacgtg

SEQ ID NO: 210913 - DNA, 20 bp, Artificial Sequence
  chemically synthesized
aggttcaggggtacacgtgc

SEQ ID NO: 210914 - DNA, 20 bp, Artificial Sequence
  chemically synthesized
acacgtgcaggtttgctata

SEQ ID NO: 210915 - DNA, 20 bp, Artificial Sequence
  chemically synthesized
cacgtgcaggtttgctatac

SEQ ID NO: 210916 - DNA, 20 bp, Artificial Sequence
  chemically synthesized
caaaatgcagttcacctgta

SEQ ID NO: 210917 - DNA, 20 bp, Artificial Sequence
  chemically synthesized
tacaggtgaactgcattttg

SEQ ID NO: 210918 - DNA, 20 bp, Artificial Sequence
  chemically synthesized
caccaaacccccgcaaaatg

SEQ ID NO: 210919 - DNA, 20 bp, Artificial Sequence
  chemically synthesized
acaggtgaactgcattttgc

SEQ ID NO: 210920 - DNA, 20 bp, Artificial Sequence
  chemically synthesized
caggtgaactgcattttgcg

SEQ ID NO: 210921 - DNA, 20 bp, Artificial Sequence
  chemically synthesized
aggtgaactgcattttgcgg

SEQ ID NO: 210922 - DNA, 20 bp, Artificial Sequence
  chemically synthesized
aactgcattttgcgggggtt

SEQ ID NO: 210923 - DNA, 20 bp, Artificial Sequence
  chemically synthesized
ttttgcgggggtttggtgta

SEQ ID NO: 210924 - DNA, 20 bp, Artificial Sequence
  chemically synthesized
gtaaagattattttctcacg

SEQ ID NO: 210925 - DNA, 20 bp, Artificial Sequence
  chemically synthesized
taaagattattttctcacgc

SEQ ID NO: 210926 - DNA, 20 bp, Artificial Sequence
  chemically synthesized
actatgtttagtacctgcgt

SEQ ID NO: 210927 - DNA, 20 bp, Artificial Sequence
  chemically synthesized
tctcacgcaggtactaaaca

SEQ ID NO: 210928 - DNA, 20 bp, Artificial Sequence
  chemically synthesized
taattattgggtactatgtt

SEQ ID NO: 210929 - DNA, 20 bp, Artificial Sequence
  chemically synthesized
gatcaggaaaaataattatt

SEQ ID NO: 210930 - DNA, 20 bp, Artificial Sequence
  chemically synthesized
agatcaggaaaaataattat

SEQ ID NO: 210931 - DNA, 20 bp, Artificial Sequence
  chemically synthesized
acaagtggagggagaagatc

SEQ ID NO: 210932 - DNA, 20 bp, Artificial Sequence
  chemically synthesized
cacaagtggagggagaagat

SEQ ID NO: 210933 - DNA, 20 bp, Artificial Sequence
  chemically synthesized
tggaacacaagtggagggag

SEQ ID NO: 210934 - DNA, 20 bp, Artificial Sequence
  chemically synthesized
gggtggaacacaagtggagg

SEQ ID NO: 210935 - DNA, 20 bp, Artificial Sequence
  chemically synthesized
gagggtggaacacaagtgga

SEQ ID NO: 210936 - DNA, 20 bp, Artificial Sequence
  chemically synthesized
ggagggtggaacacaagtgg

SEQ ID NO: 210937 - DNA, 20 bp, Artificial Sequence
  chemically synthesized
tggagggtggaacacaagtg

SEQ ID NO: 210938 - DNA, 20 bp, Artificial Sequence
  chemically synthesized
actggagggtggaacacaag

SEQ ID NO: 210939 - DNA, 20 bp, Artificial Sequence
  chemically synthesized
cctactggagggtggaacac

SEQ ID NO: 210940 - DNA, 20 bp, Artificial Sequence
  chemically synthesized
tccacttgtgttccaccctc

SEQ ID NO: 210941 - DNA, 20 bp, Artificial Sequence
  chemically synthesized
cactggggcctactggaggg

SEQ ID NO: 210942 - DNA, 20 bp, Artificial Sequence
  chemically synthesized
acttgtgttccaccctccag

SEQ ID NO: 210943 - DNA, 20 bp, Artificial Sequence
  chemically synthesized
cttgtgttccaccctccagt

SEQ ID NO: 210944 - DNA, 20 bp, Artificial Sequence
  chemically synthesized
acacactggggcctactgga

SEQ ID NO: 210945 - DNA, 20 bp, Artificial Sequence
  chemically synthesized
cacacactggggcctactgg

SEQ ID NO: 210946 - DNA, 20 bp, Artificial Sequence
  chemically synthesized
acacacactggggcctactg

SEQ ID NO: 210947 - DNA, 20 bp, Artificial Sequence
  chemically synthesized
taacacacactggggcctac

SEQ ID NO: 210948 - DNA, 20 bp, Artificial Sequence
  chemically synthesized
ttccaccctccagtaggccc

SEQ ID NO: 210949 - DNA, 20 bp, Artificial Sequence
  chemically synthesized
gaggggaataacacacactg

SEQ ID NO: 210950 - DNA, 20 bp, Artificial Sequence
  chemically synthesized
agaggggaataacacacact

SEQ ID NO: 210951 - DNA, 20 bp, Artificial Sequence
  chemically synthesized
aagaggggaataacacacac

SEQ ID NO: 210952 - DNA, 20 bp, Artificial Sequence
  chemically synthesized
gaacatatggacacaaagag

SEQ ID NO: 210953 - DNA, 20 bp, Artificial Sequence
  chemically synthesized
agaacatatggacacaaaga

SEQ ID NO: 210954 - DNA, 20 bp, Artificial Sequence
  chemically synthesized
gagaacatatggacacaaag

SEQ ID NO: 210955 - DNA, 20 bp, Artificial Sequence
  chemically synthesized
tgagaacatatggacacaaa

SEQ ID NO: 210956 - DNA, 20 bp, Artificial Sequence
  chemically synthesized
gatgagaacatatggacaca

SEQ ID NO: 210957 - DNA, 20 bp, Artificial Sequence
  chemically synthesized
agctaaatgatgagaacata

SEQ ID NO: 210958 - DNA, 20 bp, Artificial Sequence
  chemically synthesized
gtccatatgttctcatcatt

SEQ ID NO: 210959 - DNA, 20 bp, Artificial Sequence
  chemically synthesized
ataaatggaagctaaatgat

SEQ ID NO: 210960 - DNA, 20 bp, Artificial Sequence
  chemically synthesized
gtgttctcacttataaatgg

SEQ ID NO: 210961 - DNA, 20 bp, Artificial Sequence
  chemically synthesized
atcatttagcttccatttat

SEQ ID NO: 210962 - DNA, 20 bp, Artificial Sequence
  chemically synthesized
tgcgtgttctcacttataaa

SEQ ID NO: 210963 - DNA, 20 bp, Artificial Sequence
  chemically synthesized
tttagcttccatttataagt

SEQ ID NO: 210964 - DNA, 20 bp, Artificial Sequence
  chemically synthesized
catttataagtgagaacacg

SEQ ID NO: 210965 - DNA, 20 bp, Artificial Sequence
  chemically synthesized
aagtgagaacacgcagtatt

SEQ ID NO: 210966 - DNA, 20 bp, Artificial Sequence
  chemically synthesized
ttagcaaacttatatggaaa

SEQ ID NO: 210967 - DNA, 20 bp, Artificial Sequence
  chemically synthesized
ttggttttctgtttccatat

SEQ ID NO: 210968 - DNA, 20 bp, Artificial Sequence
  chemically synthesized
ttatccttagcaaacttata

SEQ ID NO: 210969 - DNA, 20 bp, Artificial Sequence
  chemically synthesized
tgtttccatataagtttgct

SEQ ID NO: 210970 - DNA, 20 bp, Artificial Sequence
  chemically synthesized
gtttccatataagtttgcta

SEQ ID NO: 210971 - DNA, 20 bp, Artificial Sequence
  chemically synthesized
tataagtttgctaaggataa

SEQ ID NO: 210972 - DNA, 20 bp, Artificial Sequence
  chemically synthesized
gagccagtggccattatcct

SEQ ID NO: 210973 - DNA, 20 bp, Artificial Sequence
  chemically synthesized
ttgctaaggataatggccac

SEQ ID NO: 210974 - DNA, 20 bp, Artificial Sequence
  chemically synthesized
agcgacatggatggagccag

SEQ ID NO: 210975 - DNA, 20 bp, Artificial Sequence
  chemically synthesized
tgcagcgacatggatggagc

SEQ ID NO: 210976 - DNA, 20 bp, Artificial Sequence
  chemically synthesized
cctttgcagcgacatggatg

SEQ ID NO: 210977 - DNA, 20 bp, Artificial Sequence
  chemically synthesized
gtcctttgcagcgacatgga

SEQ ID NO: 210978 - DNA, 20 bp, Artificial Sequence
  chemically synthesized
tcatgtcctttgcagcgaca

SEQ ID NO: 210979 - DNA, 20 bp, Artificial Sequence
  chemically synthesized
gctccatccatgtcgctgca

SEQ ID NO: 210980 - DNA, 20 bp, Artificial Sequence
  chemically synthesized
ctccatccatgtcgctgcaa

SEQ ID NO: 210981 - DNA, 20 bp, Artificial Sequence
  chemically synthesized
gaatgagatcatgtcctttg

SEQ ID NO: 210982 - DNA, 20 bp, Artificial Sequence
  chemically synthesized
atgtggccatgaaaaagaat

SEQ ID NO: 210983 - DNA, 20 bp, Artificial Sequence
  chemically synthesized
catgatctcattctttttca

SEQ ID NO: 210984 - DNA, 20 bp, Artificial Sequence
  chemically synthesized
aatactatgtggccatgaaa

SEQ ID NO: 210985 - DNA, 20 bp, Artificial Sequence
  chemically synthesized
cattctttttcatggccaca

SEQ ID NO: 210986 - DNA, 20 bp, Artificial Sequence
  chemically synthesized
atacaccatggaatactatg

SEQ ID NO: 210987 - DNA, 20 bp, Artificial Sequence
  chemically synthesized
catggccacatagtattcca

SEQ ID NO: 210988 - DNA, 20 bp, Artificial Sequence
  chemically synthesized
aatgtggtacatatacacca

SEQ ID NO: 210989 - DNA, 20 bp, Artificial Sequence
  chemically synthesized
cagactgaataaagaaaatg

SEQ ID NO: 210990 - DNA, 20 bp, Artificial Sequence
  chemically synthesized
tgtaccacattttctttatt

SEQ ID NO: 210991 - DNA, 20 bp, Artificial Sequence
  chemically synthesized
atcaatgaacagactgaata

SEQ ID NO: 210992 - DNA, 20 bp, Artificial Sequence
  chemically synthesized
cttaaatgcctatcaatgaa

SEQ ID NO: 210993 - DNA, 20 bp, Artificial Sequence
  chemically synthesized
ttattcagtctgttcattga

SEQ ID NO: 210994 - DNA, 20 bp, Artificial Sequence
  chemically synthesized
tattcagtctgttcattgat

SEQ ID NO: 210995 - DNA, 20 bp, Artificial Sequence
  chemically synthesized
ctgttcattgataggcattt

SEQ ID NO: 210996 - DNA, 20 bp, Artificial Sequence
  chemically synthesized
tactcacaatagcaaagaca

SEQ ID NO: 210997 - DNA, 20 bp, Artificial Sequence
  chemically synthesized
caacactactcacaatagca

SEQ ID NO: 210998 - DNA, 20 bp, Artificial Sequence
  chemically synthesized
atccatgtctttgctattgt

SEQ ID NO: 210999 - DNA, 20 bp, Artificial Sequence
  chemically synthesized
catgtctttgctattgtgag

SEQ ID NO: 211000 - DNA, 20 bp, Artificial Sequence
  chemically synthesized
cattgcaacactactcacaa

SEQ ID NO: 211001 - DNA, 20 bp, Artificial Sequence
  chemically synthesized
acaacgtgcatatgtcttta

SEQ ID NO: 211002 - DNA, 20 bp, Artificial Sequence
  chemically synthesized
acgtgcatatgtctttatgg

SEQ ID NO: 211003 - DNA, 20 bp, Artificial Sequence
  chemically synthesized
atagaaatcattctaccata

SEQ ID NO: 211004 - DNA, 20 bp, Artificial Sequence
  chemically synthesized
tagaatgatttctattcctc

SEQ ID NO: 211005 - DNA, 20 bp, Artificial Sequence
  chemically synthesized
agaatgatttctattcctct

SEQ ID NO: 211006 - DNA, 20 bp, Artificial Sequence
  chemically synthesized
tgggcatatacccagaggaa

SEQ ID NO: 211007 - DNA, 20 bp, Artificial Sequence
  chemically synthesized
attattgggcatatacccag

SEQ ID NO: 211008 - DNA, 20 bp, Artificial Sequence
  chemically synthesized
cattattgggcatataccca

SEQ ID NO: 211009 - DNA, 20 bp, Artificial Sequence
  chemically synthesized
cccattattgggcatatacc

SEQ ID NO: 211010 - DNA, 20 bp, Artificial Sequence
  chemically synthesized
tctgggtatatgcccaataa

SEQ ID NO: 211011 - DNA, 20 bp, Artificial Sequence
  chemically synthesized
ctgggtatatgcccaataat

SEQ ID NO: 211012 - DNA, 20 bp, Artificial Sequence
  chemically synthesized
gacccagcaatcccattatt

SEQ ID NO: 211013 - DNA, 20 bp, Artificial Sequence
  chemically synthesized
tgacccagcaatcccattat

SEQ ID NO: 211014 - DNA, 20 bp, Artificial Sequence
  chemically synthesized
atgcccaataatgggattgc

SEQ ID NO: 211015 - DNA, 20 bp, Artificial Sequence
  chemically synthesized
tgcccaataatgggattgct

SEQ ID NO: 211016 - DNA, 20 bp, Artificial Sequence
  chemically synthesized
aatgggattgctgggtcaaa

SEQ ID NO: 211017 - DNA, 20 bp, Artificial Sequence
  chemically synthesized
aaaagaattaccatttgacc

SEQ ID NO: 211018 - DNA, 20 bp, Artificial Sequence
  chemically synthesized
tcaaatggtaattcttttgt

SEQ ID NO: 211019 - DNA, 20 bp, Artificial Sequence
  chemically synthesized
atttctcaaataacttacaa

SEQ ID NO: 211020 - DNA, 20 bp, Artificial Sequence
  chemically synthesized
aattcttttgtaagttattt

SEQ ID NO: 211021 - DNA, 20 bp, Artificial Sequence
  chemically synthesized
ttcggtcgttgaaagcagtg

SEQ ID NO: 211022 - DNA, 20 bp, Artificial Sequence
  chemically synthesized
attagttcggtcgttgaaag

SEQ ID NO: 211023 - DNA, 20 bp, Artificial Sequence
  chemically synthesized
taaattagttcggtcgttga

SEQ ID NO: 211024 - DNA, 20 bp, Artificial Sequence
  chemically synthesized
ggtgggaacgtaaattagtt

SEQ ID NO: 211025 - DNA, 20 bp, Artificial Sequence
  chemically synthesized
ctgctggtgggaacgtaaat

SEQ ID NO: 211026 - DNA, 20 bp, Artificial Sequence
  chemically synthesized
gaactaatttacgttcccac

SEQ ID NO: 211027 - DNA, 20 bp, Artificial Sequence
  chemically synthesized
ctaatttacgttcccaccag

SEQ ID NO: 211028 - DNA, 20 bp, Artificial Sequence
  chemically synthesized
acacttaacacactgctggt

SEQ ID NO: 211029 - DNA, 20 bp, Artificial Sequence
  chemically synthesized
aacacttaacacactgctgg

SEQ ID NO: 211030 - DNA, 20 bp, Artificial Sequence
  chemically synthesized
aggaacacttaacacactgc

SEQ ID NO: 211031 - DNA, 20 bp, Artificial Sequence
  chemically synthesized
gttcccaccagcagtgtgtt

SEQ ID NO: 211032 - DNA, 20 bp, Artificial Sequence
  chemically synthesized
gtgtgttaagtgttcctatt

SEQ ID NO: 211033 - DNA, 20 bp, Artificial Sequence
  chemically synthesized
gtgttaagtgttcctattaa

SEQ ID NO: 211034 - DNA, 20 bp, Artificial Sequence
  chemically synthesized
ggatttaataatctcttaat

SEQ ID NO: 211035 - DNA, 20 bp, Artificial Sequence
  chemically synthesized
gggatttaataatctcttaa

SEQ ID NO: 211036 - DNA, 20 bp, Artificial Sequence
  chemically synthesized
aataacttcctagaaggata

SEQ ID NO: 211037 - DNA, 20 bp, Artificial Sequence
  chemically synthesized
ttattaaatccctatccttc

SEQ ID NO: 211038 - DNA, 20 bp, Artificial Sequence
  chemically synthesized
aaataacttcctagaaggat

SEQ ID NO: 211039 - DNA, 20 bp, Artificial Sequence
  chemically synthesized
tattaaatccctatccttct

SEQ ID NO: 211040 - DNA, 20 bp, Artificial Sequence
  chemically synthesized
caaataacttcctagaagga

SEQ ID NO: 211041 - DNA, 20 bp, Artificial Sequence
  chemically synthesized
taaatccctatccttctagg

SEQ ID NO: 211042 - DNA, 20 bp, Artificial Sequence
  chemically synthesized
acttcaaataacttcctaga

SEQ ID NO: 211043 - DNA, 20 bp, Artificial Sequence
  chemically synthesized
tacttcaaataacttcctag

SEQ ID NO: 211044 - DNA, 20 bp, Artificial Sequence
  chemically synthesized
gactacttcaaataacttcc

SEQ ID NO: 211045 - DNA, 20 bp, Artificial Sequence
  chemically synthesized
tccttctaggaagttatttg

SEQ ID NO: 211046 - DNA, 20 bp, Artificial Sequence
  chemically synthesized
ttctaggaagttatttgaag

SEQ ID NO: 211047 - DNA, 20 bp, Artificial Sequence
  chemically synthesized
ggaagttatttgaagtagtc

SEQ ID NO: 211048 - DNA, 20 bp, Artificial Sequence
  chemically synthesized
tgaagtagtcaagaactaca

SEQ ID NO: 211049 - DNA, 20 bp, Artificial Sequence
  chemically synthesized
aagtagtcaagaactacaca

SEQ ID NO: 211050 - DNA, 20 bp, Artificial Sequence
  chemically synthesized
ttgtctcagtgatctctgtg

SEQ ID NO: 211051 - DNA, 20 bp, Artificial Sequence
  chemically synthesized
agaactacacagagatcact

SEQ ID NO: 211052 - DNA, 20 bp, Artificial Sequence
  chemically synthesized
acacagagatcactgagaca

SEQ ID NO: 211053 - DNA, 20 bp, Artificial Sequence
  chemically synthesized
tgttcttcaaatctttgtct

SEQ ID NO: 211054 - DNA, 20 bp, Artificial Sequence
  chemically synthesized
atcactgagacaaagatttg

SEQ ID NO: 211055 - DNA, 20 bp, Artificial Sequence
  chemically synthesized
acaaagatttgaagaacaat

SEQ ID NO: 211056 - DNA, 20 bp, Artificial Sequence
  chemically synthesized
gaagaacaattggaatctta

SEQ ID NO: 211057 - DNA, 20 bp, Artificial Sequence
  chemically synthesized
aacaattggaatcttacagc

SEQ ID NO: 211058 - DNA, 20 bp, Artificial Sequence
  chemically synthesized
ttctgatagtagctagctgt

SEQ ID NO: 211059 - DNA, 20 bp, Artificial Sequence
  chemically synthesized
ttgttatttctgatagtagc

SEQ ID NO: 211060 - DNA, 20 bp, Artificial Sequence
  chemically synthesized
atcttacagctagctactat

SEQ ID NO: 211061 - DNA, 20 bp, Artificial Sequence
  chemically synthesized
cgggttgttatttctgatag

SEQ ID NO: 211062 - DNA, 20 bp, Artificial Sequence
  chemically synthesized
ctacgggttgttatttctga

SEQ ID NO: 211063 - DNA, 20 bp, Artificial Sequence
  chemically synthesized
ctatcagaaataacaacccg

SEQ ID NO: 211064 - DNA, 20 bp, Artificial Sequence
  chemically synthesized
aactacataatatttactac

SEQ ID NO: 211065 - DNA, 20 bp, Artificial Sequence
  chemically synthesized
taactacataatatttacta

SEQ ID NO: 211066 - DNA, 20 bp, Artificial Sequence
  chemically synthesized
aacccgtagtaaatattatg

SEQ ID NO: 211067 - DNA, 20 bp, Artificial Sequence
  chemically synthesized
ctcattaaacataatgtaag

SEQ ID NO: 211068 - DNA, 20 bp, Artificial Sequence
  chemically synthesized
ggactcattaaacataatgt

SEQ ID NO: 211069 - DNA, 20 bp, Artificial Sequence
  chemically synthesized
ctacttacattatgtttaat

SEQ ID NO: 211070 - DNA, 20 bp, Artificial Sequence
  chemically synthesized
atgtttaatgagtcctcatc

SEQ ID NO: 211071 - DNA, 20 bp, Artificial Sequence
  chemically synthesized
ttactcatggtttcttgatg

SEQ ID NO: 211072 - DNA, 20 bp, Artificial Sequence
  chemically synthesized
gttactcatggtttcttgat

SEQ ID NO: 211073 - DNA, 20 bp, Artificial Sequence
  chemically synthesized
agtcctcatcaagaaaccat

SEQ ID NO: 211074 - DNA, 20 bp, Artificial Sequence
  chemically synthesized
tattaactttatgttactca

SEQ ID NO: 211075 - DNA, 20 bp, Artificial Sequence
  chemically synthesized
aagaaaccatgagtaacata

SEQ ID NO: 211076 - DNA, 20 bp, Artificial Sequence
  chemically synthesized
agtaacataaagttaataaa

SEQ ID NO: 211077 - DNA, 20 bp, Artificial Sequence
  chemically synthesized
taacataaagttaataaaca

SEQ ID NO: 211078 - DNA, 20 bp, Artificial Sequence
  chemically synthesized
aataaacagagatgacatga

SEQ ID NO: 211079 - DNA, 20 bp, Artificial Sequence
  chemically synthesized
gatgacatgatagaatctcc

SEQ ID NO: 211080 - DNA, 20 bp, Artificial Sequence
  chemically synthesized
gacatgatagaatctccaag

SEQ ID NO: 211081 - DNA, 20 bp, Artificial Sequence
  chemically synthesized
atctctgattcaacttcttg

SEQ ID NO: 211082 - DNA, 20 bp, Artificial Sequence
  chemically synthesized
taatctctgattcaacttct

SEQ ID NO: 211083 - DNA, 20 bp, Artificial Sequence
  chemically synthesized
gaatctccaagaagttgaat

SEQ ID NO: 211084 - DNA, 20 bp, Artificial Sequence
  chemically synthesized
atctccaagaagttgaatca

SEQ ID NO: 211085 - DNA, 20 bp, Artificial Sequence
  chemically synthesized
tgaatcagagattaccttca

SEQ ID NO: 211086 - DNA, 20 bp, Artificial Sequence
  chemically synthesized
tttgttctggtaaactttga

SEQ ID NO: 211087 - DNA, 20 bp, Artificial Sequence
  chemically synthesized
atttgttctggtaaactttg

SEQ ID NO: 211088 - DNA, 20 bp, Artificial Sequence
  chemically synthesized
agattaccttcaaagtttac

SEQ ID NO: 211089 - DNA, 20 bp, Artificial Sequence
  chemically synthesized
caatttctgttgatttgttc

SEQ ID NO: 211090 - DNA, 20 bp, Artificial Sequence
  chemically synthesized
agtttaccagaacaaatcaa

SEQ ID NO: 211091 - DNA, 20 bp, Artificial Sequence
  chemically synthesized
acaaatcaacagaaattgca

SEQ ID NO: 211092 - DNA, 20 bp, Artificial Sequence
  chemically synthesized
caacagaaattgcatagaat

SEQ ID NO: 211093 - DNA, 20 bp, Artificial Sequence
  chemically synthesized
agaaattgcatagaattaga

SEQ ID NO: 211094 - DNA, 20 bp, Artificial Sequence
  chemically synthesized
tgcatagaattagaaagctc

SEQ ID NO: 211095 - DNA, 20 bp, Artificial Sequence
  chemically synthesized
atagaattagaaagctctag

SEQ ID NO: 211096 - DNA, 20 bp, Artificial Sequence
  chemically synthesized
cccctcctaatggacttcta

SEQ ID NO: 211097 - DNA, 20 bp, Artificial Sequence
  chemically synthesized
ctcccctcctaatggacttc

SEQ ID NO: 211098 - DNA, 20 bp, Artificial Sequence
  chemically synthesized
agaaagctctagaagtccat

SEQ ID NO: 211099 - DNA, 20 bp, Artificial Sequence
  chemically synthesized
gaaagctctagaagtccatt

SEQ ID NO: 211100 - DNA, 20 bp, Artificial Sequence
  chemically synthesized
aagctctagaagtccattag

SEQ ID NO: 211101 - DNA, 20 bp, Artificial Sequence
  chemically synthesized
agctctagaagtccattagg

SEQ ID NO: 211102 - DNA, 20 bp, Artificial Sequence
  chemically synthesized
gctctagaagtccattagga

SEQ ID NO: 211103 - DNA, 20 bp, Artificial Sequence
  chemically synthesized
ctctagaagtccattaggag

SEQ ID NO: 211104 - DNA, 20 bp, Artificial Sequence
  chemically synthesized
tattctaactcccctcctaa

SEQ ID NO: 211105 - DNA, 20 bp, Artificial Sequence
  chemically synthesized
ctagaagtccattaggaggg

SEQ ID NO: 211106 - DNA, 20 bp, Artificial Sequence
  chemically synthesized
aagtccattaggaggggagt

SEQ ID NO: 211107 - DNA, 20 bp, Artificial Sequence
  chemically synthesized
gaggggagttagaatacctt

SEQ ID NO: 211108 - DNA, 20 bp, Artificial Sequence
  chemically synthesized
ggggagttagaataccttca

SEQ ID NO: 211109 - DNA, 20 bp, Artificial Sequence
  chemically synthesized
tcctgtttgtttttctctga

SEQ ID NO: 211110 - DNA, 20 bp, Artificial Sequence
  chemically synthesized
ttcctgtttgtttttctctg

SEQ ID NO: 211111 - DNA, 20 bp, Artificial Sequence
  chemically synthesized
taccttcagagaaaaacaaa

SEQ ID NO: 211112 - DNA, 20 bp, Artificial Sequence
  chemically synthesized
accttcagagaaaaacaaac

SEQ ID NO: 211113 - DNA, 20 bp, Artificial Sequence
  chemically synthesized
cagagaaaaacaaacaggaa

SEQ ID NO: 211114 - DNA, 20 bp, Artificial Sequence
  chemically synthesized
aaagtgaaatttaactatct

SEQ ID NO: 211115 - DNA, 20 bp, Artificial Sequence
  chemically synthesized
aagtgaaatttaactatcta

SEQ ID NO: 211116 - DNA, 20 bp, Artificial Sequence
  chemically synthesized
tttcacacattttccttaga

SEQ ID NO: 211117 - DNA, 20 bp, Artificial Sequence
  chemically synthesized
tgtctttcacacattttcct

SEQ ID NO: 211118 - DNA, 20 bp, Artificial Sequence
  chemically synthesized
tatctaaggaaaatgtgtga

SEQ ID NO: 211119 - DNA, 20 bp, Artificial Sequence
  chemically synthesized
cttcagctttgttagtgaca

SEQ ID NO: 211120 - DNA, 20 bp, Artificial Sequence
  chemically synthesized
ccttcagctttgttagtgac

SEQ ID NO: 211121 - DNA, 20 bp, Artificial Sequence
  chemically synthesized
tccttcagctttgttagtga

SEQ ID NO: 211122 - DNA, 20 bp, Artificial Sequence
  chemically synthesized
ttaaatccctgtcactaaca

SEQ ID NO: 211123 - DNA, 20 bp, Artificial Sequence
  chemically synthesized
cactcttccttcagctttgt

SEQ ID NO: 211124 - DNA, 20 bp, Artificial Sequence
  chemically synthesized
ccctgtcactaacaaagctg

SEQ ID NO: 211125 - DNA, 20 bp, Artificial Sequence
  chemically synthesized
cctgtcactaacaaagctga

SEQ ID NO: 211126 - DNA, 20 bp, Artificial Sequence
  chemically synthesized
gtcactaacaaagctgaagg

SEQ ID NO: 211127 - DNA, 20 bp, Artificial Sequence
  chemically synthesized
cactaacaaagctgaaggaa

SEQ ID NO: 211128 - DNA, 20 bp, Artificial Sequence
  chemically synthesized
atctgaagacactcttcctt

SEQ ID NO: 211129 - DNA, 20 bp, Artificial Sequence
  chemically synthesized
agctgaaggaagagtgtctt

SEQ ID NO: 211130 - DNA, 20 bp, Artificial Sequence
  chemically synthesized
ggaagagtgtcttcagatta

SEQ ID NO: 211131 - DNA, 20 bp, Artificial Sequence
  chemically synthesized
gaagaaacacctgtaatctg

SEQ ID NO: 211132 - DNA, 20 bp, Artificial Sequence
  chemically synthesized
gaagagtgtcttcagattac

SEQ ID NO: 211133 - DNA, 20 bp, Artificial Sequence
  chemically synthesized
ccaggttttcatgtaggtag

SEQ ID NO: 211134 - DNA, 20 bp, Artificial Sequence
  chemically synthesized
ttcccaggttttcatgtagg

SEQ ID NO: 211135 - DNA, 20 bp, Artificial Sequence
  chemically synthesized
catttcccaggttttcatgt

SEQ ID NO: 211136 - DNA, 20 bp, Artificial Sequence
  chemically synthesized
ccatttcccaggttttcatg

SEQ ID NO: 211137 - DNA, 20 bp, Artificial Sequence
  chemically synthesized
cttctacctacatgaaaacc

SEQ ID NO: 211138 - DNA, 20 bp, Artificial Sequence
  chemically synthesized
ttctacctacatgaaaacct

SEQ ID NO: 211139 - DNA, 20 bp, Artificial Sequence
  chemically synthesized
ctacatgaaaacctgggaaa

SEQ ID NO: 211140 - DNA, 20 bp, Artificial Sequence
  chemically synthesized
tacatgaaaacctgggaaat

SEQ ID NO: 211141 - DNA, 20 bp, Artificial Sequence
  chemically synthesized
tcttcacttgcccatttccc

SEQ ID NO: 211142 - DNA, 20 bp, Artificial Sequence
  chemically synthesized
ctcttcacttgcccatttcc

SEQ ID NO: 211143 - DNA, 20 bp, Artificial Sequence
  chemically synthesized
tgaaaacctgggaaatgggc

SEQ ID NO: 211144 - DNA, 20 bp, Artificial Sequence
  chemically synthesized
acctgggaaatgggcaagtg

SEQ ID NO: 211145 - DNA, 20 bp, Artificial Sequence
  chemically synthesized
ctgggaaatgggcaagtgaa

SEQ ID NO: 211146 - DNA, 20 bp, Artificial Sequence
  chemically synthesized
aaatgggcaagtgaagagca

SEQ ID NO: 211147 - DNA, 20 bp, Artificial Sequence
  chemically synthesized
agagcacagatttatctctg

SEQ ID NO: 211148 - DNA, 20 bp, Artificial Sequence
  chemically synthesized
cacagatttatctctgaaga

SEQ ID NO: 211149 - DNA, 20 bp, Artificial Sequence
  chemically synthesized
gtgggagggttctttcttca

SEQ ID NO: 211150 - DNA, 20 bp, Artificial Sequence
  chemically synthesized
aggtgggagggttctttctt

SEQ ID NO: 211151 - DNA, 20 bp, Artificial Sequence
  chemically synthesized
ctagtagctgtaaggtggga

SEQ ID NO: 211152 - DNA, 20 bp, Artificial Sequence
  chemically synthesized
tctagtagctgtaaggtggg

SEQ ID NO: 211153 - DNA, 20 bp, Artificial Sequence
  chemically synthesized
ctctagtagctgtaaggtgg

SEQ ID NO: 211154 - DNA, 20 bp, Artificial Sequence
  chemically synthesized
gaaagaaccctcccacctta

SEQ ID NO: 211155 - DNA, 20 bp, Artificial Sequence
  chemically synthesized
cactctagtagctgtaaggt

SEQ ID NO: 211156 - DNA, 20 bp, Artificial Sequence
  chemically synthesized
ccactctagtagctgtaagg

SEQ ID NO: 211157 - DNA, 20 bp, Artificial Sequence
  chemically synthesized
tgaccactctagtagctgta

SEQ ID NO: 211158 - DNA, 20 bp, Artificial Sequence
  chemically synthesized
ttgaccactctagtagctgt

SEQ ID NO: 211159 - DNA, 20 bp, Artificial Sequence
  chemically synthesized
ccctcccaccttacagctac

SEQ ID NO: 211160 - DNA, 20 bp, Artificial Sequence
  chemically synthesized
ctcccaccttacagctacta

SEQ ID NO: 211161 - DNA, 20 bp, Artificial Sequence
  chemically synthesized
ccaccttacagctactagag

SEQ ID NO: 211162 - DNA, 20 bp, Artificial Sequence
  chemically synthesized
aagtgggttgaccactctag

SEQ ID NO: 211163 - DNA, 20 bp, Artificial Sequence
  chemically synthesized
taaaagtgggttgaccactc

SEQ ID NO: 211164 - DNA, 20 bp, Artificial Sequence
  chemically synthesized
agagtggtcaacccactttt

SEQ ID NO: 211165 - DNA, 20 bp, Artificial Sequence
  chemically synthesized
gagtggtcaacccactttta

SEQ ID NO: 211166 - DNA, 20 bp, Artificial Sequence
  chemically synthesized
ataatccccaccttaaaagt

SEQ ID NO: 211167 - DNA, 20 bp, Artificial Sequence
  chemically synthesized
aataatccccaccttaaaag

SEQ ID NO: 211168 - DNA, 20 bp, Artificial Sequence
  chemically synthesized
tggtcaacccacttttaagg

SEQ ID NO: 211169 - DNA, 20 bp, Artificial Sequence
  chemically synthesized
ggtcaacccacttttaaggt

SEQ ID NO: 211170 - DNA, 20 bp, Artificial Sequence
  chemically synthesized
acgaataatccccaccttaa

SEQ ID NO: 211171 - DNA, 20 bp, Artificial Sequence
  chemically synthesized
gtcaacccacttttaaggtg

SEQ ID NO: 211172 - DNA, 20 bp, Artificial Sequence
  chemically synthesized
ttaaggtggggattattcgt

SEQ ID NO: 211173 - DNA, 20 bp, Artificial Sequence
  chemically synthesized
ttattcgtcagcgttatcca

SEQ ID NO: 211174 - DNA, 20 bp, Artificial Sequence
  chemically synthesized
gtcagcgttatccacagcct

SEQ ID NO: 211175 - DNA, 20 bp, Artificial Sequence
  chemically synthesized
tcagcgttatccacagcctc

SEQ ID NO: 211176 - DNA, 20 bp, Artificial Sequence
  chemically synthesized
ggagtatttccctgaggctg

SEQ ID NO: 211177 - DNA, 20 bp, Artificial Sequence
  chemically synthesized
cagcgttatccacagcctca

SEQ ID NO: 211178 - DNA, 20 bp, Artificial Sequence
  chemically synthesized
ctttgaggagtatttccctg

SEQ ID NO: 211179 - DNA, 20 bp, Artificial Sequence
  chemically synthesized
tctttgaggagtatttccct

SEQ ID NO: 211180 - DNA, 20 bp, Artificial Sequence
  chemically synthesized
cctcagggaaatactcctca

SEQ ID NO: 211181 - DNA, 20 bp, Artificial Sequence
  chemically synthesized
aggaatgagatgtctttgag

SEQ ID NO: 211182 - DNA, 20 bp, Artificial Sequence
  chemically synthesized
caaggaatgagatgtctttg

SEQ ID NO: 211183 - DNA, 20 bp, Artificial Sequence
  chemically synthesized
gcaaggaatgagatgtcttt

SEQ ID NO: 211184 - DNA, 20 bp, Artificial Sequence
  chemically synthesized
gaagcaatggagcaaggaat

SEQ ID NO: 211185 - DNA, 20 bp, Artificial Sequence
  chemically synthesized
tgatcagaagcaatggagca

SEQ ID NO: 211186 - DNA, 20 bp, Artificial Sequence
  chemically synthesized
atgatcagaagcaatggagc

SEQ ID NO: 211187 - DNA, 20 bp, Artificial Sequence
  chemically synthesized
cttcatgatcagaagcaatg

SEQ ID NO: 211188 - DNA, 20 bp, Artificial Sequence
  chemically synthesized
gacttcatgatcagaagcaa

SEQ ID NO: 211189 - DNA, 20 bp, Artificial Sequence
  chemically synthesized
gaaacggacttcatgatcag

SEQ ID NO: 211190 - DNA, 20 bp, Artificial Sequence
  chemically synthesized
ctccattgcttctgatcatg

SEQ ID NO: 211191 - DNA, 20 bp, Artificial Sequence
  chemically synthesized
catgaaacggacttcatgat

SEQ ID NO: 211192 - DNA, 20 bp, Artificial Sequence
  chemically synthesized
agagagcgatgatcatgaaa

SEQ ID NO: 211193 - DNA, 20 bp, Artificial Sequence
  chemically synthesized
ttagaagttttagaattaga

SEQ ID NO: 211194 - DNA, 20 bp, Artificial Sequence
  chemically synthesized
ggttagaagttttagaatta

SEQ ID NO: 211195 - DNA, 20 bp, Artificial Sequence
  chemically synthesized
atggttagaagttttagaat

SEQ ID NO: 211196 - DNA, 20 bp, Artificial Sequence
  chemically synthesized
tatctcatggttagaagttt

SEQ ID NO: 211197 - DNA, 20 bp, Artificial Sequence
  chemically synthesized
gaaacttatctcatggttag

SEQ ID NO: 211198 - DNA, 20 bp, Artificial Sequence
  chemically synthesized
attctaaaacttctaaccat

SEQ ID NO: 211199 - DNA, 20 bp, Artificial Sequence
  chemically synthesized
ttagaaacttatctcatggt

SEQ ID NO: 211200 - DNA, 20 bp, Artificial Sequence
  chemically synthesized
aaaacttctaaccatgagat

SEQ ID NO: 211201 - DNA, 20 bp, Artificial Sequence
  chemically synthesized
taacttagaaacttatctca

SEQ ID NO: 211202 - DNA, 20 bp, Artificial Sequence
  chemically synthesized
taaccatgagataagtttct

SEQ ID NO: 211203 - DNA, 20 bp, Artificial Sequence
  chemically synthesized
ctgagtgtgtgagggtaact

SEQ ID NO: 211204 - DNA, 20 bp, Artificial Sequence
  chemically synthesized
ctggatacctgagtgtgtga

SEQ ID NO: 211205 - DNA, 20 bp, Artificial Sequence
  chemically synthesized
actggatacctgagtgtgtg

SEQ ID NO: 211206 - DNA, 20 bp, Artificial Sequence
  chemically synthesized
ctaagttaccctcacacact

SEQ ID NO: 211207 - DNA, 20 bp, Artificial Sequence
  chemically synthesized
aactggatacctgagtgtgt

SEQ ID NO: 211208 - DNA, 20 bp, Artificial Sequence
  chemically synthesized
taagttaccctcacacactc

SEQ ID NO: 211209 - DNA, 20 bp, Artificial Sequence
  chemically synthesized
ccctcacacactcaggtatc

SEQ ID NO: 211210 - DNA, 20 bp, Artificial Sequence
  chemically synthesized
ttttcagaaactggatacct

SEQ ID NO: 211211 - DNA, 20 bp, Artificial Sequence
  chemically synthesized
tgtactaccttttcagaaac

SEQ ID NO: 211212 - DNA, 20 bp, Artificial Sequence
  chemically synthesized
tcaggtatccagtttctgaa

SEQ ID NO: 211213 - DNA, 20 bp, Artificial Sequence
  chemically synthesized
caggtatccagtttctgaaa

SEQ ID NO: 211214 - DNA, 20 bp, Artificial Sequence
  chemically synthesized
gtatccagtttctgaaaagg

SEQ ID NO: 211215 - DNA, 20 bp, Artificial Sequence
  chemically synthesized
cattacttgtactacctttt

SEQ ID NO: 211216 - DNA, 20 bp, Artificial Sequence
  chemically synthesized
agtttctgaaaaggtagtac

SEQ ID NO: 211217 - DNA, 20 bp, Artificial Sequence
  chemically synthesized
agtacaagtaatgtgaatga

SEQ ID NO: 211218 - DNA, 20 bp, Artificial Sequence
  chemically synthesized
tacaagtaatgtgaatgaaa

SEQ ID NO: 211219 - DNA, 20 bp, Artificial Sequence
  chemically synthesized
atgtgaatgaaagagtattc

SEQ ID NO: 211220 - DNA, 20 bp, Artificial Sequence
  chemically synthesized
aatgaaagagtattccggtt

SEQ ID NO: 211221 - DNA, 20 bp, Artificial Sequence
  chemically synthesized
attcagaatcatatccaaac

SEQ ID NO: 211222 - DNA, 20 bp, Artificial Sequence
  chemically synthesized
ttggatatgattctgaattt

SEQ ID NO: 211223 - DNA, 20 bp, Artificial Sequence
  chemically synthesized
tggatatgattctgaatttt

SEQ ID NO: 211224 - DNA, 20 bp, Artificial Sequence
  chemically synthesized
gaaaaaaaaaacccaaaatt

SEQ ID NO: 211225 - DNA, 20 bp, Artificial Sequence
  chemically synthesized
tttgggttttttttttctgc

SEQ ID NO: 211226 - DNA, 20 bp, Artificial Sequence
  chemically synthesized
ttgggttttttttttctgct

SEQ ID NO: 211227 - DNA, 20 bp, Artificial Sequence
  chemically synthesized
cctagattggattgtcccag

SEQ ID NO: 211228 - DNA, 20 bp, Artificial Sequence
  chemically synthesized
tcacctagattggattgtcc

SEQ ID NO: 211229 - DNA, 20 bp, Artificial Sequence
  chemically synthesized
tctgctgggacaatccaatc

SEQ ID NO: 211230 - DNA, 20 bp, Artificial Sequence
  chemically synthesized
ctgctgggacaatccaatct

SEQ ID NO: 211231 - DNA, 20 bp, Artificial Sequence
  chemically synthesized
ttgggttggctcacctagat

SEQ ID NO: 211232 - DNA, 20 bp, Artificial Sequence
  chemically synthesized
tgggacaatccaatctaggt

SEQ ID NO: 211233 - DNA, 20 bp, Artificial Sequence
  chemically synthesized
cagcattgggttggctcacc

SEQ ID NO: 211234 - DNA, 20 bp, Artificial Sequence
  chemically synthesized
tctgtccctcagcattgggt

SEQ ID NO: 211235 - DNA, 20 bp, Artificial Sequence
  chemically synthesized
aggtgagccaacccaatgct

SEQ ID NO: 211236 - DNA, 20 bp, Artificial Sequence
  chemically synthesized
ggtgagccaacccaatgctg

SEQ ID NO: 211237 - DNA, 20 bp, Artificial Sequence
  chemically synthesized
agggtctgtccctcagcatt

SEQ ID NO: 211238 - DNA, 20 bp, Artificial Sequence
  chemically synthesized
gtgagccaacccaatgctga

SEQ ID NO: 211239 - DNA, 20 bp, Artificial Sequence
  chemically synthesized
cagggtctgtccctcagcat

SEQ ID NO: 211240 - DNA, 20 bp, Artificial Sequence
  chemically synthesized
gccaacccaatgctgaggga

SEQ ID NO: 211241 - DNA, 20 bp, Artificial Sequence
  chemically synthesized
tttaaccagggtctgtccct

SEQ ID NO: 211242 - DNA, 20 bp, Artificial Sequence
  chemically synthesized
caatgctgagggacagaccc

SEQ ID NO: 211243 - DNA, 20 bp, Artificial Sequence
  chemically synthesized
tgagggacagaccctggtta

SEQ ID NO: 211244 - DNA, 20 bp, Artificial Sequence
  chemically synthesized
gagggacagaccctggttaa

SEQ ID NO: 211245 - DNA, 20 bp, Artificial Sequence
  chemically synthesized
tgaagcatctcctttaacca

SEQ ID NO: 211246 - DNA, 20 bp, Artificial Sequence
  chemically synthesized
ttgaagcatctcctttaacc

SEQ ID NO: 211247 - DNA, 20 bp, Artificial Sequence
  chemically synthesized
gggacagaccctggttaaag

SEQ ID NO: 211248 - DNA, 20 bp, Artificial Sequence
  chemically synthesized
gttgaagcatctcctttaac

SEQ ID NO: 211249 - DNA, 20 bp, Artificial Sequence
  chemically synthesized
ttaaaggagatgcttcaaca

SEQ ID NO: 211250 - DNA, 20 bp, Artificial Sequence
  chemically synthesized
taaaggagatgcttcaacac

SEQ ID NO: 211251 - DNA, 20 bp, Artificial Sequence
  chemically synthesized
tcataggatggcctgtgttg

SEQ ID NO: 211252 - DNA, 20 bp, Artificial Sequence
  chemically synthesized
ttcaacacaggccatcctat

SEQ ID NO: 211253 - DNA, 20 bp, Artificial Sequence
  chemically synthesized
tcaacacaggccatcctatg

SEQ ID NO: 211254 - DNA, 20 bp, Artificial Sequence
  chemically synthesized
tcagacagcacctcatagga

SEQ ID NO: 211255 - DNA, 20 bp, Artificial Sequence
  chemically synthesized
cctctcagacagcacctcat

SEQ ID NO: 211256 - DNA, 20 bp, Artificial Sequence
  chemically synthesized
gcctctcagacagcacctca

SEQ ID NO: 211257 - DNA, 20 bp, Artificial Sequence
  chemically synthesized
catcctatgaggtgctgtct

SEQ ID NO: 211258 - DNA, 20 bp, Artificial Sequence
  chemically synthesized
tcctatgaggtgctgtctga

SEQ ID NO: 211259 - DNA, 20 bp, Artificial Sequence
  chemically synthesized
cctatgaggtgctgtctgag

SEQ ID NO: 211260 - DNA, 20 bp, Artificial Sequence
  chemically synthesized
aggttgactggcctctcaga

SEQ ID NO: 211261 - DNA, 20 bp, Artificial Sequence
  chemically synthesized
tgaggtgctgtctgagaggc

SEQ ID NO: 211262 - DNA, 20 bp, Artificial Sequence
  chemically synthesized
agagaggttgactggcctct

SEQ ID NO: 211263 - DNA, 20 bp, Artificial Sequence
  chemically synthesized
gagctttcagagaggttgac

SEQ ID NO: 211264 - DNA, 20 bp, Artificial Sequence
  chemically synthesized
aggccagtcaacctctctga

SEQ ID NO: 211265 - DNA, 20 bp, Artificial Sequence
  chemically synthesized
catgagcagagctttcagag

SEQ ID NO: 211266 - DNA, 20 bp, Artificial Sequence
  chemically synthesized
acatgagcagagctttcaga

SEQ ID NO: 211267 - DNA, 20 bp, Artificial Sequence
  chemically synthesized
acacatgagcagagctttca

SEQ ID NO: 211268 - DNA, 20 bp, Artificial Sequence
  chemically synthesized
aaacacatgagcagagcttt

SEQ ID NO: 211269 - DNA, 20 bp, Artificial Sequence
  chemically synthesized
gaaaattaaacacatgagca

SEQ ID NO: 211270 - DNA, 20 bp, Artificial Sequence
  chemically synthesized
ctgaaaattaaacacatgag

SEQ ID NO: 211271 - DNA, 20 bp, Artificial Sequence
  chemically synthesized
ttgctgaaaattaaacacat

SEQ ID NO: 211272 - DNA, 20 bp, Artificial Sequence
  chemically synthesized
ctgctcatgtgtttaatttt

SEQ ID NO: 211273 - DNA, 20 bp, Artificial Sequence
  chemically synthesized
atgtgtttaattttcagcaa

SEQ ID NO: 211274 - DNA, 20 bp, Artificial Sequence
  chemically synthesized
ttttcagcaacggatattgc

SEQ ID NO: 211275 - DNA, 20 bp, Artificial Sequence
  chemically synthesized
ttcagcaacggatattgcaa

SEQ ID NO: 211276 - DNA, 20 bp, Artificial Sequence
  chemically synthesized
caacggatattgcaagagaa

SEQ ID NO: 211277 - DNA, 20 bp, Artificial Sequence
  chemically synthesized
ctaatcataggaaaatgaca

SEQ ID NO: 211278 - DNA, 20 bp, Artificial Sequence
  chemically synthesized
gtctaatcataggaaaatga

SEQ ID NO: 211279 - DNA, 20 bp, Artificial Sequence
  chemically synthesized
ctctgtcattttcctatgat

SEQ ID NO: 211280 - DNA, 20 bp, Artificial Sequence
  chemically synthesized
tttattagttgtctaatcat

SEQ ID NO: 211281 - DNA, 20 bp, Artificial Sequence
  chemically synthesized
atttattagttgtctaatca

SEQ ID NO: 211282 - DNA, 20 bp, Artificial Sequence
  chemically synthesized
tgattagacaactaataaat

SEQ ID NO: 211283 - DNA, 20 bp, Artificial Sequence
  chemically synthesized
gccagagctggcttatttat

SEQ ID NO: 211284 - DNA, 20 bp, Artificial Sequence
  chemically synthesized
tagacaactaataaataagc

SEQ ID NO: 211285 - DNA, 20 bp, Artificial Sequence
  chemically synthesized
actaataaataagccagctc

SEQ ID NO: 211286 - DNA, 20 bp, Artificial Sequence
  chemically synthesized
tgctacatttaagccagagc

SEQ ID NO: 211287 - DNA, 20 bp, Artificial Sequence
  chemically synthesized
aaagtgctacatttaagcca

SEQ ID NO: 211288 - DNA, 20 bp, Artificial Sequence
  chemically synthesized
taaaagtgctacatttaagc

SEQ ID NO: 211289 - DNA, 20 bp, Artificial Sequence
  chemically synthesized
agccagctctggcttaaatg

SEQ ID NO: 211290 - DNA, 20 bp, Artificial Sequence
  chemically synthesized
gagttaaaagtgctacattt

SEQ ID NO: 211291 - DNA, 20 bp, Artificial Sequence
  chemically synthesized
taaatgtagcacttttaact

SEQ ID NO: 211292 - DNA, 20 bp, Artificial Sequence
  chemically synthesized
aaatgtagcacttttaactc

SEQ ID NO: 211293 - DNA, 20 bp, Artificial Sequence
  chemically synthesized
atgggcatggcctgagttaa

SEQ ID NO: 211294 - DNA, 20 bp, Artificial Sequence
  chemically synthesized
taaaaaaatgggcatggcct

SEQ ID NO: 211295 - DNA, 20 bp, Artificial Sequence
  chemically synthesized
gtggcataaaaaaatgggca

SEQ ID NO: 211296 - DNA, 20 bp, Artificial Sequence
  chemically synthesized
gatgtgtggcataaaaaaat

SEQ ID NO: 211297 - DNA, 20 bp, Artificial Sequence
  chemically synthesized
agatgtgtggcataaaaaaa

SEQ ID NO: 211298 - DNA, 20 bp, Artificial Sequence
  chemically synthesized
gctgtgcctgagaagatgtg

SEQ ID NO: 211299 - DNA, 20 bp, Artificial Sequence
  chemically synthesized
ttttatgccacacatcttct

SEQ ID NO: 211300 - DNA, 20 bp, Artificial Sequence
  chemically synthesized
tttatgccacacatcttctc

SEQ ID NO: 211301 - DNA, 20 bp, Artificial Sequence
  chemically synthesized
gtgttcccgctgtgcctgag

SEQ ID NO: 211302 - DNA, 20 bp, Artificial Sequence
  chemically synthesized
gccacacatcttctcaggca

SEQ ID NO: 211303 - DNA, 20 bp, Artificial Sequence
  chemically synthesized
agtgtgttcccgctgtgcct

SEQ ID NO: 211304 - DNA, 20 bp, Artificial Sequence
  chemically synthesized
acacatcttctcaggcacag

SEQ ID NO: 211305 - DNA, 20 bp, Artificial Sequence
  chemically synthesized
cacatcttctcaggcacagc

SEQ ID NO: 211306 - DNA, 20 bp, Artificial Sequence
  chemically synthesized
gcacagcgggaacacacttg

SEQ ID NO: 211307 - DNA, 20 bp, Artificial Sequence
  chemically synthesized
gcgggaacacacttgcggcg

SEQ ID NO: 211308 - DNA, 20 bp, Artificial Sequence
  chemically synthesized
atctgctgctgctacgccgc

SEQ ID NO: 211309 - DNA, 20 bp, Artificial Sequence
  chemically synthesized
ggaacacacttgcggcgtag

SEQ ID NO: 211310 - DNA, 20 bp, Artificial Sequence
  chemically synthesized
acacacttgcggcgtagcag

SEQ ID NO: 211311 - DNA, 20 bp, Artificial Sequence
  chemically synthesized
cacttgcggcgtagcagcag

SEQ ID NO: 211312 - DNA, 20 bp, Artificial Sequence
  chemically synthesized
gcagcagatgatttttttca

SEQ ID NO: 211313 - DNA, 20 bp, Artificial Sequence
  chemically synthesized
gcagatgatttttttcaaag

SEQ ID NO: 211314 - DNA, 20 bp, Artificial Sequence
  chemically synthesized
agatgatttttttcaaagaa

SEQ ID NO: 211315 - DNA, 20 bp, Artificial Sequence
  chemically synthesized
tgatttttttcaaagaagag

SEQ ID NO: 211316 - DNA, 20 bp, Artificial Sequence
  chemically synthesized
atttttttcaaagaagagaa

SEQ ID NO: 211317 - DNA, 20 bp, Artificial Sequence
  chemically synthesized
tttttcaaagaagagaagag

SEQ ID NO: 211318 - DNA, 20 bp, Artificial Sequence
  chemically synthesized
aagagaagagaagacacctt

SEQ ID NO: 211319 - DNA, 20 bp, Artificial Sequence
  chemically synthesized
tatcagcactgttttgccaa

SEQ ID NO: 211320 - DNA, 20 bp, Artificial Sequence
  chemically synthesized
ttatcagcactgttttgcca

SEQ ID NO: 211321 - DNA, 20 bp, Artificial Sequence
  chemically synthesized
agaagacacctttggcaaaa

SEQ ID NO: 211322 - DNA, 20 bp, Artificial Sequence
  chemically synthesized
gctcctgactattagtttat

SEQ ID NO: 211323 - DNA, 20 bp, Artificial Sequence
  chemically synthesized
aaacagtgctgataaactaa

SEQ ID NO: 211324 - DNA, 20 bp, Artificial Sequence
  chemically synthesized
agtgctgataaactaatagt

SEQ ID NO: 211325 - DNA, 20 bp, Artificial Sequence
  chemically synthesized
gtgctgataaactaatagtc

SEQ ID NO: 211326 - DNA, 20 bp, Artificial Sequence
  chemically synthesized
ctgtcaaagctcctgactat

SEQ ID NO: 211327 - DNA, 20 bp, Artificial Sequence
  chemically synthesized
gctgataaactaatagtcag

SEQ ID NO: 211328 - DNA, 20 bp, Artificial Sequence
  chemically synthesized
ctaatagtcaggagctttga

SEQ ID NO: 211329 - DNA, 20 bp, Artificial Sequence
  chemically synthesized
ttttctttaacattctgtca

SEQ ID NO: 211330 - DNA, 20 bp, Artificial Sequence
  chemically synthesized
ggagctttgacagaatgtta

SEQ ID NO: 211331 - DNA, 20 bp, Artificial Sequence
  chemically synthesized
tttgacagaatgttaaagaa

SEQ ID NO: 211332 - DNA, 20 bp, Artificial Sequence
  chemically synthesized
tgaaaaaaatcgaagaaaat

SEQ ID NO: 211333 - DNA, 20 bp, Artificial Sequence
  chemically synthesized
tgttgtcctgaaaaaaatcg

SEQ ID NO: 211334 - DNA, 20 bp, Artificial Sequence
  chemically synthesized
tgattttcttcgattttttt

SEQ ID NO: 211335 - DNA, 20 bp, Artificial Sequence
  chemically synthesized
gattttcttcgatttttttc

SEQ ID NO: 211336 - DNA, 20 bp, Artificial Sequence
  chemically synthesized
aattcaattcaaggataaca

SEQ ID NO: 211337 - DNA, 20 bp, Artificial Sequence
  chemically synthesized
agaattcaattcaaggataa

SEQ ID NO: 211338 - DNA, 20 bp, Artificial Sequence
  chemically synthesized
tggaataagaattcaattca

SEQ ID NO: 211339 - DNA, 20 bp, Artificial Sequence
  chemically synthesized
gtggaataagaattcaattc

SEQ ID NO: 211340 - DNA, 20 bp, Artificial Sequence
  chemically synthesized
tggattttgatgtgtggaat

SEQ ID NO: 211341 - DNA, 20 bp, Artificial Sequence
  chemically synthesized
tagatatggattttgatgtg

SEQ ID NO: 211342 - DNA, 20 bp, Artificial Sequence
  chemically synthesized
acacatcaaaatccatatct

SEQ ID NO: 211343 - DNA, 20 bp, Artificial Sequence
  chemically synthesized
tctctggtgtttcttagata

SEQ ID NO: 211344 - DNA, 20 bp, Artificial Sequence
  chemically synthesized
aagaattctctggtgtttct

SEQ ID NO: 211345 - DNA, 20 bp, Artificial Sequence
  chemically synthesized
aatccatatctaagaaacac

SEQ ID NO: 211346 - DNA, 20 bp, Artificial Sequence
  chemically synthesized
tccatatctaagaaacacca

SEQ ID NO: 211347 - DNA, 20 bp, Artificial Sequence
  chemically synthesized
atgtatctggaagaattctc

SEQ ID NO: 211348 - DNA, 20 bp, Artificial Sequence
  chemically synthesized
gaaacaccagagaattcttc

SEQ ID NO: 211349 - DNA, 20 bp, Artificial Sequence
  chemically synthesized
ataagtttctatgtatctgg

SEQ ID NO: 211350 - DNA, 20 bp, Artificial Sequence
  chemically synthesized
agagaattcttccagataca

SEQ ID NO: 211351 - DNA, 20 bp, Artificial Sequence
  chemically synthesized
tatataagtttctatgtatc

SEQ ID NO: 211352 - DNA, 20 bp, Artificial Sequence
  chemically synthesized
tatcactgaaaaaaatatat

SEQ ID NO: 211353 - DNA, 20 bp, Artificial Sequence
  chemically synthesized
agaaacttatatattttttt

SEQ ID NO: 211354 - DNA, 20 bp, Artificial Sequence
  chemically synthesized
tatatatttttttcagtgat

SEQ ID NO: 211355 - DNA, 20 bp, Artificial Sequence
  chemically synthesized
atatttttttcagtgataag

SEQ ID NO: 211356 - DNA, 20 bp, Artificial Sequence
  chemically synthesized
gataagcagtttgattataa

SEQ ID NO: 211357 - DNA, 20 bp, Artificial Sequence
  chemically synthesized
ataaaacatgactgataaaa

SEQ ID NO: 211358 - DNA, 20 bp, Artificial Sequence
  chemically synthesized
tctaagccatgcttttttat

SEQ ID NO: 211359 - DNA, 20 bp, Artificial Sequence
  chemically synthesized
acatgactgataaaaaagca

SEQ ID NO: 211360 - DNA, 20 bp, Artificial Sequence
  chemically synthesized
actgataaaaaagcatggct

SEQ ID NO: 211361 - DNA, 20 bp, Artificial Sequence
  chemically synthesized
aaaagcatggcttagatgtt

SEQ ID NO: 211362 - DNA, 20 bp, Artificial Sequence
  chemically synthesized
acaatatttactcaacatct

SEQ ID NO: 211363 - DNA, 20 bp, Artificial Sequence
  chemically synthesized
tagatgttgagtaaatattg

SEQ ID NO: 211364 - DNA, 20 bp, Artificial Sequence
  chemically synthesized
gatgttgagctttcaggatt

SEQ ID NO: 211365 - DNA, 20 bp, Artificial Sequence
  chemically synthesized
atattgtagctaaatcctga

SEQ ID NO: 211366 - DNA, 20 bp, Artificial Sequence
  chemically synthesized
tttattgatgttgagctttc

SEQ ID NO: 211367 - DNA, 20 bp, Artificial Sequence
  chemically synthesized
atttattgatgttgagcttt

SEQ ID NO: 211368 - DNA, 20 bp, Artificial Sequence
  chemically synthesized
ttccattatttattgatgtt

SEQ ID NO: 211369 - DNA, 20 bp, Artificial Sequence
  chemically synthesized
agctcaacatcaataaataa

SEQ ID NO: 211370 - DNA, 20 bp, Artificial Sequence
  chemically synthesized
tcaacatcaataaataatgg

SEQ ID NO: 211371 - DNA, 20 bp, Artificial Sequence
  chemically synthesized
tcaataaataatggaagctt

SEQ ID NO: 211372 - DNA, 20 bp, Artificial Sequence
  chemically synthesized
atccagagcattggtttcta

SEQ ID NO: 211373 - DNA, 20 bp, Artificial Sequence
  chemically synthesized
agctttagaaaccaatgctc

SEQ ID NO: 211374 - DNA, 20 bp, Artificial Sequence
  chemically synthesized
agggatgttatccagagcat

SEQ ID NO: 211375 - DNA, 20 bp, Artificial Sequence
  chemically synthesized
taaaatagggatgttatcca

SEQ ID NO: 211376 - DNA, 20 bp, Artificial Sequence
  chemically synthesized
tctaaaatagggatgttatc

SEQ ID NO: 211377 - DNA, 20 bp, Artificial Sequence
  chemically synthesized
tctggataacatccctattt

SEQ ID NO: 211378 - DNA, 20 bp, Artificial Sequence
  chemically synthesized
cctttgagtattctaaaata

SEQ ID NO: 211379 - DNA, 20 bp, Artificial Sequence
  chemically synthesized
ccctttgagtattctaaaat

SEQ ID NO: 211380 - DNA, 20 bp, Artificial Sequence
  chemically synthesized
gccctttgagtattctaaaa

SEQ ID NO: 211381 - DNA, 20 bp, Artificial Sequence
  chemically synthesized
tccctattttagaatactca

SEQ ID NO: 211382 - DNA, 20 bp, Artificial Sequence
  chemically synthesized
ccctattttagaatactcaa

SEQ ID NO: 211383 - DNA, 20 bp, Artificial Sequence
  chemically synthesized
cctattttagaatactcaaa

SEQ ID NO: 211384 - DNA, 20 bp, Artificial Sequence
  chemically synthesized
aatagctgtagcagcccttt

SEQ ID NO: 211385 - DNA, 20 bp, Artificial Sequence
  chemically synthesized
gaatactcaaagggctgcta

SEQ ID NO: 211386 - DNA, 20 bp, Artificial Sequence
  chemically synthesized
aaaaaaaaaaatagctgtag

SEQ ID NO: 211387 - DNA, 20 bp, Artificial Sequence
  chemically synthesized
gccaaaaaaaaaaatagctg

SEQ ID NO: 211388 - DNA, 20 bp, Artificial Sequence
  chemically synthesized
ggaactgccaaaaaaaaaaa

SEQ ID NO: 211389 - DNA, 20 bp, Artificial Sequence
  chemically synthesized
gctacagctatttttttttt

SEQ ID NO: 211390 - DNA, 20 bp, Artificial Sequence
  chemically synthesized
acagctatttttttttttgg

SEQ ID NO: 211391 - DNA, 20 bp, Artificial Sequence
  chemically synthesized
tttggcagttccattctcca

SEQ ID NO: 211392 - DNA, 20 bp, Artificial Sequence
  chemically synthesized
tatagatcacctgtggagaa

SEQ ID NO: 211393 - DNA, 20 bp, Artificial Sequence
  chemically synthesized
ttggcagttccattctccac

SEQ ID NO: 211394 - DNA, 20 bp, Artificial Sequence
  chemically synthesized
caagctatagatcacctgtg

SEQ ID NO: 211395 - DNA, 20 bp, Artificial Sequence
  chemically synthesized
ttcaagctatagatcacctg

SEQ ID NO: 211396 - DNA, 20 bp, Artificial Sequence
  chemically synthesized
cattctccacaggtgatcta

SEQ ID NO: 211397 - DNA, 20 bp, Artificial Sequence
  chemically synthesized
tttaggtttagttcaagcta

SEQ ID NO: 211398 - DNA, 20 bp, Artificial Sequence
  chemically synthesized
gatggctttaggtttagttc

SEQ ID NO: 211399 - DNA, 20 bp, Artificial Sequence
  chemically synthesized
tatagcttgaactaaaccta

SEQ ID NO: 211400 - DNA, 20 bp, Artificial Sequence
  chemically synthesized
aaatctgatggctttaggtt

SEQ ID NO: 211401 - DNA, 20 bp, Artificial Sequence
  chemically synthesized
ctggaaaatctgatggcttt

SEQ ID NO: 211402 - DNA, 20 bp, Artificial Sequence
  chemically synthesized
tgaactaaacctaaagccat

SEQ ID NO: 211403 - DNA, 20 bp, Artificial Sequence
  chemically synthesized
cctggaaaatctgatggctt

SEQ ID NO: 211404 - DNA, 20 bp, Artificial Sequence
  chemically synthesized
tttaaacctggaaaatctga

SEQ ID NO: 211405 - DNA, 20 bp, Artificial Sequence
  chemically synthesized
cctaaagccatcagattttc

SEQ ID NO: 211406 - DNA, 20 bp, Artificial Sequence
  chemically synthesized
ctaaagccatcagattttcc

SEQ ID NO: 211407 - DNA, 20 bp, Artificial Sequence
  chemically synthesized
attttaaaatgttttaaacc

SEQ ID NO: 211408 - DNA, 20 bp, Artificial Sequence
  chemically synthesized
aggtttaaaacattttaaaa

SEQ ID NO: 211409 - DNA, 20 bp, Artificial Sequence
  chemically synthesized
taaaaacctgtggattagat

SEQ ID NO: 211410 - DNA, 20 bp, Artificial Sequence
  chemically synthesized
ttaaaaacctgtggattaga

SEQ ID NO: 211411 - DNA, 20 bp, Artificial Sequence
  chemically synthesized
aaatggtcccatctaatcca

SEQ ID NO: 211412 - DNA, 20 bp, Artificial Sequence
  chemically synthesized
aatggtcccatctaatccac

SEQ ID NO: 211413 - DNA, 20 bp, Artificial Sequence
  chemically synthesized
aactttaaaaacctgtggat

SEQ ID NO: 211414 - DNA, 20 bp, Artificial Sequence
  chemically synthesized
actgtaactttaaaaacctg

SEQ ID NO: 211415 - DNA, 20 bp, Artificial Sequence
  chemically synthesized
atctaatccacaggttttta

SEQ ID NO: 211416 - DNA, 20 bp, Artificial Sequence
  chemically synthesized
tccacaggtttttaaagtta

SEQ ID NO: 211417 - DNA, 20 bp, Artificial Sequence
  chemically synthesized
tttcttctagtgtatgtttt

SEQ ID NO: 211418 - DNA, 20 bp, Artificial Sequence
  chemically synthesized
atgttactgaaaacatacac

SEQ ID NO: 211419 - DNA, 20 bp, Artificial Sequence
  chemically synthesized
ttactgaaaacatacactag

SEQ ID NO: 211420 - DNA, 20 bp, Artificial Sequence
  chemically synthesized
tgtcttgataacatttcttc

SEQ ID NO: 211421 - DNA, 20 bp, Artificial Sequence
  chemically synthesized
acactagaagaaatgttatc

SEQ ID NO: 211422 - DNA, 20 bp, Artificial Sequence
  chemically synthesized
gttatcaagacattaattaa

SEQ ID NO: 211423 - DNA, 20 bp, Artificial Sequence
  chemically synthesized
catgttgttaaaatatatac

SEQ ID NO: 211424 - DNA, 20 bp, Artificial Sequence
  chemically synthesized
aatatatacaagacatacac

SEQ ID NO: 211425 - DNA, 20 bp, Artificial Sequence
  chemically synthesized
aataatatttttaaaaattc

SEQ ID NO: 211426 - DNA, 20 bp, Artificial Sequence
  chemically synthesized
tttccttactttcattttat

SEQ ID NO: 211427 - DNA, 20 bp, Artificial Sequence
  chemically synthesized
ttcacatactaataaaatga

SEQ ID NO: 211428 - DNA, 20 bp, Artificial Sequence
  chemically synthesized
catactaataaaatgaaagt

SEQ ID NO: 211429 - DNA, 20 bp, Artificial Sequence
  chemically synthesized
atactaataaaatgaaagta

SEQ ID NO: 211430 - DNA, 20 bp, Artificial Sequence
  chemically synthesized
ggaaataatacaataattac

SEQ ID NO: 211431 - DNA, 20 bp, Artificial Sequence
  chemically synthesized
acaataattacaagaacttc

SEQ ID NO: 211432 - DNA, 20 bp, Artificial Sequence
  chemically synthesized
ctagctatgagaaattcttg

SEQ ID NO: 211433 - DNA, 20 bp, Artificial Sequence
  chemically synthesized
agaacttcaagaatttctca

SEQ ID NO: 211434 - DNA, 20 bp, Artificial Sequence
  chemically synthesized
cttcaagaatttctcatagc

SEQ ID NO: 211435 - DNA, 20 bp, Artificial Sequence
  chemically synthesized
gtatgttcactactagctat

SEQ ID NO: 211436 - DNA, 20 bp, Artificial Sequence
  chemically synthesized
caagaatttctcatagctag

SEQ ID NO: 211437 - DNA, 20 bp, Artificial Sequence
  chemically synthesized
ctgatcagtatgttcactac

SEQ ID NO: 211438 - DNA, 20 bp, Artificial Sequence
  chemically synthesized
ctagtagtgaacatactgat

SEQ ID NO: 211439 - DNA, 20 bp, Artificial Sequence
  chemically synthesized
ccccaagcccttatactgat

SEQ ID NO: 211440 - DNA, 20 bp, Artificial Sequence
  chemically synthesized
gtgaacatactgatcagtat

SEQ ID NO: 211441 - DNA, 20 bp, Artificial Sequence
  chemically synthesized
tgaacatactgatcagtata

SEQ ID NO: 211442 - DNA, 20 bp, Artificial Sequence
  chemically synthesized
gaacatactgatcagtataa

SEQ ID NO: 211443 - DNA, 20 bp, Artificial Sequence
  chemically synthesized
tactgatcagtataagggct

SEQ ID NO: 211444 - DNA, 20 bp, Artificial Sequence
  chemically synthesized
actgatcagtataagggctt

SEQ ID NO: 211445 - DNA, 20 bp, Artificial Sequence
  chemically synthesized
ctgatcagtataagggcttg

SEQ ID NO: 211446 - DNA, 20 bp, Artificial Sequence
  chemically synthesized
tgatcagtataagggcttgg

SEQ ID NO: 211447 - DNA, 20 bp, Artificial Sequence
  chemically synthesized
agaaatattaataaaccccc

SEQ ID NO: 211448 - DNA, 20 bp, Artificial Sequence
  chemically synthesized
gggggtttattaatatttct

SEQ ID NO: 211449 - DNA, 20 bp, Artificial Sequence
  chemically synthesized
ggggtttattaatatttctg

SEQ ID NO: 211450 - DNA, 20 bp, Artificial Sequence
  chemically synthesized
tttttaagacagttatgcct

SEQ ID NO: 211451 - DNA, 20 bp, Artificial Sequence
  chemically synthesized
tgaggcataactgtcttaaa

SEQ ID NO: 211452 - DNA, 20 bp, Artificial Sequence
  chemically synthesized
acttttggctctttttaaga

SEQ ID NO: 211453 - DNA, 20 bp, Artificial Sequence
  chemically synthesized
aggcataactgtcttaaaaa

SEQ ID NO: 211454 - DNA, 20 bp, Artificial Sequence
  chemically synthesized
tctcacttttggctcttttt

SEQ ID NO: 211455 - DNA, 20 bp, Artificial Sequence
  chemically synthesized
actgtcttaaaaagagccaa

SEQ ID NO: 211456 - DNA, 20 bp, Artificial Sequence
  chemically synthesized
tcttaaaaagagccaaaagt

SEQ ID NO: 211457 - DNA, 20 bp, Artificial Sequence
  chemically synthesized
aaattatcagatctcacttt

SEQ ID NO: 211458 - DNA, 20 bp, Artificial Sequence
  chemically synthesized
tagacaatctgataaattat

SEQ ID NO: 211459 - DNA, 20 bp, Artificial Sequence
  chemically synthesized
agtgagatctgataatttat

SEQ ID NO: 211460 - DNA, 20 bp, Artificial Sequence
  chemically synthesized
gataatttatcagattgtct

SEQ ID NO: 211461 - DNA, 20 bp, Artificial Sequence
  chemically synthesized
gatgaatattaacattttct

SEQ ID NO: 211462 - DNA, 20 bp, Artificial Sequence
  chemically synthesized
aagaaaagttagtcatttta

SEQ ID NO: 211463 - DNA, 20 bp, Artificial Sequence
  chemically synthesized
catgtacaccaaagaaaagt

SEQ ID NO: 211464 - DNA, 20 bp, Artificial Sequence
  chemically synthesized
taaaatgactaacttttctt

SEQ ID NO: 211465 - DNA, 20 bp, Artificial Sequence
  chemically synthesized
aaaccatgtacaccaaagaa

SEQ ID NO: 211466 - DNA, 20 bp, Artificial Sequence
  chemically synthesized
cttgaaaaccatgtacacca

SEQ ID NO: 211467 - DNA, 20 bp, Artificial Sequence
  chemically synthesized
taacttttctttggtgtaca

SEQ ID NO: 211468 - DNA, 20 bp, Artificial Sequence
  chemically synthesized
ctttggtgtacatggttttc

SEQ ID NO: 211469 - DNA, 20 bp, Artificial Sequence
  chemically synthesized
ttcaacatttaaaatttgcc

SEQ ID NO: 211470 - DNA, 20 bp, Artificial Sequence
  chemically synthesized
caacatttaaaatttgccta

SEQ ID NO: 211471 - DNA, 20 bp, Artificial Sequence
  chemically synthesized
acatttaaaatttgcctaga

SEQ ID NO: 211472 - DNA, 20 bp, Artificial Sequence
  chemically synthesized
tttaaaatttgcctagagag

SEQ ID NO: 211473 - DNA, 20 bp, Artificial Sequence
  chemically synthesized
cagggatgctgctgctctct

SEQ ID NO: 211474 - DNA, 20 bp, Artificial Sequence
  chemically synthesized
tcagggatgctgctgctctc

SEQ ID NO: 211475 - DNA, 20 bp, Artificial Sequence
  chemically synthesized
aaaatttgcctagagagcag

SEQ ID NO: 211476 - DNA, 20 bp, Artificial Sequence
  chemically synthesized
gagagcagcagcatccctga

SEQ ID NO: 211477 - DNA, 20 bp, Artificial Sequence
  chemically synthesized
tagcatgagccagtctgtca

SEQ ID NO: 211478 - DNA, 20 bp, Artificial Sequence
  chemically synthesized
cagcagcatccctgacagac

SEQ ID NO: 211479 - DNA, 20 bp, Artificial Sequence
  chemically synthesized
atagcatgagccagtctgtc

SEQ ID NO: 211480 - DNA, 20 bp, Artificial Sequence
  chemically synthesized
catagcatgagccagtctgt

SEQ ID NO: 211481 - DNA, 20 bp, Artificial Sequence
  chemically synthesized
caccgaatcatagcatgagc

SEQ ID NO: 211482 - DNA, 20 bp, Artificial Sequence
  chemically synthesized
ctgacaccgaatcatagcat

SEQ ID NO: 211483 - DNA, 20 bp, Artificial Sequence
  chemically synthesized
gactggctcatgctatgatt

SEQ ID NO: 211484 - DNA, 20 bp, Artificial Sequence
  chemically synthesized
ttcatcctgacaccgaatca

SEQ ID NO: 211485 - DNA, 20 bp, Artificial Sequence
  chemically synthesized
ctcatgctatgattcggtgt

SEQ ID NO: 211486 - DNA, 20 bp, Artificial Sequence
  chemically synthesized
tcatgctatgattcggtgtc

SEQ ID NO: 211487 - DNA, 20 bp, Artificial Sequence
  chemically synthesized
tgattcggtgtcaggatgaa

SEQ ID NO: 211488 - DNA, 20 bp, Artificial Sequence
  chemically synthesized
gattcggtgtcaggatgaaa

SEQ ID NO: 211489 - DNA, 20 bp, Artificial Sequence
  chemically synthesized
cggtgtcaggatgaaaaggc

SEQ ID NO: 211490 - DNA, 20 bp, Artificial Sequence
  chemically synthesized
tcaggatgaaaaggctggct

SEQ ID NO: 211491 - DNA, 20 bp, Artificial Sequence
  chemically synthesized
aggatgaaaaggctggctta

SEQ ID NO: 211492 - DNA, 20 bp, Artificial Sequence
  chemically synthesized
cccagaacatgtctctaagc

SEQ ID NO: 211493 - DNA, 20 bp, Artificial Sequence
  chemically synthesized
tgaacccagaacatgtctct

SEQ ID NO: 211494 - DNA, 20 bp, Artificial Sequence
  chemically synthesized
gctggcttagagacatgttc

SEQ ID NO: 211495 - DNA, 20 bp, Artificial Sequence
  chemically synthesized
ctggcttagagacatgttct

SEQ ID NO: 211496 - DNA, 20 bp, Artificial Sequence
  chemically synthesized
aaaccactggaaattgaacc

SEQ ID NO: 211497 - DNA, 20 bp, Artificial Sequence
  chemically synthesized
catgttctgggttcaatttc

SEQ ID NO: 211498 - DNA, 20 bp, Artificial Sequence
  chemically synthesized
gttctgggttcaatttccag

SEQ ID NO: 211499 - DNA, 20 bp, Artificial Sequence
  chemically synthesized
caagaaatcttttaaaccac

SEQ ID NO: 211500 - DNA, 20 bp, Artificial Sequence
  chemically synthesized
ttcaatttccagtggtttaa

SEQ ID NO: 211501 - DNA, 20 bp, Artificial Sequence
  chemically synthesized
cagtggtttaaaagatttct

SEQ ID NO: 211502 - DNA, 20 bp, Artificial Sequence
  chemically synthesized
gtggtttaaaagatttcttg

SEQ ID NO: 211503 - DNA, 20 bp, Artificial Sequence
  chemically synthesized
tttaaaagatttcttggagt

SEQ ID NO: 211504 - DNA, 20 bp, Artificial Sequence
  chemically synthesized
ttaaaagatttcttggagtt

SEQ ID NO: 211505 - DNA, 20 bp, Artificial Sequence
  chemically synthesized
atcatgcacaacctaactcc

SEQ ID NO: 211506 - DNA, 20 bp, Artificial Sequence
  chemically synthesized
catgataatgtgcctcaatc

SEQ ID NO: 211507 - DNA, 20 bp, Artificial Sequence
  chemically synthesized
cccatgcctcttctagattg

SEQ ID NO: 211508 - DNA, 20 bp, Artificial Sequence
  chemically synthesized
gataatgtgcctcaatctag

SEQ ID NO: 211509 - DNA, 20 bp, Artificial Sequence
  chemically synthesized
gcccatgcctcttctagatt

SEQ ID NO: 211510 - DNA, 20 bp, Artificial Sequence
  chemically synthesized
taatgtgcctcaatctagaa

SEQ ID NO: 211511 - DNA, 20 bp, Artificial Sequence
  chemically synthesized
aatgtgcctcaatctagaag

SEQ ID NO: 211512 - DNA, 20 bp, Artificial Sequence
  chemically synthesized
ggagttgcccatgcctcttc

SEQ ID NO: 211513 - DNA, 20 bp, Artificial Sequence
  chemically synthesized
gcctcaatctagaagaggca

SEQ ID NO: 211514 - DNA, 20 bp, Artificial Sequence
  chemically synthesized
cctcaatctagaagaggcat

SEQ ID NO: 211515 - DNA, 20 bp, Artificial Sequence
  chemically synthesized
gaagaggcatgggcaactcc

SEQ ID NO: 211516 - DNA, 20 bp, Artificial Sequence
  chemically synthesized
gagctctgcttgcatgctgg

SEQ ID NO: 211517 - DNA, 20 bp, Artificial Sequence
  chemically synthesized
atgggcaactcccagcatgc

SEQ ID NO: 211518 - DNA, 20 bp, Artificial Sequence
  chemically synthesized
aggagctctgcttgcatgct

SEQ ID NO: 211519 - DNA, 20 bp, Artificial Sequence
  chemically synthesized
caggagctctgcttgcatgc

SEQ ID NO: 211520 - DNA, 20 bp, Artificial Sequence
  chemically synthesized
ggcaactcccagcatgcaag

SEQ ID NO: 211521 - DNA, 20 bp, Artificial Sequence
  chemically synthesized
caactcccagcatgcaagca

SEQ ID NO: 211522 - DNA, 20 bp, Artificial Sequence
  chemically synthesized
cagcatgcaagcagagctcc

SEQ ID NO: 211523 - DNA, 20 bp, Artificial Sequence
  chemically synthesized
tactttcagatgttaaccag

SEQ ID NO: 211524 - DNA, 20 bp, Artificial Sequence
  chemically synthesized
aatactttcagatgttaacc

SEQ ID NO: 211525 - DNA, 20 bp, Artificial Sequence
  chemically synthesized
gaatactttcagatgttaac

SEQ ID NO: 211526 - DNA, 20 bp, Artificial Sequence
  chemically synthesized
agctcctggttaacatctga

SEQ ID NO: 211527 - DNA, 20 bp, Artificial Sequence
  chemically synthesized
acggtgtgggtgaatacttt

SEQ ID NO: 211528 - DNA, 20 bp, Artificial Sequence
  chemically synthesized
aaaccagcggattacggtgt

SEQ ID NO: 211529 - DNA, 20 bp, Artificial Sequence
  chemically synthesized
taaaccagcggattacggtg

SEQ ID NO: 211530 - DNA, 20 bp, Artificial Sequence
  chemically synthesized
tggaataaaccagcggatta

SEQ ID NO: 211531 - DNA, 20 bp, Artificial Sequence
  chemically synthesized
tcacccacaccgtaatccgc

SEQ ID NO: 211532 - DNA, 20 bp, Artificial Sequence
  chemically synthesized
ataaaggtggaataaaccag

SEQ ID NO: 211533 - DNA, 20 bp, Artificial Sequence
  chemically synthesized
ttcataaaggtggaataaac

SEQ ID NO: 211534 - DNA, 20 bp, Artificial Sequence
  chemically synthesized
taataggagtttcataaagg

SEQ ID NO: 211535 - DNA, 20 bp, Artificial Sequence
  chemically synthesized
atgtaataggagtttcataa

SEQ ID NO: 211536 - DNA, 20 bp, Artificial Sequence
  chemically synthesized
aatgtaataggagtttcata

SEQ ID NO: 211537 - DNA, 20 bp, Artificial Sequence
  chemically synthesized
agggtggacaaatgtaatag

SEQ ID NO: 211538 - DNA, 20 bp, Artificial Sequence
  chemically synthesized
acagggtggacaaatgtaat

SEQ ID NO: 211539 - DNA, 20 bp, Artificial Sequence
  chemically synthesized
cacagggtggacaaatgtaa

SEQ ID NO: 211540 - DNA, 20 bp, Artificial Sequence
  chemically synthesized
ttgctgctttaagcacaggg

SEQ ID NO: 211541 - DNA, 20 bp, Artificial Sequence
  chemically synthesized
ctgttgctgctttaagcaca

SEQ ID NO: 211542 - DNA, 20 bp, Artificial Sequence
  chemically synthesized
atttgtccaccctgtgctta

SEQ ID NO: 211543 - DNA, 20 bp, Artificial Sequence
  chemically synthesized
gctgttgctgctttaagcac

SEQ ID NO: 211544 - DNA, 20 bp, Artificial Sequence
  chemically synthesized
agctgttgctgctttaagca

SEQ ID NO: 211545 - DNA, 20 bp, Artificial Sequence
  chemically synthesized
tgtccaccctgtgcttaaag

SEQ ID NO: 211546 - DNA, 20 bp, Artificial Sequence
  chemically synthesized
ttttaagctgttgctgcttt

SEQ ID NO: 211547 - DNA, 20 bp, Artificial Sequence
  chemically synthesized
ccctgtgcttaaagcagcaa

SEQ ID NO: 211548 - DNA, 20 bp, Artificial Sequence
  chemically synthesized
ttaaagcagcaacagcttaa

SEQ ID NO: 211549 - DNA, 20 bp, Artificial Sequence
  chemically synthesized
aaagcagcaacagcttaaaa

SEQ ID NO: 211550 - DNA, 20 bp, Artificial Sequence
  chemically synthesized
aagcagcaacagcttaaaag

SEQ ID NO: 211551 - DNA, 20 bp, Artificial Sequence
  chemically synthesized
agcagcaacagcttaaaaga

SEQ ID NO: 211552 - DNA, 20 bp, Artificial Sequence
  chemically synthesized
gtctgaagtgtccctctttt

SEQ ID NO: 211553 - DNA, 20 bp, Artificial Sequence
  chemically synthesized
agcttaaaagagggacactt

SEQ ID NO: 211554 - DNA, 20 bp, Artificial Sequence
  chemically synthesized
aaaagagggacacttcagac

SEQ ID NO: 211555 - DNA, 20 bp, Artificial Sequence
  chemically synthesized
aaagagggacacttcagaca

SEQ ID NO: 211556 - DNA, 20 bp, Artificial Sequence
  chemically synthesized
cccagaaggggccttgtctg

SEQ ID NO: 211557 - DNA, 20 bp, Artificial Sequence
  chemically synthesized
acttcagacaaggccccttc

SEQ ID NO: 211558 - DNA, 20 bp, Artificial Sequence
  chemically synthesized
cttcagacaaggccccttct

SEQ ID NO: 211559 - DNA, 20 bp, Artificial Sequence
  chemically synthesized
aagagaaagagacccagaag

SEQ ID NO: 211560 - DNA, 20 bp, Artificial Sequence
  chemically synthesized
aaagagaaagagacccagaa

SEQ ID NO: 211561 - DNA, 20 bp, Artificial Sequence
  chemically synthesized
gaaagagaaagagacccaga

SEQ ID NO: 211562 - DNA, 20 bp, Artificial Sequence
  chemically synthesized
tgaaagagaaagagacccag

SEQ ID NO: 211563 - DNA, 20 bp, Artificial Sequence
  chemically synthesized
tactgaaagagaaagagacc

SEQ ID NO: 211564 - DNA, 20 bp, Artificial Sequence
  chemically synthesized
ctgcggtactgaaagagaaa

SEQ ID NO: 211565 - DNA, 20 bp, Artificial Sequence
  chemically synthesized
ttctgggtctctttctcttt

SEQ ID NO: 211566 - DNA, 20 bp, Artificial Sequence
  chemically synthesized
ctctgcggtactgaaagaga

SEQ ID NO: 211567 - DNA, 20 bp, Artificial Sequence
  chemically synthesized
ttttctctgcggtactgaaa

SEQ ID NO: 211568 - DNA, 20 bp, Artificial Sequence
  chemically synthesized
ctttttctctgcggtactga

SEQ ID NO: 211569 - DNA, 20 bp, Artificial Sequence
  chemically synthesized
ctctttctctttcagtaccg

SEQ ID NO: 211570 - DNA, 20 bp, Artificial Sequence
  chemically synthesized
ctttctctttcagtaccgca

SEQ ID NO: 211571 - DNA, 20 bp, Artificial Sequence
  chemically synthesized
ccattgtatctttttctctg

SEQ ID NO: 211572 - DNA, 20 bp, Artificial Sequence
  chemically synthesized
ctttcagtaccgcagagaaa

SEQ ID NO: 211573 - DNA, 20 bp, Artificial Sequence
  chemically synthesized
ccgcagagaaaaagatacaa

SEQ ID NO: 211574 - DNA, 20 bp, Artificial Sequence
  chemically synthesized
cagagaaaaagatacaatgg

SEQ ID NO: 211575 - DNA, 20 bp, Artificial Sequence
  chemically synthesized
aaaagatacaatggaagcaa

SEQ ID NO: 211576 - DNA, 20 bp, Artificial Sequence
  chemically synthesized
agatacaatggaagcaacag

SEQ ID NO: 211577 - DNA, 20 bp, Artificial Sequence
  chemically synthesized
tacaatggaagcaacagcag

SEQ ID NO: 211578 - DNA, 20 bp, Artificial Sequence
  chemically synthesized
atggaagcaacagcagtaga

SEQ ID NO: 211579 - DNA, 20 bp, Artificial Sequence
  chemically synthesized
atctgaaagctatttagtgg

SEQ ID NO: 211580 - DNA, 20 bp, Artificial Sequence
  chemically synthesized
tttgaaacaccaccactaaa

SEQ ID NO: 211581 - DNA, 20 bp, Artificial Sequence
  chemically synthesized
ctcatctgaaagctatttag

SEQ ID NO: 211582 - DNA, 20 bp, Artificial Sequence
  chemically synthesized
ttcctcatctgaaagctatt

SEQ ID NO: 211583 - DNA, 20 bp, Artificial Sequence
  chemically synthesized
caccaccactaaatagcttt

SEQ ID NO: 211584 - DNA, 20 bp, Artificial Sequence
  chemically synthesized
ccactaaatagctttcagat

SEQ ID NO: 211585 - DNA, 20 bp, Artificial Sequence
  chemically synthesized
cactaaatagctttcagatg

SEQ ID NO: 211586 - DNA, 20 bp, Artificial Sequence
  chemically synthesized
gaattgtattcctcatctga

SEQ ID NO: 211587 - DNA, 20 bp, Artificial Sequence
  chemically synthesized
agatgaggaatacaattctt

SEQ ID NO: 211588 - DNA, 20 bp, Artificial Sequence
  chemically synthesized
tatttaaaatagaaatacca

SEQ ID NO: 211589 - DNA, 20 bp, Artificial Sequence
  chemically synthesized
tttggtatttctattttaaa

SEQ ID NO: 211590 - DNA, 20 bp, Artificial Sequence
  chemically synthesized
agcccctgcactatttaaaa

SEQ ID NO: 211591 - DNA, 20 bp, Artificial Sequence
  chemically synthesized
tatttctattttaaatagtg

SEQ ID NO: 211592 - DNA, 20 bp, Artificial Sequence
  chemically synthesized
atttctattttaaatagtgc

SEQ ID NO: 211593 - DNA, 20 bp, Artificial Sequence
  chemically synthesized
tttctattttaaatagtgca

SEQ ID NO: 211594 - DNA, 20 bp, Artificial Sequence
  chemically synthesized
ttctattttaaatagtgcag

SEQ ID NO: 211595 - DNA, 20 bp, Artificial Sequence
  chemically synthesized
attttaaatagtgcaggggc

SEQ ID NO: 211596 - DNA, 20 bp, Artificial Sequence
  chemically synthesized
ttttaaatagtgcaggggct

SEQ ID NO: 211597 - DNA, 20 bp, Artificial Sequence
  chemically synthesized
tagtgcaggggctgggctat

SEQ ID NO: 211598 - DNA, 20 bp, Artificial Sequence
  chemically synthesized
catatgaaaatctcatagcc

SEQ ID NO: 211599 - DNA, 20 bp, Artificial Sequence
  chemically synthesized
gatagcatatgaaaatctca

SEQ ID NO: 211600 - DNA, 20 bp, Artificial Sequence
  chemically synthesized
gataaatgaaataaatgaga

SEQ ID NO: 211601 - DNA, 20 bp, Artificial Sequence
  chemically synthesized
tatagataaatgaaataaat

SEQ ID NO: 211602 - DNA, 20 bp, Artificial Sequence
  chemically synthesized
cactctaaattaaacatgta

SEQ ID NO: 211603 - DNA, 20 bp, Artificial Sequence
  chemically synthesized
ttatctatacatgtttaatt

SEQ ID NO: 211604 - DNA, 20 bp, Artificial Sequence
  chemically synthesized
atctatacatgtttaattta

SEQ ID NO: 211605 - DNA, 20 bp, Artificial Sequence
  chemically synthesized
ttagagtgatgatgtaacat

SEQ ID NO: 211606 - DNA, 20 bp, Artificial Sequence
  chemically synthesized
tgatgatgtaacattggatg

SEQ ID NO: 211607 - DNA, 20 bp, Artificial Sequence
  chemically synthesized
atgatgtaacattggatgtg

SEQ ID NO: 211608 - DNA, 20 bp, Artificial Sequence
  chemically synthesized
cattggatgtggagactcca

SEQ ID NO: 211609 - DNA, 20 bp, Artificial Sequence
  chemically synthesized
tattacattattcagctttg

SEQ ID NO: 211610 - DNA, 20 bp, Artificial Sequence
  chemically synthesized
tatattacattattcagctt

SEQ ID NO: 211611 - DNA, 20 bp, Artificial Sequence
  chemically synthesized
tattgatatattacattatt

SEQ ID NO: 211612 - DNA, 20 bp, Artificial Sequence
  chemically synthesized
atatatcaatacaatacctg

SEQ ID NO: 211613 - DNA, 20 bp, Artificial Sequence
  chemically synthesized
caatacaatacctgcagaaa

SEQ ID NO: 211614 - DNA, 20 bp, Artificial Sequence
  chemically synthesized
cactgcatagctgtttctgc

SEQ ID NO: 211615 - DNA, 20 bp, Artificial Sequence
  chemically synthesized
ccactgcatagctgtttctg

SEQ ID NO: 211616 - DNA, 20 bp, Artificial Sequence
  chemically synthesized
tacctgcagaaacagctatg

SEQ ID NO: 211617 - DNA, 20 bp, Artificial Sequence
  chemically synthesized
ctgcagaaacagctatgcag

SEQ ID NO: 211618 - DNA, 20 bp, Artificial Sequence
  chemically synthesized
gcagaaacagctatgcagtg

SEQ ID NO: 211619 - DNA, 20 bp, Artificial Sequence
  chemically synthesized
aaccaaaatactccactgca

SEQ ID NO: 211620 - DNA, 20 bp, Artificial Sequence
  chemically synthesized
agctatgcagtggagtattt

SEQ ID NO: 211621 - DNA, 20 bp, Artificial Sequence
  chemically synthesized
cgtgatgaacatttttgagg

SEQ ID NO: 211622 - DNA, 20 bp, Artificial Sequence
  chemically synthesized
taacgtgatgaacatttttg

SEQ ID NO: 211623 - DNA, 20 bp, Artificial Sequence
  chemically synthesized
ataacgtgatgaacattttt

SEQ ID NO: 211624 - DNA, 20 bp, Artificial Sequence
  chemically synthesized
aaaaaaaaaaaaaaaaaaaa

SEQ ID NO: 211625 - DNA, 20 bp, Artificial Sequence
  chemically synthesized
ttttttttttttttttttta

SEQ ID NO: 211626 - DNA, 20 bp, Artificial Sequence
  chemically synthesized
tttttttttttatagaaaca

SEQ ID NO: 211627 - DNA, 20 bp, Artificial Sequence
  chemically synthesized
ttttttttttatagaaacac

SEQ ID NO: 211628 - DNA, 20 bp, Artificial Sequence
  chemically synthesized
tttttatagaaacacaggac

SEQ ID NO: 211629 - DNA, 20 bp, Artificial Sequence
  chemically synthesized
tagaaacacaggactggctt

SEQ ID NO: 211630 - DNA, 20 bp, Artificial Sequence
  chemically synthesized
gaaacacaggactggctttg

SEQ ID NO: 211631 - DNA, 20 bp, Artificial Sequence
  chemically synthesized
cccctaaataactccaaagc

SEQ ID NO: 211632 - DNA, 20 bp, Artificial Sequence
  chemically synthesized
tcttcccctaaataactcca

SEQ ID NO: 211633 - DNA, 20 bp, Artificial Sequence
  chemically synthesized
ggactggctttggagttatt

SEQ ID NO: 211634 - DNA, 20 bp, Artificial Sequence
  chemically synthesized
gactggctttggagttattt

SEQ ID NO: 211635 - DNA, 20 bp, Artificial Sequence
  chemically synthesized
actggctttggagttattta

SEQ ID NO: 211636 - DNA, 20 bp, Artificial Sequence
  chemically synthesized
ctggctttggagttatttag

SEQ ID NO: 211637 - DNA, 20 bp, Artificial Sequence
  chemically synthesized
gctttggagttatttagggg

SEQ ID NO: 211638 - DNA, 20 bp, Artificial Sequence
  chemically synthesized
tttggagttatttaggggaa

SEQ ID NO: 211639 - DNA, 20 bp, Artificial Sequence
  chemically synthesized
atttaggggaagagtgcctt

SEQ ID NO: 211640 - DNA, 20 bp, Artificial Sequence
  chemically synthesized
aagatttctctaaagaccaa

SEQ ID NO: 211641 - DNA, 20 bp, Artificial Sequence
  chemically synthesized
ggaagagtgcctttggtctt

SEQ ID NO: 211642 - DNA, 20 bp, Artificial Sequence
  chemically synthesized
gaagatttctctaaagacca

SEQ ID NO: 211643 - DNA, 20 bp, Artificial Sequence
  chemically synthesized
aagagtgcctttggtcttta

SEQ ID NO: 211644 - DNA, 20 bp, Artificial Sequence
  chemically synthesized
tgtccaggaagatttctcta

SEQ ID NO: 211645 - DNA, 20 bp, Artificial Sequence
  chemically synthesized
ggtctttagagaaatcttcc

SEQ ID NO: 211646 - DNA, 20 bp, Artificial Sequence
  chemically synthesized
tgttacaagaattgtccagg

SEQ ID NO: 211647 - DNA, 20 bp, Artificial Sequence
  chemically synthesized
atttgttacaagaattgtcc

SEQ ID NO: 211648 - DNA, 20 bp, Artificial Sequence
  chemically synthesized
tatttgttacaagaattgtc

SEQ ID NO: 211649 - DNA, 20 bp, Artificial Sequence
  chemically synthesized
cttgatgttttatttgttac

SEQ ID NO: 211650 - DNA, 20 bp, Artificial Sequence
  chemically synthesized
cttgtaacaaataaaacatc

SEQ ID NO: 211651 - DNA, 20 bp, Artificial Sequence
  chemically synthesized
ttgtaacaaataaaacatca

SEQ ID NO: 211652 - DNA, 20 bp, Artificial Sequence
  chemically synthesized
acaaataagttgcgttttaa

SEQ ID NO: 211653 - DNA, 20 bp, Artificial Sequence
  chemically synthesized
agctaaaatatagtacaaat

SEQ ID NO: 211654 - DNA, 20 bp, Artificial Sequence
  chemically synthesized
aacttatttgtactatattt

SEQ ID NO: 211655 - DNA, 20 bp, Artificial Sequence
  chemically synthesized
gtgttaaaacagctaaaata

SEQ ID NO: 211656 - DNA, 20 bp, Artificial Sequence
  chemically synthesized
aaggtcacttagtgttaaaa

SEQ ID NO: 211657 - DNA, 20 bp, Artificial Sequence
  chemically synthesized
attttagctgttttaacact

SEQ ID NO: 211658 - DNA, 20 bp, Artificial Sequence
  chemically synthesized
tgaatgagtgtaaggtcact

SEQ ID NO: 211659 - DNA, 20 bp, Artificial Sequence
  chemically synthesized
agaaacaatgaatgagtgta

SEQ ID NO: 211660 - DNA, 20 bp, Artificial Sequence
  chemically synthesized
tagaaacaatgaatgagtgt

SEQ ID NO: 211661 - DNA, 20 bp, Artificial Sequence
  chemically synthesized
gagcaatagaaacaatgaat

SEQ ID NO: 211662 - DNA, 20 bp, Artificial Sequence
  chemically synthesized
ggaacaataacagggagcaa

SEQ ID NO: 211663 - DNA, 20 bp, Artificial Sequence
  chemically synthesized
tagaaaggaacaataacagg

SEQ ID NO: 211664 - DNA, 20 bp, Artificial Sequence
  chemically synthesized
tttagaaaggaacaataaca

SEQ ID NO: 211665 - DNA, 20 bp, Artificial Sequence
  chemically synthesized
ttttagaaaggaacaataac

SEQ ID NO: 211666 - DNA, 20 bp, Artificial Sequence
  chemically synthesized
cttttagaaaggaacaataa

SEQ ID NO: 211667 - DNA, 20 bp, Artificial Sequence
  chemically synthesized
ctgttattgttcctttctaa

SEQ ID NO: 211668 - DNA, 20 bp, Artificial Sequence
  chemically synthesized
gggagaacattcttttagaa

SEQ ID NO: 211669 - DNA, 20 bp, Artificial Sequence
  chemically synthesized
agggagaacattcttttaga

SEQ ID NO: 211670 - DNA, 20 bp, Artificial Sequence
  chemically synthesized
tataagggagaacattcttt

SEQ ID NO: 211671 - DNA, 20 bp, Artificial Sequence
  chemically synthesized
tgatagtacagtatataagg

SEQ ID NO: 211672 - DNA, 20 bp, Artificial Sequence
  chemically synthesized
ggtgatagtacagtatataa

SEQ ID NO: 211673 - DNA, 20 bp, Artificial Sequence
  chemically synthesized
tggtgatagtacagtatata

SEQ ID NO: 211674 - DNA, 20 bp, Artificial Sequence
  chemically synthesized
gtggtgatagtacagtatat

SEQ ID NO: 211675 - DNA, 20 bp, Artificial Sequence
  chemically synthesized
attaagtagtggtgatagta

SEQ ID NO: 211676 - DNA, 20 bp, Artificial Sequence
  chemically synthesized
aactaattaagtagtggtga

SEQ ID NO: 211677 - DNA, 20 bp, Artificial Sequence
  chemically synthesized
tacaaaaactaattaagtag

SEQ ID NO: 211678 - DNA, 20 bp, Artificial Sequence
  chemically synthesized
tactatcaccactacttaat

SEQ ID NO: 211679 - DNA, 20 bp, Artificial Sequence
  chemically synthesized
gaatacaaaaactaattaag

SEQ ID NO: 211680 - DNA, 20 bp, Artificial Sequence
  chemically synthesized
attgaatacaaaaactaatt

SEQ ID NO: 211681 - DNA, 20 bp, Artificial Sequence
  chemically synthesized
taattagtttttgtattcaa

SEQ ID NO: 211682 - DNA, 20 bp, Artificial Sequence
  chemically synthesized
tattcaatagtcttgctcat

SEQ ID NO: 211683 - DNA, 20 bp, Artificial Sequence
  chemically synthesized
taatgttagcgccaatgagc

SEQ ID NO: 211684 - DNA, 20 bp, Artificial Sequence
  chemically synthesized
actttaatgttagcgccaat

SEQ ID NO: 211685 - DNA, 20 bp, Artificial Sequence
  chemically synthesized
gctcattggcgctaacatta

SEQ ID NO: 211686 - DNA, 20 bp, Artificial Sequence
  chemically synthesized
cttatttcatactttaatgt

SEQ ID NO: 211687 - DNA, 20 bp, Artificial Sequence
  chemically synthesized
ctaacattaaagtatgaaat

SEQ ID NO: 211688 - DNA, 20 bp, Artificial Sequence
  chemically synthesized
atgaaataagttaaatataa

SEQ ID NO: 211689 - DNA, 20 bp, Artificial Sequence
  chemically synthesized
aaaataatttcttactttaa

SEQ ID NO: 211690 - DNA, 20 bp, Artificial Sequence
  chemically synthesized
actaaagtgactattaaagt

SEQ ID NO: 211691 - DNA, 20 bp, Artificial Sequence
  chemically synthesized
gaagactaaagtgactatta

SEQ ID NO: 211692 - DNA, 20 bp, Artificial Sequence
  chemically synthesized
tcttactttaatagtcactt

SEQ ID NO: 211693 - DNA, 20 bp, Artificial Sequence
  chemically synthesized
gaattctattgtgaagacta

SEQ ID NO: 211694 - DNA, 20 bp, Artificial Sequence
  chemically synthesized
agtcactttagtcttcacaa

SEQ ID NO: 211695 - DNA, 20 bp, Artificial Sequence
  chemically synthesized
atttaaagaattctattgtg

SEQ ID NO: 211696 - DNA, 20 bp, Artificial Sequence
  chemically synthesized
agtattgagttatagattta

SEQ ID NO: 211697 - DNA, 20 bp, Artificial Sequence
  chemically synthesized
agctgttaagtattgagtta

SEQ ID NO: 211698 - DNA, 20 bp, Artificial Sequence
  chemically synthesized
cttctcagctgttaagtatt

SEQ ID NO: 211699 - DNA, 20 bp, Artificial Sequence
  chemically synthesized
atctataactcaatacttaa

SEQ ID NO: 211700 - DNA, 20 bp, Artificial Sequence
  chemically synthesized
taactcaatacttaacagct

SEQ ID NO: 211701 - DNA, 20 bp, Artificial Sequence
  chemically synthesized
tcatattcttctcagctgtt

SEQ ID NO: 211702 - DNA, 20 bp, Artificial Sequence
  chemically synthesized
ctcaatacttaacagctgag

SEQ ID NO: 211703 - DNA, 20 bp, Artificial Sequence
  chemically synthesized
aaacacactcatattcttct

SEQ ID NO: 211704 - DNA, 20 bp, Artificial Sequence
  chemically synthesized
ttaacagctgagaagaatat

SEQ ID NO: 211705 - DNA, 20 bp, Artificial Sequence
  chemically synthesized
agtgtgtttaatataaatta

SEQ ID NO: 211706 - DNA, 20 bp, Artificial Sequence
  chemically synthesized
gtgtttaatataaattaaag

SEQ ID NO: 211707 - DNA, 20 bp, Artificial Sequence
  chemically synthesized
aaagaaaatgtggtatgaaa

SEQ ID NO: 211708 - DNA, 20 bp, Artificial Sequence
  chemically synthesized
gatgaattgaaaagaaaatg

SEQ ID NO: 211709 - DNA, 20 bp, Artificial Sequence
  chemically synthesized
ccatcagtggatgaattgaa

SEQ ID NO: 211710 - DNA, 20 bp, Artificial Sequence
  chemically synthesized
cttttcaattcatccactga

SEQ ID NO: 211711 - DNA, 20 bp, Artificial Sequence
  chemically synthesized
tcaacctaaacgtccatcag

SEQ ID NO: 211712 - DNA, 20 bp, Artificial Sequence
  chemically synthesized
gaatcaacctaaacgtccat

SEQ ID NO: 211713 - DNA, 20 bp, Artificial Sequence
  chemically synthesized
ttcatccactgatggacgtt

SEQ ID NO: 211714 - DNA, 20 bp, Artificial Sequence
  chemically synthesized
tcatccactgatggacgttt

SEQ ID NO: 211715 - DNA, 20 bp, Artificial Sequence
  chemically synthesized
tttaggttgattccatatca

SEQ ID NO: 211716 - DNA, 20 bp, Artificial Sequence
  chemically synthesized
ttttcatactagccatgata

SEQ ID NO: 211717 - DNA, 20 bp, Artificial Sequence
  chemically synthesized
ggttgattccatatcatggc

SEQ ID NO: 211718 - DNA, 20 bp, Artificial Sequence
  chemically synthesized
catatcatggctagtatgaa

SEQ ID NO: 211719 - DNA, 20 bp, Artificial Sequence
  chemically synthesized
tactgcagcacttttcatac

SEQ ID NO: 211720 - DNA, 20 bp, Artificial Sequence
  chemically synthesized
ggctagtatgaaaagtgctg

SEQ ID NO: 211721 - DNA, 20 bp, Artificial Sequence
  chemically synthesized
ctttgttcccatgtttactg

SEQ ID NO: 211722 - DNA, 20 bp, Artificial Sequence
  chemically synthesized
gaaaagtgctgcagtaaaca

SEQ ID NO: 211723 - DNA, 20 bp, Artificial Sequence
  chemically synthesized
aaaagtgctgcagtaaacat

SEQ ID NO: 211724 - DNA, 20 bp, Artificial Sequence
  chemically synthesized
ctgcagtaaacatgggaaca

SEQ ID NO: 211725 - DNA, 20 bp, Artificial Sequence
  chemically synthesized
aatcagtatctttgaagaga

SEQ ID NO: 211726 - DNA, 20 bp, Artificial Sequence
  chemically synthesized
ggaacaaagctatctcttca

SEQ ID NO: 211727 - DNA, 20 bp, Artificial Sequence
  chemically synthesized
aggaaatcagtatctttgaa

SEQ ID NO: 211728 - DNA, 20 bp, Artificial Sequence
  chemically synthesized
aaaggaaatcagtatctttg

SEQ ID NO: 211729 - DNA, 20 bp, Artificial Sequence
  chemically synthesized
ttatccaaagaaaaggaaat

SEQ ID NO: 211730 - DNA, 20 bp, Artificial Sequence
  chemically synthesized
gatactgatttccttttctt

SEQ ID NO: 211731 - DNA, 20 bp, Artificial Sequence
  chemically synthesized
tgggcatttatccaaagaaa

SEQ ID NO: 211732 - DNA, 20 bp, Artificial Sequence
  chemically synthesized
ctgggcatttatccaaagaa

SEQ ID NO: 211733 - DNA, 20 bp, Artificial Sequence
  chemically synthesized
cactactgggcatttatcca

SEQ ID NO: 211734 - DNA, 20 bp, Artificial Sequence
  chemically synthesized
cttttctttggataaatgcc

SEQ ID NO: 211735 - DNA, 20 bp, Artificial Sequence
  chemically synthesized
ttctttggataaatgcccag

SEQ ID NO: 211736 - DNA, 20 bp, Artificial Sequence
  chemically synthesized
tttggataaatgcccagtag

SEQ ID NO: 211737 - DNA, 20 bp, Artificial Sequence
  chemically synthesized
ttggataaatgcccagtagt

SEQ ID NO: 211738 - DNA, 20 bp, Artificial Sequence
  chemically synthesized
gatccagcaatcccactact

SEQ ID NO: 211739 - DNA, 20 bp, Artificial Sequence
  chemically synthesized
tgatccagcaatcccactac

SEQ ID NO: 211740 - DNA, 20 bp, Artificial Sequence
  chemically synthesized
atgcccagtagtgggattgc

SEQ ID NO: 211741 - DNA, 20 bp, Artificial Sequence
  chemically synthesized
agtgggattgctggatcatc

SEQ ID NO: 211742 - DNA, 20 bp, Artificial Sequence
  chemically synthesized
tgaattgctaccagatgatc

SEQ ID NO: 211743 - DNA, 20 bp, Artificial Sequence
  chemically synthesized
gggattgctggatcatctgg

SEQ ID NO: 211744 - DNA, 20 bp, Artificial Sequence
  chemically synthesized
aataaaacatgaattgctac

SEQ ID NO: 211745 - DNA, 20 bp, Artificial Sequence
  chemically synthesized
gtagcaattcatgttttatt

SEQ ID NO: 211746 - DNA, 20 bp, Artificial Sequence
  chemically synthesized
caattcatgttttattaaga

SEQ ID NO: 211747 - DNA, 20 bp, Artificial Sequence
  chemically synthesized
ttaagaaagtgtttacaaca

SEQ ID NO: 211748 - DNA, 20 bp, Artificial Sequence
  chemically synthesized
agaaagtgtttacaacacag

SEQ ID NO: 211749 - DNA, 20 bp, Artificial Sequence
  chemically synthesized
tttacaacacagaagctcaa

SEQ ID NO: 211750 - DNA, 20 bp, Artificial Sequence
  chemically synthesized
agagatagctgaaggctttt

SEQ ID NO: 211751 - DNA, 20 bp, Artificial Sequence
  chemically synthesized
cacagaagctcaaaagcctt

SEQ ID NO: 211752 - DNA, 20 bp, Artificial Sequence
  chemically synthesized
cattgtatagagatagctga

SEQ ID NO: 211753 - DNA, 20 bp, Artificial Sequence
  chemically synthesized
gcattgtatagagatagctg

SEQ ID NO: 211754 - DNA, 20 bp, Artificial Sequence
  chemically synthesized
aaaatggcattgtatagaga

SEQ ID NO: 211755 - DNA, 20 bp, Artificial Sequence
  chemically synthesized
gtttaaaatggcattgtata

SEQ ID NO: 211756 - DNA, 20 bp, Artificial Sequence
  chemically synthesized
gtgtttaaaatggcattgta

SEQ ID NO: 211757 - DNA, 20 bp, Artificial Sequence
  chemically synthesized
tcttccaaaggtgtttaaaa

SEQ ID NO: 211758 - DNA, 20 bp, Artificial Sequence
  chemically synthesized
aatgccattttaaacacctt

SEQ ID NO: 211759 - DNA, 20 bp, Artificial Sequence
  chemically synthesized
gccattttaaacacctttgg

SEQ ID NO: 211760 - DNA, 20 bp, Artificial Sequence
  chemically synthesized
atattttaataatcttccaa

SEQ ID NO: 211761 - DNA, 20 bp, Artificial Sequence
  chemically synthesized
catattttaataatcttcca

SEQ ID NO: 211762 - DNA, 20 bp, Artificial Sequence
  chemically synthesized
tgtcttgctttttaaatttt

SEQ ID NO: 211763 - DNA, 20 bp, Artificial Sequence
  chemically synthesized
cgaaaaactaaaaatttaaa

SEQ ID NO: 211764 - DNA, 20 bp, Artificial Sequence
  chemically synthesized
aaactaaaaatttaaaaagc

SEQ ID NO: 211765 - DNA, 20 bp, Artificial Sequence
  chemically synthesized
taaaaatttaaaaagcaaga

SEQ ID NO: 211766 - DNA, 20 bp, Artificial Sequence
  chemically synthesized
aaaaatttaaaaagcaagac

SEQ ID NO: 211767 - DNA, 20 bp, Artificial Sequence
  chemically synthesized
aaaagcaagacaggtcaaca

SEQ ID NO: 211768 - DNA, 20 bp, Artificial Sequence
  chemically synthesized
aaagcaagacaggtcaacaa

SEQ ID NO: 211769 - DNA, 20 bp, Artificial Sequence
  chemically synthesized
caagacaggtcaacaaaggc

SEQ ID NO: 211770 - DNA, 20 bp, Artificial Sequence
  chemically synthesized
caggtcaacaaaggccagat

SEQ ID NO: 211771 - DNA, 20 bp, Artificial Sequence
  chemically synthesized
atttatggtaatttctaatc

SEQ ID NO: 211772 - DNA, 20 bp, Artificial Sequence
  chemically synthesized
tttatgactttaataattta

SEQ ID NO: 211773 - DNA, 20 bp, Artificial Sequence
  chemically synthesized
gaaattaccataaattatta

SEQ ID NO: 211774 - DNA, 20 bp, Artificial Sequence
  chemically synthesized
ataaaacatactgaaatctt

SEQ ID NO: 211775 - DNA, 20 bp, Artificial Sequence
  chemically synthesized
aaattacatcccaaagattt

SEQ ID NO: 211776 - DNA, 20 bp, Artificial Sequence
  chemically synthesized
taaaacatactgaaatcttt

SEQ ID NO: 211777 - DNA, 20 bp, Artificial Sequence
  chemically synthesized
atgtgttaaattacatccca

SEQ ID NO: 211778 - DNA, 20 bp, Artificial Sequence
  chemically synthesized
tgggatgtaatttaacacat

SEQ ID NO: 211779 - DNA, 20 bp, Artificial Sequence
  chemically synthesized
catgagatttacgactactc

SEQ ID NO: 211780 - DNA, 20 bp, Artificial Sequence
  chemically synthesized
gagatttacgactactcaag

SEQ ID NO: 211781 - DNA, 20 bp, Artificial Sequence
  chemically synthesized
tacatagtatgcttcttgag

SEQ ID NO: 211782 - DNA, 20 bp, Artificial Sequence
  chemically synthesized
tactacatagtatgcttctt

SEQ ID NO: 211783 - DNA, 20 bp, Artificial Sequence
  chemically synthesized
tactcaagaagcatactatg

SEQ ID NO: 211784 - DNA, 20 bp, Artificial Sequence
  chemically synthesized
cacaaaagtgacatactaca

SEQ ID NO: 211785 - DNA, 20 bp, Artificial Sequence
  chemically synthesized
gttccttgctcaaagcacaa

SEQ ID NO: 211786 - DNA, 20 bp, Artificial Sequence
  chemically synthesized
gtatgtcacttttgtgcttt

SEQ ID NO: 211787 - DNA, 20 bp, Artificial Sequence
  chemically synthesized
gtcacttttgtgctttgagc

SEQ ID NO: 211788 - DNA, 20 bp, Artificial Sequence
  chemically synthesized
tcacttttgtgctttgagca

SEQ ID NO: 211789 - DNA, 20 bp, Artificial Sequence
  chemically synthesized
caaagtatgttccttgctca

SEQ ID NO: 211790 - DNA, 20 bp, Artificial Sequence
  chemically synthesized
ccactgaaatagaggaatca

SEQ ID NO: 211791 - DNA, 20 bp, Artificial Sequence
  chemically synthesized
atactttgattcctctattt

SEQ ID NO: 211792 - DNA, 20 bp, Artificial Sequence
  chemically synthesized
ttttcatcccactgaaatag

SEQ ID NO: 211793 - DNA, 20 bp, Artificial Sequence
  chemically synthesized
gttttcatcccactgaaata

SEQ ID NO: 211794 - DNA, 20 bp, Artificial Sequence
  chemically synthesized
ctttgattcctctatttcag

SEQ ID NO: 211795 - DNA, 20 bp, Artificial Sequence
  chemically synthesized
tttgattcctctatttcagt

SEQ ID NO: 211796 - DNA, 20 bp, Artificial Sequence
  chemically synthesized
ctgttttcatcccactgaaa

SEQ ID NO: 211797 - DNA, 20 bp, Artificial Sequence
  chemically synthesized
ctatttcagtgggatgaaaa

SEQ ID NO: 211798 - DNA, 20 bp, Artificial Sequence
  chemically synthesized
atgaaaacagcttgtgcctc

SEQ ID NO: 211799 - DNA, 20 bp, Artificial Sequence
  chemically synthesized
tgtcttaattctagaggcac

SEQ ID NO: 211800 - DNA, 20 bp, Artificial Sequence
  chemically synthesized
ggccattgtcttaattctag

SEQ ID NO: 211801 - DNA, 20 bp, Artificial Sequence
  chemically synthesized
cagcttgtgcctctagaatt

SEQ ID NO: 211802 - DNA, 20 bp, Artificial Sequence
  chemically synthesized
gggccattgtcttaattcta

SEQ ID NO: 211803 - DNA, 20 bp, Artificial Sequence
  chemically synthesized
gtgggccattgtcttaattc

SEQ ID NO: 211804 - DNA, 20 bp, Artificial Sequence
  chemically synthesized
tgcctctagaattaagacaa

SEQ ID NO: 211805 - DNA, 20 bp, Artificial Sequence
  chemically synthesized
agaattaagacaatggccca

SEQ ID NO: 211806 - DNA, 20 bp, Artificial Sequence
  chemically synthesized
tatcatattattaattctgt

SEQ ID NO: 211807 - DNA, 20 bp, Artificial Sequence
  chemically synthesized
ttatcatattattaattctg

SEQ ID NO: 211808 - DNA, 20 bp, Artificial Sequence
  chemically synthesized
gttattttctgtgaaatata

SEQ ID NO: 211809 - DNA, 20 bp, Artificial Sequence
  chemically synthesized
attaaattctctatatttca

SEQ ID NO: 211810 - DNA, 20 bp, Artificial Sequence
  chemically synthesized
ttgttattttctgtgaaata

SEQ ID NO: 211811 - DNA, 20 bp, Artificial Sequence
  chemically synthesized
ctatctgagggttttattga

SEQ ID NO: 211812 - DNA, 20 bp, Artificial Sequence
  chemically synthesized
atgactgtcaataaaaccct

SEQ ID NO: 211813 - DNA, 20 bp, Artificial Sequence
  chemically synthesized
ctgtcaataaaaccctcaga

SEQ ID NO: 211814 - DNA, 20 bp, Artificial Sequence
  chemically synthesized
tacagagttgaactatctga

SEQ ID NO: 211815 - DNA, 20 bp, Artificial Sequence
  chemically synthesized
atacagagttgaactatctg

SEQ ID NO: 211816 - DNA, 20 bp, Artificial Sequence
  chemically synthesized
tatacagagttgaactatct

SEQ ID NO: 211817 - DNA, 20 bp, Artificial Sequence
  chemically synthesized
tttttcttgttagttataca

SEQ ID NO: 211818 - DNA, 20 bp, Artificial Sequence
  chemically synthesized
aatttttcttgttagttata

SEQ ID NO: 211819 - DNA, 20 bp, Artificial Sequence
  chemically synthesized
ttcaactctgtataactaac

SEQ ID NO: 211820 - DNA, 20 bp, Artificial Sequence
  chemically synthesized
tttaaactaatttttcttgt

SEQ ID NO: 211821 - DNA, 20 bp, Artificial Sequence
  chemically synthesized
gtataactaacaagaaaaat

SEQ ID NO: 211822 - DNA, 20 bp, Artificial Sequence
  chemically synthesized
aagcttttttttttaaagga

SEQ ID NO: 211823 - DNA, 20 bp, Artificial Sequence
  chemically synthesized
taagcttttttttttaaagg

SEQ ID NO: 211824 - DNA, 20 bp, Artificial Sequence
  chemically synthesized
ataagcttttttttttaaag

SEQ ID NO: 211825 - DNA, 20 bp, Artificial Sequence
  chemically synthesized
agataagcttttttttttaa

SEQ ID NO: 211826 - DNA, 20 bp, Artificial Sequence
  chemically synthesized
tagataagctttttttttta

SEQ ID NO: 211827 - DNA, 20 bp, Artificial Sequence
  chemically synthesized
taaccctcctttaaaaaaaa

SEQ ID NO: 211828 - DNA, 20 bp, Artificial Sequence
  chemically synthesized
tatctccagtaaatttagat

SEQ ID NO: 211829 - DNA, 20 bp, Artificial Sequence
  chemically synthesized
aaaagcttatctaaatttac

SEQ ID NO: 211830 - DNA, 20 bp, Artificial Sequence
  chemically synthesized
attgatatctccagtaaatt

SEQ ID NO: 211831 - DNA, 20 bp, Artificial Sequence
  chemically synthesized
aagcttatctaaatttactg

SEQ ID NO: 211832 - DNA, 20 bp, Artificial Sequence
  chemically synthesized
cgtaacctcattgatatctc

SEQ ID NO: 211833 - DNA, 20 bp, Artificial Sequence
  chemically synthesized
aatttactggagatatcaat

SEQ ID NO: 211834 - DNA, 20 bp, Artificial Sequence
  chemically synthesized
atttactggagatatcaatg

SEQ ID NO: 211835 - DNA, 20 bp, Artificial Sequence
  chemically synthesized
tggagatatcaatgaggtta

SEQ ID NO: 211836 - DNA, 20 bp, Artificial Sequence
  chemically synthesized
gagatatcaatgaggttacg

SEQ ID NO: 211837 - DNA, 20 bp, Artificial Sequence
  chemically synthesized
aggttacggagaattatttt

SEQ ID NO: 211838 - DNA, 20 bp, Artificial Sequence
  chemically synthesized
attattttaagaaatgtaaa

SEQ ID NO: 211839 - DNA, 20 bp, Artificial Sequence
  chemically synthesized
ttattttaagaaatgtaaaa

SEQ ID NO: 211840 - DNA, 20 bp, Artificial Sequence
  chemically synthesized
aatgtaaaaaggaaccacaa

SEQ ID NO: 211841 - DNA, 20 bp, Artificial Sequence
  chemically synthesized
taatgagcaaagaaccattg

SEQ ID NO: 211842 - DNA, 20 bp, Artificial Sequence
  chemically synthesized
tagcattttgttaatgagca

SEQ ID NO: 211843 - DNA, 20 bp, Artificial Sequence
  chemically synthesized
ttatgtagcattttgttaat

SEQ ID NO: 211844 - DNA, 20 bp, Artificial Sequence
  chemically synthesized
aaccatctcttgtagttatg

SEQ ID NO: 211845 - DNA, 20 bp, Artificial Sequence
  chemically synthesized
acaaaatgctacataactac

SEQ ID NO: 211846 - DNA, 20 bp, Artificial Sequence
  chemically synthesized
aaaatgctacataactacaa

SEQ ID NO: 211847 - DNA, 20 bp, Artificial Sequence
  chemically synthesized
tgctacataactacaagaga

SEQ ID NO: 211848 - DNA, 20 bp, Artificial Sequence
  chemically synthesized
taattataaaccatctcttg

SEQ ID NO: 211849 - DNA, 20 bp, Artificial Sequence
  chemically synthesized
aagagatggtttataattac

SEQ ID NO: 211850 - DNA, 20 bp, Artificial Sequence
  chemically synthesized
gagatggtttataattacaa

SEQ ID NO: 211851 - DNA, 20 bp, Artificial Sequence
  chemically synthesized
agatggtttataattacaag

SEQ ID NO: 211852 - DNA, 20 bp, Artificial Sequence
  chemically synthesized
agaggttaatcatgctttgc

SEQ ID NO: 211853 - DNA, 20 bp, Artificial Sequence
  chemically synthesized
agtaaattttacaacttgca

SEQ ID NO: 211854 - DNA, 20 bp, Artificial Sequence
  chemically synthesized
agttgtaaaatttactctct

SEQ ID NO: 211855 - DNA, 20 bp, Artificial Sequence
  chemically synthesized
gttgtaaaatttactctctt

SEQ ID NO: 211856 - DNA, 20 bp, Artificial Sequence
  chemically synthesized
cttgaaattatttcctaaga

SEQ ID NO: 211857 - DNA, 20 bp, Artificial Sequence
  chemically synthesized
ctcttgaaattatttcctaa

SEQ ID NO: 211858 - DNA, 20 bp, Artificial Sequence
  chemically synthesized
gactcttgaaattatttcct

SEQ ID NO: 211859 - DNA, 20 bp, Artificial Sequence
  chemically synthesized
ctctcttaggaaataatttc

SEQ ID NO: 211860 - DNA, 20 bp, Artificial Sequence
  chemically synthesized
ctcttaggaaataatttcaa

SEQ ID NO: 211861 - DNA, 20 bp, Artificial Sequence
  chemically synthesized
ttaacctgttaacaatcagt

SEQ ID NO: 211862 - DNA, 20 bp, Artificial Sequence
  chemically synthesized
tttaacctgttaacaatcag

SEQ ID NO: 211863 - DNA, 20 bp, Artificial Sequence
  chemically synthesized
ttttttaacctgttaacaat

SEQ ID NO: 211864 - DNA, 20 bp, Artificial Sequence
  chemically synthesized
agagtcctactgattgttaa

SEQ ID NO: 211865 - DNA, 20 bp, Artificial Sequence
  chemically synthesized
gagtcctactgattgttaac

SEQ ID NO: 211866 - DNA, 20 bp, Artificial Sequence
  chemically synthesized
aatgtgttaacaaacgttga

SEQ ID NO: 211867 - DNA, 20 bp, Artificial Sequence
  chemically synthesized
taatgtgttaacaaacgttg

SEQ ID NO: 211868 - DNA, 20 bp, Artificial Sequence
  chemically synthesized
acgtttgttaacacattaaa

SEQ ID NO: 211869 - DNA, 20 bp, Artificial Sequence
  chemically synthesized
tggtaaaggccaaatatgtg

SEQ ID NO: 211870 - DNA, 20 bp, Artificial Sequence
  chemically synthesized
ttaaaaagtcttcacatatt

SEQ ID NO: 211871 - DNA, 20 bp, Artificial Sequence
  chemically synthesized
cacatatttggcctttacca

SEQ ID NO: 211872 - DNA, 20 bp, Artificial Sequence
  chemically synthesized
actactgcctactttggtaa

SEQ ID NO: 211873 - DNA, 20 bp, Artificial Sequence
  chemically synthesized
cactactgcctactttggta

SEQ ID NO: 211874 - DNA, 20 bp, Artificial Sequence
  chemically synthesized
atatttggcctttaccaaag

SEQ ID NO: 211875 - DNA, 20 bp, Artificial Sequence
  chemically synthesized
tatttggcctttaccaaagt

SEQ ID NO: 211876 - DNA, 20 bp, Artificial Sequence
  chemically synthesized
ttggcctttaccaaagtagg

SEQ ID NO: 211877 - DNA, 20 bp, Artificial Sequence
  chemically synthesized
atggtcactactgcctactt

SEQ ID NO: 211878 - DNA, 20 bp, Artificial Sequence
  chemically synthesized
gcctttaccaaagtaggcag

SEQ ID NO: 211879 - DNA, 20 bp, Artificial Sequence
  chemically synthesized
aaagtaggcagtagtgacca

SEQ ID NO: 211880 - DNA, 20 bp, Artificial Sequence
  chemically synthesized
tattaaagtataggtgacca

SEQ ID NO: 211881 - DNA, 20 bp, Artificial Sequence
  chemically synthesized
tctaaaaactattaaagtat

SEQ ID NO: 211882 - DNA, 20 bp, Artificial Sequence
  chemically synthesized
ttctaaaaactattaaagta

SEQ ID NO: 211883 - DNA, 20 bp, Artificial Sequence
  chemically synthesized
catggtcacctatactttaa

SEQ ID NO: 211884 - DNA, 20 bp, Artificial Sequence
  chemically synthesized
agttgttctaaaaactatta

SEQ ID NO: 211885 - DNA, 20 bp, Artificial Sequence
  chemically synthesized
acctatactttaatagtttt

SEQ ID NO: 211886 - DNA, 20 bp, Artificial Sequence
  chemically synthesized
tttttagaacaacttataca

SEQ ID NO: 211887 - DNA, 20 bp, Artificial Sequence
  chemically synthesized
ccatttcaagaactatgtat

SEQ ID NO: 211888 - DNA, 20 bp, Artificial Sequence
  chemically synthesized
cttatacatagttcttgaaa

SEQ ID NO: 211889 - DNA, 20 bp, Artificial Sequence
  chemically synthesized
ctaattcttattgccatttc

SEQ ID NO: 211890 - DNA, 20 bp, Artificial Sequence
  chemically synthesized
atagttcttgaaatggcaat

SEQ ID NO: 211891 - DNA, 20 bp, Artificial Sequence
  chemically synthesized
cttgaaatggcaataagaat

SEQ ID NO: 211892 - DNA, 20 bp, Artificial Sequence
  chemically synthesized
gaaatggcaataagaattag

SEQ ID NO: 211893 - DNA, 20 bp, Artificial Sequence
  chemically synthesized
acacaatattgttaaaactc

SEQ ID NO: 211894 - DNA, 20 bp, Artificial Sequence
  chemically synthesized
acatatctaagtgaacactg

SEQ ID NO: 211895 - DNA, 20 bp, Artificial Sequence
  chemically synthesized
ttacatatctaagtgaacac

SEQ ID NO: 211896 - DNA, 20 bp, Artificial Sequence
  chemically synthesized
ttaaaactccagtgttcact

SEQ ID NO: 211897 - DNA, 20 bp, Artificial Sequence
  chemically synthesized
gttacatagattacatatct

SEQ ID NO: 211898 - DNA, 20 bp, Artificial Sequence
  chemically synthesized
aattatgcaatattgttaca

SEQ ID NO: 211899 - DNA, 20 bp, Artificial Sequence
  chemically synthesized
gtaacaatattgcataattg

SEQ ID NO: 211900 - DNA, 20 bp, Artificial Sequence
  chemically synthesized
aacaatattgcataattgaa

SEQ ID NO: 211901 - DNA, 20 bp, Artificial Sequence
  chemically synthesized
gcataattgaagagtttgcc

SEQ ID NO: 211902 - DNA, 20 bp, Artificial Sequence
  chemically synthesized
atatacatcagtaattatct

SEQ ID NO: 211903 - DNA, 20 bp, Artificial Sequence
  chemically synthesized
gaagaaaaatatatatacat

SEQ ID NO: 211904 - DNA, 20 bp, Artificial Sequence
  chemically synthesized
gccatgaatatttgtaaatg

SEQ ID NO: 211905 - DNA, 20 bp, Artificial Sequence
  chemically synthesized
tcttcatttacaaatattca

SEQ ID NO: 211906 - DNA, 20 bp, Artificial Sequence
  chemically synthesized
atcaataatgccaaaatgtt

SEQ ID NO: 211907 - DNA, 20 bp, Artificial Sequence
  chemically synthesized
acaaaaataactaaacattt

SEQ ID NO: 211908 - DNA, 20 bp, Artificial Sequence
  chemically synthesized
aaatgtttagttatttttgt

SEQ ID NO: 211909 - DNA, 20 bp, Artificial Sequence
  chemically synthesized
tattatctgttttgtgtatt

SEQ ID NO: 211910 - DNA, 20 bp, Artificial Sequence
  chemically synthesized
agatatctcaatacacaaaa

SEQ ID NO: 211911 - DNA, 20 bp, Artificial Sequence
  chemically synthesized
tcaatacacaaaacagataa

SEQ ID NO: 211912 - DNA, 20 bp, Artificial Sequence
  chemically synthesized
aaatataaattaatgtttgt

SEQ ID NO: 211913 - DNA, 20 bp, Artificial Sequence
  chemically synthesized
atataaattaatgtttgtta

SEQ ID NO: 211914 - DNA, 20 bp, Artificial Sequence
  chemically synthesized
ttgttagagtctatttattt

SEQ ID NO: 211915 - DNA, 20 bp, Artificial Sequence
  chemically synthesized
agatgtgtatctaaaataaa

SEQ ID NO: 211916 - DNA, 20 bp, Artificial Sequence
  chemically synthesized
tcttaatgctgttgaaggaa

SEQ ID NO: 211917 - DNA, 20 bp, Artificial Sequence
  chemically synthesized
atacacatctcttccttcaa

SEQ ID NO: 211918 - DNA, 20 bp, Artificial Sequence
  chemically synthesized
tttcttaatgctgttgaagg

SEQ ID NO: 211919 - DNA, 20 bp, Artificial Sequence
  chemically synthesized
gtatttcttaatgctgttga

SEQ ID NO: 211920 - DNA, 20 bp, Artificial Sequence
  chemically synthesized
tgtatttcttaatgctgttg

SEQ ID NO: 211921 - DNA, 20 bp, Artificial Sequence
  chemically synthesized
tctcttccttcaacagcatt

SEQ ID NO: 211922 - DNA, 20 bp, Artificial Sequence
  chemically synthesized
attaagaaatacacaatctc

SEQ ID NO: 211923 - DNA, 20 bp, Artificial Sequence
  chemically synthesized
gaaatacacaatctccagtg

SEQ ID NO: 211924 - DNA, 20 bp, Artificial Sequence
  chemically synthesized
aaatacacaatctccagtgt

SEQ ID NO: 211925 - DNA, 20 bp, Artificial Sequence
  chemically synthesized
tataaggaggtcctacactg

SEQ ID NO: 211926 - DNA, 20 bp, Artificial Sequence
  chemically synthesized
tctataaggaggtcctacac

SEQ ID NO: 211927 - DNA, 20 bp, Artificial Sequence
  chemically synthesized
tccagtgtaggacctcctta

SEQ ID NO: 211928 - DNA, 20 bp, Artificial Sequence
  chemically synthesized
tagaatgtttttctataagg

SEQ ID NO: 211929 - DNA, 20 bp, Artificial Sequence
  chemically synthesized
atagaatgtttttctataag

SEQ ID NO: 211930 - DNA, 20 bp, Artificial Sequence
  chemically synthesized
tgatagaatgtttttctata

SEQ ID NO: 211931 - DNA, 20 bp, Artificial Sequence
  chemically synthesized
gtgatagaatgtttttctat

SEQ ID NO: 211932 - DNA, 20 bp, Artificial Sequence
  chemically synthesized
aataaccctatgcaaagtga

SEQ ID NO: 211933 - DNA, 20 bp, Artificial Sequence
  chemically synthesized
aaacattctatcactttgca

SEQ ID NO: 211934 - DNA, 20 bp, Artificial Sequence
  chemically synthesized
aacattctatcactttgcat

SEQ ID NO: 211935 - DNA, 20 bp, Artificial Sequence
  chemically synthesized
acattctatcactttgcata

SEQ ID NO: 211936 - DNA, 20 bp, Artificial Sequence
  chemically synthesized
catctgaataaccctatgca

SEQ ID NO: 211937 - DNA, 20 bp, Artificial Sequence
  chemically synthesized
tcactttgcatagggttatt

SEQ ID NO: 211938 - DNA, 20 bp, Artificial Sequence
  chemically synthesized
catagggttattcagatgtg

SEQ ID NO: 211939 - DNA, 20 bp, Artificial Sequence
  chemically synthesized
atagggttattcagatgtgc

SEQ ID NO: 211940 - DNA, 20 bp, Artificial Sequence
  chemically synthesized
ggttattcagatgtgcagga

SEQ ID NO: 211941 - DNA, 20 bp, Artificial Sequence
  chemically synthesized
cagatgtgcaggaaagaacc

SEQ ID NO: 211942 - DNA, 20 bp, Artificial Sequence
  chemically synthesized
gataaccaataattatttct

SEQ ID NO: 211943 - DNA, 20 bp, Artificial Sequence
  chemically synthesized
aagaaccaagaaataattat

SEQ ID NO: 211944 - DNA, 20 bp, Artificial Sequence
  chemically synthesized
gcctatgaattttagtataa

SEQ ID NO: 211945 - DNA, 20 bp, Artificial Sequence
  chemically synthesized
atctattatactaaaattca

SEQ ID NO: 211946 - DNA, 20 bp, Artificial Sequence
  chemically synthesized
cccttcaggcctatgaattt

SEQ ID NO: 211947 - DNA, 20 bp, Artificial Sequence
  chemically synthesized
tctattatactaaaattcat

SEQ ID NO: 211948 - DNA, 20 bp, Artificial Sequence
  chemically synthesized
tactaaaattcataggcctg

SEQ ID NO: 211949 - DNA, 20 bp, Artificial Sequence
  chemically synthesized
actaaaattcataggcctga

SEQ ID NO: 211950 - DNA, 20 bp, Artificial Sequence
  chemically synthesized
ctaaaattcataggcctgaa

SEQ ID NO: 211951 - DNA, 20 bp, Artificial Sequence
  chemically synthesized
cctattttgatgtacccttc

SEQ ID NO: 211952 - DNA, 20 bp, Artificial Sequence
  chemically synthesized
tcctattttgatgtaccctt

SEQ ID NO: 211953 - DNA, 20 bp, Artificial Sequence
  chemically synthesized
gcctgaagggtacatcaaaa

SEQ ID NO: 211954 - DNA, 20 bp, Artificial Sequence
  chemically synthesized
cctgaagggtacatcaaaat

SEQ ID NO: 211955 - DNA, 20 bp, Artificial Sequence
  chemically synthesized
gaagggtacatcaaaatagg

SEQ ID NO: 211956 - DNA, 20 bp, Artificial Sequence
  chemically synthesized
ggtacatcaaaataggaaga

SEQ ID NO: 211957 - DNA, 20 bp, Artificial Sequence
  chemically synthesized
atcaaaataggaagatagcc

SEQ ID NO: 211958 - DNA, 20 bp, Artificial Sequence
  chemically synthesized
ataggaagatagccaagaaa

SEQ ID NO: 211959 - DNA, 20 bp, Artificial Sequence
  chemically synthesized
tgaaaatgaacaccatttct

SEQ ID NO: 211960 - DNA, 20 bp, Artificial Sequence
  chemically synthesized
aagaaatggtgttcattttc

SEQ ID NO: 211961 - DNA, 20 bp, Artificial Sequence
  chemically synthesized
attttcaagtatctttactc

SEQ ID NO: 211962 - DNA, 20 bp, Artificial Sequence
  chemically synthesized
ttacagacttagcttgagta

SEQ ID NO: 211963 - DNA, 20 bp, Artificial Sequence
  chemically synthesized
caagtatctttactcaagct

SEQ ID NO: 211964 - DNA, 20 bp, Artificial Sequence
  chemically synthesized
atgacttacagacttagctt

SEQ ID NO: 211965 - DNA, 20 bp, Artificial Sequence
  chemically synthesized
tttactcaagctaagtctgt

SEQ ID NO: 211966 - DNA, 20 bp, Artificial Sequence
  chemically synthesized
gaatacatgacttacagact

SEQ ID NO: 211967 - DNA, 20 bp, Artificial Sequence
  chemically synthesized
ttttgtgaatacatgactta

SEQ ID NO: 211968 - DNA, 20 bp, Artificial Sequence
  chemically synthesized
tgtattcacaaaacgatgct

SEQ ID NO: 211969 - DNA, 20 bp, Artificial Sequence
  chemically synthesized
attcacaaaacgatgcttag

SEQ ID NO: 211970 - DNA, 20 bp, Artificial Sequence
  chemically synthesized
gtgtactgccacaagccact

SEQ ID NO: 211971 - DNA, 20 bp, Artificial Sequence
  chemically synthesized
aaacgatgcttagtggcttg

SEQ ID NO: 211972 - DNA, 20 bp, Artificial Sequence
  chemically synthesized
cgatgcttagtggcttgtgg

SEQ ID NO: 211973 - DNA, 20 bp, Artificial Sequence
  chemically synthesized
tatttacagtgtactgccac

SEQ ID NO: 211974 - DNA, 20 bp, Artificial Sequence
  chemically synthesized
tacagctcatttggtattta

SEQ ID NO: 211975 - DNA, 20 bp, Artificial Sequence
  chemically synthesized
gtacactgtaaataccaaat

SEQ ID NO: 211976 - DNA, 20 bp, Artificial Sequence
  chemically synthesized
aaagtcctatacagctcatt

SEQ ID NO: 211977 - DNA, 20 bp, Artificial Sequence
  chemically synthesized
taaataccaaatgagctgta

SEQ ID NO: 211978 - DNA, 20 bp, Artificial Sequence
  chemically synthesized
aaataccaaatgagctgtat

SEQ ID NO: 211979 - DNA, 20 bp, Artificial Sequence
  chemically synthesized
catttcctgaaagtcctata

SEQ ID NO: 211980 - DNA, 20 bp, Artificial Sequence
  chemically synthesized
aatgagctgtataggacttt

SEQ ID NO: 211981 - DNA, 20 bp, Artificial Sequence
  chemically synthesized
atgagctgtataggactttc

SEQ ID NO: 211982 - DNA, 20 bp, Artificial Sequence
  chemically synthesized
caaaaaccatcatttcctga

SEQ ID NO: 211983 - DNA, 20 bp, Artificial Sequence
  chemically synthesized
ataggactttcaggaaatga

SEQ ID NO: 211984 - DNA, 20 bp, Artificial Sequence
  chemically synthesized
ttcaggaaatgatggttttt

SEQ ID NO: 211985 - DNA, 20 bp, Artificial Sequence
  chemically synthesized
caggaaatgatggtttttga

SEQ ID NO: 211986 - DNA, 20 bp, Artificial Sequence
  chemically synthesized
ggaaatgatggtttttgaga

SEQ ID NO: 211987 - DNA, 20 bp, Artificial Sequence
  chemically synthesized
aatgatggtttttgagagag

SEQ ID NO: 211988 - DNA, 20 bp, Artificial Sequence
  chemically synthesized
atgatggtttttgagagagt

SEQ ID NO: 211989 - DNA, 20 bp, Artificial Sequence
  chemically synthesized
ggtttttgagagagtaggtg

SEQ ID NO: 211990 - DNA, 20 bp, Artificial Sequence
  chemically synthesized
ttttgagagagtaggtgtgg

SEQ ID NO: 211991 - DNA, 20 bp, Artificial Sequence
  chemically synthesized
tttgagagagtaggtgtggc

SEQ ID NO: 211992 - DNA, 20 bp, Artificial Sequence
  chemically synthesized
agtaggtgtggcaggtcttc

SEQ ID NO: 211993 - DNA, 20 bp, Artificial Sequence
  chemically synthesized
gtaggtgtggcaggtcttca

SEQ ID NO: 211994 - DNA, 20 bp, Artificial Sequence
  chemically synthesized
taggtgtggcaggtcttcaa

SEQ ID NO: 211995 - DNA, 20 bp, Artificial Sequence
  chemically synthesized
aggtgtggcaggtcttcaag

SEQ ID NO: 211996 - DNA, 20 bp, Artificial Sequence
  chemically synthesized
ggtgtggcaggtcttcaagg

SEQ ID NO: 211997 - DNA, 20 bp, Artificial Sequence
  chemically synthesized
caagtcccattgcccccttg

SEQ ID NO: 211998 - DNA, 20 bp, Artificial Sequence
  chemically synthesized
gcaggtcttcaagggggcaa

SEQ ID NO: 211999 - DNA, 20 bp, Artificial Sequence
  chemically synthesized
caggtcttcaagggggcaat

SEQ ID NO: 212000 - DNA, 20 bp, Artificial Sequence
  chemically synthesized
tcaagggggcaatgggactt

SEQ ID NO: 212001 - DNA, 20 bp, Artificial Sequence
  chemically synthesized
gggggcaatgggacttgagc

SEQ ID NO: 212002 - DNA, 20 bp, Artificial Sequence
  chemically synthesized
tcatcacaagacacttgctc

SEQ ID NO: 212003 - DNA, 20 bp, Artificial Sequence
  chemically synthesized
gagcaagtgtcttgtgatga

SEQ ID NO: 212004 - DNA, 20 bp, Artificial Sequence
  chemically synthesized
caaattacacccatcatcac

SEQ ID NO: 212005 - DNA, 20 bp, Artificial Sequence
  chemically synthesized
agcaagtgtcttgtgatgat

SEQ ID NO: 212006 - DNA, 20 bp, Artificial Sequence
  chemically synthesized
gtgtaatttgtaccttgcat

SEQ ID NO: 212007 - DNA, 20 bp, Artificial Sequence
  chemically synthesized
tgtaatttgtaccttgcatg

SEQ ID NO: 212008 - DNA, 20 bp, Artificial Sequence
  chemically synthesized
gtaatttgtaccttgcatga

SEQ ID NO: 212009 - DNA, 20 bp, Artificial Sequence
  chemically synthesized
tcgccatttaccctcatgca

SEQ ID NO: 212010 - DNA, 20 bp, Artificial Sequence
  chemically synthesized
ttcgccatttaccctcatgc

SEQ ID NO: 212011 - DNA, 20 bp, Artificial Sequence
  chemically synthesized
gtaccttgcatgagggtaaa

SEQ ID NO: 212012 - DNA, 20 bp, Artificial Sequence
  chemically synthesized
gcatgagggtaaatggcgaa

SEQ ID NO: 212013 - DNA, 20 bp, Artificial Sequence
  chemically synthesized
catgagggtaaatggcgaac

SEQ ID NO: 212014 - DNA, 20 bp, Artificial Sequence
  chemically synthesized
tgagggtaaatggcgaacag

SEQ ID NO: 212015 - DNA, 20 bp, Artificial Sequence
  chemically synthesized
agggtaaatggcgaacagga

SEQ ID NO: 212016 - DNA, 20 bp, Artificial Sequence
  chemically synthesized
aaatggcgaacaggagagca

SEQ ID NO: 212017 - DNA, 20 bp, Artificial Sequence
  chemically synthesized
aatggcgaacaggagagcat

SEQ ID NO: 212018 - DNA, 20 bp, Artificial Sequence
  chemically synthesized
atggcgaacaggagagcatg

SEQ ID NO: 212019 - DNA, 20 bp, Artificial Sequence
  chemically synthesized
cgaacaggagagcatggggc

SEQ ID NO: 212020 - DNA, 20 bp, Artificial Sequence
  chemically synthesized
tgatttgtctcatgtttttc

SEQ ID NO: 212021 - DNA, 20 bp, Artificial Sequence
  chemically synthesized
gcatggggctagaaaaacat

SEQ ID NO: 212022 - DNA, 20 bp, Artificial Sequence
  chemically synthesized
tagaaaaacatgagacaaat

SEQ ID NO: 212023 - DNA, 20 bp, Artificial Sequence
  chemically synthesized
gaaaaacatgagacaaatca

SEQ ID NO: 212024 - DNA, 20 bp, Artificial Sequence
  chemically synthesized
aaaaacatgagacaaatcag

SEQ ID NO: 212025 - DNA, 20 bp, Artificial Sequence
  chemically synthesized
acatgagacaaatcagagga

SEQ ID NO: 212026 - DNA, 20 bp, Artificial Sequence
  chemically synthesized
aatcagaggacagttaatgc

SEQ ID NO: 212027 - DNA, 20 bp, Artificial Sequence
  chemically synthesized
ggacagttaatgctggcatt

SEQ ID NO: 212028 - DNA, 20 bp, Artificial Sequence
  chemically synthesized
ccagcacatcttctaaatgc

SEQ ID NO: 212029 - DNA, 20 bp, Artificial Sequence
  chemically synthesized
cagttaatgctggcatttag

SEQ ID NO: 212030 - DNA, 20 bp, Artificial Sequence
  chemically synthesized
ctggcatttagaagatgtgc

SEQ ID NO: 212031 - DNA, 20 bp, Artificial Sequence
  chemically synthesized
ggcatttagaagatgtgctg

SEQ ID NO: 212032 - DNA, 20 bp, Artificial Sequence
  chemically synthesized
gcatttagaagatgtgctgg

SEQ ID NO: 212033 - DNA, 20 bp, Artificial Sequence
  chemically synthesized
ctcttttggtaattcacctc

SEQ ID NO: 212034 - DNA, 20 bp, Artificial Sequence
  chemically synthesized
tgctggaggtgaattaccaa

SEQ ID NO: 212035 - DNA, 20 bp, Artificial Sequence
  chemically synthesized
ctggaggtgaattaccaaaa

SEQ ID NO: 212036 - DNA, 20 bp, Artificial Sequence
  chemically synthesized
caagccctttcagactcttt

SEQ ID NO: 212037 - DNA, 20 bp, Artificial Sequence
  chemically synthesized
gaattaccaaaagagtctga

SEQ ID NO: 212038 - DNA, 20 bp, Artificial Sequence
  chemically synthesized
aattaccaaaagagtctgaa

SEQ ID NO: 212039 - DNA, 20 bp, Artificial Sequence
  chemically synthesized
attaccaaaagagtctgaaa

SEQ ID NO: 212040 - DNA, 20 bp, Artificial Sequence
  chemically synthesized
gaataatctccaagcccttt

SEQ ID NO: 212041 - DNA, 20 bp, Artificial Sequence
  chemically synthesized
caaaagagtctgaaagggct

SEQ ID NO: 212042 - DNA, 20 bp, Artificial Sequence
  chemically synthesized
aaagagtctgaaagggcttg

SEQ ID NO: 212043 - DNA, 20 bp, Artificial Sequence
  chemically synthesized
tggaaggaggaataatctcc

SEQ ID NO: 212044 - DNA, 20 bp, Artificial Sequence
  chemically synthesized
ttggagattattcctccttc

SEQ ID NO: 212045 - DNA, 20 bp, Artificial Sequence
  chemically synthesized
ggagattattcctccttcca

SEQ ID NO: 212046 - DNA, 20 bp, Artificial Sequence
  chemically synthesized
gtttcttcacctctggaagg

SEQ ID NO: 212047 - DNA, 20 bp, Artificial Sequence
  chemically synthesized
gagattattcctccttccag

SEQ ID NO: 212048 - DNA, 20 bp, Artificial Sequence
  chemically synthesized
tgtttcttcacctctggaag

SEQ ID NO: 212049 - DNA, 20 bp, Artificial Sequence
  chemically synthesized
cctgtttcttcacctctgga

SEQ ID NO: 212050 - DNA, 20 bp, Artificial Sequence
  chemically synthesized
gcctgtttcttcacctctgg

SEQ ID NO: 212051 - DNA, 20 bp, Artificial Sequence
  chemically synthesized
tattcctccttccagaggtg

SEQ ID NO: 212052 - DNA, 20 bp, Artificial Sequence
  chemically synthesized
tgggcctgtttcttcacctc

SEQ ID NO: 212053 - DNA, 20 bp, Artificial Sequence
  chemically synthesized
tccttccagaggtgaagaaa

SEQ ID NO: 212054 - DNA, 20 bp, Artificial Sequence
  chemically synthesized
ccttccagaggtgaagaaac

SEQ ID NO: 212055 - DNA, 20 bp, Artificial Sequence
  chemically synthesized
cagaggtgaagaaacaggcc

SEQ ID NO: 212056 - DNA, 20 bp, Artificial Sequence
  chemically synthesized
gaggtgaagaaacaggccca

SEQ ID NO: 212057 - DNA, 20 bp, Artificial Sequence
  chemically synthesized
tcaagttatgcaacgactct

SEQ ID NO: 212058 - DNA, 20 bp, Artificial Sequence
  chemically synthesized
atcaagttatgcaacgactc

SEQ ID NO: 212059 - DNA, 20 bp, Artificial Sequence
  chemically synthesized
cagggccctattatttgatc

SEQ ID NO: 212060 - DNA, 20 bp, Artificial Sequence
  chemically synthesized
tgcataacttgatcaaataa

SEQ ID NO: 212061 - DNA, 20 bp, Artificial Sequence
  chemically synthesized
gcataacttgatcaaataat

SEQ ID NO: 212062 - DNA, 20 bp, Artificial Sequence
  chemically synthesized
cataacttgatcaaataata

SEQ ID NO: 212063 - DNA, 20 bp, Artificial Sequence
  chemically synthesized
gacgatgattcaaaaagaca

SEQ ID NO: 212064 - DNA, 20 bp, Artificial Sequence
  chemically synthesized
ggacgatgattcaaaaagac

SEQ ID NO: 212065 - DNA, 20 bp, Artificial Sequence
  chemically synthesized
tggacgatgattcaaaaaga

SEQ ID NO: 212066 - DNA, 20 bp, Artificial Sequence
  chemically synthesized
gcagtggacgatgattcaaa

SEQ ID NO: 212067 - DNA, 20 bp, Artificial Sequence
  chemically synthesized
gaatcatcgtccactgcctc

SEQ ID NO: 212068 - DNA, 20 bp, Artificial Sequence
  chemically synthesized
atggaagtagctcgaggcag

SEQ ID NO: 212069 - DNA, 20 bp, Artificial Sequence
  chemically synthesized
gaaatggaagtagctcgagg

SEQ ID NO: 212070 - DNA, 20 bp, Artificial Sequence
  chemically synthesized
gaggaaatggaagtagctcg

SEQ ID NO: 212071 - DNA, 20 bp, Artificial Sequence
  chemically synthesized
agaggaaatggaagtagctc

SEQ ID NO: 212072 - DNA, 20 bp, Artificial Sequence
  chemically synthesized
aagaatagaggaaatggaag

SEQ ID NO: 212073 - DNA, 20 bp, Artificial Sequence
  chemically synthesized
tgaaagaatagaggaaatgg

SEQ ID NO: 212074 - DNA, 20 bp, Artificial Sequence
  chemically synthesized
tagtgaaagaatagaggaaa

SEQ ID NO: 212075 - DNA, 20 bp, Artificial Sequence
  chemically synthesized
tttaactagtgaaagaatag

SEQ ID NO: 212076 - DNA, 20 bp, Artificial Sequence
  chemically synthesized
ttttaactagtgaaagaata

SEQ ID NO: 212077 - DNA, 20 bp, Artificial Sequence
  chemically synthesized
cattttaactagtgaaagaa

SEQ ID NO: 212078 - DNA, 20 bp, Artificial Sequence
  chemically synthesized
catttcctctattctttcac

SEQ ID NO: 212079 - DNA, 20 bp, Artificial Sequence
  chemically synthesized
aggtacattttaactagtga

SEQ ID NO: 212080 - DNA, 20 bp, Artificial Sequence
  chemically synthesized
gtgaaaaggtacattttaac

SEQ ID NO: 212081 - DNA, 20 bp, Artificial Sequence
  chemically synthesized
gtcattttcacaaagtgaaa

SEQ ID NO: 212082 - DNA, 20 bp, Artificial Sequence
  chemically synthesized
cgtcattttcacaaagtgaa

SEQ ID NO: 212083 - DNA, 20 bp, Artificial Sequence
  chemically synthesized
tcactcacgtcattttcaca

SEQ ID NO: 212084 - DNA, 20 bp, Artificial Sequence
  chemically synthesized
tcactttgtgaaaatgacgt

SEQ ID NO: 212085 - DNA, 20 bp, Artificial Sequence
  chemically synthesized
tttgtgaaaatgacgtgagt

SEQ ID NO: 212086 - DNA, 20 bp, Artificial Sequence
  chemically synthesized
tgtgaaaatgacgtgagtga

SEQ ID NO: 212087 - DNA, 20 bp, Artificial Sequence
  chemically synthesized
aatgacgtgagtgagagtaa

SEQ ID NO: 212088 - DNA, 20 bp, Artificial Sequence
  chemically synthesized
ggcttgaaactatggataac

SEQ ID NO: 212089 - DNA, 20 bp, Artificial Sequence
  chemically synthesized
agaaaatatctcgttatcca

SEQ ID NO: 212090 - DNA, 20 bp, Artificial Sequence
  chemically synthesized
atctcgttatccatagtttc

SEQ ID NO: 212091 - DNA, 20 bp, Artificial Sequence
  chemically synthesized
caaatctaggcttgaaacta

SEQ ID NO: 212092 - DNA, 20 bp, Artificial Sequence
  chemically synthesized
gttatccatagtttcaagcc

SEQ ID NO: 212093 - DNA, 20 bp, Artificial Sequence
  chemically synthesized
tagtttcaagcctagatttg

SEQ ID NO: 212094 - DNA, 20 bp, Artificial Sequence
  chemically synthesized
attctgacttccacaaatct

SEQ ID NO: 212095 - DNA, 20 bp, Artificial Sequence
  chemically synthesized
cattctgacttccacaaatc

SEQ ID NO: 212096 - DNA, 20 bp, Artificial Sequence
  chemically synthesized
tttcaagcctagatttgtgg

SEQ ID NO: 212097 - DNA, 20 bp, Artificial Sequence
  chemically synthesized
aagcctagatttgtggaagt

SEQ ID NO: 212098 - DNA, 20 bp, Artificial Sequence
  chemically synthesized
atttgtggaagtcagaatga

SEQ ID NO: 212099 - DNA, 20 bp, Artificial Sequence
  chemically synthesized
atgaaaacttgttatattaa

SEQ ID NO: 212100 - DNA, 20 bp, Artificial Sequence
  chemically synthesized
acagtttcttttaatataac

SEQ ID NO: 212101 - DNA, 20 bp, Artificial Sequence
  chemically synthesized
ttcattgataaaattatttt

SEQ ID NO: 212102 - DNA, 20 bp, Artificial Sequence
  chemically synthesized
ttattttcagaaaattctct

SEQ ID NO: 212103 - DNA, 20 bp, Artificial Sequence
  chemically synthesized
aaccaactcaagagtactta

SEQ ID NO: 212104 - DNA, 20 bp, Artificial Sequence
  chemically synthesized
ttaaccaactcaagagtact

SEQ ID NO: 212105 - DNA, 20 bp, Artificial Sequence
  chemically synthesized
aaaattctctaagtactctt

SEQ ID NO: 212106 - DNA, 20 bp, Artificial Sequence
  chemically synthesized
ttctctaagtactcttgagt

SEQ ID NO: 212107 - DNA, 20 bp, Artificial Sequence
  chemically synthesized
aaggactttaaccaactcaa

SEQ ID NO: 212108 - DNA, 20 bp, Artificial Sequence
  chemically synthesized
ataaggactttaaccaactc

SEQ ID NO: 212109 - DNA, 20 bp, Artificial Sequence
  chemically synthesized
aagtactcttgagttggtta

SEQ ID NO: 212110 - DNA, 20 bp, Artificial Sequence
  chemically synthesized
tttctttggggagggaaata

SEQ ID NO: 212111 - DNA, 20 bp, Artificial Sequence
  chemically synthesized
ttttctttggggagggaaat

SEQ ID NO: 212112 - DNA, 20 bp, Artificial Sequence
  chemically synthesized
agtccttatttccctcccca

SEQ ID NO: 212113 - DNA, 20 bp, Artificial Sequence
  chemically synthesized
tttaagattttctttgggga

SEQ ID NO: 212114 - DNA, 20 bp, Artificial Sequence
  chemically synthesized
atttaagattttctttgggg

SEQ ID NO: 212115 - DNA, 20 bp, Artificial Sequence
  chemically synthesized
aatttaagattttctttggg

SEQ ID NO: 212116 - DNA, 20 bp, Artificial Sequence
  chemically synthesized
ggaatttaagattttctttg

SEQ ID NO: 212117 - DNA, 20 bp, Artificial Sequence
  chemically synthesized
aggaatttaagattttcttt

SEQ ID NO: 212118 - DNA, 20 bp, Artificial Sequence
  chemically synthesized
gaggaatttaagattttctt

SEQ ID NO: 212119 - DNA, 20 bp, Artificial Sequence
  chemically synthesized
gacctggtctcgaggaattt

SEQ ID NO: 212120 - DNA, 20 bp, Artificial Sequence
  chemically synthesized
aagaaaatcttaaattcctc

SEQ ID NO: 212121 - DNA, 20 bp, Artificial Sequence
  chemically synthesized
aatcttaaattcctcgagac

SEQ ID NO: 212122 - DNA, 20 bp, Artificial Sequence
  chemically synthesized
atcttaaattcctcgagacc

SEQ ID NO: 212123 - DNA, 20 bp, Artificial Sequence
  chemically synthesized
catacacagacctggtctcg

SEQ ID NO: 212124 - DNA, 20 bp, Artificial Sequence
  chemically synthesized
tcatacacagacctggtctc

SEQ ID NO: 212125 - DNA, 20 bp, Artificial Sequence
  chemically synthesized
agatgattcatacacagacc

SEQ ID NO: 212126 - DNA, 20 bp, Artificial Sequence
  chemically synthesized
gatttcagatgattcataca

SEQ ID NO: 212127 - DNA, 20 bp, Artificial Sequence
  chemically synthesized
catccctttggggaggattt

SEQ ID NO: 212128 - DNA, 20 bp, Artificial Sequence
  chemically synthesized
atcatctgaaatcctcccca

SEQ ID NO: 212129 - DNA, 20 bp, Artificial Sequence
  chemically synthesized
tcatctgaaatcctccccaa

SEQ ID NO: 212130 - DNA, 20 bp, Artificial Sequence
  chemically synthesized
catctgaaatcctccccaaa

SEQ ID NO: 212131 - DNA, 20 bp, Artificial Sequence
  chemically synthesized
cattatccatccctttgggg

SEQ ID NO: 212132 - DNA, 20 bp, Artificial Sequence
  chemically synthesized
gcattatccatccctttggg

SEQ ID NO: 212133 - DNA, 20 bp, Artificial Sequence
  chemically synthesized
aggcattatccatccctttg

SEQ ID NO: 212134 - DNA, 20 bp, Artificial Sequence
  chemically synthesized
tgaaatcctccccaaaggga

SEQ ID NO: 212135 - DNA, 20 bp, Artificial Sequence
  chemically synthesized
aaggcattatccatcccttt

SEQ ID NO: 212136 - DNA, 20 bp, Artificial Sequence
  chemically synthesized
aaaggcattatccatccctt

SEQ ID NO: 212137 - DNA, 20 bp, Artificial Sequence
  chemically synthesized
aagcacctacatttagacaa

SEQ ID NO: 212138 - DNA, 20 bp, Artificial Sequence
  chemically synthesized
taagcacctacatttagaca

SEQ ID NO: 212139 - DNA, 20 bp, Artificial Sequence
  chemically synthesized
ataatgcctttgtctaaatg

SEQ ID NO: 212140 - DNA, 20 bp, Artificial Sequence
  chemically synthesized
taatgcctttgtctaaatgt

SEQ ID NO: 212141 - DNA, 20 bp, Artificial Sequence
  chemically synthesized
atttactaagcacctacatt

SEQ ID NO: 212142 - DNA, 20 bp, Artificial Sequence
  chemically synthesized
tttgtctaaatgtaggtgct

SEQ ID NO: 212143 - DNA, 20 bp, Artificial Sequence
  chemically synthesized
acttttatccataatttact

SEQ ID NO: 212144 - DNA, 20 bp, Artificial Sequence
  chemically synthesized
tgtaggtgcttagtaaatta

SEQ ID NO: 212145 - DNA, 20 bp, Artificial Sequence
  chemically synthesized
gcttagtaaattatggataa

SEQ ID NO: 212146 - DNA, 20 bp, Artificial Sequence
  chemically synthesized
aattatggataaaagttgaa

SEQ ID NO: 212147 - DNA, 20 bp, Artificial Sequence
  chemically synthesized
ggataaaagttgaacagcac

SEQ ID NO: 212148 - DNA, 20 bp, Artificial Sequence
  chemically synthesized
ttgatgtgaattattgttgc

SEQ ID NO: 212149 - DNA, 20 bp, Artificial Sequence
  chemically synthesized
ggcaacaataattcacatca

SEQ ID NO: 212150 - DNA, 20 bp, Artificial Sequence
  chemically synthesized
attcacatcaaagtacattc

SEQ ID NO: 212151 - DNA, 20 bp, Artificial Sequence
  chemically synthesized
ttctatgtgatataaagaac

SEQ ID NO: 212152 - DNA, 20 bp, Artificial Sequence
  chemically synthesized
ctttatttctatgtgatata

SEQ ID NO: 212153 - DNA, 20 bp, Artificial Sequence
  chemically synthesized
ttctagttctttatatcaca

SEQ ID NO: 212154 - DNA, 20 bp, Artificial Sequence
  chemically synthesized
ctttatatcacatagaaata

SEQ ID NO: 212155 - DNA, 20 bp, Artificial Sequence
  chemically synthesized
ttcacatttacaaaatttat

SEQ ID NO: 212156 - DNA, 20 bp, Artificial Sequence
  chemically synthesized
tataaattttgtaaatgtga

SEQ ID NO: 212157 - DNA, 20 bp, Artificial Sequence
  chemically synthesized
tttgtaaatgtgaaagaaaa

SEQ ID NO: 212158 - DNA, 20 bp, Artificial Sequence
  chemically synthesized
gaaagaaaatagaaccaatt

SEQ ID NO: 212159 - DNA, 20 bp, Artificial Sequence
  chemically synthesized
ttgacatttattttctaaat

SEQ ID NO: 212160 - DNA, 20 bp, Artificial Sequence
  chemically synthesized
aggagcaacaattaaaatgc

SEQ ID NO: 212161 - DNA, 20 bp, Artificial Sequence
  chemically synthesized
ttgtaaaattaatgtgaaag

SEQ ID NO: 212162 - DNA, 20 bp, Artificial Sequence
  chemically synthesized
ttttgtaaaattaatgtgaa

SEQ ID NO: 212163 - DNA, 20 bp, Artificial Sequence
  chemically synthesized
tttttgtaaaattaatgtga

SEQ ID NO: 212164 - DNA, 20 bp, Artificial Sequence
  chemically synthesized
tagaaaatcaaatcagaaac

SEQ ID NO: 212165 - DNA, 20 bp, Artificial Sequence
  chemically synthesized
taatccatagaaaatcaaat

SEQ ID NO: 212166 - DNA, 20 bp, Artificial Sequence
  chemically synthesized
gtttctgatttgattttcta

SEQ ID NO: 212167 - DNA, 20 bp, Artificial Sequence
  chemically synthesized
cacagaatgcttttaatcca

SEQ ID NO: 212168 - DNA, 20 bp, Artificial Sequence
  chemically synthesized
tttgattttctatggattaa

SEQ ID NO: 212169 - DNA, 20 bp, Artificial Sequence
  chemically synthesized
tggattaaaagcattctgtg

SEQ ID NO: 212170 - DNA, 20 bp, Artificial Sequence
  chemically synthesized
ttaaaagcattctgtgcagt

SEQ ID NO: 212171 - DNA, 20 bp, Artificial Sequence
  chemically synthesized
ataatgagcttccaactgca

SEQ ID NO: 212172 - DNA, 20 bp, Artificial Sequence
  chemically synthesized
aaagcattctgtgcagttgg

SEQ ID NO: 212173 - DNA, 20 bp, Artificial Sequence
  chemically synthesized
cagttgtcatgattaataat

SEQ ID NO: 212174 - DNA, 20 bp, Artificial Sequence
  chemically synthesized
attattaatcatgacaactg

SEQ ID NO: 212175 - DNA, 20 bp, Artificial Sequence
  chemically synthesized
attaatcatgacaactgtag

SEQ ID NO: 212176 - DNA, 20 bp, Artificial Sequence
  chemically synthesized
attcatactagcagccacta

SEQ ID NO: 212177 - DNA, 20 bp, Artificial Sequence
  chemically synthesized
atgacaactgtagtggctgc

SEQ ID NO: 212178 - DNA, 20 bp, Artificial Sequence
  chemically synthesized
atgtgcttaattcatactag

SEQ ID NO: 212179 - DNA, 20 bp, Artificial Sequence
  chemically synthesized
tatatgtgcttaattcatac

SEQ ID NO: 212180 - DNA, 20 bp, Artificial Sequence
  chemically synthesized
agtggctgctagtatgaatt

SEQ ID NO: 212181 - DNA, 20 bp, Artificial Sequence
  chemically synthesized
aagcacatataccatgtgcc

SEQ ID NO: 212182 - DNA, 20 bp, Artificial Sequence
  chemically synthesized
ttgccatttagctaggcaca

SEQ ID NO: 212183 - DNA, 20 bp, Artificial Sequence
  chemically synthesized
ataccatgtgcctagctaaa

SEQ ID NO: 212184 - DNA, 20 bp, Artificial Sequence
  chemically synthesized
gaatggcttgccatttagct

SEQ ID NO: 212185 - DNA, 20 bp, Artificial Sequence
  chemically synthesized
tgaatggcttgccatttagc

SEQ ID NO: 212186 - DNA, 20 bp, Artificial Sequence
  chemically synthesized
catgtgcctagctaaatggc

SEQ ID NO: 212187 - DNA, 20 bp, Artificial Sequence
  chemically synthesized
gatctgaatggcttgccatt

SEQ ID NO: 212188 - DNA, 20 bp, Artificial Sequence
  chemically synthesized
tagctaaatggcaagccatt

SEQ ID NO: 212189 - DNA, 20 bp, Artificial Sequence
  chemically synthesized
gtagtagaaagagatctgaa

SEQ ID NO: 212190 - DNA, 20 bp, Artificial Sequence
  chemically synthesized
ataatcaactgtagtagaaa

SEQ ID NO: 212191 - DNA, 20 bp, Artificial Sequence
  chemically synthesized
attcagatctctttctacta

SEQ ID NO: 212192 - DNA, 20 bp, Artificial Sequence
  chemically synthesized
ttataatcaactgtagtaga

SEQ ID NO: 212193 - DNA, 20 bp, Artificial Sequence
  chemically synthesized
aaacttataatcaactgtag

SEQ ID NO: 212194 - DNA, 20 bp, Artificial Sequence
  chemically synthesized
aaaaaacttataatcaactg

SEQ ID NO: 212195 - DNA, 20 bp, Artificial Sequence
  chemically synthesized
tttctactacagttgattat

SEQ ID NO: 212196 - DNA, 20 bp, Artificial Sequence
  chemically synthesized
ttttttttttattatacttt

SEQ ID NO: 212197 - DNA, 20 bp, Artificial Sequence
  chemically synthesized
ttttattatactttaagttt

SEQ ID NO: 212198 - DNA, 20 bp, Artificial Sequence
  chemically synthesized
cacatgaaccctaaaactta

SEQ ID NO: 212199 - DNA, 20 bp, Artificial Sequence
  chemically synthesized
tttattatactttaagtttt

SEQ ID NO: 212200 - DNA, 20 bp, Artificial Sequence
  chemically synthesized
ttattatactttaagtttta

SEQ ID NO: 212201 - DNA, 20 bp, Artificial Sequence
  chemically synthesized
gggttcatgtgcacaacatg

SEQ ID NO: 212202 - DNA, 20 bp, Artificial Sequence
  chemically synthesized
ggttcatgtgcacaacatgc

SEQ ID NO: 212203 - DNA, 20 bp, Artificial Sequence
  chemically synthesized
catgtgcacaacatgcaggt

SEQ ID NO: 212204 - DNA, 20 bp, Artificial Sequence
  chemically synthesized
cacgtatacatgtgccatgt

SEQ ID NO: 212205 - DNA, 20 bp, Artificial Sequence
  chemically synthesized
atgggtgcagcacaccaaca

SEQ ID NO: 212206 - DNA, 20 bp, Artificial Sequence
  chemically synthesized
aaatgacgagttaatgggtg

SEQ ID NO: 212207 - DNA, 20 bp, Artificial Sequence
  chemically synthesized
atggtaaatgacgagttaat

SEQ ID NO: 212208 - DNA, 20 bp, Artificial Sequence
  chemically synthesized
aatggtaaatgacgagttaa

SEQ ID NO: 212209 - DNA, 20 bp, Artificial Sequence
  chemically synthesized
cttacctaatggtaaatgac

SEQ ID NO: 212210 - DNA, 20 bp, Artificial Sequence
  chemically synthesized
attaactcgtcatttaccat

SEQ ID NO: 212211 - DNA, 20 bp, Artificial Sequence
  chemically synthesized
ttaactcgtcatttaccatt

SEQ ID NO: 212212 - DNA, 20 bp, Artificial Sequence
  chemically synthesized
ctcgtcatttaccattaggt

SEQ ID NO: 212213 - DNA, 20 bp, Artificial Sequence
  chemically synthesized
actcttaaaaacttacctaa

SEQ ID NO: 212214 - DNA, 20 bp, Artificial Sequence
  chemically synthesized
ttaccattaggtaagttttt

SEQ ID NO: 212215 - DNA, 20 bp, Artificial Sequence
  chemically synthesized
accattaggtaagtttttaa

SEQ ID NO: 212216 - DNA, 20 bp, Artificial Sequence
  chemically synthesized
ttaggtaagtttttaagagt

SEQ ID NO: 212217 - DNA, 20 bp, Artificial Sequence
  chemically synthesized
taggtaagtttttaagagtc

SEQ ID NO: 212218 - DNA, 20 bp, Artificial Sequence
  chemically synthesized
aagagtcaggcatgatatct

SEQ ID NO: 212219 - DNA, 20 bp, Artificial Sequence
  chemically synthesized
ttttggatagaaagatggct

SEQ ID NO: 212220 - DNA, 20 bp, Artificial Sequence
  chemically synthesized
atgcattttggatagaaaga

SEQ ID NO: 212221 - DNA, 20 bp, Artificial Sequence
  chemically synthesized
tgctatgcattttggataga

SEQ ID NO: 212222 - DNA, 20 bp, Artificial Sequence
  chemically synthesized
atcatgctatgcattttgga

SEQ ID NO: 212223 - DNA, 20 bp, Artificial Sequence
  chemically synthesized
atctttctatccaaaatgca

SEQ ID NO: 212224 - DNA, 20 bp, Artificial Sequence
  chemically synthesized
agggatcatgctatgcattt

SEQ ID NO: 212225 - DNA, 20 bp, Artificial Sequence
  chemically synthesized
attgcacatgacacatgtca

SEQ ID NO: 212226 - DNA, 20 bp, Artificial Sequence
  chemically synthesized
gattgcacatgacacatgtc

SEQ ID NO: 212227 - DNA, 20 bp, Artificial Sequence
  chemically synthesized
ggattgcacatgacacatgt

SEQ ID NO: 212228 - DNA, 20 bp, Artificial Sequence
  chemically synthesized
ggatttattatttttaaatt

SEQ ID NO: 212229 - DNA, 20 bp, Artificial Sequence
  chemically synthesized
aatggaaatgtatttggtag

SEQ ID NO: 212230 - DNA, 20 bp, Artificial Sequence
  chemically synthesized
taatggaaatgtatttggta

SEQ ID NO: 212231 - DNA, 20 bp, Artificial Sequence
  chemically synthesized
ttaatggaaatgtatttggt

SEQ ID NO: 212232 - DNA, 20 bp, Artificial Sequence
  chemically synthesized
tttaatggaaatgtatttgg

SEQ ID NO: 212233 - DNA, 20 bp, Artificial Sequence
  chemically synthesized
atatttaatggaaatgtatt

SEQ ID NO: 212234 - DNA, 20 bp, Artificial Sequence
  chemically synthesized
aactcatgtgaaatatttaa

SEQ ID NO: 212235 - DNA, 20 bp, Artificial Sequence
  chemically synthesized
ttccattaaatatttcacat

SEQ ID NO: 212236 - DNA, 20 bp, Artificial Sequence
  chemically synthesized
aatatttcacatgagttatc

SEQ ID NO: 212237 - DNA, 20 bp, Artificial Sequence
  chemically synthesized
ggtttgggggatgattaaac

SEQ ID NO: 212238 - DNA, 20 bp, Artificial Sequence
  chemically synthesized
atttgtaaagtgaggtttgg

SEQ ID NO: 212239 - DNA, 20 bp, Artificial Sequence
  chemically synthesized
catttgtaaagtgaggtttg

SEQ ID NO: 212240 - DNA, 20 bp, Artificial Sequence
  chemically synthesized
ccatttgtaaagtgaggttt

SEQ ID NO: 212241 - DNA, 20 bp, Artificial Sequence
  chemically synthesized
tccatttgtaaagtgaggtt

SEQ ID NO: 212242 - DNA, 20 bp, Artificial Sequence
  chemically synthesized
gtttctccatttgtaaagtg

SEQ ID NO: 212243 - DNA, 20 bp, Artificial Sequence
  chemically synthesized
tgtttctccatttgtaaagt

SEQ ID NO: 212244 - DNA, 20 bp, Artificial Sequence
  chemically synthesized
cccaaacctcactttacaaa

SEQ ID NO: 212245 - DNA, 20 bp, Artificial Sequence
  chemically synthesized
cttttgtttctccatttgta

SEQ ID NO: 212246 - DNA, 20 bp, Artificial Sequence
  chemically synthesized
caaacctcactttacaaatg

SEQ ID NO: 212247 - DNA, 20 bp, Artificial Sequence
  chemically synthesized
ctttacaaatggagaaacaa

SEQ ID NO: 212248 - DNA, 20 bp, Artificial Sequence
  chemically synthesized
ctttctatctgtggggcatt

SEQ ID NO: 212249 - DNA, 20 bp, Artificial Sequence
  chemically synthesized
actttctatctgtggggcat

SEQ ID NO: 212250 - DNA, 20 bp, Artificial Sequence
  chemically synthesized
gtaacacgcccaatgcccca

SEQ ID NO: 212251 - DNA, 20 bp, Artificial Sequence
  chemically synthesized
cacgcccaatgccccacaga

SEQ ID NO: 212252 - DNA, 20 bp, Artificial Sequence
  chemically synthesized
tccaccactttctatctgtg

SEQ ID NO: 212253 - DNA, 20 bp, Artificial Sequence
  chemically synthesized
ctccaccactttctatctgt

SEQ ID NO: 212254 - DNA, 20 bp, Artificial Sequence
  chemically synthesized
gctccaccactttctatctg

SEQ ID NO: 212255 - DNA, 20 bp, Artificial Sequence
  chemically synthesized
cccaatgccccacagataga

SEQ ID NO: 212256 - DNA, 20 bp, Artificial Sequence
  chemically synthesized
aatgccccacagatagaaag

SEQ ID NO: 212257 - DNA, 20 bp, Artificial Sequence
  chemically synthesized
gccccacagatagaaagtgg

SEQ ID NO: 212258 - DNA, 20 bp, Artificial Sequence
  chemically synthesized
cccacagatagaaagtggtg

SEQ ID NO: 212259 - DNA, 20 bp, Artificial Sequence
  chemically synthesized
agatagaaagtggtggagcc

SEQ ID NO: 212260 - DNA, 20 bp, Artificial Sequence
  chemically synthesized
gatagaaagtggtggagcca

SEQ ID NO: 212261 - DNA, 20 bp, Artificial Sequence
  chemically synthesized
aagagcctgggttcaaacct

SEQ ID NO: 212262 - DNA, 20 bp, Artificial Sequence
  chemically synthesized
gtggagccaaggtttgaacc

SEQ ID NO: 212263 - DNA, 20 bp, Artificial Sequence
  chemically synthesized
tggagccaaggtttgaaccc

SEQ ID NO: 212264 - DNA, 20 bp, Artificial Sequence
  chemically synthesized
gctctggagtcaaagagcct

SEQ ID NO: 212265 - DNA, 20 bp, Artificial Sequence
  chemically synthesized
ggctctggagtcaaagagcc

SEQ ID NO: 212266 - DNA, 20 bp, Artificial Sequence
  chemically synthesized
gcaggggctctggagtcaaa

SEQ ID NO: 212267 - DNA, 20 bp, Artificial Sequence
  chemically synthesized
gaacccaggctctttgactc

SEQ ID NO: 212268 - DNA, 20 bp, Artificial Sequence
  chemically synthesized
ttgcaggggctctggagtca

SEQ ID NO: 212269 - DNA, 20 bp, Artificial Sequence
  chemically synthesized
acccaggctctttgactcca

SEQ ID NO: 212270 - DNA, 20 bp, Artificial Sequence
  chemically synthesized
attttcttgcaggggctctg

SEQ ID NO: 212271 - DNA, 20 bp, Artificial Sequence
  chemically synthesized
gtattttcttgcaggggctc

SEQ ID NO: 212272 - DNA, 20 bp, Artificial Sequence
  chemically synthesized
tttgactccagagcccctgc

SEQ ID NO: 212273 - DNA, 20 bp, Artificial Sequence
  chemically synthesized
agagttgtattttcttgcag

SEQ ID NO: 212274 - DNA, 20 bp, Artificial Sequence
  chemically synthesized
tagagttgtattttcttgca

SEQ ID NO: 212275 - DNA, 20 bp, Artificial Sequence
  chemically synthesized
atagagttgtattttcttgc

SEQ ID NO: 212276 - DNA, 20 bp, Artificial Sequence
  chemically synthesized
catagagttgtattttcttg

SEQ ID NO: 212277 - DNA, 20 bp, Artificial Sequence
  chemically synthesized
agctatgtcaaggcagcata

SEQ ID NO: 212278 - DNA, 20 bp, Artificial Sequence
  chemically synthesized
agagctatgtcaaggcagca

SEQ ID NO: 212279 - DNA, 20 bp, Artificial Sequence
  chemically synthesized
tttgaagagctatgtcaagg

SEQ ID NO: 212280 - DNA, 20 bp, Artificial Sequence
  chemically synthesized
aactctatgctgccttgaca

SEQ ID NO: 212281 - DNA, 20 bp, Artificial Sequence
  chemically synthesized
ttatttgaagagctatgtca

SEQ ID NO: 212282 - DNA, 20 bp, Artificial Sequence
  chemically synthesized
tttatttgaagagctatgtc

SEQ ID NO: 212283 - DNA, 20 bp, Artificial Sequence
  chemically synthesized
tgaatggctgtttatttgaa

SEQ ID NO: 212284 - DNA, 20 bp, Artificial Sequence
  chemically synthesized
attgaatggctgtttatttg

SEQ ID NO: 212285 - DNA, 20 bp, Artificial Sequence
  chemically synthesized
gacatagctcttcaaataaa

SEQ ID NO: 212286 - DNA, 20 bp, Artificial Sequence
  chemically synthesized
aatcactgagcataattgaa

SEQ ID NO: 212287 - DNA, 20 bp, Artificial Sequence
  chemically synthesized
aacagccattcaattatgct

SEQ ID NO: 212288 - DNA, 20 bp, Artificial Sequence
  chemically synthesized
gaaactattaggaaatcact

SEQ ID NO: 212289 - DNA, 20 bp, Artificial Sequence
  chemically synthesized
tatgctcagtgatttcctaa

SEQ ID NO: 212290 - DNA, 20 bp, Artificial Sequence
  chemically synthesized
ctagaattctggaaactatt

SEQ ID NO: 212291 - DNA, 20 bp, Artificial Sequence
  chemically synthesized
gctagaattctggaaactat

SEQ ID NO: 212292 - DNA, 20 bp, Artificial Sequence
  chemically synthesized
agtgatttcctaatagtttc

SEQ ID NO: 212293 - DNA, 20 bp, Artificial Sequence
  chemically synthesized
cctaatagtttccagaattc

SEQ ID NO: 212294 - DNA, 20 bp, Artificial Sequence
  chemically synthesized
ttttctcatggctagaattc

SEQ ID NO: 212295 - DNA, 20 bp, Artificial Sequence
  chemically synthesized
gtttccagaattctagccat

SEQ ID NO: 212296 - DNA, 20 bp, Artificial Sequence
  chemically synthesized
accattatttttctcatggc

SEQ ID NO: 212297 - DNA, 20 bp, Artificial Sequence
  chemically synthesized
agtaaccattatttttctca

SEQ ID NO: 212298 - DNA, 20 bp, Artificial Sequence
  chemically synthesized
tctagccatgagaaaaataa

SEQ ID NO: 212299 - DNA, 20 bp, Artificial Sequence
  chemically synthesized
aattcttacgttattcaaat

SEQ ID NO: 212300 - DNA, 20 bp, Artificial Sequence
  chemically synthesized
gttactaatttgaataacgt

SEQ ID NO: 212301 - DNA, 20 bp, Artificial Sequence
  chemically synthesized
catggcctcccgttttttgt

SEQ ID NO: 212302 - DNA, 20 bp, Artificial Sequence
  chemically synthesized
attatattaccaacaaaaaa

SEQ ID NO: 212303 - DNA, 20 bp, Artificial Sequence
  chemically synthesized
ttatattaccaacaaaaaac

SEQ ID NO: 212304 - DNA, 20 bp, Artificial Sequence
  chemically synthesized
atattaccaacaaaaaacgg

SEQ ID NO: 212305 - DNA, 20 bp, Artificial Sequence
  chemically synthesized
tattaccaacaaaaaacggg

SEQ ID NO: 212306 - DNA, 20 bp, Artificial Sequence
  chemically synthesized
aaaaaacgggaggccatgct

SEQ ID NO: 212307 - DNA, 20 bp, Artificial Sequence
  chemically synthesized
aaaaacgggaggccatgctt

SEQ ID NO: 212308 - DNA, 20 bp, Artificial Sequence
  chemically synthesized
aaacgggaggccatgcttag

SEQ ID NO: 212309 - DNA, 20 bp, Artificial Sequence
  chemically synthesized
atcacagtgtctcctaagca

SEQ ID NO: 212310 - DNA, 20 bp, Artificial Sequence
  chemically synthesized
ctgttatcacagtgtctcct

SEQ ID NO: 212311 - DNA, 20 bp, Artificial Sequence
  chemically synthesized
cttaggagacactgtgataa

SEQ ID NO: 212312 - DNA, 20 bp, Artificial Sequence
  chemically synthesized
tgagctttctactgttatca

SEQ ID NO: 212313 - DNA, 20 bp, Artificial Sequence
  chemically synthesized
aggagacactgtgataacag

SEQ ID NO: 212314 - DNA, 20 bp, Artificial Sequence
  chemically synthesized
gacactgtgataacagtaga

SEQ ID NO: 212315 - DNA, 20 bp, Artificial Sequence
  chemically synthesized
tttaaaaaaattatttattt

SEQ ID NO: 212316 - DNA, 20 bp, Artificial Sequence
  chemically synthesized
tcaaataaataattttttta

SEQ ID NO: 212317 - DNA, 20 bp, Artificial Sequence
  chemically synthesized
aataatttttttaaagttcc

SEQ ID NO: 212318 - DNA, 20 bp, Artificial Sequence
  chemically synthesized
ataatttttttaaagttcca

SEQ ID NO: 212319 - DNA, 20 bp, Artificial Sequence
  chemically synthesized
taatttttttaaagttccaa

SEQ ID NO: 212320 - DNA, 20 bp, Artificial Sequence
  chemically synthesized
tatttttttaatggatccct

SEQ ID NO: 212321 - DNA, 20 bp, Artificial Sequence
  chemically synthesized
ttttttttgtatttttttaa

SEQ ID NO: 212322 - DNA, 20 bp, Artificial Sequence
  chemically synthesized
taaaaaaatacaaaaaaaaa

SEQ ID NO: 212323 - DNA, 20 bp, Artificial Sequence
  chemically synthesized
tgtgaataaaatattagaaa

SEQ ID NO: 212324 - DNA, 20 bp, Artificial Sequence
  chemically synthesized
cgtcactgtgaataaaatat

SEQ ID NO: 212325 - DNA, 20 bp, Artificial Sequence
  chemically synthesized
catttctaatattttattca

SEQ ID NO: 212326 - DNA, 20 bp, Artificial Sequence
  chemically synthesized
taatattttattcacagtga

SEQ ID NO: 212327 - DNA, 20 bp, Artificial Sequence
  chemically synthesized
aatattttattcacagtgac

SEQ ID NO: 212328 - DNA, 20 bp, Artificial Sequence
  chemically synthesized
ttattcacagtgacgggcct

SEQ ID NO: 212329 - DNA, 20 bp, Artificial Sequence
  chemically synthesized
cttcagtttatgttatgctc

SEQ ID NO: 212330 - DNA, 20 bp, Artificial Sequence
  chemically synthesized
ccttcagtttatgttatgct

SEQ ID NO: 212331 - DNA, 20 bp, Artificial Sequence
  chemically synthesized
cctgagcataacataaactg

SEQ ID NO: 212332 - DNA, 20 bp, Artificial Sequence
  chemically synthesized
ctgagcataacataaactga

SEQ ID NO: 212333 - DNA, 20 bp, Artificial Sequence
  chemically synthesized
tctaacatggtaagagcctt

SEQ ID NO: 212334 - DNA, 20 bp, Artificial Sequence
  chemically synthesized
tttattttctaacatggtaa

SEQ ID NO: 212335 - DNA, 20 bp, Artificial Sequence
  chemically synthesized
actgaaggctcttaccatgt

SEQ ID NO: 212336 - DNA, 20 bp, Artificial Sequence
  chemically synthesized
agtttattttctaacatggt

SEQ ID NO: 212337 - DNA, 20 bp, Artificial Sequence
  chemically synthesized
tttaagtttattttctaaca

SEQ ID NO: 212338 - DNA, 20 bp, Artificial Sequence
  chemically synthesized
catgttagaaaataaactta

SEQ ID NO: 212339 - DNA, 20 bp, Artificial Sequence
  chemically synthesized
gttagaaaataaacttaaag

SEQ ID NO: 212340 - DNA, 20 bp, Artificial Sequence
  chemically synthesized
tagaaaataaacttaaagta

SEQ ID NO: 212341 - DNA, 20 bp, Artificial Sequence
  chemically synthesized
tccagtgaaatctctacttt

SEQ ID NO: 212342 - DNA, 20 bp, Artificial Sequence
  chemically synthesized
acttaaagtagagatttcac

SEQ ID NO: 212343 - DNA, 20 bp, Artificial Sequence
  chemically synthesized
ttaaagtagagatttcactg

SEQ ID NO: 212344 - DNA, 20 bp, Artificial Sequence
  chemically synthesized
aaagtagagatttcactgga

SEQ ID NO: 212345 - DNA, 20 bp, Artificial Sequence
  chemically synthesized
agagatttcactggagagct

SEQ ID NO: 212346 - DNA, 20 bp, Artificial Sequence
  chemically synthesized
tacctgggtcctcagctctc

SEQ ID NO: 212347 - DNA, 20 bp, Artificial Sequence
  chemically synthesized
gagatttcactggagagctg

SEQ ID NO: 212348 - DNA, 20 bp, Artificial Sequence
  chemically synthesized
tcactggagagctgaggacc

SEQ ID NO: 212349 - DNA, 20 bp, Artificial Sequence
  chemically synthesized
cactggagagctgaggaccc

SEQ ID NO: 212350 - DNA, 20 bp, Artificial Sequence
  chemically synthesized
acctcacctacctgggtcct

SEQ ID NO: 212351 - DNA, 20 bp, Artificial Sequence
  chemically synthesized
tggagagctgaggacccagg

SEQ ID NO: 212352 - DNA, 20 bp, Artificial Sequence
  chemically synthesized
ggagagctgaggacccaggt

SEQ ID NO: 212353 - DNA, 20 bp, Artificial Sequence
  chemically synthesized
actcagaacctcacctacct

SEQ ID NO: 212354 - DNA, 20 bp, Artificial Sequence
  chemically synthesized
agctgaggacccaggtaggt

SEQ ID NO: 212355 - DNA, 20 bp, Artificial Sequence
  chemically synthesized
cactcagaacctcacctacc

SEQ ID NO: 212356 - DNA, 20 bp, Artificial Sequence
  chemically synthesized
gctgaggacccaggtaggtg

SEQ ID NO: 212357 - DNA, 20 bp, Artificial Sequence
  chemically synthesized
acccaggtaggtgaggttct

SEQ ID NO: 212358 - DNA, 20 bp, Artificial Sequence
  chemically synthesized
acccctctgttagatgcact

SEQ ID NO: 212359 - DNA, 20 bp, Artificial Sequence
  chemically synthesized
gaggttctgagtgcatctaa

SEQ ID NO: 212360 - DNA, 20 bp, Artificial Sequence
  chemically synthesized
ggttctgagtgcatctaaca

SEQ ID NO: 212361 - DNA, 20 bp, Artificial Sequence
  chemically synthesized
gttctgagtgcatctaacag

SEQ ID NO: 212362 - DNA, 20 bp, Artificial Sequence
  chemically synthesized
ttctgagtgcatctaacaga

SEQ ID NO: 212363 - DNA, 20 bp, Artificial Sequence
  chemically synthesized
tctgagtgcatctaacagag

SEQ ID NO: 212364 - DNA, 20 bp, Artificial Sequence
  chemically synthesized
gtggctaataacccctctgt

SEQ ID NO: 212365 - DNA, 20 bp, Artificial Sequence
  chemically synthesized
gcatctaacagaggggttat

SEQ ID NO: 212366 - DNA, 20 bp, Artificial Sequence
  chemically synthesized
ttttaagtgattgaatgatg

SEQ ID NO: 212367 - DNA, 20 bp, Artificial Sequence
  chemically synthesized
atcattcaatcacttaaaat

SEQ ID NO: 212368 - DNA, 20 bp, Artificial Sequence
  chemically synthesized
tgcgtatatagtcttatttt

SEQ ID NO: 212369 - DNA, 20 bp, Artificial Sequence
  chemically synthesized
tcgctaatgctatgcgtata

SEQ ID NO: 212370 - DNA, 20 bp, Artificial Sequence
  chemically synthesized
aaaataagactatatacgca

SEQ ID NO: 212371 - DNA, 20 bp, Artificial Sequence
  chemically synthesized
agactatatacgcatagcat

SEQ ID NO: 212372 - DNA, 20 bp, Artificial Sequence
  chemically synthesized
tatatacgcatagcattagc

SEQ ID NO: 212373 - DNA, 20 bp, Artificial Sequence
  chemically synthesized
ttagcgagtcaaccatcatt

SEQ ID NO: 212374 - DNA, 20 bp, Artificial Sequence
  chemically synthesized
aaatccgcttgtcttaatga

SEQ ID NO: 212375 - DNA, 20 bp, Artificial Sequence
  chemically synthesized
gagtcaaccatcattaagac

SEQ ID NO: 212376 - DNA, 20 bp, Artificial Sequence
  chemically synthesized
tcaaccatcattaagacaag

SEQ ID NO: 212377 - DNA, 20 bp, Artificial Sequence
  chemically synthesized
attaagacaagcggattttt

SEQ ID NO: 212378 - DNA, 20 bp, Artificial Sequence
  chemically synthesized
taagacaagcggatttttcg

SEQ ID NO: 212379 - DNA, 20 bp, Artificial Sequence
  chemically synthesized
agcggatttttcggagactt

SEQ ID NO: 212380 - DNA, 20 bp, Artificial Sequence
  chemically synthesized
tttttcggagactttagcat

SEQ ID NO: 212381 - DNA, 20 bp, Artificial Sequence
  chemically synthesized
ggtcatctggactcatgcta

SEQ ID NO: 212382 - DNA, 20 bp, Artificial Sequence
  chemically synthesized
cggagactttagcatgagtc

SEQ ID NO: 212383 - DNA, 20 bp, Artificial Sequence
  chemically synthesized
agcagaggagtttggtcatc

SEQ ID NO: 212384 - DNA, 20 bp, Artificial Sequence
  chemically synthesized
atctgcagagcagaggagtt

SEQ ID NO: 212385 - DNA, 20 bp, Artificial Sequence
  chemically synthesized
atggcatctgcagagcagag

SEQ ID NO: 212386 - DNA, 20 bp, Artificial Sequence
  chemically synthesized
atatggcatctgcagagcag

SEQ ID NO: 212387 - DNA, 20 bp, Artificial Sequence
  chemically synthesized
gaccaaactcctctgctctg

SEQ ID NO: 212388 - DNA, 20 bp, Artificial Sequence
  chemically synthesized
catatggcatctgcagagca

SEQ ID NO: 212389 - DNA, 20 bp, Artificial Sequence
  chemically synthesized
tacatatggcatctgcagag

SEQ ID NO: 212390 - DNA, 20 bp, Artificial Sequence
  chemically synthesized
cattacatatggcatctgca

SEQ ID NO: 212391 - DNA, 20 bp, Artificial Sequence
  chemically synthesized
tgcattacatatggcatctg

SEQ ID NO: 212392 - DNA, 20 bp, Artificial Sequence
  chemically synthesized
atgcaaatctgcattacata

SEQ ID NO: 212393 - DNA, 20 bp, Artificial Sequence
  chemically synthesized
tgcagatgccatatgtaatg

SEQ ID NO: 212394 - DNA, 20 bp, Artificial Sequence
  chemically synthesized
ttgcatatttctaatgtatt

SEQ ID NO: 212395 - DNA, 20 bp, Artificial Sequence
  chemically synthesized
acagtaatacctgaatacat

SEQ ID NO: 212396 - DNA, 20 bp, Artificial Sequence
  chemically synthesized
tgcatatttctaatgtattc

SEQ ID NO: 212397 - DNA, 20 bp, Artificial Sequence
  chemically synthesized
ttattctagtagattttaaa

SEQ ID NO: 212398 - DNA, 20 bp, Artificial Sequence
  chemically synthesized
tattactgtttaaaatctac

SEQ ID NO: 212399 - DNA, 20 bp, Artificial Sequence
  chemically synthesized
taaagctgtcgttattctag

SEQ ID NO: 212400 - DNA, 20 bp, Artificial Sequence
  chemically synthesized
tattaaagctgtcgttattc

SEQ ID NO: 212401 - DNA, 20 bp, Artificial Sequence
  chemically synthesized
aaaatctactagaataacga

SEQ ID NO: 212402 - DNA, 20 bp, Artificial Sequence
  chemically synthesized
attcaaactctattttatta

SEQ ID NO: 212403 - DNA, 20 bp, Artificial Sequence
  chemically synthesized
taacgacagctttaataaaa

SEQ ID NO: 212404 - DNA, 20 bp, Artificial Sequence
  chemically synthesized
acgacagctttaataaaata

SEQ ID NO: 212405 - DNA, 20 bp, Artificial Sequence
  chemically synthesized
ttaataaaatagagtttgaa

SEQ ID NO: 212406 - DNA, 20 bp, Artificial Sequence
  chemically synthesized
tagagtttgaatggcttcaa

SEQ ID NO: 212407 - DNA, 20 bp, Artificial Sequence
  chemically synthesized
aagaattttctttgctattg

SEQ ID NO: 212408 - DNA, 20 bp, Artificial Sequence
  chemically synthesized
tttgaatggcttcaatagca

SEQ ID NO: 212409 - DNA, 20 bp, Artificial Sequence
  chemically synthesized
aatagcaaagaaaattctta

SEQ ID NO: 212410 - DNA, 20 bp, Artificial Sequence
  chemically synthesized
tcttgaacccttgaatcttt

SEQ ID NO: 212411 - DNA, 20 bp, Artificial Sequence
  chemically synthesized
aagaaaattcttaaagattc

SEQ ID NO: 212412 - DNA, 20 bp, Artificial Sequence
  chemically synthesized
agaaaattcttaaagattca

SEQ ID NO: 212413 - DNA, 20 bp, Artificial Sequence
  chemically synthesized
gaaaattcttaaagattcaa

SEQ ID NO: 212414 - DNA, 20 bp, Artificial Sequence
  chemically synthesized
tcttaaagattcaagggttc

SEQ ID NO: 212415 - DNA, 20 bp, Artificial Sequence
  chemically synthesized
ttaaagattcaagggttcaa

SEQ ID NO: 212416 - DNA, 20 bp, Artificial Sequence
  chemically synthesized
aagattcaagggttcaagag

SEQ ID NO: 212417 - DNA, 20 bp, Artificial Sequence
  chemically synthesized
gggttcaagagtagtctact

SEQ ID NO: 212418 - DNA, 20 bp, Artificial Sequence
  chemically synthesized
gttaaatgattatttctaag

SEQ ID NO: 212419 - DNA, 20 bp, Artificial Sequence
  chemically synthesized
ggggttaaatgattatttct

SEQ ID NO: 212420 - DNA, 20 bp, Artificial Sequence
  chemically synthesized
aaaaaaatgttcattaatgg

SEQ ID NO: 212421 - DNA, 20 bp, Artificial Sequence
  chemically synthesized
aaaaaaaatgttcattaatg

SEQ ID NO: 212422 - DNA, 20 bp, Artificial Sequence
  chemically synthesized
caaaaaaaatgttcattaat

SEQ ID NO: 212423 - DNA, 20 bp, Artificial Sequence
  chemically synthesized
ccaaaaaaaatgttcattaa

SEQ ID NO: 212424 - DNA, 20 bp, Artificial Sequence
  chemically synthesized
ccattaatgaacattttttt

SEQ ID NO: 212425 - DNA, 20 bp, Artificial Sequence
  chemically synthesized
aatgaacattttttttggat

SEQ ID NO: 212426 - DNA, 20 bp, Artificial Sequence
  chemically synthesized
tttttttggatcagtatcta

SEQ ID NO: 212427 - DNA, 20 bp, Artificial Sequence
  chemically synthesized
aaactttaaaaaaagaactg

SEQ ID NO: 212428 - DNA, 20 bp, Artificial Sequence
  chemically synthesized
tatctacagttcttttttta

SEQ ID NO: 212429 - DNA, 20 bp, Artificial Sequence
  chemically synthesized
aatttaaaaaactttaaaaa

SEQ ID NO: 212430 - DNA, 20 bp, Artificial Sequence
  chemically synthesized
tttaaagttttttaaatttt

SEQ ID NO: 212431 - DNA, 20 bp, Artificial Sequence
  chemically synthesized
gttttttaaattttaagttc

SEQ ID NO: 212432 - DNA, 20 bp, Artificial Sequence
  chemically synthesized
ttttttaaattttaagttct

SEQ ID NO: 212433 - DNA, 20 bp, Artificial Sequence
  chemically synthesized
cacgttctgcacatgtttcc

SEQ ID NO: 212434 - DNA, 20 bp, Artificial Sequence
  chemically synthesized
taagttctgggaaacatgtg

SEQ ID NO: 212435 - DNA, 20 bp, Artificial Sequence
  chemically synthesized
ggaaacatgtgcagaacgtg

SEQ ID NO: 212436 - DNA, 20 bp, Artificial Sequence
  chemically synthesized
gaacgtgcagatttgttaca

SEQ ID NO: 212437 - DNA, 20 bp, Artificial Sequence
  chemically synthesized
aacgtgcagatttgttacat

SEQ ID NO: 212438 - DNA, 20 bp, Artificial Sequence
  chemically synthesized
acataggtacacatgtgcca

SEQ ID NO: 212439 - DNA, 20 bp, Artificial Sequence
  chemically synthesized
taggtacacatgtgccatag

SEQ ID NO: 212440 - DNA, 20 bp, Artificial Sequence
  chemically synthesized
ataggtgcagcaaaccacta

SEQ ID NO: 212441 - DNA, 20 bp, Artificial Sequence
  chemically synthesized
aaatgacgggttcataggtg

SEQ ID NO: 212442 - DNA, 20 bp, Artificial Sequence
  chemically synthesized
aacctaaatgacgggttcat

SEQ ID NO: 212443 - DNA, 20 bp, Artificial Sequence
  chemically synthesized
aaacctaaatgacgggttca

SEQ ID NO: 212444 - DNA, 20 bp, Artificial Sequence
  chemically synthesized
gcacctatgaacccgtcatt

SEQ ID NO: 212445 - DNA, 20 bp, Artificial Sequence
  chemically synthesized
cacctatgaacccgtcattt

SEQ ID NO: 212446 - DNA, 20 bp, Artificial Sequence
  chemically synthesized
gggcttaaaacctaaatgac

SEQ ID NO: 212447 - DNA, 20 bp, Artificial Sequence
  chemically synthesized
ggggcttaaaacctaaatga

SEQ ID NO: 212448 - DNA, 20 bp, Artificial Sequence
  chemically synthesized
gaacccgtcatttaggtttt

SEQ ID NO: 212449 - DNA, 20 bp, Artificial Sequence
  chemically synthesized
acaaatacctaatgcatgcg

SEQ ID NO: 212450 - DNA, 20 bp, Artificial Sequence
  chemically synthesized
gacaaatacctaatgcatgc

SEQ ID NO: 212451 - DNA, 20 bp, Artificial Sequence
  chemically synthesized
gttttaagccccgcatgcat

SEQ ID NO: 212452 - DNA, 20 bp, Artificial Sequence
  chemically synthesized
ggacaaatacctaatgcatg

SEQ ID NO: 212453 - DNA, 20 bp, Artificial Sequence
  chemically synthesized
ttttaagccccgcatgcatt

SEQ ID NO: 212454 - DNA, 20 bp, Artificial Sequence
  chemically synthesized
gcaaggggagggagagcatt

SEQ ID NO: 212455 - DNA, 20 bp, Artificial Sequence
  chemically synthesized
ggcaaggggagggagagcat

SEQ ID NO: 212456 - DNA, 20 bp, Artificial Sequence
  chemically synthesized
gtggggggcaaggggaggga

SEQ ID NO: 212457 - DNA, 20 bp, Artificial Sequence
  chemically synthesized
aggtggggggcaaggggagg

SEQ ID NO: 212458 - DNA, 20 bp, Artificial Sequence
  chemically synthesized
cgaggtggggggcaagggga

SEQ ID NO: 212459 - DNA, 20 bp, Artificial Sequence
  chemically synthesized
gcgaggtggggggcaagggg

SEQ ID NO: 212460 - DNA, 20 bp, Artificial Sequence
  chemically synthesized
cgcgaggtggggggcaaggg

SEQ ID NO: 212461 - DNA, 20 bp, Artificial Sequence
  chemically synthesized
gtcgcgaggtggggggcaag

SEQ ID NO: 212462 - DNA, 20 bp, Artificial Sequence
  chemically synthesized
tgtcgcgaggtggggggcaa

SEQ ID NO: 212463 - DNA, 20 bp, Artificial Sequence
  chemically synthesized
ctgtcgcgaggtggggggca

SEQ ID NO: 212464 - DNA, 20 bp, Artificial Sequence
  chemically synthesized
cctgtcgcgaggtggggggc

SEQ ID NO: 212465 - DNA, 20 bp, Artificial Sequence
  chemically synthesized
gaggcctgtcgcgaggtggg

SEQ ID NO: 212466 - DNA, 20 bp, Artificial Sequence
  chemically synthesized
cgaggcctgtcgcgaggtgg

SEQ ID NO: 212467 - DNA, 20 bp, Artificial Sequence
  chemically synthesized
ccgaggcctgtcgcgaggtg

SEQ ID NO: 212468 - DNA, 20 bp, Artificial Sequence
  chemically synthesized
accgaggcctgtcgcgaggt

SEQ ID NO: 212469 - DNA, 20 bp, Artificial Sequence
  chemically synthesized
caccgaggcctgtcgcgagg

SEQ ID NO: 212470 - DNA, 20 bp, Artificial Sequence
  chemically synthesized
ccttgccccccacctcgcga

SEQ ID NO: 212471 - DNA, 20 bp, Artificial Sequence
  chemically synthesized
cttgccccccacctcgcgac

SEQ ID NO: 212472 - DNA, 20 bp, Artificial Sequence
  chemically synthesized
acacaccgaggcctgtcgcg

SEQ ID NO: 212473 - DNA, 20 bp, Artificial Sequence
  chemically synthesized
cacacaccgaggcctgtcgc

SEQ ID NO: 212474 - DNA, 20 bp, Artificial Sequence
  chemically synthesized
ccccacctcgcgacaggcct

SEQ ID NO: 212475 - DNA, 20 bp, Artificial Sequence
  chemically synthesized
gaggggaacatcacacaccg

SEQ ID NO: 212476 - DNA, 20 bp, Artificial Sequence
  chemically synthesized
ggaggggaacatcacacacc

SEQ ID NO: 212477 - DNA, 20 bp, Artificial Sequence
  chemically synthesized
ggtgtgtgatgttcccctcc

SEQ ID NO: 212478 - DNA, 20 bp, Artificial Sequence
  chemically synthesized
gaacacatggacaccgggag

SEQ ID NO: 212479 - DNA, 20 bp, Artificial Sequence
  chemically synthesized
agaacacatggacaccggga

SEQ ID NO: 212480 - DNA, 20 bp, Artificial Sequence
  chemically synthesized
gagaacacatggacaccggg

SEQ ID NO: 212481 - DNA, 20 bp, Artificial Sequence
  chemically synthesized
tgagaacacatggacaccgg

SEQ ID NO: 212482 - DNA, 20 bp, Artificial Sequence
  chemically synthesized
aatgagaacacatggacacc

SEQ ID NO: 212483 - DNA, 20 bp, Artificial Sequence
  chemically synthesized
caatgagaacacatggacac

SEQ ID NO: 212484 - DNA, 20 bp, Artificial Sequence
  chemically synthesized
agttgagcaatgagaacaca

SEQ ID NO: 212485 - DNA, 20 bp, Artificial Sequence
  chemically synthesized
ataattgggagttgagcaat

SEQ ID NO: 212486 - DNA, 20 bp, Artificial Sequence
  chemically synthesized
ctcactcataattgggagtt

SEQ ID NO: 212487 - DNA, 20 bp, Artificial Sequence
  chemically synthesized
attttctcactcataattgg

SEQ ID NO: 212488 - DNA, 20 bp, Artificial Sequence
  chemically synthesized
attgctcaactcccaattat

SEQ ID NO: 212489 - DNA, 20 bp, Artificial Sequence
  chemically synthesized
gcattttctcactcataatt

SEQ ID NO: 212490 - DNA, 20 bp, Artificial Sequence
  chemically synthesized
cgcattttctcactcataat

SEQ ID NO: 212491 - DNA, 20 bp, Artificial Sequence
  chemically synthesized
ctcaactcccaattatgagt

SEQ ID NO: 212492 - DNA, 20 bp, Artificial Sequence
  chemically synthesized
caattatgagtgagaaaatg

SEQ ID NO: 212493 - DNA, 20 bp, Artificial Sequence
  chemically synthesized
ctaacacaggaatggaaaaa

SEQ ID NO: 212494 - DNA, 20 bp, Artificial Sequence
  chemically synthesized
tcagcaaactaacacaggaa

SEQ ID NO: 212495 - DNA, 20 bp, Artificial Sequence
  chemically synthesized
ctgtttttccattcctgtgt

SEQ ID NO: 212496 - DNA, 20 bp, Artificial Sequence
  chemically synthesized
catcctcagcaaactaacac

SEQ ID NO: 212497 - DNA, 20 bp, Artificial Sequence
  chemically synthesized
tcatcctcagcaaactaaca

SEQ ID NO: 212498 - DNA, 20 bp, Artificial Sequence
  chemically synthesized
cattcctgtgttagtttgct

SEQ ID NO: 212499 - DNA, 20 bp, Artificial Sequence
  chemically synthesized
attcctgtgttagtttgctg

SEQ ID NO: 212500 - DNA, 20 bp, Artificial Sequence
  chemically synthesized
tgttagtttgctgaggatga

SEQ ID NO: 212501 - DNA, 20 bp, Artificial Sequence
  chemically synthesized
aagctggaagccatcatcct

SEQ ID NO: 212502 - DNA, 20 bp, Artificial Sequence
  chemically synthesized
ttgctgaggatgatggcttc

SEQ ID NO: 212503 - DNA, 20 bp, Artificial Sequence
  chemically synthesized
agggacatggataaagctgg

SEQ ID NO: 212504 - DNA, 20 bp, Artificial Sequence
  chemically synthesized
tgaagggacatggataaagc

SEQ ID NO: 212505 - DNA, 20 bp, Artificial Sequence
  chemically synthesized
cctttgaagggacatggata

SEQ ID NO: 212506 - DNA, 20 bp, Artificial Sequence
  chemically synthesized
tcatgtcctttgaagggaca

SEQ ID NO: 212507 - DNA, 20 bp, Artificial Sequence
  chemically synthesized
gctttatccatgtcccttca

SEQ ID NO: 212508 - DNA, 20 bp, Artificial Sequence
  chemically synthesized
ctttatccatgtcccttcaa

SEQ ID NO: 212509 - DNA, 20 bp, Artificial Sequence
  chemically synthesized
acgagttcatgtcctttgaa

SEQ ID NO: 212510 - DNA, 20 bp, Artificial Sequence
  chemically synthesized
aacgagttcatgtcctttga

SEQ ID NO: 212511 - DNA, 20 bp, Artificial Sequence
  chemically synthesized
gaacgagttcatgtcctttg

SEQ ID NO: 212512 - DNA, 20 bp, Artificial Sequence
  chemically synthesized
atgaatccataaaaaagaac

SEQ ID NO: 212513 - DNA, 20 bp, Artificial Sequence
  chemically synthesized
catgaactcgttctttttta

SEQ ID NO: 212514 - DNA, 20 bp, Artificial Sequence
  chemically synthesized
aatactatgaatccataaaa

SEQ ID NO: 212515 - DNA, 20 bp, Artificial Sequence
  chemically synthesized
cgttcttttttatggattca

SEQ ID NO: 212516 - DNA, 20 bp, Artificial Sequence
  chemically synthesized
tatggattcatagtattcca

SEQ ID NO: 212517 - DNA, 20 bp, Artificial Sequence
  chemically synthesized
aaggtggcacatacacacca

SEQ ID NO: 212518 - DNA, 20 bp, Artificial Sequence
  chemically synthesized
tggactggataaagaaaagg

SEQ ID NO: 212519 - DNA, 20 bp, Artificial Sequence
  chemically synthesized
tgatggactggataaagaaa

SEQ ID NO: 212520 - DNA, 20 bp, Artificial Sequence
  chemically synthesized
gtgatggactggataaagaa

SEQ ID NO: 212521 - DNA, 20 bp, Artificial Sequence
  chemically synthesized
tgtgccaccttttctttatc

SEQ ID NO: 212522 - DNA, 20 bp, Artificial Sequence
  chemically synthesized
catcagtgatggactggata

SEQ ID NO: 212523 - DNA, 20 bp, Artificial Sequence
  chemically synthesized
aatgcccatcagtgatggac

SEQ ID NO: 212524 - DNA, 20 bp, Artificial Sequence
  chemically synthesized
tttatccagtccatcactga

SEQ ID NO: 212525 - DNA, 20 bp, Artificial Sequence
  chemically synthesized
acccaaatgcccatcagtga

SEQ ID NO: 212526 - DNA, 20 bp, Artificial Sequence
  chemically synthesized
ttatccagtccatcactgat

SEQ ID NO: 212527 - DNA, 20 bp, Artificial Sequence
  chemically synthesized
ttatcaacccaaatgcccat

SEQ ID NO: 212528 - DNA, 20 bp, Artificial Sequence
  chemically synthesized
gtccatcactgatgggcatt

SEQ ID NO: 212529 - DNA, 20 bp, Artificial Sequence
  chemically synthesized
tccatcactgatgggcattt

SEQ ID NO: 212530 - DNA, 20 bp, Artificial Sequence
  chemically synthesized
tgggttgataaacatatata

SEQ ID NO: 212531 - DNA, 20 bp, Artificial Sequence
  chemically synthesized
tacttttccttaggataaga

SEQ ID NO: 212532 - DNA, 20 bp, Artificial Sequence
  chemically synthesized
aaagatcactttcttatcct

SEQ ID NO: 212533 - DNA, 20 bp, Artificial Sequence
  chemically synthesized
aagatcactttcttatccta

SEQ ID NO: 212534 - DNA, 20 bp, Artificial Sequence
  chemically synthesized
agtatacttttccttaggat

SEQ ID NO: 212535 - DNA, 20 bp, Artificial Sequence
  chemically synthesized
cactttcttatcctaaggaa

SEQ ID NO: 212536 - DNA, 20 bp, Artificial Sequence
  chemically synthesized
atacaagtatacttttcctt

SEQ ID NO: 212537 - DNA, 20 bp, Artificial Sequence
  chemically synthesized
tatacaagtatacttttcct

SEQ ID NO: 212538 - DNA, 20 bp, Artificial Sequence
  chemically synthesized
ggaaaagtatacttgtataa

SEQ ID NO: 212539 - DNA, 20 bp, Artificial Sequence
  chemically synthesized
gaaaagtatacttgtataat

SEQ ID NO: 212540 - DNA, 20 bp, Artificial Sequence
  chemically synthesized
tatatctggtcccattatac

SEQ ID NO: 212541 - DNA, 20 bp, Artificial Sequence
  chemically synthesized
gtatacttgtataatgggac

SEQ ID NO: 212542 - DNA, 20 bp, Artificial Sequence
  chemically synthesized
actaagtcactttatatatc

SEQ ID NO: 212543 - DNA, 20 bp, Artificial Sequence
  chemically synthesized
ataatgggaccagatatata

SEQ ID NO: 212544 - DNA, 20 bp, Artificial Sequence
  chemically synthesized
accagatatataaagtgact

SEQ ID NO: 212545 - DNA, 20 bp, Artificial Sequence
  chemically synthesized
ggttgatttgtattttaact

SEQ ID NO: 212546 - DNA, 20 bp, Artificial Sequence
  chemically synthesized
ttaaaatacaaatcaaccct

SEQ ID NO: 212547 - DNA, 20 bp, Artificial Sequence
  chemically synthesized
tccctttaattttatactta

SEQ ID NO: 212548 - DNA, 20 bp, Artificial Sequence
  chemically synthesized
ttccctttaattttatactt

SEQ ID NO: 212549 - DNA, 20 bp, Artificial Sequence
  chemically synthesized
attccctttaattttatact

SEQ ID NO: 212550 - DNA, 20 bp, Artificial Sequence
  chemically synthesized
caaccctaagtataaaatta

SEQ ID NO: 212551 - DNA, 20 bp, Artificial Sequence
  chemically synthesized
aaccctaagtataaaattaa

SEQ ID NO: 212552 - DNA, 20 bp, Artificial Sequence
  chemically synthesized
accctaagtataaaattaaa

SEQ ID NO: 212553 - DNA, 20 bp, Artificial Sequence
  chemically synthesized
ttccatatacatgttgtatt

SEQ ID NO: 212554 - DNA, 20 bp, Artificial Sequence
  chemically synthesized
ttctaaatacaacatgtata

SEQ ID NO: 212555 - DNA, 20 bp, Artificial Sequence
  chemically synthesized
attaggaatttagttattat

SEQ ID NO: 212556 - DNA, 20 bp, Artificial Sequence
  chemically synthesized
cattaggaatttagttatta

SEQ ID NO: 212557 - DNA, 20 bp, Artificial Sequence
  chemically synthesized
ctttgtcaacattaggaatt

SEQ ID NO: 212558 - DNA, 20 bp, Artificial Sequence
  chemically synthesized
tcaagtgctttgtcaacatt

SEQ ID NO: 212559 - DNA, 20 bp, Artificial Sequence
  chemically synthesized
gtcaagtgctttgtcaacat

SEQ ID NO: 212560 - DNA, 20 bp, Artificial Sequence
  chemically synthesized
ctaaattcctaatgttgaca

SEQ ID NO: 212561 - DNA, 20 bp, Artificial Sequence
  chemically synthesized
aatgttgacaaagcacttga

SEQ ID NO: 212562 - DNA, 20 bp, Artificial Sequence
  chemically synthesized
aaaagaatttgtaaactgtc

SEQ ID NO: 212563 - DNA, 20 bp, Artificial Sequence
  chemically synthesized
taaatgctatgatatagtaa

SEQ ID NO: 212564 - DNA, 20 bp, Artificial Sequence
  chemically synthesized
caaattcttttactatatca

SEQ ID NO: 212565 - DNA, 20 bp, Artificial Sequence
  chemically synthesized
cattattaaatgctatgata

SEQ ID NO: 212566 - DNA, 20 bp, Artificial Sequence
  chemically synthesized
agcatttaataatgttaatg

SEQ ID NO: 212567 - DNA, 20 bp, Artificial Sequence
  chemically synthesized
tgttaatgaagtctgtcacg

SEQ ID NO: 212568 - DNA, 20 bp, Artificial Sequence
  chemically synthesized
gttaatgaagtctgtcacgt

SEQ ID NO: 212569 - DNA, 20 bp, Artificial Sequence
  chemically synthesized
catgcaaaatgcctacgtga

SEQ ID NO: 212570 - DNA, 20 bp, Artificial Sequence
  chemically synthesized
taggcattttgcatgtttta

SEQ ID NO: 212571 - DNA, 20 bp, Artificial Sequence
  chemically synthesized
attttgcatgttttacagtt

SEQ ID NO: 212572 - DNA, 20 bp, Artificial Sequence
  chemically synthesized
gttcagaaaatgttttcttc

SEQ ID NO: 212573 - DNA, 20 bp, Artificial Sequence
  chemically synthesized
ttttagctgagatttactgg

SEQ ID NO: 212574 - DNA, 20 bp, Artificial Sequence
  chemically synthesized
agtttttagctgagatttac

SEQ ID NO: 212575 - DNA, 20 bp, Artificial Sequence
  chemically synthesized
tgttttcttccagtaaatct

SEQ ID NO: 212576 - DNA, 20 bp, Artificial Sequence
  chemically synthesized
agcttcagcagtttttagct

SEQ ID NO: 212577 - DNA, 20 bp, Artificial Sequence
  chemically synthesized
gccctagcttcagcagtttt

SEQ ID NO: 212578 - DNA, 20 bp, Artificial Sequence
  chemically synthesized
atctcagctaaaaactgctg

SEQ ID NO: 212579 - DNA, 20 bp, Artificial Sequence
  chemically synthesized
cagctaaaaactgctgaagc

SEQ ID NO: 212580 - DNA, 20 bp, Artificial Sequence
  chemically synthesized
tgttcaagccctagcttcag

SEQ ID NO: 212581 - DNA, 20 bp, Artificial Sequence
  chemically synthesized
agctaaaaactgctgaagct

SEQ ID NO: 212582 - DNA, 20 bp, Artificial Sequence
  chemically synthesized
gctaaaaactgctgaagcta

SEQ ID NO: 212583 - DNA, 20 bp, Artificial Sequence
  chemically synthesized
agatgttcaagccctagctt

SEQ ID NO: 212584 - DNA, 20 bp, Artificial Sequence
  chemically synthesized
taagacagatgttcaagccc

SEQ ID NO: 212585 - DNA, 20 bp, Artificial Sequence
  chemically synthesized
tgggaataagacagatgttc

SEQ ID NO: 212586 - DNA, 20 bp, Artificial Sequence
  chemically synthesized
tgttaaaaatgggaataaga

SEQ ID NO: 212587 - DNA, 20 bp, Artificial Sequence
  chemically synthesized
tccgtgttaaaaatgggaat

SEQ ID NO: 212588 - DNA, 20 bp, Artificial Sequence
  chemically synthesized
taacagtccgtgttaaaaat

SEQ ID NO: 212589 - DNA, 20 bp, Artificial Sequence
  chemically synthesized
gtaacagtccgtgttaaaaa

SEQ ID NO: 212590 - DNA, 20 bp, Artificial Sequence
  chemically synthesized
tcttattcccatttttaaca

SEQ ID NO: 212591 - DNA, 20 bp, Artificial Sequence
  chemically synthesized
aaaagtagatgaaaatgtaa

SEQ ID NO: 212592 - DNA, 20 bp, Artificial Sequence
  chemically synthesized
actttattagtcaaaaaaag

SEQ ID NO: 212593 - DNA, 20 bp, Artificial Sequence
  chemically synthesized
ttgactttattagtcaaaaa

SEQ ID NO: 212594 - DNA, 20 bp, Artificial Sequence
  chemically synthesized
tctactttttttgactaata

SEQ ID NO: 212595 - DNA, 20 bp, Artificial Sequence
  chemically synthesized
gactttcatattgactttat

SEQ ID NO: 212596 - DNA, 20 bp, Artificial Sequence
  chemically synthesized
gactaataaagtcaatatga

SEQ ID NO: 212597 - DNA, 20 bp, Artificial Sequence
  chemically synthesized
aataaagtcaatatgaaagt

SEQ ID NO: 212598 - DNA, 20 bp, Artificial Sequence
  chemically synthesized
agtcaatatgaaagtcagtc

SEQ ID NO: 212599 - DNA, 20 bp, Artificial Sequence
  chemically synthesized
tatgaaagtcagtctagatt

SEQ ID NO: 212600 - DNA, 20 bp, Artificial Sequence
  chemically synthesized
atgaaagtcagtctagattc

SEQ ID NO: 212601 - DNA, 20 bp, Artificial Sequence
  chemically synthesized
agatgtgcaaagcctgaatc

SEQ ID NO: 212602 - DNA, 20 bp, Artificial Sequence
  chemically synthesized
cattgtaaagaagatgtgca

SEQ ID NO: 212603 - DNA, 20 bp, Artificial Sequence
  chemically synthesized
aactcgctagcattgtaaag

SEQ ID NO: 212604 - DNA, 20 bp, Artificial Sequence
  chemically synthesized
ccaaactcgctagcattgta

SEQ ID NO: 212605 - DNA, 20 bp, Artificial Sequence
  chemically synthesized
gcacatcttctttacaatgc

SEQ ID NO: 212606 - DNA, 20 bp, Artificial Sequence
  chemically synthesized
atcttctttacaatgctagc

SEQ ID NO: 212607 - DNA, 20 bp, Artificial Sequence
  chemically synthesized
ctttacaatgctagcgagtt

SEQ ID NO: 212608 - DNA, 20 bp, Artificial Sequence
  chemically synthesized
tctggttgccccaaactcgc

SEQ ID NO: 212609 - DNA, 20 bp, Artificial Sequence
  chemically synthesized
tttacaatgctagcgagttt

SEQ ID NO: 212610 - DNA, 20 bp, Artificial Sequence
  chemically synthesized
ttacaatgctagcgagtttg

SEQ ID NO: 212611 - DNA, 20 bp, Artificial Sequence
  chemically synthesized
gctagcgagtttggggcaac

SEQ ID NO: 212612 - DNA, 20 bp, Artificial Sequence
  chemically synthesized
gagtgcttttggtgtttatc

SEQ ID NO: 212613 - DNA, 20 bp, Artificial Sequence
  chemically synthesized
ggcaaccagataaacaccaa

SEQ ID NO: 212614 - DNA, 20 bp, Artificial Sequence
  chemically synthesized
tcatgttctttgagtgcttt

SEQ ID NO: 212615 - DNA, 20 bp, Artificial Sequence
  chemically synthesized
ataaacaccaaaagcactca

SEQ ID NO: 212616 - DNA, 20 bp, Artificial Sequence
  chemically synthesized
aatttatggtcatgttcttt

SEQ ID NO: 212617 - DNA, 20 bp, Artificial Sequence
  chemically synthesized
atggatttatttttaattta

SEQ ID NO: 212618 - DNA, 20 bp, Artificial Sequence
  chemically synthesized
catagcatctgaatttatta

SEQ ID NO: 212619 - DNA, 20 bp, Artificial Sequence
  chemically synthesized
aaataaatccataataaatt

SEQ ID NO: 212620 - DNA, 20 bp, Artificial Sequence
  chemically synthesized
atttttttccttgaagagca

SEQ ID NO: 212621 - DNA, 20 bp, Artificial Sequence
  chemically synthesized
attcagatgctatgctcttc

SEQ ID NO: 212622 - DNA, 20 bp, Artificial Sequence
  chemically synthesized
ttcagatgctatgctcttca

SEQ ID NO: 212623 - DNA, 20 bp, Artificial Sequence
  chemically synthesized
ttttgatttttttccttgaa

SEQ ID NO: 212624 - DNA, 20 bp, Artificial Sequence
  chemically synthesized
ctttttgatttttttccttg

SEQ ID NO: 212625 - DNA, 20 bp, Artificial Sequence
  chemically synthesized
cttcaaggaaaaaaatcaaa

SEQ ID NO: 212626 - DNA, 20 bp, Artificial Sequence
  chemically synthesized
ttcaaggaaaaaaatcaaaa

SEQ ID NO: 212627 - DNA, 20 bp, Artificial Sequence
  chemically synthesized
tcaaggaaaaaaatcaaaaa

SEQ ID NO: 212628 - DNA, 20 bp, Artificial Sequence
  chemically synthesized
caaggaaaaaaatcaaaaag

SEQ ID NO: 212629 - DNA, 20 bp, Artificial Sequence
  chemically synthesized
tgcatatatcacgcaaatac

SEQ ID NO: 212630 - DNA, 20 bp, Artificial Sequence
  chemically synthesized
atgcatatatcacgcaaata

SEQ ID NO: 212631 - DNA, 20 bp, Artificial Sequence
  chemically synthesized
tatatgcatatatatgtacg

SEQ ID NO: 212632 - DNA, 20 bp, Artificial Sequence
  chemically synthesized
atatgcatatatatgtacgt

SEQ ID NO: 212633 - DNA, 20 bp, Artificial Sequence
  chemically synthesized
tttatgtgtatatatgtata

SEQ ID NO: 212634 - DNA, 20 bp, Artificial Sequence
  chemically synthesized
gtatatatgtatatagttta

SEQ ID NO: 212635 - DNA, 20 bp, Artificial Sequence
  chemically synthesized
gtaaaaatcatataaatata

SEQ ID NO: 212636 - DNA, 20 bp, Artificial Sequence
  chemically synthesized
taaatatatagaaataaata

SEQ ID NO: 212637 - DNA, 20 bp, Artificial Sequence
  chemically synthesized
tagaaataaataaagatcta

SEQ ID NO: 212638 - DNA, 20 bp, Artificial Sequence
  chemically synthesized
gtttctctaaaatggtacta

SEQ ID NO: 212639 - DNA, 20 bp, Artificial Sequence
  chemically synthesized
aaagatctatagtaccattt

SEQ ID NO: 212640 - DNA, 20 bp, Artificial Sequence
  chemically synthesized
agatctatagtaccatttta

SEQ ID NO: 212641 - DNA, 20 bp, Artificial Sequence
  chemically synthesized
gctttattgtttctctaaaa

SEQ ID NO: 212642 - DNA, 20 bp, Artificial Sequence
  chemically synthesized
accattttagagaaacaata

SEQ ID NO: 212643 - DNA, 20 bp, Artificial Sequence
  chemically synthesized
aaacaataaagcataatttc

SEQ ID NO: 212644 - DNA, 20 bp, Artificial Sequence
  chemically synthesized
acccaactttaattttttgc

SEQ ID NO: 212645 - DNA, 20 bp, Artificial Sequence
  chemically synthesized
taatttctggcaaaaaatta

SEQ ID NO: 212646 - DNA, 20 bp, Artificial Sequence
  chemically synthesized
ttctggcaaaaaattaaagt

SEQ ID NO: 212647 - DNA, 20 bp, Artificial Sequence
  chemically synthesized
tctggcaaaaaattaaagtt

SEQ ID NO: 212648 - DNA, 20 bp, Artificial Sequence
  chemically synthesized
gttgggtataattcaaatat

SEQ ID NO: 212649 - DNA, 20 bp, Artificial Sequence
  chemically synthesized
tcaaatatcagtccattata

SEQ ID NO: 212650 - DNA, 20 bp, Artificial Sequence
  chemically synthesized
cttttactttttctgtataa

SEQ ID NO: 212651 - DNA, 20 bp, Artificial Sequence
  chemically synthesized
atcagtccattatacagaaa

SEQ ID NO: 212652 - DNA, 20 bp, Artificial Sequence
  chemically synthesized
ccattatacagaaaaagtaa

SEQ ID NO: 212653 - DNA, 20 bp, Artificial Sequence
  chemically synthesized
agtaaaagtttgtcctacct

SEQ ID NO: 212654 - DNA, 20 bp, Artificial Sequence
  chemically synthesized
taatcagtaaaatccaaggt

SEQ ID NO: 212655 - DNA, 20 bp, Artificial Sequence
  chemically synthesized
ataatcagtaaaatccaagg

SEQ ID NO: 212656 - DNA, 20 bp, Artificial Sequence
  chemically synthesized
tttataatcagtaaaatcca

SEQ ID NO: 212657 - DNA, 20 bp, Artificial Sequence
  chemically synthesized
ttttataatcagtaaaatcc

SEQ ID NO: 212658 - DNA, 20 bp, Artificial Sequence
  chemically synthesized
ttgtgctttcattttataat

SEQ ID NO: 212659 - DNA, 20 bp, Artificial Sequence
  chemically synthesized
ttttactgattataaaatga

SEQ ID NO: 212660 - DNA, 20 bp, Artificial Sequence
  chemically synthesized
gcacaaatgattaaaatttc

SEQ ID NO: 212661 - DNA, 20 bp, Artificial Sequence
  chemically synthesized
tatagtacctggtgtaaaac

SEQ ID NO: 212662 - DNA, 20 bp, Artificial Sequence
  chemically synthesized
taaaatttctagttttacac

SEQ ID NO: 212663 - DNA, 20 bp, Artificial Sequence
  chemically synthesized
aaaatttctagttttacacc

SEQ ID NO: 212664 - DNA, 20 bp, Artificial Sequence
  chemically synthesized
catgccatcagtatagtacc

SEQ ID NO: 212665 - DNA, 20 bp, Artificial Sequence
  chemically synthesized
tacaccaggtactatactga

SEQ ID NO: 212666 - DNA, 20 bp, Artificial Sequence
  chemically synthesized
gggtgggcatgccatcagta

SEQ ID NO: 212667 - DNA, 20 bp, Artificial Sequence
  chemically synthesized
agacagggtgggcatgccat

SEQ ID NO: 212668 - DNA, 20 bp, Artificial Sequence
  chemically synthesized
gactattagcaagacagggt

SEQ ID NO: 212669 - DNA, 20 bp, Artificial Sequence
  chemically synthesized
ggactattagcaagacaggg

SEQ ID NO: 212670 - DNA, 20 bp, Artificial Sequence
  chemically synthesized
actggactattagcaagaca

SEQ ID NO: 212671 - DNA, 20 bp, Artificial Sequence
  chemically synthesized
aactggactattagcaagac

SEQ ID NO: 212672 - DNA, 20 bp, Artificial Sequence
  chemically synthesized
aaactggactattagcaaga

SEQ ID NO: 212673 - DNA, 20 bp, Artificial Sequence
  chemically synthesized
tgcccaccctgtcttgctaa

SEQ ID NO: 212674 - DNA, 20 bp, Artificial Sequence
  chemically synthesized
atgaaaactggactattagc

SEQ ID NO: 212675 - DNA, 20 bp, Artificial Sequence
  chemically synthesized
accctgtcttgctaatagtc

SEQ ID NO: 212676 - DNA, 20 bp, Artificial Sequence
  chemically synthesized
gtttatgaaaactggactat

SEQ ID NO: 212677 - DNA, 20 bp, Artificial Sequence
  chemically synthesized
acaaggtagtttatgaaaac

SEQ ID NO: 212678 - DNA, 20 bp, Artificial Sequence
  chemically synthesized
attctcattttcaaacaagg

SEQ ID NO: 212679 - DNA, 20 bp, Artificial Sequence
  chemically synthesized
aaaattctcattttcaaaca

SEQ ID NO: 212680 - DNA, 20 bp, Artificial Sequence
  chemically synthesized
gaaaattctcattttcaaac

SEQ ID NO: 212681 - DNA, 20 bp, Artificial Sequence
  chemically synthesized
aaactaccttgtttgaaaat

SEQ ID NO: 212682 - DNA, 20 bp, Artificial Sequence
  chemically synthesized
aaaatgagaattttcatgtg

SEQ ID NO: 212683 - DNA, 20 bp, Artificial Sequence
  chemically synthesized
tgagaattttcatgtgaagt

SEQ ID NO: 212684 - DNA, 20 bp, Artificial Sequence
  chemically synthesized
gagaattttcatgtgaagtc

SEQ ID NO: 212685 - DNA, 20 bp, Artificial Sequence
  chemically synthesized
agaattttcatgtgaagtca

SEQ ID NO: 212686 - DNA, 20 bp, Artificial Sequence
  chemically synthesized
gtgaagtcagggctccacat

SEQ ID NO: 212687 - DNA, 20 bp, Artificial Sequence
  chemically synthesized
catcagtgttttccaatgtg

SEQ ID NO: 212688 - DNA, 20 bp, Artificial Sequence
  chemically synthesized
aacatcagtgttttccaatg

SEQ ID NO: 212689 - DNA, 20 bp, Artificial Sequence
  chemically synthesized
ctagaatgagttagaaacat

SEQ ID NO: 212690 - DNA, 20 bp, Artificial Sequence
  chemically synthesized
atgaaatatctagaatgagt

SEQ ID NO: 212691 - DNA, 20 bp, Artificial Sequence
  chemically synthesized
ctgatgtttctaactcattc

SEQ ID NO: 212692 - DNA, 20 bp, Artificial Sequence
  chemically synthesized
gagaatgaaatatctagaat

SEQ ID NO: 212693 - DNA, 20 bp, Artificial Sequence
  chemically synthesized
gaaagagagaatgaaatatc

SEQ ID NO: 212694 - DNA, 20 bp, Artificial Sequence
  chemically synthesized
aaattacatgggtagaaaga

SEQ ID NO: 212695 - DNA, 20 bp, Artificial Sequence
  chemically synthesized
taaaattacatgggtagaaa

SEQ ID NO: 212696 - DNA, 20 bp, Artificial Sequence
  chemically synthesized
gctaaaattacatgggtaga

SEQ ID NO: 212697 - DNA, 20 bp, Artificial Sequence
  chemically synthesized
caatgctaaaattacatggg

SEQ ID NO: 212698 - DNA, 20 bp, Artificial Sequence
  chemically synthesized
aagcaatgctaaaattacat

SEQ ID NO: 212699 - DNA, 20 bp, Artificial Sequence
  chemically synthesized
caagcaatgctaaaattaca

SEQ ID NO: 212700 - DNA, 20 bp, Artificial Sequence
  chemically synthesized
tctttctacccatgtaattt

SEQ ID NO: 212701 - DNA, 20 bp, Artificial Sequence
  chemically synthesized
attttagcattgcttgctcc

SEQ ID NO: 212702 - DNA, 20 bp, Artificial Sequence
  chemically synthesized
ccaaacattgtgctaggagc

SEQ ID NO: 212703 - DNA, 20 bp, Artificial Sequence
  chemically synthesized
tgtgccaaacattgtgctag

SEQ ID NO: 212704 - DNA, 20 bp, Artificial Sequence
  chemically synthesized
tatgtgccaaacattgtgct

SEQ ID NO: 212705 - DNA, 20 bp, Artificial Sequence
  chemically synthesized
gtatgtgccaaacattgtgc

SEQ ID NO: 212706 - DNA, 20 bp, Artificial Sequence
  chemically synthesized
cttgctcctagcacaatgtt

SEQ ID NO: 212707 - DNA, 20 bp, Artificial Sequence
  chemically synthesized
aagaacttgtattaagaaac

SEQ ID NO: 212708 - DNA, 20 bp, Artificial Sequence
  chemically synthesized
acatacttgtttcttaatac

SEQ ID NO: 212709 - DNA, 20 bp, Artificial Sequence
  chemically synthesized
tgagttaaagaacttgtatt

SEQ ID NO: 212710 - DNA, 20 bp, Artificial Sequence
  chemically synthesized
tgattatattgtttgagtta

SEQ ID NO: 212711 - DNA, 20 bp, Artificial Sequence
  chemically synthesized
ctgagatgattatattgttt

SEQ ID NO: 212712 - DNA, 20 bp, Artificial Sequence
  chemically synthesized
ctcaaacaatataatcatct

SEQ ID NO: 212713 - DNA, 20 bp, Artificial Sequence
  chemically synthesized
ggtatggcactgaatttact

SEQ ID NO: 212714 - DNA, 20 bp, Artificial Sequence
  chemically synthesized
tataatcatctcagtaaatt

SEQ ID NO: 212715 - DNA, 20 bp, Artificial Sequence
  chemically synthesized
gagaaggtaaagtatgggta

SEQ ID NO: 212716 - DNA, 20 bp, Artificial Sequence
  chemically synthesized
aataagagaaggtaaagtat

SEQ ID NO: 212717 - DNA, 20 bp, Artificial Sequence
  chemically synthesized
gaataagagaaggtaaagta

SEQ ID NO: 212718 - DNA, 20 bp, Artificial Sequence
  chemically synthesized
cgggagaataagagaaggta

SEQ ID NO: 212719 - DNA, 20 bp, Artificial Sequence
  chemically synthesized
agccccgggagaataagaga

SEQ ID NO: 212720 - DNA, 20 bp, Artificial Sequence
  chemically synthesized
tagccccgggagaataagag

SEQ ID NO: 212721 - DNA, 20 bp, Artificial Sequence
  chemically synthesized
atttagccccgggagaataa

SEQ ID NO: 212722 - DNA, 20 bp, Artificial Sequence
  chemically synthesized
tttaccttctcttattctcc

SEQ ID NO: 212723 - DNA, 20 bp, Artificial Sequence
  chemically synthesized
atatttagccccgggagaat

SEQ ID NO: 212724 - DNA, 20 bp, Artificial Sequence
  chemically synthesized
ttaccttctcttattctccc

SEQ ID NO: 212725 - DNA, 20 bp, Artificial Sequence
  chemically synthesized
taccttctcttattctcccg

SEQ ID NO: 212726 - DNA, 20 bp, Artificial Sequence
  chemically synthesized
gtgatcatatttagccccgg

SEQ ID NO: 212727 - DNA, 20 bp, Artificial Sequence
  chemically synthesized
aagtgatcatatttagcccc

SEQ ID NO: 212728 - DNA, 20 bp, Artificial Sequence
  chemically synthesized
gaagtgatcatatttagccc

SEQ ID NO: 212729 - DNA, 20 bp, Artificial Sequence
  chemically synthesized
ctgattgaagtgatcatatt

SEQ ID NO: 212730 - DNA, 20 bp, Artificial Sequence
  chemically synthesized
ctaaatatgatcacttcaat

SEQ ID NO: 212731 - DNA, 20 bp, Artificial Sequence
  chemically synthesized
ttttatgagcattctgattg

SEQ ID NO: 212732 - DNA, 20 bp, Artificial Sequence
  chemically synthesized
atcaggtgattttgttttat

SEQ ID NO: 212733 - DNA, 20 bp, Artificial Sequence
  chemically synthesized
aaacataagttgcattaatc

SEQ ID NO: 212734 - DNA, 20 bp, Artificial Sequence
  chemically synthesized
aaaacataagttgcattaat

SEQ ID NO: 212735 - DNA, 20 bp, Artificial Sequence
  chemically synthesized
tttaaacttcatgaaaacat

SEQ ID NO: 212736 - DNA, 20 bp, Artificial Sequence
  chemically synthesized
atgcaacttatgttttcatg

SEQ ID NO: 212737 - DNA, 20 bp, Artificial Sequence
  chemically synthesized
aagtttaaatcaaaatcatt

SEQ ID NO: 212738 - DNA, 20 bp, Artificial Sequence
  chemically synthesized
taaaagggttttaaaatgaa

SEQ ID NO: 212739 - DNA, 20 bp, Artificial Sequence
  chemically synthesized
tttaaaagggttttaaaatg

SEQ ID NO: 212740 - DNA, 20 bp, Artificial Sequence
  chemically synthesized
tagactaatctattttaaaa

SEQ ID NO: 212741 - DNA, 20 bp, Artificial Sequence
  chemically synthesized
attttaaaacccttttaaaa

SEQ ID NO: 212742 - DNA, 20 bp, Artificial Sequence
  chemically synthesized
gtagactaatctattttaaa

SEQ ID NO: 212743 - DNA, 20 bp, Artificial Sequence
  chemically synthesized
agtagactaatctattttaa

SEQ ID NO: 212744 - DNA, 20 bp, Artificial Sequence
  chemically synthesized
aaaacccttttaaaatagat

SEQ ID NO: 212745 - DNA, 20 bp, Artificial Sequence
  chemically synthesized
tatttaccaaggcaataaag

SEQ ID NO: 212746 - DNA, 20 bp, Artificial Sequence
  chemically synthesized
ctatatttaccaaggcaata

SEQ ID NO: 212747 - DNA, 20 bp, Artificial Sequence
  chemically synthesized
attagtctactttattgcct

SEQ ID NO: 212748 - DNA, 20 bp, Artificial Sequence
  chemically synthesized
tcaacattctatatttacca

SEQ ID NO: 212749 - DNA, 20 bp, Artificial Sequence
  chemically synthesized
ttcaacattctatatttacc

SEQ ID NO: 212750 - DNA, 20 bp, Artificial Sequence
  chemically synthesized
ctttattgccttggtaaata

SEQ ID NO: 212751 - DNA, 20 bp, Artificial Sequence
  chemically synthesized
ttttaatcattgctaatgat

SEQ ID NO: 212752 - DNA, 20 bp, Artificial Sequence
  chemically synthesized
tttaatcattgctaatgatt

SEQ ID NO: 212753 - DNA, 20 bp, Artificial Sequence
  chemically synthesized
ttaatcattgctaatgattg

SEQ ID NO: 212754 - DNA, 20 bp, Artificial Sequence
  chemically synthesized
tttttaatgaccccaatcat

SEQ ID NO: 212755 - DNA, 20 bp, Artificial Sequence
  chemically synthesized
taatgattggggtcattaaa

SEQ ID NO: 212756 - DNA, 20 bp, Artificial Sequence
  chemically synthesized
ttggggtcattaaaaagttc

SEQ ID NO: 212757 - DNA, 20 bp, Artificial Sequence
  chemically synthesized
atttgtaaagatgacgattc

SEQ ID NO: 212758 - DNA, 20 bp, Artificial Sequence
  chemically synthesized
agaatcgtcatctttacaaa

SEQ ID NO: 212759 - DNA, 20 bp, Artificial Sequence
  chemically synthesized
atactcagagactatttgta

SEQ ID NO: 212760 - DNA, 20 bp, Artificial Sequence
  chemically synthesized
catctttacaaatagtctct

SEQ ID NO: 212761 - DNA, 20 bp, Artificial Sequence
  chemically synthesized
catgcacagcagtatactca

SEQ ID NO: 212762 - DNA, 20 bp, Artificial Sequence
  chemically synthesized
aacatgcacagcagtatact

SEQ ID NO: 212763 - DNA, 20 bp, Artificial Sequence
  chemically synthesized
taagccctcaacatgcacag

SEQ ID NO: 212764 - DNA, 20 bp, Artificial Sequence
  chemically synthesized
gcctaagccctcaacatgca

SEQ ID NO: 212765 - DNA, 20 bp, Artificial Sequence
  chemically synthesized
agtatactgctgtgcatgtt

SEQ ID NO: 212766 - DNA, 20 bp, Artificial Sequence
  chemically synthesized
gtatactgctgtgcatgttg

SEQ ID NO: 212767 - DNA, 20 bp, Artificial Sequence
  chemically synthesized
tatactgctgtgcatgttga

SEQ ID NO: 212768 - DNA, 20 bp, Artificial Sequence
  chemically synthesized
tgctgtgcatgttgagggct

SEQ ID NO: 212769 - DNA, 20 bp, Artificial Sequence
  chemically synthesized
gctgtgcatgttgagggctt

SEQ ID NO: 212770 - DNA, 20 bp, Artificial Sequence
  chemically synthesized
cctcacaaatttaaaggcct

SEQ ID NO: 212771 - DNA, 20 bp, Artificial Sequence
  chemically synthesized
gatttgcctcacaaatttaa

SEQ ID NO: 212772 - DNA, 20 bp, Artificial Sequence
  chemically synthesized
agatttgcctcacaaattta

SEQ ID NO: 212773 - DNA, 20 bp, Artificial Sequence
  chemically synthesized
gcttaggcctttaaatttgt

SEQ ID NO: 212774 - DNA, 20 bp, Artificial Sequence
  chemically synthesized
cttaggcctttaaatttgtg

SEQ ID NO: 212775 - DNA, 20 bp, Artificial Sequence
  chemically synthesized
aaatttgtgaggcaaatcta

SEQ ID NO: 212776 - DNA, 20 bp, Artificial Sequence
  chemically synthesized
tgaggcaaatctatggccta

SEQ ID NO: 212777 - DNA, 20 bp, Artificial Sequence
  chemically synthesized
atagggcacactgtaggcca

SEQ ID NO: 212778 - DNA, 20 bp, Artificial Sequence
  chemically synthesized
atgttcatagggcacactgt

SEQ ID NO: 212779 - DNA, 20 bp, Artificial Sequence
  chemically synthesized
aatgttcatagggcacactg

SEQ ID NO: 212780 - DNA, 20 bp, Artificial Sequence
  chemically synthesized
tcctaaaagcaatgttcata

SEQ ID NO: 212781 - DNA, 20 bp, Artificial Sequence
  chemically synthesized
ttcctaaaagcaatgttcat

SEQ ID NO: 212782 - DNA, 20 bp, Artificial Sequence
  chemically synthesized
attcctaaaagcaatgttca

SEQ ID NO: 212783 - DNA, 20 bp, Artificial Sequence
  chemically synthesized
tgccctatgaacattgcttt

SEQ ID NO: 212784 - DNA, 20 bp, Artificial Sequence
  chemically synthesized
gccctatgaacattgctttt

SEQ ID NO: 212785 - DNA, 20 bp, Artificial Sequence
  chemically synthesized
taacatcaatttattcctaa

SEQ ID NO: 212786 - DNA, 20 bp, Artificial Sequence
  chemically synthesized
tttaggaataaattgatgtt

SEQ ID NO: 212787 - DNA, 20 bp, Artificial Sequence
  chemically synthesized
aattgatgttaagaatgtac

SEQ ID NO: 212788 - DNA, 20 bp, Artificial Sequence
  chemically synthesized
ctgttggtgggattgtaaac

SEQ ID NO: 212789 - DNA, 20 bp, Artificial Sequence
  chemically synthesized
ctagtttacaatcccaccaa

SEQ ID NO: 212790 - DNA, 20 bp, Artificial Sequence
  chemically synthesized
aacacttttacactgttggt

SEQ ID NO: 212791 - DNA, 20 bp, Artificial Sequence
  chemically synthesized
gaacacttttacactgttgg

SEQ ID NO: 212792 - DNA, 20 bp, Artificial Sequence
  chemically synthesized
taggaacacttttacactgt

SEQ ID NO: 212793 - DNA, 20 bp, Artificial Sequence
  chemically synthesized
caatcccaccaacagtgtaa

SEQ ID NO: 212794 - DNA, 20 bp, Artificial Sequence
  chemically synthesized
tggagaggatggggagaaat

SEQ ID NO: 212795 - DNA, 20 bp, Artificial Sequence
  chemically synthesized
ctggagaggatggggagaaa

SEQ ID NO: 212796 - DNA, 20 bp, Artificial Sequence
  chemically synthesized
caggtgctggagaggatggg

SEQ ID NO: 212797 - DNA, 20 bp, Artificial Sequence
  chemically synthesized
aacaggtgctggagaggatg

SEQ ID NO: 212798 - DNA, 20 bp, Artificial Sequence
  chemically synthesized
caacaggtgctggagaggat

SEQ ID NO: 212799 - DNA, 20 bp, Artificial Sequence
  chemically synthesized
ctatttctccccatcctctc

SEQ ID NO: 212800 - DNA, 20 bp, Artificial Sequence
  chemically synthesized
acaacaggtgctggagagga

SEQ ID NO: 212801 - DNA, 20 bp, Artificial Sequence
  chemically synthesized
ggaaacaacaggtgctggag

SEQ ID NO: 212802 - DNA, 20 bp, Artificial Sequence
  chemically synthesized
aggaaacaacaggtgctgga

SEQ ID NO: 212803 - DNA, 20 bp, Artificial Sequence
  chemically synthesized
tcaggaaacaacaggtgctg

SEQ ID NO: 212804 - DNA, 20 bp, Artificial Sequence
  chemically synthesized
agtcaggaaacaacaggtgc

SEQ ID NO: 212805 - DNA, 20 bp, Artificial Sequence
  chemically synthesized
ttaaaaagtcaggaaacaac

SEQ ID NO: 212806 - DNA, 20 bp, Artificial Sequence
  chemically synthesized
attaaaaagtcaggaaacaa

SEQ ID NO: 212807 - DNA, 20 bp, Artificial Sequence
  chemically synthesized
atggcaatcattaaaaagtc

SEQ ID NO: 212808 - DNA, 20 bp, Artificial Sequence
  chemically synthesized
aatggcaatcattaaaaagt

SEQ ID NO: 212809 - DNA, 20 bp, Artificial Sequence
  chemically synthesized
ttagaatggcaatcattaaa

SEQ ID NO: 212810 - DNA, 20 bp, Artificial Sequence
  chemically synthesized
ttaatgattgccattctaac

SEQ ID NO: 212811 - DNA, 20 bp, Artificial Sequence
  chemically synthesized
ccatctcacaccagttagaa

SEQ ID NO: 212812 - DNA, 20 bp, Artificial Sequence
  chemically synthesized
agataccatctcacaccagt

SEQ ID NO: 212813 - DNA, 20 bp, Artificial Sequence
  chemically synthesized
attgccattctaactggtgt

SEQ ID NO: 212814 - DNA, 20 bp, Artificial Sequence
  chemically synthesized
aatgagataccatctcacac

SEQ ID NO: 212815 - DNA, 20 bp, Artificial Sequence
  chemically synthesized
ccattctaactggtgtgaga

SEQ ID NO: 212816 - DNA, 20 bp, Artificial Sequence
  chemically synthesized
tgtgagatggtatctcattg

SEQ ID NO: 212817 - DNA, 20 bp, Artificial Sequence
  chemically synthesized
atgcaaatcaaaaccacaat

SEQ ID NO: 212818 - DNA, 20 bp, Artificial Sequence
  chemically synthesized
tttgatttgcatgtctctga

SEQ ID NO: 212819 - DNA, 20 bp, Artificial Sequence
  chemically synthesized
atttgcatgtctctgatggc

SEQ ID NO: 212820 - DNA, 20 bp, Artificial Sequence
  chemically synthesized
ctcaccatcactggccatca

SEQ ID NO: 212821 - DNA, 20 bp, Artificial Sequence
  chemically synthesized
tgctcaccatcactggccat

SEQ ID NO: 212822 - DNA, 20 bp, Artificial Sequence
  chemically synthesized
atgtctctgatggccagtga

SEQ ID NO: 212823 - DNA, 20 bp, Artificial Sequence
  chemically synthesized
gaaaaaatgctcaccatcac

SEQ ID NO: 212824 - DNA, 20 bp, Artificial Sequence
  chemically synthesized
ctctgatggccagtgatggt

SEQ ID NO: 212825 - DNA, 20 bp, Artificial Sequence
  chemically synthesized
gcattttttcatgtgttttt

SEQ ID NO: 212826 - DNA, 20 bp, Artificial Sequence
  chemically synthesized
ctcaaaagaagacatttatg

SEQ ID NO: 212827 - DNA, 20 bp, Artificial Sequence
  chemically synthesized
ctgcataaatgtcttctttt

SEQ ID NO: 212828 - DNA, 20 bp, Artificial Sequence
  chemically synthesized
gaacagacacttctcaaaag

SEQ ID NO: 212829 - DNA, 20 bp, Artificial Sequence
  chemically synthesized
cataaatgtcttcttttgag

SEQ ID NO: 212830 - DNA, 20 bp, Artificial Sequence
  chemically synthesized
aatgaacagacacttctcaa

SEQ ID NO: 212831 - DNA, 20 bp, Artificial Sequence
  chemically synthesized
tgagaagtgtctgttcattg

SEQ ID NO: 212832 - DNA, 20 bp, Artificial Sequence
  chemically synthesized
acactgccttccacaatgaa

SEQ ID NO: 212833 - DNA, 20 bp, Artificial Sequence
  chemically synthesized
gaagtgtctgttcattgtgg

SEQ ID NO: 212834 - DNA, 20 bp, Artificial Sequence
  chemically synthesized
aagtgtctgttcattgtgga

SEQ ID NO: 212835 - DNA, 20 bp, Artificial Sequence
  chemically synthesized
tgtctgttcattgtggaagg

SEQ ID NO: 212836 - DNA, 20 bp, Artificial Sequence
  chemically synthesized
gttcattgtggaaggcagtg

SEQ ID NO: 212837 - DNA, 20 bp, Artificial Sequence
  chemically synthesized
aaggcagtgtggcgattcct

SEQ ID NO: 212838 - DNA, 20 bp, Artificial Sequence
  chemically synthesized
aggcagtgtggcgattcctc

SEQ ID NO: 212839 - DNA, 20 bp, Artificial Sequence
  chemically synthesized
ggcagtgtggcgattcctca

SEQ ID NO: 212840 - DNA, 20 bp, Artificial Sequence
  chemically synthesized
gcagtgtggcgattcctcag

SEQ ID NO: 212841 - DNA, 20 bp, Artificial Sequence
  chemically synthesized
tttctagttctaggcccctg

SEQ ID NO: 212842 - DNA, 20 bp, Artificial Sequence
  chemically synthesized
gtggcgattcctcaggggcc

SEQ ID NO: 212843 - DNA, 20 bp, Artificial Sequence
  chemically synthesized
atttctagttctaggcccct

SEQ ID NO: 212844 - DNA, 20 bp, Artificial Sequence
  chemically synthesized
attcctcaggggcctagaac

SEQ ID NO: 212845 - DNA, 20 bp, Artificial Sequence
  chemically synthesized
caaatggtatttctagttct

SEQ ID NO: 212846 - DNA, 20 bp, Artificial Sequence
  chemically synthesized
tcaaatggtatttctagttc

SEQ ID NO: 212847 - DNA, 20 bp, Artificial Sequence
  chemically synthesized
gctgggtcaaatggtatttc

SEQ ID NO: 212848 - DNA, 20 bp, Artificial Sequence
  chemically synthesized
actagaaataccatttgacc

SEQ ID NO: 212849 - DNA, 20 bp, Artificial Sequence
  chemically synthesized
aatgggatggctgggtcaaa

SEQ ID NO: 212850 - DNA, 20 bp, Artificial Sequence
  chemically synthesized
tacccagtaatgggatggct

SEQ ID NO: 212851 - DNA, 20 bp, Artificial Sequence
  chemically synthesized
atacccagtaatgggatggc

SEQ ID NO: 212852 - DNA, 20 bp, Artificial Sequence
  chemically synthesized
gtatatacccagtaatggga

SEQ ID NO: 212853 - DNA, 20 bp, Artificial Sequence
  chemically synthesized
tgacccagccatcccattac

SEQ ID NO: 212854 - DNA, 20 bp, Artificial Sequence
  chemically synthesized
gacccagccatcccattact

SEQ ID NO: 212855 - DNA, 20 bp, Artificial Sequence
  chemically synthesized
ttgggtatatacccagtaat

SEQ ID NO: 212856 - DNA, 20 bp, Artificial Sequence
  chemically synthesized
tttgggtatatacccagtaa

SEQ ID NO: 212857 - DNA, 20 bp, Artificial Sequence
  chemically synthesized
tagtcctttgggtatatacc

SEQ ID NO: 212858 - DNA, 20 bp, Artificial Sequence
  chemically synthesized
cattactgggtatataccca

SEQ ID NO: 212859 - DNA, 20 bp, Artificial Sequence
  chemically synthesized
attactgggtatatacccaa

SEQ ID NO: 212860 - DNA, 20 bp, Artificial Sequence
  chemically synthesized
agcatgatttatagtccttt

SEQ ID NO: 212861 - DNA, 20 bp, Artificial Sequence
  chemically synthesized
cagcatgatttatagtcctt

SEQ ID NO: 212862 - DNA, 20 bp, Artificial Sequence
  chemically synthesized
ctttatagcagcatgattta

SEQ ID NO: 212863 - DNA, 20 bp, Artificial Sequence
  chemically synthesized
ctataaatcatgctgctata

SEQ ID NO: 212864 - DNA, 20 bp, Artificial Sequence
  chemically synthesized
gtgtgcacgtgtctttatag

SEQ ID NO: 212865 - DNA, 20 bp, Artificial Sequence
  chemically synthesized
tatgtgtgcacgtgtcttta

SEQ ID NO: 212866 - DNA, 20 bp, Artificial Sequence
  chemically synthesized
gtgcacacatatgtttattg

SEQ ID NO: 212867 - DNA, 20 bp, Artificial Sequence
  chemically synthesized
agtctttgctattgtgaata

SEQ ID NO: 212868 - DNA, 20 bp, Artificial Sequence
  chemically synthesized
tattgcggctctattcacaa

SEQ ID NO: 212869 - DNA, 20 bp, Artificial Sequence
  chemically synthesized
caagtctttgctattgtgaa

SEQ ID NO: 212870 - DNA, 20 bp, Artificial Sequence
  chemically synthesized
cggctctattcacaatagca

SEQ ID NO: 212871 - DNA, 20 bp, Artificial Sequence
  chemically synthesized
tattcacaatagcaaagact

SEQ ID NO: 212872 - DNA, 20 bp, Artificial Sequence
  chemically synthesized
tggacatttgggttggttcc

SEQ ID NO: 212873 - DNA, 20 bp, Artificial Sequence
  chemically synthesized
tcattgttggacatttgggt

SEQ ID NO: 212874 - DNA, 20 bp, Artificial Sequence
  chemically synthesized
tctatcattgttggacattt

SEQ ID NO: 212875 - DNA, 20 bp, Artificial Sequence
  chemically synthesized
gtctatcattgttggacatt

SEQ ID NO: 212876 - DNA, 20 bp, Artificial Sequence
  chemically synthesized
acccaaatgtccaacaatga

SEQ ID NO: 212877 - DNA, 20 bp, Artificial Sequence
  chemically synthesized
ttaatccagtctatcattgt

SEQ ID NO: 212878 - DNA, 20 bp, Artificial Sequence
  chemically synthesized
aatgtccaacaatgatagac

SEQ ID NO: 212879 - DNA, 20 bp, Artificial Sequence
  chemically synthesized
caacaatgatagactggatt

SEQ ID NO: 212880 - DNA, 20 bp, Artificial Sequence
  chemically synthesized
tgtgccacattttcttaatc

SEQ ID NO: 212881 - DNA, 20 bp, Artificial Sequence
  chemically synthesized
tagactggattaagaaaatg

SEQ ID NO: 212882 - DNA, 20 bp, Artificial Sequence
  chemically synthesized
aatgtggcacatatacacca

SEQ ID NO: 212883 - DNA, 20 bp, Artificial Sequence
  chemically synthesized
tctggctgcatagtattcca

SEQ ID NO: 212884 - DNA, 20 bp, Artificial Sequence
  chemically synthesized
atacaccatggaatactatg

SEQ ID NO: 212885 - DNA, 20 bp, Artificial Sequence
  chemically synthesized
accatggaatactatgcagc

SEQ ID NO: 212886 - DNA, 20 bp, Artificial Sequence
  chemically synthesized
catcattttttctggctgca

SEQ ID NO: 212887 - DNA, 20 bp, Artificial Sequence
  chemically synthesized
catgaactcatcattttttc

SEQ ID NO: 212888 - DNA, 20 bp, Artificial Sequence
  chemically synthesized
atgcagccagaaaaaatgat

SEQ ID NO: 212889 - DNA, 20 bp, Artificial Sequence
  chemically synthesized
tgatgagttcatgtcctttg

SEQ ID NO: 212890 - DNA, 20 bp, Artificial Sequence
  chemically synthesized
gatgagttcatgtcctttgt

SEQ ID NO: 212891 - DNA, 20 bp, Artificial Sequence
  chemically synthesized
atgagttcatgtcctttgta

SEQ ID NO: 212892 - DNA, 20 bp, Artificial Sequence
  chemically synthesized
tttcatccatgtccctacaa

SEQ ID NO: 212893 - DNA, 20 bp, Artificial Sequence
  chemically synthesized
gtttcatccatgtccctaca

SEQ ID NO: 212894 - DNA, 20 bp, Artificial Sequence
  chemically synthesized
tcatgtcctttgtagggaca

SEQ ID NO: 212895 - DNA, 20 bp, Artificial Sequence
  chemically synthesized
tgtagggacatggatgaaac

SEQ ID NO: 212896 - DNA, 20 bp, Artificial Sequence
  chemically synthesized
ttactgagaatgatgtattc

SEQ ID NO: 212897 - DNA, 20 bp, Artificial Sequence
  chemically synthesized
aaactggaatacatcattct

SEQ ID NO: 212898 - DNA, 20 bp, Artificial Sequence
  chemically synthesized
tgtccttgcgatagtttact

SEQ ID NO: 212899 - DNA, 20 bp, Artificial Sequence
  chemically synthesized
cattctcagtaaactatcgc

SEQ ID NO: 212900 - DNA, 20 bp, Artificial Sequence
  chemically synthesized
attctcagtaaactatcgca

SEQ ID NO: 212901 - DNA, 20 bp, Artificial Sequence
  chemically synthesized
ttggttttttgtccttgcga

SEQ ID NO: 212902 - DNA, 20 bp, Artificial Sequence
  chemically synthesized
cgcaaggacaaaaaaccaaa

SEQ ID NO: 212903 - DNA, 20 bp, Artificial Sequence
  chemically synthesized
gagtgagaacatgcgctgtt

SEQ ID NO: 212904 - DNA, 20 bp, Artificial Sequence
  chemically synthesized
acagcgcatgttctcactct

SEQ ID NO: 212905 - DNA, 20 bp, Artificial Sequence
  chemically synthesized
cagcgcatgttctcactctt

SEQ ID NO: 212906 - DNA, 20 bp, Artificial Sequence
  chemically synthesized
ttccattcccacctaagagt

SEQ ID NO: 212907 - DNA, 20 bp, Artificial Sequence
  chemically synthesized
cgcatgttctcactcttagg

SEQ ID NO: 212908 - DNA, 20 bp, Artificial Sequence
  chemically synthesized
gcatgttctcactcttaggt

SEQ ID NO: 212909 - DNA, 20 bp, Artificial Sequence
  chemically synthesized
attgttccattcccacctaa

SEQ ID NO: 212910 - DNA, 20 bp, Artificial Sequence
  chemically synthesized
tcattgttccattcccacct

SEQ ID NO: 212911 - DNA, 20 bp, Artificial Sequence
  chemically synthesized
ttctcactcttaggtgggaa

SEQ ID NO: 212912 - DNA, 20 bp, Artificial Sequence
  chemically synthesized
ttaggtgggaatggaacaat

SEQ ID NO: 212913 - DNA, 20 bp, Artificial Sequence
  chemically synthesized
aatggaacaatgagaacaca

SEQ ID NO: 212914 - DNA, 20 bp, Artificial Sequence
  chemically synthesized
acaatgagaacacatggaca

SEQ ID NO: 212915 - DNA, 20 bp, Artificial Sequence
  chemically synthesized
caatgagaacacatggacac

SEQ ID NO: 212916 - DNA, 20 bp, Artificial Sequence
  chemically synthesized
tgagaacacatggacacagg

SEQ ID NO: 212917 - DNA, 20 bp, Artificial Sequence
  chemically synthesized
gagaacacatggacacagga

SEQ ID NO: 212918 - DNA, 20 bp, Artificial Sequence
  chemically synthesized
agaacacatggacacaggaa

SEQ ID NO: 212919 - DNA, 20 bp, Artificial Sequence
  chemically synthesized
gaacacatggacacaggaag

SEQ ID NO: 212920 - DNA, 20 bp, Artificial Sequence
  chemically synthesized
ggaaggggaacatcacaccc

SEQ ID NO: 212921 - DNA, 20 bp, Artificial Sequence
  chemically synthesized
gaaggggaacatcacaccct

SEQ ID NO: 212922 - DNA, 20 bp, Artificial Sequence
  chemically synthesized
ccaccccacaacagttccca

SEQ ID NO: 212923 - DNA, 20 bp, Artificial Sequence
  chemically synthesized
cccaccccacaacagttccc

SEQ ID NO: 212924 - DNA, 20 bp, Artificial Sequence
  chemically synthesized
ccccaccccacaacagttcc

SEQ ID NO: 212925 - DNA, 20 bp, Artificial Sequence
  chemically synthesized
tcacaccctgggaactgttg

SEQ ID NO: 212926 - DNA, 20 bp, Artificial Sequence
  chemically synthesized
cacaccctgggaactgttgt

SEQ ID NO: 212927 - DNA, 20 bp, Artificial Sequence
  chemically synthesized
acaccctgggaactgttgtg

SEQ ID NO: 212928 - DNA, 20 bp, Artificial Sequence
  chemically synthesized
cccctccccccaccccacaa

SEQ ID NO: 212929 - DNA, 20 bp, Artificial Sequence
  chemically synthesized
ccctgggaactgttgtgggg

SEQ ID NO: 212930 - DNA, 20 bp, Artificial Sequence
  chemically synthesized
cctgggaactgttgtggggt

SEQ ID NO: 212931 - DNA, 20 bp, Artificial Sequence
  chemically synthesized
ctgggaactgttgtggggtg

SEQ ID NO: 212932 - DNA, 20 bp, Artificial Sequence
  chemically synthesized
tgggaactgttgtggggtgg

SEQ ID NO: 212933 - DNA, 20 bp, Artificial Sequence
  chemically synthesized
gggaactgttgtggggtggg

SEQ ID NO: 212934 - DNA, 20 bp, Artificial Sequence
  chemically synthesized
gaactgttgtggggtggggg

SEQ ID NO: 212935 - DNA, 20 bp, Artificial Sequence
  chemically synthesized
aactgttgtggggtgggggg

SEQ ID NO: 212936 - DNA, 20 bp, Artificial Sequence
  chemically synthesized
actgttgtggggtgggggga

SEQ ID NO: 212937 - DNA, 20 bp, Artificial Sequence
  chemically synthesized
ctgttgtggggtggggggag

SEQ ID NO: 212938 - DNA, 20 bp, Artificial Sequence
  chemically synthesized
tgttgtggggtggggggagg

SEQ ID NO: 212939 - DNA, 20 bp, Artificial Sequence
  chemically synthesized
gttgtggggtggggggaggg

SEQ ID NO: 212940 - DNA, 20 bp, Artificial Sequence
  chemically synthesized
tgtggggtggggggaggggg

SEQ ID NO: 212941 - DNA, 20 bp, Artificial Sequence
  chemically synthesized
gtggggtggggggagggggg

SEQ ID NO: 212942 - DNA, 20 bp, Artificial Sequence
  chemically synthesized
tggggtggggggagggggga

SEQ ID NO: 212943 - DNA, 20 bp, Artificial Sequence
  chemically synthesized
gtggggggaggggggaggga

SEQ ID NO: 212944 - DNA, 20 bp, Artificial Sequence
  chemically synthesized
ggaggggggagggacagcat

SEQ ID NO: 212945 - DNA, 20 bp, Artificial Sequence
  chemically synthesized
gaggggggagggacagcatt

SEQ ID NO: 212946 - DNA, 20 bp, Artificial Sequence
  chemically synthesized
ggggggagggacagcattag

SEQ ID NO: 212947 - DNA, 20 bp, Artificial Sequence
  chemically synthesized
ttaactcttcatttaacatt

SEQ ID NO: 212948 - DNA, 20 bp, Artificial Sequence
  chemically synthesized
attaactcttcatttaacat

SEQ ID NO: 212949 - DNA, 20 bp, Artificial Sequence
  chemically synthesized
gatatacctaatgttaaatg

SEQ ID NO: 212950 - DNA, 20 bp, Artificial Sequence
  chemically synthesized
tatacctaatgttaaatgaa

SEQ ID NO: 212951 - DNA, 20 bp, Artificial Sequence
  chemically synthesized
aatgttaaatgaagagttaa

SEQ ID NO: 212952 - DNA, 20 bp, Artificial Sequence
  chemically synthesized
atgttaaatgaagagttaat

SEQ ID NO: 212953 - DNA, 20 bp, Artificial Sequence
  chemically synthesized
aaatgaagagttaatgggtg

SEQ ID NO: 212954 - DNA, 20 bp, Artificial Sequence
  chemically synthesized
atgggtgcagcactccaaca

SEQ ID NO: 212955 - DNA, 20 bp, Artificial Sequence
  chemically synthesized
tgtatacctgtgccatgttg

SEQ ID NO: 212956 - DNA, 20 bp, Artificial Sequence
  chemically synthesized
tatgtatacctgtgccatgt

SEQ ID NO: 212957 - DNA, 20 bp, Artificial Sequence
  chemically synthesized
tgcagcactccaacatggca

SEQ ID NO: 212958 - DNA, 20 bp, Artificial Sequence
  chemically synthesized
gcagcactccaacatggcac

SEQ ID NO: 212959 - DNA, 20 bp, Artificial Sequence
  chemically synthesized
catgtgcacagtgtgcaagt

SEQ ID NO: 212960 - DNA, 20 bp, Artificial Sequence
  chemically synthesized
ggtacatgtgcacagtgtgc

SEQ ID NO: 212961 - DNA, 20 bp, Artificial Sequence
  chemically synthesized
agttttagggtacatgtgca

SEQ ID NO: 212962 - DNA, 20 bp, Artificial Sequence
  chemically synthesized
taattatactttaagtttta

SEQ ID NO: 212963 - DNA, 20 bp, Artificial Sequence
  chemically synthesized
ttaattatactttaagtttt

SEQ ID NO: 212964 - DNA, 20 bp, Artificial Sequence
  chemically synthesized
cacatgtaccctaaaactta

SEQ ID NO: 212965 - DNA, 20 bp, Artificial Sequence
  chemically synthesized
tttaattatactttaagttt

SEQ ID NO: 212966 - DNA, 20 bp, Artificial Sequence
  chemically synthesized
tttttttttaattatacttt

SEQ ID NO: 212967 - DNA, 20 bp, Artificial Sequence
  chemically synthesized
aaagtataattaaaaaaaaa

SEQ ID NO: 212968 - DNA, 20 bp, Artificial Sequence
  chemically synthesized
aagtataattaaaaaaaaaa

SEQ ID NO: 212969 - DNA, 20 bp, Artificial Sequence
  chemically synthesized
ggaaaaagacacatcatggt

SEQ ID NO: 212970 - DNA, 20 bp, Artificial Sequence
  chemically synthesized
aggaaaaagacacatcatgg

SEQ ID NO: 212971 - DNA, 20 bp, Artificial Sequence
  chemically synthesized
cctaggaaaaagacacatca

SEQ ID NO: 212972 - DNA, 20 bp, Artificial Sequence
  chemically synthesized
accatgatgtgtctttttcc

SEQ ID NO: 212973 - DNA, 20 bp, Artificial Sequence
  chemically synthesized
ccatgatgtgtctttttcct

SEQ ID NO: 212974 - DNA, 20 bp, Artificial Sequence
  chemically synthesized
tttatgccagtcctaggaaa

SEQ ID NO: 212975 - DNA, 20 bp, Artificial Sequence
  chemically synthesized
atgtgtctttttcctaggac

SEQ ID NO: 212976 - DNA, 20 bp, Artificial Sequence
  chemically synthesized
gtttattttatgccagtcct

SEQ ID NO: 212977 - DNA, 20 bp, Artificial Sequence
  chemically synthesized
agtttattttatgccagtcc

SEQ ID NO: 212978 - DNA, 20 bp, Artificial Sequence
  chemically synthesized
cagattagtttattttatgc

SEQ ID NO: 212979 - DNA, 20 bp, Artificial Sequence
  chemically synthesized
tggcataaaataaactaatc

SEQ ID NO: 212980 - DNA, 20 bp, Artificial Sequence
  chemically synthesized
aaattgtctgtgagccagat

SEQ ID NO: 212981 - DNA, 20 bp, Artificial Sequence
  chemically synthesized
aaataaactaatctggctca

SEQ ID NO: 212982 - DNA, 20 bp, Artificial Sequence
  chemically synthesized
aactgaaattgtctgtgagc

SEQ ID NO: 212983 - DNA, 20 bp, Artificial Sequence
  chemically synthesized
gataaactgaaattgtctgt

SEQ ID NO: 212984 - DNA, 20 bp, Artificial Sequence
  chemically synthesized
atctggctcacagacaattt

SEQ ID NO: 212985 - DNA, 20 bp, Artificial Sequence
  chemically synthesized
gtcacatggtgataaaaatg

SEQ ID NO: 212986 - DNA, 20 bp, Artificial Sequence
  chemically synthesized
ggtcacatggtgataaaaat

SEQ ID NO: 212987 - DNA, 20 bp, Artificial Sequence
  chemically synthesized
tagttatgcccgaggtcaca

SEQ ID NO: 212988 - DNA, 20 bp, Artificial Sequence
  chemically synthesized
tttttatcaccatgtgacct

SEQ ID NO: 212989 - DNA, 20 bp, Artificial Sequence
  chemically synthesized
ttttatcaccatgtgacctc

SEQ ID NO: 212990 - DNA, 20 bp, Artificial Sequence
  chemically synthesized
atcatgtttagttatgcccg

SEQ ID NO: 212991 - DNA, 20 bp, Artificial Sequence
  chemically synthesized
gatcatgtttagttatgccc

SEQ ID NO: 212992 - DNA, 20 bp, Artificial Sequence
  chemically synthesized
acataaaattagatcatgtt

SEQ ID NO: 212993 - DNA, 20 bp, Artificial Sequence
  chemically synthesized
atccagaagtaacataaaat

SEQ ID NO: 212994 - DNA, 20 bp, Artificial Sequence
  chemically synthesized
atctaattttatgttacttc

SEQ ID NO: 212995 - DNA, 20 bp, Artificial Sequence
  chemically synthesized
ggcaaatgcattgaatccag

SEQ ID NO: 212996 - DNA, 20 bp, Artificial Sequence
  chemically synthesized
agaggcaaatgcattgaatc

SEQ ID NO: 212997 - DNA, 20 bp, Artificial Sequence
  chemically synthesized
caatgcatttgcctctctct

SEQ ID NO: 212998 - DNA, 20 bp, Artificial Sequence
  chemically synthesized
tacaaatagatctcagagag

SEQ ID NO: 212999 - DNA, 20 bp, Artificial Sequence
  chemically synthesized
ttacaaatagatctcagaga

SEQ ID NO: 213000 - DNA, 20 bp, Artificial Sequence
  chemically synthesized
gattacaaatagatctcaga

SEQ ID NO: 213001 - DNA, 20 bp, Artificial Sequence
  chemically synthesized
ttgattacaaatagatctca

SEQ ID NO: 213002 - DNA, 20 bp, Artificial Sequence
  chemically synthesized
atttgattacaaatagatct

SEQ ID NO: 213003 - DNA, 20 bp, Artificial Sequence
  chemically synthesized
ttaacaaatttgattacaaa

SEQ ID NO: 213004 - DNA, 20 bp, Artificial Sequence
  chemically synthesized
atttgttaattccatcctga

SEQ ID NO: 213005 - DNA, 20 bp, Artificial Sequence
  chemically synthesized
tttgttaattccatcctgaa

SEQ ID NO: 213006 - DNA, 20 bp, Artificial Sequence
  chemically synthesized
tttacttctccctttcagga

SEQ ID NO: 213007 - DNA, 20 bp, Artificial Sequence
  chemically synthesized
ttgttaattccatcctgaaa

SEQ ID NO: 213008 - DNA, 20 bp, Artificial Sequence
  chemically synthesized
gttaattccatcctgaaagg

SEQ ID NO: 213009 - DNA, 20 bp, Artificial Sequence
  chemically synthesized
cctttttacttctccctttc

SEQ ID NO: 213010 - DNA, 20 bp, Artificial Sequence
  chemically synthesized
tcctttttacttctcccttt

SEQ ID NO: 213011 - DNA, 20 bp, Artificial Sequence
  chemically synthesized
aattccatcctgaaagggag

SEQ ID NO: 213012 - DNA, 20 bp, Artificial Sequence
  chemically synthesized
tcctgaaagggagaagtaaa

SEQ ID NO: 213013 - DNA, 20 bp, Artificial Sequence
  chemically synthesized
cctgaaagggagaagtaaaa

SEQ ID NO: 213014 - DNA, 20 bp, Artificial Sequence
  chemically synthesized
ggagaagtaaaaaggaaaaa

SEQ ID NO: 213015 - DNA, 20 bp, Artificial Sequence
  chemically synthesized
ttcaaagttgaaatgttaga

SEQ ID NO: 213016 - DNA, 20 bp, Artificial Sequence
  chemically synthesized
gtagttcaaagttgaaatgt

SEQ ID NO: 213017 - DNA, 20 bp, Artificial Sequence
  chemically synthesized
tctggggatggggtagttca

SEQ ID NO: 213018 - DNA, 20 bp, Artificial Sequence
  chemically synthesized
agtttcttctggggatgggg

SEQ ID NO: 213019 - DNA, 20 bp, Artificial Sequence
  chemically synthesized
actttgaactaccccatccc

SEQ ID NO: 213020 - DNA, 20 bp, Artificial Sequence
  chemically synthesized
agcagtttcttctggggatg

SEQ ID NO: 213021 - DNA, 20 bp, Artificial Sequence
  chemically synthesized
tagcagtttcttctggggat

SEQ ID NO: 213022 - DNA, 20 bp, Artificial Sequence
  chemically synthesized
ttgaactaccccatccccag

SEQ ID NO: 213023 - DNA, 20 bp, Artificial Sequence
  chemically synthesized
atagcagtttcttctgggga

SEQ ID NO: 213024 - DNA, 20 bp, Artificial Sequence
  chemically synthesized
tttaatagcagtttcttctg

SEQ ID NO: 213025 - DNA, 20 bp, Artificial Sequence
  chemically synthesized
ctttaatagcagtttcttct

SEQ ID NO: 213026 - DNA, 20 bp, Artificial Sequence
  chemically synthesized
tctttaatagcagtttcttc

SEQ ID NO: 213027 - DNA, 20 bp, Artificial Sequence
  chemically synthesized
cccagaagaaactgctatta

SEQ ID NO: 213028 - DNA, 20 bp, Artificial Sequence
  chemically synthesized
tcaaaacttatctttaatag

SEQ ID NO: 213029 - DNA, 20 bp, Artificial Sequence
  chemically synthesized
ttttcaaaacttatctttaa

SEQ ID NO: 213030 - DNA, 20 bp, Artificial Sequence
  chemically synthesized
aagaaactgctattaaagat

SEQ ID NO: 213031 - DNA, 20 bp, Artificial Sequence
  chemically synthesized
ataagttttgaaaactacac

SEQ ID NO: 213032 - DNA, 20 bp, Artificial Sequence
  chemically synthesized
taagttttgaaaactacaca

SEQ ID NO: 213033 - DNA, 20 bp, Artificial Sequence
  chemically synthesized
aagttttgaaaactacacaa

SEQ ID NO: 213034 - DNA, 20 bp, Artificial Sequence
  chemically synthesized
gataatgtaaggcccttgtg

SEQ ID NO: 213035 - DNA, 20 bp, Artificial Sequence
  chemically synthesized
tatatgttcaagataatgta

SEQ ID NO: 213036 - DNA, 20 bp, Artificial Sequence
  chemically synthesized
atatatgttcaagataatgt

SEQ ID NO: 213037 - DNA, 20 bp, Artificial Sequence
  chemically synthesized
tgtaaataatatatatgttc

SEQ ID NO: 213038 - DNA, 20 bp, Artificial Sequence
  chemically synthesized
tgaacatatatattatttac

SEQ ID NO: 213039 - DNA, 20 bp, Artificial Sequence
  chemically synthesized
gttaaatgaggaagaaagtt

SEQ ID NO: 213040 - DNA, 20 bp, Artificial Sequence
  chemically synthesized
agttaaatgaggaagaaagt

SEQ ID NO: 213041 - DNA, 20 bp, Artificial Sequence
  chemically synthesized
tttcagttaaatgaggaaga

SEQ ID NO: 213042 - DNA, 20 bp, Artificial Sequence
  chemically synthesized
agcttttcagttaaatgagg

SEQ ID NO: 213043 - DNA, 20 bp, Artificial Sequence
  chemically synthesized
gaaagcttttcagttaaatg

SEQ ID NO: 213044 - DNA, 20 bp, Artificial Sequence
  chemically synthesized
tgaaagcttttcagttaaat

SEQ ID NO: 213045 - DNA, 20 bp, Artificial Sequence
  chemically synthesized
ttcttcctcatttaactgaa

SEQ ID NO: 213046 - DNA, 20 bp, Artificial Sequence
  chemically synthesized
taggctatctgaaagctttt

SEQ ID NO: 213047 - DNA, 20 bp, Artificial Sequence
  chemically synthesized
tcatttaactgaaaagcttt

SEQ ID NO: 213048 - DNA, 20 bp, Artificial Sequence
  chemically synthesized
ttaactgaaaagctttcaga

SEQ ID NO: 213049 - DNA, 20 bp, Artificial Sequence
  chemically synthesized
gaaaaaagtaggctatctga

SEQ ID NO: 213050 - DNA, 20 bp, Artificial Sequence
  chemically synthesized
tacttatgtgagaaaaaagt

SEQ ID NO: 213051 - DNA, 20 bp, Artificial Sequence
  chemically synthesized
ctacttatgtgagaaaaaag

SEQ ID NO: 213052 - DNA, 20 bp, Artificial Sequence
  chemically synthesized
catctacttatgtgagaaaa

SEQ ID NO: 213053 - DNA, 20 bp, Artificial Sequence
  chemically synthesized
agcctacttttttctcacat

SEQ ID NO: 213054 - DNA, 20 bp, Artificial Sequence
  chemically synthesized
ctacttttttctcacataag

SEQ ID NO: 213055 - DNA, 20 bp, Artificial Sequence
  chemically synthesized
tttttttcatctacttatgt

SEQ ID NO: 213056 - DNA, 20 bp, Artificial Sequence
  chemically synthesized
tcacataagtagatgaaaaa

SEQ ID NO: 213057 - DNA, 20 bp, Artificial Sequence
  chemically synthesized
ataagtagatgaaaaaaaga

SEQ ID NO: 213058 - DNA, 20 bp, Artificial Sequence
  chemically synthesized
atatctgggaaaataataca

SEQ ID NO: 213059 - DNA, 20 bp, Artificial Sequence
  chemically synthesized
atcactgtgtattattttcc

SEQ ID NO: 213060 - DNA, 20 bp, Artificial Sequence
  chemically synthesized
acatatatatatatatatct

SEQ ID NO: 213061 - DNA, 20 bp, Artificial Sequence
  chemically synthesized
tacatatatatatatatatc

SEQ ID NO: 213062 - DNA, 20 bp, Artificial Sequence
  chemically synthesized
atatgtatatatatatatat

SEQ ID NO: 213063 - DNA, 20 bp, Artificial Sequence
  chemically synthesized
tatatatatattagctacta

SEQ ID NO: 213064 - DNA, 20 bp, Artificial Sequence
  chemically synthesized
tgcatttacattttccgtag

SEQ ID NO: 213065 - DNA, 20 bp, Artificial Sequence
  chemically synthesized
aaatgcatttacattttccg

SEQ ID NO: 213066 - DNA, 20 bp, Artificial Sequence
  chemically synthesized
tgtaaatgcatttatctcac

SEQ ID NO: 213067 - DNA, 20 bp, Artificial Sequence
  chemically synthesized
gtaaatgcatttatctcaca

SEQ ID NO: 213068 - DNA, 20 bp, Artificial Sequence
  chemically synthesized
aatgcatttatctcacaagg

SEQ ID NO: 213069 - DNA, 20 bp, Artificial Sequence
  chemically synthesized
aaggctttaaacttccttgt

SEQ ID NO: 213070 - DNA, 20 bp, Artificial Sequence
  chemically synthesized
ttatctcacaaggaagttta

SEQ ID NO: 213071 - DNA, 20 bp, Artificial Sequence
  chemically synthesized
cacaaggaagtttaaagcct

SEQ ID NO: 213072 - DNA, 20 bp, Artificial Sequence
  chemically synthesized
caaggaagtttaaagccttg

SEQ ID NO: 213073 - DNA, 20 bp, Artificial Sequence
  chemically synthesized
atacagaaaacatggctcca

SEQ ID NO: 213074 - DNA, 20 bp, Artificial Sequence
  chemically synthesized
aatacagaaaacatggctcc

SEQ ID NO: 213075 - DNA, 20 bp, Artificial Sequence
  chemically synthesized
acgtgttaatacagaaaaca

SEQ ID NO: 213076 - DNA, 20 bp, Artificial Sequence
  chemically synthesized
gatgaaaacacgtgttaata

SEQ ID NO: 213077 - DNA, 20 bp, Artificial Sequence
  chemically synthesized
aaaaacaattgtggaggaag

SEQ ID NO: 213078 - DNA, 20 bp, Artificial Sequence
  chemically synthesized
ctaaaaaacaattgtggagg

SEQ ID NO: 213079 - DNA, 20 bp, Artificial Sequence
  chemically synthesized
aatctaaaaaacaattgtgg

SEQ ID NO: 213080 - DNA, 20 bp, Artificial Sequence
  chemically synthesized
aaatctaaaaaacaattgtg

SEQ ID NO: 213081 - DNA, 20 bp, Artificial Sequence
  chemically synthesized
gtaaatctaaaaaacaattg

SEQ ID NO: 213082 - DNA, 20 bp, Artificial Sequence
  chemically synthesized
cttcctccacaattgttttt

SEQ ID NO: 213083 - DNA, 20 bp, Artificial Sequence
  chemically synthesized
tttagatttacgctttttca

SEQ ID NO: 213084 - DNA, 20 bp, Artificial Sequence
  chemically synthesized
gggttatttatgctttgaaa

SEQ ID NO: 213085 - DNA, 20 bp, Artificial Sequence
  chemically synthesized
tttcaaagcataaataaccc

SEQ ID NO: 213086 - DNA, 20 bp, Artificial Sequence
  chemically synthesized
ttgcagctgaagacaaactg

SEQ ID NO: 213087 - DNA, 20 bp, Artificial Sequence
  chemically synthesized
attgcagctgaagacaaact

SEQ ID NO: 213088 - DNA, 20 bp, Artificial Sequence
  chemically synthesized
cattgcagctgaagacaaac

SEQ ID NO: 213089 - DNA, 20 bp, Artificial Sequence
  chemically synthesized
aaataaccccagtttgtctt

SEQ ID NO: 213090 - DNA, 20 bp, Artificial Sequence
  chemically synthesized
atgttttctcattgcagctg

SEQ ID NO: 213091 - DNA, 20 bp, Artificial Sequence
  chemically synthesized
agtttgtcttcagctgcaat

SEQ ID NO: 213092 - DNA, 20 bp, Artificial Sequence
  chemically synthesized
catgctatgttttctcattg

SEQ ID NO: 213093 - DNA, 20 bp, Artificial Sequence
  chemically synthesized
tcagctgcaatgagaaaaca

SEQ ID NO: 213094 - DNA, 20 bp, Artificial Sequence
  chemically synthesized
tgcaatgagaaaacatagca

SEQ ID NO: 213095 - DNA, 20 bp, Artificial Sequence
  chemically synthesized
ggcaaattgacagatagcaa

SEQ ID NO: 213096 - DNA, 20 bp, Artificial Sequence
  chemically synthesized
taggcaaattgacagatagc

SEQ ID NO: 213097 - DNA, 20 bp, Artificial Sequence
  chemically synthesized
ttaataggcaaattgacaga

SEQ ID NO: 213098 - DNA, 20 bp, Artificial Sequence
  chemically synthesized
tattttaataggcaaattga

SEQ ID NO: 213099 - DNA, 20 bp, Artificial Sequence
  chemically synthesized
aaggtgaacaatattttaat

SEQ ID NO: 213100 - DNA, 20 bp, Artificial Sequence
  chemically synthesized
aaaggtgaacaatattttaa

SEQ ID NO: 213101 - DNA, 20 bp, Artificial Sequence
  chemically synthesized
aatattgttcaccttttctt

SEQ ID NO: 213102 - DNA, 20 bp, Artificial Sequence
  chemically synthesized
agaaaaaccctccaaagaaa

SEQ ID NO: 213103 - DNA, 20 bp, Artificial Sequence
  chemically synthesized
tattgttcaccttttctttg

SEQ ID NO: 213104 - DNA, 20 bp, Artificial Sequence
  chemically synthesized
aagaaaaaccctccaaagaa

SEQ ID NO: 213105 - DNA, 20 bp, Artificial Sequence
  chemically synthesized
attgttcaccttttctttgg

SEQ ID NO: 213106 - DNA, 20 bp, Artificial Sequence
  chemically synthesized
ttgttcaccttttctttgga

SEQ ID NO: 213107 - DNA, 20 bp, Artificial Sequence
  chemically synthesized
aggcgaagaaaaaccctcca

SEQ ID NO: 213108 - DNA, 20 bp, Artificial Sequence
  chemically synthesized
tagtcaggaaagaggaggcg

SEQ ID NO: 213109 - DNA, 20 bp, Artificial Sequence
  chemically synthesized
aactttagtcaggaaagagg

SEQ ID NO: 213110 - DNA, 20 bp, Artificial Sequence
  chemically synthesized
aaactttagtcaggaaagag

SEQ ID NO: 213111 - DNA, 20 bp, Artificial Sequence
  chemically synthesized
agaaactttagtcaggaaag

SEQ ID NO: 213112 - DNA, 20 bp, Artificial Sequence
  chemically synthesized
aagaaactttagtcaggaaa

SEQ ID NO: 213113 - DNA, 20 bp, Artificial Sequence
  chemically synthesized
gcaagaaactttagtcagga

SEQ ID NO: 213114 - DNA, 20 bp, Artificial Sequence
  chemically synthesized
cgcctcctctttcctgacta

SEQ ID NO: 213115 - DNA, 20 bp, Artificial Sequence
  chemically synthesized
ggatgcaagaaactttagtc

SEQ ID NO: 213116 - DNA, 20 bp, Artificial Sequence
  chemically synthesized
gggatgcaagaaactttagt

SEQ ID NO: 213117 - DNA, 20 bp, Artificial Sequence
  chemically synthesized
gcacgggatgcaagaaactt

SEQ ID NO: 213118 - DNA, 20 bp, Artificial Sequence
  chemically synthesized
ttgacggatgcacgggatgc

SEQ ID NO: 213119 - DNA, 20 bp, Artificial Sequence
  chemically synthesized
taagcctttgacggatgcac

SEQ ID NO: 213120 - DNA, 20 bp, Artificial Sequence
  chemically synthesized
ctaagcctttgacggatgca

SEQ ID NO: 213121 - DNA, 20 bp, Artificial Sequence
  chemically synthesized
tgcatcccgtgcatccgtca

SEQ ID NO: 213122 - DNA, 20 bp, Artificial Sequence
  chemically synthesized
gcatcccgtgcatccgtcaa

SEQ ID NO: 213123 - DNA, 20 bp, Artificial Sequence
  chemically synthesized
acagaaagctaagcctttga

SEQ ID NO: 213124 - DNA, 20 bp, Artificial Sequence
  chemically synthesized
ccgtgcatccgtcaaaggct

SEQ ID NO: 213125 - DNA, 20 bp, Artificial Sequence
  chemically synthesized
aacaaacaaaacagaaagct

SEQ ID NO: 213126 - DNA, 20 bp, Artificial Sequence
  chemically synthesized
ctttgaacaaacaaaacaga

SEQ ID NO: 213127 - DNA, 20 bp, Artificial Sequence
  chemically synthesized
cgggctttgaacaaacaaaa

SEQ ID NO: 213128 - DNA, 20 bp, Artificial Sequence
  chemically synthesized
ctttctgttttgtttgttca

SEQ ID NO: 213129 - DNA, 20 bp, Artificial Sequence
  chemically synthesized
tttgttcaaagcccgccttt

SEQ ID NO: 213130 - DNA, 20 bp, Artificial Sequence
  chemically synthesized
ttgttcaaagcccgcctttt

SEQ ID NO: 213131 - DNA, 20 bp, Artificial Sequence
  chemically synthesized
ggaccaagctcccaaaaggc

SEQ ID NO: 213132 - DNA, 20 bp, Artificial Sequence
  chemically synthesized
gggaccaagctcccaaaagg

SEQ ID NO: 213133 - DNA, 20 bp, Artificial Sequence
  chemically synthesized
gttcaaagcccgccttttgg

SEQ ID NO: 213134 - DNA, 20 bp, Artificial Sequence
  chemically synthesized
gatgggaccaagctcccaaa

SEQ ID NO: 213135 - DNA, 20 bp, Artificial Sequence
  chemically synthesized
agatgggaccaagctcccaa

SEQ ID NO: 213136 - DNA, 20 bp, Artificial Sequence
  chemically synthesized
aagcccgccttttgggagct

SEQ ID NO: 213137 - DNA, 20 bp, Artificial Sequence
  chemically synthesized
agggaagcaaagatgggacc

SEQ ID NO: 213138 - DNA, 20 bp, Artificial Sequence
  chemically synthesized
agcaggagggaagcaaagat

SEQ ID NO: 213139 - DNA, 20 bp, Artificial Sequence
  chemically synthesized
tagcaggagggaagcaaaga

SEQ ID NO: 213140 - DNA, 20 bp, Artificial Sequence
  chemically synthesized
atgatagcaggagggaagca

SEQ ID NO: 213141 - DNA, 20 bp, Artificial Sequence
  chemically synthesized
aggagatgatagcaggaggg

SEQ ID NO: 213142 - DNA, 20 bp, Artificial Sequence
  chemically synthesized
agaaggagatgatagcagga

SEQ ID NO: 213143 - DNA, 20 bp, Artificial Sequence
  chemically synthesized
tagaaggagatgatagcagg

SEQ ID NO: 213144 - DNA, 20 bp, Artificial Sequence
  chemically synthesized
ttagaaggagatgatagcag

SEQ ID NO: 213145 - DNA, 20 bp, Artificial Sequence
  chemically synthesized
gcttagaaggagatgatagc

SEQ ID NO: 213146 - DNA, 20 bp, Artificial Sequence
  chemically synthesized
tgcttagaaggagatgatag

SEQ ID NO: 213147 - DNA, 20 bp, Artificial Sequence
  chemically synthesized
gaatgcttagaaggagatga

SEQ ID NO: 213148 - DNA, 20 bp, Artificial Sequence
  chemically synthesized
tcctgctatcatctccttct

SEQ ID NO: 213149 - DNA, 20 bp, Artificial Sequence
  chemically synthesized
aaaaacagaatgcttagaag

SEQ ID NO: 213150 - DNA, 20 bp, Artificial Sequence
  chemically synthesized
ctaaaaacagaatgcttaga

SEQ ID NO: 213151 - DNA, 20 bp, Artificial Sequence
  chemically synthesized
gctaaaaacagaatgcttag

SEQ ID NO: 213152 - DNA, 20 bp, Artificial Sequence
  chemically synthesized
gaagctaaaaacagaatgct

SEQ ID NO: 213153 - DNA, 20 bp, Artificial Sequence
  chemically synthesized
ccttctaagcattctgtttt

SEQ ID NO: 213154 - DNA, 20 bp, Artificial Sequence
  chemically synthesized
gggagatgtgaagctaaaaa

SEQ ID NO: 213155 - DNA, 20 bp, Artificial Sequence
  chemically synthesized
gcatggcgaagggagatgtg

SEQ ID NO: 213156 - DNA, 20 bp, Artificial Sequence
  chemically synthesized
caaaagaagcatggcgaagg

SEQ ID NO: 213157 - DNA, 20 bp, Artificial Sequence
  chemically synthesized
agcaaaagaagcatggcgaa

SEQ ID NO: 213158 - DNA, 20 bp, Artificial Sequence
  chemically synthesized
aagcaaaagaagcatggcga

SEQ ID NO: 213159 - DNA, 20 bp, Artificial Sequence
  chemically synthesized
taagcaaaagaagcatggcg

SEQ ID NO: 213160 - DNA, 20 bp, Artificial Sequence
  chemically synthesized
tgttctaagcaaaagaagca

SEQ ID NO: 213161 - DNA, 20 bp, Artificial Sequence
  chemically synthesized
gttattgttctaagcaaaag

SEQ ID NO: 213162 - DNA, 20 bp, Artificial Sequence
  chemically synthesized
ttcgccatgcttcttttgct

SEQ ID NO: 213163 - DNA, 20 bp, Artificial Sequence
  chemically synthesized
tgcgttattgttctaagcaa

SEQ ID NO: 213164 - DNA, 20 bp, Artificial Sequence
  chemically synthesized
tgctgctgcgttattgttct

SEQ ID NO: 213165 - DNA, 20 bp, Artificial Sequence
  chemically synthesized
ttttgcttagaacaataacg

SEQ ID NO: 213166 - DNA, 20 bp, Artificial Sequence
  chemically synthesized
tgcttagaacaataacgcag

SEQ ID NO: 213167 - DNA, 20 bp, Artificial Sequence
  chemically synthesized
tagaacaataacgcagcagc

SEQ ID NO: 213168 - DNA, 20 bp, Artificial Sequence
  chemically synthesized
agcaagtacatcgattgctt

SEQ ID NO: 213169 - DNA, 20 bp, Artificial Sequence
  chemically synthesized
gcaagtacatcgattgcttt

SEQ ID NO: 213170 - DNA, 20 bp, Artificial Sequence
  chemically synthesized
aagtacatcgattgctttag

SEQ ID NO: 213171 - DNA, 20 bp, Artificial Sequence
  chemically synthesized
agtacatcgattgctttagg

SEQ ID NO: 213172 - DNA, 20 bp, Artificial Sequence
  chemically synthesized
tacaagataaaatcctccta

SEQ ID NO: 213173 - DNA, 20 bp, Artificial Sequence
  chemically synthesized
ggaggattttatcttgtact

SEQ ID NO: 213174 - DNA, 20 bp, Artificial Sequence
  chemically synthesized
aggaacatggaactgagtac

SEQ ID NO: 213175 - DNA, 20 bp, Artificial Sequence
  chemically synthesized
atgaataggaacatggaact

SEQ ID NO: 213176 - DNA, 20 bp, Artificial Sequence
  chemically synthesized
caaatgaatgaataggaaca

SEQ ID NO: 213177 - DNA, 20 bp, Artificial Sequence
  chemically synthesized
ataaagacaaatgaatgaat

SEQ ID NO: 213178 - DNA, 20 bp, Artificial Sequence
  chemically synthesized
aataaagacaaatgaatgaa

SEQ ID NO: 213179 - DNA, 20 bp, Artificial Sequence
  chemically synthesized
tcgagaaacttaaagaaata

SEQ ID NO: 213180 - DNA, 20 bp, Artificial Sequence
  chemically synthesized
tcatttgtctttatttcttt

SEQ ID NO: 213181 - DNA, 20 bp, Artificial Sequence
  chemically synthesized
tatttgcctcgagaaactta

SEQ ID NO: 213182 - DNA, 20 bp, Artificial Sequence
  chemically synthesized
tttatttctttaagtttctc

SEQ ID NO: 213183 - DNA, 20 bp, Artificial Sequence
  chemically synthesized
ttatttctttaagtttctcg

SEQ ID NO: 213184 - DNA, 20 bp, Artificial Sequence
  chemically synthesized
taacactaaatatttgcctc

SEQ ID NO: 213185 - DNA, 20 bp, Artificial Sequence
  chemically synthesized
agtttctcgaggcaaatatt

SEQ ID NO: 213186 - DNA, 20 bp, Artificial Sequence
  chemically synthesized
gaggcaaatatttagtgtta

SEQ ID NO: 213187 - DNA, 20 bp, Artificial Sequence
  chemically synthesized
tgttacagatctatgcctac

SEQ ID NO: 213188 - DNA, 20 bp, Artificial Sequence
  chemically synthesized
cagacatcaactcgtaggca

SEQ ID NO: 213189 - DNA, 20 bp, Artificial Sequence
  chemically synthesized
gcaaccagacatcaactcgt

SEQ ID NO: 213190 - DNA, 20 bp, Artificial Sequence
  chemically synthesized
ggcaaccagacatcaactcg

SEQ ID NO: 213191 - DNA, 20 bp, Artificial Sequence
  chemically synthesized
tatgcctacgagttgatgtc

SEQ ID NO: 213192 - DNA, 20 bp, Artificial Sequence
  chemically synthesized
acgagttgatgtctggttgc

SEQ ID NO: 213193 - DNA, 20 bp, Artificial Sequence
  chemically synthesized
tctgataaaattctggcaac

SEQ ID NO: 213194 - DNA, 20 bp, Artificial Sequence
  chemically synthesized
gtatgtatctgataaaattc

SEQ ID NO: 213195 - DNA, 20 bp, Artificial Sequence
  chemically synthesized
tctggttgccagaattttat

SEQ ID NO: 213196 - DNA, 20 bp, Artificial Sequence
  chemically synthesized
aattttatcagatacataca

SEQ ID NO: 213197 - DNA, 20 bp, Artificial Sequence
  chemically synthesized
gatacatacacagctcatca

SEQ ID NO: 213198 - DNA, 20 bp, Artificial Sequence
  chemically synthesized
ttaatcacattgtctgtgat

SEQ ID NO: 213199 - DNA, 20 bp, Artificial Sequence
  chemically synthesized
attttacataattcatgcag

SEQ ID NO: 213200 - DNA, 20 bp, Artificial Sequence
  chemically synthesized
aacattttacataattcatg

SEQ ID NO: 213201 - DNA, 20 bp, Artificial Sequence
  chemically synthesized
attatgtaaaatgttcgtat

SEQ ID NO: 213202 - DNA, 20 bp, Artificial Sequence
  chemically synthesized
tatgtaaaatgttcgtatca

SEQ ID NO: 213203 - DNA, 20 bp, Artificial Sequence
  chemically synthesized
ttcgtatcagagtcttttca

SEQ ID NO: 213204 - DNA, 20 bp, Artificial Sequence
  chemically synthesized
actaatatctttactatgaa

SEQ ID NO: 213205 - DNA, 20 bp, Artificial Sequence
  chemically synthesized
atcagagtcttttcatagta

SEQ ID NO: 213206 - DNA, 20 bp, Artificial Sequence
  chemically synthesized
tcttttcatagtaaagatat

SEQ ID NO: 213207 - DNA, 20 bp, Artificial Sequence
  chemically synthesized
atattagtgatattatgtat

SEQ ID NO: 213208 - DNA, 20 bp, Artificial Sequence
  chemically synthesized
tattttgttatattttgttg

SEQ ID NO: 213209 - DNA, 20 bp, Artificial Sequence
  chemically synthesized
tttgttgcagaacatgttct

SEQ ID NO: 213210 - DNA, 20 bp, Artificial Sequence
  chemically synthesized
taggtgaaaagaagaaaact

SEQ ID NO: 213211 - DNA, 20 bp, Artificial Sequence
  chemically synthesized
ctccaaatctaggtgaaaag

SEQ ID NO: 213212 - DNA, 20 bp, Artificial Sequence
  chemically synthesized
tgagttttcttcttttcacc

SEQ ID NO: 213213 - DNA, 20 bp, Artificial Sequence
  chemically synthesized
aaactccaaatctaggtgaa

SEQ ID NO: 213214 - DNA, 20 bp, Artificial Sequence
  chemically synthesized
ttcttcttttcacctagatt

SEQ ID NO: 213215 - DNA, 20 bp, Artificial Sequence
  chemically synthesized
cttcttttcacctagatttg

SEQ ID NO: 213216 - DNA, 20 bp, Artificial Sequence
  chemically synthesized
catattaaaactccaaatct

SEQ ID NO: 213217 - DNA, 20 bp, Artificial Sequence
  chemically synthesized
ccatattaaaactccaaatc

SEQ ID NO: 213218 - DNA, 20 bp, Artificial Sequence
  chemically synthesized
ctagatttggagttttaata

SEQ ID NO: 213219 - DNA, 20 bp, Artificial Sequence
  chemically synthesized
agatttggagttttaatatg

SEQ ID NO: 213220 - DNA, 20 bp, Artificial Sequence
  chemically synthesized
tttggagttttaatatggag

SEQ ID NO: 213221 - DNA, 20 bp, Artificial Sequence
  chemically synthesized
ggagttttaatatggagaag

SEQ ID NO: 213222 - DNA, 20 bp, Artificial Sequence
  chemically synthesized
gttttaatatggagaagcag

SEQ ID NO: 213223 - DNA, 20 bp, Artificial Sequence
  chemically synthesized
ttaatatggagaagcagtgg

SEQ ID NO: 213224 - DNA, 20 bp, Artificial Sequence
  chemically synthesized
gagaagcagtggtggtttaa

SEQ ID NO: 213225 - DNA, 20 bp, Artificial Sequence
  chemically synthesized
agtggtggtttaaaagacca

SEQ ID NO: 213226 - DNA, 20 bp, Artificial Sequence
  chemically synthesized
gcctgtctgacatcattctg

SEQ ID NO: 213227 - DNA, 20 bp, Artificial Sequence
  chemically synthesized
aaaagaccacagaatgatgt

SEQ ID NO: 213228 - DNA, 20 bp, Artificial Sequence
  chemically synthesized
gaccacagaatgatgtcaga

SEQ ID NO: 213229 - DNA, 20 bp, Artificial Sequence
  chemically synthesized
accacagaatgatgtcagac

SEQ ID NO: 213230 - DNA, 20 bp, Artificial Sequence
  chemically synthesized
cagaatgatgtcagacaggc

SEQ ID NO: 213231 - DNA, 20 bp, Artificial Sequence
  chemically synthesized
gaatgatgtcagacaggcca

SEQ ID NO: 213232 - DNA, 20 bp, Artificial Sequence
  chemically synthesized
taaaacctgtatttgaactc

SEQ ID NO: 213233 - DNA, 20 bp, Artificial Sequence
  chemically synthesized
gacaggccagagttcaaata

SEQ ID NO: 213234 - DNA, 20 bp, Artificial Sequence
  chemically synthesized
acaggccagagttcaaatac

SEQ ID NO: 213235 - DNA, 20 bp, Artificial Sequence
  chemically synthesized
atacaggttttactactcta

SEQ ID NO: 213236 - DNA, 20 bp, Artificial Sequence
  chemically synthesized
acgctcatagagccatagag

SEQ ID NO: 213237 - DNA, 20 bp, Artificial Sequence
  chemically synthesized
ctcacgctcatagagccata

SEQ ID NO: 213238 - DNA, 20 bp, Artificial Sequence
  chemically synthesized
tactcacgctcatagagcca

SEQ ID NO: 213239 - DNA, 20 bp, Artificial Sequence
  chemically synthesized
ttactactctatggctctat

SEQ ID NO: 213240 - DNA, 20 bp, Artificial Sequence
  chemically synthesized
gtaacttactcacgctcata

SEQ ID NO: 213241 - DNA, 20 bp, Artificial Sequence
  chemically synthesized
ctctatggctctatgagcgt

SEQ ID NO: 213242 - DNA, 20 bp, Artificial Sequence
  chemically synthesized
gggtaacttactcacgctca

SEQ ID NO: 213243 - DNA, 20 bp, Artificial Sequence
  chemically synthesized
atggctctatgagcgtgagt

SEQ ID NO: 213244 - DNA, 20 bp, Artificial Sequence
  chemically synthesized
tgagcgtgagtaagttaccc

SEQ ID NO: 213245 - DNA, 20 bp, Artificial Sequence
  chemically synthesized
attgagctggagagaggcta

SEQ ID NO: 213246 - DNA, 20 bp, Artificial Sequence
  chemically synthesized
aattgagctggagagaggct

SEQ ID NO: 213247 - DNA, 20 bp, Artificial Sequence
  chemically synthesized
aaattgagctggagagaggc

SEQ ID NO: 213248 - DNA, 20 bp, Artificial Sequence
  chemically synthesized
aagttaccctagcctctctc

SEQ ID NO: 213249 - DNA, 20 bp, Artificial Sequence
  chemically synthesized
tcctaaattgagctggagag

SEQ ID NO: 213250 - DNA, 20 bp, Artificial Sequence
  chemically synthesized
atcctaaattgagctggaga

SEQ ID NO: 213251 - DNA, 20 bp, Artificial Sequence
  chemically synthesized
taatcctaaattgagctgga

SEQ ID NO: 213252 - DNA, 20 bp, Artificial Sequence
  chemically synthesized
agtaatcctaaattgagctg

SEQ ID NO: 213253 - DNA, 20 bp, Artificial Sequence
  chemically synthesized
gtagtaatcctaaattgagc

SEQ ID NO: 213254 - DNA, 20 bp, Artificial Sequence
  chemically synthesized
agcctctctccagctcaatt

SEQ ID NO: 213255 - DNA, 20 bp, Artificial Sequence
  chemically synthesized
gcctctctccagctcaattt

SEQ ID NO: 213256 - DNA, 20 bp, Artificial Sequence
  chemically synthesized
cttcgtagtaatcctaaatt

SEQ ID NO: 213257 - DNA, 20 bp, Artificial Sequence
  chemically synthesized
ctcaatttaggattactacg

SEQ ID NO: 213258 - DNA, 20 bp, Artificial Sequence
  chemically synthesized
aatttaggattactacgaag

SEQ ID NO: 213259 - DNA, 20 bp, Artificial Sequence
  chemically synthesized
gaggtttccgagcttcttcg

SEQ ID NO: 213260 - DNA, 20 bp, Artificial Sequence
  chemically synthesized
aggattactacgaagaagct

SEQ ID NO: 213261 - DNA, 20 bp, Artificial Sequence
  chemically synthesized
tttccctgtgtgaggtttcc

SEQ ID NO: 213262 - DNA, 20 bp, Artificial Sequence
  chemically synthesized
agaagctcggaaacctcaca

SEQ ID NO: 213263 - DNA, 20 bp, Artificial Sequence
  chemically synthesized
gaagctcggaaacctcacac

SEQ ID NO: 213264 - DNA, 20 bp, Artificial Sequence
  chemically synthesized
aagctcggaaacctcacaca

SEQ ID NO: 213265 - DNA, 20 bp, Artificial Sequence
  chemically synthesized
acatgacttttccctgtgtg

SEQ ID NO: 213266 - DNA, 20 bp, Artificial Sequence
  chemically synthesized
tacatgacttttccctgtgt

SEQ ID NO: 213267 - DNA, 20 bp, Artificial Sequence
  chemically synthesized
cggaaacctcacacagggaa

SEQ ID NO: 213268 - DNA, 20 bp, Artificial Sequence
  chemically synthesized
tcacacagggaaaagtcatg

SEQ ID NO: 213269 - DNA, 20 bp, Artificial Sequence
  chemically synthesized
cacagggaaaagtcatgtag

SEQ ID NO: 213270 - DNA, 20 bp, Artificial Sequence
  chemically synthesized
acagggaaaagtcatgtagt

SEQ ID NO: 213271 - DNA, 20 bp, Artificial Sequence
  chemically synthesized
gaaaagtcatgtagtgggca

SEQ ID NO: 213272 - DNA, 20 bp, Artificial Sequence
  chemically synthesized
tgtagtgggcatagcacgat

SEQ ID NO: 213273 - DNA, 20 bp, Artificial Sequence
  chemically synthesized
cgttaattgagggtgtgtta

SEQ ID NO: 213274 - DNA, 20 bp, Artificial Sequence
  chemically synthesized
caggtatcaacgttaattga

SEQ ID NO: 213275 - DNA, 20 bp, Artificial Sequence
  chemically synthesized
gcaggtatcaacgttaattg

SEQ ID NO: 213276 - DNA, 20 bp, Artificial Sequence
  chemically synthesized
agcaggtatcaacgttaatt

SEQ ID NO: 213277 - DNA, 20 bp, Artificial Sequence
  chemically synthesized
gtgaggatgagaataagagc

SEQ ID NO: 213278 - DNA, 20 bp, Artificial Sequence
  chemically synthesized
ggtgaggatgagaataagag

SEQ ID NO: 213279 - DNA, 20 bp, Artificial Sequence
  chemically synthesized
aatggtgaggatgagaataa

SEQ ID NO: 213280 - DNA, 20 bp, Artificial Sequence
  chemically synthesized
gcaatggtgaggatgagaat

SEQ ID NO: 213281 - DNA, 20 bp, Artificial Sequence
  chemically synthesized
acaatagcaatggtgaggat

SEQ ID NO: 213282 - DNA, 20 bp, Artificial Sequence
  chemically synthesized
tagttacaatagcaatggtg

SEQ ID NO: 213283 - DNA, 20 bp, Artificial Sequence
  chemically synthesized
atagttacaatagcaatggt

SEQ ID NO: 213284 - DNA, 20 bp, Artificial Sequence
  chemically synthesized
gaaaatagttacaatagcaa

SEQ ID NO: 213285 - DNA, 20 bp, Artificial Sequence
  chemically synthesized
aggggagaaaatagttacaa

SEQ ID NO: 213286 - DNA, 20 bp, Artificial Sequence
  chemically synthesized
ccaattgcaaggggagaaaa

SEQ ID NO: 213287 - DNA, 20 bp, Artificial Sequence
  chemically synthesized
ctgggaaccaattgcaaggg

SEQ ID NO: 213288 - DNA, 20 bp, Artificial Sequence
  chemically synthesized
ttctgggaaccaattgcaag

SEQ ID NO: 213289 - DNA, 20 bp, Artificial Sequence
  chemically synthesized
ctattttctccccttgcaat

SEQ ID NO: 213290 - DNA, 20 bp, Artificial Sequence
  chemically synthesized
attctgggaaccaattgcaa

SEQ ID NO: 213291 - DNA, 20 bp, Artificial Sequence
  chemically synthesized
aattctgggaaccaattgca

SEQ ID NO: 213292 - DNA, 20 bp, Artificial Sequence
  chemically synthesized
aaattctgggaaccaattgc

SEQ ID NO: 213293 - DNA, 20 bp, Artificial Sequence
  chemically synthesized
ctccccttgcaattggttcc

SEQ ID NO: 213294 - DNA, 20 bp, Artificial Sequence
  chemically synthesized
catagtttatgtgaaattct

SEQ ID NO: 213295 - DNA, 20 bp, Artificial Sequence
  chemically synthesized
tcatagtttatgtgaaattc

SEQ ID NO: 213296 - DNA, 20 bp, Artificial Sequence
  chemically synthesized
tttcacataaactatgaatc

SEQ ID NO: 213297 - DNA, 20 bp, Artificial Sequence
  chemically synthesized
ttaagttcaaactggattca

SEQ ID NO: 213298 - DNA, 20 bp, Artificial Sequence
  chemically synthesized
aataaatattaagttcaaac

SEQ ID NO: 213299 - DNA, 20 bp, Artificial Sequence
  chemically synthesized
aaaataattcaataaatatt

SEQ ID NO: 213300 - DNA, 20 bp, Artificial Sequence
  chemically synthesized
ggaaaattagaaatgtttag

SEQ ID NO: 213301 - DNA, 20 bp, Artificial Sequence
  chemically synthesized
atgggaaaattagaaatgtt

SEQ ID NO: 213302 - DNA, 20 bp, Artificial Sequence
  chemically synthesized
ttttcaagaaatgggaaaat

SEQ ID NO: 213303 - DNA, 20 bp, Artificial Sequence
  chemically synthesized
aaaagttcttttcaagaaat

SEQ ID NO: 213304 - DNA, 20 bp, Artificial Sequence
  chemically synthesized
taaaagttcttttcaagaaa

SEQ ID NO: 213305 - DNA, 20 bp, Artificial Sequence
  chemically synthesized
taattttcccatttcttgaa

SEQ ID NO: 213306 - DNA, 20 bp, Artificial Sequence
  chemically synthesized
atctggtaaaagttcttttc

SEQ ID NO: 213307 - DNA, 20 bp, Artificial Sequence
  chemically synthesized
ttcttgaaaagaacttttac

SEQ ID NO: 213308 - DNA, 20 bp, Artificial Sequence
  chemically synthesized
atatgaataacatctggtaa

SEQ ID NO: 213309 - DNA, 20 bp, Artificial Sequence
  chemically synthesized
aattcaatatgaataacatc

SEQ ID NO: 213310 - DNA, 20 bp, Artificial Sequence
  chemically synthesized
aaatttaaaactattataat

SEQ ID NO: 213311 - DNA, 20 bp, Artificial Sequence
  chemically synthesized
tatatttcagcttattataa

SEQ ID NO: 213312 - DNA, 20 bp, Artificial Sequence
  chemically synthesized
tctaaccaagggatatattt

SEQ ID NO: 213313 - DNA, 20 bp, Artificial Sequence
  chemically synthesized
ataagctgaaatatatccct

SEQ ID NO: 213314 - DNA, 20 bp, Artificial Sequence
  chemically synthesized
gctgaaatatatcccttggt

SEQ ID NO: 213315 - DNA, 20 bp, Artificial Sequence
  chemically synthesized
tgaaatatatcccttggtta

SEQ ID NO: 213316 - DNA, 20 bp, Artificial Sequence
  chemically synthesized
gtgttaagtcctctaaccaa

SEQ ID NO: 213317 - DNA, 20 bp, Artificial Sequence
  chemically synthesized
gaaatatatcccttggttag

SEQ ID NO: 213318 - DNA, 20 bp, Artificial Sequence
  chemically synthesized
agtgttaagtcctctaacca

SEQ ID NO: 213319 - DNA, 20 bp, Artificial Sequence
  chemically synthesized
aagtgttaagtcctctaacc

SEQ ID NO: 213320 - DNA, 20 bp, Artificial Sequence
  chemically synthesized
tgttatattggtaaagtgtt

SEQ ID NO: 213321 - DNA, 20 bp, Artificial Sequence
  chemically synthesized
ttataattgttatattggta

SEQ ID NO: 213322 - DNA, 20 bp, Artificial Sequence
  chemically synthesized
actgattataattgttatat

SEQ ID NO: 213323 - DNA, 20 bp, Artificial Sequence
  chemically synthesized
accaatataacaattataat

SEQ ID NO: 213324 - DNA, 20 bp, Artificial Sequence
  chemically synthesized
atataacaattataatcagt

SEQ ID NO: 213325 - DNA, 20 bp, Artificial Sequence
  chemically synthesized
tgtaataaaatgttatatag

SEQ ID NO: 213326 - DNA, 20 bp, Artificial Sequence
  chemically synthesized
aattgtaataaaatgttata

SEQ ID NO: 213327 - DNA, 20 bp, Artificial Sequence
  chemically synthesized
attttattacaattttgcta

SEQ ID NO: 213328 - DNA, 20 bp, Artificial Sequence
  chemically synthesized
tgggggacacatttaaacta

SEQ ID NO: 213329 - DNA, 20 bp, Artificial Sequence
  chemically synthesized
ttccaacacatgaaatttgg

SEQ ID NO: 213330 - DNA, 20 bp, Artificial Sequence
  chemically synthesized
tttccaacacatgaaatttg

SEQ ID NO: 213331 - DNA, 20 bp, Artificial Sequence
  chemically synthesized
gtttccaacacatgaaattt

SEQ ID NO: 213332 - DNA, 20 bp, Artificial Sequence
  chemically synthesized
agtttccaacacatgaaatt

SEQ ID NO: 213333 - DNA, 20 bp, Artificial Sequence
  chemically synthesized
gtcccccaaatttcatgtgt

SEQ ID NO: 213334 - DNA, 20 bp, Artificial Sequence
  chemically synthesized
gtgctgccacgttggggatt

SEQ ID NO: 213335 - DNA, 20 bp, Artificial Sequence
  chemically synthesized
tggaaacttaatccccaacg

SEQ ID NO: 213336 - DNA, 20 bp, Artificial Sequence
  chemically synthesized
ctcccggtgctgccacgttg

SEQ ID NO: 213337 - DNA, 20 bp, Artificial Sequence
  chemically synthesized
aaacttaatccccaacgtgg

SEQ ID NO: 213338 - DNA, 20 bp, Artificial Sequence
  chemically synthesized
tctcccggtgctgccacgtt

SEQ ID NO: 213339 - DNA, 20 bp, Artificial Sequence
  chemically synthesized
atctcccggtgctgccacgt

SEQ ID NO: 213340 - DNA, 20 bp, Artificial Sequence
  chemically synthesized
aatccccaacgtggcagcac

SEQ ID NO: 213341 - DNA, 20 bp, Artificial Sequence
  chemically synthesized
atccccaacgtggcagcacc

SEQ ID NO: 213342 - DNA, 20 bp, Artificial Sequence
  chemically synthesized
ccccaacgtggcagcaccgg

SEQ ID NO: 213343 - DNA, 20 bp, Artificial Sequence
  chemically synthesized
ctcttaaaggcacaatctcc

SEQ ID NO: 213344 - DNA, 20 bp, Artificial Sequence
  chemically synthesized
caccgggagattgtgccttt

SEQ ID NO: 213345 - DNA, 20 bp, Artificial Sequence
  chemically synthesized
ccgggagattgtgcctttaa

SEQ ID NO: 213346 - DNA, 20 bp, Artificial Sequence
  chemically synthesized
cgggagattgtgcctttaag

SEQ ID NO: 213347 - DNA, 20 bp, Artificial Sequence
  chemically synthesized
atgatgcaatcacctcttaa

SEQ ID NO: 213348 - DNA, 20 bp, Artificial Sequence
  chemically synthesized
catgatgcaatcacctctta

SEQ ID NO: 213349 - DNA, 20 bp, Artificial Sequence
  chemically synthesized
ttaagaggtgattgcatcat

SEQ ID NO: 213350 - DNA, 20 bp, Artificial Sequence
  chemically synthesized
taagaggtgattgcatcatg

SEQ ID NO: 213351 - DNA, 20 bp, Artificial Sequence
  chemically synthesized
aagaggtgattgcatcatga

SEQ ID NO: 213352 - DNA, 20 bp, Artificial Sequence
  chemically synthesized
tgaatccattcataagggca

SEQ ID NO: 213353 - DNA, 20 bp, Artificial Sequence
  chemically synthesized
gatgaatccattcataaggg

SEQ ID NO: 213354 - DNA, 20 bp, Artificial Sequence
  chemically synthesized
gagggctctgcccttatgaa

SEQ ID NO: 213355 - DNA, 20 bp, Artificial Sequence
  chemically synthesized
atggatgaatccattcataa

SEQ ID NO: 213356 - DNA, 20 bp, Artificial Sequence
  chemically synthesized
aatggatgaatccattcata

SEQ ID NO: 213357 - DNA, 20 bp, Artificial Sequence
  chemically synthesized
gaatggatgaatccattcat

SEQ ID NO: 213358 - DNA, 20 bp, Artificial Sequence
  chemically synthesized
ttaacctattaatttatgaa

SEQ ID NO: 213359 - DNA, 20 bp, Artificial Sequence
  chemically synthesized
ttcatccattcataaattaa

SEQ ID NO: 213360 - DNA, 20 bp, Artificial Sequence
  chemically synthesized
tcatccattcataaattaat

SEQ ID NO: 213361 - DNA, 20 bp, Artificial Sequence
  chemically synthesized
ttcataaattaataggttaa

SEQ ID NO: 213362 - DNA, 20 bp, Artificial Sequence
  chemically synthesized
tcataaattaataggttaat

SEQ ID NO: 213363 - DNA, 20 bp, Artificial Sequence
  chemically synthesized
aataggttaatgggttatca

SEQ ID NO: 213364 - DNA, 20 bp, Artificial Sequence
  chemically synthesized
ataggttaatgggttatcat

SEQ ID NO: 213365 - DNA, 20 bp, Artificial Sequence
  chemically synthesized
aggttaatgggttatcatgg

SEQ ID NO: 213366 - DNA, 20 bp, Artificial Sequence
  chemically synthesized
ttaatgggttatcatgggag

SEQ ID NO: 213367 - DNA, 20 bp, Artificial Sequence
  chemically synthesized
taatgggttatcatgggagt

SEQ ID NO: 213368 - DNA, 20 bp, Artificial Sequence
  chemically synthesized
agtaggattcatgattttat

SEQ ID NO: 213369 - DNA, 20 bp, Artificial Sequence
  chemically synthesized
gattcatgattttataagaa

SEQ ID NO: 213370 - DNA, 20 bp, Artificial Sequence
  chemically synthesized
attcatgattttataagaac

SEQ ID NO: 213371 - DNA, 20 bp, Artificial Sequence
  chemically synthesized
catgattttataagaacagg

SEQ ID NO: 213372 - DNA, 20 bp, Artificial Sequence
  chemically synthesized
tgattttataagaacaggaa

SEQ ID NO: 213373 - DNA, 20 bp, Artificial Sequence
  chemically synthesized
attttataagaacaggaaga

SEQ ID NO: 213374 - DNA, 20 bp, Artificial Sequence
  chemically synthesized
gaagagagacatgaacacat

SEQ ID NO: 213375 - DNA, 20 bp, Artificial Sequence
  chemically synthesized
catgaacacattagaatact

SEQ ID NO: 213376 - DNA, 20 bp, Artificial Sequence
  chemically synthesized
cattacatggcaagaaggct

SEQ ID NO: 213377 - DNA, 20 bp, Artificial Sequence
  chemically synthesized
caggacattacatggcaaga

SEQ ID NO: 213378 - DNA, 20 bp, Artificial Sequence
  chemically synthesized
gcaggacattacatggcaag

SEQ ID NO: 213379 - DNA, 20 bp, Artificial Sequence
  chemically synthesized
agtgcaggacattacatggc

SEQ ID NO: 213380 - DNA, 20 bp, Artificial Sequence
  chemically synthesized
aggcagtgcaggacattaca

SEQ ID NO: 213381 - DNA, 20 bp, Artificial Sequence
  chemically synthesized
gcagagccctgaggcagtgc

SEQ ID NO: 213382 - DNA, 20 bp, Artificial Sequence
  chemically synthesized
agcagagccctgaggcagtg

SEQ ID NO: 213383 - DNA, 20 bp, Artificial Sequence
  chemically synthesized
tgtaatgtcctgcactgcct

SEQ ID NO: 213384 - DNA, 20 bp, Artificial Sequence
  chemically synthesized
gtaatgtcctgcactgcctc

SEQ ID NO: 213385 - DNA, 20 bp, Artificial Sequence
  chemically synthesized
taatgtcctgcactgcctca

SEQ ID NO: 213386 - DNA, 20 bp, Artificial Sequence
  chemically synthesized
gacacagcagagccctgagg

SEQ ID NO: 213387 - DNA, 20 bp, Artificial Sequence
  chemically synthesized
ggggacacagcagagccctg

SEQ ID NO: 213388 - DNA, 20 bp, Artificial Sequence
  chemically synthesized
tggggacacagcagagccct

SEQ ID NO: 213389 - DNA, 20 bp, Artificial Sequence
  chemically synthesized
ttgctcatggggacacagca

SEQ ID NO: 213390 - DNA, 20 bp, Artificial Sequence
  chemically synthesized
ttttgctcatggggacacag

SEQ ID NO: 213391 - DNA, 20 bp, Artificial Sequence
  chemically synthesized
cctttttgctcatggggaca

SEQ ID NO: 213392 - DNA, 20 bp, Artificial Sequence
  chemically synthesized
gggctctgctgtgtccccat

SEQ ID NO: 213393 - DNA, 20 bp, Artificial Sequence
  chemically synthesized
ttagagcctttttgctcatg

SEQ ID NO: 213394 - DNA, 20 bp, Artificial Sequence
  chemically synthesized
gttagagcctttttgctcat

SEQ ID NO: 213395 - DNA, 20 bp, Artificial Sequence
  chemically synthesized
tgttagagcctttttgctca

SEQ ID NO: 213396 - DNA, 20 bp, Artificial Sequence
  chemically synthesized
gctgtgtccccatgagcaaa

SEQ ID NO: 213397 - DNA, 20 bp, Artificial Sequence
  chemically synthesized
ctgtgtccccatgagcaaaa

SEQ ID NO: 213398 - DNA, 20 bp, Artificial Sequence
  chemically synthesized
atgagcaaaaaggctctaac

SEQ ID NO: 213399 - DNA, 20 bp, Artificial Sequence
  chemically synthesized
gtgtggctgtagacttgtta

SEQ ID NO: 213400 - DNA, 20 bp, Artificial Sequence
  chemically synthesized
tggtgtggctgtagacttgt

SEQ ID NO: 213401 - DNA, 20 bp, Artificial Sequence
  chemically synthesized
aaaaggctctaacaagtcta

SEQ ID NO: 213402 - DNA, 20 bp, Artificial Sequence
  chemically synthesized
cgtttaggctggtgtggctg

SEQ ID NO: 213403 - DNA, 20 bp, Artificial Sequence
  chemically synthesized
taacaagtctacagccacac

SEQ ID NO: 213404 - DNA, 20 bp, Artificial Sequence
  chemically synthesized
tgggcgcgtttaggctggtg

SEQ ID NO: 213405 - DNA, 20 bp, Artificial Sequence
  chemically synthesized
aagagtgggcgcgtttaggc

SEQ ID NO: 213406 - DNA, 20 bp, Artificial Sequence
  chemically synthesized
agataagagtgggcgcgttt

SEQ ID NO: 213407 - DNA, 20 bp, Artificial Sequence
  chemically synthesized
cagataagagtgggcgcgtt

SEQ ID NO: 213408 - DNA, 20 bp, Artificial Sequence
  chemically synthesized
ttccaagatcagataagagt

SEQ ID NO: 213409 - DNA, 20 bp, Artificial Sequence
  chemically synthesized
cttccaagatcagataagag

SEQ ID NO: 213410 - DNA, 20 bp, Artificial Sequence
  chemically synthesized
tagcttccaagatcagataa

SEQ ID NO: 213411 - DNA, 20 bp, Artificial Sequence
  chemically synthesized
cttagcttccaagatcagat

SEQ ID NO: 213412 - DNA, 20 bp, Artificial Sequence
  chemically synthesized
cgcccactcttatctgatct

SEQ ID NO: 213413 - DNA, 20 bp, Artificial Sequence
  chemically synthesized
ccactcttatctgatcttgg

SEQ ID NO: 213414 - DNA, 20 bp, Artificial Sequence
  chemically synthesized
cctcacttagcttccaagat

SEQ ID NO: 213415 - DNA, 20 bp, Artificial Sequence
  chemically synthesized
cttatctgatcttggaagct

SEQ ID NO: 213416 - DNA, 20 bp, Artificial Sequence
  chemically synthesized
tcgaacctcacttagcttcc

SEQ ID NO: 213417 - DNA, 20 bp, Artificial Sequence
  chemically synthesized
tctgatcttggaagctaagt

SEQ ID NO: 213418 - DNA, 20 bp, Artificial Sequence
  chemically synthesized
ctgatcttggaagctaagtg

SEQ ID NO: 213419 - DNA, 20 bp, Artificial Sequence
  chemically synthesized
taaccaggtcgaacctcact

SEQ ID NO: 213420 - DNA, 20 bp, Artificial Sequence
  chemically synthesized
aagctaagtgaggttcgacc

SEQ ID NO: 213421 - DNA, 20 bp, Artificial Sequence
  chemically synthesized
taagtgaggttcgacctggt

SEQ ID NO: 213422 - DNA, 20 bp, Artificial Sequence
  chemically synthesized
ctcccatccaagtactaacc

SEQ ID NO: 213423 - DNA, 20 bp, Artificial Sequence
  chemically synthesized
tctcccatccaagtactaac

SEQ ID NO: 213424 - DNA, 20 bp, Artificial Sequence
  chemically synthesized
ggttcgacctggttagtact

SEQ ID NO: 213425 - DNA, 20 bp, Artificial Sequence
  chemically synthesized
cgacctggttagtacttgga

SEQ ID NO: 213426 - DNA, 20 bp, Artificial Sequence
  chemically synthesized
gacctggttagtacttggat

SEQ ID NO: 213427 - DNA, 20 bp, Artificial Sequence
  chemically synthesized
cctggttagtacttggatgg

SEQ ID NO: 213428 - DNA, 20 bp, Artificial Sequence
  chemically synthesized
gtcagagccttctcccatcc

SEQ ID NO: 213429 - DNA, 20 bp, Artificial Sequence
  chemically synthesized
ggttagtacttggatgggag

SEQ ID NO: 213430 - DNA, 20 bp, Artificial Sequence
  chemically synthesized
gttagtacttggatgggaga

SEQ ID NO: 213431 - DNA, 20 bp, Artificial Sequence
  chemically synthesized
ggatgggagaaggctctgac

SEQ ID NO: 213432 - DNA, 20 bp, Artificial Sequence
  chemically synthesized
tgaggggccacatctggtca

SEQ ID NO: 213433 - DNA, 20 bp, Artificial Sequence
  chemically synthesized
gttgaggggccacatctggt

SEQ ID NO: 213434 - DNA, 20 bp, Artificial Sequence
  chemically synthesized
gagaaggctctgaccagatg

SEQ ID NO: 213435 - DNA, 20 bp, Artificial Sequence
  chemically synthesized
caaggttgaggggccacatc

SEQ ID NO: 213436 - DNA, 20 bp, Artificial Sequence
  chemically synthesized
ctgagaagtccaaggttgag

SEQ ID NO: 213437 - DNA, 20 bp, Artificial Sequence
  chemically synthesized
cagatgtggcccctcaacct

SEQ ID NO: 213438 - DNA, 20 bp, Artificial Sequence
  chemically synthesized
gctgagaagtccaaggttga

SEQ ID NO: 213439 - DNA, 20 bp, Artificial Sequence
  chemically synthesized
ggctgagaagtccaaggttg

SEQ ID NO: 213440 - DNA, 20 bp, Artificial Sequence
  chemically synthesized
aggctgagaagtccaaggtt

SEQ ID NO: 213441 - DNA, 20 bp, Artificial Sequence
  chemically synthesized
tacggaggctgagaagtcca

SEQ ID NO: 213442 - DNA, 20 bp, Artificial Sequence
  chemically synthesized
ttacggaggctgagaagtcc

SEQ ID NO: 213443 - DNA, 20 bp, Artificial Sequence
  chemically synthesized
cccctcaaccttggacttct

SEQ ID NO: 213444 - DNA, 20 bp, Artificial Sequence
  chemically synthesized
ttacagttacggaggctgag

SEQ ID NO: 213445 - DNA, 20 bp, Artificial Sequence
  chemically synthesized
ttcttacagttacggaggct

SEQ ID NO: 213446 - DNA, 20 bp, Artificial Sequence
  chemically synthesized
tttacttcttacagttacgg

SEQ ID NO: 213447 - DNA, 20 bp, Artificial Sequence
  chemically synthesized
gtttacttcttacagttacg

SEQ ID NO: 213448 - DNA, 20 bp, Artificial Sequence
  chemically synthesized
ttctcagcctccgtaactgt

SEQ ID NO: 213449 - DNA, 20 bp, Artificial Sequence
  chemically synthesized
gagtttacttcttacagtta

SEQ ID NO: 213450 - DNA, 20 bp, Artificial Sequence
  chemically synthesized
tcagcctccgtaactgtaag

SEQ ID NO: 213451 - DNA, 20 bp, Artificial Sequence
  chemically synthesized
gaaaaggagtttacttctta

SEQ ID NO: 213452 - DNA, 20 bp, Artificial Sequence
  chemically synthesized
gggtaatttacaaagaaaag

SEQ ID NO: 213453 - DNA, 20 bp, Artificial Sequence
  chemically synthesized
atgggtaatttacaaagaaa

SEQ ID NO: 213454 - DNA, 20 bp, Artificial Sequence
  chemically synthesized
aatgggtaatttacaaagaa

SEQ ID NO: 213455 - DNA, 20 bp, Artificial Sequence
  chemically synthesized
ctgaaaatgggtaatttaca

SEQ ID NO: 213456 - DNA, 20 bp, Artificial Sequence
  chemically synthesized
ctttgtaaattacccatttt

SEQ ID NO: 213457 - DNA, 20 bp, Artificial Sequence
  chemically synthesized
tttgtaaattacccattttc

SEQ ID NO: 213458 - DNA, 20 bp, Artificial Sequence
  chemically synthesized
gtaacagaatacctgaaaat

SEQ ID NO: 213459 - DNA, 20 bp, Artificial Sequence
  chemically synthesized
tgtaacagaatacctgaaaa

SEQ ID NO: 213460 - DNA, 20 bp, Artificial Sequence
  chemically synthesized
attttcaggtattctgttac

SEQ ID NO: 213461 - DNA, 20 bp, Artificial Sequence
  chemically synthesized
ccatttgctgttgcttgtaa

SEQ ID NO: 213462 - DNA, 20 bp, Artificial Sequence
  chemically synthesized
aggtattctgttacaagcaa

SEQ ID NO: 213463 - DNA, 20 bp, Artificial Sequence
  chemically synthesized
ctgttacaagcaacagcaaa

SEQ ID NO: 213464 - DNA, 20 bp, Artificial Sequence
  chemically synthesized
caagcaacagcaaatggact

SEQ ID NO: 213465 - DNA, 20 bp, Artificial Sequence
  chemically synthesized
tactgtgaaagaattcgtct

SEQ ID NO: 213466 - DNA, 20 bp, Artificial Sequence
  chemically synthesized
gacttagacgaattctttca

SEQ ID NO: 213467 - DNA, 20 bp, Artificial Sequence
  chemically synthesized
aataaaatcttatactgtga

SEQ ID NO: 213468 - DNA, 20 bp, Artificial Sequence
  chemically synthesized
gacgaattctttcacagtat

SEQ ID NO: 213469 - DNA, 20 bp, Artificial Sequence
  chemically synthesized
tataagattttattgacaca

SEQ ID NO: 213470 - DNA, 20 bp, Artificial Sequence
  chemically synthesized
atagtgtgttgaataaataa

SEQ ID NO: 213471 - DNA, 20 bp, Artificial Sequence
  chemically synthesized
aaacttaattttgattacaa

SEQ ID NO: 213472 - DNA, 20 bp, Artificial Sequence
  chemically synthesized
catcttttgtaatcaaaatt

SEQ ID NO: 213473 - DNA, 20 bp, Artificial Sequence
  chemically synthesized
aatcaaaattaagtttgtat

SEQ ID NO: 213474 - DNA, 20 bp, Artificial Sequence
  chemically synthesized
gaatgagttaggaacaatac

SEQ ID NO: 213475 - DNA, 20 bp, Artificial Sequence
  chemically synthesized
tgaatgagttaggaacaata

SEQ ID NO: 213476 - DNA, 20 bp, Artificial Sequence
  chemically synthesized
acctgatctttgaatgagtt

SEQ ID NO: 213477 - DNA, 20 bp, Artificial Sequence
  chemically synthesized
cacctgatctttgaatgagt

SEQ ID NO: 213478 - DNA, 20 bp, Artificial Sequence
  chemically synthesized
tattgttcctaactcattca

SEQ ID NO: 213479 - DNA, 20 bp, Artificial Sequence
  chemically synthesized
catccacctgatctttgaat

SEQ ID NO: 213480 - DNA, 20 bp, Artificial Sequence
  chemically synthesized
ttcctaactcattcaaagat

SEQ ID NO: 213481 - DNA, 20 bp, Artificial Sequence
  chemically synthesized
tcctaactcattcaaagatc

SEQ ID NO: 213482 - DNA, 20 bp, Artificial Sequence
  chemically synthesized
taactcattcaaagatcagg

SEQ ID NO: 213483 - DNA, 20 bp, Artificial Sequence
  chemically synthesized
attcaaagatcaggtggatg

SEQ ID NO: 213484 - DNA, 20 bp, Artificial Sequence
  chemically synthesized
ttcaaagatcaggtggatga

SEQ ID NO: 213485 - DNA, 20 bp, Artificial Sequence
  chemically synthesized
aagatcaggtggatgaagga

SEQ ID NO: 213486 - DNA, 20 bp, Artificial Sequence
  chemically synthesized
caggtggatgaaggacagac

SEQ ID NO: 213487 - DNA, 20 bp, Artificial Sequence
  chemically synthesized
gtaaagtcattaaaattttc

SEQ ID NO: 213488 - DNA, 20 bp, Artificial Sequence
  chemically synthesized
gtaaatgacttatttaagta

SEQ ID NO: 213489 - DNA, 20 bp, Artificial Sequence
  chemically synthesized
tttaatgactttacttaaat

SEQ ID NO: 213490 - DNA, 20 bp, Artificial Sequence
  chemically synthesized
aataagtaaatgacttattt

SEQ ID NO: 213491 - DNA, 20 bp, Artificial Sequence
  chemically synthesized
aagtcatttacttatttaaa

SEQ ID NO: 213492 - DNA, 20 bp, Artificial Sequence
  chemically synthesized
aaatatgtgactttttaaat

SEQ ID NO: 213493 - DNA, 20 bp, Artificial Sequence
  chemically synthesized
acatatttaaatgaataatt

SEQ ID NO: 213494 - DNA, 20 bp, Artificial Sequence
  chemically synthesized
aataatttggttgtataaca

SEQ ID NO: 213495 - DNA, 20 bp, Artificial Sequence
  chemically synthesized
gttgtataacacagttactt

SEQ ID NO: 213496 - DNA, 20 bp, Artificial Sequence
  chemically synthesized
gatataatatttttattcta

SEQ ID NO: 213497 - DNA, 20 bp, Artificial Sequence
  chemically synthesized
tttattactttaaaatatta

SEQ ID NO: 213498 - DNA, 20 bp, Artificial Sequence
  chemically synthesized
attatatctataatatttta

SEQ ID NO: 213499 - DNA, 20 bp, Artificial Sequence
  chemically synthesized
taatattttaaagtaataaa

SEQ ID NO: 213500 - DNA, 20 bp, Artificial Sequence
  chemically synthesized
aatattttaaagtaataaat

SEQ ID NO: 213501 - DNA, 20 bp, Artificial Sequence
  chemically synthesized
taaagtaataaataggacca

SEQ ID NO: 213502 - DNA, 20 bp, Artificial Sequence
  chemically synthesized
aaagtaataaataggaccat

SEQ ID NO: 213503 - DNA, 20 bp, Artificial Sequence
  chemically synthesized
catatttcataaatagccta

SEQ ID NO: 213504 - DNA, 20 bp, Artificial Sequence
  chemically synthesized
ttcatgtcatatttcataaa

SEQ ID NO: 213505 - DNA, 20 bp, Artificial Sequence
  chemically synthesized
tatgaaatatgacatgaatt

SEQ ID NO: 213506 - DNA, 20 bp, Artificial Sequence
  chemically synthesized
tgacatgaatttagaatttc

SEQ ID NO: 213507 - DNA, 20 bp, Artificial Sequence
  chemically synthesized
attgcccatttaaataaata

SEQ ID NO: 213508 - DNA, 20 bp, Artificial Sequence
  chemically synthesized
caaatctatatttatttaaa

SEQ ID NO: 213509 - DNA, 20 bp, Artificial Sequence
  chemically synthesized
aaatctatatttatttaaat

SEQ ID NO: 213510 - DNA, 20 bp, Artificial Sequence
  chemically synthesized
atttatttaaatgggcaata

SEQ ID NO: 213511 - DNA, 20 bp, Artificial Sequence
  chemically synthesized
ttaaatgggcaatatggttt

SEQ ID NO: 213512 - DNA, 20 bp, Artificial Sequence
  chemically synthesized
tgggcaatatggtttgagaa

SEQ ID NO: 213513 - DNA, 20 bp, Artificial Sequence
  chemically synthesized
tttcttattcatcagaagat

SEQ ID NO: 213514 - DNA, 20 bp, Artificial Sequence
  chemically synthesized
ttttcttattcatcagaaga

SEQ ID NO: 213515 - DNA, 20 bp, Artificial Sequence
  chemically synthesized
gtgtttttcttattcatcag

SEQ ID NO: 213516 - DNA, 20 bp, Artificial Sequence
  chemically synthesized
gaacccatcttctgatgaat

SEQ ID NO: 213517 - DNA, 20 bp, Artificial Sequence
  chemically synthesized
tgagtgtttttcttattcat

SEQ ID NO: 213518 - DNA, 20 bp, Artificial Sequence
  chemically synthesized
gaataagaaaaacactcaat

SEQ ID NO: 213519 - DNA, 20 bp, Artificial Sequence
  chemically synthesized
gatcagctccattgccaatt

SEQ ID NO: 213520 - DNA, 20 bp, Artificial Sequence
  chemically synthesized
gaaaaacactcaattggcaa

SEQ ID NO: 213521 - DNA, 20 bp, Artificial Sequence
  chemically synthesized
aaaacactcaattggcaatg

SEQ ID NO: 213522 - DNA, 20 bp, Artificial Sequence
  chemically synthesized
aatttcaatgaatgcatgat

SEQ ID NO: 213523 - DNA, 20 bp, Artificial Sequence
  chemically synthesized
tgcattcattgaaattaaat

SEQ ID NO: 213524 - DNA, 20 bp, Artificial Sequence
  chemically synthesized
attgaaattaaattggcttt

SEQ ID NO: 213525 - DNA, 20 bp, Artificial Sequence
  chemically synthesized
aagaagactagtacaactta

SEQ ID NO: 213526 - DNA, 20 bp, Artificial Sequence
  chemically synthesized
aaattggctttaagttgtac

SEQ ID NO: 213527 - DNA, 20 bp, Artificial Sequence
  chemically synthesized
tactcgttgcataagaagac

SEQ ID NO: 213528 - DNA, 20 bp, Artificial Sequence
  chemically synthesized
ggagctactcgttgcataag

SEQ ID NO: 213529 - DNA, 20 bp, Artificial Sequence
  chemically synthesized
tactagtcttcttatgcaac

SEQ ID NO: 213530 - DNA, 20 bp, Artificial Sequence
  chemically synthesized
taaggagctactcgttgcat

SEQ ID NO: 213531 - DNA, 20 bp, Artificial Sequence
  chemically synthesized
tagtcttcttatgcaacgag

SEQ ID NO: 213532 - DNA, 20 bp, Artificial Sequence
  chemically synthesized
ggaattttcatcaaaataag

SEQ ID NO: 213533 - DNA, 20 bp, Artificial Sequence
  chemically synthesized
ggggaattttcatcaaaata

SEQ ID NO: 213534 - DNA, 20 bp, Artificial Sequence
  chemically synthesized
tggggaattttcatcaaaat

SEQ ID NO: 213535 - DNA, 20 bp, Artificial Sequence
  chemically synthesized
ccagtcttagttataaattg

SEQ ID NO: 213536 - DNA, 20 bp, Artificial Sequence
  chemically synthesized
tccagtcttagttataaatt

SEQ ID NO: 213537 - DNA, 20 bp, Artificial Sequence
  chemically synthesized
atccagtcttagttataaat

SEQ ID NO: 213538 - DNA, 20 bp, Artificial Sequence
  chemically synthesized
aaattccccaatttataact

SEQ ID NO: 213539 - DNA, 20 bp, Artificial Sequence
  chemically synthesized
ccccaatttataactaagac

SEQ ID NO: 213540 - DNA, 20 bp, Artificial Sequence
  chemically synthesized
aaaataacaagatccagtct

SEQ ID NO: 213541 - DNA, 20 bp, Artificial Sequence
  chemically synthesized
ctgatcaaaataacaagatc

SEQ ID NO: 213542 - DNA, 20 bp, Artificial Sequence
  chemically synthesized
gcatctctgatcaaaataac

SEQ ID NO: 213543 - DNA, 20 bp, Artificial Sequence
  chemically synthesized
ctggatcttgttattttgat

SEQ ID NO: 213544 - DNA, 20 bp, Artificial Sequence
  chemically synthesized
ggatcttgttattttgatca

SEQ ID NO: 213545 - DNA, 20 bp, Artificial Sequence
  chemically synthesized
atcagagatgcaaatgtctt

SEQ ID NO: 213546 - DNA, 20 bp, Artificial Sequence
  chemically synthesized
aacccccaactttttttcca

SEQ ID NO: 213547 - DNA, 20 bp, Artificial Sequence
  chemically synthesized
tgcaaatgtctttggaaaaa

SEQ ID NO: 213548 - DNA, 20 bp, Artificial Sequence
  chemically synthesized
aatgtctttggaaaaaaagt

SEQ ID NO: 213549 - DNA, 20 bp, Artificial Sequence
  chemically synthesized
atgtctttggaaaaaaagtt

SEQ ID NO: 213550 - DNA, 20 bp, Artificial Sequence
  chemically synthesized
tgtctttggaaaaaaagttg

SEQ ID NO: 213551 - DNA, 20 bp, Artificial Sequence
  chemically synthesized
gtctttggaaaaaaagttgg

SEQ ID NO: 213552 - DNA, 20 bp, Artificial Sequence
  chemically synthesized
cagtgataagtcatgtgatt

SEQ ID NO: 213553 - DNA, 20 bp, Artificial Sequence
  chemically synthesized
taatcacatgacttatcact

SEQ ID NO: 213554 - DNA, 20 bp, Artificial Sequence
  chemically synthesized
ttttataaattctcagtgat

SEQ ID NO: 213555 - DNA, 20 bp, Artificial Sequence
  chemically synthesized
aaaatgtttttataaattct

SEQ ID NO: 213556 - DNA, 20 bp, Artificial Sequence
  chemically synthesized
aaaaacattttatccccttg

SEQ ID NO: 213557 - DNA, 20 bp, Artificial Sequence
  chemically synthesized
ttgagatcgatttctacaag

SEQ ID NO: 213558 - DNA, 20 bp, Artificial Sequence
  chemically synthesized
tttgagatcgatttctacaa

SEQ ID NO: 213559 - DNA, 20 bp, Artificial Sequence
  chemically synthesized
gtttgagatcgatttctaca

SEQ ID NO: 213560 - DNA, 20 bp, Artificial Sequence
  chemically synthesized
agtttgagatcgatttctac

SEQ ID NO: 213561 - DNA, 20 bp, Artificial Sequence
  chemically synthesized
gtagaaatcgatctcaaact

SEQ ID NO: 213562 - DNA, 20 bp, Artificial Sequence
  chemically synthesized
tagaaatcgatctcaaactt

SEQ ID NO: 213563 - DNA, 20 bp, Artificial Sequence
  chemically synthesized
agaaatcgatctcaaactta

SEQ ID NO: 213564 - DNA, 20 bp, Artificial Sequence
  chemically synthesized
attatatgttccctaagttt

SEQ ID NO: 213565 - DNA, 20 bp, Artificial Sequence
  chemically synthesized
ctctaaattatatgttccct

SEQ ID NO: 213566 - DNA, 20 bp, Artificial Sequence
  chemically synthesized
aacttagggaacatataatt

SEQ ID NO: 213567 - DNA, 20 bp, Artificial Sequence
  chemically synthesized
cttagggaacatataattta

SEQ ID NO: 213568 - DNA, 20 bp, Artificial Sequence
  chemically synthesized
cagctccgttgggttaaaaa

SEQ ID NO: 213569 - DNA, 20 bp, Artificial Sequence
  chemically synthesized
agaaactatttttaacccaa

SEQ ID NO: 213570 - DNA, 20 bp, Artificial Sequence
  chemically synthesized
aaactatttttaacccaacg

SEQ ID NO: 213571 - DNA, 20 bp, Artificial Sequence
  chemically synthesized
aacctaaatgcagctccgtt

SEQ ID NO: 213572 - DNA, 20 bp, Artificial Sequence
  chemically synthesized
taacctaaatgcagctccgt

SEQ ID NO: 213573 - DNA, 20 bp, Artificial Sequence
  chemically synthesized
taacccaacggagctgcatt

SEQ ID NO: 213574 - DNA, 20 bp, Artificial Sequence
  chemically synthesized
aacccaacggagctgcattt

SEQ ID NO: 213575 - DNA, 20 bp, Artificial Sequence
  chemically synthesized
cacagggagtaacctaaatg

SEQ ID NO: 213576 - DNA, 20 bp, Artificial Sequence
  chemically synthesized
agttcaaaagtaatcacagg

SEQ ID NO: 213577 - DNA, 20 bp, Artificial Sequence
  chemically synthesized
caagttcaaaagtaatcaca

SEQ ID NO: 213578 - DNA, 20 bp, Artificial Sequence
  chemically synthesized
ccaagttcaaaagtaatcac

SEQ ID NO: 213579 - DNA, 20 bp, Artificial Sequence
  chemically synthesized
accaagttcaaaagtaatca

SEQ ID NO: 213580 - DNA, 20 bp, Artificial Sequence
  chemically synthesized
cctgtgattacttttgaact

SEQ ID NO: 213581 - DNA, 20 bp, Artificial Sequence
  chemically synthesized
aagagtgctaccaagttcaa

SEQ ID NO: 213582 - DNA, 20 bp, Artificial Sequence
  chemically synthesized
gtgattacttttgaacttgg

SEQ ID NO: 213583 - DNA, 20 bp, Artificial Sequence
  chemically synthesized
taaccaagaagagtgctacc

SEQ ID NO: 213584 - DNA, 20 bp, Artificial Sequence
  chemically synthesized
gaacttggtagcactcttct

SEQ ID NO: 213585 - DNA, 20 bp, Artificial Sequence
  chemically synthesized
ataacagtgctaaccaagaa

SEQ ID NO: 213586 - DNA, 20 bp, Artificial Sequence
  chemically synthesized
ttggtagcactcttcttggt

SEQ ID NO: 213587 - DNA, 20 bp, Artificial Sequence
  chemically synthesized
aaataacagtgctaaccaag

SEQ ID NO: 213588 - DNA, 20 bp, Artificial Sequence
  chemically synthesized
tccaaataacagtgctaacc

SEQ ID NO: 213589 - DNA, 20 bp, Artificial Sequence
  chemically synthesized
tcttggttagcactgttatt

SEQ ID NO: 213590 - DNA, 20 bp, Artificial Sequence
  chemically synthesized
ttggttagcactgttatttg

SEQ ID NO: 213591 - DNA, 20 bp, Artificial Sequence
  chemically synthesized
atgatattgtctccaaataa

SEQ ID NO: 213592 - DNA, 20 bp, Artificial Sequence
  chemically synthesized
atttggagacaatatcatac

SEQ ID NO: 213593 - DNA, 20 bp, Artificial Sequence
  chemically synthesized
tttggagacaatatcatacg

SEQ ID NO: 213594 - DNA, 20 bp, Artificial Sequence
  chemically synthesized
atcatacgaggtttatcttg

SEQ ID NO: 213595 - DNA, 20 bp, Artificial Sequence
  chemically synthesized
tcatacgaggtttatcttgt

SEQ ID NO: 213596 - DNA, 20 bp, Artificial Sequence
  chemically synthesized
aattactgaacatgtcctac

SEQ ID NO: 213597 - DNA, 20 bp, Artificial Sequence
  chemically synthesized
tttatcttgtaggacatgtt

SEQ ID NO: 213598 - DNA, 20 bp, Artificial Sequence
  chemically synthesized
ggacatgttcagtaatttcc

SEQ ID NO: 213599 - DNA, 20 bp, Artificial Sequence
  chemically synthesized
atgttcagtaatttcctgga

SEQ ID NO: 213600 - DNA, 20 bp, Artificial Sequence
  chemically synthesized
taataatttgaacactatcc

SEQ ID NO: 213601 - DNA, 20 bp, Artificial Sequence
  chemically synthesized
ttaataatttgaacactatc

SEQ ID NO: 213602 - DNA, 20 bp, Artificial Sequence
  chemically synthesized
gatagtgttcaaattattaa

SEQ ID NO: 213603 - DNA, 20 bp, Artificial Sequence
  chemically synthesized
atattcactggaataatgat

SEQ ID NO: 213604 - DNA, 20 bp, Artificial Sequence
  chemically synthesized
ttaatagctaatcattattc

SEQ ID NO: 213605 - DNA, 20 bp, Artificial Sequence
  chemically synthesized
gtacactgtattatattcac

SEQ ID NO: 213606 - DNA, 20 bp, Artificial Sequence
  chemically synthesized
ttattccagtgaatataata

SEQ ID NO: 213607 - DNA, 20 bp, Artificial Sequence
  chemically synthesized
tataatacagtgtactttaa

SEQ ID NO: 213608 - DNA, 20 bp, Artificial Sequence
  chemically synthesized
atatataatgatgactttta

SEQ ID NO: 213609 - DNA, 20 bp, Artificial Sequence
  chemically synthesized
gattatttttcatttatcgt

SEQ ID NO: 213610 - DNA, 20 bp, Artificial Sequence
  chemically synthesized
aaatgaaaaataatcatacg

SEQ ID NO: 213611 - DNA, 20 bp, Artificial Sequence
  chemically synthesized
aaataatcatacgcagatat

SEQ ID NO: 213612 - DNA, 20 bp, Artificial Sequence
  chemically synthesized
agatatgagaactataatgt

SEQ ID NO: 213613 - DNA, 20 bp, Artificial Sequence
  chemically synthesized
agcactttattccaacatta

SEQ ID NO: 213614 - DNA, 20 bp, Artificial Sequence
  chemically synthesized
agaactataatgttggaata

SEQ ID NO: 213615 - DNA, 20 bp, Artificial Sequence
  chemically synthesized
acgcgtgtggggcagcaatg

SEQ ID NO: 213616 - DNA, 20 bp, Artificial Sequence
  chemically synthesized
aagtgctaacgcgtgtgggg

SEQ ID NO: 213617 - DNA, 20 bp, Artificial Sequence
  chemically synthesized
ttcaagtgctaacgcgtgtg

SEQ ID NO: 213618 - DNA, 20 bp, Artificial Sequence
  chemically synthesized
attcaagtgctaacgcgtgt

SEQ ID NO: 213619 - DNA, 20 bp, Artificial Sequence
  chemically synthesized
cattgctgccccacacgcgt

SEQ ID NO: 213620 - DNA, 20 bp, Artificial Sequence
  chemically synthesized
tattcaagtgctaacgcgtg

SEQ ID NO: 213621 - DNA, 20 bp, Artificial Sequence
  chemically synthesized
ctttatatccacatttattc

SEQ ID NO: 213622 - DNA, 20 bp, Artificial Sequence
  chemically synthesized
cgttagcacttgaataaatg

SEQ ID NO: 213623 - DNA, 20 bp, Artificial Sequence
  chemically synthesized
cttgaataaatgtggatata

SEQ ID NO: 213624 - DNA, 20 bp, Artificial Sequence
  chemically synthesized
gaataaatgtggatataaag

SEQ ID NO: 213625 - DNA, 20 bp, Artificial Sequence
  chemically synthesized
aaatgtggatataaagtaga

SEQ ID NO: 213626 - DNA, 20 bp, Artificial Sequence
  chemically synthesized
agaaagaaatattaaatatc

SEQ ID NO: 213627 - DNA, 20 bp, Artificial Sequence
  chemically synthesized
aagtgttattccaaccatta

SEQ ID NO: 213628 - DNA, 20 bp, Artificial Sequence
  chemically synthesized
agtaaaaatcctttaatggt

SEQ ID NO: 213629 - DNA, 20 bp, Artificial Sequence
  chemically synthesized
agtgttattccaaccattaa

SEQ ID NO: 213630 - DNA, 20 bp, Artificial Sequence
  chemically synthesized
tcttagtaaaaatcctttaa

SEQ ID NO: 213631 - DNA, 20 bp, Artificial Sequence
  chemically synthesized
accattaaaggatttttact

SEQ ID NO: 213632 - DNA, 20 bp, Artificial Sequence
  chemically synthesized
cattaaaggatttttactaa

SEQ ID NO: 213633 - DNA, 20 bp, Artificial Sequence
  chemically synthesized
taaaggatttttactaagag

SEQ ID NO: 213634 - DNA, 20 bp, Artificial Sequence
  chemically synthesized
gtgaagaaagattcttctct

SEQ ID NO: 213635 - DNA, 20 bp, Artificial Sequence
  chemically synthesized
atagagtcatcatgtgaaga

SEQ ID NO: 213636 - DNA, 20 bp, Artificial Sequence
  chemically synthesized
agttatagagtcatcatgtg

SEQ ID NO: 213637 - DNA, 20 bp, Artificial Sequence
  chemically synthesized
cacatgatgactctataact

SEQ ID NO: 213638 - DNA, 20 bp, Artificial Sequence
  chemically synthesized
ttgttttcagctaagttata

SEQ ID NO: 213639 - DNA, 20 bp, Artificial Sequence
  chemically synthesized
ttttgttttcagctaagtta

SEQ ID NO: 213640 - DNA, 20 bp, Artificial Sequence
  chemically synthesized
atgcgcttttgttttcagct

SEQ ID NO: 213641 - DNA, 20 bp, Artificial Sequence
  chemically synthesized
tataacttagctgaaaacaa

SEQ ID NO: 213642 - DNA, 20 bp, Artificial Sequence
  chemically synthesized
catttatgcgcttttgtttt

SEQ ID NO: 213643 - DNA, 20 bp, Artificial Sequence
  chemically synthesized
tgaaaacaaaagcgcataaa

SEQ ID NO: 213644 - DNA, 20 bp, Artificial Sequence
  chemically synthesized
cgcataaatggcctctcctg

SEQ ID NO: 213645 - DNA, 20 bp, Artificial Sequence
  chemically synthesized
gtaagacatagcttcaggag

SEQ ID NO: 213646 - DNA, 20 bp, Artificial Sequence
  chemically synthesized
tgtaagacatagcttcagga

SEQ ID NO: 213647 - DNA, 20 bp, Artificial Sequence
  chemically synthesized
agtgtaagacatagcttcag

SEQ ID NO: 213648 - DNA, 20 bp, Artificial Sequence
  chemically synthesized
ggagtgtaagacatagcttc

SEQ ID NO: 213649 - DNA, 20 bp, Artificial Sequence
  chemically synthesized
aggagtgtaagacatagctt

SEQ ID NO: 213650 - DNA, 20 bp, Artificial Sequence
  chemically synthesized
atcagaaggagtgtaagaca

SEQ ID NO: 213651 - DNA, 20 bp, Artificial Sequence
  chemically synthesized
aatgtcatcagaaggagtgt

SEQ ID NO: 213652 - DNA, 20 bp, Artificial Sequence
  chemically synthesized
aattgaaatgtcatcagaag

SEQ ID NO: 213653 - DNA, 20 bp, Artificial Sequence
  chemically synthesized
ataattgaaatgtcatcaga

SEQ ID NO: 213654 - DNA, 20 bp, Artificial Sequence
  chemically synthesized
tataattgaaatgtcatcag

SEQ ID NO: 213655 - DNA, 20 bp, Artificial Sequence
  chemically synthesized
gcttataattgaaatgtcat

SEQ ID NO: 213656 - DNA, 20 bp, Artificial Sequence
  chemically synthesized
tctgatgacatttcaattat

SEQ ID NO: 213657 - DNA, 20 bp, Artificial Sequence
  chemically synthesized
gacatttcaattataagccg

SEQ ID NO: 213658 - DNA, 20 bp, Artificial Sequence
  chemically synthesized
tcgattgtttcgtggagctt

SEQ ID NO: 213659 - DNA, 20 bp, Artificial Sequence
  chemically synthesized
taggaatcgattgtttcgtg

SEQ ID NO: 213660 - DNA, 20 bp, Artificial Sequence
  chemically synthesized
tttaggaatcgattgtttcg

SEQ ID NO: 213661 - DNA, 20 bp, Artificial Sequence
  chemically synthesized
cacgaaacaatcgattccta

SEQ ID NO: 213662 - DNA, 20 bp, Artificial Sequence
  chemically synthesized
acgaaacaatcgattcctaa

SEQ ID NO: 213663 - DNA, 20 bp, Artificial Sequence
  chemically synthesized
tgatcaattgttagaccttt

SEQ ID NO: 213664 - DNA, 20 bp, Artificial Sequence
  chemically synthesized
gtgatcaattgttagacctt

SEQ ID NO: 213665 - DNA, 20 bp, Artificial Sequence
  chemically synthesized
tgtacggagtgatcaattgt

SEQ ID NO: 213666 - DNA, 20 bp, Artificial Sequence
  chemically synthesized
tacaggcacttcagtgtacg

SEQ ID NO: 213667 - DNA, 20 bp, Artificial Sequence
  chemically synthesized
attgatcactccgtacactg

SEQ ID NO: 213668 - DNA, 20 bp, Artificial Sequence
  chemically synthesized
attacaggcacttcagtgta

SEQ ID NO: 213669 - DNA, 20 bp, Artificial Sequence
  chemically synthesized
agtagtcattacaggcactt

SEQ ID NO: 213670 - DNA, 20 bp, Artificial Sequence
  chemically synthesized
ttataaacagtagtcattac

SEQ ID NO: 213671 - DNA, 20 bp, Artificial Sequence
  chemically synthesized
tttataaacagtagtcatta

SEQ ID NO: 213672 - DNA, 20 bp, Artificial Sequence
  chemically synthesized
agcaaaacatttataaacag

SEQ ID NO: 213673 - DNA, 20 bp, Artificial Sequence
  chemically synthesized
taaagcaaaacatttataaa

SEQ ID NO: 213674 - DNA, 20 bp, Artificial Sequence
  chemically synthesized
atagtgtgccttatttttta

SEQ ID NO: 213675 - DNA, 20 bp, Artificial Sequence
  chemically synthesized
aatgttttgctttaaaaaat

SEQ ID NO: 213676 - DNA, 20 bp, Artificial Sequence
  chemically synthesized
atgttttgctttaaaaaata

SEQ ID NO: 213677 - DNA, 20 bp, Artificial Sequence
  chemically synthesized
taaagcaaactgtttattaa

SEQ ID NO: 213678 - DNA, 20 bp, Artificial Sequence
  chemically synthesized
taaggcacactattaataaa

SEQ ID NO: 213679 - DNA, 20 bp, Artificial Sequence
  chemically synthesized
taataaacagtttgctttaa

SEQ ID NO: 213680 - DNA, 20 bp, Artificial Sequence
  chemically synthesized
aacttgcatttgttctatta

SEQ ID NO: 213681 - DNA, 20 bp, Artificial Sequence
  chemically synthesized
tgctttaatagaacaaatgc

SEQ ID NO: 213682 - DNA, 20 bp, Artificial Sequence
  chemically synthesized
caagttttcaaaatatttat

SEQ ID NO: 213683 - DNA, 20 bp, Artificial Sequence
  chemically synthesized
atctgagtcaggaagagtcg

SEQ ID NO: 213684 - DNA, 20 bp, Artificial Sequence
  chemically synthesized
aagccaatctgagtcaggaa

SEQ ID NO: 213685 - DNA, 20 bp, Artificial Sequence
  chemically synthesized
gaccacgactcttcctgact

SEQ ID NO: 213686 - DNA, 20 bp, Artificial Sequence
  chemically synthesized
tgaagccaatctgagtcagg

SEQ ID NO: 213687 - DNA, 20 bp, Artificial Sequence
  chemically synthesized
atctgaagccaatctgagtc

SEQ ID NO: 213688 - DNA, 20 bp, Artificial Sequence
  chemically synthesized
catctgaagccaatctgagt

SEQ ID NO: 213689 - DNA, 20 bp, Artificial Sequence
  chemically synthesized
cgactcttcctgactcagat

SEQ ID NO: 213690 - DNA, 20 bp, Artificial Sequence
  chemically synthesized
catacatctgaagccaatct

SEQ ID NO: 213691 - DNA, 20 bp, Artificial Sequence
  chemically synthesized
ttcctgactcagattggctt

SEQ ID NO: 213692 - DNA, 20 bp, Artificial Sequence
  chemically synthesized
cttccttatacatacatctg

SEQ ID NO: 213693 - DNA, 20 bp, Artificial Sequence
  chemically synthesized
ttggcttcagatgtatgtat

SEQ ID NO: 213694 - DNA, 20 bp, Artificial Sequence
  chemically synthesized
tggcttcagatgtatgtata

SEQ ID NO: 213695 - DNA, 20 bp, Artificial Sequence
  chemically synthesized
cttcagatgtatgtataagg

SEQ ID NO: 213696 - DNA, 20 bp, Artificial Sequence
  chemically synthesized
ttcagatgtatgtataagga

SEQ ID NO: 213697 - DNA, 20 bp, Artificial Sequence
  chemically synthesized
gcagtgtttacgaatataat

SEQ ID NO: 213698 - DNA, 20 bp, Artificial Sequence
  chemically synthesized
agcagtgtttacgaatataa

SEQ ID NO: 213699 - DNA, 20 bp, Artificial Sequence
  chemically synthesized
ttatattcgtaaacactgct

SEQ ID NO: 213700 - DNA, 20 bp, Artificial Sequence
  chemically synthesized
ttcgtaaacactgctaagtt

SEQ ID NO: 213701 - DNA, 20 bp, Artificial Sequence
  chemically synthesized
aaacaggtctctcaacttag

SEQ ID NO: 213702 - DNA, 20 bp, Artificial Sequence
  chemically synthesized
cgtaaacactgctaagttga

SEQ ID NO: 213703 - DNA, 20 bp, Artificial Sequence
  chemically synthesized
tagaaacaggtctctcaact

SEQ ID NO: 213704 - DNA, 20 bp, Artificial Sequence
  chemically synthesized
taagttgagagacctgtttc

SEQ ID NO: 213705 - DNA, 20 bp, Artificial Sequence
  chemically synthesized
atttactgggatctagaaac

SEQ ID NO: 213706 - DNA, 20 bp, Artificial Sequence
  chemically synthesized
tatttactgggatctagaaa

SEQ ID NO: 213707 - DNA, 20 bp, Artificial Sequence
  chemically synthesized
agagacctgtttctagatcc

SEQ ID NO: 213708 - DNA, 20 bp, Artificial Sequence
  chemically synthesized
cttaactatttactgggatc

SEQ ID NO: 213709 - DNA, 20 bp, Artificial Sequence
  chemically synthesized
tgtttctagatcccagtaaa

SEQ ID NO: 213710 - DNA, 20 bp, Artificial Sequence
  chemically synthesized
atttctcttaactatttact

SEQ ID NO: 213711 - DNA, 20 bp, Artificial Sequence
  chemically synthesized
aatttctcttaactatttac

SEQ ID NO: 213712 - DNA, 20 bp, Artificial Sequence
  chemically synthesized
ctagatcccagtaaatagtt

SEQ ID NO: 213713 - DNA, 20 bp, Artificial Sequence
  chemically synthesized
agatcccagtaaatagttaa

SEQ ID NO: 213714 - DNA, 20 bp, Artificial Sequence
  chemically synthesized
agaaattcacatcattgatc

SEQ ID NO: 213715 - DNA, 20 bp, Artificial Sequence
  chemically synthesized
catcattgatctggttgcat

SEQ ID NO: 213716 - DNA, 20 bp, Artificial Sequence
  chemically synthesized
ctgtgtgaaactgatgcaac

SEQ ID NO: 213717 - DNA, 20 bp, Artificial Sequence
  chemically synthesized
ctggttgcatcagtttcaca

SEQ ID NO: 213718 - DNA, 20 bp, Artificial Sequence
  chemically synthesized
ggggggaaaaaaggttatat

SEQ ID NO: 213719 - DNA, 20 bp, Artificial Sequence
  chemically synthesized
atagccactggggggaaaaa

SEQ ID NO: 213720 - DNA, 20 bp, Artificial Sequence
  chemically synthesized
aatagccactggggggaaaa

SEQ ID NO: 213721 - DNA, 20 bp, Artificial Sequence
  chemically synthesized
tatataaccttttttccccc

SEQ ID NO: 213722 - DNA, 20 bp, Artificial Sequence
  chemically synthesized
ataaccttttttccccccag

SEQ ID NO: 213723 - DNA, 20 bp, Artificial Sequence
  chemically synthesized
ctaaatgaatagccactggg

SEQ ID NO: 213724 - DNA, 20 bp, Artificial Sequence
  chemically synthesized
cctaaatgaatagccactgg

SEQ ID NO: 213725 - DNA, 20 bp, Artificial Sequence
  chemically synthesized
tcctaaatgaatagccactg

SEQ ID NO: 213726 - DNA, 20 bp, Artificial Sequence
  chemically synthesized
atcctaaatgaatagccact

SEQ ID NO: 213727 - DNA, 20 bp, Artificial Sequence
  chemically synthesized
tatcctaaatgaatagccac

SEQ ID NO: 213728 - DNA, 20 bp, Artificial Sequence
  chemically synthesized
ccccccagtggctattcatt

SEQ ID NO: 213729 - DNA, 20 bp, Artificial Sequence
  chemically synthesized
cccccagtggctattcattt

SEQ ID NO: 213730 - DNA, 20 bp, Artificial Sequence
  chemically synthesized
taaaggatatcctaaatgaa

SEQ ID NO: 213731 - DNA, 20 bp, Artificial Sequence
  chemically synthesized
tattcatttaggatatcctt

SEQ ID NO: 213732 - DNA, 20 bp, Artificial Sequence
  chemically synthesized
atcctattcttttgttctaa

SEQ ID NO: 213733 - DNA, 20 bp, Artificial Sequence
  chemically synthesized
aatcctattcttttgttcta

SEQ ID NO: 213734 - DNA, 20 bp, Artificial Sequence
  chemically synthesized
taggatatcctttagaacaa

SEQ ID NO: 213735 - DNA, 20 bp, Artificial Sequence
  chemically synthesized
tatcctttagaacaaaagaa

SEQ ID NO: 213736 - DNA, 20 bp, Artificial Sequence
  chemically synthesized
atcctttagaacaaaagaat

SEQ ID NO: 213737 - DNA, 20 bp, Artificial Sequence
  chemically synthesized
tagaacaaaagaataggatt

SEQ ID NO: 213738 - DNA, 20 bp, Artificial Sequence
  chemically synthesized
gaataggattgagtgtcatt

SEQ ID NO: 213739 - DNA, 20 bp, Artificial Sequence
  chemically synthesized
taggattgagtgtcatttag

SEQ ID NO: 213740 - DNA, 20 bp, Artificial Sequence
  chemically synthesized
attgagtgtcatttagcaga

SEQ ID NO: 213741 - DNA, 20 bp, Artificial Sequence
  chemically synthesized
gagtgtcatttagcagaaag

SEQ ID NO: 213742 - DNA, 20 bp, Artificial Sequence
  chemically synthesized
agtgtcatttagcagaaaga

SEQ ID NO: 213743 - DNA, 20 bp, Artificial Sequence
  chemically synthesized
gtgtcatttagcagaaagaa

SEQ ID NO: 213744 - DNA, 20 bp, Artificial Sequence
  chemically synthesized
gtcatttagcagaaagaagg

SEQ ID NO: 213745 - DNA, 20 bp, Artificial Sequence
  chemically synthesized
ttagcagaaagaagggagct

SEQ ID NO: 213746 - DNA, 20 bp, Artificial Sequence
  chemically synthesized
aaagaagggagctaagctga

SEQ ID NO: 213747 - DNA, 20 bp, Artificial Sequence
  chemically synthesized
aagaagggagctaagctgac

SEQ ID NO: 213748 - DNA, 20 bp, Artificial Sequence
  chemically synthesized
gaacactatgcctgtcagct

SEQ ID NO: 213749 - DNA, 20 bp, Artificial Sequence
  chemically synthesized
gggagctaagctgacaggca

SEQ ID NO: 213750 - DNA, 20 bp, Artificial Sequence
  chemically synthesized
caacagaacactatgcctgt

SEQ ID NO: 213751 - DNA, 20 bp, Artificial Sequence
  chemically synthesized
acaggcatagtgttctgttg

SEQ ID NO: 213752 - DNA, 20 bp, Artificial Sequence
  chemically synthesized
gaaaacacaaaatactgcaa

SEQ ID NO: 213753 - DNA, 20 bp, Artificial Sequence
  chemically synthesized
gtattttgtgttttcatcat

SEQ ID NO: 213754 - DNA, 20 bp, Artificial Sequence
  chemically synthesized
tttgtgttttcatcattgga

SEQ ID NO: 213755 - DNA, 20 bp, Artificial Sequence
  chemically synthesized
tcattggacagcaatgacta

SEQ ID NO: 213756 - DNA, 20 bp, Artificial Sequence
  chemically synthesized
gacagcaatgactacagaac

SEQ ID NO: 213757 - DNA, 20 bp, Artificial Sequence
  chemically synthesized
tgctgccgtggccggttctg

SEQ ID NO: 213758 - DNA, 20 bp, Artificial Sequence
  chemically synthesized
aatgactacagaaccggcca

SEQ ID NO: 213759 - DNA, 20 bp, Artificial Sequence
  chemically synthesized
gactacagaaccggccacgg

SEQ ID NO: 213760 - DNA, 20 bp, Artificial Sequence
  chemically synthesized
gaggggtttgctgccgtggc

SEQ ID NO: 213761 - DNA, 20 bp, Artificial Sequence
  chemically synthesized
ctctgaggggtttgctgccg

SEQ ID NO: 213762 - DNA, 20 bp, Artificial Sequence
  chemically synthesized
ggccacggcagcaaacccct

SEQ ID NO: 213763 - DNA, 20 bp, Artificial Sequence
  chemically synthesized
ccacggcagcaaacccctca

SEQ ID NO: 213764 - DNA, 20 bp, Artificial Sequence
  chemically synthesized
cccaagccctgaactctgag

SEQ ID NO: 213765 - DNA, 20 bp, Artificial Sequence
  chemically synthesized
tcccaagccctgaactctga

SEQ ID NO: 213766 - DNA, 20 bp, Artificial Sequence
  chemically synthesized
gcagcaaacccctcagagtt

SEQ ID NO: 213767 - DNA, 20 bp, Artificial Sequence
  chemically synthesized
ctcccaagccctgaactctg

SEQ ID NO: 213768 - DNA, 20 bp, Artificial Sequence
  chemically synthesized
cagcaaacccctcagagttc

SEQ ID NO: 213769 - DNA, 20 bp, Artificial Sequence
  chemically synthesized
actcccaagccctgaactct

SEQ ID NO: 213770 - DNA, 20 bp, Artificial Sequence
  chemically synthesized
agcaaacccctcagagttca

SEQ ID NO: 213771 - DNA, 20 bp, Artificial Sequence
  chemically synthesized
acccctcagagttcagggct

SEQ ID NO: 213772 - DNA, 20 bp, Artificial Sequence
  chemically synthesized
cccctcagagttcagggctt

SEQ ID NO: 213773 - DNA, 20 bp, Artificial Sequence
  chemically synthesized
cctcagagttcagggcttgg

SEQ ID NO: 213774 - DNA, 20 bp, Artificial Sequence
  chemically synthesized
cagagttcagggcttgggag

SEQ ID NO: 213775 - DNA, 20 bp, Artificial Sequence
  chemically synthesized
agagttcagggcttgggagt

SEQ ID NO: 213776 - DNA, 20 bp, Artificial Sequence
  chemically synthesized
gagttcagggcttgggagtg

SEQ ID NO: 213777 - DNA, 20 bp, Artificial Sequence
  chemically synthesized
catcccactcccccactccc

SEQ ID NO: 213778 - DNA, 20 bp, Artificial Sequence
  chemically synthesized
agttcagggcttgggagtgg

SEQ ID NO: 213779 - DNA, 20 bp, Artificial Sequence
  chemically synthesized
ttcagggcttgggagtgggg

SEQ ID NO: 213780 - DNA, 20 bp, Artificial Sequence
  chemically synthesized
agggcttgggagtgggggag

SEQ ID NO: 213781 - DNA, 20 bp, Artificial Sequence
  chemically synthesized
gggcttgggagtgggggagt

SEQ ID NO: 213782 - DNA, 20 bp, Artificial Sequence
  chemically synthesized
ttgggagtgggggagtggga

SEQ ID NO: 213783 - DNA, 20 bp, Artificial Sequence
  chemically synthesized
gagtgggatggacaacaact

SEQ ID NO: 213784 - DNA, 20 bp, Artificial Sequence
  chemically synthesized
agtgggatggacaacaactg

SEQ ID NO: 213785 - DNA, 20 bp, Artificial Sequence
  chemically synthesized
tgggatggacaacaactgag

SEQ ID NO: 213786 - DNA, 20 bp, Artificial Sequence
  chemically synthesized
gggatggacaacaactgagg

SEQ ID NO: 213787 - DNA, 20 bp, Artificial Sequence
  chemically synthesized
atggacaacaactgaggagg

SEQ ID NO: 213788 - DNA, 20 bp, Artificial Sequence
  chemically synthesized
gttctctgtctctgcctcct

SEQ ID NO: 213789 - DNA, 20 bp, Artificial Sequence
  chemically synthesized
ggacaacaactgaggaggca

SEQ ID NO: 213790 - DNA, 20 bp, Artificial Sequence
  chemically synthesized
aacaactgaggaggcagaga

SEQ ID NO: 213791 - DNA, 20 bp, Artificial Sequence
  chemically synthesized
caactgaggaggcagagaca

SEQ ID NO: 213792 - DNA, 20 bp, Artificial Sequence
  chemically synthesized
ggcagagacagagaactgct

SEQ ID NO: 213793 - DNA, 20 bp, Artificial Sequence
  chemically synthesized
tcttcttcctttttgctaag

SEQ ID NO: 213794 - DNA, 20 bp, Artificial Sequence
  chemically synthesized
acagagaactgcttagcaaa

SEQ ID NO: 213795 - DNA, 20 bp, Artificial Sequence
  chemically synthesized
cagagaactgcttagcaaaa

SEQ ID NO: 213796 - DNA, 20 bp, Artificial Sequence
  chemically synthesized
atttcttcttcctttttgct

SEQ ID NO: 213797 - DNA, 20 bp, Artificial Sequence
  chemically synthesized
agaactgcttagcaaaaagg

SEQ ID NO: 213798 - DNA, 20 bp, Artificial Sequence
  chemically synthesized
actgcttagcaaaaaggaag

SEQ ID NO: 213799 - DNA, 20 bp, Artificial Sequence
  chemically synthesized
taatgattatcttctctcct

SEQ ID NO: 213800 - DNA, 20 bp, Artificial Sequence
  chemically synthesized
ttgcagtagcccaaggagag

SEQ ID NO: 213801 - DNA, 20 bp, Artificial Sequence
  chemically synthesized
aatgattatcttctctcctt

SEQ ID NO: 213802 - DNA, 20 bp, Artificial Sequence
  chemically synthesized
gagttgcagtagcccaagga

SEQ ID NO: 213803 - DNA, 20 bp, Artificial Sequence
  chemically synthesized
cagagttgcagtagcccaag

SEQ ID NO: 213804 - DNA, 20 bp, Artificial Sequence
  chemically synthesized
aacagagttgcagtagccca

SEQ ID NO: 213805 - DNA, 20 bp, Artificial Sequence
  chemically synthesized
taacagagttgcagtagccc

SEQ ID NO: 213806 - DNA, 20 bp, Artificial Sequence
  chemically synthesized
ctaaattaacagagttgcag

SEQ ID NO: 213807 - DNA, 20 bp, Artificial Sequence
  chemically synthesized
tgcctaaattaacagagttg

SEQ ID NO: 213808 - DNA, 20 bp, Artificial Sequence
  chemically synthesized
aaatcatgcctaaattaaca

SEQ ID NO: 213809 - DNA, 20 bp, Artificial Sequence
  chemically synthesized
ctactgcaactctgttaatt

SEQ ID NO: 213810 - DNA, 20 bp, Artificial Sequence
  chemically synthesized
tactgcaactctgttaattt

SEQ ID NO: 213811 - DNA, 20 bp, Artificial Sequence
  chemically synthesized
aaaaatcatgcctaaattaa

SEQ ID NO: 213812 - DNA, 20 bp, Artificial Sequence
  chemically synthesized
tttccaattcaaagaatatg

SEQ ID NO: 213813 - DNA, 20 bp, Artificial Sequence
  chemically synthesized
gtactacatattctttgaat

SEQ ID NO: 213814 - DNA, 20 bp, Artificial Sequence
  chemically synthesized
aaaatatattttccaattca

SEQ ID NO: 213815 - DNA, 20 bp, Artificial Sequence
  chemically synthesized
aatatatttttgatgtattt

SEQ ID NO: 213816 - DNA, 20 bp, Artificial Sequence
  chemically synthesized
atatatttttgatgtatttc

SEQ ID NO: 213817 - DNA, 20 bp, Artificial Sequence
  chemically synthesized
atatttttgatgtatttcgg

SEQ ID NO: 213818 - DNA, 20 bp, Artificial Sequence
  chemically synthesized
tatttttgatgtatttcggg

SEQ ID NO: 213819 - DNA, 20 bp, Artificial Sequence
  chemically synthesized
taatacataatccttctgat

SEQ ID NO: 213820 - DNA, 20 bp, Artificial Sequence
  chemically synthesized
aacaaatattgcttatcaga

SEQ ID NO: 213821 - DNA, 20 bp, Artificial Sequence
  chemically synthesized
caacaaatattgcttatcag

SEQ ID NO: 213822 - DNA, 20 bp, Artificial Sequence
  chemically synthesized
gctcaacaaatattgcttat

SEQ ID NO: 213823 - DNA, 20 bp, Artificial Sequence
  chemically synthesized
tctgataagcaatatttgtt

SEQ ID NO: 213824 - DNA, 20 bp, Artificial Sequence
  chemically synthesized
agcacctgacataattagag

SEQ ID NO: 213825 - DNA, 20 bp, Artificial Sequence
  chemically synthesized
caaagcacctgacataatta

SEQ ID NO: 213826 - DNA, 20 bp, Artificial Sequence
  chemically synthesized
tttatctgctctaattatgt

SEQ ID NO: 213827 - DNA, 20 bp, Artificial Sequence
  chemically synthesized
agcaaagcacctgacataat

SEQ ID NO: 213828 - DNA, 20 bp, Artificial Sequence
  chemically synthesized
ttatctgctctaattatgtc

SEQ ID NO: 213829 - DNA, 20 bp, Artificial Sequence
  chemically synthesized
gtggttactgtgaagtagca

SEQ ID NO: 213830 - DNA, 20 bp, Artificial Sequence
  chemically synthesized
tcaggtgctttgctacttca

SEQ ID NO: 213831 - DNA, 20 bp, Artificial Sequence
  chemically synthesized
atcatgtggttactgtgaag

SEQ ID NO: 213832 - DNA, 20 bp, Artificial Sequence
  chemically synthesized
tttatcatgtggttactgtg

SEQ ID NO: 213833 - DNA, 20 bp, Artificial Sequence
  chemically synthesized
ttcacagtaaccacatgata

SEQ ID NO: 213834 - DNA, 20 bp, Artificial Sequence
  chemically synthesized
attcatagttctttatcatg

SEQ ID NO: 213835 - DNA, 20 bp, Artificial Sequence
  chemically synthesized
acatgataaagaactatgaa

SEQ ID NO: 213836 - DNA, 20 bp, Artificial Sequence
  chemically synthesized
ttctaagctagggctattca

SEQ ID NO: 213837 - DNA, 20 bp, Artificial Sequence
  chemically synthesized
taaagaactatgaatagccc

SEQ ID NO: 213838 - DNA, 20 bp, Artificial Sequence
  chemically synthesized
aactatgaatagccctagct

SEQ ID NO: 213839 - DNA, 20 bp, Artificial Sequence
  chemically synthesized
ttacttttatttctaagcta

SEQ ID NO: 213840 - DNA, 20 bp, Artificial Sequence
  chemically synthesized
tttacttttatttctaagct

SEQ ID NO: 213841 - DNA, 20 bp, Artificial Sequence
  chemically synthesized
ttttacttttatttctaagc

SEQ ID NO: 213842 - DNA, 20 bp, Artificial Sequence
  chemically synthesized
tagtttttacttttatttct

SEQ ID NO: 213843 - DNA, 20 bp, Artificial Sequence
  chemically synthesized
tagccctagcttagaaataa

SEQ ID NO: 213844 - DNA, 20 bp, Artificial Sequence
  chemically synthesized
ttagaaataaaagtaaaaac

SEQ ID NO: 213845 - DNA, 20 bp, Artificial Sequence
  chemically synthesized
agaaataaaagtaaaaacta

SEQ ID NO: 213846 - DNA, 20 bp, Artificial Sequence
  chemically synthesized
aaataaaagtaaaaactaga

SEQ ID NO: 213847 - DNA, 20 bp, Artificial Sequence
  chemically synthesized
aataaaagtaaaaactagag

SEQ ID NO: 213848 - DNA, 20 bp, Artificial Sequence
  chemically synthesized
ggtgggttgctttacctctc

SEQ ID NO: 213849 - DNA, 20 bp, Artificial Sequence
  chemically synthesized
aagtaaaaactagagaggta

SEQ ID NO: 213850 - DNA, 20 bp, Artificial Sequence
  chemically synthesized
ctatgtatatgatgttgggt

SEQ ID NO: 213851 - DNA, 20 bp, Artificial Sequence
  chemically synthesized
actatgtatatgatgttggg

SEQ ID NO: 213852 - DNA, 20 bp, Artificial Sequence
  chemically synthesized
ttcactatgtatatgatgtt

SEQ ID NO: 213853 - DNA, 20 bp, Artificial Sequence
  chemically synthesized
cttcactatgtatatgatgt

SEQ ID NO: 213854 - DNA, 20 bp, Artificial Sequence
  chemically synthesized
cccacccaacatcatataca

SEQ ID NO: 213855 - DNA, 20 bp, Artificial Sequence
  chemically synthesized
ccaacatcatatacatagtg

SEQ ID NO: 213856 - DNA, 20 bp, Artificial Sequence
  chemically synthesized
acatcatatacatagtgaag

SEQ ID NO: 213857 - DNA, 20 bp, Artificial Sequence
  chemically synthesized
atacatagtgaagaagctgc

SEQ ID NO: 213858 - DNA, 20 bp, Artificial Sequence
  chemically synthesized
tacatagtgaagaagctgcc

SEQ ID NO: 213859 - DNA, 20 bp, Artificial Sequence
  chemically synthesized
agtgaagaagctgccaggac

SEQ ID NO: 213860 - DNA, 20 bp, Artificial Sequence
  chemically synthesized
aatctggcctccagtcctgg

SEQ ID NO: 213861 - DNA, 20 bp, Artificial Sequence
  chemically synthesized
tgaagaagctgccaggactg

SEQ ID NO: 213862 - DNA, 20 bp, Artificial Sequence
  chemically synthesized
gaagaagctgccaggactgg

SEQ ID NO: 213863 - DNA, 20 bp, Artificial Sequence
  chemically synthesized
gcaaatctggcctccagtcc

SEQ ID NO: 213864 - DNA, 20 bp, Artificial Sequence
  chemically synthesized
aagctgccaggactggaggc

SEQ ID NO: 213865 - DNA, 20 bp, Artificial Sequence
  chemically synthesized
acacaggcaaatctggcctc

SEQ ID NO: 213866 - DNA, 20 bp, Artificial Sequence
  chemically synthesized
ttagaggacacaggcaaatc

SEQ ID NO: 213867 - DNA, 20 bp, Artificial Sequence
  chemically synthesized
catttagcattagaggacac

SEQ ID NO: 213868 - DNA, 20 bp, Artificial Sequence
  chemically synthesized
acatttagcattagaggaca

SEQ ID NO: 213869 - DNA, 20 bp, Artificial Sequence
  chemically synthesized
ctgtgcacatttagcattag

SEQ ID NO: 213870 - DNA, 20 bp, Artificial Sequence
  chemically synthesized
cctgtgcacatttagcatta

SEQ ID NO: 213871 - DNA, 20 bp, Artificial Sequence
  chemically synthesized
gccctgtgcacatttagcat

SEQ ID NO: 213872 - DNA, 20 bp, Artificial Sequence
  chemically synthesized
ctctaagccctgtgcacatt

SEQ ID NO: 213873 - DNA, 20 bp, Artificial Sequence
  chemically synthesized
cctctaatgctaaatgtgca

SEQ ID NO: 213874 - DNA, 20 bp, Artificial Sequence
  chemically synthesized
ctctaatgctaaatgtgcac

SEQ ID NO: 213875 - DNA, 20 bp, Artificial Sequence
  chemically synthesized
tctaatgctaaatgtgcaca

SEQ ID NO: 213876 - DNA, 20 bp, Artificial Sequence
  chemically synthesized
tgctaaatgtgcacagggct

SEQ ID NO: 213877 - DNA, 20 bp, Artificial Sequence
  chemically synthesized
ctaaatgtgcacagggctta

SEQ ID NO: 213878 - DNA, 20 bp, Artificial Sequence
  chemically synthesized
acagaattcagaacagctct

SEQ ID NO: 213879 - DNA, 20 bp, Artificial Sequence
  chemically synthesized
gggtattacagaattcagaa

SEQ ID NO: 213880 - DNA, 20 bp, Artificial Sequence
  chemically synthesized
acattgggtattacagaatt

SEQ ID NO: 213881 - DNA, 20 bp, Artificial Sequence
  chemically synthesized
aagggagacattgggtatta

SEQ ID NO: 213882 - DNA, 20 bp, Artificial Sequence
  chemically synthesized
gttctaaaaagggagacatt

SEQ ID NO: 213883 - DNA, 20 bp, Artificial Sequence
  chemically synthesized
ggttctaaaaagggagacat

SEQ ID NO: 213884 - DNA, 20 bp, Artificial Sequence
  chemically synthesized
atacccaatgtctccctttt

SEQ ID NO: 213885 - DNA, 20 bp, Artificial Sequence
  chemically synthesized
aaatgttggttctaaaaagg

SEQ ID NO: 213886 - DNA, 20 bp, Artificial Sequence
  chemically synthesized
ctaaatgttggttctaaaaa

SEQ ID NO: 213887 - DNA, 20 bp, Artificial Sequence
  chemically synthesized
actaaatgttggttctaaaa

SEQ ID NO: 213888 - DNA, 20 bp, Artificial Sequence
  chemically synthesized
tactaaatgttggttctaaa

SEQ ID NO: 213889 - DNA, 20 bp, Artificial Sequence
  chemically synthesized
ccctttttagaaccaacatt

SEQ ID NO: 213890 - DNA, 20 bp, Artificial Sequence
  chemically synthesized
atgagggtgttactaaatgt

SEQ ID NO: 213891 - DNA, 20 bp, Artificial Sequence
  chemically synthesized
catttcagggtggtaaatga

SEQ ID NO: 213892 - DNA, 20 bp, Artificial Sequence
  chemically synthesized
tcatttcagggtggtaaatg

SEQ ID NO: 213893 - DNA, 20 bp, Artificial Sequence
  chemically synthesized
ttcatttcagggtggtaaat

SEQ ID NO: 213894 - DNA, 20 bp, Artificial Sequence
  chemically synthesized
ctattcatttcatttcaggg

SEQ ID NO: 213895 - DNA, 20 bp, Artificial Sequence
  chemically synthesized
gatctattcatttcatttca

SEQ ID NO: 213896 - DNA, 20 bp, Artificial Sequence
  chemically synthesized
agatctattcatttcatttc

SEQ ID NO: 213897 - DNA, 20 bp, Artificial Sequence
  chemically synthesized
gagatctattcatttcattt

SEQ ID NO: 213898 - DNA, 20 bp, Artificial Sequence
  chemically synthesized
ccaccctgaaatgaaatgaa

SEQ ID NO: 213899 - DNA, 20 bp, Artificial Sequence
  chemically synthesized
cactgtgcagacaagtttat

SEQ ID NO: 213900 - DNA, 20 bp, Artificial Sequence
  chemically synthesized
atctcataaacttgtctgca

SEQ ID NO: 213901 - DNA, 20 bp, Artificial Sequence
  chemically synthesized
ggttagatcactgtgcagac

SEQ ID NO: 213902 - DNA, 20 bp, Artificial Sequence
  chemically synthesized
atgatggttagatcactgtg

SEQ ID NO: 213903 - DNA, 20 bp, Artificial Sequence
  chemically synthesized
tttcttttttatatgatggt

SEQ ID NO: 213904 - DNA, 20 bp, Artificial Sequence
  chemically synthesized
tttctttcttttttatatga

SEQ ID NO: 213905 - DNA, 20 bp, Artificial Sequence
  chemically synthesized
gatctaaccatcatataaaa

SEQ ID NO: 213906 - DNA, 20 bp, Artificial Sequence
  chemically synthesized
taaccatcatataaaaaaga

SEQ ID NO: 213907 - DNA, 20 bp, Artificial Sequence
  chemically synthesized
gaaaacattcacacgtttca

SEQ ID NO: 213908 - DNA, 20 bp, Artificial Sequence
  chemically synthesized
gaaacgtgtgaatgttttca

SEQ ID NO: 213909 - DNA, 20 bp, Artificial Sequence
  chemically synthesized
gaatgttttcatggccacac

SEQ ID NO: 213910 - DNA, 20 bp, Artificial Sequence
  chemically synthesized
tgttttcatggccacaccag

SEQ ID NO: 213911 - DNA, 20 bp, Artificial Sequence
  chemically synthesized
cttcaataggtcttctggtg

SEQ ID NO: 213912 - DNA, 20 bp, Artificial Sequence
  chemically synthesized
ggcatcttcaataggtcttc

SEQ ID NO: 213913 - DNA, 20 bp, Artificial Sequence
  chemically synthesized
ccacaccagaagacctattg

SEQ ID NO: 213914 - DNA, 20 bp, Artificial Sequence
  chemically synthesized
aagtgtctggcatcttcaat

SEQ ID NO: 213915 - DNA, 20 bp, Artificial Sequence
  chemically synthesized
caagtgtctggcatcttcaa

SEQ ID NO: 213916 - DNA, 20 bp, Artificial Sequence
  chemically synthesized
agaagacctattgaagatgc

SEQ ID NO: 213917 - DNA, 20 bp, Artificial Sequence
  chemically synthesized
ttaacataggcgcaagtgtc

SEQ ID NO: 213918 - DNA, 20 bp, Artificial Sequence
  chemically synthesized
gggattcttaacataggcgc

SEQ ID NO: 213919 - DNA, 20 bp, Artificial Sequence
  chemically synthesized
cagacacttgcgcctatgtt

SEQ ID NO: 213920 - DNA, 20 bp, Artificial Sequence
  chemically synthesized
ttaaaggggattcttaacat

SEQ ID NO: 213921 - DNA, 20 bp, Artificial Sequence
  chemically synthesized
attaaaggggattcttaaca

SEQ ID NO: 213922 - DNA, 20 bp, Artificial Sequence
  chemically synthesized
tgaaaaattctacattaaag

SEQ ID NO: 213923 - DNA, 20 bp, Artificial Sequence
  chemically synthesized
gttaagaatcccctttaatg

SEQ ID NO: 213924 - DNA, 20 bp, Artificial Sequence
  chemically synthesized
ttgaaaaattctacattaaa

SEQ ID NO: 213925 - DNA, 20 bp, Artificial Sequence
  chemically synthesized
tttgaaaaattctacattaa

SEQ ID NO: 213926 - DNA, 20 bp, Artificial Sequence
  chemically synthesized
atttgaaaaattctacatta

SEQ ID NO: 213927 - DNA, 20 bp, Artificial Sequence
  chemically synthesized
tttcaaatgtcccctgaata

SEQ ID NO: 213928 - DNA, 20 bp, Artificial Sequence
  chemically synthesized
tacaactcacctatattcag

SEQ ID NO: 213929 - DNA, 20 bp, Artificial Sequence
  chemically synthesized
ttcaaatgtcccctgaatat

SEQ ID NO: 213930 - DNA, 20 bp, Artificial Sequence
  chemically synthesized
atacaactcacctatattca

SEQ ID NO: 213931 - DNA, 20 bp, Artificial Sequence
  chemically synthesized
catacaactcacctatattc

SEQ ID NO: 213932 - DNA, 20 bp, Artificial Sequence
  chemically synthesized
ccatacaactcacctatatt

SEQ ID NO: 213933 - DNA, 20 bp, Artificial Sequence
  chemically synthesized
aatgtcccctgaatataggt

SEQ ID NO: 213934 - DNA, 20 bp, Artificial Sequence
  chemically synthesized
ctgaatataggtgagttgta

SEQ ID NO: 213935 - DNA, 20 bp, Artificial Sequence
  chemically synthesized
gtgagttgtatggaacactc

SEQ ID NO: 213936 - DNA, 20 bp, Artificial Sequence
  chemically synthesized
ccttgcgactcatggtactt

SEQ ID NO: 213937 - DNA, 20 bp, Artificial Sequence
  chemically synthesized
atggaacactcaagtaccat

SEQ ID NO: 213938 - DNA, 20 bp, Artificial Sequence
  chemically synthesized
cttaatagccttgcgactca

SEQ ID NO: 213939 - DNA, 20 bp, Artificial Sequence
  chemically synthesized
actcaagtaccatgagtcgc

SEQ ID NO: 213940 - DNA, 20 bp, Artificial Sequence
  chemically synthesized
ctcaagtaccatgagtcgca

SEQ ID NO: 213941 - DNA, 20 bp, Artificial Sequence
  chemically synthesized
ccatgagtcgcaaggctatt

SEQ ID NO: 213942 - DNA, 20 bp, Artificial Sequence
  chemically synthesized
agcagaaaactaggacttaa

SEQ ID NO: 213943 - DNA, 20 bp, Artificial Sequence
  chemically synthesized
gtcgcaaggctattaagtcc

SEQ ID NO: 213944 - DNA, 20 bp, Artificial Sequence
  chemically synthesized
cttttccatagcagaaaact

SEQ ID NO: 213945 - DNA, 20 bp, Artificial Sequence
  chemically synthesized
tcttttccatagcagaaaac

SEQ ID NO: 213946 - DNA, 20 bp, Artificial Sequence
  chemically synthesized
taagtcctagttttctgcta

SEQ ID NO: 213947 - DNA, 20 bp, Artificial Sequence
  chemically synthesized
ctaggagctcttttccatag

SEQ ID NO: 213948 - DNA, 20 bp, Artificial Sequence
  chemically synthesized
cctagttttctgctatggaa

SEQ ID NO: 213949 - DNA, 20 bp, Artificial Sequence
  chemically synthesized
tagttttctgctatggaaaa

SEQ ID NO: 213950 - DNA, 20 bp, Artificial Sequence
  chemically synthesized
ttcctaggagctcttttcca

SEQ ID NO: 213951 - DNA, 20 bp, Artificial Sequence
  chemically synthesized
ctgctatggaaaagagctcc

SEQ ID NO: 213952 - DNA, 20 bp, Artificial Sequence
  chemically synthesized
tgctatggaaaagagctcct

SEQ ID NO: 213953 - DNA, 20 bp, Artificial Sequence
  chemically synthesized
aatttctagaagtttcctag

SEQ ID NO: 213954 - DNA, 20 bp, Artificial Sequence
  chemically synthesized
acaatttctagaagtttcct

SEQ ID NO: 213955 - DNA, 20 bp, Artificial Sequence
  chemically synthesized
aacaatttctagaagtttcc

SEQ ID NO: 213956 - DNA, 20 bp, Artificial Sequence
  chemically synthesized
aagagctcctaggaaacttc

SEQ ID NO: 213957 - DNA, 20 bp, Artificial Sequence
  chemically synthesized
aattatagaacaatttctag

SEQ ID NO: 213958 - DNA, 20 bp, Artificial Sequence
  chemically synthesized
agcaattatagaacaatttc

SEQ ID NO: 213959 - DNA, 20 bp, Artificial Sequence
  chemically synthesized
tttcaagaatgcagcaatta

SEQ ID NO: 213960 - DNA, 20 bp, Artificial Sequence
  chemically synthesized
tgctgaatttttcaagaatg

SEQ ID NO: 213961 - DNA, 20 bp, Artificial Sequence
  chemically synthesized
tgatagttgctgaatttttc

SEQ ID NO: 213962 - DNA, 20 bp, Artificial Sequence
  chemically synthesized
tgctgcattcttgaaaaatt

SEQ ID NO: 213963 - DNA, 20 bp, Artificial Sequence
  chemically synthesized
gagaggaaatgcagttttga

SEQ ID NO: 213964 - DNA, 20 bp, Artificial Sequence
  chemically synthesized
gggagacaggagaggaaatg

SEQ ID NO: 213965 - DNA, 20 bp, Artificial Sequence
  chemically synthesized
ctggagcagggagacaggag

SEQ ID NO: 213966 - DNA, 20 bp, Artificial Sequence
  chemically synthesized
actggagcagggagacagga

SEQ ID NO: 213967 - DNA, 20 bp, Artificial Sequence
  chemically synthesized
ttactggagcagggagacag

SEQ ID NO: 213968 - DNA, 20 bp, Artificial Sequence
  chemically synthesized
ttttactggagcagggagac

SEQ ID NO: 213969 - DNA, 20 bp, Artificial Sequence
  chemically synthesized
tttttactggagcagggaga

SEQ ID NO: 213970 - DNA, 20 bp, Artificial Sequence
  chemically synthesized
cctctcctgtctccctgctc

SEQ ID NO: 213971 - DNA, 20 bp, Artificial Sequence
  chemically synthesized
atgttttttactggagcagg

SEQ ID NO: 213972 - DNA, 20 bp, Artificial Sequence
  chemically synthesized
ggatgttttttactggagca

SEQ ID NO: 213973 - DNA, 20 bp, Artificial Sequence
  chemically synthesized
tggatgttttttactggagc

SEQ ID NO: 213974 - DNA, 20 bp, Artificial Sequence
  chemically synthesized
gtggatgttttttactggag

SEQ ID NO: 213975 - DNA, 20 bp, Artificial Sequence
  chemically synthesized
tgtgtggatgttttttactg

SEQ ID NO: 213976 - DNA, 20 bp, Artificial Sequence
  chemically synthesized
tttgtgtggatgttttttac

SEQ ID NO: 213977 - DNA, 20 bp, Artificial Sequence
  chemically synthesized
aacacaaagcgtgttttgtg

SEQ ID NO: 213978 - DNA, 20 bp, Artificial Sequence
  chemically synthesized
ccatttaacatataaacaca

SEQ ID NO: 213979 - DNA, 20 bp, Artificial Sequence
  chemically synthesized
ctttgtgtttatatgttaaa

SEQ ID NO: 213980 - DNA, 20 bp, Artificial Sequence
  chemically synthesized
tgttaaatggatttacattc

SEQ ID NO: 213981 - DNA, 20 bp, Artificial Sequence
  chemically synthesized
gttaaatggatttacattct

SEQ ID NO: 213982 - DNA, 20 bp, Artificial Sequence
  chemically synthesized
ttaaatggatttacattcta

SEQ ID NO: 213983 - DNA, 20 bp, Artificial Sequence
  chemically synthesized
taaatggatttacattctag

SEQ ID NO: 213984 - DNA, 20 bp, Artificial Sequence
  chemically synthesized
tgtttatagttaatttcccc

SEQ ID NO: 213985 - DNA, 20 bp, Artificial Sequence
  chemically synthesized
aggggaaattaactataaac

SEQ ID NO: 213986 - DNA, 20 bp, Artificial Sequence
  chemically synthesized
ggggaaattaactataaaca

SEQ ID NO: 213987 - DNA, 20 bp, Artificial Sequence
  chemically synthesized
atagaggaaaaccttgttta

SEQ ID NO: 213988 - DNA, 20 bp, Artificial Sequence
  chemically synthesized
acccctgcacattcaaatag

SEQ ID NO: 213989 - DNA, 20 bp, Artificial Sequence
  chemically synthesized
tacccctgcacattcaaata

SEQ ID NO: 213990 - DNA, 20 bp, Artificial Sequence
  chemically synthesized
catacccctgcacattcaaa

SEQ ID NO: 213991 - DNA, 20 bp, Artificial Sequence
  chemically synthesized
ttttcctctatttgaatgtg

SEQ ID NO: 213992 - DNA, 20 bp, Artificial Sequence
  chemically synthesized
tttcctctatttgaatgtgc

SEQ ID NO: 213993 - DNA, 20 bp, Artificial Sequence
  chemically synthesized
ttcctctatttgaatgtgca

SEQ ID NO: 213994 - DNA, 20 bp, Artificial Sequence
  chemically synthesized
tcctctatttgaatgtgcag

SEQ ID NO: 213995 - DNA, 20 bp, Artificial Sequence
  chemically synthesized
atttgaatgtgcaggggtat

SEQ ID NO: 213996 - DNA, 20 bp, Artificial Sequence
  chemically synthesized
tttgaatgtgcaggggtatg

SEQ ID NO: 213997 - DNA, 20 bp, Artificial Sequence
  chemically synthesized
gactcttcatgatgcgtaaa

SEQ ID NO: 213998 - DNA, 20 bp, Artificial Sequence
  chemically synthesized
aacactgtttacgcatcatg

SEQ ID NO: 213999 - DNA, 20 bp, Artificial Sequence
  chemically synthesized
cactgtttacgcatcatgaa

SEQ ID NO: 214000 - DNA, 20 bp, Artificial Sequence
  chemically synthesized
tttacgcatcatgaagagtc

SEQ ID NO: 214001 - DNA, 20 bp, Artificial Sequence
  chemically synthesized
aacgtgtgttggtaagcgac

SEQ ID NO: 214002 - DNA, 20 bp, Artificial Sequence
  chemically synthesized
tggcactaacgtgtgttggt

SEQ ID NO: 214003 - DNA, 20 bp, Artificial Sequence
  chemically synthesized
ctgctggcactaacgtgtgt

SEQ ID NO: 214004 - DNA, 20 bp, Artificial Sequence
  chemically synthesized
agtcgcttaccaacacacgt

SEQ ID NO: 214005 - DNA, 20 bp, Artificial Sequence
  chemically synthesized
ttaccaacacacgttagtgc

SEQ ID NO: 214006 - DNA, 20 bp, Artificial Sequence
  chemically synthesized
ccaacacacgttagtgccag

SEQ ID NO: 214007 - DNA, 20 bp, Artificial Sequence
  chemically synthesized
tgatgaaaggtggacactgc

SEQ ID NO: 214008 - DNA, 20 bp, Artificial Sequence
  chemically synthesized
ttggttgttatgatgaaagg

SEQ ID NO: 214009 - DNA, 20 bp, Artificial Sequence
  chemically synthesized
tttttggttgttatgatgaa

SEQ ID NO: 214010 - DNA, 20 bp, Artificial Sequence
  chemically synthesized
atttttggttgttatgatga

SEQ ID NO: 214011 - DNA, 20 bp, Artificial Sequence
  chemically synthesized
ttgaacaagggaggcatttt

SEQ ID NO: 214012 - DNA, 20 bp, Artificial Sequence
  chemically synthesized
ctctctgaattgaacaaggg

SEQ ID NO: 214013 - DNA, 20 bp, Artificial Sequence
  chemically synthesized
tctctctgaattgaacaagg

SEQ ID NO: 214014 - DNA, 20 bp, Artificial Sequence
  chemically synthesized
ggtctctctgaattgaacaa

SEQ ID NO: 214015 - DNA, 20 bp, Artificial Sequence
  chemically synthesized
tggtctctctgaattgaaca

SEQ ID NO: 214016 - DNA, 20 bp, Artificial Sequence
  chemically synthesized
atggtctctctgaattgaac

SEQ ID NO: 214017 - DNA, 20 bp, Artificial Sequence
  chemically synthesized
aatgcctcccttgttcaatt

SEQ ID NO: 214018 - DNA, 20 bp, Artificial Sequence
  chemically synthesized
tgcctcccttgttcaattca

SEQ ID NO: 214019 - DNA, 20 bp, Artificial Sequence
  chemically synthesized
cctcccttgttcaattcaga

SEQ ID NO: 214020 - DNA, 20 bp, Artificial Sequence
  chemically synthesized
aattcagagagaccatattc

SEQ ID NO: 214021 - DNA, 20 bp, Artificial Sequence
  chemically synthesized
tttctgtttctgctggaata

SEQ ID NO: 214022 - DNA, 20 bp, Artificial Sequence
  chemically synthesized
tcagagagaccatattccag

SEQ ID NO: 214023 - DNA, 20 bp, Artificial Sequence
  chemically synthesized
agaccatattccagcagaaa

SEQ ID NO: 214024 - DNA, 20 bp, Artificial Sequence
  chemically synthesized
tgaggcatttctgtttctgc

SEQ ID NO: 214025 - DNA, 20 bp, Artificial Sequence
  chemically synthesized
cagcagaaacagaaatgcct

SEQ ID NO: 214026 - DNA, 20 bp, Artificial Sequence
  chemically synthesized
agcagaaacagaaatgcctc

SEQ ID NO: 214027 - DNA, 20 bp, Artificial Sequence
  chemically synthesized
gaaacagaaatgcctcaggt

SEQ ID NO: 214028 - DNA, 20 bp, Artificial Sequence
  chemically synthesized
aatgttacaattcttacctg

SEQ ID NO: 214029 - DNA, 20 bp, Artificial Sequence
  chemically synthesized
taatgttacaattcttacct

SEQ ID NO: 214030 - DNA, 20 bp, Artificial Sequence
  chemically synthesized
caggtaagaattgtaacatt

SEQ ID NO: 214031 - DNA, 20 bp, Artificial Sequence
  chemically synthesized
ggtaagaattgtaacattaa

SEQ ID NO: 214032 - DNA, 20 bp, Artificial Sequence
  chemically synthesized
acattaagagaacatatgca

SEQ ID NO: 214033 - DNA, 20 bp, Artificial Sequence
  chemically synthesized
gagaacatatgcaaagatct

SEQ ID NO: 214034 - DNA, 20 bp, Artificial Sequence
  chemically synthesized
catatgcaaagatctcagtg

SEQ ID NO: 214035 - DNA, 20 bp, Artificial Sequence
  chemically synthesized
gagtgcaaaagtactgcact

SEQ ID NO: 214036 - DNA, 20 bp, Artificial Sequence
  chemically synthesized
ttagtgcttgttgagtgcaa

SEQ ID NO: 214037 - DNA, 20 bp, Artificial Sequence
  chemically synthesized
gcagtacttttgcactcaac

SEQ ID NO: 214038 - DNA, 20 bp, Artificial Sequence
  chemically synthesized
ccatttatttagtgcttgtt

SEQ ID NO: 214039 - DNA, 20 bp, Artificial Sequence
  chemically synthesized
ctcaacaagcactaaataaa

SEQ ID NO: 214040 - DNA, 20 bp, Artificial Sequence
  chemically synthesized
actaatagctaccatttatt

SEQ ID NO: 214041 - DNA, 20 bp, Artificial Sequence
  chemically synthesized
aacaagcactaaataaatgg

SEQ ID NO: 214042 - DNA, 20 bp, Artificial Sequence
  chemically synthesized
actaaataaatggtagctat

SEQ ID NO: 214043 - DNA, 20 bp, Artificial Sequence
  chemically synthesized
gaattgtcattattcactaa

SEQ ID NO: 214044 - DNA, 20 bp, Artificial Sequence
  chemically synthesized
agagcaattctgtataaata

SEQ ID NO: 214045 - DNA, 20 bp, Artificial Sequence
  chemically synthesized
atgacaattctatatttata

SEQ ID NO: 214046 - DNA, 20 bp, Artificial Sequence
  chemically synthesized
tatacagaattgctcttaca

SEQ ID NO: 214047 - DNA, 20 bp, Artificial Sequence
  chemically synthesized
tgttaatataagctttgtaa

SEQ ID NO: 214048 - DNA, 20 bp, Artificial Sequence
  chemically synthesized
gctgttaatataagctttgt

SEQ ID NO: 214049 - DNA, 20 bp, Artificial Sequence
  chemically synthesized
tcttacaaagcttatattaa

SEQ ID NO: 214050 - DNA, 20 bp, Artificial Sequence
  chemically synthesized
tctgtttaagctgttaatat

SEQ ID NO: 214051 - DNA, 20 bp, Artificial Sequence
  chemically synthesized
gcttatattaacagcttaaa

SEQ ID NO: 214052 - DNA, 20 bp, Artificial Sequence
  chemically synthesized
aaatgttacaatttctgttt

SEQ ID NO: 214053 - DNA, 20 bp, Artificial Sequence
  chemically synthesized
aacagaaattgtaacattta

SEQ ID NO: 214054 - DNA, 20 bp, Artificial Sequence
  chemically synthesized
cacatagctttattcatttt

SEQ ID NO: 214055 - DNA, 20 bp, Artificial Sequence
  chemically synthesized
tttatagcttaaaatgaata

SEQ ID NO: 214056 - DNA, 20 bp, Artificial Sequence
  chemically synthesized
atcatttaatgtatcacaca

SEQ ID NO: 214057 - DNA, 20 bp, Artificial Sequence
  chemically synthesized
atttaaattttaaaaactgt

SEQ ID NO: 214058 - DNA, 20 bp, Artificial Sequence
  chemically synthesized
gttttccacattaattctta

SEQ ID NO: 214059 - DNA, 20 bp, Artificial Sequence
  chemically synthesized
aaaaactgtaagaattaatg

SEQ ID NO: 214060 - DNA, 20 bp, Artificial Sequence
  chemically synthesized
taagaattaatgtggaaaac

SEQ ID NO: 214061 - DNA, 20 bp, Artificial Sequence
  chemically synthesized
gaaataactcaaattaaaac

SEQ ID NO: 214062 - DNA, 20 bp, Artificial Sequence
  chemically synthesized
tggaaaactggttttaattt

SEQ ID NO: 214063 - DNA, 20 bp, Artificial Sequence
  chemically synthesized
gggcaataaaatgtgtataa

SEQ ID NO: 214064 - DNA, 20 bp, Artificial Sequence
  chemically synthesized
atgggcaataaaatgtgtat

SEQ ID NO: 214065 - DNA, 20 bp, Artificial Sequence
  chemically synthesized
acattttattgcccatatga

SEQ ID NO: 214066 - DNA, 20 bp, Artificial Sequence
  chemically synthesized
aaagtctacctctatcatat

SEQ ID NO: 214067 - DNA, 20 bp, Artificial Sequence
  chemically synthesized
attttattgcccatatgata

SEQ ID NO: 214068 - DNA, 20 bp, Artificial Sequence
  chemically synthesized
gaaagtctacctctatcata

SEQ ID NO: 214069 - DNA, 20 bp, Artificial Sequence
  chemically synthesized
ttttattgcccatatgatag

SEQ ID NO: 214070 - DNA, 20 bp, Artificial Sequence
  chemically synthesized
tattgcccatatgatagagg

SEQ ID NO: 214071 - DNA, 20 bp, Artificial Sequence
  chemically synthesized
aatatgattgttttagaaga

SEQ ID NO: 214072 - DNA, 20 bp, Artificial Sequence
  chemically synthesized
cattaatatgattgttttag

SEQ ID NO: 214073 - DNA, 20 bp, Artificial Sequence
  chemically synthesized
aatcattaatatgattgttt

SEQ ID NO: 214074 - DNA, 20 bp, Artificial Sequence
  chemically synthesized
aatgatttaaacaaaaacgt

SEQ ID NO: 214075 - DNA, 20 bp, Artificial Sequence
  chemically synthesized
gagatcaggtgattattatg

SEQ ID NO: 214076 - DNA, 20 bp, Artificial Sequence
  chemically synthesized
cagttaaatttgaagagatc

SEQ ID NO: 214077 - DNA, 20 bp, Artificial Sequence
  chemically synthesized
acagttaaatttgaagagat

SEQ ID NO: 214078 - DNA, 20 bp, Artificial Sequence
  chemically synthesized
gtgtgacagttaaatttgaa

SEQ ID NO: 214079 - DNA, 20 bp, Artificial Sequence
  chemically synthesized
ttgtgtgacagttaaatttg

SEQ ID NO: 214080 - DNA, 20 bp, Artificial Sequence
  chemically synthesized
tcaaatttaactgtcacaca

SEQ ID NO: 214081 - DNA, 20 bp, Artificial Sequence
  chemically synthesized
aggaactgagctttgtgtga

SEQ ID NO: 214082 - DNA, 20 bp, Artificial Sequence
  chemically synthesized
tttaactgtcacacaaagct

SEQ ID NO: 214083 - DNA, 20 bp, Artificial Sequence
  chemically synthesized
tatagccatgaaaaggaact

SEQ ID NO: 214084 - DNA, 20 bp, Artificial Sequence
  chemically synthesized
caaagctcagttccttttca

SEQ ID NO: 214085 - DNA, 20 bp, Artificial Sequence
  chemically synthesized
tgtaatttatagccatgaaa

SEQ ID NO: 214086 - DNA, 20 bp, Artificial Sequence
  chemically synthesized
atgtaatttatagccatgaa

SEQ ID NO: 214087 - DNA, 20 bp, Artificial Sequence
  chemically synthesized
aagttctgaaatgtaattta

SEQ ID NO: 214088 - DNA, 20 bp, Artificial Sequence
  chemically synthesized
catggctataaattacattt

SEQ ID NO: 214089 - DNA, 20 bp, Artificial Sequence
  chemically synthesized
attagcagtataaagacaca

SEQ ID NO: 214090 - DNA, 20 bp, Artificial Sequence
  chemically synthesized
tatgacttattagcagtata

SEQ ID NO: 214091 - DNA, 20 bp, Artificial Sequence
  chemically synthesized
tgtgtctttatactgctaat

SEQ ID NO: 214092 - DNA, 20 bp, Artificial Sequence
  chemically synthesized
tatcaaatatgacttattag

SEQ ID NO: 214093 - DNA, 20 bp, Artificial Sequence
  chemically synthesized
gattatcaaatatgacttat

SEQ ID NO: 214094 - DNA, 20 bp, Artificial Sequence
  chemically synthesized
ataagtcatatttgataatc

SEQ ID NO: 214095 - DNA, 20 bp, Artificial Sequence
  chemically synthesized
acgatccttttattatatgc

SEQ ID NO: 214096 - DNA, 20 bp, Artificial Sequence
  chemically synthesized
gataatccagcatataataa

SEQ ID NO: 214097 - DNA, 20 bp, Artificial Sequence
  chemically synthesized
ataatccagcatataataaa

SEQ ID NO: 214098 - DNA, 20 bp, Artificial Sequence
  chemically synthesized
tcgtgtacaacattaattac

SEQ ID NO: 214099 - DNA, 20 bp, Artificial Sequence
  chemically synthesized
cgtgtacaacattaattaca

SEQ ID NO: 214100 - DNA, 20 bp, Artificial Sequence
  chemically synthesized
tacaacattaattacaaggt

SEQ ID NO: 214101 - DNA, 20 bp, Artificial Sequence
  chemically synthesized
acattaattacaaggtcagt

SEQ ID NO: 214102 - DNA, 20 bp, Artificial Sequence
  chemically synthesized
aggtcagttagatgtcaatg

SEQ ID NO: 214103 - DNA, 20 bp, Artificial Sequence
  chemically synthesized
caatgtagaaactcattgaa

SEQ ID NO: 214104 - DNA, 20 bp, Artificial Sequence
  chemically synthesized
ccacaaaaatactattcaat

SEQ ID NO: 214105 - DNA, 20 bp, Artificial Sequence
  chemically synthesized
ctcattgaatagtatttttg

SEQ ID NO: 214106 - DNA, 20 bp, Artificial Sequence
  chemically synthesized
attgaatagtatttttgtgg

SEQ ID NO: 214107 - DNA, 20 bp, Artificial Sequence
  chemically synthesized
gaatagtatttttgtggaag

SEQ ID NO: 214108 - DNA, 20 bp, Artificial Sequence
  chemically synthesized
agtatttttgtggaagtagc

SEQ ID NO: 214109 - DNA, 20 bp, Artificial Sequence
  chemically synthesized
agtttaaacataatagagtc

SEQ ID NO: 214110 - DNA, 20 bp, Artificial Sequence
  chemically synthesized
ggtgaagtttaaacataata

SEQ ID NO: 214111 - DNA, 20 bp, Artificial Sequence
  chemically synthesized
atggtgaagtttaaacataa

SEQ ID NO: 214112 - DNA, 20 bp, Artificial Sequence
  chemically synthesized
acaaattattcattatggtg

SEQ ID NO: 214113 - DNA, 20 bp, Artificial Sequence
  chemically synthesized
ctgatacaaattattcatta

SEQ ID NO: 214114 - DNA, 20 bp, Artificial Sequence
  chemically synthesized
ccataatgaataatttgtat

SEQ ID NO: 214115 - DNA, 20 bp, Artificial Sequence
  chemically synthesized
ttgtatcagacttaattcac

SEQ ID NO: 214116 - DNA, 20 bp, Artificial Sequence
  chemically synthesized
tcacttttctctcgtgaatt

SEQ ID NO: 214117 - DNA, 20 bp, Artificial Sequence
  chemically synthesized
gtatcagacttaattcacga

SEQ ID NO: 214118 - DNA, 20 bp, Artificial Sequence
  chemically synthesized
agacttaattcacgagagaa

SEQ ID NO: 214119 - DNA, 20 bp, Artificial Sequence
  chemically synthesized
aattcacgagagaaaagtga

SEQ ID NO: 214120 - DNA, 20 bp, Artificial Sequence
  chemically synthesized
agagaaaagtgaaagttctg

SEQ ID NO: 214121 - DNA, 20 bp, Artificial Sequence
  chemically synthesized
aaagtgaaagttctgcggca

SEQ ID NO: 214122 - DNA, 20 bp, Artificial Sequence
  chemically synthesized
gagaaaaagccactttgccg

SEQ ID NO: 214123 - DNA, 20 bp, Artificial Sequence
  chemically synthesized
gtgaaagttctgcggcaaag

SEQ ID NO: 214124 - DNA, 20 bp, Artificial Sequence
  chemically synthesized
taacattatttcgggagaaa

SEQ ID NO: 214125 - DNA, 20 bp, Artificial Sequence
  chemically synthesized
aattattaacattatttcgg

SEQ ID NO: 214126 - DNA, 20 bp, Artificial Sequence
  chemically synthesized
tcaattattaacattatttc

SEQ ID NO: 214127 - DNA, 20 bp, Artificial Sequence
  chemically synthesized
ttcaattattaacattattt

SEQ ID NO: 214128 - DNA, 20 bp, Artificial Sequence
  chemically synthesized
cgaaataatgttaataattg

SEQ ID NO: 214129 - DNA, 20 bp, Artificial Sequence
  chemically synthesized
gaaataatgttaataattga

SEQ ID NO: 214130 - DNA, 20 bp, Artificial Sequence
  chemically synthesized
tttgcaggaaaaaattttga

SEQ ID NO: 214131 - DNA, 20 bp, Artificial Sequence
  chemically synthesized
taatcacatctgaaatttgc

SEQ ID NO: 214132 - DNA, 20 bp, Artificial Sequence
  chemically synthesized
aaattttttcctgcaaattt

SEQ ID NO: 214133 - DNA, 20 bp, Artificial Sequence
  chemically synthesized
ttaatcacatctgaaatttg

SEQ ID NO: 214134 - DNA, 20 bp, Artificial Sequence
  chemically synthesized
tgcaaatttcagatgtgatt

SEQ ID NO: 214135 - DNA, 20 bp, Artificial Sequence
  chemically synthesized
gattaagtgttgactttata

SEQ ID NO: 214136 - DNA, 20 bp, Artificial Sequence
  chemically synthesized
attaagtgttgactttataa

SEQ ID NO: 214137 - DNA, 20 bp, Artificial Sequence
  chemically synthesized
tgacgtttccagcctttata

SEQ ID NO: 214138 - DNA, 20 bp, Artificial Sequence
  chemically synthesized
agtgttgactttataaaggc

SEQ ID NO: 214139 - DNA, 20 bp, Artificial Sequence
  chemically synthesized
tttaaagtgtttgacgtttc

SEQ ID NO: 214140 - DNA, 20 bp, Artificial Sequence
  chemically synthesized
tggaaacgtcaaacacttta

SEQ ID NO: 214141 - DNA, 20 bp, Artificial Sequence
  chemically synthesized
gaaaacacaattttacttta

SEQ ID NO: 214142 - DNA, 20 bp, Artificial Sequence
  chemically synthesized
atgtttttcatcattaaatt

SEQ ID NO: 214143 - DNA, 20 bp, Artificial Sequence
  chemically synthesized
ttagatctattagacagcat

SEQ ID NO: 214144 - DNA, 20 bp, Artificial Sequence
  chemically synthesized
aacatacttatgctgtctaa

SEQ ID NO: 214145 - DNA, 20 bp, Artificial Sequence
  chemically synthesized
tcttggttagatctattaga

SEQ ID NO: 214146 - DNA, 20 bp, Artificial Sequence
  chemically synthesized
aaattcttggttagatctat

SEQ ID NO: 214147 - DNA, 20 bp, Artificial Sequence
  chemically synthesized
gctgtctaatagatctaacc

SEQ ID NO: 214148 - DNA, 20 bp, Artificial Sequence
  chemically synthesized
atgaatcagaaattcttggt

SEQ ID NO: 214149 - DNA, 20 bp, Artificial Sequence
  chemically synthesized
tcaaatgaatcagaaattct

SEQ ID NO: 214150 - DNA, 20 bp, Artificial Sequence
  chemically synthesized
ggtagaccaatcaaatgaat

SEQ ID NO: 214151 - DNA, 20 bp, Artificial Sequence
  chemically synthesized
gaatttctgattcatttgat

SEQ ID NO: 214152 - DNA, 20 bp, Artificial Sequence
  chemically synthesized
attcatttgattggtctacc

SEQ ID NO: 214153 - DNA, 20 bp, Artificial Sequence
  chemically synthesized
taattttattattttccagg

SEQ ID NO: 214154 - DNA, 20 bp, Artificial Sequence
  chemically synthesized
tattaattttattattttcc

SEQ ID NO: 214155 - DNA, 20 bp, Artificial Sequence
  chemically synthesized
ttattaattttattattttc

SEQ ID NO: 214156 - DNA, 20 bp, Artificial Sequence
  chemically synthesized
ggaaaataataaaattaata

SEQ ID NO: 214157 - DNA, 20 bp, Artificial Sequence
  chemically synthesized
gaaaataataaaattaataa

SEQ ID NO: 214158 - DNA, 20 bp, Artificial Sequence
  chemically synthesized
aaataataaaattaataaag

SEQ ID NO: 214159 - DNA, 20 bp, Artificial Sequence
  chemically synthesized
ataataaaattaataaagga

SEQ ID NO: 214160 - DNA, 20 bp, Artificial Sequence
  chemically synthesized
agtataaaatgcatattctg

SEQ ID NO: 214161 - DNA, 20 bp, Artificial Sequence
  chemically synthesized
gacacatcatttatgtacta

SEQ ID NO: 214162 - DNA, 20 bp, Artificial Sequence
  chemically synthesized
tatttcagttgacattttaa

SEQ ID NO: 214163 - DNA, 20 bp, Artificial Sequence
  chemically synthesized
cattttaaaaaatattattt

SEQ ID NO: 214164 - DNA, 20 bp, Artificial Sequence
  chemically synthesized
aaataatattttttaaaatg

SEQ ID NO: 214165 - DNA, 20 bp, Artificial Sequence
  chemically synthesized
cactaaaaatcatttttaaa

SEQ ID NO: 214166 - DNA, 20 bp, Artificial Sequence
  chemically synthesized
agccatttaaaaatgatttt

SEQ ID NO: 214167 - DNA, 20 bp, Artificial Sequence
  chemically synthesized
aaatgatttttagtgtaaat

SEQ ID NO: 214168 - DNA, 20 bp, Artificial Sequence
  chemically synthesized
ttttagtgtaaataagatgc

SEQ ID NO: 214169 - DNA, 20 bp, Artificial Sequence
  chemically synthesized
tagtgtaaataagatgccag

SEQ ID NO: 214170 - DNA, 20 bp, Artificial Sequence
  chemically synthesized
gtaaataagatgccagaaga

SEQ ID NO: 214171 - DNA, 20 bp, Artificial Sequence
  chemically synthesized
ttttatacctgtccatcttc

SEQ ID NO: 214172 - DNA, 20 bp, Artificial Sequence
  chemically synthesized
ataagatgccagaagatgga

SEQ ID NO: 214173 - DNA, 20 bp, Artificial Sequence
  chemically synthesized
taagatgccagaagatggac

SEQ ID NO: 214174 - DNA, 20 bp, Artificial Sequence
  chemically synthesized
gaaattatggttatgggtag

SEQ ID NO: 214175 - DNA, 20 bp, Artificial Sequence
  chemically synthesized
tgaaattatggttatgggta

SEQ ID NO: 214176 - DNA, 20 bp, Artificial Sequence
  chemically synthesized
tatgaaattatggttatggg

SEQ ID NO: 214177 - DNA, 20 bp, Artificial Sequence
  chemically synthesized
tactatgaaattatggttat

SEQ ID NO: 214178 - DNA, 20 bp, Artificial Sequence
  chemically synthesized
ctactatgaaattatggtta

SEQ ID NO: 214179 - DNA, 20 bp, Artificial Sequence
  chemically synthesized
cattaactactatgaaatta

SEQ ID NO: 214180 - DNA, 20 bp, Artificial Sequence
  chemically synthesized
tacccataaccataatttca

SEQ ID NO: 214181 - DNA, 20 bp, Artificial Sequence
  chemically synthesized
ccataaccataatttcatag

SEQ ID NO: 214182 - DNA, 20 bp, Artificial Sequence
  chemically synthesized
ataatttcatagtagttaat

SEQ ID NO: 214183 - DNA, 20 bp, Artificial Sequence
  chemically synthesized
gtagttaatgagctcaactc

SEQ ID NO: 214184 - DNA, 20 bp, Artificial Sequence
  chemically synthesized
ttctatccttttcttgagtt

SEQ ID NO: 214185 - DNA, 20 bp, Artificial Sequence
  chemically synthesized
taatgagctcaactcaagaa

SEQ ID NO: 214186 - DNA, 20 bp, Artificial Sequence
  chemically synthesized
aatgagctcaactcaagaaa

SEQ ID NO: 214187 - DNA, 20 bp, Artificial Sequence
  chemically synthesized
tagacttctatccttttctt

SEQ ID NO: 214188 - DNA, 20 bp, Artificial Sequence
  chemically synthesized
agctcaactcaagaaaagga

SEQ ID NO: 214189 - DNA, 20 bp, Artificial Sequence
  chemically synthesized
tcaactcaagaaaaggatag

SEQ ID NO: 214190 - DNA, 20 bp, Artificial Sequence
  chemically synthesized
tcaagaaaaggatagaagtc

SEQ ID NO: 214191 - DNA, 20 bp, Artificial Sequence
  chemically synthesized
gaaaaggatagaagtctagt

SEQ ID NO: 214192 - DNA, 20 bp, Artificial Sequence
  chemically synthesized
aaaaggatagaagtctagtc

SEQ ID NO: 214193 - DNA, 20 bp, Artificial Sequence
  chemically synthesized
tgcattacccttttcctgac

SEQ ID NO: 214194 - DNA, 20 bp, Artificial Sequence
  chemically synthesized
gatagaagtctagtcaggaa

SEQ ID NO: 214195 - DNA, 20 bp, Artificial Sequence
  chemically synthesized
atagaagtctagtcaggaaa

SEQ ID NO: 214196 - DNA, 20 bp, Artificial Sequence
  chemically synthesized
tagaagtctagtcaggaaaa

SEQ ID NO: 214197 - DNA, 20 bp, Artificial Sequence
  chemically synthesized
gtcaggaaaagggtaatgca

SEQ ID NO: 214198 - DNA, 20 bp, Artificial Sequence
  chemically synthesized
taatgcaaagtgaaacatta

SEQ ID NO: 214199 - DNA, 20 bp, Artificial Sequence
  chemically synthesized
taaattatttccctcatttt

SEQ ID NO: 214200 - DNA, 20 bp, Artificial Sequence
  chemically synthesized
taacctgttaccaaaaatga

SEQ ID NO: 214201 - DNA, 20 bp, Artificial Sequence
  chemically synthesized
ataacctgttaccaaaaatg

SEQ ID NO: 214202 - DNA, 20 bp, Artificial Sequence
  chemically synthesized
aataacctgttaccaaaaat

SEQ ID NO: 214203 - DNA, 20 bp, Artificial Sequence
  chemically synthesized
atttccctcatttttggtaa

SEQ ID NO: 214204 - DNA, 20 bp, Artificial Sequence
  chemically synthesized
tttccctcatttttggtaac

SEQ ID NO: 214205 - DNA, 20 bp, Artificial Sequence
  chemically synthesized
ttggtaacaggttattaaaa

SEQ ID NO: 214206 - DNA, 20 bp, Artificial Sequence
  chemically synthesized
gttattaaaatagacttgaa

SEQ ID NO: 214207 - DNA, 20 bp, Artificial Sequence
  chemically synthesized
ttattaaaatagacttgaat

SEQ ID NO: 214208 - DNA, 20 bp, Artificial Sequence
  chemically synthesized
tcatattgaaaaacccattc

SEQ ID NO: 214209 - DNA, 20 bp, Artificial Sequence
  chemically synthesized
ggtttttcaatatgaaacac

SEQ ID NO: 214210 - DNA, 20 bp, Artificial Sequence
  chemically synthesized
gtttttcaatatgaaacact

SEQ ID NO: 214211 - DNA, 20 bp, Artificial Sequence
  chemically synthesized
tcaatatgaaacactaggat

SEQ ID NO: 214212 - DNA, 20 bp, Artificial Sequence
  chemically synthesized
gaagcacagaaagctcatcc

SEQ ID NO: 214213 - DNA, 20 bp, Artificial Sequence
  chemically synthesized
tgaagaaactgaagcacaga

SEQ ID NO: 214214 - DNA, 20 bp, Artificial Sequence
  chemically synthesized
aggatgagctttctgtgctt

SEQ ID NO: 214215 - DNA, 20 bp, Artificial Sequence
  chemically synthesized
cagatgaagaaactgaagca

SEQ ID NO: 214216 - DNA, 20 bp, Artificial Sequence
  chemically synthesized
tccttcagatgaagaaactg

SEQ ID NO: 214217 - DNA, 20 bp, Artificial Sequence
  chemically synthesized
tgcttcagtttcttcatctg

SEQ ID NO: 214218 - DNA, 20 bp, Artificial Sequence
  chemically synthesized
gcttcagtttcttcatctga

SEQ ID NO: 214219 - DNA, 20 bp, Artificial Sequence
  chemically synthesized
gacagcctctccttcagatg

SEQ ID NO: 214220 - DNA, 20 bp, Artificial Sequence
  chemically synthesized
ttcagtttcttcatctgaag

SEQ ID NO: 214221 - DNA, 20 bp, Artificial Sequence
  chemically synthesized
cagtttcttcatctgaagga

SEQ ID NO: 214222 - DNA, 20 bp, Artificial Sequence
  chemically synthesized
agtttcttcatctgaaggag

SEQ ID NO: 214223 - DNA, 20 bp, Artificial Sequence
  chemically synthesized
tactcagacagcctctcctt

SEQ ID NO: 214224 - DNA, 20 bp, Artificial Sequence
  chemically synthesized
atctgaaggagaggctgtct

SEQ ID NO: 214225 - DNA, 20 bp, Artificial Sequence
  chemically synthesized
tgaaggagaggctgtctgag

SEQ ID NO: 214226 - DNA, 20 bp, Artificial Sequence
  chemically synthesized
gaaggagaggctgtctgagt

SEQ ID NO: 214227 - DNA, 20 bp, Artificial Sequence
  chemically synthesized
cttatggtcccctactcaga

SEQ ID NO: 214228 - DNA, 20 bp, Artificial Sequence
  chemically synthesized
aaggagaggctgtctgagta

SEQ ID NO: 214229 - DNA, 20 bp, Artificial Sequence
  chemically synthesized
aggagaggctgtctgagtag

SEQ ID NO: 214230 - DNA, 20 bp, Artificial Sequence
  chemically synthesized
gattcttatggtcccctact

SEQ ID NO: 214231 - DNA, 20 bp, Artificial Sequence
  chemically synthesized
ctgtctgagtaggggaccat

SEQ ID NO: 214232 - DNA, 20 bp, Artificial Sequence
  chemically synthesized
gaagctgaagtggattctta

SEQ ID NO: 214233 - DNA, 20 bp, Artificial Sequence
  chemically synthesized
gggaccataagaatccactt

SEQ ID NO: 214234 - DNA, 20 bp, Artificial Sequence
  chemically synthesized
atagactacagaagctgaag

SEQ ID NO: 214235 - DNA, 20 bp, Artificial Sequence
  chemically synthesized
atcatagactacagaagctg

SEQ ID NO: 214236 - DNA, 20 bp, Artificial Sequence
  chemically synthesized
agaatccacttcagcttctg

SEQ ID NO: 214237 - DNA, 20 bp, Artificial Sequence
  chemically synthesized
agatatatcatagactacag

SEQ ID NO: 214238 - DNA, 20 bp, Artificial Sequence
  chemically synthesized
tgcagatatatcatagacta

SEQ ID NO: 214239 - DNA, 20 bp, Artificial Sequence
  chemically synthesized
ataaaaatgcagatatatca

SEQ ID NO: 214240 - DNA, 20 bp, Artificial Sequence
  chemically synthesized
ataaatgcctgataaaaatg

SEQ ID NO: 214241 - DNA, 20 bp, Artificial Sequence
  chemically synthesized
tgatatatctgcatttttat

SEQ ID NO: 214242 - DNA, 20 bp, Artificial Sequence
  chemically synthesized
gatatatctgcatttttatc

SEQ ID NO: 214243 - DNA, 20 bp, Artificial Sequence
  chemically synthesized
catttattattattcccatg

SEQ ID NO: 214244 - DNA, 20 bp, Artificial Sequence
  chemically synthesized
ttattattattcccatgtag

SEQ ID NO: 214245 - DNA, 20 bp, Artificial Sequence
  chemically synthesized
tattattattcccatgtagc

SEQ ID NO: 214246 - DNA, 20 bp, Artificial Sequence
  chemically synthesized
cagaacattccctgctacat

SEQ ID NO: 214247 - DNA, 20 bp, Artificial Sequence
  chemically synthesized
attattattcccatgtagca

SEQ ID NO: 214248 - DNA, 20 bp, Artificial Sequence
  chemically synthesized
gcagaacattccctgctaca

SEQ ID NO: 214249 - DNA, 20 bp, Artificial Sequence
  chemically synthesized
tcctggctcaagggagggag

SEQ ID NO: 214250 - DNA, 20 bp, Artificial Sequence
  chemically synthesized
acttcctggctcaagggagg

SEQ ID NO: 214251 - DNA, 20 bp, Artificial Sequence
  chemically synthesized
aatgttctgctccctccctt

SEQ ID NO: 214252 - DNA, 20 bp, Artificial Sequence
  chemically synthesized
gtacttcctggctcaaggga

SEQ ID NO: 214253 - DNA, 20 bp, Artificial Sequence
  chemically synthesized
tgtacttcctggctcaaggg

SEQ ID NO: 214254 - DNA, 20 bp, Artificial Sequence
  chemically synthesized
ttgtacttcctggctcaagg

SEQ ID NO: 214255 - DNA, 20 bp, Artificial Sequence
  chemically synthesized
ttctgctccctcccttgagc

SEQ ID NO: 214256 - DNA, 20 bp, Artificial Sequence
  chemically synthesized
tctgctccctcccttgagcc

SEQ ID NO: 214257 - DNA, 20 bp, Artificial Sequence
  chemically synthesized
aattgtacttcctggctcaa

SEQ ID NO: 214258 - DNA, 20 bp, Artificial Sequence
  chemically synthesized
aaattgtacttcctggctca

SEQ ID NO: 214259 - DNA, 20 bp, Artificial Sequence
  chemically synthesized
caaattgtacttcctggctc

SEQ ID NO: 214260 - DNA, 20 bp, Artificial Sequence
  chemically synthesized
gctccctcccttgagccagg

SEQ ID NO: 214261 - DNA, 20 bp, Artificial Sequence
  chemically synthesized
ctgatacaaattgtacttcc

SEQ ID NO: 214262 - DNA, 20 bp, Artificial Sequence
  chemically synthesized
ccaggaagtacaatttgtat

SEQ ID NO: 214263 - DNA, 20 bp, Artificial Sequence
  chemically synthesized
caggaagtacaatttgtatc

SEQ ID NO: 214264 - DNA, 20 bp, Artificial Sequence
  chemically synthesized
gatggagcaaaacataattc

SEQ ID NO: 214265 - DNA, 20 bp, Artificial Sequence
  chemically synthesized
gaaatgactgggattagatg

SEQ ID NO: 214266 - DNA, 20 bp, Artificial Sequence
  chemically synthesized
gagaaatgactgggattaga

SEQ ID NO: 214267 - DNA, 20 bp, Artificial Sequence
  chemically synthesized
tgttttgctccatctaatcc

SEQ ID NO: 214268 - DNA, 20 bp, Artificial Sequence
  chemically synthesized
tgtagagaaatgactgggat

SEQ ID NO: 214269 - DNA, 20 bp, Artificial Sequence
  chemically synthesized
agatatgtagagaaatgact

SEQ ID NO: 214270 - DNA, 20 bp, Artificial Sequence
  chemically synthesized
cagatatgtagagaaatgac

SEQ ID NO: 214271 - DNA, 20 bp, Artificial Sequence
  chemically synthesized
gtgaaaaatacagatatgta

SEQ ID NO: 214272 - DNA, 20 bp, Artificial Sequence
  chemically synthesized
tggtgaaaaatacagatatg

SEQ ID NO: 214273 - DNA, 20 bp, Artificial Sequence
  chemically synthesized
attaagtatggtgaaaaata

SEQ ID NO: 214274 - DNA, 20 bp, Artificial Sequence
  chemically synthesized
ccctataattttattaagta

SEQ ID NO: 214275 - DNA, 20 bp, Artificial Sequence
  chemically synthesized
gaaatccctataattttatt

SEQ ID NO: 214276 - DNA, 20 bp, Artificial Sequence
  chemically synthesized
caccatacttaataaaatta

SEQ ID NO: 214277 - DNA, 20 bp, Artificial Sequence
  chemically synthesized
accatacttaataaaattat

SEQ ID NO: 214278 - DNA, 20 bp, Artificial Sequence
  chemically synthesized
ccatacttaataaaattata

SEQ ID NO: 214279 - DNA, 20 bp, Artificial Sequence
  chemically synthesized
aagtgaagtggtagaacaag

SEQ ID NO: 214280 - DNA, 20 bp, Artificial Sequence
  chemically synthesized
atgaagtgaagtggtagaac

SEQ ID NO: 214281 - DNA, 20 bp, Artificial Sequence
  chemically synthesized
gagaccatgaagtgaagtgg

SEQ ID NO: 214282 - DNA, 20 bp, Artificial Sequence
  chemically synthesized
gtggagaccatgaagtgaag

SEQ ID NO: 214283 - DNA, 20 bp, Artificial Sequence
  chemically synthesized
tgttctaccacttcacttca

SEQ ID NO: 214284 - DNA, 20 bp, Artificial Sequence
  chemically synthesized
caagtggagaccatgaagtg

SEQ ID NO: 214285 - DNA, 20 bp, Artificial Sequence
  chemically synthesized
ttactcaagtggagaccatg

SEQ ID NO: 214286 - DNA, 20 bp, Artificial Sequence
  chemically synthesized
tcacttcatggtctccactt

SEQ ID NO: 214287 - DNA, 20 bp, Artificial Sequence
  chemically synthesized
ttgattgcattactcaagtg

SEQ ID NO: 214288 - DNA, 20 bp, Artificial Sequence
  chemically synthesized
agttgattgcattactcaag

SEQ ID NO: 214289 - DNA, 20 bp, Artificial Sequence
  chemically synthesized
gccagttgattgcattactc

SEQ ID NO: 214290 - DNA, 20 bp, Artificial Sequence
  chemically synthesized
acttgagtaatgcaatcaac

SEQ ID NO: 214291 - DNA, 20 bp, Artificial Sequence
  chemically synthesized
tgagtaatgcaatcaactgg

SEQ ID NO: 214292 - DNA, 20 bp, Artificial Sequence
  chemically synthesized
gagtaatgcaatcaactggc

SEQ ID NO: 214293 - DNA, 20 bp, Artificial Sequence
  chemically synthesized
ctcatggtaattgtacctgc

SEQ ID NO: 214294 - DNA, 20 bp, Artificial Sequence
  chemically synthesized
ctggcaggtacaattaccat

SEQ ID NO: 214295 - DNA, 20 bp, Artificial Sequence
  chemically synthesized
tggcaggtacaattaccatg

SEQ ID NO: 214296 - DNA, 20 bp, Artificial Sequence
  chemically synthesized
caggtacaattaccatgagg

SEQ ID NO: 214297 - DNA, 20 bp, Artificial Sequence
  chemically synthesized
ggtacaattaccatgaggca

SEQ ID NO: 214298 - DNA, 20 bp, Artificial Sequence
  chemically synthesized
aaacatttccctctgcctca

SEQ ID NO: 214299 - DNA, 20 bp, Artificial Sequence
  chemically synthesized
gtacaattaccatgaggcag

SEQ ID NO: 214300 - DNA, 20 bp, Artificial Sequence
  chemically synthesized
tacaattaccatgaggcaga

SEQ ID NO: 214301 - DNA, 20 bp, Artificial Sequence
  chemically synthesized
aggcagagggaaatgtttct

SEQ ID NO: 214302 - DNA, 20 bp, Artificial Sequence
  chemically synthesized
ggcagagggaaatgtttctt

SEQ ID NO: 214303 - DNA, 20 bp, Artificial Sequence
  chemically synthesized
gggaaatgtttcttaggacc

SEQ ID NO: 214304 - DNA, 20 bp, Artificial Sequence
  chemically synthesized
ggaaatgtttcttaggaccc

SEQ ID NO: 214305 - DNA, 20 bp, Artificial Sequence
  chemically synthesized
atcagttttgcctgggtcct

SEQ ID NO: 214306 - DNA, 20 bp, Artificial Sequence
  chemically synthesized
aaaataaatcagttttgcct

SEQ ID NO: 214307 - DNA, 20 bp, Artificial Sequence
  chemically synthesized
gaaaataaatcagttttgcc

SEQ ID NO: 214308 - DNA, 20 bp, Artificial Sequence
  chemically synthesized
tggcacaaaggaaaataaat

SEQ ID NO: 214309 - DNA, 20 bp, Artificial Sequence
  chemically synthesized
acatgtaagatttggcacaa

SEQ ID NO: 214310 - DNA, 20 bp, Artificial Sequence
  chemically synthesized
tacatgtaagatttggcaca

SEQ ID NO: 214311 - DNA, 20 bp, Artificial Sequence
  chemically synthesized
gtaaaagtacatgtaagatt

SEQ ID NO: 214312 - DNA, 20 bp, Artificial Sequence
  chemically synthesized
cttggtgtaaaagtacatgt

SEQ ID NO: 214313 - DNA, 20 bp, Artificial Sequence
  chemically synthesized
cttacatgtacttttacacc

SEQ ID NO: 214314 - DNA, 20 bp, Artificial Sequence
  chemically synthesized
agcaggttaacttggtgtaa

SEQ ID NO: 214315 - DNA, 20 bp, Artificial Sequence
  chemically synthesized
tttgcctaagcaggttaact

SEQ ID NO: 214316 - DNA, 20 bp, Artificial Sequence
  chemically synthesized
ttacaccaagttaacctgct

SEQ ID NO: 214317 - DNA, 20 bp, Artificial Sequence
  chemically synthesized
tacaccaagttaacctgctt

SEQ ID NO: 214318 - DNA, 20 bp, Artificial Sequence
  chemically synthesized
gctcctccctttgcctaagc

SEQ ID NO: 214319 - DNA, 20 bp, Artificial Sequence
  chemically synthesized
ggctcctccctttgcctaag

SEQ ID NO: 214320 - DNA, 20 bp, Artificial Sequence
  chemically synthesized
caagttaacctgcttaggca

SEQ ID NO: 214321 - DNA, 20 bp, Artificial Sequence
  chemically synthesized
aagttaacctgcttaggcaa

SEQ ID NO: 214322 - DNA, 20 bp, Artificial Sequence
  chemically synthesized
agttaacctgcttaggcaaa

SEQ ID NO: 214323 - DNA, 20 bp, Artificial Sequence
  chemically synthesized
gatggctcctccctttgcct

SEQ ID NO: 214324 - DNA, 20 bp, Artificial Sequence
  chemically synthesized
ttaacctgcttaggcaaagg

SEQ ID NO: 214325 - DNA, 20 bp, Artificial Sequence
  chemically synthesized
taacctgcttaggcaaaggg

SEQ ID NO: 214326 - DNA, 20 bp, Artificial Sequence
  chemically synthesized
acctgcttaggcaaagggag

SEQ ID NO: 214327 - DNA, 20 bp, Artificial Sequence
  chemically synthesized
attgcagagcttgaaaaaga

SEQ ID NO: 214328 - DNA, 20 bp, Artificial Sequence
  chemically synthesized
agggaggagccatctttttc

SEQ ID NO: 214329 - DNA, 20 bp, Artificial Sequence
  chemically synthesized
gatcattgcagagcttgaaa

SEQ ID NO: 214330 - DNA, 20 bp, Artificial Sequence
  chemically synthesized
ctttctcaaggatcattgca

SEQ ID NO: 214331 - DNA, 20 bp, Artificial Sequence
  chemically synthesized
tgctttctcaaggatcattg

SEQ ID NO: 214332 - DNA, 20 bp, Artificial Sequence
  chemically synthesized
caagctctgcaatgatcctt

SEQ ID NO: 214333 - DNA, 20 bp, Artificial Sequence
  chemically synthesized
ctctgcaatgatccttgaga

SEQ ID NO: 214334 - DNA, 20 bp, Artificial Sequence
  chemically synthesized
ttgacttttctgctttctca

SEQ ID NO: 214335 - DNA, 20 bp, Artificial Sequence
  chemically synthesized
tgcaatgatccttgagaaag

SEQ ID NO: 214336 - DNA, 20 bp, Artificial Sequence
  chemically synthesized
attgacttttctgctttctc

SEQ ID NO: 214337 - DNA, 20 bp, Artificial Sequence
  chemically synthesized
tgatccttgagaaagcagaa

SEQ ID NO: 214338 - DNA, 20 bp, Artificial Sequence
  chemically synthesized
tgagaaagcagaaaagtcaa

SEQ ID NO: 214339 - DNA, 20 bp, Artificial Sequence
  chemically synthesized
gagaaagcagaaaagtcaat

SEQ ID NO: 214340 - DNA, 20 bp, Artificial Sequence
  chemically synthesized
aactcacaccataaaaatat

SEQ ID NO: 214341 - DNA, 20 bp, Artificial Sequence
  chemically synthesized
aatgggatctaatattttta

SEQ ID NO: 214342 - DNA, 20 bp, Artificial Sequence
  chemically synthesized
atctaatatttttatggtgt

SEQ ID NO: 214343 - DNA, 20 bp, Artificial Sequence
  chemically synthesized
tttatggtgtgagttccatc

SEQ ID NO: 214344 - DNA, 20 bp, Artificial Sequence
  chemically synthesized
ttatggtgtgagttccatct

SEQ ID NO: 214345 - DNA, 20 bp, Artificial Sequence
  chemically synthesized
tatggtgtgagttccatctg

SEQ ID NO: 214346 - DNA, 20 bp, Artificial Sequence
  chemically synthesized
cccatacaaatgtccccaga

SEQ ID NO: 214347 - DNA, 20 bp, Artificial Sequence
  chemically synthesized
caaccccatacaaatgtccc

SEQ ID NO: 214348 - DNA, 20 bp, Artificial Sequence
  chemically synthesized
tccatctggggacatttgta

SEQ ID NO: 214349 - DNA, 20 bp, Artificial Sequence
  chemically synthesized
ccatctggggacatttgtat

SEQ ID NO: 214350 - DNA, 20 bp, Artificial Sequence
  chemically synthesized
catctggggacatttgtatg

SEQ ID NO: 214351 - DNA, 20 bp, Artificial Sequence
  chemically synthesized
gggacatttgtatggggttg

SEQ ID NO: 214352 - DNA, 20 bp, Artificial Sequence
  chemically synthesized
gacatttgtatggggttgaa

SEQ ID NO: 214353 - DNA, 20 bp, Artificial Sequence
  chemically synthesized
acatttgtatggggttgaag

SEQ ID NO: 214354 - DNA, 20 bp, Artificial Sequence
  chemically synthesized
tgaagaggaatgcatttgat

SEQ ID NO: 214355 - DNA, 20 bp, Artificial Sequence
  chemically synthesized
gaagaggaatgcatttgatg

SEQ ID NO: 214356 - DNA, 20 bp, Artificial Sequence
  chemically synthesized
gaggaatgcatttgatgagg

SEQ ID NO: 214357 - DNA, 20 bp, Artificial Sequence
  chemically synthesized
acgtggtacctaagatcaaa

SEQ ID NO: 214358 - DNA, 20 bp, Artificial Sequence
  chemically synthesized
aggcagtgactgtttgatct

SEQ ID NO: 214359 - DNA, 20 bp, Artificial Sequence
  chemically synthesized
ggcagtgactgtttgatctt

SEQ ID NO: 214360 - DNA, 20 bp, Artificial Sequence
  chemically synthesized
tactgaggaacgtggtacct

SEQ ID NO: 214361 - DNA, 20 bp, Artificial Sequence
  chemically synthesized
atcttaggtaccacgttcct

SEQ ID NO: 214362 - DNA, 20 bp, Artificial Sequence
  chemically synthesized
ctcccacatactgaggaacg

SEQ ID NO: 214363 - DNA, 20 bp, Artificial Sequence
  chemically synthesized
gtaccacgttcctcagtatg

SEQ ID NO: 214364 - DNA, 20 bp, Artificial Sequence
  chemically synthesized
ctttacactcccacatactg

SEQ ID NO: 214365 - DNA, 20 bp, Artificial Sequence
  chemically synthesized
taccacgttcctcagtatgt

SEQ ID NO: 214366 - DNA, 20 bp, Artificial Sequence
  chemically synthesized
gctttacactcccacatact

SEQ ID NO: 214367 - DNA, 20 bp, Artificial Sequence
  chemically synthesized
ccacgttcctcagtatgtgg

SEQ ID NO: 214368 - DNA, 20 bp, Artificial Sequence
  chemically synthesized
cctcagtatgtgggagtgta

SEQ ID NO: 214369 - DNA, 20 bp, Artificial Sequence
  chemically synthesized
ctaaaaataatttgttcatg

SEQ ID NO: 214370 - DNA, 20 bp, Artificial Sequence
  chemically synthesized
cttcatgaacaaattatttt

SEQ ID NO: 214371 - DNA, 20 bp, Artificial Sequence
  chemically synthesized
tgaacaaattatttttagtt

SEQ ID NO: 214372 - DNA, 20 bp, Artificial Sequence
  chemically synthesized
ttatttttagttgagctaaa

SEQ ID NO: 214373 - DNA, 20 bp, Artificial Sequence
  chemically synthesized
atgatcaactcatagccatt

SEQ ID NO: 214374 - DNA, 20 bp, Artificial Sequence
  chemically synthesized
tagttgagctaaatggctat

SEQ ID NO: 214375 - DNA, 20 bp, Artificial Sequence
  chemically synthesized
aatcattaatgatcaactca

SEQ ID NO: 214376 - DNA, 20 bp, Artificial Sequence
  chemically synthesized
atgagttgatcattaatgat

SEQ ID NO: 214377 - DNA, 20 bp, Artificial Sequence
  chemically synthesized
tgagttgatcattaatgatt

SEQ ID NO: 214378 - DNA, 20 bp, Artificial Sequence
  chemically synthesized
gatcattaatgattaggaaa

SEQ ID NO: 214379 - DNA, 20 bp, Artificial Sequence
  chemically synthesized
tcattaatgattaggaaaaa

SEQ ID NO: 214380 - DNA, 20 bp, Artificial Sequence
  chemically synthesized
taatgattaggaaaaagagc

SEQ ID NO: 214381 - DNA, 20 bp, Artificial Sequence
  chemically synthesized
aatgattaggaaaaagagcc

SEQ ID NO: 214382 - DNA, 20 bp, Artificial Sequence
  chemically synthesized
attaggaaaaagagccagga

SEQ ID NO: 214383 - DNA, 20 bp, Artificial Sequence
  chemically synthesized
taggaaaaagagccaggatg

SEQ ID NO: 214384 - DNA, 20 bp, Artificial Sequence
  chemically synthesized
aggaaaaagagccaggatgg

SEQ ID NO: 214385 - DNA, 20 bp, Artificial Sequence
  chemically synthesized
aagagcgtaatcctccatcc

SEQ ID NO: 214386 - DNA, 20 bp, Artificial Sequence
  chemically synthesized
aggatggaggattacgctct

SEQ ID NO: 214387 - DNA, 20 bp, Artificial Sequence
  chemically synthesized
ttagagatcttcaaggccaa

SEQ ID NO: 214388 - DNA, 20 bp, Artificial Sequence
  chemically synthesized
ggattacgctcttggccttg

SEQ ID NO: 214389 - DNA, 20 bp, Artificial Sequence
  chemically synthesized
ccttagagatcttcaaggcc

SEQ ID NO: 214390 - DNA, 20 bp, Artificial Sequence
  chemically synthesized
tactgccttagagatcttca

SEQ ID NO: 214391 - DNA, 20 bp, Artificial Sequence
  chemically synthesized
ctactgccttagagatcttc

SEQ ID NO: 214392 - DNA, 20 bp, Artificial Sequence
  chemically synthesized
tcttggccttgaagatctct

SEQ ID NO: 214393 - DNA, 20 bp, Artificial Sequence
  chemically synthesized
cttggccttgaagatctcta

SEQ ID NO: 214394 - DNA, 20 bp, Artificial Sequence
  chemically synthesized
ggccttgaagatctctaagg

SEQ ID NO: 214395 - DNA, 20 bp, Artificial Sequence
  chemically synthesized
ttactctttctactgcctta

SEQ ID NO: 214396 - DNA, 20 bp, Artificial Sequence
  chemically synthesized
cttgaagatctctaaggcag

SEQ ID NO: 214397 - DNA, 20 bp, Artificial Sequence
  chemically synthesized
tattactctttctactgcct

SEQ ID NO: 214398 - DNA, 20 bp, Artificial Sequence
  chemically synthesized
aagatctctaaggcagtaga

SEQ ID NO: 214399 - DNA, 20 bp, Artificial Sequence
  chemically synthesized
gatctctaaggcagtagaaa

SEQ ID NO: 214400 - DNA, 20 bp, Artificial Sequence
  chemically synthesized
aaggcagtagaaagagtaat

SEQ ID NO: 214401 - DNA, 20 bp, Artificial Sequence
  chemically synthesized
aggcagtagaaagagtaata

SEQ ID NO: 214402 - DNA, 20 bp, Artificial Sequence
  chemically synthesized
gcagtagaaagagtaataag

SEQ ID NO: 214403 - DNA, 20 bp, Artificial Sequence
  chemically synthesized
aagagtaataaggagtatat

SEQ ID NO: 214404 - DNA, 20 bp, Artificial Sequence
  chemically synthesized
agagtaataaggagtatatt

SEQ ID NO: 214405 - DNA, 20 bp, Artificial Sequence
  chemically synthesized
gagtaataaggagtatatta

SEQ ID NO: 214406 - DNA, 20 bp, Artificial Sequence
  chemically synthesized
aggagtatattagggttcct

SEQ ID NO: 214407 - DNA, 20 bp, Artificial Sequence
  chemically synthesized
gagtatattagggttcctta

SEQ ID NO: 214408 - DNA, 20 bp, Artificial Sequence
  chemically synthesized
ttattccttttgtttctcta

SEQ ID NO: 214409 - DNA, 20 bp, Artificial Sequence
  chemically synthesized
cttattccttttgtttctct

SEQ ID NO: 214410 - DNA, 20 bp, Artificial Sequence
  chemically synthesized
agggttccttagagaaacaa

SEQ ID NO: 214411 - DNA, 20 bp, Artificial Sequence
  chemically synthesized
gggttccttagagaaacaaa

SEQ ID NO: 214412 - DNA, 20 bp, Artificial Sequence
  chemically synthesized
cttagagaaacaaaaggaat

SEQ ID NO: 214413 - DNA, 20 bp, Artificial Sequence
  chemically synthesized
tagagaaacaaaaggaataa

SEQ ID NO: 214414 - DNA, 20 bp, Artificial Sequence
  chemically synthesized
accacatacaaacacacaca

SEQ ID NO: 214415 - DNA, 20 bp, Artificial Sequence
  chemically synthesized
ttaccacatacaaacacaca

SEQ ID NO: 214416 - DNA, 20 bp, Artificial Sequence
  chemically synthesized
tctctgtgtgtgtttgtatg

SEQ ID NO: 214417 - DNA, 20 bp, Artificial Sequence
  chemically synthesized
tgtgtgtgtttgtatgtggt

SEQ ID NO: 214418 - DNA, 20 bp, Artificial Sequence
  chemically synthesized
gtttgtatgtggtaagaaat

SEQ ID NO: 214419 - DNA, 20 bp, Artificial Sequence
  chemically synthesized
agttgcctccataattgcat

SEQ ID NO: 214420 - DNA, 20 bp, Artificial Sequence
  chemically synthesized
gaaattggctcatgcaatta

SEQ ID NO: 214421 - DNA, 20 bp, Artificial Sequence
  chemically synthesized
aattggctcatgcaattatg

SEQ ID NO: 214422 - DNA, 20 bp, Artificial Sequence
  chemically synthesized
attggctcatgcaattatgg

SEQ ID NO: 214423 - DNA, 20 bp, Artificial Sequence
  chemically synthesized
tgcaattatggaggcaacta

SEQ ID NO: 214424 - DNA, 20 bp, Artificial Sequence
  chemically synthesized
caattatggaggcaactatg

SEQ ID NO: 214425 - DNA, 20 bp, Artificial Sequence
  chemically synthesized
ttgggagttgtcagtctcca

SEQ ID NO: 214426 - DNA, 20 bp, Artificial Sequence
  chemically synthesized
ctgtataccttgggagttgt

SEQ ID NO: 214427 - DNA, 20 bp, Artificial Sequence
  chemically synthesized
tatggagactgacaactccc

SEQ ID NO: 214428 - DNA, 20 bp, Artificial Sequence
  chemically synthesized
atggagactgacaactccca

SEQ ID NO: 214429 - DNA, 20 bp, Artificial Sequence
  chemically synthesized
gttcaccctgtataccttgg

SEQ ID NO: 214430 - DNA, 20 bp, Artificial Sequence
  chemically synthesized
ttgttcaccctgtatacctt

SEQ ID NO: 214431 - DNA, 20 bp, Artificial Sequence
  chemically synthesized
ctgacaactcccaaggtata

SEQ ID NO: 214432 - DNA, 20 bp, Artificial Sequence
  chemically synthesized
cttgttcaccctgtatacct

SEQ ID NO: 214433 - DNA, 20 bp, Artificial Sequence
  chemically synthesized
tgacaactcccaaggtatac

SEQ ID NO: 214434 - DNA, 20 bp, Artificial Sequence
  chemically synthesized
gacaactcccaaggtataca

SEQ ID NO: 214435 - DNA, 20 bp, Artificial Sequence
  chemically synthesized
ccaaggtatacagggtgaac

SEQ ID NO: 214436 - DNA, 20 bp, Artificial Sequence
  chemically synthesized
ggtatacagggtgaacaagc

SEQ ID NO: 214437 - DNA, 20 bp, Artificial Sequence
  chemically synthesized
tacagggtgaacaagcaagc

SEQ ID NO: 214438 - DNA, 20 bp, Artificial Sequence
  chemically synthesized
cagggtgaacaagcaagctg

SEQ ID NO: 214439 - DNA, 20 bp, Artificial Sequence
  chemically synthesized
aacaagcaagctggagaccc

SEQ ID NO: 214440 - DNA, 20 bp, Artificial Sequence
  chemically synthesized
tatcagctctctcgggtctc

SEQ ID NO: 214441 - DNA, 20 bp, Artificial Sequence
  chemically synthesized
caagcaagctggagacccga

SEQ ID NO: 214442 - DNA, 20 bp, Artificial Sequence
  chemically synthesized
agcaagctggagacccgaga

SEQ ID NO: 214443 - DNA, 20 bp, Artificial Sequence
  chemically synthesized
actacactatcagctctctc

SEQ ID NO: 214444 - DNA, 20 bp, Artificial Sequence
  chemically synthesized
aactacactatcagctctct

SEQ ID NO: 214445 - DNA, 20 bp, Artificial Sequence
  chemically synthesized
tggagacccgagagagctga

SEQ ID NO: 214446 - DNA, 20 bp, Artificial Sequence
  chemically synthesized
acccgagagagctgatagtg

SEQ ID NO: 214447 - DNA, 20 bp, Artificial Sequence
  chemically synthesized
ttcgattggaactacactat

SEQ ID NO: 214448 - DNA, 20 bp, Artificial Sequence
  chemically synthesized
tgatagtgtagttccaatcg

SEQ ID NO: 214449 - DNA, 20 bp, Artificial Sequence
  chemically synthesized
tagtgtagttccaatcgaag

SEQ ID NO: 214450 - DNA, 20 bp, Artificial Sequence
  chemically synthesized
caagtctgctctacttcgat

SEQ ID NO: 214451 - DNA, 20 bp, Artificial Sequence
  chemically synthesized
gtgtagttccaatcgaagta

SEQ ID NO: 214452 - DNA, 20 bp, Artificial Sequence
  chemically synthesized
tagttccaatcgaagtagag

SEQ ID NO: 214453 - DNA, 20 bp, Artificial Sequence
  chemically synthesized
aatcgaagtagagcagactt

SEQ ID NO: 214454 - DNA, 20 bp, Artificial Sequence
  chemically synthesized
gtagagcagacttgagatac

SEQ ID NO: 214455 - DNA, 20 bp, Artificial Sequence
  chemically synthesized
attagctgttcttgtatctc

SEQ ID NO: 214456 - DNA, 20 bp, Artificial Sequence
  chemically synthesized
gcagacttgagatacaagaa

SEQ ID NO: 214457 - DNA, 20 bp, Artificial Sequence
  chemically synthesized
tacaagaacagctaatattg

SEQ ID NO: 214458 - DNA, 20 bp, Artificial Sequence
  chemically synthesized
tcagactttaaccacaatat

SEQ ID NO: 214459 - DNA, 20 bp, Artificial Sequence
  chemically synthesized
aacagctaatattgtggtta

SEQ ID NO: 214460 - DNA, 20 bp, Artificial Sequence
  chemically synthesized
aatattgtggttaaagtctg

SEQ ID NO: 214461 - DNA, 20 bp, Artificial Sequence
  chemically synthesized
atattgtggttaaagtctga

SEQ ID NO: 214462 - DNA, 20 bp, Artificial Sequence
  chemically synthesized
ttgtggttaaagtctgaagg

SEQ ID NO: 214463 - DNA, 20 bp, Artificial Sequence
  chemically synthesized
tgtggttaaagtctgaaggc

SEQ ID NO: 214464 - DNA, 20 bp, Artificial Sequence
  chemically synthesized
catgggctttttcctgcctt

SEQ ID NO: 214465 - DNA, 20 bp, Artificial Sequence
  chemically synthesized
taaagtctgaaggcaggaaa

SEQ ID NO: 214466 - DNA, 20 bp, Artificial Sequence
  chemically synthesized
gcaggaaaaagcccatgtcc

SEQ ID NO: 214467 - DNA, 20 bp, Artificial Sequence
  chemically synthesized
ctgccttcaaactgggacat

SEQ ID NO: 214468 - DNA, 20 bp, Artificial Sequence
  chemically synthesized
actgccttcaaactgggaca

SEQ ID NO: 214469 - DNA, 20 bp, Artificial Sequence
  chemically synthesized
aaagcccatgtcccagtttg

SEQ ID NO: 214470 - DNA, 20 bp, Artificial Sequence
  chemically synthesized
aagcccatgtcccagtttga

SEQ ID NO: 214471 - DNA, 20 bp, Artificial Sequence
  chemically synthesized
tgcccgactgccttcaaact

SEQ ID NO: 214472 - DNA, 20 bp, Artificial Sequence
  chemically synthesized
ctgcccgactgccttcaaac

SEQ ID NO: 214473 - DNA, 20 bp, Artificial Sequence
  chemically synthesized
cccatgtcccagtttgaagg

SEQ ID NO: 214474 - DNA, 20 bp, Artificial Sequence
  chemically synthesized
tgtcccagtttgaaggcagt

SEQ ID NO: 214475 - DNA, 20 bp, Artificial Sequence
  chemically synthesized
gtcccagtttgaaggcagtc

SEQ ID NO: 214476 - DNA, 20 bp, Artificial Sequence
  chemically synthesized
ccagtttgaaggcagtcggg

SEQ ID NO: 214477 - DNA, 20 bp, Artificial Sequence
  chemically synthesized
cagaacgattcccttttgct

SEQ ID NO: 214478 - DNA, 20 bp, Artificial Sequence
  chemically synthesized
tgaccctcccctgagcaaaa

SEQ ID NO: 214479 - DNA, 20 bp, Artificial Sequence
  chemically synthesized
agaacgattcccttttgctc

SEQ ID NO: 214480 - DNA, 20 bp, Artificial Sequence
  chemically synthesized
ctgaccctcccctgagcaaa

SEQ ID NO: 214481 - DNA, 20 bp, Artificial Sequence
  chemically synthesized
gaacgattcccttttgctca

SEQ ID NO: 214482 - DNA, 20 bp, Artificial Sequence
  chemically synthesized
actgaccctcccctgagcaa

SEQ ID NO: 214483 - DNA, 20 bp, Artificial Sequence
  chemically synthesized
aacgattcccttttgctcag

SEQ ID NO: 214484 - DNA, 20 bp, Artificial Sequence
  chemically synthesized
cgattcccttttgctcaggg

SEQ ID NO: 214485 - DNA, 20 bp, Artificial Sequence
  chemically synthesized
gattcccttttgctcagggg

SEQ ID NO: 214486 - DNA, 20 bp, Artificial Sequence
  chemically synthesized
attcccttttgctcagggga

SEQ ID NO: 214487 - DNA, 20 bp, Artificial Sequence
  chemically synthesized
aaaaacactgaccctcccct

SEQ ID NO: 214488 - DNA, 20 bp, Artificial Sequence
  chemically synthesized
ccttttgctcaggggagggt

SEQ ID NO: 214489 - DNA, 20 bp, Artificial Sequence
  chemically synthesized
gtcagtgtttttcttctatt

SEQ ID NO: 214490 - DNA, 20 bp, Artificial Sequence
  chemically synthesized
tcagtgtttttcttctattc

SEQ ID NO: 214491 - DNA, 20 bp, Artificial Sequence
  chemically synthesized
ttaattaaaggcctgaatag

SEQ ID NO: 214492 - DNA, 20 bp, Artificial Sequence
  chemically synthesized
taattaattaaaggcctgaa

SEQ ID NO: 214493 - DNA, 20 bp, Artificial Sequence
  chemically synthesized
gacttcatgtaattaattaa

SEQ ID NO: 214494 - DNA, 20 bp, Artificial Sequence
  chemically synthesized
agacttcatgtaattaatta

SEQ ID NO: 214495 - DNA, 20 bp, Artificial Sequence
  chemically synthesized
ggcctttaattaattacatg

SEQ ID NO: 214496 - DNA, 20 bp, Artificial Sequence
  chemically synthesized
tacatgaagtctgctcacat

SEQ ID NO: 214497 - DNA, 20 bp, Artificial Sequence
  chemically synthesized
attgcccttcctaatgtgag

SEQ ID NO: 214498 - DNA, 20 bp, Artificial Sequence
  chemically synthesized
acatgaagtctgctcacatt

SEQ ID NO: 214499 - DNA, 20 bp, Artificial Sequence
  chemically synthesized
tagattgcccttcctaatgt

SEQ ID NO: 214500 - DNA, 20 bp, Artificial Sequence
  chemically synthesized
tgaagtctgctcacattagg

SEQ ID NO: 214501 - DNA, 20 bp, Artificial Sequence
  chemically synthesized
gaagtctgctcacattagga

SEQ ID NO: 214502 - DNA, 20 bp, Artificial Sequence
  chemically synthesized
aagtctgctcacattaggaa

SEQ ID NO: 214503 - DNA, 20 bp, Artificial Sequence
  chemically synthesized
gaagggcaatctactttact

SEQ ID NO: 214504 - DNA, 20 bp, Artificial Sequence
  chemically synthesized
aattggtagactgagtaaag

SEQ ID NO: 214505 - DNA, 20 bp, Artificial Sequence
  chemically synthesized
ttaaattggtagactgagta

SEQ ID NO: 214506 - DNA, 20 bp, Artificial Sequence
  chemically synthesized
aacatttaaattggtagact

SEQ ID NO: 214507 - DNA, 20 bp, Artificial Sequence
  chemically synthesized
gagattaacatttaaattgg

SEQ ID NO: 214508 - DNA, 20 bp, Artificial Sequence
  chemically synthesized
gatgagattaacatttaaat

SEQ ID NO: 214509 - DNA, 20 bp, Artificial Sequence
  chemically synthesized
ctgtgcaagtgttatcagat

SEQ ID NO: 214510 - DNA, 20 bp, Artificial Sequence
  chemically synthesized
tgattctgtgcaagtgttat

SEQ ID NO: 214511 - DNA, 20 bp, Artificial Sequence
  chemically synthesized
ctcatctgataacacttgca

SEQ ID NO: 214512 - DNA, 20 bp, Artificial Sequence
  chemically synthesized
tattctgggtgattctgtgc

SEQ ID NO: 214513 - DNA, 20 bp, Artificial Sequence
  chemically synthesized
aacacttgcacagaatcacc

SEQ ID NO: 214514 - DNA, 20 bp, Artificial Sequence
  chemically synthesized
atttggtcaaacattattct

SEQ ID NO: 214515 - DNA, 20 bp, Artificial Sequence
  chemically synthesized
tatttggtcaaacattattc

SEQ ID NO: 214516 - DNA, 20 bp, Artificial Sequence
  chemically synthesized
ataatgtttgaccaaatatc

SEQ ID NO: 214517 - DNA, 20 bp, Artificial Sequence
  chemically synthesized
taatgtttgaccaaatatct

SEQ ID NO: 214518 - DNA, 20 bp, Artificial Sequence
  chemically synthesized
ctacaaggtgcccagatatt

SEQ ID NO: 214519 - DNA, 20 bp, Artificial Sequence
  chemically synthesized
tgactgggctacaaggtgcc

SEQ ID NO: 214520 - DNA, 20 bp, Artificial Sequence
  chemically synthesized
ccaaatatctgggcaccttg

SEQ ID NO: 214521 - DNA, 20 bp, Artificial Sequence
  chemically synthesized
tatctgggcaccttgtagcc

SEQ ID NO: 214522 - DNA, 20 bp, Artificial Sequence
  chemically synthesized
atcaacttgactgggctaca

SEQ ID NO: 214523 - DNA, 20 bp, Artificial Sequence
  chemically synthesized
catcaacttgactgggctac

SEQ ID NO: 214524 - DNA, 20 bp, Artificial Sequence
  chemically synthesized
gggcaccttgtagcccagtc

SEQ ID NO: 214525 - DNA, 20 bp, Artificial Sequence
  chemically synthesized
ttttgtgcatcaacttgact

SEQ ID NO: 214526 - DNA, 20 bp, Artificial Sequence
  chemically synthesized
attttgtgcatcaacttgac

SEQ ID NO: 214527 - DNA, 20 bp, Artificial Sequence
  chemically synthesized
atgcacaaaattaaccatta

SEQ ID NO: 214528 - DNA, 20 bp, Artificial Sequence
  chemically synthesized
tgcacaaaattaaccattac

SEQ ID NO: 214529 - DNA, 20 bp, Artificial Sequence
  chemically synthesized
acaaaattaaccattacggg

SEQ ID NO: 214530 - DNA, 20 bp, Artificial Sequence
  chemically synthesized
tctgtcaacactgcccgtaa

SEQ ID NO: 214531 - DNA, 20 bp, Artificial Sequence
  chemically synthesized
accattacgggcagtgttga

SEQ ID NO: 214532 - DNA, 20 bp, Artificial Sequence
  chemically synthesized
cgggcagtgttgacagatca

SEQ ID NO: 214533 - DNA, 20 bp, Artificial Sequence
  chemically synthesized
gcagtgttgacagatcaaag

SEQ ID NO: 214534 - DNA, 20 bp, Artificial Sequence
  chemically synthesized
gtgttgacagatcaaagtag

SEQ ID NO: 214535 - DNA, 20 bp, Artificial Sequence
  chemically synthesized
acagatcaaagtagtggtaa

SEQ ID NO: 214536 - DNA, 20 bp, Artificial Sequence
  chemically synthesized
gatcaaagtagtggtaacag

SEQ ID NO: 214537 - DNA, 20 bp, Artificial Sequence
  chemically synthesized
atcaaagtagtggtaacagt

SEQ ID NO: 214538 - DNA, 20 bp, Artificial Sequence
  chemically synthesized
tagtggtaacagtaggtgca

SEQ ID NO: 214539 - DNA, 20 bp, Artificial Sequence
  chemically synthesized
agtaggtgcaaagtgaacaa

SEQ ID NO: 214540 - DNA, 20 bp, Artificial Sequence
  chemically synthesized
aaagtgaacaacagtatcat

SEQ ID NO: 214541 - DNA, 20 bp, Artificial Sequence
  chemically synthesized
aacagtatcattagaatgtc

SEQ ID NO: 214542 - DNA, 20 bp, Artificial Sequence
  chemically synthesized
acagtatcattagaatgtcc

SEQ ID NO: 214543 - DNA, 20 bp, Artificial Sequence
  chemically synthesized
cagtatcattagaatgtcca

SEQ ID NO: 214544 - DNA, 20 bp, Artificial Sequence
  chemically synthesized
tctggaattgaaaaagtccc

SEQ ID NO: 214545 - DNA, 20 bp, Artificial Sequence
  chemically synthesized
atatgtttctggaattgaaa

SEQ ID NO: 214546 - DNA, 20 bp, Artificial Sequence
  chemically synthesized
tccagggactttttcaattc

SEQ ID NO: 214547 - DNA, 20 bp, Artificial Sequence
  chemically synthesized
aaacccagtcaatatgtttc

SEQ ID NO: 214548 - DNA, 20 bp, Artificial Sequence
  chemically synthesized
aattccagaaacatattgac

SEQ ID NO: 214549 - DNA, 20 bp, Artificial Sequence
  chemically synthesized
attccagaaacatattgact

SEQ ID NO: 214550 - DNA, 20 bp, Artificial Sequence
  chemically synthesized
aagttatggggcatcaaacc

SEQ ID NO: 214551 - DNA, 20 bp, Artificial Sequence
  chemically synthesized
ttgttacttgtaaagttatg

SEQ ID NO: 214552 - DNA, 20 bp, Artificial Sequence
  chemically synthesized
gttgttacttgtaaagttat

SEQ ID NO: 214553 - DNA, 20 bp, Artificial Sequence
  chemically synthesized
agttgttacttgtaaagtta

SEQ ID NO: 214554 - DNA, 20 bp, Artificial Sequence
  chemically synthesized
ttgatgccccataactttac

SEQ ID NO: 214555 - DNA, 20 bp, Artificial Sequence
  chemically synthesized
tggaatagttgttacttgta

SEQ ID NO: 214556 - DNA, 20 bp, Artificial Sequence
  chemically synthesized
gcattgagtatcatgtggaa

SEQ ID NO: 214557 - DNA, 20 bp, Artificial Sequence
  chemically synthesized
tatgagcattgagtatcatg

SEQ ID NO: 214558 - DNA, 20 bp, Artificial Sequence
  chemically synthesized
aaggcagtcatatgagcatt

SEQ ID NO: 214559 - DNA, 20 bp, Artificial Sequence
  chemically synthesized
ttcctccaaggcagtcatat

SEQ ID NO: 214560 - DNA, 20 bp, Artificial Sequence
  chemically synthesized
caatgctcatatgactgcct

SEQ ID NO: 214561 - DNA, 20 bp, Artificial Sequence
  chemically synthesized
atgctcatatgactgccttg

SEQ ID NO: 214562 - DNA, 20 bp, Artificial Sequence
  chemically synthesized
tgctcatatgactgccttgg

SEQ ID NO: 214563 - DNA, 20 bp, Artificial Sequence
  chemically synthesized
tgtcaattattcctccaagg

SEQ ID NO: 214564 - DNA, 20 bp, Artificial Sequence
  chemically synthesized
gaatgtcaattattcctcca

SEQ ID NO: 214565 - DNA, 20 bp, Artificial Sequence
  chemically synthesized
agaatgtcaattattcctcc

SEQ ID NO: 214566 - DNA, 20 bp, Artificial Sequence
  chemically synthesized
aaagtttgggacagggggta

SEQ ID NO: 214567 - DNA, 20 bp, Artificial Sequence
  chemically synthesized
ttaaagtttgggacaggggg

SEQ ID NO: 214568 - DNA, 20 bp, Artificial Sequence
  chemically synthesized
tttttaaagtttgggacagg

SEQ ID NO: 214569 - DNA, 20 bp, Artificial Sequence
  chemically synthesized
ttttttaaagtttgggacag

SEQ ID NO: 214570 - DNA, 20 bp, Artificial Sequence
  chemically synthesized
gttttttaaagtttgggaca

SEQ ID NO: 214571 - DNA, 20 bp, Artificial Sequence
  chemically synthesized
tgttttttaaagtttgggac

SEQ ID NO: 214572 - DNA, 20 bp, Artificial Sequence
  chemically synthesized
atgttttttaaagtttggga

SEQ ID NO: 214573 - DNA, 20 bp, Artificial Sequence
  chemically synthesized
caaaatgttttttaaagttt

SEQ ID NO: 214574 - DNA, 20 bp, Artificial Sequence
  chemically synthesized
acaaaatgttttttaaagtt

SEQ ID NO: 214575 - DNA, 20 bp, Artificial Sequence
  chemically synthesized
agtacacaaaatgtttttta

SEQ ID NO: 214576 - DNA, 20 bp, Artificial Sequence
  chemically synthesized
cagttcatcctaaatcattt

SEQ ID NO: 214577 - DNA, 20 bp, Artificial Sequence
  chemically synthesized
ttttgtgtactgaaatgatt

SEQ ID NO: 214578 - DNA, 20 bp, Artificial Sequence
  chemically synthesized
tttgtgtactgaaatgattt

SEQ ID NO: 214579 - DNA, 20 bp, Artificial Sequence
  chemically synthesized
gatttaggatgaactgtgac

SEQ ID NO: 214580 - DNA, 20 bp, Artificial Sequence
  chemically synthesized
tattttcttgtttccggtca

SEQ ID NO: 214581 - DNA, 20 bp, Artificial Sequence
  chemically synthesized
gatgaactgtgaccggaaac

SEQ ID NO: 214582 - DNA, 20 bp, Artificial Sequence
  chemically synthesized
agttactattttcttgtttc

SEQ ID NO: 214583 - DNA, 20 bp, Artificial Sequence
  chemically synthesized
tgtgaccggaaacaagaaaa

SEQ ID NO: 214584 - DNA, 20 bp, Artificial Sequence
  chemically synthesized
aacaagaaaatagtaactca

SEQ ID NO: 214585 - DNA, 20 bp, Artificial Sequence
  chemically synthesized
acaagaaaatagtaactcac

SEQ ID NO: 214586 - DNA, 20 bp, Artificial Sequence
  chemically synthesized
caagaaaatagtaactcacg

SEQ ID NO: 214587 - DNA, 20 bp, Artificial Sequence
  chemically synthesized
gaaaatagtaactcacgggg

SEQ ID NO: 214588 - DNA, 20 bp, Artificial Sequence
  chemically synthesized
tcttgcttggaccaccccgt

SEQ ID NO: 214589 - DNA, 20 bp, Artificial Sequence
  chemically synthesized
agtaactcacggggtggtcc

SEQ ID NO: 214590 - DNA, 20 bp, Artificial Sequence
  chemically synthesized
actcacggggtggtccaagc

SEQ ID NO: 214591 - DNA, 20 bp, Artificial Sequence
  chemically synthesized
aagttggctgtcatcttgct

SEQ ID NO: 214592 - DNA, 20 bp, Artificial Sequence
  chemically synthesized
gggtggtccaagcaagatga

SEQ ID NO: 214593 - DNA, 20 bp, Artificial Sequence
  chemically synthesized
caaaacaaagaacaaaaagt

SEQ ID NO: 214594 - DNA, 20 bp, Artificial Sequence
  chemically synthesized
aaaacaaaacaaagaacaaa

SEQ ID NO: 214595 - DNA, 20 bp, Artificial Sequence
  chemically synthesized
taagaatctaaaacaaaaca

SEQ ID NO: 214596 - DNA, 20 bp, Artificial Sequence
  chemically synthesized
ttttgttctttgttttgttt

SEQ ID NO: 214597 - DNA, 20 bp, Artificial Sequence
  chemically synthesized
gttttagattcttaacgctt

SEQ ID NO: 214598 - DNA, 20 bp, Artificial Sequence
  chemically synthesized
tccaacttcactaaagcgtt

SEQ ID NO: 214599 - DNA, 20 bp, Artificial Sequence
  chemically synthesized
agattcttaacgctttagtg

SEQ ID NO: 214600 - DNA, 20 bp, Artificial Sequence
  chemically synthesized
atgtggatccaacttcacta

SEQ ID NO: 214601 - DNA, 20 bp, Artificial Sequence
  chemically synthesized
tcttaacgctttagtgaagt

SEQ ID NO: 214602 - DNA, 20 bp, Artificial Sequence
  chemically synthesized
tatttgcaatgatcaaaatg

SEQ ID NO: 214603 - DNA, 20 bp, Artificial Sequence
  chemically synthesized
attttgatcattgcaaatat

SEQ ID NO: 214604 - DNA, 20 bp, Artificial Sequence
  chemically synthesized
tcttaccttgttgaacatgt

SEQ ID NO: 214605 - DNA, 20 bp, Artificial Sequence
  chemically synthesized
aaacaacttacatgttcaac

SEQ ID NO: 214606 - DNA, 20 bp, Artificial Sequence
  chemically synthesized
aacaacttacatgttcaaca

SEQ ID NO: 214607 - DNA, 20 bp, Artificial Sequence
  chemically synthesized
acttacatgttcaacaaggt

SEQ ID NO: 214608 - DNA, 20 bp, Artificial Sequence
  chemically synthesized
catgttcaacaaggtaagat

SEQ ID NO: 214609 - DNA, 20 bp, Artificial Sequence
  chemically synthesized
taagattggttaaaaaaaat

SEQ ID NO: 214610 - DNA, 20 bp, Artificial Sequence
  chemically synthesized
caaatacaacaaaatactat

SEQ ID NO: 214611 - DNA, 20 bp, Artificial Sequence
  chemically synthesized
aaatacaacaaaatactatc

SEQ ID NO: 214612 - DNA, 20 bp, Artificial Sequence
  chemically synthesized
cacatttttaaatgacctga

SEQ ID NO: 214613 - DNA, 20 bp, Artificial Sequence
  chemically synthesized
caggtcatttaaaaatgtga

SEQ ID NO: 214614 - DNA, 20 bp, Artificial Sequence
  chemically synthesized
aatgtgaaagaatgaaattt

SEQ ID NO: 214615 - DNA, 20 bp, Artificial Sequence
  chemically synthesized
tgtgaaagaatgaaatttaa

SEQ ID NO: 214616 - DNA, 20 bp, Artificial Sequence
  chemically synthesized
aagaatgaaatttaagagca

SEQ ID NO: 214617 - DNA, 20 bp, Artificial Sequence
  chemically synthesized
aatgaaatttaagagcaaag

SEQ ID NO: 214618 - DNA, 20 bp, Artificial Sequence
  chemically synthesized
caaagaagaatctcatgcta

SEQ ID NO: 214619 - DNA, 20 bp, Artificial Sequence
  chemically synthesized
aagagaaatctctgtagcat

SEQ ID NO: 214620 - DNA, 20 bp, Artificial Sequence
  chemically synthesized
aagaagaatctcatgctaca

SEQ ID NO: 214621 - DNA, 20 bp, Artificial Sequence
  chemically synthesized
ctttgtaagagaaatctctg

SEQ ID NO: 214622 - DNA, 20 bp, Artificial Sequence
  chemically synthesized
ctacagagatttctcttaca

SEQ ID NO: 214623 - DNA, 20 bp, Artificial Sequence
  chemically synthesized
ttagatgactttctttgtaa

SEQ ID NO: 214624 - DNA, 20 bp, Artificial Sequence
  chemically synthesized
agagatttctcttacaaaga

SEQ ID NO: 214625 - DNA, 20 bp, Artificial Sequence
  chemically synthesized
atttagatgactttctttgt

SEQ ID NO: 214626 - DNA, 20 bp, Artificial Sequence
  chemically synthesized
gcattctatccatgagaatt

SEQ ID NO: 214627 - DNA, 20 bp, Artificial Sequence
  chemically synthesized
gaaagtcatctaaattctca

SEQ ID NO: 214628 - DNA, 20 bp, Artificial Sequence
  chemically synthesized
gtcatctaaattctcatgga

SEQ ID NO: 214629 - DNA, 20 bp, Artificial Sequence
  chemically synthesized
atctattgcattctatccat

SEQ ID NO: 214630 - DNA, 20 bp, Artificial Sequence
  chemically synthesized
ttctcatggatagaatgcaa

SEQ ID NO: 214631 - DNA, 20 bp, Artificial Sequence
  chemically synthesized
atagaatgcaatagattaat

SEQ ID NO: 214632 - DNA, 20 bp, Artificial Sequence
  chemically synthesized
tagaatgcaatagattaatt

SEQ ID NO: 214633 - DNA, 20 bp, Artificial Sequence
  chemically synthesized
gcaatagattaattaggaaa

SEQ ID NO: 214634 - DNA, 20 bp, Artificial Sequence
  chemically synthesized
taattaggaaacagtattta

SEQ ID NO: 214635 - DNA, 20 bp, Artificial Sequence
  chemically synthesized
ggaaacagtatttatagaaa

SEQ ID NO: 214636 - DNA, 20 bp, Artificial Sequence
  chemically synthesized
gaaacagtatttatagaaac

SEQ ID NO: 214637 - DNA, 20 bp, Artificial Sequence
  chemically synthesized
taattttatggcaatttaac

SEQ ID NO: 214638 - DNA, 20 bp, Artificial Sequence
  chemically synthesized
tcgttaaattgccataaaat

SEQ ID NO: 214639 - DNA, 20 bp, Artificial Sequence
  chemically synthesized
ttgttcttgttctaatttta

SEQ ID NO: 214640 - DNA, 20 bp, Artificial Sequence
  chemically synthesized
aattgccataaaattagaac

SEQ ID NO: 214641 - DNA, 20 bp, Artificial Sequence
  chemically synthesized
attagaacaagaacaaacac

SEQ ID NO: 214642 - DNA, 20 bp, Artificial Sequence
  chemically synthesized
aagaacaaacactagcttaa

SEQ ID NO: 214643 - DNA, 20 bp, Artificial Sequence
  chemically synthesized
ggcacttttctcttttaagc

SEQ ID NO: 214644 - DNA, 20 bp, Artificial Sequence
  chemically synthesized
gaacaaacactagcttaaaa

SEQ ID NO: 214645 - DNA, 20 bp, Artificial Sequence
  chemically synthesized
aaaaggcacttttctctttt

SEQ ID NO: 214646 - DNA, 20 bp, Artificial Sequence
  chemically synthesized
aacactagcttaaaagagaa

SEQ ID NO: 214647 - DNA, 20 bp, Artificial Sequence
  chemically synthesized
agagaaaagtgccttttcct

SEQ ID NO: 214648 - DNA, 20 bp, Artificial Sequence
  chemically synthesized
gagaaaagtgccttttcctg

SEQ ID NO: 214649 - DNA, 20 bp, Artificial Sequence
  chemically synthesized
tatcacatgtcctcaggaaa

SEQ ID NO: 214650 - DNA, 20 bp, Artificial Sequence
  chemically synthesized
gtatcacatgtcctcaggaa

SEQ ID NO: 214651 - DNA, 20 bp, Artificial Sequence
  chemically synthesized
tcattgtatcacatgtcctc

SEQ ID NO: 214652 - DNA, 20 bp, Artificial Sequence
  chemically synthesized
atcattgtatcacatgtcct

SEQ ID NO: 214653 - DNA, 20 bp, Artificial Sequence
  chemically synthesized
gaggacatgtgatacaatga

SEQ ID NO: 214654 - DNA, 20 bp, Artificial Sequence
  chemically synthesized
tgatacaatgatggcattta

SEQ ID NO: 214655 - DNA, 20 bp, Artificial Sequence
  chemically synthesized
gatggcatttacagaaaaat

SEQ ID NO: 214656 - DNA, 20 bp, Artificial Sequence
  chemically synthesized
aaaaatgagttaatgatact

SEQ ID NO: 214657 - DNA, 20 bp, Artificial Sequence
  chemically synthesized
aaaatgagttaatgatactg

SEQ ID NO: 214658 - DNA, 20 bp, Artificial Sequence
  chemically synthesized
aaatgagttaatgatactga

SEQ ID NO: 214659 - DNA, 20 bp, Artificial Sequence
  chemically synthesized
agttaatgatactgagggac

SEQ ID NO: 214660 - DNA, 20 bp, Artificial Sequence
  chemically synthesized
ctttctttttgccagtccct

SEQ ID NO: 214661 - DNA, 20 bp, Artificial Sequence
  chemically synthesized
gatactgagggactggcaaa

SEQ ID NO: 214662 - DNA, 20 bp, Artificial Sequence
  chemically synthesized
atggcctcctttctttttgc

SEQ ID NO: 214663 - DNA, 20 bp, Artificial Sequence
  chemically synthesized
ctgagggactggcaaaaaga

SEQ ID NO: 214664 - DNA, 20 bp, Artificial Sequence
  chemically synthesized
tgagggactggcaaaaagaa

SEQ ID NO: 214665 - DNA, 20 bp, Artificial Sequence
  chemically synthesized
agggactggcaaaaagaaag

SEQ ID NO: 214666 - DNA, 20 bp, Artificial Sequence
  chemically synthesized
gggactggcaaaaagaaagg

SEQ ID NO: 214667 - DNA, 20 bp, Artificial Sequence
  chemically synthesized
aagaaaggaggccattttca

SEQ ID NO: 214668 - DNA, 20 bp, Artificial Sequence
  chemically synthesized
tttccttggttccatgaaaa

SEQ ID NO: 214669 - DNA, 20 bp, Artificial Sequence
  chemically synthesized
gaggccattttcatggaacc

SEQ ID NO: 214670 - DNA, 20 bp, Artificial Sequence
  chemically synthesized
aggccattttcatggaacca

SEQ ID NO: 214671 - DNA, 20 bp, Artificial Sequence
  chemically synthesized
cctttgaatatagttttcct

SEQ ID NO: 214672 - DNA, 20 bp, Artificial Sequence
  chemically synthesized
accaaggaaaactatattca

SEQ ID NO: 214673 - DNA, 20 bp, Artificial Sequence
  chemically synthesized
ccaaggaaaactatattcaa

SEQ ID NO: 214674 - DNA, 20 bp, Artificial Sequence
  chemically synthesized
aaagataccacctttgaata

SEQ ID NO: 214675 - DNA, 20 bp, Artificial Sequence
  chemically synthesized
aggaaaactatattcaaagg

SEQ ID NO: 214676 - DNA, 20 bp, Artificial Sequence
  chemically synthesized
ataaaaccaatagcagagaa

SEQ ID NO: 214677 - DNA, 20 bp, Artificial Sequence
  chemically synthesized
tggtatcttttctctgctat

SEQ ID NO: 214678 - DNA, 20 bp, Artificial Sequence
  chemically synthesized
tgattataaaaccaatagca

SEQ ID NO: 214679 - DNA, 20 bp, Artificial Sequence
  chemically synthesized
tatgattataaaaccaatag

SEQ ID NO: 214680 - DNA, 20 bp, Artificial Sequence
  chemically synthesized
gtatatgattataaaaccaa

SEQ ID NO: 214681 - DNA, 20 bp, Artificial Sequence
  chemically synthesized
gttttataatcatataccta

SEQ ID NO: 214682 - DNA, 20 bp, Artificial Sequence
  chemically synthesized
taatttttaagtgtagctat

SEQ ID NO: 214683 - DNA, 20 bp, Artificial Sequence
  chemically synthesized
ttaatttttaagtgtagcta

SEQ ID NO: 214684 - DNA, 20 bp, Artificial Sequence
  chemically synthesized
agtattttaatttttaagtg

SEQ ID NO: 214685 - DNA, 20 bp, Artificial Sequence
  chemically synthesized
ctgtaagtattttaattttt

SEQ ID NO: 214686 - DNA, 20 bp, Artificial Sequence
  chemically synthesized
cttaaaaattaaaatactta

SEQ ID NO: 214687 - DNA, 20 bp, Artificial Sequence
  chemically synthesized
atcaaagttatattttctgt

SEQ ID NO: 214688 - DNA, 20 bp, Artificial Sequence
  chemically synthesized
gtttcagactatcaatatca

SEQ ID NO: 214689 - DNA, 20 bp, Artificial Sequence
  chemically synthesized
aaatataactttgatattga

SEQ ID NO: 214690 - DNA, 20 bp, Artificial Sequence
  chemically synthesized
gaggttggggtagagagttt

SEQ ID NO: 214691 - DNA, 20 bp, Artificial Sequence
  chemically synthesized
agagaagaggttggggtaga

SEQ ID NO: 214692 - DNA, 20 bp, Artificial Sequence
  chemically synthesized
taagagaagaggttggggta

SEQ ID NO: 214693 - DNA, 20 bp, Artificial Sequence
  chemically synthesized
attaagagaagaggttgggg

SEQ ID NO: 214694 - DNA, 20 bp, Artificial Sequence
  chemically synthesized
tccattaagagaagaggttg

SEQ ID NO: 214695 - DNA, 20 bp, Artificial Sequence
  chemically synthesized
atccattaagagaagaggtt

SEQ ID NO: 214696 - DNA, 20 bp, Artificial Sequence
  chemically synthesized
tatccattaagagaagaggt

SEQ ID NO: 214697 - DNA, 20 bp, Artificial Sequence
  chemically synthesized
taattatccattaagagaag

SEQ ID NO: 214698 - DNA, 20 bp, Artificial Sequence
  chemically synthesized
ataattatccattaagagaa

SEQ ID NO: 214699 - DNA, 20 bp, Artificial Sequence
  chemically synthesized
accccaacctcttctcttaa

SEQ ID NO: 214700 - DNA, 20 bp, Artificial Sequence
  chemically synthesized
acataattatccattaagag

SEQ ID NO: 214701 - DNA, 20 bp, Artificial Sequence
  chemically synthesized
taaacataattatccattaa

SEQ ID NO: 214702 - DNA, 20 bp, Artificial Sequence
  chemically synthesized
cttaaacataattatccatt

SEQ ID NO: 214703 - DNA, 20 bp, Artificial Sequence
  chemically synthesized
cttaatggataattatgttt

SEQ ID NO: 214704 - DNA, 20 bp, Artificial Sequence
  chemically synthesized
atggataattatgtttaaga

SEQ ID NO: 214705 - DNA, 20 bp, Artificial Sequence
  chemically synthesized
gatggttttttaaataacgt

SEQ ID NO: 214706 - DNA, 20 bp, Artificial Sequence
  chemically synthesized
atggttttttaaataacgtg

SEQ ID NO: 214707 - DNA, 20 bp, Artificial Sequence
  chemically synthesized
aataacgtgaggttttttat

SEQ ID NO: 214708 - DNA, 20 bp, Artificial Sequence
  chemically synthesized
cgtgaggttttttattagtt

SEQ ID NO: 214709 - DNA, 20 bp, Artificial Sequence
  chemically synthesized
tttttattagttaagaacac

SEQ ID NO: 214710 - DNA, 20 bp, Artificial Sequence
  chemically synthesized
ttttattagttaagaacaca

SEQ ID NO: 214711 - DNA, 20 bp, Artificial Sequence
  chemically synthesized
ttattagttaagaacacaag

SEQ ID NO: 214712 - DNA, 20 bp, Artificial Sequence
  chemically synthesized
taagaacacaaggagcatgt

SEQ ID NO: 214713 - DNA, 20 bp, Artificial Sequence
  chemically synthesized
tttctgaacttcacaacatg

SEQ ID NO: 214714 - DNA, 20 bp, Artificial Sequence
  chemically synthesized
agaatacactgcatgttgtg

SEQ ID NO: 214715 - DNA, 20 bp, Artificial Sequence
  chemically synthesized
acactgcatgttgtgaagtt

SEQ ID NO: 214716 - DNA, 20 bp, Artificial Sequence
  chemically synthesized
tgcatgttgtgaagttcaga

SEQ ID NO: 214717 - DNA, 20 bp, Artificial Sequence
  chemically synthesized
gttcagaaagcctgttataa

SEQ ID NO: 214718 - DNA, 20 bp, Artificial Sequence
  chemically synthesized
agatactgctcttttataac

SEQ ID NO: 214719 - DNA, 20 bp, Artificial Sequence
  chemically synthesized
aagatactgctcttttataa

SEQ ID NO: 214720 - DNA, 20 bp, Artificial Sequence
  chemically synthesized
tcagaaagcctgttataaaa

SEQ ID NO: 214721 - DNA, 20 bp, Artificial Sequence
  chemically synthesized
gaaagcctgttataaaagag

SEQ ID NO: 214722 - DNA, 20 bp, Artificial Sequence
  chemically synthesized
tatgtttatgaaaaggcaat

SEQ ID NO: 214723 - DNA, 20 bp, Artificial Sequence
  chemically synthesized
acattcgtatgtttatgaaa

SEQ ID NO: 214724 - DNA, 20 bp, Artificial Sequence
  chemically synthesized
aacattcgtatgtttatgaa

SEQ ID NO: 214725 - DNA, 20 bp, Artificial Sequence
  chemically synthesized
taaaattcatatttatataa

SEQ ID NO: 214726 - DNA, 20 bp, Artificial Sequence
  chemically synthesized
aaaattcatatttatataac

SEQ ID NO: 214727 - DNA, 20 bp, Artificial Sequence
  chemically synthesized
atatttatataacaggaaaa

SEQ ID NO: 214728 - DNA, 20 bp, Artificial Sequence
  chemically synthesized
ataacaggaaaaaagactat

SEQ ID NO: 214729 - DNA, 20 bp, Artificial Sequence
  chemically synthesized
taacaggaaaaaagactatt

SEQ ID NO: 214730 - DNA, 20 bp, Artificial Sequence
  chemically synthesized
catgttcaaacatttcctaa

SEQ ID NO: 214731 - DNA, 20 bp, Artificial Sequence
  chemically synthesized
aaaatgtatcaaaatgttaa

SEQ ID NO: 214732 - DNA, 20 bp, Artificial Sequence
  chemically synthesized
atgtatcaaaatgttaaaag

SEQ ID NO: 214733 - DNA, 20 bp, Artificial Sequence
  chemically synthesized
aaatgttaaaagtggtttgc

SEQ ID NO: 214734 - DNA, 20 bp, Artificial Sequence
  chemically synthesized
aatgttaaaagtggtttgct

SEQ ID NO: 214735 - DNA, 20 bp, Artificial Sequence
  chemically synthesized
atgttaaaagtggtttgctg

SEQ ID NO: 214736 - DNA, 20 bp, Artificial Sequence
  chemically synthesized
taaaagtggtttgctgggga

SEQ ID NO: 214737 - DNA, 20 bp, Artificial Sequence
  chemically synthesized
ttctttaatatcactttccc

SEQ ID NO: 214738 - DNA, 20 bp, Artificial Sequence
  chemically synthesized
tgctggggaaagtgatatta

SEQ ID NO: 214739 - DNA, 20 bp, Artificial Sequence
  chemically synthesized
tggggaaagtgatattaaag

SEQ ID NO: 214740 - DNA, 20 bp, Artificial Sequence
  chemically synthesized
taggctgatagatgagcata

SEQ ID NO: 214741 - DNA, 20 bp, Artificial Sequence
  chemically synthesized
tataggctgatagatgagca

SEQ ID NO: 214742 - DNA, 20 bp, Artificial Sequence
  chemically synthesized
ttttctctatgctcatctat

SEQ ID NO: 214743 - DNA, 20 bp, Artificial Sequence
  chemically synthesized
aaatgtataggctgatagat

SEQ ID NO: 214744 - DNA, 20 bp, Artificial Sequence
  chemically synthesized
atgaaaaatgtataggctga

SEQ ID NO: 214745 - DNA, 20 bp, Artificial Sequence
  chemically synthesized
gtttattatgaaaaatgtat

SEQ ID NO: 214746 - DNA, 20 bp, Artificial Sequence
  chemically synthesized
ggtttattatgaaaaatgta

SEQ ID NO: 214747 - DNA, 20 bp, Artificial Sequence
  chemically synthesized
tcagaatatgcaaataatat

SEQ ID NO: 214748 - DNA, 20 bp, Artificial Sequence
  chemically synthesized
ttatttgcatattctgaaaa

SEQ ID NO: 214749 - DNA, 20 bp, Artificial Sequence
  chemically synthesized
caagtaaataacactttttt

SEQ ID NO: 214750 - DNA, 20 bp, Artificial Sequence
  chemically synthesized
aaaaagtgttatttacttgt

SEQ ID NO: 214751 - DNA, 20 bp, Artificial Sequence
  chemically synthesized
aacatgaaattttagctaac

SEQ ID NO: 214752 - DNA, 20 bp, Artificial Sequence
  chemically synthesized
aatcaaataacatgaaattt

SEQ ID NO: 214753 - DNA, 20 bp, Artificial Sequence
  chemically synthesized
aaatttcatgttatttgatt

SEQ ID NO: 214754 - DNA, 20 bp, Artificial Sequence
  chemically synthesized
aaaactgagcagaagaaaca

SEQ ID NO: 214755 - DNA, 20 bp, Artificial Sequence
  chemically synthesized
cagactgtgtttcttctgct

SEQ ID NO: 214756 - DNA, 20 bp, Artificial Sequence
  chemically synthesized
gcattccaaaaactgagcag

SEQ ID NO: 214757 - DNA, 20 bp, Artificial Sequence
  chemically synthesized
agagcattccaaaaactgag

SEQ ID NO: 214758 - DNA, 20 bp, Artificial Sequence
  chemically synthesized
tgtttcttctgctcagtttt

SEQ ID NO: 214759 - DNA, 20 bp, Artificial Sequence
  chemically synthesized
gagagagcattccaaaaact

SEQ ID NO: 214760 - DNA, 20 bp, Artificial Sequence
  chemically synthesized
atagattgagtgtagagaga

SEQ ID NO: 214761 - DNA, 20 bp, Artificial Sequence
  chemically synthesized
agatagattgagtgtagaga

SEQ ID NO: 214762 - DNA, 20 bp, Artificial Sequence
  chemically synthesized
tcagatagattgagtgtaga

SEQ ID NO: 214763 - DNA, 20 bp, Artificial Sequence
  chemically synthesized
tctcagatagattgagtgta

SEQ ID NO: 214764 - DNA, 20 bp, Artificial Sequence
  chemically synthesized
cttctcagatagattgagtg

SEQ ID NO: 214765 - DNA, 20 bp, Artificial Sequence
  chemically synthesized
tgattcttctcagatagatt

SEQ ID NO: 214766 - DNA, 20 bp, Artificial Sequence
  chemically synthesized
tctctacactcaatctatct

SEQ ID NO: 214767 - DNA, 20 bp, Artificial Sequence
  chemically synthesized
ctacactcaatctatctgag

SEQ ID NO: 214768 - DNA, 20 bp, Artificial Sequence
  chemically synthesized
agctgttgattcttctcaga

SEQ ID NO: 214769 - DNA, 20 bp, Artificial Sequence
  chemically synthesized
ttgtagctgttgattcttct

SEQ ID NO: 214770 - DNA, 20 bp, Artificial Sequence
  chemically synthesized
atctatctgagaagaatcaa

SEQ ID NO: 214771 - DNA, 20 bp, Artificial Sequence
  chemically synthesized
gcaaaaaaaaaattgtattg

SEQ ID NO: 214772 - DNA, 20 bp, Artificial Sequence
  chemically synthesized
tacaattttttttttgcatt

SEQ ID NO: 214773 - DNA, 20 bp, Artificial Sequence
  chemically synthesized
caattttttttttgcattta

SEQ ID NO: 214774 - DNA, 20 bp, Artificial Sequence
  chemically synthesized
agaattattctgggcgcata

SEQ ID NO: 214775 - DNA, 20 bp, Artificial Sequence
  chemically synthesized
atttagagactctatgcgcc

SEQ ID NO: 214776 - DNA, 20 bp, Artificial Sequence
  chemically synthesized
acagaattattctgggcgca

SEQ ID NO: 214777 - DNA, 20 bp, Artificial Sequence
  chemically synthesized
acatatcacagaattattct

SEQ ID NO: 214778 - DNA, 20 bp, Artificial Sequence
  chemically synthesized
tacatatcacagaattattc

SEQ ID NO: 214779 - DNA, 20 bp, Artificial Sequence
  chemically synthesized
ataaagagaaatacatatca

SEQ ID NO: 214780 - DNA, 20 bp, Artificial Sequence
  chemically synthesized
tatatagacttttagataaa

SEQ ID NO: 214781 - DNA, 20 bp, Artificial Sequence
  chemically synthesized
atgtatttctctttatctaa

SEQ ID NO: 214782 - DNA, 20 bp, Artificial Sequence
  chemically synthesized
tctatatagacttttagata

SEQ ID NO: 214783 - DNA, 20 bp, Artificial Sequence
  chemically synthesized
cccttgtctatatagacttt

SEQ ID NO: 214784 - DNA, 20 bp, Artificial Sequence
  chemically synthesized
tctttatctaaaagtctata

SEQ ID NO: 214785 - DNA, 20 bp, Artificial Sequence
  chemically synthesized
atctaaaagtctatatagac

SEQ ID NO: 214786 - DNA, 20 bp, Artificial Sequence
  chemically synthesized
atcagagccccttgtctata

SEQ ID NO: 214787 - DNA, 20 bp, Artificial Sequence
  chemically synthesized
tctaaaagtctatatagaca

SEQ ID NO: 214788 - DNA, 20 bp, Artificial Sequence
  chemically synthesized
ctaaaagtctatatagacaa

SEQ ID NO: 214789 - DNA, 20 bp, Artificial Sequence
  chemically synthesized
taaaagtctatatagacaag

SEQ ID NO: 214790 - DNA, 20 bp, Artificial Sequence
  chemically synthesized
agacaaggggctctgataca

SEQ ID NO: 214791 - DNA, 20 bp, Artificial Sequence
  chemically synthesized
aaagaagaaaccatgtatca

SEQ ID NO: 214792 - DNA, 20 bp, Artificial Sequence
  chemically synthesized
ttaaagaagaaaccatgtat

SEQ ID NO: 214793 - DNA, 20 bp, Artificial Sequence
  chemically synthesized
tgatacatggtttcttcttt

SEQ ID NO: 214794 - DNA, 20 bp, Artificial Sequence
  chemically synthesized
tgttcgatggtggcttaaag

SEQ ID NO: 214795 - DNA, 20 bp, Artificial Sequence
  chemically synthesized
gcatgttcgatggtggctta

SEQ ID NO: 214796 - DNA, 20 bp, Artificial Sequence
  chemically synthesized
tcctgcagcatgttcgatgg

SEQ ID NO: 214797 - DNA, 20 bp, Artificial Sequence
  chemically synthesized
ctttcctgcagcatgttcga

SEQ ID NO: 214798 - DNA, 20 bp, Artificial Sequence
  chemically synthesized
agccaccatcgaacatgctg

SEQ ID NO: 214799 - DNA, 20 bp, Artificial Sequence
  chemically synthesized
gccaccatcgaacatgctgc

SEQ ID NO: 214800 - DNA, 20 bp, Artificial Sequence
  chemically synthesized
ccatcgaacatgctgcagga

SEQ ID NO: 214801 - DNA, 20 bp, Artificial Sequence
  chemically synthesized
ccccacgattaactttcctg

SEQ ID NO: 214802 - DNA, 20 bp, Artificial Sequence
  chemically synthesized
tgctgcaggaaagttaatcg

SEQ ID NO: 214803 - DNA, 20 bp, Artificial Sequence
  chemically synthesized
gctgcaggaaagttaatcgt

SEQ ID NO: 214804 - DNA, 20 bp, Artificial Sequence
  chemically synthesized
ctgcaggaaagttaatcgtg

SEQ ID NO: 214805 - DNA, 20 bp, Artificial Sequence
  chemically synthesized
ttaatcgtggggatatccaa

SEQ ID NO: 214806 - DNA, 20 bp, Artificial Sequence
  chemically synthesized
aatcgtggggatatccaaca

SEQ ID NO: 214807 - DNA, 20 bp, Artificial Sequence
  chemically synthesized
ttattgatacaggtctctgt

SEQ ID NO: 214808 - DNA, 20 bp, Artificial Sequence
  chemically synthesized
ttttcttatgttattgatac

SEQ ID NO: 214809 - DNA, 20 bp, Artificial Sequence
  chemically synthesized
attttcttatgttattgata

SEQ ID NO: 214810 - DNA, 20 bp, Artificial Sequence
  chemically synthesized
gagacctgtatcaataacat

SEQ ID NO: 214811 - DNA, 20 bp, Artificial Sequence
  chemically synthesized
gtatcaataacataagaaaa

SEQ ID NO: 214812 - DNA, 20 bp, Artificial Sequence
  chemically synthesized
tatcaataacataagaaaat

SEQ ID NO: 214813 - DNA, 20 bp, Artificial Sequence
  chemically synthesized
ccctaggaaataaaagtatc

SEQ ID NO: 214814 - DNA, 20 bp, Artificial Sequence
  chemically synthesized
accctaggaaataaaagtat

SEQ ID NO: 214815 - DNA, 20 bp, Artificial Sequence
  chemically synthesized
tttttcaccctaggaaataa

SEQ ID NO: 214816 - DNA, 20 bp, Artificial Sequence
  chemically synthesized
cacccgatacttttatttcc

SEQ ID NO: 214817 - DNA, 20 bp, Artificial Sequence
  chemically synthesized
acccgatacttttatttcct

SEQ ID NO: 214818 - DNA, 20 bp, Artificial Sequence
  chemically synthesized
cccgatacttttatttccta

SEQ ID NO: 214819 - DNA, 20 bp, Artificial Sequence
  chemically synthesized
tctaatttctttttcaccct

SEQ ID NO: 214820 - DNA, 20 bp, Artificial Sequence
  chemically synthesized
ctctaatttctttttcaccc

SEQ ID NO: 214821 - DNA, 20 bp, Artificial Sequence
  chemically synthesized
ttttatttcctagggtgaaa

SEQ ID NO: 214822 - DNA, 20 bp, Artificial Sequence
  chemically synthesized
tcctagggtgaaaaagaaat

SEQ ID NO: 214823 - DNA, 20 bp, Artificial Sequence
  chemically synthesized
ctagggtgaaaaagaaatta

SEQ ID NO: 214824 - DNA, 20 bp, Artificial Sequence
  chemically synthesized
ggtgaaaaagaaattagagc

SEQ ID NO: 214825 - DNA, 20 bp, Artificial Sequence
  chemically synthesized
gtgaaaaagaaattagagcc

SEQ ID NO: 214826 - DNA, 20 bp, Artificial Sequence
  chemically synthesized
tttttataccagatattacc

SEQ ID NO: 214827 - DNA, 20 bp, Artificial Sequence
  chemically synthesized
aattagagccaggtaatatc

SEQ ID NO: 214828 - DNA, 20 bp, Artificial Sequence
  chemically synthesized
gatattacctatttttatac

SEQ ID NO: 214829 - DNA, 20 bp, Artificial Sequence
  chemically synthesized
ggtaatatctggtataaaaa

SEQ ID NO: 214830 - DNA, 20 bp, Artificial Sequence
  chemically synthesized
gtaatatctggtataaaaat

SEQ ID NO: 214831 - DNA, 20 bp, Artificial Sequence
  chemically synthesized
atatcatacaaaattcatta

SEQ ID NO: 214832 - DNA, 20 bp, Artificial Sequence
  chemically synthesized
aaattcattaaagaaaatct

SEQ ID NO: 214833 - DNA, 20 bp, Artificial Sequence
  chemically synthesized
cattaaagaaaatctgagtg

SEQ ID NO: 214834 - DNA, 20 bp, Artificial Sequence
  chemically synthesized
gatttggtaatttccgcact

SEQ ID NO: 214835 - DNA, 20 bp, Artificial Sequence
  chemically synthesized
gtgcggaaattaccaaatca

SEQ ID NO: 214836 - DNA, 20 bp, Artificial Sequence
  chemically synthesized
agctctaatattctgtgatt

SEQ ID NO: 214837 - DNA, 20 bp, Artificial Sequence
  chemically synthesized
attaccaaatcacagaatat

SEQ ID NO: 214838 - DNA, 20 bp, Artificial Sequence
  chemically synthesized
taccaaatcacagaatatta

SEQ ID NO: 214839 - DNA, 20 bp, Artificial Sequence
  chemically synthesized
aaatcacagaatattagagc

SEQ ID NO: 214840 - DNA, 20 bp, Artificial Sequence
  chemically synthesized
acagaatattagagctggaa

SEQ ID NO: 214841 - DNA, 20 bp, Artificial Sequence
  chemically synthesized
tatctgtacaatgtcttttc

SEQ ID NO: 214842 - DNA, 20 bp, Artificial Sequence
  chemically synthesized
gagctggaaaagacattgta

SEQ ID NO: 214843 - DNA, 20 bp, Artificial Sequence
  chemically synthesized
gaaaagacattgtacagata

SEQ ID NO: 214844 - DNA, 20 bp, Artificial Sequence
  chemically synthesized
aatttgaaaaaaaaaaaata

SEQ ID NO: 214845 - DNA, 20 bp, Artificial Sequence
  chemically synthesized
tttgaaaaaaaaaaaataca

SEQ ID NO: 214846 - DNA, 20 bp, Artificial Sequence
  chemically synthesized
aaaaaaaaaatacagagatg

SEQ ID NO: 214847 - DNA, 20 bp, Artificial Sequence
  chemically synthesized
aggcatttctgtgaggacag

SEQ ID NO: 214848 - DNA, 20 bp, Artificial Sequence
  chemically synthesized
tgatcattctgctgtcctca

SEQ ID NO: 214849 - DNA, 20 bp, Artificial Sequence
  chemically synthesized
agcaggcatttctgtgagga

SEQ ID NO: 214850 - DNA, 20 bp, Artificial Sequence
  chemically synthesized
aagtagcaggcatttctgtg

SEQ ID NO: 214851 - DNA, 20 bp, Artificial Sequence
  chemically synthesized
gaagtagcaggcatttctgt

SEQ ID NO: 214852 - DNA, 20 bp, Artificial Sequence
  chemically synthesized
gaaaattcaatagaagtagc

SEQ ID NO: 214853 - DNA, 20 bp, Artificial Sequence
  chemically synthesized
ggaaaattcaatagaagtag

SEQ ID NO: 214854 - DNA, 20 bp, Artificial Sequence
  chemically synthesized
agaggaaaattcaatagaag

SEQ ID NO: 214855 - DNA, 20 bp, Artificial Sequence
  chemically synthesized
atgagaggaaaattcaatag

SEQ ID NO: 214856 - DNA, 20 bp, Artificial Sequence
  chemically synthesized
aagatgagaggaaaattcaa

SEQ ID NO: 214857 - DNA, 20 bp, Artificial Sequence
  chemically synthesized
aatgcttaaaggaagatgag

SEQ ID NO: 214858 - DNA, 20 bp, Artificial Sequence
  chemically synthesized
aaatgcttaaaggaagatga

SEQ ID NO: 214859 - DNA, 20 bp, Artificial Sequence
  chemically synthesized
agaaatgcttaaaggaagat

SEQ ID NO: 214860 - DNA, 20 bp, Artificial Sequence
  chemically synthesized
ttttcctctcatcttccttt

SEQ ID NO: 214861 - DNA, 20 bp, Artificial Sequence
  chemically synthesized
actccagaaatgcttaaagg

SEQ ID NO: 214862 - DNA, 20 bp, Artificial Sequence
  chemically synthesized
cgcactccagaaatgcttaa

SEQ ID NO: 214863 - DNA, 20 bp, Artificial Sequence
  chemically synthesized
acgcactccagaaatgctta

SEQ ID NO: 214864 - DNA, 20 bp, Artificial Sequence
  chemically synthesized
catcttcctttaagcatttc

SEQ ID NO: 214865 - DNA, 20 bp, Artificial Sequence
  chemically synthesized
tcttcctttaagcatttctg

SEQ ID NO: 214866 - DNA, 20 bp, Artificial Sequence
  chemically synthesized
ttaagcatttctggagtgcg

SEQ ID NO: 214867 - DNA, 20 bp, Artificial Sequence
  chemically synthesized
attacacacaccacgcactc

SEQ ID NO: 214868 - DNA, 20 bp, Artificial Sequence
  chemically synthesized
gcgtggtgtgtgtaatcata

SEQ ID NO: 214869 - DNA, 20 bp, Artificial Sequence
  chemically synthesized
gttttgtgttaaatgccaaa

SEQ ID NO: 214870 - DNA, 20 bp, Artificial Sequence
  chemically synthesized
ttttgtgttaaatgccaaaa

SEQ ID NO: 214871 - DNA, 20 bp, Artificial Sequence
  chemically synthesized
ttgtgttaaatgccaaaaag

SEQ ID NO: 214872 - DNA, 20 bp, Artificial Sequence
  chemically synthesized
tgtgttaaatgccaaaaagg

SEQ ID NO: 214873 - DNA, 20 bp, Artificial Sequence
  chemically synthesized
ttttatgatttcctcctttt

SEQ ID NO: 214874 - DNA, 20 bp, Artificial Sequence
  chemically synthesized
caaaaaggaggaaatcataa

SEQ ID NO: 214875 - DNA, 20 bp, Artificial Sequence
  chemically synthesized
aaaaggaggaaatcataaaa

SEQ ID NO: 214876 - DNA, 20 bp, Artificial Sequence
  chemically synthesized
aggaggaaatcataaaagag

SEQ ID NO: 214877 - DNA, 20 bp, Artificial Sequence
  chemically synthesized
gcaggactatcaaaatataa

SEQ ID NO: 214878 - DNA, 20 bp, Artificial Sequence
  chemically synthesized
atttttctattatattttga

SEQ ID NO: 214879 - DNA, 20 bp, Artificial Sequence
  chemically synthesized
aaaataattatgcagagggc

SEQ ID NO: 214880 - DNA, 20 bp, Artificial Sequence
  chemically synthesized
caaaataattatgcagaggg

SEQ ID NO: 214881 - DNA, 20 bp, Artificial Sequence
  chemically synthesized
aaacaaaataattatgcaga

SEQ ID NO: 214882 - DNA, 20 bp, Artificial Sequence
  chemically synthesized
gaaacaaaataattatgcag

SEQ ID NO: 214883 - DNA, 20 bp, Artificial Sequence
  chemically synthesized
agaaacaaaataattatgca

SEQ ID NO: 214884 - DNA, 20 bp, Artificial Sequence
  chemically synthesized
ttagaaacaaaataattatg

SEQ ID NO: 214885 - DNA, 20 bp, Artificial Sequence
  chemically synthesized
agagattatgttggagacat

SEQ ID NO: 214886 - DNA, 20 bp, Artificial Sequence
  chemically synthesized
atgtttaagagattatgttg

SEQ ID NO: 214887 - DNA, 20 bp, Artificial Sequence
  chemically synthesized
aaatgtttaagagattatgt

SEQ ID NO: 214888 - DNA, 20 bp, Artificial Sequence
  chemically synthesized
atattttaagaaatgtttaa

SEQ ID NO: 214889 - DNA, 20 bp, Artificial Sequence
  chemically synthesized
aaatattttaagaaatgttt

SEQ ID NO: 214890 - DNA, 20 bp, Artificial Sequence
  chemically synthesized
taggataaaaaaaatatttt

SEQ ID NO: 214891 - DNA, 20 bp, Artificial Sequence
  chemically synthesized
attttttttatcctaaatgc

SEQ ID NO: 214892 - DNA, 20 bp, Artificial Sequence
  chemically synthesized
gccttagtcggctcgcattt

SEQ ID NO: 214893 - DNA, 20 bp, Artificial Sequence
  chemically synthesized
tgccttagtcggctcgcatt

SEQ ID NO: 214894 - DNA, 20 bp, Artificial Sequence
  chemically synthesized
atcctaaatgcgagccgact

SEQ ID NO: 214895 - DNA, 20 bp, Artificial Sequence
  chemically synthesized
tcctaaatgcgagccgacta

SEQ ID NO: 214896 - DNA, 20 bp, Artificial Sequence
  chemically synthesized
tgtcaagaagttgccttagt

SEQ ID NO: 214897 - DNA, 20 bp, Artificial Sequence
  chemically synthesized
tgtttgtcaagaagttgcct

SEQ ID NO: 214898 - DNA, 20 bp, Artificial Sequence
  chemically synthesized
tttgacgtgtgtttgtcaag

SEQ ID NO: 214899 - DNA, 20 bp, Artificial Sequence
  chemically synthesized
ttatttgacgtgtgtttgtc

SEQ ID NO: 214900 - DNA, 20 bp, Artificial Sequence
  chemically synthesized
gaatggttagattttgatgt

SEQ ID NO: 214901 - DNA, 20 bp, Artificial Sequence
  chemically synthesized
acctcatggatgtgaatggt

SEQ ID NO: 214902 - DNA, 20 bp, Artificial Sequence
  chemically synthesized
ctttacctcatggatgtgaa

SEQ ID NO: 214903 - DNA, 20 bp, Artificial Sequence
  chemically synthesized
atctaaccattcacatccat

SEQ ID NO: 214904 - DNA, 20 bp, Artificial Sequence
  chemically synthesized
tctaaccattcacatccatg

SEQ ID NO: 214905 - DNA, 20 bp, Artificial Sequence
  chemically synthesized
ccattcacatccatgaggta

SEQ ID NO: 214906 - DNA, 20 bp, Artificial Sequence
  chemically synthesized
atttggttttctttacctca

SEQ ID NO: 214907 - DNA, 20 bp, Artificial Sequence
  chemically synthesized
gtaaagaaaaccaaattaac

SEQ ID NO: 214908 - DNA, 20 bp, Artificial Sequence
  chemically synthesized
aaaataatgactggttaatt

SEQ ID NO: 214909 - DNA, 20 bp, Artificial Sequence
  chemically synthesized
agccattgaaaaataatgac

SEQ ID NO: 214910 - DNA, 20 bp, Artificial Sequence
  chemically synthesized
aaccagtcattatttttcaa

SEQ ID NO: 214911 - DNA, 20 bp, Artificial Sequence
  chemically synthesized
ctgtactattataaaagtca

SEQ ID NO: 214912 - DNA, 20 bp, Artificial Sequence
  chemically synthesized
aatggctatgacttttataa

SEQ ID NO: 214913 - DNA, 20 bp, Artificial Sequence
  chemically synthesized
actaagctgtactattataa

SEQ ID NO: 214914 - DNA, 20 bp, Artificial Sequence
  chemically synthesized
ctatgacttttataatagta

SEQ ID NO: 214915 - DNA, 20 bp, Artificial Sequence
  chemically synthesized
acttttataatagtacagct

SEQ ID NO: 214916 - DNA, 20 bp, Artificial Sequence
  chemically synthesized
taggaggatgcatagaaact

SEQ ID NO: 214917 - DNA, 20 bp, Artificial Sequence
  chemically synthesized
tcagaatataggaggatgca

SEQ ID NO: 214918 - DNA, 20 bp, Artificial Sequence
  chemically synthesized
gctgaatctcagaatatagg

SEQ ID NO: 214919 - DNA, 20 bp, Artificial Sequence
  chemically synthesized
cgctgaatctcagaatatag

SEQ ID NO: 214920 - DNA, 20 bp, Artificial Sequence
  chemically synthesized
tatgcatcctcctatattct

SEQ ID NO: 214921 - DNA, 20 bp, Artificial Sequence
  chemically synthesized
aacgctgaatctcagaatat

SEQ ID NO: 214922 - DNA, 20 bp, Artificial Sequence
  chemically synthesized
taacgctgaatctcagaata

SEQ ID NO: 214923 - DNA, 20 bp, Artificial Sequence
  chemically synthesized
tcctcctatattctgagatt

SEQ ID NO: 214924 - DNA, 20 bp, Artificial Sequence
  chemically synthesized
aaatgtataacgctgaatct

SEQ ID NO: 214925 - DNA, 20 bp, Artificial Sequence
  chemically synthesized
cattttcaatttgattttgc

SEQ ID NO: 214926 - DNA, 20 bp, Artificial Sequence
  chemically synthesized
aagaacaaatgaaatttgac

SEQ ID NO: 214927 - DNA, 20 bp, Artificial Sequence
  chemically synthesized
ttcatttgttcttgtttgat

SEQ ID NO: 214928 - DNA, 20 bp, Artificial Sequence
  chemically synthesized
taaacgacagccaatcaaac

SEQ ID NO: 214929 - DNA, 20 bp, Artificial Sequence
  chemically synthesized
agcacctaataggtaaacga

SEQ ID NO: 214930 - DNA, 20 bp, Artificial Sequence
  chemically synthesized
attggctgtcgtttacctat

SEQ ID NO: 214931 - DNA, 20 bp, Artificial Sequence
  chemically synthesized
ttggctgtcgtttacctatt

SEQ ID NO: 214932 - DNA, 20 bp, Artificial Sequence
  chemically synthesized
aattgaaggcagcacctaat

SEQ ID NO: 214933 - DNA, 20 bp, Artificial Sequence
  chemically synthesized
gaattgaaggcagcacctaa

SEQ ID NO: 214934 - DNA, 20 bp, Artificial Sequence
  chemically synthesized
atgtaaaaatgaattgaagg

SEQ ID NO: 214935 - DNA, 20 bp, Artificial Sequence
  chemically synthesized
agaatgtaaaaatgaattga

SEQ ID NO: 214936 - DNA, 20 bp, Artificial Sequence
  chemically synthesized
gagaatgtaaaaatgaattg

SEQ ID NO: 214937 - DNA, 20 bp, Artificial Sequence
  chemically synthesized
caattcatttttacattctc

SEQ ID NO: 214938 - DNA, 20 bp, Artificial Sequence
  chemically synthesized
aattcatttttacattctct

SEQ ID NO: 214939 - DNA, 20 bp, Artificial Sequence
  chemically synthesized
attcatttttacattctctg

SEQ ID NO: 214940 - DNA, 20 bp, Artificial Sequence
  chemically synthesized
tcatttttacattctctggg

SEQ ID NO: 214941 - DNA, 20 bp, Artificial Sequence
  chemically synthesized
gtgtgtaggttgtctcccca

SEQ ID NO: 214942 - DNA, 20 bp, Artificial Sequence
  chemically synthesized
tcgtgtgtaggttgtctccc

SEQ ID NO: 214943 - DNA, 20 bp, Artificial Sequence
  chemically synthesized
ggggagacaacctacacacg

SEQ ID NO: 214944 - DNA, 20 bp, Artificial Sequence
  chemically synthesized
gtggcaaaaccttcgtgtgt

SEQ ID NO: 214945 - DNA, 20 bp, Artificial Sequence
  chemically synthesized
gggagacaacctacacacga

SEQ ID NO: 214946 - DNA, 20 bp, Artificial Sequence
  chemically synthesized
agtggcaaaaccttcgtgtg

SEQ ID NO: 214947 - DNA, 20 bp, Artificial Sequence
  chemically synthesized
gcagaattaaacatttaaag

SEQ ID NO: 214948 - DNA, 20 bp, Artificial Sequence
  chemically synthesized
gttgcagaattaaacattta

SEQ ID NO: 214949 - DNA, 20 bp, Artificial Sequence
  chemically synthesized
ttttactctgcaacgtgttg

SEQ ID NO: 214950 - DNA, 20 bp, Artificial Sequence
  chemically synthesized
tttaattctgcaacacgttg

SEQ ID NO: 214951 - DNA, 20 bp, Artificial Sequence
  chemically synthesized
taattctgcaacacgttgca

SEQ ID NO: 214952 - DNA, 20 bp, Artificial Sequence
  chemically synthesized
ttctataggataaatcgagg

SEQ ID NO: 214953 - DNA, 20 bp, Artificial Sequence
  chemically synthesized
aacttctataggataaatcg

SEQ ID NO: 214954 - DNA, 20 bp, Artificial Sequence
  chemically synthesized
aaacttctataggataaatc

SEQ ID NO: 214955 - DNA, 20 bp, Artificial Sequence
  chemically synthesized
atcttcctcgatttatccta

SEQ ID NO: 214956 - DNA, 20 bp, Artificial Sequence
  chemically synthesized
ttcctcgatttatcctatag

SEQ ID NO: 214957 - DNA, 20 bp, Artificial Sequence
  chemically synthesized
ttgtcacaggaaacttctat

SEQ ID NO: 214958 - DNA, 20 bp, Artificial Sequence
  chemically synthesized
attgtcacaggaaacttcta

SEQ ID NO: 214959 - DNA, 20 bp, Artificial Sequence
  chemically synthesized
tttttcacttgcattgtcac

SEQ ID NO: 214960 - DNA, 20 bp, Artificial Sequence
  chemically synthesized
gtttttcacttgcattgtca

SEQ ID NO: 214961 - DNA, 20 bp, Artificial Sequence
  chemically synthesized
gaagtttcctgtgacaatgc

SEQ ID NO: 214962 - DNA, 20 bp, Artificial Sequence
  chemically synthesized
aagtgaaaaaccaaaactca

SEQ ID NO: 214963 - DNA, 20 bp, Artificial Sequence
  chemically synthesized
acttgccacactttgagttt

SEQ ID NO: 214964 - DNA, 20 bp, Artificial Sequence
  chemically synthesized
aaaaaccaaaactcaaagtg

SEQ ID NO: 214965 - DNA, 20 bp, Artificial Sequence
  chemically synthesized
gctccaacttgccacacttt

SEQ ID NO: 214966 - DNA, 20 bp, Artificial Sequence
  chemically synthesized
accaaaactcaaagtgtggc

SEQ ID NO: 214967 - DNA, 20 bp, Artificial Sequence
  chemically synthesized
aaactcaaagtgtggcaagt

SEQ ID NO: 214968 - DNA, 20 bp, Artificial Sequence
  chemically synthesized
actcaaagtgtggcaagttg

SEQ ID NO: 214969 - DNA, 20 bp, Artificial Sequence
  chemically synthesized
aagtgtggcaagttggagct

SEQ ID NO: 214970 - DNA, 20 bp, Artificial Sequence
  chemically synthesized
agtgtggcaagttggagcta

SEQ ID NO: 214971 - DNA, 20 bp, Artificial Sequence
  chemically synthesized
gttgattccaggatcagcct

SEQ ID NO: 214972 - DNA, 20 bp, Artificial Sequence
  chemically synthesized
gttggagctaaggctgatcc

SEQ ID NO: 214973 - DNA, 20 bp, Artificial Sequence
  chemically synthesized
aaactagttgattccaggat

SEQ ID NO: 214974 - DNA, 20 bp, Artificial Sequence
  chemically synthesized
tgtggaaactagttgattcc

SEQ ID NO: 214975 - DNA, 20 bp, Artificial Sequence
  chemically synthesized
ctgtggaaactagttgattc

SEQ ID NO: 214976 - DNA, 20 bp, Artificial Sequence
  chemically synthesized
aggctgatcctggaatcaac

SEQ ID NO: 214977 - DNA, 20 bp, Artificial Sequence
  chemically synthesized
ctggaatcaactagtttcca

SEQ ID NO: 214978 - DNA, 20 bp, Artificial Sequence
  chemically synthesized
tctttttttactgtggaaac

SEQ ID NO: 214979 - DNA, 20 bp, Artificial Sequence
  chemically synthesized
ttctcattctttttttactg

SEQ ID NO: 214980 - DNA, 20 bp, Artificial Sequence
  chemically synthesized
actagtttccacagtaaaaa

SEQ ID NO: 214981 - DNA, 20 bp, Artificial Sequence
  chemically synthesized
ttccacagtaaaaaaagaat

SEQ ID NO: 214982 - DNA, 20 bp, Artificial Sequence
  chemically synthesized
agtaaaaaaagaatgagaat

SEQ ID NO: 214983 - DNA, 20 bp, Artificial Sequence
  chemically synthesized
aaaagaatgagaatgagaca

SEQ ID NO: 214984 - DNA, 20 bp, Artificial Sequence
  chemically synthesized
acctctattggatttaagtg

SEQ ID NO: 214985 - DNA, 20 bp, Artificial Sequence
  chemically synthesized
tacctctattggatttaagt

SEQ ID NO: 214986 - DNA, 20 bp, Artificial Sequence
  chemically synthesized
ctacctctattggatttaag

SEQ ID NO: 214987 - DNA, 20 bp, Artificial Sequence
  chemically synthesized
aaactacctctattggattt

SEQ ID NO: 214988 - DNA, 20 bp, Artificial Sequence
  chemically synthesized
gattccccacttaaatccaa

SEQ ID NO: 214989 - DNA, 20 bp, Artificial Sequence
  chemically synthesized
ttccccacttaaatccaata

SEQ ID NO: 214990 - DNA, 20 bp, Artificial Sequence
  chemically synthesized
tccccacttaaatccaatag

SEQ ID NO: 214991 - DNA, 20 bp, Artificial Sequence
  chemically synthesized
ccacttaaatccaatagagg

SEQ ID NO: 214992 - DNA, 20 bp, Artificial Sequence
  chemically synthesized
agagtgaaaactacctctat

SEQ ID NO: 214993 - DNA, 20 bp, Artificial Sequence
  chemically synthesized
cacactgttgcatgataaca

SEQ ID NO: 214994 - DNA, 20 bp, Artificial Sequence
  chemically synthesized
cacacactgttgcatgataa

SEQ ID NO: 214995 - DNA, 20 bp, Artificial Sequence
  chemically synthesized
ttcactctgttatcatgcaa

SEQ ID NO: 214996 - DNA, 20 bp, Artificial Sequence
  chemically synthesized
tatcatgcaacagtgtgtga

SEQ ID NO: 214997 - DNA, 20 bp, Artificial Sequence
  chemically synthesized
gtgtgtgatagtcaatgttg

SEQ ID NO: 214998 - DNA, 20 bp, Artificial Sequence
  chemically synthesized
aatgttgaagtcatataaac

SEQ ID NO: 214999 - DNA, 20 bp, Artificial Sequence
  chemically synthesized
agtcatataaacaagttatt

SEQ ID NO: 215000 - DNA, 20 bp, Artificial Sequence
  chemically synthesized
ataaacaagttatttggttt

SEQ ID NO: 215001 - DNA, 20 bp, Artificial Sequence
  chemically synthesized
tggttttagcatttaaaata

SEQ ID NO: 215002 - DNA, 20 bp, Artificial Sequence
  chemically synthesized
ggttttagcatttaaaataa

SEQ ID NO: 215003 - DNA, 20 bp, Artificial Sequence
  chemically synthesized
ttttagcatttaaaataaag

SEQ ID NO: 215004 - DNA, 20 bp, Artificial Sequence
  chemically synthesized
ttgtgtttaccacaaattga

SEQ ID NO: 215005 - DNA, 20 bp, Artificial Sequence
  chemically synthesized
aaaggagttctatcaatttg

SEQ ID NO: 215006 - DNA, 20 bp, Artificial Sequence
  chemically synthesized
aaggaagagaacaatatggg

SEQ ID NO: 215007 - DNA, 20 bp, Artificial Sequence
  chemically synthesized
ctaaaggaagagaacaatat

SEQ ID NO: 215008 - DNA, 20 bp, Artificial Sequence
  chemically synthesized
tctaaaggaagagaacaata

SEQ ID NO: 215009 - DNA, 20 bp, Artificial Sequence
  chemically synthesized
cccatattgttctcttcctt

SEQ ID NO: 215010 - DNA, 20 bp, Artificial Sequence
  chemically synthesized
ccagttagagtctaaaggaa

SEQ ID NO: 215011 - DNA, 20 bp, Artificial Sequence
  chemically synthesized
ctccagttagagtctaaagg

SEQ ID NO: 215012 - DNA, 20 bp, Artificial Sequence
  chemically synthesized
cttctccagttagagtctaa

SEQ ID NO: 215013 - DNA, 20 bp, Artificial Sequence
  chemically synthesized
tcttctccagttagagtcta

SEQ ID NO: 215014 - DNA, 20 bp, Artificial Sequence
  chemically synthesized
ctcttcctttagactctaac

SEQ ID NO: 215015 - DNA, 20 bp, Artificial Sequence
  chemically synthesized
cttcctttagactctaactg

SEQ ID NO: 215016 - DNA, 20 bp, Artificial Sequence
  chemically synthesized
tatactctcttctccagtta

SEQ ID NO: 215017 - DNA, 20 bp, Artificial Sequence
  chemically synthesized
cctttagactctaactggag

SEQ ID NO: 215018 - DNA, 20 bp, Artificial Sequence
  chemically synthesized
aatatactctcttctccagt

SEQ ID NO: 215019 - DNA, 20 bp, Artificial Sequence
  chemically synthesized
tttagactctaactggagaa

SEQ ID NO: 215020 - DNA, 20 bp, Artificial Sequence
  chemically synthesized
tagactctaactggagaaga

SEQ ID NO: 215021 - DNA, 20 bp, Artificial Sequence
  chemically synthesized
agaaaatatactctcttctc

SEQ ID NO: 215022 - DNA, 20 bp, Artificial Sequence
  chemically synthesized
ctattacctgggaaaagagg

SEQ ID NO: 215023 - DNA, 20 bp, Artificial Sequence
  chemically synthesized
atattttctgcctcttttcc

SEQ ID NO: 215024 - DNA, 20 bp, Artificial Sequence
  chemically synthesized
atgctattacctgggaaaag

SEQ ID NO: 215025 - DNA, 20 bp, Artificial Sequence
  chemically synthesized
tattttctgcctcttttccc

SEQ ID NO: 215026 - DNA, 20 bp, Artificial Sequence
  chemically synthesized
aatgctattacctgggaaaa

SEQ ID NO: 215027 - DNA, 20 bp, Artificial Sequence
  chemically synthesized
taaatgctattacctgggaa

SEQ ID NO: 215028 - DNA, 20 bp, Artificial Sequence
  chemically synthesized
ctgcctcttttcccaggtaa

SEQ ID NO: 215029 - DNA, 20 bp, Artificial Sequence
  chemically synthesized
tcctataaatgctattacct

SEQ ID NO: 215030 - DNA, 20 bp, Artificial Sequence
  chemically synthesized
atcctataaatgctattacc

SEQ ID NO: 215031 - DNA, 20 bp, Artificial Sequence
  chemically synthesized
ttcccaggtaatagcattta

SEQ ID NO: 215032 - DNA, 20 bp, Artificial Sequence
  chemically synthesized
tcccaggtaatagcatttat

SEQ ID NO: 215033 - DNA, 20 bp, Artificial Sequence
  chemically synthesized
ggtaatagcatttataggat

SEQ ID NO: 215034 - DNA, 20 bp, Artificial Sequence
  chemically synthesized
gtaatagcatttataggatg

SEQ ID NO: 215035 - DNA, 20 bp, Artificial Sequence
  chemically synthesized
aatagcatttataggatgag

SEQ ID NO: 215036 - DNA, 20 bp, Artificial Sequence
  chemically synthesized
gcatttataggatgaggagc

SEQ ID NO: 215037 - DNA, 20 bp, Artificial Sequence
  chemically synthesized
taggatgaggagctggctaa

SEQ ID NO: 215038 - DNA, 20 bp, Artificial Sequence
  chemically synthesized
gtggaactgaagccattagc

SEQ ID NO: 215039 - DNA, 20 bp, Artificial Sequence
  chemically synthesized
gaggagctggctaatggctt

SEQ ID NO: 215040 - DNA, 20 bp, Artificial Sequence
  chemically synthesized
ccatgtggaactgaagccat

SEQ ID NO: 215041 - DNA, 20 bp, Artificial Sequence
  chemically synthesized
tagctagccatgtggaactg

SEQ ID NO: 215042 - DNA, 20 bp, Artificial Sequence
  chemically synthesized
ctaatggcttcagttccaca

SEQ ID NO: 215043 - DNA, 20 bp, Artificial Sequence
  chemically synthesized
tggcttcagttccacatggc

SEQ ID NO: 215044 - DNA, 20 bp, Artificial Sequence
  chemically synthesized
ccctagtgtagctagccatg

SEQ ID NO: 215045 - DNA, 20 bp, Artificial Sequence
  chemically synthesized
ttccacatggctagctacac

SEQ ID NO: 215046 - DNA, 20 bp, Artificial Sequence
  chemically synthesized
ttttttccccctagtgtagc

SEQ ID NO: 215047 - DNA, 20 bp, Artificial Sequence
  chemically synthesized
tccacatggctagctacact

SEQ ID NO: 215048 - DNA, 20 bp, Artificial Sequence
  chemically synthesized
ccacatggctagctacacta

SEQ ID NO: 215049 - DNA, 20 bp, Artificial Sequence
  chemically synthesized
cacatggctagctacactag

SEQ ID NO: 215050 - DNA, 20 bp, Artificial Sequence
  chemically synthesized
acatggctagctacactagg

SEQ ID NO: 215051 - DNA, 20 bp, Artificial Sequence
  chemically synthesized
ctttttttttccccctagtg

SEQ ID NO: 215052 - DNA, 20 bp, Artificial Sequence
  chemically synthesized
ttatgctttttttttccccc

SEQ ID NO: 215053 - DNA, 20 bp, Artificial Sequence
  chemically synthesized
ctacactagggggaaaaaaa

SEQ ID NO: 215054 - DNA, 20 bp, Artificial Sequence
  chemically synthesized
aaaaaaaagcataatgctgc

SEQ ID NO: 215055 - DNA, 20 bp, Artificial Sequence
  chemically synthesized
ctacatcggaattttgcttg

SEQ ID NO: 215056 - DNA, 20 bp, Artificial Sequence
  chemically synthesized
ctgcaagcaaaattccgatg

SEQ ID NO: 215057 - DNA, 20 bp, Artificial Sequence
  chemically synthesized
tgtccttcttgtgactacat

SEQ ID NO: 215058 - DNA, 20 bp, Artificial Sequence
  chemically synthesized
caaaattccgatgtagtcac

SEQ ID NO: 215059 - DNA, 20 bp, Artificial Sequence
  chemically synthesized
aattccgatgtagtcacaag

SEQ ID NO: 215060 - DNA, 20 bp, Artificial Sequence
  chemically synthesized
attccgatgtagtcacaaga

SEQ ID NO: 215061 - DNA, 20 bp, Artificial Sequence
  chemically synthesized
cacattttttcaaaaggaaa

SEQ ID NO: 215062 - DNA, 20 bp, Artificial Sequence
  chemically synthesized
ctgaaacacattttttcaaa

SEQ ID NO: 215063 - DNA, 20 bp, Artificial Sequence
  chemically synthesized
cctgaaacacattttttcaa

SEQ ID NO: 215064 - DNA, 20 bp, Artificial Sequence
  chemically synthesized
ccttttgaaaaaatgtgttt

SEQ ID NO: 215065 - DNA, 20 bp, Artificial Sequence
  chemically synthesized
cttttgaaaaaatgtgtttc

SEQ ID NO: 215066 - DNA, 20 bp, Artificial Sequence
  chemically synthesized
aaaaatgtgtttcaggttct

SEQ ID NO: 215067 - DNA, 20 bp, Artificial Sequence
  chemically synthesized
aaaatgtgtttcaggttctt

SEQ ID NO: 215068 - DNA, 20 bp, Artificial Sequence
  chemically synthesized
ttctaccaccagatttaccc

SEQ ID NO: 215069 - DNA, 20 bp, Artificial Sequence
  chemically synthesized
ttcaggttcttgggtaaatc

SEQ ID NO: 215070 - DNA, 20 bp, Artificial Sequence
  chemically synthesized
aggttcttgggtaaatctgg

SEQ ID NO: 215071 - DNA, 20 bp, Artificial Sequence
  chemically synthesized
ttcttgggtaaatctggtgg

SEQ ID NO: 215072 - DNA, 20 bp, Artificial Sequence
  chemically synthesized
ggtggtaaactttctaccac

SEQ ID NO: 215073 - DNA, 20 bp, Artificial Sequence
  chemically synthesized
tgggtaaatctggtggtaga

SEQ ID NO: 215074 - DNA, 20 bp, Artificial Sequence
  chemically synthesized
tcacattacagaattatagg

SEQ ID NO: 215075 - DNA, 20 bp, Artificial Sequence
  chemically synthesized
ggatcacattacagaattat

SEQ ID NO: 215076 - DNA, 20 bp, Artificial Sequence
  chemically synthesized
aggatcacattacagaatta

SEQ ID NO: 215077 - DNA, 20 bp, Artificial Sequence
  chemically synthesized
tataaaggaggatcacatta

SEQ ID NO: 215078 - DNA, 20 bp, Artificial Sequence
  chemically synthesized
taataacaattttataaagg

SEQ ID NO: 215079 - DNA, 20 bp, Artificial Sequence
  chemically synthesized
gtaataacaattttataaag

SEQ ID NO: 215080 - DNA, 20 bp, Artificial Sequence
  chemically synthesized
aagtaataacaattttataa

SEQ ID NO: 215081 - DNA, 20 bp, Artificial Sequence
  chemically synthesized
caagtaataacaattttata

SEQ ID NO: 215082 - DNA, 20 bp, Artificial Sequence
  chemically synthesized
tataaaattgttattacttg

SEQ ID NO: 215083 - DNA, 20 bp, Artificial Sequence
  chemically synthesized
aaattgttattacttgtggc

SEQ ID NO: 215084 - DNA, 20 bp, Artificial Sequence
  chemically synthesized
gcctcctcttttcttgccac

SEQ ID NO: 215085 - DNA, 20 bp, Artificial Sequence
  chemically synthesized
gttattacttgtggcaagaa

SEQ ID NO: 215086 - DNA, 20 bp, Artificial Sequence
  chemically synthesized
tattacttgtggcaagaaaa

SEQ ID NO: 215087 - DNA, 20 bp, Artificial Sequence
  chemically synthesized
attacttgtggcaagaaaag

SEQ ID NO: 215088 - DNA, 20 bp, Artificial Sequence
  chemically synthesized
tacttgtggcaagaaaagag

SEQ ID NO: 215089 - DNA, 20 bp, Artificial Sequence
  chemically synthesized
acttgtggcaagaaaagagg

SEQ ID NO: 215090 - DNA, 20 bp, Artificial Sequence
  chemically synthesized
tgtggcaagaaaagaggagg

SEQ ID NO: 215091 - DNA, 20 bp, Artificial Sequence
  chemically synthesized
gcaagaaaagaggaggcaga

SEQ ID NO: 215092 - DNA, 20 bp, Artificial Sequence
  chemically synthesized
ggaggcagatggtactgtgt

SEQ ID NO: 215093 - DNA, 20 bp, Artificial Sequence
  chemically synthesized
ttctttttcagcatctgaca

SEQ ID NO: 215094 - DNA, 20 bp, Artificial Sequence
  chemically synthesized
tactgtgtcagatgctgaaa

SEQ ID NO: 215095 - DNA, 20 bp, Artificial Sequence
  chemically synthesized
gtgtcagatgctgaaaaaga

SEQ ID NO: 215096 - DNA, 20 bp, Artificial Sequence
  chemically synthesized
gagatgctcactttcttttt

SEQ ID NO: 215097 - DNA, 20 bp, Artificial Sequence
  chemically synthesized
cagatgctgaaaaagaaagt

SEQ ID NO: 215098 - DNA, 20 bp, Artificial Sequence
  chemically synthesized
aaaagaaagtgagcatctcc

SEQ ID NO: 215099 - DNA, 20 bp, Artificial Sequence
  chemically synthesized
cttccactgtaatattctag

SEQ ID NO: 215100 - DNA, 20 bp, Artificial Sequence
  chemically synthesized
tacttccactgtaatattct

SEQ ID NO: 215101 - DNA, 20 bp, Artificial Sequence
  chemically synthesized
atacttccactgtaatattc

SEQ ID NO: 215102 - DNA, 20 bp, Artificial Sequence
  chemically synthesized
gagcatctcctagaatatta

SEQ ID NO: 215103 - DNA, 20 bp, Artificial Sequence
  chemically synthesized
catctcctagaatattacag

SEQ ID NO: 215104 - DNA, 20 bp, Artificial Sequence
  chemically synthesized
ctcctagaatattacagtgg

SEQ ID NO: 215105 - DNA, 20 bp, Artificial Sequence
  chemically synthesized
agtggaagtatccaacattg

SEQ ID NO: 215106 - DNA, 20 bp, Artificial Sequence
  chemically synthesized
gtggaagtatccaacattga

SEQ ID NO: 215107 - DNA, 20 bp, Artificial Sequence
  chemically synthesized
cagagatctgccttcaatgt

SEQ ID NO: 215108 - DNA, 20 bp, Artificial Sequence
  chemically synthesized
gaagtatccaacattgaagg

SEQ ID NO: 215109 - DNA, 20 bp, Artificial Sequence
  chemically synthesized
caacattgaaggcagatctc

SEQ ID NO: 215110 - DNA, 20 bp, Artificial Sequence
  chemically synthesized
acttctgaatttgtattcca

SEQ ID NO: 215111 - DNA, 20 bp, Artificial Sequence
  chemically synthesized
ttacttctgaatttgtattc

SEQ ID NO: 215112 - DNA, 20 bp, Artificial Sequence
  chemically synthesized
agatctctggaatacaaatt

SEQ ID NO: 215113 - DNA, 20 bp, Artificial Sequence
  chemically synthesized
tctctggaatacaaattcag

SEQ ID NO: 215114 - DNA, 20 bp, Artificial Sequence
  chemically synthesized
aaattcagaagtaaataaaa

SEQ ID NO: 215115 - DNA, 20 bp, Artificial Sequence
  chemically synthesized
taaaatagacattctacaaa

SEQ ID NO: 215116 - DNA, 20 bp, Artificial Sequence
  chemically synthesized
atttatttggtcactgtttg

SEQ ID NO: 215117 - DNA, 20 bp, Artificial Sequence
  chemically synthesized
tcacagtccagacatttatt

SEQ ID NO: 215118 - DNA, 20 bp, Artificial Sequence
  chemically synthesized
acagtgaccaaataaatgtc

SEQ ID NO: 215119 - DNA, 20 bp, Artificial Sequence
  chemically synthesized
ggataaactgtttcacagtc

SEQ ID NO: 215120 - DNA, 20 bp, Artificial Sequence
  chemically synthesized
taaatgtctggactgtgaaa

SEQ ID NO: 215121 - DNA, 20 bp, Artificial Sequence
  chemically synthesized
acaatggataaactgtttca

SEQ ID NO: 215122 - DNA, 20 bp, Artificial Sequence
  chemically synthesized
attatttcttatgtaaacaa

SEQ ID NO: 215123 - DNA, 20 bp, Artificial Sequence
  chemically synthesized
agtttatccattgtttacat

SEQ ID NO: 215124 - DNA, 20 bp, Artificial Sequence
  chemically synthesized
tgtttacataagaaataatg

SEQ ID NO: 215125 - DNA, 20 bp, Artificial Sequence
  chemically synthesized
ataatgcggattatattgca

SEQ ID NO: 215126 - DNA, 20 bp, Artificial Sequence
  chemically synthesized
tgcggattatattgcatagc

SEQ ID NO: 215127 - DNA, 20 bp, Artificial Sequence
  chemically synthesized
tgttggtttggggtacatac

SEQ ID NO: 215128 - DNA, 20 bp, Artificial Sequence
  chemically synthesized
aaaatatatttgttggtttg

SEQ ID NO: 215129 - DNA, 20 bp, Artificial Sequence
  chemically synthesized
taaaatatatttgttggttt

SEQ ID NO: 215130 - DNA, 20 bp, Artificial Sequence
  chemically synthesized
ttaaaatatatttgttggtt

SEQ ID NO: 215131 - DNA, 20 bp, Artificial Sequence
  chemically synthesized
gacctttaaaatatatttgt

SEQ ID NO: 215132 - DNA, 20 bp, Artificial Sequence
  chemically synthesized
aaaccaacaaatatatttta

SEQ ID NO: 215133 - DNA, 20 bp, Artificial Sequence
  chemically synthesized
aaccaacaaatatattttaa

SEQ ID NO: 215134 - DNA, 20 bp, Artificial Sequence
  chemically synthesized
tattttaaaggtccatcaaa

SEQ ID NO: 215135 - DNA, 20 bp, Artificial Sequence
  chemically synthesized
aaccttattgggctgtttga

SEQ ID NO: 215136 - DNA, 20 bp, Artificial Sequence
  chemically synthesized
ggtccatcaaacagcccaat

SEQ ID NO: 215137 - DNA, 20 bp, Artificial Sequence
  chemically synthesized
gtccatcaaacagcccaata

SEQ ID NO: 215138 - DNA, 20 bp, Artificial Sequence
  chemically synthesized
tgtgaaaatggaaccttatt

SEQ ID NO: 215139 - DNA, 20 bp, Artificial Sequence
  chemically synthesized
atgtgaaaatggaaccttat

SEQ ID NO: 215140 - DNA, 20 bp, Artificial Sequence
  chemically synthesized
gctgcatgcgtatgtgaaaa

SEQ ID NO: 215141 - DNA, 20 bp, Artificial Sequence
  chemically synthesized
tccattttcacatacgcatg

SEQ ID NO: 215142 - DNA, 20 bp, Artificial Sequence
  chemically synthesized
acgcatgcagcattttataa

SEQ ID NO: 215143 - DNA, 20 bp, Artificial Sequence
  chemically synthesized
gcagcattttataacagtcc

SEQ ID NO: 215144 - DNA, 20 bp, Artificial Sequence
  chemically synthesized
cagcattttataacagtcct

SEQ ID NO: 215145 - DNA, 20 bp, Artificial Sequence
  chemically synthesized
tctgtatatacacatatcct

SEQ ID NO: 215146 - DNA, 20 bp, Artificial Sequence
  chemically synthesized
ctctgtatatacacatatcc

SEQ ID NO: 215147 - DNA, 20 bp, Artificial Sequence
  chemically synthesized
tcctaggatatgtgtatata

SEQ ID NO: 215148 - DNA, 20 bp, Artificial Sequence
  chemically synthesized
ctaggatatgtgtatataca

SEQ ID NO: 215149 - DNA, 20 bp, Artificial Sequence
  chemically synthesized
taggatatgtgtatatacag

SEQ ID NO: 215150 - DNA, 20 bp, Artificial Sequence
  chemically synthesized
aggatatgtgtatatacaga

SEQ ID NO: 215151 - DNA, 20 bp, Artificial Sequence
  chemically synthesized
tatgtgtatatacagaggga

SEQ ID NO: 215152 - DNA, 20 bp, Artificial Sequence
  chemically synthesized
acagagggatggaaaaaata

SEQ ID NO: 215153 - DNA, 20 bp, Artificial Sequence
  chemically synthesized
tggaaaaaatacagttttaa

SEQ ID NO: 215154 - DNA, 20 bp, Artificial Sequence
  chemically synthesized
aaaaatacagttttaaaaga

SEQ ID NO: 215155 - DNA, 20 bp, Artificial Sequence
  chemically synthesized
ccagatggcaataaaatgta

SEQ ID NO: 215156 - DNA, 20 bp, Artificial Sequence
  chemically synthesized
cccagatggcaataaaatgt

SEQ ID NO: 215157 - DNA, 20 bp, Artificial Sequence
  chemically synthesized
gcccagatggcaataaaatg

SEQ ID NO: 215158 - DNA, 20 bp, Artificial Sequence
  chemically synthesized
ccctacattttattgccatc

SEQ ID NO: 215159 - DNA, 20 bp, Artificial Sequence
  chemically synthesized
cctacattttattgccatct

SEQ ID NO: 215160 - DNA, 20 bp, Artificial Sequence
  chemically synthesized
acattttattgccatctggg

SEQ ID NO: 215161 - DNA, 20 bp, Artificial Sequence
  chemically synthesized
aacgtgtgtttctgcccaga

SEQ ID NO: 215162 - DNA, 20 bp, Artificial Sequence
  chemically synthesized
atggaacgtgtgtttctgcc

SEQ ID NO: 215163 - DNA, 20 bp, Artificial Sequence
  chemically synthesized
ccacggagaaacgaaaagaa

SEQ ID NO: 215164 - DNA, 20 bp, Artificial Sequence
  chemically synthesized
agaagccacggagaaacgaa

SEQ ID NO: 215165 - DNA, 20 bp, Artificial Sequence
  chemically synthesized
ccattcttttcgtttctccg

SEQ ID NO: 215166 - DNA, 20 bp, Artificial Sequence
  chemically synthesized
tctctttgggagaagccacg

SEQ ID NO: 215167 - DNA, 20 bp, Artificial Sequence
  chemically synthesized
tttctctttgggagaagcca

SEQ ID NO: 215168 - DNA, 20 bp, Artificial Sequence
  chemically synthesized
tttctccgtggcttctccca

SEQ ID NO: 215169 - DNA, 20 bp, Artificial Sequence
  chemically synthesized
ggcctatttctctttgggag

SEQ ID NO: 215170 - DNA, 20 bp, Artificial Sequence
  chemically synthesized
tctccgtggcttctcccaaa

SEQ ID NO: 215171 - DNA, 20 bp, Artificial Sequence
  chemically synthesized
acaggcctatttctctttgg

SEQ ID NO: 215172 - DNA, 20 bp, Artificial Sequence
  chemically synthesized
aaacaggcctatttctcttt

SEQ ID NO: 215173 - DNA, 20 bp, Artificial Sequence
  chemically synthesized
gaaacaggcctatttctctt

SEQ ID NO: 215174 - DNA, 20 bp, Artificial Sequence
  chemically synthesized
tggcttctcccaaagagaaa

SEQ ID NO: 215175 - DNA, 20 bp, Artificial Sequence
  chemically synthesized
ggcttctcccaaagagaaat

SEQ ID NO: 215176 - DNA, 20 bp, Artificial Sequence
  chemically synthesized
aaaaaattgtttaaagaaac

SEQ ID NO: 215177 - DNA, 20 bp, Artificial Sequence
  chemically synthesized
aaaaaaattgtttaaagaaa

SEQ ID NO: 215178 - DNA, 20 bp, Artificial Sequence
  chemically synthesized
gcttataaaaaaattgttta

SEQ ID NO: 215179 - DNA, 20 bp, Artificial Sequence
  chemically synthesized
tctttaaacaatttttttat

SEQ ID NO: 215180 - DNA, 20 bp, Artificial Sequence
  chemically synthesized
tactcaacttcaagaaggga

SEQ ID NO: 215181 - DNA, 20 bp, Artificial Sequence
  chemically synthesized
ataagcgctatcccttcttg

SEQ ID NO: 215182 - DNA, 20 bp, Artificial Sequence
  chemically synthesized
gctatactcaacttcaagaa

SEQ ID NO: 215183 - DNA, 20 bp, Artificial Sequence
  chemically synthesized
tgctatactcaacttcaaga

SEQ ID NO: 215184 - DNA, 20 bp, Artificial Sequence
  chemically synthesized
atgctatactcaacttcaag

SEQ ID NO: 215185 - DNA, 20 bp, Artificial Sequence
  chemically synthesized
cgctatcccttcttgaagtt

SEQ ID NO: 215186 - DNA, 20 bp, Artificial Sequence
  chemically synthesized
gttatgctatactcaacttc

SEQ ID NO: 215187 - DNA, 20 bp, Artificial Sequence
  chemically synthesized
tcccttcttgaagttgagta

SEQ ID NO: 215188 - DNA, 20 bp, Artificial Sequence
  chemically synthesized
tatccttaagaaaaaaattt

SEQ ID NO: 215189 - DNA, 20 bp, Artificial Sequence
  chemically synthesized
tttactaaaatttttttctt

SEQ ID NO: 215190 - DNA, 20 bp, Artificial Sequence
  chemically synthesized
ttactaaaatttttttctta

SEQ ID NO: 215191 - DNA, 20 bp, Artificial Sequence
  chemically synthesized
tttattctactgttatcctt

SEQ ID NO: 215192 - DNA, 20 bp, Artificial Sequence
  chemically synthesized
aatttttttcttaaggataa

SEQ ID NO: 215193 - DNA, 20 bp, Artificial Sequence
  chemically synthesized
ttttttcttaaggataacag

SEQ ID NO: 215194 - DNA, 20 bp, Artificial Sequence
  chemically synthesized
ttaaggataacagtagaata

SEQ ID NO: 215195 - DNA, 20 bp, Artificial Sequence
  chemically synthesized
acagtagaataaagaacaat

SEQ ID NO: 215196 - DNA, 20 bp, Artificial Sequence
  chemically synthesized
ggcttatctctgtaacaaag

SEQ ID NO: 215197 - DNA, 20 bp, Artificial Sequence
  chemically synthesized
aacaatgagccactttgtta

SEQ ID NO: 215198 - DNA, 20 bp, Artificial Sequence
  chemically synthesized
caatgagccactttgttaca

SEQ ID NO: 215199 - DNA, 20 bp, Artificial Sequence
  chemically synthesized
catggcttatctctgtaaca

SEQ ID NO: 215200 - DNA, 20 bp, Artificial Sequence
  chemically synthesized
agccactttgttacagagat

SEQ ID NO: 215201 - DNA, 20 bp, Artificial Sequence
  chemically synthesized
tataaaccaaaagaatgaca

SEQ ID NO: 215202 - DNA, 20 bp, Artificial Sequence
  chemically synthesized
gataagccatgtcattcttt

SEQ ID NO: 215203 - DNA, 20 bp, Artificial Sequence
  chemically synthesized
gcaaatacattataaaccaa

SEQ ID NO: 215204 - DNA, 20 bp, Artificial Sequence
  chemically synthesized
tttataatgtatttgcccaa

SEQ ID NO: 215205 - DNA, 20 bp, Artificial Sequence
  chemically synthesized
gctagccacataatactttt

SEQ ID NO: 215206 - DNA, 20 bp, Artificial Sequence
  chemically synthesized
agctagccacataatacttt

SEQ ID NO: 215207 - DNA, 20 bp, Artificial Sequence
  chemically synthesized
atttgcccaaaagtattatg

SEQ ID NO: 215208 - DNA, 20 bp, Artificial Sequence
  chemically synthesized
gcccaaaagtattatgtggc

SEQ ID NO: 215209 - DNA, 20 bp, Artificial Sequence
  chemically synthesized
agtattatgtggctagctga

SEQ ID NO: 215210 - DNA, 20 bp, Artificial Sequence
  chemically synthesized
tagtctatgcagctatcagc

SEQ ID NO: 215211 - DNA, 20 bp, Artificial Sequence
  chemically synthesized
tagttagtctatgcagctat

SEQ ID NO: 215212 - DNA, 20 bp, Artificial Sequence
  chemically synthesized
gtggctagctgatagctgca

SEQ ID NO: 215213 - DNA, 20 bp, Artificial Sequence
  chemically synthesized
aaagctgtagttagtctatg

SEQ ID NO: 215214 - DNA, 20 bp, Artificial Sequence
  chemically synthesized
atagctgcatagactaacta

SEQ ID NO: 215215 - DNA, 20 bp, Artificial Sequence
  chemically synthesized
aaatagtaaaaagctgtagt

SEQ ID NO: 215216 - DNA, 20 bp, Artificial Sequence
  chemically synthesized
tcacaaatagtaaaaagctg

SEQ ID NO: 215217 - DNA, 20 bp, Artificial Sequence
  chemically synthesized
ggtgtatcacaaatagtaaa

SEQ ID NO: 215218 - DNA, 20 bp, Artificial Sequence
  chemically synthesized
ggaacctggtgtatcacaaa

SEQ ID NO: 215219 - DNA, 20 bp, Artificial Sequence
  chemically synthesized
ttttactatttgtgatacac

SEQ ID NO: 215220 - DNA, 20 bp, Artificial Sequence
  chemically synthesized
tttactatttgtgatacacc

SEQ ID NO: 215221 - DNA, 20 bp, Artificial Sequence
  chemically synthesized
aagtttgattaaagggaacc

SEQ ID NO: 215222 - DNA, 20 bp, Artificial Sequence
  chemically synthesized
ataactgaagtttgattaaa

SEQ ID NO: 215223 - DNA, 20 bp, Artificial Sequence
  chemically synthesized
gataactgaagtttgattaa

SEQ ID NO: 215224 - DNA, 20 bp, Artificial Sequence
  chemically synthesized
agataactgaagtttgatta

SEQ ID NO: 215225 - DNA, 20 bp, Artificial Sequence
  chemically synthesized
ggttccctttaatcaaactt

SEQ ID NO: 215226 - DNA, 20 bp, Artificial Sequence
  chemically synthesized
aatatagatacagataactg

SEQ ID NO: 215227 - DNA, 20 bp, Artificial Sequence
  chemically synthesized
tcctaaggagaatatagata

SEQ ID NO: 215228 - DNA, 20 bp, Artificial Sequence
  chemically synthesized
ggcttatcctaaggagaata

SEQ ID NO: 215229 - DNA, 20 bp, Artificial Sequence
  chemically synthesized
atctgtatctatattctcct

SEQ ID NO: 215230 - DNA, 20 bp, Artificial Sequence
  chemically synthesized
tctgtatctatattctcctt

SEQ ID NO: 215231 - DNA, 20 bp, Artificial Sequence
  chemically synthesized
caatctaggcttatcctaag

SEQ ID NO: 215232 - DNA, 20 bp, Artificial Sequence
  chemically synthesized
atctatattctccttaggat

SEQ ID NO: 215233 - DNA, 20 bp, Artificial Sequence
  chemically synthesized
gacaatctaggcttatccta

SEQ ID NO: 215234 - DNA, 20 bp, Artificial Sequence
  chemically synthesized
agacaatctaggcttatcct

SEQ ID NO: 215235 - DNA, 20 bp, Artificial Sequence
  chemically synthesized
tattctccttaggataagcc

SEQ ID NO: 215236 - DNA, 20 bp, Artificial Sequence
  chemically synthesized
gctctaaatttagacaatct

SEQ ID NO: 215237 - DNA, 20 bp, Artificial Sequence
  chemically synthesized
agctctaaatttagacaatc

SEQ ID NO: 215238 - DNA, 20 bp, Artificial Sequence
  chemically synthesized
aagcctagattgtctaaatt

SEQ ID NO: 215239 - DNA, 20 bp, Artificial Sequence
  chemically synthesized
gcctagattgtctaaattta

SEQ ID NO: 215240 - DNA, 20 bp, Artificial Sequence
  chemically synthesized
gtggtagcaagctctaaatt

SEQ ID NO: 215241 - DNA, 20 bp, Artificial Sequence
  chemically synthesized
agaatgtctggggtggtagc

SEQ ID NO: 215242 - DNA, 20 bp, Artificial Sequence
  chemically synthesized
tttagagcttgctaccaccc

SEQ ID NO: 215243 - DNA, 20 bp, Artificial Sequence
  chemically synthesized
agaaagaatgtctggggtgg

SEQ ID NO: 215244 - DNA, 20 bp, Artificial Sequence
  chemically synthesized
aaaagaaagaatgtctgggg

SEQ ID NO: 215245 - DNA, 20 bp, Artificial Sequence
  chemically synthesized
ccaaaaagaaagaatgtctg

SEQ ID NO: 215246 - DNA, 20 bp, Artificial Sequence
  chemically synthesized
accaaaaagaaagaatgtct

SEQ ID NO: 215247 - DNA, 20 bp, Artificial Sequence
  chemically synthesized
aaccaaaaagaaagaatgtc

SEQ ID NO: 215248 - DNA, 20 bp, Artificial Sequence
  chemically synthesized
ccccagacattctttctttt

SEQ ID NO: 215249 - DNA, 20 bp, Artificial Sequence
  chemically synthesized
tgatatgataaccaaaaaga

SEQ ID NO: 215250 - DNA, 20 bp, Artificial Sequence
  chemically synthesized
gacttgatatgataaccaaa

SEQ ID NO: 215251 - DNA, 20 bp, Artificial Sequence
  chemically synthesized
ttctttttggttatcatatc

SEQ ID NO: 215252 - DNA, 20 bp, Artificial Sequence
  chemically synthesized
catatcaagtcccaactgtg

SEQ ID NO: 215253 - DNA, 20 bp, Artificial Sequence
  chemically synthesized
gaattccaggctgcacagtt

SEQ ID NO: 215254 - DNA, 20 bp, Artificial Sequence
  chemically synthesized
tgaattccaggctgcacagt

SEQ ID NO: 215255 - DNA, 20 bp, Artificial Sequence
  chemically synthesized
caagtcccaactgtgcagcc

SEQ ID NO: 215256 - DNA, 20 bp, Artificial Sequence
  chemically synthesized
acattgaattccaggctgca

SEQ ID NO: 215257 - DNA, 20 bp, Artificial Sequence
  chemically synthesized
agtggttgacattgaattcc

SEQ ID NO: 215258 - DNA, 20 bp, Artificial Sequence
  chemically synthesized
aagtggttgacattgaattc

SEQ ID NO: 215259 - DNA, 20 bp, Artificial Sequence
  chemically synthesized
attgtgtgaggtatggaaag

SEQ ID NO: 215260 - DNA, 20 bp, Artificial Sequence
  chemically synthesized
gggattgtgtgaggtatgga

SEQ ID NO: 215261 - DNA, 20 bp, Artificial Sequence
  chemically synthesized
cacagggattgtgtgaggta

SEQ ID NO: 215262 - DNA, 20 bp, Artificial Sequence
  chemically synthesized
ggaatcacagggattgtgtg

SEQ ID NO: 215263 - DNA, 20 bp, Artificial Sequence
  chemically synthesized
tggaatcacagggattgtgt

SEQ ID NO: 215264 - DNA, 20 bp, Artificial Sequence
  chemically synthesized
tcagagctgatggaatcaca

SEQ ID NO: 215265 - DNA, 20 bp, Artificial Sequence
  chemically synthesized
gtcagagctgatggaatcac

SEQ ID NO: 215266 - DNA, 20 bp, Artificial Sequence
  chemically synthesized
ggtcagagctgatggaatca

SEQ ID NO: 215267 - DNA, 20 bp, Artificial Sequence
  chemically synthesized
cacaatccctgtgattccat

SEQ ID NO: 215268 - DNA, 20 bp, Artificial Sequence
  chemically synthesized
tatgattcggtcagagctga

SEQ ID NO: 215269 - DNA, 20 bp, Artificial Sequence
  chemically synthesized
tgtttattatgattcggtca

SEQ ID NO: 215270 - DNA, 20 bp, Artificial Sequence
  chemically synthesized
gttgtttattatgattcggt

SEQ ID NO: 215271 - DNA, 20 bp, Artificial Sequence
  chemically synthesized
aactgttgtttattatgatt

SEQ ID NO: 215272 - DNA, 20 bp, Artificial Sequence
  chemically synthesized
gaccgaatcataataaacaa

SEQ ID NO: 215273 - DNA, 20 bp, Artificial Sequence
  chemically synthesized
acagtttattatgatgcttc

SEQ ID NO: 215274 - DNA, 20 bp, Artificial Sequence
  chemically synthesized
tgctgcagagatgggacttg

SEQ ID NO: 215275 - DNA, 20 bp, Artificial Sequence
  chemically synthesized
tgcttcaagtcccatctctg

SEQ ID NO: 215276 - DNA, 20 bp, Artificial Sequence
  chemically synthesized
gaagcacttgctgcagagat

SEQ ID NO: 215277 - DNA, 20 bp, Artificial Sequence
  chemically synthesized
agaagcacttgctgcagaga

SEQ ID NO: 215278 - DNA, 20 bp, Artificial Sequence
  chemically synthesized
tcaagtcccatctctgcagc

SEQ ID NO: 215279 - DNA, 20 bp, Artificial Sequence
  chemically synthesized
ctggagaagcacttgctgca

SEQ ID NO: 215280 - DNA, 20 bp, Artificial Sequence
  chemically synthesized
acctggagaagcacttgctg

SEQ ID NO: 215281 - DNA, 20 bp, Artificial Sequence
  chemically synthesized
ctctgcagcaagtgcttctc

SEQ ID NO: 215282 - DNA, 20 bp, Artificial Sequence
  chemically synthesized
tctgcagcaagtgcttctcc

SEQ ID NO: 215283 - DNA, 20 bp, Artificial Sequence
  chemically synthesized
ggtaattaaatcacctggag

SEQ ID NO: 215284 - DNA, 20 bp, Artificial Sequence
  chemically synthesized
attggtaattaaatcacctg

SEQ ID NO: 215285 - DNA, 20 bp, Artificial Sequence
  chemically synthesized
ttattggtaattaaatcacc

SEQ ID NO: 215286 - DNA, 20 bp, Artificial Sequence
  chemically synthesized
tcagattttaaaaagattat

SEQ ID NO: 215287 - DNA, 20 bp, Artificial Sequence
  chemically synthesized
ctggggtttcagattttaaa

SEQ ID NO: 215288 - DNA, 20 bp, Artificial Sequence
  chemically synthesized
ctttttaaaatctgaaaccc

SEQ ID NO: 215289 - DNA, 20 bp, Artificial Sequence
  chemically synthesized
caaaaacgggactggggttt

SEQ ID NO: 215290 - DNA, 20 bp, Artificial Sequence
  chemically synthesized
aatgggcaaaaacgggactg

SEQ ID NO: 215291 - DNA, 20 bp, Artificial Sequence
  chemically synthesized
caatgggcaaaaacgggact

SEQ ID NO: 215292 - DNA, 20 bp, Artificial Sequence
  chemically synthesized
tcaatgggcaaaaacgggac

SEQ ID NO: 215293 - DNA, 20 bp, Artificial Sequence
  chemically synthesized
tctgctcaatgggcaaaaac

SEQ ID NO: 215294 - DNA, 20 bp, Artificial Sequence
  chemically synthesized
ctctgctcaatgggcaaaaa

SEQ ID NO: 215295 - DNA, 20 bp, Artificial Sequence
  chemically synthesized
cagtcccgtttttgcccatt

SEQ ID NO: 215296 - DNA, 20 bp, Artificial Sequence
  chemically synthesized
tcccgtttttgcccattgag

SEQ ID NO: 215297 - DNA, 20 bp, Artificial Sequence
  chemically synthesized
aatcctagcctctgctcaat

SEQ ID NO: 215298 - DNA, 20 bp, Artificial Sequence
  chemically synthesized
ccgtttttgcccattgagca

SEQ ID NO: 215299 - DNA, 20 bp, Artificial Sequence
  chemically synthesized
aaatcctagcctctgctcaa

SEQ ID NO: 215300 - DNA, 20 bp, Artificial Sequence
  chemically synthesized
cgtttttgcccattgagcag

SEQ ID NO: 215301 - DNA, 20 bp, Artificial Sequence
  chemically synthesized
tttgcccattgagcagaggc

SEQ ID NO: 215302 - DNA, 20 bp, Artificial Sequence
  chemically synthesized
ttgcccattgagcagaggct

SEQ ID NO: 215303 - DNA, 20 bp, Artificial Sequence
  chemically synthesized
atcctctgtataataaatcc

SEQ ID NO: 215304 - DNA, 20 bp, Artificial Sequence
  chemically synthesized
agaggctaggatttattata

SEQ ID NO: 215305 - DNA, 20 bp, Artificial Sequence
  chemically synthesized
aggctaggatttattataca

SEQ ID NO: 215306 - DNA, 20 bp, Artificial Sequence
  chemically synthesized
ggctaggatttattatacag

SEQ ID NO: 215307 - DNA, 20 bp, Artificial Sequence
  chemically synthesized
ggatattgttttattatcta

SEQ ID NO: 215308 - DNA, 20 bp, Artificial Sequence
  chemically synthesized
aagagaataatttattgcca

SEQ ID NO: 215309 - DNA, 20 bp, Artificial Sequence
  chemically synthesized
atataactatagagtaacaa

SEQ ID NO: 215310 - DNA, 20 bp, Artificial Sequence
  chemically synthesized
atatataactatagagtaac

SEQ ID NO: 215311 - DNA, 20 bp, Artificial Sequence
  chemically synthesized
attattctcttgttactcta

SEQ ID NO: 215312 - DNA, 20 bp, Artificial Sequence
  chemically synthesized
gaatgtaatatataactata

SEQ ID NO: 215313 - DNA, 20 bp, Artificial Sequence
  chemically synthesized
cagaatgtaatatataacta

SEQ ID NO: 215314 - DNA, 20 bp, Artificial Sequence
  chemically synthesized
aggtatctgaaatttgtttg

SEQ ID NO: 215315 - DNA, 20 bp, Artificial Sequence
  chemically synthesized
tacattctgcaaacaaattt

SEQ ID NO: 215316 - DNA, 20 bp, Artificial Sequence
  chemically synthesized
aaacaaatttcagatacctc

SEQ ID NO: 215317 - DNA, 20 bp, Artificial Sequence
  chemically synthesized
aacaaatttcagatacctca

SEQ ID NO: 215318 - DNA, 20 bp, Artificial Sequence
  chemically synthesized
acaaatttcagatacctcaa

SEQ ID NO: 215319 - DNA, 20 bp, Artificial Sequence
  chemically synthesized
atatattattcatgcccttg

SEQ ID NO: 215320 - DNA, 20 bp, Artificial Sequence
  chemically synthesized
aatatattattcatgccctt

SEQ ID NO: 215321 - DNA, 20 bp, Artificial Sequence
  chemically synthesized
gcatgaataatatatttgat

SEQ ID NO: 215322 - DNA, 20 bp, Artificial Sequence
  chemically synthesized
tatttgattagctgatttat

SEQ ID NO: 215323 - DNA, 20 bp, Artificial Sequence
  chemically synthesized
tgcattctatgccaataaat

SEQ ID NO: 215324 - DNA, 20 bp, Artificial Sequence
  chemically synthesized
gattagctgatttattggca

SEQ ID NO: 215325 - DNA, 20 bp, Artificial Sequence
  chemically synthesized
tggcatagaatgcatttatc

SEQ ID NO: 215326 - DNA, 20 bp, Artificial Sequence
  chemically synthesized
catttatcgagctttaatta

SEQ ID NO: 215327 - DNA, 20 bp, Artificial Sequence
  chemically synthesized
atttatcgagctttaattat

SEQ ID NO: 215328 - DNA, 20 bp, Artificial Sequence
  chemically synthesized
cactttttggcccataatta

SEQ ID NO: 215329 - DNA, 20 bp, Artificial Sequence
  chemically synthesized
agctttaattatgggccaaa

SEQ ID NO: 215330 - DNA, 20 bp, Artificial Sequence
  chemically synthesized
tcagggcgtagtacactttt

SEQ ID NO: 215331 - DNA, 20 bp, Artificial Sequence
  chemically synthesized
aaaaagtgtactacgccctg

SEQ ID NO: 215332 - DNA, 20 bp, Artificial Sequence
  chemically synthesized
atctttctgacttcagggcg

SEQ ID NO: 215333 - DNA, 20 bp, Artificial Sequence
  chemically synthesized
agtgtactacgccctgaagt

SEQ ID NO: 215334 - DNA, 20 bp, Artificial Sequence
  chemically synthesized
ttgtcatctttctgacttca

SEQ ID NO: 215335 - DNA, 20 bp, Artificial Sequence
  chemically synthesized
tttgtcatctttctgacttc

SEQ ID NO: 215336 - DNA, 20 bp, Artificial Sequence
  chemically synthesized
ctttgtcatctttctgactt

SEQ ID NO: 215337 - DNA, 20 bp, Artificial Sequence
  chemically synthesized
tactacgccctgaagtcaga

SEQ ID NO: 215338 - DNA, 20 bp, Artificial Sequence
  chemically synthesized
ctgaagtcagaaagatgaca

SEQ ID NO: 215339 - DNA, 20 bp, Artificial Sequence
  chemically synthesized
agatgacaaagaaatgttct

SEQ ID NO: 215340 - DNA, 20 bp, Artificial Sequence
  chemically synthesized
aagaaatgttcttggctttc

SEQ ID NO: 215341 - DNA, 20 bp, Artificial Sequence
  chemically synthesized
acgggatctccttgaaagcc

SEQ ID NO: 215342 - DNA, 20 bp, Artificial Sequence
  chemically synthesized
agaaatgttcttggctttca

SEQ ID NO: 215343 - DNA, 20 bp, Artificial Sequence
  chemically synthesized
aaatgttcttggctttcaag

SEQ ID NO: 215344 - DNA, 20 bp, Artificial Sequence
  chemically synthesized
gagggacgggatctccttga

SEQ ID NO: 215345 - DNA, 20 bp, Artificial Sequence
  chemically synthesized
ttagaatgaattcgagggac

SEQ ID NO: 215346 - DNA, 20 bp, Artificial Sequence
  chemically synthesized
attagaatgaattcgaggga

SEQ ID NO: 215347 - DNA, 20 bp, Artificial Sequence
  chemically synthesized
aattattagaatgaattcga

SEQ ID NO: 215348 - DNA, 20 bp, Artificial Sequence
  chemically synthesized
aaattattagaatgaattcg

SEQ ID NO: 215349 - DNA, 20 bp, Artificial Sequence
  chemically synthesized
aaaattattagaatgaattc

SEQ ID NO: 215350 - DNA, 20 bp, Artificial Sequence
  chemically synthesized
aactctcttctaaaaattat

SEQ ID NO: 215351 - DNA, 20 bp, Artificial Sequence
  chemically synthesized
gaattcattctaataatttt

SEQ ID NO: 215352 - DNA, 20 bp, Artificial Sequence
  chemically synthesized
ttcattctaataatttttag

SEQ ID NO: 215353 - DNA, 20 bp, Artificial Sequence
  chemically synthesized
cattctaataatttttagaa

SEQ ID NO: 215354 - DNA, 20 bp, Artificial Sequence
  chemically synthesized
ttctaataatttttagaaga

SEQ ID NO: 215355 - DNA, 20 bp, Artificial Sequence
  chemically synthesized
taatttttagaagagagtta

SEQ ID NO: 215356 - DNA, 20 bp, Artificial Sequence
  chemically synthesized
tttttagaagagagttaaag

SEQ ID NO: 215357 - DNA, 20 bp, Artificial Sequence
  chemically synthesized
agagttaaagaagaatgctc

SEQ ID NO: 215358 - DNA, 20 bp, Artificial Sequence
  chemically synthesized
taaagaagaatgctctagac

SEQ ID NO: 215359 - DNA, 20 bp, Artificial Sequence
  chemically synthesized
gtttgagaaccactggtcta

SEQ ID NO: 215360 - DNA, 20 bp, Artificial Sequence
  chemically synthesized
agaagaatgctctagaccag

SEQ ID NO: 215361 - DNA, 20 bp, Artificial Sequence
  chemically synthesized
aagtttgagaaccactggtc

SEQ ID NO: 215362 - DNA, 20 bp, Artificial Sequence
  chemically synthesized
cactaaagtttgagaaccac

SEQ ID NO: 215363 - DNA, 20 bp, Artificial Sequence
  chemically synthesized
gaccagtggttctcaaactt

SEQ ID NO: 215364 - DNA, 20 bp, Artificial Sequence
  chemically synthesized
tttgatgcacactaaagttt

SEQ ID NO: 215365 - DNA, 20 bp, Artificial Sequence
  chemically synthesized
aggtaatttgatgcacacta

SEQ ID NO: 215366 - DNA, 20 bp, Artificial Sequence
  chemically synthesized
ttagtgtgcatcaaattacc

SEQ ID NO: 215367 - DNA, 20 bp, Artificial Sequence
  chemically synthesized
agtgtgcatcaaattaccta

SEQ ID NO: 215368 - DNA, 20 bp, Artificial Sequence
  chemically synthesized
gtgtgcatcaaattacctag

SEQ ID NO: 215369 - DNA, 20 bp, Artificial Sequence
  chemically synthesized
tgtgcatcaaattacctaga

SEQ ID NO: 215370 - DNA, 20 bp, Artificial Sequence
  chemically synthesized
tgtatttttatcagccctct

SEQ ID NO: 215371 - DNA, 20 bp, Artificial Sequence
  chemically synthesized
ctgtatttttatcagccctc

SEQ ID NO: 215372 - DNA, 20 bp, Artificial Sequence
  chemically synthesized
tgagcagcctgtatttttat

SEQ ID NO: 215373 - DNA, 20 bp, Artificial Sequence
  chemically synthesized
ctagagggctgataaaaata

SEQ ID NO: 215374 - DNA, 20 bp, Artificial Sequence
  chemically synthesized
tagagggctgataaaaatac

SEQ ID NO: 215375 - DNA, 20 bp, Artificial Sequence
  chemically synthesized
cattggagagtggagatgag

SEQ ID NO: 215376 - DNA, 20 bp, Artificial Sequence
  chemically synthesized
aaacattggagagtggagat

SEQ ID NO: 215377 - DNA, 20 bp, Artificial Sequence
  chemically synthesized
atcagaaacattggagagtg

SEQ ID NO: 215378 - DNA, 20 bp, Artificial Sequence
  chemically synthesized
tgatcagaaacattggagag

SEQ ID NO: 215379 - DNA, 20 bp, Artificial Sequence
  chemically synthesized
gcttgatcagaaacattgga

SEQ ID NO: 215380 - DNA, 20 bp, Artificial Sequence
  chemically synthesized
ctgcttgatcagaaacattg

SEQ ID NO: 215381 - DNA, 20 bp, Artificial Sequence
  chemically synthesized
acctgcttgatcagaaacat

SEQ ID NO: 215382 - DNA, 20 bp, Artificial Sequence
  chemically synthesized
actctccaatgtttctgatc

SEQ ID NO: 215383 - DNA, 20 bp, Artificial Sequence
  chemically synthesized
ctccaatgtttctgatcaag

SEQ ID NO: 215384 - DNA, 20 bp, Artificial Sequence
  chemically synthesized
tccaatgtttctgatcaagc

SEQ ID NO: 215385 - DNA, 20 bp, Artificial Sequence
  chemically synthesized
tcatctcagacctgcttgat

SEQ ID NO: 215386 - DNA, 20 bp, Artificial Sequence
  chemically synthesized
gtttctgatcaagcaggtct

SEQ ID NO: 215387 - DNA, 20 bp, Artificial Sequence
  chemically synthesized
tgatcaagcaggtctgagat

SEQ ID NO: 215388 - DNA, 20 bp, Artificial Sequence
  chemically synthesized
gatcaagcaggtctgagatg

SEQ ID NO: 215389 - DNA, 20 bp, Artificial Sequence
  chemically synthesized
tagatcctcaggcctcatct

SEQ ID NO: 215390 - DNA, 20 bp, Artificial Sequence
  chemically synthesized
gcaggtctgagatgaggcct

SEQ ID NO: 215391 - DNA, 20 bp, Artificial Sequence
  chemically synthesized
caggtctgagatgaggcctg

SEQ ID NO: 215392 - DNA, 20 bp, Artificial Sequence
  chemically synthesized
cattagaaatatagatcctc

SEQ ID NO: 215393 - DNA, 20 bp, Artificial Sequence
  chemically synthesized
tcattagaaatatagatcct

SEQ ID NO: 215394 - DNA, 20 bp, Artificial Sequence
  chemically synthesized
ctgggaattcattagaaata

SEQ ID NO: 215395 - DNA, 20 bp, Artificial Sequence
  chemically synthesized
agcaccatctgggaattcat

SEQ ID NO: 215396 - DNA, 20 bp, Artificial Sequence
  chemically synthesized
ctatatttctaatgaattcc

SEQ ID NO: 215397 - DNA, 20 bp, Artificial Sequence
  chemically synthesized
atttctaatgaattcccaga

SEQ ID NO: 215398 - DNA, 20 bp, Artificial Sequence
  chemically synthesized
cagcaacatcagcaccatct

SEQ ID NO: 215399 - DNA, 20 bp, Artificial Sequence
  chemically synthesized
ccagcaacatcagcaccatc

SEQ ID NO: 215400 - DNA, 20 bp, Artificial Sequence
  chemically synthesized
ccagatggtgctgatgttgc

SEQ ID NO: 215401 - DNA, 20 bp, Artificial Sequence
  chemically synthesized
tttcgctggaccagcaacat

SEQ ID NO: 215402 - DNA, 20 bp, Artificial Sequence
  chemically synthesized
tggtgctgatgttgctggtc

SEQ ID NO: 215403 - DNA, 20 bp, Artificial Sequence
  chemically synthesized
aaatcactctttcgctggac

SEQ ID NO: 215404 - DNA, 20 bp, Artificial Sequence
  chemically synthesized
tgatgttgctggtccagcga

SEQ ID NO: 215405 - DNA, 20 bp, Artificial Sequence
  chemically synthesized
atgttgctggtccagcgaaa

SEQ ID NO: 215406 - DNA, 20 bp, Artificial Sequence
  chemically synthesized
tctctaaatcactctttcgc

SEQ ID NO: 215407 - DNA, 20 bp, Artificial Sequence
  chemically synthesized
ggtccagcgaaagagtgatt

SEQ ID NO: 215408 - DNA, 20 bp, Artificial Sequence
  chemically synthesized
tccagcgaaagagtgattta

SEQ ID NO: 215409 - DNA, 20 bp, Artificial Sequence
  chemically synthesized
cgaaagagtgatttagagaa

SEQ ID NO: 215410 - DNA, 20 bp, Artificial Sequence
  chemically synthesized
agagtgatttagagaatgga

SEQ ID NO: 215411 - DNA, 20 bp, Artificial Sequence
  chemically synthesized
gagtgatttagagaatggaa

SEQ ID NO: 215412 - DNA, 20 bp, Artificial Sequence
  chemically synthesized
agaatggaaaggcaattaaa

SEQ ID NO: 215413 - DNA, 20 bp, Artificial Sequence
  chemically synthesized
gaatggaaaggcaattaaat

SEQ ID NO: 215414 - DNA, 20 bp, Artificial Sequence
  chemically synthesized
gcaattaaataggcaatgca

SEQ ID NO: 215415 - DNA, 20 bp, Artificial Sequence
  chemically synthesized
aggcaatgcaaagacacaac

SEQ ID NO: 215416 - DNA, 20 bp, Artificial Sequence
  chemically synthesized
ggcaatgcaaagacacaacg

SEQ ID NO: 215417 - DNA, 20 bp, Artificial Sequence
  chemically synthesized
aatgcaaagacacaacgagg

SEQ ID NO: 215418 - DNA, 20 bp, Artificial Sequence
  chemically synthesized
tgcaaagacacaacgaggta

SEQ ID NO: 215419 - DNA, 20 bp, Artificial Sequence
  chemically synthesized
gcaaagacacaacgaggtag

SEQ ID NO: 215420 - DNA, 20 bp, Artificial Sequence
  chemically synthesized
caaagacacaacgaggtaga

SEQ ID NO: 215421 - DNA, 20 bp, Artificial Sequence
  chemically synthesized
cgctgctacttgaatacagt

SEQ ID NO: 215422 - DNA, 20 bp, Artificial Sequence
  chemically synthesized
gtagagggccaactgtattc

SEQ ID NO: 215423 - DNA, 20 bp, Artificial Sequence
  chemically synthesized
ttcccgctgctacttgaata

SEQ ID NO: 215424 - DNA, 20 bp, Artificial Sequence
  chemically synthesized
gagggccaactgtattcaag

SEQ ID NO: 215425 - DNA, 20 bp, Artificial Sequence
  chemically synthesized
ggccaactgtattcaagtag

SEQ ID NO: 215426 - DNA, 20 bp, Artificial Sequence
  chemically synthesized
caactgtattcaagtagcag

SEQ ID NO: 215427 - DNA, 20 bp, Artificial Sequence
  chemically synthesized
aactgtattcaagtagcagc

SEQ ID NO: 215428 - DNA, 20 bp, Artificial Sequence
  chemically synthesized
tgtattcaagtagcagcggg

SEQ ID NO: 215429 - DNA, 20 bp, Artificial Sequence
  chemically synthesized
gtattcaagtagcagcggga

SEQ ID NO: 215430 - DNA, 20 bp, Artificial Sequence
  chemically synthesized
gtagcagcgggaaggtcata

SEQ ID NO: 215431 - DNA, 20 bp, Artificial Sequence
  chemically synthesized
gcagcgggaaggtcatatgg

SEQ ID NO: 215432 - DNA, 20 bp, Artificial Sequence
  chemically synthesized
cagcgggaaggtcatatggt

SEQ ID NO: 215433 - DNA, 20 bp, Artificial Sequence
  chemically synthesized
ggaaggtcatatggtgggtt

SEQ ID NO: 215434 - DNA, 20 bp, Artificial Sequence
  chemically synthesized
aaggtcatatggtgggttta

SEQ ID NO: 215435 - DNA, 20 bp, Artificial Sequence
  chemically synthesized
aggtcatatggtgggtttag

SEQ ID NO: 215436 - DNA, 20 bp, Artificial Sequence
  chemically synthesized
ggtcatatggtgggtttaga

SEQ ID NO: 215437 - DNA, 20 bp, Artificial Sequence
  chemically synthesized
tggtgggtttagagggtgca

SEQ ID NO: 215438 - DNA, 20 bp, Artificial Sequence
  chemically synthesized
ggtgggtttagagggtgcat

SEQ ID NO: 215439 - DNA, 20 bp, Artificial Sequence
  chemically synthesized
gtgggtttagagggtgcata

SEQ ID NO: 215440 - DNA, 20 bp, Artificial Sequence
  chemically synthesized
tgcatagggtgaccacaaca

SEQ ID NO: 215441 - DNA, 20 bp, Artificial Sequence
  chemically synthesized
cgtctccaagtgccatgttg

SEQ ID NO: 215442 - DNA, 20 bp, Artificial Sequence
  chemically synthesized
ggtgaccacaacatggcact

SEQ ID NO: 215443 - DNA, 20 bp, Artificial Sequence
  chemically synthesized
tgaccacaacatggcacttg

SEQ ID NO: 215444 - DNA, 20 bp, Artificial Sequence
  chemically synthesized
attataatctattcgtctcc

SEQ ID NO: 215445 - DNA, 20 bp, Artificial Sequence
  chemically synthesized
acatggcacttggagacgaa

SEQ ID NO: 215446 - DNA, 20 bp, Artificial Sequence
  chemically synthesized
tggagacgaatagattataa

SEQ ID NO: 215447 - DNA, 20 bp, Artificial Sequence
  chemically synthesized
ggagacgaatagattataat

SEQ ID NO: 215448 - DNA, 20 bp, Artificial Sequence
  chemically synthesized
gaatagattataataggttt

SEQ ID NO: 215449 - DNA, 20 bp, Artificial Sequence
  chemically synthesized
ataataggttttggacatca

SEQ ID NO: 215450 - DNA, 20 bp, Artificial Sequence
  chemically synthesized
ggttttggacatcatggtaa

SEQ ID NO: 215451 - DNA, 20 bp, Artificial Sequence
  chemically synthesized
ttggacatcatggtaatggt

SEQ ID NO: 215452 - DNA, 20 bp, Artificial Sequence
  chemically synthesized
tggacatcatggtaatggta

SEQ ID NO: 215453 - DNA, 20 bp, Artificial Sequence
  chemically synthesized
catggtaatggtaaggaatg

SEQ ID NO: 215454 - DNA, 20 bp, Artificial Sequence
  chemically synthesized
atggtaaggaatgtagatat

SEQ ID NO: 215455 - DNA, 20 bp, Artificial Sequence
  chemically synthesized
gtaaggaatgtagatattag

SEQ ID NO: 215456 - DNA, 20 bp, Artificial Sequence
  chemically synthesized
attagaagaatcatcatcat

SEQ ID NO: 215457 - DNA, 20 bp, Artificial Sequence
  chemically synthesized
catcagaaatttgtaaataa

SEQ ID NO: 215458 - DNA, 20 bp, Artificial Sequence
  chemically synthesized
tcagaaatttgtaaataacg

SEQ ID NO: 215459 - DNA, 20 bp, Artificial Sequence
  chemically synthesized
cagaaatttgtaaataacgg

SEQ ID NO: 215460 - DNA, 20 bp, Artificial Sequence
  chemically synthesized
agaaatttgtaaataacgga

SEQ ID NO: 215461 - DNA, 20 bp, Artificial Sequence
  chemically synthesized
cggagggatgtgatcacacc

SEQ ID NO: 215462 - DNA, 20 bp, Artificial Sequence
  chemically synthesized
ggagggatgtgatcacacct

SEQ ID NO: 215463 - DNA, 20 bp, Artificial Sequence
  chemically synthesized
atgtgatcacacctgggctt

SEQ ID NO: 215464 - DNA, 20 bp, Artificial Sequence
  chemically synthesized
ctttctaaaagctaaagccc

SEQ ID NO: 215465 - DNA, 20 bp, Artificial Sequence
  chemically synthesized
tctttctaaaagctaaagcc

SEQ ID NO: 215466 - DNA, 20 bp, Artificial Sequence
  chemically synthesized
cacacctgggctttagcttt

SEQ ID NO: 215467 - DNA, 20 bp, Artificial Sequence
  chemically synthesized
tgttttctttctaaaagcta

SEQ ID NO: 215468 - DNA, 20 bp, Artificial Sequence
  chemically synthesized
cctgggctttagcttttaga

SEQ ID NO: 215469 - DNA, 20 bp, Artificial Sequence
  chemically synthesized
ccctattgttttctttctaa

SEQ ID NO: 215470 - DNA, 20 bp, Artificial Sequence
  chemically synthesized
agcttttagaaagaaaacaa

SEQ ID NO: 215471 - DNA, 20 bp, Artificial Sequence
  chemically synthesized
gcttttagaaagaaaacaat

SEQ ID NO: 215472 - DNA, 20 bp, Artificial Sequence
  chemically synthesized
cttttagaaagaaaacaata

SEQ ID NO: 215473 - DNA, 20 bp, Artificial Sequence
  chemically synthesized
ttagaaagaaaacaataggg

SEQ ID NO: 215474 - DNA, 20 bp, Artificial Sequence
  chemically synthesized
agaaagaaaacaatagggca

SEQ ID NO: 215475 - DNA, 20 bp, Artificial Sequence
  chemically synthesized
gaaagaaaacaatagggcag

SEQ ID NO: 215476 - DNA, 20 bp, Artificial Sequence
  chemically synthesized
gggcagaggatatgtctaca

SEQ ID NO: 215477 - DNA, 20 bp, Artificial Sequence
  chemically synthesized
gcagaggatatgtctacaca

SEQ ID NO: 215478 - DNA, 20 bp, Artificial Sequence
  chemically synthesized
cagaggatatgtctacacag

SEQ ID NO: 215479 - DNA, 20 bp, Artificial Sequence
  chemically synthesized
gtatgatacaatcctctgtg

SEQ ID NO: 215480 - DNA, 20 bp, Artificial Sequence
  chemically synthesized
gattgtatcatactgatatt

SEQ ID NO: 215481 - DNA, 20 bp, Artificial Sequence
  chemically synthesized
catctttgtggtctaaatat

SEQ ID NO: 215482 - DNA, 20 bp, Artificial Sequence
  chemically synthesized
atactgatatttagaccaca

SEQ ID NO: 215483 - DNA, 20 bp, Artificial Sequence
  chemically synthesized
gatatttagaccacaaagat

SEQ ID NO: 215484 - DNA, 20 bp, Artificial Sequence
  chemically synthesized
aaaatcaaatctcatctttg

SEQ ID NO: 215485 - DNA, 20 bp, Artificial Sequence
  chemically synthesized
tacctagccctcagtgttga

SEQ ID NO: 215486 - DNA, 20 bp, Artificial Sequence
  chemically synthesized
tttgattttctttcaacact

SEQ ID NO: 215487 - DNA, 20 bp, Artificial Sequence
  chemically synthesized
ttgattttctttcaacactg

SEQ ID NO: 215488 - DNA, 20 bp, Artificial Sequence
  chemically synthesized
tgattttctttcaacactga

SEQ ID NO: 215489 - DNA, 20 bp, Artificial Sequence
  chemically synthesized
tttctttcaacactgagggc

SEQ ID NO: 215490 - DNA, 20 bp, Artificial Sequence
  chemically synthesized
ttctttcaacactgagggct

SEQ ID NO: 215491 - DNA, 20 bp, Artificial Sequence
  chemically synthesized
gaagcatgatacctagccct

SEQ ID NO: 215492 - DNA, 20 bp, Artificial Sequence
  chemically synthesized
taaatatgaagcatgatacc

SEQ ID NO: 215493 - DNA, 20 bp, Artificial Sequence
  chemically synthesized
tgagacagaccataaatatg

SEQ ID NO: 215494 - DNA, 20 bp, Artificial Sequence
  chemically synthesized
ggtatcatgcttcatattta

SEQ ID NO: 215495 - DNA, 20 bp, Artificial Sequence
  chemically synthesized
ttcatatttatggtctgtct

SEQ ID NO: 215496 - DNA, 20 bp, Artificial Sequence
  chemically synthesized
ccaggtgaggaaagctgaga

SEQ ID NO: 215497 - DNA, 20 bp, Artificial Sequence
  chemically synthesized
ttggccaggtgaggaaagct

SEQ ID NO: 215498 - DNA, 20 bp, Artificial Sequence
  chemically synthesized
taaaattggccaggtgagga

SEQ ID NO: 215499 - DNA, 20 bp, Artificial Sequence
  chemically synthesized
ctgtctcagctttcctcacc

SEQ ID NO: 215500 - DNA, 20 bp, Artificial Sequence
  chemically synthesized
ttgttaaaattggccaggtg

SEQ ID NO: 215501 - DNA, 20 bp, Artificial Sequence
  chemically synthesized
gttgttaaaattggccaggt

SEQ ID NO: 215502 - DNA, 20 bp, Artificial Sequence
  chemically synthesized
ggaggttgttaaaattggcc

SEQ ID NO: 215503 - DNA, 20 bp, Artificial Sequence
  chemically synthesized
aggaggttgttaaaattggc

SEQ ID NO: 215504 - DNA, 20 bp, Artificial Sequence
  chemically synthesized
ccctaggaggttgttaaaat

SEQ ID NO: 215505 - DNA, 20 bp, Artificial Sequence
  chemically synthesized
ggccaattttaacaacctcc

SEQ ID NO: 215506 - DNA, 20 bp, Artificial Sequence
  chemically synthesized
gccaattttaacaacctcct

SEQ ID NO: 215507 - DNA, 20 bp, Artificial Sequence
  chemically synthesized
ccaattttaacaacctccta

SEQ ID NO: 215508 - DNA, 20 bp, Artificial Sequence
  chemically synthesized
gaggctgtgatttccctagg

SEQ ID NO: 215509 - DNA, 20 bp, Artificial Sequence
  chemically synthesized
ggaggctgtgatttccctag

SEQ ID NO: 215510 - DNA, 20 bp, Artificial Sequence
  chemically synthesized
ctggaggctgtgatttccct

SEQ ID NO: 215511 - DNA, 20 bp, Artificial Sequence
  chemically synthesized
actggaggctgtgatttccc

SEQ ID NO: 215512 - DNA, 20 bp, Artificial Sequence
  chemically synthesized
acaacctcctagggaaatca

SEQ ID NO: 215513 - DNA, 20 bp, Artificial Sequence
  chemically synthesized
cctagggaaatcacagcctc

SEQ ID NO: 215514 - DNA, 20 bp, Artificial Sequence
  chemically synthesized
ggagagaggaggtggactgg

SEQ ID NO: 215515 - DNA, 20 bp, Artificial Sequence
  chemically synthesized
gggagagaggaggtggactg

SEQ ID NO: 215516 - DNA, 20 bp, Artificial Sequence
  chemically synthesized
gagggagagaggaggtggac

SEQ ID NO: 215517 - DNA, 20 bp, Artificial Sequence
  chemically synthesized
tatgggagggagagaggagg

SEQ ID NO: 215518 - DNA, 20 bp, Artificial Sequence
  chemically synthesized
cattatgggagggagagagg

SEQ ID NO: 215519 - DNA, 20 bp, Artificial Sequence
  chemically synthesized
ccattatgggagggagagag

SEQ ID NO: 215520 - DNA, 20 bp, Artificial Sequence
  chemically synthesized
tgccattatgggagggagag

SEQ ID NO: 215521 - DNA, 20 bp, Artificial Sequence
  chemically synthesized
ttgccattatgggagggaga

SEQ ID NO: 215522 - DNA, 20 bp, Artificial Sequence
  chemically synthesized
acttgccattatgggaggga

SEQ ID NO: 215523 - DNA, 20 bp, Artificial Sequence
  chemically synthesized
ctacttgccattatgggagg

SEQ ID NO: 215524 - DNA, 20 bp, Artificial Sequence
  chemically synthesized
atctacttgccattatggga

SEQ ID NO: 215525 - DNA, 20 bp, Artificial Sequence
  chemically synthesized
ctcctctctccctcccataa

SEQ ID NO: 215526 - DNA, 20 bp, Artificial Sequence
  chemically synthesized
tatctacttgccattatggg

SEQ ID NO: 215527 - DNA, 20 bp, Artificial Sequence
  chemically synthesized
atatctacttgccattatgg

SEQ ID NO: 215528 - DNA, 20 bp, Artificial Sequence
  chemically synthesized
agatatctacttgccattat

SEQ ID NO: 215529 - DNA, 20 bp, Artificial Sequence
  chemically synthesized
tctctccctcccataatggc

SEQ ID NO: 215530 - DNA, 20 bp, Artificial Sequence
  chemically synthesized
cagatatctacttgccatta

SEQ ID NO: 215531 - DNA, 20 bp, Artificial Sequence
  chemically synthesized
ctccctcccataatggcaag

SEQ ID NO: 215532 - DNA, 20 bp, Artificial Sequence
  chemically synthesized
cataatggcaagtagatatc

SEQ ID NO: 215533 - DNA, 20 bp, Artificial Sequence
  chemically synthesized
gctatttaatagcgggattc

SEQ ID NO: 215534 - DNA, 20 bp, Artificial Sequence
  chemically synthesized
tgttgatgctatttaatagc

SEQ ID NO: 215535 - DNA, 20 bp, Artificial Sequence
  chemically synthesized
atgttgatgctatttaatag

SEQ ID NO: 215536 - DNA, 20 bp, Artificial Sequence
  chemically synthesized
tctggaatcccgctattaaa

SEQ ID NO: 215537 - DNA, 20 bp, Artificial Sequence
  chemically synthesized
cagatgttgatgctatttaa

SEQ ID NO: 215538 - DNA, 20 bp, Artificial Sequence
  chemically synthesized
atcggtgaaacacatgaatt

SEQ ID NO: 215539 - DNA, 20 bp, Artificial Sequence
  chemically synthesized
catgtgtttcaccgatttct

SEQ ID NO: 215540 - DNA, 20 bp, Artificial Sequence
  chemically synthesized
atgtgtttcaccgatttctc

SEQ ID NO: 215541 - DNA, 20 bp, Artificial Sequence
  chemically synthesized
gctataatagcctgagaaat

SEQ ID NO: 215542 - DNA, 20 bp, Artificial Sequence
  chemically synthesized
ttctcctgctataatagcct

SEQ ID NO: 215543 - DNA, 20 bp, Artificial Sequence
  chemically synthesized
accgatttctcaggctatta

SEQ ID NO: 215544 - DNA, 20 bp, Artificial Sequence
  chemically synthesized
gatttctcaggctattatag

SEQ ID NO: 215545 - DNA, 20 bp, Artificial Sequence
  chemically synthesized
atttctcaggctattatagc

SEQ ID NO: 215546 - DNA, 20 bp, Artificial Sequence
  chemically synthesized
atgagtttctcctgctataa

SEQ ID NO: 215547 - DNA, 20 bp, Artificial Sequence
  chemically synthesized
ttctcaggctattatagcag

SEQ ID NO: 215548 - DNA, 20 bp, Artificial Sequence
  chemically synthesized
gataagtaaaattacaacat

SEQ ID NO: 215549 - DNA, 20 bp, Artificial Sequence
  chemically synthesized
catgttgtaattttacttat

SEQ ID NO: 215550 - DNA, 20 bp, Artificial Sequence
  chemically synthesized
atgttgtaattttacttatc

SEQ ID NO: 215551 - DNA, 20 bp, Artificial Sequence
  chemically synthesized
ttggctttcaaattcctgat

SEQ ID NO: 215552 - DNA, 20 bp, Artificial Sequence
  chemically synthesized
tttacttatcaggaatttga

SEQ ID NO: 215553 - DNA, 20 bp, Artificial Sequence
  chemically synthesized
caggaatttgaaagccaaat

SEQ ID NO: 215554 - DNA, 20 bp, Artificial Sequence
  chemically synthesized
tttaatttacttaactaatt

SEQ ID NO: 215555 - DNA, 20 bp, Artificial Sequence
  chemically synthesized
atttgaaagccaaattagtt

SEQ ID NO: 215556 - DNA, 20 bp, Artificial Sequence
  chemically synthesized
caaattagttaagtaaatta

SEQ ID NO: 215557 - DNA, 20 bp, Artificial Sequence
  chemically synthesized
ttaagtaaattaaagtaacg

SEQ ID NO: 215558 - DNA, 20 bp, Artificial Sequence
  chemically synthesized
gtaaattaaagtaacgcagc

SEQ ID NO: 215559 - DNA, 20 bp, Artificial Sequence
  chemically synthesized
aaagtaacgcagctagttaa

SEQ ID NO: 215560 - DNA, 20 bp, Artificial Sequence
  chemically synthesized
gttttgactctgctgttaac

SEQ ID NO: 215561 - DNA, 20 bp, Artificial Sequence
  chemically synthesized
gtaacgcagctagttaacag

SEQ ID NO: 215562 - DNA, 20 bp, Artificial Sequence
  chemically synthesized
aacgcagctagttaacagca

SEQ ID NO: 215563 - DNA, 20 bp, Artificial Sequence
  chemically synthesized
gttaacagcagagtcaaaac

SEQ ID NO: 215564 - DNA, 20 bp, Artificial Sequence
  chemically synthesized
taacagcagagtcaaaacta

SEQ ID NO: 215565 - DNA, 20 bp, Artificial Sequence
  chemically synthesized
atattgagatagttgagctc

SEQ ID NO: 215566 - DNA, 20 bp, Artificial Sequence
  chemically synthesized
aacacaatattgagatagtt

SEQ ID NO: 215567 - DNA, 20 bp, Artificial Sequence
  chemically synthesized
taataaacacaatattgaga

SEQ ID NO: 215568 - DNA, 20 bp, Artificial Sequence
  chemically synthesized
atactaataaacacaatatt

SEQ ID NO: 215569 - DNA, 20 bp, Artificial Sequence
  chemically synthesized
tatctcaatattgtgtttat

SEQ ID NO: 215570 - DNA, 20 bp, Artificial Sequence
  chemically synthesized
attgttgtcaattaattaaa

SEQ ID NO: 215571 - DNA, 20 bp, Artificial Sequence
  chemically synthesized
ttaattgacaacaatatgaa

SEQ ID NO: 215572 - DNA, 20 bp, Artificial Sequence
  chemically synthesized
tagttacgtttgcacctgca

SEQ ID NO: 215573 - DNA, 20 bp, Artificial Sequence
  chemically synthesized
agttacgtttgcacctgcac

SEQ ID NO: 215574 - DNA, 20 bp, Artificial Sequence
  chemically synthesized
ttagttattattgcctgtgc

SEQ ID NO: 215575 - DNA, 20 bp, Artificial Sequence
  chemically synthesized
attagttattattgcctgtg

SEQ ID NO: 215576 - DNA, 20 bp, Artificial Sequence
  chemically synthesized
aggcaataataactaatgca

SEQ ID NO: 215577 - DNA, 20 bp, Artificial Sequence
  chemically synthesized
atggtgtcacagctgtgcat

SEQ ID NO: 215578 - DNA, 20 bp, Artificial Sequence
  chemically synthesized
tctcataggtgatggtgtca

SEQ ID NO: 215579 - DNA, 20 bp, Artificial Sequence
  chemically synthesized
cagatacgtctcataggtga

SEQ ID NO: 215580 - DNA, 20 bp, Artificial Sequence
  chemically synthesized
gctgtgacaccatcacctat

SEQ ID NO: 215581 - DNA, 20 bp, Artificial Sequence
  chemically synthesized
tgaaaacagatacgtctcat

SEQ ID NO: 215582 - DNA, 20 bp, Artificial Sequence
  chemically synthesized
ctgaaaacagatacgtctca

SEQ ID NO: 215583 - DNA, 20 bp, Artificial Sequence
  chemically synthesized
ctatgagacgtatctgtttt

SEQ ID NO: 215584 - DNA, 20 bp, Artificial Sequence
  chemically synthesized
gtttttaatatttctgaaaa

SEQ ID NO: 215585 - DNA, 20 bp, Artificial Sequence
  chemically synthesized
ttttcagaaatattaaaaac

SEQ ID NO: 215586 - DNA, 20 bp, Artificial Sequence
  chemically synthesized
tttcagaaatattaaaaaca

SEQ ID NO: 215587 - DNA, 20 bp, Artificial Sequence
  chemically synthesized
tattaaaaacaaggtgcatc

SEQ ID NO: 215588 - DNA, 20 bp, Artificial Sequence
  chemically synthesized
taaaaacaaggtgcatccag

SEQ ID NO: 215589 - DNA, 20 bp, Artificial Sequence
  chemically synthesized
aaaaacaaggtgcatccagt

SEQ ID NO: 215590 - DNA, 20 bp, Artificial Sequence
  chemically synthesized
aaaacaaggtgcatccagta

SEQ ID NO: 215591 - DNA, 20 bp, Artificial Sequence
  chemically synthesized
attaactatagtcaccctac

SEQ ID NO: 215592 - DNA, 20 bp, Artificial Sequence
  chemically synthesized
tgcatccagtagggtgacta

SEQ ID NO: 215593 - DNA, 20 bp, Artificial Sequence
  chemically synthesized
aaatagattgtcattaacta

SEQ ID NO: 215594 - DNA, 20 bp, Artificial Sequence
  chemically synthesized
agctattttgaaatacaaaa

SEQ ID NO: 215595 - DNA, 20 bp, Artificial Sequence
  chemically synthesized
atctattttgtatttcaaaa

SEQ ID NO: 215596 - DNA, 20 bp, Artificial Sequence
  chemically synthesized
acatttcacgtattttatta

SEQ ID NO: 215597 - DNA, 20 bp, Artificial Sequence
  chemically synthesized
cgtgaaatgttcccaacaca

SEQ ID NO: 215598 - DNA, 20 bp, Artificial Sequence
  chemically synthesized
atttaccattgctttgtgtt

SEQ ID NO: 215599 - DNA, 20 bp, Artificial Sequence
  chemically synthesized
catttaccattgctttgtgt

SEQ ID NO: 215600 - DNA, 20 bp, Artificial Sequence
  chemically synthesized
atgttcccaacacaaagcaa

SEQ ID NO: 215601 - DNA, 20 bp, Artificial Sequence
  chemically synthesized
caaagcaatggtaaatgttt

SEQ ID NO: 215602 - DNA, 20 bp, Artificial Sequence
  chemically synthesized
aaagcaatggtaaatgtttg

SEQ ID NO: 215603 - DNA, 20 bp, Artificial Sequence
  chemically synthesized
atggtaaatgtttgaggtga

SEQ ID NO: 215604 - DNA, 20 bp, Artificial Sequence
  chemically synthesized
aatgtttgaggtgacggata

SEQ ID NO: 215605 - DNA, 20 bp, Artificial Sequence
  chemically synthesized
ccatgtgtaattatcaaata

SEQ ID NO: 215606 - DNA, 20 bp, Artificial Sequence
  chemically synthesized
accatgtgtaattatcaaat

SEQ ID NO: 215607 - DNA, 20 bp, Artificial Sequence
  chemically synthesized
ccttatttgataattacaca

SEQ ID NO: 215608 - DNA, 20 bp, Artificial Sequence
  chemically synthesized
taataattgtacatatttgt

SEQ ID NO: 215609 - DNA, 20 bp, Artificial Sequence
  chemically synthesized
ataataattgtacatatttg

SEQ ID NO: 215610 - DNA, 20 bp, Artificial Sequence
  chemically synthesized
caatttaaaaatgcacatct

SEQ ID NO: 215611 - DNA, 20 bp, Artificial Sequence
  chemically synthesized
tgctgtattttattgcaact

SEQ ID NO: 215612 - DNA, 20 bp, Artificial Sequence
  chemically synthesized
atcttagttgcaataaaata

SEQ ID NO: 215613 - DNA, 20 bp, Artificial Sequence
  chemically synthesized
gcaataaaatacagcaaaca

SEQ ID NO: 215614 - DNA, 20 bp, Artificial Sequence
  chemically synthesized
caataaaatacagcaaacac

SEQ ID NO: 215615 - DNA, 20 bp, Artificial Sequence
  chemically synthesized
agcaaacacaggtgactttt

SEQ ID NO: 215616 - DNA, 20 bp, Artificial Sequence
  chemically synthesized
gcaaacacaggtgacttttc

SEQ ID NO: 215617 - DNA, 20 bp, Artificial Sequence
  chemically synthesized
caaacacaggtgacttttca

SEQ ID NO: 215618 - DNA, 20 bp, Artificial Sequence
  chemically synthesized
aacgaaatcgaggccctgaa

SEQ ID NO: 215619 - DNA, 20 bp, Artificial Sequence
  chemically synthesized
tcttcccatgaacgaaatcg

SEQ ID NO: 215620 - DNA, 20 bp, Artificial Sequence
  chemically synthesized
ttcttcccatgaacgaaatc

SEQ ID NO: 215621 - DNA, 20 bp, Artificial Sequence
  chemically synthesized
cagggcctcgatttcgttca

SEQ ID NO: 215622 - DNA, 20 bp, Artificial Sequence
  chemically synthesized
agggcctcgatttcgttcat

SEQ ID NO: 215623 - DNA, 20 bp, Artificial Sequence
  chemically synthesized
gcctcgatttcgttcatggg

SEQ ID NO: 215624 - DNA, 20 bp, Artificial Sequence
  chemically synthesized
ttcgttcatgggaagaatga

SEQ ID NO: 215625 - DNA, 20 bp, Artificial Sequence
  chemically synthesized
gggcatggaaaaagtcatca

SEQ ID NO: 215626 - DNA, 20 bp, Artificial Sequence
  chemically synthesized
tagggcatggaaaaagtcat

SEQ ID NO: 215627 - DNA, 20 bp, Artificial Sequence
  chemically synthesized
ctggaaatagggcatggaaa

SEQ ID NO: 215628 - DNA, 20 bp, Artificial Sequence
  chemically synthesized
tgttgcctggaaatagggca

SEQ ID NO: 215629 - DNA, 20 bp, Artificial Sequence
  chemically synthesized
ctttttccatgccctatttc

SEQ ID NO: 215630 - DNA, 20 bp, Artificial Sequence
  chemically synthesized
tttttccatgccctatttcc

SEQ ID NO: 215631 - DNA, 20 bp, Artificial Sequence
  chemically synthesized
cactctgttgcctggaaata

SEQ ID NO: 215632 - DNA, 20 bp, Artificial Sequence
  chemically synthesized
acactctgttgcctggaaat

SEQ ID NO: 215633 - DNA, 20 bp, Artificial Sequence
  chemically synthesized
gacactctgttgcctggaaa

SEQ ID NO: 215634 - DNA, 20 bp, Artificial Sequence
  chemically synthesized
catgccctatttccaggcaa

SEQ ID NO: 215635 - DNA, 20 bp, Artificial Sequence
  chemically synthesized
tgccctatttccaggcaaca

SEQ ID NO: 215636 - DNA, 20 bp, Artificial Sequence
  chemically synthesized
tagaaggacactctgttgcc

SEQ ID NO: 215637 - DNA, 20 bp, Artificial Sequence
  chemically synthesized
aacagagtgtccttctaaac

SEQ ID NO: 215638 - DNA, 20 bp, Artificial Sequence
  chemically synthesized
ctgaactcttctggtttaga

SEQ ID NO: 215639 - DNA, 20 bp, Artificial Sequence
  chemically synthesized
gctgaactcttctggtttag

SEQ ID NO: 215640 - DNA, 20 bp, Artificial Sequence
  chemically synthesized
agagtgtccttctaaaccag

SEQ ID NO: 215641 - DNA, 20 bp, Artificial Sequence
  chemically synthesized
agagctgaactcttctggtt

SEQ ID NO: 215642 - DNA, 20 bp, Artificial Sequence
  chemically synthesized
agtgtccttctaaaccagaa

SEQ ID NO: 215643 - DNA, 20 bp, Artificial Sequence
  chemically synthesized
gtgttagagctgaactcttc

SEQ ID NO: 215644 - DNA, 20 bp, Artificial Sequence
  chemically synthesized
ccttctaaaccagaagagtt

SEQ ID NO: 215645 - DNA, 20 bp, Artificial Sequence
  chemically synthesized
agaagagttcagctctaaca

SEQ ID NO: 215646 - DNA, 20 bp, Artificial Sequence
  chemically synthesized
tataatagtcttctgtgtta

SEQ ID NO: 215647 - DNA, 20 bp, Artificial Sequence
  chemically synthesized
agagttcagctctaacacag

SEQ ID NO: 215648 - DNA, 20 bp, Artificial Sequence
  chemically synthesized
tttataatagtcttctgtgt

SEQ ID NO: 215649 - DNA, 20 bp, Artificial Sequence
  chemically synthesized
aacacagaagactattataa

SEQ ID NO: 215650 - DNA, 20 bp, Artificial Sequence
  chemically synthesized
aaggagtctaacttttataa

SEQ ID NO: 215651 - DNA, 20 bp, Artificial Sequence
  chemically synthesized
cagaagactattataaaagt

SEQ ID NO: 215652 - DNA, 20 bp, Artificial Sequence
  chemically synthesized
tataaaagttagactccttt

SEQ ID NO: 215653 - DNA, 20 bp, Artificial Sequence
  chemically synthesized
taaaagttagactcctttga

SEQ ID NO: 215654 - DNA, 20 bp, Artificial Sequence
  chemically synthesized
aacagccaatgctctcaaag

SEQ ID NO: 215655 - DNA, 20 bp, Artificial Sequence
  chemically synthesized
agaacagccaatgctctcaa

SEQ ID NO: 215656 - DNA, 20 bp, Artificial Sequence
  chemically synthesized
aagaacagccaatgctctca

SEQ ID NO: 215657 - DNA, 20 bp, Artificial Sequence
  chemically synthesized
ttagactcctttgagagcat

SEQ ID NO: 215658 - DNA, 20 bp, Artificial Sequence
  chemically synthesized
atatacacaaaaataaagaa

SEQ ID NO: 215659 - DNA, 20 bp, Artificial Sequence
  chemically synthesized
aaaggatatacacaaaaata

SEQ ID NO: 215660 - DNA, 20 bp, Artificial Sequence
  chemically synthesized
ttgtgaaatcgagaaaggaa

SEQ ID NO: 215661 - DNA, 20 bp, Artificial Sequence
  chemically synthesized
cttgtgaaatcgagaaagga

SEQ ID NO: 215662 - DNA, 20 bp, Artificial Sequence
  chemically synthesized
gttgcttgtgaaatcgagaa

SEQ ID NO: 215663 - DNA, 20 bp, Artificial Sequence
  chemically synthesized
agttgcttgtgaaatcgaga

SEQ ID NO: 215664 - DNA, 20 bp, Artificial Sequence
  chemically synthesized
caggagttgcttgtgaaatc

SEQ ID NO: 215665 - DNA, 20 bp, Artificial Sequence
  chemically synthesized
ctttcctttctcgatttcac

SEQ ID NO: 215666 - DNA, 20 bp, Artificial Sequence
  chemically synthesized
taaattcctagaatcgtcag

SEQ ID NO: 215667 - DNA, 20 bp, Artificial Sequence
  chemically synthesized
aataaattcctagaatcgtc

SEQ ID NO: 215668 - DNA, 20 bp, Artificial Sequence
  chemically synthesized
caagcaactcctgacgattc

SEQ ID NO: 215669 - DNA, 20 bp, Artificial Sequence
  chemically synthesized
caataaattcctagaatcgt

SEQ ID NO: 215670 - DNA, 20 bp, Artificial Sequence
  chemically synthesized
aagcaactcctgacgattct

SEQ ID NO: 215671 - DNA, 20 bp, Artificial Sequence
  chemically synthesized
aaaattggacaataaattcc

SEQ ID NO: 215672 - DNA, 20 bp, Artificial Sequence
  chemically synthesized
tatgatcaggaaattaaaat

SEQ ID NO: 215673 - DNA, 20 bp, Artificial Sequence
  chemically synthesized
caattttaatttcctgatca

SEQ ID NO: 215674 - DNA, 20 bp, Artificial Sequence
  chemically synthesized
tcaaagctataactatgatc

SEQ ID NO: 215675 - DNA, 20 bp, Artificial Sequence
  chemically synthesized
ttcaaagctataactatgat

SEQ ID NO: 215676 - DNA, 20 bp, Artificial Sequence
  chemically synthesized
taatttcctgatcatagtta

SEQ ID NO: 215677 - DNA, 20 bp, Artificial Sequence
  chemically synthesized
tgatcatagttatagctttg

SEQ ID NO: 215678 - DNA, 20 bp, Artificial Sequence
  chemically synthesized
aagtttgataatgaacttca

SEQ ID NO: 215679 - DNA, 20 bp, Artificial Sequence
  chemically synthesized
ggaatgagggcatgaggtca

SEQ ID NO: 215680 - DNA, 20 bp, Artificial Sequence
  chemically synthesized
gaggtaggaatgagggcatg

SEQ ID NO: 215681 - DNA, 20 bp, Artificial Sequence
  chemically synthesized
agaggtaggaatgagggcat

SEQ ID NO: 215682 - DNA, 20 bp, Artificial Sequence
  chemically synthesized
tgtctgagaggtaggaatga

SEQ ID NO: 215683 - DNA, 20 bp, Artificial Sequence
  chemically synthesized
gtgtctgagaggtaggaatg

SEQ ID NO: 215684 - DNA, 20 bp, Artificial Sequence
  chemically synthesized
tgtgtctgagaggtaggaat

SEQ ID NO: 215685 - DNA, 20 bp, Artificial Sequence
  chemically synthesized
atgccctcattcctacctct

SEQ ID NO: 215686 - DNA, 20 bp, Artificial Sequence
  chemically synthesized
ataatttgtgtctgagaggt

SEQ ID NO: 215687 - DNA, 20 bp, Artificial Sequence
  chemically synthesized
tataatttgtgtctgagagg

SEQ ID NO: 215688 - DNA, 20 bp, Artificial Sequence
  chemically synthesized
taatataatttgtgtctgag

SEQ ID NO: 215689 - DNA, 20 bp, Artificial Sequence
  chemically synthesized
ataatataatttgtgtctga

SEQ ID NO: 215690 - DNA, 20 bp, Artificial Sequence
  chemically synthesized
taataatataatttgtgtct

SEQ ID NO: 215691 - DNA, 20 bp, Artificial Sequence
  chemically synthesized
agacacaaattatattatta

SEQ ID NO: 215692 - DNA, 20 bp, Artificial Sequence
  chemically synthesized
gacacaaattatattattac

SEQ ID NO: 215693 - DNA, 20 bp, Artificial Sequence
  chemically synthesized
acacaaattatattattaca

SEQ ID NO: 215694 - DNA, 20 bp, Artificial Sequence
  chemically synthesized
ttatttggatttaggaaagg

SEQ ID NO: 215695 - DNA, 20 bp, Artificial Sequence
  chemically synthesized
gttttatttggatttaggaa

SEQ ID NO: 215696 - DNA, 20 bp, Artificial Sequence
  chemically synthesized
tgttttatttggatttagga

SEQ ID NO: 215697 - DNA, 20 bp, Artificial Sequence
  chemically synthesized
ctattgttttatttggattt

SEQ ID NO: 215698 - DNA, 20 bp, Artificial Sequence
  chemically synthesized
tctattgttttatttggatt

SEQ ID NO: 215699 - DNA, 20 bp, Artificial Sequence
  chemically synthesized
cagtattctattgttttatt

SEQ ID NO: 215700 - DNA, 20 bp, Artificial Sequence
  chemically synthesized
cctaaatccaaataaaacaa

SEQ ID NO: 215701 - DNA, 20 bp, Artificial Sequence
  chemically synthesized
attatcgtagtaatttaatt

SEQ ID NO: 215702 - DNA, 20 bp, Artificial Sequence
  chemically synthesized
gaaacaatgataaattatcg

SEQ ID NO: 215703 - DNA, 20 bp, Artificial Sequence
  chemically synthesized
gaaaaaaaacaagaaaatat

SEQ ID NO: 215704 - DNA, 20 bp, Artificial Sequence
  chemically synthesized
cacattctcagaaaaaaaac

SEQ ID NO: 215705 - DNA, 20 bp, Artificial Sequence
  chemically synthesized
tattttcttgttttttttct

SEQ ID NO: 215706 - DNA, 20 bp, Artificial Sequence
  chemically synthesized
ttgttttttttctgagaatg

SEQ ID NO: 215707 - DNA, 20 bp, Artificial Sequence
  chemically synthesized
ctattcaataaccacattct

SEQ ID NO: 215708 - DNA, 20 bp, Artificial Sequence
  chemically synthesized
ctgagaatgtggttattgaa

SEQ ID NO: 215709 - DNA, 20 bp, Artificial Sequence
  chemically synthesized
gccttgcataatcaaaaaag

SEQ ID NO: 215710 - DNA, 20 bp, Artificial Sequence
  chemically synthesized
tgagccttgcataatcaaaa

SEQ ID NO: 215711 - DNA, 20 bp, Artificial Sequence
  chemically synthesized
gactacttttttgattatgc

SEQ ID NO: 215712 - DNA, 20 bp, Artificial Sequence
  chemically synthesized
actacttttttgattatgca

SEQ ID NO: 215713 - DNA, 20 bp, Artificial Sequence
  chemically synthesized
agcaacaaaatgttgacatt

SEQ ID NO: 215714 - DNA, 20 bp, Artificial Sequence
  chemically synthesized
gattacttaatgttataatt

SEQ ID NO: 215715 - DNA, 20 bp, Artificial Sequence
  chemically synthesized
tgttgctaaattataacatt

SEQ ID NO: 215716 - DNA, 20 bp, Artificial Sequence
  chemically synthesized
aattataacattaagtaatc

SEQ ID NO: 215717 - DNA, 20 bp, Artificial Sequence
  chemically synthesized
aagaaaaatattgtgtgatc

SEQ ID NO: 215718 - DNA, 20 bp, Artificial Sequence
  chemically synthesized
gatcacacaatatttttctt

SEQ ID NO: 215719 - DNA, 20 bp, Artificial Sequence
  chemically synthesized
cacaatatttttctttagct

SEQ ID NO: 215720 - DNA, 20 bp, Artificial Sequence
  chemically synthesized
ttaaacatgtttcttagcta

SEQ ID NO: 215721 - DNA, 20 bp, Artificial Sequence
  chemically synthesized
tggaagttaaacatgtttct

SEQ ID NO: 215722 - DNA, 20 bp, Artificial Sequence
  chemically synthesized
taagaaacatgtttaacttc

SEQ ID NO: 215723 - DNA, 20 bp, Artificial Sequence
  chemically synthesized
tgagaaaatgttgtagctgg

SEQ ID NO: 215724 - DNA, 20 bp, Artificial Sequence
  chemically synthesized
ctgtgagaaaatgttgtagc

SEQ ID NO: 215725 - DNA, 20 bp, Artificial Sequence
  chemically synthesized
tattctgtgagaaaatgttg

SEQ ID NO: 215726 - DNA, 20 bp, Artificial Sequence
  chemically synthesized
ccagctacaacattttctca

SEQ ID NO: 215727 - DNA, 20 bp, Artificial Sequence
  chemically synthesized
acaacattttctcacagaat

SEQ ID NO: 215728 - DNA, 20 bp, Artificial Sequence
  chemically synthesized
caatgtaattcttattctgt

SEQ ID NO: 215729 - DNA, 20 bp, Artificial Sequence
  chemically synthesized
acattgtttgtatttatctt

SEQ ID NO: 215730 - DNA, 20 bp, Artificial Sequence
  chemically synthesized
tttgtatttatctttagctt

SEQ ID NO: 215731 - DNA, 20 bp, Artificial Sequence
  chemically synthesized
tgcaataagtgctgaagcta

SEQ ID NO: 215732 - DNA, 20 bp, Artificial Sequence
  chemically synthesized
tataactgcaataagtgctg

SEQ ID NO: 215733 - DNA, 20 bp, Artificial Sequence
  chemically synthesized
tttagcttcagcacttattg

SEQ ID NO: 215734 - DNA, 20 bp, Artificial Sequence
  chemically synthesized
acatattttataactgcaat

SEQ ID NO: 215735 - DNA, 20 bp, Artificial Sequence
  chemically synthesized
tataaaatatgttaatatca

SEQ ID NO: 215736 - DNA, 20 bp, Artificial Sequence
  chemically synthesized
ataaaatatgttaatatcat

SEQ ID NO: 215737 - DNA, 20 bp, Artificial Sequence
  chemically synthesized
atcatgggcataacaactga

SEQ ID NO: 215738 - DNA, 20 bp, Artificial Sequence
  chemically synthesized
tgaacaattaagtacgcttt

SEQ ID NO: 215739 - DNA, 20 bp, Artificial Sequence
  chemically synthesized
gtccccaaggttgaacaatt

SEQ ID NO: 215740 - DNA, 20 bp, Artificial Sequence
  chemically synthesized
cgtacttaattgttcaacct

SEQ ID NO: 215741 - DNA, 20 bp, Artificial Sequence
  chemically synthesized
gtacttaattgttcaacctt

SEQ ID NO: 215742 - DNA, 20 bp, Artificial Sequence
  chemically synthesized
tacttaattgttcaaccttg

SEQ ID NO: 215743 - DNA, 20 bp, Artificial Sequence
  chemically synthesized
tgtagattatgtggtcccca

SEQ ID NO: 215744 - DNA, 20 bp, Artificial Sequence
  chemically synthesized
atgtagattatgtggtcccc

SEQ ID NO: 215745 - DNA, 20 bp, Artificial Sequence
  chemically synthesized
gaaatctgatgtagattatg

SEQ ID NO: 215746 - DNA, 20 bp, Artificial Sequence
  chemically synthesized
ggggaccacataatctacat

SEQ ID NO: 215747 - DNA, 20 bp, Artificial Sequence
  chemically synthesized
aaacccatagaaatctgatg

SEQ ID NO: 215748 - DNA, 20 bp, Artificial Sequence
  chemically synthesized
taatctacatcagatttcta

SEQ ID NO: 215749 - DNA, 20 bp, Artificial Sequence
  chemically synthesized
aatctacatcagatttctat

SEQ ID NO: 215750 - DNA, 20 bp, Artificial Sequence
  chemically synthesized
ccagagacatgaaaaaccca

SEQ ID NO: 215751 - DNA, 20 bp, Artificial Sequence
  chemically synthesized
ctatgggtttttcatgtctc

SEQ ID NO: 215752 - DNA, 20 bp, Artificial Sequence
  chemically synthesized
gaaaggtgcaatcataacca

SEQ ID NO: 215753 - DNA, 20 bp, Artificial Sequence
  chemically synthesized
tggaaaggtgcaatcataac

SEQ ID NO: 215754 - DNA, 20 bp, Artificial Sequence
  chemically synthesized
ggcacagagacaaattggaa

SEQ ID NO: 215755 - DNA, 20 bp, Artificial Sequence
  chemically synthesized
aggcacagagacaaattgga

SEQ ID NO: 215756 - DNA, 20 bp, Artificial Sequence
  chemically synthesized
gttgaggcacagagacaaat

SEQ ID NO: 215757 - DNA, 20 bp, Artificial Sequence
  chemically synthesized
agagagagagttgaggcaca

SEQ ID NO: 215758 - DNA, 20 bp, Artificial Sequence
  chemically synthesized
ggagagagagagttgaggca

SEQ ID NO: 215759 - DNA, 20 bp, Artificial Sequence
  chemically synthesized
taaggggagagagagagttg

SEQ ID NO: 215760 - DNA, 20 bp, Artificial Sequence
  chemically synthesized
ataaggggagagagagagtt

SEQ ID NO: 215761 - DNA, 20 bp, Artificial Sequence
  chemically synthesized
gatggataaggggagagaga

SEQ ID NO: 215762 - DNA, 20 bp, Artificial Sequence
  chemically synthesized
aggatggataaggggagaga

SEQ ID NO: 215763 - DNA, 20 bp, Artificial Sequence
  chemically synthesized
acaggatggataaggggaga

SEQ ID NO: 215764 - DNA, 20 bp, Artificial Sequence
  chemically synthesized
acacaggatggataagggga

SEQ ID NO: 215765 - DNA, 20 bp, Artificial Sequence
  chemically synthesized
ctacacaggatggataaggg

SEQ ID NO: 215766 - DNA, 20 bp, Artificial Sequence
  chemically synthesized
ggctacacaggatggataag

SEQ ID NO: 215767 - DNA, 20 bp, Artificial Sequence
  chemically synthesized
gggctacacaggatggataa

SEQ ID NO: 215768 - DNA, 20 bp, Artificial Sequence
  chemically synthesized
agggctacacaggatggata

SEQ ID NO: 215769 - DNA, 20 bp, Artificial Sequence
  chemically synthesized
aagggctacacaggatggat

SEQ ID NO: 215770 - DNA, 20 bp, Artificial Sequence
  chemically synthesized
ctccccttatccatcctgtg

SEQ ID NO: 215771 - DNA, 20 bp, Artificial Sequence
  chemically synthesized
tttagaagggctacacagga

SEQ ID NO: 215772 - DNA, 20 bp, Artificial Sequence
  chemically synthesized
tctttttagaagggctacac

SEQ ID NO: 215773 - DNA, 20 bp, Artificial Sequence
  chemically synthesized
ttctttttagaagggctaca

SEQ ID NO: 215774 - DNA, 20 bp, Artificial Sequence
  chemically synthesized
tcctgtgtagcccttctaaa

SEQ ID NO: 215775 - DNA, 20 bp, Artificial Sequence
  chemically synthesized
ttcaaagattctttttagaa

SEQ ID NO: 215776 - DNA, 20 bp, Artificial Sequence
  chemically synthesized
attcaaagattctttttaga

SEQ ID NO: 215777 - DNA, 20 bp, Artificial Sequence
  chemically synthesized
tattcaaagattctttttag

SEQ ID NO: 215778 - DNA, 20 bp, Artificial Sequence
  chemically synthesized
atatattcaaagattctttt

SEQ ID NO: 215779 - DNA, 20 bp, Artificial Sequence
  chemically synthesized
tgagtaaaagtatatattca

SEQ ID NO: 215780 - DNA, 20 bp, Artificial Sequence
  chemically synthesized
ggcgatcataaaatgagtaa

SEQ ID NO: 215781 - DNA, 20 bp, Artificial Sequence
  chemically synthesized
ggaacaggcgatcataaaat

SEQ ID NO: 215782 - DNA, 20 bp, Artificial Sequence
  chemically synthesized
tttatgatcgcctgttcctc

SEQ ID NO: 215783 - DNA, 20 bp, Artificial Sequence
  chemically synthesized
gagaagctagctggaggaac

SEQ ID NO: 215784 - DNA, 20 bp, Artificial Sequence
  chemically synthesized
agagaagctagctggaggaa

SEQ ID NO: 215785 - DNA, 20 bp, Artificial Sequence
  chemically synthesized
tgatcgcctgttcctccagc

SEQ ID NO: 215786 - DNA, 20 bp, Artificial Sequence
  chemically synthesized
gtcaaagagaagctagctgg

SEQ ID NO: 215787 - DNA, 20 bp, Artificial Sequence
  chemically synthesized
ggtcaaagagaagctagctg

SEQ ID NO: 215788 - DNA, 20 bp, Artificial Sequence
  chemically synthesized
gaggtcaaagagaagctagc

SEQ ID NO: 215789 - DNA, 20 bp, Artificial Sequence
  chemically synthesized
caatgaggtcaaagagaagc

SEQ ID NO: 215790 - DNA, 20 bp, Artificial Sequence
  chemically synthesized
gagtcaatgaggtcaaagag

SEQ ID NO: 215791 - DNA, 20 bp, Artificial Sequence
  chemically synthesized
attgagtcaatgaggtcaaa

SEQ ID NO: 215792 - DNA, 20 bp, Artificial Sequence
  chemically synthesized
gaattgagtcaatgaggtca

SEQ ID NO: 215793 - DNA, 20 bp, Artificial Sequence
  chemically synthesized
taaggtgaattgagtcaatg

SEQ ID NO: 215794 - DNA, 20 bp, Artificial Sequence
  chemically synthesized
ataaggtgaattgagtcaat

SEQ ID NO: 215795 - DNA, 20 bp, Artificial Sequence
  chemically synthesized
ggaaaggcataaggtgaatt

SEQ ID NO: 215796 - DNA, 20 bp, Artificial Sequence
  chemically synthesized
gatattaggggaaaggcata

SEQ ID NO: 215797 - DNA, 20 bp, Artificial Sequence
  chemically synthesized
agatattaggggaaaggcat

SEQ ID NO: 215798 - DNA, 20 bp, Artificial Sequence
  chemically synthesized
gacacaagatattaggggaa

SEQ ID NO: 215799 - DNA, 20 bp, Artificial Sequence
  chemically synthesized
agacacaagatattagggga

SEQ ID NO: 215800 - DNA, 20 bp, Artificial Sequence
  chemically synthesized
gattagacacaagatattag

SEQ ID NO: 215801 - DNA, 20 bp, Artificial Sequence
  chemically synthesized
tgattagacacaagatatta

SEQ ID NO: 215802 - DNA, 20 bp, Artificial Sequence
  chemically synthesized
atgattagacacaagatatt

SEQ ID NO: 215803 - DNA, 20 bp, Artificial Sequence
  chemically synthesized
catgattagacacaagatat

SEQ ID NO: 215804 - DNA, 20 bp, Artificial Sequence
  chemically synthesized
agtctcacatgattagacac

SEQ ID NO: 215805 - DNA, 20 bp, Artificial Sequence
  chemically synthesized
tatcttgtgtctaatcatgt

SEQ ID NO: 215806 - DNA, 20 bp, Artificial Sequence
  chemically synthesized
attaagaagtctcacatgat

SEQ ID NO: 215807 - DNA, 20 bp, Artificial Sequence
  chemically synthesized
tctgccctggaaatattaag

SEQ ID NO: 215808 - DNA, 20 bp, Artificial Sequence
  chemically synthesized
cggtctgccctggaaatatt

SEQ ID NO: 215809 - DNA, 20 bp, Artificial Sequence
  chemically synthesized
gtgagacttcttaatatttc

SEQ ID NO: 215810 - DNA, 20 bp, Artificial Sequence
  chemically synthesized
tgagacttcttaatatttcc

SEQ ID NO: 215811 - DNA, 20 bp, Artificial Sequence
  chemically synthesized
gagacttcttaatatttcca

SEQ ID NO: 215812 - DNA, 20 bp, Artificial Sequence
  chemically synthesized
acttcttaatatttccaggg

SEQ ID NO: 215813 - DNA, 20 bp, Artificial Sequence
  chemically synthesized
caaaagaggacggtctgccc

SEQ ID NO: 215814 - DNA, 20 bp, Artificial Sequence
  chemically synthesized
cttgaaaggacaaaagagga

SEQ ID NO: 215815 - DNA, 20 bp, Artificial Sequence
  chemically synthesized
taaccttgaaaggacaaaag

SEQ ID NO: 215816 - DNA, 20 bp, Artificial Sequence
  chemically synthesized
ataaccttgaaaggacaaaa

SEQ ID NO: 215817 - DNA, 20 bp, Artificial Sequence
  chemically synthesized
gaataaccttgaaaggacaa

SEQ ID NO: 215818 - DNA, 20 bp, Artificial Sequence
  chemically synthesized
ccgtcctcttttgtcctttc

SEQ ID NO: 215819 - DNA, 20 bp, Artificial Sequence
  chemically synthesized
cgtcctcttttgtcctttca

SEQ ID NO: 215820 - DNA, 20 bp, Artificial Sequence
  chemically synthesized
acagcttgaataaccttgaa

SEQ ID NO: 215821 - DNA, 20 bp, Artificial Sequence
  chemically synthesized
aacagcttgaataaccttga

SEQ ID NO: 215822 - DNA, 20 bp, Artificial Sequence
  chemically synthesized
ttgtcctttcaaggttattc

SEQ ID NO: 215823 - DNA, 20 bp, Artificial Sequence
  chemically synthesized
aacatcagaagtgtggacaa

SEQ ID NO: 215824 - DNA, 20 bp, Artificial Sequence
  chemically synthesized
gagggagaacatcagaagtg

SEQ ID NO: 215825 - DNA, 20 bp, Artificial Sequence
  chemically synthesized
ttatagagggagaacatcag

SEQ ID NO: 215826 - DNA, 20 bp, Artificial Sequence
  chemically synthesized
tcattatagagggagaacat

SEQ ID NO: 215827 - DNA, 20 bp, Artificial Sequence
  chemically synthesized
gaagcttgtcattatagagg

SEQ ID NO: 215828 - DNA, 20 bp, Artificial Sequence
  chemically synthesized
tagaagcttgtcattataga

SEQ ID NO: 215829 - DNA, 20 bp, Artificial Sequence
  chemically synthesized
gtagaagcttgtcattatag

SEQ ID NO: 215830 - DNA, 20 bp, Artificial Sequence
  chemically synthesized
agtagaagcttgtcattata

SEQ ID NO: 215831 - DNA, 20 bp, Artificial Sequence
  chemically synthesized
tgttctccctctataatgac

SEQ ID NO: 215832 - DNA, 20 bp, Artificial Sequence
  chemically synthesized
tgagtagaagcttgtcatta

SEQ ID NO: 215833 - DNA, 20 bp, Artificial Sequence
  chemically synthesized
tataatgacaagcttctact

SEQ ID NO: 215834 - DNA, 20 bp, Artificial Sequence
  chemically synthesized
tcatctgggaggctgagtag

SEQ ID NO: 215835 - DNA, 20 bp, Artificial Sequence
  chemically synthesized
agctcatctgggaggctgag

SEQ ID NO: 215836 - DNA, 20 bp, Artificial Sequence
  chemically synthesized
caagcttctactcagcctcc

SEQ ID NO: 215837 - DNA, 20 bp, Artificial Sequence
  chemically synthesized
attagctcatctgggaggct

SEQ ID NO: 215838 - DNA, 20 bp, Artificial Sequence
  chemically synthesized
ttctactcagcctcccagat

SEQ ID NO: 215839 - DNA, 20 bp, Artificial Sequence
  chemically synthesized
ggtagattagctcatctggg

SEQ ID NO: 215840 - DNA, 20 bp, Artificial Sequence
  chemically synthesized
tggtagattagctcatctgg

SEQ ID NO: 215841 - DNA, 20 bp, Artificial Sequence
  chemically synthesized
ggtggtagattagctcatct

SEQ ID NO: 215842 - DNA, 20 bp, Artificial Sequence
  chemically synthesized
aggtggtagattagctcatc

SEQ ID NO: 215843 - DNA, 20 bp, Artificial Sequence
  chemically synthesized
tcacggagaaggtggtagat

SEQ ID NO: 215844 - DNA, 20 bp, Artificial Sequence
  chemically synthesized
cagcttcacggagaaggtgg

SEQ ID NO: 215845 - DNA, 20 bp, Artificial Sequence
  chemically synthesized
acccagcttcacggagaagg

SEQ ID NO: 215846 - DNA, 20 bp, Artificial Sequence
  chemically synthesized
aagacccagcttcacggaga

SEQ ID NO: 215847 - DNA, 20 bp, Artificial Sequence
  chemically synthesized
aatctaccaccttctccgtg

SEQ ID NO: 215848 - DNA, 20 bp, Artificial Sequence
  chemically synthesized
taagacccagcttcacggag

SEQ ID NO: 215849 - DNA, 20 bp, Artificial Sequence
  chemically synthesized
gcgtaagacccagcttcacg

SEQ ID NO: 215850 - DNA, 20 bp, Artificial Sequence
  chemically synthesized
taccaccttctccgtgaagc

SEQ ID NO: 215851 - DNA, 20 bp, Artificial Sequence
  chemically synthesized
accaccttctccgtgaagct

SEQ ID NO: 215852 - DNA, 20 bp, Artificial Sequence
  chemically synthesized
gagcgtaagacccagcttca

SEQ ID NO: 215853 - DNA, 20 bp, Artificial Sequence
  chemically synthesized
ctccaacagagcgtaagacc

SEQ ID NO: 215854 - DNA, 20 bp, Artificial Sequence
  chemically synthesized
tctcttctccaacagagcgt

SEQ ID NO: 215855 - DNA, 20 bp, Artificial Sequence
  chemically synthesized
agctgggtcttacgctctgt

SEQ ID NO: 215856 - DNA, 20 bp, Artificial Sequence
  chemically synthesized
ctgggtcttacgctctgttg

SEQ ID NO: 215857 - DNA, 20 bp, Artificial Sequence
  chemically synthesized
gagtagtctcttctccaaca

SEQ ID NO: 215858 - DNA, 20 bp, Artificial Sequence
  chemically synthesized
ggtcttacgctctgttggag

SEQ ID NO: 215859 - DNA, 20 bp, Artificial Sequence
  chemically synthesized
cagagtagtctcttctccaa

SEQ ID NO: 215860 - DNA, 20 bp, Artificial Sequence
  chemically synthesized
tcttacgctctgttggagaa

SEQ ID NO: 215861 - DNA, 20 bp, Artificial Sequence
  chemically synthesized
aatctgtgaaggaatcagag

SEQ ID NO: 215862 - DNA, 20 bp, Artificial Sequence
  chemically synthesized
taaaatctgtgaaggaatca

SEQ ID NO: 215863 - DNA, 20 bp, Artificial Sequence
  chemically synthesized
agtaaaatctgtgaaggaat

SEQ ID NO: 215864 - DNA, 20 bp, Artificial Sequence
  chemically synthesized
agactactctgattccttca

SEQ ID NO: 215865 - DNA, 20 bp, Artificial Sequence
  chemically synthesized
aggtacagtaaaatctgtga

SEQ ID NO: 215866 - DNA, 20 bp, Artificial Sequence
  chemically synthesized
taggtacagtaaaatctgtg

SEQ ID NO: 215867 - DNA, 20 bp, Artificial Sequence
  chemically synthesized
atagtatcccaagataggta

SEQ ID NO: 215868 - DNA, 20 bp, Artificial Sequence
  chemically synthesized
agattttactgtacctatct

SEQ ID NO: 215869 - DNA, 20 bp, Artificial Sequence
  chemically synthesized
gattttactgtacctatctt

SEQ ID NO: 215870 - DNA, 20 bp, Artificial Sequence
  chemically synthesized
tcattatagtatcccaagat

SEQ ID NO: 215871 - DNA, 20 bp, Artificial Sequence
  chemically synthesized
atcattatagtatcccaaga

SEQ ID NO: 215872 - DNA, 20 bp, Artificial Sequence
  chemically synthesized
caaaatcattatagtatccc

SEQ ID NO: 215873 - DNA, 20 bp, Artificial Sequence
  chemically synthesized
gaacagcatcaaaatcatta

SEQ ID NO: 215874 - DNA, 20 bp, Artificial Sequence
  chemically synthesized
ctgggtttagtcaggtagaa

SEQ ID NO: 215875 - DNA, 20 bp, Artificial Sequence
  chemically synthesized
aacagctgggtttagtcagg

SEQ ID NO: 215876 - DNA, 20 bp, Artificial Sequence
  chemically synthesized
agtaacagctgggtttagtc

SEQ ID NO: 215877 - DNA, 20 bp, Artificial Sequence
  chemically synthesized
tagtaacagctgggtttagt

SEQ ID NO: 215878 - DNA, 20 bp, Artificial Sequence
  chemically synthesized
ctgttctacctgactaaacc

SEQ ID NO: 215879 - DNA, 20 bp, Artificial Sequence
  chemically synthesized
taaatagtaacagctgggtt

SEQ ID NO: 215880 - DNA, 20 bp, Artificial Sequence
  chemically synthesized
attgctaaatagtaacagct

SEQ ID NO: 215881 - DNA, 20 bp, Artificial Sequence
  chemically synthesized
cattgctaaatagtaacagc

SEQ ID NO: 215882 - DNA, 20 bp, Artificial Sequence
  chemically synthesized
tatccattgctaaatagtaa

SEQ ID NO: 215883 - DNA, 20 bp, Artificial Sequence
  chemically synthesized
taaacccagctgttactatt

SEQ ID NO: 215884 - DNA, 20 bp, Artificial Sequence
  chemically synthesized
atgttgtatccattgctaaa

SEQ ID NO: 215885 - DNA, 20 bp, Artificial Sequence
  chemically synthesized
cagctgttactatttagcaa

SEQ ID NO: 215886 - DNA, 20 bp, Artificial Sequence
  chemically synthesized
atttagcaatggatacaaca

SEQ ID NO: 215887 - DNA, 20 bp, Artificial Sequence
  chemically synthesized
tagcaatggatacaacatag

SEQ ID NO: 215888 - DNA, 20 bp, Artificial Sequence
  chemically synthesized
ctaattaaaagacatttgtt

SEQ ID NO: 215889 - DNA, 20 bp, Artificial Sequence
  chemically synthesized
ctcaacaaatgtcttttaat

SEQ ID NO: 215890 - DNA, 20 bp, Artificial Sequence
  chemically synthesized
gctgctcatgcactaattaa

SEQ ID NO: 215891 - DNA, 20 bp, Artificial Sequence
  chemically synthesized
atgtcttttaattagtgcat

SEQ ID NO: 215892 - DNA, 20 bp, Artificial Sequence
  chemically synthesized
tcttttaattagtgcatgag

SEQ ID NO: 215893 - DNA, 20 bp, Artificial Sequence
  chemically synthesized
tttaattagtgcatgagcag

SEQ ID NO: 215894 - DNA, 20 bp, Artificial Sequence
  chemically synthesized
catgagcagcagtatctgca

SEQ ID NO: 215895 - DNA, 20 bp, Artificial Sequence
  chemically synthesized
agacagtggctttcactgtg

SEQ ID NO: 215896 - DNA, 20 bp, Artificial Sequence
  chemically synthesized
cagcagtatctgcacagtga

SEQ ID NO: 215897 - DNA, 20 bp, Artificial Sequence
  chemically synthesized
aggtgaggatatacagacag

SEQ ID NO: 215898 - DNA, 20 bp, Artificial Sequence
  chemically synthesized
aggaggtgaggatatacaga

SEQ ID NO: 215899 - DNA, 20 bp, Artificial Sequence
  chemically synthesized
tagtaggaggtgaggatata

SEQ ID NO: 215900 - DNA, 20 bp, Artificial Sequence
  chemically synthesized
ttaaaatgtagtaggaggtg

SEQ ID NO: 215901 - DNA, 20 bp, Artificial Sequence
  chemically synthesized
gttaaaatgtagtaggaggt

SEQ ID NO: 215902 - DNA, 20 bp, Artificial Sequence
  chemically synthesized
gtaggttaaaatgtagtagg

SEQ ID NO: 215903 - DNA, 20 bp, Artificial Sequence
  chemically synthesized
ggtaggttaaaatgtagtag

SEQ ID NO: 215904 - DNA, 20 bp, Artificial Sequence
  chemically synthesized
gtggtaggttaaaatgtagt

SEQ ID NO: 215905 - DNA, 20 bp, Artificial Sequence
  chemically synthesized
tgtggtaggttaaaatgtag

SEQ ID NO: 215906 - DNA, 20 bp, Artificial Sequence
  chemically synthesized
atttgtggtaggttaaaatg

SEQ ID NO: 215907 - DNA, 20 bp, Artificial Sequence
  chemically synthesized
atcaaaaaactatttgtggt

SEQ ID NO: 215908 - DNA, 20 bp, Artificial Sequence
  chemically synthesized
acattttaacctaccacaaa

SEQ ID NO: 215909 - DNA, 20 bp, Artificial Sequence
  chemically synthesized
catcaaaaaactatttgtgg

SEQ ID NO: 215910 - DNA, 20 bp, Artificial Sequence
  chemically synthesized
atgcatcaaaaaactatttg

SEQ ID NO: 215911 - DNA, 20 bp, Artificial Sequence
  chemically synthesized
agttttttgatgcatgcttc

SEQ ID NO: 215912 - DNA, 20 bp, Artificial Sequence
  chemically synthesized
ataaaagacattttcactgg

SEQ ID NO: 215913 - DNA, 20 bp, Artificial Sequence
  chemically synthesized
ttgataaaagacattttcac

SEQ ID NO: 215914 - DNA, 20 bp, Artificial Sequence
  chemically synthesized
cagtgaaaatgtcttttatc

SEQ ID NO: 215915 - DNA, 20 bp, Artificial Sequence
  chemically synthesized
agtgaaaatgtcttttatca

SEQ ID NO: 215916 - DNA, 20 bp, Artificial Sequence
  chemically synthesized
ctcatacttgaccttgataa

SEQ ID NO: 215917 - DNA, 20 bp, Artificial Sequence
  chemically synthesized
aaatgtcttttatcaaggtc

SEQ ID NO: 215918 - DNA, 20 bp, Artificial Sequence
  chemically synthesized
cttttatcaaggtcaagtat

SEQ ID NO: 215919 - DNA, 20 bp, Artificial Sequence
  chemically synthesized
ccattgggttttgcaatatg

SEQ ID NO: 215920 - DNA, 20 bp, Artificial Sequence
  chemically synthesized
gaccattgggttttgcaata

SEQ ID NO: 215921 - DNA, 20 bp, Artificial Sequence
  chemically synthesized
ctccatattgcaaaacccaa

SEQ ID NO: 215922 - DNA, 20 bp, Artificial Sequence
  chemically synthesized
acacaaaagaatagaccatt

SEQ ID NO: 215923 - DNA, 20 bp, Artificial Sequence
  chemically synthesized
aacacaaaagaatagaccat

SEQ ID NO: 215924 - DNA, 20 bp, Artificial Sequence
  chemically synthesized
attagacaaacacaaaagaa

SEQ ID NO: 215925 - DNA, 20 bp, Artificial Sequence
  chemically synthesized
atacaattagacaaacacaa

SEQ ID NO: 215926 - DNA, 20 bp, Artificial Sequence
  chemically synthesized
tcaaatgttgaaaatacaat

SEQ ID NO: 215927 - DNA, 20 bp, Artificial Sequence
  chemically synthesized
cttcatgatagaatcaaaaa

SEQ ID NO: 215928 - DNA, 20 bp, Artificial Sequence
  chemically synthesized
ctgtttttgattctatcatg

SEQ ID NO: 215929 - DNA, 20 bp, Artificial Sequence
  chemically synthesized
tgtttttgattctatcatga

SEQ ID NO: 215930 - DNA, 20 bp, Artificial Sequence
  chemically synthesized
atgaagaaagtccttcatga

SEQ ID NO: 215931 - DNA, 20 bp, Artificial Sequence
  chemically synthesized
ccaggcaagtgggatgaaga

SEQ ID NO: 215932 - DNA, 20 bp, Artificial Sequence
  chemically synthesized
aaaaccaggcaagtgggatg

SEQ ID NO: 215933 - DNA, 20 bp, Artificial Sequence
  chemically synthesized
ctttcttcatcccacttgcc

SEQ ID NO: 215934 - DNA, 20 bp, Artificial Sequence
  chemically synthesized
atagagaaaaccaggcaagt

SEQ ID NO: 215935 - DNA, 20 bp, Artificial Sequence
  chemically synthesized
tatagagaaaaccaggcaag

SEQ ID NO: 215936 - DNA, 20 bp, Artificial Sequence
  chemically synthesized
atttatagagaaaaccaggc

SEQ ID NO: 215937 - DNA, 20 bp, Artificial Sequence
  chemically synthesized
tgtgatttatagagaaaacc

SEQ ID NO: 215938 - DNA, 20 bp, Artificial Sequence
  chemically synthesized
ctgtgatttatagagaaaac

SEQ ID NO: 215939 - DNA, 20 bp, Artificial Sequence
  chemically synthesized
agcaacttctgtgatttata

SEQ ID NO: 215940 - DNA, 20 bp, Artificial Sequence
  chemically synthesized
ctggttttctctataaatca

SEQ ID NO: 215941 - DNA, 20 bp, Artificial Sequence
  chemically synthesized
aaagcaacttctgtgattta

SEQ ID NO: 215942 - DNA, 20 bp, Artificial Sequence
  chemically synthesized
gttttctctataaatcacag

SEQ ID NO: 215943 - DNA, 20 bp, Artificial Sequence
  chemically synthesized
aaaatactcaaaggagacaa

SEQ ID NO: 215944 - DNA, 20 bp, Artificial Sequence
  chemically synthesized
aagttgcttttgtctccttt

SEQ ID NO: 215945 - DNA, 20 bp, Artificial Sequence
  chemically synthesized
aagaaaaaaaatactcaaag

SEQ ID NO: 215946 - DNA, 20 bp, Artificial Sequence
  chemically synthesized
ggaagaaaaaaaatactcaa

SEQ ID NO: 215947 - DNA, 20 bp, Artificial Sequence
  chemically synthesized
aggaagaaaaaaaatactca

SEQ ID NO: 215948 - DNA, 20 bp, Artificial Sequence
  chemically synthesized
gcacctttcaaaacaggagg

SEQ ID NO: 215949 - DNA, 20 bp, Artificial Sequence
  chemically synthesized
actgcacctttcaaaacagg

SEQ ID NO: 215950 - DNA, 20 bp, Artificial Sequence
  chemically synthesized
gactgcacctttcaaaacag

SEQ ID NO: 215951 - DNA, 20 bp, Artificial Sequence
  chemically synthesized
ttttcttcctcctgttttga

SEQ ID NO: 215952 - DNA, 20 bp, Artificial Sequence
  chemically synthesized
ttgactgcacctttcaaaac

SEQ ID NO: 215953 - DNA, 20 bp, Artificial Sequence
  chemically synthesized
tttcttcctcctgttttgaa

SEQ ID NO: 215954 - DNA, 20 bp, Artificial Sequence
  chemically synthesized
attgactgcacctttcaaaa

SEQ ID NO: 215955 - DNA, 20 bp, Artificial Sequence
  chemically synthesized
tcctcctgttttgaaaggtg

SEQ ID NO: 215956 - DNA, 20 bp, Artificial Sequence
  chemically synthesized
tgaaaggtgcagtcaattct

SEQ ID NO: 215957 - DNA, 20 bp, Artificial Sequence
  chemically synthesized
gaaaggtgcagtcaattctc

SEQ ID NO: 215958 - DNA, 20 bp, Artificial Sequence
  chemically synthesized
agagtttgggaaaagagccc

SEQ ID NO: 215959 - DNA, 20 bp, Artificial Sequence
  chemically synthesized
aggaggagagtttgggaaaa

SEQ ID NO: 215960 - DNA, 20 bp, Artificial Sequence
  chemically synthesized
ctaggaggagagtttgggaa

SEQ ID NO: 215961 - DNA, 20 bp, Artificial Sequence
  chemically synthesized
gtcttctaggaggagagttt

SEQ ID NO: 215962 - DNA, 20 bp, Artificial Sequence
  chemically synthesized
agtcttctaggaggagagtt

SEQ ID NO: 215963 - DNA, 20 bp, Artificial Sequence
  chemically synthesized
cttttcccaaactctcctcc

SEQ ID NO: 215964 - DNA, 20 bp, Artificial Sequence
  chemically synthesized
gatgaagtcttctaggagga

SEQ ID NO: 215965 - DNA, 20 bp, Artificial Sequence
  chemically synthesized
ttcccaaactctcctcctag

SEQ ID NO: 215966 - DNA, 20 bp, Artificial Sequence
  chemically synthesized
tggatgaagtcttctaggag

SEQ ID NO: 215967 - DNA, 20 bp, Artificial Sequence
  chemically synthesized
actggatgaagtcttctagg

SEQ ID NO: 215968 - DNA, 20 bp, Artificial Sequence
  chemically synthesized
gactggatgaagtcttctag

SEQ ID NO: 215969 - DNA, 20 bp, Artificial Sequence
  chemically synthesized
gggactggatgaagtcttct

SEQ ID NO: 215970 - DNA, 20 bp, Artificial Sequence
  chemically synthesized
tgggactggatgaagtcttc

SEQ ID NO: 215971 - DNA, 20 bp, Artificial Sequence
  chemically synthesized
tcctcctagaagacttcatc

SEQ ID NO: 215972 - DNA, 20 bp, Artificial Sequence
  chemically synthesized
taaagacatgggactggatg

SEQ ID NO: 215973 - DNA, 20 bp, Artificial Sequence
  chemically synthesized
ggtttttaaagacatgggac

SEQ ID NO: 215974 - DNA, 20 bp, Artificial Sequence
  chemically synthesized
tagatggtttttaaagacat

SEQ ID NO: 215975 - DNA, 20 bp, Artificial Sequence
  chemically synthesized
ttagatggtttttaaagaca

SEQ ID NO: 215976 - DNA, 20 bp, Artificial Sequence
  chemically synthesized
aggcccttagatggttttta

SEQ ID NO: 215977 - DNA, 20 bp, Artificial Sequence
  chemically synthesized
catgtctttaaaaaccatct

SEQ ID NO: 215978 - DNA, 20 bp, Artificial Sequence
  chemically synthesized
atgtctttaaaaaccatcta

SEQ ID NO: 215979 - DNA, 20 bp, Artificial Sequence
  chemically synthesized
tgtctttaaaaaccatctaa

SEQ ID NO: 215980 - DNA, 20 bp, Artificial Sequence
  chemically synthesized
ggcagtcataggcccttaga

SEQ ID NO: 215981 - DNA, 20 bp, Artificial Sequence
  chemically synthesized
atgtggcagtcataggccct

SEQ ID NO: 215982 - DNA, 20 bp, Artificial Sequence
  chemically synthesized
ataaataatgtggcagtcat

SEQ ID NO: 215983 - DNA, 20 bp, Artificial Sequence
  chemically synthesized
aataaataatgtggcagtca

SEQ ID NO: 215984 - DNA, 20 bp, Artificial Sequence
  chemically synthesized
taaataaataaataatgtgg

SEQ ID NO: 215985 - DNA, 20 bp, Artificial Sequence
  chemically synthesized
aaataaataaataaataatg

SEQ ID NO: 215986 - DNA, 20 bp, Artificial Sequence
  chemically synthesized
attatttatttatttatttt

SEQ ID NO: 215987 - DNA, 20 bp, Artificial Sequence
  chemically synthesized
tttatttatttattttgaga

SEQ ID NO: 215988 - DNA, 20 bp, Artificial Sequence
  chemically synthesized
ttatttatttattttgagac

SEQ ID NO: 215989 - DNA, 20 bp, Artificial Sequence
  chemically synthesized
tatttatttattttgagaca

SEQ ID NO: 215990 - DNA, 20 bp, Artificial Sequence
  chemically synthesized
tccagcctgggcaacagagt

SEQ ID NO: 215991 - DNA, 20 bp, Artificial Sequence
  chemically synthesized
cagggtctcactctgttgcc

SEQ ID NO: 215992 - DNA, 20 bp, Artificial Sequence
  chemically synthesized
gcactccagcctgggcaaca

SEQ ID NO: 215993 - DNA, 20 bp, Artificial Sequence
  chemically synthesized
agggtctcactctgttgccc

SEQ ID NO: 215994 - DNA, 20 bp, Artificial Sequence
  chemically synthesized
ctgcactccagcctgggcaa

SEQ ID NO: 215995 - DNA, 20 bp, Artificial Sequence
  chemically synthesized
tctcactctgttgcccaggc

SEQ ID NO: 215996 - DNA, 20 bp, Artificial Sequence
  chemically synthesized
tcactctgttgcccaggctg

SEQ ID NO: 215997 - DNA, 20 bp, Artificial Sequence
  chemically synthesized
acaccgctgcactccagcct

SEQ ID NO: 215998 - DNA, 20 bp, Artificial Sequence
  chemically synthesized
cacaccgctgcactccagcc

SEQ ID NO: 215999 - DNA, 20 bp, Artificial Sequence
  chemically synthesized
ctgttgcccaggctggagtg

SEQ ID NO: 216000 - DNA, 20 bp, Artificial Sequence
  chemically synthesized
gtgatcacaccgctgcactc

SEQ ID NO: 216001 - DNA, 20 bp, Artificial Sequence
  chemically synthesized
ttgcccaggctggagtgcag

SEQ ID NO: 216002 - DNA, 20 bp, Artificial Sequence
  chemically synthesized
ggagtgcagcggtgtgatca

SEQ ID NO: 216003 - DNA, 20 bp, Artificial Sequence
  chemically synthesized
ggtgtgatcacggctcactg

SEQ ID NO: 216004 - DNA, 20 bp, Artificial Sequence
  chemically synthesized
tgggaagtcaaggctgcagt

SEQ ID NO: 216005 - DNA, 20 bp, Artificial Sequence
  chemically synthesized
agcctgggaagtcaaggctg

SEQ ID NO: 216006 - DNA, 20 bp, Artificial Sequence
  chemically synthesized
cacttgagcctgggaagtca

SEQ ID NO: 216007 - DNA, 20 bp, Artificial Sequence
  chemically synthesized
tcactgcagccttgacttcc

SEQ ID NO: 216008 - DNA, 20 bp, Artificial Sequence
  chemically synthesized
tcacttgagcctgggaagtc

SEQ ID NO: 216009 - DNA, 20 bp, Artificial Sequence
  chemically synthesized
cactgcagccttgacttccc

SEQ ID NO: 216010 - DNA, 20 bp, Artificial Sequence
  chemically synthesized
aaggatcacttgagcctggg

SEQ ID NO: 216011 - DNA, 20 bp, Artificial Sequence
  chemically synthesized
agccttgacttcccaggctc

SEQ ID NO: 216012 - DNA, 20 bp, Artificial Sequence
  chemically synthesized
ctgaaggatcacttgagcct

SEQ ID NO: 216013 - DNA, 20 bp, Artificial Sequence
  chemically synthesized
gctgaaggatcacttgagcc

SEQ ID NO: 216014 - DNA, 20 bp, Artificial Sequence
  chemically synthesized
ccgaggctgaaggatcactt

SEQ ID NO: 216015 - DNA, 20 bp, Artificial Sequence
  chemically synthesized
cccaggctcaagtgatcctt

SEQ ID NO: 216016 - DNA, 20 bp, Artificial Sequence
  chemically synthesized
ctcaagtgatccttcagcct

SEQ ID NO: 216017 - DNA, 20 bp, Artificial Sequence
  chemically synthesized
actcaggaggccgaggctga

SEQ ID NO: 216018 - DNA, 20 bp, Artificial Sequence
  chemically synthesized
tactcaggaggccgaggctg

SEQ ID NO: 216019 - DNA, 20 bp, Artificial Sequence
  chemically synthesized
cccagatactcaggaggccg

SEQ ID NO: 216020 - DNA, 20 bp, Artificial Sequence
  chemically synthesized
tcccagatactcaggaggcc

SEQ ID NO: 216021 - DNA, 20 bp, Artificial Sequence
  chemically synthesized
tccttcagcctcggcctcct

SEQ ID NO: 216022 - DNA, 20 bp, Artificial Sequence
  chemically synthesized
tgtagtcccagatactcagg

SEQ ID NO: 216023 - DNA, 20 bp, Artificial Sequence
  chemically synthesized
ctgtagtcccagatactcag

SEQ ID NO: 216024 - DNA, 20 bp, Artificial Sequence
  chemically synthesized
gcctcggcctcctgagtatc

SEQ ID NO: 216025 - DNA, 20 bp, Artificial Sequence
  chemically synthesized
gcctgtagtcccagatactc

SEQ ID NO: 216026 - DNA, 20 bp, Artificial Sequence
  chemically synthesized
cctcggcctcctgagtatct

SEQ ID NO: 216027 - DNA, 20 bp, Artificial Sequence
  chemically synthesized
tgcctgtagtcccagatact

SEQ ID NO: 216028 - DNA, 20 bp, Artificial Sequence
  chemically synthesized
ctcctgagtatctgggacta

SEQ ID NO: 216029 - DNA, 20 bp, Artificial Sequence
  chemically synthesized
tcctgagtatctgggactac

SEQ ID NO: 216030 - DNA, 20 bp, Artificial Sequence
  chemically synthesized
gtggcacatgcctgtagtcc

SEQ ID NO: 216031 - DNA, 20 bp, Artificial Sequence
  chemically synthesized
ggtgtggtggcacatgcctg

SEQ ID NO: 216032 - DNA, 20 bp, Artificial Sequence
  chemically synthesized
caaaaattaatcgggtgtgg

SEQ ID NO: 216033 - DNA, 20 bp, Artificial Sequence
  chemically synthesized
gcgcaaaaattaatcgggtg

SEQ ID NO: 216034 - DNA, 20 bp, Artificial Sequence
  chemically synthesized
cacgcgcgcaaaaattaatc

SEQ ID NO: 216035 - DNA, 20 bp, Artificial Sequence
  chemically synthesized
acacgcgcgcaaaaattaat

SEQ ID NO: 216036 - DNA, 20 bp, Artificial Sequence
  chemically synthesized
tttgcgcgcgtgtgtgtgtg

SEQ ID NO: 216037 - DNA, 20 bp, Artificial Sequence
  chemically synthesized
tgcgcgcgtgtgtgtgtgta

SEQ ID NO: 216038 - DNA, 20 bp, Artificial Sequence
  chemically synthesized
gcgcgcgtgtgtgtgtgtag

SEQ ID NO: 216039 - DNA, 20 bp, Artificial Sequence
  chemically synthesized
gcgtgtgtgtgtgtagaggc

SEQ ID NO: 216040 - DNA, 20 bp, Artificial Sequence
  chemically synthesized
cgtgtgtgtgtgtagaggcg

SEQ ID NO: 216041 - DNA, 20 bp, Artificial Sequence
  chemically synthesized
accagcctgggtaacacagc

SEQ ID NO: 216042 - DNA, 20 bp, Artificial Sequence
  chemically synthesized
cgaggtctcgctgtgttacc

SEQ ID NO: 216043 - DNA, 20 bp, Artificial Sequence
  chemically synthesized
caagaccagcctgggtaaca

SEQ ID NO: 216044 - DNA, 20 bp, Artificial Sequence
  chemically synthesized
gaggtctcgctgtgttaccc

SEQ ID NO: 216045 - DNA, 20 bp, Artificial Sequence
  chemically synthesized
tctcgctgtgttacccaggc

SEQ ID NO: 216046 - DNA, 20 bp, Artificial Sequence
  chemically synthesized
caggagtccaagaccagcct

SEQ ID NO: 216047 - DNA, 20 bp, Artificial Sequence
  chemically synthesized
ccaggagtccaagaccagcc

SEQ ID NO: 216048 - DNA, 20 bp, Artificial Sequence
  chemically synthesized
tgtgttacccaggctggtct

SEQ ID NO: 216049 - DNA, 20 bp, Artificial Sequence
  chemically synthesized
tgagcccaggagtccaagac

SEQ ID NO: 216050 - DNA, 20 bp, Artificial Sequence
  chemically synthesized
ccaggctggtcttggactcc

SEQ ID NO: 216051 - DNA, 20 bp, Artificial Sequence
  chemically synthesized
ttacttgagcccaggagtcc

SEQ ID NO: 216052 - DNA, 20 bp, Artificial Sequence
  chemically synthesized
caggctggtcttggactcct

SEQ ID NO: 216053 - DNA, 20 bp, Artificial Sequence
  chemically synthesized
ggagaattacttgagcccag

SEQ ID NO: 216054 - DNA, 20 bp, Artificial Sequence
  chemically synthesized
ggtcttggactcctgggctc

SEQ ID NO: 216055 - DNA, 20 bp, Artificial Sequence
  chemically synthesized
taggagaattacttgagccc

SEQ ID NO: 216056 - DNA, 20 bp, Artificial Sequence
  chemically synthesized
ataggagaattacttgagcc

SEQ ID NO: 216057 - DNA, 20 bp, Artificial Sequence
  chemically synthesized
ccaggataggagaattactt

SEQ ID NO: 216058 - DNA, 20 bp, Artificial Sequence
  chemically synthesized
ctcaagtaattctcctatcc

SEQ ID NO: 216059 - DNA, 20 bp, Artificial Sequence
  chemically synthesized
actttgggaggccaggatag

SEQ ID NO: 216060 - DNA, 20 bp, Artificial Sequence
  chemically synthesized
gcactttgggaggccaggat

SEQ ID NO: 216061 - DNA, 20 bp, Artificial Sequence
  chemically synthesized
agcactttgggaggccagga

SEQ ID NO: 216062 - DNA, 20 bp, Artificial Sequence
  chemically synthesized
tcccagcactttgggaggcc

SEQ ID NO: 216063 - DNA, 20 bp, Artificial Sequence
  chemically synthesized
atcccagcactttgggaggc

SEQ ID NO: 216064 - DNA, 20 bp, Artificial Sequence
  chemically synthesized
tctcctatcctggcctccca

SEQ ID NO: 216065 - DNA, 20 bp, Artificial Sequence
  chemically synthesized
tataatcccagcactttggg

SEQ ID NO: 216066 - DNA, 20 bp, Artificial Sequence
  chemically synthesized
ctataatcccagcactttgg

SEQ ID NO: 216067 - DNA, 20 bp, Artificial Sequence
  chemically synthesized
atcctggcctcccaaagtgc

SEQ ID NO: 216068 - DNA, 20 bp, Artificial Sequence
  chemically synthesized
tcctataatcccagcacttt

SEQ ID NO: 216069 - DNA, 20 bp, Artificial Sequence
  chemically synthesized
tcctggcctcccaaagtgct

SEQ ID NO: 216070 - DNA, 20 bp, Artificial Sequence
  chemically synthesized
ctcctataatcccagcactt

SEQ ID NO: 216071 - DNA, 20 bp, Artificial Sequence
  chemically synthesized
ctcccaaagtgctgggatta

SEQ ID NO: 216072 - DNA, 20 bp, Artificial Sequence
  chemically synthesized
tcccaaagtgctgggattat

SEQ ID NO: 216073 - DNA, 20 bp, Artificial Sequence
  chemically synthesized
gtggctcactcctataatcc

SEQ ID NO: 216074 - DNA, 20 bp, Artificial Sequence
  chemically synthesized
ccaaagtgctgggattatag

SEQ ID NO: 216075 - DNA, 20 bp, Artificial Sequence
  chemically synthesized
agtgctgggattataggagt

SEQ ID NO: 216076 - DNA, 20 bp, Artificial Sequence
  chemically synthesized
taggagtgagccactgtgtc

SEQ ID NO: 216077 - DNA, 20 bp, Artificial Sequence
  chemically synthesized
taagagttggccggacacag

SEQ ID NO: 216078 - DNA, 20 bp, Artificial Sequence
  chemically synthesized
acgtaagagttggccggaca

SEQ ID NO: 216079 - DNA, 20 bp, Artificial Sequence
  chemically synthesized
ataataacgtaagagttggc

SEQ ID NO: 216080 - DNA, 20 bp, Artificial Sequence
  chemically synthesized
tggaataataacgtaagagt

SEQ ID NO: 216081 - DNA, 20 bp, Artificial Sequence
  chemically synthesized
tgactggaataataacgtaa

SEQ ID NO: 216082 - DNA, 20 bp, Artificial Sequence
  chemically synthesized
tgtgactggaataataacgt

SEQ ID NO: 216083 - DNA, 20 bp, Artificial Sequence
  chemically synthesized
caactcttacgttattattc

SEQ ID NO: 216084 - DNA, 20 bp, Artificial Sequence
  chemically synthesized
ttacgttattattccagtca

SEQ ID NO: 216085 - DNA, 20 bp, Artificial Sequence
  chemically synthesized
ctgaagacagatactgtgac

SEQ ID NO: 216086 - DNA, 20 bp, Artificial Sequence
  chemically synthesized
ccagtcacagtatctgtctt

SEQ ID NO: 216087 - DNA, 20 bp, Artificial Sequence
  chemically synthesized
gatcagtctgaagctgaaga

SEQ ID NO: 216088 - DNA, 20 bp, Artificial Sequence
  chemically synthesized
acagtatctgtcttcagctt

SEQ ID NO: 216089 - DNA, 20 bp, Artificial Sequence
  chemically synthesized
ggtagatcagtctgaagctg

SEQ ID NO: 216090 - DNA, 20 bp, Artificial Sequence
  chemically synthesized
aagttgggtagatcagtctg

SEQ ID NO: 216091 - DNA, 20 bp, Artificial Sequence
  chemically synthesized
ggaaagaaagttgggtagat

SEQ ID NO: 216092 - DNA, 20 bp, Artificial Sequence
  chemically synthesized
atgctggaaagaaagttggg

SEQ ID NO: 216093 - DNA, 20 bp, Artificial Sequence
  chemically synthesized
gaaatgctggaaagaaagtt

SEQ ID NO: 216094 - DNA, 20 bp, Artificial Sequence
  chemically synthesized
ggaaatgctggaaagaaagt

SEQ ID NO: 216095 - DNA, 20 bp, Artificial Sequence
  chemically synthesized
gatctacccaactttctttc

SEQ ID NO: 216096 - DNA, 20 bp, Artificial Sequence
  chemically synthesized
aagtggaaatgctggaaaga

SEQ ID NO: 216097 - DNA, 20 bp, Artificial Sequence
  chemically synthesized
atccaagtggaaatgctgga

SEQ ID NO: 216098 - DNA, 20 bp, Artificial Sequence
  chemically synthesized
agatatccaagtggaaatgc

SEQ ID NO: 216099 - DNA, 20 bp, Artificial Sequence
  chemically synthesized
ttctttccagcatttccact

SEQ ID NO: 216100 - DNA, 20 bp, Artificial Sequence
  chemically synthesized
agtctcattagatatccaag

SEQ ID NO: 216101 - DNA, 20 bp, Artificial Sequence
  chemically synthesized
cagagtctcattagatatcc

SEQ ID NO: 216102 - DNA, 20 bp, Artificial Sequence
  chemically synthesized
tttccacttggatatctaat

SEQ ID NO: 216103 - DNA, 20 bp, Artificial Sequence
  chemically synthesized
tcttattatcagagtctcat

SEQ ID NO: 216104 - DNA, 20 bp, Artificial Sequence
  chemically synthesized
tctaatgagactctgataat

SEQ ID NO: 216105 - DNA, 20 bp, Artificial Sequence
  chemically synthesized
aagagtctctcttattatca

SEQ ID NO: 216106 - DNA, 20 bp, Artificial Sequence
  chemically synthesized
taatgagactctgataataa

SEQ ID NO: 216107 - DNA, 20 bp, Artificial Sequence
  chemically synthesized
tcaagagtctctcttattat

SEQ ID NO: 216108 - DNA, 20 bp, Artificial Sequence
  chemically synthesized
atgagactctgataataaga

SEQ ID NO: 216109 - DNA, 20 bp, Artificial Sequence
  chemically synthesized
acaaggtgtgatgaaatcaa

SEQ ID NO: 216110 - DNA, 20 bp, Artificial Sequence
  chemically synthesized
gtacaaggtgtgatgaaatc

SEQ ID NO: 216111 - DNA, 20 bp, Artificial Sequence
  chemically synthesized
gaggaaaaagttagggtaca

SEQ ID NO: 216112 - DNA, 20 bp, Artificial Sequence
  chemically synthesized
ggaggaaaaagttagggtac

SEQ ID NO: 216113 - DNA, 20 bp, Artificial Sequence
  chemically synthesized
agtggaggaggaaaaagtta

SEQ ID NO: 216114 - DNA, 20 bp, Artificial Sequence
  chemically synthesized
aagtggaggaggaaaaagtt

SEQ ID NO: 216115 - DNA, 20 bp, Artificial Sequence
  chemically synthesized
aaagtggaggaggaaaaagt

SEQ ID NO: 216116 - DNA, 20 bp, Artificial Sequence
  chemically synthesized
gggaaaagtggaggaggaaa

SEQ ID NO: 216117 - DNA, 20 bp, Artificial Sequence
  chemically synthesized
ttgctggggaaaagtggagg

SEQ ID NO: 216118 - DNA, 20 bp, Artificial Sequence
  chemically synthesized
tttgctggggaaaagtggag

SEQ ID NO: 216119 - DNA, 20 bp, Artificial Sequence
  chemically synthesized
tctttgctggggaaaagtgg

SEQ ID NO: 216120 - DNA, 20 bp, Artificial Sequence
  chemically synthesized
ttctttgctggggaaaagtg

SEQ ID NO: 216121 - DNA, 20 bp, Artificial Sequence
  chemically synthesized
agttctttgctggggaaaag

SEQ ID NO: 216122 - DNA, 20 bp, Artificial Sequence
  chemically synthesized
tttcctcctccacttttccc

SEQ ID NO: 216123 - DNA, 20 bp, Artificial Sequence
  chemically synthesized
ctaagttctttgctggggaa

SEQ ID NO: 216124 - DNA, 20 bp, Artificial Sequence
  chemically synthesized
tcctccacttttccccagca

SEQ ID NO: 216125 - DNA, 20 bp, Artificial Sequence
  chemically synthesized
tatttctaagttctttgctg

SEQ ID NO: 216126 - DNA, 20 bp, Artificial Sequence
  chemically synthesized
ttatttctaagttctttgct

SEQ ID NO: 216127 - DNA, 20 bp, Artificial Sequence
  chemically synthesized
attatttctaagttctttgc

SEQ ID NO: 216128 - DNA, 20 bp, Artificial Sequence
  chemically synthesized
cttttccccagcaaagaact

SEQ ID NO: 216129 - DNA, 20 bp, Artificial Sequence
  chemically synthesized
aataattgagaattatttct

SEQ ID NO: 216130 - DNA, 20 bp, Artificial Sequence
  chemically synthesized
tgtaaagtatgagaataatt

SEQ ID NO: 216131 - DNA, 20 bp, Artificial Sequence
  chemically synthesized
atgaattagatgtaaagtat

SEQ ID NO: 216132 - DNA, 20 bp, Artificial Sequence
  chemically synthesized
gctgtgatgaattagatgta

SEQ ID NO: 216133 - DNA, 20 bp, Artificial Sequence
  chemically synthesized
caggatttgctgtgatgaat

SEQ ID NO: 216134 - DNA, 20 bp, Artificial Sequence
  chemically synthesized
actttacatctaattcatca

SEQ ID NO: 216135 - DNA, 20 bp, Artificial Sequence
  chemically synthesized
ttcatcacagcaaatcctgt

SEQ ID NO: 216136 - DNA, 20 bp, Artificial Sequence
  chemically synthesized
attttaaagacaaagctgac

SEQ ID NO: 216137 - DNA, 20 bp, Artificial Sequence
  chemically synthesized
cattttaaagacaaagctga

SEQ ID NO: 216138 - DNA, 20 bp, Artificial Sequence
  chemically synthesized
taggatacattttaaagaca

SEQ ID NO: 216139 - DNA, 20 bp, Artificial Sequence
  chemically synthesized
ggtatttaggatacatttta

SEQ ID NO: 216140 - DNA, 20 bp, Artificial Sequence
  chemically synthesized
ttaaaatgtatcctaaatac

SEQ ID NO: 216141 - DNA, 20 bp, Artificial Sequence
  chemically synthesized
cagttagagagctggtattt

SEQ ID NO: 216142 - DNA, 20 bp, Artificial Sequence
  chemically synthesized
tcagttagagagctggtatt

SEQ ID NO: 216143 - DNA, 20 bp, Artificial Sequence
  chemically synthesized
ggtggggtcagttagagagc

SEQ ID NO: 216144 - DNA, 20 bp, Artificial Sequence
  chemically synthesized
gagtggtggggtcagttaga

SEQ ID NO: 216145 - DNA, 20 bp, Artificial Sequence
  chemically synthesized
tggagtggtggggtcagtta

SEQ ID NO: 216146 - DNA, 20 bp, Artificial Sequence
  chemically synthesized
ggtggagtggtggggtcagt

SEQ ID NO: 216147 - DNA, 20 bp, Artificial Sequence
  chemically synthesized
ctagggtggagtggtggggt

SEQ ID NO: 216148 - DNA, 20 bp, Artificial Sequence
  chemically synthesized
cagactagggtggagtggtg

SEQ ID NO: 216149 - DNA, 20 bp, Artificial Sequence
  chemically synthesized
tcagactagggtggagtggt

SEQ ID NO: 216150 - DNA, 20 bp, Artificial Sequence
  chemically synthesized
ttcagactagggtggagtgg

SEQ ID NO: 216151 - DNA, 20 bp, Artificial Sequence
  chemically synthesized
tggttcagactagggtggag

SEQ ID NO: 216152 - DNA, 20 bp, Artificial Sequence
  chemically synthesized
ctgaccccaccactccaccc

SEQ ID NO: 216153 - DNA, 20 bp, Artificial Sequence
  chemically synthesized
aggtggttcagactagggtg

SEQ ID NO: 216154 - DNA, 20 bp, Artificial Sequence
  chemically synthesized
agaggtggttcagactaggg

SEQ ID NO: 216155 - DNA, 20 bp, Artificial Sequence
  chemically synthesized
atcagaggtggttcagacta

SEQ ID NO: 216156 - DNA, 20 bp, Artificial Sequence
  chemically synthesized
catcagaggtggttcagact

SEQ ID NO: 216157 - DNA, 20 bp, Artificial Sequence
  chemically synthesized
acatcagaggtggttcagac

SEQ ID NO: 216158 - DNA, 20 bp, Artificial Sequence
  chemically synthesized
agtccacatcagaggtggtt

SEQ ID NO: 216159 - DNA, 20 bp, Artificial Sequence
  chemically synthesized
ttactagtccacatcagagg

SEQ ID NO: 216160 - DNA, 20 bp, Artificial Sequence
  chemically synthesized
agtctgaaccacctctgatg

SEQ ID NO: 216161 - DNA, 20 bp, Artificial Sequence
  chemically synthesized
acgttactagtccacatcag

SEQ ID NO: 216162 - DNA, 20 bp, Artificial Sequence
  chemically synthesized
cacgttactagtccacatca

SEQ ID NO: 216163 - DNA, 20 bp, Artificial Sequence
  chemically synthesized
gccacgttactagtccacat

SEQ ID NO: 216164 - DNA, 20 bp, Artificial Sequence
  chemically synthesized
gaaccacctctgatgtggac

SEQ ID NO: 216165 - DNA, 20 bp, Artificial Sequence
  chemically synthesized
tctgatgtggactagtaacg

SEQ ID NO: 216166 - DNA, 20 bp, Artificial Sequence
  chemically synthesized
agcacaggaagccacgttac

SEQ ID NO: 216167 - DNA, 20 bp, Artificial Sequence
  chemically synthesized
atacagggagatagcacagg

SEQ ID NO: 216168 - DNA, 20 bp, Artificial Sequence
  chemically synthesized
tgaatacagggagatagcac

SEQ ID NO: 216169 - DNA, 20 bp, Artificial Sequence
  chemically synthesized
gtgaatacagggagatagca

SEQ ID NO: 216170 - DNA, 20 bp, Artificial Sequence
  chemically synthesized
caatagtgaatacagggaga

SEQ ID NO: 216171 - DNA, 20 bp, Artificial Sequence
  chemically synthesized
gaagcaatagtgaatacagg

SEQ ID NO: 216172 - DNA, 20 bp, Artificial Sequence
  chemically synthesized
tggaagcaatagtgaataca

SEQ ID NO: 216173 - DNA, 20 bp, Artificial Sequence
  chemically synthesized
atggaagcaatagtgaatac

SEQ ID NO: 216174 - DNA, 20 bp, Artificial Sequence
  chemically synthesized
aatggaagcaatagtgaata

SEQ ID NO: 216175 - DNA, 20 bp, Artificial Sequence
  chemically synthesized
ttagactgaaatggaagcaa

SEQ ID NO: 216176 - DNA, 20 bp, Artificial Sequence
  chemically synthesized
attcactattgcttccattt

SEQ ID NO: 216177 - DNA, 20 bp, Artificial Sequence
  chemically synthesized
tagaggttagactgaaatgg

SEQ ID NO: 216178 - DNA, 20 bp, Artificial Sequence
  chemically synthesized
gagtagaggttagactgaaa

SEQ ID NO: 216179 - DNA, 20 bp, Artificial Sequence
  chemically synthesized
catcattgctgagtagaggt

SEQ ID NO: 216180 - DNA, 20 bp, Artificial Sequence
  chemically synthesized
atttcagtctaacctctact

SEQ ID NO: 216181 - DNA, 20 bp, Artificial Sequence
  chemically synthesized
cattcatcattgctgagtag

SEQ ID NO: 216182 - DNA, 20 bp, Artificial Sequence
  chemically synthesized
tcattcatcattgctgagta

SEQ ID NO: 216183 - DNA, 20 bp, Artificial Sequence
  chemically synthesized
gttcattcatcattgctgag

SEQ ID NO: 216184 - DNA, 20 bp, Artificial Sequence
  chemically synthesized
agagttcattcatcattgct

SEQ ID NO: 216185 - DNA, 20 bp, Artificial Sequence
  chemically synthesized
aatgatgaatgaactctttg

SEQ ID NO: 216186 - DNA, 20 bp, Artificial Sequence
  chemically synthesized
cctgatctgctttcttcaaa

SEQ ID NO: 216187 - DNA, 20 bp, Artificial Sequence
  chemically synthesized
atgaatgaactctttgaaga

SEQ ID NO: 216188 - DNA, 20 bp, Artificial Sequence
  chemically synthesized
tacctgatctgctttcttca

SEQ ID NO: 216189 - DNA, 20 bp, Artificial Sequence
  chemically synthesized
aatgaactctttgaagaaag

SEQ ID NO: 216190 - DNA, 20 bp, Artificial Sequence
  chemically synthesized
actctttgaagaaagcagat

SEQ ID NO: 216191 - DNA, 20 bp, Artificial Sequence
  chemically synthesized
ctctttgaagaaagcagatc

SEQ ID NO: 216192 - DNA, 20 bp, Artificial Sequence
  chemically synthesized
gaatttagaaaaatagagtg

SEQ ID NO: 216193 - DNA, 20 bp, Artificial Sequence
  chemically synthesized
aagaatttagaaaaatagag

SEQ ID NO: 216194 - DNA, 20 bp, Artificial Sequence
  chemically synthesized
ttgaagaatttagaaaaata

SEQ ID NO: 216195 - DNA, 20 bp, Artificial Sequence
  chemically synthesized
cattgaagaatttagaaaaa

SEQ ID NO: 216196 - DNA, 20 bp, Artificial Sequence
  chemically synthesized
caggacatcattgaagaatt

SEQ ID NO: 216197 - DNA, 20 bp, Artificial Sequence
  chemically synthesized
attttgacaggacatcattg

SEQ ID NO: 216198 - DNA, 20 bp, Artificial Sequence
  chemically synthesized
aactctttcataattttgac

SEQ ID NO: 216199 - DNA, 20 bp, Artificial Sequence
  chemically synthesized
taactctttcataattttga

SEQ ID NO: 216200 - DNA, 20 bp, Artificial Sequence
  chemically synthesized
atgtcctgtcaaaattatga

SEQ ID NO: 216201 - DNA, 20 bp, Artificial Sequence
  chemically synthesized
gtcctgtcaaaattatgaaa

SEQ ID NO: 216202 - DNA, 20 bp, Artificial Sequence
  chemically synthesized
agagttaaattcttttatca

SEQ ID NO: 216203 - DNA, 20 bp, Artificial Sequence
  chemically synthesized
gatcttgcaggccgtgataa

SEQ ID NO: 216204 - DNA, 20 bp, Artificial Sequence
  chemically synthesized
attcttttatcacggcctgc

SEQ ID NO: 216205 - DNA, 20 bp, Artificial Sequence
  chemically synthesized
aagatcacacgggatcttgc

SEQ ID NO: 216206 - DNA, 20 bp, Artificial Sequence
  chemically synthesized
caagatcacacgggatcttg

SEQ ID NO: 216207 - DNA, 20 bp, Artificial Sequence
  chemically synthesized
aggcaagggcaagatcacac

SEQ ID NO: 216208 - DNA, 20 bp, Artificial Sequence
  chemically synthesized
taggcaagggcaagatcaca

SEQ ID NO: 216209 - DNA, 20 bp, Artificial Sequence
  chemically synthesized
gtgcaagtataggcaagggc

SEQ ID NO: 216210 - DNA, 20 bp, Artificial Sequence
  chemically synthesized
ggaggtgcaagtataggcaa

SEQ ID NO: 216211 - DNA, 20 bp, Artificial Sequence
  chemically synthesized
aggaggtgcaagtataggca

SEQ ID NO: 216212 - DNA, 20 bp, Artificial Sequence
  chemically synthesized
aaggaggtgcaagtataggc

SEQ ID NO: 216213 - DNA, 20 bp, Artificial Sequence
  chemically synthesized
aaggaaggaggtgcaagtat

SEQ ID NO: 216214 - DNA, 20 bp, Artificial Sequence
  chemically synthesized
gaaggaaggaggtgcaagta

SEQ ID NO: 216215 - DNA, 20 bp, Artificial Sequence
  chemically synthesized
gtggggaaggaaggaggtgc

SEQ ID NO: 216216 - DNA, 20 bp, Artificial Sequence
  chemically synthesized
gagaaggtggggaaggaagg

SEQ ID NO: 216217 - DNA, 20 bp, Artificial Sequence
  chemically synthesized
agagaaggtggggaaggaag

SEQ ID NO: 216218 - DNA, 20 bp, Artificial Sequence
  chemically synthesized
taagagaaggtggggaagga

SEQ ID NO: 216219 - DNA, 20 bp, Artificial Sequence
  chemically synthesized
gtaagagaaggtggggaagg

SEQ ID NO: 216220 - DNA, 20 bp, Artificial Sequence
  chemically synthesized
agtgtaagagaaggtgggga

SEQ ID NO: 216221 - DNA, 20 bp, Artificial Sequence
  chemically synthesized
cagtgtaagagaaggtgggg

SEQ ID NO: 216222 - DNA, 20 bp, Artificial Sequence
  chemically synthesized
ttccagtgtaagagaaggtg

SEQ ID NO: 216223 - DNA, 20 bp, Artificial Sequence
  chemically synthesized
attccagtgtaagagaaggt

SEQ ID NO: 216224 - DNA, 20 bp, Artificial Sequence
  chemically synthesized
gattccagtgtaagagaagg

SEQ ID NO: 216225 - DNA, 20 bp, Artificial Sequence
  chemically synthesized
aaggattccagtgtaagaga

SEQ ID NO: 216226 - DNA, 20 bp, Artificial Sequence
  chemically synthesized
caaggattccagtgtaagag

SEQ ID NO: 216227 - DNA, 20 bp, Artificial Sequence
  chemically synthesized
ttccccaccttctcttacac

SEQ ID NO: 216228 - DNA, 20 bp, Artificial Sequence
  chemically synthesized
tagcaaggattccagtgtaa

SEQ ID NO: 216229 - DNA, 20 bp, Artificial Sequence
  chemically synthesized
aatagcaaggattccagtgt

SEQ ID NO: 216230 - DNA, 20 bp, Artificial Sequence
  chemically synthesized
ccaacaaatagcaaggattc

SEQ ID NO: 216231 - DNA, 20 bp, Artificial Sequence
  chemically synthesized
gacctagccaacaaatagca

SEQ ID NO: 216232 - DNA, 20 bp, Artificial Sequence
  chemically synthesized
tgacctagccaacaaatagc

SEQ ID NO: 216233 - DNA, 20 bp, Artificial Sequence
  chemically synthesized
ctggaatccttgctatttgt

SEQ ID NO: 216234 - DNA, 20 bp, Artificial Sequence
  chemically synthesized
gacttgacctagccaacaaa

SEQ ID NO: 216235 - DNA, 20 bp, Artificial Sequence
  chemically synthesized
aatccttgctatttgttggc

SEQ ID NO: 216236 - DNA, 20 bp, Artificial Sequence
  chemically synthesized
atccttgctatttgttggct

SEQ ID NO: 216237 - DNA, 20 bp, Artificial Sequence
  chemically synthesized
tgctatttgttggctaggtc

SEQ ID NO: 216238 - DNA, 20 bp, Artificial Sequence
  chemically synthesized
agttcaaaagagacttgacc

SEQ ID NO: 216239 - DNA, 20 bp, Artificial Sequence
  chemically synthesized
caagggcactgagttcaaaa

SEQ ID NO: 216240 - DNA, 20 bp, Artificial Sequence
  chemically synthesized
ggtcaagtctcttttgaact

SEQ ID NO: 216241 - DNA, 20 bp, Artificial Sequence
  chemically synthesized
ggcaagggcactgagttcaa

SEQ ID NO: 216242 - DNA, 20 bp, Artificial Sequence
  chemically synthesized
gaaacaagggcaagggcact

SEQ ID NO: 216243 - DNA, 20 bp, Artificial Sequence
  chemically synthesized
ggcagaggaaacaagggcaa

SEQ ID NO: 216244 - DNA, 20 bp, Artificial Sequence
  chemically synthesized
aggcagaggaaacaagggca

SEQ ID NO: 216245 - DNA, 20 bp, Artificial Sequence
  chemically synthesized
caggcagaggaaacaagggc

SEQ ID NO: 216246 - DNA, 20 bp, Artificial Sequence
  chemically synthesized
attccaggcagaggaaacaa

SEQ ID NO: 216247 - DNA, 20 bp, Artificial Sequence
  chemically synthesized
cattccaggcagaggaaaca

SEQ ID NO: 216248 - DNA, 20 bp, Artificial Sequence
  chemically synthesized
acattccaggcagaggaaac

SEQ ID NO: 216249 - DNA, 20 bp, Artificial Sequence
  chemically synthesized
ttgcccttgtttcctctgcc

SEQ ID NO: 216250 - DNA, 20 bp, Artificial Sequence
  chemically synthesized
ggcaaaaacattccaggcag

SEQ ID NO: 216251 - DNA, 20 bp, Artificial Sequence
  chemically synthesized
gggcaaaaacattccaggca

SEQ ID NO: 216252 - DNA, 20 bp, Artificial Sequence
  chemically synthesized
ttgggcaaaaacattccagg

SEQ ID NO: 216253 - DNA, 20 bp, Artificial Sequence
  chemically synthesized
aatttgggcaaaaacattcc

SEQ ID NO: 216254 - DNA, 20 bp, Artificial Sequence
  chemically synthesized
caatttgggcaaaaacattc

SEQ ID NO: 216255 - DNA, 20 bp, Artificial Sequence
  chemically synthesized
tggaatgtttttgcccaaat

SEQ ID NO: 216256 - DNA, 20 bp, Artificial Sequence
  chemically synthesized
gaatgtttttgcccaaattg

SEQ ID NO: 216257 - DNA, 20 bp, Artificial Sequence
  chemically synthesized
gagcagatattctccaattt

SEQ ID NO: 216258 - DNA, 20 bp, Artificial Sequence
  chemically synthesized
agagcagatattctccaatt

SEQ ID NO: 216259 - DNA, 20 bp, Artificial Sequence
  chemically synthesized
tatttgagcagatatgagag

SEQ ID NO: 216260 - DNA, 20 bp, Artificial Sequence
  chemically synthesized
cagtatttgagcagatatga

SEQ ID NO: 216261 - DNA, 20 bp, Artificial Sequence
  chemically synthesized
ggcagtatttgagcagatat

SEQ ID NO: 216262 - DNA, 20 bp, Artificial Sequence
  chemically synthesized
tctagggggcagtatttgag

SEQ ID NO: 216263 - DNA, 20 bp, Artificial Sequence
  chemically synthesized
ttctctagggggcagtattt

SEQ ID NO: 216264 - DNA, 20 bp, Artificial Sequence
  chemically synthesized
tctgctcaaatactgccccc

SEQ ID NO: 216265 - DNA, 20 bp, Artificial Sequence
  chemically synthesized
tgctcaaatactgcccccta

SEQ ID NO: 216266 - DNA, 20 bp, Artificial Sequence
  chemically synthesized
ggcatggcttctctaggggg

SEQ ID NO: 216267 - DNA, 20 bp, Artificial Sequence
  chemically synthesized
tcaaatactgccccctagag

SEQ ID NO: 216268 - DNA, 20 bp, Artificial Sequence
  chemically synthesized
attggcatggcttctctagg

SEQ ID NO: 216269 - DNA, 20 bp, Artificial Sequence
  chemically synthesized
gattggcatggcttctctag

SEQ ID NO: 216270 - DNA, 20 bp, Artificial Sequence
  chemically synthesized
ggattggcatggcttctcta

SEQ ID NO: 216271 - DNA, 20 bp, Artificial Sequence
  chemically synthesized
tggattggcatggcttctct

SEQ ID NO: 216272 - DNA, 20 bp, Artificial Sequence
  chemically synthesized
gtggattggcatggcttctc

SEQ ID NO: 216273 - DNA, 20 bp, Artificial Sequence
  chemically synthesized
ttagattgggtggattggca

SEQ ID NO: 216274 - DNA, 20 bp, Artificial Sequence
  chemically synthesized
cttgtttagattgggtggat

SEQ ID NO: 216275 - DNA, 20 bp, Artificial Sequence
  chemically synthesized
gtggacttgtttagattggg

SEQ ID NO: 216276 - DNA, 20 bp, Artificial Sequence
  chemically synthesized
aaggtggacttgtttagatt

SEQ ID NO: 216277 - DNA, 20 bp, Artificial Sequence
  chemically synthesized
gaaggtggacttgtttagat

SEQ ID NO: 216278 - DNA, 20 bp, Artificial Sequence
  chemically synthesized
ccaatccacccaatctaaac

SEQ ID NO: 216279 - DNA, 20 bp, Artificial Sequence
  chemically synthesized
atattgaaggtggacttgtt

SEQ ID NO: 216280 - DNA, 20 bp, Artificial Sequence
  chemically synthesized
atagaaaatgatattgaagg

SEQ ID NO: 216281 - DNA, 20 bp, Artificial Sequence
  chemically synthesized
ggaatagaaaatgatattga

SEQ ID NO: 216282 - DNA, 20 bp, Artificial Sequence
  chemically synthesized
gggaatagaaaatgatattg

SEQ ID NO: 216283 - DNA, 20 bp, Artificial Sequence
  chemically synthesized
aataaagctggttaagggaa

SEQ ID NO: 216284 - DNA, 20 bp, Artificial Sequence
  chemically synthesized
tcattttctattcccttaac

SEQ ID NO: 216285 - DNA, 20 bp, Artificial Sequence
  chemically synthesized
ttggaaataaagctggttaa

SEQ ID NO: 216286 - DNA, 20 bp, Artificial Sequence
  chemically synthesized
attggaaataaagctggtta

SEQ ID NO: 216287 - DNA, 20 bp, Artificial Sequence
  chemically synthesized
tattggaaataaagctggtt

SEQ ID NO: 216288 - DNA, 20 bp, Artificial Sequence
  chemically synthesized
atccatattggaaataaagc

SEQ ID NO: 216289 - DNA, 20 bp, Artificial Sequence
  chemically synthesized
agtgatccatattggaaata

SEQ ID NO: 216290 - DNA, 20 bp, Artificial Sequence
  chemically synthesized
aaccagctttatttccaata

SEQ ID NO: 216291 - DNA, 20 bp, Artificial Sequence
  chemically synthesized
tttcagatagtgatccatat

SEQ ID NO: 216292 - DNA, 20 bp, Artificial Sequence
  chemically synthesized
catacacatatgatttcaga

SEQ ID NO: 216293 - DNA, 20 bp, Artificial Sequence
  chemically synthesized
tatgcatacacatatgattt

SEQ ID NO: 216294 - DNA, 20 bp, Artificial Sequence
  chemically synthesized
aaataatatcatttattctc

SEQ ID NO: 216295 - DNA, 20 bp, Artificial Sequence
  chemically synthesized
tacactctagtagtgagcta

SEQ ID NO: 216296 - DNA, 20 bp, Artificial Sequence
  chemically synthesized
cttacactctagtagtgagc

SEQ ID NO: 216297 - DNA, 20 bp, Artificial Sequence
  chemically synthesized
tttattctctagctcactac

SEQ ID NO: 216298 - DNA, 20 bp, Artificial Sequence
  chemically synthesized
tattctctagctcactacta

SEQ ID NO: 216299 - DNA, 20 bp, Artificial Sequence
  chemically synthesized
agaacttacactctagtagt

SEQ ID NO: 216300 - DNA, 20 bp, Artificial Sequence
  chemically synthesized
tcgtagaacttacactctag

SEQ ID NO: 216301 - DNA, 20 bp, Artificial Sequence
  chemically synthesized
ctagctcactactagagtgt

SEQ ID NO: 216302 - DNA, 20 bp, Artificial Sequence
  chemically synthesized
gtctcgtagaacttacactc

SEQ ID NO: 216303 - DNA, 20 bp, Artificial Sequence
  chemically synthesized
tactagagtgtaagttctac

SEQ ID NO: 216304 - DNA, 20 bp, Artificial Sequence
  chemically synthesized
gagtgtaagttctacgagac

SEQ ID NO: 216305 - DNA, 20 bp, Artificial Sequence
  chemically synthesized
agtgtaagttctacgagact

SEQ ID NO: 216306 - DNA, 20 bp, Artificial Sequence
  chemically synthesized
taagtatgtccctagtctcg

SEQ ID NO: 216307 - DNA, 20 bp, Artificial Sequence
  chemically synthesized
gtgtaagttctacgagacta

SEQ ID NO: 216308 - DNA, 20 bp, Artificial Sequence
  chemically synthesized
agaatacataagtatgtccc

SEQ ID NO: 216309 - DNA, 20 bp, Artificial Sequence
  chemically synthesized
cttgggatacaagaatacat

SEQ ID NO: 216310 - DNA, 20 bp, Artificial Sequence
  chemically synthesized
cttatgtattcttgtatccc

SEQ ID NO: 216311 - DNA, 20 bp, Artificial Sequence
  chemically synthesized
atgccaggtacttgggatac

SEQ ID NO: 216312 - DNA, 20 bp, Artificial Sequence
  chemically synthesized
attcttgtatcccaagtacc

SEQ ID NO: 216313 - DNA, 20 bp, Artificial Sequence
  chemically synthesized
atgatatatgccaggtactt

SEQ ID NO: 216314 - DNA, 20 bp, Artificial Sequence
  chemically synthesized
catgatatatgccaggtact

SEQ ID NO: 216315 - DNA, 20 bp, Artificial Sequence
  chemically synthesized
tgaagtacatgatatatgcc

SEQ ID NO: 216316 - DNA, 20 bp, Artificial Sequence
  chemically synthesized
gtgaagtacatgatatatgc

SEQ ID NO: 216317 - DNA, 20 bp, Artificial Sequence
  chemically synthesized
ttattccacagatatttgtg

SEQ ID NO: 216318 - DNA, 20 bp, Artificial Sequence
  chemically synthesized
atgtacttcacaaatatctg

SEQ ID NO: 216319 - DNA, 20 bp, Artificial Sequence
  chemically synthesized
caatgtgttcatttattcca

SEQ ID NO: 216320 - DNA, 20 bp, Artificial Sequence
  chemically synthesized
tggaataaatgaacacattg

SEQ ID NO: 216321 - DNA, 20 bp, Artificial Sequence
  chemically synthesized
gaataaatgaacacattgaa

SEQ ID NO: 216322 - DNA, 20 bp, Artificial Sequence
  chemically synthesized
tacatcacgatggcataatg

SEQ ID NO: 216323 - DNA, 20 bp, Artificial Sequence
  chemically synthesized
aaacaatttttacatcacga

SEQ ID NO: 216324 - DNA, 20 bp, Artificial Sequence
  chemically synthesized
cgtgatgtaaaaattgtttt

SEQ ID NO: 216325 - DNA, 20 bp, Artificial Sequence
  chemically synthesized
gtaaaaattgttttgagcta

SEQ ID NO: 216326 - DNA, 20 bp, Artificial Sequence
  chemically synthesized
tgttgatcctcaaatggctt

SEQ ID NO: 216327 - DNA, 20 bp, Artificial Sequence
  chemically synthesized
gttttgagctaaagccattt

SEQ ID NO: 216328 - DNA, 20 bp, Artificial Sequence
  chemically synthesized
ttttgagctaaagccatttg

SEQ ID NO: 216329 - DNA, 20 bp, Artificial Sequence
  chemically synthesized
cgtatctgttgatcctcaaa

SEQ ID NO: 216330 - DNA, 20 bp, Artificial Sequence
  chemically synthesized
taaagccatttgaggatcaa

SEQ ID NO: 216331 - DNA, 20 bp, Artificial Sequence
  chemically synthesized
catttgaggatcaacagata

SEQ ID NO: 216332 - DNA, 20 bp, Artificial Sequence
  chemically synthesized
atttgaggatcaacagatac

SEQ ID NO: 216333 - DNA, 20 bp, Artificial Sequence
  chemically synthesized
tgaggatcaacagatacggg

SEQ ID NO: 216334 - DNA, 20 bp, Artificial Sequence
  chemically synthesized
gaggatcaacagatacggga

SEQ ID NO: 216335 - DNA, 20 bp, Artificial Sequence
  chemically synthesized
aggatcaacagatacgggaa

SEQ ID NO: 216336 - DNA, 20 bp, Artificial Sequence
  chemically synthesized
ggatcaacagatacgggaag

SEQ ID NO: 216337 - DNA, 20 bp, Artificial Sequence
  chemically synthesized
agatagggggagtacagaaa

SEQ ID NO: 216338 - DNA, 20 bp, Artificial Sequence
  chemically synthesized
ttaggcagatagggggagta

SEQ ID NO: 216339 - DNA, 20 bp, Artificial Sequence
  chemically synthesized
tgcttttaggcagatagggg

SEQ ID NO: 216340 - DNA, 20 bp, Artificial Sequence
  chemically synthesized
tttgcttttaggcagatagg

SEQ ID NO: 216341 - DNA, 20 bp, Artificial Sequence
  chemically synthesized
ctttgcttttaggcagatag

SEQ ID NO: 216342 - DNA, 20 bp, Artificial Sequence
  chemically synthesized
tctttgcttttaggcagata

SEQ ID NO: 216343 - DNA, 20 bp, Artificial Sequence
  chemically synthesized
atctttgcttttaggcagat

SEQ ID NO: 216344 - DNA, 20 bp, Artificial Sequence
  chemically synthesized
aatctttgcttttaggcaga

SEQ ID NO: 216345 - DNA, 20 bp, Artificial Sequence
  chemically synthesized
tactccccctatctgcctaa

SEQ ID NO: 216346 - DNA, 20 bp, Artificial Sequence
  chemically synthesized
cagaaatctttgcttttagg

SEQ ID NO: 216347 - DNA, 20 bp, Artificial Sequence
  chemically synthesized
cccctatctgcctaaaagca

SEQ ID NO: 216348 - DNA, 20 bp, Artificial Sequence
  chemically synthesized
tttcagaaatctttgctttt

SEQ ID NO: 216349 - DNA, 20 bp, Artificial Sequence
  chemically synthesized
atttcagaaatctttgcttt

SEQ ID NO: 216350 - DNA, 20 bp, Artificial Sequence
  chemically synthesized
ttaaaacagttgaattattt

SEQ ID NO: 216351 - DNA, 20 bp, Artificial Sequence
  chemically synthesized
ccttaaaggaggatttaaaa

SEQ ID NO: 216352 - DNA, 20 bp, Artificial Sequence
  chemically synthesized
actgttttaaatcctccttt

SEQ ID NO: 216353 - DNA, 20 bp, Artificial Sequence
  chemically synthesized
ctgttttaaatcctccttta

SEQ ID NO: 216354 - DNA, 20 bp, Artificial Sequence
  chemically synthesized
caagaaactttccttaaagg

SEQ ID NO: 216355 - DNA, 20 bp, Artificial Sequence
  chemically synthesized
gcaagaaactttccttaaag

SEQ ID NO: 216356 - DNA, 20 bp, Artificial Sequence
  chemically synthesized
tttaaatcctcctttaagga

SEQ ID NO: 216357 - DNA, 20 bp, Artificial Sequence
  chemically synthesized
gtgcaagaaactttccttaa

SEQ ID NO: 216358 - DNA, 20 bp, Artificial Sequence
  chemically synthesized
ggtgcaagaaactttcctta

SEQ ID NO: 216359 - DNA, 20 bp, Artificial Sequence
  chemically synthesized
ttaaggaaagtttcttgcac

SEQ ID NO: 216360 - DNA, 20 bp, Artificial Sequence
  chemically synthesized
taaggaaagtttcttgcacc

SEQ ID NO: 216361 - DNA, 20 bp, Artificial Sequence
  chemically synthesized
aaggaaagtttcttgcacca

SEQ ID NO: 216362 - DNA, 20 bp, Artificial Sequence
  chemically synthesized
aggaaagtttcttgcaccag

SEQ ID NO: 216363 - DNA, 20 bp, Artificial Sequence
  chemically synthesized
tcactctttacccctggtgc

SEQ ID NO: 216364 - DNA, 20 bp, Artificial Sequence
  chemically synthesized
agtttcttgcaccaggggta

SEQ ID NO: 216365 - DNA, 20 bp, Artificial Sequence
  chemically synthesized
caggagtcactctttacccc

SEQ ID NO: 216366 - DNA, 20 bp, Artificial Sequence
  chemically synthesized
tttcttgcaccaggggtaaa

SEQ ID NO: 216367 - DNA, 20 bp, Artificial Sequence
  chemically synthesized
taaagagtgactcctgtcac

SEQ ID NO: 216368 - DNA, 20 bp, Artificial Sequence
  chemically synthesized
cttctcatctctggtgacag

SEQ ID NO: 216369 - DNA, 20 bp, Artificial Sequence
  chemically synthesized
aagagtgactcctgtcacca

SEQ ID NO: 216370 - DNA, 20 bp, Artificial Sequence
  chemically synthesized
aacttctcatctctggtgac

SEQ ID NO: 216371 - DNA, 20 bp, Artificial Sequence
  chemically synthesized
caacttctcatctctggtga

SEQ ID NO: 216372 - DNA, 20 bp, Artificial Sequence
  chemically synthesized
tgactcctgtcaccagagat

SEQ ID NO: 216373 - DNA, 20 bp, Artificial Sequence
  chemically synthesized
cagcgacaacttctcatctc

SEQ ID NO: 216374 - DNA, 20 bp, Artificial Sequence
  chemically synthesized
ctcctgtcaccagagatgag

SEQ ID NO: 216375 - DNA, 20 bp, Artificial Sequence
  chemically synthesized
cagagatgagaagttgtcgc

SEQ ID NO: 216376 - DNA, 20 bp, Artificial Sequence
  chemically synthesized
agagatgagaagttgtcgct

SEQ ID NO: 216377 - DNA, 20 bp, Artificial Sequence
  chemically synthesized
tgagaagttgtcgctgggaa

SEQ ID NO: 216378 - DNA, 20 bp, Artificial Sequence
  chemically synthesized
tttatgtaattttcttttcc

SEQ ID NO: 216379 - DNA, 20 bp, Artificial Sequence
  chemically synthesized
ggaaaagaaaattacataaa

SEQ ID NO: 216380 - DNA, 20 bp, Artificial Sequence
  chemically synthesized
aggtaatgtttgttttagta

SEQ ID NO: 216381 - DNA, 20 bp, Artificial Sequence
  chemically synthesized
atgaaaggtaatgtttgttt

SEQ ID NO: 216382 - DNA, 20 bp, Artificial Sequence
  chemically synthesized
aaacaaacattacctttcat

SEQ ID NO: 216383 - DNA, 20 bp, Artificial Sequence
  chemically synthesized
atatgaaagaaactaatgaa

SEQ ID NO: 216384 - DNA, 20 bp, Artificial Sequence
  chemically synthesized
aatatgaaagaaactaatga

SEQ ID NO: 216385 - DNA, 20 bp, Artificial Sequence
  chemically synthesized
aaagttggtgggaaatatga

SEQ ID NO: 216386 - DNA, 20 bp, Artificial Sequence
  chemically synthesized
tttcaagccacaaagttggt

SEQ ID NO: 216387 - DNA, 20 bp, Artificial Sequence
  chemically synthesized
atttcaagccacaaagttgg

SEQ ID NO: 216388 - DNA, 20 bp, Artificial Sequence
  chemically synthesized
catatttcccaccaactttg

SEQ ID NO: 216389 - DNA, 20 bp, Artificial Sequence
  chemically synthesized
agaatttcaagccacaaagt

SEQ ID NO: 216390 - DNA, 20 bp, Artificial Sequence
  chemically synthesized
tgttagaatttcaagccaca

SEQ ID NO: 216391 - DNA, 20 bp, Artificial Sequence
  chemically synthesized
aagaagagtgttagaatttc

SEQ ID NO: 216392 - DNA, 20 bp, Artificial Sequence
  chemically synthesized
ggttttgaaaagaagagtgt

SEQ ID NO: 216393 - DNA, 20 bp, Artificial Sequence
  chemically synthesized
aacaagggttttgaaaagaa

SEQ ID NO: 216394 - DNA, 20 bp, Artificial Sequence
  chemically synthesized
ttaacaagggttttgaaaag

SEQ ID NO: 216395 - DNA, 20 bp, Artificial Sequence
  chemically synthesized
attttaacaagggttttgaa

SEQ ID NO: 216396 - DNA, 20 bp, Artificial Sequence
  chemically synthesized
cttatgtactattttaacaa

SEQ ID NO: 216397 - DNA, 20 bp, Artificial Sequence
  chemically synthesized
gcttatgtactattttaaca

SEQ ID NO: 216398 - DNA, 20 bp, Artificial Sequence
  chemically synthesized
tttcaaaacccttgttaaaa

SEQ ID NO: 216399 - DNA, 20 bp, Artificial Sequence
  chemically synthesized
ggcttatgtactattttaac

SEQ ID NO: 216400 - DNA, 20 bp, Artificial Sequence
  chemically synthesized
cccttgttaaaatagtacat

SEQ ID NO: 216401 - DNA, 20 bp, Artificial Sequence
  chemically synthesized
ctcaatgaagttagaatttg

SEQ ID NO: 216402 - DNA, 20 bp, Artificial Sequence
  chemically synthesized
gctcaatgaagttagaattt

SEQ ID NO: 216403 - DNA, 20 bp, Artificial Sequence
  chemically synthesized
agctcaatgaagttagaatt

SEQ ID NO: 216404 - DNA, 20 bp, Artificial Sequence
  chemically synthesized
aaaacatagctcaatgaagt

SEQ ID NO: 216405 - DNA, 20 bp, Artificial Sequence
  chemically synthesized
ccccaaattctaacttcatt

SEQ ID NO: 216406 - DNA, 20 bp, Artificial Sequence
  chemically synthesized
acagaaaacatagctcaatg

SEQ ID NO: 216407 - DNA, 20 bp, Artificial Sequence
  chemically synthesized
gtgggagctcacagaaaaca

SEQ ID NO: 216408 - DNA, 20 bp, Artificial Sequence
  chemically synthesized
cattgagctatgttttctgt

SEQ ID NO: 216409 - DNA, 20 bp, Artificial Sequence
  chemically synthesized
gagaagtatgtgggagctca

SEQ ID NO: 216410 - DNA, 20 bp, Artificial Sequence
  chemically synthesized
ttattcagagaagtatgtgg

SEQ ID NO: 216411 - DNA, 20 bp, Artificial Sequence
  chemically synthesized
gtttattcagagaagtatgt

SEQ ID NO: 216412 - DNA, 20 bp, Artificial Sequence
  chemically synthesized
agtttattcagagaagtatg

SEQ ID NO: 216413 - DNA, 20 bp, Artificial Sequence
  chemically synthesized
aagacaaagtttattcagag

SEQ ID NO: 216414 - DNA, 20 bp, Artificial Sequence
  chemically synthesized
gaaaagacaaagtttattca

SEQ ID NO: 216415 - DNA, 20 bp, Artificial Sequence
  chemically synthesized
tagaaaagacaaagtttatt

SEQ ID NO: 216416 - DNA, 20 bp, Artificial Sequence
  chemically synthesized
gattggcaatagaaaagaca

SEQ ID NO: 216417 - DNA, 20 bp, Artificial Sequence
  chemically synthesized
cagatagattggcaatagaa

SEQ ID NO: 216418 - DNA, 20 bp, Artificial Sequence
  chemically synthesized
gacgacagatagattggcaa

SEQ ID NO: 216419 - DNA, 20 bp, Artificial Sequence
  chemically synthesized
taaactgacgacagatagat

SEQ ID NO: 216420 - DNA, 20 bp, Artificial Sequence
  chemically synthesized
caaattaaactgacgacaga

SEQ ID NO: 216421 - DNA, 20 bp, Artificial Sequence
  chemically synthesized
attgccaatctatctgtcgt

SEQ ID NO: 216422 - DNA, 20 bp, Artificial Sequence
  chemically synthesized
gctgcaaattaaactgacga

SEQ ID NO: 216423 - DNA, 20 bp, Artificial Sequence
  chemically synthesized
tctgtcgtcagtttaatttg

SEQ ID NO: 216424 - DNA, 20 bp, Artificial Sequence
  chemically synthesized
agtttaatttgcagcccccc

SEQ ID NO: 216425 - DNA, 20 bp, Artificial Sequence
  chemically synthesized
tcttaggttcattacttggg

SEQ ID NO: 216426 - DNA, 20 bp, Artificial Sequence
  chemically synthesized
ctcttaggttcattacttgg

SEQ ID NO: 216427 - DNA, 20 bp, Artificial Sequence
  chemically synthesized
cctcttaggttcattacttg

SEQ ID NO: 216428 - DNA, 20 bp, Artificial Sequence
  chemically synthesized
ccctcttaggttcattactt

SEQ ID NO: 216429 - DNA, 20 bp, Artificial Sequence
  chemically synthesized
cccctcttaggttcattact

SEQ ID NO: 216430 - DNA, 20 bp, Artificial Sequence
  chemically synthesized
gccccccaagtaatgaacct

SEQ ID NO: 216431 - DNA, 20 bp, Artificial Sequence
  chemically synthesized
cccccaagtaatgaacctaa

SEQ ID NO: 216432 - DNA, 20 bp, Artificial Sequence
  chemically synthesized
ccccaagtaatgaacctaag

SEQ ID NO: 216433 - DNA, 20 bp, Artificial Sequence
  chemically synthesized
cccaagtaatgaacctaaga

SEQ ID NO: 216434 - DNA, 20 bp, Artificial Sequence
  chemically synthesized
ccaagtaatgaacctaagag

SEQ ID NO: 216435 - DNA, 20 bp, Artificial Sequence
  chemically synthesized
aagtaatgaacctaagaggg

SEQ ID NO: 216436 - DNA, 20 bp, Artificial Sequence
  chemically synthesized
aactttttcactcccctctt

SEQ ID NO: 216437 - DNA, 20 bp, Artificial Sequence
  chemically synthesized
aaactttttcactcccctct

SEQ ID NO: 216438 - DNA, 20 bp, Artificial Sequence
  chemically synthesized
aacctaagaggggagtgaaa

SEQ ID NO: 216439 - DNA, 20 bp, Artificial Sequence
  chemically synthesized
gtccatttgtgttgtcaggg

SEQ ID NO: 216440 - DNA, 20 bp, Artificial Sequence
  chemically synthesized
tgtgtccatttgtgttgtca

SEQ ID NO: 216441 - DNA, 20 bp, Artificial Sequence
  chemically synthesized
atgtgtccatttgtgttgtc

SEQ ID NO: 216442 - DNA, 20 bp, Artificial Sequence
  chemically synthesized
gatgtgtccatttgtgttgt

SEQ ID NO: 216443 - DNA, 20 bp, Artificial Sequence
  chemically synthesized
ttcttccctgacaacacaaa

SEQ ID NO: 216444 - DNA, 20 bp, Artificial Sequence
  chemically synthesized
caaatggacacatcaataaa

SEQ ID NO: 216445 - DNA, 20 bp, Artificial Sequence
  chemically synthesized
tggacacatcaataaatgga

SEQ ID NO: 216446 - DNA, 20 bp, Artificial Sequence
  chemically synthesized
catcaataaatggatagctt

SEQ ID NO: 216447 - DNA, 20 bp, Artificial Sequence
  chemically synthesized
aaacatgaggaaatttactc

SEQ ID NO: 216448 - DNA, 20 bp, Artificial Sequence
  chemically synthesized
gagtgaggcttagaaacatg

SEQ ID NO: 216449 - DNA, 20 bp, Artificial Sequence
  chemically synthesized
ggagtgaggcttagaaacat

SEQ ID NO: 216450 - DNA, 20 bp, Artificial Sequence
  chemically synthesized
gtaaatttcctcatgtttct

SEQ ID NO: 216451 - DNA, 20 bp, Artificial Sequence
  chemically synthesized
aaatgtaatggagtgaggct

SEQ ID NO: 216452 - DNA, 20 bp, Artificial Sequence
  chemically synthesized
aataaaaatgtaatggagtg

SEQ ID NO: 216453 - DNA, 20 bp, Artificial Sequence
  chemically synthesized
caataaaaatgtaatggagt

SEQ ID NO: 216454 - DNA, 20 bp, Artificial Sequence
  chemically synthesized
tgatcaataaaaatgtaatg

SEQ ID NO: 216455 - DNA, 20 bp, Artificial Sequence
  chemically synthesized
tgtgatcaataaaaatgtaa

SEQ ID NO: 216456 - DNA, 20 bp, Artificial Sequence
  chemically synthesized
cattacatttttattgatca

SEQ ID NO: 216457 - DNA, 20 bp, Artificial Sequence
  chemically synthesized
atttttattgatcacagcac

SEQ ID NO: 216458 - DNA, 20 bp, Artificial Sequence
  chemically synthesized
attgatcacagcaccagtgc

SEQ ID NO: 216459 - DNA, 20 bp, Artificial Sequence
  chemically synthesized
tcccatttgtcgtctggcac

SEQ ID NO: 216460 - DNA, 20 bp, Artificial Sequence
  chemically synthesized
aagaattcccatttgtcgtc

SEQ ID NO: 216461 - DNA, 20 bp, Artificial Sequence
  chemically synthesized
caccagtgccagacgacaaa

SEQ ID NO: 216462 - DNA, 20 bp, Artificial Sequence
  chemically synthesized
accagtgccagacgacaaat

SEQ ID NO: 216463 - DNA, 20 bp, Artificial Sequence
  chemically synthesized
gacgacaaatgggaattctt

SEQ ID NO: 216464 - DNA, 20 bp, Artificial Sequence
  chemically synthesized
cgacaaatgggaattcttaa

SEQ ID NO: 216465 - DNA, 20 bp, Artificial Sequence
  chemically synthesized
aaatgggaattcttaagaga

SEQ ID NO: 216466 - DNA, 20 bp, Artificial Sequence
  chemically synthesized
aatgggaattcttaagagaa

SEQ ID NO: 216467 - DNA, 20 bp, Artificial Sequence
  chemically synthesized
cttctaatgccctttctctt

SEQ ID NO: 216468 - DNA, 20 bp, Artificial Sequence
  chemically synthesized
atgggaattcttaagagaaa

SEQ ID NO: 216469 - DNA, 20 bp, Artificial Sequence
  chemically synthesized
attcttaagagaaagggcat

SEQ ID NO: 216470 - DNA, 20 bp, Artificial Sequence
  chemically synthesized
cttaagagaaagggcattag

SEQ ID NO: 216471 - DNA, 20 bp, Artificial Sequence
  chemically synthesized
aagggcattagaagtgttaa

SEQ ID NO: 216472 - DNA, 20 bp, Artificial Sequence
  chemically synthesized
agggcattagaagtgttaaa

SEQ ID NO: 216473 - DNA, 20 bp, Artificial Sequence
  chemically synthesized
gaagtgttaaaaggcaacca

SEQ ID NO: 216474 - DNA, 20 bp, Artificial Sequence
  chemically synthesized
agtgttaaaaggcaaccaca

SEQ ID NO: 216475 - DNA, 20 bp, Artificial Sequence
  chemically synthesized
tgttaaaaggcaaccacaga

SEQ ID NO: 216476 - DNA, 20 bp, Artificial Sequence
  chemically synthesized
ctccatgtgacagctctctg

SEQ ID NO: 216477 - DNA, 20 bp, Artificial Sequence
  chemically synthesized
aaccacagagagctgtcaca

SEQ ID NO: 216478 - DNA, 20 bp, Artificial Sequence
  chemically synthesized
ccacagagagctgtcacatg

SEQ ID NO: 216479 - DNA, 20 bp, Artificial Sequence
  chemically synthesized
tggaccatttctccatgtga

SEQ ID NO: 216480 - DNA, 20 bp, Artificial Sequence
  chemically synthesized
agagctgtcacatggagaaa

SEQ ID NO: 216481 - DNA, 20 bp, Artificial Sequence
  chemically synthesized
gagatcaaatgaagatggca

SEQ ID NO: 216482 - DNA, 20 bp, Artificial Sequence
  chemically synthesized
ggagtgagatcaaatgaaga

SEQ ID NO: 216483 - DNA, 20 bp, Artificial Sequence
  chemically synthesized
actaggagtgagatcaaatg

SEQ ID NO: 216484 - DNA, 20 bp, Artificial Sequence
  chemically synthesized
tcttcatttgatctcactcc

SEQ ID NO: 216485 - DNA, 20 bp, Artificial Sequence
  chemically synthesized
gatgactcccaactaggagt

SEQ ID NO: 216486 - DNA, 20 bp, Artificial Sequence
  chemically synthesized
catttgatctcactcctagt

SEQ ID NO: 216487 - DNA, 20 bp, Artificial Sequence
  chemically synthesized
atttgatctcactcctagtt

SEQ ID NO: 216488 - DNA, 20 bp, Artificial Sequence
  chemically synthesized
ttctgatgactcccaactag

SEQ ID NO: 216489 - DNA, 20 bp, Artificial Sequence
  chemically synthesized
ttgatctcactcctagttgg

SEQ ID NO: 216490 - DNA, 20 bp, Artificial Sequence
  chemically synthesized
cattctgatgactcccaact

SEQ ID NO: 216491 - DNA, 20 bp, Artificial Sequence
  chemically synthesized
ccattctgatgactcccaac

SEQ ID NO: 216492 - DNA, 20 bp, Artificial Sequence
  chemically synthesized
cactcctagttgggagtcat

SEQ ID NO: 216493 - DNA, 20 bp, Artificial Sequence
  chemically synthesized
ctagttgggagtcatcagaa

SEQ ID NO: 216494 - DNA, 20 bp, Artificial Sequence
  chemically synthesized
tagttgggagtcatcagaat

SEQ ID NO: 216495 - DNA, 20 bp, Artificial Sequence
  chemically synthesized
agttgggagtcatcagaatg

SEQ ID NO: 216496 - DNA, 20 bp, Artificial Sequence
  chemically synthesized
ggagtcatcagaatggggaa

SEQ ID NO: 216497 - DNA, 20 bp, Artificial Sequence
  chemically synthesized
agtcatcagaatggggaacg

SEQ ID NO: 216498 - DNA, 20 bp, Artificial Sequence
  chemically synthesized
tggggaacggagatatcttt

SEQ ID NO: 216499 - DNA, 20 bp, Artificial Sequence
  chemically synthesized
gaacggagatatctttcagc

SEQ ID NO: 216500 - DNA, 20 bp, Artificial Sequence
  chemically synthesized
aacggagatatctttcagca

SEQ ID NO: 216501 - DNA, 20 bp, Artificial Sequence
  chemically synthesized
cactgggacctccttgctga

SEQ ID NO: 216502 - DNA, 20 bp, Artificial Sequence
  chemically synthesized
cggagatatctttcagcaag

SEQ ID NO: 216503 - DNA, 20 bp, Artificial Sequence
  chemically synthesized
ggagatatctttcagcaagg

SEQ ID NO: 216504 - DNA, 20 bp, Artificial Sequence
  chemically synthesized
atctttcagcaaggaggtcc

SEQ ID NO: 216505 - DNA, 20 bp, Artificial Sequence
  chemically synthesized
tttttattaatcatatcact

SEQ ID NO: 216506 - DNA, 20 bp, Artificial Sequence
  chemically synthesized
atttttattaatcatatcac

SEQ ID NO: 216507 - DNA, 20 bp, Artificial Sequence
  chemically synthesized
gattaataaaaatatgtcaa

SEQ ID NO: 216508 - DNA, 20 bp, Artificial Sequence
  chemically synthesized
aaatatgtcaaaagacacat

SEQ ID NO: 216509 - DNA, 20 bp, Artificial Sequence
  chemically synthesized
tgtcaaaagacacatgagaa

SEQ ID NO: 216510 - DNA, 20 bp, Artificial Sequence
  chemically synthesized
caaaagacacatgagaatag

SEQ ID NO: 216511 - DNA, 20 bp, Artificial Sequence
  chemically synthesized
aatagaagttcatttgatac

SEQ ID NO: 216512 - DNA, 20 bp, Artificial Sequence
  chemically synthesized
aagttcatttgatacaagca

SEQ ID NO: 216513 - DNA, 20 bp, Artificial Sequence
  chemically synthesized
agttcatttgatacaagcaa

SEQ ID NO: 216514 - DNA, 20 bp, Artificial Sequence
  chemically synthesized
tattgtttattctactaata

SEQ ID NO: 216515 - DNA, 20 bp, Artificial Sequence
  chemically synthesized
attctgtggaaccgtattag

SEQ ID NO: 216516 - DNA, 20 bp, Artificial Sequence
  chemically synthesized
tggattctgtggaaccgtat

SEQ ID NO: 216517 - DNA, 20 bp, Artificial Sequence
  chemically synthesized
attctactaatacggttcca

SEQ ID NO: 216518 - DNA, 20 bp, Artificial Sequence
  chemically synthesized
taatacggttccacagaatc

SEQ ID NO: 216519 - DNA, 20 bp, Artificial Sequence
  chemically synthesized
ctgctgggacctggattctg

SEQ ID NO: 216520 - DNA, 20 bp, Artificial Sequence
  chemically synthesized
aatacggttccacagaatcc

SEQ ID NO: 216521 - DNA, 20 bp, Artificial Sequence
  chemically synthesized
gttccacagaatccaggtcc

SEQ ID NO: 216522 - DNA, 20 bp, Artificial Sequence
  chemically synthesized
gagggggcactgctgggacc

SEQ ID NO: 216523 - DNA, 20 bp, Artificial Sequence
  chemically synthesized
ccacagaatccaggtcccag

SEQ ID NO: 216524 - DNA, 20 bp, Artificial Sequence
  chemically synthesized
ttctaagagggggcactgct

SEQ ID NO: 216525 - DNA, 20 bp, Artificial Sequence
  chemically synthesized
cttctaagagggggcactgc

SEQ ID NO: 216526 - DNA, 20 bp, Artificial Sequence
  chemically synthesized
gtcccagcagtgccccctct

SEQ ID NO: 216527 - DNA, 20 bp, Artificial Sequence
  chemically synthesized
aggcttgtccttctaagagg

SEQ ID NO: 216528 - DNA, 20 bp, Artificial Sequence
  chemically synthesized
ccagcagtgccccctcttag

SEQ ID NO: 216529 - DNA, 20 bp, Artificial Sequence
  chemically synthesized
gaggcttgtccttctaagag

SEQ ID NO: 216530 - DNA, 20 bp, Artificial Sequence
  chemically synthesized
cagcagtgccccctcttaga

SEQ ID NO: 216531 - DNA, 20 bp, Artificial Sequence
  chemically synthesized
ggaggcttgtccttctaaga

SEQ ID NO: 216532 - DNA, 20 bp, Artificial Sequence
  chemically synthesized
gggaggcttgtccttctaag

SEQ ID NO: 216533 - DNA, 20 bp, Artificial Sequence
  chemically synthesized
agggaggcttgtccttctaa

SEQ ID NO: 216534 - DNA, 20 bp, Artificial Sequence
  chemically synthesized
ctagggaggcttgtccttct

SEQ ID NO: 216535 - DNA, 20 bp, Artificial Sequence
  chemically synthesized
gtgccccctcttagaaggac

SEQ ID NO: 216536 - DNA, 20 bp, Artificial Sequence
  chemically synthesized
cttagaaggacaagcctccc

SEQ ID NO: 216537 - DNA, 20 bp, Artificial Sequence
  chemically synthesized
tgaagacttgaaaactaggg

SEQ ID NO: 216538 - DNA, 20 bp, Artificial Sequence
  chemically synthesized
gtgaagacttgaaaactagg

SEQ ID NO: 216539 - DNA, 20 bp, Artificial Sequence
  chemically synthesized
ttgtgaagacttgaaaacta

SEQ ID NO: 216540 - DNA, 20 bp, Artificial Sequence
  chemically synthesized
gacaagcctccctagttttc

SEQ ID NO: 216541 - DNA, 20 bp, Artificial Sequence
  chemically synthesized
tttgtgaagacttgaaaact

SEQ ID NO: 216542 - DNA, 20 bp, Artificial Sequence
  chemically synthesized
atttgtgaagacttgaaaac

SEQ ID NO: 216543 - DNA, 20 bp, Artificial Sequence
  chemically synthesized
gtcagctagccacatttgtg

SEQ ID NO: 216544 - DNA, 20 bp, Artificial Sequence
  chemically synthesized
ttttcaagtcttcacaaatg

SEQ ID NO: 216545 - DNA, 20 bp, Artificial Sequence
  chemically synthesized
caagtcttcacaaatgtggc

SEQ ID NO: 216546 - DNA, 20 bp, Artificial Sequence
  chemically synthesized
tcagatggtattttgtcagc

SEQ ID NO: 216547 - DNA, 20 bp, Artificial Sequence
  chemically synthesized
ttgatcagatggtattttgt

SEQ ID NO: 216548 - DNA, 20 bp, Artificial Sequence
  chemically synthesized
tgacaaaataccatctgatc

SEQ ID NO: 216549 - DNA, 20 bp, Artificial Sequence
  chemically synthesized
aagattatgacttgatcaga

SEQ ID NO: 216550 - DNA, 20 bp, Artificial Sequence
  chemically synthesized
tgagaagattatgacttgat

SEQ ID NO: 216551 - DNA, 20 bp, Artificial Sequence
  chemically synthesized
tgatcaagtcataatcttct

SEQ ID NO: 216552 - DNA, 20 bp, Artificial Sequence
  chemically synthesized
agatttatgaaggatctgag

SEQ ID NO: 216553 - DNA, 20 bp, Artificial Sequence
  chemically synthesized
agaagatttatgaaggatct

SEQ ID NO: 216554 - DNA, 20 bp, Artificial Sequence
  chemically synthesized
ggcagtaagaagatttatga

SEQ ID NO: 216555 - DNA, 20 bp, Artificial Sequence
  chemically synthesized
tggcagtaagaagatttatg

SEQ ID NO: 216556 - DNA, 20 bp, Artificial Sequence
  chemically synthesized
aacatgagcatggcagtaag

SEQ ID NO: 216557 - DNA, 20 bp, Artificial Sequence
  chemically synthesized
aaaaacatgagcatggcagt

SEQ ID NO: 216558 - DNA, 20 bp, Artificial Sequence
  chemically synthesized
ggttaaaaacatgagcatgg

SEQ ID NO: 216559 - DNA, 20 bp, Artificial Sequence
  chemically synthesized
aggggttaaaaacatgagca

SEQ ID NO: 216560 - DNA, 20 bp, Artificial Sequence
  chemically synthesized
ttggaaggggttaaaaacat

SEQ ID NO: 216561 - DNA, 20 bp, Artificial Sequence
  chemically synthesized
cagctcgaagaggttggaag

SEQ ID NO: 216562 - DNA, 20 bp, Artificial Sequence
  chemically synthesized
tcagctcgaagaggttggaa

SEQ ID NO: 216563 - DNA, 20 bp, Artificial Sequence
  chemically synthesized
gtcagctcgaagaggttgga

SEQ ID NO: 216564 - DNA, 20 bp, Artificial Sequence
  chemically synthesized
tgtcagctcgaagaggttgg

SEQ ID NO: 216565 - DNA, 20 bp, Artificial Sequence
  chemically synthesized
taatgtcagctcgaagaggt

SEQ ID NO: 216566 - DNA, 20 bp, Artificial Sequence
  chemically synthesized
taaccccttccaacctcttc

SEQ ID NO: 216567 - DNA, 20 bp, Artificial Sequence
  chemically synthesized
tacttaatgtcagctcgaag

SEQ ID NO: 216568 - DNA, 20 bp, Artificial Sequence
  chemically synthesized
ctacttaatgtcagctcgaa

SEQ ID NO: 216569 - DNA, 20 bp, Artificial Sequence
  chemically synthesized
agctacttaatgtcagctcg

SEQ ID NO: 216570 - DNA, 20 bp, Artificial Sequence
  chemically synthesized
aacctcttcgagctgacatt

SEQ ID NO: 216571 - DNA, 20 bp, Artificial Sequence
  chemically synthesized
taaaagaagctacttaatgt

SEQ ID NO: 216572 - DNA, 20 bp, Artificial Sequence
  chemically synthesized
ctcttcgagctgacattaag

SEQ ID NO: 216573 - DNA, 20 bp, Artificial Sequence
  chemically synthesized
cttctgctggtttttaaaag

SEQ ID NO: 216574 - DNA, 20 bp, Artificial Sequence
  chemically synthesized
aaccttctgctggtttttaa

SEQ ID NO: 216575 - DNA, 20 bp, Artificial Sequence
  chemically synthesized
aagtagcttcttttaaaaac

SEQ ID NO: 216576 - DNA, 20 bp, Artificial Sequence
  chemically synthesized
tagcttcttttaaaaaccag

SEQ ID NO: 216577 - DNA, 20 bp, Artificial Sequence
  chemically synthesized
cttcttttaaaaaccagcag

SEQ ID NO: 216578 - DNA, 20 bp, Artificial Sequence
  chemically synthesized
ttcttttaaaaaccagcaga

SEQ ID NO: 216579 - DNA, 20 bp, Artificial Sequence
  chemically synthesized
tgcattcatgaaccttctgc

SEQ ID NO: 216580 - DNA, 20 bp, Artificial Sequence
  chemically synthesized
agaaggttcatgaatgcata

SEQ ID NO: 216581 - DNA, 20 bp, Artificial Sequence
  chemically synthesized
gaaggttcatgaatgcatat

SEQ ID NO: 216582 - DNA, 20 bp, Artificial Sequence
  chemically synthesized
aggttcatgaatgcatatgg

SEQ ID NO: 216583 - DNA, 20 bp, Artificial Sequence
  chemically synthesized
ttcatgaatgcatatgggag

SEQ ID NO: 216584 - DNA, 20 bp, Artificial Sequence
  chemically synthesized
catgaatgcatatgggagaa

SEQ ID NO: 216585 - DNA, 20 bp, Artificial Sequence
  chemically synthesized
tatgggagaagagtgaattt

SEQ ID NO: 216586 - DNA, 20 bp, Artificial Sequence
  chemically synthesized
atgggagaagagtgaatttt

SEQ ID NO: 216587 - DNA, 20 bp, Artificial Sequence
  chemically synthesized
tgaattttaggtcaaattcc

SEQ ID NO: 216588 - DNA, 20 bp, Artificial Sequence
  chemically synthesized
gaattttaggtcaaattccc

SEQ ID NO: 216589 - DNA, 20 bp, Artificial Sequence
  chemically synthesized
acaaggttaaatcatagcct

SEQ ID NO: 216590 - DNA, 20 bp, Artificial Sequence
  chemically synthesized
gacaaggttaaatcatagcc

SEQ ID NO: 216591 - DNA, 20 bp, Artificial Sequence
  chemically synthesized
attgcgacaaggttaaatca

SEQ ID NO: 216592 - DNA, 20 bp, Artificial Sequence
  chemically synthesized
ggagagtacaaattgcgaca

SEQ ID NO: 216593 - DNA, 20 bp, Artificial Sequence
  chemically synthesized
gggagagtacaaattgcgac

SEQ ID NO: 216594 - DNA, 20 bp, Artificial Sequence
  chemically synthesized
gcttcctctctgatttggga

SEQ ID NO: 216595 - DNA, 20 bp, Artificial Sequence
  chemically synthesized
caatttgtactctcccaaat

SEQ ID NO: 216596 - DNA, 20 bp, Artificial Sequence
  chemically synthesized
aggcttcctctctgatttgg

SEQ ID NO: 216597 - DNA, 20 bp, Artificial Sequence
  chemically synthesized
atttgtactctcccaaatca

SEQ ID NO: 216598 - DNA, 20 bp, Artificial Sequence
  chemically synthesized
gcaggcttcctctctgattt

SEQ ID NO: 216599 - DNA, 20 bp, Artificial Sequence
  chemically synthesized
ttgtactctcccaaatcaga

SEQ ID NO: 216600 - DNA, 20 bp, Artificial Sequence
  chemically synthesized
ggcaggcttcctctctgatt

SEQ ID NO: 216601 - DNA, 20 bp, Artificial Sequence
  chemically synthesized
tgtactctcccaaatcagag

SEQ ID NO: 216602 - DNA, 20 bp, Artificial Sequence
  chemically synthesized
actctcccaaatcagagagg

SEQ ID NO: 216603 - DNA, 20 bp, Artificial Sequence
  chemically synthesized
tcagagaggaagcctgccta

SEQ ID NO: 216604 - DNA, 20 bp, Artificial Sequence
  chemically synthesized
cagagaggaagcctgcctac

SEQ ID NO: 216605 - DNA, 20 bp, Artificial Sequence
  chemically synthesized
agagaggaagcctgcctaca

SEQ ID NO: 216606 - DNA, 20 bp, Artificial Sequence
  chemically synthesized
attctaagtgccctgtaggc

SEQ ID NO: 216607 - DNA, 20 bp, Artificial Sequence
  chemically synthesized
gattctaagtgccctgtagg

SEQ ID NO: 216608 - DNA, 20 bp, Artificial Sequence
  chemically synthesized
ttagattctaagtgccctgt

SEQ ID NO: 216609 - DNA, 20 bp, Artificial Sequence
  chemically synthesized
cttagattctaagtgccctg

SEQ ID NO: 216610 - DNA, 20 bp, Artificial Sequence
  chemically synthesized
aagcctgcctacagggcact

SEQ ID NO: 216611 - DNA, 20 bp, Artificial Sequence
  chemically synthesized
ctacagggcacttagaatct

SEQ ID NO: 216612 - DNA, 20 bp, Artificial Sequence
  chemically synthesized
aaggcactttcttagattct

SEQ ID NO: 216613 - DNA, 20 bp, Artificial Sequence
  chemically synthesized
agggcacttagaatctaaga

SEQ ID NO: 216614 - DNA, 20 bp, Artificial Sequence
  chemically synthesized
ctccaccgaaggcactttct

SEQ ID NO: 216615 - DNA, 20 bp, Artificial Sequence
  chemically synthesized
agaatctaagaaagtgcctt

SEQ ID NO: 216616 - DNA, 20 bp, Artificial Sequence
  chemically synthesized
atctaagaaagtgccttcgg

SEQ ID NO: 216617 - DNA, 20 bp, Artificial Sequence
  chemically synthesized
ctaagaaagtgccttcggtg

SEQ ID NO: 216618 - DNA, 20 bp, Artificial Sequence
  chemically synthesized
ttaaatattttctccaccga

SEQ ID NO: 216619 - DNA, 20 bp, Artificial Sequence
  chemically synthesized
gttaaatattttctccaccg

SEQ ID NO: 216620 - DNA, 20 bp, Artificial Sequence
  chemically synthesized
tggagaaaatatttaaccaa

SEQ ID NO: 216621 - DNA, 20 bp, Artificial Sequence
  chemically synthesized
ggagaaaatatttaaccaat

SEQ ID NO: 216622 - DNA, 20 bp, Artificial Sequence
  chemically synthesized
catcccccaaacaaacctat

SEQ ID NO: 216623 - DNA, 20 bp, Artificial Sequence
  chemically synthesized
atttaaccaataggtttgtt

SEQ ID NO: 216624 - DNA, 20 bp, Artificial Sequence
  chemically synthesized
tttaaccaataggtttgttt

SEQ ID NO: 216625 - DNA, 20 bp, Artificial Sequence
  chemically synthesized
ttaaccaataggtttgtttg

SEQ ID NO: 216626 - DNA, 20 bp, Artificial Sequence
  chemically synthesized
taaccaataggtttgtttgg

SEQ ID NO: 216627 - DNA, 20 bp, Artificial Sequence
  chemically synthesized
caataggtttgtttggggga

SEQ ID NO: 216628 - DNA, 20 bp, Artificial Sequence
  chemically synthesized
ggtttgtttgggggatggtt

SEQ ID NO: 216629 - DNA, 20 bp, Artificial Sequence
  chemically synthesized
tgtttgggggatggtttgga

SEQ ID NO: 216630 - DNA, 20 bp, Artificial Sequence
  chemically synthesized
gtttgggggatggtttggat

SEQ ID NO: 216631 - DNA, 20 bp, Artificial Sequence
  chemically synthesized
tttgggggatggtttggata

SEQ ID NO: 216632 - DNA, 20 bp, Artificial Sequence
  chemically synthesized
ttggatagggatcttctata

SEQ ID NO: 216633 - DNA, 20 bp, Artificial Sequence
  chemically synthesized
atccttctaggtccatatag

SEQ ID NO: 216634 - DNA, 20 bp, Artificial Sequence
  chemically synthesized
ataatccttctaggtccata

SEQ ID NO: 216635 - DNA, 20 bp, Artificial Sequence
  chemically synthesized
agggatcttctatatggacc

SEQ ID NO: 216636 - DNA, 20 bp, Artificial Sequence
  chemically synthesized
gatcttctatatggacctag

SEQ ID NO: 216637 - DNA, 20 bp, Artificial Sequence
  chemically synthesized
atcttctatatggacctaga

SEQ ID NO: 216638 - DNA, 20 bp, Artificial Sequence
  chemically synthesized
tctctgatgataatccttct

SEQ ID NO: 216639 - DNA, 20 bp, Artificial Sequence
  chemically synthesized
gtctctgatgataatccttc

SEQ ID NO: 216640 - DNA, 20 bp, Artificial Sequence
  chemically synthesized
ggacctagaaggattatcat

SEQ ID NO: 216641 - DNA, 20 bp, Artificial Sequence
  chemically synthesized
acctagaaggattatcatca

SEQ ID NO: 216642 - DNA, 20 bp, Artificial Sequence
  chemically synthesized
aaggattatcatcagagaca

SEQ ID NO: 216643 - DNA, 20 bp, Artificial Sequence
  chemically synthesized
ggattatcatcagagacaaa

SEQ ID NO: 216644 - DNA, 20 bp, Artificial Sequence
  chemically synthesized
catctctgggcattaacaga

SEQ ID NO: 216645 - DNA, 20 bp, Artificial Sequence
  chemically synthesized
gtcacatctctgggcattaa

SEQ ID NO: 216646 - DNA, 20 bp, Artificial Sequence
  chemically synthesized
gtgaactttctgttaatgcc

SEQ ID NO: 216647 - DNA, 20 bp, Artificial Sequence
  chemically synthesized
gaactttctgttaatgccca

SEQ ID NO: 216648 - DNA, 20 bp, Artificial Sequence
  chemically synthesized
tctctggttgtcacatctct

SEQ ID NO: 216649 - DNA, 20 bp, Artificial Sequence
  chemically synthesized
ctctctggttgtcacatctc

SEQ ID NO: 216650 - DNA, 20 bp, Artificial Sequence
  chemically synthesized
atgcccagagatgtgacaac

SEQ ID NO: 216651 - DNA, 20 bp, Artificial Sequence
  chemically synthesized
gcccagagatgtgacaacca

SEQ ID NO: 216652 - DNA, 20 bp, Artificial Sequence
  chemically synthesized
ccagagatgtgacaaccaga

SEQ ID NO: 216653 - DNA, 20 bp, Artificial Sequence
  chemically synthesized
cagagatgtgacaaccagag

SEQ ID NO: 216654 - DNA, 20 bp, Artificial Sequence
  chemically synthesized
gatgtgacaaccagagaggc

SEQ ID NO: 216655 - DNA, 20 bp, Artificial Sequence
  chemically synthesized
tctgttctgcccagcctctc

SEQ ID NO: 216656 - DNA, 20 bp, Artificial Sequence
  chemically synthesized
atgtgacaaccagagaggct

SEQ ID NO: 216657 - DNA, 20 bp, Artificial Sequence
  chemically synthesized
tgacaaccagagaggctggg

SEQ ID NO: 216658 - DNA, 20 bp, Artificial Sequence
  chemically synthesized
accagagaggctgggcagaa

SEQ ID NO: 216659 - DNA, 20 bp, Artificial Sequence
  chemically synthesized
ctctgagattctgttctgcc

SEQ ID NO: 216660 - DNA, 20 bp, Artificial Sequence
  chemically synthesized
ggctgggcagaacagaatct

SEQ ID NO: 216661 - DNA, 20 bp, Artificial Sequence
  chemically synthesized
ctgggcagaacagaatctca

SEQ ID NO: 216662 - DNA, 20 bp, Artificial Sequence
  chemically synthesized
tgggcagaacagaatctcag

SEQ ID NO: 216663 - DNA, 20 bp, Artificial Sequence
  chemically synthesized
gggcagaacagaatctcaga

SEQ ID NO: 216664 - DNA, 20 bp, Artificial Sequence
  chemically synthesized
agttgctccacatgccctct

SEQ ID NO: 216665 - DNA, 20 bp, Artificial Sequence
  chemically synthesized
acagaatctcagagggcatg

SEQ ID NO: 216666 - DNA, 20 bp, Artificial Sequence
  chemically synthesized
agaatctcagagggcatgtg

SEQ ID NO: 216667 - DNA, 20 bp, Artificial Sequence
  chemically synthesized
agagggcatgtggagcaact

SEQ ID NO: 216668 - DNA, 20 bp, Artificial Sequence
  chemically synthesized
gggcatgtggagcaactgag

SEQ ID NO: 216669 - DNA, 20 bp, Artificial Sequence
  chemically synthesized
caatgcctttatagtcttct

SEQ ID NO: 216670 - DNA, 20 bp, Artificial Sequence
  chemically synthesized
gagcaactgagaagactata

SEQ ID NO: 216671 - DNA, 20 bp, Artificial Sequence
  chemically synthesized
agcaactgagaagactataa

SEQ ID NO: 216672 - DNA, 20 bp, Artificial Sequence
  chemically synthesized
aagaaaacacaatgccttta

SEQ ID NO: 216673 - DNA, 20 bp, Artificial Sequence
  chemically synthesized
gcattgtgttttcttacctc

SEQ ID NO: 216674 - DNA, 20 bp, Artificial Sequence
  chemically synthesized
gccttacgtgaacttgaggt

SEQ ID NO: 216675 - DNA, 20 bp, Artificial Sequence
  chemically synthesized
ataagccttacgtgaacttg

SEQ ID NO: 216676 - DNA, 20 bp, Artificial Sequence
  chemically synthesized
tataagccttacgtgaactt

SEQ ID NO: 216677 - DNA, 20 bp, Artificial Sequence
  chemically synthesized
ttcttacctcaagttcacgt

SEQ ID NO: 216678 - DNA, 20 bp, Artificial Sequence
  chemically synthesized
tcttacctcaagttcacgta

SEQ ID NO: 216679 - DNA, 20 bp, Artificial Sequence
  chemically synthesized
atagatgattttacagttat

SEQ ID NO: 216680 - DNA, 20 bp, Artificial Sequence
  chemically synthesized
tccaaaaatagatgatttta

SEQ ID NO: 216681 - DNA, 20 bp, Artificial Sequence
  chemically synthesized
actgtaaaatcatctatttt

SEQ ID NO: 216682 - DNA, 20 bp, Artificial Sequence
  chemically synthesized
tttcatggataatccaaaaa

SEQ ID NO: 216683 - DNA, 20 bp, Artificial Sequence
  chemically synthesized
gcctaggattgagaatttca

SEQ ID NO: 216684 - DNA, 20 bp, Artificial Sequence
  chemically synthesized
atccatgaaattctcaatcc

SEQ ID NO: 216685 - DNA, 20 bp, Artificial Sequence
  chemically synthesized
tccatgaaattctcaatcct

SEQ ID NO: 216686 - DNA, 20 bp, Artificial Sequence
  chemically synthesized
aaaactgctagcctaggatt

SEQ ID NO: 216687 - DNA, 20 bp, Artificial Sequence
  chemically synthesized
tgaaattctcaatcctaggc

SEQ ID NO: 216688 - DNA, 20 bp, Artificial Sequence
  chemically synthesized
aattctcaatcctaggctag

SEQ ID NO: 216689 - DNA, 20 bp, Artificial Sequence
  chemically synthesized
ttgcagaaaactgctagcct

SEQ ID NO: 216690 - DNA, 20 bp, Artificial Sequence
  chemically synthesized
gttgcagaaaactgctagcc

SEQ ID NO: 216691 - DNA, 20 bp, Artificial Sequence
  chemically synthesized
tgtaagttgcagaaaactgc

SEQ ID NO: 216692 - DNA, 20 bp, Artificial Sequence
  chemically synthesized
aggcatgggcttgtaagttg

SEQ ID NO: 216693 - DNA, 20 bp, Artificial Sequence
  chemically synthesized
agcagttttctgcaacttac

SEQ ID NO: 216694 - DNA, 20 bp, Artificial Sequence
  chemically synthesized
taggagaggcatgggcttgt

SEQ ID NO: 216695 - DNA, 20 bp, Artificial Sequence
  chemically synthesized
tttgaatgtaggagaggcat

SEQ ID NO: 216696 - DNA, 20 bp, Artificial Sequence
  chemically synthesized
ctttgaatgtaggagaggca

SEQ ID NO: 216697 - DNA, 20 bp, Artificial Sequence
  chemically synthesized
gaaacctttgaatgtaggag

SEQ ID NO: 216698 - DNA, 20 bp, Artificial Sequence
  chemically synthesized
ggaaacctttgaatgtagga

SEQ ID NO: 216699 - DNA, 20 bp, Artificial Sequence
  chemically synthesized
ttggaaacctttgaatgtag

SEQ ID NO: 216700 - DNA, 20 bp, Artificial Sequence
  chemically synthesized
ccatgcctctcctacattca

SEQ ID NO: 216701 - DNA, 20 bp, Artificial Sequence
  chemically synthesized
tattggaaacctttgaatgt

SEQ ID NO: 216702 - DNA, 20 bp, Artificial Sequence
  chemically synthesized
catgcctctcctacattcaa

SEQ ID NO: 216703 - DNA, 20 bp, Artificial Sequence
  chemically synthesized
ttattggaaacctttgaatg

SEQ ID NO: 216704 - DNA, 20 bp, Artificial Sequence
  chemically synthesized
gtccctgggtgtaatgttat

SEQ ID NO: 216705 - DNA, 20 bp, Artificial Sequence
  chemically synthesized
gtttccaataacattacacc

SEQ ID NO: 216706 - DNA, 20 bp, Artificial Sequence
  chemically synthesized
tttccaataacattacaccc

SEQ ID NO: 216707 - DNA, 20 bp, Artificial Sequence
  chemically synthesized
ttccaataacattacaccca

SEQ ID NO: 216708 - DNA, 20 bp, Artificial Sequence
  chemically synthesized
ataacattacacccagggac

SEQ ID NO: 216709 - DNA, 20 bp, Artificial Sequence
  chemically synthesized
ataatatacttcttgtccct

SEQ ID NO: 216710 - DNA, 20 bp, Artificial Sequence
  chemically synthesized
aataatatacttcttgtccc

SEQ ID NO: 216711 - DNA, 20 bp, Artificial Sequence
  chemically synthesized
acattacacccagggacaag

SEQ ID NO: 216712 - DNA, 20 bp, Artificial Sequence
  chemically synthesized
caagaagtatattattttat

SEQ ID NO: 216713 - DNA, 20 bp, Artificial Sequence
  chemically synthesized
atattattttattggcctgt

SEQ ID NO: 216714 - DNA, 20 bp, Artificial Sequence
  chemically synthesized
tattattttattggcctgtg

SEQ ID NO: 216715 - DNA, 20 bp, Artificial Sequence
  chemically synthesized
tattttattggcctgtgagg

SEQ ID NO: 216716 - DNA, 20 bp, Artificial Sequence
  chemically synthesized
attttattggcctgtgaggt

SEQ ID NO: 216717 - DNA, 20 bp, Artificial Sequence
  chemically synthesized
gtccccttcccccacctcac

SEQ ID NO: 216718 - DNA, 20 bp, Artificial Sequence
  chemically synthesized
ttttattggcctgtgaggtg

SEQ ID NO: 216719 - DNA, 20 bp, Artificial Sequence
  chemically synthesized
tgtccccttcccccacctca

SEQ ID NO: 216720 - DNA, 20 bp, Artificial Sequence
  chemically synthesized
tttattggcctgtgaggtgg

SEQ ID NO: 216721 - DNA, 20 bp, Artificial Sequence
  chemically synthesized
attggcctgtgaggtggggg

SEQ ID NO: 216722 - DNA, 20 bp, Artificial Sequence
  chemically synthesized
ttggcctgtgaggtggggga

SEQ ID NO: 216723 - DNA, 20 bp, Artificial Sequence
  chemically synthesized
tggcctgtgaggtgggggaa

SEQ ID NO: 216724 - DNA, 20 bp, Artificial Sequence
  chemically synthesized
ggcctgtgaggtgggggaag

SEQ ID NO: 216725 - DNA, 20 bp, Artificial Sequence
  chemically synthesized
gggacaaaatttatataata

SEQ ID NO: 216726 - DNA, 20 bp, Artificial Sequence
  chemically synthesized
taaactttactgtgtaaaat

SEQ ID NO: 216727 - DNA, 20 bp, Artificial Sequence
  chemically synthesized
ataaagtatcctattttaca

SEQ ID NO: 216728 - DNA, 20 bp, Artificial Sequence
  chemically synthesized
ataaactttactgtgtaaaa

SEQ ID NO: 216729 - DNA, 20 bp, Artificial Sequence
  chemically synthesized
gtatcctattttacacagta

SEQ ID NO: 216730 - DNA, 20 bp, Artificial Sequence
  chemically synthesized
gatcagtgtttaataaagta

SEQ ID NO: 216731 - DNA, 20 bp, Artificial Sequence
  chemically synthesized
tcagtgatcagtgtttaata

SEQ ID NO: 216732 - DNA, 20 bp, Artificial Sequence
  chemically synthesized
tagaacagatcatcagtgat

SEQ ID NO: 216733 - DNA, 20 bp, Artificial Sequence
  chemically synthesized
aaagctatagaacagatcat

SEQ ID NO: 216734 - DNA, 20 bp, Artificial Sequence
  chemically synthesized
atcactgatgatctgttcta

SEQ ID NO: 216735 - DNA, 20 bp, Artificial Sequence
  chemically synthesized
gttttgggaaagctatagaa

SEQ ID NO: 216736 - DNA, 20 bp, Artificial Sequence
  chemically synthesized
acagggttttgggaaagcta

SEQ ID NO: 216737 - DNA, 20 bp, Artificial Sequence
  chemically synthesized
agaaacacagggttttggga

SEQ ID NO: 216738 - DNA, 20 bp, Artificial Sequence
  chemically synthesized
atccagaaacacagggtttt

SEQ ID NO: 216739 - DNA, 20 bp, Artificial Sequence
  chemically synthesized
aatccagaaacacagggttt

SEQ ID NO: 216740 - DNA, 20 bp, Artificial Sequence
  chemically synthesized
attgaaaatccagaaacaca

SEQ ID NO: 216741 - DNA, 20 bp, Artificial Sequence
  chemically synthesized
ttcccaaaaccctgtgtttc

SEQ ID NO: 216742 - DNA, 20 bp, Artificial Sequence
  chemically synthesized
aattgaaaatccagaaacac

SEQ ID NO: 216743 - DNA, 20 bp, Artificial Sequence
  chemically synthesized
taattgaaaatccagaaaca

SEQ ID NO: 216744 - DNA, 20 bp, Artificial Sequence
  chemically synthesized
tctctgcataattgaaaatc

SEQ ID NO: 216745 - DNA, 20 bp, Artificial Sequence
  chemically synthesized
tttctggattttcaattatg

SEQ ID NO: 216746 - DNA, 20 bp, Artificial Sequence
  chemically synthesized
tctggattttcaattatgca

SEQ ID NO: 216747 - DNA, 20 bp, Artificial Sequence
  chemically synthesized
tttcaattatgcagagaaaa

SEQ ID NO: 216748 - DNA, 20 bp, Artificial Sequence
  chemically synthesized
agaaaaaagtgaaatctcct

SEQ ID NO: 216749 - DNA, 20 bp, Artificial Sequence
  chemically synthesized
aaaagtgaaatctcctgagc

SEQ ID NO: 216750 - DNA, 20 bp, Artificial Sequence
  chemically synthesized
gggaagagctgccagctcag

SEQ ID NO: 216751 - DNA, 20 bp, Artificial Sequence
  chemically synthesized
agtgaaatctcctgagctgg

SEQ ID NO: 216752 - DNA, 20 bp, Artificial Sequence
  chemically synthesized
aggggaagagctgccagctc

SEQ ID NO: 216753 - DNA, 20 bp, Artificial Sequence
  chemically synthesized
gaggggaagagctgccagct

SEQ ID NO: 216754 - DNA, 20 bp, Artificial Sequence
  chemically synthesized
tgatggaggggaagagctgc

SEQ ID NO: 216755 - DNA, 20 bp, Artificial Sequence
  chemically synthesized
tgaactatgatggaggggaa

SEQ ID NO: 216756 - DNA, 20 bp, Artificial Sequence
  chemically synthesized
tttgaactatgatggagggg

SEQ ID NO: 216757 - DNA, 20 bp, Artificial Sequence
  chemically synthesized
ccttttgaactatgatggag

SEQ ID NO: 216758 - DNA, 20 bp, Artificial Sequence
  chemically synthesized
gcagctcttcccctccatca

SEQ ID NO: 216759 - DNA, 20 bp, Artificial Sequence
  chemically synthesized
accttttgaactatgatgga

SEQ ID NO: 216760 - DNA, 20 bp, Artificial Sequence
  chemically synthesized
caccttttgaactatgatgg

SEQ ID NO: 216761 - DNA, 20 bp, Artificial Sequence
  chemically synthesized
tcaccttttgaactatgatg

SEQ ID NO: 216762 - DNA, 20 bp, Artificial Sequence
  chemically synthesized
tgtcaccttttgaactatga

SEQ ID NO: 216763 - DNA, 20 bp, Artificial Sequence
  chemically synthesized
tcccctccatcatagttcaa

SEQ ID NO: 216764 - DNA, 20 bp, Artificial Sequence
  chemically synthesized
cccctccatcatagttcaaa

SEQ ID NO: 216765 - DNA, 20 bp, Artificial Sequence
  chemically synthesized
catcatagttcaaaaggtga

SEQ ID NO: 216766 - DNA, 20 bp, Artificial Sequence
  chemically synthesized
atcatagttcaaaaggtgac

SEQ ID NO: 216767 - DNA, 20 bp, Artificial Sequence
  chemically synthesized
tcatagttcaaaaggtgaca

SEQ ID NO: 216768 - DNA, 20 bp, Artificial Sequence
  chemically synthesized
gttcaaaaggtgacagggaa

SEQ ID NO: 216769 - DNA, 20 bp, Artificial Sequence
  chemically synthesized
caaaaggtgacagggaatag

SEQ ID NO: 216770 - DNA, 20 bp, Artificial Sequence
  chemically synthesized
tgacagggaatagcagccta

SEQ ID NO: 216771 - DNA, 20 bp, Artificial Sequence
  chemically synthesized
acagggaatagcagcctaca

SEQ ID NO: 216772 - DNA, 20 bp, Artificial Sequence
  chemically synthesized
ttatgttctgttcactctgt

SEQ ID NO: 216773 - DNA, 20 bp, Artificial Sequence
  chemically synthesized
gttatgttctgttcactctg

SEQ ID NO: 216774 - DNA, 20 bp, Artificial Sequence
  chemically synthesized
atagcagcctacagagtgaa

SEQ ID NO: 216775 - DNA, 20 bp, Artificial Sequence
  chemically synthesized
tgaacagaacataactctct

SEQ ID NO: 216776 - DNA, 20 bp, Artificial Sequence
  chemically synthesized
gagcttaaccatggctcaga

SEQ ID NO: 216777 - DNA, 20 bp, Artificial Sequence
  chemically synthesized
gaacataactctctgagcca

SEQ ID NO: 216778 - DNA, 20 bp, Artificial Sequence
  chemically synthesized
tggagcttaaccatggctca

SEQ ID NO: 216779 - DNA, 20 bp, Artificial Sequence
  chemically synthesized
gctggagcttaaccatggct

SEQ ID NO: 216780 - DNA, 20 bp, Artificial Sequence
  chemically synthesized
taactctctgagccatggtt

SEQ ID NO: 216781 - DNA, 20 bp, Artificial Sequence
  chemically synthesized
aaattgctggagcttaacca

SEQ ID NO: 216782 - DNA, 20 bp, Artificial Sequence
  chemically synthesized
tctgagccatggttaagctc

SEQ ID NO: 216783 - DNA, 20 bp, Artificial Sequence
  chemically synthesized
tgcgaccaccaaaattgctg

SEQ ID NO: 216784 - DNA, 20 bp, Artificial Sequence
  chemically synthesized
tggttaagctccagcaattt

SEQ ID NO: 216785 - DNA, 20 bp, Artificial Sequence
  chemically synthesized
actgcgaccaccaaaattgc

SEQ ID NO: 216786 - DNA, 20 bp, Artificial Sequence
  chemically synthesized
ttaagctccagcaattttgg

SEQ ID NO: 216787 - DNA, 20 bp, Artificial Sequence
  chemically synthesized
tccagcaattttggtggtcg

SEQ ID NO: 216788 - DNA, 20 bp, Artificial Sequence
  chemically synthesized
ttggtggtcgcagtaaacac

SEQ ID NO: 216789 - DNA, 20 bp, Artificial Sequence
  chemically synthesized
tggtggtcgcagtaaacact

SEQ ID NO: 216790 - DNA, 20 bp, Artificial Sequence
  chemically synthesized
gaagttccttgggtttagcc

SEQ ID NO: 216791 - DNA, 20 bp, Artificial Sequence
  chemically synthesized
gtaaacactgggctaaaccc

SEQ ID NO: 216792 - DNA, 20 bp, Artificial Sequence
  chemically synthesized
taaacactgggctaaaccca

SEQ ID NO: 216793 - DNA, 20 bp, Artificial Sequence
  chemically synthesized
ggggagaagttccttgggtt

SEQ ID NO: 216794 - DNA, 20 bp, Artificial Sequence
  chemically synthesized
tagagggggagaagttcctt

SEQ ID NO: 216795 - DNA, 20 bp, Artificial Sequence
  chemically synthesized
atagagggggagaagttcct

SEQ ID NO: 216796 - DNA, 20 bp, Artificial Sequence
  chemically synthesized
aaagccacatagagggggag

SEQ ID NO: 216797 - DNA, 20 bp, Artificial Sequence
  chemically synthesized
accaaagccacatagagggg

SEQ ID NO: 216798 - DNA, 20 bp, Artificial Sequence
  chemically synthesized
taaccaaagccacatagagg

SEQ ID NO: 216799 - DNA, 20 bp, Artificial Sequence
  chemically synthesized
ggaacttctccccctctatg

SEQ ID NO: 216800 - DNA, 20 bp, Artificial Sequence
  chemically synthesized
ataaccaaagccacatagag

SEQ ID NO: 216801 - DNA, 20 bp, Artificial Sequence
  chemically synthesized
tataaccaaagccacataga

SEQ ID NO: 216802 - DNA, 20 bp, Artificial Sequence
  chemically synthesized
atataaccaaagccacatag

SEQ ID NO: 216803 - DNA, 20 bp, Artificial Sequence
  chemically synthesized
tatataaccaaagccacata

SEQ ID NO: 216804 - DNA, 20 bp, Artificial Sequence
  chemically synthesized
aatatataaccaaagccaca

SEQ ID NO: 216805 - DNA, 20 bp, Artificial Sequence
  chemically synthesized
tctccccctctatgtggctt

SEQ ID NO: 216806 - DNA, 20 bp, Artificial Sequence
  chemically synthesized
tggttatcaatatataacca

SEQ ID NO: 216807 - DNA, 20 bp, Artificial Sequence
  chemically synthesized
tggttatatattgataacca

SEQ ID NO: 216808 - DNA, 20 bp, Artificial Sequence
  chemically synthesized
aaccaaagcaatatcagctt

SEQ ID NO: 216809 - DNA, 20 bp, Artificial Sequence
  chemically synthesized
tttgataaccaaagcaatat

SEQ ID NO: 216810 - DNA, 20 bp, Artificial Sequence
  chemically synthesized
aaccaaagctgatattgctt

SEQ ID NO: 216811 - DNA, 20 bp, Artificial Sequence
  chemically synthesized
tgatattgctttgataacca

SEQ ID NO: 216812 - DNA, 20 bp, Artificial Sequence
  chemically synthesized
tgatattgctttggttatca

SEQ ID NO: 216813 - DNA, 20 bp, Artificial Sequence
  chemically synthesized
tttggttatcaaagcaatat

SEQ ID NO: 216814 - DNA, 20 bp, Artificial Sequence
  chemically synthesized
aaagcaatatcagcatgacc

SEQ ID NO: 216815 - DNA, 20 bp, Artificial Sequence
  chemically synthesized
aagcaatatcagcatgacct

SEQ ID NO: 216816 - DNA, 20 bp, Artificial Sequence
  chemically synthesized
tacttttctaataagttccc

SEQ ID NO: 216817 - DNA, 20 bp, Artificial Sequence
  chemically synthesized
ttacttttctaataagttcc

SEQ ID NO: 216818 - DNA, 20 bp, Artificial Sequence
  chemically synthesized
agcatgacctgggaacttat

SEQ ID NO: 216819 - DNA, 20 bp, Artificial Sequence
  chemically synthesized
gacctgggaacttattagaa

SEQ ID NO: 216820 - DNA, 20 bp, Artificial Sequence
  chemically synthesized
tgagaatttacttttctaat

SEQ ID NO: 216821 - DNA, 20 bp, Artificial Sequence
  chemically synthesized
ttattagaaaagtaaattct

SEQ ID NO: 216822 - DNA, 20 bp, Artificial Sequence
  chemically synthesized
tattagaaaagtaaattctc

SEQ ID NO: 216823 - DNA, 20 bp, Artificial Sequence
  chemically synthesized
gtagctgtggggtgagacct

SEQ ID NO: 216824 - DNA, 20 bp, Artificial Sequence
  chemically synthesized
aattctcaggtctcacccca

SEQ ID NO: 216825 - DNA, 20 bp, Artificial Sequence
  chemically synthesized
tgataaggtagctgtggggt

SEQ ID NO: 216826 - DNA, 20 bp, Artificial Sequence
  chemically synthesized
gttctgataaggtagctgtg

SEQ ID NO: 216827 - DNA, 20 bp, Artificial Sequence
  chemically synthesized
agttctgataaggtagctgt

SEQ ID NO: 216828 - DNA, 20 bp, Artificial Sequence
  chemically synthesized
gagttctgataaggtagctg

SEQ ID NO: 216829 - DNA, 20 bp, Artificial Sequence
  chemically synthesized
tcaccccacagctaccttat

SEQ ID NO: 216830 - DNA, 20 bp, Artificial Sequence
  chemically synthesized
tcgtaggagttctgataagg

SEQ ID NO: 216831 - DNA, 20 bp, Artificial Sequence
  chemically synthesized
cactcgtaggagttctgata

SEQ ID NO: 216832 - DNA, 20 bp, Artificial Sequence
  chemically synthesized
ccactcgtaggagttctgat

SEQ ID NO: 216833 - DNA, 20 bp, Artificial Sequence
  chemically synthesized
taccttatcagaactcctac

SEQ ID NO: 216834 - DNA, 20 bp, Artificial Sequence
  chemically synthesized
cttatcagaactcctacgag

SEQ ID NO: 216835 - DNA, 20 bp, Artificial Sequence
  chemically synthesized
ttgctgtgccccactcgtag

SEQ ID NO: 216836 - DNA, 20 bp, Artificial Sequence
  chemically synthesized
ttatcagaactcctacgagt

SEQ ID NO: 216837 - DNA, 20 bp, Artificial Sequence
  chemically synthesized
tatcagaactcctacgagtg

SEQ ID NO: 216838 - DNA, 20 bp, Artificial Sequence
  chemically synthesized
gattgctgtgccccactcgt

SEQ ID NO: 216839 - DNA, 20 bp, Artificial Sequence
  chemically synthesized
tgattgctgtgccccactcg

SEQ ID NO: 216840 - DNA, 20 bp, Artificial Sequence
  chemically synthesized
gaactcctacgagtggggca

SEQ ID NO: 216841 - DNA, 20 bp, Artificial Sequence
  chemically synthesized
tacgagtggggcacagcaat

SEQ ID NO: 216842 - DNA, 20 bp, Artificial Sequence
  chemically synthesized
acagcaatcagtattttaat

SEQ ID NO: 216843 - DNA, 20 bp, Artificial Sequence
  chemically synthesized
cagtattttaatgagtcacc

SEQ ID NO: 216844 - DNA, 20 bp, Artificial Sequence
  chemically synthesized
gatcctgcatcaaaatttcc

SEQ ID NO: 216845 - DNA, 20 bp, Artificial Sequence
  chemically synthesized
tgatcctgcatcaaaatttc

SEQ ID NO: 216846 - DNA, 20 bp, Artificial Sequence
  chemically synthesized
gtcacctggaaattttgatg

SEQ ID NO: 216847 - DNA, 20 bp, Artificial Sequence
  chemically synthesized
tcacctggaaattttgatgc

SEQ ID NO: 216848 - DNA, 20 bp, Artificial Sequence
  chemically synthesized
ggattgctgctatagggcga

SEQ ID NO: 216849 - DNA, 20 bp, Artificial Sequence
  chemically synthesized
atgtgaaaaccatcgcccta

SEQ ID NO: 216850 - DNA, 20 bp, Artificial Sequence
  chemically synthesized
tgaaaaccatcgccctatag

SEQ ID NO: 216851 - DNA, 20 bp, Artificial Sequence
  chemically synthesized
ggttggggattgctgctata

SEQ ID NO: 216852 - DNA, 20 bp, Artificial Sequence
  chemically synthesized
aggttggggattgctgctat

SEQ ID NO: 216853 - DNA, 20 bp, Artificial Sequence
  chemically synthesized
aaggttggggattgctgcta

SEQ ID NO: 216854 - DNA, 20 bp, Artificial Sequence
  chemically synthesized
ctctggtgccgaaaaggttg

SEQ ID NO: 216855 - DNA, 20 bp, Artificial Sequence
  chemically synthesized
tctctggtgccgaaaaggtt

SEQ ID NO: 216856 - DNA, 20 bp, Artificial Sequence
  chemically synthesized
gcagcaatccccaacctttt

SEQ ID NO: 216857 - DNA, 20 bp, Artificial Sequence
  chemically synthesized
gtctctggtgccgaaaaggt

SEQ ID NO: 216858 - DNA, 20 bp, Artificial Sequence
  chemically synthesized
accagtctctggtgccgaaa

SEQ ID NO: 216859 - DNA, 20 bp, Artificial Sequence
  chemically synthesized
aaccagtctctggtgccgaa

SEQ ID NO: 216860 - DNA, 20 bp, Artificial Sequence
  chemically synthesized
atccccaaccttttcggcac

SEQ ID NO: 216861 - DNA, 20 bp, Artificial Sequence
  chemically synthesized
ccccaaccttttcggcacca

SEQ ID NO: 216862 - DNA, 20 bp, Artificial Sequence
  chemically synthesized
accttttcggcaccagagac

SEQ ID NO: 216863 - DNA, 20 bp, Artificial Sequence
  chemically synthesized
tcttcctctaaaccagtctc

SEQ ID NO: 216864 - DNA, 20 bp, Artificial Sequence
  chemically synthesized
ttcggcaccagagactggtt

SEQ ID NO: 216865 - DNA, 20 bp, Artificial Sequence
  chemically synthesized
cggcaccagagactggttta

SEQ ID NO: 216866 - DNA, 20 bp, Artificial Sequence
  chemically synthesized
ggcaccagagactggtttag

SEQ ID NO: 216867 - DNA, 20 bp, Artificial Sequence
  chemically synthesized
aaaattgtcttcctctaaac

SEQ ID NO: 216868 - DNA, 20 bp, Artificial Sequence
  chemically synthesized
accagagactggtttagagg

SEQ ID NO: 216869 - DNA, 20 bp, Artificial Sequence
  chemically synthesized
agaggaagacaatttttcca

SEQ ID NO: 216870 - DNA, 20 bp, Artificial Sequence
  chemically synthesized
aagacaatttttccatggat

SEQ ID NO: 216871 - DNA, 20 bp, Artificial Sequence
  chemically synthesized
agacaatttttccatggatc

SEQ ID NO: 216872 - DNA, 20 bp, Artificial Sequence
  chemically synthesized
gacaatttttccatggatca

SEQ ID NO: 216873 - DNA, 20 bp, Artificial Sequence
  chemically synthesized
ccccacccgcccctgatcca

SEQ ID NO: 216874 - DNA, 20 bp, Artificial Sequence
  chemically synthesized
acaatttttccatggatcag

SEQ ID NO: 216875 - DNA, 20 bp, Artificial Sequence
  chemically synthesized
atttttccatggatcagggg

SEQ ID NO: 216876 - DNA, 20 bp, Artificial Sequence
  chemically synthesized
tttttccatggatcaggggc

SEQ ID NO: 216877 - DNA, 20 bp, Artificial Sequence
  chemically synthesized
ttccatggatcaggggcggg

SEQ ID NO: 216878 - DNA, 20 bp, Artificial Sequence
  chemically synthesized
tccatggatcaggggcgggt

SEQ ID NO: 216879 - DNA, 20 bp, Artificial Sequence
  chemically synthesized
ccatggatcaggggcgggtg

SEQ ID NO: 216880 - DNA, 20 bp, Artificial Sequence
  chemically synthesized
atcaggggcgggtggggttg

SEQ ID NO: 216881 - DNA, 20 bp, Artificial Sequence
  chemically synthesized
tcaggggcgggtggggttgt

SEQ ID NO: 216882 - DNA, 20 bp, Artificial Sequence
  chemically synthesized
caggggcgggtggggttgtg

SEQ ID NO: 216883 - DNA, 20 bp, Artificial Sequence
  chemically synthesized
ggggcgggtggggttgtggg

SEQ ID NO: 216884 - DNA, 20 bp, Artificial Sequence
  chemically synthesized
ggcgggtggggttgtgggga

SEQ ID NO: 216885 - DNA, 20 bp, Artificial Sequence
  chemically synthesized
gcgggtggggttgtggggag

SEQ ID NO: 216886 - DNA, 20 bp, Artificial Sequence
  chemically synthesized
gggttgtggggagaggtgcg

SEQ ID NO: 216887 - DNA, 20 bp, Artificial Sequence
  chemically synthesized
ggttgtggggagaggtgcgt

SEQ ID NO: 216888 - DNA, 20 bp, Artificial Sequence
  chemically synthesized
ttgtggggagaggtgcgtgg

SEQ ID NO: 216889 - DNA, 20 bp, Artificial Sequence
  chemically synthesized
tgtggggagaggtgcgtggg

SEQ ID NO: 216890 - DNA, 20 bp, Artificial Sequence
  chemically synthesized
gagaggtgcgtgggaggcga

SEQ ID NO: 216891 - DNA, 20 bp, Artificial Sequence
  chemically synthesized
gtgcgtgggaggcgatggtt

SEQ ID NO: 216892 - DNA, 20 bp, Artificial Sequence
  chemically synthesized
tgcgtgggaggcgatggttt

SEQ ID NO: 216893 - DNA, 20 bp, Artificial Sequence
  chemically synthesized
gcgtgggaggcgatggtttg

SEQ ID NO: 216894 - DNA, 20 bp, Artificial Sequence
  chemically synthesized
cctgaagatctgaggtgcaa

SEQ ID NO: 216895 - DNA, 20 bp, Artificial Sequence
  chemically synthesized
gggataaaactgttgcacct

SEQ ID NO: 216896 - DNA, 20 bp, Artificial Sequence
  chemically synthesized
atctaatgcctgaagatctg

SEQ ID NO: 216897 - DNA, 20 bp, Artificial Sequence
  chemically synthesized
actgttgcacctcagatctt

SEQ ID NO: 216898 - DNA, 20 bp, Artificial Sequence
  chemically synthesized
aatctaatgcctgaagatct

SEQ ID NO: 216899 - DNA, 20 bp, Artificial Sequence
  chemically synthesized
ctgttgcacctcagatcttc

SEQ ID NO: 216900 - DNA, 20 bp, Artificial Sequence
  chemically synthesized
cacctcagatcttcaggcat

SEQ ID NO: 216901 - DNA, 20 bp, Artificial Sequence
  chemically synthesized
ttatgagaatctaatgcctg

SEQ ID NO: 216902 - DNA, 20 bp, Artificial Sequence
  chemically synthesized
ttcaggcattagattctcat

SEQ ID NO: 216903 - DNA, 20 bp, Artificial Sequence
  chemically synthesized
tcaggcattagattctcata

SEQ ID NO: 216904 - DNA, 20 bp, Artificial Sequence
  chemically synthesized
aggcattagattctcataag

SEQ ID NO: 216905 - DNA, 20 bp, Artificial Sequence
  chemically synthesized
ctaggttgtgtgctccttat

SEQ ID NO: 216906 - DNA, 20 bp, Artificial Sequence
  chemically synthesized
ctcataaggagcacacaacc

SEQ ID NO: 216907 - DNA, 20 bp, Artificial Sequence
  chemically synthesized
actgtccacacgagggatct

SEQ ID NO: 216908 - DNA, 20 bp, Artificial Sequence
  chemically synthesized
aactgtccacacgagggatc

SEQ ID NO: 216909 - DNA, 20 bp, Artificial Sequence
  chemically synthesized
cacaacctagatccctcgtg

SEQ ID NO: 216910 - DNA, 20 bp, Artificial Sequence
  chemically synthesized
attgtgaactgtccacacga

SEQ ID NO: 216911 - DNA, 20 bp, Artificial Sequence
  chemically synthesized
tattgtgaactgtccacacg

SEQ ID NO: 216912 - DNA, 20 bp, Artificial Sequence
  chemically synthesized
acctagatccctcgtgtgga

SEQ ID NO: 216913 - DNA, 20 bp, Artificial Sequence
  chemically synthesized
ctattgtgaactgtccacac

SEQ ID NO: 216914 - DNA, 20 bp, Artificial Sequence
  chemically synthesized
ctcgtgtggacagttcacaa

SEQ ID NO: 216915 - DNA, 20 bp, Artificial Sequence
  chemically synthesized
tcgtgtggacagttcacaat

SEQ ID NO: 216916 - DNA, 20 bp, Artificial Sequence
  chemically synthesized
cgtgtggacagttcacaata

SEQ ID NO: 216917 - DNA, 20 bp, Artificial Sequence
  chemically synthesized
aatagggttcgtgatcctat

SEQ ID NO: 216918 - DNA, 20 bp, Artificial Sequence
  chemically synthesized
cagcggtattagattctcat

SEQ ID NO: 216919 - DNA, 20 bp, Artificial Sequence
  chemically synthesized
gcagcggtattagattctca

SEQ ID NO: 216920 - DNA, 20 bp, Artificial Sequence
  chemically synthesized
tatcagctcagcagcggtat

SEQ ID NO: 216921 - DNA, 20 bp, Artificial Sequence
  chemically synthesized
gagaatctaataccgctgct

SEQ ID NO: 216922 - DNA, 20 bp, Artificial Sequence
  chemically synthesized
accttctatcagctcagcag

SEQ ID NO: 216923 - DNA, 20 bp, Artificial Sequence
  chemically synthesized
tccaccttctatcagctcag

SEQ ID NO: 216924 - DNA, 20 bp, Artificial Sequence
  chemically synthesized
taataccgctgctgagctga

SEQ ID NO: 216925 - DNA, 20 bp, Artificial Sequence
  chemically synthesized
agctccaccttctatcagct

SEQ ID NO: 216926 - DNA, 20 bp, Artificial Sequence
  chemically synthesized
taccgctgctgagctgatag

SEQ ID NO: 216927 - DNA, 20 bp, Artificial Sequence
  chemically synthesized
accgctgctgagctgataga

SEQ ID NO: 216928 - DNA, 20 bp, Artificial Sequence
  chemically synthesized
acttgagctccaccttctat

SEQ ID NO: 216929 - DNA, 20 bp, Artificial Sequence
  chemically synthesized
gctgctgagctgatagaagg

SEQ ID NO: 216930 - DNA, 20 bp, Artificial Sequence
  chemically synthesized
tgctgagctgatagaaggtg

SEQ ID NO: 216931 - DNA, 20 bp, Artificial Sequence
  chemically synthesized
gctgatagaaggtggagctc

SEQ ID NO: 216932 - DNA, 20 bp, Artificial Sequence
  chemically synthesized
gatagaaggtggagctcaag

SEQ ID NO: 216933 - DNA, 20 bp, Artificial Sequence
  chemically synthesized
ggccgccagcattaccactt

SEQ ID NO: 216934 - DNA, 20 bp, Artificial Sequence
  chemically synthesized
tggagctcaagtggtaatgc

SEQ ID NO: 216935 - DNA, 20 bp, Artificial Sequence
  chemically synthesized
agctcaagtggtaatgctgg

SEQ ID NO: 216936 - DNA, 20 bp, Artificial Sequence
  chemically synthesized
gaggtgagctgcagggccgc

SEQ ID NO: 216937 - DNA, 20 bp, Artificial Sequence
  chemically synthesized
tggtaatgctggcggccctg

SEQ ID NO: 216938 - DNA, 20 bp, Artificial Sequence
  chemically synthesized
acatcaggaggtgagctgca

SEQ ID NO: 216939 - DNA, 20 bp, Artificial Sequence
  chemically synthesized
cacatcaggaggtgagctgc

SEQ ID NO: 216940 - DNA, 20 bp, Artificial Sequence
  chemically synthesized
ccacatcaggaggtgagctg

SEQ ID NO: 216941 - DNA, 20 bp, Artificial Sequence
  chemically synthesized
ggggccccacatcaggaggt

SEQ ID NO: 216942 - DNA, 20 bp, Artificial Sequence
  chemically synthesized
ctgcagctcacctcctgatg

SEQ ID NO: 216943 - DNA, 20 bp, Artificial Sequence
  chemically synthesized
aaccggggccccacatcagg

SEQ ID NO: 216944 - DNA, 20 bp, Artificial Sequence
  chemically synthesized
tgcagctcacctcctgatgt

SEQ ID NO: 216945 - DNA, 20 bp, Artificial Sequence
  chemically synthesized
gaaccggggccccacatcag

SEQ ID NO: 216946 - DNA, 20 bp, Artificial Sequence
  chemically synthesized
gcagctcacctcctgatgtg

SEQ ID NO: 216947 - DNA, 20 bp, Artificial Sequence
  chemically synthesized
aggaaccggggccccacatc

SEQ ID NO: 216948 - DNA, 20 bp, Artificial Sequence
  chemically synthesized
taggaaccggggccccacat

SEQ ID NO: 216949 - DNA, 20 bp, Artificial Sequence
  chemically synthesized
cacctcctgatgtggggccc

SEQ ID NO: 216950 - DNA, 20 bp, Artificial Sequence
  chemically synthesized
cagtgacctgttaggaaccg

SEQ ID NO: 216951 - DNA, 20 bp, Artificial Sequence
  chemically synthesized
tcagtgacctgttaggaacc

SEQ ID NO: 216952 - DNA, 20 bp, Artificial Sequence
  chemically synthesized
gtcagtgacctgttaggaac

SEQ ID NO: 216953 - DNA, 20 bp, Artificial Sequence
  chemically synthesized
tgtggggccccggttcctaa

SEQ ID NO: 216954 - DNA, 20 bp, Artificial Sequence
  chemically synthesized
gtggggccccggttcctaac

SEQ ID NO: 216955 - DNA, 20 bp, Artificial Sequence
  chemically synthesized
gtacaggtcagtgacctgtt

SEQ ID NO: 216956 - DNA, 20 bp, Artificial Sequence
  chemically synthesized
agtacaggtcagtgacctgt

SEQ ID NO: 216957 - DNA, 20 bp, Artificial Sequence
  chemically synthesized
ggccacagaccagtacaggt

SEQ ID NO: 216958 - DNA, 20 bp, Artificial Sequence
  chemically synthesized
aacaggtcactgacctgtac

SEQ ID NO: 216959 - DNA, 20 bp, Artificial Sequence
  chemically synthesized
ctggggccacagaccagtac

SEQ ID NO: 216960 - DNA, 20 bp, Artificial Sequence
  chemically synthesized
cctggggccacagaccagta

SEQ ID NO: 216961 - DNA, 20 bp, Artificial Sequence
  chemically synthesized
cactgacctgtactggtctg

SEQ ID NO: 216962 - DNA, 20 bp, Artificial Sequence
  chemically synthesized
ccagccctggggccacagac

SEQ ID NO: 216963 - DNA, 20 bp, Artificial Sequence
  chemically synthesized
cctgtactggtctgtggccc

SEQ ID NO: 216964 - DNA, 20 bp, Artificial Sequence
  chemically synthesized
ctgtactggtctgtggcccc

SEQ ID NO: 216965 - DNA, 20 bp, Artificial Sequence
  chemically synthesized
ggtccccagccctggggcca

SEQ ID NO: 216966 - DNA, 20 bp, Artificial Sequence
  chemically synthesized
tgtactggtctgtggcccca

SEQ ID NO: 216967 - DNA, 20 bp, Artificial Sequence
  chemically synthesized
ctggtctgtggccccagggc

SEQ ID NO: 216968 - DNA, 20 bp, Artificial Sequence
  chemically synthesized
tggtctgtggccccagggct

SEQ ID NO: 216969 - DNA, 20 bp, Artificial Sequence
  chemically synthesized
agcaagggtccccagccctg

SEQ ID NO: 216970 - DNA, 20 bp, Artificial Sequence
  chemically synthesized
ggtctgtggccccagggctg

SEQ ID NO: 216971 - DNA, 20 bp, Artificial Sequence
  chemically synthesized
gagcaagggtccccagccct

SEQ ID NO: 216972 - DNA, 20 bp, Artificial Sequence
  chemically synthesized
agagcaagggtccccagccc

SEQ ID NO: 216973 - DNA, 20 bp, Artificial Sequence
  chemically synthesized
cactatagagcaagggtccc

SEQ ID NO: 216974 - DNA, 20 bp, Artificial Sequence
  chemically synthesized
cttttaacactatagagcaa

SEQ ID NO: 216975 - DNA, 20 bp, Artificial Sequence
  chemically synthesized
ggctggggacccttgctcta

SEQ ID NO: 216976 - DNA, 20 bp, Artificial Sequence
  chemically synthesized
gcttttaacactatagagca

SEQ ID NO: 216977 - DNA, 20 bp, Artificial Sequence
  chemically synthesized
ggcttttaacactatagagc

SEQ ID NO: 216978 - DNA, 20 bp, Artificial Sequence
  chemically synthesized
ctttggcttttaacactata

SEQ ID NO: 216979 - DNA, 20 bp, Artificial Sequence
  chemically synthesized
tcctttggcttttaacacta

SEQ ID NO: 216980 - DNA, 20 bp, Artificial Sequence
  chemically synthesized
cccttgctctatagtgttaa

SEQ ID NO: 216981 - DNA, 20 bp, Artificial Sequence
  chemically synthesized
ctctatagtgttaaaagcca

SEQ ID NO: 216982 - DNA, 20 bp, Artificial Sequence
  chemically synthesized
tctatagtgttaaaagccaa

SEQ ID NO: 216983 - DNA, 20 bp, Artificial Sequence
  chemically synthesized
tagtgttaaaagccaaagga

SEQ ID NO: 216984 - DNA, 20 bp, Artificial Sequence
  chemically synthesized
gtgatctgcccgctttcctt

SEQ ID NO: 216985 - DNA, 20 bp, Artificial Sequence
  chemically synthesized
tgttaaaagccaaaggaaag

SEQ ID NO: 216986 - DNA, 20 bp, Artificial Sequence
  chemically synthesized
gttaaaagccaaaggaaagc

SEQ ID NO: 216987 - DNA, 20 bp, Artificial Sequence
  chemically synthesized
aaaagccaaaggaaagcggg

SEQ ID NO: 216988 - DNA, 20 bp, Artificial Sequence
  chemically synthesized
ggaaagcgggcagatcactt

SEQ ID NO: 216989 - DNA, 20 bp, Artificial Sequence
  chemically synthesized
gaaagcgggcagatcacttg

SEQ ID NO: 216990 - DNA, 20 bp, Artificial Sequence
  chemically synthesized
gcgggcagatcacttgaggt

SEQ ID NO: 216991 - DNA, 20 bp, Artificial Sequence
  chemically synthesized
cgggcagatcacttgaggtc

SEQ ID NO: 216992 - DNA, 20 bp, Artificial Sequence
  chemically synthesized
gatctcaaacgcctgacctc

SEQ ID NO: 216993 - DNA, 20 bp, Artificial Sequence
  chemically synthesized
tcacttgaggtcaggcgttt

SEQ ID NO: 216994 - DNA, 20 bp, Artificial Sequence
  chemically synthesized
tgaggtcaggcgtttgagat

SEQ ID NO: 216995 - DNA, 20 bp, Artificial Sequence
  chemically synthesized
tcaggcgtttgagatcagtc

SEQ ID NO: 216996 - DNA, 20 bp, Artificial Sequence
  chemically synthesized
caggcgtttgagatcagtct

SEQ ID NO: 216997 - DNA, 20 bp, Artificial Sequence
  chemically synthesized
tgagatcagtctgggcaaca

SEQ ID NO: 216998 - DNA, 20 bp, Artificial Sequence
  chemically synthesized
cagggtttcaccatgttgcc

SEQ ID NO: 216999 - DNA, 20 bp, Artificial Sequence
  chemically synthesized
ttgcatttttagtagagaca

SEQ ID NO: 217000 - DNA, 20 bp, Artificial Sequence
  chemically synthesized
tttgcatttttagtagagac

SEQ ID NO: 217001 - DNA, 20 bp, Artificial Sequence
  chemically synthesized
ttttgcatttttagtagaga

SEQ ID NO: 217002 - DNA, 20 bp, Artificial Sequence
  chemically synthesized
taagttttgcatttttagta

SEQ ID NO: 217003 - DNA, 20 bp, Artificial Sequence
  chemically synthesized
gctaagttttgcatttttag

SEQ ID NO: 217004 - DNA, 20 bp, Artificial Sequence
  chemically synthesized
cctgctaagttttgcatttt

SEQ ID NO: 217005 - DNA, 20 bp, Artificial Sequence
  chemically synthesized
tctactaaaaatgcaaaact

SEQ ID NO: 217006 - DNA, 20 bp, Artificial Sequence
  chemically synthesized
actaaaaatgcaaaacttag

SEQ ID NO: 217007 - DNA, 20 bp, Artificial Sequence
  chemically synthesized
ctaaaaatgcaaaacttagc

SEQ ID NO: 217008 - DNA, 20 bp, Artificial Sequence
  chemically synthesized
taaaaatgcaaaacttagca

SEQ ID NO: 217009 - DNA, 20 bp, Artificial Sequence
  chemically synthesized
tggcgccaccaggccctgct

SEQ ID NO: 217010 - DNA, 20 bp, Artificial Sequence
  chemically synthesized
atgcaaaacttagcagggcc

SEQ ID NO: 217011 - DNA, 20 bp, Artificial Sequence
  chemically synthesized
caaaacttagcagggcctgg

SEQ ID NO: 217012 - DNA, 20 bp, Artificial Sequence
  chemically synthesized
acaggtgctctggcgccacc

SEQ ID NO: 217013 - DNA, 20 bp, Artificial Sequence
  chemically synthesized
ttagcagggcctggtggcgc

SEQ ID NO: 217014 - DNA, 20 bp, Artificial Sequence
  chemically synthesized
tacaggtgctctggcgccac

SEQ ID NO: 217015 - DNA, 20 bp, Artificial Sequence
  chemically synthesized
agcagggcctggtggcgcca

SEQ ID NO: 217016 - DNA, 20 bp, Artificial Sequence
  chemically synthesized
agctgggattacaggtgctc

SEQ ID NO: 217017 - DNA, 20 bp, Artificial Sequence
  chemically synthesized
cgccagagcacctgtaatcc

SEQ ID NO: 217018 - DNA, 20 bp, Artificial Sequence
  chemically synthesized
tcccaagtagctgggattac

SEQ ID NO: 217019 - DNA, 20 bp, Artificial Sequence
  chemically synthesized
ctcccaagtagctgggatta

SEQ ID NO: 217020 - DNA, 20 bp, Artificial Sequence
  chemically synthesized
cacctgtaatcccagctact

SEQ ID NO: 217021 - DNA, 20 bp, Artificial Sequence
  chemically synthesized
ccacagcctcccaagtagct

SEQ ID NO: 217022 - DNA, 20 bp, Artificial Sequence
  chemically synthesized
acctgtaatcccagctactt

SEQ ID NO: 217023 - DNA, 20 bp, Artificial Sequence
  chemically synthesized
gccacagcctcccaagtagc

SEQ ID NO: 217024 - DNA, 20 bp, Artificial Sequence
  chemically synthesized
ctgtaatcccagctacttgg

SEQ ID NO: 217025 - DNA, 20 bp, Artificial Sequence
  chemically synthesized
tgtaatcccagctacttggg

SEQ ID NO: 217026 - DNA, 20 bp, Artificial Sequence
  chemically synthesized
tcatgccacagcctcccaag

SEQ ID NO: 217027 - DNA, 20 bp, Artificial Sequence
  chemically synthesized
ttctcatgccacagcctccc

SEQ ID NO: 217028 - DNA, 20 bp, Artificial Sequence
  chemically synthesized
cccagctacttgggaggctg

SEQ ID NO: 217029 - DNA, 20 bp, Artificial Sequence
  chemically synthesized
tacttgggaggctgtggcat

SEQ ID NO: 217030 - DNA, 20 bp, Artificial Sequence
  chemically synthesized
ttcaggtgattctcatgcca

SEQ ID NO: 217031 - DNA, 20 bp, Artificial Sequence
  chemically synthesized
gcatgagaatcacctgaacc

SEQ ID NO: 217032 - DNA, 20 bp, Artificial Sequence
  chemically synthesized
catgagaatcacctgaacct

SEQ ID NO: 217033 - DNA, 20 bp, Artificial Sequence
  chemically synthesized
aacctccgcgtcccaggttc

SEQ ID NO: 217034 - DNA, 20 bp, Artificial Sequence
  chemically synthesized
aaacctccgcgtcccaggtt

SEQ ID NO: 217035 - DNA, 20 bp, Artificial Sequence
  chemically synthesized
aatcacctgaacctgggacg

SEQ ID NO: 217036 - DNA, 20 bp, Artificial Sequence
  chemically synthesized
cactgaaacctccgcgtccc

SEQ ID NO: 217037 - DNA, 20 bp, Artificial Sequence
  chemically synthesized
tcacctgaacctgggacgcg

SEQ ID NO: 217038 - DNA, 20 bp, Artificial Sequence
  chemically synthesized
tcactgaaacctccgcgtcc

SEQ ID NO: 217039 - DNA, 20 bp, Artificial Sequence
  chemically synthesized
cacctgaacctgggacgcgg

SEQ ID NO: 217040 - DNA, 20 bp, Artificial Sequence
  chemically synthesized
aacctgggacgcggaggttt

SEQ ID NO: 217041 - DNA, 20 bp, Artificial Sequence
  chemically synthesized
tgggacgcggaggtttcagt

SEQ ID NO: 217042 - DNA, 20 bp, Artificial Sequence
  chemically synthesized
cgcggaggtttcagtgagct

SEQ ID NO: 217043 - DNA, 20 bp, Artificial Sequence
  chemically synthesized
gaagtgccctgggatgatct

SEQ ID NO: 217044 - DNA, 20 bp, Artificial Sequence
  chemically synthesized
tcagtgagcttagatcatcc

SEQ ID NO: 217045 - DNA, 20 bp, Artificial Sequence
  chemically synthesized
cagtgagcttagatcatccc

SEQ ID NO: 217046 - DNA, 20 bp, Artificial Sequence
  chemically synthesized
agtgagcttagatcatccca

SEQ ID NO: 217047 - DNA, 20 bp, Artificial Sequence
  chemically synthesized
tcatccaggtgaagtgccct

SEQ ID NO: 217048 - DNA, 20 bp, Artificial Sequence
  chemically synthesized
gtcatccaggtgaagtgccc

SEQ ID NO: 217049 - DNA, 20 bp, Artificial Sequence
  chemically synthesized
tcatcccagggcacttcacc

SEQ ID NO: 217050 - DNA, 20 bp, Artificial Sequence
  chemically synthesized
ctcactctgtcatccaggtg

SEQ ID NO: 217051 - DNA, 20 bp, Artificial Sequence
  chemically synthesized
agggcacttcacctggatga

SEQ ID NO: 217052 - DNA, 20 bp, Artificial Sequence
  chemically synthesized
actgtctcactctgtcatcc

SEQ ID NO: 217053 - DNA, 20 bp, Artificial Sequence
  chemically synthesized
ggcacttcacctggatgaca

SEQ ID NO: 217054 - DNA, 20 bp, Artificial Sequence
  chemically synthesized
aactgtctcactctgtcatc

SEQ ID NO: 217055 - DNA, 20 bp, Artificial Sequence
  chemically synthesized
cttcacctggatgacagagt

SEQ ID NO: 217056 - DNA, 20 bp, Artificial Sequence
  chemically synthesized
acctggatgacagagtgaga

SEQ ID NO: 217057 - DNA, 20 bp, Artificial Sequence
  chemically synthesized
agttaaaaaaaaaaaaaaaa

SEQ ID NO: 217058 - DNA, 20 bp, Artificial Sequence
  chemically synthesized
aaaaaaaaaaaaaaagccaa

SEQ ID NO: 217059 - DNA, 20 bp, Artificial Sequence
  chemically synthesized
aaaaaaaaaaaaaagccaaa

SEQ ID NO: 217060 - DNA, 20 bp, Artificial Sequence
  chemically synthesized
aaaaaaaaagccaaaaggat

SEQ ID NO: 217061 - DNA, 20 bp, Artificial Sequence
  chemically synthesized
cctctgtgctctaatccttt

SEQ ID NO: 217062 - DNA, 20 bp, Artificial Sequence
  chemically synthesized
aaaaaaagccaaaaggatta

SEQ ID NO: 217063 - DNA, 20 bp, Artificial Sequence
  chemically synthesized
aagccaaaaggattagagca

SEQ ID NO: 217064 - DNA, 20 bp, Artificial Sequence
  chemically synthesized
gccaaaaggattagagcaca

SEQ ID NO: 217065 - DNA, 20 bp, Artificial Sequence
  chemically synthesized
ccaaaaggattagagcacag

SEQ ID NO: 217066 - DNA, 20 bp, Artificial Sequence
  chemically synthesized
aggattagagcacagaggat

SEQ ID NO: 217067 - DNA, 20 bp, Artificial Sequence
  chemically synthesized
attagagcacagaggattgg

SEQ ID NO: 217068 - DNA, 20 bp, Artificial Sequence
  chemically synthesized
cacagaggattggcagtctt

SEQ ID NO: 217069 - DNA, 20 bp, Artificial Sequence
  chemically synthesized
atagggttacgttagttctc

SEQ ID NO: 217070 - DNA, 20 bp, Artificial Sequence
  chemically synthesized
ccttgcaaatagggttacgt

SEQ ID NO: 217071 - DNA, 20 bp, Artificial Sequence
  chemically synthesized
actaacgtaaccctatttgc

SEQ ID NO: 217072 - DNA, 20 bp, Artificial Sequence
  chemically synthesized
atactgtcaccttgcaaata

SEQ ID NO: 217073 - DNA, 20 bp, Artificial Sequence
  chemically synthesized
ctaacgtaaccctatttgca

SEQ ID NO: 217074 - DNA, 20 bp, Artificial Sequence
  chemically synthesized
catactgtcaccttgcaaat

SEQ ID NO: 217075 - DNA, 20 bp, Artificial Sequence
  chemically synthesized
acatactgtcaccttgcaaa

SEQ ID NO: 217076 - DNA, 20 bp, Artificial Sequence
  chemically synthesized
taaccctatttgcaaggtga

SEQ ID NO: 217077 - DNA, 20 bp, Artificial Sequence
  chemically synthesized
gtatgtatattgaactgtat

SEQ ID NO: 217078 - DNA, 20 bp, Artificial Sequence
  chemically synthesized
tatgtatattgaactgtatc

SEQ ID NO: 217079 - DNA, 20 bp, Artificial Sequence
  chemically synthesized
gctgcattgcggacctgata

SEQ ID NO: 217080 - DNA, 20 bp, Artificial Sequence
  chemically synthesized
actgtatcaggtccgcaatg

SEQ ID NO: 217081 - DNA, 20 bp, Artificial Sequence
  chemically synthesized
ttatacgaaaggctgcattg

SEQ ID NO: 217082 - DNA, 20 bp, Artificial Sequence
  chemically synthesized
taggagcctagttatacgaa

SEQ ID NO: 217083 - DNA, 20 bp, Artificial Sequence
  chemically synthesized
ctaggagcctagttatacga

SEQ ID NO: 217084 - DNA, 20 bp, Artificial Sequence
  chemically synthesized
aatgcagcctttcgtataac

SEQ ID NO: 217085 - DNA, 20 bp, Artificial Sequence
  chemically synthesized
atgcagcctttcgtataact

SEQ ID NO: 217086 - DNA, 20 bp, Artificial Sequence
  chemically synthesized
ctttcgtataactaggctcc

SEQ ID NO: 217087 - DNA, 20 bp, Artificial Sequence
  chemically synthesized
atacaaccgcactaggagcc

SEQ ID NO: 217088 - DNA, 20 bp, Artificial Sequence
  chemically synthesized
gtataactaggctcctagtg

SEQ ID NO: 217089 - DNA, 20 bp, Artificial Sequence
  chemically synthesized
ttagcatacaaccgcactag

SEQ ID NO: 217090 - DNA, 20 bp, Artificial Sequence
  chemically synthesized
gattagcatacaaccgcact

SEQ ID NO: 217091 - DNA, 20 bp, Artificial Sequence
  chemically synthesized
ggattagcatacaaccgcac

SEQ ID NO: 217092 - DNA, 20 bp, Artificial Sequence
  chemically synthesized
gtgcggttgtatgctaatcc

SEQ ID NO: 217093 - DNA, 20 bp, Artificial Sequence
  chemically synthesized
cttggttttaggactaggat

SEQ ID NO: 217094 - DNA, 20 bp, Artificial Sequence
  chemically synthesized
ctaatcttggttttaggact

SEQ ID NO: 217095 - DNA, 20 bp, Artificial Sequence
  chemically synthesized
cctaatcttggttttaggac

SEQ ID NO: 217096 - DNA, 20 bp, Artificial Sequence
  chemically synthesized
ctaatcctagtcctaaaacc

SEQ ID NO: 217097 - DNA, 20 bp, Artificial Sequence
  chemically synthesized
ttttgcctaatcttggtttt

SEQ ID NO: 217098 - DNA, 20 bp, Artificial Sequence
  chemically synthesized
tttttgcctaatcttggttt

SEQ ID NO: 217099 - DNA, 20 bp, Artificial Sequence
  chemically synthesized
cctagtcctaaaaccaagat

SEQ ID NO: 217100 - DNA, 20 bp, Artificial Sequence
  chemically synthesized
ctagtcctaaaaccaagatt

SEQ ID NO: 217101 - DNA, 20 bp, Artificial Sequence
  chemically synthesized
agtctgtttttgcctaatct

SEQ ID NO: 217102 - DNA, 20 bp, Artificial Sequence
  chemically synthesized
aaaccaagattaggcaaaaa

SEQ ID NO: 217103 - DNA, 20 bp, Artificial Sequence
  chemically synthesized
gattaggcaaaaacagactt

SEQ ID NO: 217104 - DNA, 20 bp, Artificial Sequence
  chemically synthesized
ccttgactcaaatgaatctc

SEQ ID NO: 217105 - DNA, 20 bp, Artificial Sequence
  chemically synthesized
aacagacttgagattcattt

SEQ ID NO: 217106 - DNA, 20 bp, Artificial Sequence
  chemically synthesized
acttgagattcatttgagtc

SEQ ID NO: 217107 - DNA, 20 bp, Artificial Sequence
  chemically synthesized
cttgagattcatttgagtca

SEQ ID NO: 217108 - DNA, 20 bp, Artificial Sequence
  chemically synthesized
tgagtcaaggtcccattact

SEQ ID NO: 217109 - DNA, 20 bp, Artificial Sequence
  chemically synthesized
ctcaggagttactgagtaat

SEQ ID NO: 217110 - DNA, 20 bp, Artificial Sequence
  chemically synthesized
tctcaggagttactgagtaa

SEQ ID NO: 217111 - DNA, 20 bp, Artificial Sequence
  chemically synthesized
tgttcatctcaggagttact

SEQ ID NO: 217112 - DNA, 20 bp, Artificial Sequence
  chemically synthesized
cccattactcagtaactcct

SEQ ID NO: 217113 - DNA, 20 bp, Artificial Sequence
  chemically synthesized
gggcattgtgttcatctcag

SEQ ID NO: 217114 - DNA, 20 bp, Artificial Sequence
  chemically synthesized
atgggcattgtgttcatctc

SEQ ID NO: 217115 - DNA, 20 bp, Artificial Sequence
  chemically synthesized
tatgggcattgtgttcatct

SEQ ID NO: 217116 - DNA, 20 bp, Artificial Sequence
  chemically synthesized
cggagatcctagttatatat

SEQ ID NO: 217117 - DNA, 20 bp, Artificial Sequence
  chemically synthesized
ccggagatcctagttatata

SEQ ID NO: 217118 - DNA, 20 bp, Artificial Sequence
  chemically synthesized
acacaatgcccatatataac

SEQ ID NO: 217119 - DNA, 20 bp, Artificial Sequence
  chemically synthesized
cacaatgcccatatataact

SEQ ID NO: 217120 - DNA, 20 bp, Artificial Sequence
  chemically synthesized
ccatatataactaggatctc

SEQ ID NO: 217121 - DNA, 20 bp, Artificial Sequence
  chemically synthesized
tgagggtacaccggagatcc

SEQ ID NO: 217122 - DNA, 20 bp, Artificial Sequence
  chemically synthesized
cagaagatgagggtacaccg

SEQ ID NO: 217123 - DNA, 20 bp, Artificial Sequence
  chemically synthesized
atcagaagatgagggtacac

SEQ ID NO: 217124 - DNA, 20 bp, Artificial Sequence
  chemically synthesized
gaggcagtatcagaagatga

SEQ ID NO: 217125 - DNA, 20 bp, Artificial Sequence
  chemically synthesized
ggaggcagtatcagaagatg

SEQ ID NO: 217126 - DNA, 20 bp, Artificial Sequence
  chemically synthesized
aggaggcagtatcagaagat

SEQ ID NO: 217127 - DNA, 20 bp, Artificial Sequence
  chemically synthesized
tgagaaggaggcagtatcag

SEQ ID NO: 217128 - DNA, 20 bp, Artificial Sequence
  chemically synthesized
aaatgagaaggaggcagtat

SEQ ID NO: 217129 - DNA, 20 bp, Artificial Sequence
  chemically synthesized
caaggcaaatgagaaggagg

SEQ ID NO: 217130 - DNA, 20 bp, Artificial Sequence
  chemically synthesized
ggacaaggcaaatgagaagg

SEQ ID NO: 217131 - DNA, 20 bp, Artificial Sequence
  chemically synthesized
tggacaaggcaaatgagaag

SEQ ID NO: 217132 - DNA, 20 bp, Artificial Sequence
  chemically synthesized
agtggacaaggcaaatgaga

SEQ ID NO: 217133 - DNA, 20 bp, Artificial Sequence
  chemically synthesized
cagtggacaaggcaaatgag

SEQ ID NO: 217134 - DNA, 20 bp, Artificial Sequence
  chemically synthesized
tcacagtggacaaggcaaat

SEQ ID NO: 217135 - DNA, 20 bp, Artificial Sequence
  chemically synthesized
gggccacatcacagtggaca

SEQ ID NO: 217136 - DNA, 20 bp, Artificial Sequence
  chemically synthesized
agggccacatcacagtggac

SEQ ID NO: 217137 - DNA, 20 bp, Artificial Sequence
  chemically synthesized
cagaaagggccacatcacag

SEQ ID NO: 217138 - DNA, 20 bp, Artificial Sequence
  chemically synthesized
ttgccttgtccactgtgatg

SEQ ID NO: 217139 - DNA, 20 bp, Artificial Sequence
  chemically synthesized
agacagaaagggccacatca

SEQ ID NO: 217140 - DNA, 20 bp, Artificial Sequence
  chemically synthesized
atctacatggaagacagaaa

SEQ ID NO: 217141 - DNA, 20 bp, Artificial Sequence
  chemically synthesized
catctacatggaagacagaa

SEQ ID NO: 217142 - DNA, 20 bp, Artificial Sequence
  chemically synthesized
gcatctacatggaagacaga

SEQ ID NO: 217143 - DNA, 20 bp, Artificial Sequence
  chemically synthesized
ttatgcatctacatggaaga

SEQ ID NO: 217144 - DNA, 20 bp, Artificial Sequence
  chemically synthesized
ggccctttctgtcttccatg

SEQ ID NO: 217145 - DNA, 20 bp, Artificial Sequence
  chemically synthesized
ggctttatgcatctacatgg

SEQ ID NO: 217146 - DNA, 20 bp, Artificial Sequence
  chemically synthesized
tagggctttatgcatctaca

SEQ ID NO: 217147 - DNA, 20 bp, Artificial Sequence
  chemically synthesized
gtcttccatgtagatgcata

SEQ ID NO: 217148 - DNA, 20 bp, Artificial Sequence
  chemically synthesized
gatgcataaagccctatacc

SEQ ID NO: 217149 - DNA, 20 bp, Artificial Sequence
  chemically synthesized
tgtttgcagtgcttggtata

SEQ ID NO: 217150 - DNA, 20 bp, Artificial Sequence
  chemically synthesized
atgtttgcagtgcttggtat

SEQ ID NO: 217151 - DNA, 20 bp, Artificial Sequence
  chemically synthesized
tatgtttgcagtgcttggta

SEQ ID NO: 217152 - DNA, 20 bp, Artificial Sequence
  chemically synthesized
agctatatgtttgcagtgct

SEQ ID NO: 217153 - DNA, 20 bp, Artificial Sequence
  chemically synthesized
ccttctcagctatatgtttg

SEQ ID NO: 217154 - DNA, 20 bp, Artificial Sequence
  chemically synthesized
taccaagcactgcaaacata

SEQ ID NO: 217155 - DNA, 20 bp, Artificial Sequence
  chemically synthesized
agcactgcaaacatatagct

SEQ ID NO: 217156 - DNA, 20 bp, Artificial Sequence
  chemically synthesized
actgcaaacatatagctgag

SEQ ID NO: 217157 - DNA, 20 bp, Artificial Sequence
  chemically synthesized
ctgcaaacatatagctgaga

SEQ ID NO: 217158 - DNA, 20 bp, Artificial Sequence
  chemically synthesized
ctggaggctgaggaccttct

SEQ ID NO: 217159 - DNA, 20 bp, Artificial Sequence
  chemically synthesized
catatagctgagaaggtcct

SEQ ID NO: 217160 - DNA, 20 bp, Artificial Sequence
  chemically synthesized
ctgagaaggtcctcagcctc

SEQ ID NO: 217161 - DNA, 20 bp, Artificial Sequence
  chemically synthesized
aagtaagtttctggaggctg

SEQ ID NO: 217162 - DNA, 20 bp, Artificial Sequence
  chemically synthesized
aaagtaagtttctggaggct

SEQ ID NO: 217163 - DNA, 20 bp, Artificial Sequence
  chemically synthesized
agacaaaagtaagtttctgg

SEQ ID NO: 217164 - DNA, 20 bp, Artificial Sequence
  chemically synthesized
aagacaaaagtaagtttctg

SEQ ID NO: 217165 - DNA, 20 bp, Artificial Sequence
  chemically synthesized
ttaagacaaaagtaagtttc

SEQ ID NO: 217166 - DNA, 20 bp, Artificial Sequence
  chemically synthesized
gatgtggttaagacaaaagt

SEQ ID NO: 217167 - DNA, 20 bp, Artificial Sequence
  chemically synthesized
atcagatgtggttaagacaa

SEQ ID NO: 217168 - DNA, 20 bp, Artificial Sequence
  chemically synthesized
aacatcaatcagatgtggtt

SEQ ID NO: 217169 - DNA, 20 bp, Artificial Sequence
  chemically synthesized
agataaacatcaatcagatg

SEQ ID NO: 217170 - DNA, 20 bp, Artificial Sequence
  chemically synthesized
acccatagataaacatcaat

SEQ ID NO: 217171 - DNA, 20 bp, Artificial Sequence
  chemically synthesized
atctgattgatgtttatcta

SEQ ID NO: 217172 - DNA, 20 bp, Artificial Sequence
  chemically synthesized
tctgattgatgtttatctat

SEQ ID NO: 217173 - DNA, 20 bp, Artificial Sequence
  chemically synthesized
acagttcgcataaagaccca

SEQ ID NO: 217174 - DNA, 20 bp, Artificial Sequence
  chemically synthesized
aagaagaaacagttcgcata

SEQ ID NO: 217175 - DNA, 20 bp, Artificial Sequence
  chemically synthesized
ggtaattcagaaagaagaaa

SEQ ID NO: 217176 - DNA, 20 bp, Artificial Sequence
  chemically synthesized
gggaagggtaattcagaaag

SEQ ID NO: 217177 - DNA, 20 bp, Artificial Sequence
  chemically synthesized
gcagggaagggtaattcaga

SEQ ID NO: 217178 - DNA, 20 bp, Artificial Sequence
  chemically synthesized
gaaagcagggaagggtaatt

SEQ ID NO: 217179 - DNA, 20 bp, Artificial Sequence
  chemically synthesized
tgaagaatgaaagcagggaa

SEQ ID NO: 217180 - DNA, 20 bp, Artificial Sequence
  chemically synthesized
atgaagaatgaaagcaggga

SEQ ID NO: 217181 - DNA, 20 bp, Artificial Sequence
  chemically synthesized
aatgaagaatgaaagcaggg

SEQ ID NO: 217182 - DNA, 20 bp, Artificial Sequence
  chemically synthesized
caaaatgaagaatgaaagca

SEQ ID NO: 217183 - DNA, 20 bp, Artificial Sequence
  chemically synthesized
ccaaaatgaagaatgaaagc

SEQ ID NO: 217184 - DNA, 20 bp, Artificial Sequence
  chemically synthesized
cccaaaatgaagaatgaaag

SEQ ID NO: 217185 - DNA, 20 bp, Artificial Sequence
  chemically synthesized
agtcccaaaatgaagaatga

SEQ ID NO: 217186 - DNA, 20 bp, Artificial Sequence
  chemically synthesized
cctgctttcattcttcattt

SEQ ID NO: 217187 - DNA, 20 bp, Artificial Sequence
  chemically synthesized
ctgctttcattcttcatttt

SEQ ID NO: 217188 - DNA, 20 bp, Artificial Sequence
  chemically synthesized
gtggaatcagtcccaaaatg

SEQ ID NO: 217189 - DNA, 20 bp, Artificial Sequence
  chemically synthesized
tcattttgggactgattcca

SEQ ID NO: 217190 - DNA, 20 bp, Artificial Sequence
  chemically synthesized
gccacccagggctgtggaat

SEQ ID NO: 217191 - DNA, 20 bp, Artificial Sequence
  chemically synthesized
tgggactgattccacagccc

SEQ ID NO: 217192 - DNA, 20 bp, Artificial Sequence
  chemically synthesized
gggactgattccacagccct

SEQ ID NO: 217193 - DNA, 20 bp, Artificial Sequence
  chemically synthesized
gtgatggccacccagggctg

SEQ ID NO: 217194 - DNA, 20 bp, Artificial Sequence
  chemically synthesized
actgattccacagccctggg

SEQ ID NO: 217195 - DNA, 20 bp, Artificial Sequence
  chemically synthesized
cagggtgtgatggccaccca

SEQ ID NO: 217196 - DNA, 20 bp, Artificial Sequence
  chemically synthesized
acagggtgtgatggccaccc

SEQ ID NO: 217197 - DNA, 20 bp, Artificial Sequence
  chemically synthesized
cacagggtgtgatggccacc

SEQ ID NO: 217198 - DNA, 20 bp, Artificial Sequence
  chemically synthesized
agggtgaccacagggtgtga

SEQ ID NO: 217199 - DNA, 20 bp, Artificial Sequence
  chemically synthesized
tgggtggccatcacaccctg

SEQ ID NO: 217200 - DNA, 20 bp, Artificial Sequence
  chemically synthesized
cactgaaaagggtgaccaca

SEQ ID NO: 217201 - DNA, 20 bp, Artificial Sequence
  chemically synthesized
gcactgaaaagggtgaccac

SEQ ID NO: 217202 - DNA, 20 bp, Artificial Sequence
  chemically synthesized
tgcactgaaaagggtgacca

SEQ ID NO: 217203 - DNA, 20 bp, Artificial Sequence
  chemically synthesized
caccctgtggtcaccctttt

SEQ ID NO: 217204 - DNA, 20 bp, Artificial Sequence
  chemically synthesized
gcaagactgtgcactgaaaa

SEQ ID NO: 217205 - DNA, 20 bp, Artificial Sequence
  chemically synthesized
tgcaagactgtgcactgaaa

SEQ ID NO: 217206 - DNA, 20 bp, Artificial Sequence
  chemically synthesized
ttgcaagactgtgcactgaa

SEQ ID NO: 217207 - DNA, 20 bp, Artificial Sequence
  chemically synthesized
tggtcacccttttcagtgca

SEQ ID NO: 217208 - DNA, 20 bp, Artificial Sequence
  chemically synthesized
ctgtataatcaagtaattgc

SEQ ID NO: 217209 - DNA, 20 bp, Artificial Sequence
  chemically synthesized
cttgcaattacttgattata

SEQ ID NO: 217210 - DNA, 20 bp, Artificial Sequence
  chemically synthesized
ggcaagtcagctgtataatc

SEQ ID NO: 217211 - DNA, 20 bp, Artificial Sequence
  chemically synthesized
tcctagttgaggtggcaagt

SEQ ID NO: 217212 - DNA, 20 bp, Artificial Sequence
  chemically synthesized
cagctcctagttgaggtggc

SEQ ID NO: 217213 - DNA, 20 bp, Artificial Sequence
  chemically synthesized
agctgacttgccacctcaac

SEQ ID NO: 217214 - DNA, 20 bp, Artificial Sequence
  chemically synthesized
caaccagctcctagttgagg

SEQ ID NO: 217215 - DNA, 20 bp, Artificial Sequence
  chemically synthesized
gctgacttgccacctcaact

SEQ ID NO: 217216 - DNA, 20 bp, Artificial Sequence
  chemically synthesized
tgacttgccacctcaactag

SEQ ID NO: 217217 - DNA, 20 bp, Artificial Sequence
  chemically synthesized
cttcaaccagctcctagttg

SEQ ID NO: 217218 - DNA, 20 bp, Artificial Sequence
  chemically synthesized
ccttcaaccagctcctagtt

SEQ ID NO: 217219 - DNA, 20 bp, Artificial Sequence
  chemically synthesized
ttgccacctcaactaggagc

SEQ ID NO: 217220 - DNA, 20 bp, Artificial Sequence
  chemically synthesized
ccctcccttcaaccagctcc

SEQ ID NO: 217221 - DNA, 20 bp, Artificial Sequence
  chemically synthesized
cctcaactaggagctggttg

SEQ ID NO: 217222 - DNA, 20 bp, Artificial Sequence
  chemically synthesized
ctcaactaggagctggttga

SEQ ID NO: 217223 - DNA, 20 bp, Artificial Sequence
  chemically synthesized
tcaactaggagctggttgaa

SEQ ID NO: 217224 - DNA, 20 bp, Artificial Sequence
  chemically synthesized
acacagcccctcccttcaac

SEQ ID NO: 217225 - DNA, 20 bp, Artificial Sequence
  chemically synthesized
aactaggagctggttgaagg

SEQ ID NO: 217226 - DNA, 20 bp, Artificial Sequence
  chemically synthesized
actaggagctggttgaaggg

SEQ ID NO: 217227 - DNA, 20 bp, Artificial Sequence
  chemically synthesized
ctaggagctggttgaaggga

SEQ ID NO: 217228 - DNA, 20 bp, Artificial Sequence
  chemically synthesized
taggagctggttgaagggag

SEQ ID NO: 217229 - DNA, 20 bp, Artificial Sequence
  chemically synthesized
tgataaagagatgaaagaca

SEQ ID NO: 217230 - DNA, 20 bp, Artificial Sequence
  chemically synthesized
tgctggtgataaagagatga

SEQ ID NO: 217231 - DNA, 20 bp, Artificial Sequence
  chemically synthesized
tgcaatatgctggtgataaa

SEQ ID NO: 217232 - DNA, 20 bp, Artificial Sequence
  chemically synthesized
gtctttcatctctttatcac

SEQ ID NO: 217233 - DNA, 20 bp, Artificial Sequence
  chemically synthesized
tgtgcaatatgctggtgata

SEQ ID NO: 217234 - DNA, 20 bp, Artificial Sequence
  chemically synthesized
gtaggaactgtgcaatatgc

SEQ ID NO: 217235 - DNA, 20 bp, Artificial Sequence
  chemically synthesized
tttatcaccagcatattgca

SEQ ID NO: 217236 - DNA, 20 bp, Artificial Sequence
  chemically synthesized
tattgcacagttcctaccta

SEQ ID NO: 217237 - DNA, 20 bp, Artificial Sequence
  chemically synthesized
atcaactatcaactataggt

SEQ ID NO: 217238 - DNA, 20 bp, Artificial Sequence
  chemically synthesized
tatcaactatcaactatagg

SEQ ID NO: 217239 - DNA, 20 bp, Artificial Sequence
  chemically synthesized
agttatcaactatcaactat

SEQ ID NO: 217240 - DNA, 20 bp, Artificial Sequence
  chemically synthesized
cagttcctacctatagttga

SEQ ID NO: 217241 - DNA, 20 bp, Artificial Sequence
  chemically synthesized
aagttatcaactatcaacta

SEQ ID NO: 217242 - DNA, 20 bp, Artificial Sequence
  chemically synthesized
ctcgttcattcattcatcaa

SEQ ID NO: 217243 - DNA, 20 bp, Artificial Sequence
  chemically synthesized
cttttgatgaatgaatgaac

SEQ ID NO: 217244 - DNA, 20 bp, Artificial Sequence
  chemically synthesized
atgaatgaatgaacgagaat

SEQ ID NO: 217245 - DNA, 20 bp, Artificial Sequence
  chemically synthesized
agaatcagacattaaatttt

SEQ ID NO: 217246 - DNA, 20 bp, Artificial Sequence
  chemically synthesized
atcagacattaaattttcag

SEQ ID NO: 217247 - DNA, 20 bp, Artificial Sequence
  chemically synthesized
tcagacattaaattttcaga

SEQ ID NO: 217248 - DNA, 20 bp, Artificial Sequence
  chemically synthesized
aaattttcagaaggaaaaaa

SEQ ID NO: 217249 - DNA, 20 bp, Artificial Sequence
  chemically synthesized
aatccagacacatttgttta

SEQ ID NO: 217250 - DNA, 20 bp, Artificial Sequence
  chemically synthesized
gaatccagacacatttgttt

SEQ ID NO: 217251 - DNA, 20 bp, Artificial Sequence
  chemically synthesized
tatccttaaacaaatgtgtc

SEQ ID NO: 217252 - DNA, 20 bp, Artificial Sequence
  chemically synthesized
taaacaaatgtgtctggatt

SEQ ID NO: 217253 - DNA, 20 bp, Artificial Sequence
  chemically synthesized
acaaatgtgtctggattcag

SEQ ID NO: 217254 - DNA, 20 bp, Artificial Sequence
  chemically synthesized
gaaaatgattcttctgaatc

SEQ ID NO: 217255 - DNA, 20 bp, Artificial Sequence
  chemically synthesized
tttgtgagcataaagtcgaa

SEQ ID NO: 217256 - DNA, 20 bp, Artificial Sequence
  chemically synthesized
atttgtgagcataaagtcga

SEQ ID NO: 217257 - DNA, 20 bp, Artificial Sequence
  chemically synthesized
catttgtgagcataaagtcg

SEQ ID NO: 217258 - DNA, 20 bp, Artificial Sequence
  chemically synthesized
ccaacacatttgtgagcata

SEQ ID NO: 217259 - DNA, 20 bp, Artificial Sequence
  chemically synthesized
ctgaatcccaacacatttgt

SEQ ID NO: 217260 - DNA, 20 bp, Artificial Sequence
  chemically synthesized
ctttatgctcacaaatgtgt

SEQ ID NO: 217261 - DNA, 20 bp, Artificial Sequence
  chemically synthesized
tttatgctcacaaatgtgtt

SEQ ID NO: 217262 - DNA, 20 bp, Artificial Sequence
  chemically synthesized
ctcacaaatgtgttgggatt

SEQ ID NO: 217263 - DNA, 20 bp, Artificial Sequence
  chemically synthesized
acaaatgtgttgggattcag

SEQ ID NO: 217264 - DNA, 20 bp, Artificial Sequence
  chemically synthesized
gacaaggcaaatgaaaaggt

SEQ ID NO: 217265 - DNA, 20 bp, Artificial Sequence
  chemically synthesized
catggacaaggcaaatgaaa

SEQ ID NO: 217266 - DNA, 20 bp, Artificial Sequence
  chemically synthesized
acatggacaaggcaaatgaa

SEQ ID NO: 217267 - DNA, 20 bp, Artificial Sequence
  chemically synthesized
gaaaccatataacatggaca

SEQ ID NO: 217268 - DNA, 20 bp, Artificial Sequence
  chemically synthesized
agaaaccatataacatggac

SEQ ID NO: 217269 - DNA, 20 bp, Artificial Sequence
  chemically synthesized
tttgccttgtccatgttata

SEQ ID NO: 217270 - DNA, 20 bp, Artificial Sequence
  chemically synthesized
ctataagaaaccatataaca

SEQ ID NO: 217271 - DNA, 20 bp, Artificial Sequence
  chemically synthesized
ccatgttatatggtttctta

SEQ ID NO: 217272 - DNA, 20 bp, Artificial Sequence
  chemically synthesized
ttatatggtttcttatagcc

SEQ ID NO: 217273 - DNA, 20 bp, Artificial Sequence
  chemically synthesized
cactgctttagctaggctat

SEQ ID NO: 217274 - DNA, 20 bp, Artificial Sequence
  chemically synthesized
ggtttcttatagcctagcta

SEQ ID NO: 217275 - DNA, 20 bp, Artificial Sequence
  chemically synthesized
tgaaaaccactgctttagct

SEQ ID NO: 217276 - DNA, 20 bp, Artificial Sequence
  chemically synthesized
ttcttatagcctagctaaag

SEQ ID NO: 217277 - DNA, 20 bp, Artificial Sequence
  chemically synthesized
gtgaaaaccactgctttagc

SEQ ID NO: 217278 - DNA, 20 bp, Artificial Sequence
  chemically synthesized
ttatagcctagctaaagcag

SEQ ID NO: 217279 - DNA, 20 bp, Artificial Sequence
  chemically synthesized
tgctgtgaaaaccactgctt

SEQ ID NO: 217280 - DNA, 20 bp, Artificial Sequence
  chemically synthesized
agctaaagcagtggttttca

SEQ ID NO: 217281 - DNA, 20 bp, Artificial Sequence
  chemically synthesized
gtggttttcacagcatgatc

SEQ ID NO: 217282 - DNA, 20 bp, Artificial Sequence
  chemically synthesized
tggttttcacagcatgatca

SEQ ID NO: 217283 - DNA, 20 bp, Artificial Sequence
  chemically synthesized
tttcacagcatgatcaaggc

SEQ ID NO: 217284 - DNA, 20 bp, Artificial Sequence
  chemically synthesized
cacagcatgatcaaggccag

SEQ ID NO: 217285 - DNA, 20 bp, Artificial Sequence
  chemically synthesized
atgatcaaggccagcagcat

SEQ ID NO: 217286 - DNA, 20 bp, Artificial Sequence
  chemically synthesized
ccaggtgatgctgatgctgc

SEQ ID NO: 217287 - DNA, 20 bp, Artificial Sequence
  chemically synthesized
ccagcagcatcagcatcacc

SEQ ID NO: 217288 - DNA, 20 bp, Artificial Sequence
  chemically synthesized
tgcatttctagcaagttacc

SEQ ID NO: 217289 - DNA, 20 bp, Artificial Sequence
  chemically synthesized
ttgcatttctagcaagttac

SEQ ID NO: 217290 - DNA, 20 bp, Artificial Sequence
  chemically synthesized
agcatcacctggtaacttgc

SEQ ID NO: 217291 - DNA, 20 bp, Artificial Sequence
  chemically synthesized
ccagaatttgcatttctagc

SEQ ID NO: 217292 - DNA, 20 bp, Artificial Sequence
  chemically synthesized
aggtccagaatttgcatttc

SEQ ID NO: 217293 - DNA, 20 bp, Artificial Sequence
  chemically synthesized
cttgctagaaatgcaaattc

SEQ ID NO: 217294 - DNA, 20 bp, Artificial Sequence
  chemically synthesized
cagtaactttggtgcaggtc

SEQ ID NO: 217295 - DNA, 20 bp, Artificial Sequence
  chemically synthesized
caaattctggacctgcacca

SEQ ID NO: 217296 - DNA, 20 bp, Artificial Sequence
  chemically synthesized
tggtccagtaactttggtgc

SEQ ID NO: 217297 - DNA, 20 bp, Artificial Sequence
  chemically synthesized
ctggtccagtaactttggtg

SEQ ID NO: 217298 - DNA, 20 bp, Artificial Sequence
  chemically synthesized
tggacctgcaccaaagttac

SEQ ID NO: 217299 - DNA, 20 bp, Artificial Sequence
  chemically synthesized
agttgctggtccagtaactt

SEQ ID NO: 217300 - DNA, 20 bp, Artificial Sequence
  chemically synthesized
ctgcaccaaagttactggac

SEQ ID NO: 217301 - DNA, 20 bp, Artificial Sequence
  chemically synthesized
agccttcaaagttgctggtc

SEQ ID NO: 217302 - DNA, 20 bp, Artificial Sequence
  chemically synthesized
aggctagccttcaaagttgc

SEQ ID NO: 217303 - DNA, 20 bp, Artificial Sequence
  chemically synthesized
ttactggaccagcaactttg

SEQ ID NO: 217304 - DNA, 20 bp, Artificial Sequence
  chemically synthesized
tactggaccagcaactttga

SEQ ID NO: 217305 - DNA, 20 bp, Artificial Sequence
  chemically synthesized
ggaccagcaactttgaaggc

SEQ ID NO: 217306 - DNA, 20 bp, Artificial Sequence
  chemically synthesized
gattgctaggctagccttca

SEQ ID NO: 217307 - DNA, 20 bp, Artificial Sequence
  chemically synthesized
agcaactttgaaggctagcc

SEQ ID NO: 217308 - DNA, 20 bp, Artificial Sequence
  chemically synthesized
tataccacagattgctaggc

SEQ ID NO: 217309 - DNA, 20 bp, Artificial Sequence
  chemically synthesized
ttgctataccacagattgct

SEQ ID NO: 217310 - DNA, 20 bp, Artificial Sequence
  chemically synthesized
tttgctataccacagattgc

SEQ ID NO: 217311 - DNA, 20 bp, Artificial Sequence
  chemically synthesized
aaggctagcctagcaatctg

SEQ ID NO: 217312 - DNA, 20 bp, Artificial Sequence
  chemically synthesized
tagcctagcaatctgtggta

SEQ ID NO: 217313 - DNA, 20 bp, Artificial Sequence
  chemically synthesized
ctggagggtttgctatacca

SEQ ID NO: 217314 - DNA, 20 bp, Artificial Sequence
  chemically synthesized
ctgtggtatagcaaaccctc

SEQ ID NO: 217315 - DNA, 20 bp, Artificial Sequence
  chemically synthesized
tcacgtcagaatcagctgga

SEQ ID NO: 217316 - DNA, 20 bp, Artificial Sequence
  chemically synthesized
ctcacgtcagaatcagctgg

SEQ ID NO: 217317 - DNA, 20 bp, Artificial Sequence
  chemically synthesized
actcacgtcagaatcagctg

SEQ ID NO: 217318 - DNA, 20 bp, Artificial Sequence
  chemically synthesized
gtactcacgtcagaatcagc

SEQ ID NO: 217319 - DNA, 20 bp, Artificial Sequence
  chemically synthesized
agtagtactcacgtcagaat

SEQ ID NO: 217320 - DNA, 20 bp, Artificial Sequence
  chemically synthesized
cctccagctgattctgacgt

SEQ ID NO: 217321 - DNA, 20 bp, Artificial Sequence
  chemically synthesized
taggccagtagtactcacgt

SEQ ID NO: 217322 - DNA, 20 bp, Artificial Sequence
  chemically synthesized
gattctgacgtgagtactac

SEQ ID NO: 217323 - DNA, 20 bp, Artificial Sequence
  chemically synthesized
tgacgtgagtactactggcc

SEQ ID NO: 217324 - DNA, 20 bp, Artificial Sequence
  chemically synthesized
tagaagcaactctaggccag

SEQ ID NO: 217325 - DNA, 20 bp, Artificial Sequence
  chemically synthesized
acgtgagtactactggccta

SEQ ID NO: 217326 - DNA, 20 bp, Artificial Sequence
  chemically synthesized
tcttagaagcaactctaggc

SEQ ID NO: 217327 - DNA, 20 bp, Artificial Sequence
  chemically synthesized
aaagtcttagaagcaactct

SEQ ID NO: 217328 - DNA, 20 bp, Artificial Sequence
  chemically synthesized
caaagtcttagaagcaactc

SEQ ID NO: 217329 - DNA, 20 bp, Artificial Sequence
  chemically synthesized
actggcctagagttgcttct

SEQ ID NO: 217330 - DNA, 20 bp, Artificial Sequence
  chemically synthesized
tagttataccaaagtcttag

SEQ ID NO: 217331 - DNA, 20 bp, Artificial Sequence
  chemically synthesized
tagagttgcttctaagactt

SEQ ID NO: 217332 - DNA, 20 bp, Artificial Sequence
  chemically synthesized
tggtagttataccaaagtct

SEQ ID NO: 217333 - DNA, 20 bp, Artificial Sequence
  chemically synthesized
tctgactggtagttatacca

SEQ ID NO: 217334 - DNA, 20 bp, Artificial Sequence
  chemically synthesized
taagactttggtataactac

SEQ ID NO: 217335 - DNA, 20 bp, Artificial Sequence
  chemically synthesized
actttggtataactaccagt

SEQ ID NO: 217336 - DNA, 20 bp, Artificial Sequence
  chemically synthesized
aagacctagattctgactgg

SEQ ID NO: 217337 - DNA, 20 bp, Artificial Sequence
  chemically synthesized
gtgaagacctagattctgac

SEQ ID NO: 217338 - DNA, 20 bp, Artificial Sequence
  chemically synthesized
tataactaccagtcagaatc

SEQ ID NO: 217339 - DNA, 20 bp, Artificial Sequence
  chemically synthesized
ataactaccagtcagaatct

SEQ ID NO: 217340 - DNA, 20 bp, Artificial Sequence
  chemically synthesized
agtgtctgtgtgtgaagacc

SEQ ID NO: 217341 - DNA, 20 bp, Artificial Sequence
  chemically synthesized
agaatctaggtcttcacaca

SEQ ID NO: 217342 - DNA, 20 bp, Artificial Sequence
  chemically synthesized
tgaatcagtgtctgtgtgtg

SEQ ID NO: 217343 - DNA, 20 bp, Artificial Sequence
  chemically synthesized
ttcacacacagacactgatt

SEQ ID NO: 217344 - DNA, 20 bp, Artificial Sequence
  chemically synthesized
acacacagacactgattcag

SEQ ID NO: 217345 - DNA, 20 bp, Artificial Sequence
  chemically synthesized
cacacagacactgattcagt

SEQ ID NO: 217346 - DNA, 20 bp, Artificial Sequence
  chemically synthesized
tcatcccaaacctactgaat

SEQ ID NO: 217347 - DNA, 20 bp, Artificial Sequence
  chemically synthesized
agacactgattcagtaggtt

SEQ ID NO: 217348 - DNA, 20 bp, Artificial Sequence
  chemically synthesized
gacactgattcagtaggttt

SEQ ID NO: 217349 - DNA, 20 bp, Artificial Sequence
  chemically synthesized
gattcagtaggtttgggatg

SEQ ID NO: 217350 - DNA, 20 bp, Artificial Sequence
  chemically synthesized
attcagtaggtttgggatga

SEQ ID NO: 217351 - DNA, 20 bp, Artificial Sequence
  chemically synthesized
ttcagtaggtttgggatgaa

SEQ ID NO: 217352 - DNA, 20 bp, Artificial Sequence
  chemically synthesized
agtaggtttgggatgaaggg

SEQ ID NO: 217353 - DNA, 20 bp, Artificial Sequence
  chemically synthesized
gtaggtttgggatgaagggc

SEQ ID NO: 217354 - DNA, 20 bp, Artificial Sequence
  chemically synthesized
ggtttgggatgaagggcagg

SEQ ID NO: 217355 - DNA, 20 bp, Artificial Sequence
  chemically synthesized
gatgaagggcaggcagtcta

SEQ ID NO: 217356 - DNA, 20 bp, Artificial Sequence
  chemically synthesized
gggcagcttgataaaggctg

SEQ ID NO: 217357 - DNA, 20 bp, Artificial Sequence
  chemically synthesized
ggcagtctacagcctttatc

SEQ ID NO: 217358 - DNA, 20 bp, Artificial Sequence
  chemically synthesized
tcatctgggcagcttgataa

SEQ ID NO: 217359 - DNA, 20 bp, Artificial Sequence
  chemically synthesized
atcatctgggcagcttgata

SEQ ID NO: 217360 - DNA, 20 bp, Artificial Sequence
  chemically synthesized
acagcctttatcaagctgcc

SEQ ID NO: 217361 - DNA, 20 bp, Artificial Sequence
  chemically synthesized
acctttcagcatcatctggg

SEQ ID NO: 217362 - DNA, 20 bp, Artificial Sequence
  chemically synthesized
aacacctttcagcatcatct

SEQ ID NO: 217363 - DNA, 20 bp, Artificial Sequence
  chemically synthesized
aaacacctttcagcatcatc

SEQ ID NO: 217364 - DNA, 20 bp, Artificial Sequence
  chemically synthesized
agctgcccagatgatgctga

SEQ ID NO: 217365 - DNA, 20 bp, Artificial Sequence
  chemically synthesized
gctgcccagatgatgctgaa

SEQ ID NO: 217366 - DNA, 20 bp, Artificial Sequence
  chemically synthesized
tgaatccataaaacaccttt

SEQ ID NO: 217367 - DNA, 20 bp, Artificial Sequence
  chemically synthesized
tgatgctgaaaggtgtttta

SEQ ID NO: 217368 - DNA, 20 bp, Artificial Sequence
  chemically synthesized
tgaaaggtgttttatggatt

SEQ ID NO: 217369 - DNA, 20 bp, Artificial Sequence
  chemically synthesized
aaggtgttttatggattcag

SEQ ID NO: 217370 - DNA, 20 bp, Artificial Sequence
  chemically synthesized
ggtgttttatggattcagaa

SEQ ID NO: 217371 - DNA, 20 bp, Artificial Sequence
  chemically synthesized
tttatgctcacgaatgtgtt

SEQ ID NO: 217372 - DNA, 20 bp, Artificial Sequence
  chemically synthesized
aagagtctcaacacattcgt

SEQ ID NO: 217373 - DNA, 20 bp, Artificial Sequence
  chemically synthesized
tcaacacattcgtgagcata

SEQ ID NO: 217374 - DNA, 20 bp, Artificial Sequence
  chemically synthesized
cattcgtgagcataaagttg

SEQ ID NO: 217375 - DNA, 20 bp, Artificial Sequence
  chemically synthesized
attcgtgagcataaagttga

SEQ ID NO: 217376 - DNA, 20 bp, Artificial Sequence
  chemically synthesized
ttcgtgagcataaagttgaa

SEQ ID NO: 217377 - DNA, 20 bp, Artificial Sequence
  chemically synthesized
aaatgtttaatgaatttgcc

SEQ ID NO: 217378 - DNA, 20 bp, Artificial Sequence
  chemically synthesized
aatgtttaatgaatttgcct

SEQ ID NO: 217379 - DNA, 20 bp, Artificial Sequence
  chemically synthesized
atgtttaatgaatttgcctg

SEQ ID NO: 217380 - DNA, 20 bp, Artificial Sequence
  chemically synthesized
ggaagaagtaacaaaacccc

SEQ ID NO: 217381 - DNA, 20 bp, Artificial Sequence
  chemically synthesized
tggaagaagtaacaaaaccc

SEQ ID NO: 217382 - DNA, 20 bp, Artificial Sequence
  chemically synthesized
aatgaagttaggagtggaag

SEQ ID NO: 217383 - DNA, 20 bp, Artificial Sequence
  chemically synthesized
ataaatgaagttaggagtgg

SEQ ID NO: 217384 - DNA, 20 bp, Artificial Sequence
  chemically synthesized
attataaatgaagttaggag

SEQ ID NO: 217385 - DNA, 20 bp, Artificial Sequence
  chemically synthesized
ttgattataaatgaagttag

SEQ ID NO: 217386 - DNA, 20 bp, Artificial Sequence
  chemically synthesized
ccttgattataaatgaagtt

SEQ ID NO: 217387 - DNA, 20 bp, Artificial Sequence
  chemically synthesized
gccttgattataaatgaagt

SEQ ID NO: 217388 - DNA, 20 bp, Artificial Sequence
  chemically synthesized
tagggccttgattataaatg

SEQ ID NO: 217389 - DNA, 20 bp, Artificial Sequence
  chemically synthesized
tcctaacttcatttataatc

SEQ ID NO: 217390 - DNA, 20 bp, Artificial Sequence
  chemically synthesized
cctaacttcatttataatca

SEQ ID NO: 217391 - DNA, 20 bp, Artificial Sequence
  chemically synthesized
tcatttataatcaaggccct

SEQ ID NO: 217392 - DNA, 20 bp, Artificial Sequence
  chemically synthesized
tttataatcaaggccctaag

SEQ ID NO: 217393 - DNA, 20 bp, Artificial Sequence
  chemically synthesized
aagtggaaaccagctgctta

SEQ ID NO: 217394 - DNA, 20 bp, Artificial Sequence
  chemically synthesized
taatcaaggccctaagcagc

SEQ ID NO: 217395 - DNA, 20 bp, Artificial Sequence
  chemically synthesized
taagtggaaaccagctgctt

SEQ ID NO: 217396 - DNA, 20 bp, Artificial Sequence
  chemically synthesized
ttaagtggaaaccagctgct

SEQ ID NO: 217397 - DNA, 20 bp, Artificial Sequence
  chemically synthesized
tggtaaggttaagtggaaac

SEQ ID NO: 217398 - DNA, 20 bp, Artificial Sequence
  chemically synthesized
atgagtttggtaaggttaag

SEQ ID NO: 217399 - DNA, 20 bp, Artificial Sequence
  chemically synthesized
tgtatgagtttggtaaggtt

SEQ ID NO: 217400 - DNA, 20 bp, Artificial Sequence
  chemically synthesized
gaatttgtatgagtttggta

SEQ ID NO: 217401 - DNA, 20 bp, Artificial Sequence
  chemically synthesized
tgaatttgtatgagtttggt

SEQ ID NO: 217402 - DNA, 20 bp, Artificial Sequence
  chemically synthesized
caactgaatttgtatgagtt

SEQ ID NO: 217403 - DNA, 20 bp, Artificial Sequence
  chemically synthesized
aatcccaactgaatttgtat

SEQ ID NO: 217404 - DNA, 20 bp, Artificial Sequence
  chemically synthesized
ttaccaaactcatacaaatt

SEQ ID NO: 217405 - DNA, 20 bp, Artificial Sequence
  chemically synthesized
caaactcatacaaattcagt

SEQ ID NO: 217406 - DNA, 20 bp, Artificial Sequence
  chemically synthesized
aaactcatacaaattcagtt

SEQ ID NO: 217407 - DNA, 20 bp, Artificial Sequence
  chemically synthesized
ttgggattatttacaacttc

SEQ ID NO: 217408 - DNA, 20 bp, Artificial Sequence
  chemically synthesized
tgggattatttacaacttcc

SEQ ID NO: 217409 - DNA, 20 bp, Artificial Sequence
  chemically synthesized
gggattatttacaacttcca

SEQ ID NO: 217410 - DNA, 20 bp, Artificial Sequence
  chemically synthesized
acaattgcaagtaaccctgg

SEQ ID NO: 217411 - DNA, 20 bp, Artificial Sequence
  chemically synthesized
tatacaattgcaagtaaccc

SEQ ID NO: 217412 - DNA, 20 bp, Artificial Sequence
  chemically synthesized
gagactcagtatacaattgc

SEQ ID NO: 217413 - DNA, 20 bp, Artificial Sequence
  chemically synthesized
gttacttgcaattgtatact

SEQ ID NO: 217414 - DNA, 20 bp, Artificial Sequence
  chemically synthesized
caattgtatactgagtctcc

SEQ ID NO: 217415 - DNA, 20 bp, Artificial Sequence
  chemically synthesized
cattaaccaccttggagact

SEQ ID NO: 217416 - DNA, 20 bp, Artificial Sequence
  chemically synthesized
aattgtatactgagtctcca

SEQ ID NO: 217417 - DNA, 20 bp, Artificial Sequence
  chemically synthesized
tgtatactgagtctccaagg

SEQ ID NO: 217418 - DNA, 20 bp, Artificial Sequence
  chemically synthesized
gtggctcattaaccaccttg

SEQ ID NO: 217419 - DNA, 20 bp, Artificial Sequence
  chemically synthesized
aagtggctcattaaccacct

SEQ ID NO: 217420 - DNA, 20 bp, Artificial Sequence
  chemically synthesized
gagtctccaaggtggttaat

SEQ ID NO: 217421 - DNA, 20 bp, Artificial Sequence
  chemically synthesized
aggtggttaatgagccactt

SEQ ID NO: 217422 - DNA, 20 bp, Artificial Sequence
  chemically synthesized
gtggttgttatcatccaaag

SEQ ID NO: 217423 - DNA, 20 bp, Artificial Sequence
  chemically synthesized
aaggtggttgttatcatcca

SEQ ID NO: 217424 - DNA, 20 bp, Artificial Sequence
  chemically synthesized
ttggatgataacaaccacct

SEQ ID NO: 217425 - DNA, 20 bp, Artificial Sequence
  chemically synthesized
aatttagttatcagccaagg

SEQ ID NO: 217426 - DNA, 20 bp, Artificial Sequence
  chemically synthesized
atcaatttagttatcagcca

SEQ ID NO: 217427 - DNA, 20 bp, Artificial Sequence
  chemically synthesized
tatcaatttagttatcagcc

SEQ ID NO: 217428 - DNA, 20 bp, Artificial Sequence
  chemically synthesized
ttacctatcaatttagttat

SEQ ID NO: 217429 - DNA, 20 bp, Artificial Sequence
  chemically synthesized
ttggctgataactaaattga

SEQ ID NO: 217430 - DNA, 20 bp, Artificial Sequence
  chemically synthesized
tggctgataactaaattgat

SEQ ID NO: 217431 - DNA, 20 bp, Artificial Sequence
  chemically synthesized
acattgcttacctatcaatt

SEQ ID NO: 217432 - DNA, 20 bp, Artificial Sequence
  chemically synthesized
tgataactaaattgataggt

SEQ ID NO: 217433 - DNA, 20 bp, Artificial Sequence
  chemically synthesized
aggtaagcaatgtattataa

SEQ ID NO: 217434 - DNA, 20 bp, Artificial Sequence
  chemically synthesized
aaatcagagaagcaagggtt

SEQ ID NO: 217435 - DNA, 20 bp, Artificial Sequence
  chemically synthesized
tcagtaaatcagagaagcaa

SEQ ID NO: 217436 - DNA, 20 bp, Artificial Sequence
  chemically synthesized
gtcagtaaatcagagaagca

SEQ ID NO: 217437 - DNA, 20 bp, Artificial Sequence
  chemically synthesized
ggtcagtaaatcagagaagc

SEQ ID NO: 217438 - DNA, 20 bp, Artificial Sequence
  chemically synthesized
gacaggtcagtaaatcagag

SEQ ID NO: 217439 - DNA, 20 bp, Artificial Sequence
  chemically synthesized
tgtgacaggtcagtaaatca

SEQ ID NO: 217440 - DNA, 20 bp, Artificial Sequence
  chemically synthesized
tctgtgacaggtcagtaaat

SEQ ID NO: 217441 - DNA, 20 bp, Artificial Sequence
  chemically synthesized
ggtccatatctgtgacaggt

SEQ ID NO: 217442 - DNA, 20 bp, Artificial Sequence
  chemically synthesized
tctgatttactgacctgtca

SEQ ID NO: 217443 - DNA, 20 bp, Artificial Sequence
  chemically synthesized
gtttggtccatatctgtgac

SEQ ID NO: 217444 - DNA, 20 bp, Artificial Sequence
  chemically synthesized
ggtttggtccatatctgtga

SEQ ID NO: 217445 - DNA, 20 bp, Artificial Sequence
  chemically synthesized
ttactgacctgtcacagata

SEQ ID NO: 217446 - DNA, 20 bp, Artificial Sequence
  chemically synthesized
agaatttcagaaatttggtt

SEQ ID NO: 217447 - DNA, 20 bp, Artificial Sequence
  chemically synthesized
cagccagaatttcagaaatt

SEQ ID NO: 217448 - DNA, 20 bp, Artificial Sequence
  chemically synthesized
aaaccaaatttctgaaattc

SEQ ID NO: 217449 - DNA, 20 bp, Artificial Sequence
  chemically synthesized
gatttgagcagccagaattt

SEQ ID NO: 217450 - DNA, 20 bp, Artificial Sequence
  chemically synthesized
gcaattgggatttgagcagc

SEQ ID NO: 217451 - DNA, 20 bp, Artificial Sequence
  chemically synthesized
ggttgcaattgggatttgag

SEQ ID NO: 217452 - DNA, 20 bp, Artificial Sequence
  chemically synthesized
tcaggttgcaattgggattt

SEQ ID NO: 217453 - DNA, 20 bp, Artificial Sequence
  chemically synthesized
gcctcaatcaggttgcaatt

SEQ ID NO: 217454 - DNA, 20 bp, Artificial Sequence
  chemically synthesized
tgcctcaatcaggttgcaat

SEQ ID NO: 217455 - DNA, 20 bp, Artificial Sequence
  chemically synthesized
atcccaattgcaacctgatt

SEQ ID NO: 217456 - DNA, 20 bp, Artificial Sequence
  chemically synthesized
tcccaattgcaacctgattg

SEQ ID NO: 217457 - DNA, 20 bp, Artificial Sequence
  chemically synthesized
atactaataatgcctcaatc

SEQ ID NO: 217458 - DNA, 20 bp, Artificial Sequence
  chemically synthesized
aatactaataatgcctcaat

SEQ ID NO: 217459 - DNA, 20 bp, Artificial Sequence
  chemically synthesized
caacctgattgaggcattat

SEQ ID NO: 217460 - DNA, 20 bp, Artificial Sequence
  chemically synthesized
gattgaggcattattagtat

SEQ ID NO: 217461 - DNA, 20 bp, Artificial Sequence
  chemically synthesized
ttgaggcattattagtattg

SEQ ID NO: 217462 - DNA, 20 bp, Artificial Sequence
  chemically synthesized
attattagtattggagtttg

SEQ ID NO: 217463 - DNA, 20 bp, Artificial Sequence
  chemically synthesized
tacaaatgcatcgactgaaa

SEQ ID NO: 217464 - DNA, 20 bp, Artificial Sequence
  chemically synthesized
acaaatgcatcgactgaaat

SEQ ID NO: 217465 - DNA, 20 bp, Artificial Sequence
  chemically synthesized
aatgcatcgactgaaatagg

SEQ ID NO: 217466 - DNA, 20 bp, Artificial Sequence
  chemically synthesized
ggcttgttctctacctattt

SEQ ID NO: 217467 - DNA, 20 bp, Artificial Sequence
  chemically synthesized
tgcatcgactgaaataggta

SEQ ID NO: 217468 - DNA, 20 bp, Artificial Sequence
  chemically synthesized
gactgaaataggtagagaac

SEQ ID NO: 217469 - DNA, 20 bp, Artificial Sequence
  chemically synthesized
aaataggtagagaacaagcc

SEQ ID NO: 217470 - DNA, 20 bp, Artificial Sequence
  chemically synthesized
taggtagagaacaagcccgg

SEQ ID NO: 217471 - DNA, 20 bp, Artificial Sequence
  chemically synthesized
taacgaacgtttgcacttcc

SEQ ID NO: 217472 - DNA, 20 bp, Artificial Sequence
  chemically synthesized
ctaacgaacgtttgcacttc

SEQ ID NO: 217473 - DNA, 20 bp, Artificial Sequence
  chemically synthesized
ccggaagtgcaaacgttcgt

SEQ ID NO: 217474 - DNA, 20 bp, Artificial Sequence
  chemically synthesized
gaagtgcaaacgttcgttag

SEQ ID NO: 217475 - DNA, 20 bp, Artificial Sequence
  chemically synthesized
ttagaagttactgatttgtg

SEQ ID NO: 217476 - DNA, 20 bp, Artificial Sequence
  chemically synthesized
acacagagttctgcacaaat

SEQ ID NO: 217477 - DNA, 20 bp, Artificial Sequence
  chemically synthesized
gatttgtgcagaactctgtg

SEQ ID NO: 217478 - DNA, 20 bp, Artificial Sequence
  chemically synthesized
gtgactgcccaagccacaca

SEQ ID NO: 217479 - DNA, 20 bp, Artificial Sequence
  chemically synthesized
gtgcagaactctgtgtggct

SEQ ID NO: 217480 - DNA, 20 bp, Artificial Sequence
  chemically synthesized
aagtgactgcccaagccaca

SEQ ID NO: 217481 - DNA, 20 bp, Artificial Sequence
  chemically synthesized
tgcagaactctgtgtggctt

SEQ ID NO: 217482 - DNA, 20 bp, Artificial Sequence
  chemically synthesized
agaactctgtgtggcttggg

SEQ ID NO: 217483 - DNA, 20 bp, Artificial Sequence
  chemically synthesized
acaaagagaagtgactgccc

SEQ ID NO: 217484 - DNA, 20 bp, Artificial Sequence
  chemically synthesized
tatgtttacttgacaaagag

SEQ ID NO: 217485 - DNA, 20 bp, Artificial Sequence
  chemically synthesized
ggcagtcacttctctttgtc

SEQ ID NO: 217486 - DNA, 20 bp, Artificial Sequence
  chemically synthesized
ttgtatgtttacttgacaaa

SEQ ID NO: 217487 - DNA, 20 bp, Artificial Sequence
  chemically synthesized
ttttgtatgtttacttgaca

SEQ ID NO: 217488 - DNA, 20 bp, Artificial Sequence
  chemically synthesized
gataccattgcaattggaag

SEQ ID NO: 217489 - DNA, 20 bp, Artificial Sequence
  chemically synthesized
tggataccattgcaattgga

SEQ ID NO: 217490 - DNA, 20 bp, Artificial Sequence
  chemically synthesized
atggataccattgcaattgg

SEQ ID NO: 217491 - DNA, 20 bp, Artificial Sequence
  chemically synthesized
tttgctccttccaattgcaa

SEQ ID NO: 217492 - DNA, 20 bp, Artificial Sequence
  chemically synthesized
accatggataccattgcaat

SEQ ID NO: 217493 - DNA, 20 bp, Artificial Sequence
  chemically synthesized
tccaattgcaatggtatcca

SEQ ID NO: 217494 - DNA, 20 bp, Artificial Sequence
  chemically synthesized
aattgcaatggtatccatgg

SEQ ID NO: 217495 - DNA, 20 bp, Artificial Sequence
  chemically synthesized
tgcattgcacgtatctacca

SEQ ID NO: 217496 - DNA, 20 bp, Artificial Sequence
  chemically synthesized
gcatttgaaaataataactt

SEQ ID NO: 217497 - DNA, 20 bp, Artificial Sequence
  chemically synthesized
attttttgtctttcgatctc

SEQ ID NO: 217498 - DNA, 20 bp, Artificial Sequence
  chemically synthesized
aaataataacttgagatcga

SEQ ID NO: 217499 - DNA, 20 bp, Artificial Sequence
  chemically synthesized
agacaaaaaatgaatacgct

SEQ ID NO: 217500 - DNA, 20 bp, Artificial Sequence
  chemically synthesized
gacaaaaaatgaatacgcta

SEQ ID NO: 217501 - DNA, 20 bp, Artificial Sequence
  chemically synthesized
aaaaaatgaatacgctaagg

SEQ ID NO: 217502 - DNA, 20 bp, Artificial Sequence
  chemically synthesized
ttgtgactgccacacttcct

SEQ ID NO: 217503 - DNA, 20 bp, Artificial Sequence
  chemically synthesized
atgaatacgctaaggaagtg

SEQ ID NO: 217504 - DNA, 20 bp, Artificial Sequence
  chemically synthesized
aatacgctaaggaagtgtgg

SEQ ID NO: 217505 - DNA, 20 bp, Artificial Sequence
  chemically synthesized
aaggaagtgtggcagtcaca

SEQ ID NO: 217506 - DNA, 20 bp, Artificial Sequence
  chemically synthesized
ggaagtgtggcagtcacaaa

SEQ ID NO: 217507 - DNA, 20 bp, Artificial Sequence
  chemically synthesized
gaagtgtggcagtcacaaag

SEQ ID NO: 217508 - DNA, 20 bp, Artificial Sequence
  chemically synthesized
gtcacaaagaggaatgtatc

SEQ ID NO: 217509 - DNA, 20 bp, Artificial Sequence
  chemically synthesized
ggtctgccctgattaagaac

SEQ ID NO: 217510 - DNA, 20 bp, Artificial Sequence
  chemically synthesized
gaatgtatctagttcttaat

SEQ ID NO: 217511 - DNA, 20 bp, Artificial Sequence
  chemically synthesized
aatgtatctagttcttaatc

SEQ ID NO: 217512 - DNA, 20 bp, Artificial Sequence
  chemically synthesized
atgtatctagttcttaatca

SEQ ID NO: 217513 - DNA, 20 bp, Artificial Sequence
  chemically synthesized
tattgaggtctgccctgatt

SEQ ID NO: 217514 - DNA, 20 bp, Artificial Sequence
  chemically synthesized
tatctagttcttaatcaggg

SEQ ID NO: 217515 - DNA, 20 bp, Artificial Sequence
  chemically synthesized
tgctaaaaatgtgaatattg

SEQ ID NO: 217516 - DNA, 20 bp, Artificial Sequence
  chemically synthesized
gtgctaaaaatgtgaatatt

SEQ ID NO: 217517 - DNA, 20 bp, Artificial Sequence
  chemically synthesized
gacctcaatattcacatttt

SEQ ID NO: 217518 - DNA, 20 bp, Artificial Sequence
  chemically synthesized
tattcacatttttagcacaa

SEQ ID NO: 217519 - DNA, 20 bp, Artificial Sequence
  chemically synthesized
atttttagcacaaaagccaa

SEQ ID NO: 217520 - DNA, 20 bp, Artificial Sequence
  chemically synthesized
tttttagcacaaaagccaaa

SEQ ID NO: 217521 - DNA, 20 bp, Artificial Sequence
  chemically synthesized
ttttagcacaaaagccaaaa

SEQ ID NO: 217522 - DNA, 20 bp, Artificial Sequence
  chemically synthesized
ttagcacaaaagccaaaagg

SEQ ID NO: 217523 - DNA, 20 bp, Artificial Sequence
  chemically synthesized
tagcacaaaagccaaaaggg

SEQ ID NO: 217524 - DNA, 20 bp, Artificial Sequence
  chemically synthesized
agcacaaaagccaaaaggga

SEQ ID NO: 217525 - DNA, 20 bp, Artificial Sequence
  chemically synthesized
taaatttcaaccctcccttt

SEQ ID NO: 217526 - DNA, 20 bp, Artificial Sequence
  chemically synthesized
aagggagggttgaaatttac

SEQ ID NO: 217527 - DNA, 20 bp, Artificial Sequence
  chemically synthesized
atttacaagtcccttcatct

SEQ ID NO: 217528 - DNA, 20 bp, Artificial Sequence
  chemically synthesized
cagagcctaaccaagatgaa

SEQ ID NO: 217529 - DNA, 20 bp, Artificial Sequence
  chemically synthesized
acagagcctaaccaagatga

SEQ ID NO: 217530 - DNA, 20 bp, Artificial Sequence
  chemically synthesized
cacagagcctaaccaagatg

SEQ ID NO: 217531 - DNA, 20 bp, Artificial Sequence
  chemically synthesized
acaagtcccttcatcttggt

SEQ ID NO: 217532 - DNA, 20 bp, Artificial Sequence
  chemically synthesized
caagtcccttcatcttggtt

SEQ ID NO: 217533 - DNA, 20 bp, Artificial Sequence
  chemically synthesized
actccccacagagcctaacc

SEQ ID NO: 217534 - DNA, 20 bp, Artificial Sequence
  chemically synthesized
ttcatcttggttaggctctg

SEQ ID NO: 217535 - DNA, 20 bp, Artificial Sequence
  chemically synthesized
tcatcttggttaggctctgt

SEQ ID NO: 217536 - DNA, 20 bp, Artificial Sequence
  chemically synthesized
catcttggttaggctctgtg

SEQ ID NO: 217537 - DNA, 20 bp, Artificial Sequence
  chemically synthesized
tcttggttaggctctgtggg

SEQ ID NO: 217538 - DNA, 20 bp, Artificial Sequence
  chemically synthesized
tgcagggagaactccccaca

SEQ ID NO: 217539 - DNA, 20 bp, Artificial Sequence
  chemically synthesized
gctgcagggagaactcccca

SEQ ID NO: 217540 - DNA, 20 bp, Artificial Sequence
  chemically synthesized
tctgtggggagttctccctg

SEQ ID NO: 217541 - DNA, 20 bp, Artificial Sequence
  chemically synthesized
agcagcccaccagctgcagg

SEQ ID NO: 217542 - DNA, 20 bp, Artificial Sequence
  chemically synthesized
tggggagttctccctgcagc

SEQ ID NO: 217543 - DNA, 20 bp, Artificial Sequence
  chemically synthesized
gaagcagcccaccagctgca

SEQ ID NO: 217544 - DNA, 20 bp, Artificial Sequence
  chemically synthesized
ggaagcagcccaccagctgc

SEQ ID NO: 217545 - DNA, 20 bp, Artificial Sequence
  chemically synthesized
ggagttctccctgcagctgg

SEQ ID NO: 217546 - DNA, 20 bp, Artificial Sequence
  chemically synthesized
aggaagcagcccaccagctg

SEQ ID NO: 217547 - DNA, 20 bp, Artificial Sequence
  chemically synthesized
gagttctccctgcagctggt

SEQ ID NO: 217548 - DNA, 20 bp, Artificial Sequence
  chemically synthesized
agaagcaggaagcagcccac

SEQ ID NO: 217549 - DNA, 20 bp, Artificial Sequence
  chemically synthesized
gagacatcagaagcaggaag

SEQ ID NO: 217550 - DNA, 20 bp, Artificial Sequence
  chemically synthesized
gtggagacatcagaagcagg

SEQ ID NO: 217551 - DNA, 20 bp, Artificial Sequence
  chemically synthesized
caggtggagacatcagaagc

SEQ ID NO: 217552 - DNA, 20 bp, Artificial Sequence
  chemically synthesized
gcaggtggagacatcagaag

SEQ ID NO: 217553 - DNA, 20 bp, Artificial Sequence
  chemically synthesized
cctgcaggtggagacatcag

SEQ ID NO: 217554 - DNA, 20 bp, Artificial Sequence
  chemically synthesized
ccacctgcaggtggagacat

SEQ ID NO: 217555 - DNA, 20 bp, Artificial Sequence
  chemically synthesized
gcttctgatgtctccacctg

SEQ ID NO: 217556 - DNA, 20 bp, Artificial Sequence
  chemically synthesized
cttctgatgtctccacctgc

SEQ ID NO: 217557 - DNA, 20 bp, Artificial Sequence
  chemically synthesized
agtgccaccacctgcaggtg

SEQ ID NO: 217558 - DNA, 20 bp, Artificial Sequence
  chemically synthesized
ccagtgccaccacctgcagg

SEQ ID NO: 217559 - DNA, 20 bp, Artificial Sequence
  chemically synthesized
ctgatgtctccacctgcagg

SEQ ID NO: 217560 - DNA, 20 bp, Artificial Sequence
  chemically synthesized
gggccagtgccaccacctgc

SEQ ID NO: 217561 - DNA, 20 bp, Artificial Sequence
  chemically synthesized
atgtctccacctgcaggtgg

SEQ ID NO: 217562 - DNA, 20 bp, Artificial Sequence
  chemically synthesized
ggggccagtgccaccacctg

SEQ ID NO: 217563 - DNA, 20 bp, Artificial Sequence
  chemically synthesized
ccacctgcaggtggtggcac

SEQ ID NO: 217564 - DNA, 20 bp, Artificial Sequence
  chemically synthesized
tatttcaggaggtcaggggc

SEQ ID NO: 217565 - DNA, 20 bp, Artificial Sequence
  chemically synthesized
ggcttatttcaggaggtcag

SEQ ID NO: 217566 - DNA, 20 bp, Artificial Sequence
  chemically synthesized
aggcttatttcaggaggtca

SEQ ID NO: 217567 - DNA, 20 bp, Artificial Sequence
  chemically synthesized
caggcttatttcaggaggtc

SEQ ID NO: 217568 - DNA, 20 bp, Artificial Sequence
  chemically synthesized
acaggcttatttcaggaggt

SEQ ID NO: 217569 - DNA, 20 bp, Artificial Sequence
  chemically synthesized
atcaacaggcttatttcagg

SEQ ID NO: 217570 - DNA, 20 bp, Artificial Sequence
  chemically synthesized
ggcccctgacctcctgaaat

SEQ ID NO: 217571 - DNA, 20 bp, Artificial Sequence
  chemically synthesized
gatcaacaggcttatttcag

SEQ ID NO: 217572 - DNA, 20 bp, Artificial Sequence
  chemically synthesized
aagatcaacaggcttatttc

SEQ ID NO: 217573 - DNA, 20 bp, Artificial Sequence
  chemically synthesized
gaagatcaacaggcttattt

SEQ ID NO: 217574 - DNA, 20 bp, Artificial Sequence
  chemically synthesized
taatgtgggagaagatcaac

SEQ ID NO: 217575 - DNA, 20 bp, Artificial Sequence
  chemically synthesized
ataatgtgggagaagatcaa

SEQ ID NO: 217576 - DNA, 20 bp, Artificial Sequence
  chemically synthesized
cagcaggaataatgtgggag

SEQ ID NO: 217577 - DNA, 20 bp, Artificial Sequence
  chemically synthesized
aggcagcaggaataatgtgg

SEQ ID NO: 217578 - DNA, 20 bp, Artificial Sequence
  chemically synthesized
acaggcagcaggaataatgt

SEQ ID NO: 217579 - DNA, 20 bp, Artificial Sequence
  chemically synthesized
cacaggcagcaggaataatg

SEQ ID NO: 217580 - DNA, 20 bp, Artificial Sequence
  chemically synthesized
gtcagcagtccacaggcagc

SEQ ID NO: 217581 - DNA, 20 bp, Artificial Sequence
  chemically synthesized
cacattattcctgctgcctg

SEQ ID NO: 217582 - DNA, 20 bp, Artificial Sequence
  chemically synthesized
tgtcagcagtccacaggcag

SEQ ID NO: 217583 - DNA, 20 bp, Artificial Sequence
  chemically synthesized
tcctgtcagcagtccacagg

SEQ ID NO: 217584 - DNA, 20 bp, Artificial Sequence
  chemically synthesized
acttcctgtcagcagtccac

SEQ ID NO: 217585 - DNA, 20 bp, Artificial Sequence
  chemically synthesized
aacttcctgtcagcagtcca

SEQ ID NO: 217586 - DNA, 20 bp, Artificial Sequence
  chemically synthesized
tgctgcctgtggactgctga

SEQ ID NO: 217587 - DNA, 20 bp, Artificial Sequence
  chemically synthesized
gctgcctgtggactgctgac

SEQ ID NO: 217588 - DNA, 20 bp, Artificial Sequence
  chemically synthesized
gtcccctaacttcctgtcag

SEQ ID NO: 217589 - DNA, 20 bp, Artificial Sequence
  chemically synthesized
gcctgtggactgctgacagg

SEQ ID NO: 217590 - DNA, 20 bp, Artificial Sequence
  chemically synthesized
gtcgtcccctaacttcctgt

SEQ ID NO: 217591 - DNA, 20 bp, Artificial Sequence
  chemically synthesized
gtggactgctgacaggaagt

SEQ ID NO: 217592 - DNA, 20 bp, Artificial Sequence
  chemically synthesized
tggactgctgacaggaagtt

SEQ ID NO: 217593 - DNA, 20 bp, Artificial Sequence
  chemically synthesized
ggactgctgacaggaagtta

SEQ ID NO: 217594 - DNA, 20 bp, Artificial Sequence
  chemically synthesized
gactgctgacaggaagttag

SEQ ID NO: 217595 - DNA, 20 bp, Artificial Sequence
  chemically synthesized
ggaagttaggggacgacaaa

SEQ ID NO: 217596 - DNA, 20 bp, Artificial Sequence
  chemically synthesized
ggggacgacaaaaagtccct

SEQ ID NO: 217597 - DNA, 20 bp, Artificial Sequence
  chemically synthesized
gacaaaaagtccctcagtaa

SEQ ID NO: 217598 - DNA, 20 bp, Artificial Sequence
  chemically synthesized
ttaatcgagtcttttactga

SEQ ID NO: 217599 - DNA, 20 bp, Artificial Sequence
  chemically synthesized
cttaatcgagtcttttactg

SEQ ID NO: 217600 - DNA, 20 bp, Artificial Sequence
  chemically synthesized
acttaatcgagtcttttact

SEQ ID NO: 217601 - DNA, 20 bp, Artificial Sequence
  chemically synthesized
cctcagtaaaagactcgatt

SEQ ID NO: 217602 - DNA, 20 bp, Artificial Sequence
  chemically synthesized
cagtaaaagactcgattaag

SEQ ID NO: 217603 - DNA, 20 bp, Artificial Sequence
  chemically synthesized
cgttatttagccacttaatc

SEQ ID NO: 217604 - DNA, 20 bp, Artificial Sequence
  chemically synthesized
ctttcggaggaaacgttatt

SEQ ID NO: 217605 - DNA, 20 bp, Artificial Sequence
  chemically synthesized
ctaaataacgtttcctccga

SEQ ID NO: 217606 - DNA, 20 bp, Artificial Sequence
  chemically synthesized
tttgaaaagaaagctttcgg

SEQ ID NO: 217607 - DNA, 20 bp, Artificial Sequence
  chemically synthesized
atttgaaaagaaagctttcg

SEQ ID NO: 217608 - DNA, 20 bp, Artificial Sequence
  chemically synthesized
ttatttgaaaagaaagcttt

SEQ ID NO: 217609 - DNA, 20 bp, Artificial Sequence
  chemically synthesized
gaaaaccttatttgaaaaga

SEQ ID NO: 217610 - DNA, 20 bp, Artificial Sequence
  chemically synthesized
cgaaagctttcttttcaaat

SEQ ID NO: 217611 - DNA, 20 bp, Artificial Sequence
  chemically synthesized
ttttgaaaaccttatttgaa

SEQ ID NO: 217612 - DNA, 20 bp, Artificial Sequence
  chemically synthesized
gaaagctttcttttcaaata

SEQ ID NO: 217613 - DNA, 20 bp, Artificial Sequence
  chemically synthesized
tatatatatatatatgtatt

SEQ ID NO: 217614 - DNA, 20 bp, Artificial Sequence
  chemically synthesized
tatatgtattcggttttatt

SEQ ID NO: 217615 - DNA, 20 bp, Artificial Sequence
  chemically synthesized
attcggttttattcagaatg

SEQ ID NO: 217616 - DNA, 20 bp, Artificial Sequence
  chemically synthesized
cggttttattcagaatgcag

SEQ ID NO: 217617 - DNA, 20 bp, Artificial Sequence
  chemically synthesized
agaatgcagaagtgtatctg

SEQ ID NO: 217618 - DNA, 20 bp, Artificial Sequence
  chemically synthesized
aatgcagaagtgtatctgcg

SEQ ID NO: 217619 - DNA, 20 bp, Artificial Sequence
  chemically synthesized
tgcagaagtgtatctgcgga

SEQ ID NO: 217620 - DNA, 20 bp, Artificial Sequence
  chemically synthesized
agaagtgtatctgcggagag

SEQ ID NO: 217621 - DNA, 20 bp, Artificial Sequence
  chemically synthesized
caatgcccttctgctctccg

SEQ ID NO: 217622 - DNA, 20 bp, Artificial Sequence
  chemically synthesized
agtgtatctgcggagagcag

SEQ ID NO: 217623 - DNA, 20 bp, Artificial Sequence
  chemically synthesized
gtgtatctgcggagagcaga

SEQ ID NO: 217624 - DNA, 20 bp, Artificial Sequence
  chemically synthesized
tgtatctgcggagagcagaa

SEQ ID NO: 217625 - DNA, 20 bp, Artificial Sequence
  chemically synthesized
tgcggagagcagaagggcat

SEQ ID NO: 217626 - DNA, 20 bp, Artificial Sequence
  chemically synthesized
ggagagcagaagggcattgg

SEQ ID NO: 217627 - DNA, 20 bp, Artificial Sequence
  chemically synthesized
gagagcagaagggcattgga

SEQ ID NO: 217628 - DNA, 20 bp, Artificial Sequence
  chemically synthesized
gagcagaagggcattggaag

SEQ ID NO: 217629 - DNA, 20 bp, Artificial Sequence
  chemically synthesized
ttttccttttggcatatagt

SEQ ID NO: 217630 - DNA, 20 bp, Artificial Sequence
  chemically synthesized
ttgcttttccttttggcata

SEQ ID NO: 217631 - DNA, 20 bp, Artificial Sequence
  chemically synthesized
acacactcactatatgccaa

SEQ ID NO: 217632 - DNA, 20 bp, Artificial Sequence
  chemically synthesized
cacactcactatatgccaaa

SEQ ID NO: 217633 - DNA, 20 bp, Artificial Sequence
  chemically synthesized
tcactatatgccaaaaggaa

SEQ ID NO: 217634 - DNA, 20 bp, Artificial Sequence
  chemically synthesized
ctcctgtttgcttttccttt

SEQ ID NO: 217635 - DNA, 20 bp, Artificial Sequence
  chemically synthesized
atgccaaaaggaaaagcaaa

SEQ ID NO: 217636 - DNA, 20 bp, Artificial Sequence
  chemically synthesized
tgccaaaaggaaaagcaaac

SEQ ID NO: 217637 - DNA, 20 bp, Artificial Sequence
  chemically synthesized
ccaaaaggaaaagcaaacag

SEQ ID NO: 217638 - DNA, 20 bp, Artificial Sequence
  chemically synthesized
ggaaaagcaaacaggagaaa

SEQ ID NO: 217639 - DNA, 20 bp, Artificial Sequence
  chemically synthesized
aagatgtgttgaaatcttga

SEQ ID NO: 217640 - DNA, 20 bp, Artificial Sequence
  chemically synthesized
gatgtgttgaaatcttgaca

SEQ ID NO: 217641 - DNA, 20 bp, Artificial Sequence
  chemically synthesized
actgttgtctgtgctctgtc

SEQ ID NO: 217642 - DNA, 20 bp, Artificial Sequence
  chemically synthesized
gttgaaatcttgacagagca

SEQ ID NO: 217643 - DNA, 20 bp, Artificial Sequence
  chemically synthesized
tcttgacagagcacagacaa

SEQ ID NO: 217644 - DNA, 20 bp, Artificial Sequence
  chemically synthesized
tgacagagcacagacaacag

SEQ ID NO: 217645 - DNA, 20 bp, Artificial Sequence
  chemically synthesized
cagacaacagtggcatattt

SEQ ID NO: 217646 - DNA, 20 bp, Artificial Sequence
  chemically synthesized
caacagtggcatatttgagt

SEQ ID NO: 217647 - DNA, 20 bp, Artificial Sequence
  chemically synthesized
atttgagttagaaaataaac

SEQ ID NO: 217648 - DNA, 20 bp, Artificial Sequence
  chemically synthesized
tttgagttagaaaataaaca

SEQ ID NO: 217649 - DNA, 20 bp, Artificial Sequence
  chemically synthesized
ttgagttagaaaataaacaa

SEQ ID NO: 217650 - DNA, 20 bp, Artificial Sequence
  chemically synthesized
ataaacaagggtgtgcattt

SEQ ID NO: 217651 - DNA, 20 bp, Artificial Sequence
  chemically synthesized
ggtgtgcattttagaattct

SEQ ID NO: 217652 - DNA, 20 bp, Artificial Sequence
  chemically synthesized
gacaaaaatcaaataaatct

SEQ ID NO: 217653 - DNA, 20 bp, Artificial Sequence
  chemically synthesized
actccttactttgtagtggt

SEQ ID NO: 217654 - DNA, 20 bp, Artificial Sequence
  chemically synthesized
atttttgtccaaccactaca

SEQ ID NO: 217655 - DNA, 20 bp, Artificial Sequence
  chemically synthesized
gtttactccttactttgtag

SEQ ID NO: 217656 - DNA, 20 bp, Artificial Sequence
  chemically synthesized
ttgtccaaccactacaaagt

SEQ ID NO: 217657 - DNA, 20 bp, Artificial Sequence
  chemically synthesized
tgtccaaccactacaaagta

SEQ ID NO: 217658 - DNA, 20 bp, Artificial Sequence
  chemically synthesized
cacgtttactccttactttg

SEQ ID NO: 217659 - DNA, 20 bp, Artificial Sequence
  chemically synthesized
tccaaccactacaaagtaag

SEQ ID NO: 217660 - DNA, 20 bp, Artificial Sequence
  chemically synthesized
taaggagtaaacgtgaatat

SEQ ID NO: 217661 - DNA, 20 bp, Artificial Sequence
  chemically synthesized
aaggagtaaacgtgaatatg

SEQ ID NO: 217662 - DNA, 20 bp, Artificial Sequence
  chemically synthesized
aggagtaaacgtgaatatga

SEQ ID NO: 217663 - DNA, 20 bp, Artificial Sequence
  chemically synthesized
ggagtaaacgtgaatatgag

SEQ ID NO: 217664 - DNA, 20 bp, Artificial Sequence
  chemically synthesized
gagtaaacgtgaatatgagg

SEQ ID NO: 217665 - DNA, 20 bp, Artificial Sequence
  chemically synthesized
aaacgtgaatatgagggggt

SEQ ID NO: 217666 - DNA, 20 bp, Artificial Sequence
  chemically synthesized
acgtgaatatgagggggtaa

SEQ ID NO: 217667 - DNA, 20 bp, Artificial Sequence
  chemically synthesized
atgagggggtaagagaaaat

SEQ ID NO: 217668 - DNA, 20 bp, Artificial Sequence
  chemically synthesized
gagaaaataagttgatttaa

SEQ ID NO: 217669 - DNA, 20 bp, Artificial Sequence
  chemically synthesized
aagttgatttaatggtgaac

SEQ ID NO: 217670 - DNA, 20 bp, Artificial Sequence
  chemically synthesized
agttgatttaatggtgaact

SEQ ID NO: 217671 - DNA, 20 bp, Artificial Sequence
  chemically synthesized
gttgatttaatggtgaacta

SEQ ID NO: 217672 - DNA, 20 bp, Artificial Sequence
  chemically synthesized
ttaatggtgaactagggaca

SEQ ID NO: 217673 - DNA, 20 bp, Artificial Sequence
  chemically synthesized
aaacactaggactttgtccc

SEQ ID NO: 217674 - DNA, 20 bp, Artificial Sequence
  chemically synthesized
gtgaactagggacaaagtcc

SEQ ID NO: 217675 - DNA, 20 bp, Artificial Sequence
  chemically synthesized
cagagcaaatgcaaaacact

SEQ ID NO: 217676 - DNA, 20 bp, Artificial Sequence
  chemically synthesized
acagagcaaatgcaaaacac

SEQ ID NO: 217677 - DNA, 20 bp, Artificial Sequence
  chemically synthesized
tttgcatttgctctgtgacc

SEQ ID NO: 217678 - DNA, 20 bp, Artificial Sequence
  chemically synthesized
tgctgaagacctgggtcaca

SEQ ID NO: 217679 - DNA, 20 bp, Artificial Sequence
  chemically synthesized
ttgcatttgctctgtgaccc

SEQ ID NO: 217680 - DNA, 20 bp, Artificial Sequence
  chemically synthesized
ggtgctgaagacctgggtca

SEQ ID NO: 217681 - DNA, 20 bp, Artificial Sequence
  chemically synthesized
tgctctgtgacccaggtctt

SEQ ID NO: 217682 - DNA, 20 bp, Artificial Sequence
  chemically synthesized
aggaaaggtgctgaagacct

SEQ ID NO: 217683 - DNA, 20 bp, Artificial Sequence
  chemically synthesized
aaggaaaggtgctgaagacc

SEQ ID NO: 217684 - DNA, 20 bp, Artificial Sequence
  chemically synthesized
cttgccaaggaaaggtgctg

SEQ ID NO: 217685 - DNA, 20 bp, Artificial Sequence
  chemically synthesized
aggtcttcagcacctttcct

SEQ ID NO: 217686 - DNA, 20 bp, Artificial Sequence
  chemically synthesized
catcctgacttgccaaggaa

SEQ ID NO: 217687 - DNA, 20 bp, Artificial Sequence
  chemically synthesized
tcatcctgacttgccaagga

SEQ ID NO: 217688 - DNA, 20 bp, Artificial Sequence
  chemically synthesized
cttcagcacctttccttggc

SEQ ID NO: 217689 - DNA, 20 bp, Artificial Sequence
  chemically synthesized
aaaatcatcctgacttgcca

SEQ ID NO: 217690 - DNA, 20 bp, Artificial Sequence
  chemically synthesized
agcacctttccttggcaagt

SEQ ID NO: 217691 - DNA, 20 bp, Artificial Sequence
  chemically synthesized
aaaaatcatcctgacttgcc

SEQ ID NO: 217692 - DNA, 20 bp, Artificial Sequence
  chemically synthesized
gcacctttccttggcaagtc

SEQ ID NO: 217693 - DNA, 20 bp, Artificial Sequence
  chemically synthesized
aagtcaggatgatttttaac

SEQ ID NO: 217694 - DNA, 20 bp, Artificial Sequence
  chemically synthesized
caagaaagctagttaggagc

SEQ ID NO: 217695 - DNA, 20 bp, Artificial Sequence
  chemically synthesized
atttttaactagctcctaac

SEQ ID NO: 217696 - DNA, 20 bp, Artificial Sequence
  chemically synthesized
aacacaagaaagctagttag

SEQ ID NO: 217697 - DNA, 20 bp, Artificial Sequence
  chemically synthesized
ctaacacaagaaagctagtt

SEQ ID NO: 217698 - DNA, 20 bp, Artificial Sequence
  chemically synthesized
actaacacaagaaagctagt

SEQ ID NO: 217699 - DNA, 20 bp, Artificial Sequence
  chemically synthesized
cagaactaacacaagaaagc

SEQ ID NO: 217700 - DNA, 20 bp, Artificial Sequence
  chemically synthesized
gaaacagaactaacacaaga

SEQ ID NO: 217701 - DNA, 20 bp, Artificial Sequence
  chemically synthesized
cctaactagctttcttgtgt

SEQ ID NO: 217702 - DNA, 20 bp, Artificial Sequence
  chemically synthesized
gaaggaaacagaactaacac

SEQ ID NO: 217703 - DNA, 20 bp, Artificial Sequence
  chemically synthesized
gcctatagattcgaaggaaa

SEQ ID NO: 217704 - DNA, 20 bp, Artificial Sequence
  chemically synthesized
agcttggcctatagattcga

SEQ ID NO: 217705 - DNA, 20 bp, Artificial Sequence
  chemically synthesized
cagcttggcctatagattcg

SEQ ID NO: 217706 - DNA, 20 bp, Artificial Sequence
  chemically synthesized
ttctgtttccttcgaatcta

SEQ ID NO: 217707 - DNA, 20 bp, Artificial Sequence
  chemically synthesized
tctgtttccttcgaatctat

SEQ ID NO: 217708 - DNA, 20 bp, Artificial Sequence
  chemically synthesized
ttccttcgaatctataggcc

SEQ ID NO: 217709 - DNA, 20 bp, Artificial Sequence
  chemically synthesized
cccttctgcagcttggccta

SEQ ID NO: 217710 - DNA, 20 bp, Artificial Sequence
  chemically synthesized
cgaatctataggccaagctg

SEQ ID NO: 217711 - DNA, 20 bp, Artificial Sequence
  chemically synthesized
gaaagcccccttctgcagct

SEQ ID NO: 217712 - DNA, 20 bp, Artificial Sequence
  chemically synthesized
atctataggccaagctgcag

SEQ ID NO: 217713 - DNA, 20 bp, Artificial Sequence
  chemically synthesized
tctataggccaagctgcaga

SEQ ID NO: 217714 - DNA, 20 bp, Artificial Sequence
  chemically synthesized
ctataggccaagctgcagaa

SEQ ID NO: 217715 - DNA, 20 bp, Artificial Sequence
  chemically synthesized
tataggccaagctgcagaag

SEQ ID NO: 217716 - DNA, 20 bp, Artificial Sequence
  chemically synthesized
ataggccaagctgcagaagg

SEQ ID NO: 217717 - DNA, 20 bp, Artificial Sequence
  chemically synthesized
ttttagaaagcccccttctg

SEQ ID NO: 217718 - DNA, 20 bp, Artificial Sequence
  chemically synthesized
tcacaggcctgaattttaga

SEQ ID NO: 217719 - DNA, 20 bp, Artificial Sequence
  chemically synthesized
gaagggggctttctaaaatt

SEQ ID NO: 217720 - DNA, 20 bp, Artificial Sequence
  chemically synthesized
aagggggctttctaaaattc

SEQ ID NO: 217721 - DNA, 20 bp, Artificial Sequence
  chemically synthesized
gacttcacaggcctgaattt

SEQ ID NO: 217722 - DNA, 20 bp, Artificial Sequence
  chemically synthesized
ttctaaaattcaggcctgtg

SEQ ID NO: 217723 - DNA, 20 bp, Artificial Sequence
  chemically synthesized
atactggccaatgacttcac

SEQ ID NO: 217724 - DNA, 20 bp, Artificial Sequence
  chemically synthesized
tatactggccaatgacttca

SEQ ID NO: 217725 - DNA, 20 bp, Artificial Sequence
  chemically synthesized
attcaggcctgtgaagtcat

SEQ ID NO: 217726 - DNA, 20 bp, Artificial Sequence
  chemically synthesized
aggcctgtgaagtcattggc

SEQ ID NO: 217727 - DNA, 20 bp, Artificial Sequence
  chemically synthesized
gaagtcattggccagtataa

SEQ ID NO: 217728 - DNA, 20 bp, Artificial Sequence
  chemically synthesized
accatataaggcttttatac

SEQ ID NO: 217729 - DNA, 20 bp, Artificial Sequence
  chemically synthesized
gccagtataaaagccttata

SEQ ID NO: 217730 - DNA, 20 bp, Artificial Sequence
  chemically synthesized
gctataggaaaaaccatata

SEQ ID NO: 217731 - DNA, 20 bp, Artificial Sequence
  chemically synthesized
cgctataggaaaaaccatat

SEQ ID NO: 217732 - DNA, 20 bp, Artificial Sequence
  chemically synthesized
gccttatatggtttttccta

SEQ ID NO: 217733 - DNA, 20 bp, Artificial Sequence
  chemically synthesized
atatggtttttcctatagcg

SEQ ID NO: 217734 - DNA, 20 bp, Artificial Sequence
  chemically synthesized
cactgctttagctacgctat

SEQ ID NO: 217735 - DNA, 20 bp, Artificial Sequence
  chemically synthesized
ccactgctttagctacgcta

SEQ ID NO: 217736 - DNA, 20 bp, Artificial Sequence
  chemically synthesized
tttttcctatagcgtagcta

SEQ ID NO: 217737 - DNA, 20 bp, Artificial Sequence
  chemically synthesized
ttcctatagcgtagctaaag

SEQ ID NO: 217738 - DNA, 20 bp, Artificial Sequence
  chemically synthesized
ctatagcgtagctaaagcag

SEQ ID NO: 217739 - DNA, 20 bp, Artificial Sequence
  chemically synthesized
tgctttgaaaaccactgctt

SEQ ID NO: 217740 - DNA, 20 bp, Artificial Sequence
  chemically synthesized
agctaaagcagtggttttca

SEQ ID NO: 217741 - DNA, 20 bp, Artificial Sequence
  chemically synthesized
gtggttttcaaagcacgatc

SEQ ID NO: 217742 - DNA, 20 bp, Artificial Sequence
  chemically synthesized
tggttttcaaagcacgatca

SEQ ID NO: 217743 - DNA, 20 bp, Artificial Sequence
  chemically synthesized
tttcaaagcacgatcaaggc

SEQ ID NO: 217744 - DNA, 20 bp, Artificial Sequence
  chemically synthesized
caaagcacgatcaaggccag

SEQ ID NO: 217745 - DNA, 20 bp, Artificial Sequence
  chemically synthesized
acgatcaaggccagcagcat

SEQ ID NO: 217746 - DNA, 20 bp, Artificial Sequence
  chemically synthesized
ccaggtgatactgatgctgc

SEQ ID NO: 217747 - DNA, 20 bp, Artificial Sequence
  chemically synthesized
ccagcagcatcagtatcacc

SEQ ID NO: 217748 - DNA, 20 bp, Artificial Sequence
  chemically synthesized
tgcatttccagcaagttacc

SEQ ID NO: 217749 - DNA, 20 bp, Artificial Sequence
  chemically synthesized
ttgcatttccagcaagttac

SEQ ID NO: 217750 - DNA, 20 bp, Artificial Sequence
  chemically synthesized
agtatcacctggtaacttgc

SEQ ID NO: 217751 - DNA, 20 bp, Artificial Sequence
  chemically synthesized
ccagattttgcatttccagc

SEQ ID NO: 217752 - DNA, 20 bp, Artificial Sequence
  chemically synthesized
aggtccagattttgcatttc

SEQ ID NO: 217753 - DNA, 20 bp, Artificial Sequence
  chemically synthesized
cttgctggaaatgcaaaatc

SEQ ID NO: 217754 - DNA, 20 bp, Artificial Sequence
  chemically synthesized
cagtaactttggtgcaggtc

SEQ ID NO: 217755 - DNA, 20 bp, Artificial Sequence
  chemically synthesized
caaaatctggacctgcacca

SEQ ID NO: 217756 - DNA, 20 bp, Artificial Sequence
  chemically synthesized
tggtccagtaactttggtgc

SEQ ID NO: 217757 - DNA, 20 bp, Artificial Sequence
  chemically synthesized
ctggtccagtaactttggtg

SEQ ID NO: 217758 - DNA, 20 bp, Artificial Sequence
  chemically synthesized
tggacctgcaccaaagttac

SEQ ID NO: 217759 - DNA, 20 bp, Artificial Sequence
  chemically synthesized
agttgctggtccagtaactt

SEQ ID NO: 217760 - DNA, 20 bp, Artificial Sequence
  chemically synthesized
ctgcaccaaagttactggac

SEQ ID NO: 217761 - DNA, 20 bp, Artificial Sequence
  chemically synthesized
agccttcagagttgctggtc

SEQ ID NO: 217762 - DNA, 20 bp, Artificial Sequence
  chemically synthesized
aggttagccttcagagttgc

SEQ ID NO: 217763 - DNA, 20 bp, Artificial Sequence
  chemically synthesized
ttactggaccagcaactctg

SEQ ID NO: 217764 - DNA, 20 bp, Artificial Sequence
  chemically synthesized
tactggaccagcaactctga

SEQ ID NO: 217765 - DNA, 20 bp, Artificial Sequence
  chemically synthesized
gattgctaggttagccttca

SEQ ID NO: 217766 - DNA, 20 bp, Artificial Sequence
  chemically synthesized
cagattgctaggttagcctt

SEQ ID NO: 217767 - DNA, 20 bp, Artificial Sequence
  chemically synthesized
agcaactctgaaggctaacc

SEQ ID NO: 217768 - DNA, 20 bp, Artificial Sequence
  chemically synthesized
tataccacagattgctaggt

SEQ ID NO: 217769 - DNA, 20 bp, Artificial Sequence
  chemically synthesized
ttgctataccacagattgct

SEQ ID NO: 217770 - DNA, 20 bp, Artificial Sequence
  chemically synthesized
tttgctataccacagattgc

SEQ ID NO: 217771 - DNA, 20 bp, Artificial Sequence
  chemically synthesized
aaggctaacctagcaatctg

SEQ ID NO: 217772 - DNA, 20 bp, Artificial Sequence
  chemically synthesized
taacctagcaatctgtggta

SEQ ID NO: 217773 - DNA, 20 bp, Artificial Sequence
  chemically synthesized
ctggagggtttgctatacca

SEQ ID NO: 217774 - DNA, 20 bp, Artificial Sequence
  chemically synthesized
ctgtggtatagcaaaccctc

SEQ ID NO: 217775 - DNA, 20 bp, Artificial Sequence
  chemically synthesized
tcacatcagaatcagctgga

SEQ ID NO: 217776 - DNA, 20 bp, Artificial Sequence
  chemically synthesized
ctcacatcagaatcagctgg

SEQ ID NO: 217777 - DNA, 20 bp, Artificial Sequence
  chemically synthesized
actcacatcagaatcagctg

SEQ ID NO: 217778 - DNA, 20 bp, Artificial Sequence
  chemically synthesized
atactcacatcagaatcagc

SEQ ID NO: 217779 - DNA, 20 bp, Artificial Sequence
  chemically synthesized
agtaatactcacatcagaat

SEQ ID NO: 217780 - DNA, 20 bp, Artificial Sequence
  chemically synthesized
cctccagctgattctgatgt

SEQ ID NO: 217781 - DNA, 20 bp, Artificial Sequence
  chemically synthesized
taggccagtaatactcacat

SEQ ID NO: 217782 - DNA, 20 bp, Artificial Sequence
  chemically synthesized
gattctgatgtgagtattac

SEQ ID NO: 217783 - DNA, 20 bp, Artificial Sequence
  chemically synthesized
tgatgtgagtattactggcc

SEQ ID NO: 217784 - DNA, 20 bp, Artificial Sequence
  chemically synthesized
atgtgagtattactggccta

SEQ ID NO: 217785 - DNA, 20 bp, Artificial Sequence
  chemically synthesized
tcttagaagcaactctaggc

SEQ ID NO: 217786 - DNA, 20 bp, Artificial Sequence
  chemically synthesized
aaagtcttagaagcaactct

SEQ ID NO: 217787 - DNA, 20 bp, Artificial Sequence
  chemically synthesized
caaagtcttagaagcaactc

SEQ ID NO: 217788 - DNA, 20 bp, Artificial Sequence
  chemically synthesized
actggcctagagttgcttct

SEQ ID NO: 217789 - DNA, 20 bp, Artificial Sequence
  chemically synthesized
taattataccaaagtcttag

SEQ ID NO: 217790 - DNA, 20 bp, Artificial Sequence
  chemically synthesized
tagagttgcttctaagactt

SEQ ID NO: 217791 - DNA, 20 bp, Artificial Sequence
  chemically synthesized
tggtaattataccaaagtct

SEQ ID NO: 217792 - DNA, 20 bp, Artificial Sequence
  chemically synthesized
tgtgactggtaattatacca

SEQ ID NO: 217793 - DNA, 20 bp, Artificial Sequence
  chemically synthesized
taagactttggtataattac

SEQ ID NO: 217794 - DNA, 20 bp, Artificial Sequence
  chemically synthesized
gtgaagacctagattgtgac

SEQ ID NO: 217795 - DNA, 20 bp, Artificial Sequence
  chemically synthesized
tataattaccagtcacaatc

SEQ ID NO: 217796 - DNA, 20 bp, Artificial Sequence
  chemically synthesized
ataattaccagtcacaatct

SEQ ID NO: 217797 - DNA, 20 bp, Artificial Sequence
  chemically synthesized
agtgtctgtgtgtgaagacc

SEQ ID NO: 217798 - DNA, 20 bp, Artificial Sequence
  chemically synthesized
acaatctaggtcttcacaca

SEQ ID NO: 217799 - DNA, 20 bp, Artificial Sequence
  chemically synthesized
tgaatcagtgtctgtgtgtg

SEQ ID NO: 217800 - DNA, 20 bp, Artificial Sequence
  chemically synthesized
acacacagacactgattcaa

SEQ ID NO: 217801 - DNA, 20 bp, Artificial Sequence
  chemically synthesized
cacacagacactgattcaat

SEQ ID NO: 217802 - DNA, 20 bp, Artificial Sequence
  chemically synthesized
tcatcccaaacctattgaat

SEQ ID NO: 217803 - DNA, 20 bp, Artificial Sequence
  chemically synthesized
agacactgattcaataggtt

SEQ ID NO: 217804 - DNA, 20 bp, Artificial Sequence
  chemically synthesized
gacactgattcaataggttt

SEQ ID NO: 217805 - DNA, 20 bp, Artificial Sequence
  chemically synthesized
gattcaataggtttgggatg

SEQ ID NO: 217806 - DNA, 20 bp, Artificial Sequence
  chemically synthesized
attcaataggtttgggatga

SEQ ID NO: 217807 - DNA, 20 bp, Artificial Sequence
  chemically synthesized
ttcaataggtttgggatgaa

SEQ ID NO: 217808 - DNA, 20 bp, Artificial Sequence
  chemically synthesized
aataggtttgggatgaaggg

SEQ ID NO: 217809 - DNA, 20 bp, Artificial Sequence
  chemically synthesized
ataggtttgggatgaagggt

SEQ ID NO: 217810 - DNA, 20 bp, Artificial Sequence
  chemically synthesized
aggtttgggatgaagggtag

SEQ ID NO: 217811 - DNA, 20 bp, Artificial Sequence
  chemically synthesized
ggatgaagggtaggagtcta

SEQ ID NO: 217812 - DNA, 20 bp, Artificial Sequence
  chemically synthesized
gggcagcttgataaaagctg

SEQ ID NO: 217813 - DNA, 20 bp, Artificial Sequence
  chemically synthesized
aggagtctacagcttttatc

SEQ ID NO: 217814 - DNA, 20 bp, Artificial Sequence
  chemically synthesized
tcatctgggcagcttgataa

SEQ ID NO: 217815 - DNA, 20 bp, Artificial Sequence
  chemically synthesized
acagcttttatcaagctgcc

SEQ ID NO: 217816 - DNA, 20 bp, Artificial Sequence
  chemically synthesized
accttacagaatcatctggg

SEQ ID NO: 217817 - DNA, 20 bp, Artificial Sequence
  chemically synthesized
aacaccttacagaatcatct

SEQ ID NO: 217818 - DNA, 20 bp, Artificial Sequence
  chemically synthesized
taacaccttacagaatcatc

SEQ ID NO: 217819 - DNA, 20 bp, Artificial Sequence
  chemically synthesized
agctgcccagatgattctgt

SEQ ID NO: 217820 - DNA, 20 bp, Artificial Sequence
  chemically synthesized
gctgcccagatgattctgta

SEQ ID NO: 217821 - DNA, 20 bp, Artificial Sequence
  chemically synthesized
gcaatccagataacacctta

SEQ ID NO: 217822 - DNA, 20 bp, Artificial Sequence
  chemically synthesized
tgattctgtaaggtgttatc

SEQ ID NO: 217823 - DNA, 20 bp, Artificial Sequence
  chemically synthesized
gcatttctctaaatgcaatc

SEQ ID NO: 217824 - DNA, 20 bp, Artificial Sequence
  chemically synthesized
ggtgttatctggattgcatt

SEQ ID NO: 217825 - DNA, 20 bp, Artificial Sequence
  chemically synthesized
tgttatctggattgcattta

SEQ ID NO: 217826 - DNA, 20 bp, Artificial Sequence
  chemically synthesized
gattgcatttagagaaatgc

SEQ ID NO: 217827 - DNA, 20 bp, Artificial Sequence
  chemically synthesized
atttagagaaatgctggcca

SEQ ID NO: 217828 - DNA, 20 bp, Artificial Sequence
  chemically synthesized
gatactatttagactgtggc

SEQ ID NO: 217829 - DNA, 20 bp, Artificial Sequence
  chemically synthesized
ttcagatactatttagactg

SEQ ID NO: 217830 - DNA, 20 bp, Artificial Sequence
  chemically synthesized
aatgctggccacagtctaaa

SEQ ID NO: 217831 - DNA, 20 bp, Artificial Sequence
  chemically synthesized
ttagtggttcagatactatt

SEQ ID NO: 217832 - DNA, 20 bp, Artificial Sequence
  chemically synthesized
gagagatgtatttagtggtt

SEQ ID NO: 217833 - DNA, 20 bp, Artificial Sequence
  chemically synthesized
gcacagagagatgtatttag

SEQ ID NO: 217834 - DNA, 20 bp, Artificial Sequence
  chemically synthesized
ggggcacagagagatgtatt

SEQ ID NO: 217835 - DNA, 20 bp, Artificial Sequence
  chemically synthesized
gggtgggcagggggcacaga

SEQ ID NO: 217836 - DNA, 20 bp, Artificial Sequence
  chemically synthesized
tggggtgggcagggggcaca

SEQ ID NO: 217837 - DNA, 20 bp, Artificial Sequence
  chemically synthesized
gatggggtgggcagggggca

SEQ ID NO: 217838 - DNA, 20 bp, Artificial Sequence
  chemically synthesized
tcacagatggggtgggcagg

SEQ ID NO: 217839 - DNA, 20 bp, Artificial Sequence
  chemically synthesized
ttcacagatggggtgggcag

SEQ ID NO: 217840 - DNA, 20 bp, Artificial Sequence
  chemically synthesized
tttcacagatggggtgggca

SEQ ID NO: 217841 - DNA, 20 bp, Artificial Sequence
  chemically synthesized
atttcacagatggggtgggc

SEQ ID NO: 217842 - DNA, 20 bp, Artificial Sequence
  chemically synthesized
aatttcacagatggggtggg

SEQ ID NO: 217843 - DNA, 20 bp, Artificial Sequence
  chemically synthesized
aaaaatttcacagatggggt

SEQ ID NO: 217844 - DNA, 20 bp, Artificial Sequence
  chemically synthesized
aaaaaatttcacagatgggg

SEQ ID NO: 217845 - DNA, 20 bp, Artificial Sequence
  chemically synthesized
ctcaaaaaatttcacagatg

SEQ ID NO: 217846 - DNA, 20 bp, Artificial Sequence
  chemically synthesized
tctcaaaaaatttcacagat

SEQ ID NO: 217847 - DNA, 20 bp, Artificial Sequence
  chemically synthesized
atctcaaaaaatttcacaga

SEQ ID NO: 217848 - DNA, 20 bp, Artificial Sequence
  chemically synthesized
gatgatctcaaaaaatttca

SEQ ID NO: 217849 - DNA, 20 bp, Artificial Sequence
  chemically synthesized
ccccatctgtgaaatttttt

SEQ ID NO: 217850 - DNA, 20 bp, Artificial Sequence
  chemically synthesized
aaattttttgagatcatctt

SEQ ID NO: 217851 - DNA, 20 bp, Artificial Sequence
  chemically synthesized
tgtgctgtgacggggagctc

SEQ ID NO: 217852 - DNA, 20 bp, Artificial Sequence
  chemically synthesized
tcatcttgagctccccgtca

SEQ ID NO: 217853 - DNA, 20 bp, Artificial Sequence
  chemically synthesized
aggcactgtgctgtgacggg

SEQ ID NO: 217854 - DNA, 20 bp, Artificial Sequence
  chemically synthesized
gcaggcactgtgctgtgacg

SEQ ID NO: 217855 - DNA, 20 bp, Artificial Sequence
  chemically synthesized
tgcaggcactgtgctgtgac

SEQ ID NO: 217856 - DNA, 20 bp, Artificial Sequence
  chemically synthesized
ttgcaggcactgtgctgtga

SEQ ID NO: 217857 - DNA, 20 bp, Artificial Sequence
  chemically synthesized
ttgagctccccgtcacagca

SEQ ID NO: 217858 - DNA, 20 bp, Artificial Sequence
  chemically synthesized
tcacagcacagtgcctgcaa

SEQ ID NO: 217859 - DNA, 20 bp, Artificial Sequence
  chemically synthesized
gaatgtgtcagttctgttgc

SEQ ID NO: 217860 - DNA, 20 bp, Artificial Sequence
  chemically synthesized
ggaatgtgtcagttctgttg

SEQ ID NO: 217861 - DNA, 20 bp, Artificial Sequence
  chemically synthesized
acatttagagaggaatgtgt

SEQ ID NO: 217862 - DNA, 20 bp, Artificial Sequence
  chemically synthesized
ttattcagaaacatttagag

SEQ ID NO: 217863 - DNA, 20 bp, Artificial Sequence
  chemically synthesized
tttattcagaaacatttaga

SEQ ID NO: 217864 - DNA, 20 bp, Artificial Sequence
  chemically synthesized
tatttattcagaaacattta

SEQ ID NO: 217865 - DNA, 20 bp, Artificial Sequence
  chemically synthesized
tttatttattcagaaacatt

SEQ ID NO: 217866 - DNA, 20 bp, Artificial Sequence
  chemically synthesized
caaagtgcagtttatttatt

SEQ ID NO: 217867 - DNA, 20 bp, Artificial Sequence
  chemically synthesized
tgaataaataaactgcactt

SEQ ID NO: 217868 - DNA, 20 bp, Artificial Sequence
  chemically synthesized
gcaatttgtctgccaaagtg

SEQ ID NO: 217869 - DNA, 20 bp, Artificial Sequence
  chemically synthesized
ataaataaactgcactttgg

SEQ ID NO: 217870 - DNA, 20 bp, Artificial Sequence
  chemically synthesized
ggattgcaatttgtctgcca

SEQ ID NO: 217871 - DNA, 20 bp, Artificial Sequence
  chemically synthesized
gagaaaaaaggttcacatta

SEQ ID NO: 217872 - DNA, 20 bp, Artificial Sequence
  chemically synthesized
agagaaaaaaggttcacatt

SEQ ID NO: 217873 - DNA, 20 bp, Artificial Sequence
  chemically synthesized
aagagaaaaaaggttcacat

SEQ ID NO: 217874 - DNA, 20 bp, Artificial Sequence
  chemically synthesized
ttgtctagataagagaaaaa

SEQ ID NO: 217875 - DNA, 20 bp, Artificial Sequence
  chemically synthesized
tttgtctagataagagaaaa

SEQ ID NO: 217876 - DNA, 20 bp, Artificial Sequence
  chemically synthesized
tgaaccttttttctcttatc

SEQ ID NO: 217877 - DNA, 20 bp, Artificial Sequence
  chemically synthesized
tgcctcatttgtctagataa

SEQ ID NO: 217878 - DNA, 20 bp, Artificial Sequence
  chemically synthesized
tttgcctcatttgtctagat

SEQ ID NO: 217879 - DNA, 20 bp, Artificial Sequence
  chemically synthesized
tttctcttatctagacaaat

SEQ ID NO: 217880 - DNA, 20 bp, Artificial Sequence
  chemically synthesized
gtagttttgcctcatttgtc

SEQ ID NO: 217881 - DNA, 20 bp, Artificial Sequence
  chemically synthesized
ttctcttatctagacaaatg

SEQ ID NO: 217882 - DNA, 20 bp, Artificial Sequence
  chemically synthesized
atgaggcaaaactactctga

SEQ ID NO: 217883 - DNA, 20 bp, Artificial Sequence
  chemically synthesized
accactgaagtctgtcagag

SEQ ID NO: 217884 - DNA, 20 bp, Artificial Sequence
  chemically synthesized
actaccactgaagtctgtca

SEQ ID NO: 217885 - DNA, 20 bp, Artificial Sequence
  chemically synthesized
aaactaccactgaagtctgt

SEQ ID NO: 217886 - DNA, 20 bp, Artificial Sequence
  chemically synthesized
aaaactactctgacagactt

SEQ ID NO: 217887 - DNA, 20 bp, Artificial Sequence
  chemically synthesized
actactctgacagacttcag

SEQ ID NO: 217888 - DNA, 20 bp, Artificial Sequence
  chemically synthesized
actctgacagacttcagtgg

SEQ ID NO: 217889 - DNA, 20 bp, Artificial Sequence
  chemically synthesized
caatttaaaaactaccactg

SEQ ID NO: 217890 - DNA, 20 bp, Artificial Sequence
  chemically synthesized
tttttaaattgttgttattt

SEQ ID NO: 217891 - DNA, 20 bp, Artificial Sequence
  chemically synthesized
ttttaaattgttgttattta

SEQ ID NO: 217892 - DNA, 20 bp, Artificial Sequence
  chemically synthesized
ttaaggaatacactactcat

SEQ ID NO: 217893 - DNA, 20 bp, Artificial Sequence
  chemically synthesized
taaggaatacactactcata

SEQ ID NO: 217894 - DNA, 20 bp, Artificial Sequence
  chemically synthesized
agaagaaaagtccttatgag

SEQ ID NO: 217895 - DNA, 20 bp, Artificial Sequence
  chemically synthesized
gtgagaagaaaagtccttat

SEQ ID NO: 217896 - DNA, 20 bp, Artificial Sequence
  chemically synthesized
aatgttcaatgtgagaagaa

SEQ ID NO: 217897 - DNA, 20 bp, Artificial Sequence
  chemically synthesized
cttgtaatgttcaatgtgag

SEQ ID NO: 217898 - DNA, 20 bp, Artificial Sequence
  chemically synthesized
tatcttgtaatgttcaatgt

SEQ ID NO: 217899 - DNA, 20 bp, Artificial Sequence
  chemically synthesized
cttctcacattgaacattac

SEQ ID NO: 217900 - DNA, 20 bp, Artificial Sequence
  chemically synthesized
aaattaaaataattttatct

SEQ ID NO: 217901 - DNA, 20 bp, Artificial Sequence
  chemically synthesized
ttagtgtcaggacatttact

SEQ ID NO: 217902 - DNA, 20 bp, Artificial Sequence
  chemically synthesized
taagtaaatgtcctgacact

SEQ ID NO: 217903 - DNA, 20 bp, Artificial Sequence
  chemically synthesized
gtctggctaaacttagtgtc

SEQ ID NO: 217904 - DNA, 20 bp, Artificial Sequence
  chemically synthesized
agtctggctaaacttagtgt

SEQ ID NO: 217905 - DNA, 20 bp, Artificial Sequence
  chemically synthesized
aaatgtcctgacactaagtt

SEQ ID NO: 217906 - DNA, 20 bp, Artificial Sequence
  chemically synthesized
gggtgaagtctggctaaact

SEQ ID NO: 217907 - DNA, 20 bp, Artificial Sequence
  chemically synthesized
gtcctgacactaagtttagc

SEQ ID NO: 217908 - DNA, 20 bp, Artificial Sequence
  chemically synthesized
accgattaaggggtgaagtc

SEQ ID NO: 217909 - DNA, 20 bp, Artificial Sequence
  chemically synthesized
agaaaaccgattaaggggtg

SEQ ID NO: 217910 - DNA, 20 bp, Artificial Sequence
  chemically synthesized
gccagacttcaccccttaat

SEQ ID NO: 217911 - DNA, 20 bp, Artificial Sequence
  chemically synthesized
gttttagaaaaccgattaag

SEQ ID NO: 217912 - DNA, 20 bp, Artificial Sequence
  chemically synthesized
tgttttagaaaaccgattaa

SEQ ID NO: 217913 - DNA, 20 bp, Artificial Sequence
  chemically synthesized
gtgttttagaaaaccgatta

SEQ ID NO: 217914 - DNA, 20 bp, Artificial Sequence
  chemically synthesized
tgtgttttagaaaaccgatt

SEQ ID NO: 217915 - DNA, 20 bp, Artificial Sequence
  chemically synthesized
tttgttttctttttgtgttt

SEQ ID NO: 217916 - DNA, 20 bp, Artificial Sequence
  chemically synthesized
tcggttttctaaaacacaaa

SEQ ID NO: 217917 - DNA, 20 bp, Artificial Sequence
  chemically synthesized
gaaaacaaatgacacctaca

SEQ ID NO: 217918 - DNA, 20 bp, Artificial Sequence
  chemically synthesized
caaaagtaaaatttccatgt

SEQ ID NO: 217919 - DNA, 20 bp, Artificial Sequence
  chemically synthesized
tcaaaagtaaaatttccatg

SEQ ID NO: 217920 - DNA, 20 bp, Artificial Sequence
  chemically synthesized
atggaaattttacttttgaa

SEQ ID NO: 217921 - DNA, 20 bp, Artificial Sequence
  chemically synthesized
tttctttcactgcttttcaa

SEQ ID NO: 217922 - DNA, 20 bp, Artificial Sequence
  chemically synthesized
gaaattttacttttgaaaag

SEQ ID NO: 217923 - DNA, 20 bp, Artificial Sequence
  chemically synthesized
ttacttttgaaaagcagtga

SEQ ID NO: 217924 - DNA, 20 bp, Artificial Sequence
  chemically synthesized
ttttgaaaagcagtgaaaga

SEQ ID NO: 217925 - DNA, 20 bp, Artificial Sequence
  chemically synthesized
tgaaaagcagtgaaagaaag

SEQ ID NO: 217926 - DNA, 20 bp, Artificial Sequence
  chemically synthesized
agcagtgaaagaaagcagtg

SEQ ID NO: 217927 - DNA, 20 bp, Artificial Sequence
  chemically synthesized
agtgaagacgctttgacctt

SEQ ID NO: 217928 - DNA, 20 bp, Artificial Sequence
  chemically synthesized
tgtaatcttactcaaggtca

SEQ ID NO: 217929 - DNA, 20 bp, Artificial Sequence
  chemically synthesized
aagacgctttgaccttgagt

SEQ ID NO: 217930 - DNA, 20 bp, Artificial Sequence
  chemically synthesized
agaggctgtaatcttactca

SEQ ID NO: 217931 - DNA, 20 bp, Artificial Sequence
  chemically synthesized
cagaggctgtaatcttactc

SEQ ID NO: 217932 - DNA, 20 bp, Artificial Sequence
  chemically synthesized
tttgaccttgagtaagatta

SEQ ID NO: 217933 - DNA, 20 bp, Artificial Sequence
  chemically synthesized
ttgagtaagattacagcctc

SEQ ID NO: 217934 - DNA, 20 bp, Artificial Sequence
  chemically synthesized
atgtctcatttggggaccag

SEQ ID NO: 217935 - DNA, 20 bp, Artificial Sequence
  chemically synthesized
catgtctcatttggggacca

SEQ ID NO: 217936 - DNA, 20 bp, Artificial Sequence
  chemically synthesized
cacatgtctcatttggggac

SEQ ID NO: 217937 - DNA, 20 bp, Artificial Sequence
  chemically synthesized
acagcctctggtccccaaat

SEQ ID NO: 217938 - DNA, 20 bp, Artificial Sequence
  chemically synthesized
gactacacatgtctcatttg

SEQ ID NO: 217939 - DNA, 20 bp, Artificial Sequence
  chemically synthesized
agactacacatgtctcattt

SEQ ID NO: 217940 - DNA, 20 bp, Artificial Sequence
  chemically synthesized
aagactacacatgtctcatt

SEQ ID NO: 217941 - DNA, 20 bp, Artificial Sequence
  chemically synthesized
gtccccaaatgagacatgtg

SEQ ID NO: 217942 - DNA, 20 bp, Artificial Sequence
  chemically synthesized
acatttacctgagacaaggt

SEQ ID NO: 217943 - DNA, 20 bp, Artificial Sequence
  chemically synthesized
tgtgtagtcttaccttgtct

SEQ ID NO: 217944 - DNA, 20 bp, Artificial Sequence
  chemically synthesized
gtgtagtcttaccttgtctc

SEQ ID NO: 217945 - DNA, 20 bp, Artificial Sequence
  chemically synthesized
acacacatttacctgagaca

SEQ ID NO: 217946 - DNA, 20 bp, Artificial Sequence
  chemically synthesized
aacacacatttacctgagac

SEQ ID NO: 217947 - DNA, 20 bp, Artificial Sequence
  chemically synthesized
agatgaacacacatttacct

SEQ ID NO: 217948 - DNA, 20 bp, Artificial Sequence
  chemically synthesized
catgtggtatgtatgtatac

SEQ ID NO: 217949 - DNA, 20 bp, Artificial Sequence
  chemically synthesized
ttccccttcctgtattcatg

SEQ ID NO: 217950 - DNA, 20 bp, Artificial Sequence
  chemically synthesized
acatacataccacatgaata

SEQ ID NO: 217951 - DNA, 20 bp, Artificial Sequence
  chemically synthesized
catacataccacatgaatac

SEQ ID NO: 217952 - DNA, 20 bp, Artificial Sequence
  chemically synthesized
acataccacatgaatacagg

SEQ ID NO: 217953 - DNA, 20 bp, Artificial Sequence
  chemically synthesized
cataccacatgaatacagga

SEQ ID NO: 217954 - DNA, 20 bp, Artificial Sequence
  chemically synthesized
ataccacatgaatacaggaa

SEQ ID NO: 217955 - DNA, 20 bp, Artificial Sequence
  chemically synthesized
taccacatgaatacaggaag

SEQ ID NO: 217956 - DNA, 20 bp, Artificial Sequence
  chemically synthesized
ggaaggggaatactaaaacc

SEQ ID NO: 217957 - DNA, 20 bp, Artificial Sequence
  chemically synthesized
ccattcaccttactaggttt

SEQ ID NO: 217958 - DNA, 20 bp, Artificial Sequence
  chemically synthesized
ggggaatactaaaacctagt

SEQ ID NO: 217959 - DNA, 20 bp, Artificial Sequence
  chemically synthesized
gggaatactaaaacctagta

SEQ ID NO: 217960 - DNA, 20 bp, Artificial Sequence
  chemically synthesized
acaaaaccattcaccttact

SEQ ID NO: 217961 - DNA, 20 bp, Artificial Sequence
  chemically synthesized
cacaaaaccattcaccttac

SEQ ID NO: 217962 - DNA, 20 bp, Artificial Sequence
  chemically synthesized
ctaaaacctagtaaggtgaa

SEQ ID NO: 217963 - DNA, 20 bp, Artificial Sequence
  chemically synthesized
agtaaggtgaatggttttgt

SEQ ID NO: 217964 - DNA, 20 bp, Artificial Sequence
  chemically synthesized
acaagacagatttttttcat

SEQ ID NO: 217965 - DNA, 20 bp, Artificial Sequence
  chemically synthesized
aggtccatcctgtaacaaga

SEQ ID NO: 217966 - DNA, 20 bp, Artificial Sequence
  chemically synthesized
gaaaaaaatctgtcttgtta

SEQ ID NO: 217967 - DNA, 20 bp, Artificial Sequence
  chemically synthesized
aaaaaaatctgtcttgttac

SEQ ID NO: 217968 - DNA, 20 bp, Artificial Sequence
  chemically synthesized
agaaaggtccatcctgtaac

SEQ ID NO: 217969 - DNA, 20 bp, Artificial Sequence
  chemically synthesized
aaatctgtcttgttacagga

SEQ ID NO: 217970 - DNA, 20 bp, Artificial Sequence
  chemically synthesized
ttaaagaaccacgggaagaa

SEQ ID NO: 217971 - DNA, 20 bp, Artificial Sequence
  chemically synthesized
gttaaagaaccacgggaaga

SEQ ID NO: 217972 - DNA, 20 bp, Artificial Sequence
  chemically synthesized
aggatggacctttcttcccg

SEQ ID NO: 217973 - DNA, 20 bp, Artificial Sequence
  chemically synthesized
tcaagttaaagaaccacggg

SEQ ID NO: 217974 - DNA, 20 bp, Artificial Sequence
  chemically synthesized
cactcaagttaaagaaccac

SEQ ID NO: 217975 - DNA, 20 bp, Artificial Sequence
  chemically synthesized
acactcaagttaaagaacca

SEQ ID NO: 217976 - DNA, 20 bp, Artificial Sequence
  chemically synthesized
ttcccgtggttctttaactt

SEQ ID NO: 217977 - DNA, 20 bp, Artificial Sequence
  chemically synthesized
tctaacgcacactcaagtta

SEQ ID NO: 217978 - DNA, 20 bp, Artificial Sequence
  chemically synthesized
ggcaattctaacgcacactc

SEQ ID NO: 217979 - DNA, 20 bp, Artificial Sequence
  chemically synthesized
tctttaacttgagtgtgcgt

SEQ ID NO: 217980 - DNA, 20 bp, Artificial Sequence
  chemically synthesized
gtgtgcgttagaattgccta

SEQ ID NO: 217981 - DNA, 20 bp, Artificial Sequence
  chemically synthesized
tgtgcgttagaattgcctac

SEQ ID NO: 217982 - DNA, 20 bp, Artificial Sequence
  chemically synthesized
gtgcgttagaattgcctaca

SEQ ID NO: 217983 - DNA, 20 bp, Artificial Sequence
  chemically synthesized
gatctgtgatcaagccctgt

SEQ ID NO: 217984 - DNA, 20 bp, Artificial Sequence
  chemically synthesized
agatctgtgatcaagccctg

SEQ ID NO: 217985 - DNA, 20 bp, Artificial Sequence
  chemically synthesized
ttgcctacagggcttgatca

SEQ ID NO: 217986 - DNA, 20 bp, Artificial Sequence
  chemically synthesized
gagcccgcagatctgtgatc

SEQ ID NO: 217987 - DNA, 20 bp, Artificial Sequence
  chemically synthesized
agggcttgatcacagatctg

SEQ ID NO: 217988 - DNA, 20 bp, Artificial Sequence
  chemically synthesized
gggcttgatcacagatctgc

SEQ ID NO: 217989 - DNA, 20 bp, Artificial Sequence
  chemically synthesized
ttcttggagagtggagcccg

SEQ ID NO: 217990 - DNA, 20 bp, Artificial Sequence
  chemically synthesized
acagaaattcttggagagtg

SEQ ID NO: 217991 - DNA, 20 bp, Artificial Sequence
  chemically synthesized
atctgcgggctccactctcc

SEQ ID NO: 217992 - DNA, 20 bp, Artificial Sequence
  chemically synthesized
aaacagaaattcttggagag

SEQ ID NO: 217993 - DNA, 20 bp, Artificial Sequence
  chemically synthesized
ctgaaacagaaattcttgga

SEQ ID NO: 217994 - DNA, 20 bp, Artificial Sequence
  chemically synthesized
tactgaaacagaaattcttg

SEQ ID NO: 217995 - DNA, 20 bp, Artificial Sequence
  chemically synthesized
cctactgaaacagaaattct

SEQ ID NO: 217996 - DNA, 20 bp, Artificial Sequence
  chemically synthesized
ctctccaagaatttctgttt

SEQ ID NO: 217997 - DNA, 20 bp, Artificial Sequence
  chemically synthesized
tccaagaatttctgtttcag

SEQ ID NO: 217998 - DNA, 20 bp, Artificial Sequence
  chemically synthesized
ccaagaatttctgtttcagt

SEQ ID NO: 217999 - DNA, 20 bp, Artificial Sequence
  chemically synthesized
tcacaacagacctactgaaa

SEQ ID NO: 218000 - DNA, 20 bp, Artificial Sequence
  chemically synthesized
tgtttcagtaggtctgttgt

SEQ ID NO: 218001 - DNA, 20 bp, Artificial Sequence
  chemically synthesized
gtttcagtaggtctgttgtg

SEQ ID NO: 218002 - DNA, 20 bp, Artificial Sequence
  chemically synthesized
cccattcttgagcctcacaa

SEQ ID NO: 218003 - DNA, 20 bp, Artificial Sequence
  chemically synthesized
gtaggtctgttgtgaggctc

SEQ ID NO: 218004 - DNA, 20 bp, Artificial Sequence
  chemically synthesized
tctgttgtgaggctcaagaa

SEQ ID NO: 218005 - DNA, 20 bp, Artificial Sequence
  chemically synthesized
ctgttgtgaggctcaagaat

SEQ ID NO: 218006 - DNA, 20 bp, Artificial Sequence
  chemically synthesized
ggttagaaatgcccattctt

SEQ ID NO: 218007 - DNA, 20 bp, Artificial Sequence
  chemically synthesized
atcagcatcacggggatggt

SEQ ID NO: 218008 - DNA, 20 bp, Artificial Sequence
  chemically synthesized
ccagatcagcatcacgggga

SEQ ID NO: 218009 - DNA, 20 bp, Artificial Sequence
  chemically synthesized
ggtcccagatcagcatcacg

SEQ ID NO: 218010 - DNA, 20 bp, Artificial Sequence
  chemically synthesized
gggtcccagatcagcatcac

SEQ ID NO: 218011 - DNA, 20 bp, Artificial Sequence
  chemically synthesized
tgggtcccagatcagcatca

SEQ ID NO: 218012 - DNA, 20 bp, Artificial Sequence
  chemically synthesized
ccatccccgtgatgctgatc

SEQ ID NO: 218013 - DNA, 20 bp, Artificial Sequence
  chemically synthesized
catccccgtgatgctgatct

SEQ ID NO: 218014 - DNA, 20 bp, Artificial Sequence
  chemically synthesized
tcaaagtgtgggtcccagat

SEQ ID NO: 218015 - DNA, 20 bp, Artificial Sequence
  chemically synthesized
tgttttcaaagtgtgggtcc

SEQ ID NO: 218016 - DNA, 20 bp, Artificial Sequence
  chemically synthesized
agcagttgttttcaaagtgt

SEQ ID NO: 218017 - DNA, 20 bp, Artificial Sequence
  chemically synthesized
gagcagttgttttcaaagtg

SEQ ID NO: 218018 - DNA, 20 bp, Artificial Sequence
  chemically synthesized
gagtagagcagttgttttca

SEQ ID NO: 218019 - DNA, 20 bp, Artificial Sequence
  chemically synthesized
tttccccctatggagtagag

SEQ ID NO: 218020 - DNA, 20 bp, Artificial Sequence
  chemically synthesized
aaaacaactgctctactcca

SEQ ID NO: 218021 - DNA, 20 bp, Artificial Sequence
  chemically synthesized
tcatttccccctatggagta

SEQ ID NO: 218022 - DNA, 20 bp, Artificial Sequence
  chemically synthesized
aaacaactgctctactccat

SEQ ID NO: 218023 - DNA, 20 bp, Artificial Sequence
  chemically synthesized
aacaactgctctactccata

SEQ ID NO: 218024 - DNA, 20 bp, Artificial Sequence
  chemically synthesized
attcatttccccctatggag

SEQ ID NO: 218025 - DNA, 20 bp, Artificial Sequence
  chemically synthesized
acaactgctctactccatag

SEQ ID NO: 218026 - DNA, 20 bp, Artificial Sequence
  chemically synthesized
caactgctctactccatagg

SEQ ID NO: 218027 - DNA, 20 bp, Artificial Sequence
  chemically synthesized
cacattcatttccccctatg

SEQ ID NO: 218028 - DNA, 20 bp, Artificial Sequence
  chemically synthesized
gacacattcatttcccccta

SEQ ID NO: 218029 - DNA, 20 bp, Artificial Sequence
  chemically synthesized
atagggggaaatgaatgtgt

SEQ ID NO: 218030 - DNA, 20 bp, Artificial Sequence
  chemically synthesized
tagggggaaatgaatgtgtc

SEQ ID NO: 218031 - DNA, 20 bp, Artificial Sequence
  chemically synthesized
gaaatgaatgtgtcaggaaa

SEQ ID NO: 218032 - DNA, 20 bp, Artificial Sequence
  chemically synthesized
aaatgaatgtgtcaggaaaa

SEQ ID NO: 218033 - DNA, 20 bp, Artificial Sequence
  chemically synthesized
tttctctttcttcagaaaca

SEQ ID NO: 218034 - DNA, 20 bp, Artificial Sequence
  chemically synthesized
aaaaaggtgctctgtttctg

SEQ ID NO: 218035 - DNA, 20 bp, Artificial Sequence
  chemically synthesized
tgtttctctttcttcagaaa

SEQ ID NO: 218036 - DNA, 20 bp, Artificial Sequence
  chemically synthesized
aggtgctctgtttctgaaga

SEQ ID NO: 218037 - DNA, 20 bp, Artificial Sequence
  chemically synthesized
gtgctctgtttctgaagaaa

SEQ ID NO: 218038 - DNA, 20 bp, Artificial Sequence
  chemically synthesized
ctttcatgtttctctttctt

SEQ ID NO: 218039 - DNA, 20 bp, Artificial Sequence
  chemically synthesized
ctgaagaaagagaaacatga

SEQ ID NO: 218040 - DNA, 20 bp, Artificial Sequence
  chemically synthesized
tgaagaaagagaaacatgaa

SEQ ID NO: 218041 - DNA, 20 bp, Artificial Sequence
  chemically synthesized
gaaagagaaacatgaaaggt

SEQ ID NO: 218042 - DNA, 20 bp, Artificial Sequence
  chemically synthesized
gaaacatgaaaggttagaca

SEQ ID NO: 218043 - DNA, 20 bp, Artificial Sequence
  chemically synthesized
aaggttagacaaagaatata

SEQ ID NO: 218044 - DNA, 20 bp, Artificial Sequence
  chemically synthesized
aggttagacaaagaatataa

SEQ ID NO: 218045 - DNA, 20 bp, Artificial Sequence
  chemically synthesized
ttattttacttcgaggattt

SEQ ID NO: 218046 - DNA, 20 bp, Artificial Sequence
  chemically synthesized
aaaggtaactgaaatcctcg

SEQ ID NO: 218047 - DNA, 20 bp, Artificial Sequence
  chemically synthesized
gtggaatttattttacttcg

SEQ ID NO: 218048 - DNA, 20 bp, Artificial Sequence
  chemically synthesized
ggtggaatttattttacttc

SEQ ID NO: 218049 - DNA, 20 bp, Artificial Sequence
  chemically synthesized
ttataggtatagttaagagg

SEQ ID NO: 218050 - DNA, 20 bp, Artificial Sequence
  chemically synthesized
ggattataggtatagttaag

SEQ ID NO: 218051 - DNA, 20 bp, Artificial Sequence
  chemically synthesized
aggattataggtatagttaa

SEQ ID NO: 218052 - DNA, 20 bp, Artificial Sequence
  chemically synthesized
aaaggattataggtatagtt

SEQ ID NO: 218053 - DNA, 20 bp, Artificial Sequence
  chemically synthesized
gaaacaaaggattataggta

SEQ ID NO: 218054 - DNA, 20 bp, Artificial Sequence
  chemically synthesized
cctgtgaaacaaaggattat

SEQ ID NO: 218055 - DNA, 20 bp, Artificial Sequence
  chemically synthesized
gcctgtgaaacaaaggatta

SEQ ID NO: 218056 - DNA, 20 bp, Artificial Sequence
  chemically synthesized
taggctggcctgtgaaacaa

SEQ ID NO: 218057 - DNA, 20 bp, Artificial Sequence
  chemically synthesized
acctataatcctttgtttca

SEQ ID NO: 218058 - DNA, 20 bp, Artificial Sequence
  chemically synthesized
ttaggctggcctgtgaaaca

SEQ ID NO: 218059 - DNA, 20 bp, Artificial Sequence
  chemically synthesized
cctataatcctttgtttcac

SEQ ID NO: 218060 - DNA, 20 bp, Artificial Sequence
  chemically synthesized
taatcctttgtttcacaggc

SEQ ID NO: 218061 - DNA, 20 bp, Artificial Sequence
  chemically synthesized
ataaagtggtaaatttaggc

SEQ ID NO: 218062 - DNA, 20 bp, Artificial Sequence
  chemically synthesized
taagataaagtggtaaattt

SEQ ID NO: 218063 - DNA, 20 bp, Artificial Sequence
  chemically synthesized
ataagataaagtggtaaatt

SEQ ID NO: 218064 - DNA, 20 bp, Artificial Sequence
  chemically synthesized
gacaactctataagataaag

SEQ ID NO: 218065 - DNA, 20 bp, Artificial Sequence
  chemically synthesized
aaatttaccactttatctta

SEQ ID NO: 218066 - DNA, 20 bp, Artificial Sequence
  chemically synthesized
acagacaactctataagata

SEQ ID NO: 218067 - DNA, 20 bp, Artificial Sequence
  chemically synthesized
atttaccactttatcttata

SEQ ID NO: 218068 - DNA, 20 bp, Artificial Sequence
  chemically synthesized
attcacacagacaactctat

SEQ ID NO: 218069 - DNA, 20 bp, Artificial Sequence
  chemically synthesized
cataagaaagcggattcaca

SEQ ID NO: 218070 - DNA, 20 bp, Artificial Sequence
  chemically synthesized
ctcactatatcataagaaag

SEQ ID NO: 218071 - DNA, 20 bp, Artificial Sequence
  chemically synthesized
gagctcactatatcataaga

SEQ ID NO: 218072 - DNA, 20 bp, Artificial Sequence
  chemically synthesized
gaatccgctttcttatgata

SEQ ID NO: 218073 - DNA, 20 bp, Artificial Sequence
  chemically synthesized
aaaggagctcactatatcat

SEQ ID NO: 218074 - DNA, 20 bp, Artificial Sequence
  chemically synthesized
ccgctttcttatgatatagt

SEQ ID NO: 218075 - DNA, 20 bp, Artificial Sequence
  chemically synthesized
gcatgccacaatgtttaaag

SEQ ID NO: 218076 - DNA, 20 bp, Artificial Sequence
  chemically synthesized
aagcatgccacaatgtttaa

SEQ ID NO: 218077 - DNA, 20 bp, Artificial Sequence
  chemically synthesized
aaagcatgccacaatgttta

SEQ ID NO: 218078 - DNA, 20 bp, Artificial Sequence
  chemically synthesized
gtgagctcctttaaacattg

SEQ ID NO: 218079 - DNA, 20 bp, Artificial Sequence
  chemically synthesized
gacagacataaagatgaata

SEQ ID NO: 218080 - DNA, 20 bp, Artificial Sequence
  chemically synthesized
tctaatctatgacagacata

SEQ ID NO: 218081 - DNA, 20 bp, Artificial Sequence
  chemically synthesized
attcatctttatgtctgtca

SEQ ID NO: 218082 - DNA, 20 bp, Artificial Sequence
  chemically synthesized
ttactacttctaatctatga

SEQ ID NO: 218083 - DNA, 20 bp, Artificial Sequence
  chemically synthesized
tctttatgtctgtcatagat

SEQ ID NO: 218084 - DNA, 20 bp, Artificial Sequence
  chemically synthesized
ttatgtctgtcatagattag

SEQ ID NO: 218085 - DNA, 20 bp, Artificial Sequence
  chemically synthesized
tgtctgtcatagattagaag

SEQ ID NO: 218086 - DNA, 20 bp, Artificial Sequence
  chemically synthesized
tgtcatagattagaagtagt

SEQ ID NO: 218087 - DNA, 20 bp, Artificial Sequence
  chemically synthesized
ataaacatttgttgcgttaa

SEQ ID NO: 218088 - DNA, 20 bp, Artificial Sequence
  chemically synthesized
atttgttgcgttaaaagtat

SEQ ID NO: 218089 - DNA, 20 bp, Artificial Sequence
  chemically synthesized
gttgcgttaaaagtattaga

SEQ ID NO: 218090 - DNA, 20 bp, Artificial Sequence
  chemically synthesized
ttgcgttaaaagtattagaa

SEQ ID NO: 218091 - DNA, 20 bp, Artificial Sequence
  chemically synthesized
taaaagtattagaaaggaaa

SEQ ID NO: 218092 - DNA, 20 bp, Artificial Sequence
  chemically synthesized
ccaatcgagaataaagtgta

SEQ ID NO: 218093 - DNA, 20 bp, Artificial Sequence
  chemically synthesized
atttctaccaatcgagaata

SEQ ID NO: 218094 - DNA, 20 bp, Artificial Sequence
  chemically synthesized
ctgtacactttattctcgat

SEQ ID NO: 218095 - DNA, 20 bp, Artificial Sequence
  chemically synthesized
tacactttattctcgattgg

SEQ ID NO: 218096 - DNA, 20 bp, Artificial Sequence
  chemically synthesized
ccataaaatttctaccaatc

SEQ ID NO: 218097 - DNA, 20 bp, Artificial Sequence
  chemically synthesized
ctcgattggtagaaatttta

SEQ ID NO: 218098 - DNA, 20 bp, Artificial Sequence
  chemically synthesized
aaattttatggtgtaatcct

SEQ ID NO: 218099 - DNA, 20 bp, Artificial Sequence
  chemically synthesized
aattttatggtgtaatccta

SEQ ID NO: 218100 - DNA, 20 bp, Artificial Sequence
  chemically synthesized
ttatggtgtaatcctaaggt

SEQ ID NO: 218101 - DNA, 20 bp, Artificial Sequence
  chemically synthesized
tatggtgtaatcctaaggta

SEQ ID NO: 218102 - DNA, 20 bp, Artificial Sequence
  chemically synthesized
tcaatagtgtaccttacctt

SEQ ID NO: 218103 - DNA, 20 bp, Artificial Sequence
  chemically synthesized
atcaatagtgtaccttacct

SEQ ID NO: 218104 - DNA, 20 bp, Artificial Sequence
  chemically synthesized
aattcaaacattgaaatcaa

SEQ ID NO: 218105 - DNA, 20 bp, Artificial Sequence
  chemically synthesized
cacatgtgaattgttttaga

SEQ ID NO: 218106 - DNA, 20 bp, Artificial Sequence
  chemically synthesized
attacacatgtgaattgttt

SEQ ID NO: 218107 - DNA, 20 bp, Artificial Sequence
  chemically synthesized
aagtatcacctcacaaaaga

SEQ ID NO: 218108 - DNA, 20 bp, Artificial Sequence
  chemically synthesized
attaaacatctgtcttttgt

SEQ ID NO: 218109 - DNA, 20 bp, Artificial Sequence
  chemically synthesized
ttaaacatctgtcttttgtg

SEQ ID NO: 218110 - DNA, 20 bp, Artificial Sequence
  chemically synthesized
ttttaagtatcacctcacaa

SEQ ID NO: 218111 - DNA, 20 bp, Artificial Sequence
  chemically synthesized
agtgtctctaagtatttttt

SEQ ID NO: 218112 - DNA, 20 bp, Artificial Sequence
  chemically synthesized
ggtgatacttaaaaaatact

SEQ ID NO: 218113 - DNA, 20 bp, Artificial Sequence
  chemically synthesized
tgatacttaaaaaatactta

SEQ ID NO: 218114 - DNA, 20 bp, Artificial Sequence
  chemically synthesized
ctccttatttaagtgtctct

SEQ ID NO: 218115 - DNA, 20 bp, Artificial Sequence
  chemically synthesized
atacttagagacacttaaat

SEQ ID NO: 218116 - DNA, 20 bp, Artificial Sequence
  chemically synthesized
tacttagagacacttaaata

SEQ ID NO: 218117 - DNA, 20 bp, Artificial Sequence
  chemically synthesized
cttagagacacttaaataag

SEQ ID NO: 218118 - DNA, 20 bp, Artificial Sequence
  chemically synthesized
cagcattatgctccttattt

SEQ ID NO: 218119 - DNA, 20 bp, Artificial Sequence
  chemically synthesized
aaataaggagcataatgctg

SEQ ID NO: 218120 - DNA, 20 bp, Artificial Sequence
  chemically synthesized
ttccatatatggtatttcta

SEQ ID NO: 218121 - DNA, 20 bp, Artificial Sequence
  chemically synthesized
tgctgtagaaataccatata

SEQ ID NO: 218122 - DNA, 20 bp, Artificial Sequence
  chemically synthesized
aattgaatagattccatata

SEQ ID NO: 218123 - DNA, 20 bp, Artificial Sequence
  chemically synthesized
taaagttttgttaaattgaa

SEQ ID NO: 218124 - DNA, 20 bp, Artificial Sequence
  chemically synthesized
atttaacaaaactttatatt

SEQ ID NO: 218125 - DNA, 20 bp, Artificial Sequence
  chemically synthesized
tgtggtagaagctcaatata

SEQ ID NO: 218126 - DNA, 20 bp, Artificial Sequence
  chemically synthesized
tactatcaggcatgtggtag

SEQ ID NO: 218127 - DNA, 20 bp, Artificial Sequence
  chemically synthesized
gtatactatcaggcatgtgg

SEQ ID NO: 218128 - DNA, 20 bp, Artificial Sequence
  chemically synthesized
tgagtatactatcaggcatg

SEQ ID NO: 218129 - DNA, 20 bp, Artificial Sequence
  chemically synthesized
agcttctaccacatgcctga

SEQ ID NO: 218130 - DNA, 20 bp, Artificial Sequence
  chemically synthesized
ccagcattgagtatactatc

SEQ ID NO: 218131 - DNA, 20 bp, Artificial Sequence
  chemically synthesized
tccagcattgagtatactat

SEQ ID NO: 218132 - DNA, 20 bp, Artificial Sequence
  chemically synthesized
cctgatagtatactcaatgc

SEQ ID NO: 218133 - DNA, 20 bp, Artificial Sequence
  chemically synthesized
tattagatatttccagcatt

SEQ ID NO: 218134 - DNA, 20 bp, Artificial Sequence
  chemically synthesized
atcattatattagatatttc

SEQ ID NO: 218135 - DNA, 20 bp, Artificial Sequence
  chemically synthesized
agctcttaacatcattatat

SEQ ID NO: 218136 - DNA, 20 bp, Artificial Sequence
  chemically synthesized
atatctaatataatgatgtt

SEQ ID NO: 218137 - DNA, 20 bp, Artificial Sequence
  chemically synthesized
atctaatataatgatgttaa

SEQ ID NO: 218138 - DNA, 20 bp, Artificial Sequence
  chemically synthesized
gctaactaatcaataaattg

SEQ ID NO: 218139 - DNA, 20 bp, Artificial Sequence
  chemically synthesized
aagagcttcaatttattgat

SEQ ID NO: 218140 - DNA, 20 bp, Artificial Sequence
  chemically synthesized
gcttcaatttattgattagt

SEQ ID NO: 218141 - DNA, 20 bp, Artificial Sequence
  chemically synthesized
attgattagttagcatacaa

SEQ ID NO: 218142 - DNA, 20 bp, Artificial Sequence
  chemically synthesized
ttgattagttagcatacaac

SEQ ID NO: 218143 - DNA, 20 bp, Artificial Sequence
  chemically synthesized
gcatacaacaggcaatctgc

SEQ ID NO: 218144 - DNA, 20 bp, Artificial Sequence
  chemically synthesized
catacaacaggcaatctgca

SEQ ID NO: 218145 - DNA, 20 bp, Artificial Sequence
  chemically synthesized
aatttgctgtaaacaccttg

SEQ ID NO: 218146 - DNA, 20 bp, Artificial Sequence
  chemically synthesized
ggcaatctgcaaggtgttta

SEQ ID NO: 218147 - DNA, 20 bp, Artificial Sequence
  chemically synthesized
aggtattgcgatgagtaaat

SEQ ID NO: 218148 - DNA, 20 bp, Artificial Sequence
  chemically synthesized
cttcgtagaggtattgcgat

SEQ ID NO: 218149 - DNA, 20 bp, Artificial Sequence
  chemically synthesized
ctcatcgcaatacctctacg

SEQ ID NO: 218150 - DNA, 20 bp, Artificial Sequence
  chemically synthesized
taataaagccaacttcgtag

SEQ ID NO: 218151 - DNA, 20 bp, Artificial Sequence
  chemically synthesized
ctaataaagccaacttcgta

SEQ ID NO: 218152 - DNA, 20 bp, Artificial Sequence
  chemically synthesized
tcgcaatacctctacgaagt

SEQ ID NO: 218153 - DNA, 20 bp, Artificial Sequence
  chemically synthesized
tgctaataaagccaacttcg

SEQ ID NO: 218154 - DNA, 20 bp, Artificial Sequence
  chemically synthesized
ctctacgaagttggctttat

SEQ ID NO: 218155 - DNA, 20 bp, Artificial Sequence
  chemically synthesized
ttaatctggagatgctaata

SEQ ID NO: 218156 - DNA, 20 bp, Artificial Sequence
  chemically synthesized
gttggctttattagcatctc

SEQ ID NO: 218157 - DNA, 20 bp, Artificial Sequence
  chemically synthesized
tttattagcatctccagatt

SEQ ID NO: 218158 - DNA, 20 bp, Artificial Sequence
  chemically synthesized
ttattagcatctccagatta

SEQ ID NO: 218159 - DNA, 20 bp, Artificial Sequence
  chemically synthesized
atttcctcttccttaatctg

SEQ ID NO: 218160 - DNA, 20 bp, Artificial Sequence
  chemically synthesized
tgatttcctcttccttaatc

SEQ ID NO: 218161 - DNA, 20 bp, Artificial Sequence
  chemically synthesized
ttagcatctccagattaagg

SEQ ID NO: 218162 - DNA, 20 bp, Artificial Sequence
  chemically synthesized
agcatctccagattaaggaa

SEQ ID NO: 218163 - DNA, 20 bp, Artificial Sequence
  chemically synthesized
gcatctccagattaaggaag

SEQ ID NO: 218164 - DNA, 20 bp, Artificial Sequence
  chemically synthesized
gattaaggaagaggaaatca

SEQ ID NO: 218165 - DNA, 20 bp, Artificial Sequence
  chemically synthesized
tagaataaattaatgtttta

SEQ ID NO: 218166 - DNA, 20 bp, Artificial Sequence
  chemically synthesized
ttaatttattctaaatcaca

SEQ ID NO: 218167 - DNA, 20 bp, Artificial Sequence
  chemically synthesized
catttcttagctgtgtgatt

SEQ ID NO: 218168 - DNA, 20 bp, Artificial Sequence
  chemically synthesized
ttattctaaatcacacagct

SEQ ID NO: 218169 - DNA, 20 bp, Artificial Sequence
  chemically synthesized
atcatggttccgtcatttct

SEQ ID NO: 218170 - DNA, 20 bp, Artificial Sequence
  chemically synthesized
atcacacagctaagaaatga

SEQ ID NO: 218171 - DNA, 20 bp, Artificial Sequence
  chemically synthesized
gaaatgacggaaccatgatt

SEQ ID NO: 218172 - DNA, 20 bp, Artificial Sequence
  chemically synthesized
gacaacgttggtccgaatca

SEQ ID NO: 218173 - DNA, 20 bp, Artificial Sequence
  chemically synthesized
actctagcttcggacaacgt

SEQ ID NO: 218174 - DNA, 20 bp, Artificial Sequence
  chemically synthesized
attcggaccaacgttgtccg

SEQ ID NO: 218175 - DNA, 20 bp, Artificial Sequence
  chemically synthesized
ggaccaacgttgtccgaagc

SEQ ID NO: 218176 - DNA, 20 bp, Artificial Sequence
  chemically synthesized
accaacgttgtccgaagcta

SEQ ID NO: 218177 - DNA, 20 bp, Artificial Sequence
  chemically synthesized
ttgaaagcagactctagctt

SEQ ID NO: 218178 - DNA, 20 bp, Artificial Sequence
  chemically synthesized
gagctgttgaaagcagactc

SEQ ID NO: 218179 - DNA, 20 bp, Artificial Sequence
  chemically synthesized
aagctagagtctgctttcaa

SEQ ID NO: 218180 - DNA, 20 bp, Artificial Sequence
  chemically synthesized
tacagcagagctgttgaaag

SEQ ID NO: 218181 - DNA, 20 bp, Artificial Sequence
  chemically synthesized
caatacagcagagctgttga

SEQ ID NO: 218182 - DNA, 20 bp, Artificial Sequence
  chemically synthesized
cggaatgagtcaatacagca

SEQ ID NO: 218183 - DNA, 20 bp, Artificial Sequence
  chemically synthesized
ttcggaatgagtcaatacag

SEQ ID NO: 218184 - DNA, 20 bp, Artificial Sequence
  chemically synthesized
gtcttcggaatgagtcaata

SEQ ID NO: 218185 - DNA, 20 bp, Artificial Sequence
  chemically synthesized
tgctgtattgactcattccg

SEQ ID NO: 218186 - DNA, 20 bp, Artificial Sequence
  chemically synthesized
gctaaccctgtcttcggaat

SEQ ID NO: 218187 - DNA, 20 bp, Artificial Sequence
  chemically synthesized
gtattgactcattccgaaga

SEQ ID NO: 218188 - DNA, 20 bp, Artificial Sequence
  chemically synthesized
tattgactcattccgaagac

SEQ ID NO: 218189 - DNA, 20 bp, Artificial Sequence
  chemically synthesized
attgactcattccgaagaca

SEQ ID NO: 218190 - DNA, 20 bp, Artificial Sequence
  chemically synthesized
ctaagggctaaccctgtctt

SEQ ID NO: 218191 - DNA, 20 bp, Artificial Sequence
  chemically synthesized
actcattccgaagacagggt

SEQ ID NO: 218192 - DNA, 20 bp, Artificial Sequence
  chemically synthesized
ccgaagacagggttagccct

SEQ ID NO: 218193 - DNA, 20 bp, Artificial Sequence
  chemically synthesized
cgaagacagggttagccctt

SEQ ID NO: 218194 - DNA, 20 bp, Artificial Sequence
  chemically synthesized
gacagggttagcccttagga

SEQ ID NO: 218195 - DNA, 20 bp, Artificial Sequence
  chemically synthesized
tttgcatgtggctttcctaa

SEQ ID NO: 218196 - DNA, 20 bp, Artificial Sequence
  chemically synthesized
ttttgcatgtggctttccta

SEQ ID NO: 218197 - DNA, 20 bp, Artificial Sequence
  chemically synthesized
cttttgcatgtggctttcct

SEQ ID NO: 218198 - DNA, 20 bp, Artificial Sequence
  chemically synthesized
cttaggaaagccacatgcaa

SEQ ID NO: 218199 - DNA, 20 bp, Artificial Sequence
  chemically synthesized
aattgggtctcttttgcatg

SEQ ID NO: 218200 - DNA, 20 bp, Artificial Sequence
  chemically synthesized
taggaaagccacatgcaaaa

SEQ ID NO: 218201 - DNA, 20 bp, Artificial Sequence
  chemically synthesized
ttaaacagtagaaagtaatt

SEQ ID NO: 218202 - DNA, 20 bp, Artificial Sequence
  chemically synthesized
tttaaacagtagaaagtaat

SEQ ID NO: 218203 - DNA, 20 bp, Artificial Sequence
  chemically synthesized
gctcaggtttaaacagtaga

SEQ ID NO: 218204 - DNA, 20 bp, Artificial Sequence
  chemically synthesized
tttcgctcaggtttaaacag

SEQ ID NO: 218205 - DNA, 20 bp, Artificial Sequence
  chemically synthesized
tagtttcgctcaggtttaaa

SEQ ID NO: 218206 - DNA, 20 bp, Artificial Sequence
  chemically synthesized
actttctactgtttaaacct

SEQ ID NO: 218207 - DNA, 20 bp, Artificial Sequence
  chemically synthesized
acgtaaccctagtttcgctc

SEQ ID NO: 218208 - DNA, 20 bp, Artificial Sequence
  chemically synthesized
aacgtaaccctagtttcgct

SEQ ID NO: 218209 - DNA, 20 bp, Artificial Sequence
  chemically synthesized
tgtttaaacctgagcgaaac

SEQ ID NO: 218210 - DNA, 20 bp, Artificial Sequence
  chemically synthesized
gtttaaacctgagcgaaact

SEQ ID NO: 218211 - DNA, 20 bp, Artificial Sequence
  chemically synthesized
tttaaacctgagcgaaacta

SEQ ID NO: 218212 - DNA, 20 bp, Artificial Sequence
  chemically synthesized
gacctaggtaaacgtaaccc

SEQ ID NO: 218213 - DNA, 20 bp, Artificial Sequence
  chemically synthesized
aaactagggttacgtttacc

SEQ ID NO: 218214 - DNA, 20 bp, Artificial Sequence
  chemically synthesized
aactagggttacgtttacct

SEQ ID NO: 218215 - DNA, 20 bp, Artificial Sequence
  chemically synthesized
gttacgtttacctaggtcca

SEQ ID NO: 218216 - DNA, 20 bp, Artificial Sequence
  chemically synthesized
tctattaggactttggacct

SEQ ID NO: 218217 - DNA, 20 bp, Artificial Sequence
  chemically synthesized
gtctattaggactttggacc

SEQ ID NO: 218218 - DNA, 20 bp, Artificial Sequence
  chemically synthesized
tttggggtctattaggactt

SEQ ID NO: 218219 - DNA, 20 bp, Artificial Sequence
  chemically synthesized
acctaggtccaaagtcctaa

SEQ ID NO: 218220 - DNA, 20 bp, Artificial Sequence
  chemically synthesized
gctcccctttggggtctatt

SEQ ID NO: 218221 - DNA, 20 bp, Artificial Sequence
  chemically synthesized
agctcccctttggggtctat

SEQ ID NO: 218222 - DNA, 20 bp, Artificial Sequence
  chemically synthesized
caaagtcctaatagacccca

SEQ ID NO: 218223 - DNA, 20 bp, Artificial Sequence
  chemically synthesized
aaagtcctaatagaccccaa

SEQ ID NO: 218224 - DNA, 20 bp, Artificial Sequence
  chemically synthesized
aagtcctaatagaccccaaa

SEQ ID NO: 218225 - DNA, 20 bp, Artificial Sequence
  chemically synthesized
agtcctaatagaccccaaag

SEQ ID NO: 218226 - DNA, 20 bp, Artificial Sequence
  chemically synthesized
tcctaatagaccccaaaggg

SEQ ID NO: 218227 - DNA, 20 bp, Artificial Sequence
  chemically synthesized
caaaaaagagctcccctttg

SEQ ID NO: 218228 - DNA, 20 bp, Artificial Sequence
  chemically synthesized
ccaaaaaagagctccccttt

SEQ ID NO: 218229 - DNA, 20 bp, Artificial Sequence
  chemically synthesized
tccaaaaaagagctcccctt

SEQ ID NO: 218230 - DNA, 20 bp, Artificial Sequence
  chemically synthesized
cccaaaggggagctcttttt

SEQ ID NO: 218231 - DNA, 20 bp, Artificial Sequence
  chemically synthesized
cctgacatgtatccaaaaaa

SEQ ID NO: 218232 - DNA, 20 bp, Artificial Sequence
  chemically synthesized
ttcctgacatgtatccaaaa

SEQ ID NO: 218233 - DNA, 20 bp, Artificial Sequence
  chemically synthesized
gctcttttttggatacatgt

SEQ ID NO: 218234 - DNA, 20 bp, Artificial Sequence
  chemically synthesized
ctcttttttggatacatgtc

SEQ ID NO: 218235 - DNA, 20 bp, Artificial Sequence
  chemically synthesized
atacatgtcaggaacatgtt

SEQ ID NO: 218236 - DNA, 20 bp, Artificial Sequence
  chemically synthesized
tacatgtcaggaacatgtta

SEQ ID NO: 218237 - DNA, 20 bp, Artificial Sequence
  chemically synthesized
ttattgaattgatgaatgaa

SEQ ID NO: 218238 - DNA, 20 bp, Artificial Sequence
  chemically synthesized
tgtacacaacaaatattcaa

SEQ ID NO: 218239 - DNA, 20 bp, Artificial Sequence
  chemically synthesized
attgtacacaacaaatattc

SEQ ID NO: 218240 - DNA, 20 bp, Artificial Sequence
  chemically synthesized
tttgttgtgtacaattactg

SEQ ID NO: 218241 - DNA, 20 bp, Artificial Sequence
  chemically synthesized
ccactgaattcatagaacca

SEQ ID NO: 218242 - DNA, 20 bp, Artificial Sequence
  chemically synthesized
ttactgtggttctatgaatt

SEQ ID NO: 218243 - DNA, 20 bp, Artificial Sequence
  chemically synthesized
cttactcaccactgaattca

SEQ ID NO: 218244 - DNA, 20 bp, Artificial Sequence
  chemically synthesized
ctgtggttctatgaattcag

SEQ ID NO: 218245 - DNA, 20 bp, Artificial Sequence
  chemically synthesized
ggttctatgaattcagtggt

SEQ ID NO: 218246 - DNA, 20 bp, Artificial Sequence
  chemically synthesized
ctatgaattcagtggtgagt

SEQ ID NO: 218247 - DNA, 20 bp, Artificial Sequence
  chemically synthesized
aattcagtggtgagtaagta

SEQ ID NO: 218248 - DNA, 20 bp, Artificial Sequence
  chemically synthesized
agtaaagaatgcccaatatc

SEQ ID NO: 218249 - DNA, 20 bp, Artificial Sequence
  chemically synthesized
tgtgtcacccactagatatt

SEQ ID NO: 218250 - DNA, 20 bp, Artificial Sequence
  chemically synthesized
ctgtgtcacccactagatat

SEQ ID NO: 218251 - DNA, 20 bp, Artificial Sequence
  chemically synthesized
aaagaatgcccaatatctag

SEQ ID NO: 218252 - DNA, 20 bp, Artificial Sequence
  chemically synthesized
aagaatgcccaatatctagt

SEQ ID NO: 218253 - DNA, 20 bp, Artificial Sequence
  chemically synthesized
ttattatctgtgtcacccac

SEQ ID NO: 218254 - DNA, 20 bp, Artificial Sequence
  chemically synthesized
ccaatatctagtgggtgaca

SEQ ID NO: 218255 - DNA, 20 bp, Artificial Sequence
  chemically synthesized
aattacatgttatttgtgtg

SEQ ID NO: 218256 - DNA, 20 bp, Artificial Sequence
  chemically synthesized
taattacatgttatttgtgt

SEQ ID NO: 218257 - DNA, 20 bp, Artificial Sequence
  chemically synthesized
atgtaattacaaactgaatt

SEQ ID NO: 218258 - DNA, 20 bp, Artificial Sequence
  chemically synthesized
tgtaattacaaactgaatta

SEQ ID NO: 218259 - DNA, 20 bp, Artificial Sequence
  chemically synthesized
tcctctcctcatccttaatt

SEQ ID NO: 218260 - DNA, 20 bp, Artificial Sequence
  chemically synthesized
ttacaaactgaattaaggat

SEQ ID NO: 218261 - DNA, 20 bp, Artificial Sequence
  chemically synthesized
tacaaactgaattaaggatg

SEQ ID NO: 218262 - DNA, 20 bp, Artificial Sequence
  chemically synthesized
caaactgaattaaggatgag

SEQ ID NO: 218263 - DNA, 20 bp, Artificial Sequence
  chemically synthesized
aactgaattaaggatgagga

SEQ ID NO: 218264 - DNA, 20 bp, Artificial Sequence
  chemically synthesized
actgaattaaggatgaggag

SEQ ID NO: 218265 - DNA, 20 bp, Artificial Sequence
  chemically synthesized
aggatgaggagaggaaaata

SEQ ID NO: 218266 - DNA, 20 bp, Artificial Sequence
  chemically synthesized
gatgaggagaggaaaataaa

SEQ ID NO: 218267 - DNA, 20 bp, Artificial Sequence
  chemically synthesized
gagaggaaaataaagagcac

SEQ ID NO: 218268 - DNA, 20 bp, Artificial Sequence
  chemically synthesized
agaggaaaataaagagcact

SEQ ID NO: 218269 - DNA, 20 bp, Artificial Sequence
  chemically synthesized
gaaaataaagagcactagga

SEQ ID NO: 218270 - DNA, 20 bp, Artificial Sequence
  chemically synthesized
cctcttgctgcatgctgtcc

SEQ ID NO: 218271 - DNA, 20 bp, Artificial Sequence
  chemically synthesized
aagagcactaggacagcatg

SEQ ID NO: 218272 - DNA, 20 bp, Artificial Sequence
  chemically synthesized
gcactaggacagcatgcagc

SEQ ID NO: 218273 - DNA, 20 bp, Artificial Sequence
  chemically synthesized
actaggacagcatgcagcaa

SEQ ID NO: 218274 - DNA, 20 bp, Artificial Sequence
  chemically synthesized
ctaggacagcatgcagcaag

SEQ ID NO: 218275 - DNA, 20 bp, Artificial Sequence
  chemically synthesized
ccccctccacaaattgaatt

SEQ ID NO: 218276 - DNA, 20 bp, Artificial Sequence
  chemically synthesized
agaggacttaattcaatttg

SEQ ID NO: 218277 - DNA, 20 bp, Artificial Sequence
  chemically synthesized
aggacttaattcaatttgtg

SEQ ID NO: 218278 - DNA, 20 bp, Artificial Sequence
  chemically synthesized
ggacttaattcaatttgtgg

SEQ ID NO: 218279 - DNA, 20 bp, Artificial Sequence
  chemically synthesized
gacttaattcaatttgtgga

SEQ ID NO: 218280 - DNA, 20 bp, Artificial Sequence
  chemically synthesized
acttaattcaatttgtggag

SEQ ID NO: 218281 - DNA, 20 bp, Artificial Sequence
  chemically synthesized
cttaattcaatttgtggagg

SEQ ID NO: 218282 - DNA, 20 bp, Artificial Sequence
  chemically synthesized
caatttgtggagggggtgac

SEQ ID NO: 218283 - DNA, 20 bp, Artificial Sequence
  chemically synthesized
aatttgtggagggggtgacc

SEQ ID NO: 218284 - DNA, 20 bp, Artificial Sequence
  chemically synthesized
atttgtggagggggtgacca

SEQ ID NO: 218285 - DNA, 20 bp, Artificial Sequence
  chemically synthesized
cttgctcaggaaggtttccc

SEQ ID NO: 218286 - DNA, 20 bp, Artificial Sequence
  chemically synthesized
gtgaccagggaaaccttcct

SEQ ID NO: 218287 - DNA, 20 bp, Artificial Sequence
  chemically synthesized
cggttgtcacttgctcagga

SEQ ID NO: 218288 - DNA, 20 bp, Artificial Sequence
  chemically synthesized
ccagggaaaccttcctgagc

SEQ ID NO: 218289 - DNA, 20 bp, Artificial Sequence
  chemically synthesized
tcggttgtcacttgctcagg

SEQ ID NO: 218290 - DNA, 20 bp, Artificial Sequence
  chemically synthesized
tgatcggttgtcacttgctc

SEQ ID NO: 218291 - DNA, 20 bp, Artificial Sequence
  chemically synthesized
ttgatcggttgtcacttgct

SEQ ID NO: 218292 - DNA, 20 bp, Artificial Sequence
  chemically synthesized
tgagcaagtgacaaccgatc

SEQ ID NO: 218293 - DNA, 20 bp, Artificial Sequence
  chemically synthesized
cccgtcttaccggtcttgat

SEQ ID NO: 218294 - DNA, 20 bp, Artificial Sequence
  chemically synthesized
aagtgacaaccgatcaagac

SEQ ID NO: 218295 - DNA, 20 bp, Artificial Sequence
  chemically synthesized
gacaaccgatcaagaccggt

SEQ ID NO: 218296 - DNA, 20 bp, Artificial Sequence
  chemically synthesized
accgatcaagaccggtaaga

SEQ ID NO: 218297 - DNA, 20 bp, Artificial Sequence
  chemically synthesized
ccgatcaagaccggtaagac

SEQ ID NO: 218298 - DNA, 20 bp, Artificial Sequence
  chemically synthesized
cgttttcctgcccgtcttac

SEQ ID NO: 218299 - DNA, 20 bp, Artificial Sequence
  chemically synthesized
atcaagaccggtaagacggg

SEQ ID NO: 218300 - DNA, 20 bp, Artificial Sequence
  chemically synthesized
tcaagaccggtaagacgggc

SEQ ID NO: 218301 - DNA, 20 bp, Artificial Sequence
  chemically synthesized
taagacgggcaggaaaacgt

SEQ ID NO: 218302 - DNA, 20 bp, Artificial Sequence
  chemically synthesized
ggcaggaaaacgtgagtgtg

SEQ ID NO: 218303 - DNA, 20 bp, Artificial Sequence
  chemically synthesized
caggaaaacgtgagtgtgtg

SEQ ID NO: 218304 - DNA, 20 bp, Artificial Sequence
  chemically synthesized
gaaaacgtgagtgtgtggag

SEQ ID NO: 218305 - DNA, 20 bp, Artificial Sequence
  chemically synthesized
aaaacgtgagtgtgtggagt

SEQ ID NO: 218306 - DNA, 20 bp, Artificial Sequence
  chemically synthesized
acgtgagtgtgtggagtggg

SEQ ID NO: 218307 - DNA, 20 bp, Artificial Sequence
  chemically synthesized
gtgagtgtgtggagtgggtg

SEQ ID NO: 218308 - DNA, 20 bp, Artificial Sequence
  chemically synthesized
gtgtgtggagtgggtggaga

SEQ ID NO: 218309 - DNA, 20 bp, Artificial Sequence
  chemically synthesized
gtggagtgggtggagacagt

SEQ ID NO: 218310 - DNA, 20 bp, Artificial Sequence
  chemically synthesized
gagtgggtggagacagtgag

SEQ ID NO: 218311 - DNA, 20 bp, Artificial Sequence
  chemically synthesized
tgagcagattccctgacaaa

SEQ ID NO: 218312 - DNA, 20 bp, Artificial Sequence
  chemically synthesized
acgtactattccgtttgtca

SEQ ID NO: 218313 - DNA, 20 bp, Artificial Sequence
  chemically synthesized
cacgtactattccgtttgtc

SEQ ID NO: 218314 - DNA, 20 bp, Artificial Sequence
  chemically synthesized
gcacgtactattccgtttgt

SEQ ID NO: 218315 - DNA, 20 bp, Artificial Sequence
  chemically synthesized
agattccctgacaaacggaa

SEQ ID NO: 218316 - DNA, 20 bp, Artificial Sequence
  chemically synthesized
caaacggaatagtacgtgca

SEQ ID NO: 218317 - DNA, 20 bp, Artificial Sequence
  chemically synthesized
aaacggaatagtacgtgcaa

SEQ ID NO: 218318 - DNA, 20 bp, Artificial Sequence
  chemically synthesized
aatagtacgtgcaaaggaaa

SEQ ID NO: 218319 - DNA, 20 bp, Artificial Sequence
  chemically synthesized
tagtacgtgcaaaggaaaaa

SEQ ID NO: 218320 - DNA, 20 bp, Artificial Sequence
  chemically synthesized
tgcaaaggaaaaagagatta

SEQ ID NO: 218321 - DNA, 20 bp, Artificial Sequence
  chemically synthesized
aaaaagagattacagcactg

SEQ ID NO: 218322 - DNA, 20 bp, Artificial Sequence
  chemically synthesized
agagattacagcactgtagt

SEQ ID NO: 218323 - DNA, 20 bp, Artificial Sequence
  chemically synthesized
agattacagcactgtagtta

SEQ ID NO: 218324 - DNA, 20 bp, Artificial Sequence
  chemically synthesized
tttttagatttctctaacta

SEQ ID NO: 218325 - DNA, 20 bp, Artificial Sequence
  chemically synthesized
actttgtttttttttttttt

SEQ ID NO: 218326 - DNA, 20 bp, Artificial Sequence
  chemically synthesized
tctaaaaaaaaaaaaaaaca

SEQ ID NO: 218327 - DNA, 20 bp, Artificial Sequence
  chemically synthesized
aaaaaaaaaaaaaacaaagt

SEQ ID NO: 218328 - DNA, 20 bp, Artificial Sequence
  chemically synthesized
aaaaaaaaacaaagttagtg

SEQ ID NO: 218329 - DNA, 20 bp, Artificial Sequence
  chemically synthesized
aaaaacaaagttagtgtagt

SEQ ID NO: 218330 - DNA, 20 bp, Artificial Sequence
  chemically synthesized
aaacaaagttagtgtagttg

SEQ ID NO: 218331 - DNA, 20 bp, Artificial Sequence
  chemically synthesized
aagttagtgtagttggagta

SEQ ID NO: 218332 - DNA, 20 bp, Artificial Sequence
  chemically synthesized
gttagtgtagttggagtaca

SEQ ID NO: 218333 - DNA, 20 bp, Artificial Sequence
  chemically synthesized
gtagttggagtacagagaat

SEQ ID NO: 218334 - DNA, 20 bp, Artificial Sequence
  chemically synthesized
gttggagtacagagaatgag

SEQ ID NO: 218335 - DNA, 20 bp, Artificial Sequence
  chemically synthesized
agtacagagaatgagcagat

SEQ ID NO: 218336 - DNA, 20 bp, Artificial Sequence
  chemically synthesized
tacagagaatgagcagatga

SEQ ID NO: 218337 - DNA, 20 bp, Artificial Sequence
  chemically synthesized
acagagaatgagcagatgag

SEQ ID NO: 218338 - DNA, 20 bp, Artificial Sequence
  chemically synthesized
cagagaatgagcagatgaga

SEQ ID NO: 218339 - DNA, 20 bp, Artificial Sequence
  chemically synthesized
gaatgagcagatgagaggga

SEQ ID NO: 218340 - DNA, 20 bp, Artificial Sequence
  chemically synthesized
agtaaaaaatactgccaaca

SEQ ID NO: 218341 - DNA, 20 bp, Artificial Sequence
  chemically synthesized
tctgtcctttgctatgttgg

SEQ ID NO: 218342 - DNA, 20 bp, Artificial Sequence
  chemically synthesized
tagtctgtcctttgctatgt

SEQ ID NO: 218343 - DNA, 20 bp, Artificial Sequence
  chemically synthesized
aaaatactgccaacatagca

SEQ ID NO: 218344 - DNA, 20 bp, Artificial Sequence
  chemically synthesized
aaatactgccaacatagcaa

SEQ ID NO: 218345 - DNA, 20 bp, Artificial Sequence
  chemically synthesized
actgccaacatagcaaagga

SEQ ID NO: 218346 - DNA, 20 bp, Artificial Sequence
  chemically synthesized
agcaaaggacagactatgca

SEQ ID NO: 218347 - DNA, 20 bp, Artificial Sequence
  chemically synthesized
atggtgtgcaaagctttgca

SEQ ID NO: 218348 - DNA, 20 bp, Artificial Sequence
  chemically synthesized
tagccttaaaatggtgtgca

SEQ ID NO: 218349 - DNA, 20 bp, Artificial Sequence
  chemically synthesized
aaagctttgcacaccatttt

SEQ ID NO: 218350 - DNA, 20 bp, Artificial Sequence
  chemically synthesized
aagctttgcacaccatttta

SEQ ID NO: 218351 - DNA, 20 bp, Artificial Sequence
  chemically synthesized
cattaattttagccttaaaa

SEQ ID NO: 218352 - DNA, 20 bp, Artificial Sequence
  chemically synthesized
caaaaggttcacattaattt

SEQ ID NO: 218353 - DNA, 20 bp, Artificial Sequence
  chemically synthesized
aaattaatgtgaaccttttg

SEQ ID NO: 218354 - DNA, 20 bp, Artificial Sequence
  chemically synthesized
aattaatgtgaaccttttga

SEQ ID NO: 218355 - DNA, 20 bp, Artificial Sequence
  chemically synthesized
ttaatgtgaaccttttgaag

SEQ ID NO: 218356 - DNA, 20 bp, Artificial Sequence
  chemically synthesized
ggctagatttctccttcaaa

SEQ ID NO: 218357 - DNA, 20 bp, Artificial Sequence
  chemically synthesized
tggctagatttctccttcaa

SEQ ID NO: 218358 - DNA, 20 bp, Artificial Sequence
  chemically synthesized
aaccttttgaaggagaaatc

SEQ ID NO: 218359 - DNA, 20 bp, Artificial Sequence
  chemically synthesized
tttgaaggagaaatctagcc

SEQ ID NO: 218360 - DNA, 20 bp, Artificial Sequence
  chemically synthesized
ttgaaggagaaatctagcca

SEQ ID NO: 218361 - DNA, 20 bp, Artificial Sequence
  chemically synthesized
aatataaatctagccttggc

SEQ ID NO: 218362 - DNA, 20 bp, Artificial Sequence
  chemically synthesized
aggagaaatctagccaaggc

SEQ ID NO: 218363 - DNA, 20 bp, Artificial Sequence
  chemically synthesized
aataaatataaatctagcct

SEQ ID NO: 218364 - DNA, 20 bp, Artificial Sequence
  chemically synthesized
atatttaataaatataaatc

SEQ ID NO: 218365 - DNA, 20 bp, Artificial Sequence
  chemically synthesized
attaaatatcacactatctg

SEQ ID NO: 218366 - DNA, 20 bp, Artificial Sequence
  chemically synthesized
ttaaatatcacactatctgt

SEQ ID NO: 218367 - DNA, 20 bp, Artificial Sequence
  chemically synthesized
cagactgttctgcctacaga

SEQ ID NO: 218368 - DNA, 20 bp, Artificial Sequence
  chemically synthesized
aatatcacactatctgtagg

SEQ ID NO: 218369 - DNA, 20 bp, Artificial Sequence
  chemically synthesized
ccaccagactgttctgccta

SEQ ID NO: 218370 - DNA, 20 bp, Artificial Sequence
  chemically synthesized
cacactatctgtaggcagaa

SEQ ID NO: 218371 - DNA, 20 bp, Artificial Sequence
  chemically synthesized
tatctgtaggcagaacagtc

SEQ ID NO: 218372 - DNA, 20 bp, Artificial Sequence
  chemically synthesized
ctgtaggcagaacagtctgg

SEQ ID NO: 218373 - DNA, 20 bp, Artificial Sequence
  chemically synthesized
tgtaggcagaacagtctggt

SEQ ID NO: 218374 - DNA, 20 bp, Artificial Sequence
  chemically synthesized
aggcagaacagtctggtggg

SEQ ID NO: 218375 - DNA, 20 bp, Artificial Sequence
  chemically synthesized
ggcagaacagtctggtgggt

SEQ ID NO: 218376 - DNA, 20 bp, Artificial Sequence
  chemically synthesized
gcagaacagtctggtgggta

SEQ ID NO: 218377 - DNA, 20 bp, Artificial Sequence
  chemically synthesized
acagtaacccccctacccac

SEQ ID NO: 218378 - DNA, 20 bp, Artificial Sequence
  chemically synthesized
cagaacagtctggtgggtag

SEQ ID NO: 218379 - DNA, 20 bp, Artificial Sequence
  chemically synthesized
agaacagtctggtgggtagg

SEQ ID NO: 218380 - DNA, 20 bp, Artificial Sequence
  chemically synthesized
gaacagtctggtgggtaggg

SEQ ID NO: 218381 - DNA, 20 bp, Artificial Sequence
  chemically synthesized
gtctctcattggaattaaca

SEQ ID NO: 218382 - DNA, 20 bp, Artificial Sequence
  chemically synthesized
gttactgtgttaattccaat

SEQ ID NO: 218383 - DNA, 20 bp, Artificial Sequence
  chemically synthesized
tactgtgttaattccaatga

SEQ ID NO: 218384 - DNA, 20 bp, Artificial Sequence
  chemically synthesized
aagctaccatcgtctctcat

SEQ ID NO: 218385 - DNA, 20 bp, Artificial Sequence
  chemically synthesized
ttaattccaatgagagacga

SEQ ID NO: 218386 - DNA, 20 bp, Artificial Sequence
  chemically synthesized
attccaatgagagacgatgg

SEQ ID NO: 218387 - DNA, 20 bp, Artificial Sequence
  chemically synthesized
gagacgatggtagcttgcac

SEQ ID NO: 218388 - DNA, 20 bp, Artificial Sequence
  chemically synthesized
agacgatggtagcttgcact

SEQ ID NO: 218389 - DNA, 20 bp, Artificial Sequence
  chemically synthesized
gcccattagtatcctagtgc

SEQ ID NO: 218390 - DNA, 20 bp, Artificial Sequence
  chemically synthesized
ctttatgcccattagtatcc

SEQ ID NO: 218391 - DNA, 20 bp, Artificial Sequence
  chemically synthesized
agcttgcactaggatactaa

SEQ ID NO: 218392 - DNA, 20 bp, Artificial Sequence
  chemically synthesized
gcttgcactaggatactaat

SEQ ID NO: 218393 - DNA, 20 bp, Artificial Sequence
  chemically synthesized
cagtttttctttatgcccat

SEQ ID NO: 218394 - DNA, 20 bp, Artificial Sequence
  chemically synthesized
ctaggatactaatgggcata

SEQ ID NO: 218395 - DNA, 20 bp, Artificial Sequence
  chemically synthesized
atgggcataaagaaaaactg

SEQ ID NO: 218396 - DNA, 20 bp, Artificial Sequence
  chemically synthesized
gggcataaagaaaaactgta

SEQ ID NO: 218397 - DNA, 20 bp, Artificial Sequence
  chemically synthesized
taaccttctcaatatctcta

SEQ ID NO: 218398 - DNA, 20 bp, Artificial Sequence
  chemically synthesized
agaaaaactgtagagatatt

SEQ ID NO: 218399 - DNA, 20 bp, Artificial Sequence
  chemically synthesized
aaaactgtagagatattgag

SEQ ID NO: 218400 - DNA, 20 bp, Artificial Sequence
  chemically synthesized
aaactgtagagatattgaga

SEQ ID NO: 218401 - DNA, 20 bp, Artificial Sequence
  chemically synthesized
agatattgagaaggttaaat

SEQ ID NO: 218402 - DNA, 20 bp, Artificial Sequence
  chemically synthesized
tattgagaaggttaaatcag

SEQ ID NO: 218403 - DNA, 20 bp, Artificial Sequence
  chemically synthesized
attgagaaggttaaatcagt

SEQ ID NO: 218404 - DNA, 20 bp, Artificial Sequence
  chemically synthesized
gaaggttaaatcagtaggac

SEQ ID NO: 218405 - DNA, 20 bp, Artificial Sequence
  chemically synthesized
aaggttaaatcagtaggacc

SEQ ID NO: 218406 - DNA, 20 bp, Artificial Sequence
  chemically synthesized
aaatcagtaggaccaggtga

SEQ ID NO: 218407 - DNA, 20 bp, Artificial Sequence
  chemically synthesized
ccattattaaatctgtcacc

SEQ ID NO: 218408 - DNA, 20 bp, Artificial Sequence
  chemically synthesized
ccaggtgacagatttaataa

SEQ ID NO: 218409 - DNA, 20 bp, Artificial Sequence
  chemically synthesized
ggtgacagatttaataatgg

SEQ ID NO: 218410 - DNA, 20 bp, Artificial Sequence
  chemically synthesized
gatttaataatggtagttga

SEQ ID NO: 218411 - DNA, 20 bp, Artificial Sequence
  chemically synthesized
taataatggtagttgacgga

SEQ ID NO: 218412 - DNA, 20 bp, Artificial Sequence
  chemically synthesized
aatggtagttgacggacagt

SEQ ID NO: 218413 - DNA, 20 bp, Artificial Sequence
  chemically synthesized
atggtagttgacggacagtg

SEQ ID NO: 218414 - DNA, 20 bp, Artificial Sequence
  chemically synthesized
gtagttgacggacagtgagg

SEQ ID NO: 218415 - DNA, 20 bp, Artificial Sequence
  chemically synthesized
agttgacggacagtgaggaa

SEQ ID NO: 218416 - DNA, 20 bp, Artificial Sequence
  chemically synthesized
gacggacagtgaggaagagt

SEQ ID NO: 218417 - DNA, 20 bp, Artificial Sequence
  chemically synthesized
acggacagtgaggaagagtg

SEQ ID NO: 218418 - DNA, 20 bp, Artificial Sequence
  chemically synthesized
aagagtgaggaaaaaaaatc

SEQ ID NO: 218419 - DNA, 20 bp, Artificial Sequence
  chemically synthesized
ggaaaaaaaatccagacttt

SEQ ID NO: 218420 - DNA, 20 bp, Artificial Sequence
  chemically synthesized
agttaagcaagccaaaagtc

SEQ ID NO: 218421 - DNA, 20 bp, Artificial Sequence
  chemically synthesized
tatccagttaagcaagccaa

SEQ ID NO: 218422 - DNA, 20 bp, Artificial Sequence
  chemically synthesized
agacttttggcttgcttaac

SEQ ID NO: 218423 - DNA, 20 bp, Artificial Sequence
  chemically synthesized
atgacactatccagttaagc

SEQ ID NO: 218424 - DNA, 20 bp, Artificial Sequence
  chemically synthesized
ttttggcttgcttaactgga

SEQ ID NO: 218425 - DNA, 20 bp, Artificial Sequence
  chemically synthesized
gtgaatgacactatccagtt

SEQ ID NO: 218426 - DNA, 20 bp, Artificial Sequence
  chemically synthesized
tcccagtgaatgacactatc

SEQ ID NO: 218427 - DNA, 20 bp, Artificial Sequence
  chemically synthesized
aactggatagtgtcattcac

SEQ ID NO: 218428 - DNA, 20 bp, Artificial Sequence
  chemically synthesized
actggatagtgtcattcact

SEQ ID NO: 218429 - DNA, 20 bp, Artificial Sequence
  chemically synthesized
gatagtgtcattcactggga

SEQ ID NO: 218430 - DNA, 20 bp, Artificial Sequence
  chemically synthesized
tagtgtcattcactgggatg

SEQ ID NO: 218431 - DNA, 20 bp, Artificial Sequence
  chemically synthesized
agtgtcattcactgggatgg

SEQ ID NO: 218432 - DNA, 20 bp, Artificial Sequence
  chemically synthesized
acatccaggttcctccatcc

SEQ ID NO: 218433 - DNA, 20 bp, Artificial Sequence
  chemically synthesized
ttcactgggatggaggaacc

SEQ ID NO: 218434 - DNA, 20 bp, Artificial Sequence
  chemically synthesized
ttcaaacccgatacacatcc

SEQ ID NO: 218435 - DNA, 20 bp, Artificial Sequence
  chemically synthesized
cttcaaacccgatacacatc

SEQ ID NO: 218436 - DNA, 20 bp, Artificial Sequence
  chemically synthesized
ggaggaacctggatgtgtat

SEQ ID NO: 218437 - DNA, 20 bp, Artificial Sequence
  chemically synthesized
gaggaacctggatgtgtatc

SEQ ID NO: 218438 - DNA, 20 bp, Artificial Sequence
  chemically synthesized
ctggatgtgtatcgggtttg

SEQ ID NO: 218439 - DNA, 20 bp, Artificial Sequence
  chemically synthesized
tggatgtgtatcgggtttga

SEQ ID NO: 218440 - DNA, 20 bp, Artificial Sequence
  chemically synthesized
gtgtatcgggtttgaaggac

SEQ ID NO: 218441 - DNA, 20 bp, Artificial Sequence
  chemically synthesized
tgtatcgggtttgaaggaca

SEQ ID NO: 218442 - DNA, 20 bp, Artificial Sequence
  chemically synthesized
gaaggacaaggtcgaacatt

SEQ ID NO: 218443 - DNA, 20 bp, Artificial Sequence
  chemically synthesized
acaaggtcgaacattcagtt

SEQ ID NO: 218444 - DNA, 20 bp, Artificial Sequence
  chemically synthesized
cattcagtttggtccttgtt

SEQ ID NO: 218445 - DNA, 20 bp, Artificial Sequence
  chemically synthesized
gaggcaactcagactcaaca

SEQ ID NO: 218446 - DNA, 20 bp, Artificial Sequence
  chemically synthesized
agaggcaactcagactcaac

SEQ ID NO: 218447 - DNA, 20 bp, Artificial Sequence
  chemically synthesized
gtttggtccttgttgagtct

SEQ ID NO: 218448 - DNA, 20 bp, Artificial Sequence
  chemically synthesized
taaatgtatcagaggcaact

SEQ ID NO: 218449 - DNA, 20 bp, Artificial Sequence
  chemically synthesized
tctccacttaaatgtatcag

SEQ ID NO: 218450 - DNA, 20 bp, Artificial Sequence
  chemically synthesized
atctccacttaaatgtatca

SEQ ID NO: 218451 - DNA, 20 bp, Artificial Sequence
  chemically synthesized
acatctccacttaaatgtat

SEQ ID NO: 218452 - DNA, 20 bp, Artificial Sequence
  chemically synthesized
gagttgcctctgatacattt

SEQ ID NO: 218453 - DNA, 20 bp, Artificial Sequence
  chemically synthesized
ttgcctctgatacatttaag

SEQ ID NO: 218454 - DNA, 20 bp, Artificial Sequence
  chemically synthesized
gcctctgatacatttaagtg

SEQ ID NO: 218455 - DNA, 20 bp, Artificial Sequence
  chemically synthesized
atttaagtggagatgtcaat

SEQ ID NO: 218456 - DNA, 20 bp, Artificial Sequence
  chemically synthesized
tttaagtggagatgtcaatt

SEQ ID NO: 218457 - DNA, 20 bp, Artificial Sequence
  chemically synthesized
aagtggagatgtcaattagg

SEQ ID NO: 218458 - DNA, 20 bp, Artificial Sequence
  chemically synthesized
agtggagatgtcaattaggc

SEQ ID NO: 218459 - DNA, 20 bp, Artificial Sequence
  chemically synthesized
gtggagatgtcaattaggca

SEQ ID NO: 218460 - DNA, 20 bp, Artificial Sequence
  chemically synthesized
tggagatgtcaattaggcag

SEQ ID NO: 218461 - DNA, 20 bp, Artificial Sequence
  chemically synthesized
ggagatgtcaattaggcagg

SEQ ID NO: 218462 - DNA, 20 bp, Artificial Sequence
  chemically synthesized
gagatgtcaattaggcaggg

SEQ ID NO: 218463 - DNA, 20 bp, Artificial Sequence
  chemically synthesized
aggcaggggggtatgtatat

SEQ ID NO: 218464 - DNA, 20 bp, Artificial Sequence
  chemically synthesized
ggggggtatgtatataagac

SEQ ID NO: 218465 - DNA, 20 bp, Artificial Sequence
  chemically synthesized
tgaaactctcatttgaatgc

SEQ ID NO: 218466 - DNA, 20 bp, Artificial Sequence
  chemically synthesized
tataagactagcattcaaat

SEQ ID NO: 218467 - DNA, 20 bp, Artificial Sequence
  chemically synthesized
taagactagcattcaaatga

SEQ ID NO: 218468 - DNA, 20 bp, Artificial Sequence
  chemically synthesized
tagcattcaaatgagagttt

SEQ ID NO: 218469 - DNA, 20 bp, Artificial Sequence
  chemically synthesized
agcattcaaatgagagtttc

SEQ ID NO: 218470 - DNA, 20 bp, Artificial Sequence
  chemically synthesized
gcattcaaatgagagtttca

SEQ ID NO: 218471 - DNA, 20 bp, Artificial Sequence
  chemically synthesized
tcaaatgagagtttcagggc

SEQ ID NO: 218472 - DNA, 20 bp, Artificial Sequence
  chemically synthesized
aaatgagagtttcagggctg

SEQ ID NO: 218473 - DNA, 20 bp, Artificial Sequence
  chemically synthesized
gcttctaatatttacatctc

SEQ ID NO: 218474 - DNA, 20 bp, Artificial Sequence
  chemically synthesized
agggctggagatgtaaatat

SEQ ID NO: 218475 - DNA, 20 bp, Artificial Sequence
  chemically synthesized
gctggagatgtaaatattag

SEQ ID NO: 218476 - DNA, 20 bp, Artificial Sequence
  chemically synthesized
tgtaaatattagaagctttg

SEQ ID NO: 218477 - DNA, 20 bp, Artificial Sequence
  chemically synthesized
acctaactaatgtttctgca

SEQ ID NO: 218478 - DNA, 20 bp, Artificial Sequence
  chemically synthesized
tagaagctttgcagaaacat

SEQ ID NO: 218479 - DNA, 20 bp, Artificial Sequence
  chemically synthesized
agctttgcagaaacattagt

SEQ ID NO: 218480 - DNA, 20 bp, Artificial Sequence
  chemically synthesized
gctttgcagaaacattagtt

SEQ ID NO: 218481 - DNA, 20 bp, Artificial Sequence
  chemically synthesized
aaacattagttaggttaaat

SEQ ID NO: 218482 - DNA, 20 bp, Artificial Sequence
  chemically synthesized
aacattagttaggttaaatc

SEQ ID NO: 218483 - DNA, 20 bp, Artificial Sequence
  chemically synthesized
gttaggttaaatcaggaaca

SEQ ID NO: 218484 - DNA, 20 bp, Artificial Sequence
  chemically synthesized
gttaaatcaggaacatagat

SEQ ID NO: 218485 - DNA, 20 bp, Artificial Sequence
  chemically synthesized
ggaacatagataagattacc

SEQ ID NO: 218486 - DNA, 20 bp, Artificial Sequence
  chemically synthesized
gaacatagataagattacct

SEQ ID NO: 218487 - DNA, 20 bp, Artificial Sequence
  chemically synthesized
aacatagataagattaccta

SEQ ID NO: 218488 - DNA, 20 bp, Artificial Sequence
  chemically synthesized
tagataagattacctaggga

SEQ ID NO: 218489 - DNA, 20 bp, Artificial Sequence
  chemically synthesized
tcactttgtcttctgtccct

SEQ ID NO: 218490 - DNA, 20 bp, Artificial Sequence
  chemically synthesized
ataagattacctagggacag

SEQ ID NO: 218491 - DNA, 20 bp, Artificial Sequence
  chemically synthesized
ttcactttgtcttctgtccc

SEQ ID NO: 218492 - DNA, 20 bp, Artificial Sequence
  chemically synthesized
ttacctagggacagaagaca

SEQ ID NO: 218493 - DNA, 20 bp, Artificial Sequence
  chemically synthesized
tagggacagaagacaaagtg

SEQ ID NO: 218494 - DNA, 20 bp, Artificial Sequence
  chemically synthesized
aagacaaagtgaagaaatga

SEQ ID NO: 218495 - DNA, 20 bp, Artificial Sequence
  chemically synthesized
agacaaagtgaagaaatgaa

SEQ ID NO: 218496 - DNA, 20 bp, Artificial Sequence
  chemically synthesized
acaaagtgaagaaatgaaag

SEQ ID NO: 218497 - DNA, 20 bp, Artificial Sequence
  chemically synthesized
aggagatatcattccttctt

SEQ ID NO: 218498 - DNA, 20 bp, Artificial Sequence
  chemically synthesized
actacacaaggttccaaaga

SEQ ID NO: 218499 - DNA, 20 bp, Artificial Sequence
  chemically synthesized
cactacacaaggttccaaag

SEQ ID NO: 218500 - DNA, 20 bp, Artificial Sequence
  chemically synthesized
attcactacacaaggttcca

SEQ ID NO: 218501 - DNA, 20 bp, Artificial Sequence
  chemically synthesized
tccttctttggaaccttgtg

SEQ ID NO: 218502 - DNA, 20 bp, Artificial Sequence
  chemically synthesized
tgattctgattcactacaca

SEQ ID NO: 218503 - DNA, 20 bp, Artificial Sequence
  chemically synthesized
ttgattctgattcactacac

SEQ ID NO: 218504 - DNA, 20 bp, Artificial Sequence
  chemically synthesized
tggaaccttgtgtagtgaat

SEQ ID NO: 218505 - DNA, 20 bp, Artificial Sequence
  chemically synthesized
ttgtaatttaaaattaaaca

SEQ ID NO: 218506 - DNA, 20 bp, Artificial Sequence
  chemically synthesized
tttgtaatttaaaattaaac

SEQ ID NO: 218507 - DNA, 20 bp, Artificial Sequence
  chemically synthesized
ctttgtaatttaaaattaaa

SEQ ID NO: 218508 - DNA, 20 bp, Artificial Sequence
  chemically synthesized
ctgtttaattttaaattaca

SEQ ID NO: 218509 - DNA, 20 bp, Artificial Sequence
  chemically synthesized
tacacagtgagtggttagat

SEQ ID NO: 218510 - DNA, 20 bp, Artificial Sequence
  chemically synthesized
tcatctacacagtgagtggt

SEQ ID NO: 218511 - DNA, 20 bp, Artificial Sequence
  chemically synthesized
ctcttcatctacacagtgag

SEQ ID NO: 218512 - DNA, 20 bp, Artificial Sequence
  chemically synthesized
caatctaaccactcactgtg

SEQ ID NO: 218513 - DNA, 20 bp, Artificial Sequence
  chemically synthesized
gttctcttcatctacacagt

SEQ ID NO: 218514 - DNA, 20 bp, Artificial Sequence
  chemically synthesized
ttcagttctcttcatctaca

SEQ ID NO: 218515 - DNA, 20 bp, Artificial Sequence
  chemically synthesized
aaccactcactgtgtagatg

SEQ ID NO: 218516 - DNA, 20 bp, Artificial Sequence
  chemically synthesized
ccactcactgtgtagatgaa

SEQ ID NO: 218517 - DNA, 20 bp, Artificial Sequence
  chemically synthesized
tgtgtagatgaagagaactg

SEQ ID NO: 218518 - DNA, 20 bp, Artificial Sequence
  chemically synthesized
ggataaaactcgcaggactt

SEQ ID NO: 218519 - DNA, 20 bp, Artificial Sequence
  chemically synthesized
gaagagaactgaagtcctgc

SEQ ID NO: 218520 - DNA, 20 bp, Artificial Sequence
  chemically synthesized
agcaaatggataaaactcgc

SEQ ID NO: 218521 - DNA, 20 bp, Artificial Sequence
  chemically synthesized
tagcaaatggataaaactcg

SEQ ID NO: 218522 - DNA, 20 bp, Artificial Sequence
  chemically synthesized
tgcgagttttatccatttgc

SEQ ID NO: 218523 - DNA, 20 bp, Artificial Sequence
  chemically synthesized
gacttttacaatctagcaaa

SEQ ID NO: 218524 - DNA, 20 bp, Artificial Sequence
  chemically synthesized
ccagcttgacttttacaatc

SEQ ID NO: 218525 - DNA, 20 bp, Artificial Sequence
  chemically synthesized
atccatttgctagattgtaa

SEQ ID NO: 218526 - DNA, 20 bp, Artificial Sequence
  chemically synthesized
tttgctagattgtaaaagtc

SEQ ID NO: 218527 - DNA, 20 bp, Artificial Sequence
  chemically synthesized
ctagattgtaaaagtcaagc

SEQ ID NO: 218528 - DNA, 20 bp, Artificial Sequence
  chemically synthesized
tagattgtaaaagtcaagct

SEQ ID NO: 218529 - DNA, 20 bp, Artificial Sequence
  chemically synthesized
agattgtaaaagtcaagctg

SEQ ID NO: 218530 - DNA, 20 bp, Artificial Sequence
  chemically synthesized
tgtaaaagtcaagctggggc

SEQ ID NO: 218531 - DNA, 20 bp, Artificial Sequence
  chemically synthesized
gaagacctgagttcttgccc

SEQ ID NO: 218532 - DNA, 20 bp, Artificial Sequence
  chemically synthesized
gtcaagctggggcaagaact

SEQ ID NO: 218533 - DNA, 20 bp, Artificial Sequence
  chemically synthesized
tcaagctggggcaagaactc

SEQ ID NO: 218534 - DNA, 20 bp, Artificial Sequence
  chemically synthesized
aactgcagctcagaagacct

SEQ ID NO: 218535 - DNA, 20 bp, Artificial Sequence
  chemically synthesized
ggcaagaactcaggtcttct

SEQ ID NO: 218536 - DNA, 20 bp, Artificial Sequence
  chemically synthesized
agaattaaactgcagctcag

SEQ ID NO: 218537 - DNA, 20 bp, Artificial Sequence
  chemically synthesized
aactcaggtcttctgagctg

SEQ ID NO: 218538 - DNA, 20 bp, Artificial Sequence
  chemically synthesized
tggagaattaaactgcagct

SEQ ID NO: 218539 - DNA, 20 bp, Artificial Sequence
  chemically synthesized
aaaggtggagaattaaactg

SEQ ID NO: 218540 - DNA, 20 bp, Artificial Sequence
  chemically synthesized
aagaaatatcgataaaggtg

SEQ ID NO: 218541 - DNA, 20 bp, Artificial Sequence
  chemically synthesized
ttaagaaatatcgataaagg

SEQ ID NO: 218542 - DNA, 20 bp, Artificial Sequence
  chemically synthesized
attttaagaaatatcgataa

SEQ ID NO: 218543 - DNA, 20 bp, Artificial Sequence
  chemically synthesized
cattttaagaaatatcgata

SEQ ID NO: 218544 - DNA, 20 bp, Artificial Sequence
  chemically synthesized
tatcgatatttcttaaaatg

SEQ ID NO: 218545 - DNA, 20 bp, Artificial Sequence
  chemically synthesized
tggttccaggaccacatttt

SEQ ID NO: 218546 - DNA, 20 bp, Artificial Sequence
  chemically synthesized
tatttcttaaaatgtggtcc

SEQ ID NO: 218547 - DNA, 20 bp, Artificial Sequence
  chemically synthesized
ttaaaatgtggtcctggaac

SEQ ID NO: 218548 - DNA, 20 bp, Artificial Sequence
  chemically synthesized
atgctgatgctgctggttcc

SEQ ID NO: 218549 - DNA, 20 bp, Artificial Sequence
  chemically synthesized
aaatgtggtcctggaaccag

SEQ ID NO: 218550 - DNA, 20 bp, Artificial Sequence
  chemically synthesized
gatgctgatgctgctggttc

SEQ ID NO: 218551 - DNA, 20 bp, Artificial Sequence
  chemically synthesized
ggtcctggaaccagcagcat

SEQ ID NO: 218552 - DNA, 20 bp, Artificial Sequence
  chemically synthesized
ataagtgatgctgatgctgc

SEQ ID NO: 218553 - DNA, 20 bp, Artificial Sequence
  chemically synthesized
atttgcatttttaagtgtat

SEQ ID NO: 218554 - DNA, 20 bp, Artificial Sequence
  chemically synthesized
gcctaaatatttgcattttt

SEQ ID NO: 218555 - DNA, 20 bp, Artificial Sequence
  chemically synthesized
cacttaaaaatgcaaatatt

SEQ ID NO: 218556 - DNA, 20 bp, Artificial Sequence
  chemically synthesized
acttaaaaatgcaaatattt

SEQ ID NO: 218557 - DNA, 20 bp, Artificial Sequence
  chemically synthesized
caaatatttaggccccatcc

SEQ ID NO: 218558 - DNA, 20 bp, Artificial Sequence
  chemically synthesized
gattcagtagatctgggatg

SEQ ID NO: 218559 - DNA, 20 bp, Artificial Sequence
  chemically synthesized
tgattcagtagatctgggat

SEQ ID NO: 218560 - DNA, 20 bp, Artificial Sequence
  chemically synthesized
ctgattcagtagatctggga

SEQ ID NO: 218561 - DNA, 20 bp, Artificial Sequence
  chemically synthesized
gcttctgattcagtagatct

SEQ ID NO: 218562 - DNA, 20 bp, Artificial Sequence
  chemically synthesized
agcttctgattcagtagatc

SEQ ID NO: 218563 - DNA, 20 bp, Artificial Sequence
  chemically synthesized
ccatcccagatctactgaat

SEQ ID NO: 218564 - DNA, 20 bp, Artificial Sequence
  chemically synthesized
ccatagagcttctgattcag

SEQ ID NO: 218565 - DNA, 20 bp, Artificial Sequence
  chemically synthesized
tcccagatctactgaatcag

SEQ ID NO: 218566 - DNA, 20 bp, Artificial Sequence
  chemically synthesized
tagccatagagcttctgatt

SEQ ID NO: 218567 - DNA, 20 bp, Artificial Sequence
  chemically synthesized
ctactgaatcagaagctcta

SEQ ID NO: 218568 - DNA, 20 bp, Artificial Sequence
  chemically synthesized
tgaatcagaagctctatggc

SEQ ID NO: 218569 - DNA, 20 bp, Artificial Sequence
  chemically synthesized
gaatcagaagctctatggct

SEQ ID NO: 218570 - DNA, 20 bp, Artificial Sequence
  chemically synthesized
gcatctgagccctagccata

SEQ ID NO: 218571 - DNA, 20 bp, Artificial Sequence
  chemically synthesized
aatcagaagctctatggcta

SEQ ID NO: 218572 - DNA, 20 bp, Artificial Sequence
  chemically synthesized
atgcatctgagccctagcca

SEQ ID NO: 218573 - DNA, 20 bp, Artificial Sequence
  chemically synthesized
gaagctctatggctagggct

SEQ ID NO: 218574 - DNA, 20 bp, Artificial Sequence
  chemically synthesized
ctgaatatgcatctgagccc

SEQ ID NO: 218575 - DNA, 20 bp, Artificial Sequence
  chemically synthesized
tctgacctgaatatgcatct

SEQ ID NO: 218576 - DNA, 20 bp, Artificial Sequence
  chemically synthesized
ctagggctcagatgcatatt

SEQ ID NO: 218577 - DNA, 20 bp, Artificial Sequence
  chemically synthesized
tagggctcagatgcatattc

SEQ ID NO: 218578 - DNA, 20 bp, Artificial Sequence
  chemically synthesized
gctcagatgcatattcaggt

SEQ ID NO: 218579 - DNA, 20 bp, Artificial Sequence
  chemically synthesized
tcagatgcatattcaggtca

SEQ ID NO: 218580 - DNA, 20 bp, Artificial Sequence
  chemically synthesized
cagatgcatattcaggtcag

SEQ ID NO: 218581 - DNA, 20 bp, Artificial Sequence
  chemically synthesized
agatgcatattcaggtcaga

SEQ ID NO: 218582 - DNA, 20 bp, Artificial Sequence
  chemically synthesized
gattacacaaaatagagcag

SEQ ID NO: 218583 - DNA, 20 bp, Artificial Sequence
  chemically synthesized
gggattacacaaaatagagc

SEQ ID NO: 218584 - DNA, 20 bp, Artificial Sequence
  chemically synthesized
ggggattacacaaaatagag

SEQ ID NO: 218585 - DNA, 20 bp, Artificial Sequence
  chemically synthesized
gaaggggattacacaaaata

SEQ ID NO: 218586 - DNA, 20 bp, Artificial Sequence
  chemically synthesized
aggaaggggattacacaaaa

SEQ ID NO: 218587 - DNA, 20 bp, Artificial Sequence
  chemically synthesized
ttttgtgtaatccccttcct

SEQ ID NO: 218588 - DNA, 20 bp, Artificial Sequence
  chemically synthesized
ctttgctaacactcaggaag

SEQ ID NO: 218589 - DNA, 20 bp, Artificial Sequence
  chemically synthesized
actttgctaacactcaggaa

SEQ ID NO: 218590 - DNA, 20 bp, Artificial Sequence
  chemically synthesized
cactttgctaacactcagga

SEQ ID NO: 218591 - DNA, 20 bp, Artificial Sequence
  chemically synthesized
tcactttgctaacactcagg

SEQ ID NO: 218592 - DNA, 20 bp, Artificial Sequence
  chemically synthesized
gtaatccccttcctgagtgt

SEQ ID NO: 218593 - DNA, 20 bp, Artificial Sequence
  chemically synthesized
ccatcactttgctaacactc

SEQ ID NO: 218594 - DNA, 20 bp, Artificial Sequence
  chemically synthesized
cccatcactttgctaacact

SEQ ID NO: 218595 - DNA, 20 bp, Artificial Sequence
  chemically synthesized
ccccttcctgagtgttagca

SEQ ID NO: 218596 - DNA, 20 bp, Artificial Sequence
  chemically synthesized
cctgagtgttagcaaagtga

SEQ ID NO: 218597 - DNA, 20 bp, Artificial Sequence
  chemically synthesized
ctgagtgttagcaaagtgat

SEQ ID NO: 218598 - DNA, 20 bp, Artificial Sequence
  chemically synthesized
aagtgatgggttcacactta

SEQ ID NO: 218599 - DNA, 20 bp, Artificial Sequence
  chemically synthesized
agtgatgggttcacacttac

SEQ ID NO: 218600 - DNA, 20 bp, Artificial Sequence
  chemically synthesized
gatgggttcacacttacggg

SEQ ID NO: 218601 - DNA, 20 bp, Artificial Sequence
  chemically synthesized
tgggttcacacttacgggta

SEQ ID NO: 218602 - DNA, 20 bp, Artificial Sequence
  chemically synthesized
cctgctacctctctacccgt

SEQ ID NO: 218603 - DNA, 20 bp, Artificial Sequence
  chemically synthesized
ggttcacacttacgggtaga

SEQ ID NO: 218604 - DNA, 20 bp, Artificial Sequence
  chemically synthesized
gttcacacttacgggtagag

SEQ ID NO: 218605 - DNA, 20 bp, Artificial Sequence
  chemically synthesized
cacacttacgggtagagagg

SEQ ID NO: 218606 - DNA, 20 bp, Artificial Sequence
  chemically synthesized
acttacgggtagagaggtag

SEQ ID NO: 218607 - DNA, 20 bp, Artificial Sequence
  chemically synthesized
cttacgggtagagaggtagc

SEQ ID NO: 218608 - DNA, 20 bp, Artificial Sequence
  chemically synthesized
tacgggtagagaggtagcag

SEQ ID NO: 218609 - DNA, 20 bp, Artificial Sequence
  chemically synthesized
acgggtagagaggtagcagg

SEQ ID NO: 218610 - DNA, 20 bp, Artificial Sequence
  chemically synthesized
gtagagaggtagcaggagga

SEQ ID NO: 218611 - DNA, 20 bp, Artificial Sequence
  chemically synthesized
gaggtagcaggaggaaagtg

SEQ ID NO: 218612 - DNA, 20 bp, Artificial Sequence
  chemically synthesized
ttctggcacagagtcaagaa

SEQ ID NO: 218613 - DNA, 20 bp, Artificial Sequence
  chemically synthesized
atctcttctggcacagagtc

SEQ ID NO: 218614 - DNA, 20 bp, Artificial Sequence
  chemically synthesized
agctgttcttgactctgtgc

SEQ ID NO: 218615 - DNA, 20 bp, Artificial Sequence
  chemically synthesized
ctgtaatctcttctggcaca

SEQ ID NO: 218616 - DNA, 20 bp, Artificial Sequence
  chemically synthesized
tgttcttgactctgtgccag

SEQ ID NO: 218617 - DNA, 20 bp, Artificial Sequence
  chemically synthesized
ttctgtaatctcttctggca

SEQ ID NO: 218618 - DNA, 20 bp, Artificial Sequence
  chemically synthesized
ttcttgactctgtgccagaa

SEQ ID NO: 218619 - DNA, 20 bp, Artificial Sequence
  chemically synthesized
tcagtttctgtaatctcttc

SEQ ID NO: 218620 - DNA, 20 bp, Artificial Sequence
  chemically synthesized
ctctgtgccagaagagatta

SEQ ID NO: 218621 - DNA, 20 bp, Artificial Sequence
  chemically synthesized
tctgttgagttcgagagggt

SEQ ID NO: 218622 - DNA, 20 bp, Artificial Sequence
  chemically synthesized
agcttctgttgagttcgaga

SEQ ID NO: 218623 - DNA, 20 bp, Artificial Sequence
  chemically synthesized
cagcttctgttgagttcgag

SEQ ID NO: 218624 - DNA, 20 bp, Artificial Sequence
  chemically synthesized
acagcttctgttgagttcga

SEQ ID NO: 218625 - DNA, 20 bp, Artificial Sequence
  chemically synthesized
ctacagcttctgttgagttc

SEQ ID NO: 218626 - DNA, 20 bp, Artificial Sequence
  chemically synthesized
actgaccctctcgaactcaa

SEQ ID NO: 218627 - DNA, 20 bp, Artificial Sequence
  chemically synthesized
gaccctctcgaactcaacag

SEQ ID NO: 218628 - DNA, 20 bp, Artificial Sequence
  chemically synthesized
tgtggtctacagcttctgtt

SEQ ID NO: 218629 - DNA, 20 bp, Artificial Sequence
  chemically synthesized
ctcgaactcaacagaagctg

SEQ ID NO: 218630 - DNA, 20 bp, Artificial Sequence
  chemically synthesized
acatgtaccaatgtggtcta

SEQ ID NO: 218631 - DNA, 20 bp, Artificial Sequence
  chemically synthesized
acagaagctgtagaccacat

SEQ ID NO: 218632 - DNA, 20 bp, Artificial Sequence
  chemically synthesized
ataaaacacatgtaccaatg

SEQ ID NO: 218633 - DNA, 20 bp, Artificial Sequence
  chemically synthesized
agaaacggcatgcatgattg

SEQ ID NO: 218634 - DNA, 20 bp, Artificial Sequence
  chemically synthesized
tcttttgcaaagcacagaaa

SEQ ID NO: 218635 - DNA, 20 bp, Artificial Sequence
  chemically synthesized
tctgtctcttttgcaaagca

SEQ ID NO: 218636 - DNA, 20 bp, Artificial Sequence
  chemically synthesized
gccgtttctgtgctttgcaa

SEQ ID NO: 218637 - DNA, 20 bp, Artificial Sequence
  chemically synthesized
cgtttctgtgctttgcaaaa

SEQ ID NO: 218638 - DNA, 20 bp, Artificial Sequence
  chemically synthesized
cactatctgtctcttttgca

SEQ ID NO: 218639 - DNA, 20 bp, Artificial Sequence
  chemically synthesized
tctgtgctttgcaaaagaga

SEQ ID NO: 218640 - DNA, 20 bp, Artificial Sequence
  chemically synthesized
tgctttgcaaaagagacaga

SEQ ID NO: 218641 - DNA, 20 bp, Artificial Sequence
  chemically synthesized
tttgcaaaagagacagatag

SEQ ID NO: 218642 - DNA, 20 bp, Artificial Sequence
  chemically synthesized
aaagagacagatagtggtgc

SEQ ID NO: 218643 - DNA, 20 bp, Artificial Sequence
  chemically synthesized
aagagacagatagtggtgcc

SEQ ID NO: 218644 - DNA, 20 bp, Artificial Sequence
  chemically synthesized
agagacagatagtggtgcca

SEQ ID NO: 218645 - DNA, 20 bp, Artificial Sequence
  chemically synthesized
gagacagatagtggtgccag

SEQ ID NO: 218646 - DNA, 20 bp, Artificial Sequence
  chemically synthesized
cagatagtggtgccagggga

SEQ ID NO: 218647 - DNA, 20 bp, Artificial Sequence
  chemically synthesized
agatagtggtgccaggggaa

SEQ ID NO: 218648 - DNA, 20 bp, Artificial Sequence
  chemically synthesized
actgctaatgtcctttcccc

SEQ ID NO: 218649 - DNA, 20 bp, Artificial Sequence
  chemically synthesized
ggtgccaggggaaaggacat

SEQ ID NO: 218650 - DNA, 20 bp, Artificial Sequence
  chemically synthesized
gccaggggaaaggacattag

SEQ ID NO: 218651 - DNA, 20 bp, Artificial Sequence
  chemically synthesized
ggaaaggacattagcagtcc

SEQ ID NO: 218652 - DNA, 20 bp, Artificial Sequence
  chemically synthesized
cattagcagtccaagttgat

SEQ ID NO: 218653 - DNA, 20 bp, Artificial Sequence
  chemically synthesized
accattttacctaatcaact

SEQ ID NO: 218654 - DNA, 20 bp, Artificial Sequence
  chemically synthesized
attagcagtccaagttgatt

SEQ ID NO: 218655 - DNA, 20 bp, Artificial Sequence
  chemically synthesized
tccaagttgattaggtaaaa

SEQ ID NO: 218656 - DNA, 20 bp, Artificial Sequence
  chemically synthesized
ttaggtaaaatggtctgaca

SEQ ID NO: 218657 - DNA, 20 bp, Artificial Sequence
  chemically synthesized
gtaaaatggtctgacacagt

SEQ ID NO: 218658 - DNA, 20 bp, Artificial Sequence
  chemically synthesized
caacttttgcctcactgtgt

SEQ ID NO: 218659 - DNA, 20 bp, Artificial Sequence
  chemically synthesized
taaaatggtctgacacagtg

SEQ ID NO: 218660 - DNA, 20 bp, Artificial Sequence
  chemically synthesized
ggtctgacacagtgaggcaa

SEQ ID NO: 218661 - DNA, 20 bp, Artificial Sequence
  chemically synthesized
cagtgaggcaaaagttgatt

SEQ ID NO: 218662 - DNA, 20 bp, Artificial Sequence
  chemically synthesized
gatttggtaaaaacttgaca

SEQ ID NO: 218663 - DNA, 20 bp, Artificial Sequence
  chemically synthesized
ttgaaagtgccgtctatgtc

SEQ ID NO: 218664 - DNA, 20 bp, Artificial Sequence
  chemically synthesized
tggtaaaaacttgacataga

SEQ ID NO: 218665 - DNA, 20 bp, Artificial Sequence
  chemically synthesized
aagtggataccgatggttga

SEQ ID NO: 218666 - DNA, 20 bp, Artificial Sequence
  chemically synthesized
tagacggcactttcaaccat

SEQ ID NO: 218667 - DNA, 20 bp, Artificial Sequence
  chemically synthesized
atctattaagtggataccga

SEQ ID NO: 218668 - DNA, 20 bp, Artificial Sequence
  chemically synthesized
aaccatcggtatccacttaa

SEQ ID NO: 218669 - DNA, 20 bp, Artificial Sequence
  chemically synthesized
agctgtttacatctattaag

SEQ ID NO: 218670 - DNA, 20 bp, Artificial Sequence
  chemically synthesized
aatagctgtttacatctatt

SEQ ID NO: 218671 - DNA, 20 bp, Artificial Sequence
  chemically synthesized
atccacttaatagatgtaaa

SEQ ID NO: 218672 - DNA, 20 bp, Artificial Sequence
  chemically synthesized
gggtgtttgtgtcgtgaaaa

SEQ ID NO: 218673 - DNA, 20 bp, Artificial Sequence
  chemically synthesized
tgttctaaagatgtaagtgt

SEQ ID NO: 218674 - DNA, 20 bp, Artificial Sequence
  chemically synthesized
ctgttctaaagatgtaagtg

SEQ ID NO: 218675 - DNA, 20 bp, Artificial Sequence
  chemically synthesized
aacacccacacttacatctt

SEQ ID NO: 218676 - DNA, 20 bp, Artificial Sequence
  chemically synthesized
tgagactgttctaaagatgt

SEQ ID NO: 218677 - DNA, 20 bp, Artificial Sequence
  chemically synthesized
ccacacttacatctttagaa

SEQ ID NO: 218678 - DNA, 20 bp, Artificial Sequence
  chemically synthesized
gaattgctgagactgttcta

SEQ ID NO: 218679 - DNA, 20 bp, Artificial Sequence
  chemically synthesized
ttacatctttagaacagtct

SEQ ID NO: 218680 - DNA, 20 bp, Artificial Sequence
  chemically synthesized
ggcaagcatacagaattgct

SEQ ID NO: 218681 - DNA, 20 bp, Artificial Sequence
  chemically synthesized
agatttatctggcaagcata

SEQ ID NO: 218682 - DNA, 20 bp, Artificial Sequence
  chemically synthesized
cagcaattctgtatgcttgc

SEQ ID NO: 218683 - DNA, 20 bp, Artificial Sequence
  chemically synthesized
gcagcagagatttatctggc

SEQ ID NO: 218684 - DNA, 20 bp, Artificial Sequence
  chemically synthesized
atttgcagcagagatttatc

SEQ ID NO: 218685 - DNA, 20 bp, Artificial Sequence
  chemically synthesized
ctggaggataatttgcagca

SEQ ID NO: 218686 - DNA, 20 bp, Artificial Sequence
  chemically synthesized
ggctggaggataatttgcag

SEQ ID NO: 218687 - DNA, 20 bp, Artificial Sequence
  chemically synthesized
catggctggaggataatttg

SEQ ID NO: 218688 - DNA, 20 bp, Artificial Sequence
  chemically synthesized
ctctgctgcaaattatcctc

SEQ ID NO: 218689 - DNA, 20 bp, Artificial Sequence
  chemically synthesized
gttttaaatctcatggctgg

SEQ ID NO: 218690 - DNA, 20 bp, Artificial Sequence
  chemically synthesized
gcaaattatcctccagccat

SEQ ID NO: 218691 - DNA, 20 bp, Artificial Sequence
  chemically synthesized
ggttttaaatctcatggctg

SEQ ID NO: 218692 - DNA, 20 bp, Artificial Sequence
  chemically synthesized
ttggttttaaatctcatggc

SEQ ID NO: 218693 - DNA, 20 bp, Artificial Sequence
  chemically synthesized
actcttggttttaaatctca

SEQ ID NO: 218694 - DNA, 20 bp, Artificial Sequence
  chemically synthesized
cagccatgagatttaaaacc

SEQ ID NO: 218695 - DNA, 20 bp, Artificial Sequence
  chemically synthesized
gccatgagatttaaaaccaa

SEQ ID NO: 218696 - DNA, 20 bp, Artificial Sequence
  chemically synthesized
aacaaaacactagaaactct

SEQ ID NO: 218697 - DNA, 20 bp, Artificial Sequence
  chemically synthesized
gatttaaaaccaagagtttc

SEQ ID NO: 218698 - DNA, 20 bp, Artificial Sequence
  chemically synthesized
atttcaaaggaacaaaacac

SEQ ID NO: 218699 - DNA, 20 bp, Artificial Sequence
  chemically synthesized
gttaaggttacatatttcaa

SEQ ID NO: 218700 - DNA, 20 bp, Artificial Sequence
  chemically synthesized
ggttaaggttacatatttca

SEQ ID NO: 218701 - DNA, 20 bp, Artificial Sequence
  chemically synthesized
ttgaaatatgtaaccttaac

SEQ ID NO: 218702 - DNA, 20 bp, Artificial Sequence
  chemically synthesized
agggtataaacatctggtta

SEQ ID NO: 218703 - DNA, 20 bp, Artificial Sequence
  chemically synthesized
cagggtataaacatctggtt

SEQ ID NO: 218704 - DNA, 20 bp, Artificial Sequence
  chemically synthesized
tgacccagggtataaacatc

SEQ ID NO: 218705 - DNA, 20 bp, Artificial Sequence
  chemically synthesized
ttaaccagatgtttataccc

SEQ ID NO: 218706 - DNA, 20 bp, Artificial Sequence
  chemically synthesized
taaccagatgtttataccct

SEQ ID NO: 218707 - DNA, 20 bp, Artificial Sequence
  chemically synthesized
aattagatttttgtgaccca

SEQ ID NO: 218708 - DNA, 20 bp, Artificial Sequence
  chemically synthesized
caattagatttttgtgaccc

SEQ ID NO: 218709 - DNA, 20 bp, Artificial Sequence
  chemically synthesized
tcaattagatttttgtgacc

SEQ ID NO: 218710 - DNA, 20 bp, Artificial Sequence
  chemically synthesized
gtcacaaaaatctaattgaa

SEQ ID NO: 218711 - DNA, 20 bp, Artificial Sequence
  chemically synthesized
catcaagtgaactattcaat

SEQ ID NO: 218712 - DNA, 20 bp, Artificial Sequence
  chemically synthesized
cttaattgtgcgaacacatc

SEQ ID NO: 218713 - DNA, 20 bp, Artificial Sequence
  chemically synthesized
cttgatgtgttcgcacaatt

SEQ ID NO: 218714 - DNA, 20 bp, Artificial Sequence
  chemically synthesized
cttcccctattaaggaagaa

SEQ ID NO: 218715 - DNA, 20 bp, Artificial Sequence
  chemically synthesized
ctcttcccctattaaggaag

SEQ ID NO: 218716 - DNA, 20 bp, Artificial Sequence
  chemically synthesized
aagaaactcttcttccttaa

SEQ ID NO: 218717 - DNA, 20 bp, Artificial Sequence
  chemically synthesized
agaaactcttcttccttaat

SEQ ID NO: 218718 - DNA, 20 bp, Artificial Sequence
  chemically synthesized
cccctcttcccctattaagg

SEQ ID NO: 218719 - DNA, 20 bp, Artificial Sequence
  chemically synthesized
gaaactcttcttccttaata

SEQ ID NO: 218720 - DNA, 20 bp, Artificial Sequence
  chemically synthesized
aaactcttcttccttaatag

SEQ ID NO: 218721 - DNA, 20 bp, Artificial Sequence
  chemically synthesized
ttgcccctcttcccctatta

SEQ ID NO: 218722 - DNA, 20 bp, Artificial Sequence
  chemically synthesized
tttgcccctcttcccctatt

SEQ ID NO: 218723 - DNA, 20 bp, Artificial Sequence
  chemically synthesized
ctcttcttccttaatagggg

SEQ ID NO: 218724 - DNA, 20 bp, Artificial Sequence
  chemically synthesized
cttcttccttaataggggaa

SEQ ID NO: 218725 - DNA, 20 bp, Artificial Sequence
  chemically synthesized
ttcttccttaataggggaag

SEQ ID NO: 218726 - DNA, 20 bp, Artificial Sequence
  chemically synthesized
tcttccttaataggggaaga

SEQ ID NO: 218727 - DNA, 20 bp, Artificial Sequence
  chemically synthesized
cttccttaataggggaagag

SEQ ID NO: 218728 - DNA, 20 bp, Artificial Sequence
  chemically synthesized
atgtttaattttcaaaaaca

SEQ ID NO: 218729 - DNA, 20 bp, Artificial Sequence
  chemically synthesized
gtttaattttcaaaaacaca

SEQ ID NO: 218730 - DNA, 20 bp, Artificial Sequence
  chemically synthesized
tgatagactgttgtagagca

SEQ ID NO: 218731 - DNA, 20 bp, Artificial Sequence
  chemically synthesized
gctgatagactgttgtagag

SEQ ID NO: 218732 - DNA, 20 bp, Artificial Sequence
  chemically synthesized
gagcgttctctgctctacaa

SEQ ID NO: 218733 - DNA, 20 bp, Artificial Sequence
  chemically synthesized
ctagctgatagactgttgta

SEQ ID NO: 218734 - DNA, 20 bp, Artificial Sequence
  chemically synthesized
ttctagctgatagactgttg

SEQ ID NO: 218735 - DNA, 20 bp, Artificial Sequence
  chemically synthesized
tctgctctacaacagtctat

SEQ ID NO: 218736 - DNA, 20 bp, Artificial Sequence
  chemically synthesized
ctctacaacagtctatcagc

SEQ ID NO: 218737 - DNA, 20 bp, Artificial Sequence
  chemically synthesized
taatagacatttctagctga

SEQ ID NO: 218738 - DNA, 20 bp, Artificial Sequence
  chemically synthesized
agacagttaatagacatttc

SEQ ID NO: 218739 - DNA, 20 bp, Artificial Sequence
  chemically synthesized
agtagagaagagacagttaa

SEQ ID NO: 218740 - DNA, 20 bp, Artificial Sequence
  chemically synthesized
ctcatgaagtagagaagaga

SEQ ID NO: 218741 - DNA, 20 bp, Artificial Sequence
  chemically synthesized
tgtgctcatgaagtagagaa

SEQ ID NO: 218742 - DNA, 20 bp, Artificial Sequence
  chemically synthesized
tttgtgctcatgaagtagag

SEQ ID NO: 218743 - DNA, 20 bp, Artificial Sequence
  chemically synthesized
atctttgtgctcatgaagta

SEQ ID NO: 218744 - DNA, 20 bp, Artificial Sequence
  chemically synthesized
ctgtctcttctctacttcat

SEQ ID NO: 218745 - DNA, 20 bp, Artificial Sequence
  chemically synthesized
ttatctttgtgctcatgaag

SEQ ID NO: 218746 - DNA, 20 bp, Artificial Sequence
  chemically synthesized
aacttatctttgtgctcatg

SEQ ID NO: 218747 - DNA, 20 bp, Artificial Sequence
  chemically synthesized
ttctctacttcatgagcaca

SEQ ID NO: 218748 - DNA, 20 bp, Artificial Sequence
  chemically synthesized
tacttcatgagcacaaagat

SEQ ID NO: 218749 - DNA, 20 bp, Artificial Sequence
  chemically synthesized
atgagcacaaagataagttg

SEQ ID NO: 218750 - DNA, 20 bp, Artificial Sequence
  chemically synthesized
acaaagataagttgtggttt

SEQ ID NO: 218751 - DNA, 20 bp, Artificial Sequence
  chemically synthesized
caaagataagttgtggtttt

SEQ ID NO: 218752 - DNA, 20 bp, Artificial Sequence
  chemically synthesized
aaagataagttgtggtttta

SEQ ID NO: 218753 - DNA, 20 bp, Artificial Sequence
  chemically synthesized
ttgtggttttagggaccctt

SEQ ID NO: 218754 - DNA, 20 bp, Artificial Sequence
  chemically synthesized
tgtggttttagggacccttt

SEQ ID NO: 218755 - DNA, 20 bp, Artificial Sequence
  chemically synthesized
gtggttttagggaccctttg

SEQ ID NO: 218756 - DNA, 20 bp, Artificial Sequence
  chemically synthesized
tggttttagggaccctttgg

SEQ ID NO: 218757 - DNA, 20 bp, Artificial Sequence
  chemically synthesized
atctcttaatatcccccaaa

SEQ ID NO: 218758 - DNA, 20 bp, Artificial Sequence
  chemically synthesized
gatctcttaatatcccccaa

SEQ ID NO: 218759 - DNA, 20 bp, Artificial Sequence
  chemically synthesized
agatctcttaatatccccca

SEQ ID NO: 218760 - DNA, 20 bp, Artificial Sequence
  chemically synthesized
gggaccctttgggggatatt

SEQ ID NO: 218761 - DNA, 20 bp, Artificial Sequence
  chemically synthesized
gaccctttgggggatattaa

SEQ ID NO: 218762 - DNA, 20 bp, Artificial Sequence
  chemically synthesized
gggggatattaagagatctt

SEQ ID NO: 218763 - DNA, 20 bp, Artificial Sequence
  chemically synthesized
ggggatattaagagatcttg

SEQ ID NO: 218764 - DNA, 20 bp, Artificial Sequence
  chemically synthesized
tttggtttagcatttacctc

SEQ ID NO: 218765 - DNA, 20 bp, Artificial Sequence
  chemically synthesized
gaggtaaatgctaaaccaaa

SEQ ID NO: 218766 - DNA, 20 bp, Artificial Sequence
  chemically synthesized
acaaactaaactgtttggtt

SEQ ID NO: 218767 - DNA, 20 bp, Artificial Sequence
  chemically synthesized
aaatgctaaaccaaacagtt

SEQ ID NO: 218768 - DNA, 20 bp, Artificial Sequence
  chemically synthesized
tgaatacaaactaaactgtt

SEQ ID NO: 218769 - DNA, 20 bp, Artificial Sequence
  chemically synthesized
caaacagtttagtttgtatt

SEQ ID NO: 218770 - DNA, 20 bp, Artificial Sequence
  chemically synthesized
aaacagtttagtttgtattc

SEQ ID NO: 218771 - DNA, 20 bp, Artificial Sequence
  chemically synthesized
agtttagtttgtattcagga

SEQ ID NO: 218772 - DNA, 20 bp, Artificial Sequence
  chemically synthesized
ttagtttgtattcaggacag

SEQ ID NO: 218773 - DNA, 20 bp, Artificial Sequence
  chemically synthesized
ttaatgttaaagtaggatga

SEQ ID NO: 218774 - DNA, 20 bp, Artificial Sequence
  chemically synthesized
aatataattaatgttaaagt

SEQ ID NO: 218775 - DNA, 20 bp, Artificial Sequence
  chemically synthesized
taatataattaatgttaaag

SEQ ID NO: 218776 - DNA, 20 bp, Artificial Sequence
  chemically synthesized
ttttaatataattaatgtta

SEQ ID NO: 218777 - DNA, 20 bp, Artificial Sequence
  chemically synthesized
ttagatagcccagttaaaag

SEQ ID NO: 218778 - DNA, 20 bp, Artificial Sequence
  chemically synthesized
taaaaaattcttcttttaac

SEQ ID NO: 218779 - DNA, 20 bp, Artificial Sequence
  chemically synthesized
aaaaaattcttcttttaact

SEQ ID NO: 218780 - DNA, 20 bp, Artificial Sequence
  chemically synthesized
taattagatagcccagttaa

SEQ ID NO: 218781 - DNA, 20 bp, Artificial Sequence
  chemically synthesized
gccttattaattagatagcc

SEQ ID NO: 218782 - DNA, 20 bp, Artificial Sequence
  chemically synthesized
tgctggccttattaattaga

SEQ ID NO: 218783 - DNA, 20 bp, Artificial Sequence
  chemically synthesized
aactgggctatctaattaat

SEQ ID NO: 218784 - DNA, 20 bp, Artificial Sequence
  chemically synthesized
actgggctatctaattaata

SEQ ID NO: 218785 - DNA, 20 bp, Artificial Sequence
  chemically synthesized
atgttgctggccttattaat

SEQ ID NO: 218786 - DNA, 20 bp, Artificial Sequence
  chemically synthesized
ggctatctaattaataaggc

SEQ ID NO: 218787 - DNA, 20 bp, Artificial Sequence
  chemically synthesized
tattggtcaaggaatgttgc

SEQ ID NO: 218788 - DNA, 20 bp, Artificial Sequence
  chemically synthesized
ttatacaagcatattggtca

SEQ ID NO: 218789 - DNA, 20 bp, Artificial Sequence
  chemically synthesized
cttatacaagcatattggtc

SEQ ID NO: 218790 - DNA, 20 bp, Artificial Sequence
  chemically synthesized
ctaagcttatacaagcatat

SEQ ID NO: 218791 - DNA, 20 bp, Artificial Sequence
  chemically synthesized
cttgaccaatatgcttgtat

SEQ ID NO: 218792 - DNA, 20 bp, Artificial Sequence
  chemically synthesized
aaaataaactaagcttatac

SEQ ID NO: 218793 - DNA, 20 bp, Artificial Sequence
  chemically synthesized
ccaatatgcttgtataagct

SEQ ID NO: 218794 - DNA, 20 bp, Artificial Sequence
  chemically synthesized
cctatacacaaaaataaact

SEQ ID NO: 218795 - DNA, 20 bp, Artificial Sequence
  chemically synthesized
gcttagtttatttttgtgta

SEQ ID NO: 218796 - DNA, 20 bp, Artificial Sequence
  chemically synthesized
cttagtttatttttgtgtat

SEQ ID NO: 218797 - DNA, 20 bp, Artificial Sequence
  chemically synthesized
ttcaattgtactgatgaaaa

SEQ ID NO: 218798 - DNA, 20 bp, Artificial Sequence
  chemically synthesized
gctcctgatacttttttcat

SEQ ID NO: 218799 - DNA, 20 bp, Artificial Sequence
  chemically synthesized
tgtactgatgaaaaaagtat

SEQ ID NO: 218800 - DNA, 20 bp, Artificial Sequence
  chemically synthesized
gtactgatgaaaaaagtatc

SEQ ID NO: 218801 - DNA, 20 bp, Artificial Sequence
  chemically synthesized
actgatgaaaaaagtatcag

SEQ ID NO: 218802 - DNA, 20 bp, Artificial Sequence
  chemically synthesized
ctgtcacaaaggaagatcag

SEQ ID NO: 218803 - DNA, 20 bp, Artificial Sequence
  chemically synthesized
tcactgtcacaaaggaagat

SEQ ID NO: 218804 - DNA, 20 bp, Artificial Sequence
  chemically synthesized
atttctcactgtcacaaagg

SEQ ID NO: 218805 - DNA, 20 bp, Artificial Sequence
  chemically synthesized
cttctgatcttcctttgtga

SEQ ID NO: 218806 - DNA, 20 bp, Artificial Sequence
  chemically synthesized
tgtatttctcactgtcacaa

SEQ ID NO: 218807 - DNA, 20 bp, Artificial Sequence
  chemically synthesized
ctgtatttctcactgtcaca

SEQ ID NO: 218808 - DNA, 20 bp, Artificial Sequence
  chemically synthesized
tgatcttcctttgtgacagt

SEQ ID NO: 218809 - DNA, 20 bp, Artificial Sequence
  chemically synthesized
ctttgtgacagtgagaaata

SEQ ID NO: 218810 - DNA, 20 bp, Artificial Sequence
  chemically synthesized
agtgagaaatacagaactct

SEQ ID NO: 218811 - DNA, 20 bp, Artificial Sequence
  chemically synthesized
acagagttgttaagtgctga

SEQ ID NO: 218812 - DNA, 20 bp, Artificial Sequence
  chemically synthesized
ggacagagttgttaagtgct

SEQ ID NO: 218813 - DNA, 20 bp, Artificial Sequence
  chemically synthesized
agggtttggacagagttgtt

SEQ ID NO: 218814 - DNA, 20 bp, Artificial Sequence
  chemically synthesized
ttagtgcaagggtttggaca

SEQ ID NO: 218815 - DNA, 20 bp, Artificial Sequence
  chemically synthesized
tcttagtgcaagggtttgga

SEQ ID NO: 218816 - DNA, 20 bp, Artificial Sequence
  chemically synthesized
caagtcttagtgcaagggtt

SEQ ID NO: 218817 - DNA, 20 bp, Artificial Sequence
  chemically synthesized
tctgtccaaacccttgcact

SEQ ID NO: 218818 - DNA, 20 bp, Artificial Sequence
  chemically synthesized
ttagtcaagtcttagtgcaa

SEQ ID NO: 218819 - DNA, 20 bp, Artificial Sequence
  chemically synthesized
tttagtcaagtcttagtgca

SEQ ID NO: 218820 - DNA, 20 bp, Artificial Sequence
  chemically synthesized
gtttagtcaagtcttagtgc

SEQ ID NO: 218821 - DNA, 20 bp, Artificial Sequence
  chemically synthesized
actagagtttagtcaagtct

SEQ ID NO: 218822 - DNA, 20 bp, Artificial Sequence
  chemically synthesized
aaccatactagagtttagtc

SEQ ID NO: 218823 - DNA, 20 bp, Artificial Sequence
  chemically synthesized
actaagacttgactaaactc

SEQ ID NO: 218824 - DNA, 20 bp, Artificial Sequence
  chemically synthesized
ctagaaaccatactagagtt

SEQ ID NO: 218825 - DNA, 20 bp, Artificial Sequence
  chemically synthesized
gacttgactaaactctagta

SEQ ID NO: 218826 - DNA, 20 bp, Artificial Sequence
  chemically synthesized
tggggctagaaaccatacta

SEQ ID NO: 218827 - DNA, 20 bp, Artificial Sequence
  chemically synthesized
tctggggctagaaaccatac

SEQ ID NO: 218828 - DNA, 20 bp, Artificial Sequence
  chemically synthesized
ctaaactctagtatggtttc

SEQ ID NO: 218829 - DNA, 20 bp, Artificial Sequence
  chemically synthesized
tctagtatggtttctagccc

SEQ ID NO: 218830 - DNA, 20 bp, Artificial Sequence
  chemically synthesized
agtatggtttctagccccag

SEQ ID NO: 218831 - DNA, 20 bp, Artificial Sequence
  chemically synthesized
gggacatggccttctggggc

SEQ ID NO: 218832 - DNA, 20 bp, Artificial Sequence
  chemically synthesized
gtatggtttctagccccaga

SEQ ID NO: 218833 - DNA, 20 bp, Artificial Sequence
  chemically synthesized
cctagggacatggccttctg

SEQ ID NO: 218834 - DNA, 20 bp, Artificial Sequence
  chemically synthesized
tcctagggacatggccttct

SEQ ID NO: 218835 - DNA, 20 bp, Artificial Sequence
  chemically synthesized
atcctagggacatggccttc

SEQ ID NO: 218836 - DNA, 20 bp, Artificial Sequence
  chemically synthesized
gccccagaaggccatgtccc

SEQ ID NO: 218837 - DNA, 20 bp, Artificial Sequence
  chemically synthesized
ccccagaaggccatgtccct

SEQ ID NO: 218838 - DNA, 20 bp, Artificial Sequence
  chemically synthesized
ctagggtcatcctagggaca

SEQ ID NO: 218839 - DNA, 20 bp, Artificial Sequence
  chemically synthesized
ggaaggctagggtcatccta

SEQ ID NO: 218840 - DNA, 20 bp, Artificial Sequence
  chemically synthesized
gggaaggctagggtcatcct

SEQ ID NO: 218841 - DNA, 20 bp, Artificial Sequence
  chemically synthesized
agggaaggctagggtcatcc

SEQ ID NO: 218842 - DNA, 20 bp, Artificial Sequence
  chemically synthesized
ccatgtccctaggatgaccc

SEQ ID NO: 218843 - DNA, 20 bp, Artificial Sequence
  chemically synthesized
aggcacttaagggaaggcta

SEQ ID NO: 218844 - DNA, 20 bp, Artificial Sequence
  chemically synthesized
caggcacttaagggaaggct

SEQ ID NO: 218845 - DNA, 20 bp, Artificial Sequence
  chemically synthesized
gcaggcacttaagggaaggc

SEQ ID NO: 218846 - DNA, 20 bp, Artificial Sequence
  chemically synthesized
gatgaccctagccttccctt

SEQ ID NO: 218847 - DNA, 20 bp, Artificial Sequence
  chemically synthesized
tcaagcaggcacttaaggga

SEQ ID NO: 218848 - DNA, 20 bp, Artificial Sequence
  chemically synthesized
ctcaagcaggcacttaaggg

SEQ ID NO: 218849 - DNA, 20 bp, Artificial Sequence
  chemically synthesized
tttctcaagcaggcacttaa

SEQ ID NO: 218850 - DNA, 20 bp, Artificial Sequence
  chemically synthesized
ctttctcaagcaggcactta

SEQ ID NO: 218851 - DNA, 20 bp, Artificial Sequence
  chemically synthesized
gctttctcaagcaggcactt

SEQ ID NO: 218852 - DNA, 20 bp, Artificial Sequence
  chemically synthesized
cttcccttaagtgcctgctt

SEQ ID NO: 218853 - DNA, 20 bp, Artificial Sequence
  chemically synthesized
agcactgagctttctcaagc

SEQ ID NO: 218854 - DNA, 20 bp, Artificial Sequence
  chemically synthesized
ccttaagtgcctgcttgaga

SEQ ID NO: 218855 - DNA, 20 bp, Artificial Sequence
  chemically synthesized
cagcactgagctttctcaag

SEQ ID NO: 218856 - DNA, 20 bp, Artificial Sequence
  chemically synthesized
tggcagcactgagctttctc

SEQ ID NO: 218857 - DNA, 20 bp, Artificial Sequence
  chemically synthesized
agtgcctgcttgagaaagct

SEQ ID NO: 218858 - DNA, 20 bp, Artificial Sequence
  chemically synthesized
taaattttcctggcagcact

SEQ ID NO: 218859 - DNA, 20 bp, Artificial Sequence
  chemically synthesized
ttgagaaagctcagtgctgc

SEQ ID NO: 218860 - DNA, 20 bp, Artificial Sequence
  chemically synthesized
tgagaaagctcagtgctgcc

SEQ ID NO: 218861 - DNA, 20 bp, Artificial Sequence
  chemically synthesized
caaacattaaattttcctgg

SEQ ID NO: 218862 - DNA, 20 bp, Artificial Sequence
  chemically synthesized
gaacaaacattaaattttcc

SEQ ID NO: 218863 - DNA, 20 bp, Artificial Sequence
  chemically synthesized
ggaaaatttaatgtttgttc

SEQ ID NO: 218864 - DNA, 20 bp, Artificial Sequence
  chemically synthesized
atcaacagatgtgtgttggc

SEQ ID NO: 218865 - DNA, 20 bp, Artificial Sequence
  chemically synthesized
tcctatcaacagatgtgtgt

SEQ ID NO: 218866 - DNA, 20 bp, Artificial Sequence
  chemically synthesized
agccaacacacatctgttga

SEQ ID NO: 218867 - DNA, 20 bp, Artificial Sequence
  chemically synthesized
gccaacacacatctgttgat

SEQ ID NO: 218868 - DNA, 20 bp, Artificial Sequence
  chemically synthesized
ggaggtaagagtcctatcaa

SEQ ID NO: 218869 - DNA, 20 bp, Artificial Sequence
  chemically synthesized
gttctaagaaacggaggtaa

SEQ ID NO: 218870 - DNA, 20 bp, Artificial Sequence
  chemically synthesized
atgttctaagaaacggaggt

SEQ ID NO: 218871 - DNA, 20 bp, Artificial Sequence
  chemically synthesized
gtaaatgttctaagaaacgg

SEQ ID NO: 218872 - DNA, 20 bp, Artificial Sequence
  chemically synthesized
ggactcttacctccgtttct

SEQ ID NO: 218873 - DNA, 20 bp, Artificial Sequence
  chemically synthesized
agtaaatgttctaagaaacg

SEQ ID NO: 218874 - DNA, 20 bp, Artificial Sequence
  chemically synthesized
tgagtaaatgttctaagaaa

SEQ ID NO: 218875 - DNA, 20 bp, Artificial Sequence
  chemically synthesized
cccttttgagtaaatgttct

SEQ ID NO: 218876 - DNA, 20 bp, Artificial Sequence
  chemically synthesized
ttcttagaacatttactcaa

SEQ ID NO: 218877 - DNA, 20 bp, Artificial Sequence
  chemically synthesized
tcttagaacatttactcaaa

SEQ ID NO: 218878 - DNA, 20 bp, Artificial Sequence
  chemically synthesized
cttagaacatttactcaaaa

SEQ ID NO: 218879 - DNA, 20 bp, Artificial Sequence
  chemically synthesized
tcacaattgtaagccctttt

SEQ ID NO: 218880 - DNA, 20 bp, Artificial Sequence
  chemically synthesized
agctacatgttcacaattgt

SEQ ID NO: 218881 - DNA, 20 bp, Artificial Sequence
  chemically synthesized
ggcttacaattgtgaacatg

SEQ ID NO: 218882 - DNA, 20 bp, Artificial Sequence
  chemically synthesized
aattgtgaacatgtagctct

SEQ ID NO: 218883 - DNA, 20 bp, Artificial Sequence
  chemically synthesized
gagacacttctgatttccaa

SEQ ID NO: 218884 - DNA, 20 bp, Artificial Sequence
  chemically synthesized
aacatgtagctcttggaaat

SEQ ID NO: 218885 - DNA, 20 bp, Artificial Sequence
  chemically synthesized
gagagacacttctgatttcc

SEQ ID NO: 218886 - DNA, 20 bp, Artificial Sequence
  chemically synthesized
atgtagctcttggaaatcag

SEQ ID NO: 218887 - DNA, 20 bp, Artificial Sequence
  chemically synthesized
atcagaagtgtctctcactc

SEQ ID NO: 218888 - DNA, 20 bp, Artificial Sequence
  chemically synthesized
tcagaagtgtctctcactca

SEQ ID NO: 218889 - DNA, 20 bp, Artificial Sequence
  chemically synthesized
gctttcaggtccttgagtga

SEQ ID NO: 218890 - DNA, 20 bp, Artificial Sequence
  chemically synthesized
tggctttcaggtccttgagt

SEQ ID NO: 218891 - DNA, 20 bp, Artificial Sequence
  chemically synthesized
agaatggctttcaggtcctt

SEQ ID NO: 218892 - DNA, 20 bp, Artificial Sequence
  chemically synthesized
tctctcactcaaggacctga

SEQ ID NO: 218893 - DNA, 20 bp, Artificial Sequence
  chemically synthesized
atttgaaaagaatggctttc

SEQ ID NO: 218894 - DNA, 20 bp, Artificial Sequence
  chemically synthesized
catttgaaaagaatggcttt

SEQ ID NO: 218895 - DNA, 20 bp, Artificial Sequence
  chemically synthesized
atgatgtcatttgaaaagaa

SEQ ID NO: 218896 - DNA, 20 bp, Artificial Sequence
  chemically synthesized
tcttgatgatgtcatttgaa

SEQ ID NO: 218897 - DNA, 20 bp, Artificial Sequence
  chemically synthesized
tcttttcaaatgacatcatc

SEQ ID NO: 218898 - DNA, 20 bp, Artificial Sequence
  chemically synthesized
tttcaaatgacatcatcaag

SEQ ID NO: 218899 - DNA, 20 bp, Artificial Sequence
  chemically synthesized
ttcaaatgacatcatcaaga

SEQ ID NO: 218900 - DNA, 20 bp, Artificial Sequence
  chemically synthesized
atgacatcatcaagaaggat

SEQ ID NO: 218901 - DNA, 20 bp, Artificial Sequence
  chemically synthesized
ccacagagaacaggagacag

SEQ ID NO: 218902 - DNA, 20 bp, Artificial Sequence
  chemically synthesized
cccacagagaacaggagaca

SEQ ID NO: 218903 - DNA, 20 bp, Artificial Sequence
  chemically synthesized
ttcccacagagaacaggaga

SEQ ID NO: 218904 - DNA, 20 bp, Artificial Sequence
  chemically synthesized
tatcttcccacagagaacag

SEQ ID NO: 218905 - DNA, 20 bp, Artificial Sequence
  chemically synthesized
tctatcttcccacagagaac

SEQ ID NO: 218906 - DNA, 20 bp, Artificial Sequence
  chemically synthesized
cctctgtctcctgttctctg

SEQ ID NO: 218907 - DNA, 20 bp, Artificial Sequence
  chemically synthesized
ttctatcttcccacagagaa

SEQ ID NO: 218908 - DNA, 20 bp, Artificial Sequence
  chemically synthesized
ctctgtctcctgttctctgt

SEQ ID NO: 218909 - DNA, 20 bp, Artificial Sequence
  chemically synthesized
tgtctcctgttctctgtggg

SEQ ID NO: 218910 - DNA, 20 bp, Artificial Sequence
  chemically synthesized
taggattctatcttcccaca

SEQ ID NO: 218911 - DNA, 20 bp, Artificial Sequence
  chemically synthesized
gttaggattctatcttccca

SEQ ID NO: 218912 - DNA, 20 bp, Artificial Sequence
  chemically synthesized
tcctgttctctgtgggaaga

SEQ ID NO: 218913 - DNA, 20 bp, Artificial Sequence
  chemically synthesized
agctggaagttattgaagtt

SEQ ID NO: 218914 - DNA, 20 bp, Artificial Sequence
  chemically synthesized
tagctggaagttattgaagt

SEQ ID NO: 218915 - DNA, 20 bp, Artificial Sequence
  chemically synthesized
gtgttagctggaagttattg

SEQ ID NO: 218916 - DNA, 20 bp, Artificial Sequence
  chemically synthesized
atcctaacttcaataacttc

SEQ ID NO: 218917 - DNA, 20 bp, Artificial Sequence
  chemically synthesized
aggccagctgtgttagctgg

SEQ ID NO: 218918 - DNA, 20 bp, Artificial Sequence
  chemically synthesized
tcaataacttccagctaaca

SEQ ID NO: 218919 - DNA, 20 bp, Artificial Sequence
  chemically synthesized
attaggccagctgtgttagc

SEQ ID NO: 218920 - DNA, 20 bp, Artificial Sequence
  chemically synthesized
taacttccagctaacacagc

SEQ ID NO: 218921 - DNA, 20 bp, Artificial Sequence
  chemically synthesized
tgtgattaggccagctgtgt

SEQ ID NO: 218922 - DNA, 20 bp, Artificial Sequence
  chemically synthesized
cagtgtaaatgtgattaggc

SEQ ID NO: 218923 - DNA, 20 bp, Artificial Sequence
  chemically synthesized
tggacagtgtaaatgtgatt

SEQ ID NO: 218924 - DNA, 20 bp, Artificial Sequence
  chemically synthesized
ctggacagtgtaaatgtgat

SEQ ID NO: 218925 - DNA, 20 bp, Artificial Sequence
  chemically synthesized
ctaatcacatttacactgtc

SEQ ID NO: 218926 - DNA, 20 bp, Artificial Sequence
  chemically synthesized
aaaaagtacaaagggctgga

SEQ ID NO: 218927 - DNA, 20 bp, Artificial Sequence
  chemically synthesized
agtaaaaaagtacaaagggc

SEQ ID NO: 218928 - DNA, 20 bp, Artificial Sequence
  chemically synthesized
gagaagtaaaaaagtacaaa

SEQ ID NO: 218929 - DNA, 20 bp, Artificial Sequence
  chemically synthesized
agagaagtaaaaaagtacaa

SEQ ID NO: 218930 - DNA, 20 bp, Artificial Sequence
  chemically synthesized
tagagaagtaaaaaagtaca

SEQ ID NO: 218931 - DNA, 20 bp, Artificial Sequence
  chemically synthesized
ttcgagttagagaagtaaaa

SEQ ID NO: 218932 - DNA, 20 bp, Artificial Sequence
  chemically synthesized
ggggttcattcgagttagag

SEQ ID NO: 218933 - DNA, 20 bp, Artificial Sequence
  chemically synthesized
gtgggggttcattcgagtta

SEQ ID NO: 218934 - DNA, 20 bp, Artificial Sequence
  chemically synthesized
gagtgggggttcattcgagt

SEQ ID NO: 218935 - DNA, 20 bp, Artificial Sequence
  chemically synthesized
gaaggagtgggggttcattc

SEQ ID NO: 218936 - DNA, 20 bp, Artificial Sequence
  chemically synthesized
gaaggagggagaaggagtgg

SEQ ID NO: 218937 - DNA, 20 bp, Artificial Sequence
  chemically synthesized
agaaggagggagaaggagtg

SEQ ID NO: 218938 - DNA, 20 bp, Artificial Sequence
  chemically synthesized
aagaaggagggagaaggagt

SEQ ID NO: 218939 - DNA, 20 bp, Artificial Sequence
  chemically synthesized
caagaaggagggagaaggag

SEQ ID NO: 218940 - DNA, 20 bp, Artificial Sequence
  chemically synthesized
aggcaagaaggagggagaag

SEQ ID NO: 218941 - DNA, 20 bp, Artificial Sequence
  chemically synthesized
taaggcaagaaggagggaga

SEQ ID NO: 218942 - DNA, 20 bp, Artificial Sequence
  chemically synthesized
ttaaggcaagaaggagggag

SEQ ID NO: 218943 - DNA, 20 bp, Artificial Sequence
  chemically synthesized
gttttaaggcaagaaggagg

SEQ ID NO: 218944 - DNA, 20 bp, Artificial Sequence
  chemically synthesized
ttgttttaaggcaagaagga

SEQ ID NO: 218945 - DNA, 20 bp, Artificial Sequence
  chemically synthesized
gttgttttaaggcaagaagg

SEQ ID NO: 218946 - DNA, 20 bp, Artificial Sequence
  chemically synthesized
ggttgttttaaggcaagaag

SEQ ID NO: 218947 - DNA, 20 bp, Artificial Sequence
  chemically synthesized
ttggttgttttaaggcaaga

SEQ ID NO: 218948 - DNA, 20 bp, Artificial Sequence
  chemically synthesized
cttggttgttttaaggcaag

SEQ ID NO: 218949 - DNA, 20 bp, Artificial Sequence
  chemically synthesized
cgacttggttgttttaaggc

SEQ ID NO: 218950 - DNA, 20 bp, Artificial Sequence
  chemically synthesized
gaggcgacttggttgtttta

SEQ ID NO: 218951 - DNA, 20 bp, Artificial Sequence
  chemically synthesized
agaggcgacttggttgtttt

SEQ ID NO: 218952 - DNA, 20 bp, Artificial Sequence
  chemically synthesized
cttcttgccttaaaacaacc

SEQ ID NO: 218953 - DNA, 20 bp, Artificial Sequence
  chemically synthesized
taatttgtgcagaggcgact

SEQ ID NO: 218954 - DNA, 20 bp, Artificial Sequence
  chemically synthesized
atccattctaatttgtgcag

SEQ ID NO: 218955 - DNA, 20 bp, Artificial Sequence
  chemically synthesized
gatccattctaatttgtgca

SEQ ID NO: 218956 - DNA, 20 bp, Artificial Sequence
  chemically synthesized
caagtcgcctctgcacaaat

SEQ ID NO: 218957 - DNA, 20 bp, Artificial Sequence
  chemically synthesized
gagatccattctaatttgtg

SEQ ID NO: 218958 - DNA, 20 bp, Artificial Sequence
  chemically synthesized
cgcctctgcacaaattagaa

SEQ ID NO: 218959 - DNA, 20 bp, Artificial Sequence
  chemically synthesized
gcacaaattagaatggatct

SEQ ID NO: 218960 - DNA, 20 bp, Artificial Sequence
  chemically synthesized
cgtgaaattaggggagagct

SEQ ID NO: 218961 - DNA, 20 bp, Artificial Sequence
  chemically synthesized
tacctcgtgaaattagggga

SEQ ID NO: 218962 - DNA, 20 bp, Artificial Sequence
  chemically synthesized
aatacctcgtgaaattaggg

SEQ ID NO: 218963 - DNA, 20 bp, Artificial Sequence
  chemically synthesized
tcaatacctcgtgaaattag

SEQ ID NO: 218964 - DNA, 20 bp, Artificial Sequence
  chemically synthesized
ttcaatacctcgtgaaatta

SEQ ID NO: 218965 - DNA, 20 bp, Artificial Sequence
  chemically synthesized
attcaatacctcgtgaaatt

SEQ ID NO: 218966 - DNA, 20 bp, Artificial Sequence
  chemically synthesized
cagctctcccctaatttcac

SEQ ID NO: 218967 - DNA, 20 bp, Artificial Sequence
  chemically synthesized
tattcaatacctcgtgaaat

SEQ ID NO: 218968 - DNA, 20 bp, Artificial Sequence
  chemically synthesized
agctctcccctaatttcacg

SEQ ID NO: 218969 - DNA, 20 bp, Artificial Sequence
  chemically synthesized
ggatattaaagaggtaaaaa

SEQ ID NO: 218970 - DNA, 20 bp, Artificial Sequence
  chemically synthesized
aacacagctggatattaaag

SEQ ID NO: 218971 - DNA, 20 bp, Artificial Sequence
  chemically synthesized
aaacacagctggatattaaa

SEQ ID NO: 218972 - DNA, 20 bp, Artificial Sequence
  chemically synthesized
gtttttacctctttaatatc

SEQ ID NO: 218973 - DNA, 20 bp, Artificial Sequence
  chemically synthesized
ataaacacagctggatatta

SEQ ID NO: 218974 - DNA, 20 bp, Artificial Sequence
  chemically synthesized
ttgtcagagataaacacagc

SEQ ID NO: 218975 - DNA, 20 bp, Artificial Sequence
  chemically synthesized
tatattgtcagagataaaca

SEQ ID NO: 218976 - DNA, 20 bp, Artificial Sequence
  chemically synthesized
tgagagcatatatattgtca

SEQ ID NO: 218977 - DNA, 20 bp, Artificial Sequence
  chemically synthesized
tttgagagcatatatattgt

SEQ ID NO: 218978 - DNA, 20 bp, Artificial Sequence
  chemically synthesized
gacaatatatatgctctcaa

SEQ ID NO: 218979 - DNA, 20 bp, Artificial Sequence
  chemically synthesized
atttatcggaatgcttttga

SEQ ID NO: 218980 - DNA, 20 bp, Artificial Sequence
  chemically synthesized
ttatttatcggaatgctttt

SEQ ID NO: 218981 - DNA, 20 bp, Artificial Sequence
  chemically synthesized
attgaggaaaatttatttat

SEQ ID NO: 218982 - DNA, 20 bp, Artificial Sequence
  chemically synthesized
tttattatgcttgatcattg

SEQ ID NO: 218983 - DNA, 20 bp, Artificial Sequence
  chemically synthesized
ataaattttcctcaatgatc

SEQ ID NO: 218984 - DNA, 20 bp, Artificial Sequence
  chemically synthesized
ttttattatgcttgatcatt

SEQ ID NO: 218985 - DNA, 20 bp, Artificial Sequence
  chemically synthesized
tcaagcataataaaatacat

SEQ ID NO: 218986 - DNA, 20 bp, Artificial Sequence
  chemically synthesized
agtatttaggtgatttaaca

SEQ ID NO: 218987 - DNA, 20 bp, Artificial Sequence
  chemically synthesized
gtagagttgtttgagtattt

SEQ ID NO: 218988 - DNA, 20 bp, Artificial Sequence
  chemically synthesized
ggtagagttgtttgagtatt

SEQ ID NO: 218989 - DNA, 20 bp, Artificial Sequence
  chemically synthesized
tactaatggtagagttgttt

SEQ ID NO: 218990 - DNA, 20 bp, Artificial Sequence
  chemically synthesized
tactcaaacaactctaccat

SEQ ID NO: 218991 - DNA, 20 bp, Artificial Sequence
  chemically synthesized
tacctcacatactaatggta

SEQ ID NO: 218992 - DNA, 20 bp, Artificial Sequence
  chemically synthesized
gctacctcacatactaatgg

SEQ ID NO: 218993 - DNA, 20 bp, Artificial Sequence
  chemically synthesized
aaagctacctcacatactaa

SEQ ID NO: 218994 - DNA, 20 bp, Artificial Sequence
  chemically synthesized
caactctaccattagtatgt

SEQ ID NO: 218995 - DNA, 20 bp, Artificial Sequence
  chemically synthesized
aactctaccattagtatgtg

SEQ ID NO: 218996 - DNA, 20 bp, Artificial Sequence
  chemically synthesized
tctaccattagtatgtgagg

SEQ ID NO: 218997 - DNA, 20 bp, Artificial Sequence
  chemically synthesized
agtatgtgaggtagctttga

SEQ ID NO: 218998 - DNA, 20 bp, Artificial Sequence
  chemically synthesized
aaaaattagaaatactttca

SEQ ID NO: 218999 - DNA, 20 bp, Artificial Sequence
  chemically synthesized
tattaaagagaaagaaaaat

SEQ ID NO: 219000 - DNA, 20 bp, Artificial Sequence
  chemically synthesized
cctgtggcatattaaagaga

SEQ ID NO: 219001 - DNA, 20 bp, Artificial Sequence
  chemically synthesized
ccttcctgtggcatattaaa

SEQ ID NO: 219002 - DNA, 20 bp, Artificial Sequence
  chemically synthesized
tcccttcctgtggcatatta

SEQ ID NO: 219003 - DNA, 20 bp, Artificial Sequence
  chemically synthesized
tctttctctttaatatgcca

SEQ ID NO: 219004 - DNA, 20 bp, Artificial Sequence
  chemically synthesized
ctttctctttaatatgccac

SEQ ID NO: 219005 - DNA, 20 bp, Artificial Sequence
  chemically synthesized
tctctttaatatgccacagg

SEQ ID NO: 219006 - DNA, 20 bp, Artificial Sequence
  chemically synthesized
ctctttaatatgccacagga

SEQ ID NO: 219007 - DNA, 20 bp, Artificial Sequence
  chemically synthesized
tctttaatatgccacaggaa

SEQ ID NO: 219008 - DNA, 20 bp, Artificial Sequence
  chemically synthesized
aaatgcctcgtcccttcctg

SEQ ID NO: 219009 - DNA, 20 bp, Artificial Sequence
  chemically synthesized
aatatgccacaggaagggac

SEQ ID NO: 219010 - DNA, 20 bp, Artificial Sequence
  chemically synthesized
atatgccacaggaagggacg

SEQ ID NO: 219011 - DNA, 20 bp, Artificial Sequence
  chemically synthesized
ctatgatagcatataattga

SEQ ID NO: 219012 - DNA, 20 bp, Artificial Sequence
  chemically synthesized
actatgatagcatataattg

SEQ ID NO: 219013 - DNA, 20 bp, Artificial Sequence
  chemically synthesized
ccttcaattatatgctatca

SEQ ID NO: 219014 - DNA, 20 bp, Artificial Sequence
  chemically synthesized
caattatatgctatcatagt

SEQ ID NO: 219015 - DNA, 20 bp, Artificial Sequence
  chemically synthesized
caatcatcttcttactatga

SEQ ID NO: 219016 - DNA, 20 bp, Artificial Sequence
  chemically synthesized
ttatatgctatcatagtaag

SEQ ID NO: 219017 - DNA, 20 bp, Artificial Sequence
  chemically synthesized
tatcatagtaagaagatgat

SEQ ID NO: 219018 - DNA, 20 bp, Artificial Sequence
  chemically synthesized
aatacatgtctttgcattta

SEQ ID NO: 219019 - DNA, 20 bp, Artificial Sequence
  chemically synthesized
atgattggaccataaatgca

SEQ ID NO: 219020 - DNA, 20 bp, Artificial Sequence
  chemically synthesized
tatttgcaattgcattgctc

SEQ ID NO: 219021 - DNA, 20 bp, Artificial Sequence
  chemically synthesized
tggacataactggcattctt

SEQ ID NO: 219022 - DNA, 20 bp, Artificial Sequence
  chemically synthesized
attgcattgctcaagaatgc

SEQ ID NO: 219023 - DNA, 20 bp, Artificial Sequence
  chemically synthesized
ggatggataatggacataac

SEQ ID NO: 219024 - DNA, 20 bp, Artificial Sequence
  chemically synthesized
ttcattgaagggatggataa

SEQ ID NO: 219025 - DNA, 20 bp, Artificial Sequence
  chemically synthesized
tctttgtttcattgaaggga

SEQ ID NO: 219026 - DNA, 20 bp, Artificial Sequence
  chemically synthesized
atggtctttgtttcattgaa

SEQ ID NO: 219027 - DNA, 20 bp, Artificial Sequence
  chemically synthesized
gatggtctttgtttcattga

SEQ ID NO: 219028 - DNA, 20 bp, Artificial Sequence
  chemically synthesized
ggatggtctttgtttcattg

SEQ ID NO: 219029 - DNA, 20 bp, Artificial Sequence
  chemically synthesized
tccatcccttcaatgaaaca

SEQ ID NO: 219030 - DNA, 20 bp, Artificial Sequence
  chemically synthesized
tacctctaaaagaaaatgga

SEQ ID NO: 219031 - DNA, 20 bp, Artificial Sequence
  chemically synthesized
tgattacctctaaaagaaaa

SEQ ID NO: 219032 - DNA, 20 bp, Artificial Sequence
  chemically synthesized
aaagaccatccattttcttt

SEQ ID NO: 219033 - DNA, 20 bp, Artificial Sequence
  chemically synthesized
agaccatccattttctttta

SEQ ID NO: 219034 - DNA, 20 bp, Artificial Sequence
  chemically synthesized
gaccatccattttcttttag

SEQ ID NO: 219035 - DNA, 20 bp, Artificial Sequence
  chemically synthesized
acagtagtgattacctctaa

SEQ ID NO: 219036 - DNA, 20 bp, Artificial Sequence
  chemically synthesized
ctgtgtcttgcattggacag

SEQ ID NO: 219037 - DNA, 20 bp, Artificial Sequence
  chemically synthesized
tttctgtgtcttgcattgga

SEQ ID NO: 219038 - DNA, 20 bp, Artificial Sequence
  chemically synthesized
taatcactactgtccaatgc

SEQ ID NO: 219039 - DNA, 20 bp, Artificial Sequence
  chemically synthesized
ctattttctgtgtcttgcat

SEQ ID NO: 219040 - DNA, 20 bp, Artificial Sequence
  chemically synthesized
ctactgtccaatgcaagaca

SEQ ID NO: 219041 - DNA, 20 bp, Artificial Sequence
  chemically synthesized
ccaatgcaagacacagaaaa

SEQ ID NO: 219042 - DNA, 20 bp, Artificial Sequence
  chemically synthesized
caatgcaagacacagaaaat

SEQ ID NO: 219043 - DNA, 20 bp, Artificial Sequence
  chemically synthesized
gacacagaaaataggcaatt

SEQ ID NO: 219044 - DNA, 20 bp, Artificial Sequence
  chemically synthesized
acagaaaataggcaatttgg

SEQ ID NO: 219045 - DNA, 20 bp, Artificial Sequence
  chemically synthesized
aaataggcaatttggaagta

SEQ ID NO: 219046 - DNA, 20 bp, Artificial Sequence
  chemically synthesized
caatttggaagtatagtaac

SEQ ID NO: 219047 - DNA, 20 bp, Artificial Sequence
  chemically synthesized
ttggaagtatagtaactagt

SEQ ID NO: 219048 - DNA, 20 bp, Artificial Sequence
  chemically synthesized
gttaaaagaatattgctaac

SEQ ID NO: 219049 - DNA, 20 bp, Artificial Sequence
  chemically synthesized
atacctatatagaaagttaa

SEQ ID NO: 219050 - DNA, 20 bp, Artificial Sequence
  chemically synthesized
tattcttttaactttctata

SEQ ID NO: 219051 - DNA, 20 bp, Artificial Sequence
  chemically synthesized
attcttttaactttctatat

SEQ ID NO: 219052 - DNA, 20 bp, Artificial Sequence
  chemically synthesized
aaaaagtatacctatataga

SEQ ID NO: 219053 - DNA, 20 bp, Artificial Sequence
  chemically synthesized
atgtaaaaagtatacctata

SEQ ID NO: 219054 - DNA, 20 bp, Artificial Sequence
  chemically synthesized
gtgaaattaatgcatgtaaa

SEQ ID NO: 219055 - DNA, 20 bp, Artificial Sequence
  chemically synthesized
cattaatttcactgtaaaac

SEQ ID NO: 219056 - DNA, 20 bp, Artificial Sequence
  chemically synthesized
atataattttacttgtttta

SEQ ID NO: 219057 - DNA, 20 bp, Artificial Sequence
  chemically synthesized
agtaaaattatatgattaaa

SEQ ID NO: 219058 - DNA, 20 bp, Artificial Sequence
  chemically synthesized
tatatgattaaaaagaaaac

SEQ ID NO: 219059 - DNA, 20 bp, Artificial Sequence
  chemically synthesized
taaaaagaaaaccagcttct

SEQ ID NO: 219060 - DNA, 20 bp, Artificial Sequence
  chemically synthesized
attctcaaaatcttagaagc

SEQ ID NO: 219061 - DNA, 20 bp, Artificial Sequence
  chemically synthesized
atgcattctcaaaatcttag

SEQ ID NO: 219062 - DNA, 20 bp, Artificial Sequence
  chemically synthesized
aaaccagcttctaagatttt

SEQ ID NO: 219063 - DNA, 20 bp, Artificial Sequence
  chemically synthesized
gcaatgcattctcaaaatct

SEQ ID NO: 219064 - DNA, 20 bp, Artificial Sequence
  chemically synthesized
tgagaatgcattgcatacaa

SEQ ID NO: 219065 - DNA, 20 bp, Artificial Sequence
  chemically synthesized
tacaatggtcaatgttaatc

SEQ ID NO: 219066 - DNA, 20 bp, Artificial Sequence
  chemically synthesized
caatgttaatctagtcaaca

SEQ ID NO: 219067 - DNA, 20 bp, Artificial Sequence
  chemically synthesized
ttgaacagttctttgttgac

SEQ ID NO: 219068 - DNA, 20 bp, Artificial Sequence
  chemically synthesized
aacaaacatgttttattgaa

SEQ ID NO: 219069 - DNA, 20 bp, Artificial Sequence
  chemically synthesized
aacatgtttgtttacaaaat

SEQ ID NO: 219070 - DNA, 20 bp, Artificial Sequence
  chemically synthesized
atgtttgtttacaaaatcag

SEQ ID NO: 219071 - DNA, 20 bp, Artificial Sequence
  chemically synthesized
tttgtttacaaaatcagtgg

SEQ ID NO: 219072 - DNA, 20 bp, Artificial Sequence
  chemically synthesized
aaatcagtggaagacttcct

SEQ ID NO: 219073 - DNA, 20 bp, Artificial Sequence
  chemically synthesized
tacataaaatatttctgagg

SEQ ID NO: 219074 - DNA, 20 bp, Artificial Sequence
  chemically synthesized
tgttacataaaatatttctg

SEQ ID NO: 219075 - DNA, 20 bp, Artificial Sequence
  chemically synthesized
ttgttacataaaatatttct

SEQ ID NO: 219076 - DNA, 20 bp, Artificial Sequence
  chemically synthesized
tattttatgtaacaaatgcc

SEQ ID NO: 219077 - DNA, 20 bp, Artificial Sequence
  chemically synthesized
attttatgtaacaaatgcct

SEQ ID NO: 219078 - DNA, 20 bp, Artificial Sequence
  chemically synthesized
ttttatgtaacaaatgccta

SEQ ID NO: 219079 - DNA, 20 bp, Artificial Sequence
  chemically synthesized
tatgtaacaaatgcctaggg

SEQ ID NO: 219080 - DNA, 20 bp, Artificial Sequence
  chemically synthesized
atgtaacaaatgcctagggt

SEQ ID NO: 219081 - DNA, 20 bp, Artificial Sequence
  chemically synthesized
ttttctcttcagcccaccct

SEQ ID NO: 219082 - DNA, 20 bp, Artificial Sequence
  chemically synthesized
tttttctcttcagcccaccc

SEQ ID NO: 219083 - DNA, 20 bp, Artificial Sequence
  chemically synthesized
caaatgcctagggtgggctg

SEQ ID NO: 219084 - DNA, 20 bp, Artificial Sequence
  chemically synthesized
aatgcctagggtgggctgaa

SEQ ID NO: 219085 - DNA, 20 bp, Artificial Sequence
  chemically synthesized
ttttactggatttttctctt

SEQ ID NO: 219086 - DNA, 20 bp, Artificial Sequence
  chemically synthesized
gtgggctgaagagaaaaatc

SEQ ID NO: 219087 - DNA, 20 bp, Artificial Sequence
  chemically synthesized
aagagaaaaatccagtaaaa

SEQ ID NO: 219088 - DNA, 20 bp, Artificial Sequence
  chemically synthesized
attttgaaatgccattttac

SEQ ID NO: 219089 - DNA, 20 bp, Artificial Sequence
  chemically synthesized
tttaaattagaggcatgtaa

SEQ ID NO: 219090 - DNA, 20 bp, Artificial Sequence
  chemically synthesized
ttttaaattagaggcatgta

SEQ ID NO: 219091 - DNA, 20 bp, Artificial Sequence
  chemically synthesized
agatatttattttaaattag

SEQ ID NO: 219092 - DNA, 20 bp, Artificial Sequence
  chemically synthesized
cagatatttattttaaatta

SEQ ID NO: 219093 - DNA, 20 bp, Artificial Sequence
  chemically synthesized
atcagatatttattttaaat

SEQ ID NO: 219094 - DNA, 20 bp, Artificial Sequence
  chemically synthesized
actaaatctatgaaaaatat

SEQ ID NO: 219095 - DNA, 20 bp, Artificial Sequence
  chemically synthesized
taaatatctgatatttttca

SEQ ID NO: 219096 - DNA, 20 bp, Artificial Sequence
  chemically synthesized
tctgatatttttcatagatt

SEQ ID NO: 219097 - DNA, 20 bp, Artificial Sequence
  chemically synthesized
tttttcatagatttagtttg

SEQ ID NO: 219098 - DNA, 20 bp, Artificial Sequence
  chemically synthesized
aaattatagttcaaatcatt

SEQ ID NO: 219099 - DNA, 20 bp, Artificial Sequence
  chemically synthesized
taaattatagttcaaatcat

SEQ ID NO: 219100 - DNA, 20 bp, Artificial Sequence
  chemically synthesized
gaatataattttttaaatta

SEQ ID NO: 219101 - DNA, 20 bp, Artificial Sequence
  chemically synthesized
ttaaaaaattatattccaaa

SEQ ID NO: 219102 - DNA, 20 bp, Artificial Sequence
  chemically synthesized
aaaattatattccaaatagc

SEQ ID NO: 219103 - DNA, 20 bp, Artificial Sequence
  chemically synthesized
caatcgattggcttgctatt

SEQ ID NO: 219104 - DNA, 20 bp, Artificial Sequence
  chemically synthesized
gattgtaaatgtcaatcgat

SEQ ID NO: 219105 - DNA, 20 bp, Artificial Sequence
  chemically synthesized
tggtactttgcatttatcag

SEQ ID NO: 219106 - DNA, 20 bp, Artificial Sequence
  chemically synthesized
aattggtactttgcatttat

SEQ ID NO: 219107 - DNA, 20 bp, Artificial Sequence
  chemically synthesized
acaatcttctgataaatgca

SEQ ID NO: 219108 - DNA, 20 bp, Artificial Sequence
  chemically synthesized
aaacgctatgtttagggaat

SEQ ID NO: 219109 - DNA, 20 bp, Artificial Sequence
  chemically synthesized
aagtaccaattccctaaaca

SEQ ID NO: 219110 - DNA, 20 bp, Artificial Sequence
  chemically synthesized
accataaaacgctatgttta

SEQ ID NO: 219111 - DNA, 20 bp, Artificial Sequence
  chemically synthesized
caccataaaacgctatgttt

SEQ ID NO: 219112 - DNA, 20 bp, Artificial Sequence
  chemically synthesized
tcaccataaaacgctatgtt

SEQ ID NO: 219113 - DNA, 20 bp, Artificial Sequence
  chemically synthesized
tccctaaacatagcgtttta

SEQ ID NO: 219114 - DNA, 20 bp, Artificial Sequence
  chemically synthesized
atgatgtagttattttgaaa

SEQ ID NO: 219115 - DNA, 20 bp, Artificial Sequence
  chemically synthesized
ctcaatagttttgaatgatg

SEQ ID NO: 219116 - DNA, 20 bp, Artificial Sequence
  chemically synthesized
ctacatcattcaaaactatt

SEQ ID NO: 219117 - DNA, 20 bp, Artificial Sequence
  chemically synthesized
aggttttacaggcaactcaa

SEQ ID NO: 219118 - DNA, 20 bp, Artificial Sequence
  chemically synthesized
tcaagcaatttaggttttac

SEQ ID NO: 219119 - DNA, 20 bp, Artificial Sequence
  chemically synthesized
ttcaagcaatttaggtttta

SEQ ID NO: 219120 - DNA, 20 bp, Artificial Sequence
  chemically synthesized
aactaatgttcaagcaattt

SEQ ID NO: 219121 - DNA, 20 bp, Artificial Sequence
  chemically synthesized
gaactaatgttcaagcaatt

SEQ ID NO: 219122 - DNA, 20 bp, Artificial Sequence
  chemically synthesized
aacctaaattgcttgaacat

SEQ ID NO: 219123 - DNA, 20 bp, Artificial Sequence
  chemically synthesized
tttctccagaactaatgttc

SEQ ID NO: 219124 - DNA, 20 bp, Artificial Sequence
  chemically synthesized
aattgcttgaacattagttc

SEQ ID NO: 219125 - DNA, 20 bp, Artificial Sequence
  chemically synthesized
ttgcttgaacattagttctg

SEQ ID NO: 219126 - DNA, 20 bp, Artificial Sequence
  chemically synthesized
aggcatcatgaaaatttctc

SEQ ID NO: 219127 - DNA, 20 bp, Artificial Sequence
  chemically synthesized
atttgacactgagagtttaa

SEQ ID NO: 219128 - DNA, 20 bp, Artificial Sequence
  chemically synthesized
aatttgacactgagagttta

SEQ ID NO: 219129 - DNA, 20 bp, Artificial Sequence
  chemically synthesized
tcatgatgcctttaaactct

SEQ ID NO: 219130 - DNA, 20 bp, Artificial Sequence
  chemically synthesized
aatgttgaatttgacactga

SEQ ID NO: 219131 - DNA, 20 bp, Artificial Sequence
  chemically synthesized
taaatgttgaatttgacact

SEQ ID NO: 219132 - DNA, 20 bp, Artificial Sequence
  chemically synthesized
tcagtgtcaaattcaacatt

SEQ ID NO: 219133 - DNA, 20 bp, Artificial Sequence
  chemically synthesized
cagtgtcaaattcaacattt

SEQ ID NO: 219134 - DNA, 20 bp, Artificial Sequence
  chemically synthesized
aattcaacatttaggcttta

SEQ ID NO: 219135 - DNA, 20 bp, Artificial Sequence
  chemically synthesized
aataccacccataggcttta

SEQ ID NO: 219136 - DNA, 20 bp, Artificial Sequence
  chemically synthesized
catttaggctttaaagccta

SEQ ID NO: 219137 - DNA, 20 bp, Artificial Sequence
  chemically synthesized
atttaggctttaaagcctat

SEQ ID NO: 219138 - DNA, 20 bp, Artificial Sequence
  chemically synthesized
taggctttaaagcctatggg

SEQ ID NO: 219139 - DNA, 20 bp, Artificial Sequence
  chemically synthesized
tggtgataaataccacccat

SEQ ID NO: 219140 - DNA, 20 bp, Artificial Sequence
  chemically synthesized
atggtgataaataccaccca

SEQ ID NO: 219141 - DNA, 20 bp, Artificial Sequence
  chemically synthesized
tgataaatgcgagtgttgaa

SEQ ID NO: 219142 - DNA, 20 bp, Artificial Sequence
  chemically synthesized
tttccttatgtgataaatgc

SEQ ID NO: 219143 - DNA, 20 bp, Artificial Sequence
  chemically synthesized
aacactcgcatttatcacat

SEQ ID NO: 219144 - DNA, 20 bp, Artificial Sequence
  chemically synthesized
acactcgcatttatcacata

SEQ ID NO: 219145 - DNA, 20 bp, Artificial Sequence
  chemically synthesized
cacataaggaaaatatgttt

SEQ ID NO: 219146 - DNA, 20 bp, Artificial Sequence
  chemically synthesized
taaggaaaatatgtttaaga

SEQ ID NO: 219147 - DNA, 20 bp, Artificial Sequence
  chemically synthesized
ttaagaaagcaaaactgaaa

SEQ ID NO: 219148 - DNA, 20 bp, Artificial Sequence
  chemically synthesized
taagaaagcaaaactgaaat

SEQ ID NO: 219149 - DNA, 20 bp, Artificial Sequence
  chemically synthesized
taaaccctgagttcctattt

SEQ ID NO: 219150 - DNA, 20 bp, Artificial Sequence
  chemically synthesized
gcaaaactgaaataggaact

SEQ ID NO: 219151 - DNA, 20 bp, Artificial Sequence
  chemically synthesized
caaaactgaaataggaactc

SEQ ID NO: 219152 - DNA, 20 bp, Artificial Sequence
  chemically synthesized
aaaactgaaataggaactca

SEQ ID NO: 219153 - DNA, 20 bp, Artificial Sequence
  chemically synthesized
gtagaagtgttttaaaccct

SEQ ID NO: 219154 - DNA, 20 bp, Artificial Sequence
  chemically synthesized
acgacacaggttataagtag

SEQ ID NO: 219155 - DNA, 20 bp, Artificial Sequence
  chemically synthesized
ggaacgacacaggttataag

SEQ ID NO: 219156 - DNA, 20 bp, Artificial Sequence
  chemically synthesized
agaggaacgacacaggttat

SEQ ID NO: 219157 - DNA, 20 bp, Artificial Sequence
  chemically synthesized
tacacaaagaggaacgacac

SEQ ID NO: 219158 - DNA, 20 bp, Artificial Sequence
  chemically synthesized
ttacacaaagaggaacgaca

SEQ ID NO: 219159 - DNA, 20 bp, Artificial Sequence
  chemically synthesized
gtcatagactttacacaaag

SEQ ID NO: 219160 - DNA, 20 bp, Artificial Sequence
  chemically synthesized
ggtcatagactttacacaaa

SEQ ID NO: 219161 - DNA, 20 bp, Artificial Sequence
  chemically synthesized
gtgtcgttcctctttgtgta

SEQ ID NO: 219162 - DNA, 20 bp, Artificial Sequence
  chemically synthesized
caggtcatagactttacaca

SEQ ID NO: 219163 - DNA, 20 bp, Artificial Sequence
  chemically synthesized
tctttccaaacagcaggtca

SEQ ID NO: 219164 - DNA, 20 bp, Artificial Sequence
  chemically synthesized
aaagtctatgacctgctgtt

SEQ ID NO: 219165 - DNA, 20 bp, Artificial Sequence
  chemically synthesized
ctggtgtctttccaaacagc

SEQ ID NO: 219166 - DNA, 20 bp, Artificial Sequence
  chemically synthesized
tctggtgtctttccaaacag

SEQ ID NO: 219167 - DNA, 20 bp, Artificial Sequence
  chemically synthesized
tctatgacctgctgtttgga

SEQ ID NO: 219168 - DNA, 20 bp, Artificial Sequence
  chemically synthesized
atatctggtgtctttccaaa

SEQ ID NO: 219169 - DNA, 20 bp, Artificial Sequence
  chemically synthesized
cctgctgtttggaaagacac

SEQ ID NO: 219170 - DNA, 20 bp, Artificial Sequence
  chemically synthesized
gtttggaaagacaccagata

SEQ ID NO: 219171 - DNA, 20 bp, Artificial Sequence
  chemically synthesized
ttggaaagacaccagatatg

SEQ ID NO: 219172 - DNA, 20 bp, Artificial Sequence
  chemically synthesized
ttcaaaatcttctccatatc

SEQ ID NO: 219173 - DNA, 20 bp, Artificial Sequence
  chemically synthesized
gaaagacaccagatatggag

SEQ ID NO: 219174 - DNA, 20 bp, Artificial Sequence
  chemically synthesized
atgctttgttataaagattt

SEQ ID NO: 219175 - DNA, 20 bp, Artificial Sequence
  chemically synthesized
gatgctttgttataaagatt

SEQ ID NO: 219176 - DNA, 20 bp, Artificial Sequence
  chemically synthesized
atgcccaaatctttataaca

SEQ ID NO: 219177 - DNA, 20 bp, Artificial Sequence
  chemically synthesized
ctgttcgatgctttgttata

SEQ ID NO: 219178 - DNA, 20 bp, Artificial Sequence
  chemically synthesized
ctttataacaaagcatcgaa

SEQ ID NO: 219179 - DNA, 20 bp, Artificial Sequence
  chemically synthesized
ttataacaaagcatcgaaca

SEQ ID NO: 219180 - DNA, 20 bp, Artificial Sequence
  chemically synthesized
tataacaaagcatcgaacag

SEQ ID NO: 219181 - DNA, 20 bp, Artificial Sequence
  chemically synthesized
gcatcgaacagaggatctga

SEQ ID NO: 219182 - DNA, 20 bp, Artificial Sequence
  chemically synthesized
cgaacagaggatctgaaaga

SEQ ID NO: 219183 - DNA, 20 bp, Artificial Sequence
  chemically synthesized
aacagaggatctgaaagaaa

SEQ ID NO: 219184 - DNA, 20 bp, Artificial Sequence
  chemically synthesized
ttctgttgtgctctttcttt

SEQ ID NO: 219185 - DNA, 20 bp, Artificial Sequence
  chemically synthesized
atctgaaagaaagagcacaa

SEQ ID NO: 219186 - DNA, 20 bp, Artificial Sequence
  chemically synthesized
gataagctagatatttcatt

SEQ ID NO: 219187 - DNA, 20 bp, Artificial Sequence
  chemically synthesized
cagaaactcaatgaaatatc

SEQ ID NO: 219188 - DNA, 20 bp, Artificial Sequence
  chemically synthesized
caatgaaatatctagcttat

SEQ ID NO: 219189 - DNA, 20 bp, Artificial Sequence
  chemically synthesized
taattgtcagactgataagc

SEQ ID NO: 219190 - DNA, 20 bp, Artificial Sequence
  chemically synthesized
tgattaattgtcagactgat

SEQ ID NO: 219191 - DNA, 20 bp, Artificial Sequence
  chemically synthesized
ccttagatatgattaattgt

SEQ ID NO: 219192 - DNA, 20 bp, Artificial Sequence
  chemically synthesized
tctgacaattaatcatatct

SEQ ID NO: 219193 - DNA, 20 bp, Artificial Sequence
  chemically synthesized
ctgacaattaatcatatcta

SEQ ID NO: 219194 - DNA, 20 bp, Artificial Sequence
  chemically synthesized
tgagattagaggtggggcct

SEQ ID NO: 219195 - DNA, 20 bp, Artificial Sequence
  chemically synthesized
aggtactgagattagaggtg

SEQ ID NO: 219196 - DNA, 20 bp, Artificial Sequence
  chemically synthesized
aaggtactgagattagaggt

SEQ ID NO: 219197 - DNA, 20 bp, Artificial Sequence
  chemically synthesized
taaggtactgagattagagg

SEQ ID NO: 219198 - DNA, 20 bp, Artificial Sequence
  chemically synthesized
taaggccccacctctaatct

SEQ ID NO: 219199 - DNA, 20 bp, Artificial Sequence
  chemically synthesized
ggctaaggtactgagattag

SEQ ID NO: 219200 - DNA, 20 bp, Artificial Sequence
  chemically synthesized
tggctaaggtactgagatta

SEQ ID NO: 219201 - DNA, 20 bp, Artificial Sequence
  chemically synthesized
tttggctaaggtactgagat

SEQ ID NO: 219202 - DNA, 20 bp, Artificial Sequence
  chemically synthesized
cacctctaatctcagtacct

SEQ ID NO: 219203 - DNA, 20 bp, Artificial Sequence
  chemically synthesized
taatttttggctaaggtact

SEQ ID NO: 219204 - DNA, 20 bp, Artificial Sequence
  chemically synthesized
tggtatttaatttttggcta

SEQ ID NO: 219205 - DNA, 20 bp, Artificial Sequence
  chemically synthesized
ttggtatttaatttttggct

SEQ ID NO: 219206 - DNA, 20 bp, Artificial Sequence
  chemically synthesized
tgtccttggtatttaatttt

SEQ ID NO: 219207 - DNA, 20 bp, Artificial Sequence
  chemically synthesized
ttagccaaaaattaaatacc

SEQ ID NO: 219208 - DNA, 20 bp, Artificial Sequence
  chemically synthesized
tagccaaaaattaaatacca

SEQ ID NO: 219209 - DNA, 20 bp, Artificial Sequence
  chemically synthesized
caaaaattaaataccaagga

SEQ ID NO: 219210 - DNA, 20 bp, Artificial Sequence
  chemically synthesized
gagcaaactgtaactgtcct

SEQ ID NO: 219211 - DNA, 20 bp, Artificial Sequence
  chemically synthesized
ttaaataccaaggacagtta

SEQ ID NO: 219212 - DNA, 20 bp, Artificial Sequence
  chemically synthesized
aggacagttacagtttgctc

SEQ ID NO: 219213 - DNA, 20 bp, Artificial Sequence
  chemically synthesized
ctctttcctctaggtatcta

SEQ ID NO: 219214 - DNA, 20 bp, Artificial Sequence
  chemically synthesized
tacagtttgctctagatacc

SEQ ID NO: 219215 - DNA, 20 bp, Artificial Sequence
  chemically synthesized
ttctctttcctctaggtatc

SEQ ID NO: 219216 - DNA, 20 bp, Artificial Sequence
  chemically synthesized
cagtttgctctagataccta

SEQ ID NO: 219217 - DNA, 20 bp, Artificial Sequence
  chemically synthesized
agtttgctctagatacctag

SEQ ID NO: 219218 - DNA, 20 bp, Artificial Sequence
  chemically synthesized
tgctctagatacctagagga

SEQ ID NO: 219219 - DNA, 20 bp, Artificial Sequence
  chemically synthesized
aaggaggttctctttcctct

SEQ ID NO: 219220 - DNA, 20 bp, Artificial Sequence
  chemically synthesized
ctctagatacctagaggaaa

SEQ ID NO: 219221 - DNA, 20 bp, Artificial Sequence
  chemically synthesized
aaaggaggttctctttcctc

SEQ ID NO: 219222 - DNA, 20 bp, Artificial Sequence
  chemically synthesized
tggaaaagatgaggaaaagg

SEQ ID NO: 219223 - DNA, 20 bp, Artificial Sequence
  chemically synthesized
atggaaaagatgaggaaaag

SEQ ID NO: 219224 - DNA, 20 bp, Artificial Sequence
  chemically synthesized
gtatggaaaagatgaggaaa

SEQ ID NO: 219225 - DNA, 20 bp, Artificial Sequence
  chemically synthesized
agtatggaaaagatgaggaa

SEQ ID NO: 219226 - DNA, 20 bp, Artificial Sequence
  chemically synthesized
tttttagtatggaaaagatg

SEQ ID NO: 219227 - DNA, 20 bp, Artificial Sequence
  chemically synthesized
atttttagtatggaaaagat

SEQ ID NO: 219228 - DNA, 20 bp, Artificial Sequence
  chemically synthesized
tatacatttttagtatggaa

SEQ ID NO: 219229 - DNA, 20 bp, Artificial Sequence
  chemically synthesized
tacagtatacatttttagta

SEQ ID NO: 219230 - DNA, 20 bp, Artificial Sequence
  chemically synthesized
aaagatacagtatacatttt

SEQ ID NO: 219231 - DNA, 20 bp, Artificial Sequence
  chemically synthesized
aaaatgtatactgtatcttt

SEQ ID NO: 219232 - DNA, 20 bp, Artificial Sequence
  chemically synthesized
atatattaatctgaaagata

SEQ ID NO: 219233 - DNA, 20 bp, Artificial Sequence
  chemically synthesized
tagctgatatattaatctga

SEQ ID NO: 219234 - DNA, 20 bp, Artificial Sequence
  chemically synthesized
tatctttcagattaatatat

SEQ ID NO: 219235 - DNA, 20 bp, Artificial Sequence
  chemically synthesized
ttattgaagtaacaaaattt

SEQ ID NO: 219236 - DNA, 20 bp, Artificial Sequence
  chemically synthesized
gctgcaaaaatggtttattg

SEQ ID NO: 219237 - DNA, 20 bp, Artificial Sequence
  chemically synthesized
acttcaataaaccatttttg

SEQ ID NO: 219238 - DNA, 20 bp, Artificial Sequence
  chemically synthesized
caagagttatgctgcaaaaa

SEQ ID NO: 219239 - DNA, 20 bp, Artificial Sequence
  chemically synthesized
atacttttatttgcagtcaa

SEQ ID NO: 219240 - DNA, 20 bp, Artificial Sequence
  chemically synthesized
atatacttttatttgcagtc

SEQ ID NO: 219241 - DNA, 20 bp, Artificial Sequence
  chemically synthesized
taactcttgactgcaaataa

SEQ ID NO: 219242 - DNA, 20 bp, Artificial Sequence
  chemically synthesized
agtatatatacttttatttg

SEQ ID NO: 219243 - DNA, 20 bp, Artificial Sequence
  chemically synthesized
aaacaaaatttgaggattgt

SEQ ID NO: 219244 - DNA, 20 bp, Artificial Sequence
  chemically synthesized
aagctgaaaaacaaaatttg

SEQ ID NO: 219245 - DNA, 20 bp, Artificial Sequence
  chemically synthesized
aaagctgaaaaacaaaattt

SEQ ID NO: 219246 - DNA, 20 bp, Artificial Sequence
  chemically synthesized
aatcctcaaattttgttttt

SEQ ID NO: 219247 - DNA, 20 bp, Artificial Sequence
  chemically synthesized
tctagtaatctgatgaagca

SEQ ID NO: 219248 - DNA, 20 bp, Artificial Sequence
  chemically synthesized
gtttttcagctttgcttcat

SEQ ID NO: 219249 - DNA, 20 bp, Artificial Sequence
  chemically synthesized
ctcattctagtaatctgatg

SEQ ID NO: 219250 - DNA, 20 bp, Artificial Sequence
  chemically synthesized
gctttgcttcatcagattac

SEQ ID NO: 219251 - DNA, 20 bp, Artificial Sequence
  chemically synthesized
cttcatcagattactagaat

SEQ ID NO: 219252 - DNA, 20 bp, Artificial Sequence
  chemically synthesized
ttcatcagattactagaatg

SEQ ID NO: 219253 - DNA, 20 bp, Artificial Sequence
  chemically synthesized
tgcatgacactgcctcattc

SEQ ID NO: 219254 - DNA, 20 bp, Artificial Sequence
  chemically synthesized
atcagattactagaatgagg

SEQ ID NO: 219255 - DNA, 20 bp, Artificial Sequence
  chemically synthesized
ttgattcaataaaatttcca

SEQ ID NO: 219256 - DNA, 20 bp, Artificial Sequence
  chemically synthesized
gtacttttattaggtgactt

SEQ ID NO: 219257 - DNA, 20 bp, Artificial Sequence
  chemically synthesized
tttccaaagtcacctaataa

SEQ ID NO: 219258 - DNA, 20 bp, Artificial Sequence
  chemically synthesized
tcataaaatgtacttttatt

SEQ ID NO: 219259 - DNA, 20 bp, Artificial Sequence
  chemically synthesized
atcataaaatgtacttttat

SEQ ID NO: 219260 - DNA, 20 bp, Artificial Sequence
  chemically synthesized
ataaaagtacattttatgat

SEQ ID NO: 219261 - DNA, 20 bp, Artificial Sequence
  chemically synthesized
gagaaaacaacaccaaaaaa

SEQ ID NO: 219262 - DNA, 20 bp, Artificial Sequence
  chemically synthesized
aagcattggtaactattttt

SEQ ID NO: 219263 - DNA, 20 bp, Artificial Sequence
  chemically synthesized
tctcaagaggtatcaagcat

SEQ ID NO: 219264 - DNA, 20 bp, Artificial Sequence
  chemically synthesized
tccacatctcaagaggtatc

SEQ ID NO: 219265 - DNA, 20 bp, Artificial Sequence
  chemically synthesized
accaatgcttgatacctctt

SEQ ID NO: 219266 - DNA, 20 bp, Artificial Sequence
  chemically synthesized
taagaggtccacatctcaag

SEQ ID NO: 219267 - DNA, 20 bp, Artificial Sequence
  chemically synthesized
ctaagaggtccacatctcaa

SEQ ID NO: 219268 - DNA, 20 bp, Artificial Sequence
  chemically synthesized
gcttgatacctcttgagatg

SEQ ID NO: 219269 - DNA, 20 bp, Artificial Sequence
  chemically synthesized
ctctaagaggtccacatctc

SEQ ID NO: 219270 - DNA, 20 bp, Artificial Sequence
  chemically synthesized
ctcttgagatgtggacctct

SEQ ID NO: 219271 - DNA, 20 bp, Artificial Sequence
  chemically synthesized
cttgagatgtggacctctta

SEQ ID NO: 219272 - DNA, 20 bp, Artificial Sequence
  chemically synthesized
ttgagatgtggacctcttag

SEQ ID NO: 219273 - DNA, 20 bp, Artificial Sequence
  chemically synthesized
ctgtcaaattggcctctaag

SEQ ID NO: 219274 - DNA, 20 bp, Artificial Sequence
  chemically synthesized
actgtcaaattggcctctaa

SEQ ID NO: 219275 - DNA, 20 bp, Artificial Sequence
  chemically synthesized
tgactgtcaaattggcctct

SEQ ID NO: 219276 - DNA, 20 bp, Artificial Sequence
  chemically synthesized
cctcttagaggccaatttga

SEQ ID NO: 219277 - DNA, 20 bp, Artificial Sequence
  chemically synthesized
tactcttctgactgtcaaat

SEQ ID NO: 219278 - DNA, 20 bp, Artificial Sequence
  chemically synthesized
ttagaggccaatttgacagt

SEQ ID NO: 219279 - DNA, 20 bp, Artificial Sequence
  chemically synthesized
gaggccaatttgacagtcag

SEQ ID NO: 219280 - DNA, 20 bp, Artificial Sequence
  chemically synthesized
ggccaatttgacagtcagaa

SEQ ID NO: 219281 - DNA, 20 bp, Artificial Sequence
  chemically synthesized
tttgacagtcagaagagtat

SEQ ID NO: 219282 - DNA, 20 bp, Artificial Sequence
  chemically synthesized
gtatgagtaatgtttttcaa

SEQ ID NO: 219283 - DNA, 20 bp, Artificial Sequence
  chemically synthesized
atgtttttcaaaagtttcat

SEQ ID NO: 219284 - DNA, 20 bp, Artificial Sequence
  chemically synthesized
agaagctggtattacattgt

SEQ ID NO: 219285 - DNA, 20 bp, Artificial Sequence
  chemically synthesized
gagaagctggtattacattg

SEQ ID NO: 219286 - DNA, 20 bp, Artificial Sequence
  chemically synthesized
aaaatcctacaatgtaatac

SEQ ID NO: 219287 - DNA, 20 bp, Artificial Sequence
  chemically synthesized
ctttaagtaggaagagaagc

SEQ ID NO: 219288 - DNA, 20 bp, Artificial Sequence
  chemically synthesized
tctcctttaagtaggaagag

SEQ ID NO: 219289 - DNA, 20 bp, Artificial Sequence
  chemically synthesized
tgatctcctttaagtaggaa

SEQ ID NO: 219290 - DNA, 20 bp, Artificial Sequence
  chemically synthesized
tatgatctcctttaagtagg

SEQ ID NO: 219291 - DNA, 20 bp, Artificial Sequence
  chemically synthesized
ccagcttctcttcctactta

SEQ ID NO: 219292 - DNA, 20 bp, Artificial Sequence
  chemically synthesized
cagcttctcttcctacttaa

SEQ ID NO: 219293 - DNA, 20 bp, Artificial Sequence
  chemically synthesized
cgttatgatctcctttaagt

SEQ ID NO: 219294 - DNA, 20 bp, Artificial Sequence
  chemically synthesized
gcttctcttcctacttaaag

SEQ ID NO: 219295 - DNA, 20 bp, Artificial Sequence
  chemically synthesized
tcgttatgatctcctttaag

SEQ ID NO: 219296 - DNA, 20 bp, Artificial Sequence
  chemically synthesized
caatcgttatgatctccttt

SEQ ID NO: 219297 - DNA, 20 bp, Artificial Sequence
  chemically synthesized
ggagatcataacgattgaat

SEQ ID NO: 219298 - DNA, 20 bp, Artificial Sequence
  chemically synthesized
gagatcataacgattgaatc

SEQ ID NO: 219299 - DNA, 20 bp, Artificial Sequence
  chemically synthesized
aatcaggattacattcaaat

SEQ ID NO: 219300 - DNA, 20 bp, Artificial Sequence
  chemically synthesized
tttcatttcacatttgtcat

SEQ ID NO: 219301 - DNA, 20 bp, Artificial Sequence
  chemically synthesized
caatgacaaatgtgaaatga

SEQ ID NO: 219302 - DNA, 20 bp, Artificial Sequence
  chemically synthesized
atgacaaatgtgaaatgaaa

SEQ ID NO: 219303 - DNA, 20 bp, Artificial Sequence
  chemically synthesized
aggatgcaatgattattggt

SEQ ID NO: 219304 - DNA, 20 bp, Artificial Sequence
  chemically synthesized
ttttaggatgcaatgattat

SEQ ID NO: 219305 - DNA, 20 bp, Artificial Sequence
  chemically synthesized
caataatcattgcatcctaa

SEQ ID NO: 219306 - DNA, 20 bp, Artificial Sequence
  chemically synthesized
gcagtttttctttggctttt

SEQ ID NO: 219307 - DNA, 20 bp, Artificial Sequence
  chemically synthesized
tcattgcatcctaaaagcca

SEQ ID NO: 219308 - DNA, 20 bp, Artificial Sequence
  chemically synthesized
agcagtttttctttggcttt

SEQ ID NO: 219309 - DNA, 20 bp, Artificial Sequence
  chemically synthesized
cccttatagcagtttttctt

SEQ ID NO: 219310 - DNA, 20 bp, Artificial Sequence
  chemically synthesized
agccaaagaaaaactgctat

SEQ ID NO: 219311 - DNA, 20 bp, Artificial Sequence
  chemically synthesized
gccaaagaaaaactgctata

SEQ ID NO: 219312 - DNA, 20 bp, Artificial Sequence
  chemically synthesized
ccaaagaaaaactgctataa

SEQ ID NO: 219313 - DNA, 20 bp, Artificial Sequence
  chemically synthesized
gattgagaagtcccttatag

SEQ ID NO: 219314 - DNA, 20 bp, Artificial Sequence
  chemically synthesized
actgattgagaagtccctta

SEQ ID NO: 219315 - DNA, 20 bp, Artificial Sequence
  chemically synthesized
gctataagggacttctcaat

SEQ ID NO: 219316 - DNA, 20 bp, Artificial Sequence
  chemically synthesized
atctatagggactgattgag

SEQ ID NO: 219317 - DNA, 20 bp, Artificial Sequence
  chemically synthesized
cctatctatagggactgatt

SEQ ID NO: 219318 - DNA, 20 bp, Artificial Sequence
  chemically synthesized
gacttctcaatcagtcccta

SEQ ID NO: 219319 - DNA, 20 bp, Artificial Sequence
  chemically synthesized
tctcaatcagtccctataga

SEQ ID NO: 219320 - DNA, 20 bp, Artificial Sequence
  chemically synthesized
ctcaatcagtccctatagat

SEQ ID NO: 219321 - DNA, 20 bp, Artificial Sequence
  chemically synthesized
actaccaattcctatctata

SEQ ID NO: 219322 - DNA, 20 bp, Artificial Sequence
  chemically synthesized
aactaccaattcctatctat

SEQ ID NO: 219323 - DNA, 20 bp, Artificial Sequence
  chemically synthesized
gaactaccaattcctatcta

SEQ ID NO: 219324 - DNA, 20 bp, Artificial Sequence
  chemically synthesized
cagtccctatagataggaat

SEQ ID NO: 219325 - DNA, 20 bp, Artificial Sequence
  chemically synthesized
tccctatagataggaattgg

SEQ ID NO: 219326 - DNA, 20 bp, Artificial Sequence
  chemically synthesized
ataggaattggtagttccta

SEQ ID NO: 219327 - DNA, 20 bp, Artificial Sequence
  chemically synthesized
tgtatatatattttttctgt

SEQ ID NO: 219328 - DNA, 20 bp, Artificial Sequence
  chemically synthesized
atgtatatatattttttctg

SEQ ID NO: 219329 - DNA, 20 bp, Artificial Sequence
  chemically synthesized
tctccatatctatatatata

SEQ ID NO: 219330 - DNA, 20 bp, Artificial Sequence
  chemically synthesized
tatatacatctatatatata

SEQ ID NO: 219331 - DNA, 20 bp, Artificial Sequence
  chemically synthesized
catctatatatatatagata

SEQ ID NO: 219332 - DNA, 20 bp, Artificial Sequence
  chemically synthesized
tctatatatatatagatatg

SEQ ID NO: 219333 - DNA, 20 bp, Artificial Sequence
  chemically synthesized
tatatatatatagatatgga

SEQ ID NO: 219334 - DNA, 20 bp, Artificial Sequence
  chemically synthesized
tatatatatagatatggaga

SEQ ID NO: 219335 - DNA, 20 bp, Artificial Sequence
  chemically synthesized
tatatatagatatggagaga

SEQ ID NO: 219336 - DNA, 20 bp, Artificial Sequence
  chemically synthesized
tatatagatatggagagaga

SEQ ID NO: 219337 - DNA, 20 bp, Artificial Sequence
  chemically synthesized
tatagatatggagagagaga

SEQ ID NO: 219338 - DNA, 20 bp, Artificial Sequence
  chemically synthesized
tagatatggagagagagaga

SEQ ID NO: 219339 - DNA, 20 bp, Artificial Sequence
  chemically synthesized
gatatggagagagagagaga

SEQ ID NO: 219340 - DNA, 20 bp, Artificial Sequence
  chemically synthesized
atatggagagagagagagag

SEQ ID NO: 219341 - DNA, 20 bp, Artificial Sequence
  chemically synthesized
tatggagagagagagagaga

SEQ ID NO: 219342 - DNA, 20 bp, Artificial Sequence
  chemically synthesized
tggagagagagagagagagg

SEQ ID NO: 219343 - DNA, 20 bp, Artificial Sequence
  chemically synthesized
ggagagagagagagagaggg

SEQ ID NO: 219344 - DNA, 20 bp, Artificial Sequence
  chemically synthesized
gagagagagagagagaggga

SEQ ID NO: 219345 - DNA, 20 bp, Artificial Sequence
  chemically synthesized
gagagagagagagagggagg

SEQ ID NO: 219346 - DNA, 20 bp, Artificial Sequence
  chemically synthesized
gagagagagagagggaggga

SEQ ID NO: 219347 - DNA, 20 bp, Artificial Sequence
  chemically synthesized
gagagagagagggagggaga

SEQ ID NO: 219348 - DNA, 20 bp, Artificial Sequence
  chemically synthesized
gagagagagggagggagaga

SEQ ID NO: 219349 - DNA, 20 bp, Artificial Sequence
  chemically synthesized
gagagagggagggagagaga

SEQ ID NO: 219350 - DNA, 20 bp, Artificial Sequence
  chemically synthesized
gagagggagggagagagaga

SEQ ID NO: 219351 - DNA, 20 bp, Artificial Sequence
  chemically synthesized
gagggagggagagagagaga

SEQ ID NO: 219352 - DNA, 20 bp, Artificial Sequence
  chemically synthesized
gggagggagagagagagaga

SEQ ID NO: 219353 - DNA, 20 bp, Artificial Sequence
  chemically synthesized
gagggagagagagagagaga

SEQ ID NO: 219354 - DNA, 20 bp, Artificial Sequence
  chemically synthesized
gggagagagagagagagaga

SEQ ID NO: 219355 - DNA, 20 bp, Artificial Sequence
  chemically synthesized
gagagagagagagagagaga

SEQ ID NO: 219356 - DNA, 20 bp, Artificial Sequence
  chemically synthesized
gagagagagagagagagaga

SEQ ID NO: 219357 - DNA, 20 bp, Artificial Sequence
  chemically synthesized
gagagagagagagagagaga

SEQ ID NO: 219358 - DNA, 20 bp, Artificial Sequence
  chemically synthesized
gagagagagagagagaaaat

SEQ ID NO: 219359 - DNA, 20 bp, Artificial Sequence
  chemically synthesized
agagaaaattggtaattcta

SEQ ID NO: 219360 - DNA, 20 bp, Artificial Sequence
  chemically synthesized
cttggacataatgttttctg

SEQ ID NO: 219361 - DNA, 20 bp, Artificial Sequence
  chemically synthesized
ctacagaaaacattatgtcc

SEQ ID NO: 219362 - DNA, 20 bp, Artificial Sequence
  chemically synthesized
agaagccaaggaaaaaatct

SEQ ID NO: 219363 - DNA, 20 bp, Artificial Sequence
  chemically synthesized
tatgtccaagattttttcct

SEQ ID NO: 219364 - DNA, 20 bp, Artificial Sequence
  chemically synthesized
ggcctcgaaatcagaagcca

SEQ ID NO: 219365 - DNA, 20 bp, Artificial Sequence
  chemically synthesized
tggcctcgaaatcagaagcc

SEQ ID NO: 219366 - DNA, 20 bp, Artificial Sequence
  chemically synthesized
ctcgttggcctcgaaatcag

SEQ ID NO: 219367 - DNA, 20 bp, Artificial Sequence
  chemically synthesized
tttccttggcttctgatttc

SEQ ID NO: 219368 - DNA, 20 bp, Artificial Sequence
  chemically synthesized
ttccttggcttctgatttcg

SEQ ID NO: 219369 - DNA, 20 bp, Artificial Sequence
  chemically synthesized
aaactcgttggcctcgaaat

SEQ ID NO: 219370 - DNA, 20 bp, Artificial Sequence
  chemically synthesized
cttctgatttcgaggccaac

SEQ ID NO: 219371 - DNA, 20 bp, Artificial Sequence
  chemically synthesized
gatttcgaggccaacgagtt

SEQ ID NO: 219372 - DNA, 20 bp, Artificial Sequence
  chemically synthesized
ttaaaatgacccaaactcgt

SEQ ID NO: 219373 - DNA, 20 bp, Artificial Sequence
  chemically synthesized
atttcgaggccaacgagttt

SEQ ID NO: 219374 - DNA, 20 bp, Artificial Sequence
  chemically synthesized
aacgagtttgggtcatttta

SEQ ID NO: 219375 - DNA, 20 bp, Artificial Sequence
  chemically synthesized
acgagtttgggtcattttaa

SEQ ID NO: 219376 - DNA, 20 bp, Artificial Sequence
  chemically synthesized
cgagtttgggtcattttaaa

SEQ ID NO: 219377 - DNA, 20 bp, Artificial Sequence
  chemically synthesized
gtttgggtcattttaaaggg

SEQ ID NO: 219378 - DNA, 20 bp, Artificial Sequence
  chemically synthesized
tcattttaaagggcagacat

SEQ ID NO: 219379 - DNA, 20 bp, Artificial Sequence
  chemically synthesized
tttaaagggcagacatcagc

SEQ ID NO: 219380 - DNA, 20 bp, Artificial Sequence
  chemically synthesized
cagacatcagcaagtgcctg

SEQ ID NO: 219381 - DNA, 20 bp, Artificial Sequence
  chemically synthesized
taataactatttgtcactgc

SEQ ID NO: 219382 - DNA, 20 bp, Artificial Sequence
  chemically synthesized
ctaataactatttgtcactg

SEQ ID NO: 219383 - DNA, 20 bp, Artificial Sequence
  chemically synthesized
caagtgcctgcagtgacaaa

SEQ ID NO: 219384 - DNA, 20 bp, Artificial Sequence
  chemically synthesized
ctgcagtgacaaatagttat

SEQ ID NO: 219385 - DNA, 20 bp, Artificial Sequence
  chemically synthesized
aaataaaaagtattgtgttg

SEQ ID NO: 219386 - DNA, 20 bp, Artificial Sequence
  chemically synthesized
ggccaacctttggaaataaa

SEQ ID NO: 219387 - DNA, 20 bp, Artificial Sequence
  chemically synthesized
cacaatactttttatttcca

SEQ ID NO: 219388 - DNA, 20 bp, Artificial Sequence
  chemically synthesized
acaatactttttatttccaa

SEQ ID NO: 219389 - DNA, 20 bp, Artificial Sequence
  chemically synthesized
tactttttatttccaaaggt

SEQ ID NO: 219390 - DNA, 20 bp, Artificial Sequence
  chemically synthesized
tggtcaatctggccaacctt

SEQ ID NO: 219391 - DNA, 20 bp, Artificial Sequence
  chemically synthesized
ttttatttccaaaggttggc

SEQ ID NO: 219392 - DNA, 20 bp, Artificial Sequence
  chemically synthesized
agattctcctttggtcaatc

SEQ ID NO: 219393 - DNA, 20 bp, Artificial Sequence
  chemically synthesized
aaggttggccagattgacca

SEQ ID NO: 219394 - DNA, 20 bp, Artificial Sequence
  chemically synthesized
aggttggccagattgaccaa

SEQ ID NO: 219395 - DNA, 20 bp, Artificial Sequence
  chemically synthesized
gttggccagattgaccaaag

SEQ ID NO: 219396 - DNA, 20 bp, Artificial Sequence
  chemically synthesized
tagaagaaaagattctcctt

SEQ ID NO: 219397 - DNA, 20 bp, Artificial Sequence
  chemically synthesized
agaaaggaaggatagaagaa

SEQ ID NO: 219398 - DNA, 20 bp, Artificial Sequence
  chemically synthesized
aaatgagaaaggaaggatag

SEQ ID NO: 219399 - DNA, 20 bp, Artificial Sequence
  chemically synthesized
gaaaaatgagaaaggaagga

SEQ ID NO: 219400 - DNA, 20 bp, Artificial Sequence
  chemically synthesized
ctttgaaaaatgagaaagga

SEQ ID NO: 219401 - DNA, 20 bp, Artificial Sequence
  chemically synthesized
tctttgaaaaatgagaaagg

SEQ ID NO: 219402 - DNA, 20 bp, Artificial Sequence
  chemically synthesized
aagtctttgaaaaatgagaa

SEQ ID NO: 219403 - DNA, 20 bp, Artificial Sequence
  chemically synthesized
aaagtctttgaaaaatgaga

SEQ ID NO: 219404 - DNA, 20 bp, Artificial Sequence
  chemically synthesized
aaaaaaagtctttgaaaaat

SEQ ID NO: 219405 - DNA, 20 bp, Artificial Sequence
  chemically synthesized
ccttcctttctcatttttca

SEQ ID NO: 219406 - DNA, 20 bp, Artificial Sequence
  chemically synthesized
ggaccaaaaaaaaaaaaaaa

SEQ ID NO: 219407 - DNA, 20 bp, Artificial Sequence
  chemically synthesized
agactttttttttttttttt

SEQ ID NO: 219408 - DNA, 20 bp, Artificial Sequence
  chemically synthesized
tttttttttttttttggtcc

SEQ ID NO: 219409 - DNA, 20 bp, Artificial Sequence
  chemically synthesized
aaaaagacttaaaggtttct

SEQ ID NO: 219410 - DNA, 20 bp, Artificial Sequence
  chemically synthesized
taaaaagacttaaaggtttc

SEQ ID NO: 219411 - DNA, 20 bp, Artificial Sequence
  chemically synthesized
ttttggtcccagaaaccttt

SEQ ID NO: 219412 - DNA, 20 bp, Artificial Sequence
  chemically synthesized
gccagcttaaaaagacttaa

SEQ ID NO: 219413 - DNA, 20 bp, Artificial Sequence
  chemically synthesized
agccagcttaaaaagactta

SEQ ID NO: 219414 - DNA, 20 bp, Artificial Sequence
  chemically synthesized
agaaacctttaagtcttttt

SEQ ID NO: 219415 - DNA, 20 bp, Artificial Sequence
  chemically synthesized
acctttaagtctttttaagc

SEQ ID NO: 219416 - DNA, 20 bp, Artificial Sequence
  chemically synthesized
gggaaaaaagccagcttaaa

SEQ ID NO: 219417 - DNA, 20 bp, Artificial Sequence
  chemically synthesized
agcgtaagggggaaaaaagc

SEQ ID NO: 219418 - DNA, 20 bp, Artificial Sequence
  chemically synthesized
ctaaagcgtaagggggaaaa

SEQ ID NO: 219419 - DNA, 20 bp, Artificial Sequence
  chemically synthesized
agcaaagctaaagcgtaagg

SEQ ID NO: 219420 - DNA, 20 bp, Artificial Sequence
  chemically synthesized
gagcaaagctaaagcgtaag

SEQ ID NO: 219421 - DNA, 20 bp, Artificial Sequence
  chemically synthesized
agagcaaagctaaagcgtaa

SEQ ID NO: 219422 - DNA, 20 bp, Artificial Sequence
  chemically synthesized
cttttttcccccttacgctt

SEQ ID NO: 219423 - DNA, 20 bp, Artificial Sequence
  chemically synthesized
aagagcaaagctaaagcgta

SEQ ID NO: 219424 - DNA, 20 bp, Artificial Sequence
  chemically synthesized
aaagagcaaagctaaagcgt

SEQ ID NO: 219425 - DNA, 20 bp, Artificial Sequence
  chemically synthesized
caaagaaaagagcaaagcta

SEQ ID NO: 219426 - DNA, 20 bp, Artificial Sequence
  chemically synthesized
agacctcaaagaaaagagca

SEQ ID NO: 219427 - DNA, 20 bp, Artificial Sequence
  chemically synthesized
cactgagacctcaaagaaaa

SEQ ID NO: 219428 - DNA, 20 bp, Artificial Sequence
  chemically synthesized
ttagctttgctcttttcttt

SEQ ID NO: 219429 - DNA, 20 bp, Artificial Sequence
  chemically synthesized
tagctttgctcttttctttg

SEQ ID NO: 219430 - DNA, 20 bp, Artificial Sequence
  chemically synthesized
gtcactgagacctcaaagaa

SEQ ID NO: 219431 - DNA, 20 bp, Artificial Sequence
  chemically synthesized
tatatgtcactgagacctca

SEQ ID NO: 219432 - DNA, 20 bp, Artificial Sequence
  chemically synthesized
tgctcttttctttgaggtct

SEQ ID NO: 219433 - DNA, 20 bp, Artificial Sequence
  chemically synthesized
tccctgacctatatgtcact

SEQ ID NO: 219434 - DNA, 20 bp, Artificial Sequence
  chemically synthesized
tttgaggtctcagtgacata

SEQ ID NO: 219435 - DNA, 20 bp, Artificial Sequence
  chemically synthesized
ttgaggtctcagtgacatat

SEQ ID NO: 219436 - DNA, 20 bp, Artificial Sequence
  chemically synthesized
ggtctcagtgacatataggt

SEQ ID NO: 219437 - DNA, 20 bp, Artificial Sequence
  chemically synthesized
gtctcagtgacatataggtc

SEQ ID NO: 219438 - DNA, 20 bp, Artificial Sequence
  chemically synthesized
tctcagtgacatataggtca

SEQ ID NO: 219439 - DNA, 20 bp, Artificial Sequence
  chemically synthesized
ccactaatattacattggta

SEQ ID NO: 219440 - DNA, 20 bp, Artificial Sequence
  chemically synthesized
actctccactaatattacat

SEQ ID NO: 219441 - DNA, 20 bp, Artificial Sequence
  chemically synthesized
cgtctttaccaatgtaatat

SEQ ID NO: 219442 - DNA, 20 bp, Artificial Sequence
  chemically synthesized
ctttaccaatgtaatattag

SEQ ID NO: 219443 - DNA, 20 bp, Artificial Sequence
  chemically synthesized
ttaccaatgtaatattagtg

SEQ ID NO: 219444 - DNA, 20 bp, Artificial Sequence
  chemically synthesized
accaatgtaatattagtgga

SEQ ID NO: 219445 - DNA, 20 bp, Artificial Sequence
  chemically synthesized
tattagtggagagttataac

SEQ ID NO: 219446 - DNA, 20 bp, Artificial Sequence
  chemically synthesized
attagtggagagttataaca

SEQ ID NO: 219447 - DNA, 20 bp, Artificial Sequence
  chemically synthesized
ttagtggagagttataacaa

SEQ ID NO: 219448 - DNA, 20 bp, Artificial Sequence
  chemically synthesized
tagtggagagttataacaag

SEQ ID NO: 219449 - DNA, 20 bp, Artificial Sequence
  chemically synthesized
agtggagagttataacaagg

SEQ ID NO: 219450 - DNA, 20 bp, Artificial Sequence
  chemically synthesized
gagagttataacaagggggt

SEQ ID NO: 219451 - DNA, 20 bp, Artificial Sequence
  chemically synthesized
agagttataacaagggggtg

SEQ ID NO: 219452 - DNA, 20 bp, Artificial Sequence
  chemically synthesized
acaagggggtgaggacactg

SEQ ID NO: 219453 - DNA, 20 bp, Artificial Sequence
  chemically synthesized
caagggggtgaggacactga

SEQ ID NO: 219454 - DNA, 20 bp, Artificial Sequence
  chemically synthesized
caggcacctgtgtaagcctt

SEQ ID NO: 219455 - DNA, 20 bp, Artificial Sequence
  chemically synthesized
gaggacactgaaggcttaca

SEQ ID NO: 219456 - DNA, 20 bp, Artificial Sequence
  chemically synthesized
aggacactgaaggcttacac

SEQ ID NO: 219457 - DNA, 20 bp, Artificial Sequence
  chemically synthesized
aattattcaggcacctgtgt

SEQ ID NO: 219458 - DNA, 20 bp, Artificial Sequence
  chemically synthesized
agtgataaggcaaattattc

SEQ ID NO: 219459 - DNA, 20 bp, Artificial Sequence
  chemically synthesized
gagtgataaggcaaattatt

SEQ ID NO: 219460 - DNA, 20 bp, Artificial Sequence
  chemically synthesized
tgcaccagtgtggagtgata

SEQ ID NO: 219461 - DNA, 20 bp, Artificial Sequence
  chemically synthesized
ttgcaccagtgtggagtgat

SEQ ID NO: 219462 - DNA, 20 bp, Artificial Sequence
  chemically synthesized
tttgccttatcactccacac

SEQ ID NO: 219463 - DNA, 20 bp, Artificial Sequence
  chemically synthesized
gcaccacttgcaccagtgtg

SEQ ID NO: 219464 - DNA, 20 bp, Artificial Sequence
  chemically synthesized
ctgcaccacttgcaccagtg

SEQ ID NO: 219465 - DNA, 20 bp, Artificial Sequence
  chemically synthesized
ttatcactccacactggtgc

SEQ ID NO: 219466 - DNA, 20 bp, Artificial Sequence
  chemically synthesized
tcactccacactggtgcaag

SEQ ID NO: 219467 - DNA, 20 bp, Artificial Sequence
  chemically synthesized
tatttctgcaccacttgcac

SEQ ID NO: 219468 - DNA, 20 bp, Artificial Sequence
  chemically synthesized
ccacactggtgcaagtggtg

SEQ ID NO: 219469 - DNA, 20 bp, Artificial Sequence
  chemically synthesized
ggtgcaagtggtgcagaaat

SEQ ID NO: 219470 - DNA, 20 bp, Artificial Sequence
  chemically synthesized
tgcaagtggtgcagaaataa

SEQ ID NO: 219471 - DNA, 20 bp, Artificial Sequence
  chemically synthesized
aagtggtgcagaaataagag

SEQ ID NO: 219472 - DNA, 20 bp, Artificial Sequence
  chemically synthesized
gcagaaataagagcagatta

SEQ ID NO: 219473 - DNA, 20 bp, Artificial Sequence
  chemically synthesized
tccaaaagtatatgtagcaa

SEQ ID NO: 219474 - DNA, 20 bp, Artificial Sequence
  chemically synthesized
tgtaaatccaaaagtatatg

SEQ ID NO: 219475 - DNA, 20 bp, Artificial Sequence
  chemically synthesized
gcttttgctacatatacttt

SEQ ID NO: 219476 - DNA, 20 bp, Artificial Sequence
  chemically synthesized
cacttgatctgtaaatccaa

SEQ ID NO: 219477 - DNA, 20 bp, Artificial Sequence
  chemically synthesized
tacatatacttttggattta

SEQ ID NO: 219478 - DNA, 20 bp, Artificial Sequence
  chemically synthesized
tacttttggatttacagatc

SEQ ID NO: 219479 - DNA, 20 bp, Artificial Sequence
  chemically synthesized
ttggatttacagatcaagtg

SEQ ID NO: 219480 - DNA, 20 bp, Artificial Sequence
  chemically synthesized
tggatttacagatcaagtgt

SEQ ID NO: 219481 - DNA, 20 bp, Artificial Sequence
  chemically synthesized
acagatcaagtgtaggtttt

SEQ ID NO: 219482 - DNA, 20 bp, Artificial Sequence
  chemically synthesized
atcaagtgtaggttttcaga

SEQ ID NO: 219483 - DNA, 20 bp, Artificial Sequence
  chemically synthesized
tgtaggttttcagaaagttt

SEQ ID NO: 219484 - DNA, 20 bp, Artificial Sequence
  chemically synthesized
attgatagtagtgggtatgg

SEQ ID NO: 219485 - DNA, 20 bp, Artificial Sequence
  chemically synthesized
ggcattgatagtagtgggta

SEQ ID NO: 219486 - DNA, 20 bp, Artificial Sequence
  chemically synthesized
attctggcattgatagtagt

SEQ ID NO: 219487 - DNA, 20 bp, Artificial Sequence
  chemically synthesized
aattctggcattgatagtag

SEQ ID NO: 219488 - DNA, 20 bp, Artificial Sequence
  chemically synthesized
gataattctggcattgatag

SEQ ID NO: 219489 - DNA, 20 bp, Artificial Sequence
  chemically synthesized
atacccactactatcaatgc

SEQ ID NO: 219490 - DNA, 20 bp, Artificial Sequence
  chemically synthesized
attgataattctggcattga

SEQ ID NO: 219491 - DNA, 20 bp, Artificial Sequence
  chemically synthesized
attttatccattgataattc

SEQ ID NO: 219492 - DNA, 20 bp, Artificial Sequence
  chemically synthesized
atcaatgccagaattatcaa

SEQ ID NO: 219493 - DNA, 20 bp, Artificial Sequence
  chemically synthesized
tatataaaactcagtgtcaa

SEQ ID NO: 219494 - DNA, 20 bp, Artificial Sequence
  chemically synthesized
tattattttctattgacact

SEQ ID NO: 219495 - DNA, 20 bp, Artificial Sequence
  chemically synthesized
atatatatatatataaaact

SEQ ID NO: 219496 - DNA, 20 bp, Artificial Sequence
  chemically synthesized
atgggaatttatacagaaac

SEQ ID NO: 219497 - DNA, 20 bp, Artificial Sequence
  chemically synthesized
gtgcattatgggaatttata

SEQ ID NO: 219498 - DNA, 20 bp, Artificial Sequence
  chemically synthesized
ttggatggagtgtgcattat

SEQ ID NO: 219499 - DNA, 20 bp, Artificial Sequence
  chemically synthesized
cttggatggagtgtgcatta

SEQ ID NO: 219500 - DNA, 20 bp, Artificial Sequence
  chemically synthesized
ccataatgcacactccatcc

SEQ ID NO: 219501 - DNA, 20 bp, Artificial Sequence
  chemically synthesized
attatgtttgttcttggatg

SEQ ID NO: 219502 - DNA, 20 bp, Artificial Sequence
  chemically synthesized
aaattatgtttgttcttgga

SEQ ID NO: 219503 - DNA, 20 bp, Artificial Sequence
  chemically synthesized
agttaaattatgtttgttct

SEQ ID NO: 219504 - DNA, 20 bp, Artificial Sequence
  chemically synthesized
gaacaaacataatttaacta

SEQ ID NO: 219505 - DNA, 20 bp, Artificial Sequence
  chemically synthesized
gagttatgtgatatgatcta

SEQ ID NO: 219506 - DNA, 20 bp, Artificial Sequence
  chemically synthesized
atcatatcacataactcctc

SEQ ID NO: 219507 - DNA, 20 bp, Artificial Sequence
  chemically synthesized
attggggtttttaaccagag

SEQ ID NO: 219508 - DNA, 20 bp, Artificial Sequence
  chemically synthesized
ccattggggtttttaaccag

SEQ ID NO: 219509 - DNA, 20 bp, Artificial Sequence
  chemically synthesized
gccattggggtttttaacca

SEQ ID NO: 219510 - DNA, 20 bp, Artificial Sequence
  chemically synthesized
aagccattggggtttttaac

SEQ ID NO: 219511 - DNA, 20 bp, Artificial Sequence
  chemically synthesized
cctctggttaaaaaccccaa

SEQ ID NO: 219512 - DNA, 20 bp, Artificial Sequence
  chemically synthesized
aattaaatgttaagccattg

SEQ ID NO: 219513 - DNA, 20 bp, Artificial Sequence
  chemically synthesized
aaattaaatgttaagccatt

SEQ ID NO: 219514 - DNA, 20 bp, Artificial Sequence
  chemically synthesized
taaattaaatgttaagccat

SEQ ID NO: 219515 - DNA, 20 bp, Artificial Sequence
  chemically synthesized
ttgtttataaattaaatgtt

SEQ ID NO: 219516 - DNA, 20 bp, Artificial Sequence
  chemically synthesized
atttaatttataaacaaaaa

SEQ ID NO: 219517 - DNA, 20 bp, Artificial Sequence
  chemically synthesized
ccgggacgttgtaaagagtt

SEQ ID NO: 219518 - DNA, 20 bp, Artificial Sequence
  chemically synthesized
tccgggacgttgtaaagagt

SEQ ID NO: 219519 - DNA, 20 bp, Artificial Sequence
  chemically synthesized
gtcttccgggacgttgtaaa

SEQ ID NO: 219520 - DNA, 20 bp, Artificial Sequence
  chemically synthesized
cagtcttccgggacgttgta

SEQ ID NO: 219521 - DNA, 20 bp, Artificial Sequence
  chemically synthesized
cccaactctttacaacgtcc

SEQ ID NO: 219522 - DNA, 20 bp, Artificial Sequence
  chemically synthesized
aactctttacaacgtcccgg

SEQ ID NO: 219523 - DNA, 20 bp, Artificial Sequence
  chemically synthesized
cagatgatgtgcagtcttcc

SEQ ID NO: 219524 - DNA, 20 bp, Artificial Sequence
  chemically synthesized
tcagatgatgtgcagtcttc

SEQ ID NO: 219525 - DNA, 20 bp, Artificial Sequence
  chemically synthesized
ggcatgcatcagatgatgtg

SEQ ID NO: 219526 - DNA, 20 bp, Artificial Sequence
  chemically synthesized
gggagagatctggcatgcat

SEQ ID NO: 219527 - DNA, 20 bp, Artificial Sequence
  chemically synthesized
gcacatcatctgatgcatgc

SEQ ID NO: 219528 - DNA, 20 bp, Artificial Sequence
  chemically synthesized
aggagatgaagggagagatc

SEQ ID NO: 219529 - DNA, 20 bp, Artificial Sequence
  chemically synthesized
agtgccaggagatgaaggga

SEQ ID NO: 219530 - DNA, 20 bp, Artificial Sequence
  chemically synthesized
taagtgccaggagatgaagg

SEQ ID NO: 219531 - DNA, 20 bp, Artificial Sequence
  chemically synthesized
ggtaagtgccaggagatgaa

SEQ ID NO: 219532 - DNA, 20 bp, Artificial Sequence
  chemically synthesized
aggtaagtgccaggagatga

SEQ ID NO: 219533 - DNA, 20 bp, Artificial Sequence
  chemically synthesized
agatctctcccttcatctcc

SEQ ID NO: 219534 - DNA, 20 bp, Artificial Sequence
  chemically synthesized
gaggtaagtgccaggagatg

SEQ ID NO: 219535 - DNA, 20 bp, Artificial Sequence
  chemically synthesized
gatggagaggtaagtgccag

SEQ ID NO: 219536 - DNA, 20 bp, Artificial Sequence
  chemically synthesized
gtgatggagaggtaagtgcc

SEQ ID NO: 219537 - DNA, 20 bp, Artificial Sequence
  chemically synthesized
ggtgatggagaggtaagtgc

SEQ ID NO: 219538 - DNA, 20 bp, Artificial Sequence
  chemically synthesized
gattttggtgatggagaggt

SEQ ID NO: 219539 - DNA, 20 bp, Artificial Sequence
  chemically synthesized
agtggattttggtgatggag

SEQ ID NO: 219540 - DNA, 20 bp, Artificial Sequence
  chemically synthesized
gagtggattttggtgatgga

SEQ ID NO: 219541 - DNA, 20 bp, Artificial Sequence
  chemically synthesized
gtgagtggattttggtgatg

SEQ ID NO: 219542 - DNA, 20 bp, Artificial Sequence
  chemically synthesized
gtgtgagtggattttggtga

SEQ ID NO: 219543 - DNA, 20 bp, Artificial Sequence
  chemically synthesized
ggaaaagtgtgagtggattt

SEQ ID NO: 219544 - DNA, 20 bp, Artificial Sequence
  chemically synthesized
tacttgaggaaaagtgtgag

SEQ ID NO: 219545 - DNA, 20 bp, Artificial Sequence
  chemically synthesized
gcctacttgaggaaaagtgt

SEQ ID NO: 219546 - DNA, 20 bp, Artificial Sequence
  chemically synthesized
atccactcacacttttcctc

SEQ ID NO: 219547 - DNA, 20 bp, Artificial Sequence
  chemically synthesized
aacttagcctacttgaggaa

SEQ ID NO: 219548 - DNA, 20 bp, Artificial Sequence
  chemically synthesized
cactcacacttttcctcaag

SEQ ID NO: 219549 - DNA, 20 bp, Artificial Sequence
  chemically synthesized
actcacacttttcctcaagt

SEQ ID NO: 219550 - DNA, 20 bp, Artificial Sequence
  chemically synthesized
tagtcaacttagcctacttg

SEQ ID NO: 219551 - DNA, 20 bp, Artificial Sequence
  chemically synthesized
atagtcaacttagcctactt

SEQ ID NO: 219552 - DNA, 20 bp, Artificial Sequence
  chemically synthesized
cacttttcctcaagtaggct

SEQ ID NO: 219553 - DNA, 20 bp, Artificial Sequence
  chemically synthesized
gtgcaattgcatagtcaact

SEQ ID NO: 219554 - DNA, 20 bp, Artificial Sequence
  chemically synthesized
acaaaaagcgtgcaattgca

SEQ ID NO: 219555 - DNA, 20 bp, Artificial Sequence
  chemically synthesized
ttccagacaaaggaaacaaa

SEQ ID NO: 219556 - DNA, 20 bp, Artificial Sequence
  chemically synthesized
cgctttttgtttcctttgtc

SEQ ID NO: 219557 - DNA, 20 bp, Artificial Sequence
  chemically synthesized
aaagaatatgttccagacaa

SEQ ID NO: 219558 - DNA, 20 bp, Artificial Sequence
  chemically synthesized
taaagaatatgttccagaca

SEQ ID NO: 219559 - DNA, 20 bp, Artificial Sequence
  chemically synthesized
gatacctaaagaatatgttc

SEQ ID NO: 219560 - DNA, 20 bp, Artificial Sequence
  chemically synthesized
tttgtctggaacatattctt

SEQ ID NO: 219561 - DNA, 20 bp, Artificial Sequence
  chemically synthesized
ttgtctggaacatattcttt

SEQ ID NO: 219562 - DNA, 20 bp, Artificial Sequence
  chemically synthesized
gtgacagaggcagataccta

SEQ ID NO: 219563 - DNA, 20 bp, Artificial Sequence
  chemically synthesized
aacctgaatagtgacagagg

SEQ ID NO: 219564 - DNA, 20 bp, Artificial Sequence
  chemically synthesized
aggaacctgaatagtgacag

SEQ ID NO: 219565 - DNA, 20 bp, Artificial Sequence
  chemically synthesized
aaggaacctgaatagtgaca

SEQ ID NO: 219566 - DNA, 20 bp, Artificial Sequence
  chemically synthesized
aaaaggaacctgaatagtga

SEQ ID NO: 219567 - DNA, 20 bp, Artificial Sequence
  chemically synthesized
tatctgcctctgtcactatt

SEQ ID NO: 219568 - DNA, 20 bp, Artificial Sequence
  chemically synthesized
atctgcctctgtcactattc

SEQ ID NO: 219569 - DNA, 20 bp, Artificial Sequence
  chemically synthesized
catttgaaaaggaacctgaa

SEQ ID NO: 219570 - DNA, 20 bp, Artificial Sequence
  chemically synthesized
tgaggaaatgacatttgaaa

SEQ ID NO: 219571 - DNA, 20 bp, Artificial Sequence
  chemically synthesized
ttgaggaaatgacatttgaa

SEQ ID NO: 219572 - DNA, 20 bp, Artificial Sequence
  chemically synthesized
aatgtcatttcctcaaacaa

SEQ ID NO: 219573 - DNA, 20 bp, Artificial Sequence
  chemically synthesized
cagagaaggacttttgtttg

SEQ ID NO: 219574 - DNA, 20 bp, Artificial Sequence
  chemically synthesized
ccagagaaggacttttgttt

SEQ ID NO: 219575 - DNA, 20 bp, Artificial Sequence
  chemically synthesized
ctcaaacaaaagtccttctc

SEQ ID NO: 219576 - DNA, 20 bp, Artificial Sequence
  chemically synthesized
ccagacagagaagccagaga

SEQ ID NO: 219577 - DNA, 20 bp, Artificial Sequence
  chemically synthesized
accagacagagaagccagag

SEQ ID NO: 219578 - DNA, 20 bp, Artificial Sequence
  chemically synthesized
aacaccagacagagaagcca

SEQ ID NO: 219579 - DNA, 20 bp, Artificial Sequence
  chemically synthesized
ataacaccagacagagaagc

SEQ ID NO: 219580 - DNA, 20 bp, Artificial Sequence
  chemically synthesized
ccttctctggcttctctgtc

SEQ ID NO: 219581 - DNA, 20 bp, Artificial Sequence
  chemically synthesized
agacataacaccagacagag

SEQ ID NO: 219582 - DNA, 20 bp, Artificial Sequence
  chemically synthesized
ttgagacataacaccagaca

SEQ ID NO: 219583 - DNA, 20 bp, Artificial Sequence
  chemically synthesized
agttgagacataacaccaga

SEQ ID NO: 219584 - DNA, 20 bp, Artificial Sequence
  chemically synthesized
tgtgagttgagacataacac

SEQ ID NO: 219585 - DNA, 20 bp, Artificial Sequence
  chemically synthesized
gtgtaactggaatgtgagtt

SEQ ID NO: 219586 - DNA, 20 bp, Artificial Sequence
  chemically synthesized
ttatgtctcaactcacattc

SEQ ID NO: 219587 - DNA, 20 bp, Artificial Sequence
  chemically synthesized
gtagagtgtaactggaatgt

SEQ ID NO: 219588 - DNA, 20 bp, Artificial Sequence
  chemically synthesized
gcagtgtggtagagtgtaac

SEQ ID NO: 219589 - DNA, 20 bp, Artificial Sequence
  chemically synthesized
gaaaagtgagcagtgtggta

SEQ ID NO: 219590 - DNA, 20 bp, Artificial Sequence
  chemically synthesized
cagaaaagtgagcagtgtgg

SEQ ID NO: 219591 - DNA, 20 bp, Artificial Sequence
  chemically synthesized
atacagaaaagtgagcagtg

SEQ ID NO: 219592 - DNA, 20 bp, Artificial Sequence
  chemically synthesized
gtcttatacagaaaagtgag

SEQ ID NO: 219593 - DNA, 20 bp, Artificial Sequence
  chemically synthesized
tatgtcttatacagaaaagt

SEQ ID NO: 219594 - DNA, 20 bp, Artificial Sequence
  chemically synthesized
tcaatatgtcttatacagaa

SEQ ID NO: 219595 - DNA, 20 bp, Artificial Sequence
  chemically synthesized
cactgctcacttttctgtat

SEQ ID NO: 219596 - DNA, 20 bp, Artificial Sequence
  chemically synthesized
aaatatcaatatgtcttata

SEQ ID NO: 219597 - DNA, 20 bp, Artificial Sequence
  chemically synthesized
ccagcgcacctggcattaaa

SEQ ID NO: 219598 - DNA, 20 bp, Artificial Sequence
  chemically synthesized
ttgttattactttttaatgc

SEQ ID NO: 219599 - DNA, 20 bp, Artificial Sequence
  chemically synthesized
tgttattactttttaatgcc

SEQ ID NO: 219600 - DNA, 20 bp, Artificial Sequence
  chemically synthesized
ctttttaatgccaggtgcgc

SEQ ID NO: 219601 - DNA, 20 bp, Artificial Sequence
  chemically synthesized
cgggcatgagccagcgcacc

SEQ ID NO: 219602 - DNA, 20 bp, Artificial Sequence
  chemically synthesized
ctgggattacgggcatgagc

SEQ ID NO: 219603 - DNA, 20 bp, Artificial Sequence
  chemically synthesized
agtgctgggattacgggcat

SEQ ID NO: 219604 - DNA, 20 bp, Artificial Sequence
  chemically synthesized
ctggctcatgcccgtaatcc

SEQ ID NO: 219605 - DNA, 20 bp, Artificial Sequence
  chemically synthesized
tcccaaagtgctgggattac

SEQ ID NO: 219606 - DNA, 20 bp, Artificial Sequence
  chemically synthesized
ctcccaaagtgctgggatta

SEQ ID NO: 219607 - DNA, 20 bp, Artificial Sequence
  chemically synthesized
tgcccgtaatcccagcactt

SEQ ID NO: 219608 - DNA, 20 bp, Artificial Sequence
  chemically synthesized
ccacggcctcccaaagtgct

SEQ ID NO: 219609 - DNA, 20 bp, Artificial Sequence
  chemically synthesized
gcccgtaatcccagcacttt

SEQ ID NO: 219610 - DNA, 20 bp, Artificial Sequence
  chemically synthesized
tccacggcctcccaaagtgc

SEQ ID NO: 219611 - DNA, 20 bp, Artificial Sequence
  chemically synthesized
ccgtaatcccagcactttgg

SEQ ID NO: 219612 - DNA, 20 bp, Artificial Sequence
  chemically synthesized
cgtaatcccagcactttggg

SEQ ID NO: 219613 - DNA, 20 bp, Artificial Sequence
  chemically synthesized
ctgccctccacggcctccca

SEQ ID NO: 219614 - DNA, 20 bp, Artificial Sequence
  chemically synthesized
cccagcactttgggaggccg

SEQ ID NO: 219615 - DNA, 20 bp, Artificial Sequence
  chemically synthesized
cagcactttgggaggccgtg

SEQ ID NO: 219616 - DNA, 20 bp, Artificial Sequence
  chemically synthesized
agcactttgggaggccgtgg

SEQ ID NO: 219617 - DNA, 20 bp, Artificial Sequence
  chemically synthesized
gcactttgggaggccgtgga

SEQ ID NO: 219618 - DNA, 20 bp, Artificial Sequence
  chemically synthesized
ctttgggaggccgtggaggg

SEQ ID NO: 219619 - DNA, 20 bp, Artificial Sequence
  chemically synthesized
ctcaggtgatctgccctcca

SEQ ID NO: 219620 - DNA, 20 bp, Artificial Sequence
  chemically synthesized
ccgtggagggcagatcacct

SEQ ID NO: 219621 - DNA, 20 bp, Artificial Sequence
  chemically synthesized
cgtggagggcagatcacctg

SEQ ID NO: 219622 - DNA, 20 bp, Artificial Sequence
  chemically synthesized
gagggcagatcacctgaggt

SEQ ID NO: 219623 - DNA, 20 bp, Artificial Sequence
  chemically synthesized
agggcagatcacctgaggtc

SEQ ID NO: 219624 - DNA, 20 bp, Artificial Sequence
  chemically synthesized
gttctcgagctcctgacctc

SEQ ID NO: 219625 - DNA, 20 bp, Artificial Sequence
  chemically synthesized
ggcagatcacctgaggtcag

SEQ ID NO: 219626 - DNA, 20 bp, Artificial Sequence
  chemically synthesized
tgttctcgagctcctgacct

SEQ ID NO: 219627 - DNA, 20 bp, Artificial Sequence
  chemically synthesized
tcacctgaggtcaggagctc

SEQ ID NO: 219628 - DNA, 20 bp, Artificial Sequence
  chemically synthesized
tgaggtcaggagctcgagaa

SEQ ID NO: 219629 - DNA, 20 bp, Artificial Sequence
  chemically synthesized
atattggccaggctgttctc

SEQ ID NO: 219630 - DNA, 20 bp, Artificial Sequence
  chemically synthesized
tcaggagctcgagaacagcc

SEQ ID NO: 219631 - DNA, 20 bp, Artificial Sequence
  chemically synthesized
ggggtttcaccatattggcc

SEQ ID NO: 219632 - DNA, 20 bp, Artificial Sequence
  chemically synthesized
cgagaacagcctggccaata

SEQ ID NO: 219633 - DNA, 20 bp, Artificial Sequence
  chemically synthesized
tggggtttcaccatattggc

SEQ ID NO: 219634 - DNA, 20 bp, Artificial Sequence
  chemically synthesized
gagatggggtttcaccatat

SEQ ID NO: 219635 - DNA, 20 bp, Artificial Sequence
  chemically synthesized
ttgtatttttagtagagatg

SEQ ID NO: 219636 - DNA, 20 bp, Artificial Sequence
  chemically synthesized
tttgtatttttagtagagat

SEQ ID NO: 219637 - DNA, 20 bp, Artificial Sequence
  chemically synthesized
ttttgtatttttagtagaga

SEQ ID NO: 219638 - DNA, 20 bp, Artificial Sequence
  chemically synthesized
taatttttgtatttttagta

SEQ ID NO: 219639 - DNA, 20 bp, Artificial Sequence
  chemically synthesized
gctaatttttgtatttttag

SEQ ID NO: 219640 - DNA, 20 bp, Artificial Sequence
  chemically synthesized
ctggctaatttttgtatttt

SEQ ID NO: 219641 - DNA, 20 bp, Artificial Sequence
  chemically synthesized
tctactaaaaatacaaaaat

SEQ ID NO: 219642 - DNA, 20 bp, Artificial Sequence
  chemically synthesized
ctaaaaatacaaaaattagc

SEQ ID NO: 219643 - DNA, 20 bp, Artificial Sequence
  chemically synthesized
taaaaatacaaaaattagcc

SEQ ID NO: 219644 - DNA, 20 bp, Artificial Sequence
  chemically synthesized
atacaaaaattagccaggca

SEQ ID NO: 219645 - DNA, 20 bp, Artificial Sequence
  chemically synthesized
caaaaattagccaggcatgg

SEQ ID NO: 219646 - DNA, 20 bp, Artificial Sequence
  chemically synthesized
caggcatgcgccaccatgcc

SEQ ID NO: 219647 - DNA, 20 bp, Artificial Sequence
  chemically synthesized
gtggcgcatgcctgtaatcc

SEQ ID NO: 219648 - DNA, 20 bp, Artificial Sequence
  chemically synthesized
taccgagtagctgggattac

SEQ ID NO: 219649 - DNA, 20 bp, Artificial Sequence
  chemically synthesized
ctaccgagtagctgggatta

SEQ ID NO: 219650 - DNA, 20 bp, Artificial Sequence
  chemically synthesized
tgcctgtaatcccagctact

SEQ ID NO: 219651 - DNA, 20 bp, Artificial Sequence
  chemically synthesized
cctcagcctaccgagtagct

SEQ ID NO: 219652 - DNA, 20 bp, Artificial Sequence
  chemically synthesized
gcctcagcctaccgagtagc

SEQ ID NO: 219653 - DNA, 20 bp, Artificial Sequence
  chemically synthesized
ctgtaatcccagctactcgg

SEQ ID NO: 219654 - DNA, 20 bp, Artificial Sequence
  chemically synthesized
tgtaatcccagctactcggt

SEQ ID NO: 219655 - DNA, 20 bp, Artificial Sequence
  chemically synthesized
tcctgcctcagcctaccgag

SEQ ID NO: 219656 - DNA, 20 bp, Artificial Sequence
  chemically synthesized
ttctcctgcctcagcctacc

SEQ ID NO: 219657 - DNA, 20 bp, Artificial Sequence
  chemically synthesized
tcccagctactcggtaggct

SEQ ID NO: 219658 - DNA, 20 bp, Artificial Sequence
  chemically synthesized
cccagctactcggtaggctg

SEQ ID NO: 219659 - DNA, 20 bp, Artificial Sequence
  chemically synthesized
agctactcggtaggctgagg

SEQ ID NO: 219660 - DNA, 20 bp, Artificial Sequence
  chemically synthesized
gctactcggtaggctgaggc

SEQ ID NO: 219661 - DNA, 20 bp, Artificial Sequence
  chemically synthesized
tactcggtaggctgaggcag

SEQ ID NO: 219662 - DNA, 20 bp, Artificial Sequence
  chemically synthesized
ttcaaatgattctcctgcct

SEQ ID NO: 219663 - DNA, 20 bp, Artificial Sequence
  chemically synthesized
gcaggagaatcatttgaacc

SEQ ID NO: 219664 - DNA, 20 bp, Artificial Sequence
  chemically synthesized
caggagaatcatttgaaccc

SEQ ID NO: 219665 - DNA, 20 bp, Artificial Sequence
  chemically synthesized
ggagaatcatttgaacccgg

SEQ ID NO: 219666 - DNA, 20 bp, Artificial Sequence
  chemically synthesized
gagaatcatttgaacccggg

SEQ ID NO: 219667 - DNA, 20 bp, Artificial Sequence
  chemically synthesized
aatcatttgaacccgggagg

SEQ ID NO: 219668 - DNA, 20 bp, Artificial Sequence
  chemically synthesized
cactgcaacctctgcctccc

SEQ ID NO: 219669 - DNA, 20 bp, Artificial Sequence
  chemically synthesized
tcatttgaacccgggaggca

SEQ ID NO: 219670 - DNA, 20 bp, Artificial Sequence
  chemically synthesized
tcactgcaacctctgcctcc

SEQ ID NO: 219671 - DNA, 20 bp, Artificial Sequence
  chemically synthesized
catttgaacccgggaggcag

SEQ ID NO: 219672 - DNA, 20 bp, Artificial Sequence
  chemically synthesized
aacccgggaggcagaggttg

SEQ ID NO: 219673 - DNA, 20 bp, Artificial Sequence
  chemically synthesized
cgggaggcagaggttgcagt

SEQ ID NO: 219674 - DNA, 20 bp, Artificial Sequence
  chemically synthesized
gaggcagaggttgcagtgag

SEQ ID NO: 219675 - DNA, 20 bp, Artificial Sequence
  chemically synthesized
ggcagaggttgcagtgagca

SEQ ID NO: 219676 - DNA, 20 bp, Artificial Sequence
  chemically synthesized
caggctggagtgcagtggca

SEQ ID NO: 219677 - DNA, 20 bp, Artificial Sequence
  chemically synthesized
tcacccaggctggagtgcag

SEQ ID NO: 219678 - DNA, 20 bp, Artificial Sequence
  chemically synthesized
gagactgtgccactgcactc

SEQ ID NO: 219679 - DNA, 20 bp, Artificial Sequence
  chemically synthesized
ctgtcacccaggctggagtg

SEQ ID NO: 219680 - DNA, 20 bp, Artificial Sequence
  chemically synthesized
tgtgccactgcactccagcc

SEQ ID NO: 219681 - DNA, 20 bp, Artificial Sequence
  chemically synthesized
gtgccactgcactccagcct

SEQ ID NO: 219682 - DNA, 20 bp, Artificial Sequence
  chemically synthesized
tcactctgtcacccaggctg

SEQ ID NO: 219683 - DNA, 20 bp, Artificial Sequence
  chemically synthesized
tctcactctgtcacccaggc

SEQ ID NO: 219684 - DNA, 20 bp, Artificial Sequence
  chemically synthesized
ctgcactccagcctgggtga

SEQ ID NO: 219685 - DNA, 20 bp, Artificial Sequence
  chemically synthesized
agagtctcactctgtcaccc

SEQ ID NO: 219686 - DNA, 20 bp, Artificial Sequence
  chemically synthesized
gcactccagcctgggtgaca

SEQ ID NO: 219687 - DNA, 20 bp, Artificial Sequence
  chemically synthesized
cagagtctcactctgtcacc

SEQ ID NO: 219688 - DNA, 20 bp, Artificial Sequence
  chemically synthesized
tccagcctgggtgacagagt

SEQ ID NO: 219689 - DNA, 20 bp, Artificial Sequence
  chemically synthesized
tattttattttgttgagaca

SEQ ID NO: 219690 - DNA, 20 bp, Artificial Sequence
  chemically synthesized
tttattttattttgttgaga

SEQ ID NO: 219691 - DNA, 20 bp, Artificial Sequence
  chemically synthesized
ttattttattttattttgtt

SEQ ID NO: 219692 - DNA, 20 bp, Artificial Sequence
  chemically synthesized
ttttttaacatctatttcat

SEQ ID NO: 219693 - DNA, 20 bp, Artificial Sequence
  chemically synthesized
gatcttatatgctaatgaaa

SEQ ID NO: 219694 - DNA, 20 bp, Artificial Sequence
  chemically synthesized
catctatttcattagcatat

SEQ ID NO: 219695 - DNA, 20 bp, Artificial Sequence
  chemically synthesized
cattagcatataagatcctt

SEQ ID NO: 219696 - DNA, 20 bp, Artificial Sequence
  chemically synthesized
ttagcatataagatccttga

SEQ ID NO: 219697 - DNA, 20 bp, Artificial Sequence
  chemically synthesized
catataagatccttgagagt

SEQ ID NO: 219698 - DNA, 20 bp, Artificial Sequence
  chemically synthesized
gcaaaaagttcttactctca

SEQ ID NO: 219699 - DNA, 20 bp, Artificial Sequence
  chemically synthesized
agcaaaaagttcttactctc

SEQ ID NO: 219700 - DNA, 20 bp, Artificial Sequence
  chemically synthesized
aggaatgaatcagaagcaaa

SEQ ID NO: 219701 - DNA, 20 bp, Artificial Sequence
  chemically synthesized
gaattacaggaatgaatcag

SEQ ID NO: 219702 - DNA, 20 bp, Artificial Sequence
  chemically synthesized
gctgaattacaggaatgaat

SEQ ID NO: 219703 - DNA, 20 bp, Artificial Sequence
  chemically synthesized
tctgattcattcctgtaatt

SEQ ID NO: 219704 - DNA, 20 bp, Artificial Sequence
  chemically synthesized
ttttctaggtgctgaattac

SEQ ID NO: 219705 - DNA, 20 bp, Artificial Sequence
  chemically synthesized
tttttctaggtgctgaatta

SEQ ID NO: 219706 - DNA, 20 bp, Artificial Sequence
  chemically synthesized
cattcctgtaattcagcacc

SEQ ID NO: 219707 - DNA, 20 bp, Artificial Sequence
  chemically synthesized
tatatgccaaatgtttttct

SEQ ID NO: 219708 - DNA, 20 bp, Artificial Sequence
  chemically synthesized
ctatatgccaaatgtttttc

SEQ ID NO: 219709 - DNA, 20 bp, Artificial Sequence
  chemically synthesized
tcagcacctagaaaaacatt

SEQ ID NO: 219710 - DNA, 20 bp, Artificial Sequence
  chemically synthesized
ctagaaaaacatttggcata

SEQ ID NO: 219711 - DNA, 20 bp, Artificial Sequence
  chemically synthesized
gaaaaacatttggcatatag

SEQ ID NO: 219712 - DNA, 20 bp, Artificial Sequence
  chemically synthesized
ggcatatagaagataatcaa

SEQ ID NO: 219713 - DNA, 20 bp, Artificial Sequence
  chemically synthesized
tatagaagataatcaatgga

SEQ ID NO: 219714 - DNA, 20 bp, Artificial Sequence
  chemically synthesized
atagaagataatcaatggat

SEQ ID NO: 219715 - DNA, 20 bp, Artificial Sequence
  chemically synthesized
tggataggtgattgaacaaa

SEQ ID NO: 219716 - DNA, 20 bp, Artificial Sequence
  chemically synthesized
gaacaaacagctctttgaaa

SEQ ID NO: 219717 - DNA, 20 bp, Artificial Sequence
  chemically synthesized
aaactcgtacctgtttcaaa

SEQ ID NO: 219718 - DNA, 20 bp, Artificial Sequence
  chemically synthesized
aacaaacagctctttgaaac

SEQ ID NO: 219719 - DNA, 20 bp, Artificial Sequence
  chemically synthesized
gaaaactcgtacctgtttca

SEQ ID NO: 219720 - DNA, 20 bp, Artificial Sequence
  chemically synthesized
cagctctttgaaacaggtac

SEQ ID NO: 219721 - DNA, 20 bp, Artificial Sequence
  chemically synthesized
ttttttatccttaagataac

SEQ ID NO: 219722 - DNA, 20 bp, Artificial Sequence
  chemically synthesized
acgagttttcttgttatctt

SEQ ID NO: 219723 - DNA, 20 bp, Artificial Sequence
  chemically synthesized
cgagttttcttgttatctta

SEQ ID NO: 219724 - DNA, 20 bp, Artificial Sequence
  chemically synthesized
ttcaggaattttttatcctt

SEQ ID NO: 219725 - DNA, 20 bp, Artificial Sequence
  chemically synthesized
ttaaggataaaaaattcctg

SEQ ID NO: 219726 - DNA, 20 bp, Artificial Sequence
  chemically synthesized
gataaaaaattcctgaagtt

SEQ ID NO: 219727 - DNA, 20 bp, Artificial Sequence
  chemically synthesized
acttaccccttctaaacttc

SEQ ID NO: 219728 - DNA, 20 bp, Artificial Sequence
  chemically synthesized
cacttaccccttctaaactt

SEQ ID NO: 219729 - DNA, 20 bp, Artificial Sequence
  chemically synthesized
aaaaaattcctgaagtttag

SEQ ID NO: 219730 - DNA, 20 bp, Artificial Sequence
  chemically synthesized
aaaaattcctgaagtttaga

SEQ ID NO: 219731 - DNA, 20 bp, Artificial Sequence
  chemically synthesized
aaaattcctgaagtttagaa

SEQ ID NO: 219732 - DNA, 20 bp, Artificial Sequence
  chemically synthesized
aaattcctgaagtttagaag

SEQ ID NO: 219733 - DNA, 20 bp, Artificial Sequence
  chemically synthesized
tcctgaagtttagaaggggt

SEQ ID NO: 219734 - DNA, 20 bp, Artificial Sequence
  chemically synthesized
agtttagaaggggtaagtga

SEQ ID NO: 219735 - DNA, 20 bp, Artificial Sequence
  chemically synthesized
gtttagaaggggtaagtgac

SEQ ID NO: 219736 - DNA, 20 bp, Artificial Sequence
  chemically synthesized
aaggggtaagtgacaggttc

SEQ ID NO: 219737 - DNA, 20 bp, Artificial Sequence
  chemically synthesized
gtgacaggttctagatcaca

SEQ ID NO: 219738 - DNA, 20 bp, Artificial Sequence
  chemically synthesized
ctgctggatgctatgtgatc

SEQ ID NO: 219739 - DNA, 20 bp, Artificial Sequence
  chemically synthesized
gttctagatcacatagcatc

SEQ ID NO: 219740 - DNA, 20 bp, Artificial Sequence
  chemically synthesized
ctagatcacatagcatccag

SEQ ID NO: 219741 - DNA, 20 bp, Artificial Sequence
  chemically synthesized
agatcacatagcatccagca

SEQ ID NO: 219742 - DNA, 20 bp, Artificial Sequence
  chemically synthesized
ctttcaatggttggctctgc

SEQ ID NO: 219743 - DNA, 20 bp, Artificial Sequence
  chemically synthesized
gtagtcttactttcaatggt

SEQ ID NO: 219744 - DNA, 20 bp, Artificial Sequence
  chemically synthesized
ccagcagagccaaccattga

SEQ ID NO: 219745 - DNA, 20 bp, Artificial Sequence
  chemically synthesized
gcatgtagtcttactttcaa

SEQ ID NO: 219746 - DNA, 20 bp, Artificial Sequence
  chemically synthesized
cagagccaaccattgaaagt

SEQ ID NO: 219747 - DNA, 20 bp, Artificial Sequence
  chemically synthesized
tatttggctagacaggcatg

SEQ ID NO: 219748 - DNA, 20 bp, Artificial Sequence
  chemically synthesized
agtaagactacatgcctgtc

SEQ ID NO: 219749 - DNA, 20 bp, Artificial Sequence
  chemically synthesized
ttcattttatttggctagac

SEQ ID NO: 219750 - DNA, 20 bp, Artificial Sequence
  chemically synthesized
attcattttatttggctaga

SEQ ID NO: 219751 - DNA, 20 bp, Artificial Sequence
  chemically synthesized
ccaaattcattttatttggc

SEQ ID NO: 219752 - DNA, 20 bp, Artificial Sequence
  chemically synthesized
gtgtccaaattcattttatt

SEQ ID NO: 219753 - DNA, 20 bp, Artificial Sequence
  chemically synthesized
ctagccaaataaaatgaatt

SEQ ID NO: 219754 - DNA, 20 bp, Artificial Sequence
  chemically synthesized
tgaatttggacacattgtga

SEQ ID NO: 219755 - DNA, 20 bp, Artificial Sequence
  chemically synthesized
aatttggacacattgtgatg

SEQ ID NO: 219756 - DNA, 20 bp, Artificial Sequence
  chemically synthesized
tggacacattgtgatggagc

SEQ ID NO: 219757 - DNA, 20 bp, Artificial Sequence
  chemically synthesized
ggacacattgtgatggagct

SEQ ID NO: 219758 - DNA, 20 bp, Artificial Sequence
  chemically synthesized
gacacattgtgatggagcta

SEQ ID NO: 219759 - DNA, 20 bp, Artificial Sequence
  chemically synthesized
tacatgatcttgacaatccc

SEQ ID NO: 219760 - DNA, 20 bp, Artificial Sequence
  chemically synthesized
tgatggagctagggattgtc

SEQ ID NO: 219761 - DNA, 20 bp, Artificial Sequence
  chemically synthesized
gggattgtcaagatcatgta

SEQ ID NO: 219762 - DNA, 20 bp, Artificial Sequence
  chemically synthesized
tccaatgcgacaagaatgtt

SEQ ID NO: 219763 - DNA, 20 bp, Artificial Sequence
  chemically synthesized
ttccaatgcgacaagaatgt

SEQ ID NO: 219764 - DNA, 20 bp, Artificial Sequence
  chemically synthesized
tcctaacattcttgtcgcat

SEQ ID NO: 219765 - DNA, 20 bp, Artificial Sequence
  chemically synthesized
tctgcgttttccaatgcgac

SEQ ID NO: 219766 - DNA, 20 bp, Artificial Sequence
  chemically synthesized
tcttgtcgcattggaaaacg

SEQ ID NO: 219767 - DNA, 20 bp, Artificial Sequence
  chemically synthesized
cagatattatcatgtattat

SEQ ID NO: 219768 - DNA, 20 bp, Artificial Sequence
  chemically synthesized
gtattatgagaataatttct

SEQ ID NO: 219769 - DNA, 20 bp, Artificial Sequence
  chemically synthesized
tatgagaataatttcttagt

SEQ ID NO: 219770 - DNA, 20 bp, Artificial Sequence
  chemically synthesized
atgagaataatttcttagtc

SEQ ID NO: 219771 - DNA, 20 bp, Artificial Sequence
  chemically synthesized
tgagaataatttcttagtca

SEQ ID NO: 219772 - DNA, 20 bp, Artificial Sequence
  chemically synthesized
actaatgaccatccctgact

SEQ ID NO: 219773 - DNA, 20 bp, Artificial Sequence
  chemically synthesized
aataatttcttagtcaggga

SEQ ID NO: 219774 - DNA, 20 bp, Artificial Sequence
  chemically synthesized
tcttagtcagggatggtcat

SEQ ID NO: 219775 - DNA, 20 bp, Artificial Sequence
  chemically synthesized
agggatggtcattagtgatg

SEQ ID NO: 219776 - DNA, 20 bp, Artificial Sequence
  chemically synthesized
gaagttatcttagttttaaa

SEQ ID NO: 219777 - DNA, 20 bp, Artificial Sequence
  chemically synthesized
tgaagttatcttagttttaa

SEQ ID NO: 219778 - DNA, 20 bp, Artificial Sequence
  chemically synthesized
agaaaaaaccctttaaaact

SEQ ID NO: 219779 - DNA, 20 bp, Artificial Sequence
  chemically synthesized
ttgaagttatcttagtttta

SEQ ID NO: 219780 - DNA, 20 bp, Artificial Sequence
  chemically synthesized
ccattttcttgaagttatct

SEQ ID NO: 219781 - DNA, 20 bp, Artificial Sequence
  chemically synthesized
tttaaaactaagataacttc

SEQ ID NO: 219782 - DNA, 20 bp, Artificial Sequence
  chemically synthesized
ttaaatgacccattttcttg

SEQ ID NO: 219783 - DNA, 20 bp, Artificial Sequence
  chemically synthesized
ctaagataacttcaagaaaa

SEQ ID NO: 219784 - DNA, 20 bp, Artificial Sequence
  chemically synthesized
taagataacttcaagaaaat

SEQ ID NO: 219785 - DNA, 20 bp, Artificial Sequence
  chemically synthesized
aaacagcagcagtagaacag

SEQ ID NO: 219786 - DNA, 20 bp, Artificial Sequence
  chemically synthesized
aaaacagcagcagtagaaca

SEQ ID NO: 219787 - DNA, 20 bp, Artificial Sequence
  chemically synthesized
gtaaaacagcagcagtagaa

SEQ ID NO: 219788 - DNA, 20 bp, Artificial Sequence
  chemically synthesized
gtcgtgtaaaacagcagcag

SEQ ID NO: 219789 - DNA, 20 bp, Artificial Sequence
  chemically synthesized
aatgtcgtgtaaaacagcag

SEQ ID NO: 219790 - DNA, 20 bp, Artificial Sequence
  chemically synthesized
gagaatgtcgtgtaaaacag

SEQ ID NO: 219791 - DNA, 20 bp, Artificial Sequence
  chemically synthesized
gaggagaatgtcgtgtaaaa

SEQ ID NO: 219792 - DNA, 20 bp, Artificial Sequence
  chemically synthesized
ttttacacgacattctcctc

SEQ ID NO: 219793 - DNA, 20 bp, Artificial Sequence
  chemically synthesized
tttacacgacattctcctct

SEQ ID NO: 219794 - DNA, 20 bp, Artificial Sequence
  chemically synthesized
tgaatacgtaatacctagag

SEQ ID NO: 219795 - DNA, 20 bp, Artificial Sequence
  chemically synthesized
actgaatacgtaatacctag

SEQ ID NO: 219796 - DNA, 20 bp, Artificial Sequence
  chemically synthesized
cactgaatacgtaataccta

SEQ ID NO: 219797 - DNA, 20 bp, Artificial Sequence
  chemically synthesized
tccactgaatacgtaatacc

SEQ ID NO: 219798 - DNA, 20 bp, Artificial Sequence
  chemically synthesized
tcctctaggtattacgtatt

SEQ ID NO: 219799 - DNA, 20 bp, Artificial Sequence
  chemically synthesized
tctaggtattacgtattcag

SEQ ID NO: 219800 - DNA, 20 bp, Artificial Sequence
  chemically synthesized
cgtattcagtggaaaatatt

SEQ ID NO: 219801 - DNA, 20 bp, Artificial Sequence
  chemically synthesized
aatatttagtgcttgtaata

SEQ ID NO: 219802 - DNA, 20 bp, Artificial Sequence
  chemically synthesized
ccattggcttactttattac

SEQ ID NO: 219803 - DNA, 20 bp, Artificial Sequence
  chemically synthesized
tttagtgcttgtaataaagt

SEQ ID NO: 219804 - DNA, 20 bp, Artificial Sequence
  chemically synthesized
cttgtaataaagtaagccaa

SEQ ID NO: 219805 - DNA, 20 bp, Artificial Sequence
  chemically synthesized
atacttcacaatatggccat

SEQ ID NO: 219806 - DNA, 20 bp, Artificial Sequence
  chemically synthesized
aagccaatggccatattgtg

SEQ ID NO: 219807 - DNA, 20 bp, Artificial Sequence
  chemically synthesized
gagcactatacttcacaata

SEQ ID NO: 219808 - DNA, 20 bp, Artificial Sequence
  chemically synthesized
aatggccatattgtgaagta

SEQ ID NO: 219809 - DNA, 20 bp, Artificial Sequence
  chemically synthesized
tgaagtatagtgctctacac

SEQ ID NO: 219810 - DNA, 20 bp, Artificial Sequence
  chemically synthesized
gtcttctgacatccagtgta

SEQ ID NO: 219811 - DNA, 20 bp, Artificial Sequence
  chemically synthesized
aggtcttctgacatccagtg

SEQ ID NO: 219812 - DNA, 20 bp, Artificial Sequence
  chemically synthesized
tagtgctctacactggatgt

SEQ ID NO: 219813 - DNA, 20 bp, Artificial Sequence
  chemically synthesized
cactgaggtcttctgacatc

SEQ ID NO: 219814 - DNA, 20 bp, Artificial Sequence
  chemically synthesized
tgctctacactggatgtcag

SEQ ID NO: 219815 - DNA, 20 bp, Artificial Sequence
  chemically synthesized
cactggatgtcagaagacct

SEQ ID NO: 219816 - DNA, 20 bp, Artificial Sequence
  chemically synthesized
atgtcagaagacctcagtgc

SEQ ID NO: 219817 - DNA, 20 bp, Artificial Sequence
  chemically synthesized
agaagcagggtctggcactg

SEQ ID NO: 219818 - DNA, 20 bp, Artificial Sequence
  chemically synthesized
aagaagcagggtctggcact

SEQ ID NO: 219819 - DNA, 20 bp, Artificial Sequence
  chemically synthesized
ctgtgtgaagaagcagggtc

SEQ ID NO: 219820 - DNA, 20 bp, Artificial Sequence
  chemically synthesized
aactactgtgtgaagaagca

SEQ ID NO: 219821 - DNA, 20 bp, Artificial Sequence
  chemically synthesized
caactactgtgtgaagaagc

SEQ ID NO: 219822 - DNA, 20 bp, Artificial Sequence
  chemically synthesized
ccaactactgtgtgaagaag

SEQ ID NO: 219823 - DNA, 20 bp, Artificial Sequence
  chemically synthesized
ccagaccctgcttcttcaca

SEQ ID NO: 219824 - DNA, 20 bp, Artificial Sequence
  chemically synthesized
cctccaactactgtgtgaag

SEQ ID NO: 219825 - DNA, 20 bp, Artificial Sequence
  chemically synthesized
gaccctgcttcttcacacag

SEQ ID NO: 219826 - DNA, 20 bp, Artificial Sequence
  chemically synthesized
taccctccaactactgtgtg

SEQ ID NO: 219827 - DNA, 20 bp, Artificial Sequence
  chemically synthesized
ctgcttcttcacacagtagt

SEQ ID NO: 219828 - DNA, 20 bp, Artificial Sequence
  chemically synthesized
gcttcttcacacagtagttg

SEQ ID NO: 219829 - DNA, 20 bp, Artificial Sequence
  chemically synthesized
cttcttcacacagtagttgg

SEQ ID NO: 219830 - DNA, 20 bp, Artificial Sequence
  chemically synthesized
ttcttcacacagtagttgga

SEQ ID NO: 219831 - DNA, 20 bp, Artificial Sequence
  chemically synthesized
cacacagtagttggagggta

SEQ ID NO: 219832 - DNA, 20 bp, Artificial Sequence
  chemically synthesized
gttggagggtaaagtcatct

SEQ ID NO: 219833 - DNA, 20 bp, Artificial Sequence
  chemically synthesized
gtaaagtcatctgagactgt

SEQ ID NO: 219834 - DNA, 20 bp, Artificial Sequence
  chemically synthesized
aattacggaactgacagtct

SEQ ID NO: 219835 - DNA, 20 bp, Artificial Sequence
  chemically synthesized
ttttaaaattacggaactga

SEQ ID NO: 219836 - DNA, 20 bp, Artificial Sequence
  chemically synthesized
ctttttccattttaaaatta

SEQ ID NO: 219837 - DNA, 20 bp, Artificial Sequence
  chemically synthesized
tcagttccgtaattttaaaa

SEQ ID NO: 219838 - DNA, 20 bp, Artificial Sequence
  chemically synthesized
ccgtaattttaaaatggaaa

SEQ ID NO: 219839 - DNA, 20 bp, Artificial Sequence
  chemically synthesized
gtcccttgaggttgatatga

SEQ ID NO: 219840 - DNA, 20 bp, Artificial Sequence
  chemically synthesized
atatctgtcatatcaacctc

SEQ ID NO: 219841 - DNA, 20 bp, Artificial Sequence
  chemically synthesized
tatctgtcatatcaacctca

SEQ ID NO: 219842 - DNA, 20 bp, Artificial Sequence
  chemically synthesized
atctgtcatatcaacctcaa

SEQ ID NO: 219843 - DNA, 20 bp, Artificial Sequence
  chemically synthesized
attgatctctcagtcccttg

SEQ ID NO: 219844 - DNA, 20 bp, Artificial Sequence
  chemically synthesized
cattgatctctcagtccctt

SEQ ID NO: 219845 - DNA, 20 bp, Artificial Sequence
  chemically synthesized
catatcaacctcaagggact

SEQ ID NO: 219846 - DNA, 20 bp, Artificial Sequence
  chemically synthesized
tatcaacctcaagggactga

SEQ ID NO: 219847 - DNA, 20 bp, Artificial Sequence
  chemically synthesized
catcatctccattgatctct

SEQ ID NO: 219848 - DNA, 20 bp, Artificial Sequence
  chemically synthesized
tcaagggactgagagatcaa

SEQ ID NO: 219849 - DNA, 20 bp, Artificial Sequence
  chemically synthesized
aagggactgagagatcaatg

SEQ ID NO: 219850 - DNA, 20 bp, Artificial Sequence
  chemically synthesized
tgagagatcaatggagatga

SEQ ID NO: 219851 - DNA, 20 bp, Artificial Sequence
  chemically synthesized
aatggagatgatggctataa

SEQ ID NO: 219852 - DNA, 20 bp, Artificial Sequence
  chemically synthesized
gcatttaaaatgtgctttta

SEQ ID NO: 219853 - DNA, 20 bp, Artificial Sequence
  chemically synthesized
taaaagcacattttaaatgc

SEQ ID NO: 219854 - DNA, 20 bp, Artificial Sequence
  chemically synthesized
aaagcacattttaaatgcca

SEQ ID NO: 219855 - DNA, 20 bp, Artificial Sequence
  chemically synthesized
aagcacattttaaatgccag

SEQ ID NO: 219856 - DNA, 20 bp, Artificial Sequence
  chemically synthesized
agcacattttaaatgccaga

SEQ ID NO: 219857 - DNA, 20 bp, Artificial Sequence
  chemically synthesized
cttccatttttatatccctc

SEQ ID NO: 219858 - DNA, 20 bp, Artificial Sequence
  chemically synthesized
atgccagagggatataaaaa

SEQ ID NO: 219859 - DNA, 20 bp, Artificial Sequence
  chemically synthesized
ccagagggatataaaaatgg

SEQ ID NO: 219860 - DNA, 20 bp, Artificial Sequence
  chemically synthesized
cagagggatataaaaatgga

SEQ ID NO: 219861 - DNA, 20 bp, Artificial Sequence
  chemically synthesized
catccctaaataacaatgat

SEQ ID NO: 219862 - DNA, 20 bp, Artificial Sequence
  chemically synthesized
tcatccctaaataacaatga

SEQ ID NO: 219863 - DNA, 20 bp, Artificial Sequence
  chemically synthesized
aaggtcccatcattgttatt

SEQ ID NO: 219864 - DNA, 20 bp, Artificial Sequence
  chemically synthesized
aggtcccatcattgttattt

SEQ ID NO: 219865 - DNA, 20 bp, Artificial Sequence
  chemically synthesized
ggtcccatcattgttattta

SEQ ID NO: 219866 - DNA, 20 bp, Artificial Sequence
  chemically synthesized
atcattgttatttagggatg

SEQ ID NO: 219867 - DNA, 20 bp, Artificial Sequence
  chemically synthesized
tcattgttatttagggatga

SEQ ID NO: 219868 - DNA, 20 bp, Artificial Sequence
  chemically synthesized
ctgaacacatatagattaaa

SEQ ID NO: 219869 - DNA, 20 bp, Artificial Sequence
  chemically synthesized
tatatgttactgaacacata

SEQ ID NO: 219870 - DNA, 20 bp, Artificial Sequence
  chemically synthesized
ctttttaatctatatgtgtt

SEQ ID NO: 219871 - DNA, 20 bp, Artificial Sequence
  chemically synthesized
ttcagtaacatatattgcat

SEQ ID NO: 219872 - DNA, 20 bp, Artificial Sequence
  chemically synthesized
acatatattgcatgagaaaa

SEQ ID NO: 219873 - DNA, 20 bp, Artificial Sequence
  chemically synthesized
catatattgcatgagaaaat

SEQ ID NO: 219874 - DNA, 20 bp, Artificial Sequence
  chemically synthesized
atacaaaaatacaatattaa

SEQ ID NO: 219875 - DNA, 20 bp, Artificial Sequence
  chemically synthesized
tagatataatgcttacctat

SEQ ID NO: 219876 - DNA, 20 bp, Artificial Sequence
  chemically synthesized
agatataatgcttacctata

SEQ ID NO: 219877 - DNA, 20 bp, Artificial Sequence
  chemically synthesized
aacaaattgaccttataggt

SEQ ID NO: 219878 - DNA, 20 bp, Artificial Sequence
  chemically synthesized
tcaaaacaaattgaccttat

SEQ ID NO: 219879 - DNA, 20 bp, Artificial Sequence
  chemically synthesized
gtcaaaacaaattgacctta

SEQ ID NO: 219880 - DNA, 20 bp, Artificial Sequence
  chemically synthesized
aatttgttttgacctaaatt

SEQ ID NO: 219881 - DNA, 20 bp, Artificial Sequence
  chemically synthesized
atgttgcctaatctaaattt

SEQ ID NO: 219882 - DNA, 20 bp, Artificial Sequence
  chemically synthesized
catgttgcctaatctaaatt

SEQ ID NO: 219883 - DNA, 20 bp, Artificial Sequence
  chemically synthesized
gttttgacctaaatttagat

SEQ ID NO: 219884 - DNA, 20 bp, Artificial Sequence
  chemically synthesized
ttttgacctaaatttagatt

SEQ ID NO: 219885 - DNA, 20 bp, Artificial Sequence
  chemically synthesized
taggcaacatgttgcataaa

SEQ ID NO: 219886 - DNA, 20 bp, Artificial Sequence
  chemically synthesized
aggcaacatgttgcataaat

SEQ ID NO: 219887 - DNA, 20 bp, Artificial Sequence
  chemically synthesized
caacatgttgcataaatggg

SEQ ID NO: 219888 - DNA, 20 bp, Artificial Sequence
  chemically synthesized
aacatgttgcataaatgggt

SEQ ID NO: 219889 - DNA, 20 bp, Artificial Sequence
  chemically synthesized
tgttgcataaatgggtgggt

SEQ ID NO: 219890 - DNA, 20 bp, Artificial Sequence
  chemically synthesized
ataaatgggtgggtcagtaa

SEQ ID NO: 219891 - DNA, 20 bp, Artificial Sequence
  chemically synthesized
gcttccttgcacatttttta

SEQ ID NO: 219892 - DNA, 20 bp, Artificial Sequence
  chemically synthesized
ttgcttccttgcacattttt

SEQ ID NO: 219893 - DNA, 20 bp, Artificial Sequence
  chemically synthesized
tgtcactctaaaaaatgtgc

SEQ ID NO: 219894 - DNA, 20 bp, Artificial Sequence
  chemically synthesized
gtcactctaaaaaatgtgca

SEQ ID NO: 219895 - DNA, 20 bp, Artificial Sequence
  chemically synthesized
actctaaaaaatgtgcaagg

SEQ ID NO: 219896 - DNA, 20 bp, Artificial Sequence
  chemically synthesized
aaggaagcaactgtccatca

SEQ ID NO: 219897 - DNA, 20 bp, Artificial Sequence
  chemically synthesized
agtaatttgaccatgatgga

SEQ ID NO: 219898 - DNA, 20 bp, Artificial Sequence
  chemically synthesized
ctgaagtaatttgaccatga

SEQ ID NO: 219899 - DNA, 20 bp, Artificial Sequence
  chemically synthesized
ccatcatggtcaaattactt

SEQ ID NO: 219900 - DNA, 20 bp, Artificial Sequence
  chemically synthesized
tcatgaattcaaggcatctg

SEQ ID NO: 219901 - DNA, 20 bp, Artificial Sequence
  chemically synthesized
gtgttttattcatgaattca

SEQ ID NO: 219902 - DNA, 20 bp, Artificial Sequence
  chemically synthesized
agtgttttattcatgaattc

SEQ ID NO: 219903 - DNA, 20 bp, Artificial Sequence
  chemically synthesized
gagatgcataaaatttgatg

SEQ ID NO: 219904 - DNA, 20 bp, Artificial Sequence
  chemically synthesized
ttgagatgcataaaatttga

SEQ ID NO: 219905 - DNA, 20 bp, Artificial Sequence
  chemically synthesized
catcaaattttatgcatctc

SEQ ID NO: 219906 - DNA, 20 bp, Artificial Sequence
  chemically synthesized
taaatgtgtgagaagtgctt

SEQ ID NO: 219907 - DNA, 20 bp, Artificial Sequence
  chemically synthesized
tgtggatttaaatgtgtgag

SEQ ID NO: 219908 - DNA, 20 bp, Artificial Sequence
  chemically synthesized
tgttgtggatttaaatgtgt

SEQ ID NO: 219909 - DNA, 20 bp, Artificial Sequence
  chemically synthesized
cctacctcactaggatgttg

SEQ ID NO: 219910 - DNA, 20 bp, Artificial Sequence
  chemically synthesized
catttaaatccacaacatcc

SEQ ID NO: 219911 - DNA, 20 bp, Artificial Sequence
  chemically synthesized
taaatccacaacatcctagt

SEQ ID NO: 219912 - DNA, 20 bp, Artificial Sequence
  chemically synthesized
aaatccacaacatcctagtg

SEQ ID NO: 219913 - DNA, 20 bp, Artificial Sequence
  chemically synthesized
tccacaacatcctagtgagg

SEQ ID NO: 219914 - DNA, 20 bp, Artificial Sequence
  chemically synthesized
tcctccttccctacctcact

SEQ ID NO: 219915 - DNA, 20 bp, Artificial Sequence
  chemically synthesized
ccacaacatcctagtgaggt

SEQ ID NO: 219916 - DNA, 20 bp, Artificial Sequence
  chemically synthesized
ttcctccttccctacctcac

SEQ ID NO: 219917 - DNA, 20 bp, Artificial Sequence
  chemically synthesized
cacaacatcctagtgaggta

SEQ ID NO: 219918 - DNA, 20 bp, Artificial Sequence
  chemically synthesized
aacatcctagtgaggtaggg

SEQ ID NO: 219919 - DNA, 20 bp, Artificial Sequence
  chemically synthesized
acatcctagtgaggtaggga

SEQ ID NO: 219920 - DNA, 20 bp, Artificial Sequence
  chemically synthesized
atcctagtgaggtagggaag

SEQ ID NO: 219921 - DNA, 20 bp, Artificial Sequence
  chemically synthesized
tcctagtgaggtagggaagg

SEQ ID NO: 219922 - DNA, 20 bp, Artificial Sequence
  chemically synthesized
aatatttcatttttcttatt

SEQ ID NO: 219923 - DNA, 20 bp, Artificial Sequence
  chemically synthesized
ttatcctcatttcaccaaat

SEQ ID NO: 219924 - DNA, 20 bp, Artificial Sequence
  chemically synthesized
tttttcttatttggtgaaat

SEQ ID NO: 219925 - DNA, 20 bp, Artificial Sequence
  chemically synthesized
ttttcttatttggtgaaatg

SEQ ID NO: 219926 - DNA, 20 bp, Artificial Sequence
  chemically synthesized
tttggtgaaatgaggataat

SEQ ID NO: 219927 - DNA, 20 bp, Artificial Sequence
  chemically synthesized
ttggtgaaatgaggataatg

SEQ ID NO: 219928 - DNA, 20 bp, Artificial Sequence
  chemically synthesized
aaatgaggataatgaggcac

SEQ ID NO: 219929 - DNA, 20 bp, Artificial Sequence
  chemically synthesized
aatgaggataatgaggcaca

SEQ ID NO: 219930 - DNA, 20 bp, Artificial Sequence
  chemically synthesized
tgaggataatgaggcacaag

SEQ ID NO: 219931 - DNA, 20 bp, Artificial Sequence
  chemically synthesized
gaggataatgaggcacaagg

SEQ ID NO: 219932 - DNA, 20 bp, Artificial Sequence
  chemically synthesized
aggcacaaggaggttaatga

SEQ ID NO: 219933 - DNA, 20 bp, Artificial Sequence
  chemically synthesized
ggaggttaatgatagatttg

SEQ ID NO: 219934 - DNA, 20 bp, Artificial Sequence
  chemically synthesized
agatttgaagtgaatgcaat

SEQ ID NO: 219935 - DNA, 20 bp, Artificial Sequence
  chemically synthesized
ttgaagtgaatgcaatcagt

SEQ ID NO: 219936 - DNA, 20 bp, Artificial Sequence
  chemically synthesized
aagtgaatgcaatcagtcag

SEQ ID NO: 219937 - DNA, 20 bp, Artificial Sequence
  chemically synthesized
atcagtcagcagcaaaacca

SEQ ID NO: 219938 - DNA, 20 bp, Artificial Sequence
  chemically synthesized
gtcagcagcaaaaccatggt

SEQ ID NO: 219939 - DNA, 20 bp, Artificial Sequence
  chemically synthesized
gggaacctaaattccaacca

SEQ ID NO: 219940 - DNA, 20 bp, Artificial Sequence
  chemically synthesized
gcaaaaccatggttggaatt

SEQ ID NO: 219941 - DNA, 20 bp, Artificial Sequence
  chemically synthesized
caaaaccatggttggaattt

SEQ ID NO: 219942 - DNA, 20 bp, Artificial Sequence
  chemically synthesized
agaaccctaagtggaattca

SEQ ID NO: 219943 - DNA, 20 bp, Artificial Sequence
  chemically synthesized
aagaaccctaagtggaattc

SEQ ID NO: 219944 - DNA, 20 bp, Artificial Sequence
  chemically synthesized
aaagaaccctaagtggaatt

SEQ ID NO: 219945 - DNA, 20 bp, Artificial Sequence
  chemically synthesized
taggttccctgaattccact

SEQ ID NO: 219946 - DNA, 20 bp, Artificial Sequence
  chemically synthesized
aggttccctgaattccactt

SEQ ID NO: 219947 - DNA, 20 bp, Artificial Sequence
  chemically synthesized
ggttccctgaattccactta

SEQ ID NO: 219948 - DNA, 20 bp, Artificial Sequence
  chemically synthesized
atctcgaaaagaaccctaag

SEQ ID NO: 219949 - DNA, 20 bp, Artificial Sequence
  chemically synthesized
agtatctcgaaaagaaccct

SEQ ID NO: 219950 - DNA, 20 bp, Artificial Sequence
  chemically synthesized
ttccacttagggttcttttc

SEQ ID NO: 219951 - DNA, 20 bp, Artificial Sequence
  chemically synthesized
agttaacgtagtatctcgaa

SEQ ID NO: 219952 - DNA, 20 bp, Artificial Sequence
  chemically synthesized
acaatgaaatgtagttaacg

SEQ ID NO: 219953 - DNA, 20 bp, Artificial Sequence
  chemically synthesized
attcctccaacaatgaaatg

SEQ ID NO: 219954 - DNA, 20 bp, Artificial Sequence
  chemically synthesized
cgttaactacatttcattgt

SEQ ID NO: 219955 - DNA, 20 bp, Artificial Sequence
  chemically synthesized
ttaactacatttcattgttg

SEQ ID NO: 219956 - DNA, 20 bp, Artificial Sequence
  chemically synthesized
taactacatttcattgttgg

SEQ ID NO: 219957 - DNA, 20 bp, Artificial Sequence
  chemically synthesized
attgttggaggaatttaatt

SEQ ID NO: 219958 - DNA, 20 bp, Artificial Sequence
  chemically synthesized
aggaatttaattcagtcatg

SEQ ID NO: 219959 - DNA, 20 bp, Artificial Sequence
  chemically synthesized
ttaattcagtcatgtagata

SEQ ID NO: 219960 - DNA, 20 bp, Artificial Sequence
  chemically synthesized
aggatgaaaaaagatgttgt

SEQ ID NO: 219961 - DNA, 20 bp, Artificial Sequence
  chemically synthesized
attccttagtaggatgaaaa

SEQ ID NO: 219962 - DNA, 20 bp, Artificial Sequence
  chemically synthesized
acatcttttttcatcctact

SEQ ID NO: 219963 - DNA, 20 bp, Artificial Sequence
  chemically synthesized
catcttttttcatcctacta

SEQ ID NO: 219964 - DNA, 20 bp, Artificial Sequence
  chemically synthesized
tagcagcaagattccttagt

SEQ ID NO: 219965 - DNA, 20 bp, Artificial Sequence
  chemically synthesized
ttagcagcaagattccttag

SEQ ID NO: 219966 - DNA, 20 bp, Artificial Sequence
  chemically synthesized
gaattagcagcaagattcct

SEQ ID NO: 219967 - DNA, 20 bp, Artificial Sequence
  chemically synthesized
tcagtggttgaattagcagc

SEQ ID NO: 219968 - DNA, 20 bp, Artificial Sequence
  chemically synthesized
tgtctcagtggttgaattag

SEQ ID NO: 219969 - DNA, 20 bp, Artificial Sequence
  chemically synthesized
atttgtctcagtggttgaat

SEQ ID NO: 219970 - DNA, 20 bp, Artificial Sequence
  chemically synthesized
ttgctgctaattcaaccact

SEQ ID NO: 219971 - DNA, 20 bp, Artificial Sequence
  chemically synthesized
ccacgtattatttgtctcag

SEQ ID NO: 219972 - DNA, 20 bp, Artificial Sequence
  chemically synthesized
ggtccacgtattatttgtct

SEQ ID NO: 219973 - DNA, 20 bp, Artificial Sequence
  chemically synthesized
ccactgagacaaataatacg

SEQ ID NO: 219974 - DNA, 20 bp, Artificial Sequence
  chemically synthesized
aataatacgtggacctgcgc

SEQ ID NO: 219975 - DNA, 20 bp, Artificial Sequence
  chemically synthesized
taatacgtggacctgcgctg

SEQ ID NO: 219976 - DNA, 20 bp, Artificial Sequence
  chemically synthesized
cgaagccaaatctccagcgc

SEQ ID NO: 219977 - DNA, 20 bp, Artificial Sequence
  chemically synthesized
ccgaagccaaatctccagcg

SEQ ID NO: 219978 - DNA, 20 bp, Artificial Sequence
  chemically synthesized
gtggacctgcgctggagatt

SEQ ID NO: 219979 - DNA, 20 bp, Artificial Sequence
  chemically synthesized
gaacaccgaagccaaatctc

SEQ ID NO: 219980 - DNA, 20 bp, Artificial Sequence
  chemically synthesized
ctgcgctggagatttggctt

SEQ ID NO: 219981 - DNA, 20 bp, Artificial Sequence
  chemically synthesized
aatgacttgaatgaacaccg

SEQ ID NO: 219982 - DNA, 20 bp, Artificial Sequence
  chemically synthesized
tttggcttcggtgttcattc

SEQ ID NO: 219983 - DNA, 20 bp, Artificial Sequence
  chemically synthesized
gttcattcaagtcatttcct

SEQ ID NO: 219984 - DNA, 20 bp, Artificial Sequence
  chemically synthesized
aaaggaacagaagttagctc

SEQ ID NO: 219985 - DNA, 20 bp, Artificial Sequence
  chemically synthesized
aaaaggaacagaagttagct

SEQ ID NO: 219986 - DNA, 20 bp, Artificial Sequence
  chemically synthesized
ataggaaaaggaacagaagt

SEQ ID NO: 219987 - DNA, 20 bp, Artificial Sequence
  chemically synthesized
attcataggaaaaggaacag

SEQ ID NO: 219988 - DNA, 20 bp, Artificial Sequence
  chemically synthesized
agtattcataggaaaaggaa

SEQ ID NO: 219989 - DNA, 20 bp, Artificial Sequence
  chemically synthesized
aatatagtattcataggaaa

SEQ ID NO: 219990 - DNA, 20 bp, Artificial Sequence
  chemically synthesized
aaatatagtattcataggaa

SEQ ID NO: 219991 - DNA, 20 bp, Artificial Sequence
  chemically synthesized
tgaaaaaatatagtattcat

SEQ ID NO: 219992 - DNA, 20 bp, Artificial Sequence
  chemically synthesized
gtgaaaaaatatagtattca

SEQ ID NO: 219993 - DNA, 20 bp, Artificial Sequence
  chemically synthesized
tggtataatgtgaaaaaata

SEQ ID NO: 219994 - DNA, 20 bp, Artificial Sequence
  chemically synthesized
aatgaatctgaataattcag

SEQ ID NO: 219995 - DNA, 20 bp, Artificial Sequence
  chemically synthesized
cattataccactgaattatt

SEQ ID NO: 219996 - DNA, 20 bp, Artificial Sequence
  chemically synthesized
ttcaatgaatctgaataatt

SEQ ID NO: 219997 - DNA, 20 bp, Artificial Sequence
  chemically synthesized
tcagattcattgaataccct

SEQ ID NO: 219998 - DNA, 20 bp, Artificial Sequence
  chemically synthesized
agattcattgaataccctta

SEQ ID NO: 219999 - DNA, 20 bp, Artificial Sequence
  chemically synthesized
taacatgttaataactctaa

SEQ ID NO: 220000 - DNA, 20 bp, Artificial Sequence
  chemically synthesized
ataacatgttaataactcta

SEQ ID NO: 220001 - DNA, 20 bp, Artificial Sequence
  chemically synthesized
tataacatgttaataactct

SEQ ID NO: 220002 - DNA, 20 bp, Artificial Sequence
  chemically synthesized
ggagaaagcagtaatttttt

SEQ ID NO: 220003 - DNA, 20 bp, Artificial Sequence
  chemically synthesized
atataaccaaaaggagaaag

SEQ ID NO: 220004 - DNA, 20 bp, Artificial Sequence
  chemically synthesized
gctatataaccaaaaggaga

SEQ ID NO: 220005 - DNA, 20 bp, Artificial Sequence
  chemically synthesized
aaattactgctttctccttt

SEQ ID NO: 220006 - DNA, 20 bp, Artificial Sequence
  chemically synthesized
tctagctatataaccaaaag

SEQ ID NO: 220007 - DNA, 20 bp, Artificial Sequence
  chemically synthesized
tttctagctatataaccaaa

SEQ ID NO: 220008 - DNA, 20 bp, Artificial Sequence
  chemically synthesized
ctttctagctatataaccaa

SEQ ID NO: 220009 - DNA, 20 bp, Artificial Sequence
  chemically synthesized
gctttctccttttggttata

SEQ ID NO: 220010 - DNA, 20 bp, Artificial Sequence
  chemically synthesized
tctccttttggttatatagc

SEQ ID NO: 220011 - DNA, 20 bp, Artificial Sequence
  chemically synthesized
cttttggttatatagctaga

SEQ ID NO: 220012 - DNA, 20 bp, Artificial Sequence
  chemically synthesized
tggttatatagctagaaagt

SEQ ID NO: 220013 - DNA, 20 bp, Artificial Sequence
  chemically synthesized
ggttatatagctagaaagtc

SEQ ID NO: 220014 - DNA, 20 bp, Artificial Sequence
  chemically synthesized
tttactatatcctgactttc

SEQ ID NO: 220015 - DNA, 20 bp, Artificial Sequence
  chemically synthesized
atagctagaaagtcaggata

SEQ ID NO: 220016 - DNA, 20 bp, Artificial Sequence
  chemically synthesized
agaaagtcaggatatagtaa

SEQ ID NO: 220017 - DNA, 20 bp, Artificial Sequence
  chemically synthesized
gaaagtcaggatatagtaaa

SEQ ID NO: 220018 - DNA, 20 bp, Artificial Sequence
  chemically synthesized
aagtcaggatatagtaaaag

SEQ ID NO: 220019 - DNA, 20 bp, Artificial Sequence
  chemically synthesized
gtaaaaggagacccaaaatg

SEQ ID NO: 220020 - DNA, 20 bp, Artificial Sequence
  chemically synthesized
taaaaggagacccaaaatgt

SEQ ID NO: 220021 - DNA, 20 bp, Artificial Sequence
  chemically synthesized
attttcaaaacctacatttt

SEQ ID NO: 220022 - DNA, 20 bp, Artificial Sequence
  chemically synthesized
tattttcaaaacctacattt

SEQ ID NO: 220023 - DNA, 20 bp, Artificial Sequence
  chemically synthesized
caaaatgtaggttttgaaaa

SEQ ID NO: 220024 - DNA, 20 bp, Artificial Sequence
  chemically synthesized
aggttttgaaaatagaacgt

SEQ ID NO: 220025 - DNA, 20 bp, Artificial Sequence
  chemically synthesized
aaaatagaacgtcagttttt

SEQ ID NO: 220026 - DNA, 20 bp, Artificial Sequence
  chemically synthesized
aaatagaacgtcagtttttg

SEQ ID NO: 220027 - DNA, 20 bp, Artificial Sequence
  chemically synthesized
ggaagaaaaacaaaagtgtg

SEQ ID NO: 220028 - DNA, 20 bp, Artificial Sequence
  chemically synthesized
tgagatgggaagaaaaacaa

SEQ ID NO: 220029 - DNA, 20 bp, Artificial Sequence
  chemically synthesized
ggagtgatcaatgagatggg

SEQ ID NO: 220030 - DNA, 20 bp, Artificial Sequence
  chemically synthesized
aaaggagtgatcaatgagat

SEQ ID NO: 220031 - DNA, 20 bp, Artificial Sequence
  chemically synthesized
aaaaggagtgatcaatgaga

SEQ ID NO: 220032 - DNA, 20 bp, Artificial Sequence
  chemically synthesized
aaagaaaaggagtgatcaat

SEQ ID NO: 220033 - DNA, 20 bp, Artificial Sequence
  chemically synthesized
aaaaaaaaagaaaagaaaag

SEQ ID NO: 220034 - DNA, 20 bp, Artificial Sequence
  chemically synthesized
aaaaaaaaaaagaaaagaaa

SEQ ID NO: 220035 - DNA, 20 bp, Artificial Sequence
  chemically synthesized
aaaaaaaaaaaagaaaagaa

SEQ ID NO: 220036 - DNA, 20 bp, Artificial Sequence
  chemically synthesized
aaaaaaaaaaaaaaaaagaa

SEQ ID NO: 220037 - DNA, 20 bp, Artificial Sequence
  chemically synthesized
aaaaaaaaaaaaaaaaaaaa

SEQ ID NO: 220038 - DNA, 20 bp, Artificial Sequence
  chemically synthesized
tttttttttttttttttttt

SEQ ID NO: 220039 - DNA, 20 bp, Artificial Sequence
  chemically synthesized
tttttttttttttttagatg

SEQ ID NO: 220040 - DNA, 20 bp, Artificial Sequence
  chemically synthesized
tccaacctgggcgatggagc

SEQ ID NO: 220041 - DNA, 20 bp, Artificial Sequence
  chemically synthesized
tgaagtctcgctccatcgcc

SEQ ID NO: 220042 - DNA, 20 bp, Artificial Sequence
  chemically synthesized
gcgctccaacctgggcgatg

SEQ ID NO: 220043 - DNA, 20 bp, Artificial Sequence
  chemically synthesized
gaagtctcgctccatcgccc

SEQ ID NO: 220044 - DNA, 20 bp, Artificial Sequence
  chemically synthesized
ctgcgctccaacctgggcga

SEQ ID NO: 220045 - DNA, 20 bp, Artificial Sequence
  chemically synthesized
tctcgctccatcgcccaggt

SEQ ID NO: 220046 - DNA, 20 bp, Artificial Sequence
  chemically synthesized
tcgctccatcgcccaggttg

SEQ ID NO: 220047 - DNA, 20 bp, Artificial Sequence
  chemically synthesized
gtgccactgcgctccaacct

SEQ ID NO: 220048 - DNA, 20 bp, Artificial Sequence
  chemically synthesized
tgtgccactgcgctccaacc

SEQ ID NO: 220049 - DNA, 20 bp, Artificial Sequence
  chemically synthesized
ccatcgcccaggttggagcg

SEQ ID NO: 220050 - DNA, 20 bp, Artificial Sequence
  chemically synthesized
tcgcccaggttggagcgcag

SEQ ID NO: 220051 - DNA, 20 bp, Artificial Sequence
  chemically synthesized
agcgcagtggcacaatcttt

SEQ ID NO: 220052 - DNA, 20 bp, Artificial Sequence
  chemically synthesized
cagaggttgcagtgagccaa

SEQ ID NO: 220053 - DNA, 20 bp, Artificial Sequence
  chemically synthesized
taggagacagaggttgcagt

SEQ ID NO: 220054 - DNA, 20 bp, Artificial Sequence
  chemically synthesized
tacctaggagacagaggttg

SEQ ID NO: 220055 - DNA, 20 bp, Artificial Sequence
  chemically synthesized
tgcttgtacctaggagacag

SEQ ID NO: 220056 - DNA, 20 bp, Artificial Sequence
  chemically synthesized
tcactgcaacctctgtctcc

SEQ ID NO: 220057 - DNA, 20 bp, Artificial Sequence
  chemically synthesized
ttgcttgtacctaggagaca

SEQ ID NO: 220058 - DNA, 20 bp, Artificial Sequence
  chemically synthesized
cactgcaacctctgtctcct

SEQ ID NO: 220059 - DNA, 20 bp, Artificial Sequence
  chemically synthesized
aattgcttgtacctaggaga

SEQ ID NO: 220060 - DNA, 20 bp, Artificial Sequence
  chemically synthesized
gaagaattgcttgtacctag

SEQ ID NO: 220061 - DNA, 20 bp, Artificial Sequence
  chemically synthesized
aacctctgtctcctaggtac

SEQ ID NO: 220062 - DNA, 20 bp, Artificial Sequence
  chemically synthesized
cagaagaattgcttgtacct

SEQ ID NO: 220063 - DNA, 20 bp, Artificial Sequence
  chemically synthesized
gcagaagaattgcttgtacc

SEQ ID NO: 220064 - DNA, 20 bp, Artificial Sequence
  chemically synthesized
tacaagcaattcttctgcct

SEQ ID NO: 220065 - DNA, 20 bp, Artificial Sequence
  chemically synthesized
tgctctggaggctgaggcag

SEQ ID NO: 220066 - DNA, 20 bp, Artificial Sequence
  chemically synthesized
agctgctctggaggctgagg

SEQ ID NO: 220067 - DNA, 20 bp, Artificial Sequence
  chemically synthesized
aattcttctgcctcagcctc

SEQ ID NO: 220068 - DNA, 20 bp, Artificial Sequence
  chemically synthesized
cccagctgctctggaggctg

SEQ ID NO: 220069 - DNA, 20 bp, Artificial Sequence
  chemically synthesized
tcccagctgctctggaggct

SEQ ID NO: 220070 - DNA, 20 bp, Artificial Sequence
  chemically synthesized
ttcttctgcctcagcctcca

SEQ ID NO: 220071 - DNA, 20 bp, Artificial Sequence
  chemically synthesized
ttctgcctcagcctccagag

SEQ ID NO: 220072 - DNA, 20 bp, Artificial Sequence
  chemically synthesized
tgtagtcccagctgctctgg

SEQ ID NO: 220073 - DNA, 20 bp, Artificial Sequence
  chemically synthesized
ctgtagtcccagctgctctg

SEQ ID NO: 220074 - DNA, 20 bp, Artificial Sequence
  chemically synthesized
gcctcagcctccagagcagc

SEQ ID NO: 220075 - DNA, 20 bp, Artificial Sequence
  chemically synthesized
acctgtagtcccagctgctc

SEQ ID NO: 220076 - DNA, 20 bp, Artificial Sequence
  chemically synthesized
cctcagcctccagagcagct

SEQ ID NO: 220077 - DNA, 20 bp, Artificial Sequence
  chemically synthesized
ctccagagcagctgggacta

SEQ ID NO: 220078 - DNA, 20 bp, Artificial Sequence
  chemically synthesized
tccagagcagctgggactac

SEQ ID NO: 220079 - DNA, 20 bp, Artificial Sequence
  chemically synthesized
gtggcacacacctgtagtcc

SEQ ID NO: 220080 - DNA, 20 bp, Artificial Sequence
  chemically synthesized
ggtgtggtggcacacacctg

SEQ ID NO: 220081 - DNA, 20 bp, Artificial Sequence
  chemically synthesized
caggtgtgtgccaccacacc

SEQ ID NO: 220082 - DNA, 20 bp, Artificial Sequence
  chemically synthesized
acaaaattagctgggtgtgg

SEQ ID NO: 220083 - DNA, 20 bp, Artificial Sequence
  chemically synthesized
aatacaaaattagctgggtg

SEQ ID NO: 220084 - DNA, 20 bp, Artificial Sequence
  chemically synthesized
ctaaaaatacaaaattagct

SEQ ID NO: 220085 - DNA, 20 bp, Artificial Sequence
  chemically synthesized
actaaaaatacaaaattagc

SEQ ID NO: 220086 - DNA, 20 bp, Artificial Sequence
  chemically synthesized
ctctactaaaaatacaaaat

SEQ ID NO: 220087 - DNA, 20 bp, Artificial Sequence
  chemically synthesized
cccagctaattttgtatttt

SEQ ID NO: 220088 - DNA, 20 bp, Artificial Sequence
  chemically synthesized
agctaattttgtatttttag

SEQ ID NO: 220089 - DNA, 20 bp, Artificial Sequence
  chemically synthesized
ctaattttgtatttttagta

SEQ ID NO: 220090 - DNA, 20 bp, Artificial Sequence
  chemically synthesized
ttttgtatttttagtagaga

SEQ ID NO: 220091 - DNA, 20 bp, Artificial Sequence
  chemically synthesized
tttgtatttttagtagagat

SEQ ID NO: 220092 - DNA, 20 bp, Artificial Sequence
  chemically synthesized
ttgtatttttagtagagatg

SEQ ID NO: 220093 - DNA, 20 bp, Artificial Sequence
  chemically synthesized
gagatggggtttcaccatgt

SEQ ID NO: 220094 - DNA, 20 bp, Artificial Sequence
  chemically synthesized
tggggtttcaccatgttggc

SEQ ID NO: 220095 - DNA, 20 bp, Artificial Sequence
  chemically synthesized
ggagaccagcctggccaaca

SEQ ID NO: 220096 - DNA, 20 bp, Artificial Sequence
  chemically synthesized
ggggtttcaccatgttggcc

SEQ ID NO: 220097 - DNA, 20 bp, Artificial Sequence
  chemically synthesized
tttcaccatgttggccaggc

SEQ ID NO: 220098 - DNA, 20 bp, Artificial Sequence
  chemically synthesized
tcaggagttggagaccagcc

SEQ ID NO: 220099 - DNA, 20 bp, Artificial Sequence
  chemically synthesized
cgaggtcaggagttggagac

SEQ ID NO: 220100 - DNA, 20 bp, Artificial Sequence
  chemically synthesized
gatcacgaggtcaggagttg

SEQ ID NO: 220101 - DNA, 20 bp, Artificial Sequence
  chemically synthesized
cagatcacgaggtcaggagt

SEQ ID NO: 220102 - DNA, 20 bp, Artificial Sequence
  chemically synthesized
cgggcagatcacgaggtcag

SEQ ID NO: 220103 - DNA, 20 bp, Artificial Sequence
  chemically synthesized
ggcgggcagatcacgaggtc

SEQ ID NO: 220104 - DNA, 20 bp, Artificial Sequence
  chemically synthesized
aggcgggcagatcacgaggt

SEQ ID NO: 220105 - DNA, 20 bp, Artificial Sequence
  chemically synthesized
gccgaggcgggcagatcacg

SEQ ID NO: 220106 - DNA, 20 bp, Artificial Sequence
  chemically synthesized
ggccgaggcgggcagatcac

SEQ ID NO: 220107 - DNA, 20 bp, Artificial Sequence
  chemically synthesized
acctcgtgatctgcccgcct

SEQ ID NO: 220108 - DNA, 20 bp, Artificial Sequence
  chemically synthesized
ctttgggaggccgaggcggg

SEQ ID NO: 220109 - DNA, 20 bp, Artificial Sequence
  chemically synthesized
gtactttgggaggccgaggc

SEQ ID NO: 220110 - DNA, 20 bp, Artificial Sequence
  chemically synthesized
agtactttgggaggccgagg

SEQ ID NO: 220111 - DNA, 20 bp, Artificial Sequence
  chemically synthesized
cctagtactttgggaggccg

SEQ ID NO: 220112 - DNA, 20 bp, Artificial Sequence
  chemically synthesized
tcctagtactttgggaggcc

SEQ ID NO: 220113 - DNA, 20 bp, Artificial Sequence
  chemically synthesized
ctgcccgcctcggcctccca

SEQ ID NO: 220114 - DNA, 20 bp, Artificial Sequence
  chemically synthesized
tgtaatcctagtactttggg

SEQ ID NO: 220115 - DNA, 20 bp, Artificial Sequence
  chemically synthesized
ctgtaatcctagtactttgg

SEQ ID NO: 220116 - DNA, 20 bp, Artificial Sequence
  chemically synthesized
gcctcggcctcccaaagtac

SEQ ID NO: 220117 - DNA, 20 bp, Artificial Sequence
  chemically synthesized
acctgtaatcctagtacttt

SEQ ID NO: 220118 - DNA, 20 bp, Artificial Sequence
  chemically synthesized
cctcggcctcccaaagtact

SEQ ID NO: 220119 - DNA, 20 bp, Artificial Sequence
  chemically synthesized
cacctgtaatcctagtactt

SEQ ID NO: 220120 - DNA, 20 bp, Artificial Sequence
  chemically synthesized
ctcccaaagtactaggatta

SEQ ID NO: 220121 - DNA, 20 bp, Artificial Sequence
  chemically synthesized
tcccaaagtactaggattac

SEQ ID NO: 220122 - DNA, 20 bp, Artificial Sequence
  chemically synthesized
gtggctcacacctgtaatcc

SEQ ID NO: 220123 - DNA, 20 bp, Artificial Sequence
  chemically synthesized
agtactaggattacaggtgt

SEQ ID NO: 220124 - DNA, 20 bp, Artificial Sequence
  chemically synthesized
caggtgtgagccaccatgcc

SEQ ID NO: 220125 - DNA, 20 bp, Artificial Sequence
  chemically synthesized
gaatgatcagccaggcatgg

SEQ ID NO: 220126 - DNA, 20 bp, Artificial Sequence
  chemically synthesized
aaggaatgatcagccaggca

SEQ ID NO: 220127 - DNA, 20 bp, Artificial Sequence
  chemically synthesized
atgaaaaggaatgatcagcc

SEQ ID NO: 220128 - DNA, 20 bp, Artificial Sequence
  chemically synthesized
aatgaaaaggaatgatcagc

SEQ ID NO: 220129 - DNA, 20 bp, Artificial Sequence
  chemically synthesized
ggataatgaaaaggaatgat

SEQ ID NO: 220130 - DNA, 20 bp, Artificial Sequence
  chemically synthesized
aacagcacaggataatgaaa

SEQ ID NO: 220131 - DNA, 20 bp, Artificial Sequence
  chemically synthesized
aaacagcacaggataatgaa

SEQ ID NO: 220132 - DNA, 20 bp, Artificial Sequence
  chemically synthesized
gacaaaggagaaaacagcac

SEQ ID NO: 220133 - DNA, 20 bp, Artificial Sequence
  chemically synthesized
tgacaaaggagaaaacagca

SEQ ID NO: 220134 - DNA, 20 bp, Artificial Sequence
  chemically synthesized
tggattgacaaaggagaaaa

SEQ ID NO: 220135 - DNA, 20 bp, Artificial Sequence
  chemically synthesized
taagaggtggattgacaaag

SEQ ID NO: 220136 - DNA, 20 bp, Artificial Sequence
  chemically synthesized
attaagaggtggattgacaa

SEQ ID NO: 220137 - DNA, 20 bp, Artificial Sequence
  chemically synthesized
cattaagaggtggattgaca

SEQ ID NO: 220138 - DNA, 20 bp, Artificial Sequence
  chemically synthesized
aggactctaacattaagagg

SEQ ID NO: 220139 - DNA, 20 bp, Artificial Sequence
  chemically synthesized
ctaaggactctaacattaag

SEQ ID NO: 220140 - DNA, 20 bp, Artificial Sequence
  chemically synthesized
gtcaatccacctcttaatgt

SEQ ID NO: 220141 - DNA, 20 bp, Artificial Sequence
  chemically synthesized
actaaggactctaacattaa

SEQ ID NO: 220142 - DNA, 20 bp, Artificial Sequence
  chemically synthesized
caatccacctcttaatgtta

SEQ ID NO: 220143 - DNA, 20 bp, Artificial Sequence
  chemically synthesized
tgactaaggactctaacatt

SEQ ID NO: 220144 - DNA, 20 bp, Artificial Sequence
  chemically synthesized
cctcttaatgttagagtcct

SEQ ID NO: 220145 - DNA, 20 bp, Artificial Sequence
  chemically synthesized
tagaaatgacaacgtgacta

SEQ ID NO: 220146 - DNA, 20 bp, Artificial Sequence
  chemically synthesized
atagaaatgacaacgtgact

SEQ ID NO: 220147 - DNA, 20 bp, Artificial Sequence
  chemically synthesized
tcactaaggaagaatataga

SEQ ID NO: 220148 - DNA, 20 bp, Artificial Sequence
  chemically synthesized
tgtatcactaaggaagaata

SEQ ID NO: 220149 - DNA, 20 bp, Artificial Sequence
  chemically synthesized
tttctatctatattcttcct

SEQ ID NO: 220150 - DNA, 20 bp, Artificial Sequence
  chemically synthesized
atcagattgtatcactaagg

SEQ ID NO: 220151 - DNA, 20 bp, Artificial Sequence
  chemically synthesized
gatatcagattgtatcacta

SEQ ID NO: 220152 - DNA, 20 bp, Artificial Sequence
  chemically synthesized
tgatatcagattgtatcact

SEQ ID NO: 220153 - DNA, 20 bp, Artificial Sequence
  chemically synthesized
agtgatacaatctgatatca

SEQ ID NO: 220154 - DNA, 20 bp, Artificial Sequence
  chemically synthesized
aacatttaaagctgtgatat

SEQ ID NO: 220155 - DNA, 20 bp, Artificial Sequence
  chemically synthesized
tttgtataagataacattta

SEQ ID NO: 220156 - DNA, 20 bp, Artificial Sequence
  chemically synthesized
aatttcggaggtgtttgtat

SEQ ID NO: 220157 - DNA, 20 bp, Artificial Sequence
  chemically synthesized
gttggacgtttaaatttcgg

SEQ ID NO: 220158 - DNA, 20 bp, Artificial Sequence
  chemically synthesized
ggttggacgtttaaatttcg

SEQ ID NO: 220159 - DNA, 20 bp, Artificial Sequence
  chemically synthesized
caggttggacgtttaaattt

SEQ ID NO: 220160 - DNA, 20 bp, Artificial Sequence
  chemically synthesized
cgaaatttaaacgtccaacc

SEQ ID NO: 220161 - DNA, 20 bp, Artificial Sequence
  chemically synthesized
tcagcaaaaaaggtccaggt

SEQ ID NO: 220162 - DNA, 20 bp, Artificial Sequence
  chemically synthesized
gagttcagcaaaaaaggtcc

SEQ ID NO: 220163 - DNA, 20 bp, Artificial Sequence
  chemically synthesized
agagttcagcaaaaaaggtc

SEQ ID NO: 220164 - DNA, 20 bp, Artificial Sequence
  chemically synthesized
cctttagagttcagcaaaaa

SEQ ID NO: 220165 - DNA, 20 bp, Artificial Sequence
  chemically synthesized
acctttagagttcagcaaaa

SEQ ID NO: 220166 - DNA, 20 bp, Artificial Sequence
  chemically synthesized
accttttttgctgaactcta

SEQ ID NO: 220167 - DNA, 20 bp, Artificial Sequence
  chemically synthesized
gaataaatacctttagagtt

SEQ ID NO: 220168 - DNA, 20 bp, Artificial Sequence
  chemically synthesized
ccttttttgctgaactctaa

SEQ ID NO: 220169 - DNA, 20 bp, Artificial Sequence
  chemically synthesized
caattgaataaataccttta

SEQ ID NO: 220170 - DNA, 20 bp, Artificial Sequence
  chemically synthesized
ggcaattgaataaatacctt

SEQ ID NO: 220171 - DNA, 20 bp, Artificial Sequence
  chemically synthesized
tatcaccagatatattgaat

SEQ ID NO: 220172 - DNA, 20 bp, Artificial Sequence
  chemically synthesized
atatcaccagatatattgaa

SEQ ID NO: 220173 - DNA, 20 bp, Artificial Sequence
  chemically synthesized
aattgcctattcaatatatc

SEQ ID NO: 220174 - DNA, 20 bp, Artificial Sequence
  chemically synthesized
atatctgttagacatatcac

SEQ ID NO: 220175 - DNA, 20 bp, Artificial Sequence
  chemically synthesized
atatctggtgatatgtctaa

SEQ ID NO: 220176 - DNA, 20 bp, Artificial Sequence
  chemically synthesized
cattaaatttggatatctgt

SEQ ID NO: 220177 - DNA, 20 bp, Artificial Sequence
  chemically synthesized
gattagggaggcattaaatt

SEQ ID NO: 220178 - DNA, 20 bp, Artificial Sequence
  chemically synthesized
atagaatggggcgattaggg

SEQ ID NO: 220179 - DNA, 20 bp, Artificial Sequence
  chemically synthesized
gatagaatggggcgattagg

SEQ ID NO: 220180 - DNA, 20 bp, Artificial Sequence
  chemically synthesized
tagatagaatggggcgatta

SEQ ID NO: 220181 - DNA, 20 bp, Artificial Sequence
  chemically synthesized
atagatagaatggggcgatt

SEQ ID NO: 220182 - DNA, 20 bp, Artificial Sequence
  chemically synthesized
tatagatagaatggggcgat

SEQ ID NO: 220183 - DNA, 20 bp, Artificial Sequence
  chemically synthesized
taaagactatagatagaatg

SEQ ID NO: 220184 - DNA, 20 bp, Artificial Sequence
  chemically synthesized
ataaagactatagatagaat

SEQ ID NO: 220185 - DNA, 20 bp, Artificial Sequence
  chemically synthesized
aataaagactatagatagaa

SEQ ID NO: 220186 - DNA, 20 bp, Artificial Sequence
  chemically synthesized
taatcgccccattctatcta

SEQ ID NO: 220187 - DNA, 20 bp, Artificial Sequence
  chemically synthesized
gaaataataaagactataga

SEQ ID NO: 220188 - DNA, 20 bp, Artificial Sequence
  chemically synthesized
aactgaaataataaagacta

SEQ ID NO: 220189 - DNA, 20 bp, Artificial Sequence
  chemically synthesized
tgccctaaactgaaataata

SEQ ID NO: 220190 - DNA, 20 bp, Artificial Sequence
  chemically synthesized
atctatagtctttattattt

SEQ ID NO: 220191 - DNA, 20 bp, Artificial Sequence
  chemically synthesized
tagtctttattatttcagtt

SEQ ID NO: 220192 - DNA, 20 bp, Artificial Sequence
  chemically synthesized
agtctttattatttcagttt

SEQ ID NO: 220193 - DNA, 20 bp, Artificial Sequence
  chemically synthesized
gtctttattatttcagttta

SEQ ID NO: 220194 - DNA, 20 bp, Artificial Sequence
  chemically synthesized
ctgattaactggaagggata

SEQ ID NO: 220195 - DNA, 20 bp, Artificial Sequence
  chemically synthesized
tagggcaactttatcccttc

SEQ ID NO: 220196 - DNA, 20 bp, Artificial Sequence
  chemically synthesized
tttgctctgattaactggaa

SEQ ID NO: 220197 - DNA, 20 bp, Artificial Sequence
  chemically synthesized
ttttgctctgattaactgga

SEQ ID NO: 220198 - DNA, 20 bp, Artificial Sequence
  chemically synthesized
tttttgctctgattaactgg

SEQ ID NO: 220199 - DNA, 20 bp, Artificial Sequence
  chemically synthesized
ctttatcccttccagttaat

SEQ ID NO: 220200 - DNA, 20 bp, Artificial Sequence
  chemically synthesized
acgtttttgctctgattaac

SEQ ID NO: 220201 - DNA, 20 bp, Artificial Sequence
  chemically synthesized
ttatcccttccagttaatca

SEQ ID NO: 220202 - DNA, 20 bp, Artificial Sequence
  chemically synthesized
gttaatcagagcaaaaacgt

SEQ ID NO: 220203 - DNA, 20 bp, Artificial Sequence
  chemically synthesized
taatcagagcaaaaacgttg

SEQ ID NO: 220204 - DNA, 20 bp, Artificial Sequence
  chemically synthesized
gagaaaaatggagtcatgaa

SEQ ID NO: 220205 - DNA, 20 bp, Artificial Sequence
  chemically synthesized
aggggcatgggagaaaaatg

SEQ ID NO: 220206 - DNA, 20 bp, Artificial Sequence
  chemically synthesized
taaggggcatgggagaaaaa

SEQ ID NO: 220207 - DNA, 20 bp, Artificial Sequence
  chemically synthesized
gaattggataaggggcatgg

SEQ ID NO: 220208 - DNA, 20 bp, Artificial Sequence
  chemically synthesized
atgaattggataaggggcat

SEQ ID NO: 220209 - DNA, 20 bp, Artificial Sequence
  chemically synthesized
gatgaattggataaggggca

SEQ ID NO: 220210 - DNA, 20 bp, Artificial Sequence
  chemically synthesized
ttctggatgaattggataag

SEQ ID NO: 220211 - DNA, 20 bp, Artificial Sequence
  chemically synthesized
tttctggatgaattggataa

SEQ ID NO: 220212 - DNA, 20 bp, Artificial Sequence
  chemically synthesized
atttctggatgaattggata

SEQ ID NO: 220213 - DNA, 20 bp, Artificial Sequence
  chemically synthesized
gatttctggatgaattggat

SEQ ID NO: 220214 - DNA, 20 bp, Artificial Sequence
  chemically synthesized
tgccccttatccaattcatc

SEQ ID NO: 220215 - DNA, 20 bp, Artificial Sequence
  chemically synthesized
acaaggatttctggatgaat

SEQ ID NO: 220216 - DNA, 20 bp, Artificial Sequence
  chemically synthesized
gtggggccaacaaggatttc

SEQ ID NO: 220217 - DNA, 20 bp, Artificial Sequence
  chemically synthesized
attcatccagaaatccttgt

SEQ ID NO: 220218 - DNA, 20 bp, Artificial Sequence
  chemically synthesized
gtttggaagtggggccaaca

SEQ ID NO: 220219 - DNA, 20 bp, Artificial Sequence
  chemically synthesized
tgtttggaagtggggccaac

SEQ ID NO: 220220 - DNA, 20 bp, Artificial Sequence
  chemically synthesized
tctgaacgtgtttggaagtg

SEQ ID NO: 220221 - DNA, 20 bp, Artificial Sequence
  chemically synthesized
ttctgaacgtgtttggaagt

SEQ ID NO: 220222 - DNA, 20 bp, Artificial Sequence
  chemically synthesized
attctgaacgtgtttggaag

SEQ ID NO: 220223 - DNA, 20 bp, Artificial Sequence
  chemically synthesized
catattctgaacgtgtttgg

SEQ ID NO: 220224 - DNA, 20 bp, Artificial Sequence
  chemically synthesized
agtcatattctgaacgtgtt

SEQ ID NO: 220225 - DNA, 20 bp, Artificial Sequence
  chemically synthesized
gccccacttccaaacacgtt

SEQ ID NO: 220226 - DNA, 20 bp, Artificial Sequence
  chemically synthesized
gagaccagggtgataagaaa

SEQ ID NO: 220227 - DNA, 20 bp, Artificial Sequence
  chemically synthesized
atgactatttcttatcaccc

SEQ ID NO: 220228 - DNA, 20 bp, Artificial Sequence
  chemically synthesized
ctgactgagaccagggtgat

SEQ ID NO: 220229 - DNA, 20 bp, Artificial Sequence
  chemically synthesized
atttcttatcaccctggtct

SEQ ID NO: 220230 - DNA, 20 bp, Artificial Sequence
  chemically synthesized
gatgatgctgactgagacca

SEQ ID NO: 220231 - DNA, 20 bp, Artificial Sequence
  chemically synthesized
agatgatgctgactgagacc

SEQ ID NO: 220232 - DNA, 20 bp, Artificial Sequence
  chemically synthesized
aagatgatgctgactgagac

SEQ ID NO: 220233 - DNA, 20 bp, Artificial Sequence
  chemically synthesized
cttatcaccctggtctcagt

SEQ ID NO: 220234 - DNA, 20 bp, Artificial Sequence
  chemically synthesized
gtgagaagatgatgctgact

SEQ ID NO: 220235 - DNA, 20 bp, Artificial Sequence
  chemically synthesized
tttctctttctaagtgtgag

SEQ ID NO: 220236 - DNA, 20 bp, Artificial Sequence
  chemically synthesized
cagcatcatcttctcacact

SEQ ID NO: 220237 - DNA, 20 bp, Artificial Sequence
  chemically synthesized
gtttttctctttctaagtgt

SEQ ID NO: 220238 - DNA, 20 bp, Artificial Sequence
  chemically synthesized
atcatcttctcacacttaga

SEQ ID NO: 220239 - DNA, 20 bp, Artificial Sequence
  chemically synthesized
catcttctcacacttagaaa

SEQ ID NO: 220240 - DNA, 20 bp, Artificial Sequence
  chemically synthesized
aaggacgtttttctctttct

SEQ ID NO: 220241 - DNA, 20 bp, Artificial Sequence
  chemically synthesized
agagaaaaacgtccttacaa

SEQ ID NO: 220242 - DNA, 20 bp, Artificial Sequence
  chemically synthesized
ggacctttgaagccattgta

SEQ ID NO: 220243 - DNA, 20 bp, Artificial Sequence
  chemically synthesized
tggacctttgaagccattgt

SEQ ID NO: 220244 - DNA, 20 bp, Artificial Sequence
  chemically synthesized
acgtccttacaatggcttca

SEQ ID NO: 220245 - DNA, 20 bp, Artificial Sequence
  chemically synthesized
cgtccttacaatggcttcaa

SEQ ID NO: 220246 - DNA, 20 bp, Artificial Sequence
  chemically synthesized
gaggtgagggtggacctttg

SEQ ID NO: 220247 - DNA, 20 bp, Artificial Sequence
  chemically synthesized
gaatgttagtgaggtgaggg

SEQ ID NO: 220248 - DNA, 20 bp, Artificial Sequence
  chemically synthesized
agagaatgttagtgaggtga

SEQ ID NO: 220249 - DNA, 20 bp, Artificial Sequence
  chemically synthesized
gagagaatgttagtgaggtg

SEQ ID NO: 220250 - DNA, 20 bp, Artificial Sequence
  chemically synthesized
ggagagaatgttagtgaggt

SEQ ID NO: 220251 - DNA, 20 bp, Artificial Sequence
  chemically synthesized
tttaggagagaatgttagtg

SEQ ID NO: 220252 - DNA, 20 bp, Artificial Sequence
  chemically synthesized
gtttaggagagaatgttagt

SEQ ID NO: 220253 - DNA, 20 bp, Artificial Sequence
  chemically synthesized
agaggtttaggagagaatgt

SEQ ID NO: 220254 - DNA, 20 bp, Artificial Sequence
  chemically synthesized
taagtgagagaggtttagga

SEQ ID NO: 220255 - DNA, 20 bp, Artificial Sequence
  chemically synthesized
agtaagtgagagaggtttag

SEQ ID NO: 220256 - DNA, 20 bp, Artificial Sequence
  chemically synthesized
gaagtaagtgagagaggttt

SEQ ID NO: 220257 - DNA, 20 bp, Artificial Sequence
  chemically synthesized
tgaagtaagtgagagaggtt

SEQ ID NO: 220258 - DNA, 20 bp, Artificial Sequence
  chemically synthesized
tagagtgaagtaagtgagag

SEQ ID NO: 220259 - DNA, 20 bp, Artificial Sequence
  chemically synthesized
ctagagtgaagtaagtgaga

SEQ ID NO: 220260 - DNA, 20 bp, Artificial Sequence
  chemically synthesized
ggctagagtgaagtaagtga

SEQ ID NO: 220261 - DNA, 20 bp, Artificial Sequence
  chemically synthesized
gtggctagagtgaagtaagt

SEQ ID NO: 220262 - DNA, 20 bp, Artificial Sequence
  chemically synthesized
cagtgtggctagagtgaagt

SEQ ID NO: 220263 - DNA, 20 bp, Artificial Sequence
  chemically synthesized
ctctctcacttacttcactc

SEQ ID NO: 220264 - DNA, 20 bp, Artificial Sequence
  chemically synthesized
tctgcagtgtggctagagtg

SEQ ID NO: 220265 - DNA, 20 bp, Artificial Sequence
  chemically synthesized
ggttatctgcagtgtggcta

SEQ ID NO: 220266 - DNA, 20 bp, Artificial Sequence
  chemically synthesized
ctggttatctgcagtgtggc

SEQ ID NO: 220267 - DNA, 20 bp, Artificial Sequence
  chemically synthesized
acttcactctagccacactg

SEQ ID NO: 220268 - DNA, 20 bp, Artificial Sequence
  chemically synthesized
ggggctggttatctgcagtg

SEQ ID NO: 220269 - DNA, 20 bp, Artificial Sequence
  chemically synthesized
tgtttggggctggttatctg

SEQ ID NO: 220270 - DNA, 20 bp, Artificial Sequence
  chemically synthesized
ctagccacactgcagataac

SEQ ID NO: 220271 - DNA, 20 bp, Artificial Sequence
  chemically synthesized
gtttatctgctgtttggggc

SEQ ID NO: 220272 - DNA, 20 bp, Artificial Sequence
  chemically synthesized
tgcagataaccagccccaaa

SEQ ID NO: 220273 - DNA, 20 bp, Artificial Sequence
  chemically synthesized
agataaccagccccaaacag

SEQ ID NO: 220274 - DNA, 20 bp, Artificial Sequence
  chemically synthesized
atcggtttatctgctgtttg

SEQ ID NO: 220275 - DNA, 20 bp, Artificial Sequence
  chemically synthesized
catcggtttatctgctgttt

SEQ ID NO: 220276 - DNA, 20 bp, Artificial Sequence
  chemically synthesized
ccatcggtttatctgctgtt

SEQ ID NO: 220277 - DNA, 20 bp, Artificial Sequence
  chemically synthesized
ccaaacagcagataaaccga

SEQ ID NO: 220278 - DNA, 20 bp, Artificial Sequence
  chemically synthesized
cagcagataaaccgatggct

SEQ ID NO: 220279 - DNA, 20 bp, Artificial Sequence
  chemically synthesized
agcagataaaccgatggctt

SEQ ID NO: 220280 - DNA, 20 bp, Artificial Sequence
  chemically synthesized
atgcagaattcctaagccat

SEQ ID NO: 220281 - DNA, 20 bp, Artificial Sequence
  chemically synthesized
acagtcaatgcagaattcct

SEQ ID NO: 220282 - DNA, 20 bp, Artificial Sequence
  chemically synthesized
ggttcagtaaacagtcaatg

SEQ ID NO: 220283 - DNA, 20 bp, Artificial Sequence
  chemically synthesized
ctcattttgggttcagtaaa

SEQ ID NO: 220284 - DNA, 20 bp, Artificial Sequence
  chemically synthesized
cagtaaactcattttgggtt

SEQ ID NO: 220285 - DNA, 20 bp, Artificial Sequence
  chemically synthesized
ctgtttactgaacccaaaat

SEQ ID NO: 220286 - DNA, 20 bp, Artificial Sequence
  chemically synthesized
atcagcagtaaactcatttt

SEQ ID NO: 220287 - DNA, 20 bp, Artificial Sequence
  chemically synthesized
tatcagcagtaaactcattt

SEQ ID NO: 220288 - DNA, 20 bp, Artificial Sequence
  chemically synthesized
ttgaatcatgtagatatcag

SEQ ID NO: 220289 - DNA, 20 bp, Artificial Sequence
  chemically synthesized
gggttgaatcatgtagatat

SEQ ID NO: 220290 - DNA, 20 bp, Artificial Sequence
  chemically synthesized
aggcatggggttgaatcatg

SEQ ID NO: 220291 - DNA, 20 bp, Artificial Sequence
  chemically synthesized
atctcaaagaatgaggcatg

SEQ ID NO: 220292 - DNA, 20 bp, Artificial Sequence
  chemically synthesized
gatctcaaagaatgaggcat

SEQ ID NO: 220293 - DNA, 20 bp, Artificial Sequence
  chemically synthesized
agatctcaaagaatgaggca

SEQ ID NO: 220294 - DNA, 20 bp, Artificial Sequence
  chemically synthesized
agcaaagatctcaaagaatg

SEQ ID NO: 220295 - DNA, 20 bp, Artificial Sequence
  chemically synthesized
aaccccatgcctcattcttt

SEQ ID NO: 220296 - DNA, 20 bp, Artificial Sequence
  chemically synthesized
gagcaaagatctcaaagaat

SEQ ID NO: 220297 - DNA, 20 bp, Artificial Sequence
  chemically synthesized
acatttgagcaaagatctca

SEQ ID NO: 220298 - DNA, 20 bp, Artificial Sequence
  chemically synthesized
gagaaggtgacatttgagca

SEQ ID NO: 220299 - DNA, 20 bp, Artificial Sequence
  chemically synthesized
tcattgagaaggtgacattt

SEQ ID NO: 220300 - DNA, 20 bp, Artificial Sequence
  chemically synthesized
catggtattcttcattgaga

SEQ ID NO: 220301 - DNA, 20 bp, Artificial Sequence
  chemically synthesized
caaatgtcaccttctcaatg

SEQ ID NO: 220302 - DNA, 20 bp, Artificial Sequence
  chemically synthesized
tcatggtattcttcattgag

SEQ ID NO: 220303 - DNA, 20 bp, Artificial Sequence
  chemically synthesized
gtatcatggtattcttcatt

SEQ ID NO: 220304 - DNA, 20 bp, Artificial Sequence
  chemically synthesized
caattttaaatagggtatca

SEQ ID NO: 220305 - DNA, 20 bp, Artificial Sequence
  chemically synthesized
gtacattccaattttaaata

SEQ ID NO: 220306 - DNA, 20 bp, Artificial Sequence
  chemically synthesized
agtacattccaattttaaat

SEQ ID NO: 220307 - DNA, 20 bp, Artificial Sequence
  chemically synthesized
gagtacattccaattttaaa

SEQ ID NO: 220308 - DNA, 20 bp, Artificial Sequence
  chemically synthesized
catgataccctatttaaaat

SEQ ID NO: 220309 - DNA, 20 bp, Artificial Sequence
  chemically synthesized
tttaaaattggaatgtactc

SEQ ID NO: 220310 - DNA, 20 bp, Artificial Sequence
  chemically synthesized
attggaatgtactccagcat

SEQ ID NO: 220311 - DNA, 20 bp, Artificial Sequence
  chemically synthesized
ataagagatggctcatgctg

SEQ ID NO: 220312 - DNA, 20 bp, Artificial Sequence
  chemically synthesized
aaataagagatggctcatgc

SEQ ID NO: 220313 - DNA, 20 bp, Artificial Sequence
  chemically synthesized
aagaagggtaaaataagaga

SEQ ID NO: 220314 - DNA, 20 bp, Artificial Sequence
  chemically synthesized
aaagaagaagggtaaaataa

SEQ ID NO: 220315 - DNA, 20 bp, Artificial Sequence
  chemically synthesized
aaaaagaagaagggtaaaat

SEQ ID NO: 220316 - DNA, 20 bp, Artificial Sequence
  chemically synthesized
gctgtgaaaaaaaagaagaa

SEQ ID NO: 220317 - DNA, 20 bp, Artificial Sequence
  chemically synthesized
tgctgtgaaaaaaaagaaga

SEQ ID NO: 220318 - DNA, 20 bp, Artificial Sequence
  chemically synthesized
gtgctgtgaaaaaaaagaag

SEQ ID NO: 220319 - DNA, 20 bp, Artificial Sequence
  chemically synthesized
taagtgctgtgaaaaaaaag

SEQ ID NO: 220320 - DNA, 20 bp, Artificial Sequence
  chemically synthesized
tgataagtgctgtgaaaaaa

SEQ ID NO: 220321 - DNA, 20 bp, Artificial Sequence
  chemically synthesized
acccttcttcttttttttca

SEQ ID NO: 220322 - DNA, 20 bp, Artificial Sequence
  chemically synthesized
atagtatgttcaaaagtgat

SEQ ID NO: 220323 - DNA, 20 bp, Artificial Sequence
  chemically synthesized
atattgtatagtatgttcaa

SEQ ID NO: 220324 - DNA, 20 bp, Artificial Sequence
  chemically synthesized
gatacgataagtatattgta

SEQ ID NO: 220325 - DNA, 20 bp, Artificial Sequence
  chemically synthesized
tagtgaaagacagatacgat

SEQ ID NO: 220326 - DNA, 20 bp, Artificial Sequence
  chemically synthesized
gggtctcaaatagtgaaaga

SEQ ID NO: 220327 - DNA, 20 bp, Artificial Sequence
  chemically synthesized
ttgggggtctcaaatagtga

SEQ ID NO: 220328 - DNA, 20 bp, Artificial Sequence
  chemically synthesized
gtatctgtctttcactattt

SEQ ID NO: 220329 - DNA, 20 bp, Artificial Sequence
  chemically synthesized
ggattcttgggggtctcaaa

SEQ ID NO: 220330 - DNA, 20 bp, Artificial Sequence
  chemically synthesized
tttcactatttgagaccccc

SEQ ID NO: 220331 - DNA, 20 bp, Artificial Sequence
  chemically synthesized
tatgccctctggattcttgg

SEQ ID NO: 220332 - DNA, 20 bp, Artificial Sequence
  chemically synthesized
gtatgccctctggattcttg

SEQ ID NO: 220333 - DNA, 20 bp, Artificial Sequence
  chemically synthesized
atttgagacccccaagaatc

SEQ ID NO: 220334 - DNA, 20 bp, Artificial Sequence
  chemically synthesized
tgtatgccctctggattctt

SEQ ID NO: 220335 - DNA, 20 bp, Artificial Sequence
  chemically synthesized
atgtatgccctctggattct

SEQ ID NO: 220336 - DNA, 20 bp, Artificial Sequence
  chemically synthesized
ttgagacccccaagaatcca

SEQ ID NO: 220337 - DNA, 20 bp, Artificial Sequence
  chemically synthesized
tgagacccccaagaatccag

SEQ ID NO: 220338 - DNA, 20 bp, Artificial Sequence
  chemically synthesized
gagacccccaagaatccaga

SEQ ID NO: 220339 - DNA, 20 bp, Artificial Sequence
  chemically synthesized
cagaaaagatgtatgccctc

SEQ ID NO: 220340 - DNA, 20 bp, Artificial Sequence
  chemically synthesized
tgtcagtgaacaaagcagaa

SEQ ID NO: 220341 - DNA, 20 bp, Artificial Sequence
  chemically synthesized
gaatgtgtcagtgaacaaag

SEQ ID NO: 220342 - DNA, 20 bp, Artificial Sequence
  chemically synthesized
tttgaatgtgtcagtgaaca

SEQ ID NO: 220343 - DNA, 20 bp, Artificial Sequence
  chemically synthesized
tgtagatgttttgaatgtgt

SEQ ID NO: 220344 - DNA, 20 bp, Artificial Sequence
  chemically synthesized
tgacacattcaaaacatcta

SEQ ID NO: 220345 - DNA, 20 bp, Artificial Sequence
  chemically synthesized
cacattcaaaacatctacag

SEQ ID NO: 220346 - DNA, 20 bp, Artificial Sequence
  chemically synthesized
attcaaaacatctacagtag

SEQ ID NO: 220347 - DNA, 20 bp, Artificial Sequence
  chemically synthesized
ccatatgtcagccactactg

SEQ ID NO: 220348 - DNA, 20 bp, Artificial Sequence
  chemically synthesized
ctacagtagtggctgacata

SEQ ID NO: 220349 - DNA, 20 bp, Artificial Sequence
  chemically synthesized
attgagccaccaccatatgt

SEQ ID NO: 220350 - DNA, 20 bp, Artificial Sequence
  chemically synthesized
cagtagtggctgacatatgg

SEQ ID NO: 220351 - DNA, 20 bp, Artificial Sequence
  chemically synthesized
tagtggctgacatatggtgg

SEQ ID NO: 220352 - DNA, 20 bp, Artificial Sequence
  chemically synthesized
acatatggtggtggctcaat

SEQ ID NO: 220353 - DNA, 20 bp, Artificial Sequence
  chemically synthesized
taatttgaaaaatacttatt

SEQ ID NO: 220354 - DNA, 20 bp, Artificial Sequence
  chemically synthesized
tttcaaattaacctgatgct

SEQ ID NO: 220355 - DNA, 20 bp, Artificial Sequence
  chemically synthesized
aaagttctggacttagcatc

SEQ ID NO: 220356 - DNA, 20 bp, Artificial Sequence
  chemically synthesized
gaaagttctggacttagcat

SEQ ID NO: 220357 - DNA, 20 bp, Artificial Sequence
  chemically synthesized
aattaacctgatgctaagtc

SEQ ID NO: 220358 - DNA, 20 bp, Artificial Sequence
  chemically synthesized
gcagttgaaagttctggact

SEQ ID NO: 220359 - DNA, 20 bp, Artificial Sequence
  chemically synthesized
gactgggcagttgaaagttc

SEQ ID NO: 220360 - DNA, 20 bp, Artificial Sequence
  chemically synthesized
ctctgtgactgggcagttga

SEQ ID NO: 220361 - DNA, 20 bp, Artificial Sequence
  chemically synthesized
gtccagaactttcaactgcc

SEQ ID NO: 220362 - DNA, 20 bp, Artificial Sequence
  chemically synthesized
aagctagctctgtgactggg

SEQ ID NO: 220363 - DNA, 20 bp, Artificial Sequence
  chemically synthesized
aactttcaactgcccagtca

SEQ ID NO: 220364 - DNA, 20 bp, Artificial Sequence
  chemically synthesized
ctttcaactgcccagtcaca

SEQ ID NO: 220365 - DNA, 20 bp, Artificial Sequence
  chemically synthesized
ctgaagctagctctgtgact

SEQ ID NO: 220366 - DNA, 20 bp, Artificial Sequence
  chemically synthesized
cctgaagctagctctgtgac

SEQ ID NO: 220367 - DNA, 20 bp, Artificial Sequence
  chemically synthesized
caactgcccagtcacagagc

SEQ ID NO: 220368 - DNA, 20 bp, Artificial Sequence
  chemically synthesized
cccagtcacagagctagctt

SEQ ID NO: 220369 - DNA, 20 bp, Artificial Sequence
  chemically synthesized
ccagtcacagagctagcttc

SEQ ID NO: 220370 - DNA, 20 bp, Artificial Sequence
  chemically synthesized
cagtcacagagctagcttca

SEQ ID NO: 220371 - DNA, 20 bp, Artificial Sequence
  chemically synthesized
ttctttaaatgccctgaagc

SEQ ID NO: 220372 - DNA, 20 bp, Artificial Sequence
  chemically synthesized
tcagttctttaaatgccctg

SEQ ID NO: 220373 - DNA, 20 bp, Artificial Sequence
  chemically synthesized
agctagcttcagggcattta

SEQ ID NO: 220374 - DNA, 20 bp, Artificial Sequence
  chemically synthesized
catttaaagaactgaacaaa

SEQ ID NO: 220375 - DNA, 20 bp, Artificial Sequence
  chemically synthesized
acttccattatctgtttgtt

SEQ ID NO: 220376 - DNA, 20 bp, Artificial Sequence
  chemically synthesized
agaactgaacaaacagataa

SEQ ID NO: 220377 - DNA, 20 bp, Artificial Sequence
  chemically synthesized
actgaacaaacagataatgg

SEQ ID NO: 220378 - DNA, 20 bp, Artificial Sequence
  chemically synthesized
gaacaaacagataatggaag

SEQ ID NO: 220379 - DNA, 20 bp, Artificial Sequence
  chemically synthesized
aacaaacagataatggaagt

SEQ ID NO: 220380 - DNA, 20 bp, Artificial Sequence
  chemically synthesized
ataatggaagtgggttcatg

SEQ ID NO: 220381 - DNA, 20 bp, Artificial Sequence
  chemically synthesized
tggaagtgggttcatgtaga

SEQ ID NO: 220382 - DNA, 20 bp, Artificial Sequence
  chemically synthesized
gaagtgggttcatgtagata

SEQ ID NO: 220383 - DNA, 20 bp, Artificial Sequence
  chemically synthesized
gtgggttcatgtagatagag

SEQ ID NO: 220384 - DNA, 20 bp, Artificial Sequence
  chemically synthesized
gtagatagagaagaaattaa

SEQ ID NO: 220385 - DNA, 20 bp, Artificial Sequence
  chemically synthesized
ttctcattctacatgagaat

SEQ ID NO: 220386 - DNA, 20 bp, Artificial Sequence
  chemically synthesized
aaagaattctcattctcatg

SEQ ID NO: 220387 - DNA, 20 bp, Artificial Sequence
  chemically synthesized
attgtcttctcattctacat

SEQ ID NO: 220388 - DNA, 20 bp, Artificial Sequence
  chemically synthesized
ttctcattctcatgtagaat

SEQ ID NO: 220389 - DNA, 20 bp, Artificial Sequence
  chemically synthesized
tcattctcatgtagaatgag

SEQ ID NO: 220390 - DNA, 20 bp, Artificial Sequence
  chemically synthesized
catgtagaatgagaagacaa

SEQ ID NO: 220391 - DNA, 20 bp, Artificial Sequence
  chemically synthesized
atgtagaatgagaagacaat

SEQ ID NO: 220392 - DNA, 20 bp, Artificial Sequence
  chemically synthesized
tgtagaatgagaagacaatg

SEQ ID NO: 220393 - DNA, 20 bp, Artificial Sequence
  chemically synthesized
aatgagaagacaatggggaa

SEQ ID NO: 220394 - DNA, 20 bp, Artificial Sequence
  chemically synthesized
atgagaagacaatggggaat

SEQ ID NO: 220395 - DNA, 20 bp, Artificial Sequence
  chemically synthesized
tgagaagacaatggggaata

SEQ ID NO: 220396 - DNA, 20 bp, Artificial Sequence
  chemically synthesized
tgcctgcagtagaaaaaaaa

SEQ ID NO: 220397 - DNA, 20 bp, Artificial Sequence
  chemically synthesized
ttgcctgcagtagaaaaaaa

SEQ ID NO: 220398 - DNA, 20 bp, Artificial Sequence
  chemically synthesized
tgtcctttttttttctactg

SEQ ID NO: 220399 - DNA, 20 bp, Artificial Sequence
  chemically synthesized
gtcctttttttttctactgc

SEQ ID NO: 220400 - DNA, 20 bp, Artificial Sequence
  chemically synthesized
cttctgtgccttgcctgcag

SEQ ID NO: 220401 - DNA, 20 bp, Artificial Sequence
  chemically synthesized
tttttttttctactgcaggc

SEQ ID NO: 220402 - DNA, 20 bp, Artificial Sequence
  chemically synthesized
ttttttttctactgcaggca

SEQ ID NO: 220403 - DNA, 20 bp, Artificial Sequence
  chemically synthesized
ccgcttctgtgccttgcctg

SEQ ID NO: 220404 - DNA, 20 bp, Artificial Sequence
  chemically synthesized
tttctactgcaggcaaggca

SEQ ID NO: 220405 - DNA, 20 bp, Artificial Sequence
  chemically synthesized
ctactgcaggcaaggcacag

SEQ ID NO: 220406 - DNA, 20 bp, Artificial Sequence
  chemically synthesized
ctgcaggcaaggcacagaag

SEQ ID NO: 220407 - DNA, 20 bp, Artificial Sequence
  chemically synthesized
tgcaggcaaggcacagaagc

SEQ ID NO: 220408 - DNA, 20 bp, Artificial Sequence
  chemically synthesized
gcaggcaaggcacagaagcg

SEQ ID NO: 220409 - DNA, 20 bp, Artificial Sequence
  chemically synthesized
cagaagcggggatgtaaaca

SEQ ID NO: 220410 - DNA, 20 bp, Artificial Sequence
  chemically synthesized
agaagcggggatgtaaacaa

SEQ ID NO: 220411 - DNA, 20 bp, Artificial Sequence
  chemically synthesized
aagcggggatgtaaacaaag

SEQ ID NO: 220412 - DNA, 20 bp, Artificial Sequence
  chemically synthesized
aaacaaaggagacatccgtg

SEQ ID NO: 220413 - DNA, 20 bp, Artificial Sequence
  chemically synthesized
aacctatattagcatcttca

SEQ ID NO: 220414 - DNA, 20 bp, Artificial Sequence
  chemically synthesized
catccgtgaagatgctaata

SEQ ID NO: 220415 - DNA, 20 bp, Artificial Sequence
  chemically synthesized
atccgtgaagatgctaatat

SEQ ID NO: 220416 - DNA, 20 bp, Artificial Sequence
  chemically synthesized
agaattgtgaaaacctatat

SEQ ID NO: 220417 - DNA, 20 bp, Artificial Sequence
  chemically synthesized
gttttcacaattctaaaaaa

SEQ ID NO: 220418 - DNA, 20 bp, Artificial Sequence
  chemically synthesized
agtttattttatcttttttt

SEQ ID NO: 220419 - DNA, 20 bp, Artificial Sequence
  chemically synthesized
ccatgtcaccgttaaacaca

SEQ ID NO: 220420 - DNA, 20 bp, Artificial Sequence
  chemically synthesized
aaaataaactatgtgtttaa

SEQ ID NO: 220421 - DNA, 20 bp, Artificial Sequence
  chemically synthesized
ctatgtgtttaacggtgaca

SEQ ID NO: 220422 - DNA, 20 bp, Artificial Sequence
  chemically synthesized
ttaacggtgacatggtttta

SEQ ID NO: 220423 - DNA, 20 bp, Artificial Sequence
  chemically synthesized
aacggtgacatggttttaaa

SEQ ID NO: 220424 - DNA, 20 bp, Artificial Sequence
  chemically synthesized
ttaaagagttgctgaatgat

SEQ ID NO: 220425 - DNA, 20 bp, Artificial Sequence
  chemically synthesized
ggaaagggagactgatcatt

SEQ ID NO: 220426 - DNA, 20 bp, Artificial Sequence
  chemically synthesized
ggaagaaagaaaaggaaagg

SEQ ID NO: 220427 - DNA, 20 bp, Artificial Sequence
  chemically synthesized
ctggaagaaagaaaaggaaa

SEQ ID NO: 220428 - DNA, 20 bp, Artificial Sequence
  chemically synthesized
gctggaagaaagaaaaggaa

SEQ ID NO: 220429 - DNA, 20 bp, Artificial Sequence
  chemically synthesized
cgctggaagaaagaaaagga

SEQ ID NO: 220430 - DNA, 20 bp, Artificial Sequence
  chemically synthesized
atagcgctggaagaaagaaa

SEQ ID NO: 220431 - DNA, 20 bp, Artificial Sequence
  chemically synthesized
tatagcgctggaagaaagaa

SEQ ID NO: 220432 - DNA, 20 bp, Artificial Sequence
  chemically synthesized
ccctttccttttctttcttc

SEQ ID NO: 220433 - DNA, 20 bp, Artificial Sequence
  chemically synthesized
aataatatagcgctggaaga

SEQ ID NO: 220434 - DNA, 20 bp, Artificial Sequence
  chemically synthesized
ttgaaataatatagcgctgg

SEQ ID NO: 220435 - DNA, 20 bp, Artificial Sequence
  chemically synthesized
cctttgaaataatatagcgc

SEQ ID NO: 220436 - DNA, 20 bp, Artificial Sequence
  chemically synthesized
agtgaccctttgaaataata

SEQ ID NO: 220437 - DNA, 20 bp, Artificial Sequence
  chemically synthesized
tccagcgctatattatttca

SEQ ID NO: 220438 - DNA, 20 bp, Artificial Sequence
  chemically synthesized
ccagcgctatattatttcaa

SEQ ID NO: 220439 - DNA, 20 bp, Artificial Sequence
  chemically synthesized
cagcgctatattatttcaaa

SEQ ID NO: 220440 - DNA, 20 bp, Artificial Sequence
  chemically synthesized
atattatttcaaagggtcac

SEQ ID NO: 220441 - DNA, 20 bp, Artificial Sequence
  chemically synthesized
tctggttcccatgaagtaac

SEQ ID NO: 220442 - DNA, 20 bp, Artificial Sequence
  chemically synthesized
aagggtcactggttacttca

SEQ ID NO: 220443 - DNA, 20 bp, Artificial Sequence
  chemically synthesized
agggtcactggttacttcat

SEQ ID NO: 220444 - DNA, 20 bp, Artificial Sequence
  chemically synthesized
aacaacgtctggttcccatg

SEQ ID NO: 220445 - DNA, 20 bp, Artificial Sequence
  chemically synthesized
actggttacttcatgggaac

SEQ ID NO: 220446 - DNA, 20 bp, Artificial Sequence
  chemically synthesized
caagtggcaataacaacgtc

SEQ ID NO: 220447 - DNA, 20 bp, Artificial Sequence
  chemically synthesized
gttgttattgccacttgtat

SEQ ID NO: 220448 - DNA, 20 bp, Artificial Sequence
  chemically synthesized
attcatctgacttatacaag

SEQ ID NO: 220449 - DNA, 20 bp, Artificial Sequence
  chemically synthesized
tttattcatctgacttatac

SEQ ID NO: 220450 - DNA, 20 bp, Artificial Sequence
  chemically synthesized
ttattgccacttgtataagt

SEQ ID NO: 220451 - DNA, 20 bp, Artificial Sequence
  chemically synthesized
ttgtataagtcagatgaata

SEQ ID NO: 220452 - DNA, 20 bp, Artificial Sequence
  chemically synthesized
gtataagtcagatgaataaa

SEQ ID NO: 220453 - DNA, 20 bp, Artificial Sequence
  chemically synthesized
aagagaaattcttgataaat

SEQ ID NO: 220454 - DNA, 20 bp, Artificial Sequence
  chemically synthesized
caaagtatacctcatttatc

SEQ ID NO: 220455 - DNA, 20 bp, Artificial Sequence
  chemically synthesized
agagaaattcttgataaatg

SEQ ID NO: 220456 - DNA, 20 bp, Artificial Sequence
  chemically synthesized
gataaatgaggtatactttg

SEQ ID NO: 220457 - DNA, 20 bp, Artificial Sequence
  chemically synthesized
ataaatgaggtatactttga

SEQ ID NO: 220458 - DNA, 20 bp, Artificial Sequence
  chemically synthesized
ttctgaacattttgccttca

SEQ ID NO: 220459 - DNA, 20 bp, Artificial Sequence
  chemically synthesized
tactttgaaggcaaaatgtt

SEQ ID NO: 220460 - DNA, 20 bp, Artificial Sequence
  chemically synthesized
aaggcaaaatgttcagaaaa

SEQ ID NO: 220461 - DNA, 20 bp, Artificial Sequence
  chemically synthesized
aggcaaaatgttcagaaaat

SEQ ID NO: 220462 - DNA, 20 bp, Artificial Sequence
  chemically synthesized
ggcaaaatgttcagaaaata

SEQ ID NO: 220463 - DNA, 20 bp, Artificial Sequence
  chemically synthesized
tcagaaaatagggtatatgt

SEQ ID NO: 220464 - DNA, 20 bp, Artificial Sequence
  chemically synthesized
agggtatatgtgagatgaaa

SEQ ID NO: 220465 - DNA, 20 bp, Artificial Sequence
  chemically synthesized
gtgagatgaaaaagtatcct

SEQ ID NO: 220466 - DNA, 20 bp, Artificial Sequence
  chemically synthesized
gagatgaaaaagtatcctca

SEQ ID NO: 220467 - DNA, 20 bp, Artificial Sequence
  chemically synthesized
ggcaaatcctttcatctctg

SEQ ID NO: 220468 - DNA, 20 bp, Artificial Sequence
  chemically synthesized
tggcaaatcctttcatctct

SEQ ID NO: 220469 - DNA, 20 bp, Artificial Sequence
  chemically synthesized
aaaagtatcctcagagatga

SEQ ID NO: 220470 - DNA, 20 bp, Artificial Sequence
  chemically synthesized
aaagtatcctcagagatgaa

SEQ ID NO: 220471 - DNA, 20 bp, Artificial Sequence
  chemically synthesized
atggaatttatatcagtttt

SEQ ID NO: 220472 - DNA, 20 bp, Artificial Sequence
  chemically synthesized
tgcacccatggaatttatat

SEQ ID NO: 220473 - DNA, 20 bp, Artificial Sequence
  chemically synthesized
aaaaactgatataaattcca

SEQ ID NO: 220474 - DNA, 20 bp, Artificial Sequence
  chemically synthesized
aaaactgatataaattccat

SEQ ID NO: 220475 - DNA, 20 bp, Artificial Sequence
  chemically synthesized
tagaactctgtttgcaccca

SEQ ID NO: 220476 - DNA, 20 bp, Artificial Sequence
  chemically synthesized
ataaattccatgggtgcaaa

SEQ ID NO: 220477 - DNA, 20 bp, Artificial Sequence
  chemically synthesized
aaattccatgggtgcaaaca

SEQ ID NO: 220478 - DNA, 20 bp, Artificial Sequence
  chemically synthesized
atgggtgcaaacagagttct

SEQ ID NO: 220479 - DNA, 20 bp, Artificial Sequence
  chemically synthesized
aaatcttattgcagtaggct

SEQ ID NO: 220480 - DNA, 20 bp, Artificial Sequence
  chemically synthesized
aagtcaaatcttattgcagt

SEQ ID NO: 220481 - DNA, 20 bp, Artificial Sequence
  chemically synthesized
agttctaagcctactgcaat

SEQ ID NO: 220482 - DNA, 20 bp, Artificial Sequence
  chemically synthesized
aaagtcaaatcttattgcag

SEQ ID NO: 220483 - DNA, 20 bp, Artificial Sequence
  chemically synthesized
aataaagtcaaatcttattg

SEQ ID NO: 220484 - DNA, 20 bp, Artificial Sequence
  chemically synthesized
gcaataagatttgactttat

SEQ ID NO: 220485 - DNA, 20 bp, Artificial Sequence
  chemically synthesized
atttcatagataatccaata

SEQ ID NO: 220486 - DNA, 20 bp, Artificial Sequence
  chemically synthesized
tactacaataatatatttca

SEQ ID NO: 220487 - DNA, 20 bp, Artificial Sequence
  chemically synthesized
atctatgaaatatattattg

SEQ ID NO: 220488 - DNA, 20 bp, Artificial Sequence
  chemically synthesized
tatgaaatatattattgtag

SEQ ID NO: 220489 - DNA, 20 bp, Artificial Sequence
  chemically synthesized
atgaaatatattattgtagt

SEQ ID NO: 220490 - DNA, 20 bp, Artificial Sequence
  chemically synthesized
tgaaatatattattgtagta

SEQ ID NO: 220491 - DNA, 20 bp, Artificial Sequence
  chemically synthesized
gaaatatattattgtagtag

SEQ ID NO: 220492 - DNA, 20 bp, Artificial Sequence
  chemically synthesized
gtagtaggggtctattttta

SEQ ID NO: 220493 - DNA, 20 bp, Artificial Sequence
  chemically synthesized
accagatgtggccataaaaa

SEQ ID NO: 220494 - DNA, 20 bp, Artificial Sequence
  chemically synthesized
tctatttttatggccacatc

SEQ ID NO: 220495 - DNA, 20 bp, Artificial Sequence
  chemically synthesized
tgtgaagtctagaccagatg

SEQ ID NO: 220496 - DNA, 20 bp, Artificial Sequence
  chemically synthesized
ttttatggccacatctggtc

SEQ ID NO: 220497 - DNA, 20 bp, Artificial Sequence
  chemically synthesized
ttcttttgtgaagtctagac

SEQ ID NO: 220498 - DNA, 20 bp, Artificial Sequence
  chemically synthesized
tgtaattcttttgtgaagtc

SEQ ID NO: 220499 - DNA, 20 bp, Artificial Sequence
  chemically synthesized
atctggtctagacttcacaa

SEQ ID NO: 220500 - DNA, 20 bp, Artificial Sequence
  chemically synthesized
cccattgtaattcttttgtg

SEQ ID NO: 220501 - DNA, 20 bp, Artificial Sequence
  chemically synthesized
acttcacaaaagaattacaa

SEQ ID NO: 220502 - DNA, 20 bp, Artificial Sequence
  chemically synthesized
cttcacaaaagaattacaat

SEQ ID NO: 220503 - DNA, 20 bp, Artificial Sequence
  chemically synthesized
caatgggaatatactctacc

SEQ ID NO: 220504 - DNA, 20 bp, Artificial Sequence
  chemically synthesized
tgttttttggcatcttggta

SEQ ID NO: 220505 - DNA, 20 bp, Artificial Sequence
  chemically synthesized
tgtgttttttggcatcttgg

SEQ ID NO: 220506 - DNA, 20 bp, Artificial Sequence
  chemically synthesized
atatgtgttttttggcatct

SEQ ID NO: 220507 - DNA, 20 bp, Artificial Sequence
  chemically synthesized
atgaagagatatgtgttttt

SEQ ID NO: 220508 - DNA, 20 bp, Artificial Sequence
  chemically synthesized
caatatctttcaggaatgaa

SEQ ID NO: 220509 - DNA, 20 bp, Artificial Sequence
  chemically synthesized
ggcaatatctttcaggaatg

SEQ ID NO: 220510 - DNA, 20 bp, Artificial Sequence
  chemically synthesized
acatatctcttcattcctga

SEQ ID NO: 220511 - DNA, 20 bp, Artificial Sequence
  chemically synthesized
cagtctaggcaatatctttc

SEQ ID NO: 220512 - DNA, 20 bp, Artificial Sequence
  chemically synthesized
acagtctaggcaatatcttt

SEQ ID NO: 220513 - DNA, 20 bp, Artificial Sequence
  chemically synthesized
cattcctgaaagatattgcc

SEQ ID NO: 220514 - DNA, 20 bp, Artificial Sequence
  chemically synthesized
ttttcagatttagacagtct

SEQ ID NO: 220515 - DNA, 20 bp, Artificial Sequence
  chemically synthesized
attttcagatttagacagtc

SEQ ID NO: 220516 - DNA, 20 bp, Artificial Sequence
  chemically synthesized
tgttaattttcagatttaga

SEQ ID NO: 220517 - DNA, 20 bp, Artificial Sequence
  chemically synthesized
tccttgttaattttcagatt

SEQ ID NO: 220518 - DNA, 20 bp, Artificial Sequence
  chemically synthesized
acagaatccttgttaatttt

SEQ ID NO: 220519 - DNA, 20 bp, Artificial Sequence
  chemically synthesized
gtctaaatctgaaaattaac

SEQ ID NO: 220520 - DNA, 20 bp, Artificial Sequence
  chemically synthesized
tctaaatctgaaaattaaca

SEQ ID NO: 220521 - DNA, 20 bp, Artificial Sequence
  chemically synthesized
agatgaaaatgaagtaatta

SEQ ID NO: 220522 - DNA, 20 bp, Artificial Sequence
  chemically synthesized
gggaaatgtagatgaaaatg

SEQ ID NO: 220523 - DNA, 20 bp, Artificial Sequence
  chemically synthesized
ccttttagtttggggaaatg

SEQ ID NO: 220524 - DNA, 20 bp, Artificial Sequence
  chemically synthesized
ctaggataccttttagtttg

SEQ ID NO: 220525 - DNA, 20 bp, Artificial Sequence
  chemically synthesized
tctacatttccccaaactaa

SEQ ID NO: 220526 - DNA, 20 bp, Artificial Sequence
  chemically synthesized
tctaggataccttttagttt

SEQ ID NO: 220527 - DNA, 20 bp, Artificial Sequence
  chemically synthesized
ctacatttccccaaactaaa

SEQ ID NO: 220528 - DNA, 20 bp, Artificial Sequence
  chemically synthesized
atctaggataccttttagtt

SEQ ID NO: 220529 - DNA, 20 bp, Artificial Sequence
  chemically synthesized
aaataatctaggataccttt

SEQ ID NO: 220530 - DNA, 20 bp, Artificial Sequence
  chemically synthesized
ccccaaactaaaaggtatcc

SEQ ID NO: 220531 - DNA, 20 bp, Artificial Sequence
  chemically synthesized
atctatagctcaaataatct

SEQ ID NO: 220532 - DNA, 20 bp, Artificial Sequence
  chemically synthesized
catctatagctcaaataatc

SEQ ID NO: 220533 - DNA, 20 bp, Artificial Sequence
  chemically synthesized
aaaggtatcctagattattt

SEQ ID NO: 220534 - DNA, 20 bp, Artificial Sequence
  chemically synthesized
atcctagattatttgagcta

SEQ ID NO: 220535 - DNA, 20 bp, Artificial Sequence
  chemically synthesized
tgtacataaaaacacatcta

SEQ ID NO: 220536 - DNA, 20 bp, Artificial Sequence
  chemically synthesized
tatagatgtgtttttatgta

SEQ ID NO: 220537 - DNA, 20 bp, Artificial Sequence
  chemically synthesized
tagtggactattaatttaaa

SEQ ID NO: 220538 - DNA, 20 bp, Artificial Sequence
  chemically synthesized
tgtacagctttttaaattaa

SEQ ID NO: 220539 - DNA, 20 bp, Artificial Sequence
  chemically synthesized
tttttaaattaatagtccac

SEQ ID NO: 220540 - DNA, 20 bp, Artificial Sequence
  chemically synthesized
gctgtaaccgatagagctag

SEQ ID NO: 220541 - DNA, 20 bp, Artificial Sequence
  chemically synthesized
taatagtccactagctctat

SEQ ID NO: 220542 - DNA, 20 bp, Artificial Sequence
  chemically synthesized
actgctgtaaccgatagagc

SEQ ID NO: 220543 - DNA, 20 bp, Artificial Sequence
  chemically synthesized
tattactgctgtaaccgata

SEQ ID NO: 220544 - DNA, 20 bp, Artificial Sequence
  chemically synthesized
tccactagctctatcggtta

SEQ ID NO: 220545 - DNA, 20 bp, Artificial Sequence
  chemically synthesized
tttattactgctgtaaccga

SEQ ID NO: 220546 - DNA, 20 bp, Artificial Sequence
  chemically synthesized
actagctctatcggttacag

SEQ ID NO: 220547 - DNA, 20 bp, Artificial Sequence
  chemically synthesized
cagtaataaaaaaactttta

SEQ ID NO: 220548 - DNA, 20 bp, Artificial Sequence
  chemically synthesized
aataaaaaaacttttatgga

SEQ ID NO: 220549 - DNA, 20 bp, Artificial Sequence
  chemically synthesized
tctcagagaactttccataa

SEQ ID NO: 220550 - DNA, 20 bp, Artificial Sequence
  chemically synthesized
acttttatggaaagttctct

SEQ ID NO: 220551 - DNA, 20 bp, Artificial Sequence
  chemically synthesized
gtaaatcacttttagtctca

SEQ ID NO: 220552 - DNA, 20 bp, Artificial Sequence
  chemically synthesized
ggaaagttctctgagactaa

SEQ ID NO: 220553 - DNA, 20 bp, Artificial Sequence
  chemically synthesized
atgtaaatcacttttagtct

SEQ ID NO: 220554 - DNA, 20 bp, Artificial Sequence
  chemically synthesized
atttgcatgtaaatcacttt

SEQ ID NO: 220555 - DNA, 20 bp, Artificial Sequence
  chemically synthesized
gtgatttacatgcaaatata

SEQ ID NO: 220556 - DNA, 20 bp, Artificial Sequence
  chemically synthesized
ttttgttactgttttaagaa

SEQ ID NO: 220557 - DNA, 20 bp, Artificial Sequence
  chemically synthesized
cttttgttactgttttaaga

SEQ ID NO: 220558 - DNA, 20 bp, Artificial Sequence
  chemically synthesized
aaatgattcccttcttaaaa

SEQ ID NO: 220559 - DNA, 20 bp, Artificial Sequence
  chemically synthesized
ccttttgttactgttttaag

SEQ ID NO: 220560 - DNA, 20 bp, Artificial Sequence
  chemically synthesized
acaccttttgttactgtttt

SEQ ID NO: 220561 - DNA, 20 bp, Artificial Sequence
  chemically synthesized
ccttcttaaaacagtaacaa

SEQ ID NO: 220562 - DNA, 20 bp, Artificial Sequence
  chemically synthesized
cttcttaaaacagtaacaaa

SEQ ID NO: 220563 - DNA, 20 bp, Artificial Sequence
  chemically synthesized
gtgtttgaaaattcatgctt

SEQ ID NO: 220564 - DNA, 20 bp, Artificial Sequence
  chemically synthesized
tttgaaaattcatgctttgg

SEQ ID NO: 220565 - DNA, 20 bp, Artificial Sequence
  chemically synthesized
gaaaatcatttattcttcca

SEQ ID NO: 220566 - DNA, 20 bp, Artificial Sequence
  chemically synthesized
tgattttcacataatcattc

SEQ ID NO: 220567 - DNA, 20 bp, Artificial Sequence
  chemically synthesized
tttcacataatcattctagt

SEQ ID NO: 220568 - DNA, 20 bp, Artificial Sequence
  chemically synthesized
aataaaaataaacaacttac

SEQ ID NO: 220569 - DNA, 20 bp, Artificial Sequence
  chemically synthesized
tattgacatgcatcttttat

SEQ ID NO: 220570 - DNA, 20 bp, Artificial Sequence
  chemically synthesized
caccattaaatagctaataa

SEQ ID NO: 220571 - DNA, 20 bp, Artificial Sequence
  chemically synthesized
atcttttattagctatttaa

SEQ ID NO: 220572 - DNA, 20 bp, Artificial Sequence
  chemically synthesized
ccctgtgaaccaccattaaa

SEQ ID NO: 220573 - DNA, 20 bp, Artificial Sequence
  chemically synthesized
ttttattagctatttaatgg

SEQ ID NO: 220574 - DNA, 20 bp, Artificial Sequence
  chemically synthesized
agctatttaatggtggttca

SEQ ID NO: 220575 - DNA, 20 bp, Artificial Sequence
  chemically synthesized
gctatttaatggtggttcac

SEQ ID NO: 220576 - DNA, 20 bp, Artificial Sequence
  chemically synthesized
ctatttaatggtggttcaca

SEQ ID NO: 220577 - DNA, 20 bp, Artificial Sequence
  chemically synthesized
tatttaatggtggttcacag

SEQ ID NO: 220578 - DNA, 20 bp, Artificial Sequence
  chemically synthesized
taatggtggttcacaggggt

SEQ ID NO: 220579 - DNA, 20 bp, Artificial Sequence
  chemically synthesized
gttcacaggggtgagtgcac

SEQ ID NO: 220580 - DNA, 20 bp, Artificial Sequence
  chemically synthesized
ccgagattacaggcgtgatc

SEQ ID NO: 220581 - DNA, 20 bp, Artificial Sequence
  chemically synthesized
ctggatcacgcctgtaatct

SEQ ID NO: 220582 - DNA, 20 bp, Artificial Sequence
  chemically synthesized
tcccaaaatgccgagattac

SEQ ID NO: 220583 - DNA, 20 bp, Artificial Sequence
  chemically synthesized
ctcccaaaatgccgagatta

SEQ ID NO: 220584 - DNA, 20 bp, Artificial Sequence
  chemically synthesized
cgcctgtaatctcggcattt

SEQ ID NO: 220585 - DNA, 20 bp, Artificial Sequence
  chemically synthesized
ccttggcctcccaaaatgcc

SEQ ID NO: 220586 - DNA, 20 bp, Artificial Sequence
  chemically synthesized
gcctgtaatctcggcatttt

SEQ ID NO: 220587 - DNA, 20 bp, Artificial Sequence
  chemically synthesized
ctgtaatctcggcattttgg

SEQ ID NO: 220588 - DNA, 20 bp, Artificial Sequence
  chemically synthesized
tgtaatctcggcattttggg

SEQ ID NO: 220589 - DNA, 20 bp, Artificial Sequence
  chemically synthesized
tctcggcattttgggaggcc

SEQ ID NO: 220590 - DNA, 20 bp, Artificial Sequence
  chemically synthesized
ctcggcattttgggaggcca

SEQ ID NO: 220591 - DNA, 20 bp, Artificial Sequence
  chemically synthesized
ggcattttgggaggccaagg

SEQ ID NO: 220592 - DNA, 20 bp, Artificial Sequence
  chemically synthesized
gcattttgggaggccaaggt

SEQ ID NO: 220593 - DNA, 20 bp, Artificial Sequence
  chemically synthesized
ttttgggaggccaaggtggg

SEQ ID NO: 220594 - DNA, 20 bp, Artificial Sequence
  chemically synthesized
ctcaagcaatctgcccacct

SEQ ID NO: 220595 - DNA, 20 bp, Artificial Sequence
  chemically synthesized
ccaaggtgggcagattgctt

SEQ ID NO: 220596 - DNA, 20 bp, Artificial Sequence
  chemically synthesized
gtgggcagattgcttgagct

SEQ ID NO: 220597 - DNA, 20 bp, Artificial Sequence
  chemically synthesized
tgggcagattgcttgagctc

SEQ ID NO: 220598 - DNA, 20 bp, Artificial Sequence
  chemically synthesized
ggtctcaaactcctgagctc

SEQ ID NO: 220599 - DNA, 20 bp, Artificial Sequence
  chemically synthesized
ggcagattgcttgagctcag

SEQ ID NO: 220600 - DNA, 20 bp, Artificial Sequence
  chemically synthesized
ccatctggtctcaaactcct

SEQ ID NO: 220601 - DNA, 20 bp, Artificial Sequence
  chemically synthesized
ttgcttgagctcaggagttt

SEQ ID NO: 220602 - DNA, 20 bp, Artificial Sequence
  chemically synthesized
tgagctcaggagtttgagac

SEQ ID NO: 220603 - DNA, 20 bp, Artificial Sequence
  chemically synthesized
ctcaggagtttgagaccaga

SEQ ID NO: 220604 - DNA, 20 bp, Artificial Sequence
  chemically synthesized
agagatggtgtttcaccatc

SEQ ID NO: 220605 - DNA, 20 bp, Artificial Sequence
  chemically synthesized
tttgtatttttttttagaga

SEQ ID NO: 220606 - DNA, 20 bp, Artificial Sequence
  chemically synthesized
attttttgtattttttttta

SEQ ID NO: 220607 - DNA, 20 bp, Artificial Sequence
  chemically synthesized
taattttttgtatttttttt

SEQ ID NO: 220608 - DNA, 20 bp, Artificial Sequence
  chemically synthesized
taaaaaaaaatacaaaaaat

SEQ ID NO: 220609 - DNA, 20 bp, Artificial Sequence
  chemically synthesized
aaaaaatacaaaaaattagc

SEQ ID NO: 220610 - DNA, 20 bp, Artificial Sequence
  chemically synthesized
aaaaatacaaaaaattagct

SEQ ID NO: 220611 - DNA, 20 bp, Artificial Sequence
  chemically synthesized
tacaaaaaattagctgggca

SEQ ID NO: 220612 - DNA, 20 bp, Artificial Sequence
  chemically synthesized
aaaaaattagctgggcatgg

SEQ ID NO: 220613 - DNA, 20 bp, Artificial Sequence
  chemically synthesized
ctggcgcacgccaccatgcc

SEQ ID NO: 220614 - DNA, 20 bp, Artificial Sequence
  chemically synthesized
ctgggcatggtggcgtgcgc

SEQ ID NO: 220615 - DNA, 20 bp, Artificial Sequence
  chemically synthesized
ggcatggtggcgtgcgccag

SEQ ID NO: 220616 - DNA, 20 bp, Artificial Sequence
  chemically synthesized
gtggcgtgcgccagtagcct

SEQ ID NO: 220617 - DNA, 20 bp, Artificial Sequence
  chemically synthesized
tcccgggtagctgaggctac

SEQ ID NO: 220618 - DNA, 20 bp, Artificial Sequence
  chemically synthesized
ctcagcctcccgggtagctg

SEQ ID NO: 220619 - DNA, 20 bp, Artificial Sequence
  chemically synthesized
cgccagtagcctcagctacc

SEQ ID NO: 220620 - DNA, 20 bp, Artificial Sequence
  chemically synthesized
cctcagcctcccgggtagct

SEQ ID NO: 220621 - DNA, 20 bp, Artificial Sequence
  chemically synthesized
gccagtagcctcagctaccc

SEQ ID NO: 220622 - DNA, 20 bp, Artificial Sequence
  chemically synthesized
cagtagcctcagctacccgg

SEQ ID NO: 220623 - DNA, 20 bp, Artificial Sequence
  chemically synthesized
agtagcctcagctacccggg

SEQ ID NO: 220624 - DNA, 20 bp, Artificial Sequence
  chemically synthesized
tcccacctcagcctcccggg

SEQ ID NO: 220625 - DNA, 20 bp, Artificial Sequence
  chemically synthesized
tcctcccacctcagcctccc

SEQ ID NO: 220626 - DNA, 20 bp, Artificial Sequence
  chemically synthesized
cctcagctacccgggaggct

SEQ ID NO: 220627 - DNA, 20 bp, Artificial Sequence
  chemically synthesized
atcctcccacctcagcctcc

SEQ ID NO: 220628 - DNA, 20 bp, Artificial Sequence
  chemically synthesized
ctcagctacccgggaggctg

SEQ ID NO: 220629 - DNA, 20 bp, Artificial Sequence
  chemically synthesized
agctacccgggaggctgagg

SEQ ID NO: 220630 - DNA, 20 bp, Artificial Sequence
  chemically synthesized
gctacccgggaggctgaggt

SEQ ID NO: 220631 - DNA, 20 bp, Artificial Sequence
  chemically synthesized
tacccgggaggctgaggtgg

SEQ ID NO: 220632 - DNA, 20 bp, Artificial Sequence
  chemically synthesized
acccgggaggctgaggtggg

SEQ ID NO: 220633 - DNA, 20 bp, Artificial Sequence
  chemically synthesized
ctcaggtgatcctcccacct

SEQ ID NO: 220634 - DNA, 20 bp, Artificial Sequence
  chemically synthesized
ctgaggtgggaggatcacct

SEQ ID NO: 220635 - DNA, 20 bp, Artificial Sequence
  chemically synthesized
gtgggaggatcacctgagcc

SEQ ID NO: 220636 - DNA, 20 bp, Artificial Sequence
  chemically synthesized
tgcctcaaccatccaggctc

SEQ ID NO: 220637 - DNA, 20 bp, Artificial Sequence
  chemically synthesized
ctgcctcaaccatccaggct

SEQ ID NO: 220638 - DNA, 20 bp, Artificial Sequence
  chemically synthesized
gaggatcacctgagcctgga

SEQ ID NO: 220639 - DNA, 20 bp, Artificial Sequence
  chemically synthesized
gctcactgcctcaaccatcc

SEQ ID NO: 220640 - DNA, 20 bp, Artificial Sequence
  chemically synthesized
tcacctgagcctggatggtt

SEQ ID NO: 220641 - DNA, 20 bp, Artificial Sequence
  chemically synthesized
ggctcactgcctcaaccatc

SEQ ID NO: 220642 - DNA, 20 bp, Artificial Sequence
  chemically synthesized
cacctgagcctggatggttg

SEQ ID NO: 220643 - DNA, 20 bp, Artificial Sequence
  chemically synthesized
ctgagcctggatggttgagg

SEQ ID NO: 220644 - DNA, 20 bp, Artificial Sequence
  chemically synthesized
gcctggatggttgaggcagt

SEQ ID NO: 220645 - DNA, 20 bp, Artificial Sequence
  chemically synthesized
tgagtgcagtggtgcattca

SEQ ID NO: 220646 - DNA, 20 bp, Artificial Sequence
  chemically synthesized
ctgcccaggcttgagtgcag

SEQ ID NO: 220647 - DNA, 20 bp, Artificial Sequence
  chemically synthesized
atgaatgcaccactgcactc

SEQ ID NO: 220648 - DNA, 20 bp, Artificial Sequence
  chemically synthesized
ctgctgcccaggcttgagtg

SEQ ID NO: 220649 - DNA, 20 bp, Artificial Sequence
  chemically synthesized
tgcaccactgcactcaagcc

SEQ ID NO: 220650 - DNA, 20 bp, Artificial Sequence
  chemically synthesized
gcaccactgcactcaagcct

SEQ ID NO: 220651 - DNA, 20 bp, Artificial Sequence
  chemically synthesized
ttgctctgctgcccaggctt

SEQ ID NO: 220652 - DNA, 20 bp, Artificial Sequence
  chemically synthesized
ccactgcactcaagcctggg

SEQ ID NO: 220653 - DNA, 20 bp, Artificial Sequence
  chemically synthesized
ctgcactcaagcctgggcag

SEQ ID NO: 220654 - DNA, 20 bp, Artificial Sequence
  chemically synthesized
aaagtcttgctctgctgccc

SEQ ID NO: 220655 - DNA, 20 bp, Artificial Sequence
  chemically synthesized
gcactcaagcctgggcagca

SEQ ID NO: 220656 - DNA, 20 bp, Artificial Sequence
  chemically synthesized
caaagtcttgctctgctgcc

SEQ ID NO: 220657 - DNA, 20 bp, Artificial Sequence
  chemically synthesized
tcaagcctgggcagcagagc

SEQ ID NO: 220658 - DNA, 20 bp, Artificial Sequence
  chemically synthesized
gatcacatttttttgagaca

SEQ ID NO: 220659 - DNA, 20 bp, Artificial Sequence
  chemically synthesized
tttgtggatcacattttttt

SEQ ID NO: 220660 - DNA, 20 bp, Artificial Sequence
  chemically synthesized
caacttaaatttgttttttg

SEQ ID NO: 220661 - DNA, 20 bp, Artificial Sequence
  chemically synthesized
gatccacaaaaaacaaattt

SEQ ID NO: 220662 - DNA, 20 bp, Artificial Sequence
  chemically synthesized
atttaagttgttgaatattt

SEQ ID NO: 220663 - DNA, 20 bp, Artificial Sequence
  chemically synthesized
tttaagttgttgaatatttt

SEQ ID NO: 220664 - DNA, 20 bp, Artificial Sequence
  chemically synthesized
agttgttgaatattttaggc

SEQ ID NO: 220665 - DNA, 20 bp, Artificial Sequence
  chemically synthesized
ttaaagttaagtatttgagc

SEQ ID NO: 220666 - DNA, 20 bp, Artificial Sequence
  chemically synthesized
aaaattaaagttaagtattt

SEQ ID NO: 220667 - DNA, 20 bp, Artificial Sequence
  chemically synthesized
tttaatagaaaattaaagtt

SEQ ID NO: 220668 - DNA, 20 bp, Artificial Sequence
  chemically synthesized
tatattttaatagaaaatta

SEQ ID NO: 220669 - DNA, 20 bp, Artificial Sequence
  chemically synthesized
aaataaggtatatattttaa

SEQ ID NO: 220670 - DNA, 20 bp, Artificial Sequence
  chemically synthesized
gataccattagcattaaata

SEQ ID NO: 220671 - DNA, 20 bp, Artificial Sequence
  chemically synthesized
agataccattagcattaaat

SEQ ID NO: 220672 - DNA, 20 bp, Artificial Sequence
  chemically synthesized
tataccttatttaatgctaa

SEQ ID NO: 220673 - DNA, 20 bp, Artificial Sequence
  chemically synthesized
agctgcaaattagataccat

SEQ ID NO: 220674 - DNA, 20 bp, Artificial Sequence
  chemically synthesized
tgctaatggtatctaatttg

SEQ ID NO: 220675 - DNA, 20 bp, Artificial Sequence
  chemically synthesized
tagtaacgatagctgcaaat

SEQ ID NO: 220676 - DNA, 20 bp, Artificial Sequence
  chemically synthesized
gtttatgtgtatagtaacga

SEQ ID NO: 220677 - DNA, 20 bp, Artificial Sequence
  chemically synthesized
atttgtgcagtttatgtgta

SEQ ID NO: 220678 - DNA, 20 bp, Artificial Sequence
  chemically synthesized
tctatttattttgatttgtg

SEQ ID NO: 220679 - DNA, 20 bp, Artificial Sequence
  chemically synthesized
actgcacaaatcaaaataaa

SEQ ID NO: 220680 - DNA, 20 bp, Artificial Sequence
  chemically synthesized
aaacaaatattaataaaatt

SEQ ID NO: 220681 - DNA, 20 bp, Artificial Sequence
  chemically synthesized
aatttagtcattaacccttc

SEQ ID NO: 220682 - DNA, 20 bp, Artificial Sequence
  chemically synthesized
ttataacatgtcatccagaa

SEQ ID NO: 220683 - DNA, 20 bp, Artificial Sequence
  chemically synthesized
attataacatgtcatccaga

SEQ ID NO: 220684 - DNA, 20 bp, Artificial Sequence
  chemically synthesized
aattataacatgtcatccag

SEQ ID NO: 220685 - DNA, 20 bp, Artificial Sequence
  chemically synthesized
cctaattataacatgtcatc

SEQ ID NO: 220686 - DNA, 20 bp, Artificial Sequence
  chemically synthesized
tctggatgacatgttataat

SEQ ID NO: 220687 - DNA, 20 bp, Artificial Sequence
  chemically synthesized
ctggatgacatgttataatt

SEQ ID NO: 220688 - DNA, 20 bp, Artificial Sequence
  chemically synthesized
gttataattaggatattaat

SEQ ID NO: 220689 - DNA, 20 bp, Artificial Sequence
  chemically synthesized
attaggatattaattggaat

SEQ ID NO: 220690 - DNA, 20 bp, Artificial Sequence
  chemically synthesized
attggcattataaaaccatt

SEQ ID NO: 220691 - DNA, 20 bp, Artificial Sequence
  chemically synthesized
ttaatacaacgaattctaaa

SEQ ID NO: 220692 - DNA, 20 bp, Artificial Sequence
  chemically synthesized
ttccccatgatttatggaat

SEQ ID NO: 220693 - DNA, 20 bp, Artificial Sequence
  chemically synthesized
aaatctgattccataaatca

SEQ ID NO: 220694 - DNA, 20 bp, Artificial Sequence
  chemically synthesized
aaaaaattccccatgattta

SEQ ID NO: 220695 - DNA, 20 bp, Artificial Sequence
  chemically synthesized
aatctgattccataaatcat

SEQ ID NO: 220696 - DNA, 20 bp, Artificial Sequence
  chemically synthesized
atctgattccataaatcatg

SEQ ID NO: 220697 - DNA, 20 bp, Artificial Sequence
  chemically synthesized
tattttaatgacccatgtat

SEQ ID NO: 220698 - DNA, 20 bp, Artificial Sequence
  chemically synthesized
tttctgtaagtctaatacat

SEQ ID NO: 220699 - DNA, 20 bp, Artificial Sequence
  chemically synthesized
ttttctgtaagtctaataca

SEQ ID NO: 220700 - DNA, 20 bp, Artificial Sequence
  chemically synthesized
tgacccatgtattagactta

SEQ ID NO: 220701 - DNA, 20 bp, Artificial Sequence
  chemically synthesized
taaggtccacaattttctgt

SEQ ID NO: 220702 - DNA, 20 bp, Artificial Sequence
  chemically synthesized
attagacttacagaaaattg

SEQ ID NO: 220703 - DNA, 20 bp, Artificial Sequence
  chemically synthesized
tacagaaaattgtggacctt

SEQ ID NO: 220704 - DNA, 20 bp, Artificial Sequence
  chemically synthesized
ttttaataaaacattactta

SEQ ID NO: 220705 - DNA, 20 bp, Artificial Sequence
  chemically synthesized
attttaataaaacattactt

SEQ ID NO: 220706 - DNA, 20 bp, Artificial Sequence
  chemically synthesized
aaatatgacaaattaaatag

SEQ ID NO: 220707 - DNA, 20 bp, Artificial Sequence
  chemically synthesized
tttaaatatgacaaattaaa

SEQ ID NO: 220708 - DNA, 20 bp, Artificial Sequence
  chemically synthesized
taatttgtcatatttaaaaa

SEQ ID NO: 220709 - DNA, 20 bp, Artificial Sequence
  chemically synthesized
tttaaaaatagctaaaatca

SEQ ID NO: 220710 - DNA, 20 bp, Artificial Sequence
  chemically synthesized
taaaattaaaactatgattt

SEQ ID NO: 220711 - DNA, 20 bp, Artificial Sequence
  chemically synthesized
taaaatcatagttttaattt

SEQ ID NO: 220712 - DNA, 20 bp, Artificial Sequence
  chemically synthesized
aatatttttcattgtgttct

SEQ ID NO: 220713 - DNA, 20 bp, Artificial Sequence
  chemically synthesized
tttttcattgtgttctaagt

SEQ ID NO: 220714 - DNA, 20 bp, Artificial Sequence
  chemically synthesized
tgtttaagggttggcttact

SEQ ID NO: 220715 - DNA, 20 bp, Artificial Sequence
  chemically synthesized
agcatttgatgtttaagggt

SEQ ID NO: 220716 - DNA, 20 bp, Artificial Sequence
  chemically synthesized
agaaagcatttgatgtttaa

SEQ ID NO: 220717 - DNA, 20 bp, Artificial Sequence
  chemically synthesized
aagaaagcatttgatgttta

SEQ ID NO: 220718 - DNA, 20 bp, Artificial Sequence
  chemically synthesized
aaagaaagcatttgatgttt

SEQ ID NO: 220719 - DNA, 20 bp, Artificial Sequence
  chemically synthesized
aaacatcaaatgctttcttt

SEQ ID NO: 220720 - DNA, 20 bp, Artificial Sequence
  chemically synthesized
aacatcaaatgctttctttt

SEQ ID NO: 220721 - DNA, 20 bp, Artificial Sequence
  chemically synthesized
aaaagacatatcccaaaaga

SEQ ID NO: 220722 - DNA, 20 bp, Artificial Sequence
  chemically synthesized
gttgaaaagacatatcccaa

SEQ ID NO: 220723 - DNA, 20 bp, Artificial Sequence
  chemically synthesized
tgagggaaccagaagttgaa

SEQ ID NO: 220724 - DNA, 20 bp, Artificial Sequence
  chemically synthesized
ggatatgtcttttcaacttc

SEQ ID NO: 220725 - DNA, 20 bp, Artificial Sequence
  chemically synthesized
atcaaacctgagggaaccag

SEQ ID NO: 220726 - DNA, 20 bp, Artificial Sequence
  chemically synthesized
ttttcaacttctggttccct

SEQ ID NO: 220727 - DNA, 20 bp, Artificial Sequence
  chemically synthesized
tggatcaaacctgagggaac

SEQ ID NO: 220728 - DNA, 20 bp, Artificial Sequence
  chemically synthesized
tttcaacttctggttccctc

SEQ ID NO: 220729 - DNA, 20 bp, Artificial Sequence
  chemically synthesized
tgtcaatggatcaaacctga

SEQ ID NO: 220730 - DNA, 20 bp, Artificial Sequence
  chemically synthesized
atgtcaatggatcaaacctg

SEQ ID NO: 220731 - DNA, 20 bp, Artificial Sequence
  chemically synthesized
aatgtcaatggatcaaacct

SEQ ID NO: 220732 - DNA, 20 bp, Artificial Sequence
  chemically synthesized
aacagtgcctagaatgtcaa

SEQ ID NO: 220733 - DNA, 20 bp, Artificial Sequence
  chemically synthesized
ggtttgatccattgacattc

SEQ ID NO: 220734 - DNA, 20 bp, Artificial Sequence
  chemically synthesized
gtttgatccattgacattct

SEQ ID NO: 220735 - DNA, 20 bp, Artificial Sequence
  chemically synthesized
tgggacacaccaacagtgcc

SEQ ID NO: 220736 - DNA, 20 bp, Artificial Sequence
  chemically synthesized
attgacattctaggcactgt

SEQ ID NO: 220737 - DNA, 20 bp, Artificial Sequence
  chemically synthesized
tactaggtgggacacaccaa

SEQ ID NO: 220738 - DNA, 20 bp, Artificial Sequence
  chemically synthesized
cactgttggtgtgtcccacc

SEQ ID NO: 220739 - DNA, 20 bp, Artificial Sequence
  chemically synthesized
ctggctggtatatactaggt

SEQ ID NO: 220740 - DNA, 20 bp, Artificial Sequence
  chemically synthesized
cctggctggtatatactagg

SEQ ID NO: 220741 - DNA, 20 bp, Artificial Sequence
  chemically synthesized
aggcctggctggtatatact

SEQ ID NO: 220742 - DNA, 20 bp, Artificial Sequence
  chemically synthesized
aaggcctggctggtatatac

SEQ ID NO: 220743 - DNA, 20 bp, Artificial Sequence
  chemically synthesized
gtgtcccacctagtatatac

SEQ ID NO: 220744 - DNA, 20 bp, Artificial Sequence
  chemically synthesized
cccacctagtatataccagc

SEQ ID NO: 220745 - DNA, 20 bp, Artificial Sequence
  chemically synthesized
ccacctagtatataccagcc

SEQ ID NO: 220746 - DNA, 20 bp, Artificial Sequence
  chemically synthesized
catgataaagaaggcctggc

SEQ ID NO: 220747 - DNA, 20 bp, Artificial Sequence
  chemically synthesized
ggggcatgataaagaaggcc

SEQ ID NO: 220748 - DNA, 20 bp, Artificial Sequence
  chemically synthesized
cccagggggcatgataaaga

SEQ ID NO: 220749 - DNA, 20 bp, Artificial Sequence
  chemically synthesized
gcccagggggcatgataaag

SEQ ID NO: 220750 - DNA, 20 bp, Artificial Sequence
  chemically synthesized
tttgcccagggggcatgata

SEQ ID NO: 220751 - DNA, 20 bp, Artificial Sequence
  chemically synthesized
gccttctttatcatgccccc

SEQ ID NO: 220752 - DNA, 20 bp, Artificial Sequence
  chemically synthesized
ccttctttatcatgccccct

SEQ ID NO: 220753 - DNA, 20 bp, Artificial Sequence
  chemically synthesized
tcagtttttctttgcccagg

SEQ ID NO: 220754 - DNA, 20 bp, Artificial Sequence
  chemically synthesized
tttatcatgccccctgggca

SEQ ID NO: 220755 - DNA, 20 bp, Artificial Sequence
  chemically synthesized
atcagtttttctttgcccag

SEQ ID NO: 220756 - DNA, 20 bp, Artificial Sequence
  chemically synthesized
aatcagtttttctttgccca

SEQ ID NO: 220757 - DNA, 20 bp, Artificial Sequence
  chemically synthesized
gaatcagtttttctttgccc

SEQ ID NO: 220758 - DNA, 20 bp, Artificial Sequence
  chemically synthesized
ggaatcagtttttctttgcc

SEQ ID NO: 220759 - DNA, 20 bp, Artificial Sequence
  chemically synthesized
tattctagtataaatggaat

SEQ ID NO: 220760 - DNA, 20 bp, Artificial Sequence
  chemically synthesized
aaaactgattccatttatac

SEQ ID NO: 220761 - DNA, 20 bp, Artificial Sequence
  chemically synthesized
tgatattattctagtataaa

SEQ ID NO: 220762 - DNA, 20 bp, Artificial Sequence
  chemically synthesized
tgacaacaatgatattattc

SEQ ID NO: 220763 - DNA, 20 bp, Artificial Sequence
  chemically synthesized
ccaattgcctaggtaataag

SEQ ID NO: 220764 - DNA, 20 bp, Artificial Sequence
  chemically synthesized
tgttgtcactacttattacc

SEQ ID NO: 220765 - DNA, 20 bp, Artificial Sequence
  chemically synthesized
gttgtcactacttattacct

SEQ ID NO: 220766 - DNA, 20 bp, Artificial Sequence
  chemically synthesized
tgaccaattgcctaggtaat

SEQ ID NO: 220767 - DNA, 20 bp, Artificial Sequence
  chemically synthesized
ctacttattacctaggcaat

SEQ ID NO: 220768 - DNA, 20 bp, Artificial Sequence
  chemically synthesized
tagagtgtgaccaattgcct

SEQ ID NO: 220769 - DNA, 20 bp, Artificial Sequence
  chemically synthesized
gtagagtgtgaccaattgcc

SEQ ID NO: 220770 - DNA, 20 bp, Artificial Sequence
  chemically synthesized
agtaccataagaagggagta

SEQ ID NO: 220771 - DNA, 20 bp, Artificial Sequence
  chemically synthesized
aaagtaccataagaagggag

SEQ ID NO: 220772 - DNA, 20 bp, Artificial Sequence
  chemically synthesized
atgaaagtaccataagaagg

SEQ ID NO: 220773 - DNA, 20 bp, Artificial Sequence
  chemically synthesized
cacactctactcccttctta

SEQ ID NO: 220774 - DNA, 20 bp, Artificial Sequence
  chemically synthesized
taatgaaagtaccataagaa

SEQ ID NO: 220775 - DNA, 20 bp, Artificial Sequence
  chemically synthesized
ttaatgaaagtaccataaga

SEQ ID NO: 220776 - DNA, 20 bp, Artificial Sequence
  chemically synthesized
cttaatgaaagtaccataag

SEQ ID NO: 220777 - DNA, 20 bp, Artificial Sequence
  chemically synthesized
tgccttaatgaaagtaccat

SEQ ID NO: 220778 - DNA, 20 bp, Artificial Sequence
  chemically synthesized
cttcttatggtactttcatt

SEQ ID NO: 220779 - DNA, 20 bp, Artificial Sequence
  chemically synthesized
ttcttatggtactttcatta

SEQ ID NO: 220780 - DNA, 20 bp, Artificial Sequence
  chemically synthesized
aggaacatatgccttaatga

SEQ ID NO: 220781 - DNA, 20 bp, Artificial Sequence
  chemically synthesized
gaatggaatgtttttcataa

SEQ ID NO: 220782 - DNA, 20 bp, Artificial Sequence
  chemically synthesized
ggaatggaatgtttttcata

SEQ ID NO: 220783 - DNA, 20 bp, Artificial Sequence
  chemically synthesized
tatgaaaaacattccattcc

SEQ ID NO: 220784 - DNA, 20 bp, Artificial Sequence
  chemically synthesized
gaaaaacattccattcctgg

SEQ ID NO: 220785 - DNA, 20 bp, Artificial Sequence
  chemically synthesized
ttgacttcggctgccaggaa

SEQ ID NO: 220786 - DNA, 20 bp, Artificial Sequence
  chemically synthesized
gtagattgacttcggctgcc

SEQ ID NO: 220787 - DNA, 20 bp, Artificial Sequence
  chemically synthesized
cattccattcctggcagccg

SEQ ID NO: 220788 - DNA, 20 bp, Artificial Sequence
  chemically synthesized
tgtagattgacttcggctgc

SEQ ID NO: 220789 - DNA, 20 bp, Artificial Sequence
  chemically synthesized
ggctatttgtagattgactt

SEQ ID NO: 220790 - DNA, 20 bp, Artificial Sequence
  chemically synthesized
agccgaagtcaatctacaaa

SEQ ID NO: 220791 - DNA, 20 bp, Artificial Sequence
  chemically synthesized
atttgctacctggctatttg

SEQ ID NO: 220792 - DNA, 20 bp, Artificial Sequence
  chemically synthesized
gaagtcaatctacaaatagc

SEQ ID NO: 220793 - DNA, 20 bp, Artificial Sequence
  chemically synthesized
aagtcaatctacaaatagcc

SEQ ID NO: 220794 - DNA, 20 bp, Artificial Sequence
  chemically synthesized
tcaatctacaaatagccagg

SEQ ID NO: 220795 - DNA, 20 bp, Artificial Sequence
  chemically synthesized
atctgcattgatttgctacc

SEQ ID NO: 220796 - DNA, 20 bp, Artificial Sequence
  chemically synthesized
agccaggtagcaaatcaatg

SEQ ID NO: 220797 - DNA, 20 bp, Artificial Sequence
  chemically synthesized
agcaaatcaatgcagattac

SEQ ID NO: 220798 - DNA, 20 bp, Artificial Sequence
  chemically synthesized
caaatcaatgcagattacaa

SEQ ID NO: 220799 - DNA, 20 bp, Artificial Sequence
  chemically synthesized
tcaatgcagattacaagaga

SEQ ID NO: 220800 - DNA, 20 bp, Artificial Sequence
  chemically synthesized
gattacaagagaaagtgaac

SEQ ID NO: 220801 - DNA, 20 bp, Artificial Sequence
  chemically synthesized
aagagaaagtgaacaagcaa

SEQ ID NO: 220802 - DNA, 20 bp, Artificial Sequence
  chemically synthesized
gagaaagtgaacaagcaaca

SEQ ID NO: 220803 - DNA, 20 bp, Artificial Sequence
  chemically synthesized
aaacaaaacaaaacaaatgt

SEQ ID NO: 220804 - DNA, 20 bp, Artificial Sequence
  chemically synthesized
acaaaacaaaacaaatgtta

SEQ ID NO: 220805 - DNA, 20 bp, Artificial Sequence
  chemically synthesized
tagagattgtgacttgaacg

SEQ ID NO: 220806 - DNA, 20 bp, Artificial Sequence
  chemically synthesized
aactaggctgtgccacgttc

SEQ ID NO: 220807 - DNA, 20 bp, Artificial Sequence
  chemically synthesized
attgtgacttgaacgtggca

SEQ ID NO: 220808 - DNA, 20 bp, Artificial Sequence
  chemically synthesized
gacttgaacgtggcacagcc

SEQ ID NO: 220809 - DNA, 20 bp, Artificial Sequence
  chemically synthesized
acaaggcagaacaaggaact

SEQ ID NO: 220810 - DNA, 20 bp, Artificial Sequence
  chemically synthesized
gacaaggcagaacaaggaac

SEQ ID NO: 220811 - DNA, 20 bp, Artificial Sequence
  chemically synthesized
ttgaaggacaaggcagaaca

SEQ ID NO: 220812 - DNA, 20 bp, Artificial Sequence
  chemically synthesized
tttgaaggacaaggcagaac

SEQ ID NO: 220813 - DNA, 20 bp, Artificial Sequence
  chemically synthesized
ctgttttttgaaggacaagg

SEQ ID NO: 220814 - DNA, 20 bp, Artificial Sequence
  chemically synthesized
accctgttttttgaaggaca

SEQ ID NO: 220815 - DNA, 20 bp, Artificial Sequence
  chemically synthesized
gaccctgttttttgaaggac

SEQ ID NO: 220816 - DNA, 20 bp, Artificial Sequence
  chemically synthesized
ataatgaccctgttttttga

SEQ ID NO: 220817 - DNA, 20 bp, Artificial Sequence
  chemically synthesized
ctgccttgtccttcaaaaaa

SEQ ID NO: 220818 - DNA, 20 bp, Artificial Sequence
  chemically synthesized
aataatgaccctgttttttg

SEQ ID NO: 220819 - DNA, 20 bp, Artificial Sequence
  chemically synthesized
tgccttgtccttcaaaaaac

SEQ ID NO: 220820 - DNA, 20 bp, Artificial Sequence
  chemically synthesized
gccttgtccttcaaaaaaca

SEQ ID NO: 220821 - DNA, 20 bp, Artificial Sequence
  chemically synthesized
aaacagggtcattattttgt

SEQ ID NO: 220822 - DNA, 20 bp, Artificial Sequence
  chemically synthesized
ttattttgtgagattcaaac

SEQ ID NO: 220823 - DNA, 20 bp, Artificial Sequence
  chemically synthesized
agatgattaattttcaaaac

SEQ ID NO: 220824 - DNA, 20 bp, Artificial Sequence
  chemically synthesized
tttgaaaattaatcatctca

SEQ ID NO: 220825 - DNA, 20 bp, Artificial Sequence
  chemically synthesized
gattagaatttgtataccat

SEQ ID NO: 220826 - DNA, 20 bp, Artificial Sequence
  chemically synthesized
tacttcatccatcggtggat

SEQ ID NO: 220827 - DNA, 20 bp, Artificial Sequence
  chemically synthesized
tacaaattctaatccaccga

SEQ ID NO: 220828 - DNA, 20 bp, Artificial Sequence
  chemically synthesized
agttctacttcatccatcgg

SEQ ID NO: 220829 - DNA, 20 bp, Artificial Sequence
  chemically synthesized
ttctaatccaccgatggatg

SEQ ID NO: 220830 - DNA, 20 bp, Artificial Sequence
  chemically synthesized
gaaagttctacttcatccat

SEQ ID NO: 220831 - DNA, 20 bp, Artificial Sequence
  chemically synthesized
taatccaccgatggatgaag

SEQ ID NO: 220832 - DNA, 20 bp, Artificial Sequence
  chemically synthesized
ggcagtggaagaaacatgga

SEQ ID NO: 220833 - DNA, 20 bp, Artificial Sequence
  chemically synthesized
aagtggcagtggaagaaaca

SEQ ID NO: 220834 - DNA, 20 bp, Artificial Sequence
  chemically synthesized
tattttctaagtggcagtgg

SEQ ID NO: 220835 - DNA, 20 bp, Artificial Sequence
  chemically synthesized
tattattttctaagtggcag

SEQ ID NO: 220836 - DNA, 20 bp, Artificial Sequence
  chemically synthesized
atgtttcttccactgccact

SEQ ID NO: 220837 - DNA, 20 bp, Artificial Sequence
  chemically synthesized
caatattattttctaagtgg

SEQ ID NO: 220838 - DNA, 20 bp, Artificial Sequence
  chemically synthesized
tcccaatattattttctaag

SEQ ID NO: 220839 - DNA, 20 bp, Artificial Sequence
  chemically synthesized
aattcccaatattattttct

SEQ ID NO: 220840 - DNA, 20 bp, Artificial Sequence
  chemically synthesized
tgccacttagaaaataatat

SEQ ID NO: 220841 - DNA, 20 bp, Artificial Sequence
  chemically synthesized
gccacttagaaaataatatt

SEQ ID NO: 220842 - DNA, 20 bp, Artificial Sequence
  chemically synthesized
aatattgggaattgaacaat

SEQ ID NO: 220843 - DNA, 20 bp, Artificial Sequence
  chemically synthesized
aattgaacaatgagaacaca

SEQ ID NO: 220844 - DNA, 20 bp, Artificial Sequence
  chemically synthesized
acaatgagaacacatggaca

SEQ ID NO: 220845 - DNA, 20 bp, Artificial Sequence
  chemically synthesized
caatgagaacacatggacac

SEQ ID NO: 220846 - DNA, 20 bp, Artificial Sequence
  chemically synthesized
tgagaacacatggacacagg

SEQ ID NO: 220847 - DNA, 20 bp, Artificial Sequence
  chemically synthesized
gagaacacatggacacagga

SEQ ID NO: 220848 - DNA, 20 bp, Artificial Sequence
  chemically synthesized
agaacacatggacacaggaa

SEQ ID NO: 220849 - DNA, 20 bp, Artificial Sequence
  chemically synthesized
gaacacatggacacaggaag

SEQ ID NO: 220850 - DNA, 20 bp, Artificial Sequence
  chemically synthesized
ggaaggggaatatcacactc

SEQ ID NO: 220851 - DNA, 20 bp, Artificial Sequence
  chemically synthesized
gaaggggaatatcacactct

SEQ ID NO: 220852 - DNA, 20 bp, Artificial Sequence
  chemically synthesized
aaggggaatatcacactctg

SEQ ID NO: 220853 - DNA, 20 bp, Artificial Sequence
  chemically synthesized
ccaccccacagcagtcccca

SEQ ID NO: 220854 - DNA, 20 bp, Artificial Sequence
  chemically synthesized
ccccaccccacagcagtccc

SEQ ID NO: 220855 - DNA, 20 bp, Artificial Sequence
  chemically synthesized
tcacactctggggactgctg

SEQ ID NO: 220856 - DNA, 20 bp, Artificial Sequence
  chemically synthesized
cacactctggggactgctgt

SEQ ID NO: 220857 - DNA, 20 bp, Artificial Sequence
  chemically synthesized
acactctggggactgctgtg

SEQ ID NO: 220858 - DNA, 20 bp, Artificial Sequence
  chemically synthesized
cccttccccccaccccacag

SEQ ID NO: 220859 - DNA, 20 bp, Artificial Sequence
  chemically synthesized
ctctggggactgctgtgggg

SEQ ID NO: 220860 - DNA, 20 bp, Artificial Sequence
  chemically synthesized
tctggggactgctgtggggt

SEQ ID NO: 220861 - DNA, 20 bp, Artificial Sequence
  chemically synthesized
ctggggactgctgtggggtg

SEQ ID NO: 220862 - DNA, 20 bp, Artificial Sequence
  chemically synthesized
tcccccttccccccacccca

SEQ ID NO: 220863 - DNA, 20 bp, Artificial Sequence
  chemically synthesized
tggggactgctgtggggtgg

SEQ ID NO: 220864 - DNA, 20 bp, Artificial Sequence
  chemically synthesized
ggggactgctgtggggtggg

SEQ ID NO: 220865 - DNA, 20 bp, Artificial Sequence
  chemically synthesized
gactgctgtggggtgggggg

SEQ ID NO: 220866 - DNA, 20 bp, Artificial Sequence
  chemically synthesized
actgctgtggggtgggggga

SEQ ID NO: 220867 - DNA, 20 bp, Artificial Sequence
  chemically synthesized
ctgctgtggggtggggggaa

SEQ ID NO: 220868 - DNA, 20 bp, Artificial Sequence
  chemically synthesized
tgctgtggggtggggggaag

SEQ ID NO: 220869 - DNA, 20 bp, Artificial Sequence
  chemically synthesized
gctgtggggtggggggaagg

SEQ ID NO: 220870 - DNA, 20 bp, Artificial Sequence
  chemically synthesized
tgtggggtggggggaagggg

SEQ ID NO: 220871 - DNA, 20 bp, Artificial Sequence
  chemically synthesized
gtggggtggggggaaggggg

SEQ ID NO: 220872 - DNA, 20 bp, Artificial Sequence
  chemically synthesized
tggggtggggggaaggggga

SEQ ID NO: 220873 - DNA, 20 bp, Artificial Sequence
  chemically synthesized
gtggggggaagggggaggga

SEQ ID NO: 220874 - DNA, 20 bp, Artificial Sequence
  chemically synthesized
ggaagggggagggatagcat

SEQ ID NO: 220875 - DNA, 20 bp, Artificial Sequence
  chemically synthesized
gaagggggagggatagcatt

SEQ ID NO: 220876 - DNA, 20 bp, Artificial Sequence
  chemically synthesized
agggggagggatagcattgg

SEQ ID NO: 220877 - DNA, 20 bp, Artificial Sequence
  chemically synthesized
agcattgggagatttacctt

SEQ ID NO: 220878 - DNA, 20 bp, Artificial Sequence
  chemically synthesized
ttgggagatttaccttaagc

SEQ ID NO: 220879 - DNA, 20 bp, Artificial Sequence
  chemically synthesized
ctaactcgtcatctagctta

SEQ ID NO: 220880 - DNA, 20 bp, Artificial Sequence
  chemically synthesized
actaactcgtcatctagctt

SEQ ID NO: 220881 - DNA, 20 bp, Artificial Sequence
  chemically synthesized
tttaccttaagctagatgac

SEQ ID NO: 220882 - DNA, 20 bp, Artificial Sequence
  chemically synthesized
gcacccactaactcgtcatc

SEQ ID NO: 220883 - DNA, 20 bp, Artificial Sequence
  chemically synthesized
ccttaagctagatgacgagt

SEQ ID NO: 220884 - DNA, 20 bp, Artificial Sequence
  chemically synthesized
taagctagatgacgagttag

SEQ ID NO: 220885 - DNA, 20 bp, Artificial Sequence
  chemically synthesized
aagctagatgacgagttagt

SEQ ID NO: 220886 - DNA, 20 bp, Artificial Sequence
  chemically synthesized
agatgacgagttagtgggtg

SEQ ID NO: 220887 - DNA, 20 bp, Artificial Sequence
  chemically synthesized
agttagtgggtgcagcgcac

SEQ ID NO: 220888 - DNA, 20 bp, Artificial Sequence
  chemically synthesized
gtgggtgcagcgcaccagca

SEQ ID NO: 220889 - DNA, 20 bp, Artificial Sequence
  chemically synthesized
tatgtatacatgtgccatgc

SEQ ID NO: 220890 - DNA, 20 bp, Artificial Sequence
  chemically synthesized
catgtgcacaatgtgcaggt

SEQ ID NO: 220891 - DNA, 20 bp, Artificial Sequence
  chemically synthesized
ggcacatgtgcacaatgtgc

SEQ ID NO: 220892 - DNA, 20 bp, Artificial Sequence
  chemically synthesized
gggcacatgtgcacaatgtg

SEQ ID NO: 220893 - DNA, 20 bp, Artificial Sequence
  chemically synthesized
ttattatactttaagtttta

SEQ ID NO: 220894 - DNA, 20 bp, Artificial Sequence
  chemically synthesized
attattatactttaagtttt

SEQ ID NO: 220895 - DNA, 20 bp, Artificial Sequence
  chemically synthesized
cacatgtgccctaaaactta

SEQ ID NO: 220896 - DNA, 20 bp, Artificial Sequence
  chemically synthesized
tattattatactttaagttt

SEQ ID NO: 220897 - DNA, 20 bp, Artificial Sequence
  chemically synthesized
taaatttattattatacttt

SEQ ID NO: 220898 - DNA, 20 bp, Artificial Sequence
  chemically synthesized
ataataataaatttaaaaaa

SEQ ID NO: 220899 - DNA, 20 bp, Artificial Sequence
  chemically synthesized
aaataatattttattatgta

SEQ ID NO: 220900 - DNA, 20 bp, Artificial Sequence
  chemically synthesized
ttatgtacagcgtgcattat

SEQ ID NO: 220901 - DNA, 20 bp, Artificial Sequence
  chemically synthesized
tacagcgtgcattatcagca

SEQ ID NO: 220902 - DNA, 20 bp, Artificial Sequence
  chemically synthesized
taaacccacatttttaaaaa

SEQ ID NO: 220903 - DNA, 20 bp, Artificial Sequence
  chemically synthesized
taaaactttttttaaaaatg

SEQ ID NO: 220904 - DNA, 20 bp, Artificial Sequence
  chemically synthesized
aaaactttttttaaaaatgt

SEQ ID NO: 220905 - DNA, 20 bp, Artificial Sequence
  chemically synthesized
ttaaaaatgtgggtttattc

SEQ ID NO: 220906 - DNA, 20 bp, Artificial Sequence
  chemically synthesized
gcctcatagatttaaaaatc

SEQ ID NO: 220907 - DNA, 20 bp, Artificial Sequence
  chemically synthesized
ttctagatttttaaatctat

SEQ ID NO: 220908 - DNA, 20 bp, Artificial Sequence
  chemically synthesized
tctagatttttaaatctatg

SEQ ID NO: 220909 - DNA, 20 bp, Artificial Sequence
  chemically synthesized
agcattctaaataagcctca

SEQ ID NO: 220910 - DNA, 20 bp, Artificial Sequence
  chemically synthesized
ttaaatctatgaggcttatt

SEQ ID NO: 220911 - DNA, 20 bp, Artificial Sequence
  chemically synthesized
tttaattcagcattctaaat

SEQ ID NO: 220912 - DNA, 20 bp, Artificial Sequence
  chemically synthesized
ttaacttgtatagtttaatt

SEQ ID NO: 220913 - DNA, 20 bp, Artificial Sequence
  chemically synthesized
aatgctgaattaaactatac

SEQ ID NO: 220914 - DNA, 20 bp, Artificial Sequence
  chemically synthesized
ttcttcaagattaacttgta

SEQ ID NO: 220915 - DNA, 20 bp, Artificial Sequence
  chemically synthesized
aactatacaagttaatcttg

SEQ ID NO: 220916 - DNA, 20 bp, Artificial Sequence
  chemically synthesized
acaagttaatcttgaagaac

SEQ ID NO: 220917 - DNA, 20 bp, Artificial Sequence
  chemically synthesized
attccaatatctggttcttc

SEQ ID NO: 220918 - DNA, 20 bp, Artificial Sequence
  chemically synthesized
aatcttgaagaaccagatat

SEQ ID NO: 220919 - DNA, 20 bp, Artificial Sequence
  chemically synthesized
agagcagcaattccaatatc

SEQ ID NO: 220920 - DNA, 20 bp, Artificial Sequence
  chemically synthesized
gtgggaggaattaatgagag

SEQ ID NO: 220921 - DNA, 20 bp, Artificial Sequence
  chemically synthesized
caggtgggaggaattaatga

SEQ ID NO: 220922 - DNA, 20 bp, Artificial Sequence
  chemically synthesized
atcaggtgggaggaattaat

SEQ ID NO: 220923 - DNA, 20 bp, Artificial Sequence
  chemically synthesized
gcatacacaaatcaggtggg

SEQ ID NO: 220924 - DNA, 20 bp, Artificial Sequence
  chemically synthesized
ggcatacacaaatcaggtgg

SEQ ID NO: 220925 - DNA, 20 bp, Artificial Sequence
  chemically synthesized
atggcatacacaaatcaggt

SEQ ID NO: 220926 - DNA, 20 bp, Artificial Sequence
  chemically synthesized
gatggcatacacaaatcagg

SEQ ID NO: 220927 - DNA, 20 bp, Artificial Sequence
  chemically synthesized
ggcgatggcatacacaaatc

SEQ ID NO: 220928 - DNA, 20 bp, Artificial Sequence
  chemically synthesized
tggcgatggcatacacaaat

SEQ ID NO: 220929 - DNA, 20 bp, Artificial Sequence
  chemically synthesized
tgatttgtgtatgccatcgc

SEQ ID NO: 220930 - DNA, 20 bp, Artificial Sequence
  chemically synthesized
actatgtggtttgctggcga

SEQ ID NO: 220931 - DNA, 20 bp, Artificial Sequence
  chemically synthesized
gcaccaactatgtggtttgc

SEQ ID NO: 220932 - DNA, 20 bp, Artificial Sequence
  chemically synthesized
gccatcgccagcaaaccaca

SEQ ID NO: 220933 - DNA, 20 bp, Artificial Sequence
  chemically synthesized
tcgccagcaaaccacatagt

SEQ ID NO: 220934 - DNA, 20 bp, Artificial Sequence
  chemically synthesized
taaaggaggcaccaactatg

SEQ ID NO: 220935 - DNA, 20 bp, Artificial Sequence
  chemically synthesized
acaacttttttttgtaaagg

SEQ ID NO: 220936 - DNA, 20 bp, Artificial Sequence
  chemically synthesized
cacaacttttttttgtaaag

SEQ ID NO: 220937 - DNA, 20 bp, Artificial Sequence
  chemically synthesized
agcacaacttttttttgtaa

SEQ ID NO: 220938 - DNA, 20 bp, Artificial Sequence
  chemically synthesized
tagcacaacttttttttgta

SEQ ID NO: 220939 - DNA, 20 bp, Artificial Sequence
  chemically synthesized
ggtgcctcctttacaaaaaa

SEQ ID NO: 220940 - DNA, 20 bp, Artificial Sequence
  chemically synthesized
tttacaaaaaaaagttgtgc

SEQ ID NO: 220941 - DNA, 20 bp, Artificial Sequence
  chemically synthesized
ttacaaaaaaaagttgtgct

SEQ ID NO: 220942 - DNA, 20 bp, Artificial Sequence
  chemically synthesized
acaaaaaaaagttgtgctag

SEQ ID NO: 220943 - DNA, 20 bp, Artificial Sequence
  chemically synthesized
aaaaagttgtgctaggagac

SEQ ID NO: 220944 - DNA, 20 bp, Artificial Sequence
  chemically synthesized
tgtaatttatgcttgtctcc

SEQ ID NO: 220945 - DNA, 20 bp, Artificial Sequence
  chemically synthesized
aggagacaagcataaattac

SEQ ID NO: 220946 - DNA, 20 bp, Artificial Sequence
  chemically synthesized
ggagacaagcataaattaca

SEQ ID NO: 220947 - DNA, 20 bp, Artificial Sequence
  chemically synthesized
acaagcataaattacaaggt

SEQ ID NO: 220948 - DNA, 20 bp, Artificial Sequence
  chemically synthesized
aagcataaattacaaggtca

SEQ ID NO: 220949 - DNA, 20 bp, Artificial Sequence
  chemically synthesized
agcataaattacaaggtcag

SEQ ID NO: 220950 - DNA, 20 bp, Artificial Sequence
  chemically synthesized
aaggtcagaggaataccttc

SEQ ID NO: 220951 - DNA, 20 bp, Artificial Sequence
  chemically synthesized
aatgggtttaagattcttga

SEQ ID NO: 220952 - DNA, 20 bp, Artificial Sequence
  chemically synthesized
aaatgggtttaagattcttg

SEQ ID NO: 220953 - DNA, 20 bp, Artificial Sequence
  chemically synthesized
tatactgttcaaatgggttt

SEQ ID NO: 220954 - DNA, 20 bp, Artificial Sequence
  chemically synthesized
gaatcttaaacccatttgaa

SEQ ID NO: 220955 - DNA, 20 bp, Artificial Sequence
  chemically synthesized
ggtttctatactgttcaaat

SEQ ID NO: 220956 - DNA, 20 bp, Artificial Sequence
  chemically synthesized
aggtttctatactgttcaaa

SEQ ID NO: 220957 - DNA, 20 bp, Artificial Sequence
  chemically synthesized
ttaaacccatttgaacagta

SEQ ID NO: 220958 - DNA, 20 bp, Artificial Sequence
  chemically synthesized
atttgaacagtatagaaacc

SEQ ID NO: 220959 - DNA, 20 bp, Artificial Sequence
  chemically synthesized
tttgaacagtatagaaacct

SEQ ID NO: 220960 - DNA, 20 bp, Artificial Sequence
  chemically synthesized
ttgaacagtatagaaaccta

SEQ ID NO: 220961 - DNA, 20 bp, Artificial Sequence
  chemically synthesized
acagtatagaaacctaggga

SEQ ID NO: 220962 - DNA, 20 bp, Artificial Sequence
  chemically synthesized
ttagagttttttccatccct

SEQ ID NO: 220963 - DNA, 20 bp, Artificial Sequence
  chemically synthesized
attagagttttttccatccc

SEQ ID NO: 220964 - DNA, 20 bp, Artificial Sequence
  chemically synthesized
agggatggaaaaaactctaa

SEQ ID NO: 220965 - DNA, 20 bp, Artificial Sequence
  chemically synthesized
gatggaaaaaactctaatag

SEQ ID NO: 220966 - DNA, 20 bp, Artificial Sequence
  chemically synthesized
cttgtagttttcttctatta

SEQ ID NO: 220967 - DNA, 20 bp, Artificial Sequence
  chemically synthesized
ttcttgtagttttcttctat

SEQ ID NO: 220968 - DNA, 20 bp, Artificial Sequence
  chemically synthesized
ctctaatagaagaaaactac

SEQ ID NO: 220969 - DNA, 20 bp, Artificial Sequence
  chemically synthesized
gcttacccctttggttcttg

SEQ ID NO: 220970 - DNA, 20 bp, Artificial Sequence
  chemically synthesized
gaagaaaactacaagaacca

SEQ ID NO: 220971 - DNA, 20 bp, Artificial Sequence
  chemically synthesized
aagaaaactacaagaaccaa

SEQ ID NO: 220972 - DNA, 20 bp, Artificial Sequence
  chemically synthesized
agaaaactacaagaaccaaa

SEQ ID NO: 220973 - DNA, 20 bp, Artificial Sequence
  chemically synthesized
gaaaactacaagaaccaaag

SEQ ID NO: 220974 - DNA, 20 bp, Artificial Sequence
  chemically synthesized
actacaagaaccaaaggggt

SEQ ID NO: 220975 - DNA, 20 bp, Artificial Sequence
  chemically synthesized
gttgtactggcttacccctt

SEQ ID NO: 220976 - DNA, 20 bp, Artificial Sequence
  chemically synthesized
caagaaccaaaggggtaagc

SEQ ID NO: 220977 - DNA, 20 bp, Artificial Sequence
  chemically synthesized
tacctttgcagaggttgtac

SEQ ID NO: 220978 - DNA, 20 bp, Artificial Sequence
  chemically synthesized
aagccagtacaacctctgca

SEQ ID NO: 220979 - DNA, 20 bp, Artificial Sequence
  chemically synthesized
agccagtacaacctctgcaa

SEQ ID NO: 220980 - DNA, 20 bp, Artificial Sequence
  chemically synthesized
gagtaagattacctttgcag

SEQ ID NO: 220981 - DNA, 20 bp, Artificial Sequence
  chemically synthesized
ggagtaagattacctttgca

SEQ ID NO: 220982 - DNA, 20 bp, Artificial Sequence
  chemically synthesized
atggagtaagattacctttg

SEQ ID NO: 220983 - DNA, 20 bp, Artificial Sequence
  chemically synthesized
ctatgtttagtggatggagt

SEQ ID NO: 220984 - DNA, 20 bp, Artificial Sequence
  chemically synthesized
aatgctatgtttagtggatg

SEQ ID NO: 220985 - DNA, 20 bp, Artificial Sequence
  chemically synthesized
ataatgctatgtttagtgga

SEQ ID NO: 220986 - DNA, 20 bp, Artificial Sequence
  chemically synthesized
cttactccatccactaaaca

SEQ ID NO: 220987 - DNA, 20 bp, Artificial Sequence
  chemically synthesized
acatataatgctatgtttag

SEQ ID NO: 220988 - DNA, 20 bp, Artificial Sequence
  chemically synthesized
taaacatataatgctatgtt

SEQ ID NO: 220989 - DNA, 20 bp, Artificial Sequence
  chemically synthesized
taaacatagcattatatgtt

SEQ ID NO: 220990 - DNA, 20 bp, Artificial Sequence
  chemically synthesized
tgtttagtcactcacacaca

SEQ ID NO: 220991 - DNA, 20 bp, Artificial Sequence
  chemically synthesized
cattcactatctttgtgtgt

SEQ ID NO: 220992 - DNA, 20 bp, Artificial Sequence
  chemically synthesized
tagtcactcacacacaaaga

SEQ ID NO: 220993 - DNA, 20 bp, Artificial Sequence
  chemically synthesized
aaagatagtgaatgactgat

SEQ ID NO: 220994 - DNA, 20 bp, Artificial Sequence
  chemically synthesized
aagatagtgaatgactgata

SEQ ID NO: 220995 - DNA, 20 bp, Artificial Sequence
  chemically synthesized
gatagtgaatgactgataag

SEQ ID NO: 220996 - DNA, 20 bp, Artificial Sequence
  chemically synthesized
cctggccaggttctccttat

SEQ ID NO: 220997 - DNA, 20 bp, Artificial Sequence
  chemically synthesized
aatgactgataaggagaacc

SEQ ID NO: 220998 - DNA, 20 bp, Artificial Sequence
  chemically synthesized
actgataaggagaacctggc

SEQ ID NO: 220999 - DNA, 20 bp, Artificial Sequence
  chemically synthesized
ctgataaggagaacctggcc

SEQ ID NO: 221000 - DNA, 20 bp, Artificial Sequence
  chemically synthesized
tcccctgttaatgcctggcc

SEQ ID NO: 221001 - DNA, 20 bp, Artificial Sequence
  chemically synthesized
atcccctgttaatgcctggc

SEQ ID NO: 221002 - DNA, 20 bp, Artificial Sequence
  chemically synthesized
ggccatcccctgttaatgcc

SEQ ID NO: 221003 - DNA, 20 bp, Artificial Sequence
  chemically synthesized
agaacctggccaggcattaa

SEQ ID NO: 221004 - DNA, 20 bp, Artificial Sequence
  chemically synthesized
gaacctggccaggcattaac

SEQ ID NO: 221005 - DNA, 20 bp, Artificial Sequence
  chemically synthesized
aacctggccaggcattaaca

SEQ ID NO: 221006 - DNA, 20 bp, Artificial Sequence
  chemically synthesized
acctggccaggcattaacag

SEQ ID NO: 221007 - DNA, 20 bp, Artificial Sequence
  chemically synthesized
ggccaggcattaacagggga

SEQ ID NO: 221008 - DNA, 20 bp, Artificial Sequence
  chemically synthesized
acaggggatggcctttcatt

SEQ ID NO: 221009 - DNA, 20 bp, Artificial Sequence
  chemically synthesized
aatatcttttactcaatgaa

SEQ ID NO: 221010 - DNA, 20 bp, Artificial Sequence
  chemically synthesized
gaatatcttttactcaatga

SEQ ID NO: 221011 - DNA, 20 bp, Artificial Sequence
  chemically synthesized
gatggcctttcattgagtaa

SEQ ID NO: 221012 - DNA, 20 bp, Artificial Sequence
  chemically synthesized
tgagtaaaagatattccttc

SEQ ID NO: 221013 - DNA, 20 bp, Artificial Sequence
  chemically synthesized
agtaaaagatattccttcca

SEQ ID NO: 221014 - DNA, 20 bp, Artificial Sequence
  chemically synthesized
aaaagatattccttccagag

SEQ ID NO: 221015 - DNA, 20 bp, Artificial Sequence
  chemically synthesized
tttaccagctctactctgga

SEQ ID NO: 221016 - DNA, 20 bp, Artificial Sequence
  chemically synthesized
ctttaccagctctactctgg

SEQ ID NO: 221017 - DNA, 20 bp, Artificial Sequence
  chemically synthesized
aagatattccttccagagta

SEQ ID NO: 221018 - DNA, 20 bp, Artificial Sequence
  chemically synthesized
cggctttaccagctctactc

SEQ ID NO: 221019 - DNA, 20 bp, Artificial Sequence
  chemically synthesized
tattccttccagagtagagc

SEQ ID NO: 221020 - DNA, 20 bp, Artificial Sequence
  chemically synthesized
cttccagagtagagctggta

SEQ ID NO: 221021 - DNA, 20 bp, Artificial Sequence
  chemically synthesized
acagttctcttcggctttac

SEQ ID NO: 221022 - DNA, 20 bp, Artificial Sequence
  chemically synthesized
gagtagagctggtaaagccg

SEQ ID NO: 221023 - DNA, 20 bp, Artificial Sequence
  chemically synthesized
gtagagctggtaaagccgaa

SEQ ID NO: 221024 - DNA, 20 bp, Artificial Sequence
  chemically synthesized
catttgaatacagttctctt

SEQ ID NO: 221025 - DNA, 20 bp, Artificial Sequence
  chemically synthesized
actatactttcatttgaata

SEQ ID NO: 221026 - DNA, 20 bp, Artificial Sequence
  chemically synthesized
agagaactgtattcaaatga

SEQ ID NO: 221027 - DNA, 20 bp, Artificial Sequence
  chemically synthesized
actgtattcaaatgaaagta

SEQ ID NO: 221028 - DNA, 20 bp, Artificial Sequence
  chemically synthesized
ttttttttcaactttaattt

SEQ ID NO: 221029 - DNA, 20 bp, Artificial Sequence
  chemically synthesized
tactccctagtccaaaatta

SEQ ID NO: 221030 - DNA, 20 bp, Artificial Sequence
  chemically synthesized
tttcaactttaattttggac

SEQ ID NO: 221031 - DNA, 20 bp, Artificial Sequence
  chemically synthesized
ttcaactttaattttggact

SEQ ID NO: 221032 - DNA, 20 bp, Artificial Sequence
  chemically synthesized
tcaactttaattttggacta

SEQ ID NO: 221033 - DNA, 20 bp, Artificial Sequence
  chemically synthesized
aactttaattttggactagg

SEQ ID NO: 221034 - DNA, 20 bp, Artificial Sequence
  chemically synthesized
aatcctgcataggtactccc

SEQ ID NO: 221035 - DNA, 20 bp, Artificial Sequence
  chemically synthesized
tggactagggagtacctatg

SEQ ID NO: 221036 - DNA, 20 bp, Artificial Sequence
  chemically synthesized
ggactagggagtacctatgc

SEQ ID NO: 221037 - DNA, 20 bp, Artificial Sequence
  chemically synthesized
cccatgtaacaatcctgcat

SEQ ID NO: 221038 - DNA, 20 bp, Artificial Sequence
  chemically synthesized
acccatgtaacaatcctgca

SEQ ID NO: 221039 - DNA, 20 bp, Artificial Sequence
  chemically synthesized
acctatgcaggattgttaca

SEQ ID NO: 221040 - DNA, 20 bp, Artificial Sequence
  chemically synthesized
cctatgcaggattgttacat

SEQ ID NO: 221041 - DNA, 20 bp, Artificial Sequence
  chemically synthesized
tgggtatgttgcatgatgaa

SEQ ID NO: 221042 - DNA, 20 bp, Artificial Sequence
  chemically synthesized
atgttgcatgatgaaaagca

SEQ ID NO: 221043 - DNA, 20 bp, Artificial Sequence
  chemically synthesized
aaaagcaaagtttttgattt

SEQ ID NO: 221044 - DNA, 20 bp, Artificial Sequence
  chemically synthesized
aaagcaaagtttttgatttc

SEQ ID NO: 221045 - DNA, 20 bp, Artificial Sequence
  chemically synthesized
agtttttgatttcaggtttt

SEQ ID NO: 221046 - DNA, 20 bp, Artificial Sequence
  chemically synthesized
tttttgatttcaggtttttg

SEQ ID NO: 221047 - DNA, 20 bp, Artificial Sequence
  chemically synthesized
tttcaggtttttggagaaac

SEQ ID NO: 221048 - DNA, 20 bp, Artificial Sequence
  chemically synthesized
tcaggtttttggagaaacaa

SEQ ID NO: 221049 - DNA, 20 bp, Artificial Sequence
  chemically synthesized
ttggagaaacaagagtgcct

SEQ ID NO: 221050 - DNA, 20 bp, Artificial Sequence
  chemically synthesized
ggagaaacaagagtgcctcg

SEQ ID NO: 221051 - DNA, 20 bp, Artificial Sequence
  chemically synthesized
cagcaccatggacagctccg

SEQ ID NO: 221052 - DNA, 20 bp, Artificial Sequence
  chemically synthesized
gcagcaccatggacagctcc

SEQ ID NO: 221053 - DNA, 20 bp, Artificial Sequence
  chemically synthesized
gagtgcctcggagctgtcca

SEQ ID NO: 221054 - DNA, 20 bp, Artificial Sequence
  chemically synthesized
gtctcatgcagcaccatgga

SEQ ID NO: 221055 - DNA, 20 bp, Artificial Sequence
  chemically synthesized
cctggtctcatgcagcacca

SEQ ID NO: 221056 - DNA, 20 bp, Artificial Sequence
  chemically synthesized
agctgtccatggtgctgcat

SEQ ID NO: 221057 - DNA, 20 bp, Artificial Sequence
  chemically synthesized
aatgaaggcctggtctcatg

SEQ ID NO: 221058 - DNA, 20 bp, Artificial Sequence
  chemically synthesized
tccatggtgctgcatgagac

SEQ ID NO: 221059 - DNA, 20 bp, Artificial Sequence
  chemically synthesized
ccatggtgctgcatgagacc

SEQ ID NO: 221060 - DNA, 20 bp, Artificial Sequence
  chemically synthesized
aattctgcagaatgaaggcc

SEQ ID NO: 221061 - DNA, 20 bp, Artificial Sequence
  chemically synthesized
gcaggaattctgcagaatga

SEQ ID NO: 221062 - DNA, 20 bp, Artificial Sequence
  chemically synthesized
gagaccaggccttcattctg

SEQ ID NO: 221063 - DNA, 20 bp, Artificial Sequence
  chemically synthesized
ggcaggaattctgcagaatg

SEQ ID NO: 221064 - DNA, 20 bp, Artificial Sequence
  chemically synthesized
ttcaagaggcaggaattctg

SEQ ID NO: 221065 - DNA, 20 bp, Artificial Sequence
  chemically synthesized
ctagagaattttcaagaggc

SEQ ID NO: 221066 - DNA, 20 bp, Artificial Sequence
  chemically synthesized
cctagagaattttcaagagg

SEQ ID NO: 221067 - DNA, 20 bp, Artificial Sequence
  chemically synthesized
gggcctagagaattttcaag

SEQ ID NO: 221068 - DNA, 20 bp, Artificial Sequence
  chemically synthesized
agggcctagagaattttcaa

SEQ ID NO: 221069 - DNA, 20 bp, Artificial Sequence
  chemically synthesized
tcagggcctagagaattttc

SEQ ID NO: 221070 - DNA, 20 bp, Artificial Sequence
  chemically synthesized
cctgcctcttgaaaattctc

SEQ ID NO: 221071 - DNA, 20 bp, Artificial Sequence
  chemically synthesized
ctgcctcttgaaaattctct

SEQ ID NO: 221072 - DNA, 20 bp, Artificial Sequence
  chemically synthesized
gggttgtaagtcagggccta

SEQ ID NO: 221073 - DNA, 20 bp, Artificial Sequence
  chemically synthesized
cagggttgtaagtcagggcc

SEQ ID NO: 221074 - DNA, 20 bp, Artificial Sequence
  chemically synthesized
gcaaacagggttgtaagtca

SEQ ID NO: 221075 - DNA, 20 bp, Artificial Sequence
  chemically synthesized
agcaaacagggttgtaagtc

SEQ ID NO: 221076 - DNA, 20 bp, Artificial Sequence
  chemically synthesized
cagcaaacagggttgtaagt

SEQ ID NO: 221077 - DNA, 20 bp, Artificial Sequence
  chemically synthesized
catacagcaaacagggttgt

SEQ ID NO: 221078 - DNA, 20 bp, Artificial Sequence
  chemically synthesized
ggttaaccatacagcaaaca

SEQ ID NO: 221079 - DNA, 20 bp, Artificial Sequence
  chemically synthesized
aggttaaccatacagcaaac

SEQ ID NO: 221080 - DNA, 20 bp, Artificial Sequence
  chemically synthesized
caggttaaccatacagcaaa

SEQ ID NO: 221081 - DNA, 20 bp, Artificial Sequence
  chemically synthesized
ttacaaccctgtttgctgta

SEQ ID NO: 221082 - DNA, 20 bp, Artificial Sequence
  chemically synthesized
gggttggcaggttaaccata

SEQ ID NO: 221083 - DNA, 20 bp, Artificial Sequence
  chemically synthesized
ggggacatagcagggttggc

SEQ ID NO: 221084 - DNA, 20 bp, Artificial Sequence
  chemically synthesized
aggggacatagcagggttgg

SEQ ID NO: 221085 - DNA, 20 bp, Artificial Sequence
  chemically synthesized
tataggggacatagcagggt

SEQ ID NO: 221086 - DNA, 20 bp, Artificial Sequence
  chemically synthesized
cacttataggggacatagca

SEQ ID NO: 221087 - DNA, 20 bp, Artificial Sequence
  chemically synthesized
tcacttataggggacatagc

SEQ ID NO: 221088 - DNA, 20 bp, Artificial Sequence
  chemically synthesized
atcacttataggggacatag

SEQ ID NO: 221089 - DNA, 20 bp, Artificial Sequence
  chemically synthesized
ataatcacttataggggaca

SEQ ID NO: 221090 - DNA, 20 bp, Artificial Sequence
  chemically synthesized
aaccctgctatgtcccctat

SEQ ID NO: 221091 - DNA, 20 bp, Artificial Sequence
  chemically synthesized
tgttaaataatcacttatag

SEQ ID NO: 221092 - DNA, 20 bp, Artificial Sequence
  chemically synthesized
atgttaaataatcacttata

SEQ ID NO: 221093 - DNA, 20 bp, Artificial Sequence
  chemically synthesized
tatgttaaataatcacttat

SEQ ID NO: 221094 - DNA, 20 bp, Artificial Sequence
  chemically synthesized
ttatgttaaataatcactta

SEQ ID NO: 221095 - DNA, 20 bp, Artificial Sequence
  chemically synthesized
tttaacataatctataattt

SEQ ID NO: 221096 - DNA, 20 bp, Artificial Sequence
  chemically synthesized
aatatttagtactgaaatta

SEQ ID NO: 221097 - DNA, 20 bp, Artificial Sequence
  chemically synthesized
ataattagtcatgaaatatt

SEQ ID NO: 221098 - DNA, 20 bp, Artificial Sequence
  chemically synthesized
tatttcatgactaattataa

SEQ ID NO: 221099 - DNA, 20 bp, Artificial Sequence
  chemically synthesized
acatagagagctgttataat

SEQ ID NO: 221100 - DNA, 20 bp, Artificial Sequence
  chemically synthesized
atcacccagggaaacataga

SEQ ID NO: 221101 - DNA, 20 bp, Artificial Sequence
  chemically synthesized
atatcacccagggaaacata

SEQ ID NO: 221102 - DNA, 20 bp, Artificial Sequence
  chemically synthesized
tgatatcacccagggaaaca

SEQ ID NO: 221103 - DNA, 20 bp, Artificial Sequence
  chemically synthesized
aacagctctctatgtttccc

SEQ ID NO: 221104 - DNA, 20 bp, Artificial Sequence
  chemically synthesized
acagctctctatgtttccct

SEQ ID NO: 221105 - DNA, 20 bp, Artificial Sequence
  chemically synthesized
atgtgtggtgatatcaccca

SEQ ID NO: 221106 - DNA, 20 bp, Artificial Sequence
  chemically synthesized
aatgtgtggtgatatcaccc

SEQ ID NO: 221107 - DNA, 20 bp, Artificial Sequence
  chemically synthesized
gaatgtgtggtgatatcacc

SEQ ID NO: 221108 - DNA, 20 bp, Artificial Sequence
  chemically synthesized
atctgccaaattggaatgtg

SEQ ID NO: 221109 - DNA, 20 bp, Artificial Sequence
  chemically synthesized
tatcaccacacattccaatt

SEQ ID NO: 221110 - DNA, 20 bp, Artificial Sequence
  chemically synthesized
caccacacattccaatttgg

SEQ ID NO: 221111 - DNA, 20 bp, Artificial Sequence
  chemically synthesized
cccaccgagatctgccaaat

SEQ ID NO: 221112 - DNA, 20 bp, Artificial Sequence
  chemically synthesized
cattccaatttggcagatct

SEQ ID NO: 221113 - DNA, 20 bp, Artificial Sequence
  chemically synthesized
tccaatttggcagatctcgg

SEQ ID NO: 221114 - DNA, 20 bp, Artificial Sequence
  chemically synthesized
ccaatttggcagatctcggt

SEQ ID NO: 221115 - DNA, 20 bp, Artificial Sequence
  chemically synthesized
tacaaattcctgggcccacc

SEQ ID NO: 221116 - DNA, 20 bp, Artificial Sequence
  chemically synthesized
ttggcagatctcggtgggcc

SEQ ID NO: 221117 - DNA, 20 bp, Artificial Sequence
  chemically synthesized
tggcagatctcggtgggccc

SEQ ID NO: 221118 - DNA, 20 bp, Artificial Sequence
  chemically synthesized
atatttgcatacaaattcct

SEQ ID NO: 221119 - DNA, 20 bp, Artificial Sequence
  chemically synthesized
tatatttgcatacaaattcc

SEQ ID NO: 221120 - DNA, 20 bp, Artificial Sequence
  chemically synthesized
tccctcataagaattatatg

SEQ ID NO: 221121 - DNA, 20 bp, Artificial Sequence
  chemically synthesized
gtccctcataagaattatat

SEQ ID NO: 221122 - DNA, 20 bp, Artificial Sequence
  chemically synthesized
catcctcatataattcttat

SEQ ID NO: 221123 - DNA, 20 bp, Artificial Sequence
  chemically synthesized
atcctcatataattcttatg

SEQ ID NO: 221124 - DNA, 20 bp, Artificial Sequence
  chemically synthesized
tcctcatataattcttatga

SEQ ID NO: 221125 - DNA, 20 bp, Artificial Sequence
  chemically synthesized
gcaggactttagtccctcat

SEQ ID NO: 221126 - DNA, 20 bp, Artificial Sequence
  chemically synthesized
ataattcttatgagggacta

SEQ ID NO: 221127 - DNA, 20 bp, Artificial Sequence
  chemically synthesized
ctagagtctaagcaggactt

SEQ ID NO: 221128 - DNA, 20 bp, Artificial Sequence
  chemically synthesized
tgagggactaaagtcctgct

SEQ ID NO: 221129 - DNA, 20 bp, Artificial Sequence
  chemically synthesized
gggaagactagagtctaagc

SEQ ID NO: 221130 - DNA, 20 bp, Artificial Sequence
  chemically synthesized
tgggaagactagagtctaag

SEQ ID NO: 221131 - DNA, 20 bp, Artificial Sequence
  chemically synthesized
ctaaagtcctgcttagactc

SEQ ID NO: 221132 - DNA, 20 bp, Artificial Sequence
  chemically synthesized
ccttgggaagactagagtct

SEQ ID NO: 221133 - DNA, 20 bp, Artificial Sequence
  chemically synthesized
gggcgaccttgggaagacta

SEQ ID NO: 221134 - DNA, 20 bp, Artificial Sequence
  chemically synthesized
gtgggcgaccttgggaagac

SEQ ID NO: 221135 - DNA, 20 bp, Artificial Sequence
  chemically synthesized
gcttagactctagtcttccc

SEQ ID NO: 221136 - DNA, 20 bp, Artificial Sequence
  chemically synthesized
cttagactctagtcttccca

SEQ ID NO: 221137 - DNA, 20 bp, Artificial Sequence
  chemically synthesized
ttaaggtgggcgaccttggg

SEQ ID NO: 221138 - DNA, 20 bp, Artificial Sequence
  chemically synthesized
ggattaaggtgggcgacctt

SEQ ID NO: 221139 - DNA, 20 bp, Artificial Sequence
  chemically synthesized
gggattaaggtgggcgacct

SEQ ID NO: 221140 - DNA, 20 bp, Artificial Sequence
  chemically synthesized
agttggctcgggattaaggt

SEQ ID NO: 221141 - DNA, 20 bp, Artificial Sequence
  chemically synthesized
gagttggctcgggattaagg

SEQ ID NO: 221142 - DNA, 20 bp, Artificial Sequence
  chemically synthesized
aggtcgcccaccttaatccc

SEQ ID NO: 221143 - DNA, 20 bp, Artificial Sequence
  chemically synthesized
gacgagttggctcgggatta

SEQ ID NO: 221144 - DNA, 20 bp, Artificial Sequence
  chemically synthesized
ggacgagttggctcgggatt

SEQ ID NO: 221145 - DNA, 20 bp, Artificial Sequence
  chemically synthesized
aactggggacgagttggctc

SEQ ID NO: 221146 - DNA, 20 bp, Artificial Sequence
  chemically synthesized
caactggggacgagttggct

SEQ ID NO: 221147 - DNA, 20 bp, Artificial Sequence
  chemically synthesized
gtctccaactggggacgagt

SEQ ID NO: 221148 - DNA, 20 bp, Artificial Sequence
  chemically synthesized
atcccgagccaactcgtccc

SEQ ID NO: 221149 - DNA, 20 bp, Artificial Sequence
  chemically synthesized
tcttgtctccaactggggac

SEQ ID NO: 221150 - DNA, 20 bp, Artificial Sequence
  chemically synthesized
cgagccaactcgtccccagt

SEQ ID NO: 221151 - DNA, 20 bp, Artificial Sequence
  chemically synthesized
agccaactcgtccccagttg

SEQ ID NO: 221152 - DNA, 20 bp, Artificial Sequence
  chemically synthesized
tctgctcttgtctccaactg

SEQ ID NO: 221153 - DNA, 20 bp, Artificial Sequence
  chemically synthesized
ttctgctcttgtctccaact

SEQ ID NO: 221154 - DNA, 20 bp, Artificial Sequence
  chemically synthesized
tttctgctcttgtctccaac

SEQ ID NO: 221155 - DNA, 20 bp, Artificial Sequence
  chemically synthesized
actcgtccccagttggagac

SEQ ID NO: 221156 - DNA, 20 bp, Artificial Sequence
  chemically synthesized
tcgtccccagttggagacaa

SEQ ID NO: 221157 - DNA, 20 bp, Artificial Sequence
  chemically synthesized
tccccagttggagacaagag

SEQ ID NO: 221158 - DNA, 20 bp, Artificial Sequence
  chemically synthesized
gcagaaattttgattccaca

SEQ ID NO: 221159 - DNA, 20 bp, Artificial Sequence
  chemically synthesized
ggcctaatcaaacagctttg

SEQ ID NO: 221160 - DNA, 20 bp, Artificial Sequence
  chemically synthesized
attccacaaagctgtttgat

SEQ ID NO: 221161 - DNA, 20 bp, Artificial Sequence
  chemically synthesized
ttccacaaagctgtttgatt

SEQ ID NO: 221162 - DNA, 20 bp, Artificial Sequence
  chemically synthesized
gtatgtgaggcctaatcaaa

SEQ ID NO: 221163 - DNA, 20 bp, Artificial Sequence
  chemically synthesized
gattccagatgatgtatgtg

SEQ ID NO: 221164 - DNA, 20 bp, Artificial Sequence
  chemically synthesized
tgattccagatgatgtatgt

SEQ ID NO: 221165 - DNA, 20 bp, Artificial Sequence
  chemically synthesized
taggcctcacatacatcatc

SEQ ID NO: 221166 - DNA, 20 bp, Artificial Sequence
  chemically synthesized
aagcttcagttgtgtgattc

SEQ ID NO: 221167 - DNA, 20 bp, Artificial Sequence
  chemically synthesized
catctggaatcacacaactg

SEQ ID NO: 221168 - DNA, 20 bp, Artificial Sequence
  chemically synthesized
cagtgtcataaatgaagctt

SEQ ID NO: 221169 - DNA, 20 bp, Artificial Sequence
  chemically synthesized
ctgtagcagtgtcataaatg

SEQ ID NO: 221170 - DNA, 20 bp, Artificial Sequence
  chemically synthesized
cttcatttatgacactgcta

SEQ ID NO: 221171 - DNA, 20 bp, Artificial Sequence
  chemically synthesized
aaggaattggtacactgtag

SEQ ID NO: 221172 - DNA, 20 bp, Artificial Sequence
  chemically synthesized
ggaaaggaattggtacactg

SEQ ID NO: 221173 - DNA, 20 bp, Artificial Sequence
  chemically synthesized
aaatatatagggaaaggaat

SEQ ID NO: 221174 - DNA, 20 bp, Artificial Sequence
  chemically synthesized
aagaaaaaatatatagggaa

SEQ ID NO: 221175 - DNA, 20 bp, Artificial Sequence
  chemically synthesized
aaagaaaaaatatataggga

SEQ ID NO: 221176 - DNA, 20 bp, Artificial Sequence
  chemically synthesized
aaaaaaagaaaaaatatata

SEQ ID NO: 221177 - DNA, 20 bp, Artificial Sequence
  chemically synthesized
gaaaaaaagaaaaaatatat

SEQ ID NO: 221178 - DNA, 20 bp, Artificial Sequence
  chemically synthesized
tgaaaaaaagaaaaaatata

SEQ ID NO: 221179 - DNA, 20 bp, Artificial Sequence
  chemically synthesized
gataaataggatttgaaaaa

SEQ ID NO: 221180 - DNA, 20 bp, Artificial Sequence
  chemically synthesized
agatttgaagtaggataaat

SEQ ID NO: 221181 - DNA, 20 bp, Artificial Sequence
  chemically synthesized
gagatttgaagtaggataaa

SEQ ID NO: 221182 - DNA, 20 bp, Artificial Sequence
  chemically synthesized
gtgctatagagatttgaagt

SEQ ID NO: 221183 - DNA, 20 bp, Artificial Sequence
  chemically synthesized
ggtgctatagagatttgaag

SEQ ID NO: 221184 - DNA, 20 bp, Artificial Sequence
  chemically synthesized
tatggtgctatagagatttg

SEQ ID NO: 221185 - DNA, 20 bp, Artificial Sequence
  chemically synthesized
tatcctacttcaaatctcta

SEQ ID NO: 221186 - DNA, 20 bp, Artificial Sequence
  chemically synthesized
actctaaatatggtgctata

SEQ ID NO: 221187 - DNA, 20 bp, Artificial Sequence
  chemically synthesized
tgactctaaatatggtgcta

SEQ ID NO: 221188 - DNA, 20 bp, Artificial Sequence
  chemically synthesized
aatctctatagcaccatatt

SEQ ID NO: 221189 - DNA, 20 bp, Artificial Sequence
  chemically synthesized
tctctatagcaccatattta

SEQ ID NO: 221190 - DNA, 20 bp, Artificial Sequence
  chemically synthesized
gatctgaatgactctaaata

SEQ ID NO: 221191 - DNA, 20 bp, Artificial Sequence
  chemically synthesized
gcaccatatttagagtcatt

SEQ ID NO: 221192 - DNA, 20 bp, Artificial Sequence
  chemically synthesized
tgtagttattgattcaaatc

SEQ ID NO: 221193 - DNA, 20 bp, Artificial Sequence
  chemically synthesized
ttaagtgagttgtttcaatg

SEQ ID NO: 221194 - DNA, 20 bp, Artificial Sequence
  chemically synthesized
gcttgaatatagggttaagt

SEQ ID NO: 221195 - DNA, 20 bp, Artificial Sequence
  chemically synthesized
gaaggcttgaatatagggtt

SEQ ID NO: 221196 - DNA, 20 bp, Artificial Sequence
  chemically synthesized
actcacttaaccctatattc

SEQ ID NO: 221197 - DNA, 20 bp, Artificial Sequence
  chemically synthesized
ttcatgaaggcttgaatata

SEQ ID NO: 221198 - DNA, 20 bp, Artificial Sequence
  chemically synthesized
attcatgaaggcttgaatat

SEQ ID NO: 221199 - DNA, 20 bp, Artificial Sequence
  chemically synthesized
aattcatgaaggcttgaata

SEQ ID NO: 221200 - DNA, 20 bp, Artificial Sequence
  chemically synthesized
tttgacaggtgaattcatga

SEQ ID NO: 221201 - DNA, 20 bp, Artificial Sequence
  chemically synthesized
atttgacaggtgaattcatg

SEQ ID NO: 221202 - DNA, 20 bp, Artificial Sequence
  chemically synthesized
tgttatttttttcatttgac

SEQ ID NO: 221203 - DNA, 20 bp, Artificial Sequence
  chemically synthesized
gtgttatttttttcatttga

SEQ ID NO: 221204 - DNA, 20 bp, Artificial Sequence
  chemically synthesized
aatgaaaaaaataacaccta

SEQ ID NO: 221205 - DNA, 20 bp, Artificial Sequence
  chemically synthesized
aaataattctgcaaagctgt

SEQ ID NO: 221206 - DNA, 20 bp, Artificial Sequence
  chemically synthesized
aaaataattctgcaaagctg

SEQ ID NO: 221207 - DNA, 20 bp, Artificial Sequence
  chemically synthesized
aaataacacctacagctttg

SEQ ID NO: 221208 - DNA, 20 bp, Artificial Sequence
  chemically synthesized
accctgaaaataattctgca

SEQ ID NO: 221209 - DNA, 20 bp, Artificial Sequence
  chemically synthesized
cagctttgcagaattatttt

SEQ ID NO: 221210 - DNA, 20 bp, Artificial Sequence
  chemically synthesized
agctttgcagaattattttc

SEQ ID NO: 221211 - DNA, 20 bp, Artificial Sequence
  chemically synthesized
gctttgcagaattattttca

SEQ ID NO: 221212 - DNA, 20 bp, Artificial Sequence
  chemically synthesized
aattattttcagggtaatat

SEQ ID NO: 221213 - DNA, 20 bp, Artificial Sequence
  chemically synthesized
tttcagggtaatatgagaca

SEQ ID NO: 221214 - DNA, 20 bp, Artificial Sequence
  chemically synthesized
atgagacatggtttctaact

SEQ ID NO: 221215 - DNA, 20 bp, Artificial Sequence
  chemically synthesized
gacatggtttctaactcagc

SEQ ID NO: 221216 - DNA, 20 bp, Artificial Sequence
  chemically synthesized
agataatgtgctagctgagt

SEQ ID NO: 221217 - DNA, 20 bp, Artificial Sequence
  chemically synthesized
tatcagataatgtgctagct

SEQ ID NO: 221218 - DNA, 20 bp, Artificial Sequence
  chemically synthesized
ctgtgtatcagataatgtgc

SEQ ID NO: 221219 - DNA, 20 bp, Artificial Sequence
  chemically synthesized
ctagcacattatctgataca

SEQ ID NO: 221220 - DNA, 20 bp, Artificial Sequence
  chemically synthesized
caagtagagcaactgtgtat

SEQ ID NO: 221221 - DNA, 20 bp, Artificial Sequence
  chemically synthesized
acagaactcacatgcaagta

SEQ ID NO: 221222 - DNA, 20 bp, Artificial Sequence
  chemically synthesized
gaacagaactcacatgcaag

SEQ ID NO: 221223 - DNA, 20 bp, Artificial Sequence
  chemically synthesized
cagttgctctacttgcatgt

SEQ ID NO: 221224 - DNA, 20 bp, Artificial Sequence
  chemically synthesized
agggaacagaactcacatgc

SEQ ID NO: 221225 - DNA, 20 bp, Artificial Sequence
  chemically synthesized
atttagagaaggaaagggaa

SEQ ID NO: 221226 - DNA, 20 bp, Artificial Sequence
  chemically synthesized
aaaagatttagagaaggaaa

SEQ ID NO: 221227 - DNA, 20 bp, Artificial Sequence
  chemically synthesized
aaaaagatttagagaaggaa

SEQ ID NO: 221228 - DNA, 20 bp, Artificial Sequence
  chemically synthesized
aaaaaagatttagagaagga

SEQ ID NO: 221229 - DNA, 20 bp, Artificial Sequence
  chemically synthesized
atttaaaaaagatttagaga

SEQ ID NO: 221230 - DNA, 20 bp, Artificial Sequence
  chemically synthesized
aatttaaaaaagatttagag

SEQ ID NO: 221231 - DNA, 20 bp, Artificial Sequence
  chemically synthesized
aagaatttaaaaaagattta

SEQ ID NO: 221232 - DNA, 20 bp, Artificial Sequence
  chemically synthesized
gcaagaatttaaaaaagatt

SEQ ID NO: 221233 - DNA, 20 bp, Artificial Sequence
  chemically synthesized
aatgatgcaagaatttaaaa

SEQ ID NO: 221234 - DNA, 20 bp, Artificial Sequence
  chemically synthesized
aataaagtaataaatgatgc

SEQ ID NO: 221235 - DNA, 20 bp, Artificial Sequence
  chemically synthesized
agagttcattagatgaaata

SEQ ID NO: 221236 - DNA, 20 bp, Artificial Sequence
  chemically synthesized
tgatagaaacaagagttcat

SEQ ID NO: 221237 - DNA, 20 bp, Artificial Sequence
  chemically synthesized
gagacaaatgatagaaacaa

SEQ ID NO: 221238 - DNA, 20 bp, Artificial Sequence
  chemically synthesized
atgagacaaatgatagaaac

SEQ ID NO: 221239 - DNA, 20 bp, Artificial Sequence
  chemically synthesized
ctagttgatgagacaaatga

SEQ ID NO: 221240 - DNA, 20 bp, Artificial Sequence
  chemically synthesized
ctatcatttgtctcatcaac

SEQ ID NO: 221241 - DNA, 20 bp, Artificial Sequence
  chemically synthesized
gatctggaaagctagttgat

SEQ ID NO: 221242 - DNA, 20 bp, Artificial Sequence
  chemically synthesized
tgtctcatcaactagctttc

SEQ ID NO: 221243 - DNA, 20 bp, Artificial Sequence
  chemically synthesized
tagtcaaggatctggaaagc

SEQ ID NO: 221244 - DNA, 20 bp, Artificial Sequence
  chemically synthesized
ttattagtcaaggatctgga

SEQ ID NO: 221245 - DNA, 20 bp, Artificial Sequence
  chemically synthesized
atctttattagtcaaggatc

SEQ ID NO: 221246 - DNA, 20 bp, Artificial Sequence
  chemically synthesized
atatctatctttattagtca

SEQ ID NO: 221247 - DNA, 20 bp, Artificial Sequence
  chemically synthesized
aatatctatctttattagtc

SEQ ID NO: 221248 - DNA, 20 bp, Artificial Sequence
  chemically synthesized
ttccagatccttgactaata

SEQ ID NO: 221249 - DNA, 20 bp, Artificial Sequence
  chemically synthesized
agatccttgactaataaaga

SEQ ID NO: 221250 - DNA, 20 bp, Artificial Sequence
  chemically synthesized
tatgcaatatctatctttat

SEQ ID NO: 221251 - DNA, 20 bp, Artificial Sequence
  chemically synthesized
aaagatagatattgcatact

SEQ ID NO: 221252 - DNA, 20 bp, Artificial Sequence
  chemically synthesized
gatattgcatactaagtgtg

SEQ ID NO: 221253 - DNA, 20 bp, Artificial Sequence
  chemically synthesized
gcaaccatccaccacacact

SEQ ID NO: 221254 - DNA, 20 bp, Artificial Sequence
  chemically synthesized
attgcatactaagtgtgtgg

SEQ ID NO: 221255 - DNA, 20 bp, Artificial Sequence
  chemically synthesized
catactaagtgtgtggtgga

SEQ ID NO: 221256 - DNA, 20 bp, Artificial Sequence
  chemically synthesized
gtgtgtggtggatggttgcc

SEQ ID NO: 221257 - DNA, 20 bp, Artificial Sequence
  chemically synthesized
aaagtgctctgtgcaggtct

SEQ ID NO: 221258 - DNA, 20 bp, Artificial Sequence
  chemically synthesized
gatggttgccaagacctgca

SEQ ID NO: 221259 - DNA, 20 bp, Artificial Sequence
  chemically synthesized
tggttgccaagacctgcaca

SEQ ID NO: 221260 - DNA, 20 bp, Artificial Sequence
  chemically synthesized
atatgtaaagtgctctgtgc

SEQ ID NO: 221261 - DNA, 20 bp, Artificial Sequence
  chemically synthesized
gatatgtaaagtgctctgtg

SEQ ID NO: 221262 - DNA, 20 bp, Artificial Sequence
  chemically synthesized
cctcatggccaagatatgta

SEQ ID NO: 221263 - DNA, 20 bp, Artificial Sequence
  chemically synthesized
acagagcactttacatatct

SEQ ID NO: 221264 - DNA, 20 bp, Artificial Sequence
  chemically synthesized
actttacatatcttggccat

SEQ ID NO: 221265 - DNA, 20 bp, Artificial Sequence
  chemically synthesized
ctttacatatcttggccatg

SEQ ID NO: 221266 - DNA, 20 bp, Artificial Sequence
  chemically synthesized
atatttgagtcctcatggcc

SEQ ID NO: 221267 - DNA, 20 bp, Artificial Sequence
  chemically synthesized
tctcaatatttgagtcctca

SEQ ID NO: 221268 - DNA, 20 bp, Artificial Sequence
  chemically synthesized
gccatgaggactcaaatatt

SEQ ID NO: 221269 - DNA, 20 bp, Artificial Sequence
  chemically synthesized
aactctgcctctcaatattt

SEQ ID NO: 221270 - DNA, 20 bp, Artificial Sequence
  chemically synthesized
catgaggactcaaatattga

SEQ ID NO: 221271 - DNA, 20 bp, Artificial Sequence
  chemically synthesized
atgaggactcaaatattgag

SEQ ID NO: 221272 - DNA, 20 bp, Artificial Sequence
  chemically synthesized
aggactcaaatattgagagg

SEQ ID NO: 221273 - DNA, 20 bp, Artificial Sequence
  chemically synthesized
gactcaaatattgagaggca

SEQ ID NO: 221274 - DNA, 20 bp, Artificial Sequence
  chemically synthesized
caaatattgagaggcagagt

SEQ ID NO: 221275 - DNA, 20 bp, Artificial Sequence
  chemically synthesized
gagttggaattctgaatctc

SEQ ID NO: 221276 - DNA, 20 bp, Artificial Sequence
  chemically synthesized
aggagctgtagcttgagatt

SEQ ID NO: 221277 - DNA, 20 bp, Artificial Sequence
  chemically synthesized
gaattctgaatctcaagcta

SEQ ID NO: 221278 - DNA, 20 bp, Artificial Sequence
  chemically synthesized
catgacaggagctgtagctt

SEQ ID NO: 221279 - DNA, 20 bp, Artificial Sequence
  chemically synthesized
gtatggcatgacaggagctg

SEQ ID NO: 221280 - DNA, 20 bp, Artificial Sequence
  chemically synthesized
actgtagtatggcatgacag

SEQ ID NO: 221281 - DNA, 20 bp, Artificial Sequence
  chemically synthesized
agactgtagtatggcatgac

SEQ ID NO: 221282 - DNA, 20 bp, Artificial Sequence
  chemically synthesized
tagactgtagtatggcatga

SEQ ID NO: 221283 - DNA, 20 bp, Artificial Sequence
  chemically synthesized
gctcctgtcatgccatacta

SEQ ID NO: 221284 - DNA, 20 bp, Artificial Sequence
  chemically synthesized
aatggtaatagactgtagta

SEQ ID NO: 221285 - DNA, 20 bp, Artificial Sequence
  chemically synthesized
aatggaatggtaatagactg

SEQ ID NO: 221286 - DNA, 20 bp, Artificial Sequence
  chemically synthesized
tggaggaaatggaatggtaa

SEQ ID NO: 221287 - DNA, 20 bp, Artificial Sequence
  chemically synthesized
cacagttggaggaaatggaa

SEQ ID NO: 221288 - DNA, 20 bp, Artificial Sequence
  chemically synthesized
ttaggcacagttggaggaaa

SEQ ID NO: 221289 - DNA, 20 bp, Artificial Sequence
  chemically synthesized
cttagcttaggcacagttgg

SEQ ID NO: 221290 - DNA, 20 bp, Artificial Sequence
  chemically synthesized
acttagcttaggcacagttg

SEQ ID NO: 221291 - DNA, 20 bp, Artificial Sequence
  chemically synthesized
gcacttagcttaggcacagt

SEQ ID NO: 221292 - DNA, 20 bp, Artificial Sequence
  chemically synthesized
catttcctccaactgtgcct

SEQ ID NO: 221293 - DNA, 20 bp, Artificial Sequence
  chemically synthesized
ccaggcacttagcttaggca

SEQ ID NO: 221294 - DNA, 20 bp, Artificial Sequence
  chemically synthesized
cctccaactgtgcctaagct

SEQ ID NO: 221295 - DNA, 20 bp, Artificial Sequence
  chemically synthesized
acataccaggcacttagctt

SEQ ID NO: 221296 - DNA, 20 bp, Artificial Sequence
  chemically synthesized
cacataccaggcacttagct

SEQ ID NO: 221297 - DNA, 20 bp, Artificial Sequence
  chemically synthesized
ctgtgcctaagctaagtgcc

SEQ ID NO: 221298 - DNA, 20 bp, Artificial Sequence
  chemically synthesized
taatccacataccaggcact

SEQ ID NO: 221299 - DNA, 20 bp, Artificial Sequence
  chemically synthesized
taagctaagtgcctggtatg

SEQ ID NO: 221300 - DNA, 20 bp, Artificial Sequence
  chemically synthesized
tagcagttaatccacatacc

SEQ ID NO: 221301 - DNA, 20 bp, Artificial Sequence
  chemically synthesized
atagcagttaatccacatac

SEQ ID NO: 221302 - DNA, 20 bp, Artificial Sequence
  chemically synthesized
gtatgtggattaactgctat

SEQ ID NO: 221303 - DNA, 20 bp, Artificial Sequence
  chemically synthesized
atgtggattaactgctatca

SEQ ID NO: 221304 - DNA, 20 bp, Artificial Sequence
  chemically synthesized
agtaaaaaagactctgatag

SEQ ID NO: 221305 - DNA, 20 bp, Artificial Sequence
  chemically synthesized
tacagtaaaaaagactctga

SEQ ID NO: 221306 - DNA, 20 bp, Artificial Sequence
  chemically synthesized
tctactccattacagtaaaa

SEQ ID NO: 221307 - DNA, 20 bp, Artificial Sequence
  chemically synthesized
cagagtcttttttactgtaa

SEQ ID NO: 221308 - DNA, 20 bp, Artificial Sequence
  chemically synthesized
gagtcttttttactgtaatg

SEQ ID NO: 221309 - DNA, 20 bp, Artificial Sequence
  chemically synthesized
acaatgcatctactccatta

SEQ ID NO: 221310 - DNA, 20 bp, Artificial Sequence
  chemically synthesized
tcttttttactgtaatggag

SEQ ID NO: 221311 - DNA, 20 bp, Artificial Sequence
  chemically synthesized
tggatgcagcaaataggata

SEQ ID NO: 221312 - DNA, 20 bp, Artificial Sequence
  chemically synthesized
attatgtggatgcagcaaat

SEQ ID NO: 221313 - DNA, 20 bp, Artificial Sequence
  chemically synthesized
aattatgtggatgcagcaaa

SEQ ID NO: 221314 - DNA, 20 bp, Artificial Sequence
  chemically synthesized
gactgataattatgtggatg

SEQ ID NO: 221315 - DNA, 20 bp, Artificial Sequence
  chemically synthesized
tgaacggactgataattatg

SEQ ID NO: 221316 - DNA, 20 bp, Artificial Sequence
  chemically synthesized
tgctgcatccacataattat

SEQ ID NO: 221317 - DNA, 20 bp, Artificial Sequence
  chemically synthesized
taattatcagtccgttcaaa

SEQ ID NO: 221318 - DNA, 20 bp, Artificial Sequence
  chemically synthesized
aattggctatgctttttgaa

SEQ ID NO: 221319 - DNA, 20 bp, Artificial Sequence
  chemically synthesized
atcagtccgttcaaaaagca

SEQ ID NO: 221320 - DNA, 20 bp, Artificial Sequence
  chemically synthesized
ttactaagtgatagagcaat

SEQ ID NO: 221321 - DNA, 20 bp, Artificial Sequence
  chemically synthesized
tagccaattgctctatcact

SEQ ID NO: 221322 - DNA, 20 bp, Artificial Sequence
  chemically synthesized
tagtcgtttactaagtgata

SEQ ID NO: 221323 - DNA, 20 bp, Artificial Sequence
  chemically synthesized
gttagtcgtttactaagtga

SEQ ID NO: 221324 - DNA, 20 bp, Artificial Sequence
  chemically synthesized
gtctaagttagtcgtttact

SEQ ID NO: 221325 - DNA, 20 bp, Artificial Sequence
  chemically synthesized
cacttagtaaacgactaact

SEQ ID NO: 221326 - DNA, 20 bp, Artificial Sequence
  chemically synthesized
ttccgtccagtggtctaagt

SEQ ID NO: 221327 - DNA, 20 bp, Artificial Sequence
  chemically synthesized
aaacgactaacttagaccac

SEQ ID NO: 221328 - DNA, 20 bp, Artificial Sequence
  chemically synthesized
aaagttccgtccagtggtct

SEQ ID NO: 221329 - DNA, 20 bp, Artificial Sequence
  chemically synthesized
gactaacttagaccactgga

SEQ ID NO: 221330 - DNA, 20 bp, Artificial Sequence
  chemically synthesized
ccaaaaaaagttccgtccag

SEQ ID NO: 221331 - DNA, 20 bp, Artificial Sequence
  chemically synthesized
tttccaaaaaaagttccgtc

SEQ ID NO: 221332 - DNA, 20 bp, Artificial Sequence
  chemically synthesized
ccactggacggaactttttt

SEQ ID NO: 221333 - DNA, 20 bp, Artificial Sequence
  chemically synthesized
tttcttttggtttccaaaaa

SEQ ID NO: 221334 - DNA, 20 bp, Artificial Sequence
  chemically synthesized
gaactttttttggaaaccaa

SEQ ID NO: 221335 - DNA, 20 bp, Artificial Sequence
  chemically synthesized
atttaggagctgttttcttt

SEQ ID NO: 221336 - DNA, 20 bp, Artificial Sequence
  chemically synthesized
ttttggaaaccaaaagaaaa

SEQ ID NO: 221337 - DNA, 20 bp, Artificial Sequence
  chemically synthesized
gagcaggtacagcaatttag

SEQ ID NO: 221338 - DNA, 20 bp, Artificial Sequence
  chemically synthesized
gagagcaggtacagcaattt

SEQ ID NO: 221339 - DNA, 20 bp, Artificial Sequence
  chemically synthesized
ggagagcaggtacagcaatt

SEQ ID NO: 221340 - DNA, 20 bp, Artificial Sequence
  chemically synthesized
taatctgaggagagcaggta

SEQ ID NO: 221341 - DNA, 20 bp, Artificial Sequence
  chemically synthesized
cataataatctgaggagagc

SEQ ID NO: 221342 - DNA, 20 bp, Artificial Sequence
  chemically synthesized
attgctgtacctgctctcct

SEQ ID NO: 221343 - DNA, 20 bp, Artificial Sequence
  chemically synthesized
acataataatctgaggagag

SEQ ID NO: 221344 - DNA, 20 bp, Artificial Sequence
  chemically synthesized
agcacataataatctgagga

SEQ ID NO: 221345 - DNA, 20 bp, Artificial Sequence
  chemically synthesized
ccagcacataataatctgag

SEQ ID NO: 221346 - DNA, 20 bp, Artificial Sequence
  chemically synthesized
ttccagcacataataatctg

SEQ ID NO: 221347 - DNA, 20 bp, Artificial Sequence
  chemically synthesized
tttccagcacataataatct

SEQ ID NO: 221348 - DNA, 20 bp, Artificial Sequence
  chemically synthesized
ctcctcagattattatgtgc

SEQ ID NO: 221349 - DNA, 20 bp, Artificial Sequence
  chemically synthesized
attattatgtgctggaaaat

SEQ ID NO: 221350 - DNA, 20 bp, Artificial Sequence
  chemically synthesized
aataatcgtctccgattttc

SEQ ID NO: 221351 - DNA, 20 bp, Artificial Sequence
  chemically synthesized
tattatgtgctggaaaatcg

SEQ ID NO: 221352 - DNA, 20 bp, Artificial Sequence
  chemically synthesized
ctggaaaatgtgaagtgtat

SEQ ID NO: 221353 - DNA, 20 bp, Artificial Sequence
  chemically synthesized
tttccattctggaaaatgtg

SEQ ID NO: 221354 - DNA, 20 bp, Artificial Sequence
  chemically synthesized
ctcatacacttcacattttc

SEQ ID NO: 221355 - DNA, 20 bp, Artificial Sequence
  chemically synthesized
acacttcacattttccagaa

SEQ ID NO: 221356 - DNA, 20 bp, Artificial Sequence
  chemically synthesized
tgctacttaattttccattc

SEQ ID NO: 221357 - DNA, 20 bp, Artificial Sequence
  chemically synthesized
attttccagaatggaaaatt

SEQ ID NO: 221358 - DNA, 20 bp, Artificial Sequence
  chemically synthesized
ttccagaatggaaaattaag

SEQ ID NO: 221359 - DNA, 20 bp, Artificial Sequence
  chemically synthesized
gaatggaaaattaagtagca

SEQ ID NO: 221360 - DNA, 20 bp, Artificial Sequence
  chemically synthesized
aatggaaaattaagtagcaa

SEQ ID NO: 221361 - DNA, 20 bp, Artificial Sequence
  chemically synthesized
ggaaaattaagtagcaaagg

SEQ ID NO: 221362 - DNA, 20 bp, Artificial Sequence
  chemically synthesized
caaaggcagatgtcccctgt

SEQ ID NO: 221363 - DNA, 20 bp, Artificial Sequence
  chemically synthesized
aaaggcagatgtcccctgtt

SEQ ID NO: 221364 - DNA, 20 bp, Artificial Sequence
  chemically synthesized
aaggcagatgtcccctgttg

SEQ ID NO: 221365 - DNA, 20 bp, Artificial Sequence
  chemically synthesized
ctcaatcgttgccccaacag

SEQ ID NO: 221366 - DNA, 20 bp, Artificial Sequence
  chemically synthesized
gctcaatcgttgccccaaca

SEQ ID NO: 221367 - DNA, 20 bp, Artificial Sequence
  chemically synthesized
agctcaatcgttgccccaac

SEQ ID NO: 221368 - DNA, 20 bp, Artificial Sequence
  chemically synthesized
cagctcaatcgttgccccaa

SEQ ID NO: 221369 - DNA, 20 bp, Artificial Sequence
  chemically synthesized
cccctgttggggcaacgatt

SEQ ID NO: 221370 - DNA, 20 bp, Artificial Sequence
  chemically synthesized
tgttggggcaacgattgagc

SEQ ID NO: 221371 - DNA, 20 bp, Artificial Sequence
  chemically synthesized
ggcaacgattgagctggata

SEQ ID NO: 221372 - DNA, 20 bp, Artificial Sequence
  chemically synthesized
aacgattgagctggatatag

SEQ ID NO: 221373 - DNA, 20 bp, Artificial Sequence
  chemically synthesized
ggatatgagtcttctatatc

SEQ ID NO: 221374 - DNA, 20 bp, Artificial Sequence
  chemically synthesized
cagtttagcaaacaggatat

SEQ ID NO: 221375 - DNA, 20 bp, Artificial Sequence
  chemically synthesized
aacagcccagtttagcaaac

SEQ ID NO: 221376 - DNA, 20 bp, Artificial Sequence
  chemically synthesized
gaacagcccagtttagcaaa

SEQ ID NO: 221377 - DNA, 20 bp, Artificial Sequence
  chemically synthesized
tcatatcctgtttgctaaac

SEQ ID NO: 221378 - DNA, 20 bp, Artificial Sequence
  chemically synthesized
catatcctgtttgctaaact

SEQ ID NO: 221379 - DNA, 20 bp, Artificial Sequence
  chemically synthesized
atagtaagaacagcccagtt

SEQ ID NO: 221380 - DNA, 20 bp, Artificial Sequence
  chemically synthesized
tgagaatagtaagaacagcc

SEQ ID NO: 221381 - DNA, 20 bp, Artificial Sequence
  chemically synthesized
catgttgagaatagtaagaa

SEQ ID NO: 221382 - DNA, 20 bp, Artificial Sequence
  chemically synthesized
gtgaacatgttgagaatagt

SEQ ID NO: 221383 - DNA, 20 bp, Artificial Sequence
  chemically synthesized
tgatgtgaacatgttgagaa

SEQ ID NO: 221384 - DNA, 20 bp, Artificial Sequence
  chemically synthesized
tatgatgatgtgaacatgtt

SEQ ID NO: 221385 - DNA, 20 bp, Artificial Sequence
  chemically synthesized
tcacatcatcataataaaac

SEQ ID NO: 221386 - DNA, 20 bp, Artificial Sequence
  chemically synthesized
taataaaacaagcgcccctt

SEQ ID NO: 221387 - DNA, 20 bp, Artificial Sequence
  chemically synthesized
aatatttatggtgtcttaag

SEQ ID NO: 221388 - DNA, 20 bp, Artificial Sequence
  chemically synthesized
taatatttatggtgtcttaa

SEQ ID NO: 221389 - DNA, 20 bp, Artificial Sequence
  chemically synthesized
gtaatatttatggtgtctta

SEQ ID NO: 221390 - DNA, 20 bp, Artificial Sequence
  chemically synthesized
tgtaatatttatggtgtctt

SEQ ID NO: 221391 - DNA, 20 bp, Artificial Sequence
  chemically synthesized
gactgagattgtaatattta

SEQ ID NO: 221392 - DNA, 20 bp, Artificial Sequence
  chemically synthesized
caccataaatattacaatct

SEQ ID NO: 221393 - DNA, 20 bp, Artificial Sequence
  chemically synthesized
actctataaatatattgact

SEQ ID NO: 221394 - DNA, 20 bp, Artificial Sequence
  chemically synthesized
aatctcagtcaatatattta

SEQ ID NO: 221395 - DNA, 20 bp, Artificial Sequence
  chemically synthesized
tctcagtcaatatatttata

SEQ ID NO: 221396 - DNA, 20 bp, Artificial Sequence
  chemically synthesized
agtcaatatatttatagagt

SEQ ID NO: 221397 - DNA, 20 bp, Artificial Sequence
  chemically synthesized
gtcaatatatttatagagtc

SEQ ID NO: 221398 - DNA, 20 bp, Artificial Sequence
  chemically synthesized
aatatatttatagagtcagg

SEQ ID NO: 221399 - DNA, 20 bp, Artificial Sequence
  chemically synthesized
tatatttatagagtcaggaa

SEQ ID NO: 221400 - DNA, 20 bp, Artificial Sequence
  chemically synthesized
tttatagagtcaggaagagt

SEQ ID NO: 221401 - DNA, 20 bp, Artificial Sequence
  chemically synthesized
gaattacagttgatgaatat

SEQ ID NO: 221402 - DNA, 20 bp, Artificial Sequence
  chemically synthesized
ataataatcctgatgaatta

SEQ ID NO: 221403 - DNA, 20 bp, Artificial Sequence
  chemically synthesized
attcatcaactgtaattcat

SEQ ID NO: 221404 - DNA, 20 bp, Artificial Sequence
  chemically synthesized
ttcatcaactgtaattcatc

SEQ ID NO: 221405 - DNA, 20 bp, Artificial Sequence
  chemically synthesized
gtaattcatcaggattatta

SEQ ID NO: 221406 - DNA, 20 bp, Artificial Sequence
  chemically synthesized
ttcatcaggattattatagt

SEQ ID NO: 221407 - DNA, 20 bp, Artificial Sequence
  chemically synthesized
tcatcaggattattatagtt

SEQ ID NO: 221408 - DNA, 20 bp, Artificial Sequence
  chemically synthesized
catcaggattattatagtta

SEQ ID NO: 221409 - DNA, 20 bp, Artificial Sequence
  chemically synthesized
tcaggattattatagttagg

SEQ ID NO: 221410 - DNA, 20 bp, Artificial Sequence
  chemically synthesized
caggattattatagttaggg

SEQ ID NO: 221411 - DNA, 20 bp, Artificial Sequence
  chemically synthesized
aggattattatagttaggga

SEQ ID NO: 221412 - DNA, 20 bp, Artificial Sequence
  chemically synthesized
tagttagggagggaaaccca

SEQ ID NO: 221413 - DNA, 20 bp, Artificial Sequence
  chemically synthesized
tctttcagtgtcataacttt

SEQ ID NO: 221414 - DNA, 20 bp, Artificial Sequence
  chemically synthesized
gtctttcagtgtcataactt

SEQ ID NO: 221415 - DNA, 20 bp, Artificial Sequence
  chemically synthesized
acccaaagttatgacactga

SEQ ID NO: 221416 - DNA, 20 bp, Artificial Sequence
  chemically synthesized
aactcactgatcatgtcttt

SEQ ID NO: 221417 - DNA, 20 bp, Artificial Sequence
  chemically synthesized
atgacactgaaagacatgat

SEQ ID NO: 221418 - DNA, 20 bp, Artificial Sequence
  chemically synthesized
cactgaaagacatgatcagt

SEQ ID NO: 221419 - DNA, 20 bp, Artificial Sequence
  chemically synthesized
ttatatagcaagtatgtttt

SEQ ID NO: 221420 - DNA, 20 bp, Artificial Sequence
  chemically synthesized
ccattcctgtgttatatagc

SEQ ID NO: 221421 - DNA, 20 bp, Artificial Sequence
  chemically synthesized
aacatacttgctatataaca

SEQ ID NO: 221422 - DNA, 20 bp, Artificial Sequence
  chemically synthesized
aaagccattcctgtgttata

SEQ ID NO: 221423 - DNA, 20 bp, Artificial Sequence
  chemically synthesized
acatacttgctatataacac

SEQ ID NO: 221424 - DNA, 20 bp, Artificial Sequence
  chemically synthesized
cttgctatataacacaggaa

SEQ ID NO: 221425 - DNA, 20 bp, Artificial Sequence
  chemically synthesized
agtaatgacaaatgtgtcaa

SEQ ID NO: 221426 - DNA, 20 bp, Artificial Sequence
  chemically synthesized
cttaaaggattatttttata

SEQ ID NO: 221427 - DNA, 20 bp, Artificial Sequence
  chemically synthesized
ctttataaaaataatccttt

SEQ ID NO: 221428 - DNA, 20 bp, Artificial Sequence
  chemically synthesized
atcaccacaaagtaacttaa

SEQ ID NO: 221429 - DNA, 20 bp, Artificial Sequence
  chemically synthesized
catcaccacaaagtaactta

SEQ ID NO: 221430 - DNA, 20 bp, Artificial Sequence
  chemically synthesized
taatcctttaagttactttg

SEQ ID NO: 221431 - DNA, 20 bp, Artificial Sequence
  chemically synthesized
agaagtgtttcatcaccaca

SEQ ID NO: 221432 - DNA, 20 bp, Artificial Sequence
  chemically synthesized
ctaccactatcaagataaag

SEQ ID NO: 221433 - DNA, 20 bp, Artificial Sequence
  chemically synthesized
ttactaccactatcaagata

SEQ ID NO: 221434 - DNA, 20 bp, Artificial Sequence
  chemically synthesized
gaaacacttctttatcttga

SEQ ID NO: 221435 - DNA, 20 bp, Artificial Sequence
  chemically synthesized
acacttctttatcttgatag

SEQ ID NO: 221436 - DNA, 20 bp, Artificial Sequence
  chemically synthesized
atatagttactaccactatc

SEQ ID NO: 221437 - DNA, 20 bp, Artificial Sequence
  chemically synthesized
cttctttatcttgatagtgg

SEQ ID NO: 221438 - DNA, 20 bp, Artificial Sequence
  chemically synthesized
accatgtctatagatttata

SEQ ID NO: 221439 - DNA, 20 bp, Artificial Sequence
  chemically synthesized
gtagtaactatataaatcta

SEQ ID NO: 221440 - DNA, 20 bp, Artificial Sequence
  chemically synthesized
actatataaatctatagaca

SEQ ID NO: 221441 - DNA, 20 bp, Artificial Sequence
  chemically synthesized
tatgacattaaccatgtcta

SEQ ID NO: 221442 - DNA, 20 bp, Artificial Sequence
  chemically synthesized
tatagacatggttaatgtca

SEQ ID NO: 221443 - DNA, 20 bp, Artificial Sequence
  chemically synthesized
tggttaatgtcatagaataa

SEQ ID NO: 221444 - DNA, 20 bp, Artificial Sequence
  chemically synthesized
gaataacagataatgactca

SEQ ID NO: 221445 - DNA, 20 bp, Artificial Sequence
  chemically synthesized
cagataatgactcacagtaa

SEQ ID NO: 221446 - DNA, 20 bp, Artificial Sequence
  chemically synthesized
tgcacatgctcttttactgt

SEQ ID NO: 221447 - DNA, 20 bp, Artificial Sequence
  chemically synthesized
gataatgactcacagtaaaa

SEQ ID NO: 221448 - DNA, 20 bp, Artificial Sequence
  chemically synthesized
taaaagagcatgtgcaaaaa

SEQ ID NO: 221449 - DNA, 20 bp, Artificial Sequence
  chemically synthesized
aaaagagcatgtgcaaaaac

SEQ ID NO: 221450 - DNA, 20 bp, Artificial Sequence
  chemically synthesized
tgcaaaaacaggtgaaatcc

SEQ ID NO: 221451 - DNA, 20 bp, Artificial Sequence
  chemically synthesized
aaaacaggtgaaatccaagt

SEQ ID NO: 221452 - DNA, 20 bp, Artificial Sequence
  chemically synthesized
aaacaggtgaaatccaagta

SEQ ID NO: 221453 - DNA, 20 bp, Artificial Sequence
  chemically synthesized
actagactgtagaccttact

SEQ ID NO: 221454 - DNA, 20 bp, Artificial Sequence
  chemically synthesized
tgaaatccaagtaaggtcta

SEQ ID NO: 221455 - DNA, 20 bp, Artificial Sequence
  chemically synthesized
tccaagtaaggtctacagtc

SEQ ID NO: 221456 - DNA, 20 bp, Artificial Sequence
  chemically synthesized
cagtgcaatcaactagactg

SEQ ID NO: 221457 - DNA, 20 bp, Artificial Sequence
  chemically synthesized
attggcacagtgcaatcaac

SEQ ID NO: 221458 - DNA, 20 bp, Artificial Sequence
  chemically synthesized
ccaataaactgacattggca

SEQ ID NO: 221459 - DNA, 20 bp, Artificial Sequence
  chemically synthesized
tgattgcactgtgccaatgt

SEQ ID NO: 221460 - DNA, 20 bp, Artificial Sequence
  chemically synthesized
caaacccaataaactgacat

SEQ ID NO: 221461 - DNA, 20 bp, Artificial Sequence
  chemically synthesized
ctgtgccaatgtcagtttat

SEQ ID NO: 221462 - DNA, 20 bp, Artificial Sequence
  chemically synthesized
tgtgccaatgtcagtttatt

SEQ ID NO: 221463 - DNA, 20 bp, Artificial Sequence
  chemically synthesized
caatgtcagtttattgggtt

SEQ ID NO: 221464 - DNA, 20 bp, Artificial Sequence
  chemically synthesized
gtttggtaatatactgtatt

SEQ ID NO: 221465 - DNA, 20 bp, Artificial Sequence
  chemically synthesized
agttacatattaaccaaata

SEQ ID NO: 221466 - DNA, 20 bp, Artificial Sequence
  chemically synthesized
gtatttggttaatatgtaac

SEQ ID NO: 221467 - DNA, 20 bp, Artificial Sequence
  chemically synthesized
tatttggttaatatgtaact

SEQ ID NO: 221468 - DNA, 20 bp, Artificial Sequence
  chemically synthesized
atttggttaatatgtaactg

SEQ ID NO: 221469 - DNA, 20 bp, Artificial Sequence
  chemically synthesized
ggttaatatgtaactgggga

SEQ ID NO: 221470 - DNA, 20 bp, Artificial Sequence
  chemically synthesized
atacataacccaactttccc

SEQ ID NO: 221471 - DNA, 20 bp, Artificial Sequence
  chemically synthesized
aatatgtaactggggaaagt

SEQ ID NO: 221472 - DNA, 20 bp, Artificial Sequence
  chemically synthesized
atatgtaactggggaaagtt

SEQ ID NO: 221473 - DNA, 20 bp, Artificial Sequence
  chemically synthesized
aaagttgggttatgtataca

SEQ ID NO: 221474 - DNA, 20 bp, Artificial Sequence
  chemically synthesized
aagttgggttatgtatacac

SEQ ID NO: 221475 - DNA, 20 bp, Artificial Sequence
  chemically synthesized
ggagttgcaaaaacagtaca

SEQ ID NO: 221476 - DNA, 20 bp, Artificial Sequence
  chemically synthesized
aaggagttgcaaaaacagta

SEQ ID NO: 221477 - DNA, 20 bp, Artificial Sequence
  chemically synthesized
ctcacaaggagttgcaaaaa

SEQ ID NO: 221478 - DNA, 20 bp, Artificial Sequence
  chemically synthesized
ctgtttttgcaactccttgt

SEQ ID NO: 221479 - DNA, 20 bp, Artificial Sequence
  chemically synthesized
aatattcatagactcacaag

SEQ ID NO: 221480 - DNA, 20 bp, Artificial Sequence
  chemically synthesized
gaaatattcatagactcaca

SEQ ID NO: 221481 - DNA, 20 bp, Artificial Sequence
  chemically synthesized
tgaaatattcatagactcac

SEQ ID NO: 221482 - DNA, 20 bp, Artificial Sequence
  chemically synthesized
tttttattgtgaaatattca

SEQ ID NO: 221483 - DNA, 20 bp, Artificial Sequence
  chemically synthesized
taaagttttaagaatgtttt

SEQ ID NO: 221484 - DNA, 20 bp, Artificial Sequence
  chemically synthesized
caaaatttctataaagtttt

SEQ ID NO: 221485 - DNA, 20 bp, Artificial Sequence
  chemically synthesized
aaaacattcttaaaacttta

SEQ ID NO: 221486 - DNA, 20 bp, Artificial Sequence
  chemically synthesized
aggcaggcaaaatttctata

SEQ ID NO: 221487 - DNA, 20 bp, Artificial Sequence
  chemically synthesized
agaaattttgcctgccttca

SEQ ID NO: 221488 - DNA, 20 bp, Artificial Sequence
  chemically synthesized
cttacagtctctttgaaggc

SEQ ID NO: 221489 - DNA, 20 bp, Artificial Sequence
  chemically synthesized
ccttacagtctctttgaagg

SEQ ID NO: 221490 - DNA, 20 bp, Artificial Sequence
  chemically synthesized
aaattttgcctgccttcaaa

SEQ ID NO: 221491 - DNA, 20 bp, Artificial Sequence
  chemically synthesized
ttcccttacagtctctttga

SEQ ID NO: 221492 - DNA, 20 bp, Artificial Sequence
  chemically synthesized
tttcccttacagtctctttg

SEQ ID NO: 221493 - DNA, 20 bp, Artificial Sequence
  chemically synthesized
cctgccttcaaagagactgt

SEQ ID NO: 221494 - DNA, 20 bp, Artificial Sequence
  chemically synthesized
ctgccttcaaagagactgta

SEQ ID NO: 221495 - DNA, 20 bp, Artificial Sequence
  chemically synthesized
tgccttcaaagagactgtaa

SEQ ID NO: 221496 - DNA, 20 bp, Artificial Sequence
  chemically synthesized
tctttctctattttccctta

SEQ ID NO: 221497 - DNA, 20 bp, Artificial Sequence
  chemically synthesized
aaagagactgtaagggaaaa

SEQ ID NO: 221498 - DNA, 20 bp, Artificial Sequence
  chemically synthesized
agagactgtaagggaaaata

SEQ ID NO: 221499 - DNA, 20 bp, Artificial Sequence
  chemically synthesized
actgtaagggaaaatagaga

SEQ ID NO: 221500 - DNA, 20 bp, Artificial Sequence
  chemically synthesized
gtaagggaaaatagagaaag

SEQ ID NO: 221501 - DNA, 20 bp, Artificial Sequence
  chemically synthesized
aagggaaaatagagaaagaa

SEQ ID NO: 221502 - DNA, 20 bp, Artificial Sequence
  chemically synthesized
gggaaaatagagaaagaaga

SEQ ID NO: 221503 - DNA, 20 bp, Artificial Sequence
  chemically synthesized
agagagaaaattaaaatgtc

SEQ ID NO: 221504 - DNA, 20 bp, Artificial Sequence
  chemically synthesized
acttcctattaggaattagc

SEQ ID NO: 221505 - DNA, 20 bp, Artificial Sequence
  chemically synthesized
gaaaacttcctattaggaat

SEQ ID NO: 221506 - DNA, 20 bp, Artificial Sequence
  chemically synthesized
aatgtctggctaattcctaa

SEQ ID NO: 221507 - DNA, 20 bp, Artificial Sequence
  chemically synthesized
atgtctggctaattcctaat

SEQ ID NO: 221508 - DNA, 20 bp, Artificial Sequence
  chemically synthesized
tctggctaattcctaatagg

SEQ ID NO: 221509 - DNA, 20 bp, Artificial Sequence
  chemically synthesized
aataaagaaaacttcctatt

SEQ ID NO: 221510 - DNA, 20 bp, Artificial Sequence
  chemically synthesized
aaataaagaaaacttcctat

SEQ ID NO: 221511 - DNA, 20 bp, Artificial Sequence
  chemically synthesized
ccgtttcttgtataaaaata

SEQ ID NO: 221512 - DNA, 20 bp, Artificial Sequence
  chemically synthesized
agttttctttatttttatac

SEQ ID NO: 221513 - DNA, 20 bp, Artificial Sequence
  chemically synthesized
ctttatttttatacaagaaa

SEQ ID NO: 221514 - DNA, 20 bp, Artificial Sequence
  chemically synthesized
tatacaagaaacggaaaaca

SEQ ID NO: 221515 - DNA, 20 bp, Artificial Sequence
  chemically synthesized
aaacatagttgctatatcaa

SEQ ID NO: 221516 - DNA, 20 bp, Artificial Sequence
  chemically synthesized
aacatagttgctatatcaac

SEQ ID NO: 221517 - DNA, 20 bp, Artificial Sequence
  chemically synthesized
agactaaaatcctgttgata

SEQ ID NO: 221518 - DNA, 20 bp, Artificial Sequence
  chemically synthesized
ttgctatatcaacaggattt

SEQ ID NO: 221519 - DNA, 20 bp, Artificial Sequence
  chemically synthesized
cttcagctttgtgaagaaaa

SEQ ID NO: 221520 - DNA, 20 bp, Artificial Sequence
  chemically synthesized
tttagtctattttcttcaca

SEQ ID NO: 221521 - DNA, 20 bp, Artificial Sequence
  chemically synthesized
acaccttcttcagctttgtg

SEQ ID NO: 221522 - DNA, 20 bp, Artificial Sequence
  chemically synthesized
ctattttcttcacaaagctg

SEQ ID NO: 221523 - DNA, 20 bp, Artificial Sequence
  chemically synthesized
ttttcttcacaaagctgaag

SEQ ID NO: 221524 - DNA, 20 bp, Artificial Sequence
  chemically synthesized
tttcttcacaaagctgaaga

SEQ ID NO: 221525 - DNA, 20 bp, Artificial Sequence
  chemically synthesized
aaagtcattcacaccttctt

SEQ ID NO: 221526 - DNA, 20 bp, Artificial Sequence
  chemically synthesized
ttattcacttgcacagagaa

SEQ ID NO: 221527 - DNA, 20 bp, Artificial Sequence
  chemically synthesized
tgaatgacttttctctgtgc

SEQ ID NO: 221528 - DNA, 20 bp, Artificial Sequence
  chemically synthesized
gtatattattcacttgcaca

SEQ ID NO: 221529 - DNA, 20 bp, Artificial Sequence
  chemically synthesized
tagtatattattcacttgca

SEQ ID NO: 221530 - DNA, 20 bp, Artificial Sequence
  chemically synthesized
aagggtggaacaagtaattt

SEQ ID NO: 221531 - DNA, 20 bp, Artificial Sequence
  chemically synthesized
gacaaaaacaagggtggaac

SEQ ID NO: 221532 - DNA, 20 bp, Artificial Sequence
  chemically synthesized
aaacaagacaaaaacaaggg

SEQ ID NO: 221533 - DNA, 20 bp, Artificial Sequence
  chemically synthesized
tgtaaacaagacaaaaacaa

SEQ ID NO: 221534 - DNA, 20 bp, Artificial Sequence
  chemically synthesized
atgtaaacaagacaaaaaca

SEQ ID NO: 221535 - DNA, 20 bp, Artificial Sequence
  chemically synthesized
gatgtaaacaagacaaaaac

SEQ ID NO: 221536 - DNA, 20 bp, Artificial Sequence
  chemically synthesized
tatggaagtaggatgtaaac

SEQ ID NO: 221537 - DNA, 20 bp, Artificial Sequence
  chemically synthesized
attggcaggtttatggaagt

SEQ ID NO: 221538 - DNA, 20 bp, Artificial Sequence
  chemically synthesized
tattggcaggtttatggaag

SEQ ID NO: 221539 - DNA, 20 bp, Artificial Sequence
  chemically synthesized
aaatattggcaggtttatgg

SEQ ID NO: 221540 - DNA, 20 bp, Artificial Sequence
  chemically synthesized
actaaatattggcaggttta

SEQ ID NO: 221541 - DNA, 20 bp, Artificial Sequence
  chemically synthesized
attagtgactaaatattggc

SEQ ID NO: 221542 - DNA, 20 bp, Artificial Sequence
  chemically synthesized
gattagtgactaaatattgg

SEQ ID NO: 221543 - DNA, 20 bp, Artificial Sequence
  chemically synthesized
tccataaacctgccaatatt

SEQ ID NO: 221544 - DNA, 20 bp, Artificial Sequence
  chemically synthesized
taagattagtgactaaatat

SEQ ID NO: 221545 - DNA, 20 bp, Artificial Sequence
  chemically synthesized
aatatttagtcactaatctt

SEQ ID NO: 221546 - DNA, 20 bp, Artificial Sequence
  chemically synthesized
attctgtcatagcttaagat

SEQ ID NO: 221547 - DNA, 20 bp, Artificial Sequence
  chemically synthesized
tttaaattctgtcatagctt

SEQ ID NO: 221548 - DNA, 20 bp, Artificial Sequence
  chemically synthesized
tcactaatcttaagctatga

SEQ ID NO: 221549 - DNA, 20 bp, Artificial Sequence
  chemically synthesized
atctgttttaaattctgtca

SEQ ID NO: 221550 - DNA, 20 bp, Artificial Sequence
  chemically synthesized
agctatgacagaatttaaaa

SEQ ID NO: 221551 - DNA, 20 bp, Artificial Sequence
  chemically synthesized
gatttgaattcaccttatgt

SEQ ID NO: 221552 - DNA, 20 bp, Artificial Sequence
  chemically synthesized
gctttacaatatcttacata

SEQ ID NO: 221553 - DNA, 20 bp, Artificial Sequence
  chemically synthesized
tgctttacaatatcttacat

SEQ ID NO: 221554 - DNA, 20 bp, Artificial Sequence
  chemically synthesized
accttatgtaagatattgta

SEQ ID NO: 221555 - DNA, 20 bp, Artificial Sequence
  chemically synthesized
agttttctagatgtgtgttg

SEQ ID NO: 221556 - DNA, 20 bp, Artificial Sequence
  chemically synthesized
atgatgccacaacacacatc

SEQ ID NO: 221557 - DNA, 20 bp, Artificial Sequence
  chemically synthesized
tgagagaagacacagttttc

SEQ ID NO: 221558 - DNA, 20 bp, Artificial Sequence
  chemically synthesized
gttccatttgagagaagaca

SEQ ID NO: 221559 - DNA, 20 bp, Artificial Sequence
  chemically synthesized
aactcagttccatttgagag

SEQ ID NO: 221560 - DNA, 20 bp, Artificial Sequence
  chemically synthesized
aaactgtgtcttctctcaaa

SEQ ID NO: 221561 - DNA, 20 bp, Artificial Sequence
  chemically synthesized
aacaactcagttccatttga

SEQ ID NO: 221562 - DNA, 20 bp, Artificial Sequence
  chemically synthesized
ggaacaactcagttccattt

SEQ ID NO: 221563 - DNA, 20 bp, Artificial Sequence
  chemically synthesized
gtcttctctcaaatggaact

SEQ ID NO: 221564 - DNA, 20 bp, Artificial Sequence
  chemically synthesized
taaacatcttaggaacaact

SEQ ID NO: 221565 - DNA, 20 bp, Artificial Sequence
  chemically synthesized
aatggaactgagttgttcct

SEQ ID NO: 221566 - DNA, 20 bp, Artificial Sequence
  chemically synthesized
tcactttagttaaacatctt

SEQ ID NO: 221567 - DNA, 20 bp, Artificial Sequence
  chemically synthesized
atcactttagttaaacatct

SEQ ID NO: 221568 - DNA, 20 bp, Artificial Sequence
  chemically synthesized
gttcctaagatgtttaacta

SEQ ID NO: 221569 - DNA, 20 bp, Artificial Sequence
  chemically synthesized
ttcagcccatttaatcactt

SEQ ID NO: 221570 - DNA, 20 bp, Artificial Sequence
  chemically synthesized
gtttaactaaagtgattaaa

SEQ ID NO: 221571 - DNA, 20 bp, Artificial Sequence
  chemically synthesized
tttaactaaagtgattaaat

SEQ ID NO: 221572 - DNA, 20 bp, Artificial Sequence
  chemically synthesized
aaaatcaatatgttataatt

SEQ ID NO: 221573 - DNA, 20 bp, Artificial Sequence
  chemically synthesized
ataacatattgatttttaaa

SEQ ID NO: 221574 - DNA, 20 bp, Artificial Sequence
  chemically synthesized
atattgatttttaaatggtc

SEQ ID NO: 221575 - DNA, 20 bp, Artificial Sequence
  chemically synthesized
attaacaatgcaaatgtggc

SEQ ID NO: 221576 - DNA, 20 bp, Artificial Sequence
  chemically synthesized
aaaaattaacaatgcaaatg

SEQ ID NO: 221577 - DNA, 20 bp, Artificial Sequence
  chemically synthesized
ttgcattgttaattttttac

SEQ ID NO: 221578 - DNA, 20 bp, Artificial Sequence
  chemically synthesized
ttttttacaagattgcacca

SEQ ID NO: 221579 - DNA, 20 bp, Artificial Sequence
  chemically synthesized
ttgtcagtgatttatatcta

SEQ ID NO: 221580 - DNA, 20 bp, Artificial Sequence
  chemically synthesized
ctacttttaaaatattttgt

SEQ ID NO: 221581 - DNA, 20 bp, Artificial Sequence
  chemically synthesized
tcactgacaaaatattttaa

SEQ ID NO: 221582 - DNA, 20 bp, Artificial Sequence
  chemically synthesized
ctgacaaaatattttaaaag

SEQ ID NO: 221583 - DNA, 20 bp, Artificial Sequence
  chemically synthesized
catacaaaaatcgtcaacac

SEQ ID NO: 221584 - DNA, 20 bp, Artificial Sequence
  chemically synthesized
atacaaaaatcgtcaacact

SEQ ID NO: 221585 - DNA, 20 bp, Artificial Sequence
  chemically synthesized
ttgaaagttaaattttatcc

SEQ ID NO: 221586 - DNA, 20 bp, Artificial Sequence
  chemically synthesized
taagattattttaattttga

SEQ ID NO: 221587 - DNA, 20 bp, Artificial Sequence
  chemically synthesized
tttcaaaattaaaataatct

SEQ ID NO: 221588 - DNA, 20 bp, Artificial Sequence
  chemically synthesized
tttggataactgaattttct

SEQ ID NO: 221589 - DNA, 20 bp, Artificial Sequence
  chemically synthesized
taaaataatcttagaaaatt

SEQ ID NO: 221590 - DNA, 20 bp, Artificial Sequence
  chemically synthesized
ttagaaaattcagttatcca

SEQ ID NO: 221591 - DNA, 20 bp, Artificial Sequence
  chemically synthesized
tagaaaattcagttatccaa

SEQ ID NO: 221592 - DNA, 20 bp, Artificial Sequence
  chemically synthesized
aagtcattgcttaatgcctt

SEQ ID NO: 221593 - DNA, 20 bp, Artificial Sequence
  chemically synthesized
ttcagttatccaaaggcatt

SEQ ID NO: 221594 - DNA, 20 bp, Artificial Sequence
  chemically synthesized
cattaagcaatgacttttca

SEQ ID NO: 221595 - DNA, 20 bp, Artificial Sequence
  chemically synthesized
atatccttatcaactttgaa

SEQ ID NO: 221596 - DNA, 20 bp, Artificial Sequence
  chemically synthesized
aatgacttttcaaagttgat

SEQ ID NO: 221597 - DNA, 20 bp, Artificial Sequence
  chemically synthesized
atgacttttcaaagttgata

SEQ ID NO: 221598 - DNA, 20 bp, Artificial Sequence
  chemically synthesized
tttcaaagttgataaggata

SEQ ID NO: 221599 - DNA, 20 bp, Artificial Sequence
  chemically synthesized
ggatatagtttctattgtga

SEQ ID NO: 221600 - DNA, 20 bp, Artificial Sequence
  chemically synthesized
tgtctaatagactttcacaa

SEQ ID NO: 221601 - DNA, 20 bp, Artificial Sequence
  chemically synthesized
tttctattgtgaaagtctat

SEQ ID NO: 221602 - DNA, 20 bp, Artificial Sequence
  chemically synthesized
attgtgaaagtctattagac

SEQ ID NO: 221603 - DNA, 20 bp, Artificial Sequence
  chemically synthesized
tttgaaaagtacttgtctaa

SEQ ID NO: 221604 - DNA, 20 bp, Artificial Sequence
  chemically synthesized
ataacctatataattttgaa

SEQ ID NO: 221605 - DNA, 20 bp, Artificial Sequence
  chemically synthesized
aagtacttttcaaaattata

SEQ ID NO: 221606 - DNA, 20 bp, Artificial Sequence
  chemically synthesized
agtacttttcaaaattatat

SEQ ID NO: 221607 - DNA, 20 bp, Artificial Sequence
  chemically synthesized
aattatataggttattgtat

SEQ ID NO: 221608 - DNA, 20 bp, Artificial Sequence
  chemically synthesized
tctttatcacagcatgaaaa

SEQ ID NO: 221609 - DNA, 20 bp, Artificial Sequence
  chemically synthesized
tccgttttcatgctgtgata

SEQ ID NO: 221610 - DNA, 20 bp, Artificial Sequence
  chemically synthesized
tctcaagtatgtctttatca

SEQ ID NO: 221611 - DNA, 20 bp, Artificial Sequence
  chemically synthesized
gctgtgataaagacatactt

SEQ ID NO: 221612 - DNA, 20 bp, Artificial Sequence
  chemically synthesized
gataaagacatacttgagac

SEQ ID NO: 221613 - DNA, 20 bp, Artificial Sequence
  chemically synthesized
ataaagacatacttgagact

SEQ ID NO: 221614 - DNA, 20 bp, Artificial Sequence
  chemically synthesized
tactttttcttcccagtctc

SEQ ID NO: 221615 - DNA, 20 bp, Artificial Sequence
  chemically synthesized
aagacatacttgagactggg

SEQ ID NO: 221616 - DNA, 20 bp, Artificial Sequence
  chemically synthesized
attaaactactttttcttcc

SEQ ID NO: 221617 - DNA, 20 bp, Artificial Sequence
  chemically synthesized
tacttgagactgggaagaaa

SEQ ID NO: 221618 - DNA, 20 bp, Artificial Sequence
  chemically synthesized
ttgagactgggaagaaaaag

SEQ ID NO: 221619 - DNA, 20 bp, Artificial Sequence
  chemically synthesized
aagtagtttaattgaactta

SEQ ID NO: 221620 - DNA, 20 bp, Artificial Sequence
  chemically synthesized
ccccagtcatgtggaactat

SEQ ID NO: 221621 - DNA, 20 bp, Artificial Sequence
  chemically synthesized
aacttatagttccacatgac

SEQ ID NO: 221622 - DNA, 20 bp, Artificial Sequence
  chemically synthesized
acttatagttccacatgact

SEQ ID NO: 221623 - DNA, 20 bp, Artificial Sequence
  chemically synthesized
ctgaggcctccccagtcatg

SEQ ID NO: 221624 - DNA, 20 bp, Artificial Sequence
  chemically synthesized
cttatagttccacatgactg

SEQ ID NO: 221625 - DNA, 20 bp, Artificial Sequence
  chemically synthesized
tatagttccacatgactggg

SEQ ID NO: 221626 - DNA, 20 bp, Artificial Sequence
  chemically synthesized
atagttccacatgactgggg

SEQ ID NO: 221627 - DNA, 20 bp, Artificial Sequence
  chemically synthesized
ccatgattctgaggcctccc

SEQ ID NO: 221628 - DNA, 20 bp, Artificial Sequence
  chemically synthesized
ccacatgactggggaggcct

SEQ ID NO: 221629 - DNA, 20 bp, Artificial Sequence
  chemically synthesized
cacctcccaccatgattctg

SEQ ID NO: 221630 - DNA, 20 bp, Artificial Sequence
  chemically synthesized
ctggggaggcctcagaatca

SEQ ID NO: 221631 - DNA, 20 bp, Artificial Sequence
  chemically synthesized
tcacctcccaccatgattct

SEQ ID NO: 221632 - DNA, 20 bp, Artificial Sequence
  chemically synthesized
gggaggcctcagaatcatgg

SEQ ID NO: 221633 - DNA, 20 bp, Artificial Sequence
  chemically synthesized
ggaggcctcagaatcatggt

SEQ ID NO: 221634 - DNA, 20 bp, Artificial Sequence
  chemically synthesized
aggcctcagaatcatggtgg

SEQ ID NO: 221635 - DNA, 20 bp, Artificial Sequence
  chemically synthesized
ggcctcagaatcatggtggg

SEQ ID NO: 221636 - DNA, 20 bp, Artificial Sequence
  chemically synthesized
agaatcatggtgggaggtga

SEQ ID NO: 221637 - DNA, 20 bp, Artificial Sequence
  chemically synthesized
gaatcatggtgggaggtgaa

SEQ ID NO: 221638 - DNA, 20 bp, Artificial Sequence
  chemically synthesized
ggtgaaaggcacttcttaca

SEQ ID NO: 221639 - DNA, 20 bp, Artificial Sequence
  chemically synthesized
ctcttctgcttccatgtaag

SEQ ID NO: 221640 - DNA, 20 bp, Artificial Sequence
  chemically synthesized
gaaaggcacttcttacatgg

SEQ ID NO: 221641 - DNA, 20 bp, Artificial Sequence
  chemically synthesized
tttctcttctgcttccatgt

SEQ ID NO: 221642 - DNA, 20 bp, Artificial Sequence
  chemically synthesized
aggcacttcttacatggaag

SEQ ID NO: 221643 - DNA, 20 bp, Artificial Sequence
  chemically synthesized
cacttcttacatggaagcag

SEQ ID NO: 221644 - DNA, 20 bp, Artificial Sequence
  chemically synthesized
cttcttacatggaagcagaa

SEQ ID NO: 221645 - DNA, 20 bp, Artificial Sequence
  chemically synthesized
tggaagcagaagagaaaatg

SEQ ID NO: 221646 - DNA, 20 bp, Artificial Sequence
  chemically synthesized
gaagcagaagagaaaatgtg

SEQ ID NO: 221647 - DNA, 20 bp, Artificial Sequence
  chemically synthesized
aagagaaaatgtggagacgc

SEQ ID NO: 221648 - DNA, 20 bp, Artificial Sequence
  chemically synthesized
gagaaaatgtggagacgcaa

SEQ ID NO: 221649 - DNA, 20 bp, Artificial Sequence
  chemically synthesized
aaaatgtggagacgcaagag

SEQ ID NO: 221650 - DNA, 20 bp, Artificial Sequence
  chemically synthesized
agatctgttggttttatcag

SEQ ID NO: 221651 - DNA, 20 bp, Artificial Sequence
  chemically synthesized
gagatctgttggttttatca

SEQ ID NO: 221652 - DNA, 20 bp, Artificial Sequence
  chemically synthesized
cgagatctgttggttttatc

SEQ ID NO: 221653 - DNA, 20 bp, Artificial Sequence
  chemically synthesized
acgagatctgttggttttat

SEQ ID NO: 221654 - DNA, 20 bp, Artificial Sequence
  chemically synthesized
gaaacccctgataaaaccaa

SEQ ID NO: 221655 - DNA, 20 bp, Artificial Sequence
  chemically synthesized
ataagtctcacgagatctgt

SEQ ID NO: 221656 - DNA, 20 bp, Artificial Sequence
  chemically synthesized
ataaaaccaacagatctcgt

SEQ ID NO: 221657 - DNA, 20 bp, Artificial Sequence
  chemically synthesized
tggtactgaataagtctcac

SEQ ID NO: 221658 - DNA, 20 bp, Artificial Sequence
  chemically synthesized
cagatctcgtgagacttatt

SEQ ID NO: 221659 - DNA, 20 bp, Artificial Sequence
  chemically synthesized
ctgttctcatggtactgaat

SEQ ID NO: 221660 - DNA, 20 bp, Artificial Sequence
  chemically synthesized
tgagacttattcagtaccat

SEQ ID NO: 221661 - DNA, 20 bp, Artificial Sequence
  chemically synthesized
cttattcagtaccatgagaa

SEQ ID NO: 221662 - DNA, 20 bp, Artificial Sequence
  chemically synthesized
tttcccccatactgttctca

SEQ ID NO: 221663 - DNA, 20 bp, Artificial Sequence
  chemically synthesized
tcagtaccatgagaacagta

SEQ ID NO: 221664 - DNA, 20 bp, Artificial Sequence
  chemically synthesized
cagtaccatgagaacagtat

SEQ ID NO: 221665 - DNA, 20 bp, Artificial Sequence
  chemically synthesized
agtaccatgagaacagtatg

SEQ ID NO: 221666 - DNA, 20 bp, Artificial Sequence
  chemically synthesized
gtaccatgagaacagtatgg

SEQ ID NO: 221667 - DNA, 20 bp, Artificial Sequence
  chemically synthesized
ggtcatttgaatcatggggg

SEQ ID NO: 221668 - DNA, 20 bp, Artificial Sequence
  chemically synthesized
ggaggtcatttgaatcatgg

SEQ ID NO: 221669 - DNA, 20 bp, Artificial Sequence
  chemically synthesized
gggaggtcatttgaatcatg

SEQ ID NO: 221670 - DNA, 20 bp, Artificial Sequence
  chemically synthesized
tgggaggtcatttgaatcat

SEQ ID NO: 221671 - DNA, 20 bp, Artificial Sequence
  chemically synthesized
gtgggaggtcatttgaatca

SEQ ID NO: 221672 - DNA, 20 bp, Artificial Sequence
  chemically synthesized
tgattcaaatgacctcccac

SEQ ID NO: 221673 - DNA, 20 bp, Artificial Sequence
  chemically synthesized
tgtgggagggatccagtggg

SEQ ID NO: 221674 - DNA, 20 bp, Artificial Sequence
  chemically synthesized
ttgtgggagggatccagtgg

SEQ ID NO: 221675 - DNA, 20 bp, Artificial Sequence
  chemically synthesized
tgttgtgggagggatccagt

SEQ ID NO: 221676 - DNA, 20 bp, Artificial Sequence
  chemically synthesized
ttgttgtgggagggatccag

SEQ ID NO: 221677 - DNA, 20 bp, Artificial Sequence
  chemically synthesized
tacttgttgtgggagggatc

SEQ ID NO: 221678 - DNA, 20 bp, Artificial Sequence
  chemically synthesized
aattcctacttgttgtggga

SEQ ID NO: 221679 - DNA, 20 bp, Artificial Sequence
  chemically synthesized
taattcctacttgttgtggg

SEQ ID NO: 221680 - DNA, 20 bp, Artificial Sequence
  chemically synthesized
cactggatccctcccacaac

SEQ ID NO: 221681 - DNA, 20 bp, Artificial Sequence
  chemically synthesized
ataattcctacttgttgtgg

SEQ ID NO: 221682 - DNA, 20 bp, Artificial Sequence
  chemically synthesized
ccataattcctacttgttgt

SEQ ID NO: 221683 - DNA, 20 bp, Artificial Sequence
  chemically synthesized
tggatccctcccacaacaag

SEQ ID NO: 221684 - DNA, 20 bp, Artificial Sequence
  chemically synthesized
cccataattcctacttgttg

SEQ ID NO: 221685 - DNA, 20 bp, Artificial Sequence
  chemically synthesized
ggatccctcccacaacaagt

SEQ ID NO: 221686 - DNA, 20 bp, Artificial Sequence
  chemically synthesized
cccacaacaagtaggaatta

SEQ ID NO: 221687 - DNA, 20 bp, Artificial Sequence
  chemically synthesized
ccacaacaagtaggaattat

SEQ ID NO: 221688 - DNA, 20 bp, Artificial Sequence
  chemically synthesized
acaacaagtaggaattatgg

SEQ ID NO: 221689 - DNA, 20 bp, Artificial Sequence
  chemically synthesized
acaagtaggaattatgggag

SEQ ID NO: 221690 - DNA, 20 bp, Artificial Sequence
  chemically synthesized
gaattatgggagtagaattc

SEQ ID NO: 221691 - DNA, 20 bp, Artificial Sequence
  chemically synthesized
atgggagtagaattcaagat

SEQ ID NO: 221692 - DNA, 20 bp, Artificial Sequence
  chemically synthesized
gtagaattcaagatgagatt

SEQ ID NO: 221693 - DNA, 20 bp, Artificial Sequence
  chemically synthesized
tagaattcaagatgagattt

SEQ ID NO: 221694 - DNA, 20 bp, Artificial Sequence
  chemically synthesized
aattcaagatgagatttggg

SEQ ID NO: 221695 - DNA, 20 bp, Artificial Sequence
  chemically synthesized
attcaagatgagatttgggt

SEQ ID NO: 221696 - DNA, 20 bp, Artificial Sequence
  chemically synthesized
ttcaagatgagatttgggtg

SEQ ID NO: 221697 - DNA, 20 bp, Artificial Sequence
  chemically synthesized
atgagatttgggtggggaca

SEQ ID NO: 221698 - DNA, 20 bp, Artificial Sequence
  chemically synthesized
cttcaataactgatatggtt

SEQ ID NO: 221699 - DNA, 20 bp, Artificial Sequence
  chemically synthesized
gggacacagccaaaccatat

SEQ ID NO: 221700 - DNA, 20 bp, Artificial Sequence
  chemically synthesized
ttttccttcaataactgata

SEQ ID NO: 221701 - DNA, 20 bp, Artificial Sequence
  chemically synthesized
ccaaaccatatcagttattg

SEQ ID NO: 221702 - DNA, 20 bp, Artificial Sequence
  chemically synthesized
caaaccatatcagttattga

SEQ ID NO: 221703 - DNA, 20 bp, Artificial Sequence
  chemically synthesized
atcagttattgaaggaaaaa

SEQ ID NO: 221704 - DNA, 20 bp, Artificial Sequence
  chemically synthesized
agttattgaaggaaaaatgg

SEQ ID NO: 221705 - DNA, 20 bp, Artificial Sequence
  chemically synthesized
attgaaggaaaaatggaagc

SEQ ID NO: 221706 - DNA, 20 bp, Artificial Sequence
  chemically synthesized
ttgaaggaaaaatggaagca

SEQ ID NO: 221707 - DNA, 20 bp, Artificial Sequence
  chemically synthesized
cttgtttgagcaaaatttgg

SEQ ID NO: 221708 - DNA, 20 bp, Artificial Sequence
  chemically synthesized
tgccttgtttgagcaaaatt

SEQ ID NO: 221709 - DNA, 20 bp, Artificial Sequence
  chemically synthesized
ccaccaaattttgctcaaac

SEQ ID NO: 221710 - DNA, 20 bp, Artificial Sequence
  chemically synthesized
caccaaattttgctcaaaca

SEQ ID NO: 221711 - DNA, 20 bp, Artificial Sequence
  chemically synthesized
aggttatatctgccttgttt

SEQ ID NO: 221712 - DNA, 20 bp, Artificial Sequence
  chemically synthesized
caaattttgctcaaacaagg

SEQ ID NO: 221713 - DNA, 20 bp, Artificial Sequence
  chemically synthesized
aacaaggcagatataacctg

SEQ ID NO: 221714 - DNA, 20 bp, Artificial Sequence
  chemically synthesized
gcagatataacctgcagctg

SEQ ID NO: 221715 - DNA, 20 bp, Artificial Sequence
  chemically synthesized
cctaattgttctgcagctgc

SEQ ID NO: 221716 - DNA, 20 bp, Artificial Sequence
  chemically synthesized
acctaattgttctgcagctg

SEQ ID NO: 221717 - DNA, 20 bp, Artificial Sequence
  chemically synthesized
acataaacctaattgttctg

SEQ ID NO: 221718 - DNA, 20 bp, Artificial Sequence
  chemically synthesized
acctgcagctgcagaacaat

SEQ ID NO: 221719 - DNA, 20 bp, Artificial Sequence
  chemically synthesized
cctgcagctgcagaacaatt

SEQ ID NO: 221720 - DNA, 20 bp, Artificial Sequence
  chemically synthesized
acaattaggtttatgttttt

SEQ ID NO: 221721 - DNA, 20 bp, Artificial Sequence
  chemically synthesized
attaggtttatgtttttgag

SEQ ID NO: 221722 - DNA, 20 bp, Artificial Sequence
  chemically synthesized
ttatgtttttgagaagttta

SEQ ID NO: 221723 - DNA, 20 bp, Artificial Sequence
  chemically synthesized
atttgatacattgctctgca

SEQ ID NO: 221724 - DNA, 20 bp, Artificial Sequence
  chemically synthesized
aaactcctatgtaccatgca

SEQ ID NO: 221725 - DNA, 20 bp, Artificial Sequence
  chemically synthesized
caaaactcctatgtaccatg

SEQ ID NO: 221726 - DNA, 20 bp, Artificial Sequence
  chemically synthesized
acattgctctgcatggtaca

SEQ ID NO: 221727 - DNA, 20 bp, Artificial Sequence
  chemically synthesized
cattgctctgcatggtacat

SEQ ID NO: 221728 - DNA, 20 bp, Artificial Sequence
  chemically synthesized
ttgctctgcatggtacatag

SEQ ID NO: 221729 - DNA, 20 bp, Artificial Sequence
  chemically synthesized
tgcatggtacataggagttt

SEQ ID NO: 221730 - DNA, 20 bp, Artificial Sequence
  chemically synthesized
gttttggtcacctcattgtt

SEQ ID NO: 221731 - DNA, 20 bp, Artificial Sequence
  chemically synthesized
gagtaatgggcttaacaatg

SEQ ID NO: 221732 - DNA, 20 bp, Artificial Sequence
  chemically synthesized
ggagtaatgggcttaacaat

SEQ ID NO: 221733 - DNA, 20 bp, Artificial Sequence
  chemically synthesized
gttactgcatagggagtaat

SEQ ID NO: 221734 - DNA, 20 bp, Artificial Sequence
  chemically synthesized
tgttactgcatagggagtaa

SEQ ID NO: 221735 - DNA, 20 bp, Artificial Sequence
  chemically synthesized
taagcccattactccctatg

SEQ ID NO: 221736 - DNA, 20 bp, Artificial Sequence
  chemically synthesized
attaaatgttactgcatagg

SEQ ID NO: 221737 - DNA, 20 bp, Artificial Sequence
  chemically synthesized
atattaaatgttactgcata

SEQ ID NO: 221738 - DNA, 20 bp, Artificial Sequence
  chemically synthesized
aatattaaatgttactgcat

SEQ ID NO: 221739 - DNA, 20 bp, Artificial Sequence
  chemically synthesized
aaatattaaatgttactgca

SEQ ID NO: 221740 - DNA, 20 bp, Artificial Sequence
  chemically synthesized
atttttaaatgaataaaaat

SEQ ID NO: 221741 - DNA, 20 bp, Artificial Sequence
  chemically synthesized
tttttaaatgaataaaaata

SEQ ID NO: 221742 - DNA, 20 bp, Artificial Sequence
  chemically synthesized
taaatgaataaaaataaggt

SEQ ID NO: 221743 - DNA, 20 bp, Artificial Sequence
  chemically synthesized
aaatgaataaaaataaggtc

SEQ ID NO: 221744 - DNA, 20 bp, Artificial Sequence
  chemically synthesized
aataaaaataaggtcaggtg

SEQ ID NO: 221745 - DNA, 20 bp, Artificial Sequence
  chemically synthesized
aaaaataaggtcaggtgcag

SEQ ID NO: 221746 - DNA, 20 bp, Artificial Sequence
  chemically synthesized
tcccaaagtgttgggattat

SEQ ID NO: 221747 - DNA, 20 bp, Artificial Sequence
  chemically synthesized
ctcccaaagtgttgggatta

SEQ ID NO: 221748 - DNA, 20 bp, Artificial Sequence
  chemically synthesized
cacctataatcccaacactt

SEQ ID NO: 221749 - DNA, 20 bp, Artificial Sequence
  chemically synthesized
actcagcctcccaaagtgtt

SEQ ID NO: 221750 - DNA, 20 bp, Artificial Sequence
  chemically synthesized
acctataatcccaacacttt

SEQ ID NO: 221751 - DNA, 20 bp, Artificial Sequence
  chemically synthesized
gactcagcctcccaaagtgt

SEQ ID NO: 221752 - DNA, 20 bp, Artificial Sequence
  chemically synthesized
ctataatcccaacactttgg

SEQ ID NO: 221753 - DNA, 20 bp, Artificial Sequence
  chemically synthesized
tataatcccaacactttggg

SEQ ID NO: 221754 - DNA, 20 bp, Artificial Sequence
  chemically synthesized
ccacccgactcagcctccca

SEQ ID NO: 221755 - DNA, 20 bp, Artificial Sequence
  chemically synthesized
tcccaacactttgggaggct

SEQ ID NO: 221756 - DNA, 20 bp, Artificial Sequence
  chemically synthesized
aacactttgggaggctgagt

SEQ ID NO: 221757 - DNA, 20 bp, Artificial Sequence
  chemically synthesized
acactttgggaggctgagtc

SEQ ID NO: 221758 - DNA, 20 bp, Artificial Sequence
  chemically synthesized
ctttgggaggctgagtcggg

SEQ ID NO: 221759 - DNA, 20 bp, Artificial Sequence
  chemically synthesized
ctcaagtcatccacccgact

SEQ ID NO: 221760 - DNA, 20 bp, Artificial Sequence
  chemically synthesized
ctgagtcgggtggatgactt

SEQ ID NO: 221761 - DNA, 20 bp, Artificial Sequence
  chemically synthesized
tgagtcgggtggatgacttg

SEQ ID NO: 221762 - DNA, 20 bp, Artificial Sequence
  chemically synthesized
tcgggtggatgacttgaggc

SEQ ID NO: 221763 - DNA, 20 bp, Artificial Sequence
  chemically synthesized
cgggtggatgacttgaggct

SEQ ID NO: 221764 - DNA, 20 bp, Artificial Sequence
  chemically synthesized
ggtctcgaactcctagcctc

SEQ ID NO: 221765 - DNA, 20 bp, Artificial Sequence
  chemically synthesized
ggtggatgacttgaggctag

SEQ ID NO: 221766 - DNA, 20 bp, Artificial Sequence
  chemically synthesized
tgacttgaggctaggagttc

SEQ ID NO: 221767 - DNA, 20 bp, Artificial Sequence
  chemically synthesized
ccaggctggtctcgaactcc

SEQ ID NO: 221768 - DNA, 20 bp, Artificial Sequence
  chemically synthesized
tgaggctaggagttcgagac

SEQ ID NO: 221769 - DNA, 20 bp, Artificial Sequence
  chemically synthesized
ctaggagttcgagaccagcc

SEQ ID NO: 221770 - DNA, 20 bp, Artificial Sequence
  chemically synthesized
tttcaccatgttggccaggc

SEQ ID NO: 221771 - DNA, 20 bp, Artificial Sequence
  chemically synthesized
ggggtttcaccatgttggcc

SEQ ID NO: 221772 - DNA, 20 bp, Artificial Sequence
  chemically synthesized
cgagaccagcctggccaaca

SEQ ID NO: 221773 - DNA, 20 bp, Artificial Sequence
  chemically synthesized
cggggtttcaccatgttggc

SEQ ID NO: 221774 - DNA, 20 bp, Artificial Sequence
  chemically synthesized
gagacggggtttcaccatgt

SEQ ID NO: 221775 - DNA, 20 bp, Artificial Sequence
  chemically synthesized
ttgtatttttagtagagacg

SEQ ID NO: 221776 - DNA, 20 bp, Artificial Sequence
  chemically synthesized
tttgtatttttagtagagac

SEQ ID NO: 221777 - DNA, 20 bp, Artificial Sequence
  chemically synthesized
ttttgtatttttagtagaga

SEQ ID NO: 221778 - DNA, 20 bp, Artificial Sequence
  chemically synthesized
ttttttttgtatttttagta

SEQ ID NO: 221779 - DNA, 20 bp, Artificial Sequence
  chemically synthesized
ttttttttttgtatttttag

SEQ ID NO: 221780 - DNA, 20 bp, Artificial Sequence
  chemically synthesized
gttttttttttttgtatttt

SEQ ID NO: 221781 - DNA, 20 bp, Artificial Sequence
  chemically synthesized
atacaaaaaaaaaaaacaaa

SEQ ID NO: 221782 - DNA, 20 bp, Artificial Sequence
  chemically synthesized
aaaaaaaaaaacaaatagcc

SEQ ID NO: 221783 - DNA, 20 bp, Artificial Sequence
  chemically synthesized
aaaaaacaaatagcctggcg

SEQ ID NO: 221784 - DNA, 20 bp, Artificial Sequence
  chemically synthesized
gaggcgcccacaaccacgcc

SEQ ID NO: 221785 - DNA, 20 bp, Artificial Sequence
  chemically synthesized
agaggcgcccacaaccacgc

SEQ ID NO: 221786 - DNA, 20 bp, Artificial Sequence
  chemically synthesized
caaatagcctggcgtggttg

SEQ ID NO: 221787 - DNA, 20 bp, Artificial Sequence
  chemically synthesized
aaatagcctggcgtggttgt

SEQ ID NO: 221788 - DNA, 20 bp, Artificial Sequence
  chemically synthesized
gttgtgggcgcctctaatcc

SEQ ID NO: 221789 - DNA, 20 bp, Artificial Sequence
  chemically synthesized
tcccaagcagctgggattag

SEQ ID NO: 221790 - DNA, 20 bp, Artificial Sequence
  chemically synthesized
ctcccaagcagctgggatta

SEQ ID NO: 221791 - DNA, 20 bp, Artificial Sequence
  chemically synthesized
gcctcccaagcagctgggat

SEQ ID NO: 221792 - DNA, 20 bp, Artificial Sequence
  chemically synthesized
cgcctctaatcccagctgct

SEQ ID NO: 221793 - DNA, 20 bp, Artificial Sequence
  chemically synthesized
cctcggcctcccaagcagct

SEQ ID NO: 221794 - DNA, 20 bp, Artificial Sequence
  chemically synthesized
gcctctaatcccagctgctt

SEQ ID NO: 221795 - DNA, 20 bp, Artificial Sequence
  chemically synthesized
gcctcggcctcccaagcagc

SEQ ID NO: 221796 - DNA, 20 bp, Artificial Sequence
  chemically synthesized
ctctaatcccagctgcttgg

SEQ ID NO: 221797 - DNA, 20 bp, Artificial Sequence
  chemically synthesized
tctaatcccagctgcttggg

SEQ ID NO: 221798 - DNA, 20 bp, Artificial Sequence
  chemically synthesized
ttgtgcctcggcctcccaag

SEQ ID NO: 221799 - DNA, 20 bp, Artificial Sequence
  chemically synthesized
ttcttgtgcctcggcctccc

SEQ ID NO: 221800 - DNA, 20 bp, Artificial Sequence
  chemically synthesized
tcccagctgcttgggaggcc

SEQ ID NO: 221801 - DNA, 20 bp, Artificial Sequence
  chemically synthesized
cccagctgcttgggaggccg

SEQ ID NO: 221802 - DNA, 20 bp, Artificial Sequence
  chemically synthesized
tgcttgggaggccgaggcac

SEQ ID NO: 221803 - DNA, 20 bp, Artificial Sequence
  chemically synthesized
ttcaagtgattcttgtgcct

SEQ ID NO: 221804 - DNA, 20 bp, Artificial Sequence
  chemically synthesized
gcacaagaatcacttgaacc

SEQ ID NO: 221805 - DNA, 20 bp, Artificial Sequence
  chemically synthesized
cacaagaatcacttgaaccc

SEQ ID NO: 221806 - DNA, 20 bp, Artificial Sequence
  chemically synthesized
aacctccacctcccgggttc

SEQ ID NO: 221807 - DNA, 20 bp, Artificial Sequence
  chemically synthesized
caagaatcacttgaacccgg

SEQ ID NO: 221808 - DNA, 20 bp, Artificial Sequence
  chemically synthesized
aagaatcacttgaacccggg

SEQ ID NO: 221809 - DNA, 20 bp, Artificial Sequence
  chemically synthesized
aatcacttgaacccgggagg

SEQ ID NO: 221810 - DNA, 20 bp, Artificial Sequence
  chemically synthesized
cactgcaacctccacctccc

SEQ ID NO: 221811 - DNA, 20 bp, Artificial Sequence
  chemically synthesized
tcacttgaacccgggaggtg

SEQ ID NO: 221812 - DNA, 20 bp, Artificial Sequence
  chemically synthesized
tcactgcaacctccacctcc

SEQ ID NO: 221813 - DNA, 20 bp, Artificial Sequence
  chemically synthesized
cacttgaacccgggaggtgg

SEQ ID NO: 221814 - DNA, 20 bp, Artificial Sequence
  chemically synthesized
aacccgggaggtggaggttg

SEQ ID NO: 221815 - DNA, 20 bp, Artificial Sequence
  chemically synthesized
cgggaggtggaggttgcagt

SEQ ID NO: 221816 - DNA, 20 bp, Artificial Sequence
  chemically synthesized
ggtggaggttgcagtgagcc

SEQ ID NO: 221817 - DNA, 20 bp, Artificial Sequence
  chemically synthesized
gaagtgcagtggtatgatct

SEQ ID NO: 221818 - DNA, 20 bp, Artificial Sequence
  chemically synthesized
tcacccaggctgaagtgcag

SEQ ID NO: 221819 - DNA, 20 bp, Artificial Sequence
  chemically synthesized
gagatcataccactgcactt

SEQ ID NO: 221820 - DNA, 20 bp, Artificial Sequence
  chemically synthesized
ctgtcacccaggctgaagtg

SEQ ID NO: 221821 - DNA, 20 bp, Artificial Sequence
  chemically synthesized
cataccactgcacttcagcc

SEQ ID NO: 221822 - DNA, 20 bp, Artificial Sequence
  chemically synthesized
ataccactgcacttcagcct

SEQ ID NO: 221823 - DNA, 20 bp, Artificial Sequence
  chemically synthesized
tcgctctgtcacccaggctg

SEQ ID NO: 221824 - DNA, 20 bp, Artificial Sequence
  chemically synthesized
ctgcacttcagcctgggtga

SEQ ID NO: 221825 - DNA, 20 bp, Artificial Sequence
  chemically synthesized
ggagtctcgctctgtcaccc

SEQ ID NO: 221826 - DNA, 20 bp, Artificial Sequence
  chemically synthesized
gcacttcagcctgggtgaca

SEQ ID NO: 221827 - DNA, 20 bp, Artificial Sequence
  chemically synthesized
cggagtctcgctctgtcacc

SEQ ID NO: 221828 - DNA, 20 bp, Artificial Sequence
  chemically synthesized
ttcagcctgggtgacagagc

SEQ ID NO: 221829 - DNA, 20 bp, Artificial Sequence
  chemically synthesized
tttgtttttgttttgagacg

SEQ ID NO: 221830 - DNA, 20 bp, Artificial Sequence
  chemically synthesized
tttttgtttttgttttgaga

SEQ ID NO: 221831 - DNA, 20 bp, Artificial Sequence
  chemically synthesized
tttgtttttgtttttgtttt

SEQ ID NO: 221832 - DNA, 20 bp, Artificial Sequence
  chemically synthesized
cacgttaattctcttctaaa

SEQ ID NO: 221833 - DNA, 20 bp, Artificial Sequence
  chemically synthesized
cacactgaggccatttagaa

SEQ ID NO: 221834 - DNA, 20 bp, Artificial Sequence
  chemically synthesized
agcacactgaggccatttag

SEQ ID NO: 221835 - DNA, 20 bp, Artificial Sequence
  chemically synthesized
gagagcacactgaggccatt

SEQ ID NO: 221836 - DNA, 20 bp, Artificial Sequence
  chemically synthesized
aattctcttctaaatggcct

SEQ ID NO: 221837 - DNA, 20 bp, Artificial Sequence
  chemically synthesized
tgagtaaagagagcacactg

SEQ ID NO: 221838 - DNA, 20 bp, Artificial Sequence
  chemically synthesized
ttgagtaaagagagcacact

SEQ ID NO: 221839 - DNA, 20 bp, Artificial Sequence
  chemically synthesized
taattgccattgagtaaaga

SEQ ID NO: 221840 - DNA, 20 bp, Artificial Sequence
  chemically synthesized
actaattgccattgagtaaa

SEQ ID NO: 221841 - DNA, 20 bp, Artificial Sequence
  chemically synthesized
agtgtgctctctttactcaa

SEQ ID NO: 221842 - DNA, 20 bp, Artificial Sequence
  chemically synthesized
atactaattgccattgagta

SEQ ID NO: 221843 - DNA, 20 bp, Artificial Sequence
  chemically synthesized
tgtgcatactaattgccatt

SEQ ID NO: 221844 - DNA, 20 bp, Artificial Sequence
  chemically synthesized
tctctttactcaatggcaat

SEQ ID NO: 221845 - DNA, 20 bp, Artificial Sequence
  chemically synthesized
gaataaaaattgcaggtttg

SEQ ID NO: 221846 - DNA, 20 bp, Artificial Sequence
  chemically synthesized
agaataaaaattgcaggttt

SEQ ID NO: 221847 - DNA, 20 bp, Artificial Sequence
  chemically synthesized
gagaataaaaattgcaggtt

SEQ ID NO: 221848 - DNA, 20 bp, Artificial Sequence
  chemically synthesized
caaaggagaataaaaattgc

SEQ ID NO: 221849 - DNA, 20 bp, Artificial Sequence
  chemically synthesized
gcaaaggagaataaaaattg

SEQ ID NO: 221850 - DNA, 20 bp, Artificial Sequence
  chemically synthesized
aggaggcacagagagcaaag

SEQ ID NO: 221851 - DNA, 20 bp, Artificial Sequence
  chemically synthesized
ttaggaggcacagagagcaa

SEQ ID NO: 221852 - DNA, 20 bp, Artificial Sequence
  chemically synthesized
tttaggaggcacagagagca

SEQ ID NO: 221853 - DNA, 20 bp, Artificial Sequence
  chemically synthesized
gatgttttaggaggcacaga

SEQ ID NO: 221854 - DNA, 20 bp, Artificial Sequence
  chemically synthesized
aagatgttttaggaggcaca

SEQ ID NO: 221855 - DNA, 20 bp, Artificial Sequence
  chemically synthesized
ataagatgttttaggaggca

SEQ ID NO: 221856 - DNA, 20 bp, Artificial Sequence
  chemically synthesized
taggaataagatgttttagg

SEQ ID NO: 221857 - DNA, 20 bp, Artificial Sequence
  chemically synthesized
ataggaataagatgttttag

SEQ ID NO: 221858 - DNA, 20 bp, Artificial Sequence
  chemically synthesized
aaataggaataagatgtttt

SEQ ID NO: 221859 - DNA, 20 bp, Artificial Sequence
  chemically synthesized
aaaataggaataagatgttt

SEQ ID NO: 221860 - DNA, 20 bp, Artificial Sequence
  chemically synthesized
agttctttaaaaataggaat

SEQ ID NO: 221861 - DNA, 20 bp, Artificial Sequence
  chemically synthesized
acatcttattcctattttta

SEQ ID NO: 221862 - DNA, 20 bp, Artificial Sequence
  chemically synthesized
aaaaatagttctttaaaaat

SEQ ID NO: 221863 - DNA, 20 bp, Artificial Sequence
  chemically synthesized
taaaaatagttctttaaaaa

SEQ ID NO: 221864 - DNA, 20 bp, Artificial Sequence
  chemically synthesized
tataaataaaattttaaaaa

SEQ ID NO: 221865 - DNA, 20 bp, Artificial Sequence
  chemically synthesized
atttttaaaattttatttat

SEQ ID NO: 221866 - DNA, 20 bp, Artificial Sequence
  chemically synthesized
tttatttataagaaaaaatc

SEQ ID NO: 221867 - DNA, 20 bp, Artificial Sequence
  chemically synthesized
ctctatattatattgaattc

SEQ ID NO: 221868 - DNA, 20 bp, Artificial Sequence
  chemically synthesized
atccagaattcaatataata

SEQ ID NO: 221869 - DNA, 20 bp, Artificial Sequence
  chemically synthesized
ccagaattcaatataatata

SEQ ID NO: 221870 - DNA, 20 bp, Artificial Sequence
  chemically synthesized
cacacacacacgatcttgca

SEQ ID NO: 221871 - DNA, 20 bp, Artificial Sequence
  chemically synthesized
tattatttgagaaaccatgc

SEQ ID NO: 221872 - DNA, 20 bp, Artificial Sequence
  chemically synthesized
ttgcatggtttctcaaataa

SEQ ID NO: 221873 - DNA, 20 bp, Artificial Sequence
  chemically synthesized
tacatgagtgtctattattt

SEQ ID NO: 221874 - DNA, 20 bp, Artificial Sequence
  chemically synthesized
tcaaataatagacactcatg

SEQ ID NO: 221875 - DNA, 20 bp, Artificial Sequence
  chemically synthesized
ataatagacactcatgtaga

SEQ ID NO: 221876 - DNA, 20 bp, Artificial Sequence
  chemically synthesized
aaaattaaggctttctacat

SEQ ID NO: 221877 - DNA, 20 bp, Artificial Sequence
  chemically synthesized
taatttttaaattaaaatta

SEQ ID NO: 221878 - DNA, 20 bp, Artificial Sequence
  chemically synthesized
ttaatttttaaattaaaatt

SEQ ID NO: 221879 - DNA, 20 bp, Artificial Sequence
  chemically synthesized
taatttaaaaattaacactc

SEQ ID NO: 221880 - DNA, 20 bp, Artificial Sequence
  chemically synthesized
tttaaaaattaacactctgg

SEQ ID NO: 221881 - DNA, 20 bp, Artificial Sequence
  chemically synthesized
catttcttgtgtaacttcca

SEQ ID NO: 221882 - DNA, 20 bp, Artificial Sequence
  chemically synthesized
atcatttcttgtgtaacttc

SEQ ID NO: 221883 - DNA, 20 bp, Artificial Sequence
  chemically synthesized
taacactctggaagttacac

SEQ ID NO: 221884 - DNA, 20 bp, Artificial Sequence
  chemically synthesized
ggaagttacacaagaaatga

SEQ ID NO: 221885 - DNA, 20 bp, Artificial Sequence
  chemically synthesized
gaagttacacaagaaatgat

SEQ ID NO: 221886 - DNA, 20 bp, Artificial Sequence
  chemically synthesized
acacaagaaatgatgggcct

SEQ ID NO: 221887 - DNA, 20 bp, Artificial Sequence
  chemically synthesized
cacaagaaatgatgggcctt

SEQ ID NO: 221888 - DNA, 20 bp, Artificial Sequence
  chemically synthesized
acaagaaatgatgggccttg

SEQ ID NO: 221889 - DNA, 20 bp, Artificial Sequence
  chemically synthesized
cattttcacaaaaggcccca

SEQ ID NO: 221890 - DNA, 20 bp, Artificial Sequence
  chemically synthesized
ccattttcacaaaaggcccc

SEQ ID NO: 221891 - DNA, 20 bp, Artificial Sequence
  chemically synthesized
tatcttgccattttcacaaa

SEQ ID NO: 221892 - DNA, 20 bp, Artificial Sequence
  chemically synthesized
ttatcttgccattttcacaa

SEQ ID NO: 221893 - DNA, 20 bp, Artificial Sequence
  chemically synthesized
cttggggccttttgtgaaaa

SEQ ID NO: 221894 - DNA, 20 bp, Artificial Sequence
  chemically synthesized
gggccttttgtgaaaatggc

SEQ ID NO: 221895 - DNA, 20 bp, Artificial Sequence
  chemically synthesized
tgtgaaaatggcaagataac

SEQ ID NO: 221896 - DNA, 20 bp, Artificial Sequence
  chemically synthesized
gtgaaaatggcaagataaca

SEQ ID NO: 221897 - DNA, 20 bp, Artificial Sequence
  chemically synthesized
aaaatggcaagataacaagg

SEQ ID NO: 221898 - DNA, 20 bp, Artificial Sequence
  chemically synthesized
aaatggcaagataacaaggc

SEQ ID NO: 221899 - DNA, 20 bp, Artificial Sequence
  chemically synthesized
gcaagataacaaggcaggac

SEQ ID NO: 221900 - DNA, 20 bp, Artificial Sequence
  chemically synthesized
aagataacaaggcaggacaa

SEQ ID NO: 221901 - DNA, 20 bp, Artificial Sequence
  chemically synthesized
gataacaaggcaggacaaga

SEQ ID NO: 221902 - DNA, 20 bp, Artificial Sequence
  chemically synthesized
acaaggcaggacaagagaga

SEQ ID NO: 221903 - DNA, 20 bp, Artificial Sequence
  chemically synthesized
aaggcaggacaagagagatg

SEQ ID NO: 221904 - DNA, 20 bp, Artificial Sequence
  chemically synthesized
gacaagagagatggagataa

SEQ ID NO: 221905 - DNA, 20 bp, Artificial Sequence
  chemically synthesized
cagacacaatgaatatgtat

SEQ ID NO: 221906 - DNA, 20 bp, Artificial Sequence
  chemically synthesized
caatgtctatttgtagaaaa

SEQ ID NO: 221907 - DNA, 20 bp, Artificial Sequence
  chemically synthesized
ttcattcttttttctacaaa

SEQ ID NO: 221908 - DNA, 20 bp, Artificial Sequence
  chemically synthesized
gagccctcaatgtctatttg

SEQ ID NO: 221909 - DNA, 20 bp, Artificial Sequence
  chemically synthesized
tttttctacaaatagacatt

SEQ ID NO: 221910 - DNA, 20 bp, Artificial Sequence
  chemically synthesized
ttttctacaaatagacattg

SEQ ID NO: 221911 - DNA, 20 bp, Artificial Sequence
  chemically synthesized
tttctacaaatagacattga

SEQ ID NO: 221912 - DNA, 20 bp, Artificial Sequence
  chemically synthesized
agcagcgcaagggatatagt

SEQ ID NO: 221913 - DNA, 20 bp, Artificial Sequence
  chemically synthesized
gtgtagcagcgcaagggata

SEQ ID NO: 221914 - DNA, 20 bp, Artificial Sequence
  chemically synthesized
ccccgtgtgtagcagcgcaa

SEQ ID NO: 221915 - DNA, 20 bp, Artificial Sequence
  chemically synthesized
cccccgtgtgtagcagcgca

SEQ ID NO: 221916 - DNA, 20 bp, Artificial Sequence
  chemically synthesized
tcccccgtgtgtagcagcgc

SEQ ID NO: 221917 - DNA, 20 bp, Artificial Sequence
  chemically synthesized
atcccttgcgctgctacaca

SEQ ID NO: 221918 - DNA, 20 bp, Artificial Sequence
  chemically synthesized
agcatatcccccgtgtgtag

SEQ ID NO: 221919 - DNA, 20 bp, Artificial Sequence
  chemically synthesized
tcccttgcgctgctacacac

SEQ ID NO: 221920 - DNA, 20 bp, Artificial Sequence
  chemically synthesized
cccttgcgctgctacacacg

SEQ ID NO: 221921 - DNA, 20 bp, Artificial Sequence
  chemically synthesized
ccttgcgctgctacacacgg

SEQ ID NO: 221922 - DNA, 20 bp, Artificial Sequence
  chemically synthesized
atcagcatatcccccgtgtg

SEQ ID NO: 221923 - DNA, 20 bp, Artificial Sequence
  chemically synthesized
tatgttgccagtgtttgcat

SEQ ID NO: 221924 - DNA, 20 bp, Artificial Sequence
  chemically synthesized
ggatatgctgatgcaaacac

SEQ ID NO: 221925 - DNA, 20 bp, Artificial Sequence
  chemically synthesized
catgaaggaaggtatgttgc

SEQ ID NO: 221926 - DNA, 20 bp, Artificial Sequence
  chemically synthesized
tggcaacataccttccttca

SEQ ID NO: 221927 - DNA, 20 bp, Artificial Sequence
  chemically synthesized
gatgtaagcaccatgaagga

SEQ ID NO: 221928 - DNA, 20 bp, Artificial Sequence
  chemically synthesized
tgatgtaagcaccatgaagg

SEQ ID NO: 221929 - DNA, 20 bp, Artificial Sequence
  chemically synthesized
ttatgatgtaagcaccatga

SEQ ID NO: 221930 - DNA, 20 bp, Artificial Sequence
  chemically synthesized
attatgatgtaagcaccatg

SEQ ID NO: 221931 - DNA, 20 bp, Artificial Sequence
  chemically synthesized
tgagtctgcaattatgatgt

SEQ ID NO: 221932 - DNA, 20 bp, Artificial Sequence
  chemically synthesized
tggtgcttacatcataattg

SEQ ID NO: 221933 - DNA, 20 bp, Artificial Sequence
  chemically synthesized
ttacatcataattgcagact

SEQ ID NO: 221934 - DNA, 20 bp, Artificial Sequence
  chemically synthesized
ttcctgccttgtttttgtct

SEQ ID NO: 221935 - DNA, 20 bp, Artificial Sequence
  chemically synthesized
ttgcagactcagacaaaaac

SEQ ID NO: 221936 - DNA, 20 bp, Artificial Sequence
  chemically synthesized
tgcagactcagacaaaaaca

SEQ ID NO: 221937 - DNA, 20 bp, Artificial Sequence
  chemically synthesized
agactcagacaaaaacaagg

SEQ ID NO: 221938 - DNA, 20 bp, Artificial Sequence
  chemically synthesized
gactcagacaaaaacaaggc

SEQ ID NO: 221939 - DNA, 20 bp, Artificial Sequence
  chemically synthesized
gacaaaaacaaggcaggaaa

SEQ ID NO: 221940 - DNA, 20 bp, Artificial Sequence
  chemically synthesized
acaaggcaggaaacagaaac

SEQ ID NO: 221941 - DNA, 20 bp, Artificial Sequence
  chemically synthesized
caaggcaggaaacagaaaca

SEQ ID NO: 221942 - DNA, 20 bp, Artificial Sequence
  chemically synthesized
aggcaggaaacagaaacaag

SEQ ID NO: 221943 - DNA, 20 bp, Artificial Sequence
  chemically synthesized
ggaaacagaaacaaggagct

SEQ ID NO: 221944 - DNA, 20 bp, Artificial Sequence
  chemically synthesized
agaaacaaggagctgagcta

SEQ ID NO: 221945 - DNA, 20 bp, Artificial Sequence
  chemically synthesized
tctaacattattctatagct

SEQ ID NO: 221946 - DNA, 20 bp, Artificial Sequence
  chemically synthesized
catcctctaacattattcta

SEQ ID NO: 221947 - DNA, 20 bp, Artificial Sequence
  chemically synthesized
gctgagctatagaataatgt

SEQ ID NO: 221948 - DNA, 20 bp, Artificial Sequence
  chemically synthesized
tgagctatagaataatgtta

SEQ ID NO: 221949 - DNA, 20 bp, Artificial Sequence
  chemically synthesized
gagctatagaataatgttag

SEQ ID NO: 221950 - DNA, 20 bp, Artificial Sequence
  chemically synthesized
tatagaataatgttagagga

SEQ ID NO: 221951 - DNA, 20 bp, Artificial Sequence
  chemically synthesized
ataatgttagaggatggtgc

SEQ ID NO: 221952 - DNA, 20 bp, Artificial Sequence
  chemically synthesized
taatgttagaggatggtgca

SEQ ID NO: 221953 - DNA, 20 bp, Artificial Sequence
  chemically synthesized
aatgttagaggatggtgcaa

SEQ ID NO: 221954 - DNA, 20 bp, Artificial Sequence
  chemically synthesized
atgttagaggatggtgcaag

SEQ ID NO: 221955 - DNA, 20 bp, Artificial Sequence
  chemically synthesized
tgttagaggatggtgcaagg

SEQ ID NO: 221956 - DNA, 20 bp, Artificial Sequence
  chemically synthesized
gttagaggatggtgcaaggg

SEQ ID NO: 221957 - DNA, 20 bp, Artificial Sequence
  chemically synthesized
agaggatggtgcaagggggg

SEQ ID NO: 221958 - DNA, 20 bp, Artificial Sequence
  chemically synthesized
gatggtgcaaggggggtaga

SEQ ID NO: 221959 - DNA, 20 bp, Artificial Sequence
  chemically synthesized
ggggggtagacagccctctc

SEQ ID NO: 221960 - DNA, 20 bp, Artificial Sequence
  chemically synthesized
gggggtagacagccctctcc

SEQ ID NO: 221961 - DNA, 20 bp, Artificial Sequence
  chemically synthesized
tccaaggagagtcctggaga

SEQ ID NO: 221962 - DNA, 20 bp, Artificial Sequence
  chemically synthesized
ctccaaggagagtcctggag

SEQ ID NO: 221963 - DNA, 20 bp, Artificial Sequence
  chemically synthesized
tctccaaggagagtcctgga

SEQ ID NO: 221964 - DNA, 20 bp, Artificial Sequence
  chemically synthesized
cctctccaaggagagtcctg

SEQ ID NO: 221965 - DNA, 20 bp, Artificial Sequence
  chemically synthesized
atcctctccaaggagagtcc

SEQ ID NO: 221966 - DNA, 20 bp, Artificial Sequence
  chemically synthesized
gccctctccaggactctcct

SEQ ID NO: 221967 - DNA, 20 bp, Artificial Sequence
  chemically synthesized
cctctccaggactctccttg

SEQ ID NO: 221968 - DNA, 20 bp, Artificial Sequence
  chemically synthesized
taggtaatcctctccaagga

SEQ ID NO: 221969 - DNA, 20 bp, Artificial Sequence
  chemically synthesized
tctccaggactctccttgga

SEQ ID NO: 221970 - DNA, 20 bp, Artificial Sequence
  chemically synthesized
ctccaggactctccttggag

SEQ ID NO: 221971 - DNA, 20 bp, Artificial Sequence
  chemically synthesized
ggtaggtaatcctctccaag

SEQ ID NO: 221972 - DNA, 20 bp, Artificial Sequence
  chemically synthesized
tgggtaggtaatcctctcca

SEQ ID NO: 221973 - DNA, 20 bp, Artificial Sequence
  chemically synthesized
ttgggtaggtaatcctctcc

SEQ ID NO: 221974 - DNA, 20 bp, Artificial Sequence
  chemically synthesized
tggagaggattacctaccca

SEQ ID NO: 221975 - DNA, 20 bp, Artificial Sequence
  chemically synthesized
atagcctcagggctttgggt

SEQ ID NO: 221976 - DNA, 20 bp, Artificial Sequence
  chemically synthesized
tatagcctcagggctttggg

SEQ ID NO: 221977 - DNA, 20 bp, Artificial Sequence
  chemically synthesized
ctatatagcctcagggcttt

SEQ ID NO: 221978 - DNA, 20 bp, Artificial Sequence
  chemically synthesized
gattacctacccaaagccct

SEQ ID NO: 221979 - DNA, 20 bp, Artificial Sequence
  chemically synthesized
tctatatagcctcagggctt

SEQ ID NO: 221980 - DNA, 20 bp, Artificial Sequence
  chemically synthesized
attacctacccaaagccctg

SEQ ID NO: 221981 - DNA, 20 bp, Artificial Sequence
  chemically synthesized
gtgtcttctatatagcctca

SEQ ID NO: 221982 - DNA, 20 bp, Artificial Sequence
  chemically synthesized
cgtgtcttctatatagcctc

SEQ ID NO: 221983 - DNA, 20 bp, Artificial Sequence
  chemically synthesized
tcgtgtcttctatatagcct

SEQ ID NO: 221984 - DNA, 20 bp, Artificial Sequence
  chemically synthesized
cccaaagccctgaggctata

SEQ ID NO: 221985 - DNA, 20 bp, Artificial Sequence
  chemically synthesized
aaagccctgaggctatatag

SEQ ID NO: 221986 - DNA, 20 bp, Artificial Sequence
  chemically synthesized
ctgcaatcgtgtcttctata

SEQ ID NO: 221987 - DNA, 20 bp, Artificial Sequence
  chemically synthesized
ctatatagaagacacgattg

SEQ ID NO: 221988 - DNA, 20 bp, Artificial Sequence
  chemically synthesized
atatagaagacacgattgca

SEQ ID NO: 221989 - DNA, 20 bp, Artificial Sequence
  chemically synthesized
tatagaagacacgattgcag

SEQ ID NO: 221990 - DNA, 20 bp, Artificial Sequence
  chemically synthesized
tagaagacacgattgcagag

SEQ ID NO: 221991 - DNA, 20 bp, Artificial Sequence
  chemically synthesized
agaagacacgattgcagagg

SEQ ID NO: 221992 - DNA, 20 bp, Artificial Sequence
  chemically synthesized
gcagaggaggatgtctactc

SEQ ID NO: 221993 - DNA, 20 bp, Artificial Sequence
  chemically synthesized
agaggaggatgtctactcca

SEQ ID NO: 221994 - DNA, 20 bp, Artificial Sequence
  chemically synthesized
aggaggatgtctactccaga

SEQ ID NO: 221995 - DNA, 20 bp, Artificial Sequence
  chemically synthesized
tgcagagtgtctctctggag

SEQ ID NO: 221996 - DNA, 20 bp, Artificial Sequence
  chemically synthesized
atttgcagagtgtctctctg

SEQ ID NO: 221997 - DNA, 20 bp, Artificial Sequence
  chemically synthesized
caatttgcagagtgtctctc

SEQ ID NO: 221998 - DNA, 20 bp, Artificial Sequence
  chemically synthesized
aagttttaatacaatttgca

SEQ ID NO: 221999 - DNA, 20 bp, Artificial Sequence
  chemically synthesized
ggaagttttaatacaatttg

SEQ ID NO: 222000 - DNA, 20 bp, Artificial Sequence
  chemically synthesized
caaatcccccttgatgtggg

SEQ ID NO: 222001 - DNA, 20 bp, Artificial Sequence
  chemically synthesized
gtattaaaacttcccacatc

SEQ ID NO: 222002 - DNA, 20 bp, Artificial Sequence
  chemically synthesized
tattaaaacttcccacatca

SEQ ID NO: 222003 - DNA, 20 bp, Artificial Sequence
  chemically synthesized
attaaaacttcccacatcaa

SEQ ID NO: 222004 - DNA, 20 bp, Artificial Sequence
  chemically synthesized
cagcaaatcccccttgatgt

SEQ ID NO: 222005 - DNA, 20 bp, Artificial Sequence
  chemically synthesized
ttaaaacttcccacatcaag

SEQ ID NO: 222006 - DNA, 20 bp, Artificial Sequence
  chemically synthesized
tcagcaaatcccccttgatg

SEQ ID NO: 222007 - DNA, 20 bp, Artificial Sequence
  chemically synthesized
taaaacttcccacatcaagg

SEQ ID NO: 222008 - DNA, 20 bp, Artificial Sequence
  chemically synthesized
tattcaaacaaaaggagagt

SEQ ID NO: 222009 - DNA, 20 bp, Artificial Sequence
  chemically synthesized
acaatattcaaacaaaagga

SEQ ID NO: 222010 - DNA, 20 bp, Artificial Sequence
  chemically synthesized
tgacaatattcaaacaaaag

SEQ ID NO: 222011 - DNA, 20 bp, Artificial Sequence
  chemically synthesized
tctgacaatattcaaacaaa

SEQ ID NO: 222012 - DNA, 20 bp, Artificial Sequence
  chemically synthesized
ttctgacaatattcaaacaa

SEQ ID NO: 222013 - DNA, 20 bp, Artificial Sequence
  chemically synthesized
tccttttgtttgaatattgt

SEQ ID NO: 222014 - DNA, 20 bp, Artificial Sequence
  chemically synthesized
ttttgtttgaatattgtcag

SEQ ID NO: 222015 - DNA, 20 bp, Artificial Sequence
  chemically synthesized
aatattgtcagaagactaca

SEQ ID NO: 222016 - DNA, 20 bp, Artificial Sequence
  chemically synthesized
atattgtcagaagactacat

SEQ ID NO: 222017 - DNA, 20 bp, Artificial Sequence
  chemically synthesized
aggatggaccatttcctatg

SEQ ID NO: 222018 - DNA, 20 bp, Artificial Sequence
  chemically synthesized
tcagaagactacataggaaa

SEQ ID NO: 222019 - DNA, 20 bp, Artificial Sequence
  chemically synthesized
taaaggttggtgaggaagga

SEQ ID NO: 222020 - DNA, 20 bp, Artificial Sequence
  chemically synthesized
gccgtaaaggttggtgagga

SEQ ID NO: 222021 - DNA, 20 bp, Artificial Sequence
  chemically synthesized
ggccgtaaaggttggtgagg

SEQ ID NO: 222022 - DNA, 20 bp, Artificial Sequence
  chemically synthesized
aagggccgtaaaggttggtg

SEQ ID NO: 222023 - DNA, 20 bp, Artificial Sequence
  chemically synthesized
gaagggccgtaaaggttggt

SEQ ID NO: 222024 - DNA, 20 bp, Artificial Sequence
  chemically synthesized
tccttcctcaccaaccttta

SEQ ID NO: 222025 - DNA, 20 bp, Artificial Sequence
  chemically synthesized
gatggaagggccgtaaaggt

SEQ ID NO: 222026 - DNA, 20 bp, Artificial Sequence
  chemically synthesized
agaggatggaagggccgtaa

SEQ ID NO: 222027 - DNA, 20 bp, Artificial Sequence
  chemically synthesized
cagaggatggaagggccgta

SEQ ID NO: 222028 - DNA, 20 bp, Artificial Sequence
  chemically synthesized
ctttttctcagaggatggaa

SEQ ID NO: 222029 - DNA, 20 bp, Artificial Sequence
  chemically synthesized
tctttttctcagaggatgga

SEQ ID NO: 222030 - DNA, 20 bp, Artificial Sequence
  chemically synthesized
ctctttttctcagaggatgg

SEQ ID NO: 222031 - DNA, 20 bp, Artificial Sequence
  chemically synthesized
ttacggcccttccatcctct

SEQ ID NO: 222032 - DNA, 20 bp, Artificial Sequence
  chemically synthesized
cctctctttttctcagagga

SEQ ID NO: 222033 - DNA, 20 bp, Artificial Sequence
  chemically synthesized
aaaacctctctttttctcag

SEQ ID NO: 222034 - DNA, 20 bp, Artificial Sequence
  chemically synthesized
cccttccatcctctgagaaa

SEQ ID NO: 222035 - DNA, 20 bp, Artificial Sequence
  chemically synthesized
caaaacctctctttttctca

SEQ ID NO: 222036 - DNA, 20 bp, Artificial Sequence
  chemically synthesized
cttccatcctctgagaaaaa

SEQ ID NO: 222037 - DNA, 20 bp, Artificial Sequence
  chemically synthesized
gtcaaaacctctctttttct

SEQ ID NO: 222038 - DNA, 20 bp, Artificial Sequence
  chemically synthesized
tccatcctctgagaaaaaga

SEQ ID NO: 222039 - DNA, 20 bp, Artificial Sequence
  chemically synthesized
ccatcctctgagaaaaagag

SEQ ID NO: 222040 - DNA, 20 bp, Artificial Sequence
  chemically synthesized
gaaaaagagaggttttgaca

SEQ ID NO: 222041 - DNA, 20 bp, Artificial Sequence
  chemically synthesized
aaaaagagaggttttgacaa

SEQ ID NO: 222042 - DNA, 20 bp, Artificial Sequence
  chemically synthesized
aaaagagaggttttgacaaa

SEQ ID NO: 222043 - DNA, 20 bp, Artificial Sequence
  chemically synthesized
ggttttgacaaagggcttta

SEQ ID NO: 222044 - DNA, 20 bp, Artificial Sequence
  chemically synthesized
agtaaaacaatgaaacttta

SEQ ID NO: 222045 - DNA, 20 bp, Artificial Sequence
  chemically synthesized
caaggggactcagcaagtgc

SEQ ID NO: 222046 - DNA, 20 bp, Artificial Sequence
  chemically synthesized
ttgttttacttgcacttgct

SEQ ID NO: 222047 - DNA, 20 bp, Artificial Sequence
  chemically synthesized
aatccccaaggggactcagc

SEQ ID NO: 222048 - DNA, 20 bp, Artificial Sequence
  chemically synthesized
ataaaatccccaaggggact

SEQ ID NO: 222049 - DNA, 20 bp, Artificial Sequence
  chemically synthesized
ttgcacttgctgagtcccct

SEQ ID NO: 222050 - DNA, 20 bp, Artificial Sequence
  chemically synthesized
tgcacttgctgagtcccctt

SEQ ID NO: 222051 - DNA, 20 bp, Artificial Sequence
  chemically synthesized
gcacttgctgagtccccttg

SEQ ID NO: 222052 - DNA, 20 bp, Artificial Sequence
  chemically synthesized
gtgtagataaaatccccaag

SEQ ID NO: 222053 - DNA, 20 bp, Artificial Sequence
  chemically synthesized
agtgtagataaaatccccaa

SEQ ID NO: 222054 - DNA, 20 bp, Artificial Sequence
  chemically synthesized
tagtgtagataaaatcccca

SEQ ID NO: 222055 - DNA, 20 bp, Artificial Sequence
  chemically synthesized
atagtgtagataaaatcccc

SEQ ID NO: 222056 - DNA, 20 bp, Artificial Sequence
  chemically synthesized
tttctgtgagatggatagtg

SEQ ID NO: 222057 - DNA, 20 bp, Artificial Sequence
  chemically synthesized
cgacttttctgtgagatgga

SEQ ID NO: 222058 - DNA, 20 bp, Artificial Sequence
  chemically synthesized
tatctacactatccatctca

SEQ ID NO: 222059 - DNA, 20 bp, Artificial Sequence
  chemically synthesized
ctctcgacttttctgtgaga

SEQ ID NO: 222060 - DNA, 20 bp, Artificial Sequence
  chemically synthesized
acactatccatctcacagaa

SEQ ID NO: 222061 - DNA, 20 bp, Artificial Sequence
  chemically synthesized
aatgctctcgacttttctgt

SEQ ID NO: 222062 - DNA, 20 bp, Artificial Sequence
  chemically synthesized
atccatctcacagaaaagtc

SEQ ID NO: 222063 - DNA, 20 bp, Artificial Sequence
  chemically synthesized
ccatctcacagaaaagtcga

SEQ ID NO: 222064 - DNA, 20 bp, Artificial Sequence
  chemically synthesized
acagaaaagtcgagagcatt

SEQ ID NO: 222065 - DNA, 20 bp, Artificial Sequence
  chemically synthesized
aaagtcgagagcattaagca

SEQ ID NO: 222066 - DNA, 20 bp, Artificial Sequence
  chemically synthesized
gagagcattaagcaaagtaa

SEQ ID NO: 222067 - DNA, 20 bp, Artificial Sequence
  chemically synthesized
cattaagcaaagtaacggtt

SEQ ID NO: 222068 - DNA, 20 bp, Artificial Sequence
  chemically synthesized
aatgaagaagggatgatatt

SEQ ID NO: 222069 - DNA, 20 bp, Artificial Sequence
  chemically synthesized
tgtcctgtgttaatgaagaa

SEQ ID NO: 222070 - DNA, 20 bp, Artificial Sequence
  chemically synthesized
atgtcctgtgttaatgaaga

SEQ ID NO: 222071 - DNA, 20 bp, Artificial Sequence
  chemically synthesized
aatgtcctgtgttaatgaag

SEQ ID NO: 222072 - DNA, 20 bp, Artificial Sequence
  chemically synthesized
tataatgtcctgtgttaatg

SEQ ID NO: 222073 - DNA, 20 bp, Artificial Sequence
  chemically synthesized
tcatcccttcttcattaaca

SEQ ID NO: 222074 - DNA, 20 bp, Artificial Sequence
  chemically synthesized
catcccttcttcattaacac

SEQ ID NO: 222075 - DNA, 20 bp, Artificial Sequence
  chemically synthesized
taattttaaaacatctgact

SEQ ID NO: 222076 - DNA, 20 bp, Artificial Sequence
  chemically synthesized
catattatcatggacttagt

SEQ ID NO: 222077 - DNA, 20 bp, Artificial Sequence
  chemically synthesized
gttccatattatcatggact

SEQ ID NO: 222078 - DNA, 20 bp, Artificial Sequence
  chemically synthesized
ggaatggttccatattatca

SEQ ID NO: 222079 - DNA, 20 bp, Artificial Sequence
  chemically synthesized
tgactaagtccatgataata

SEQ ID NO: 222080 - DNA, 20 bp, Artificial Sequence
  chemically synthesized
tgtgcagagaaggataggaa

SEQ ID NO: 222081 - DNA, 20 bp, Artificial Sequence
  chemically synthesized
tcctttgtgcagagaaggat

SEQ ID NO: 222082 - DNA, 20 bp, Artificial Sequence
  chemically synthesized
ctcctttgtgcagagaagga

SEQ ID NO: 222083 - DNA, 20 bp, Artificial Sequence
  chemically synthesized
tctcctcctttgtgcagaga

SEQ ID NO: 222084 - DNA, 20 bp, Artificial Sequence
  chemically synthesized
ttctcctcctttgtgcagag

SEQ ID NO: 222085 - DNA, 20 bp, Artificial Sequence
  chemically synthesized
ttcctatccttctctgcaca

SEQ ID NO: 222086 - DNA, 20 bp, Artificial Sequence
  chemically synthesized
tcctatccttctctgcacaa

SEQ ID NO: 222087 - DNA, 20 bp, Artificial Sequence
  chemically synthesized
tatttctcctcctttgtgca

SEQ ID NO: 222088 - DNA, 20 bp, Artificial Sequence
  chemically synthesized
ctatccttctctgcacaaag

SEQ ID NO: 222089 - DNA, 20 bp, Artificial Sequence
  chemically synthesized
gatatttctcctcctttgtg

SEQ ID NO: 222090 - DNA, 20 bp, Artificial Sequence
  chemically synthesized
tatccttctctgcacaaagg

SEQ ID NO: 222091 - DNA, 20 bp, Artificial Sequence
  chemically synthesized
tccttctctgcacaaaggag

SEQ ID NO: 222092 - DNA, 20 bp, Artificial Sequence
  chemically synthesized
aaggaggagaaatatctgta

SEQ ID NO: 222093 - DNA, 20 bp, Artificial Sequence
  chemically synthesized
aactaagttcaaagactgta

SEQ ID NO: 222094 - DNA, 20 bp, Artificial Sequence
  chemically synthesized
atctgtacagtctttgaact

SEQ ID NO: 222095 - DNA, 20 bp, Artificial Sequence
  chemically synthesized
cccatatctaactaagttca

SEQ ID NO: 222096 - DNA, 20 bp, Artificial Sequence
  chemically synthesized
gtacagtctttgaacttagt

SEQ ID NO: 222097 - DNA, 20 bp, Artificial Sequence
  chemically synthesized
attcagacccatatctaact

SEQ ID NO: 222098 - DNA, 20 bp, Artificial Sequence
  chemically synthesized
tctttgaacttagttagata

SEQ ID NO: 222099 - DNA, 20 bp, Artificial Sequence
  chemically synthesized
ctttgaacttagttagatat

SEQ ID NO: 222100 - DNA, 20 bp, Artificial Sequence
  chemically synthesized
ttagatatgggtctgaattt

SEQ ID NO: 222101 - DNA, 20 bp, Artificial Sequence
  chemically synthesized
ggagtaaaatatctgaaatt

SEQ ID NO: 222102 - DNA, 20 bp, Artificial Sequence
  chemically synthesized
ctttgcaaggtcgtagcatg

SEQ ID NO: 222103 - DNA, 20 bp, Artificial Sequence
  chemically synthesized
agctttgcaaggtcgtagca

SEQ ID NO: 222104 - DNA, 20 bp, Artificial Sequence
  chemically synthesized
aggtaagctttgcaaggtcg

SEQ ID NO: 222105 - DNA, 20 bp, Artificial Sequence
  chemically synthesized
ctccatgctacgaccttgca

SEQ ID NO: 222106 - DNA, 20 bp, Artificial Sequence
  chemically synthesized
gaatttaggtaagctttgca

SEQ ID NO: 222107 - DNA, 20 bp, Artificial Sequence
  chemically synthesized
agaatttaggtaagctttgc

SEQ ID NO: 222108 - DNA, 20 bp, Artificial Sequence
  chemically synthesized
ttggggttcagaatttaggt

SEQ ID NO: 222109 - DNA, 20 bp, Artificial Sequence
  chemically synthesized
tttattggggttcagaattt

SEQ ID NO: 222110 - DNA, 20 bp, Artificial Sequence
  chemically synthesized
gtttattggggttcagaatt

SEQ ID NO: 222111 - DNA, 20 bp, Artificial Sequence
  chemically synthesized
tccatgagtttattggggtt

SEQ ID NO: 222112 - DNA, 20 bp, Artificial Sequence
  chemically synthesized
atgtatccatgagtttattg

SEQ ID NO: 222113 - DNA, 20 bp, Artificial Sequence
  chemically synthesized
aatgtatccatgagtttatt

SEQ ID NO: 222114 - DNA, 20 bp, Artificial Sequence
  chemically synthesized
taatgtatccatgagtttat

SEQ ID NO: 222115 - DNA, 20 bp, Artificial Sequence
  chemically synthesized
tctgaaccccaataaactca

SEQ ID NO: 222116 - DNA, 20 bp, Artificial Sequence
  chemically synthesized
ttttactttaatgtatccat

SEQ ID NO: 222117 - DNA, 20 bp, Artificial Sequence
  chemically synthesized
ataaactcatggatacatta

SEQ ID NO: 222118 - DNA, 20 bp, Artificial Sequence
  chemically synthesized
tcatggatacattaaagtaa

SEQ ID NO: 222119 - DNA, 20 bp, Artificial Sequence
  chemically synthesized
tattctaacaagcatgcaca

SEQ ID NO: 222120 - DNA, 20 bp, Artificial Sequence
  chemically synthesized
gctattctaacaagcatgca

SEQ ID NO: 222121 - DNA, 20 bp, Artificial Sequence
  chemically synthesized
aaagctctgtgcatgcttgt

SEQ ID NO: 222122 - DNA, 20 bp, Artificial Sequence
  chemically synthesized
tctgtgcatgcttgttagaa

SEQ ID NO: 222123 - DNA, 20 bp, Artificial Sequence
  chemically synthesized
gtatagtgtgctattctaac

SEQ ID NO: 222124 - DNA, 20 bp, Artificial Sequence
  chemically synthesized
tttgccatttggtaaatgta

SEQ ID NO: 222125 - DNA, 20 bp, Artificial Sequence
  chemically synthesized
cacactatacatttaccaaa

SEQ ID NO: 222126 - DNA, 20 bp, Artificial Sequence
  chemically synthesized
tatacatttaccaaatggca

SEQ ID NO: 222127 - DNA, 20 bp, Artificial Sequence
  chemically synthesized
atgccaggcactttgccatt

SEQ ID NO: 222128 - DNA, 20 bp, Artificial Sequence
  chemically synthesized
ttaccaaatggcaaagtgcc

SEQ ID NO: 222129 - DNA, 20 bp, Artificial Sequence
  chemically synthesized
aaatggcaaagtgcctggca

SEQ ID NO: 222130 - DNA, 20 bp, Artificial Sequence
  chemically synthesized
atggcaaagtgcctggcatg

SEQ ID NO: 222131 - DNA, 20 bp, Artificial Sequence
  chemically synthesized
taactatcattctccatgcc

SEQ ID NO: 222132 - DNA, 20 bp, Artificial Sequence
  chemically synthesized
ataactatcattctccatgc

SEQ ID NO: 222133 - DNA, 20 bp, Artificial Sequence
  chemically synthesized
gtgcctggcatggagaatga

SEQ ID NO: 222134 - DNA, 20 bp, Artificial Sequence
  chemically synthesized
ggcatggagaatgatagtta

SEQ ID NO: 222135 - DNA, 20 bp, Artificial Sequence
  chemically synthesized
atagttatagtcataaacac

SEQ ID NO: 222136 - DNA, 20 bp, Artificial Sequence
  chemically synthesized
ttcttcaattatgacgatgc

SEQ ID NO: 222137 - DNA, 20 bp, Artificial Sequence
  chemically synthesized
cactagcatcgtcataattg

SEQ ID NO: 222138 - DNA, 20 bp, Artificial Sequence
  chemically synthesized
attgaagaaattactgtcca

SEQ ID NO: 222139 - DNA, 20 bp, Artificial Sequence
  chemically synthesized
ttgaagaaattactgtccat

SEQ ID NO: 222140 - DNA, 20 bp, Artificial Sequence
  chemically synthesized
gattgactagatcccatgga

SEQ ID NO: 222141 - DNA, 20 bp, Artificial Sequence
  chemically synthesized
aaattactgtccatgggatc

SEQ ID NO: 222142 - DNA, 20 bp, Artificial Sequence
  chemically synthesized
caatgattgactagatccca

SEQ ID NO: 222143 - DNA, 20 bp, Artificial Sequence
  chemically synthesized
gtgaatactcaatgattgac

SEQ ID NO: 222144 - DNA, 20 bp, Artificial Sequence
  chemically synthesized
atgggatctagtcaatcatt

SEQ ID NO: 222145 - DNA, 20 bp, Artificial Sequence
  chemically synthesized
tcaatcattgagtattcact

SEQ ID NO: 222146 - DNA, 20 bp, Artificial Sequence
  chemically synthesized
tgagtattcactcagcattc

SEQ ID NO: 222147 - DNA, 20 bp, Artificial Sequence
  chemically synthesized
aaatatcagtcttgaatgct

SEQ ID NO: 222148 - DNA, 20 bp, Artificial Sequence
  chemically synthesized
gtggaattcagataaaatat

SEQ ID NO: 222149 - DNA, 20 bp, Artificial Sequence
  chemically synthesized
gaagggtgatttgtggaatt

SEQ ID NO: 222150 - DNA, 20 bp, Artificial Sequence
  chemically synthesized
gttgagtgaagggtgatttg

SEQ ID NO: 222151 - DNA, 20 bp, Artificial Sequence
  chemically synthesized
agaaaaccgtgttgagtgaa

SEQ ID NO: 222152 - DNA, 20 bp, Artificial Sequence
  chemically synthesized
aagaaaaccgtgttgagtga

SEQ ID NO: 222153 - DNA, 20 bp, Artificial Sequence
  chemically synthesized
taagaaaaccgtgttgagtg

SEQ ID NO: 222154 - DNA, 20 bp, Artificial Sequence
  chemically synthesized
aaatcacccttcactcaaca

SEQ ID NO: 222155 - DNA, 20 bp, Artificial Sequence
  chemically synthesized
gatgataagaaaaccgtgtt

SEQ ID NO: 222156 - DNA, 20 bp, Artificial Sequence
  chemically synthesized
tctacctgaaggatgatgat

SEQ ID NO: 222157 - DNA, 20 bp, Artificial Sequence
  chemically synthesized
gttttcttatcatcatcctt

SEQ ID NO: 222158 - DNA, 20 bp, Artificial Sequence
  chemically synthesized
ttttcttatcatcatccttc

SEQ ID NO: 222159 - DNA, 20 bp, Artificial Sequence
  chemically synthesized
tcttatcatcatccttcagg

SEQ ID NO: 222160 - DNA, 20 bp, Artificial Sequence
  chemically synthesized
ttatcatcatccttcaggta

SEQ ID NO: 222161 - DNA, 20 bp, Artificial Sequence
  chemically synthesized
gatggaggggctctacctga

SEQ ID NO: 222162 - DNA, 20 bp, Artificial Sequence
  chemically synthesized
ggatggaggggctctacctg

SEQ ID NO: 222163 - DNA, 20 bp, Artificial Sequence
  chemically synthesized
aatccagagataggatggag

SEQ ID NO: 222164 - DNA, 20 bp, Artificial Sequence
  chemically synthesized
aaatccagagataggatgga

SEQ ID NO: 222165 - DNA, 20 bp, Artificial Sequence
  chemically synthesized
caaatccagagataggatgg

SEQ ID NO: 222166 - DNA, 20 bp, Artificial Sequence
  chemically synthesized
gcaaatccagagataggatg

SEQ ID NO: 222167 - DNA, 20 bp, Artificial Sequence
  chemically synthesized
atgcaaatccagagatagga

SEQ ID NO: 222168 - DNA, 20 bp, Artificial Sequence
  chemically synthesized
gagcccctccatcctatctc

SEQ ID NO: 222169 - DNA, 20 bp, Artificial Sequence
  chemically synthesized
gtgtatgcaaatccagagat

SEQ ID NO: 222170 - DNA, 20 bp, Artificial Sequence
  chemically synthesized
agtgtatgcaaatccagaga

SEQ ID NO: 222171 - DNA, 20 bp, Artificial Sequence
  chemically synthesized
aaacagtgtatgcaaatcca

SEQ ID NO: 222172 - DNA, 20 bp, Artificial Sequence
  chemically synthesized
ccaaacagtgtatgcaaatc

SEQ ID NO: 222173 - DNA, 20 bp, Artificial Sequence
  chemically synthesized
ctggatttgcatacactgtt

SEQ ID NO: 222174 - DNA, 20 bp, Artificial Sequence
  chemically synthesized
aatggtaaagatattccaaa

SEQ ID NO: 222175 - DNA, 20 bp, Artificial Sequence
  chemically synthesized
ctgatgaaaagaaaatggta

SEQ ID NO: 222176 - DNA, 20 bp, Artificial Sequence
  chemically synthesized
gatatctgatgaaaagaaaa

SEQ ID NO: 222177 - DNA, 20 bp, Artificial Sequence
  chemically synthesized
ctttaccattttcttttcat

SEQ ID NO: 222178 - DNA, 20 bp, Artificial Sequence
  chemically synthesized
agttgtcgatatctgatgaa

SEQ ID NO: 222179 - DNA, 20 bp, Artificial Sequence
  chemically synthesized
tcagatatcgacaactttta

SEQ ID NO: 222180 - DNA, 20 bp, Artificial Sequence
  chemically synthesized
cagatatcgacaacttttat

SEQ ID NO: 222181 - DNA, 20 bp, Artificial Sequence
  chemically synthesized
atgatctagtagacctataa

SEQ ID NO: 222182 - DNA, 20 bp, Artificial Sequence
  chemically synthesized
gacaacttttataggtctac

SEQ ID NO: 222183 - DNA, 20 bp, Artificial Sequence
  chemically synthesized
cccttgatttcatgatctag

SEQ ID NO: 222184 - DNA, 20 bp, Artificial Sequence
  chemically synthesized
taacccttgatttcatgatc

SEQ ID NO: 222185 - DNA, 20 bp, Artificial Sequence
  chemically synthesized
gtctactagatcatgaaatc

SEQ ID NO: 222186 - DNA, 20 bp, Artificial Sequence
  chemically synthesized
tctactagatcatgaaatca

SEQ ID NO: 222187 - DNA, 20 bp, Artificial Sequence
  chemically synthesized
ctactagatcatgaaatcaa

SEQ ID NO: 222188 - DNA, 20 bp, Artificial Sequence
  chemically synthesized
ggttatgttcatgtattact

SEQ ID NO: 222189 - DNA, 20 bp, Artificial Sequence
  chemically synthesized
ctgaggacagaacaaaaacc

SEQ ID NO: 222190 - DNA, 20 bp, Artificial Sequence
  chemically synthesized
cttggtttttgttctgtcct

SEQ ID NO: 222191 - DNA, 20 bp, Artificial Sequence
  chemically synthesized
cttgtggtgggtgctgagga

SEQ ID NO: 222192 - DNA, 20 bp, Artificial Sequence
  chemically synthesized
gggccttgtggtgggtgctg

SEQ ID NO: 222193 - DNA, 20 bp, Artificial Sequence
  chemically synthesized
agggccttgtggtgggtgct

SEQ ID NO: 222194 - DNA, 20 bp, Artificial Sequence
  chemically synthesized
ctgtcctcagcacccaccac

SEQ ID NO: 222195 - DNA, 20 bp, Artificial Sequence
  chemically synthesized
tgtcctcagcacccaccaca

SEQ ID NO: 222196 - DNA, 20 bp, Artificial Sequence
  chemically synthesized
aaaatacagggccttgtggt

SEQ ID NO: 222197 - DNA, 20 bp, Artificial Sequence
  chemically synthesized
aaaaatacagggccttgtgg

SEQ ID NO: 222198 - DNA, 20 bp, Artificial Sequence
  chemically synthesized
tttaaaaatacagggccttg

SEQ ID NO: 222199 - DNA, 20 bp, Artificial Sequence
  chemically synthesized
tgagctcctttaaaaataca

SEQ ID NO: 222200 - DNA, 20 bp, Artificial Sequence
  chemically synthesized
ttgagctcctttaaaaatac

SEQ ID NO: 222201 - DNA, 20 bp, Artificial Sequence
  chemically synthesized
attgagctcctttaaaaata

SEQ ID NO: 222202 - DNA, 20 bp, Artificial Sequence
  chemically synthesized
cacaaggccctgtattttta

SEQ ID NO: 222203 - DNA, 20 bp, Artificial Sequence
  chemically synthesized
acaaggccctgtatttttaa

SEQ ID NO: 222204 - DNA, 20 bp, Artificial Sequence
  chemically synthesized
aaggccctgtatttttaaag

SEQ ID NO: 222205 - DNA, 20 bp, Artificial Sequence
  chemically synthesized
ccattcaatatatttatatt

SEQ ID NO: 222206 - DNA, 20 bp, Artificial Sequence
  chemically synthesized
ctcaatataaatatattgaa

SEQ ID NO: 222207 - DNA, 20 bp, Artificial Sequence
  chemically synthesized
ggaattaaatgccattgcta

SEQ ID NO: 222208 - DNA, 20 bp, Artificial Sequence
  chemically synthesized
gaggaggaaaactttagcaa

SEQ ID NO: 222209 - DNA, 20 bp, Artificial Sequence
  chemically synthesized
taacatgaggaggaaaactt

SEQ ID NO: 222210 - DNA, 20 bp, Artificial Sequence
  chemically synthesized
gggtaaagattaacatgagg

SEQ ID NO: 222211 - DNA, 20 bp, Artificial Sequence
  chemically synthesized
cgggtaaagattaacatgag

SEQ ID NO: 222212 - DNA, 20 bp, Artificial Sequence
  chemically synthesized
cacgggtaaagattaacatg

SEQ ID NO: 222213 - DNA, 20 bp, Artificial Sequence
  chemically synthesized
acacgggtaaagattaacat

SEQ ID NO: 222214 - DNA, 20 bp, Artificial Sequence
  chemically synthesized
tagtttcttttacacgggta

SEQ ID NO: 222215 - DNA, 20 bp, Artificial Sequence
  chemically synthesized
gttaatctttacccgtgtaa

SEQ ID NO: 222216 - DNA, 20 bp, Artificial Sequence
  chemically synthesized
aaggatagtttcttttacac

SEQ ID NO: 222217 - DNA, 20 bp, Artificial Sequence
  chemically synthesized
aaaggatagtttcttttaca

SEQ ID NO: 222218 - DNA, 20 bp, Artificial Sequence
  chemically synthesized
ttgtgtaactaggtaaagga

SEQ ID NO: 222219 - DNA, 20 bp, Artificial Sequence
  chemically synthesized
aaaagaaactatcctttacc

SEQ ID NO: 222220 - DNA, 20 bp, Artificial Sequence
  chemically synthesized
gaagttgtgtaactaggtaa

SEQ ID NO: 222221 - DNA, 20 bp, Artificial Sequence
  chemically synthesized
tgaagttgtgtaactaggta

SEQ ID NO: 222222 - DNA, 20 bp, Artificial Sequence
  chemically synthesized
tattatgaagttgtgtaact

SEQ ID NO: 222223 - DNA, 20 bp, Artificial Sequence
  chemically synthesized
ttattatgaagttgtgtaac

SEQ ID NO: 222224 - DNA, 20 bp, Artificial Sequence
  chemically synthesized
cagagtaataaattattatg

SEQ ID NO: 222225 - DNA, 20 bp, Artificial Sequence
  chemically synthesized
aaagttcttgtgaaaattca

SEQ ID NO: 222226 - DNA, 20 bp, Artificial Sequence
  chemically synthesized
caaaagttcttgtgaaaatt

SEQ ID NO: 222227 - DNA, 20 bp, Artificial Sequence
  chemically synthesized
ttattactctgaattttcac

SEQ ID NO: 222228 - DNA, 20 bp, Artificial Sequence
  chemically synthesized
taaatgagtggttaagtcaa

SEQ ID NO: 222229 - DNA, 20 bp, Artificial Sequence
  chemically synthesized
ttttttttaaatgagtggtt

SEQ ID NO: 222230 - DNA, 20 bp, Artificial Sequence
  chemically synthesized
gcagattttttttaaatgag

SEQ ID NO: 222231 - DNA, 20 bp, Artificial Sequence
  chemically synthesized
tctgcagattttttttaaat

SEQ ID NO: 222232 - DNA, 20 bp, Artificial Sequence
  chemically synthesized
actcatttaaaaaaaatctg

SEQ ID NO: 222233 - DNA, 20 bp, Artificial Sequence
  chemically synthesized
atatattacaggattatctg

SEQ ID NO: 222234 - DNA, 20 bp, Artificial Sequence
  chemically synthesized
gtgctggagaaatatattac

SEQ ID NO: 222235 - DNA, 20 bp, Artificial Sequence
  chemically synthesized
tgtgctggagaaatatatta

SEQ ID NO: 222236 - DNA, 20 bp, Artificial Sequence
  chemically synthesized
aatcctgtaatatatttctc

SEQ ID NO: 222237 - DNA, 20 bp, Artificial Sequence
  chemically synthesized
tgtaatatatttctccagca

SEQ ID NO: 222238 - DNA, 20 bp, Artificial Sequence
  chemically synthesized
catgagggtgaactgtgctg

SEQ ID NO: 222239 - DNA, 20 bp, Artificial Sequence
  chemically synthesized
ttcatgagggtgaactgtgc

SEQ ID NO: 222240 - DNA, 20 bp, Artificial Sequence
  chemically synthesized
cagcacagttcaccctcatg

SEQ ID NO: 222241 - DNA, 20 bp, Artificial Sequence
  chemically synthesized
caatactgcctgcttcatga

SEQ ID NO: 222242 - DNA, 20 bp, Artificial Sequence
  chemically synthesized
cacagttcaccctcatgaag

SEQ ID NO: 222243 - DNA, 20 bp, Artificial Sequence
  chemically synthesized
tcaatactgcctgcttcatg

SEQ ID NO: 222244 - DNA, 20 bp, Artificial Sequence
  chemically synthesized
acagttcaccctcatgaagc

SEQ ID NO: 222245 - DNA, 20 bp, Artificial Sequence
  chemically synthesized
ctcaatactgcctgcttcat

SEQ ID NO: 222246 - DNA, 20 bp, Artificial Sequence
  chemically synthesized
gttcaccctcatgaagcagg

SEQ ID NO: 222247 - DNA, 20 bp, Artificial Sequence
  chemically synthesized
ctcatgaagcaggcagtatt

SEQ ID NO: 222248 - DNA, 20 bp, Artificial Sequence
  chemically synthesized
tgaagcaggcagtattgagc

SEQ ID NO: 222249 - DNA, 20 bp, Artificial Sequence
  chemically synthesized
aagcaggcagtattgagcaa

SEQ ID NO: 222250 - DNA, 20 bp, Artificial Sequence
  chemically synthesized
agcaggcagtattgagcaag

SEQ ID NO: 222251 - DNA, 20 bp, Artificial Sequence
  chemically synthesized
ggcagtattgagcaagaggc

SEQ ID NO: 222252 - DNA, 20 bp, Artificial Sequence
  chemically synthesized
gcagtattgagcaagaggct

SEQ ID NO: 222253 - DNA, 20 bp, Artificial Sequence
  chemically synthesized
gagcaagaggctaggctcac

SEQ ID NO: 222254 - DNA, 20 bp, Artificial Sequence
  chemically synthesized
acttgtctaaccagtgagcc

SEQ ID NO: 222255 - DNA, 20 bp, Artificial Sequence
  chemically synthesized
aagaggctaggctcactggt

SEQ ID NO: 222256 - DNA, 20 bp, Artificial Sequence
  chemically synthesized
caattacttgtctaaccagt

SEQ ID NO: 222257 - DNA, 20 bp, Artificial Sequence
  chemically synthesized
gctaggctcactggttagac

SEQ ID NO: 222258 - DNA, 20 bp, Artificial Sequence
  chemically synthesized
gggtcaattacttgtctaac

SEQ ID NO: 222259 - DNA, 20 bp, Artificial Sequence
  chemically synthesized
ttgcatggatttaatgtgag

SEQ ID NO: 222260 - DNA, 20 bp, Artificial Sequence
  chemically synthesized
attgcatggatttaatgtga

SEQ ID NO: 222261 - DNA, 20 bp, Artificial Sequence
  chemically synthesized
gattgcatggatttaatgtg

SEQ ID NO: 222262 - DNA, 20 bp, Artificial Sequence
  chemically synthesized
agattgcatggatttaatgt

SEQ ID NO: 222263 - DNA, 20 bp, Artificial Sequence
  chemically synthesized
tgttcattatttagattgca

SEQ ID NO: 222264 - DNA, 20 bp, Artificial Sequence
  chemically synthesized
tacaattagtgttcattatt

SEQ ID NO: 222265 - DNA, 20 bp, Artificial Sequence
  chemically synthesized
ggcagcctacagcatacaat

SEQ ID NO: 222266 - DNA, 20 bp, Artificial Sequence
  chemically synthesized
tgaacactaattgtatgctg

SEQ ID NO: 222267 - DNA, 20 bp, Artificial Sequence
  chemically synthesized
gaacactaattgtatgctgt

SEQ ID NO: 222268 - DNA, 20 bp, Artificial Sequence
  chemically synthesized
cgagagaccctggcagccta

SEQ ID NO: 222269 - DNA, 20 bp, Artificial Sequence
  chemically synthesized
aattgtatgctgtaggctgc

SEQ ID NO: 222270 - DNA, 20 bp, Artificial Sequence
  chemically synthesized
attgtatgctgtaggctgcc

SEQ ID NO: 222271 - DNA, 20 bp, Artificial Sequence
  chemically synthesized
ttgtatgctgtaggctgcca

SEQ ID NO: 222272 - DNA, 20 bp, Artificial Sequence
  chemically synthesized
actacagcgagagaccctgg

SEQ ID NO: 222273 - DNA, 20 bp, Artificial Sequence
  chemically synthesized
ttaactacagcgagagaccc

SEQ ID NO: 222274 - DNA, 20 bp, Artificial Sequence
  chemically synthesized
gctgccagggtctctcgctg

SEQ ID NO: 222275 - DNA, 20 bp, Artificial Sequence
  chemically synthesized
tttacttttaactacagcga

SEQ ID NO: 222276 - DNA, 20 bp, Artificial Sequence
  chemically synthesized
tttttacttttaactacagc

SEQ ID NO: 222277 - DNA, 20 bp, Artificial Sequence
  chemically synthesized
gggtctctcgctgtagttaa

SEQ ID NO: 222278 - DNA, 20 bp, Artificial Sequence
  chemically synthesized
tgtatttttacttttaacta

SEQ ID NO: 222279 - DNA, 20 bp, Artificial Sequence
  chemically synthesized
ttttttttttttttcttttt

SEQ ID NO: 222280 - DNA, 20 bp, Artificial Sequence
  chemically synthesized
ttttttttttctttttgaga

SEQ ID NO: 222281 - DNA, 20 bp, Artificial Sequence
  chemically synthesized
gagggagactccatctcaaa

SEQ ID NO: 222282 - DNA, 20 bp, Artificial Sequence
  chemically synthesized
ttttttttctttttgagatg

SEQ ID NO: 222283 - DNA, 20 bp, Artificial Sequence
  chemically synthesized
tccagcctgggcgacagagg

SEQ ID NO: 222284 - DNA, 20 bp, Artificial Sequence
  chemically synthesized
actccagcctgggcgacaga

SEQ ID NO: 222285 - DNA, 20 bp, Artificial Sequence
  chemically synthesized
cactccagcctgggcgacag

SEQ ID NO: 222286 - DNA, 20 bp, Artificial Sequence
  chemically synthesized
tggagtctccctctgtcgcc

SEQ ID NO: 222287 - DNA, 20 bp, Artificial Sequence
  chemically synthesized
gcactccagcctgggcgaca

SEQ ID NO: 222288 - DNA, 20 bp, Artificial Sequence
  chemically synthesized
ggagtctccctctgtcgccc

SEQ ID NO: 222289 - DNA, 20 bp, Artificial Sequence
  chemically synthesized
ctgcactccagcctgggcga

SEQ ID NO: 222290 - DNA, 20 bp, Artificial Sequence
  chemically synthesized
tctccctctgtcgcccaggc

SEQ ID NO: 222291 - DNA, 20 bp, Artificial Sequence
  chemically synthesized
tccctctgtcgcccaggctg

SEQ ID NO: 222292 - DNA, 20 bp, Artificial Sequence
  chemically synthesized
aggccactgcactccagcct

SEQ ID NO: 222293 - DNA, 20 bp, Artificial Sequence
  chemically synthesized
caggccactgcactccagcc

SEQ ID NO: 222294 - DNA, 20 bp, Artificial Sequence
  chemically synthesized
ctgtcgcccaggctggagtg

SEQ ID NO: 222295 - DNA, 20 bp, Artificial Sequence
  chemically synthesized
gaggtcaggccactgcactc

SEQ ID NO: 222296 - DNA, 20 bp, Artificial Sequence
  chemically synthesized
tcgcccaggctggagtgcag

SEQ ID NO: 222297 - DNA, 20 bp, Artificial Sequence
  chemically synthesized
gcttgcagtgagcagaggtc

SEQ ID NO: 222298 - DNA, 20 bp, Artificial Sequence
  chemically synthesized
agcttgcagtgagcagaggt

SEQ ID NO: 222299 - DNA, 20 bp, Artificial Sequence
  chemically synthesized
gcggagcttgcagtgagcag

SEQ ID NO: 222300 - DNA, 20 bp, Artificial Sequence
  chemically synthesized
ggcggagcttgcagtgagca

SEQ ID NO: 222301 - DNA, 20 bp, Artificial Sequence
  chemically synthesized
gaggcggagcttgcagtgag

SEQ ID NO: 222302 - DNA, 20 bp, Artificial Sequence
  chemically synthesized
gcctgacctctgctcactgc

SEQ ID NO: 222303 - DNA, 20 bp, Artificial Sequence
  chemically synthesized
cgggaggcggagcttgcagt

SEQ ID NO: 222304 - DNA, 20 bp, Artificial Sequence
  chemically synthesized
aacccgggaggcggagcttg

SEQ ID NO: 222305 - DNA, 20 bp, Artificial Sequence
  chemically synthesized
tcactgcaagctccgcctcc

SEQ ID NO: 222306 - DNA, 20 bp, Artificial Sequence
  chemically synthesized
tggcgtgaacccgggaggcg

SEQ ID NO: 222307 - DNA, 20 bp, Artificial Sequence
  chemically synthesized
cactgcaagctccgcctccc

SEQ ID NO: 222308 - DNA, 20 bp, Artificial Sequence
  chemically synthesized
aatggcgtgaacccgggagg

SEQ ID NO: 222309 - DNA, 20 bp, Artificial Sequence
  chemically synthesized
gagaatggcgtgaacccggg

SEQ ID NO: 222310 - DNA, 20 bp, Artificial Sequence
  chemically synthesized
ggagaatggcgtgaacccgg

SEQ ID NO: 222311 - DNA, 20 bp, Artificial Sequence
  chemically synthesized
caggagaatggcgtgaaccc

SEQ ID NO: 222312 - DNA, 20 bp, Artificial Sequence
  chemically synthesized
gcaggagaatggcgtgaacc

SEQ ID NO: 222313 - DNA, 20 bp, Artificial Sequence
  chemically synthesized
gggaggttaaggcaggagaa

SEQ ID NO: 222314 - DNA, 20 bp, Artificial Sequence
  chemically synthesized
tactcgggaggttaaggcag

SEQ ID NO: 222315 - DNA, 20 bp, Artificial Sequence
  chemically synthesized
gctactcgggaggttaaggc

SEQ ID NO: 222316 - DNA, 20 bp, Artificial Sequence
  chemically synthesized
agctactcgggaggttaagg

SEQ ID NO: 222317 - DNA, 20 bp, Artificial Sequence
  chemically synthesized
cccagctactcgggaggtta

SEQ ID NO: 222318 - DNA, 20 bp, Artificial Sequence
  chemically synthesized
tcccagctactcgggaggtt

SEQ ID NO: 222319 - DNA, 20 bp, Artificial Sequence
  chemically synthesized
ttctcctgccttaacctccc

SEQ ID NO: 222320 - DNA, 20 bp, Artificial Sequence
  chemically synthesized
tcctgccttaacctcccgag

SEQ ID NO: 222321 - DNA, 20 bp, Artificial Sequence
  chemically synthesized
tgtggtcccagctactcggg

SEQ ID NO: 222322 - DNA, 20 bp, Artificial Sequence
  chemically synthesized
ctgtggtcccagctactcgg

SEQ ID NO: 222323 - DNA, 20 bp, Artificial Sequence
  chemically synthesized
gccttaacctcccgagtagc

SEQ ID NO: 222324 - DNA, 20 bp, Artificial Sequence
  chemically synthesized
gcctgtggtcccagctactc

SEQ ID NO: 222325 - DNA, 20 bp, Artificial Sequence
  chemically synthesized
ccttaacctcccgagtagct

SEQ ID NO: 222326 - DNA, 20 bp, Artificial Sequence
  chemically synthesized
cgcctgtggtcccagctact

SEQ ID NO: 222327 - DNA, 20 bp, Artificial Sequence
  chemically synthesized
ctcccgagtagctgggacca

SEQ ID NO: 222328 - DNA, 20 bp, Artificial Sequence
  chemically synthesized
tcccgagtagctgggaccac

SEQ ID NO: 222329 - DNA, 20 bp, Artificial Sequence
  chemically synthesized
gtggcgggcgcctgtggtcc

SEQ ID NO: 222330 - DNA, 20 bp, Artificial Sequence
  chemically synthesized
tgcgtggtggcgggcgcctg

SEQ ID NO: 222331 - DNA, 20 bp, Artificial Sequence
  chemically synthesized
aattagccatgcgtggtggc

SEQ ID NO: 222332 - DNA, 20 bp, Artificial Sequence
  chemically synthesized
aaattagccatgcgtggtgg

SEQ ID NO: 222333 - DNA, 20 bp, Artificial Sequence
  chemically synthesized
caggcgcccgccaccacgca

SEQ ID NO: 222334 - DNA, 20 bp, Artificial Sequence
  chemically synthesized
aaaaaattagccatgcgtgg

SEQ ID NO: 222335 - DNA, 20 bp, Artificial Sequence
  chemically synthesized
aaaaaaaaattagccatgcg

SEQ ID NO: 222336 - DNA, 20 bp, Artificial Sequence
  chemically synthesized
aaatacaaaaaaaaaaaaat

SEQ ID NO: 222337 - DNA, 20 bp, Artificial Sequence
  chemically synthesized
ttttttttttttgtattttt

SEQ ID NO: 222338 - DNA, 20 bp, Artificial Sequence
  chemically synthesized
tttttttttgtattttttag

SEQ ID NO: 222339 - DNA, 20 bp, Artificial Sequence
  chemically synthesized
tttttttgtattttttagta

SEQ ID NO: 222340 - DNA, 20 bp, Artificial Sequence
  chemically synthesized
ttgtattttttagtagagac

SEQ ID NO: 222341 - DNA, 20 bp, Artificial Sequence
  chemically synthesized
tgtattttttagtagagacg

SEQ ID NO: 222342 - DNA, 20 bp, Artificial Sequence
  chemically synthesized
gagacgaggtttcaccgtgt

SEQ ID NO: 222343 - DNA, 20 bp, Artificial Sequence
  chemically synthesized
cgaggtttcaccgtgttagc

SEQ ID NO: 222344 - DNA, 20 bp, Artificial Sequence
  chemically synthesized
cgagaccatcctggctaaca

SEQ ID NO: 222345 - DNA, 20 bp, Artificial Sequence
  chemically synthesized
gaggtttcaccgtgttagcc

SEQ ID NO: 222346 - DNA, 20 bp, Artificial Sequence
  chemically synthesized
tttcaccgtgttagccagga

SEQ ID NO: 222347 - DNA, 20 bp, Artificial Sequence
  chemically synthesized
tcaggagaccgagaccatcc

SEQ ID NO: 222348 - DNA, 20 bp, Artificial Sequence
  chemically synthesized
cgtgttagccaggatggtct

SEQ ID NO: 222349 - DNA, 20 bp, Artificial Sequence
  chemically synthesized
gatcacgaggtcaggagacc

SEQ ID NO: 222350 - DNA, 20 bp, Artificial Sequence
  chemically synthesized
cgggcggatcacgaggtcag

SEQ ID NO: 222351 - DNA, 20 bp, Artificial Sequence
  chemically synthesized
ggcgggcggatcacgaggtc

SEQ ID NO: 222352 - DNA, 20 bp, Artificial Sequence
  chemically synthesized
aggcgggcggatcacgaggt

SEQ ID NO: 222353 - DNA, 20 bp, Artificial Sequence
  chemically synthesized
gccgaggcgggcggatcacg

SEQ ID NO: 222354 - DNA, 20 bp, Artificial Sequence
  chemically synthesized
ggccgaggcgggcggatcac

SEQ ID NO: 222355 - DNA, 20 bp, Artificial Sequence
  chemically synthesized
acctcgtgatccgcccgcct

SEQ ID NO: 222356 - DNA, 20 bp, Artificial Sequence
  chemically synthesized
ctttgggaggccgaggcggg

SEQ ID NO: 222357 - DNA, 20 bp, Artificial Sequence
  chemically synthesized
gcactttgggaggccgaggc

SEQ ID NO: 222358 - DNA, 20 bp, Artificial Sequence
  chemically synthesized
agcactttgggaggccgagg

SEQ ID NO: 222359 - DNA, 20 bp, Artificial Sequence
  chemically synthesized
cccagcactttgggaggccg

SEQ ID NO: 222360 - DNA, 20 bp, Artificial Sequence
  chemically synthesized
tcccagcactttgggaggcc

SEQ ID NO: 222361 - DNA, 20 bp, Artificial Sequence
  chemically synthesized
ccgcccgcctcggcctccca

SEQ ID NO: 222362 - DNA, 20 bp, Artificial Sequence
  chemically synthesized
tgtaatcccagcactttggg

SEQ ID NO: 222363 - DNA, 20 bp, Artificial Sequence
  chemically synthesized
ctgtaatcccagcactttgg

SEQ ID NO: 222364 - DNA, 20 bp, Artificial Sequence
  chemically synthesized
gcctcggcctcccaaagtgc

SEQ ID NO: 222365 - DNA, 20 bp, Artificial Sequence
  chemically synthesized
gcctgtaatcccagcacttt

SEQ ID NO: 222366 - DNA, 20 bp, Artificial Sequence
  chemically synthesized
cctcggcctcccaaagtgct

SEQ ID NO: 222367 - DNA, 20 bp, Artificial Sequence
  chemically synthesized
cgcctgtaatcccagcactt

SEQ ID NO: 222368 - DNA, 20 bp, Artificial Sequence
  chemically synthesized
ctcccaaagtgctgggatta

SEQ ID NO: 222369 - DNA, 20 bp, Artificial Sequence
  chemically synthesized
tcccaaagtgctgggattac

SEQ ID NO: 222370 - DNA, 20 bp, Artificial Sequence
  chemically synthesized
gtggctcacgcctgtaatcc

SEQ ID NO: 222371 - DNA, 20 bp, Artificial Sequence
  chemically synthesized
agtgctgggattacaggcgt

SEQ ID NO: 222372 - DNA, 20 bp, Artificial Sequence
  chemically synthesized
caggcgtgagccaccgtgcc

SEQ ID NO: 222373 - DNA, 20 bp, Artificial Sequence
  chemically synthesized
gtatttgtggccgggcacgg

SEQ ID NO: 222374 - DNA, 20 bp, Artificial Sequence
  chemically synthesized
gatgtatttgtggccgggca

SEQ ID NO: 222375 - DNA, 20 bp, Artificial Sequence
  chemically synthesized
ataaagatgtatttgtggcc

SEQ ID NO: 222376 - DNA, 20 bp, Artificial Sequence
  chemically synthesized
tataaagatgtatttgtggc

SEQ ID NO: 222377 - DNA, 20 bp, Artificial Sequence
  chemically synthesized
aacatataaagatgtatttg

SEQ ID NO: 222378 - DNA, 20 bp, Artificial Sequence
  chemically synthesized
tagtagacagtaaacatata

SEQ ID NO: 222379 - DNA, 20 bp, Artificial Sequence
  chemically synthesized
tttatatgtttactgtctac

SEQ ID NO: 222380 - DNA, 20 bp, Artificial Sequence
  chemically synthesized
agtcttcagtatctagtaga

SEQ ID NO: 222381 - DNA, 20 bp, Artificial Sequence
  chemically synthesized
tgacagtcttcagtatctag

SEQ ID NO: 222382 - DNA, 20 bp, Artificial Sequence
  chemically synthesized
ttactgtctactagatactg

SEQ ID NO: 222383 - DNA, 20 bp, Artificial Sequence
  chemically synthesized
gaatgacagtcttcagtatc

SEQ ID NO: 222384 - DNA, 20 bp, Artificial Sequence
  chemically synthesized
agttagtgaatgacagtctt

SEQ ID NO: 222385 - DNA, 20 bp, Artificial Sequence
  chemically synthesized
agtgaccagttagtgaatga

SEQ ID NO: 222386 - DNA, 20 bp, Artificial Sequence
  chemically synthesized
gaagactgtcattcactaac

SEQ ID NO: 222387 - DNA, 20 bp, Artificial Sequence
  chemically synthesized
agttatacacagtgaccagt

SEQ ID NO: 222388 - DNA, 20 bp, Artificial Sequence
  chemically synthesized
atttagttatacacagtgac

SEQ ID NO: 222389 - DNA, 20 bp, Artificial Sequence
  chemically synthesized
tacaaggatttagttataca

SEQ ID NO: 222390 - DNA, 20 bp, Artificial Sequence
  chemically synthesized
cacattgaaatacaaggatt

SEQ ID NO: 222391 - DNA, 20 bp, Artificial Sequence
  chemically synthesized
cataatcacattgaaataca

SEQ ID NO: 222392 - DNA, 20 bp, Artificial Sequence
  chemically synthesized
tcataatcacattgaaatac

SEQ ID NO: 222393 - DNA, 20 bp, Artificial Sequence
  chemically synthesized
ttgtatttcaatgtgattat

SEQ ID NO: 222394 - DNA, 20 bp, Artificial Sequence
  chemically synthesized
tgtatttcaatgtgattatg

SEQ ID NO: 222395 - DNA, 20 bp, Artificial Sequence
  chemically synthesized
tcaatgtgattatgaggccc

SEQ ID NO: 222396 - DNA, 20 bp, Artificial Sequence
  chemically synthesized
agaacgaaacatattttctt

SEQ ID NO: 222397 - DNA, 20 bp, Artificial Sequence
  chemically synthesized
cagaacgaaacatattttct

SEQ ID NO: 222398 - DNA, 20 bp, Artificial Sequence
  chemically synthesized
caagaaaatatgtttcgttc

SEQ ID NO: 222399 - DNA, 20 bp, Artificial Sequence
  chemically synthesized
aagaaaatatgtttcgttct

SEQ ID NO: 222400 - DNA, 20 bp, Artificial Sequence
  chemically synthesized
ttaagagtttattaggtacc

SEQ ID NO: 222401 - DNA, 20 bp, Artificial Sequence
  chemically synthesized
gcaagtcttaagagtttatt

SEQ ID NO: 222402 - DNA, 20 bp, Artificial Sequence
  chemically synthesized
ggcaagtcttaagagtttat

SEQ ID NO: 222403 - DNA, 20 bp, Artificial Sequence
  chemically synthesized
tgggtacctaataaactctt

SEQ ID NO: 222404 - DNA, 20 bp, Artificial Sequence
  chemically synthesized
gggagatgggcaagtcttaa

SEQ ID NO: 222405 - DNA, 20 bp, Artificial Sequence
  chemically synthesized
gtgggagatgggcaagtctt

SEQ ID NO: 222406 - DNA, 20 bp, Artificial Sequence
  chemically synthesized
acagtttgtgggagatgggc

SEQ ID NO: 222407 - DNA, 20 bp, Artificial Sequence
  chemically synthesized
gcctacagtttgtgggagat

SEQ ID NO: 222408 - DNA, 20 bp, Artificial Sequence
  chemically synthesized
tgcctacagtttgtgggaga

SEQ ID NO: 222409 - DNA, 20 bp, Artificial Sequence
  chemically synthesized
tatttgcctacagtttgtgg

SEQ ID NO: 222410 - DNA, 20 bp, Artificial Sequence
  chemically synthesized
attatttgcctacagtttgt

SEQ ID NO: 222411 - DNA, 20 bp, Artificial Sequence
  chemically synthesized
tgcccatctcccacaaactg

SEQ ID NO: 222412 - DNA, 20 bp, Artificial Sequence
  chemically synthesized
aattatttgcctacagtttg

SEQ ID NO: 222413 - DNA, 20 bp, Artificial Sequence
  chemically synthesized
gcccatctcccacaaactgt

SEQ ID NO: 222414 - DNA, 20 bp, Artificial Sequence
  chemically synthesized
ttagaagaattatttgccta

SEQ ID NO: 222415 - DNA, 20 bp, Artificial Sequence
  chemically synthesized
aagaaataaaagcagattag

SEQ ID NO: 222416 - DNA, 20 bp, Artificial Sequence
  chemically synthesized
ataaagaaataaaagcagat

SEQ ID NO: 222417 - DNA, 20 bp, Artificial Sequence
  chemically synthesized
tcttaataaagaaataaaag

SEQ ID NO: 222418 - DNA, 20 bp, Artificial Sequence
  chemically synthesized
ttatcttaataaagaaataa

SEQ ID NO: 222419 - DNA, 20 bp, Artificial Sequence
  chemically synthesized
tctgcttttatttctttatt

SEQ ID NO: 222420 - DNA, 20 bp, Artificial Sequence
  chemically synthesized
tcaaatgctttatcttaata

SEQ ID NO: 222421 - DNA, 20 bp, Artificial Sequence
  chemically synthesized
tttatttctttattaagata

SEQ ID NO: 222422 - DNA, 20 bp, Artificial Sequence
  chemically synthesized
tttattaagataaagcattt

SEQ ID NO: 222423 - DNA, 20 bp, Artificial Sequence
  chemically synthesized
ttattaagataaagcatttg

SEQ ID NO: 222424 - DNA, 20 bp, Artificial Sequence
  chemically synthesized
tttgaggtcacaatgttcta

SEQ ID NO: 222425 - DNA, 20 bp, Artificial Sequence
  chemically synthesized
taggaatttctagatttcca

SEQ ID NO: 222426 - DNA, 20 bp, Artificial Sequence
  chemically synthesized
cacaatgttctatggaaatc

SEQ ID NO: 222427 - DNA, 20 bp, Artificial Sequence
  chemically synthesized
gattttgccttaggaatttc

SEQ ID NO: 222428 - DNA, 20 bp, Artificial Sequence
  chemically synthesized
atggaaatctagaaattcct

SEQ ID NO: 222429 - DNA, 20 bp, Artificial Sequence
  chemically synthesized
tggaaatctagaaattccta

SEQ ID NO: 222430 - DNA, 20 bp, Artificial Sequence
  chemically synthesized
tgtcacctagattttgcctt

SEQ ID NO: 222431 - DNA, 20 bp, Artificial Sequence
  chemically synthesized
gtgtcacctagattttgcct

SEQ ID NO: 222432 - DNA, 20 bp, Artificial Sequence
  chemically synthesized
gaaattcctaaggcaaaatc

SEQ ID NO: 222433 - DNA, 20 bp, Artificial Sequence
  chemically synthesized
aaattcctaaggcaaaatct

SEQ ID NO: 222434 - DNA, 20 bp, Artificial Sequence
  chemically synthesized
tcttctataattgtgtcacc

SEQ ID NO: 222435 - DNA, 20 bp, Artificial Sequence
  chemically synthesized
aaatctaggtgacacaatta

SEQ ID NO: 222436 - DNA, 20 bp, Artificial Sequence
  chemically synthesized
tctaggtgacacaattatag

SEQ ID NO: 222437 - DNA, 20 bp, Artificial Sequence
  chemically synthesized
tgcttgagggaaatcagttg

SEQ ID NO: 222438 - DNA, 20 bp, Artificial Sequence
  chemically synthesized
gaaatgtgcttgagggaaat

SEQ ID NO: 222439 - DNA, 20 bp, Artificial Sequence
  chemically synthesized
tgccgcaactgatttccctc

SEQ ID NO: 222440 - DNA, 20 bp, Artificial Sequence
  chemically synthesized
ggcaacagaaatgtgcttga

SEQ ID NO: 222441 - DNA, 20 bp, Artificial Sequence
  chemically synthesized
tggcaacagaaatgtgcttg

SEQ ID NO: 222442 - DNA, 20 bp, Artificial Sequence
  chemically synthesized
atggcaacagaaatgtgctt

SEQ ID NO: 222443 - DNA, 20 bp, Artificial Sequence
  chemically synthesized
caagcacatttctgttgcca

SEQ ID NO: 222444 - DNA, 20 bp, Artificial Sequence
  chemically synthesized
ttgagatgattctatggcaa

SEQ ID NO: 222445 - DNA, 20 bp, Artificial Sequence
  chemically synthesized
gcagatttgagatgattcta

SEQ ID NO: 222446 - DNA, 20 bp, Artificial Sequence
  chemically synthesized
gcttcaaagttggcagattt

SEQ ID NO: 222447 - DNA, 20 bp, Artificial Sequence
  chemically synthesized
gagttcagcttcaaagttgg

SEQ ID NO: 222448 - DNA, 20 bp, Artificial Sequence
  chemically synthesized
tctcaaatctgccaactttg

SEQ ID NO: 222449 - DNA, 20 bp, Artificial Sequence
  chemically synthesized
gaggagttcagcttcaaagt

SEQ ID NO: 222450 - DNA, 20 bp, Artificial Sequence
  chemically synthesized
tggagaggagttcagcttca

SEQ ID NO: 222451 - DNA, 20 bp, Artificial Sequence
  chemically synthesized
gagtggaatggagaggagtt

SEQ ID NO: 222452 - DNA, 20 bp, Artificial Sequence
  chemically synthesized
catatgagtggaatggagag

SEQ ID NO: 222453 - DNA, 20 bp, Artificial Sequence
  chemically synthesized
tccatatgagtggaatggag

SEQ ID NO: 222454 - DNA, 20 bp, Artificial Sequence
  chemically synthesized
atccatatgagtggaatgga

SEQ ID NO: 222455 - DNA, 20 bp, Artificial Sequence
  chemically synthesized
gaatccatatgagtggaatg

SEQ ID NO: 222456 - DNA, 20 bp, Artificial Sequence
  chemically synthesized
gagaatccatatgagtggaa

SEQ ID NO: 222457 - DNA, 20 bp, Artificial Sequence
  chemically synthesized
tcctctccattccactcata

SEQ ID NO: 222458 - DNA, 20 bp, Artificial Sequence
  chemically synthesized
catgtgagaatccatatgag

SEQ ID NO: 222459 - DNA, 20 bp, Artificial Sequence
  chemically synthesized
acccatgtgagaatccatat

SEQ ID NO: 222460 - DNA, 20 bp, Artificial Sequence
  chemically synthesized
cactcatatggattctcaca

SEQ ID NO: 222461 - DNA, 20 bp, Artificial Sequence
  chemically synthesized
actcatatggattctcacat

SEQ ID NO: 222462 - DNA, 20 bp, Artificial Sequence
  chemically synthesized
ttttctactaaaacccatgt

SEQ ID NO: 222463 - DNA, 20 bp, Artificial Sequence
  chemically synthesized
atggattctcacatgggttt

SEQ ID NO: 222464 - DNA, 20 bp, Artificial Sequence
  chemically synthesized
gattctcacatgggttttag

SEQ ID NO: 222465 - DNA, 20 bp, Artificial Sequence
  chemically synthesized
agtagaaaaatttaaactat

SEQ ID NO: 222466 - DNA, 20 bp, Artificial Sequence
  chemically synthesized
aaaatcagtccatgttctaa

SEQ ID NO: 222467 - DNA, 20 bp, Artificial Sequence
  chemically synthesized
aaatttaaactattagaaca

SEQ ID NO: 222468 - DNA, 20 bp, Artificial Sequence
  chemically synthesized
ttaataatccagagaaaaat

SEQ ID NO: 222469 - DNA, 20 bp, Artificial Sequence
  chemically synthesized
aacatggactgatttttctc

SEQ ID NO: 222470 - DNA, 20 bp, Artificial Sequence
  chemically synthesized
ccttctcatttaataatcca

SEQ ID NO: 222471 - DNA, 20 bp, Artificial Sequence
  chemically synthesized
acccttctcatttaataatc

SEQ ID NO: 222472 - DNA, 20 bp, Artificial Sequence
  chemically synthesized
ttttctctggattattaaat

SEQ ID NO: 222473 - DNA, 20 bp, Artificial Sequence
  chemically synthesized
tctctggattattaaatgag

SEQ ID NO: 222474 - DNA, 20 bp, Artificial Sequence
  chemically synthesized
ctctggattattaaatgaga

SEQ ID NO: 222475 - DNA, 20 bp, Artificial Sequence
  chemically synthesized
tctggattattaaatgagaa

SEQ ID NO: 222476 - DNA, 20 bp, Artificial Sequence
  chemically synthesized
attattaaatgagaagggtc

SEQ ID NO: 222477 - DNA, 20 bp, Artificial Sequence
  chemically synthesized
tagaaaagtaatggggaatc

SEQ ID NO: 222478 - DNA, 20 bp, Artificial Sequence
  chemically synthesized
ttttaattagaaaagtaatg

SEQ ID NO: 222479 - DNA, 20 bp, Artificial Sequence
  chemically synthesized
attttaattagaaaagtaat

SEQ ID NO: 222480 - DNA, 20 bp, Artificial Sequence
  chemically synthesized
tattttaattagaaaagtaa

SEQ ID NO: 222481 - DNA, 20 bp, Artificial Sequence
  chemically synthesized
tgatactattttaattagaa

SEQ ID NO: 222482 - DNA, 20 bp, Artificial Sequence
  chemically synthesized
cattacttttctaattaaaa

SEQ ID NO: 222483 - DNA, 20 bp, Artificial Sequence
  chemically synthesized
gcttttgatactattttaat

SEQ ID NO: 222484 - DNA, 20 bp, Artificial Sequence
  chemically synthesized
tctaattaaaatagtatcaa

SEQ ID NO: 222485 - DNA, 20 bp, Artificial Sequence
  chemically synthesized
ttaaaatagtatcaaaagca

SEQ ID NO: 222486 - DNA, 20 bp, Artificial Sequence
  chemically synthesized
agcaaagacaaaccaatcct

SEQ ID NO: 222487 - DNA, 20 bp, Artificial Sequence
  chemically synthesized
gtaatatacatgctgaggat

SEQ ID NO: 222488 - DNA, 20 bp, Artificial Sequence
  chemically synthesized
tctctgtaatatacatgctg

SEQ ID NO: 222489 - DNA, 20 bp, Artificial Sequence
  chemically synthesized
ttctctgtaatatacatgct

SEQ ID NO: 222490 - DNA, 20 bp, Artificial Sequence
  chemically synthesized
aatcctcagcatgtatatta

SEQ ID NO: 222491 - DNA, 20 bp, Artificial Sequence
  chemically synthesized
tcctcagcatgtatattaca

SEQ ID NO: 222492 - DNA, 20 bp, Artificial Sequence
  chemically synthesized
atattacagagaacctgtta

SEQ ID NO: 222493 - DNA, 20 bp, Artificial Sequence
  chemically synthesized
attacagagaacctgttaca

SEQ ID NO: 222494 - DNA, 20 bp, Artificial Sequence
  chemically synthesized
cttgataatgtctctgtaac

SEQ ID NO: 222495 - DNA, 20 bp, Artificial Sequence
  chemically synthesized
ccttgataatgtctctgtaa

SEQ ID NO: 222496 - DNA, 20 bp, Artificial Sequence
  chemically synthesized
cctgttacagagacattatc

SEQ ID NO: 222497 - DNA, 20 bp, Artificial Sequence
  chemically synthesized
ctgttacagagacattatca

SEQ ID NO: 222498 - DNA, 20 bp, Artificial Sequence
  chemically synthesized
cattatcaaggccatatttt

SEQ ID NO: 222499 - DNA, 20 bp, Artificial Sequence
  chemically synthesized
aagtaattttaccaaaaata

SEQ ID NO: 222500 - DNA, 20 bp, Artificial Sequence
  chemically synthesized
cttttattcaatcagatttt

SEQ ID NO: 222501 - DNA, 20 bp, Artificial Sequence
  chemically synthesized
agaggcaacttttattcaat

SEQ ID NO: 222502 - DNA, 20 bp, Artificial Sequence
  chemically synthesized
cttaaaatctgattgaataa

SEQ ID NO: 222503 - DNA, 20 bp, Artificial Sequence
  chemically synthesized
tattaatataaacgaattag

SEQ ID NO: 222504 - DNA, 20 bp, Artificial Sequence
  chemically synthesized
ctattaatataaacgaatta

SEQ ID NO: 222505 - DNA, 20 bp, Artificial Sequence
  chemically synthesized
tgctattaatataaacgaat

SEQ ID NO: 222506 - DNA, 20 bp, Artificial Sequence
  chemically synthesized
ctctaattcgtttatattaa

SEQ ID NO: 222507 - DNA, 20 bp, Artificial Sequence
  chemically synthesized
tttatattaatagcacttta

SEQ ID NO: 222508 - DNA, 20 bp, Artificial Sequence
  chemically synthesized
tatccgtatgtattacttta

SEQ ID NO: 222509 - DNA, 20 bp, Artificial Sequence
  chemically synthesized
gcactttaaagtaatacata

SEQ ID NO: 222510 - DNA, 20 bp, Artificial Sequence
  chemically synthesized
catacggatacaactttaaa

SEQ ID NO: 222511 - DNA, 20 bp, Artificial Sequence
  chemically synthesized
agataaatcccaacttttta

SEQ ID NO: 222512 - DNA, 20 bp, Artificial Sequence
  chemically synthesized
cggatacaactttaaaaagt

SEQ ID NO: 222513 - DNA, 20 bp, Artificial Sequence
  chemically synthesized
ggatacaactttaaaaagtt

SEQ ID NO: 222514 - DNA, 20 bp, Artificial Sequence
  chemically synthesized
ttttaacaggacataataat

SEQ ID NO: 222515 - DNA, 20 bp, Artificial Sequence
  chemically synthesized
ccttataagcgtattttaac

SEQ ID NO: 222516 - DNA, 20 bp, Artificial Sequence
  chemically synthesized
tccttataagcgtattttaa

SEQ ID NO: 222517 - DNA, 20 bp, Artificial Sequence
  chemically synthesized
tcctgttaaaatacgcttat

SEQ ID NO: 222518 - DNA, 20 bp, Artificial Sequence
  chemically synthesized
cctgttaaaatacgcttata

SEQ ID NO: 222519 - DNA, 20 bp, Artificial Sequence
  chemically synthesized
gttaaaatacgcttataagg

SEQ ID NO: 222520 - DNA, 20 bp, Artificial Sequence
  chemically synthesized
ctctttttggtcttccttat

SEQ ID NO: 222521 - DNA, 20 bp, Artificial Sequence
  chemically synthesized
cgcttataaggaagaccaaa

SEQ ID NO: 222522 - DNA, 20 bp, Artificial Sequence
  chemically synthesized
cttataaggaagaccaaaaa

SEQ ID NO: 222523 - DNA, 20 bp, Artificial Sequence
  chemically synthesized
cctcatcagtgtactctttt

SEQ ID NO: 222524 - DNA, 20 bp, Artificial Sequence
  chemically synthesized
accaaaaagagtacactgat

SEQ ID NO: 222525 - DNA, 20 bp, Artificial Sequence
  chemically synthesized
ccaaaaagagtacactgatg

SEQ ID NO: 222526 - DNA, 20 bp, Artificial Sequence
  chemically synthesized
attttctcaaagatcctcat

SEQ ID NO: 222527 - DNA, 20 bp, Artificial Sequence
  chemically synthesized
gtacactgatgaggatcttt

SEQ ID NO: 222528 - DNA, 20 bp, Artificial Sequence
  chemically synthesized
tttcatttttaattttctca

SEQ ID NO: 222529 - DNA, 20 bp, Artificial Sequence
  chemically synthesized
aataataaataaaattgtca

SEQ ID NO: 222530 - DNA, 20 bp, Artificial Sequence
  chemically synthesized
ataaaattgtcatggctaaa

SEQ ID NO: 222531 - DNA, 20 bp, Artificial Sequence
  chemically synthesized
tgaagactaaatatgctttt

SEQ ID NO: 222532 - DNA, 20 bp, Artificial Sequence
  chemically synthesized
tcatggctaaaaagcatatt

SEQ ID NO: 222533 - DNA, 20 bp, Artificial Sequence
  chemically synthesized
cataatagtttaacatcatg

SEQ ID NO: 222534 - DNA, 20 bp, Artificial Sequence
  chemically synthesized
gtccttgcctaattgcataa

SEQ ID NO: 222535 - DNA, 20 bp, Artificial Sequence
  chemically synthesized
atgttaaactattatgcaat

SEQ ID NO: 222536 - DNA, 20 bp, Artificial Sequence
  chemically synthesized
tgttaaactattatgcaatt

SEQ ID NO: 222537 - DNA, 20 bp, Artificial Sequence
  chemically synthesized
aaactattatgcaattaggc

SEQ ID NO: 222538 - DNA, 20 bp, Artificial Sequence
  chemically synthesized
aactattatgcaattaggca

SEQ ID NO: 222539 - DNA, 20 bp, Artificial Sequence
  chemically synthesized
gaattttatttttgaaagac

SEQ ID NO: 222540 - DNA, 20 bp, Artificial Sequence
  chemically synthesized
cccgtgaattttatttttga

SEQ ID NO: 222541 - DNA, 20 bp, Artificial Sequence
  chemically synthesized
tctttcaaaaataaaattca

SEQ ID NO: 222542 - DNA, 20 bp, Artificial Sequence
  chemically synthesized
ctttcaaaaataaaattcac

SEQ ID NO: 222543 - DNA, 20 bp, Artificial Sequence
  chemically synthesized
caaaaataaaattcacgggc

SEQ ID NO: 222544 - DNA, 20 bp, Artificial Sequence
  chemically synthesized
aaaaataaaattcacgggct

SEQ ID NO: 222545 - DNA, 20 bp, Artificial Sequence
  chemically synthesized
taaaattcacgggctgggcg

SEQ ID NO: 222546 - DNA, 20 bp, Artificial Sequence
  chemically synthesized
aattcacgggctgggcgcgg

SEQ ID NO: 222547 - DNA, 20 bp, Artificial Sequence
  chemically synthesized
cagacgtgagccaccgcgcc

SEQ ID NO: 222548 - DNA, 20 bp, Artificial Sequence
  chemically synthesized
tgggcgcggtggctcacgtc

SEQ ID NO: 222549 - DNA, 20 bp, Artificial Sequence
  chemically synthesized
agcactggaattccagacgt

SEQ ID NO: 222550 - DNA, 20 bp, Artificial Sequence
  chemically synthesized
gtggctcacgtctggaattc

SEQ ID NO: 222551 - DNA, 20 bp, Artificial Sequence
  chemically synthesized
ttcccaaagcactggaattc

SEQ ID NO: 222552 - DNA, 20 bp, Artificial Sequence
  chemically synthesized
cgtctggaattccagtgctt

SEQ ID NO: 222553 - DNA, 20 bp, Artificial Sequence
  chemically synthesized
gtctggaattccagtgcttt

SEQ ID NO: 222554 - DNA, 20 bp, Artificial Sequence
  chemically synthesized
tcctcagcttcccaaagcac

SEQ ID NO: 222555 - DNA, 20 bp, Artificial Sequence
  chemically synthesized
tggaattccagtgctttggg

SEQ ID NO: 222556 - DNA, 20 bp, Artificial Sequence
  chemically synthesized
ccaccctcctcagcttccca

SEQ ID NO: 222557 - DNA, 20 bp, Artificial Sequence
  chemically synthesized
ttccagtgctttgggaagct

SEQ ID NO: 222558 - DNA, 20 bp, Artificial Sequence
  chemically synthesized
tccagtgctttgggaagctg

SEQ ID NO: 222559 - DNA, 20 bp, Artificial Sequence
  chemically synthesized
cagtgctttgggaagctgag

SEQ ID NO: 222560 - DNA, 20 bp, Artificial Sequence
  chemically synthesized
agtgctttgggaagctgagg

SEQ ID NO: 222561 - DNA, 20 bp, Artificial Sequence
  chemically synthesized
gtgctttgggaagctgagga

SEQ ID NO: 222562 - DNA, 20 bp, Artificial Sequence
  chemically synthesized
ctttgggaagctgaggaggg

SEQ ID NO: 222563 - DNA, 20 bp, Artificial Sequence
  chemically synthesized
ctcaggtgatccaccctcct

SEQ ID NO: 222564 - DNA, 20 bp, Artificial Sequence
  chemically synthesized
ctgaggagggtggatcacct

SEQ ID NO: 222565 - DNA, 20 bp, Artificial Sequence
  chemically synthesized
tgaggagggtggatcacctg

SEQ ID NO: 222566 - DNA, 20 bp, Artificial Sequence
  chemically synthesized
gagggtggatcacctgaggt

SEQ ID NO: 222567 - DNA, 20 bp, Artificial Sequence
  chemically synthesized
agggtggatcacctgaggtc

SEQ ID NO: 222568 - DNA, 20 bp, Artificial Sequence
  chemically synthesized
ggtctcgaactcctgacctc

SEQ ID NO: 222569 - DNA, 20 bp, Artificial Sequence
  chemically synthesized
ggtggatcacctgaggtcag

SEQ ID NO: 222570 - DNA, 20 bp, Artificial Sequence
  chemically synthesized
tggtctcgaactcctgacct

SEQ ID NO: 222571 - DNA, 20 bp, Artificial Sequence
  chemically synthesized
tcacctgaggtcaggagttc

SEQ ID NO: 222572 - DNA, 20 bp, Artificial Sequence
  chemically synthesized
tgaggtcaggagttcgagac

SEQ ID NO: 222573 - DNA, 20 bp, Artificial Sequence
  chemically synthesized
tcaggagttcgagaccagcc

SEQ ID NO: 222574 - DNA, 20 bp, Artificial Sequence
  chemically synthesized
gttcaccatgttggccaggc

SEQ ID NO: 222575 - DNA, 20 bp, Artificial Sequence
  chemically synthesized
aggggttcaccatgttggcc

SEQ ID NO: 222576 - DNA, 20 bp, Artificial Sequence
  chemically synthesized
cgagaccagcctggccaaca

SEQ ID NO: 222577 - DNA, 20 bp, Artificial Sequence
  chemically synthesized
caggggttcaccatgttggc

SEQ ID NO: 222578 - DNA, 20 bp, Artificial Sequence
  chemically synthesized
gagacaggggttcaccatgt

SEQ ID NO: 222579 - DNA, 20 bp, Artificial Sequence
  chemically synthesized
tgtatttttagtagagacag

SEQ ID NO: 222580 - DNA, 20 bp, Artificial Sequence
  chemically synthesized
ttgtatttttagtagagaca

SEQ ID NO: 222581 - DNA, 20 bp, Artificial Sequence
  chemically synthesized
tttgtatttttagtagagac

SEQ ID NO: 222582 - DNA, 20 bp, Artificial Sequence
  chemically synthesized
ttttgtatttttagtagaga

SEQ ID NO: 222583 - DNA, 20 bp, Artificial Sequence
  chemically synthesized
aattttttgtatttttagta

SEQ ID NO: 222584 - DNA, 20 bp, Artificial Sequence
  chemically synthesized
ctaattttttgtatttttag

SEQ ID NO: 222585 - DNA, 20 bp, Artificial Sequence
  chemically synthesized
tggctaattttttgtatttt

SEQ ID NO: 222586 - DNA, 20 bp, Artificial Sequence
  chemically synthesized
ctactaaaaatacaaaaaat

SEQ ID NO: 222587 - DNA, 20 bp, Artificial Sequence
  chemically synthesized
taaaaatacaaaaaattagc

SEQ ID NO: 222588 - DNA, 20 bp, Artificial Sequence
  chemically synthesized
aaaaatacaaaaaattagcc

SEQ ID NO: 222589 - DNA, 20 bp, Artificial Sequence
  chemically synthesized
tacaaaaaattagccaggcg

SEQ ID NO: 222590 - DNA, 20 bp, Artificial Sequence
  chemically synthesized
aaaaaattagccaggcgtgg

SEQ ID NO: 222591 - DNA, 20 bp, Artificial Sequence
  chemically synthesized
cagatgtgcaccaccacgcc

SEQ ID NO: 222592 - DNA, 20 bp, Artificial Sequence
  chemically synthesized
gtggtgcacatctgtaatcc

SEQ ID NO: 222593 - DNA, 20 bp, Artificial Sequence
  chemically synthesized
ctccctagtagctgggatta

SEQ ID NO: 222594 - DNA, 20 bp, Artificial Sequence
  chemically synthesized
acatctgtaatcccagctac

SEQ ID NO: 222595 - DNA, 20 bp, Artificial Sequence
  chemically synthesized
catctgtaatcccagctact

SEQ ID NO: 222596 - DNA, 20 bp, Artificial Sequence
  chemically synthesized
cctcagcctccctagtagct

SEQ ID NO: 222597 - DNA, 20 bp, Artificial Sequence
  chemically synthesized
atctgtaatcccagctacta

SEQ ID NO: 222598 - DNA, 20 bp, Artificial Sequence
  chemically synthesized
gcctcagcctccctagtagc

SEQ ID NO: 222599 - DNA, 20 bp, Artificial Sequence
  chemically synthesized
ctgtaatcccagctactagg

SEQ ID NO: 222600 - DNA, 20 bp, Artificial Sequence
  chemically synthesized
tgtaatcccagctactaggg

SEQ ID NO: 222601 - DNA, 20 bp, Artificial Sequence
  chemically synthesized
tcctgcctcagcctccctag

SEQ ID NO: 222602 - DNA, 20 bp, Artificial Sequence
  chemically synthesized
ttctcctgcctcagcctccc

SEQ ID NO: 222603 - DNA, 20 bp, Artificial Sequence
  chemically synthesized
tcccagctactagggaggct

SEQ ID NO: 222604 - DNA, 20 bp, Artificial Sequence
  chemically synthesized
cccagctactagggaggctg

SEQ ID NO: 222605 - DNA, 20 bp, Artificial Sequence
  chemically synthesized
agctactagggaggctgagg

SEQ ID NO: 222606 - DNA, 20 bp, Artificial Sequence
  chemically synthesized
gctactagggaggctgaggc

SEQ ID NO: 222607 - DNA, 20 bp, Artificial Sequence
  chemically synthesized
tactagggaggctgaggcag

SEQ ID NO: 222608 - DNA, 20 bp, Artificial Sequence
  chemically synthesized
ttcaagcgattctcctgcct

SEQ ID NO: 222609 - DNA, 20 bp, Artificial Sequence
  chemically synthesized
gcaggagaatcgcttgaacc

SEQ ID NO: 222610 - DNA, 20 bp, Artificial Sequence
  chemically synthesized
caggagaatcgcttgaacct

SEQ ID NO: 222611 - DNA, 20 bp, Artificial Sequence
  chemically synthesized
aacctctaccacccaggttc

SEQ ID NO: 222612 - DNA, 20 bp, Artificial Sequence
  chemically synthesized
gagaatcgcttgaacctggg

SEQ ID NO: 222613 - DNA, 20 bp, Artificial Sequence
  chemically synthesized
aatcgcttgaacctgggtgg

SEQ ID NO: 222614 - DNA, 20 bp, Artificial Sequence
  chemically synthesized
caccacaacctctaccaccc

SEQ ID NO: 222615 - DNA, 20 bp, Artificial Sequence
  chemically synthesized
tcgcttgaacctgggtggta

SEQ ID NO: 222616 - DNA, 20 bp, Artificial Sequence
  chemically synthesized
tcaccacaacctctaccacc

SEQ ID NO: 222617 - DNA, 20 bp, Artificial Sequence
  chemically synthesized
cgcttgaacctgggtggtag

SEQ ID NO: 222618 - DNA, 20 bp, Artificial Sequence
  chemically synthesized
aacctgggtggtagaggttg

SEQ ID NO: 222619 - DNA, 20 bp, Artificial Sequence
  chemically synthesized
tgggtggtagaggttgtggt

SEQ ID NO: 222620 - DNA, 20 bp, Artificial Sequence
  chemically synthesized
ggtagaggttgtggtgagcc

SEQ ID NO: 222621 - DNA, 20 bp, Artificial Sequence
  chemically synthesized
ggggtgcaatggtgcgatct

SEQ ID NO: 222622 - DNA, 20 bp, Artificial Sequence
  chemically synthesized
ttgcccaggctggggtgcaa

SEQ ID NO: 222623 - DNA, 20 bp, Artificial Sequence
  chemically synthesized
gagatcgcaccattgcaccc

SEQ ID NO: 222624 - DNA, 20 bp, Artificial Sequence
  chemically synthesized
cgcaccattgcaccccagcc

SEQ ID NO: 222625 - DNA, 20 bp, Artificial Sequence
  chemically synthesized
gcaccattgcaccccagcct

SEQ ID NO: 222626 - DNA, 20 bp, Artificial Sequence
  chemically synthesized
cactcttgttgcccaggctg

SEQ ID NO: 222627 - DNA, 20 bp, Artificial Sequence
  chemically synthesized
tcactcttgttgcccaggct

SEQ ID NO: 222628 - DNA, 20 bp, Artificial Sequence
  chemically synthesized
ttcactcttgttgcccaggc

SEQ ID NO: 222629 - DNA, 20 bp, Artificial Sequence
  chemically synthesized
tgcaccccagcctgggcaac

SEQ ID NO: 222630 - DNA, 20 bp, Artificial Sequence
  chemically synthesized
gtgtttcactcttgttgccc

SEQ ID NO: 222631 - DNA, 20 bp, Artificial Sequence
  chemically synthesized
ggtgtttcactcttgttgcc

SEQ ID NO: 222632 - DNA, 20 bp, Artificial Sequence
  chemically synthesized
caccccagcctgggcaacaa

SEQ ID NO: 222633 - DNA, 20 bp, Artificial Sequence
  chemically synthesized
gattgactgattcattgaga

SEQ ID NO: 222634 - DNA, 20 bp, Artificial Sequence
  chemically synthesized
gaaacaccgtctcaatgaat

SEQ ID NO: 222635 - DNA, 20 bp, Artificial Sequence
  chemically synthesized
gattgattgactgattcatt

SEQ ID NO: 222636 - DNA, 20 bp, Artificial Sequence
  chemically synthesized
ctttcaaaaaatagatttca

SEQ ID NO: 222637 - DNA, 20 bp, Artificial Sequence
  chemically synthesized
gattatatactttcaaaaaa

SEQ ID NO: 222638 - DNA, 20 bp, Artificial Sequence
  chemically synthesized
ctttgaaatctattttttga

SEQ ID NO: 222639 - DNA, 20 bp, Artificial Sequence
  chemically synthesized
tagccagtgagggttttgtt

SEQ ID NO: 222640 - DNA, 20 bp, Artificial Sequence
  chemically synthesized
aaaccaaacaaaaccctcac

SEQ ID NO: 222641 - DNA, 20 bp, Artificial Sequence
  chemically synthesized
catgttgttttagccagtga

SEQ ID NO: 222642 - DNA, 20 bp, Artificial Sequence
  chemically synthesized
tcatgttgttttagccagtg

SEQ ID NO: 222643 - DNA, 20 bp, Artificial Sequence
  chemically synthesized
atcatgttgttttagccagt

SEQ ID NO: 222644 - DNA, 20 bp, Artificial Sequence
  chemically synthesized
ttccatcatgttgttttagc

SEQ ID NO: 222645 - DNA, 20 bp, Artificial Sequence
  chemically synthesized
atgtttccatcatgttgttt

SEQ ID NO: 222646 - DNA, 20 bp, Artificial Sequence
  chemically synthesized
cactggctaaaacaacatga

SEQ ID NO: 222647 - DNA, 20 bp, Artificial Sequence
  chemically synthesized
acaacatgatggaaacataa

SEQ ID NO: 222648 - DNA, 20 bp, Artificial Sequence
  chemically synthesized
atggaaacataaaagtgaca

SEQ ID NO: 222649 - DNA, 20 bp, Artificial Sequence
  chemically synthesized
acataaaagtgacaaagttt

SEQ ID NO: 222650 - DNA, 20 bp, Artificial Sequence
  chemically synthesized
aacttacatacatgtgtcat

SEQ ID NO: 222651 - DNA, 20 bp, Artificial Sequence
  chemically synthesized
taacttacatacatgtgtca

SEQ ID NO: 222652 - DNA, 20 bp, Artificial Sequence
  chemically synthesized
gacccatgacacatgtatgt

SEQ ID NO: 222653 - DNA, 20 bp, Artificial Sequence
  chemically synthesized
atgtatgtaagttatttcaa

SEQ ID NO: 222654 - DNA, 20 bp, Artificial Sequence
  chemically synthesized
gtatgtaagttatttcaaaa

SEQ ID NO: 222655 - DNA, 20 bp, Artificial Sequence
  chemically synthesized
atttcaaaagagatcactgt

SEQ ID NO: 222656 - DNA, 20 bp, Artificial Sequence
  chemically synthesized
cacttccagcaaatttctaa

SEQ ID NO: 222657 - DNA, 20 bp, Artificial Sequence
  chemically synthesized
gatcactgttagaaatttgc

SEQ ID NO: 222658 - DNA, 20 bp, Artificial Sequence
  chemically synthesized
cactgttagaaatttgctgg

SEQ ID NO: 222659 - DNA, 20 bp, Artificial Sequence
  chemically synthesized
cacagtaacaaaaacacttc

SEQ ID NO: 222660 - DNA, 20 bp, Artificial Sequence
  chemically synthesized
aaaaattgtgttattattca

SEQ ID NO: 222661 - DNA, 20 bp, Artificial Sequence
  chemically synthesized
ttgtaatttgcaatacatca

SEQ ID NO: 222662 - DNA, 20 bp, Artificial Sequence
  chemically synthesized
atttgcaatacatcatagat

SEQ ID NO: 222663 - DNA, 20 bp, Artificial Sequence
  chemically synthesized
tttgcaatacatcatagata

SEQ ID NO: 222664 - DNA, 20 bp, Artificial Sequence
  chemically synthesized
acacacataaacattgtgaa

SEQ ID NO: 222665 - DNA, 20 bp, Artificial Sequence
  chemically synthesized
cacataaacattgtgaatag

SEQ ID NO: 222666 - DNA, 20 bp, Artificial Sequence
  chemically synthesized
gtgaatagtggtaacacatt

SEQ ID NO: 222667 - DNA, 20 bp, Artificial Sequence
  chemically synthesized
gtggtaacacattcagttat

SEQ ID NO: 222668 - DNA, 20 bp, Artificial Sequence
  chemically synthesized
tggtaacacattcagttatt

SEQ ID NO: 222669 - DNA, 20 bp, Artificial Sequence
  chemically synthesized
ggtaacacattcagttattg

SEQ ID NO: 222670 - DNA, 20 bp, Artificial Sequence
  chemically synthesized
acccaggcatattatagtga

SEQ ID NO: 222671 - DNA, 20 bp, Artificial Sequence
  chemically synthesized
aggcacacccaggcatatta

SEQ ID NO: 222672 - DNA, 20 bp, Artificial Sequence
  chemically synthesized
ggctttcactataatatgcc

SEQ ID NO: 222673 - DNA, 20 bp, Artificial Sequence
  chemically synthesized
gctttcactataatatgcct

SEQ ID NO: 222674 - DNA, 20 bp, Artificial Sequence
  chemically synthesized
catccgttggaggcacaccc

SEQ ID NO: 222675 - DNA, 20 bp, Artificial Sequence
  chemically synthesized
gcatccgttggaggcacacc

SEQ ID NO: 222676 - DNA, 20 bp, Artificial Sequence
  chemically synthesized
atgcctgggtgtgcctccaa

SEQ ID NO: 222677 - DNA, 20 bp, Artificial Sequence
  chemically synthesized
ctaaatttagcatccgttgg

SEQ ID NO: 222678 - DNA, 20 bp, Artificial Sequence
  chemically synthesized
actaaatttagcatccgttg

SEQ ID NO: 222679 - DNA, 20 bp, Artificial Sequence
  chemically synthesized
gcactaaatttagcatccgt

SEQ ID NO: 222680 - DNA, 20 bp, Artificial Sequence
  chemically synthesized
cctccaacggatgctaaatt

SEQ ID NO: 222681 - DNA, 20 bp, Artificial Sequence
  chemically synthesized
gacttcaaatgcactaaatt

SEQ ID NO: 222682 - DNA, 20 bp, Artificial Sequence
  chemically synthesized
tgctaaatttagtgcatttg

SEQ ID NO: 222683 - DNA, 20 bp, Artificial Sequence
  chemically synthesized
ttagtgcatttgaagtctct

SEQ ID NO: 222684 - DNA, 20 bp, Artificial Sequence
  chemically synthesized
ttgggactgtttttttccaa

SEQ ID NO: 222685 - DNA, 20 bp, Artificial Sequence
  chemically synthesized
ccttgggactgtttttttcc

SEQ ID NO: 222686 - DNA, 20 bp, Artificial Sequence
  chemically synthesized
tgaagtctcttggaaaaaaa

SEQ ID NO: 222687 - DNA, 20 bp, Artificial Sequence
  chemically synthesized
tcttggaaaaaaacagtccc

SEQ ID NO: 222688 - DNA, 20 bp, Artificial Sequence
  chemically synthesized
cttggaaaaaaacagtccca

SEQ ID NO: 222689 - DNA, 20 bp, Artificial Sequence
  chemically synthesized
tggaaaaaaacagtcccaag

SEQ ID NO: 222690 - DNA, 20 bp, Artificial Sequence
  chemically synthesized
ccttccctttcaaactcctt

SEQ ID NO: 222691 - DNA, 20 bp, Artificial Sequence
  chemically synthesized
accttccctttcaaactcct

SEQ ID NO: 222692 - DNA, 20 bp, Artificial Sequence
  chemically synthesized
aacagtcccaaggagtttga

SEQ ID NO: 222693 - DNA, 20 bp, Artificial Sequence
  chemically synthesized
acagtcccaaggagtttgaa

SEQ ID NO: 222694 - DNA, 20 bp, Artificial Sequence
  chemically synthesized
cagtcccaaggagtttgaaa

SEQ ID NO: 222695 - DNA, 20 bp, Artificial Sequence
  chemically synthesized
tcccaaggagtttgaaaggg

SEQ ID NO: 222696 - DNA, 20 bp, Artificial Sequence
  chemically synthesized
cccaaggagtttgaaaggga

SEQ ID NO: 222697 - DNA, 20 bp, Artificial Sequence
  chemically synthesized
tttgaaagggaaggtgtttt

SEQ ID NO: 222698 - DNA, 20 bp, Artificial Sequence
  chemically synthesized
aagggaaggtgttttaagtt

SEQ ID NO: 222699 - DNA, 20 bp, Artificial Sequence
  chemically synthesized
aaggtgttttaagttcagca

SEQ ID NO: 222700 - DNA, 20 bp, Artificial Sequence
  chemically synthesized
tcagcacagcatgctccttg

SEQ ID NO: 222701 - DNA, 20 bp, Artificial Sequence
  chemically synthesized
gcacagcatgctccttgcag

SEQ ID NO: 222702 - DNA, 20 bp, Artificial Sequence
  chemically synthesized
gacacatttgctgctgcaag

SEQ ID NO: 222703 - DNA, 20 bp, Artificial Sequence
  chemically synthesized
cagacacatttgctgctgca

SEQ ID NO: 222704 - DNA, 20 bp, Artificial Sequence
  chemically synthesized
tcagacacatttgctgctgc

SEQ ID NO: 222705 - DNA, 20 bp, Artificial Sequence
  chemically synthesized
gcagcagcaaatgtgtctga

SEQ ID NO: 222706 - DNA, 20 bp, Artificial Sequence
  chemically synthesized
gcaacagagcaagaagcttt

SEQ ID NO: 222707 - DNA, 20 bp, Artificial Sequence
  chemically synthesized
tcacagtgcaacagagcaag

SEQ ID NO: 222708 - DNA, 20 bp, Artificial Sequence
  chemically synthesized
ctctcacagtgcaacagagc

SEQ ID NO: 222709 - DNA, 20 bp, Artificial Sequence
  chemically synthesized
agttctctcacagtgcaaca

SEQ ID NO: 222710 - DNA, 20 bp, Artificial Sequence
  chemically synthesized
atagttctctcacagtgcaa

SEQ ID NO: 222711 - DNA, 20 bp, Artificial Sequence
  chemically synthesized
ttcttgctctgttgcactgt

SEQ ID NO: 222712 - DNA, 20 bp, Artificial Sequence
  chemically synthesized
cttgctctgttgcactgtga

SEQ ID NO: 222713 - DNA, 20 bp, Artificial Sequence
  chemically synthesized
attttaatatagttctctca

SEQ ID NO: 222714 - DNA, 20 bp, Artificial Sequence
  chemically synthesized
actattaacacattttaata

SEQ ID NO: 222715 - DNA, 20 bp, Artificial Sequence
  chemically synthesized
actatattaaaatgtgttaa

SEQ ID NO: 222716 - DNA, 20 bp, Artificial Sequence
  chemically synthesized
atattaaaatgtgttaatag

SEQ ID NO: 222717 - DNA, 20 bp, Artificial Sequence
  chemically synthesized
taaaatgtgttaatagtaga

SEQ ID NO: 222718 - DNA, 20 bp, Artificial Sequence
  chemically synthesized
gtgttaatagtagaaagaat

SEQ ID NO: 222719 - DNA, 20 bp, Artificial Sequence
  chemically synthesized
tcaaggaaatatagtatttg

SEQ ID NO: 222720 - DNA, 20 bp, Artificial Sequence
  chemically synthesized
atcaaggaaatatagtattt

SEQ ID NO: 222721 - DNA, 20 bp, Artificial Sequence
  chemically synthesized
tctcaaaaatcaaggaaata

SEQ ID NO: 222722 - DNA, 20 bp, Artificial Sequence
  chemically synthesized
cactgttgtctcaaaaatca

SEQ ID NO: 222723 - DNA, 20 bp, Artificial Sequence
  chemically synthesized
actatatttccttgattttt

SEQ ID NO: 222724 - DNA, 20 bp, Artificial Sequence
  chemically synthesized
tcactgttgtctcaaaaatc

SEQ ID NO: 222725 - DNA, 20 bp, Artificial Sequence
  chemically synthesized
ttccttgatttttgagacaa

SEQ ID NO: 222726 - DNA, 20 bp, Artificial Sequence
  chemically synthesized
ctctataatttttaacatac

SEQ ID NO: 222727 - DNA, 20 bp, Artificial Sequence
  chemically synthesized
tctctataatttttaacata

SEQ ID NO: 222728 - DNA, 20 bp, Artificial Sequence
  chemically synthesized
ttcctgtatgttaaaaatta

SEQ ID NO: 222729 - DNA, 20 bp, Artificial Sequence
  chemically synthesized
cctgtatgttaaaaattata

SEQ ID NO: 222730 - DNA, 20 bp, Artificial Sequence
  chemically synthesized
tgtatgttaaaaattataga

SEQ ID NO: 222731 - DNA, 20 bp, Artificial Sequence
  chemically synthesized
aaattatagagagcaaaata

SEQ ID NO: 222732 - DNA, 20 bp, Artificial Sequence
  chemically synthesized
gataataaattagcgtgaaa

SEQ ID NO: 222733 - DNA, 20 bp, Artificial Sequence
  chemically synthesized
ttcacatggagataataaat

SEQ ID NO: 222734 - DNA, 20 bp, Artificial Sequence
  chemically synthesized
tgtaaatgcacattcacatg

SEQ ID NO: 222735 - DNA, 20 bp, Artificial Sequence
  chemically synthesized
aatgtaaatgcacattcaca

SEQ ID NO: 222736 - DNA, 20 bp, Artificial Sequence
  chemically synthesized
gtgaatgtgcatttacattt

SEQ ID NO: 222737 - DNA, 20 bp, Artificial Sequence
  chemically synthesized
tttacattttagataatata

SEQ ID NO: 222738 - DNA, 20 bp, Artificial Sequence
  chemically synthesized
ttttaaggcttataattcac

SEQ ID NO: 222739 - DNA, 20 bp, Artificial Sequence
  chemically synthesized
atagattacttgtgaattat

SEQ ID NO: 222740 - DNA, 20 bp, Artificial Sequence
  chemically synthesized
acatgtttgaattcatttta

SEQ ID NO: 222741 - DNA, 20 bp, Artificial Sequence
  chemically synthesized
gacatgtttgaattcatttt

SEQ ID NO: 222742 - DNA, 20 bp, Artificial Sequence
  chemically synthesized
taaaatgaattcaaacatgt

SEQ ID NO: 222743 - DNA, 20 bp, Artificial Sequence
  chemically synthesized
aatgaattcaaacatgtcag

SEQ ID NO: 222744 - DNA, 20 bp, Artificial Sequence
  chemically synthesized
atgaattcaaacatgtcagt

SEQ ID NO: 222745 - DNA, 20 bp, Artificial Sequence
  chemically synthesized
aattcaaacatgtcagtagg

SEQ ID NO: 222746 - DNA, 20 bp, Artificial Sequence
  chemically synthesized
tcaaacatgtcagtaggaag

SEQ ID NO: 222747 - DNA, 20 bp, Artificial Sequence
  chemically synthesized
ttcaagaatctgtaatatgg

SEQ ID NO: 222748 - DNA, 20 bp, Artificial Sequence
  chemically synthesized
aggaagaagctaccatatta

SEQ ID NO: 222749 - DNA, 20 bp, Artificial Sequence
  chemically synthesized
attttcaagaatctgtaata

SEQ ID NO: 222750 - DNA, 20 bp, Artificial Sequence
  chemically synthesized
aatttcaatttgtgattttc

SEQ ID NO: 222751 - DNA, 20 bp, Artificial Sequence
  chemically synthesized
taaattataatcatatcatt

SEQ ID NO: 222752 - DNA, 20 bp, Artificial Sequence
  chemically synthesized
ttaaattataatcatatcat

SEQ ID NO: 222753 - DNA, 20 bp, Artificial Sequence
  chemically synthesized
atatgattataatttaatac

SEQ ID NO: 222754 - DNA, 20 bp, Artificial Sequence
  chemically synthesized
ataatttaatactagtatca

SEQ ID NO: 222755 - DNA, 20 bp, Artificial Sequence
  chemically synthesized
taatttaatactagtatcaa

SEQ ID NO: 222756 - DNA, 20 bp, Artificial Sequence
  chemically synthesized
aggaaaaatacctttgatac

SEQ ID NO: 222757 - DNA, 20 bp, Artificial Sequence
  chemically synthesized
aattagtaaaataaaataat

SEQ ID NO: 222758 - DNA, 20 bp, Artificial Sequence
  chemically synthesized
taattagtaaaataaaataa

SEQ ID NO: 222759 - DNA, 20 bp, Artificial Sequence
  chemically synthesized
taccgatagtttacagtaat

SEQ ID NO: 222760 - DNA, 20 bp, Artificial Sequence
  chemically synthesized
ataatcctaccgatagttta

SEQ ID NO: 222761 - DNA, 20 bp, Artificial Sequence
  chemically synthesized
tactaattactgtaaactat

SEQ ID NO: 222762 - DNA, 20 bp, Artificial Sequence
  chemically synthesized
taattactgtaaactatcgg

SEQ ID NO: 222763 - DNA, 20 bp, Artificial Sequence
  chemically synthesized
aattactgtaaactatcggt

SEQ ID NO: 222764 - DNA, 20 bp, Artificial Sequence
  chemically synthesized
tgctcctataatcctaccga

SEQ ID NO: 222765 - DNA, 20 bp, Artificial Sequence
  chemically synthesized
gtaaactatcggtaggatta

SEQ ID NO: 222766 - DNA, 20 bp, Artificial Sequence
  chemically synthesized
taaactatcggtaggattat

SEQ ID NO: 222767 - DNA, 20 bp, Artificial Sequence
  chemically synthesized
aactatcggtaggattatag

SEQ ID NO: 222768 - DNA, 20 bp, Artificial Sequence
  chemically synthesized
atcggtaggattataggagc

SEQ ID NO: 222769 - DNA, 20 bp, Artificial Sequence
  chemically synthesized
gattataggagcaagacgtc

SEQ ID NO: 222770 - DNA, 20 bp, Artificial Sequence
  chemically synthesized
cttccaataaaaaattagta

SEQ ID NO: 222771 - DNA, 20 bp, Artificial Sequence
  chemically synthesized
tatggcttccaataaaaaat

SEQ ID NO: 222772 - DNA, 20 bp, Artificial Sequence
  chemically synthesized
taaccatactaattttttat

SEQ ID NO: 222773 - DNA, 20 bp, Artificial Sequence
  chemically synthesized
ccatactaattttttattgg

SEQ ID NO: 222774 - DNA, 20 bp, Artificial Sequence
  chemically synthesized
tttacaggttaaatttaata

SEQ ID NO: 222775 - DNA, 20 bp, Artificial Sequence
  chemically synthesized
ttaaatttaacctgtaaaat

SEQ ID NO: 222776 - DNA, 20 bp, Artificial Sequence
  chemically synthesized
ttttatttttctcattttac

SEQ ID NO: 222777 - DNA, 20 bp, Artificial Sequence
  chemically synthesized
tttttatttttctcatttta

SEQ ID NO: 222778 - DNA, 20 bp, Artificial Sequence
  chemically synthesized
taaaatgagaaaaataaaaa

SEQ ID NO: 222779 - DNA, 20 bp, Artificial Sequence
  chemically synthesized
aaataaaaatagtaacctca

SEQ ID NO: 222780 - DNA, 20 bp, Artificial Sequence
  chemically synthesized
gactcttaccacaatctatg

SEQ ID NO: 222781 - DNA, 20 bp, Artificial Sequence
  chemically synthesized
tgactcttaccacaatctat

SEQ ID NO: 222782 - DNA, 20 bp, Artificial Sequence
  chemically synthesized
aatagtaacctcatagattg

SEQ ID NO: 222783 - DNA, 20 bp, Artificial Sequence
  chemically synthesized
gtaacctcatagattgtggt

SEQ ID NO: 222784 - DNA, 20 bp, Artificial Sequence
  chemically synthesized
aacctcatagattgtggtaa

SEQ ID NO: 222785 - DNA, 20 bp, Artificial Sequence
  chemically synthesized
cttacaaagcaatttcatgt

SEQ ID NO: 222786 - DNA, 20 bp, Artificial Sequence
  chemically synthesized
cttacatgaaattgctttgt

SEQ ID NO: 222787 - DNA, 20 bp, Artificial Sequence
  chemically synthesized
gcagccctataaaacttaca

SEQ ID NO: 222788 - DNA, 20 bp, Artificial Sequence
  chemically synthesized
aaattgctttgtaagtttta

SEQ ID NO: 222789 - DNA, 20 bp, Artificial Sequence
  chemically synthesized
aattgctttgtaagttttat

SEQ ID NO: 222790 - DNA, 20 bp, Artificial Sequence
  chemically synthesized
attgctttgtaagttttata

SEQ ID NO: 222791 - DNA, 20 bp, Artificial Sequence
  chemically synthesized
atcatacaatcaaaacatgg

SEQ ID NO: 222792 - DNA, 20 bp, Artificial Sequence
  chemically synthesized
agtatcatacaatcaaaaca

SEQ ID NO: 222793 - DNA, 20 bp, Artificial Sequence
  chemically synthesized
tcctaaacagtagggataca

SEQ ID NO: 222794 - DNA, 20 bp, Artificial Sequence
  chemically synthesized
tactatgtatccctactgtt

SEQ ID NO: 222795 - DNA, 20 bp, Artificial Sequence
  chemically synthesized
aagagatgtcctaaacagta

SEQ ID NO: 222796 - DNA, 20 bp, Artificial Sequence
  chemically synthesized
actatgtatccctactgttt

SEQ ID NO: 222797 - DNA, 20 bp, Artificial Sequence
  chemically synthesized
gaagagatgtcctaaacagt

SEQ ID NO: 222798 - DNA, 20 bp, Artificial Sequence
  chemically synthesized
ggaagagatgtcctaaacag

SEQ ID NO: 222799 - DNA, 20 bp, Artificial Sequence
  chemically synthesized
acaggaagagatgtcctaaa

SEQ ID NO: 222800 - DNA, 20 bp, Artificial Sequence
  chemically synthesized
agagatgtcctaaacaggaa

SEQ ID NO: 222801 - DNA, 20 bp, Artificial Sequence
  chemically synthesized
ttaggacatctcttcctgtt

SEQ ID NO: 222802 - DNA, 20 bp, Artificial Sequence
  chemically synthesized
taggacatctcttcctgttt

SEQ ID NO: 222803 - DNA, 20 bp, Artificial Sequence
  chemically synthesized
aaagagatgtcctaaacagg

SEQ ID NO: 222804 - DNA, 20 bp, Artificial Sequence
  chemically synthesized
atgaaagagatgtcctaaac

SEQ ID NO: 222805 - DNA, 20 bp, Artificial Sequence
  chemically synthesized
tatgaaagagatgtcctaaa

SEQ ID NO: 222806 - DNA, 20 bp, Artificial Sequence
  chemically synthesized
aggtctctgcacatatgaaa

SEQ ID NO: 222807 - DNA, 20 bp, Artificial Sequence
  chemically synthesized
acaggtctctgcacatatga

SEQ ID NO: 222808 - DNA, 20 bp, Artificial Sequence
  chemically synthesized
ggacatctctttcatatgtg

SEQ ID NO: 222809 - DNA, 20 bp, Artificial Sequence
  chemically synthesized
acatctctttcatatgtgca

SEQ ID NO: 222810 - DNA, 20 bp, Artificial Sequence
  chemically synthesized
ataaaaaaagcagtaaacac

SEQ ID NO: 222811 - DNA, 20 bp, Artificial Sequence
  chemically synthesized
aataaaaaaagcagtaaaca

SEQ ID NO: 222812 - DNA, 20 bp, Artificial Sequence
  chemically synthesized
cacattgtgaataaaaaaag

SEQ ID NO: 222813 - DNA, 20 bp, Artificial Sequence
  chemically synthesized
gaccacattgtgaataaaaa

SEQ ID NO: 222814 - DNA, 20 bp, Artificial Sequence
  chemically synthesized
tgctttttttattcacaatg

SEQ ID NO: 222815 - DNA, 20 bp, Artificial Sequence
  chemically synthesized
tcattaacttatggtaacaa

SEQ ID NO: 222816 - DNA, 20 bp, Artificial Sequence
  chemically synthesized
atgtggtcttttgttaccat

SEQ ID NO: 222817 - DNA, 20 bp, Artificial Sequence
  chemically synthesized
aaaatgttttcattaactta

SEQ ID NO: 222818 - DNA, 20 bp, Artificial Sequence
  chemically synthesized
aagttaatgaaaacattttt

SEQ ID NO: 222819 - DNA, 20 bp, Artificial Sequence
  chemically synthesized
actaacattttataaattac

SEQ ID NO: 222820 - DNA, 20 bp, Artificial Sequence
  chemically synthesized
tcttgtaatttataaaatgt

SEQ ID NO: 222821 - DNA, 20 bp, Artificial Sequence
  chemically synthesized
gtgttattaacaactataca

SEQ ID NO: 222822 - DNA, 20 bp, Artificial Sequence
  chemically synthesized
ctatctctatcatctatgta

SEQ ID NO: 222823 - DNA, 20 bp, Artificial Sequence
  chemically synthesized
taacaactatacatagatga

SEQ ID NO: 222824 - DNA, 20 bp, Artificial Sequence
  chemically synthesized
acaactatacatagatgata

SEQ ID NO: 222825 - DNA, 20 bp, Artificial Sequence
  chemically synthesized
ctatacatagatgatagaga

SEQ ID NO: 222826 - DNA, 20 bp, Artificial Sequence
  chemically synthesized
acatagatgatagagataga

SEQ ID NO: 222827 - DNA, 20 bp, Artificial Sequence
  chemically synthesized
tgatagagatagatagatga

SEQ ID NO: 222828 - DNA, 20 bp, Artificial Sequence
  chemically synthesized
ttatctatctatcgatggat

SEQ ID NO: 222829 - DNA, 20 bp, Artificial Sequence
  chemically synthesized
tagataaaccgatccatcga

SEQ ID NO: 222830 - DNA, 20 bp, Artificial Sequence
  chemically synthesized
tttacttatctatctatcga

SEQ ID NO: 222831 - DNA, 20 bp, Artificial Sequence
  chemically synthesized
taaaccgatccatcgataga

SEQ ID NO: 222832 - DNA, 20 bp, Artificial Sequence
  chemically synthesized
cgatccatcgatagatagat

SEQ ID NO: 222833 - DNA, 20 bp, Artificial Sequence
  chemically synthesized
catcgatagatagataagta

SEQ ID NO: 222834 - DNA, 20 bp, Artificial Sequence
  chemically synthesized
atcgatagatagataagtaa

SEQ ID NO: 222835 - DNA, 20 bp, Artificial Sequence
  chemically synthesized
cgatagatagataagtaaag

SEQ ID NO: 222836 - DNA, 20 bp, Artificial Sequence
  chemically synthesized
atagatagataagtaaagga

SEQ ID NO: 222837 - DNA, 20 bp, Artificial Sequence
  chemically synthesized
agataagtaaaggagagtga

SEQ ID NO: 222838 - DNA, 20 bp, Artificial Sequence
  chemically synthesized
ataagtaaaggagagtgaca

SEQ ID NO: 222839 - DNA, 20 bp, Artificial Sequence
  chemically synthesized
gtaaaggagagtgacagaga

SEQ ID NO: 222840 - DNA, 20 bp, Artificial Sequence
  chemically synthesized
taaaggagagtgacagagac

SEQ ID NO: 222841 - DNA, 20 bp, Artificial Sequence
  chemically synthesized
aaaggagagtgacagagaca

SEQ ID NO: 222842 - DNA, 20 bp, Artificial Sequence
  chemically synthesized
aggagagtgacagagacagg

SEQ ID NO: 222843 - DNA, 20 bp, Artificial Sequence
  chemically synthesized
gagagtgacagagacaggga

SEQ ID NO: 222844 - DNA, 20 bp, Artificial Sequence
  chemically synthesized
agagtgacagagacagggag

SEQ ID NO: 222845 - DNA, 20 bp, Artificial Sequence
  chemically synthesized
gagtgacagagacagggaga

SEQ ID NO: 222846 - DNA, 20 bp, Artificial Sequence
  chemically synthesized
gtgacagagacagggagagg

SEQ ID NO: 222847 - DNA, 20 bp, Artificial Sequence
  chemically synthesized
gacagagacagggagaggga

SEQ ID NO: 222848 - DNA, 20 bp, Artificial Sequence
  chemically synthesized
acagagacagggagagggag

SEQ ID NO: 222849 - DNA, 20 bp, Artificial Sequence
  chemically synthesized
cagagacagggagagggaga

SEQ ID NO: 222850 - DNA, 20 bp, Artificial Sequence
  chemically synthesized
gacagggagagggagaggga

SEQ ID NO: 222851 - DNA, 20 bp, Artificial Sequence
  chemically synthesized
acagggagagggagagggaa

SEQ ID NO: 222852 - DNA, 20 bp, Artificial Sequence
  chemically synthesized
cagggagagggagagggaaa

SEQ ID NO: 222853 - DNA, 20 bp, Artificial Sequence
  chemically synthesized
gagagggagagggaaaggga

SEQ ID NO: 222854 - DNA, 20 bp, Artificial Sequence
  chemically synthesized
agagggagagggaaagggaa

SEQ ID NO: 222855 - DNA, 20 bp, Artificial Sequence
  chemically synthesized
gagggagagggaaagggaaa

SEQ ID NO: 222856 - DNA, 20 bp, Artificial Sequence
  chemically synthesized
gagagggaaagggaaaggga

SEQ ID NO: 222857 - DNA, 20 bp, Artificial Sequence
  chemically synthesized
agggaaagggaaagggatgg

SEQ ID NO: 222858 - DNA, 20 bp, Artificial Sequence
  chemically synthesized
gggaaagggaaagggatggt

SEQ ID NO: 222859 - DNA, 20 bp, Artificial Sequence
  chemically synthesized
gaaagggaaagggatggtgg

SEQ ID NO: 222860 - DNA, 20 bp, Artificial Sequence
  chemically synthesized
aagggaaagggatggtggga

SEQ ID NO: 222861 - DNA, 20 bp, Artificial Sequence
  chemically synthesized
gggaaagggatggtgggaga

SEQ ID NO: 222862 - DNA, 20 bp, Artificial Sequence
  chemically synthesized
gaaagggatggtgggagaga

SEQ ID NO: 222863 - DNA, 20 bp, Artificial Sequence
  chemically synthesized
agggatggtgggagagagag

SEQ ID NO: 222864 - DNA, 20 bp, Artificial Sequence
  chemically synthesized
tgggagagagagaagtaact

SEQ ID NO: 222865 - DNA, 20 bp, Artificial Sequence
  chemically synthesized
gagagagagaagtaactgag

SEQ ID NO: 222866 - DNA, 20 bp, Artificial Sequence
  chemically synthesized
gagagaagtaactgagtgga

SEQ ID NO: 222867 - DNA, 20 bp, Artificial Sequence
  chemically synthesized
catctacccatccatccact

SEQ ID NO: 222868 - DNA, 20 bp, Artificial Sequence
  chemically synthesized
gaagtaactgagtggatgga

SEQ ID NO: 222869 - DNA, 20 bp, Artificial Sequence
  chemically synthesized
aagtaactgagtggatggat

SEQ ID NO: 222870 - DNA, 20 bp, Artificial Sequence
  chemically synthesized
taactgagtggatggatggg

SEQ ID NO: 222871 - DNA, 20 bp, Artificial Sequence
  chemically synthesized
ggatggatgggtagatgaat

SEQ ID NO: 222872 - DNA, 20 bp, Artificial Sequence
  chemically synthesized
tggatgggtagatgaataag

SEQ ID NO: 222873 - DNA, 20 bp, Artificial Sequence
  chemically synthesized
tgggtagatgaataagtgga

SEQ ID NO: 222874 - DNA, 20 bp, Artificial Sequence
  chemically synthesized
tagatgaataagtggatgga

SEQ ID NO: 222875 - DNA, 20 bp, Artificial Sequence
  chemically synthesized
tgaataagtggatggatgga

SEQ ID NO: 222876 - DNA, 20 bp, Artificial Sequence
  chemically synthesized
ataagtggatggatggatgg

SEQ ID NO: 222877 - DNA, 20 bp, Artificial Sequence
  chemically synthesized
taagtggatggatggatgga

SEQ ID NO: 222878 - DNA, 20 bp, Artificial Sequence
  chemically synthesized
agtggatggatggatggaag

SEQ ID NO: 222879 - DNA, 20 bp, Artificial Sequence
  chemically synthesized
gatggatggatggaaggaga

SEQ ID NO: 222880 - DNA, 20 bp, Artificial Sequence
  chemically synthesized
atggatggatggaaggagac

SEQ ID NO: 222881 - DNA, 20 bp, Artificial Sequence
  chemically synthesized
gatggatggaaggagacagg

SEQ ID NO: 222882 - DNA, 20 bp, Artificial Sequence
  chemically synthesized
gatggaaggagacaggtaga

SEQ ID NO: 222883 - DNA, 20 bp, Artificial Sequence
  chemically synthesized
gaaggagacaggtagacagc

SEQ ID NO: 222884 - DNA, 20 bp, Artificial Sequence
  chemically synthesized
gagacaggtagacagccaga

SEQ ID NO: 222885 - DNA, 20 bp, Artificial Sequence
  chemically synthesized
agacaggtagacagccagat

SEQ ID NO: 222886 - DNA, 20 bp, Artificial Sequence
  chemically synthesized
tctatccatatatacccatc

SEQ ID NO: 222887 - DNA, 20 bp, Artificial Sequence
  chemically synthesized
gacagccagatgggtatata

SEQ ID NO: 222888 - DNA, 20 bp, Artificial Sequence
  chemically synthesized
gccagatgggtatatatgga

SEQ ID NO: 222889 - DNA, 20 bp, Artificial Sequence
  chemically synthesized
gatgggtatatatggataga

SEQ ID NO: 222890 - DNA, 20 bp, Artificial Sequence
  chemically synthesized
ggaagttaaataataggaca

SEQ ID NO: 222891 - DNA, 20 bp, Artificial Sequence
  chemically synthesized
agcaagggaagttaaataat

SEQ ID NO: 222892 - DNA, 20 bp, Artificial Sequence
  chemically synthesized
aagcaagggaagttaaataa

SEQ ID NO: 222893 - DNA, 20 bp, Artificial Sequence
  chemically synthesized
ttctaaaattgaagcaaggg

SEQ ID NO: 222894 - DNA, 20 bp, Artificial Sequence
  chemically synthesized
atcttctaaaattgaagcaa

SEQ ID NO: 222895 - DNA, 20 bp, Artificial Sequence
  chemically synthesized
tatcttctaaaattgaagca

SEQ ID NO: 222896 - DNA, 20 bp, Artificial Sequence
  chemically synthesized
atatcttctaaaattgaagc

SEQ ID NO: 222897 - DNA, 20 bp, Artificial Sequence
  chemically synthesized
aacttcccttgcttcaattt

SEQ ID NO: 222898 - DNA, 20 bp, Artificial Sequence
  chemically synthesized
ttttatatcttctaaaattg

SEQ ID NO: 222899 - DNA, 20 bp, Artificial Sequence
  chemically synthesized
ttcccttgcttcaattttag

SEQ ID NO: 222900 - DNA, 20 bp, Artificial Sequence
  chemically synthesized
caattttagaagatataaaa

SEQ ID NO: 222901 - DNA, 20 bp, Artificial Sequence
  chemically synthesized
aattttagaagatataaaat

SEQ ID NO: 222902 - DNA, 20 bp, Artificial Sequence
  chemically synthesized
aagatataaaataggataac

SEQ ID NO: 222903 - DNA, 20 bp, Artificial Sequence
  chemically synthesized
gatataaaataggataacaa

SEQ ID NO: 222904 - DNA, 20 bp, Artificial Sequence
  chemically synthesized
taacaagagtacctatctta

SEQ ID NO: 222905 - DNA, 20 bp, Artificial Sequence
  chemically synthesized
aacaagagtacctatcttat

SEQ ID NO: 222906 - DNA, 20 bp, Artificial Sequence
  chemically synthesized
tcatagcaatcctataagat

SEQ ID NO: 222907 - DNA, 20 bp, Artificial Sequence
  chemically synthesized
ctcatagcaatcctataaga

SEQ ID NO: 222908 - DNA, 20 bp, Artificial Sequence
  chemically synthesized
aatgctcatagcaatcctat

SEQ ID NO: 222909 - DNA, 20 bp, Artificial Sequence
  chemically synthesized
ctatcttataggattgctat

SEQ ID NO: 222910 - DNA, 20 bp, Artificial Sequence
  chemically synthesized
cttaactaccttaatgctca

SEQ ID NO: 222911 - DNA, 20 bp, Artificial Sequence
  chemically synthesized
ataggattgctatgagcatt

SEQ ID NO: 222912 - DNA, 20 bp, Artificial Sequence
  chemically synthesized
taggattgctatgagcatta

SEQ ID NO: 222913 - DNA, 20 bp, Artificial Sequence
  chemically synthesized
gattgctatgagcattaagg

SEQ ID NO: 222914 - DNA, 20 bp, Artificial Sequence
  chemically synthesized
ctatgagcattaaggtagtt

SEQ ID NO: 222915 - DNA, 20 bp, Artificial Sequence
  chemically synthesized
ctgagctcttagtatgtgtc

SEQ ID NO: 222916 - DNA, 20 bp, Artificial Sequence
  chemically synthesized
gctgagctcttagtatgtgt

SEQ ID NO: 222917 - DNA, 20 bp, Artificial Sequence
  chemically synthesized
agttaagcctgacacatact

SEQ ID NO: 222918 - DNA, 20 bp, Artificial Sequence
  chemically synthesized
ttaagcctgacacatactaa

SEQ ID NO: 222919 - DNA, 20 bp, Artificial Sequence
  chemically synthesized
cctgacacatactaagagct

SEQ ID NO: 222920 - DNA, 20 bp, Artificial Sequence
  chemically synthesized
cttaacacttgctgagctct

SEQ ID NO: 222921 - DNA, 20 bp, Artificial Sequence
  chemically synthesized
acacatactaagagctcagc

SEQ ID NO: 222922 - DNA, 20 bp, Artificial Sequence
  chemically synthesized
aaaaatacttaacacttgct

SEQ ID NO: 222923 - DNA, 20 bp, Artificial Sequence
  chemically synthesized
ctaagagctcagcaagtgtt

SEQ ID NO: 222924 - DNA, 20 bp, Artificial Sequence
  chemically synthesized
gtgttaagtatttttcactg

SEQ ID NO: 222925 - DNA, 20 bp, Artificial Sequence
  chemically synthesized
taagtatttttcactgtagt

SEQ ID NO: 222926 - DNA, 20 bp, Artificial Sequence
  chemically synthesized
taagagccaaataccaacta

SEQ ID NO: 222927 - DNA, 20 bp, Artificial Sequence
  chemically synthesized
ttttcactgtagttggtatt

SEQ ID NO: 222928 - DNA, 20 bp, Artificial Sequence
  chemically synthesized
tagttggtatttggctctta

SEQ ID NO: 222929 - DNA, 20 bp, Artificial Sequence
  chemically synthesized
atatgtgacagattctttaa

SEQ ID NO: 222930 - DNA, 20 bp, Artificial Sequence
  chemically synthesized
aaatatgtgacagattcttt

SEQ ID NO: 222931 - DNA, 20 bp, Artificial Sequence
  chemically synthesized
aactgtatagaaatatgtga

SEQ ID NO: 222932 - DNA, 20 bp, Artificial Sequence
  chemically synthesized
atctgtcacatatttctata

SEQ ID NO: 222933 - DNA, 20 bp, Artificial Sequence
  chemically synthesized
ctatgaatttaaaaactgta

SEQ ID NO: 222934 - DNA, 20 bp, Artificial Sequence
  chemically synthesized
ctatacagtttttaaattca

SEQ ID NO: 222935 - DNA, 20 bp, Artificial Sequence
  chemically synthesized
cagtttttaaattcatagat

SEQ ID NO: 222936 - DNA, 20 bp, Artificial Sequence
  chemically synthesized
ttaaattcatagattagatg

SEQ ID NO: 222937 - DNA, 20 bp, Artificial Sequence
  chemically synthesized
attagatgtagcctaataat

SEQ ID NO: 222938 - DNA, 20 bp, Artificial Sequence
  chemically synthesized
ggatgattgctctcattatt

SEQ ID NO: 222939 - DNA, 20 bp, Artificial Sequence
  chemically synthesized
tagatgtagcctaataatga

SEQ ID NO: 222940 - DNA, 20 bp, Artificial Sequence
  chemically synthesized
tggatgattgctctcattat

SEQ ID NO: 222941 - DNA, 20 bp, Artificial Sequence
  chemically synthesized
aatgagagcaatcatccatt

SEQ ID NO: 222942 - DNA, 20 bp, Artificial Sequence
  chemically synthesized
gacacatagagggtgcttaa

SEQ ID NO: 222943 - DNA, 20 bp, Artificial Sequence
  chemically synthesized
tctgcgtttagacacataga

SEQ ID NO: 222944 - DNA, 20 bp, Artificial Sequence
  chemically synthesized
atctgcgtttagacacatag

SEQ ID NO: 222945 - DNA, 20 bp, Artificial Sequence
  chemically synthesized
catctgcgtttagacacata

SEQ ID NO: 222946 - DNA, 20 bp, Artificial Sequence
  chemically synthesized
aacatctgcgtttagacaca

SEQ ID NO: 222947 - DNA, 20 bp, Artificial Sequence
  chemically synthesized
accctctatgtgtctaaacg

SEQ ID NO: 222948 - DNA, 20 bp, Artificial Sequence
  chemically synthesized
gtatgtaaaacatctgcgtt

SEQ ID NO: 222949 - DNA, 20 bp, Artificial Sequence
  chemically synthesized
gcagatgttttacataccgt

SEQ ID NO: 222950 - DNA, 20 bp, Artificial Sequence
  chemically synthesized
ttctcatgttatatgactta

SEQ ID NO: 222951 - DNA, 20 bp, Artificial Sequence
  chemically synthesized
taccgtaagtcatataacat

SEQ ID NO: 222952 - DNA, 20 bp, Artificial Sequence
  chemically synthesized
taacatgagaataaaccttt

SEQ ID NO: 222953 - DNA, 20 bp, Artificial Sequence
  chemically synthesized
gagagcagtaagtgtcttaa

SEQ ID NO: 222954 - DNA, 20 bp, Artificial Sequence
  chemically synthesized
ggagagcagtaagtgtctta

SEQ ID NO: 222955 - DNA, 20 bp, Artificial Sequence
  chemically synthesized
tgtaaaatggggagagcagt

SEQ ID NO: 222956 - DNA, 20 bp, Artificial Sequence
  chemically synthesized
catctgtaaaatggggagag

SEQ ID NO: 222957 - DNA, 20 bp, Artificial Sequence
  chemically synthesized
tctcatctgtaaaatgggga

SEQ ID NO: 222958 - DNA, 20 bp, Artificial Sequence
  chemically synthesized
tgtctcatctgtaaaatggg

SEQ ID NO: 222959 - DNA, 20 bp, Artificial Sequence
  chemically synthesized
ttactgctctccccatttta

SEQ ID NO: 222960 - DNA, 20 bp, Artificial Sequence
  chemically synthesized
gttgtctcatctgtaaaatg

SEQ ID NO: 222961 - DNA, 20 bp, Artificial Sequence
  chemically synthesized
ggttgtctcatctgtaaaat

SEQ ID NO: 222962 - DNA, 20 bp, Artificial Sequence
  chemically synthesized
tggttgtctcatctgtaaaa

SEQ ID NO: 222963 - DNA, 20 bp, Artificial Sequence
  chemically synthesized
gctctccccattttacagat

SEQ ID NO: 222964 - DNA, 20 bp, Artificial Sequence
  chemically synthesized
attttacagatgagacaacc

SEQ ID NO: 222965 - DNA, 20 bp, Artificial Sequence
  chemically synthesized
gatgagacaaccaagactta

SEQ ID NO: 222966 - DNA, 20 bp, Artificial Sequence
  chemically synthesized
ttgggcaatactttaagtct

SEQ ID NO: 222967 - DNA, 20 bp, Artificial Sequence
  chemically synthesized
aagaccttgggcaatacttt

SEQ ID NO: 222968 - DNA, 20 bp, Artificial Sequence
  chemically synthesized
caagacttaaagtattgccc

SEQ ID NO: 222969 - DNA, 20 bp, Artificial Sequence
  chemically synthesized
aagacttaaagtattgccca

SEQ ID NO: 222970 - DNA, 20 bp, Artificial Sequence
  chemically synthesized
taaagtattgcccaaggtct

SEQ ID NO: 222971 - DNA, 20 bp, Artificial Sequence
  chemically synthesized
gttaccaactctaagacctt

SEQ ID NO: 222972 - DNA, 20 bp, Artificial Sequence
  chemically synthesized
agttaccaactctaagacct

SEQ ID NO: 222973 - DNA, 20 bp, Artificial Sequence
  chemically synthesized
aagtattgcccaaggtctta

SEQ ID NO: 222974 - DNA, 20 bp, Artificial Sequence
  chemically synthesized
attgcccaaggtcttagagt

SEQ ID NO: 222975 - DNA, 20 bp, Artificial Sequence
  chemically synthesized
ctttgcaagttaccaactct

SEQ ID NO: 222976 - DNA, 20 bp, Artificial Sequence
  chemically synthesized
cttagagttggtaacttgca

SEQ ID NO: 222977 - DNA, 20 bp, Artificial Sequence
  chemically synthesized
ttagagttggtaacttgcaa

SEQ ID NO: 222978 - DNA, 20 bp, Artificial Sequence
  chemically synthesized
gtcattgttcttgcctttgc

SEQ ID NO: 222979 - DNA, 20 bp, Artificial Sequence
  chemically synthesized
agttggtaacttgcaaaggc

SEQ ID NO: 222980 - DNA, 20 bp, Artificial Sequence
  chemically synthesized
aagaacaatgaccacaaaac

SEQ ID NO: 222981 - DNA, 20 bp, Artificial Sequence
  chemically synthesized
tgtcagttgttctggttttg

SEQ ID NO: 222982 - DNA, 20 bp, Artificial Sequence
  chemically synthesized
tactctgctgtcagttgttc

SEQ ID NO: 222983 - DNA, 20 bp, Artificial Sequence
  chemically synthesized
cacaaaaccagaacaactga

SEQ ID NO: 222984 - DNA, 20 bp, Artificial Sequence
  chemically synthesized
aaaaccagaacaactgacag

SEQ ID NO: 222985 - DNA, 20 bp, Artificial Sequence
  chemically synthesized
aaccagaacaactgacagca

SEQ ID NO: 222986 - DNA, 20 bp, Artificial Sequence
  chemically synthesized
tggaacagatactctgctgt

SEQ ID NO: 222987 - DNA, 20 bp, Artificial Sequence
  chemically synthesized
tgacagcagagtatctgttc

SEQ ID NO: 222988 - DNA, 20 bp, Artificial Sequence
  chemically synthesized
agtaattattggagctggaa

SEQ ID NO: 222989 - DNA, 20 bp, Artificial Sequence
  chemically synthesized
tagccagtaattattggagc

SEQ ID NO: 222990 - DNA, 20 bp, Artificial Sequence
  chemically synthesized
gatgtagccagtaattattg

SEQ ID NO: 222991 - DNA, 20 bp, Artificial Sequence
  chemically synthesized
ctgatgtagccagtaattat

SEQ ID NO: 222992 - DNA, 20 bp, Artificial Sequence
  chemically synthesized
gttccagctccaataattac

SEQ ID NO: 222993 - DNA, 20 bp, Artificial Sequence
  chemically synthesized
ccaataattactggctacat

SEQ ID NO: 222994 - DNA, 20 bp, Artificial Sequence
  chemically synthesized
acccacagaactgatgtagc

SEQ ID NO: 222995 - DNA, 20 bp, Artificial Sequence
  chemically synthesized
agggacccacagaactgatg

SEQ ID NO: 222996 - DNA, 20 bp, Artificial Sequence
  chemically synthesized
tactggctacatcagttctg

SEQ ID NO: 222997 - DNA, 20 bp, Artificial Sequence
  chemically synthesized
actggctacatcagttctgt

SEQ ID NO: 222998 - DNA, 20 bp, Artificial Sequence
  chemically synthesized
taccatcatgaagggaccca

SEQ ID NO: 222999 - DNA, 20 bp, Artificial Sequence
  chemically synthesized
ttctgtgggtcccttcatga

SEQ ID NO: 223000 - DNA, 20 bp, Artificial Sequence
  chemically synthesized
ggtataggtaccatcatgaa

SEQ ID NO: 223001 - DNA, 20 bp, Artificial Sequence
  chemically synthesized
aggtataggtaccatcatga

SEQ ID NO: 223002 - DNA, 20 bp, Artificial Sequence
  chemically synthesized
gaggtataggtaccatcatg

SEQ ID NO: 223003 - DNA, 20 bp, Artificial Sequence
  chemically synthesized
catgatggtacctatacctc

SEQ ID NO: 223004 - DNA, 20 bp, Artificial Sequence
  chemically synthesized
tttttaaactctagaggtat

SEQ ID NO: 223005 - DNA, 20 bp, Artificial Sequence
  chemically synthesized
atttttaaactctagaggta

SEQ ID NO: 223006 - DNA, 20 bp, Artificial Sequence
  chemically synthesized
tgatggtacctatacctcta

SEQ ID NO: 223007 - DNA, 20 bp, Artificial Sequence
  chemically synthesized
aatttatttttaaactctag

SEQ ID NO: 223008 - DNA, 20 bp, Artificial Sequence
  chemically synthesized
taatttatttttaaactcta

SEQ ID NO: 223009 - DNA, 20 bp, Artificial Sequence
  chemically synthesized
gataatttatttttaaactc

SEQ ID NO: 223010 - DNA, 20 bp, Artificial Sequence
  chemically synthesized
tattattgacttacatcata

SEQ ID NO: 223011 - DNA, 20 bp, Artificial Sequence
  chemically synthesized
ttgcataaactctatgatgt

SEQ ID NO: 223012 - DNA, 20 bp, Artificial Sequence
  chemically synthesized
attattattgacttacatca

SEQ ID NO: 223013 - DNA, 20 bp, Artificial Sequence
  chemically synthesized
ctagtgagttaagaaagaag

SEQ ID NO: 223014 - DNA, 20 bp, Artificial Sequence
  chemically synthesized
gctagtgagttaagaaagaa

SEQ ID NO: 223015 - DNA, 20 bp, Artificial Sequence
  chemically synthesized
atgctagtgagttaagaaag

SEQ ID NO: 223016 - DNA, 20 bp, Artificial Sequence
  chemically synthesized
agtatgctagtgagttaaga

SEQ ID NO: 223017 - DNA, 20 bp, Artificial Sequence
  chemically synthesized
cctcttctttcttaactcac

SEQ ID NO: 223018 - DNA, 20 bp, Artificial Sequence
  chemically synthesized
ttacagtatgctagtgagtt

SEQ ID NO: 223019 - DNA, 20 bp, Artificial Sequence
  chemically synthesized
gtttattacagtatgctagt

SEQ ID NO: 223020 - DNA, 20 bp, Artificial Sequence
  chemically synthesized
ggatgtttattacagtatgc

SEQ ID NO: 223021 - DNA, 20 bp, Artificial Sequence
  chemically synthesized
gggtatatggatgtttatta

SEQ ID NO: 223022 - DNA, 20 bp, Artificial Sequence
  chemically synthesized
ggatctgcatggtgggtata

SEQ ID NO: 223023 - DNA, 20 bp, Artificial Sequence
  chemically synthesized
acatccatatacccaccatg

SEQ ID NO: 223024 - DNA, 20 bp, Artificial Sequence
  chemically synthesized
attgctgggatctgcatggt

SEQ ID NO: 223025 - DNA, 20 bp, Artificial Sequence
  chemically synthesized
aattgctgggatctgcatgg

SEQ ID NO: 223026 - DNA, 20 bp, Artificial Sequence
  chemically synthesized
tataattgctgggatctgca

SEQ ID NO: 223027 - DNA, 20 bp, Artificial Sequence
  chemically synthesized
tatacccaccatgcagatcc

SEQ ID NO: 223028 - DNA, 20 bp, Artificial Sequence
  chemically synthesized
cccttgagtttataattgct

SEQ ID NO: 223029 - DNA, 20 bp, Artificial Sequence
  chemically synthesized
gcccttgagtttataattgc

SEQ ID NO: 223030 - DNA, 20 bp, Artificial Sequence
  chemically synthesized
atcccagcaattataaactc

SEQ ID NO: 223031 - DNA, 20 bp, Artificial Sequence
  chemically synthesized
tcccagcaattataaactca

SEQ ID NO: 223032 - DNA, 20 bp, Artificial Sequence
  chemically synthesized
cccagcaattataaactcaa

SEQ ID NO: 223033 - DNA, 20 bp, Artificial Sequence
  chemically synthesized
atgaaaccatatgggccctt

SEQ ID NO: 223034 - DNA, 20 bp, Artificial Sequence
  chemically synthesized
tataaactcaagggcccata

SEQ ID NO: 223035 - DNA, 20 bp, Artificial Sequence
  chemically synthesized
ggatgtagatgaaaccatat

SEQ ID NO: 223036 - DNA, 20 bp, Artificial Sequence
  chemically synthesized
gggatgtagatgaaaccata

SEQ ID NO: 223037 - DNA, 20 bp, Artificial Sequence
  chemically synthesized
gggttgcgcttggtgggatg

SEQ ID NO: 223038 - DNA, 20 bp, Artificial Sequence
  chemically synthesized
ggtttcatctacatcccacc

SEQ ID NO: 223039 - DNA, 20 bp, Artificial Sequence
  chemically synthesized
aggggtgggttgcgcttggt

SEQ ID NO: 223040 - DNA, 20 bp, Artificial Sequence
  chemically synthesized
taggggtgggttgcgcttgg

SEQ ID NO: 223041 - DNA, 20 bp, Artificial Sequence
  chemically synthesized
gtttaggggtgggttgcgct

SEQ ID NO: 223042 - DNA, 20 bp, Artificial Sequence
  chemically synthesized
acaaagctaggtttaggggt

SEQ ID NO: 223043 - DNA, 20 bp, Artificial Sequence
  chemically synthesized
tacaaagctaggtttagggg

SEQ ID NO: 223044 - DNA, 20 bp, Artificial Sequence
  chemically synthesized
gcgcaacccacccctaaacc

SEQ ID NO: 223045 - DNA, 20 bp, Artificial Sequence
  chemically synthesized
taatacaaagctaggtttag

SEQ ID NO: 223046 - DNA, 20 bp, Artificial Sequence
  chemically synthesized
ataatacaaagctaggttta

SEQ ID NO: 223047 - DNA, 20 bp, Artificial Sequence
  chemically synthesized
aataatacaaagctaggttt

SEQ ID NO: 223048 - DNA, 20 bp, Artificial Sequence
  chemically synthesized
aaataatacaaagctaggtt

SEQ ID NO: 223049 - DNA, 20 bp, Artificial Sequence
  chemically synthesized
ttgcaaaataatacaaagct

SEQ ID NO: 223050 - DNA, 20 bp, Artificial Sequence
  chemically synthesized
cttgcaaaataatacaaagc

SEQ ID NO: 223051 - DNA, 20 bp, Artificial Sequence
  chemically synthesized
gtcacttgcaaaataataca

SEQ ID NO: 223052 - DNA, 20 bp, Artificial Sequence
  chemically synthesized
ctagctttgtattattttgc

SEQ ID NO: 223053 - DNA, 20 bp, Artificial Sequence
  chemically synthesized
tattattttgcaagtgacct

SEQ ID NO: 223054 - DNA, 20 bp, Artificial Sequence
  chemically synthesized
cagcaaaagaaggatcactt

SEQ ID NO: 223055 - DNA, 20 bp, Artificial Sequence
  chemically synthesized
gcagcaaaagaaggatcact

SEQ ID NO: 223056 - DNA, 20 bp, Artificial Sequence
  chemically synthesized
gtattccaagcagcaaaaga

SEQ ID NO: 223057 - DNA, 20 bp, Artificial Sequence
  chemically synthesized
ggtattccaagcagcaaaag

SEQ ID NO: 223058 - DNA, 20 bp, Artificial Sequence
  chemically synthesized
cttggtattccaagcagcaa

SEQ ID NO: 223059 - DNA, 20 bp, Artificial Sequence
  chemically synthesized
gtgatccttcttttgctgct

SEQ ID NO: 223060 - DNA, 20 bp, Artificial Sequence
  chemically synthesized
cattaacttggtattccaag

SEQ ID NO: 223061 - DNA, 20 bp, Artificial Sequence
  chemically synthesized
actcattaacttggtattcc

SEQ ID NO: 223062 - DNA, 20 bp, Artificial Sequence
  chemically synthesized
cttttgctgcttggaatacc

SEQ ID NO: 223063 - DNA, 20 bp, Artificial Sequence
  chemically synthesized
gcttggaataccaagttaat

SEQ ID NO: 223064 - DNA, 20 bp, Artificial Sequence
  chemically synthesized
catgaaataactcattaact

SEQ ID NO: 223065 - DNA, 20 bp, Artificial Sequence
  chemically synthesized
gttaatgagttatttcatgt

SEQ ID NO: 223066 - DNA, 20 bp, Artificial Sequence
  chemically synthesized
atgagttatttcatgtgaga

SEQ ID NO: 223067 - DNA, 20 bp, Artificial Sequence
  chemically synthesized
gcaacagctttgtgatttat

SEQ ID NO: 223068 - DNA, 20 bp, Artificial Sequence
  chemically synthesized
gagatagctaataaatcaca

SEQ ID NO: 223069 - DNA, 20 bp, Artificial Sequence
  chemically synthesized
aaatcacaaagctgttgctt

SEQ ID NO: 223070 - DNA, 20 bp, Artificial Sequence
  chemically synthesized
ggacacctattctcaagcaa

SEQ ID NO: 223071 - DNA, 20 bp, Artificial Sequence
  chemically synthesized
acaaagctgttgcttgagaa

SEQ ID NO: 223072 - DNA, 20 bp, Artificial Sequence
  chemically synthesized
caaagctgttgcttgagaat

SEQ ID NO: 223073 - DNA, 20 bp, Artificial Sequence
  chemically synthesized
atattgggacacctattctc

SEQ ID NO: 223074 - DNA, 20 bp, Artificial Sequence
  chemically synthesized
aaatgaaacacagcaatatt

SEQ ID NO: 223075 - DNA, 20 bp, Artificial Sequence
  chemically synthesized
aaaatgaaacacagcaatat

SEQ ID NO: 223076 - DNA, 20 bp, Artificial Sequence
  chemically synthesized
catagaatgaaaatgaaaca

SEQ ID NO: 223077 - DNA, 20 bp, Artificial Sequence
  chemically synthesized
gtttcattttcattctatga

SEQ ID NO: 223078 - DNA, 20 bp, Artificial Sequence
  chemically synthesized
tttcattttcattctatgat

SEQ ID NO: 223079 - DNA, 20 bp, Artificial Sequence
  chemically synthesized
cattttcattctatgatagg

SEQ ID NO: 223080 - DNA, 20 bp, Artificial Sequence
  chemically synthesized
cataaaaacgctacctatca

SEQ ID NO: 223081 - DNA, 20 bp, Artificial Sequence
  chemically synthesized
gtttttatgatatatgtcat

SEQ ID NO: 223082 - DNA, 20 bp, Artificial Sequence
  chemically synthesized
tttatgatatatgtcattgg

SEQ ID NO: 223083 - DNA, 20 bp, Artificial Sequence
  chemically synthesized
aagtcatatgtcaatcagta

SEQ ID NO: 223084 - DNA, 20 bp, Artificial Sequence
  chemically synthesized
accagaagtcatatgtcaat

SEQ ID NO: 223085 - DNA, 20 bp, Artificial Sequence
  chemically synthesized
actgattgacatatgacttc

SEQ ID NO: 223086 - DNA, 20 bp, Artificial Sequence
  chemically synthesized
gtattttaagcgttcaccag

SEQ ID NO: 223087 - DNA, 20 bp, Artificial Sequence
  chemically synthesized
caagtattttaagcgttcac

SEQ ID NO: 223088 - DNA, 20 bp, Artificial Sequence
  chemically synthesized
aaaacaaaatcaagtatttt

SEQ ID NO: 223089 - DNA, 20 bp, Artificial Sequence
  chemically synthesized
atgtatataaaaacaaaatc

SEQ ID NO: 223090 - DNA, 20 bp, Artificial Sequence
  chemically synthesized
atacatatgtatgtatgtat

SEQ ID NO: 223091 - DNA, 20 bp, Artificial Sequence
  chemically synthesized
tatgtatgtatgtataagca

SEQ ID NO: 223092 - DNA, 20 bp, Artificial Sequence
  chemically synthesized
tatctatttaataggaatat

SEQ ID NO: 223093 - DNA, 20 bp, Artificial Sequence
  chemically synthesized
ttatctatttaataggaata

SEQ ID NO: 223094 - DNA, 20 bp, Artificial Sequence
  chemically synthesized
catcccatattcctattaaa

SEQ ID NO: 223095 - DNA, 20 bp, Artificial Sequence
  chemically synthesized
tatcaacttatctatttaat

SEQ ID NO: 223096 - DNA, 20 bp, Artificial Sequence
  chemically synthesized
atatcaacttatctatttaa

SEQ ID NO: 223097 - DNA, 20 bp, Artificial Sequence
  chemically synthesized
catattcctattaaatagat

SEQ ID NO: 223098 - DNA, 20 bp, Artificial Sequence
  chemically synthesized
tttgacaaatacactgactt

SEQ ID NO: 223099 - DNA, 20 bp, Artificial Sequence
  chemically synthesized
tttcatattttttctaaagt

SEQ ID NO: 223100 - DNA, 20 bp, Artificial Sequence
  chemically synthesized
ttgatttcatattttttcta

SEQ ID NO: 223101 - DNA, 20 bp, Artificial Sequence
  chemically synthesized
aaatcaaatataaaataata

SEQ ID NO: 223102 - DNA, 20 bp, Artificial Sequence
  chemically synthesized
taaaataatacagctgtgta

SEQ ID NO: 223103 - DNA, 20 bp, Artificial Sequence
  chemically synthesized
acatcacaatgtaccgtaca

SEQ ID NO: 223104 - DNA, 20 bp, Artificial Sequence
  chemically synthesized
acattgtgatgttaacataa

SEQ ID NO: 223105 - DNA, 20 bp, Artificial Sequence
  chemically synthesized
ttgtgatgttaacataaaag

SEQ ID NO: 223106 - DNA, 20 bp, Artificial Sequence
  chemically synthesized
tgatgttaacataaaagaag

SEQ ID NO: 223107 - DNA, 20 bp, Artificial Sequence
  chemically synthesized
aacataaaagaagtagtgaa

SEQ ID NO: 223108 - DNA, 20 bp, Artificial Sequence
  chemically synthesized
acataaaagaagtagtgaac

SEQ ID NO: 223109 - DNA, 20 bp, Artificial Sequence
  chemically synthesized
tgtatgtcatatatgtttgt

SEQ ID NO: 223110 - DNA, 20 bp, Artificial Sequence
  chemically synthesized
gtcatatatgtttgttagca

SEQ ID NO: 223111 - DNA, 20 bp, Artificial Sequence
  chemically synthesized
tatgtttgttagcatagaaa

SEQ ID NO: 223112 - DNA, 20 bp, Artificial Sequence
  chemically synthesized
gtttgttagcatagaaaaag

SEQ ID NO: 223113 - DNA, 20 bp, Artificial Sequence
  chemically synthesized
gttagcatagaaaaagcagc

SEQ ID NO: 223114 - DNA, 20 bp, Artificial Sequence
  chemically synthesized
gcatagaaaaagcagccaga

SEQ ID NO: 223115 - DNA, 20 bp, Artificial Sequence
  chemically synthesized
cattttggtgtgtaactttc

SEQ ID NO: 223116 - DNA, 20 bp, Artificial Sequence
  chemically synthesized
ggaaaccagaattaacattt

SEQ ID NO: 223117 - DNA, 20 bp, Artificial Sequence
  chemically synthesized
acacaccaaaatgttaattc

SEQ ID NO: 223118 - DNA, 20 bp, Artificial Sequence
  chemically synthesized
tctaagtgccagttggaaac

SEQ ID NO: 223119 - DNA, 20 bp, Artificial Sequence
  chemically synthesized
tgttaattctggtttccaac

SEQ ID NO: 223120 - DNA, 20 bp, Artificial Sequence
  chemically synthesized
tagaaaatctaagtgccagt

SEQ ID NO: 223121 - DNA, 20 bp, Artificial Sequence
  chemically synthesized
tctggtttccaactggcact

SEQ ID NO: 223122 - DNA, 20 bp, Artificial Sequence
  chemically synthesized
atactagaaaatctaagtgc

SEQ ID NO: 223123 - DNA, 20 bp, Artificial Sequence
  chemically synthesized
ctaagcatactagaaaatct

SEQ ID NO: 223124 - DNA, 20 bp, Artificial Sequence
  chemically synthesized
caactggcacttagattttc

SEQ ID NO: 223125 - DNA, 20 bp, Artificial Sequence
  chemically synthesized
cttagattttctagtatgct

SEQ ID NO: 223126 - DNA, 20 bp, Artificial Sequence
  chemically synthesized
atatgaaaacctaagcatac

SEQ ID NO: 223127 - DNA, 20 bp, Artificial Sequence
  chemically synthesized
ttagattttctagtatgctt

SEQ ID NO: 223128 - DNA, 20 bp, Artificial Sequence
  chemically synthesized
gtatgctaatatgaaaacct

SEQ ID NO: 223129 - DNA, 20 bp, Artificial Sequence
  chemically synthesized
gtatgcttaggttttcatat

SEQ ID NO: 223130 - DNA, 20 bp, Artificial Sequence
  chemically synthesized
tttcatattagcatactgat

SEQ ID NO: 223131 - DNA, 20 bp, Artificial Sequence
  chemically synthesized
atattagcatactgataaga

SEQ ID NO: 223132 - DNA, 20 bp, Artificial Sequence
  chemically synthesized
tattagcatactgataagaa

SEQ ID NO: 223133 - DNA, 20 bp, Artificial Sequence
  chemically synthesized
ctcaaggatacctttcttat

SEQ ID NO: 223134 - DNA, 20 bp, Artificial Sequence
  chemically synthesized
ctgataagaaaggtatcctt

SEQ ID NO: 223135 - DNA, 20 bp, Artificial Sequence
  chemically synthesized
gacccaaacagtaagactca

SEQ ID NO: 223136 - DNA, 20 bp, Artificial Sequence
  chemically synthesized
agacccaaacagtaagactc

SEQ ID NO: 223137 - DNA, 20 bp, Artificial Sequence
  chemically synthesized
tatccttgagtcttactgtt

SEQ ID NO: 223138 - DNA, 20 bp, Artificial Sequence
  chemically synthesized
atccttgagtcttactgttt

SEQ ID NO: 223139 - DNA, 20 bp, Artificial Sequence
  chemically synthesized
ggaattcagacccaaacagt

SEQ ID NO: 223140 - DNA, 20 bp, Artificial Sequence
  chemically synthesized
aatgggaattcagacccaaa

SEQ ID NO: 223141 - DNA, 20 bp, Artificial Sequence
  chemically synthesized
aaaatggcaaaatgggaatt

SEQ ID NO: 223142 - DNA, 20 bp, Artificial Sequence
  chemically synthesized
cagttagaaaatggcaaaat

SEQ ID NO: 223143 - DNA, 20 bp, Artificial Sequence
  chemically synthesized
acagttagaaaatggcaaaa

SEQ ID NO: 223144 - DNA, 20 bp, Artificial Sequence
  chemically synthesized
gagtgtatacagttagaaaa

SEQ ID NO: 223145 - DNA, 20 bp, Artificial Sequence
  chemically synthesized
tttttttgagtgtatacagt

SEQ ID NO: 223146 - DNA, 20 bp, Artificial Sequence
  chemically synthesized
gaaatttttttgagtgtata

SEQ ID NO: 223147 - DNA, 20 bp, Artificial Sequence
  chemically synthesized
aaaaaagaagaaattttttt

SEQ ID NO: 223148 - DNA, 20 bp, Artificial Sequence
  chemically synthesized
caaaaaaaaaaaaaaaaaag

SEQ ID NO: 223149 - DNA, 20 bp, Artificial Sequence
  chemically synthesized
tctcaaaaaaaaaaaaaaaa

SEQ ID NO: 223150 - DNA, 20 bp, Artificial Sequence
  chemically synthesized
tctttttttttttttttttt

SEQ ID NO: 223151 - DNA, 20 bp, Artificial Sequence
  chemically synthesized
ttttttttttttttttgaga

SEQ ID NO: 223152 - DNA, 20 bp, Artificial Sequence
  chemically synthesized
ttttttttttttttgagatg

SEQ ID NO: 223153 - DNA, 20 bp, Artificial Sequence
  chemically synthesized
tccagcctgggtgacagagc

SEQ ID NO: 223154 - DNA, 20 bp, Artificial Sequence
  chemically synthesized
tggagtctcgctctgtcacc

SEQ ID NO: 223155 - DNA, 20 bp, Artificial Sequence
  chemically synthesized
gcactccagcctgggtgaca

SEQ ID NO: 223156 - DNA, 20 bp, Artificial Sequence
  chemically synthesized
ggagtctcgctctgtcaccc

SEQ ID NO: 223157 - DNA, 20 bp, Artificial Sequence
  chemically synthesized
ctgcactccagcctgggtga

SEQ ID NO: 223158 - DNA, 20 bp, Artificial Sequence
  chemically synthesized
tctcgctctgtcacccaggc

SEQ ID NO: 223159 - DNA, 20 bp, Artificial Sequence
  chemically synthesized
tcgctctgtcacccaggctg

SEQ ID NO: 223160 - DNA, 20 bp, Artificial Sequence
  chemically synthesized
gcgccactgcactccagcct

SEQ ID NO: 223161 - DNA, 20 bp, Artificial Sequence
  chemically synthesized
cgcgccactgcactccagcc

SEQ ID NO: 223162 - DNA, 20 bp, Artificial Sequence
  chemically synthesized
ctgtcacccaggctggagtg

SEQ ID NO: 223163 - DNA, 20 bp, Artificial Sequence
  chemically synthesized
gagatcgcgccactgcactc

SEQ ID NO: 223164 - DNA, 20 bp, Artificial Sequence
  chemically synthesized
tcacccaggctggagtgcag

SEQ ID NO: 223165 - DNA, 20 bp, Artificial Sequence
  chemically synthesized
ggagtgcagtggcgcgatct

SEQ ID NO: 223166 - DNA, 20 bp, Artificial Sequence
  chemically synthesized
ggtggaggttgcagtgagcc

SEQ ID NO: 223167 - DNA, 20 bp, Artificial Sequence
  chemically synthesized
cgggaggtggaggttgcagt

SEQ ID NO: 223168 - DNA, 20 bp, Artificial Sequence
  chemically synthesized
aacccgggaggtggaggttg

SEQ ID NO: 223169 - DNA, 20 bp, Artificial Sequence
  chemically synthesized
ggcgtgaacccgggaggtgg

SEQ ID NO: 223170 - DNA, 20 bp, Artificial Sequence
  chemically synthesized
tcactgcaacctccacctcc

SEQ ID NO: 223171 - DNA, 20 bp, Artificial Sequence
  chemically synthesized
tggcgtgaacccgggaggtg

SEQ ID NO: 223172 - DNA, 20 bp, Artificial Sequence
  chemically synthesized
cactgcaacctccacctccc

SEQ ID NO: 223173 - DNA, 20 bp, Artificial Sequence
  chemically synthesized
aatggcgtgaacccgggagg

SEQ ID NO: 223174 - DNA, 20 bp, Artificial Sequence
  chemically synthesized
gagaatggcgtgaacccggg

SEQ ID NO: 223175 - DNA, 20 bp, Artificial Sequence
  chemically synthesized
ggagaatggcgtgaacccgg

SEQ ID NO: 223176 - DNA, 20 bp, Artificial Sequence
  chemically synthesized
caggagaatggcgtgaaccc

SEQ ID NO: 223177 - DNA, 20 bp, Artificial Sequence
  chemically synthesized
gcaggagaatggcgtgaacc

SEQ ID NO: 223178 - DNA, 20 bp, Artificial Sequence
  chemically synthesized
gggaggctgaggcaggagaa

SEQ ID NO: 223179 - DNA, 20 bp, Artificial Sequence
  chemically synthesized
ttcacgccattctcctgcct

SEQ ID NO: 223180 - DNA, 20 bp, Artificial Sequence
  chemically synthesized
tactcgggaggctgaggcag

SEQ ID NO: 223181 - DNA, 20 bp, Artificial Sequence
  chemically synthesized
gctactcgggaggctgaggc

SEQ ID NO: 223182 - DNA, 20 bp, Artificial Sequence
  chemically synthesized
agctactcgggaggctgagg

SEQ ID NO: 223183 - DNA, 20 bp, Artificial Sequence
  chemically synthesized
cccagctactcgggaggctg

SEQ ID NO: 223184 - DNA, 20 bp, Artificial Sequence
  chemically synthesized
tcccagctactcgggaggct

SEQ ID NO: 223185 - DNA, 20 bp, Artificial Sequence
  chemically synthesized
ttctcctgcctcagcctccc

SEQ ID NO: 223186 - DNA, 20 bp, Artificial Sequence
  chemically synthesized
tcctgcctcagcctcccgag

SEQ ID NO: 223187 - DNA, 20 bp, Artificial Sequence
  chemically synthesized
tgtagtcccagctactcggg

SEQ ID NO: 223188 - DNA, 20 bp, Artificial Sequence
  chemically synthesized
ctgtagtcccagctactcgg

SEQ ID NO: 223189 - DNA, 20 bp, Artificial Sequence
  chemically synthesized
gcctcagcctcccgagtagc

SEQ ID NO: 223190 - DNA, 20 bp, Artificial Sequence
  chemically synthesized
gcctgtagtcccagctactc

SEQ ID NO: 223191 - DNA, 20 bp, Artificial Sequence
  chemically synthesized
cctcagcctcccgagtagct

SEQ ID NO: 223192 - DNA, 20 bp, Artificial Sequence
  chemically synthesized
tgcctgtagtcccagctact

SEQ ID NO: 223193 - DNA, 20 bp, Artificial Sequence
  chemically synthesized
ctcccgagtagctgggacta

SEQ ID NO: 223194 - DNA, 20 bp, Artificial Sequence
  chemically synthesized
tcccgagtagctgggactac

SEQ ID NO: 223195 - DNA, 20 bp, Artificial Sequence
  chemically synthesized
gtagtgggtgcctgtagtcc

SEQ ID NO: 223196 - DNA, 20 bp, Artificial Sequence
  chemically synthesized
ggcgtggtagtgggtgcctg

SEQ ID NO: 223197 - DNA, 20 bp, Artificial Sequence
  chemically synthesized
aattagcctggcgtggtagt

SEQ ID NO: 223198 - DNA, 20 bp, Artificial Sequence
  chemically synthesized
aaattagcctggcgtggtag

SEQ ID NO: 223199 - DNA, 20 bp, Artificial Sequence
  chemically synthesized
acaggcacccactaccacgc

SEQ ID NO: 223200 - DNA, 20 bp, Artificial Sequence
  chemically synthesized
caggcacccactaccacgcc

SEQ ID NO: 223201 - DNA, 20 bp, Artificial Sequence
  chemically synthesized
aaaaaattagcctggcgtgg

SEQ ID NO: 223202 - DNA, 20 bp, Artificial Sequence
  chemically synthesized
tataaaaaattagcctggcg

SEQ ID NO: 223203 - DNA, 20 bp, Artificial Sequence
  chemically synthesized
aaaaatataaaaaattagcc

SEQ ID NO: 223204 - DNA, 20 bp, Artificial Sequence
  chemically synthesized
ctactaaaaatataaaaaat

SEQ ID NO: 223205 - DNA, 20 bp, Artificial Sequence
  chemically synthesized
aggctaattttttatatttt

SEQ ID NO: 223206 - DNA, 20 bp, Artificial Sequence
  chemically synthesized
ctaattttttatatttttag

SEQ ID NO: 223207 - DNA, 20 bp, Artificial Sequence
  chemically synthesized
aattttttatatttttagta

SEQ ID NO: 223208 - DNA, 20 bp, Artificial Sequence
  chemically synthesized
ttttatatttttagtagaga

SEQ ID NO: 223209 - DNA, 20 bp, Artificial Sequence
  chemically synthesized
tttatatttttagtagagac

SEQ ID NO: 223210 - DNA, 20 bp, Artificial Sequence
  chemically synthesized
ttatatttttagtagagacg

SEQ ID NO: 223211 - DNA, 20 bp, Artificial Sequence
  chemically synthesized
cggggtttcaccgtgttcgc

SEQ ID NO: 223212 - DNA, 20 bp, Artificial Sequence
  chemically synthesized
cgagaccatcctggcgaaca

SEQ ID NO: 223213 - DNA, 20 bp, Artificial Sequence
  chemically synthesized
ggggtttcaccgtgttcgcc

SEQ ID NO: 223214 - DNA, 20 bp, Artificial Sequence
  chemically synthesized
tttcaccgtgttcgccagga

SEQ ID NO: 223215 - DNA, 20 bp, Artificial Sequence
  chemically synthesized
tcaggagatcgagaccatcc

SEQ ID NO: 223216 - DNA, 20 bp, Artificial Sequence
  chemically synthesized
gatcacgaggtcaggagatc

SEQ ID NO: 223217 - DNA, 20 bp, Artificial Sequence
  chemically synthesized
cgggctgatcacgaggtcag

SEQ ID NO: 223218 - DNA, 20 bp, Artificial Sequence
  chemically synthesized
ggcgggctgatcacgaggtc

SEQ ID NO: 223219 - DNA, 20 bp, Artificial Sequence
  chemically synthesized
aggcgggctgatcacgaggt

SEQ ID NO: 223220 - DNA, 20 bp, Artificial Sequence
  chemically synthesized
cgatctcctgacctcgtgat

SEQ ID NO: 223221 - DNA, 20 bp, Artificial Sequence
  chemically synthesized
gccgaggcgggctgatcacg

SEQ ID NO: 223222 - DNA, 20 bp, Artificial Sequence
  chemically synthesized
ggccgaggcgggctgatcac

SEQ ID NO: 223223 - DNA, 20 bp, Artificial Sequence
  chemically synthesized
acctcgtgatcagcccgcct

SEQ ID NO: 223224 - DNA, 20 bp, Artificial Sequence
  chemically synthesized
gcactttgggaggccgaggc

SEQ ID NO: 223225 - DNA, 20 bp, Artificial Sequence
  chemically synthesized
agcactttgggaggccgagg

SEQ ID NO: 223226 - DNA, 20 bp, Artificial Sequence
  chemically synthesized
cccagcactttgggaggccg

SEQ ID NO: 223227 - DNA, 20 bp, Artificial Sequence
  chemically synthesized
tcccagcactttgggaggcc

SEQ ID NO: 223228 - DNA, 20 bp, Artificial Sequence
  chemically synthesized
cagcccgcctcggcctccca

SEQ ID NO: 223229 - DNA, 20 bp, Artificial Sequence
  chemically synthesized
tgtaatcccagcactttggg

SEQ ID NO: 223230 - DNA, 20 bp, Artificial Sequence
  chemically synthesized
ctgtaatcccagcactttgg

SEQ ID NO: 223231 - DNA, 20 bp, Artificial Sequence
  chemically synthesized
gcctcggcctcccaaagtgc

SEQ ID NO: 223232 - DNA, 20 bp, Artificial Sequence
  chemically synthesized
gcctgtaatcccagcacttt

SEQ ID NO: 223233 - DNA, 20 bp, Artificial Sequence
  chemically synthesized
cctcggcctcccaaagtgct

SEQ ID NO: 223234 - DNA, 20 bp, Artificial Sequence
  chemically synthesized
cgcctgtaatcccagcactt

SEQ ID NO: 223235 - DNA, 20 bp, Artificial Sequence
  chemically synthesized
ctcccaaagtgctgggatta

SEQ ID NO: 223236 - DNA, 20 bp, Artificial Sequence
  chemically synthesized
tcccaaagtgctgggattac

SEQ ID NO: 223237 - DNA, 20 bp, Artificial Sequence
  chemically synthesized
gtggctcacgcctgtaatcc

SEQ ID NO: 223238 - DNA, 20 bp, Artificial Sequence
  chemically synthesized
agtgctgggattacaggcgt

SEQ ID NO: 223239 - DNA, 20 bp, Artificial Sequence
  chemically synthesized
caggcgtgagccaccgcacc

SEQ ID NO: 223240 - DNA, 20 bp, Artificial Sequence
  chemically synthesized
aattttttggccgggtgcgg

SEQ ID NO: 223241 - DNA, 20 bp, Artificial Sequence
  chemically synthesized
agaaattttttggccgggtg

SEQ ID NO: 223242 - DNA, 20 bp, Artificial Sequence
  chemically synthesized
aaataagaaattttttggcc

SEQ ID NO: 223243 - DNA, 20 bp, Artificial Sequence
  chemically synthesized
taaataagaaattttttggc

SEQ ID NO: 223244 - DNA, 20 bp, Artificial Sequence
  chemically synthesized
ggtataaataagaaattttt

SEQ ID NO: 223245 - DNA, 20 bp, Artificial Sequence
  chemically synthesized
gaggaagtagaggtataaat

SEQ ID NO: 223246 - DNA, 20 bp, Artificial Sequence
  chemically synthesized
tatgagaaatgaggaagtag

SEQ ID NO: 223247 - DNA, 20 bp, Artificial Sequence
  chemically synthesized
atatgagaaatgaggaagta

SEQ ID NO: 223248 - DNA, 20 bp, Artificial Sequence
  chemically synthesized
ctatatgagaaatgaggaag

SEQ ID NO: 223249 - DNA, 20 bp, Artificial Sequence
  chemically synthesized
cttctatatgagaaatgagg

SEQ ID NO: 223250 - DNA, 20 bp, Artificial Sequence
  chemically synthesized
ttacttctatatgagaaatg

SEQ ID NO: 223251 - DNA, 20 bp, Artificial Sequence
  chemically synthesized
attacttctatatgagaaat

SEQ ID NO: 223252 - DNA, 20 bp, Artificial Sequence
  chemically synthesized
ctacttcctcatttctcata

SEQ ID NO: 223253 - DNA, 20 bp, Artificial Sequence
  chemically synthesized
cttcctcatttctcatatag

SEQ ID NO: 223254 - DNA, 20 bp, Artificial Sequence
  chemically synthesized
tggcactattacttctatat

SEQ ID NO: 223255 - DNA, 20 bp, Artificial Sequence
  chemically synthesized
catttctcatatagaagtaa

SEQ ID NO: 223256 - DNA, 20 bp, Artificial Sequence
  chemically synthesized
cttctaaatagtaaggtaga

SEQ ID NO: 223257 - DNA, 20 bp, Artificial Sequence
  chemically synthesized
gagtcttctaaatagtaagg

SEQ ID NO: 223258 - DNA, 20 bp, Artificial Sequence
  chemically synthesized
gtgccatctaccttactatt

SEQ ID NO: 223259 - DNA, 20 bp, Artificial Sequence
  chemically synthesized
attgagtcttctaaatagta

SEQ ID NO: 223260 - DNA, 20 bp, Artificial Sequence
  chemically synthesized
aattgagtcttctaaatagt

SEQ ID NO: 223261 - DNA, 20 bp, Artificial Sequence
  chemically synthesized
ccatctaccttactatttag

SEQ ID NO: 223262 - DNA, 20 bp, Artificial Sequence
  chemically synthesized
gattaattgagtcttctaaa

SEQ ID NO: 223263 - DNA, 20 bp, Artificial Sequence
  chemically synthesized
gtaacttacatggattaatt

SEQ ID NO: 223264 - DNA, 20 bp, Artificial Sequence
  chemically synthesized
aagactcaattaatccatgt

SEQ ID NO: 223265 - DNA, 20 bp, Artificial Sequence
  chemically synthesized
acaggtctaagtaacttaca

SEQ ID NO: 223266 - DNA, 20 bp, Artificial Sequence
  chemically synthesized
attaatccatgtaagttact

SEQ ID NO: 223267 - DNA, 20 bp, Artificial Sequence
  chemically synthesized
atatctaaaatgacaggtct

SEQ ID NO: 223268 - DNA, 20 bp, Artificial Sequence
  chemically synthesized
gttacttagacctgtcattt

SEQ ID NO: 223269 - DNA, 20 bp, Artificial Sequence
  chemically synthesized
ataataatatctaaaatgac

SEQ ID NO: 223270 - DNA, 20 bp, Artificial Sequence
  chemically synthesized
cataataatatctaaaatga

SEQ ID NO: 223271 - DNA, 20 bp, Artificial Sequence
  chemically synthesized
agatattattatgactacat

SEQ ID NO: 223272 - DNA, 20 bp, Artificial Sequence
  chemically synthesized
tattattatgactacatcag

SEQ ID NO: 223273 - DNA, 20 bp, Artificial Sequence
  chemically synthesized
taacataatatcttctgatg

SEQ ID NO: 223274 - DNA, 20 bp, Artificial Sequence
  chemically synthesized
tacatcagaagatattatgt

SEQ ID NO: 223275 - DNA, 20 bp, Artificial Sequence
  chemically synthesized
gaagatattatgttagtaat

SEQ ID NO: 223276 - DNA, 20 bp, Artificial Sequence
  chemically synthesized
taataagaaaaacattgtta

SEQ ID NO: 223277 - DNA, 20 bp, Artificial Sequence
  chemically synthesized
ttgttaaagaatttgaaaat

SEQ ID NO: 223278 - DNA, 20 bp, Artificial Sequence
  chemically synthesized
tgttaaagaatttgaaaata

SEQ ID NO: 223279 - DNA, 20 bp, Artificial Sequence
  chemically synthesized
ttaaagaatttgaaaataag

SEQ ID NO: 223280 - DNA, 20 bp, Artificial Sequence
  chemically synthesized
aatttgaaaataaggagaat

SEQ ID NO: 223281 - DNA, 20 bp, Artificial Sequence
  chemically synthesized
taaggagaataagatttgtt

SEQ ID NO: 223282 - DNA, 20 bp, Artificial Sequence
  chemically synthesized
aaggagaataagatttgtta

SEQ ID NO: 223283 - DNA, 20 bp, Artificial Sequence
  chemically synthesized
attttaaattgttgttttgt

SEQ ID NO: 223284 - DNA, 20 bp, Artificial Sequence
  chemically synthesized
taaattgttgttttgttagt

SEQ ID NO: 223285 - DNA, 20 bp, Artificial Sequence
  chemically synthesized
attgttgttttgttagttag

SEQ ID NO: 223286 - DNA, 20 bp, Artificial Sequence
  chemically synthesized
ttgttgttttgttagttagt

SEQ ID NO: 223287 - DNA, 20 bp, Artificial Sequence
  chemically synthesized
tgttgttttgttagttagta

SEQ ID NO: 223288 - DNA, 20 bp, Artificial Sequence
  chemically synthesized
gaggtgatatgaaggatttt

SEQ ID NO: 223289 - DNA, 20 bp, Artificial Sequence
  chemically synthesized
gcttattggaggtgatatga

SEQ ID NO: 223290 - DNA, 20 bp, Artificial Sequence
  chemically synthesized
agcttattggaggtgatatg

SEQ ID NO: 223291 - DNA, 20 bp, Artificial Sequence
  chemically synthesized
tccttcatatcacctccaat

SEQ ID NO: 223292 - DNA, 20 bp, Artificial Sequence
  chemically synthesized
atttctcagaagcttattgg

SEQ ID NO: 223293 - DNA, 20 bp, Artificial Sequence
  chemically synthesized
tatttctcagaagcttattg

SEQ ID NO: 223294 - DNA, 20 bp, Artificial Sequence
  chemically synthesized
tttatttctcagaagcttat

SEQ ID NO: 223295 - DNA, 20 bp, Artificial Sequence
  chemically synthesized
atcacctccaataagcttct

SEQ ID NO: 223296 - DNA, 20 bp, Artificial Sequence
  chemically synthesized
tatatttatttatttctcag

SEQ ID NO: 223297 - DNA, 20 bp, Artificial Sequence
  chemically synthesized
tcttatatttatttatttct

SEQ ID NO: 223298 - DNA, 20 bp, Artificial Sequence
  chemically synthesized
tctgagaaataaataaatat

SEQ ID NO: 223299 - DNA, 20 bp, Artificial Sequence
  chemically synthesized
tccctgaaatgggatatgta

SEQ ID NO: 223300 - DNA, 20 bp, Artificial Sequence
  chemically synthesized
catccctgaaatgggatatg

SEQ ID NO: 223301 - DNA, 20 bp, Artificial Sequence
  chemically synthesized
agactctacatatcccattt

SEQ ID NO: 223302 - DNA, 20 bp, Artificial Sequence
  chemically synthesized
gactctacatatcccatttc

SEQ ID NO: 223303 - DNA, 20 bp, Artificial Sequence
  chemically synthesized
actctacatatcccatttca

SEQ ID NO: 223304 - DNA, 20 bp, Artificial Sequence
  chemically synthesized
ctgtaagtcatccctgaaat

SEQ ID NO: 223305 - DNA, 20 bp, Artificial Sequence
  chemically synthesized
tctgtaagtcatccctgaaa

SEQ ID NO: 223306 - DNA, 20 bp, Artificial Sequence
  chemically synthesized
cccatttcagggatgactta

SEQ ID NO: 223307 - DNA, 20 bp, Artificial Sequence
  chemically synthesized
catttcagggatgacttaca

SEQ ID NO: 223308 - DNA, 20 bp, Artificial Sequence
  chemically synthesized
atttcagggatgacttacag

SEQ ID NO: 223309 - DNA, 20 bp, Artificial Sequence
  chemically synthesized
tttcagggatgacttacaga

SEQ ID NO: 223310 - DNA, 20 bp, Artificial Sequence
  chemically synthesized
tttttattaagtccctctgt

SEQ ID NO: 223311 - DNA, 20 bp, Artificial Sequence
  chemically synthesized
gtttattctgcatttttatt

SEQ ID NO: 223312 - DNA, 20 bp, Artificial Sequence
  chemically synthesized
agagggacttaataaaaatg

SEQ ID NO: 223313 - DNA, 20 bp, Artificial Sequence
  chemically synthesized
acaaaacaaaacaaaaacaa

SEQ ID NO: 223314 - DNA, 20 bp, Artificial Sequence
  chemically synthesized
tttgttttgttttgttttac

SEQ ID NO: 223315 - DNA, 20 bp, Artificial Sequence
  chemically synthesized
taatcaaaggggagatattc

SEQ ID NO: 223316 - DNA, 20 bp, Artificial Sequence
  chemically synthesized
ttttttttttaatcaaaggg

SEQ ID NO: 223317 - DNA, 20 bp, Artificial Sequence
  chemically synthesized
ctttttttttttaatcaaag

SEQ ID NO: 223318 - DNA, 20 bp, Artificial Sequence
  chemically synthesized
tctttttttttttaatcaaa

SEQ ID NO: 223319 - DNA, 20 bp, Artificial Sequence
  chemically synthesized
atctttttttttttaatcaa

SEQ ID NO: 223320 - DNA, 20 bp, Artificial Sequence
  chemically synthesized
aatctttttttttttaatca

SEQ ID NO: 223321 - DNA, 20 bp, Artificial Sequence
  chemically synthesized
cccctttgattaaaaaaaaa

SEQ ID NO: 223322 - DNA, 20 bp, Artificial Sequence
  chemically synthesized
aaaaaaaaagattattgtaa

SEQ ID NO: 223323 - DNA, 20 bp, Artificial Sequence
  chemically synthesized
attgtaaaagatgatgctct

SEQ ID NO: 223324 - DNA, 20 bp, Artificial Sequence
  chemically synthesized
gccagtgtaaagcagactta

SEQ ID NO: 223325 - DNA, 20 bp, Artificial Sequence
  chemically synthesized
ctgccagtgtaaagcagact

SEQ ID NO: 223326 - DNA, 20 bp, Artificial Sequence
  chemically synthesized
tatggcctgccagtgtaaag

SEQ ID NO: 223327 - DNA, 20 bp, Artificial Sequence
  chemically synthesized
gctctaagtctgctttacac

SEQ ID NO: 223328 - DNA, 20 bp, Artificial Sequence
  chemically synthesized
gtctatggcctgccagtgta

SEQ ID NO: 223329 - DNA, 20 bp, Artificial Sequence
  chemically synthesized
ctaagtctgctttacactgg

SEQ ID NO: 223330 - DNA, 20 bp, Artificial Sequence
  chemically synthesized
taagtctgctttacactggc

SEQ ID NO: 223331 - DNA, 20 bp, Artificial Sequence
  chemically synthesized
tatgaatgtctatggcctgc

SEQ ID NO: 223332 - DNA, 20 bp, Artificial Sequence
  chemically synthesized
tgctttacactggcaggcca

SEQ ID NO: 223333 - DNA, 20 bp, Artificial Sequence
  chemically synthesized
aatttatttatgaatgtcta

SEQ ID NO: 223334 - DNA, 20 bp, Artificial Sequence
  chemically synthesized
taattcctatttcattttgt

SEQ ID NO: 223335 - DNA, 20 bp, Artificial Sequence
  chemically synthesized
ttaattcctatttcattttg

SEQ ID NO: 223336 - DNA, 20 bp, Artificial Sequence
  chemically synthesized
taaattcctacaaaatgaaa

SEQ ID NO: 223337 - DNA, 20 bp, Artificial Sequence
  chemically synthesized
aaattcctacaaaatgaaat

SEQ ID NO: 223338 - DNA, 20 bp, Artificial Sequence
  chemically synthesized
ttagctatagtatttgtaca

SEQ ID NO: 223339 - DNA, 20 bp, Artificial Sequence
  chemically synthesized
gttagctatagtatttgtac

SEQ ID NO: 223340 - DNA, 20 bp, Artificial Sequence
  chemically synthesized
taatccttgtacaaatacta

SEQ ID NO: 223341 - DNA, 20 bp, Artificial Sequence
  chemically synthesized
aaactgtacttagttagcta

SEQ ID NO: 223342 - DNA, 20 bp, Artificial Sequence
  chemically synthesized
tacaaatactatagctaact

SEQ ID NO: 223343 - DNA, 20 bp, Artificial Sequence
  chemically synthesized
ttctagaaactgtacttagt

SEQ ID NO: 223344 - DNA, 20 bp, Artificial Sequence
  chemically synthesized
atactatagctaactaagta

SEQ ID NO: 223345 - DNA, 20 bp, Artificial Sequence
  chemically synthesized
atacttctagaaactgtact

SEQ ID NO: 223346 - DNA, 20 bp, Artificial Sequence
  chemically synthesized
agctaactaagtacagtttc

SEQ ID NO: 223347 - DNA, 20 bp, Artificial Sequence
  chemically synthesized
taactaagtacagtttctag

SEQ ID NO: 223348 - DNA, 20 bp, Artificial Sequence
  chemically synthesized
ttcatttcaaaatatacttc

SEQ ID NO: 223349 - DNA, 20 bp, Artificial Sequence
  chemically synthesized
atgaaatttatgtatatcac

SEQ ID NO: 223350 - DNA, 20 bp, Artificial Sequence
  chemically synthesized
aaatgagtacaagttatcac

SEQ ID NO: 223351 - DNA, 20 bp, Artificial Sequence
  chemically synthesized
agaagcatttaaatgagtac

SEQ ID NO: 223352 - DNA, 20 bp, Artificial Sequence
  chemically synthesized
tgcttcagaagcatttaaat

SEQ ID NO: 223353 - DNA, 20 bp, Artificial Sequence
  chemically synthesized
tactcatttaaatgcttctg

SEQ ID NO: 223354 - DNA, 20 bp, Artificial Sequence
  chemically synthesized
ttctgaagagaatgcttcag

SEQ ID NO: 223355 - DNA, 20 bp, Artificial Sequence
  chemically synthesized
aacttctgaagagaatgctt

SEQ ID NO: 223356 - DNA, 20 bp, Artificial Sequence
  chemically synthesized
tgcttctgaagcattctctt

SEQ ID NO: 223357 - DNA, 20 bp, Artificial Sequence
  chemically synthesized
ttctgaagcattctcttcag

SEQ ID NO: 223358 - DNA, 20 bp, Artificial Sequence
  chemically synthesized
aaaagttattaacttctgaa

SEQ ID NO: 223359 - DNA, 20 bp, Artificial Sequence
  chemically synthesized
agaaaagttattaacttctg

SEQ ID NO: 223360 - DNA, 20 bp, Artificial Sequence
  chemically synthesized
tgatttgacttattttagaa

SEQ ID NO: 223361 - DNA, 20 bp, Artificial Sequence
  chemically synthesized
gttaataacttttctaaaat

SEQ ID NO: 223362 - DNA, 20 bp, Artificial Sequence
  chemically synthesized
ttgcatgatttgacttattt

SEQ ID NO: 223363 - DNA, 20 bp, Artificial Sequence
  chemically synthesized
aatttgacgaatataaattg

SEQ ID NO: 223364 - DNA, 20 bp, Artificial Sequence
  chemically synthesized
ctcggaaaccattttagcaa

SEQ ID NO: 223365 - DNA, 20 bp, Artificial Sequence
  chemically synthesized
caattttaccattgctaaaa

SEQ ID NO: 223366 - DNA, 20 bp, Artificial Sequence
  chemically synthesized
gtaatgctcggaaaccattt

SEQ ID NO: 223367 - DNA, 20 bp, Artificial Sequence
  chemically synthesized
ccattgctaaaatggtttcc

SEQ ID NO: 223368 - DNA, 20 bp, Artificial Sequence
  chemically synthesized
tgaactcttcttgtaatgct

SEQ ID NO: 223369 - DNA, 20 bp, Artificial Sequence
  chemically synthesized
aaatggtttccgagcattac

SEQ ID NO: 223370 - DNA, 20 bp, Artificial Sequence
  chemically synthesized
tggtttccgagcattacaag

SEQ ID NO: 223371 - DNA, 20 bp, Artificial Sequence
  chemically synthesized
gtttccgagcattacaagaa

SEQ ID NO: 223372 - DNA, 20 bp, Artificial Sequence
  chemically synthesized
cattacaagaagagttcact

SEQ ID NO: 223373 - DNA, 20 bp, Artificial Sequence
  chemically synthesized
tcagtgtaaagacagtagcc

SEQ ID NO: 223374 - DNA, 20 bp, Artificial Sequence
  chemically synthesized
agtattcagtgtaaagacag

SEQ ID NO: 223375 - DNA, 20 bp, Artificial Sequence
  chemically synthesized
caaagtattcagtgtaaaga

SEQ ID NO: 223376 - DNA, 20 bp, Artificial Sequence
  chemically synthesized
tcatcaaagtattcagtgta

SEQ ID NO: 223377 - DNA, 20 bp, Artificial Sequence
  chemically synthesized
tgtaacctcatcaaagtatt

SEQ ID NO: 223378 - DNA, 20 bp, Artificial Sequence
  chemically synthesized
tttacactgaatactttgat

SEQ ID NO: 223379 - DNA, 20 bp, Artificial Sequence
  chemically synthesized
ttacactgaatactttgatg

SEQ ID NO: 223380 - DNA, 20 bp, Artificial Sequence
  chemically synthesized
ttattattgtaacctcatca

SEQ ID NO: 223381 - DNA, 20 bp, Artificial Sequence
  chemically synthesized
ttgatgaggttacaataata

SEQ ID NO: 223382 - DNA, 20 bp, Artificial Sequence
  chemically synthesized
gttacaataataaagtgaca

SEQ ID NO: 223383 - DNA, 20 bp, Artificial Sequence
  chemically synthesized
ttttaaagaaaatggtataa

SEQ ID NO: 223384 - DNA, 20 bp, Artificial Sequence
  chemically synthesized
actcctttttttaaagaaaa

SEQ ID NO: 223385 - DNA, 20 bp, Artificial Sequence
  chemically synthesized
tataccattttctttaaaaa

SEQ ID NO: 223386 - DNA, 20 bp, Artificial Sequence
  chemically synthesized
ataccattttctttaaaaaa

SEQ ID NO: 223387 - DNA, 20 bp, Artificial Sequence
  chemically synthesized
attaaggactccttttttta

SEQ ID NO: 223388 - DNA, 20 bp, Artificial Sequence
  chemically synthesized
accattttctttaaaaaaag

SEQ ID NO: 223389 - DNA, 20 bp, Artificial Sequence
  chemically synthesized
ggagttcttagaaaaaatta

SEQ ID NO: 223390 - DNA, 20 bp, Artificial Sequence
  chemically synthesized
tggagttcttagaaaaaatt

SEQ ID NO: 223391 - DNA, 20 bp, Artificial Sequence
  chemically synthesized
aggagtccttaattttttct

SEQ ID NO: 223392 - DNA, 20 bp, Artificial Sequence
  chemically synthesized
ctttcatattttggagttct

SEQ ID NO: 223393 - DNA, 20 bp, Artificial Sequence
  chemically synthesized
ttttctactttcatattttg

SEQ ID NO: 223394 - DNA, 20 bp, Artificial Sequence
  chemically synthesized
ctttttctactttcatattt

SEQ ID NO: 223395 - DNA, 20 bp, Artificial Sequence
  chemically synthesized
ctaagaactccaaaatatga

SEQ ID NO: 223396 - DNA, 20 bp, Artificial Sequence
  chemically synthesized
agaactccaaaatatgaaag

SEQ ID NO: 223397 - DNA, 20 bp, Artificial Sequence
  chemically synthesized
ccaaaatatgaaagtagaaa

SEQ ID NO: 223398 - DNA, 20 bp, Artificial Sequence
  chemically synthesized
caaaatatgaaagtagaaaa

SEQ ID NO: 223399 - DNA, 20 bp, Artificial Sequence
  chemically synthesized
aatatgaaagtagaaaaagg

SEQ ID NO: 223400 - DNA, 20 bp, Artificial Sequence
  chemically synthesized
tcttgaaatgtattcagtca

SEQ ID NO: 223401 - DNA, 20 bp, Artificial Sequence
  chemically synthesized
catttttcttgaaatgtatt

SEQ ID NO: 223402 - DNA, 20 bp, Artificial Sequence
  chemically synthesized
gctatgactgaatacatttc

SEQ ID NO: 223403 - DNA, 20 bp, Artificial Sequence
  chemically synthesized
ctcagcagatcaatttaaga

SEQ ID NO: 223404 - DNA, 20 bp, Artificial Sequence
  chemically synthesized
tggactcagcagatcaattt

SEQ ID NO: 223405 - DNA, 20 bp, Artificial Sequence
  chemically synthesized
ctttcttaaattgatctgct

SEQ ID NO: 223406 - DNA, 20 bp, Artificial Sequence
  chemically synthesized
ttaaattgatctgctgagtc

SEQ ID NO: 223407 - DNA, 20 bp, Artificial Sequence
  chemically synthesized
gacatttctgctggactcag

SEQ ID NO: 223408 - DNA, 20 bp, Artificial Sequence
  chemically synthesized
aattgatctgctgagtccag

SEQ ID NO: 223409 - DNA, 20 bp, Artificial Sequence
  chemically synthesized
ggagacatttctgctggact

SEQ ID NO: 223410 - DNA, 20 bp, Artificial Sequence
  chemically synthesized
aaccttggagacatttctgc

SEQ ID NO: 223411 - DNA, 20 bp, Artificial Sequence
  chemically synthesized
agtccagcagaaatgtctcc

SEQ ID NO: 223412 - DNA, 20 bp, Artificial Sequence
  chemically synthesized
gtccagcagaaatgtctcca

SEQ ID NO: 223413 - DNA, 20 bp, Artificial Sequence
  chemically synthesized
ctcgtcacgagaaaaccttg

SEQ ID NO: 223414 - DNA, 20 bp, Artificial Sequence
  chemically synthesized
ggctcgtcacgagaaaacct

SEQ ID NO: 223415 - DNA, 20 bp, Artificial Sequence
  chemically synthesized
ctccaaggttttctcgtgac

SEQ ID NO: 223416 - DNA, 20 bp, Artificial Sequence
  chemically synthesized
ctttagccttggctcgtcac

SEQ ID NO: 223417 - DNA, 20 bp, Artificial Sequence
  chemically synthesized
aggttttctcgtgacgagcc

SEQ ID NO: 223418 - DNA, 20 bp, Artificial Sequence
  chemically synthesized
ggttttctcgtgacgagcca

SEQ ID NO: 223419 - DNA, 20 bp, Artificial Sequence
  chemically synthesized
ctcgtgacgagccaaggcta

SEQ ID NO: 223420 - DNA, 20 bp, Artificial Sequence
  chemically synthesized
tcgtgacgagccaaggctaa

SEQ ID NO: 223421 - DNA, 20 bp, Artificial Sequence
  chemically synthesized
tccgtgtatccctttagcct

SEQ ID NO: 223422 - DNA, 20 bp, Artificial Sequence
  chemically synthesized
cgtgacgagccaaggctaaa

SEQ ID NO: 223423 - DNA, 20 bp, Artificial Sequence
  chemically synthesized
gctggctccgtgtatccctt

SEQ ID NO: 223424 - DNA, 20 bp, Artificial Sequence
  chemically synthesized
gccaaggctaaagggataca

SEQ ID NO: 223425 - DNA, 20 bp, Artificial Sequence
  chemically synthesized
caaggctaaagggatacacg

SEQ ID NO: 223426 - DNA, 20 bp, Artificial Sequence
  chemically synthesized
gctaaagggatacacggagc

SEQ ID NO: 223427 - DNA, 20 bp, Artificial Sequence
  chemically synthesized
aaagggatacacggagccag

SEQ ID NO: 223428 - DNA, 20 bp, Artificial Sequence
  chemically synthesized
ggatacacggagccagcagt

SEQ ID NO: 223429 - DNA, 20 bp, Artificial Sequence
  chemically synthesized
atacacggagccagcagtta

SEQ ID NO: 223430 - DNA, 20 bp, Artificial Sequence
  chemically synthesized
cactagatgcctctaactgc

SEQ ID NO: 223431 - DNA, 20 bp, Artificial Sequence
  chemically synthesized
tacacggagccagcagttag

SEQ ID NO: 223432 - DNA, 20 bp, Artificial Sequence
  chemically synthesized
agccagcagttagaggcatc

SEQ ID NO: 223433 - DNA, 20 bp, Artificial Sequence
  chemically synthesized
cagcagttagaggcatctag

SEQ ID NO: 223434 - DNA, 20 bp, Artificial Sequence
  chemically synthesized
agcagttagaggcatctagt

SEQ ID NO: 223435 - DNA, 20 bp, Artificial Sequence
  chemically synthesized
gcagttagaggcatctagtg

SEQ ID NO: 223436 - DNA, 20 bp, Artificial Sequence
  chemically synthesized
ttaattaaccggtgccccac

SEQ ID NO: 223437 - DNA, 20 bp, Artificial Sequence
  chemically synthesized
agaggcatctagtggggcac

SEQ ID NO: 223438 - DNA, 20 bp, Artificial Sequence
  chemically synthesized
agaagaaaaagttaattaac

SEQ ID NO: 223439 - DNA, 20 bp, Artificial Sequence
  chemically synthesized
aacttgaagcatagaagaaa

SEQ ID NO: 223440 - DNA, 20 bp, Artificial Sequence
  chemically synthesized
cattgaaacttgaagcatag

SEQ ID NO: 223441 - DNA, 20 bp, Artificial Sequence
  chemically synthesized
aactttttcttctatgcttc

SEQ ID NO: 223442 - DNA, 20 bp, Artificial Sequence
  chemically synthesized
aggcattgaaacttgaagca

SEQ ID NO: 223443 - DNA, 20 bp, Artificial Sequence
  chemically synthesized
ggtataggcattgaaacttg

SEQ ID NO: 223444 - DNA, 20 bp, Artificial Sequence
  chemically synthesized
agaacaaaaggtattggtat

SEQ ID NO: 223445 - DNA, 20 bp, Artificial Sequence
  chemically synthesized
aagaacaaaaggtattggta

SEQ ID NO: 223446 - DNA, 20 bp, Artificial Sequence
  chemically synthesized
atgcaaagaacaaaaggtat

SEQ ID NO: 223447 - DNA, 20 bp, Artificial Sequence
  chemically synthesized
tatcctatgcaaagaacaaa

SEQ ID NO: 223448 - DNA, 20 bp, Artificial Sequence
  chemically synthesized
atatcctatgcaaagaacaa

SEQ ID NO: 223449 - DNA, 20 bp, Artificial Sequence
  chemically synthesized
aataccttttgttctttgca

SEQ ID NO: 223450 - DNA, 20 bp, Artificial Sequence
  chemically synthesized
ataccttttgttctttgcat

SEQ ID NO: 223451 - DNA, 20 bp, Artificial Sequence
  chemically synthesized
ggtgcataatatcctatgca

SEQ ID NO: 223452 - DNA, 20 bp, Artificial Sequence
  chemically synthesized
tatgagtattgtttcatttt

SEQ ID NO: 223453 - DNA, 20 bp, Artificial Sequence
  chemically synthesized
tgaaacaatactcataaaaa

SEQ ID NO: 223454 - DNA, 20 bp, Artificial Sequence
  chemically synthesized
taaatattagctgtttttat

SEQ ID NO: 223455 - DNA, 20 bp, Artificial Sequence
  chemically synthesized
tactcatgctcattaaatat

SEQ ID NO: 223456 - DNA, 20 bp, Artificial Sequence
  chemically synthesized
aaaaacagctaatatttaat

SEQ ID NO: 223457 - DNA, 20 bp, Artificial Sequence
  chemically synthesized
agctaatatttaatgagcat

SEQ ID NO: 223458 - DNA, 20 bp, Artificial Sequence
  chemically synthesized
caagtgttgagaatcacaat

SEQ ID NO: 223459 - DNA, 20 bp, Artificial Sequence
  chemically synthesized
caattgtgattctcaacact

SEQ ID NO: 223460 - DNA, 20 bp, Artificial Sequence
  chemically synthesized
aatgatatatgccaagtgtt

SEQ ID NO: 223461 - DNA, 20 bp, Artificial Sequence
  chemically synthesized
cgaatgaaatgatatatgcc

SEQ ID NO: 223462 - DNA, 20 bp, Artificial Sequence
  chemically synthesized
atatcatttcattcgttttt

SEQ ID NO: 223463 - DNA, 20 bp, Artificial Sequence
  chemically synthesized
cgtttttaagtctactctat

SEQ ID NO: 223464 - DNA, 20 bp, Artificial Sequence
  chemically synthesized
atgctacttatctcatagag

SEQ ID NO: 223465 - DNA, 20 bp, Artificial Sequence
  chemically synthesized
ataatgctacttatctcata

SEQ ID NO: 223466 - DNA, 20 bp, Artificial Sequence
  chemically synthesized
ttaagtctactctatgagat

SEQ ID NO: 223467 - DNA, 20 bp, Artificial Sequence
  chemically synthesized
caataatgctacttatctca

SEQ ID NO: 223468 - DNA, 20 bp, Artificial Sequence
  chemically synthesized
agtctactctatgagataag

SEQ ID NO: 223469 - DNA, 20 bp, Artificial Sequence
  chemically synthesized
gcattattgtgctgatttta

SEQ ID NO: 223470 - DNA, 20 bp, Artificial Sequence
  chemically synthesized
cagttttgcatctgtaaaat

SEQ ID NO: 223471 - DNA, 20 bp, Artificial Sequence
  chemically synthesized
attttacagatgcaaaactg

SEQ ID NO: 223472 - DNA, 20 bp, Artificial Sequence
  chemically synthesized
acagatgcaaaactgtggcc

SEQ ID NO: 223473 - DNA, 20 bp, Artificial Sequence
  chemically synthesized
agatgcaaaactgtggccca

SEQ ID NO: 223474 - DNA, 20 bp, Artificial Sequence
  chemically synthesized
ctattgacctctctgggcca

SEQ ID NO: 223475 - DNA, 20 bp, Artificial Sequence
  chemically synthesized
atgcaaaactgtggcccaga

SEQ ID NO: 223476 - DNA, 20 bp, Artificial Sequence
  chemically synthesized
tgcaaaactgtggcccagag

SEQ ID NO: 223477 - DNA, 20 bp, Artificial Sequence
  chemically synthesized
gaaattctattgacctctct

SEQ ID NO: 223478 - DNA, 20 bp, Artificial Sequence
  chemically synthesized
tgaaattctattgacctctc

SEQ ID NO: 223479 - DNA, 20 bp, Artificial Sequence
  chemically synthesized
ctgtggcccagagaggtcaa

SEQ ID NO: 223480 - DNA, 20 bp, Artificial Sequence
  chemically synthesized
cagagaggtcaatagaattt

SEQ ID NO: 223481 - DNA, 20 bp, Artificial Sequence
  chemically synthesized
agagaggtcaatagaatttc

SEQ ID NO: 223482 - DNA, 20 bp, Artificial Sequence
  chemically synthesized
tcaatagaatttcaggtgta

SEQ ID NO: 223483 - DNA, 20 bp, Artificial Sequence
  chemically synthesized
ataccatagttaggatatta

SEQ ID NO: 223484 - DNA, 20 bp, Artificial Sequence
  chemically synthesized
gaaccataatatcctaacta

SEQ ID NO: 223485 - DNA, 20 bp, Artificial Sequence
  chemically synthesized
attatatttataccatagtt

SEQ ID NO: 223486 - DNA, 20 bp, Artificial Sequence
  chemically synthesized
tattatatttataccatagt

SEQ ID NO: 223487 - DNA, 20 bp, Artificial Sequence
  chemically synthesized
ggcatattatatttatacca

SEQ ID NO: 223488 - DNA, 20 bp, Artificial Sequence
  chemically synthesized
aaatataatatgccataaaa

SEQ ID NO: 223489 - DNA, 20 bp, Artificial Sequence
  chemically synthesized
aatataatatgccataaaat

SEQ ID NO: 223490 - DNA, 20 bp, Artificial Sequence
  chemically synthesized
cttaccacgtgcctatttta

SEQ ID NO: 223491 - DNA, 20 bp, Artificial Sequence
  chemically synthesized
tatgccataaaataggcacg

SEQ ID NO: 223492 - DNA, 20 bp, Artificial Sequence
  chemically synthesized
ccataaaataggcacgtggt

SEQ ID NO: 223493 - DNA, 20 bp, Artificial Sequence
  chemically synthesized
tggtaagtgtttgctgacta

SEQ ID NO: 223494 - DNA, 20 bp, Artificial Sequence
  chemically synthesized
cacattcttcaatctttagt

SEQ ID NO: 223495 - DNA, 20 bp, Artificial Sequence
  chemically synthesized
tgtttgctgactaaagattg

SEQ ID NO: 223496 - DNA, 20 bp, Artificial Sequence
  chemically synthesized
acaacacattcttcaatctt

SEQ ID NO: 223497 - DNA, 20 bp, Artificial Sequence
  chemically synthesized
gattgaagaatgtgttgtaa

SEQ ID NO: 223498 - DNA, 20 bp, Artificial Sequence
  chemically synthesized
ttgaagaatgtgttgtaatg

SEQ ID NO: 223499 - DNA, 20 bp, Artificial Sequence
  chemically synthesized
gtaatggagtctattaatta

SEQ ID NO: 223500 - DNA, 20 bp, Artificial Sequence
  chemically synthesized
aattccctgtctttaattaa

SEQ ID NO: 223501 - DNA, 20 bp, Artificial Sequence
  chemically synthesized
tggagtctattaattaaaga

SEQ ID NO: 223502 - DNA, 20 bp, Artificial Sequence
  chemically synthesized
ggagtctattaattaaagac

SEQ ID NO: 223503 - DNA, 20 bp, Artificial Sequence
  chemically synthesized
gagtctattaattaaagaca

SEQ ID NO: 223504 - DNA, 20 bp, Artificial Sequence
  chemically synthesized
ttaattaaagacagggaatt

SEQ ID NO: 223505 - DNA, 20 bp, Artificial Sequence
  chemically synthesized
aaagacagggaatttggacc

SEQ ID NO: 223506 - DNA, 20 bp, Artificial Sequence
  chemically synthesized
acagggaatttggacccaga

SEQ ID NO: 223507 - DNA, 20 bp, Artificial Sequence
  chemically synthesized
agaccaagccaaatctttct

SEQ ID NO: 223508 - DNA, 20 bp, Artificial Sequence
  chemically synthesized
aagaccaagccaaatctttc

SEQ ID NO: 223509 - DNA, 20 bp, Artificial Sequence
  chemically synthesized
aatttggacccagaaagatt

SEQ ID NO: 223510 - DNA, 20 bp, Artificial Sequence
  chemically synthesized
ggacccagaaagatttggct

SEQ ID NO: 223511 - DNA, 20 bp, Artificial Sequence
  chemically synthesized
tagatggccaatataagacc

SEQ ID NO: 223512 - DNA, 20 bp, Artificial Sequence
  chemically synthesized
gatttggcttggtcttatat

SEQ ID NO: 223513 - DNA, 20 bp, Artificial Sequence
  chemically synthesized
tcttagtagatggccaatat

SEQ ID NO: 223514 - DNA, 20 bp, Artificial Sequence
  chemically synthesized
tcttatattggccatctact

SEQ ID NO: 223515 - DNA, 20 bp, Artificial Sequence
  chemically synthesized
ttccaaactgtcttagtaga

SEQ ID NO: 223516 - DNA, 20 bp, Artificial Sequence
  chemically synthesized
atattggccatctactaaga

SEQ ID NO: 223517 - DNA, 20 bp, Artificial Sequence
  chemically synthesized
aagtttccaaactgtcttag

SEQ ID NO: 223518 - DNA, 20 bp, Artificial Sequence
  chemically synthesized
ataaagtttccaaactgtct

SEQ ID NO: 223519 - DNA, 20 bp, Artificial Sequence
  chemically synthesized
ggccatctactaagacagtt

SEQ ID NO: 223520 - DNA, 20 bp, Artificial Sequence
  chemically synthesized
aaatagaaactttattgata

SEQ ID NO: 223521 - DNA, 20 bp, Artificial Sequence
  chemically synthesized
gtttggaaactttatcaata

SEQ ID NO: 223522 - DNA, 20 bp, Artificial Sequence
  chemically synthesized
tatcaataaagtttctattt

SEQ ID NO: 223523 - DNA, 20 bp, Artificial Sequence
  chemically synthesized
tcaataaagtttctatttta

SEQ ID NO: 223524 - DNA, 20 bp, Artificial Sequence
  chemically synthesized
aactaagatattctctaaaa

SEQ ID NO: 223525 - DNA, 20 bp, Artificial Sequence
  chemically synthesized
ttctattttagagaatatct

SEQ ID NO: 223526 - DNA, 20 bp, Artificial Sequence
  chemically synthesized
ttttagagaatatcttagtt

SEQ ID NO: 223527 - DNA, 20 bp, Artificial Sequence
  chemically synthesized
tttagagaatatcttagttt

SEQ ID NO: 223528 - DNA, 20 bp, Artificial Sequence
  chemically synthesized
ccatttagggaacccaaact

SEQ ID NO: 223529 - DNA, 20 bp, Artificial Sequence
  chemically synthesized
cttagtttgggttccctaaa

SEQ ID NO: 223530 - DNA, 20 bp, Artificial Sequence
  chemically synthesized
tagtttgggttccctaaatg

SEQ ID NO: 223531 - DNA, 20 bp, Artificial Sequence
  chemically synthesized
agtttgggttccctaaatgg

SEQ ID NO: 223532 - DNA, 20 bp, Artificial Sequence
  chemically synthesized
catctcagaacctccattta

SEQ ID NO: 223533 - DNA, 20 bp, Artificial Sequence
  chemically synthesized
tcatctcagaacctccattt

SEQ ID NO: 223534 - DNA, 20 bp, Artificial Sequence
  chemically synthesized
ttcatctcagaacctccatt

SEQ ID NO: 223535 - DNA, 20 bp, Artificial Sequence
  chemically synthesized
gttccctaaatggaggttct

SEQ ID NO: 223536 - DNA, 20 bp, Artificial Sequence
  chemically synthesized
taaatggaggttctgagatg

SEQ ID NO: 223537 - DNA, 20 bp, Artificial Sequence
  chemically synthesized
ttttgcatgaagcttcatct

SEQ ID NO: 223538 - DNA, 20 bp, Artificial Sequence
  chemically synthesized
cattagatcatttttgcatg

SEQ ID NO: 223539 - DNA, 20 bp, Artificial Sequence
  chemically synthesized
ttcatgcaaaaatgatctaa

SEQ ID NO: 223540 - DNA, 20 bp, Artificial Sequence
  chemically synthesized
tcatgcaaaaatgatctaat

SEQ ID NO: 223541 - DNA, 20 bp, Artificial Sequence
  chemically synthesized
ttcttgaaaacacatcccat

SEQ ID NO: 223542 - DNA, 20 bp, Artificial Sequence
  chemically synthesized
atctaatgggatgtgttttc

SEQ ID NO: 223543 - DNA, 20 bp, Artificial Sequence
  chemically synthesized
gatgtgttttcaagaaacac

SEQ ID NO: 223544 - DNA, 20 bp, Artificial Sequence
  chemically synthesized
tgttttcaagaaacactggt

SEQ ID NO: 223545 - DNA, 20 bp, Artificial Sequence
  chemically synthesized
gttttcaagaaacactggta

SEQ ID NO: 223546 - DNA, 20 bp, Artificial Sequence
  chemically synthesized
ttttcaagaaacactggtaa

SEQ ID NO: 223547 - DNA, 20 bp, Artificial Sequence
  chemically synthesized
ctcacttcattttcccttac

SEQ ID NO: 223548 - DNA, 20 bp, Artificial Sequence
  chemically synthesized
aacactggtaagggaaaatg

SEQ ID NO: 223549 - DNA, 20 bp, Artificial Sequence
  chemically synthesized
ctggtaagggaaaatgaagt

SEQ ID NO: 223550 - DNA, 20 bp, Artificial Sequence
  chemically synthesized
aagggaaaatgaagtgagat

SEQ ID NO: 223551 - DNA, 20 bp, Artificial Sequence
  chemically synthesized
agggaaaatgaagtgagatt

SEQ ID NO: 223552 - DNA, 20 bp, Artificial Sequence
  chemically synthesized
gaaaatgaagtgagattggg

SEQ ID NO: 223553 - DNA, 20 bp, Artificial Sequence
  chemically synthesized
aaaatgaagtgagattggga

SEQ ID NO: 223554 - DNA, 20 bp, Artificial Sequence
  chemically synthesized
aaatgaagtgagattgggaa

SEQ ID NO: 223555 - DNA, 20 bp, Artificial Sequence
  chemically synthesized
agtgagattgggaagggaaa

SEQ ID NO: 223556 - DNA, 20 bp, Artificial Sequence
  chemically synthesized
ttttatgccatatatgtgtt

SEQ ID NO: 223557 - DNA, 20 bp, Artificial Sequence
  chemically synthesized
aaacagaccaaacacatata

SEQ ID NO: 223558 - DNA, 20 bp, Artificial Sequence
  chemically synthesized
caaacacatatatggcataa

SEQ ID NO: 223559 - DNA, 20 bp, Artificial Sequence
  chemically synthesized
acatatatggcataaaagcc

SEQ ID NO: 223560 - DNA, 20 bp, Artificial Sequence
  chemically synthesized
catatatggcataaaagccc

SEQ ID NO: 223561 - DNA, 20 bp, Artificial Sequence
  chemically synthesized
atatatggcataaaagccca

SEQ ID NO: 223562 - DNA, 20 bp, Artificial Sequence
  chemically synthesized
tatggcataaaagcccaggg

SEQ ID NO: 223563 - DNA, 20 bp, Artificial Sequence
  chemically synthesized
ggcataaaagcccagggtgg

SEQ ID NO: 223564 - DNA, 20 bp, Artificial Sequence
  chemically synthesized
gtgaatggcactgccaccct

SEQ ID NO: 223565 - DNA, 20 bp, Artificial Sequence
  chemically synthesized
tgtgaatggcactgccaccc

SEQ ID NO: 223566 - DNA, 20 bp, Artificial Sequence
  chemically synthesized
gagaaattcagaagtgtgaa

SEQ ID NO: 223567 - DNA, 20 bp, Artificial Sequence
  chemically synthesized
ttcccaactgagaaattcag

SEQ ID NO: 223568 - DNA, 20 bp, Artificial Sequence
  chemically synthesized
attcacacttctgaatttct

SEQ ID NO: 223569 - DNA, 20 bp, Artificial Sequence
  chemically synthesized
ttgttcccaactgagaaatt

SEQ ID NO: 223570 - DNA, 20 bp, Artificial Sequence
  chemically synthesized
acacttctgaatttctcagt

SEQ ID NO: 223571 - DNA, 20 bp, Artificial Sequence
  chemically synthesized
cacttctgaatttctcagtt

SEQ ID NO: 223572 - DNA, 20 bp, Artificial Sequence
  chemically synthesized
gagctttcttgttcccaact

SEQ ID NO: 223573 - DNA, 20 bp, Artificial Sequence
  chemically synthesized
tgaatttctcagttgggaac

SEQ ID NO: 223574 - DNA, 20 bp, Artificial Sequence
  chemically synthesized
tttctcagttgggaacaaga

SEQ ID NO: 223575 - DNA, 20 bp, Artificial Sequence
  chemically synthesized
ttgcagacacataaatacgt

SEQ ID NO: 223576 - DNA, 20 bp, Artificial Sequence
  chemically synthesized
cgtatttatgtgtctgcaac

SEQ ID NO: 223577 - DNA, 20 bp, Artificial Sequence
  chemically synthesized
atttatgtgtctgcaaccag

SEQ ID NO: 223578 - DNA, 20 bp, Artificial Sequence
  chemically synthesized
taatcaatgactgctggttg

SEQ ID NO: 223579 - DNA, 20 bp, Artificial Sequence
  chemically synthesized
agcccttaatcaatgactgc

SEQ ID NO: 223580 - DNA, 20 bp, Artificial Sequence
  chemically synthesized
gcaaccagcagtcattgatt

SEQ ID NO: 223581 - DNA, 20 bp, Artificial Sequence
  chemically synthesized
caaccagcagtcattgatta

SEQ ID NO: 223582 - DNA, 20 bp, Artificial Sequence
  chemically synthesized
aaccagcagtcattgattaa

SEQ ID NO: 223583 - DNA, 20 bp, Artificial Sequence
  chemically synthesized
tttatgtccctgtgtgtggg

SEQ ID NO: 223584 - DNA, 20 bp, Artificial Sequence
  chemically synthesized
gattaagggcttcccacaca

SEQ ID NO: 223585 - DNA, 20 bp, Artificial Sequence
  chemically synthesized
attaagggcttcccacacac

SEQ ID NO: 223586 - DNA, 20 bp, Artificial Sequence
  chemically synthesized
ttaagggcttcccacacaca

SEQ ID NO: 223587 - DNA, 20 bp, Artificial Sequence
  chemically synthesized
gaatttatgtccctgtgtgt

SEQ ID NO: 223588 - DNA, 20 bp, Artificial Sequence
  chemically synthesized
ggaatttatgtccctgtgtg

SEQ ID NO: 223589 - DNA, 20 bp, Artificial Sequence
  chemically synthesized
acacacagggacataaattc

SEQ ID NO: 223590 - DNA, 20 bp, Artificial Sequence
  chemically synthesized
cacacagggacataaattcc

SEQ ID NO: 223591 - DNA, 20 bp, Artificial Sequence
  chemically synthesized
cagggacataaattccagga

SEQ ID NO: 223592 - DNA, 20 bp, Artificial Sequence
  chemically synthesized
agagagagatggatctatcc

SEQ ID NO: 223593 - DNA, 20 bp, Artificial Sequence
  chemically synthesized
ggtctgtgtaaagagagaga

SEQ ID NO: 223594 - DNA, 20 bp, Artificial Sequence
  chemically synthesized
atttggtctgtgtaaagaga

SEQ ID NO: 223595 - DNA, 20 bp, Artificial Sequence
  chemically synthesized
ctatttggtctgtgtaaaga

SEQ ID NO: 223596 - DNA, 20 bp, Artificial Sequence
  chemically synthesized
gatccatctctctctttaca

SEQ ID NO: 223597 - DNA, 20 bp, Artificial Sequence
  chemically synthesized
gcctatttggtctgtgtaaa

SEQ ID NO: 223598 - DNA, 20 bp, Artificial Sequence
  chemically synthesized
gagcctatttggtctgtgta

SEQ ID NO: 223599 - DNA, 20 bp, Artificial Sequence
  chemically synthesized
ctctctttacacagaccaaa

SEQ ID NO: 223600 - DNA, 20 bp, Artificial Sequence
  chemically synthesized
tctctttacacagaccaaat

SEQ ID NO: 223601 - DNA, 20 bp, Artificial Sequence
  chemically synthesized
tgaggctgccagagcctatt

SEQ ID NO: 223602 - DNA, 20 bp, Artificial Sequence
  chemically synthesized
tacacagaccaaataggctc

SEQ ID NO: 223603 - DNA, 20 bp, Artificial Sequence
  chemically synthesized
acagaccaaataggctctgg

SEQ ID NO: 223604 - DNA, 20 bp, Artificial Sequence
  chemically synthesized
gggtggccttgaggctgcca

SEQ ID NO: 223605 - DNA, 20 bp, Artificial Sequence
  chemically synthesized
gagggtggccttgaggctgc

SEQ ID NO: 223606 - DNA, 20 bp, Artificial Sequence
  chemically synthesized
aaataggctctggcagcctc

SEQ ID NO: 223607 - DNA, 20 bp, Artificial Sequence
  chemically synthesized
aataggctctggcagcctca

SEQ ID NO: 223608 - DNA, 20 bp, Artificial Sequence
  chemically synthesized
tctgttggagggtggccttg

SEQ ID NO: 223609 - DNA, 20 bp, Artificial Sequence
  chemically synthesized
ctctgttggagggtggcctt

SEQ ID NO: 223610 - DNA, 20 bp, Artificial Sequence
  chemically synthesized
ctaatcgctctgttggaggg

SEQ ID NO: 223611 - DNA, 20 bp, Artificial Sequence
  chemically synthesized
gcctcaaggccaccctccaa

SEQ ID NO: 223612 - DNA, 20 bp, Artificial Sequence
  chemically synthesized
ctcaaggccaccctccaaca

SEQ ID NO: 223613 - DNA, 20 bp, Artificial Sequence
  chemically synthesized
tccctaatcgctctgttgga

SEQ ID NO: 223614 - DNA, 20 bp, Artificial Sequence
  chemically synthesized
ctccctaatcgctctgttgg

SEQ ID NO: 223615 - DNA, 20 bp, Artificial Sequence
  chemically synthesized
gctccctaatcgctctgttg

SEQ ID NO: 223616 - DNA, 20 bp, Artificial Sequence
  chemically synthesized
tagctccctaatcgctctgt

SEQ ID NO: 223617 - DNA, 20 bp, Artificial Sequence
  chemically synthesized
ccaccctccaacagagcgat

SEQ ID NO: 223618 - DNA, 20 bp, Artificial Sequence
  chemically synthesized
caccctccaacagagcgatt

SEQ ID NO: 223619 - DNA, 20 bp, Artificial Sequence
  chemically synthesized
accctccaacagagcgatta

SEQ ID NO: 223620 - DNA, 20 bp, Artificial Sequence
  chemically synthesized
cctccaacagagcgattagg

SEQ ID NO: 223621 - DNA, 20 bp, Artificial Sequence
  chemically synthesized
caacagagcgattagggagc

SEQ ID NO: 223622 - DNA, 20 bp, Artificial Sequence
  chemically synthesized
gcgattagggagctagttgt

SEQ ID NO: 223623 - DNA, 20 bp, Artificial Sequence
  chemically synthesized
cgattagggagctagttgtt

SEQ ID NO: 223624 - DNA, 20 bp, Artificial Sequence
  chemically synthesized
gtgcttttactcccaacaac

SEQ ID NO: 223625 - DNA, 20 bp, Artificial Sequence
  chemically synthesized
attagggagctagttgttgg

SEQ ID NO: 223626 - DNA, 20 bp, Artificial Sequence
  chemically synthesized
gagctagttgttgggagtaa

SEQ ID NO: 223627 - DNA, 20 bp, Artificial Sequence
  chemically synthesized
agttgttgggagtaaaagca

SEQ ID NO: 223628 - DNA, 20 bp, Artificial Sequence
  chemically synthesized
tgttgggagtaaaagcacag

SEQ ID NO: 223629 - DNA, 20 bp, Artificial Sequence
  chemically synthesized
gttgggagtaaaagcacagc

SEQ ID NO: 223630 - DNA, 20 bp, Artificial Sequence
  chemically synthesized
ttgggagtaaaagcacagca

SEQ ID NO: 223631 - DNA, 20 bp, Artificial Sequence
  chemically synthesized
acagcagggaaaatgttaaa

SEQ ID NO: 223632 - DNA, 20 bp, Artificial Sequence
  chemically synthesized
aaaatgttaaacggatgtga

SEQ ID NO: 223633 - DNA, 20 bp, Artificial Sequence
  chemically synthesized
aaatgttaaacggatgtgaa

SEQ ID NO: 223634 - DNA, 20 bp, Artificial Sequence
  chemically synthesized
aaacggatgtgaaaggatat

SEQ ID NO: 223635 - DNA, 20 bp, Artificial Sequence
  chemically synthesized
cggatgtgaaaggatatgag

SEQ ID NO: 223636 - DNA, 20 bp, Artificial Sequence
  chemically synthesized
ggatatgagtggatcaatga

SEQ ID NO: 223637 - DNA, 20 bp, Artificial Sequence
  chemically synthesized
gatcaatgacagcatctcta

SEQ ID NO: 223638 - DNA, 20 bp, Artificial Sequence
  chemically synthesized
tcaatgacagcatctctaca

SEQ ID NO: 223639 - DNA, 20 bp, Artificial Sequence
  chemically synthesized
gaagaaacaagttctctgta

SEQ ID NO: 223640 - DNA, 20 bp, Artificial Sequence
  chemically synthesized
atgaagaaacaagttctctg

SEQ ID NO: 223641 - DNA, 20 bp, Artificial Sequence
  chemically synthesized
ttattcctgaatgaagaaac

SEQ ID NO: 223642 - DNA, 20 bp, Artificial Sequence
  chemically synthesized
agagaacttgtttcttcatt

SEQ ID NO: 223643 - DNA, 20 bp, Artificial Sequence
  chemically synthesized
gagaacttgtttcttcattc

SEQ ID NO: 223644 - DNA, 20 bp, Artificial Sequence
  chemically synthesized
gttatttttattcctgaatg

SEQ ID NO: 223645 - DNA, 20 bp, Artificial Sequence
  chemically synthesized
attcaggaataaaaataacg

SEQ ID NO: 223646 - DNA, 20 bp, Artificial Sequence
  chemically synthesized
aggaataaaaataacgtgga

SEQ ID NO: 223647 - DNA, 20 bp, Artificial Sequence
  chemically synthesized
aaaataacgtggaaagttat

SEQ ID NO: 223648 - DNA, 20 bp, Artificial Sequence
  chemically synthesized
aaataacgtggaaagttatg

SEQ ID NO: 223649 - DNA, 20 bp, Artificial Sequence
  chemically synthesized
ggaaagttatgaggataaaa

SEQ ID NO: 223650 - DNA, 20 bp, Artificial Sequence
  chemically synthesized
gaaagttatgaggataaaac

SEQ ID NO: 223651 - DNA, 20 bp, Artificial Sequence
  chemically synthesized
aaagttatgaggataaaaca

SEQ ID NO: 223652 - DNA, 20 bp, Artificial Sequence
  chemically synthesized
aaaacagggtaatgtgttca

SEQ ID NO: 223653 - DNA, 20 bp, Artificial Sequence
  chemically synthesized
ggtaatgtgttcaaagccct

SEQ ID NO: 223654 - DNA, 20 bp, Artificial Sequence
  chemically synthesized
tgtgttcaaagcccttagcc

SEQ ID NO: 223655 - DNA, 20 bp, Artificial Sequence
  chemically synthesized
gtgttcaaagcccttagcct

SEQ ID NO: 223656 - DNA, 20 bp, Artificial Sequence
  chemically synthesized
tgtgccagtgcccaggctaa

SEQ ID NO: 223657 - DNA, 20 bp, Artificial Sequence
  chemically synthesized
gtgtgccagtgcccaggcta

SEQ ID NO: 223658 - DNA, 20 bp, Artificial Sequence
  chemically synthesized
tgtgtgccagtgcccaggct

SEQ ID NO: 223659 - DNA, 20 bp, Artificial Sequence
  chemically synthesized
aaagcccttagcctgggcac

SEQ ID NO: 223660 - DNA, 20 bp, Artificial Sequence
  chemically synthesized
gttgctgtgtgccagtgccc

SEQ ID NO: 223661 - DNA, 20 bp, Artificial Sequence
  chemically synthesized
tgttgctgtgtgccagtgcc

SEQ ID NO: 223662 - DNA, 20 bp, Artificial Sequence
  chemically synthesized
ttagcctgggcactggcaca

SEQ ID NO: 223663 - DNA, 20 bp, Artificial Sequence
  chemically synthesized
cagtgagtgttgctgtgtgc

SEQ ID NO: 223664 - DNA, 20 bp, Artificial Sequence
  chemically synthesized
tggcacacagcaacactcac

SEQ ID NO: 223665 - DNA, 20 bp, Artificial Sequence
  chemically synthesized
cacaacaagagagtgccagt

SEQ ID NO: 223666 - DNA, 20 bp, Artificial Sequence
  chemically synthesized
tcctcacaacaagagagtgc

SEQ ID NO: 223667 - DNA, 20 bp, Artificial Sequence
  chemically synthesized
attccatcctcacaacaaga

SEQ ID NO: 223668 - DNA, 20 bp, Artificial Sequence
  chemically synthesized
cactggcactctcttgttgt

SEQ ID NO: 223669 - DNA, 20 bp, Artificial Sequence
  chemically synthesized
acattccatcctcacaacaa

SEQ ID NO: 223670 - DNA, 20 bp, Artificial Sequence
  chemically synthesized
actggcactctcttgttgtg

SEQ ID NO: 223671 - DNA, 20 bp, Artificial Sequence
  chemically synthesized
ttacattccatcctcacaac

SEQ ID NO: 223672 - DNA, 20 bp, Artificial Sequence
  chemically synthesized
gcactctcttgttgtgagga

SEQ ID NO: 223673 - DNA, 20 bp, Artificial Sequence
  chemically synthesized
ggatggaatgtaatactgtg

SEQ ID NO: 223674 - DNA, 20 bp, Artificial Sequence
  chemically synthesized
caggtgctgtcagttcttca

SEQ ID NO: 223675 - DNA, 20 bp, Artificial Sequence
  chemically synthesized
gtaatactgtgaagaactga

SEQ ID NO: 223676 - DNA, 20 bp, Artificial Sequence
  chemically synthesized
tttcatgtgccaggtgctgt

SEQ ID NO: 223677 - DNA, 20 bp, Artificial Sequence
  chemically synthesized
tgtgaagaactgacagcacc

SEQ ID NO: 223678 - DNA, 20 bp, Artificial Sequence
  chemically synthesized
atctgatgttttcatgtgcc

SEQ ID NO: 223679 - DNA, 20 bp, Artificial Sequence
  chemically synthesized
tatctgatgttttcatgtgc

SEQ ID NO: 223680 - DNA, 20 bp, Artificial Sequence
  chemically synthesized
cacctggcacatgaaaacat

SEQ ID NO: 223681 - DNA, 20 bp, Artificial Sequence
  chemically synthesized
tggcacatgaaaacatcaga

SEQ ID NO: 223682 - DNA, 20 bp, Artificial Sequence
  chemically synthesized
acatgaaaacatcagatagc

SEQ ID NO: 223683 - DNA, 20 bp, Artificial Sequence
  chemically synthesized
ggaaaaatgattggcaatgc

SEQ ID NO: 223684 - DNA, 20 bp, Artificial Sequence
  chemically synthesized
actgcaataggaaaaatgat

SEQ ID NO: 223685 - DNA, 20 bp, Artificial Sequence
  chemically synthesized
gccaatcatttttcctattg

SEQ ID NO: 223686 - DNA, 20 bp, Artificial Sequence
  chemically synthesized
gcggcaccggcaactgcaat

SEQ ID NO: 223687 - DNA, 20 bp, Artificial Sequence
  chemically synthesized
agcggcaccggcaactgcaa

SEQ ID NO: 223688 - DNA, 20 bp, Artificial Sequence
  chemically synthesized
atttttcctattgcagttgc

SEQ ID NO: 223689 - DNA, 20 bp, Artificial Sequence
  chemically synthesized
attgcagttgccggtgccgc

SEQ ID NO: 223690 - DNA, 20 bp, Artificial Sequence
  chemically synthesized
tatgccaccaccagcggcac

SEQ ID NO: 223691 - DNA, 20 bp, Artificial Sequence
  chemically synthesized
gcagttgccggtgccgctgg

SEQ ID NO: 223692 - DNA, 20 bp, Artificial Sequence
  chemically synthesized
gttgccggtgccgctggtgg

SEQ ID NO: 223693 - DNA, 20 bp, Artificial Sequence
  chemically synthesized
tttaggtatgccaccaccag

SEQ ID NO: 223694 - DNA, 20 bp, Artificial Sequence
  chemically synthesized
taatttaggtatgccaccac

SEQ ID NO: 223695 - DNA, 20 bp, Artificial Sequence
  chemically synthesized
tggtggtggcatacctaaat

SEQ ID NO: 223696 - DNA, 20 bp, Artificial Sequence
  chemically synthesized
tagcagtgttattctaattt

SEQ ID NO: 223697 - DNA, 20 bp, Artificial Sequence
  chemically synthesized
atagcagtgttattctaatt

SEQ ID NO: 223698 - DNA, 20 bp, Artificial Sequence
  chemically synthesized
gactttggagttaaatatag

SEQ ID NO: 223699 - DNA, 20 bp, Artificial Sequence
  chemically synthesized
acagactttggagttaaata

SEQ ID NO: 223700 - DNA, 20 bp, Artificial Sequence
  chemically synthesized
cactgctatatttaactcca

SEQ ID NO: 223701 - DNA, 20 bp, Artificial Sequence
  chemically synthesized
caagcattttacagactttg

SEQ ID NO: 223702 - DNA, 20 bp, Artificial Sequence
  chemically synthesized
ttcaagcattttacagactt

SEQ ID NO: 223703 - DNA, 20 bp, Artificial Sequence
  chemically synthesized
gcaggtattcaagcatttta

SEQ ID NO: 223704 - DNA, 20 bp, Artificial Sequence
  chemically synthesized
acagacggtggcaggtattc

SEQ ID NO: 223705 - DNA, 20 bp, Artificial Sequence
  chemically synthesized
tcacctccacagacggtggc

SEQ ID NO: 223706 - DNA, 20 bp, Artificial Sequence
  chemically synthesized
ctcacctccacagacggtgg

SEQ ID NO: 223707 - DNA, 20 bp, Artificial Sequence
  chemically synthesized
tgaatacctgccaccgtctg

SEQ ID NO: 223708 - DNA, 20 bp, Artificial Sequence
  chemically synthesized
accctcacctccacagacgg

SEQ ID NO: 223709 - DNA, 20 bp, Artificial Sequence
  chemically synthesized
aatacctgccaccgtctgtg

SEQ ID NO: 223710 - DNA, 20 bp, Artificial Sequence
  chemically synthesized
atacctgccaccgtctgtgg

SEQ ID NO: 223711 - DNA, 20 bp, Artificial Sequence
  chemically synthesized
agcaccctcacctccacaga

SEQ ID NO: 223712 - DNA, 20 bp, Artificial Sequence
  chemically synthesized
ctgccaccgtctgtggaggt

SEQ ID NO: 223713 - DNA, 20 bp, Artificial Sequence
  chemically synthesized
aacgagcaccctcacctcca

SEQ ID NO: 223714 - DNA, 20 bp, Artificial Sequence
  chemically synthesized
tgccaccgtctgtggaggtg

SEQ ID NO: 223715 - DNA, 20 bp, Artificial Sequence
  chemically synthesized
gccaccgtctgtggaggtga

SEQ ID NO: 223716 - DNA, 20 bp, Artificial Sequence
  chemically synthesized
tggaggtgagggtgctcgtt

SEQ ID NO: 223717 - DNA, 20 bp, Artificial Sequence
  chemically synthesized
ggaggtgagggtgctcgttc

SEQ ID NO: 223718 - DNA, 20 bp, Artificial Sequence
  chemically synthesized
atggtgttcaggtcctgaac

SEQ ID NO: 223719 - DNA, 20 bp, Artificial Sequence
  chemically synthesized
ttgcttcttctatggtgttc

SEQ ID NO: 223720 - DNA, 20 bp, Artificial Sequence
  chemically synthesized
cgttcaggacctgaacacca

SEQ ID NO: 223721 - DNA, 20 bp, Artificial Sequence
  chemically synthesized
attgcttcttctatggtgtt

SEQ ID NO: 223722 - DNA, 20 bp, Artificial Sequence
  chemically synthesized
tcaggacctgaacaccatag

SEQ ID NO: 223723 - DNA, 20 bp, Artificial Sequence
  chemically synthesized
ggacctgaacaccatagaag

SEQ ID NO: 223724 - DNA, 20 bp, Artificial Sequence
  chemically synthesized
tgagaaaattgcttcttcta

SEQ ID NO: 223725 - DNA, 20 bp, Artificial Sequence
  chemically synthesized
atggtagcaataaagatggt

SEQ ID NO: 223726 - DNA, 20 bp, Artificial Sequence
  chemically synthesized
taccatggtagcaataaaga

SEQ ID NO: 223727 - DNA, 20 bp, Artificial Sequence
  chemically synthesized
ctaataccatggtagcaata

SEQ ID NO: 223728 - DNA, 20 bp, Artificial Sequence
  chemically synthesized
caccatctttattgctacca

SEQ ID NO: 223729 - DNA, 20 bp, Artificial Sequence
  chemically synthesized
gttcttacctaataccatgg

SEQ ID NO: 223730 - DNA, 20 bp, Artificial Sequence
  chemically synthesized
ctttattgctaccatggtat

SEQ ID NO: 223731 - DNA, 20 bp, Artificial Sequence
  chemically synthesized
tttattgctaccatggtatt

SEQ ID NO: 223732 - DNA, 20 bp, Artificial Sequence
  chemically synthesized
gaggttcttacctaatacca

SEQ ID NO: 223733 - DNA, 20 bp, Artificial Sequence
  chemically synthesized
ttgctaccatggtattaggt

SEQ ID NO: 223734 - DNA, 20 bp, Artificial Sequence
  chemically synthesized
atggtattaggtaagaacct

SEQ ID NO: 223735 - DNA, 20 bp, Artificial Sequence
  chemically synthesized
tggtattaggtaagaacctc

SEQ ID NO: 223736 - DNA, 20 bp, Artificial Sequence
  chemically synthesized
ccttttgttcttgcatcctg

SEQ ID NO: 223737 - DNA, 20 bp, Artificial Sequence
  chemically synthesized
aggtaagaacctcaggatgc

SEQ ID NO: 223738 - DNA, 20 bp, Artificial Sequence
  chemically synthesized
gccttttgttcttgcatcct

SEQ ID NO: 223739 - DNA, 20 bp, Artificial Sequence
  chemically synthesized
acctcaggatgcaagaacaa

SEQ ID NO: 223740 - DNA, 20 bp, Artificial Sequence
  chemically synthesized
cctcaggatgcaagaacaaa

SEQ ID NO: 223741 - DNA, 20 bp, Artificial Sequence
  chemically synthesized
caggatgcaagaacaaaagg

SEQ ID NO: 223742 - DNA, 20 bp, Artificial Sequence
  chemically synthesized
ctcatatgtgatagcaaaaa

SEQ ID NO: 223743 - DNA, 20 bp, Artificial Sequence
  chemically synthesized
tctcatatgtgatagcaaaa

SEQ ID NO: 223744 - DNA, 20 bp, Artificial Sequence
  chemically synthesized
attcagcatctcatatgtga

SEQ ID NO: 223745 - DNA, 20 bp, Artificial Sequence
  chemically synthesized
ccttttttgctatcacatat

SEQ ID NO: 223746 - DNA, 20 bp, Artificial Sequence
  chemically synthesized
aatactgttatcaataaatt

SEQ ID NO: 223747 - DNA, 20 bp, Artificial Sequence
  chemically synthesized
gatgctgaatttattgataa

SEQ ID NO: 223748 - DNA, 20 bp, Artificial Sequence
  chemically synthesized
aatttattgataacagtatt

SEQ ID NO: 223749 - DNA, 20 bp, Artificial Sequence
  chemically synthesized
atttattgataacagtatta

SEQ ID NO: 223750 - DNA, 20 bp, Artificial Sequence
  chemically synthesized
ttattgataacagtattaag

SEQ ID NO: 223751 - DNA, 20 bp, Artificial Sequence
  chemically synthesized
gataacagtattaaggagaa

SEQ ID NO: 223752 - DNA, 20 bp, Artificial Sequence
  chemically synthesized
aacagtattaaggagaatgg

SEQ ID NO: 223753 - DNA, 20 bp, Artificial Sequence
  chemically synthesized
ttaaggagaatggcagctga

SEQ ID NO: 223754 - DNA, 20 bp, Artificial Sequence
  chemically synthesized
taaggagaatggcagctgaa

SEQ ID NO: 223755 - DNA, 20 bp, Artificial Sequence
  chemically synthesized
aaatatcagaaatttccttt

SEQ ID NO: 223756 - DNA, 20 bp, Artificial Sequence
  chemically synthesized
gaggatcatgaaagaaatat

SEQ ID NO: 223757 - DNA, 20 bp, Artificial Sequence
  chemically synthesized
aaaatctgggaggatcatga

SEQ ID NO: 223758 - DNA, 20 bp, Artificial Sequence
  chemically synthesized
tatttctttcatgatcctcc

SEQ ID NO: 223759 - DNA, 20 bp, Artificial Sequence
  chemically synthesized
aaggaatgtcaaaatctggg

SEQ ID NO: 223760 - DNA, 20 bp, Artificial Sequence
  chemically synthesized
aaaggaatgtcaaaatctgg

SEQ ID NO: 223761 - DNA, 20 bp, Artificial Sequence
  chemically synthesized
tgaaaggaatgtcaaaatct

SEQ ID NO: 223762 - DNA, 20 bp, Artificial Sequence
  chemically synthesized
ttgaaaggaatgtcaaaatc

SEQ ID NO: 223763 - DNA, 20 bp, Artificial Sequence
  chemically synthesized
ctctcactaataattttgaa

SEQ ID NO: 223764 - DNA, 20 bp, Artificial Sequence
  chemically synthesized
gctctcactaataattttga

SEQ ID NO: 223765 - DNA, 20 bp, Artificial Sequence
  chemically synthesized
gacattcctttcaaaattat

SEQ ID NO: 223766 - DNA, 20 bp, Artificial Sequence
  chemically synthesized
ttcctttcaaaattattagt

SEQ ID NO: 223767 - DNA, 20 bp, Artificial Sequence
  chemically synthesized
cctttcaaaattattagtga

SEQ ID NO: 223768 - DNA, 20 bp, Artificial Sequence
  chemically synthesized
aaattattagtgagagcaat

SEQ ID NO: 223769 - DNA, 20 bp, Artificial Sequence
  chemically synthesized
tattagtgagagcaatcagt

SEQ ID NO: 223770 - DNA, 20 bp, Artificial Sequence
  chemically synthesized
gctcacatttttggtagcag

SEQ ID NO: 223771 - DNA, 20 bp, Artificial Sequence
  chemically synthesized
agggctcacatttttggtag

SEQ ID NO: 223772 - DNA, 20 bp, Artificial Sequence
  chemically synthesized
gcaagggctcacatttttgg

SEQ ID NO: 223773 - DNA, 20 bp, Artificial Sequence
  chemically synthesized
tcttctgctaccaaaaatgt

SEQ ID NO: 223774 - DNA, 20 bp, Artificial Sequence
  chemically synthesized
caagcaagggctcacatttt

SEQ ID NO: 223775 - DNA, 20 bp, Artificial Sequence
  chemically synthesized
cctaaagatgtttcaagcaa

SEQ ID NO: 223776 - DNA, 20 bp, Artificial Sequence
  chemically synthesized
acctaaagatgtttcaagca

SEQ ID NO: 223777 - DNA, 20 bp, Artificial Sequence
  chemically synthesized
tacctaaagatgtttcaagc

SEQ ID NO: 223778 - DNA, 20 bp, Artificial Sequence
  chemically synthesized
tacttacctaaagatgtttc

SEQ ID NO: 223779 - DNA, 20 bp, Artificial Sequence
  chemically synthesized
gcccttgcttgaaacatctt

SEQ ID NO: 223780 - DNA, 20 bp, Artificial Sequence
  chemically synthesized
cccttgcttgaaacatcttt

SEQ ID NO: 223781 - DNA, 20 bp, Artificial Sequence
  chemically synthesized
tgcttgaaacatctttaggt

SEQ ID NO: 223782 - DNA, 20 bp, Artificial Sequence
  chemically synthesized
gggctgactttacttaccta

SEQ ID NO: 223783 - DNA, 20 bp, Artificial Sequence
  chemically synthesized
gaaacatctttaggtaagta

SEQ ID NO: 223784 - DNA, 20 bp, Artificial Sequence
  chemically synthesized
catctttaggtaagtaaagt

SEQ ID NO: 223785 - DNA, 20 bp, Artificial Sequence
  chemically synthesized
aggtaagtaaagtcagcccc

SEQ ID NO: 223786 - DNA, 20 bp, Artificial Sequence
  chemically synthesized
ggtaagtaaagtcagcccct

SEQ ID NO: 223787 - DNA, 20 bp, Artificial Sequence
  chemically synthesized
agtaaagtcagcccctagga

SEQ ID NO: 223788 - DNA, 20 bp, Artificial Sequence
  chemically synthesized
ttgcttaagtgctttcctag

SEQ ID NO: 223789 - DNA, 20 bp, Artificial Sequence
  chemically synthesized
tttgcttaagtgctttccta

SEQ ID NO: 223790 - DNA, 20 bp, Artificial Sequence
  chemically synthesized
ttttgcttaagtgctttcct

SEQ ID NO: 223791 - DNA, 20 bp, Artificial Sequence
  chemically synthesized
cttttgcttaagtgctttcc

SEQ ID NO: 223792 - DNA, 20 bp, Artificial Sequence
  chemically synthesized
cagcccctaggaaagcactt

SEQ ID NO: 223793 - DNA, 20 bp, Artificial Sequence
  chemically synthesized
ctaggaaagcacttaagcaa

SEQ ID NO: 223794 - DNA, 20 bp, Artificial Sequence
  chemically synthesized
taggaaagcacttaagcaaa

SEQ ID NO: 223795 - DNA, 20 bp, Artificial Sequence
  chemically synthesized
ctttccctagccttttgctt

SEQ ID NO: 223796 - DNA, 20 bp, Artificial Sequence
  chemically synthesized
aaagcacttaagcaaaaggc

SEQ ID NO: 223797 - DNA, 20 bp, Artificial Sequence
  chemically synthesized
aagcacttaagcaaaaggct

SEQ ID NO: 223798 - DNA, 20 bp, Artificial Sequence
  chemically synthesized
agcacttaagcaaaaggcta

SEQ ID NO: 223799 - DNA, 20 bp, Artificial Sequence
  chemically synthesized
cttaagcaaaaggctaggga

SEQ ID NO: 223800 - DNA, 20 bp, Artificial Sequence
  chemically synthesized
taagcaaaaggctagggaaa

SEQ ID NO: 223801 - DNA, 20 bp, Artificial Sequence
  chemically synthesized
ctgatatagctctctttccc

SEQ ID NO: 223802 - DNA, 20 bp, Artificial Sequence
  chemically synthesized
agcaaaaggctagggaaaga

SEQ ID NO: 223803 - DNA, 20 bp, Artificial Sequence
  chemically synthesized
ctagggaaagagagctatat

SEQ ID NO: 223804 - DNA, 20 bp, Artificial Sequence
  chemically synthesized
tagggaaagagagctatatc

SEQ ID NO: 223805 - DNA, 20 bp, Artificial Sequence
  chemically synthesized
acggtagtttggacctgata

SEQ ID NO: 223806 - DNA, 20 bp, Artificial Sequence
  chemically synthesized
ggagtagcagcacggtagtt

SEQ ID NO: 223807 - DNA, 20 bp, Artificial Sequence
  chemically synthesized
agtgaggagtagcagcacgg

SEQ ID NO: 223808 - DNA, 20 bp, Artificial Sequence
  chemically synthesized
aagagtgaggagtagcagca

SEQ ID NO: 223809 - DNA, 20 bp, Artificial Sequence
  chemically synthesized
cttccaagagtgaggagtag

SEQ ID NO: 223810 - DNA, 20 bp, Artificial Sequence
  chemically synthesized
tttcttccaagagtgaggag

SEQ ID NO: 223811 - DNA, 20 bp, Artificial Sequence
  chemically synthesized
aattttcttccaagagtgag

SEQ ID NO: 223812 - DNA, 20 bp, Artificial Sequence
  chemically synthesized
gtgctgctactcctcactct

SEQ ID NO: 223813 - DNA, 20 bp, Artificial Sequence
  chemically synthesized
taaattttcttccaagagtg

SEQ ID NO: 223814 - DNA, 20 bp, Artificial Sequence
  chemically synthesized
ctaaattttcttccaagagt

SEQ ID NO: 223815 - DNA, 20 bp, Artificial Sequence
  chemically synthesized
ctgctactcctcactcttgg

SEQ ID NO: 223816 - DNA, 20 bp, Artificial Sequence
  chemically synthesized
aggcctaaattttcttccaa

SEQ ID NO: 223817 - DNA, 20 bp, Artificial Sequence
  chemically synthesized
aaaggcctaaattttcttcc

SEQ ID NO: 223818 - DNA, 20 bp, Artificial Sequence
  chemically synthesized
ctcactcttggaagaaaatt

SEQ ID NO: 223819 - DNA, 20 bp, Artificial Sequence
  chemically synthesized
tcactcttggaagaaaattt

SEQ ID NO: 223820 - DNA, 20 bp, Artificial Sequence
  chemically synthesized
tccattaattttcattgcaa

SEQ ID NO: 223821 - DNA, 20 bp, Artificial Sequence
  chemically synthesized
ctccattaattttcattgca

SEQ ID NO: 223822 - DNA, 20 bp, Artificial Sequence
  chemically synthesized
gcctttgcaatgaaaattaa

SEQ ID NO: 223823 - DNA, 20 bp, Artificial Sequence
  chemically synthesized
ctttgcaatgaaaattaatg

SEQ ID NO: 223824 - DNA, 20 bp, Artificial Sequence
  chemically synthesized
tgcaatgaaaattaatggag

SEQ ID NO: 223825 - DNA, 20 bp, Artificial Sequence
  chemically synthesized
ctcccttaatattaacattt

SEQ ID NO: 223826 - DNA, 20 bp, Artificial Sequence
  chemically synthesized
cctcccttaatattaacatt

SEQ ID NO: 223827 - DNA, 20 bp, Artificial Sequence
  chemically synthesized
gacacctaaatgttaatatt

SEQ ID NO: 223828 - DNA, 20 bp, Artificial Sequence
  chemically synthesized
acacctaaatgttaatatta

SEQ ID NO: 223829 - DNA, 20 bp, Artificial Sequence
  chemically synthesized
cacctaaatgttaatattaa

SEQ ID NO: 223830 - DNA, 20 bp, Artificial Sequence
  chemically synthesized
cctaaatgttaatattaagg

SEQ ID NO: 223831 - DNA, 20 bp, Artificial Sequence
  chemically synthesized
ctaaatgttaatattaaggg

SEQ ID NO: 223832 - DNA, 20 bp, Artificial Sequence
  chemically synthesized
taaatgttaatattaaggga

SEQ ID NO: 223833 - DNA, 20 bp, Artificial Sequence
  chemically synthesized
aaatgttaatattaagggag

SEQ ID NO: 223834 - DNA, 20 bp, Artificial Sequence
  chemically synthesized
gttaatattaagggagggga

SEQ ID NO: 223835 - DNA, 20 bp, Artificial Sequence
  chemically synthesized
ttaatattaagggaggggat

SEQ ID NO: 223836 - DNA, 20 bp, Artificial Sequence
  chemically synthesized
taatattaagggaggggata

SEQ ID NO: 223837 - DNA, 20 bp, Artificial Sequence
  chemically synthesized
atattaagggaggggatagg

SEQ ID NO: 223838 - DNA, 20 bp, Artificial Sequence
  chemically synthesized
aaacaggatggagtcacata

SEQ ID NO: 223839 - DNA, 20 bp, Artificial Sequence
  chemically synthesized
tgaaacaggatggagtcaca

SEQ ID NO: 223840 - DNA, 20 bp, Artificial Sequence
  chemically synthesized
agaacaaatgaaacaggatg

SEQ ID NO: 223841 - DNA, 20 bp, Artificial Sequence
  chemically synthesized
ctagaacaaatgaaacagga

SEQ ID NO: 223842 - DNA, 20 bp, Artificial Sequence
  chemically synthesized
ctcactagaacaaatgaaac

SEQ ID NO: 223843 - DNA, 20 bp, Artificial Sequence
  chemically synthesized
actcactagaacaaatgaaa

SEQ ID NO: 223844 - DNA, 20 bp, Artificial Sequence
  chemically synthesized
ccatcctgtttcatttgttc

SEQ ID NO: 223845 - DNA, 20 bp, Artificial Sequence
  chemically synthesized
cctgtttcatttgttctagt

SEQ ID NO: 223846 - DNA, 20 bp, Artificial Sequence
  chemically synthesized
taatagtaatatgtactcac

SEQ ID NO: 223847 - DNA, 20 bp, Artificial Sequence
  chemically synthesized
atcttacacacaaagtataa

SEQ ID NO: 223848 - DNA, 20 bp, Artificial Sequence
  chemically synthesized
tactattatactttgtgtgt

SEQ ID NO: 223849 - DNA, 20 bp, Artificial Sequence
  chemically synthesized
tttcttttatcttacacaca

SEQ ID NO: 223850 - DNA, 20 bp, Artificial Sequence
  chemically synthesized
atactttgtgtgtaagataa

SEQ ID NO: 223851 - DNA, 20 bp, Artificial Sequence
  chemically synthesized
tttgtgtgtaagataaaaga

SEQ ID NO: 223852 - DNA, 20 bp, Artificial Sequence
  chemically synthesized
gataaaagaaagtttaaaaa

SEQ ID NO: 223853 - DNA, 20 bp, Artificial Sequence
  chemically synthesized
gtttaaaaaaagaaaaattg

SEQ ID NO: 223854 - DNA, 20 bp, Artificial Sequence
  chemically synthesized
aagaaaaattgaagttattt

SEQ ID NO: 223855 - DNA, 20 bp, Artificial Sequence
  chemically synthesized
aaattgaagttattttagaa

SEQ ID NO: 223856 - DNA, 20 bp, Artificial Sequence
  chemically synthesized
gaacagatcaaactgcttat

SEQ ID NO: 223857 - DNA, 20 bp, Artificial Sequence
  chemically synthesized
acagatcaaactgcttatga

SEQ ID NO: 223858 - DNA, 20 bp, Artificial Sequence
  chemically synthesized
ggtagtaagcctctcataag

SEQ ID NO: 223859 - DNA, 20 bp, Artificial Sequence
  chemically synthesized
cagatcaaactgcttatgag

SEQ ID NO: 223860 - DNA, 20 bp, Artificial Sequence
  chemically synthesized
aaaggtagtaagcctctcat

SEQ ID NO: 223861 - DNA, 20 bp, Artificial Sequence
  chemically synthesized
ataatattttaaaaggtagt

SEQ ID NO: 223862 - DNA, 20 bp, Artificial Sequence
  chemically synthesized
caaaataatattttaaaagg

SEQ ID NO: 223863 - DNA, 20 bp, Artificial Sequence
  chemically synthesized
aatcaaaataatattttaaa

SEQ ID NO: 223864 - DNA, 20 bp, Artificial Sequence
  chemically synthesized
taatcaaaataatattttaa

SEQ ID NO: 223865 - DNA, 20 bp, Artificial Sequence
  chemically synthesized
ggtttttaagaatttatttt

SEQ ID NO: 223866 - DNA, 20 bp, Artificial Sequence
  chemically synthesized
aaaataaattcttaaaaacc

SEQ ID NO: 223867 - DNA, 20 bp, Artificial Sequence
  chemically synthesized
cttaccttggctgggttttt

SEQ ID NO: 223868 - DNA, 20 bp, Artificial Sequence
  chemically synthesized
aaattcttaaaaacccagcc

SEQ ID NO: 223869 - DNA, 20 bp, Artificial Sequence
  chemically synthesized
aattcttaaaaacccagcca

SEQ ID NO: 223870 - DNA, 20 bp, Artificial Sequence
  chemically synthesized
tttcttttcttaccttggct

SEQ ID NO: 223871 - DNA, 20 bp, Artificial Sequence
  chemically synthesized
ttttcttttcttaccttggc

SEQ ID NO: 223872 - DNA, 20 bp, Artificial Sequence
  chemically synthesized
cttaaaaacccagccaaggt

SEQ ID NO: 223873 - DNA, 20 bp, Artificial Sequence
  chemically synthesized
actattttcttttcttacct

SEQ ID NO: 223874 - DNA, 20 bp, Artificial Sequence
  chemically synthesized
aaacccagccaaggtaagaa

SEQ ID NO: 223875 - DNA, 20 bp, Artificial Sequence
  chemically synthesized
gccaaggtaagaaaagaaaa

SEQ ID NO: 223876 - DNA, 20 bp, Artificial Sequence
  chemically synthesized
cttagtttgagagcatgaga

SEQ ID NO: 223877 - DNA, 20 bp, Artificial Sequence
  chemically synthesized
tcttagtttgagagcatgag

SEQ ID NO: 223878 - DNA, 20 bp, Artificial Sequence
  chemically synthesized
tactcttagtttgagagcat

SEQ ID NO: 223879 - DNA, 20 bp, Artificial Sequence
  chemically synthesized
ccttctcatgctctcaaact

SEQ ID NO: 223880 - DNA, 20 bp, Artificial Sequence
  chemically synthesized
tatgtatactcttagtttga

SEQ ID NO: 223881 - DNA, 20 bp, Artificial Sequence
  chemically synthesized
ttctcatgctctcaaactaa

SEQ ID NO: 223882 - DNA, 20 bp, Artificial Sequence
  chemically synthesized
tttatgtatactcttagttt

SEQ ID NO: 223883 - DNA, 20 bp, Artificial Sequence
  chemically synthesized
agccaatttatgtatactct

SEQ ID NO: 223884 - DNA, 20 bp, Artificial Sequence
  chemically synthesized
aactaagagtatacataaat

SEQ ID NO: 223885 - DNA, 20 bp, Artificial Sequence
  chemically synthesized
agagtatacataaattggct

SEQ ID NO: 223886 - DNA, 20 bp, Artificial Sequence
  chemically synthesized
tacataaattggctaagaaa

SEQ ID NO: 223887 - DNA, 20 bp, Artificial Sequence
  chemically synthesized
gagtcatcctatccgtttct

SEQ ID NO: 223888 - DNA, 20 bp, Artificial Sequence
  chemically synthesized
taaattggctaagaaacgga

SEQ ID NO: 223889 - DNA, 20 bp, Artificial Sequence
  chemically synthesized
aaattggctaagaaacggat

SEQ ID NO: 223890 - DNA, 20 bp, Artificial Sequence
  chemically synthesized
tcttgtccctggaaaaaggg

SEQ ID NO: 223891 - DNA, 20 bp, Artificial Sequence
  chemically synthesized
taggatgactcccctttttc

SEQ ID NO: 223892 - DNA, 20 bp, Artificial Sequence
  chemically synthesized
actcttgtccctggaaaaag

SEQ ID NO: 223893 - DNA, 20 bp, Artificial Sequence
  chemically synthesized
aggatgactcccctttttcc

SEQ ID NO: 223894 - DNA, 20 bp, Artificial Sequence
  chemically synthesized
cactcttgtccctggaaaaa

SEQ ID NO: 223895 - DNA, 20 bp, Artificial Sequence
  chemically synthesized
ggatgactcccctttttcca

SEQ ID NO: 223896 - DNA, 20 bp, Artificial Sequence
  chemically synthesized
ccactcttgtccctggaaaa

SEQ ID NO: 223897 - DNA, 20 bp, Artificial Sequence
  chemically synthesized
cccactcttgtccctggaaa

SEQ ID NO: 223898 - DNA, 20 bp, Artificial Sequence
  chemically synthesized
actcccctttttccagggac

SEQ ID NO: 223899 - DNA, 20 bp, Artificial Sequence
  chemically synthesized
tcccctttttccagggacaa

SEQ ID NO: 223900 - DNA, 20 bp, Artificial Sequence
  chemically synthesized
cctaaacccactcttgtccc

SEQ ID NO: 223901 - DNA, 20 bp, Artificial Sequence
  chemically synthesized
cctttttccagggacaagag

SEQ ID NO: 223902 - DNA, 20 bp, Artificial Sequence
  chemically synthesized
ctttttccagggacaagagt

SEQ ID NO: 223903 - DNA, 20 bp, Artificial Sequence
  chemically synthesized
tccagggacaagagtgggtt

SEQ ID NO: 223904 - DNA, 20 bp, Artificial Sequence
  chemically synthesized
ccagggacaagagtgggttt

SEQ ID NO: 223905 - DNA, 20 bp, Artificial Sequence
  chemically synthesized
agggacaagagtgggtttag

SEQ ID NO: 223906 - DNA, 20 bp, Artificial Sequence
  chemically synthesized
agtgggtttaggagataatc

SEQ ID NO: 223907 - DNA, 20 bp, Artificial Sequence
  chemically synthesized
taggagataatccagttctc

SEQ ID NO: 223908 - DNA, 20 bp, Artificial Sequence
  chemically synthesized
caagtatataactagagaac

SEQ ID NO: 223909 - DNA, 20 bp, Artificial Sequence
  chemically synthesized
tttaaacaagtatataacta

SEQ ID NO: 223910 - DNA, 20 bp, Artificial Sequence
  chemically synthesized
tttttaaacaagtatataac

SEQ ID NO: 223911 - DNA, 20 bp, Artificial Sequence
  chemically synthesized
tcctcatctggtttttaaac

SEQ ID NO: 223912 - DNA, 20 bp, Artificial Sequence
  chemically synthesized
ttatatacttgtttaaaaac

SEQ ID NO: 223913 - DNA, 20 bp, Artificial Sequence
  chemically synthesized
tacttgtttaaaaaccagat

SEQ ID NO: 223914 - DNA, 20 bp, Artificial Sequence
  chemically synthesized
acttgtttaaaaaccagatg

SEQ ID NO: 223915 - DNA, 20 bp, Artificial Sequence
  chemically synthesized
ttgtttaaaaaccagatgag

SEQ ID NO: 223916 - DNA, 20 bp, Artificial Sequence
  chemically synthesized
gaggaagtgatctcctcatc

SEQ ID NO: 223917 - DNA, 20 bp, Artificial Sequence
  chemically synthesized
gaggcaaaagacgggtgagg

SEQ ID NO: 223918 - DNA, 20 bp, Artificial Sequence
  chemically synthesized
ccagaggcaaaagacgggtg

SEQ ID NO: 223919 - DNA, 20 bp, Artificial Sequence
  chemically synthesized
tccagaggcaaaagacgggt

SEQ ID NO: 223920 - DNA, 20 bp, Artificial Sequence
  chemically synthesized
tgcctccagaggcaaaagac

SEQ ID NO: 223921 - DNA, 20 bp, Artificial Sequence
  chemically synthesized
ttgcctccagaggcaaaaga

SEQ ID NO: 223922 - DNA, 20 bp, Artificial Sequence
  chemically synthesized
cctcacccgtcttttgcctc

SEQ ID NO: 223923 - DNA, 20 bp, Artificial Sequence
  chemically synthesized
ccttttgcctccagaggcaa

SEQ ID NO: 223924 - DNA, 20 bp, Artificial Sequence
  chemically synthesized
tcacccgtcttttgcctctg

SEQ ID NO: 223925 - DNA, 20 bp, Artificial Sequence
  chemically synthesized
cacccgtcttttgcctctgg

SEQ ID NO: 223926 - DNA, 20 bp, Artificial Sequence
  chemically synthesized
accataccttttgcctccag

SEQ ID NO: 223927 - DNA, 20 bp, Artificial Sequence
  chemically synthesized
gaccataccttttgcctcca

SEQ ID NO: 223928 - DNA, 20 bp, Artificial Sequence
  chemically synthesized
tcttttgcctctggaggcaa

SEQ ID NO: 223929 - DNA, 20 bp, Artificial Sequence
  chemically synthesized
ctgaccataccttttgcctc

SEQ ID NO: 223930 - DNA, 20 bp, Artificial Sequence
  chemically synthesized
cttttgcctctggaggcaaa

SEQ ID NO: 223931 - DNA, 20 bp, Artificial Sequence
  chemically synthesized
gcctctggaggcaaaaggta

SEQ ID NO: 223932 - DNA, 20 bp, Artificial Sequence
  chemically synthesized
ctggaggcaaaaggtatggt

SEQ ID NO: 223933 - DNA, 20 bp, Artificial Sequence
  chemically synthesized
ggaggcaaaaggtatggtca

SEQ ID NO: 223934 - DNA, 20 bp, Artificial Sequence
  chemically synthesized
caaaaggtatggtcagagtt

SEQ ID NO: 223935 - DNA, 20 bp, Artificial Sequence
  chemically synthesized
atggtcagagttcagtgaca

SEQ ID NO: 223936 - DNA, 20 bp, Artificial Sequence
  chemically synthesized
gtgacaaagtgacaatcatc

SEQ ID NO: 223937 - DNA, 20 bp, Artificial Sequence
  chemically synthesized
tgacaaagtgacaatcatca

SEQ ID NO: 223938 - DNA, 20 bp, Artificial Sequence
  chemically synthesized
gacaaagtgacaatcatcaa

SEQ ID NO: 223939 - DNA, 20 bp, Artificial Sequence
  chemically synthesized
caaagtgacaatcatcaagg

SEQ ID NO: 223940 - DNA, 20 bp, Artificial Sequence
  chemically synthesized
tgacaatcatcaagggagtt

SEQ ID NO: 223941 - DNA, 20 bp, Artificial Sequence
  chemically synthesized
aatcatcaagggagtttagt

SEQ ID NO: 223942 - DNA, 20 bp, Artificial Sequence
  chemically synthesized
tcaagggagtttagtcagct

SEQ ID NO: 223943 - DNA, 20 bp, Artificial Sequence
  chemically synthesized
caagggagtttagtcagctg

SEQ ID NO: 223944 - DNA, 20 bp, Artificial Sequence
  chemically synthesized
tgcctagagaaacataacct

SEQ ID NO: 223945 - DNA, 20 bp, Artificial Sequence
  chemically synthesized
cagctgaggttatgtttctc

SEQ ID NO: 223946 - DNA, 20 bp, Artificial Sequence
  chemically synthesized
agctgaggttatgtttctct

SEQ ID NO: 223947 - DNA, 20 bp, Artificial Sequence
  chemically synthesized
tgactgtataagaatgccta

SEQ ID NO: 223948 - DNA, 20 bp, Artificial Sequence
  chemically synthesized
tctgactgtataagaatgcc

SEQ ID NO: 223949 - DNA, 20 bp, Artificial Sequence
  chemically synthesized
tttctctaggcattcttata

SEQ ID NO: 223950 - DNA, 20 bp, Artificial Sequence
  chemically synthesized
tctaggcattcttatacagt

SEQ ID NO: 223951 - DNA, 20 bp, Artificial Sequence
  chemically synthesized
gtttcatggtctgactgtat

SEQ ID NO: 223952 - DNA, 20 bp, Artificial Sequence
  chemically synthesized
atacagtcagaccatgaaac

SEQ ID NO: 223953 - DNA, 20 bp, Artificial Sequence
  chemically synthesized
gaagcagtagtcttgtttca

SEQ ID NO: 223954 - DNA, 20 bp, Artificial Sequence
  chemically synthesized
tgaaacaagactactgcttc

SEQ ID NO: 223955 - DNA, 20 bp, Artificial Sequence
  chemically synthesized
gtggcatttcctggaagcag

SEQ ID NO: 223956 - DNA, 20 bp, Artificial Sequence
  chemically synthesized
gaaacaagactactgcttcc

SEQ ID NO: 223957 - DNA, 20 bp, Artificial Sequence
  chemically synthesized
attgtggcatttcctggaag

SEQ ID NO: 223958 - DNA, 20 bp, Artificial Sequence
  chemically synthesized
ggtattgtggcatttcctgg

SEQ ID NO: 223959 - DNA, 20 bp, Artificial Sequence
  chemically synthesized
ggaggtattgtggcatttcc

SEQ ID NO: 223960 - DNA, 20 bp, Artificial Sequence
  chemically synthesized
taaataataaggaggtattg

SEQ ID NO: 223961 - DNA, 20 bp, Artificial Sequence
  chemically synthesized
cagaaatgtaaataataagg

SEQ ID NO: 223962 - DNA, 20 bp, Artificial Sequence
  chemically synthesized
ccagaaatgtaaataataag

SEQ ID NO: 223963 - DNA, 20 bp, Artificial Sequence
  chemically synthesized
ttccagaaatgtaaataata

SEQ ID NO: 223964 - DNA, 20 bp, Artificial Sequence
  chemically synthesized
cttccagaaatgtaaataat

SEQ ID NO: 223965 - DNA, 20 bp, Artificial Sequence
  chemically synthesized
ctccttattatttacatttc

SEQ ID NO: 223966 - DNA, 20 bp, Artificial Sequence
  chemically synthesized
cttattatttacatttctgg

SEQ ID NO: 223967 - DNA, 20 bp, Artificial Sequence
  chemically synthesized
tatttacatttctggaagca

SEQ ID NO: 223968 - DNA, 20 bp, Artificial Sequence
  chemically synthesized
atttacatttctggaagcaa

SEQ ID NO: 223969 - DNA, 20 bp, Artificial Sequence
  chemically synthesized
aattctgctgcctttgcttc

SEQ ID NO: 223970 - DNA, 20 bp, Artificial Sequence
  chemically synthesized
tacatttctggaagcaaagg

SEQ ID NO: 223971 - DNA, 20 bp, Artificial Sequence
  chemically synthesized
atttctggaagcaaaggcag

SEQ ID NO: 223972 - DNA, 20 bp, Artificial Sequence
  chemically synthesized
gaagcaaaggcagcagaatt

SEQ ID NO: 223973 - DNA, 20 bp, Artificial Sequence
  chemically synthesized
aggcagcagaatttagccac

SEQ ID NO: 223974 - DNA, 20 bp, Artificial Sequence
  chemically synthesized
gcagcagaatttagccactg

SEQ ID NO: 223975 - DNA, 20 bp, Artificial Sequence
  chemically synthesized
gacagtggagaggactccag

SEQ ID NO: 223976 - DNA, 20 bp, Artificial Sequence
  chemically synthesized
gaagacagtggagaggactc

SEQ ID NO: 223977 - DNA, 20 bp, Artificial Sequence
  chemically synthesized
tactagagaagacagtggag

SEQ ID NO: 223978 - DNA, 20 bp, Artificial Sequence
  chemically synthesized
gtactagagaagacagtgga

SEQ ID NO: 223979 - DNA, 20 bp, Artificial Sequence
  chemically synthesized
ctgtactagagaagacagtg

SEQ ID NO: 223980 - DNA, 20 bp, Artificial Sequence
  chemically synthesized
acctgtactagagaagacag

SEQ ID NO: 223981 - DNA, 20 bp, Artificial Sequence
  chemically synthesized
gtcctctccactgtcttctc

SEQ ID NO: 223982 - DNA, 20 bp, Artificial Sequence
  chemically synthesized
actacctgtactagagaaga

SEQ ID NO: 223983 - DNA, 20 bp, Artificial Sequence
  chemically synthesized
aggaactacctgtactagag

SEQ ID NO: 223984 - DNA, 20 bp, Artificial Sequence
  chemically synthesized
ctccactgtcttctctagta

SEQ ID NO: 223985 - DNA, 20 bp, Artificial Sequence
  chemically synthesized
tccactgtcttctctagtac

SEQ ID NO: 223986 - DNA, 20 bp, Artificial Sequence
  chemically synthesized
ttcaggaactacctgtacta

SEQ ID NO: 223987 - DNA, 20 bp, Artificial Sequence
  chemically synthesized
actgtcttctctagtacagg

SEQ ID NO: 223988 - DNA, 20 bp, Artificial Sequence
  chemically synthesized
tgttcaggaactacctgtac

SEQ ID NO: 223989 - DNA, 20 bp, Artificial Sequence
  chemically synthesized
gtagatttggagtaatgttc

SEQ ID NO: 223990 - DNA, 20 bp, Artificial Sequence
  chemically synthesized
tgtagatttggagtaatgtt

SEQ ID NO: 223991 - DNA, 20 bp, Artificial Sequence
  chemically synthesized
taagggtctctgtagatttg

SEQ ID NO: 223992 - DNA, 20 bp, Artificial Sequence
  chemically synthesized
tgaacattactccaaatcta

SEQ ID NO: 223993 - DNA, 20 bp, Artificial Sequence
  chemically synthesized
aataagggtctctgtagatt

SEQ ID NO: 223994 - DNA, 20 bp, Artificial Sequence
  chemically synthesized
aacattactccaaatctaca

SEQ ID NO: 223995 - DNA, 20 bp, Artificial Sequence
  chemically synthesized
tctgtcaataagggtctctg

SEQ ID NO: 223996 - DNA, 20 bp, Artificial Sequence
  chemically synthesized
tctacagagacccttattga

SEQ ID NO: 223997 - DNA, 20 bp, Artificial Sequence
  chemically synthesized
tctgtaatatctgtcaataa

SEQ ID NO: 223998 - DNA, 20 bp, Artificial Sequence
  chemically synthesized
ctctgtaatatctgtcaata

SEQ ID NO: 223999 - DNA, 20 bp, Artificial Sequence
  chemically synthesized
tctctgtaatatctgtcaat

SEQ ID NO: 224000 - DNA, 20 bp, Artificial Sequence
  chemically synthesized
acccttattgacagatatta

SEQ ID NO: 224001 - DNA, 20 bp, Artificial Sequence
  chemically synthesized
ccttattgacagatattaca

SEQ ID NO: 224002 - DNA, 20 bp, Artificial Sequence
  chemically synthesized
tgtttcgctggcatgttggt

SEQ ID NO: 224003 - DNA, 20 bp, Artificial Sequence
  chemically synthesized
agagatactcaccaacatgc

SEQ ID NO: 224004 - DNA, 20 bp, Artificial Sequence
  chemically synthesized
accatgtttcgctggcatgt

SEQ ID NO: 224005 - DNA, 20 bp, Artificial Sequence
  chemically synthesized
aacaataaaccatgtttcgc

SEQ ID NO: 224006 - DNA, 20 bp, Artificial Sequence
  chemically synthesized
accaacatgccagcgaaaca

SEQ ID NO: 224007 - DNA, 20 bp, Artificial Sequence
  chemically synthesized
tattgttttttgttttttat

SEQ ID NO: 224008 - DNA, 20 bp, Artificial Sequence
  chemically synthesized
ttgttttttattggctattg

SEQ ID NO: 224009 - DNA, 20 bp, Artificial Sequence
  chemically synthesized
gaggataagtaaaactacaa

SEQ ID NO: 224010 - DNA, 20 bp, Artificial Sequence
  chemically synthesized
ctaataaaatagatgaggat

SEQ ID NO: 224011 - DNA, 20 bp, Artificial Sequence
  chemically synthesized
agaccctaataaaatagatg

SEQ ID NO: 224012 - DNA, 20 bp, Artificial Sequence
  chemically synthesized
aagaccctaataaaatagat

SEQ ID NO: 224013 - DNA, 20 bp, Artificial Sequence
  chemically synthesized
cttatcctcatctattttat

SEQ ID NO: 224014 - DNA, 20 bp, Artificial Sequence
  chemically synthesized
ttatcctcatctattttatt

SEQ ID NO: 224015 - DNA, 20 bp, Artificial Sequence
  chemically synthesized
tcaacaagaccctaataaaa

SEQ ID NO: 224016 - DNA, 20 bp, Artificial Sequence
  chemically synthesized
tatcctcatctattttatta

SEQ ID NO: 224017 - DNA, 20 bp, Artificial Sequence
  chemically synthesized
tattttattagggtcttgtt

SEQ ID NO: 224018 - DNA, 20 bp, Artificial Sequence
  chemically synthesized
cacgatagtgaagactcaac

SEQ ID NO: 224019 - DNA, 20 bp, Artificial Sequence
  chemically synthesized
ctgaggtgctcacgatagtg

SEQ ID NO: 224020 - DNA, 20 bp, Artificial Sequence
  chemically synthesized
tgttgagtcttcactatcgt

SEQ ID NO: 224021 - DNA, 20 bp, Artificial Sequence
  chemically synthesized
gaatactgaggtgctcacga

SEQ ID NO: 224022 - DNA, 20 bp, Artificial Sequence
  chemically synthesized
cttcactatcgtgagcacct

SEQ ID NO: 224023 - DNA, 20 bp, Artificial Sequence
  chemically synthesized
tctggagacaaggaatactg

SEQ ID NO: 224024 - DNA, 20 bp, Artificial Sequence
  chemically synthesized
ttctggagacaaggaatact

SEQ ID NO: 224025 - DNA, 20 bp, Artificial Sequence
  chemically synthesized
acctcagtattccttgtctc

SEQ ID NO: 224026 - DNA, 20 bp, Artificial Sequence
  chemically synthesized
acattttctttctggagaca

SEQ ID NO: 224027 - DNA, 20 bp, Artificial Sequence
  chemically synthesized
gacattttctttctggagac

SEQ ID NO: 224028 - DNA, 20 bp, Artificial Sequence
  chemically synthesized
cagtattccttgtctccaga

SEQ ID NO: 224029 - DNA, 20 bp, Artificial Sequence
  chemically synthesized
ctcaagacattttctttctg

SEQ ID NO: 224030 - DNA, 20 bp, Artificial Sequence
  chemically synthesized
acctcaagacattttctttc

SEQ ID NO: 224031 - DNA, 20 bp, Artificial Sequence
  chemically synthesized
ctccagaaagaaaatgtctt

SEQ ID NO: 224032 - DNA, 20 bp, Artificial Sequence
  chemically synthesized
tccagaaagaaaatgtcttg

SEQ ID NO: 224033 - DNA, 20 bp, Artificial Sequence
  chemically synthesized
gaaagaaaatgtcttgaggt

SEQ ID NO: 224034 - DNA, 20 bp, Artificial Sequence
  chemically synthesized
tacatacaatttctaacctc

SEQ ID NO: 224035 - DNA, 20 bp, Artificial Sequence
  chemically synthesized
ccatcttttttaagatggaa

SEQ ID NO: 224036 - DNA, 20 bp, Artificial Sequence
  chemically synthesized
agccatcttttttaagatgg

SEQ ID NO: 224037 - DNA, 20 bp, Artificial Sequence
  chemically synthesized
aacagccatcttttttaaga

SEQ ID NO: 224038 - DNA, 20 bp, Artificial Sequence
  chemically synthesized
ttttctcttccatcttaaaa

SEQ ID NO: 224039 - DNA, 20 bp, Artificial Sequence
  chemically synthesized
aattaacagccatctttttt

SEQ ID NO: 224040 - DNA, 20 bp, Artificial Sequence
  chemically synthesized
ctcttccatcttaaaaaaga

SEQ ID NO: 224041 - DNA, 20 bp, Artificial Sequence
  chemically synthesized
ctatgtcagtatagaattaa

SEQ ID NO: 224042 - DNA, 20 bp, Artificial Sequence
  chemically synthesized
tattagatactatgtcagta

SEQ ID NO: 224043 - DNA, 20 bp, Artificial Sequence
  chemically synthesized
ctgttaattctatactgaca

SEQ ID NO: 224044 - DNA, 20 bp, Artificial Sequence
  chemically synthesized
gcagttattagatactatgt

SEQ ID NO: 224045 - DNA, 20 bp, Artificial Sequence
  chemically synthesized
agatataaagaagcagttat

SEQ ID NO: 224046 - DNA, 20 bp, Artificial Sequence
  chemically synthesized
atctccaagatataaagaag

SEQ ID NO: 224047 - DNA, 20 bp, Artificial Sequence
  chemically synthesized
aaaatctccaagatataaag

SEQ ID NO: 224048 - DNA, 20 bp, Artificial Sequence
  chemically synthesized
ataactgcttctttatatct

SEQ ID NO: 224049 - DNA, 20 bp, Artificial Sequence
  chemically synthesized
gggaaaatctccaagatata

SEQ ID NO: 224050 - DNA, 20 bp, Artificial Sequence
  chemically synthesized
aactgcttctttatatcttg

SEQ ID NO: 224051 - DNA, 20 bp, Artificial Sequence
  chemically synthesized
atatgccagggaaaatctcc

SEQ ID NO: 224052 - DNA, 20 bp, Artificial Sequence
  chemically synthesized
tatatcttggagattttccc

SEQ ID NO: 224053 - DNA, 20 bp, Artificial Sequence
  chemically synthesized
ctatttatttgaatatgcca

SEQ ID NO: 224054 - DNA, 20 bp, Artificial Sequence
  chemically synthesized
gctatttatttgaatatgcc

SEQ ID NO: 224055 - DNA, 20 bp, Artificial Sequence
  chemically synthesized
agctatttatttgaatatgc

SEQ ID NO: 224056 - DNA, 20 bp, Artificial Sequence
  chemically synthesized
ccctggcatattcaaataaa

SEQ ID NO: 224057 - DNA, 20 bp, Artificial Sequence
  chemically synthesized
caaataaatagctgtttaaa

SEQ ID NO: 224058 - DNA, 20 bp, Artificial Sequence
  chemically synthesized
acaggtcagggctatttaaa

SEQ ID NO: 224059 - DNA, 20 bp, Artificial Sequence
  chemically synthesized
gcatatatactcacaggtca

SEQ ID NO: 224060 - DNA, 20 bp, Artificial Sequence
  chemically synthesized
tttaaatagccctgacctgt

SEQ ID NO: 224061 - DNA, 20 bp, Artificial Sequence
  chemically synthesized
ggcatatatactcacaggtc

SEQ ID NO: 224062 - DNA, 20 bp, Artificial Sequence
  chemically synthesized
gggcatatatactcacaggt

SEQ ID NO: 224063 - DNA, 20 bp, Artificial Sequence
  chemically synthesized
acaagggcatatatactcac

SEQ ID NO: 224064 - DNA, 20 bp, Artificial Sequence
  chemically synthesized
tacaagggcatatatactca

SEQ ID NO: 224065 - DNA, 20 bp, Artificial Sequence
  chemically synthesized
atatacattcatgtgtacaa

SEQ ID NO: 224066 - DNA, 20 bp, Artificial Sequence
  chemically synthesized
catatacattcatgtgtaca

SEQ ID NO: 224067 - DNA, 20 bp, Artificial Sequence
  chemically synthesized
acatatacattcatgtgtac

SEQ ID NO: 224068 - DNA, 20 bp, Artificial Sequence
  chemically synthesized
aatgtatatgtaaatatgca

SEQ ID NO: 224069 - DNA, 20 bp, Artificial Sequence
  chemically synthesized
gatacaaaatgataaataca

SEQ ID NO: 224070 - DNA, 20 bp, Artificial Sequence
  chemically synthesized
aaatgataaatacaaagtga

SEQ ID NO: 224071 - DNA, 20 bp, Artificial Sequence
  chemically synthesized
aatgataaatacaaagtgaa

SEQ ID NO: 224072 - DNA, 20 bp, Artificial Sequence
  chemically synthesized
atatattttaactcattcaa

SEQ ID NO: 224073 - DNA, 20 bp, Artificial Sequence
  chemically synthesized
ccttctttcttctgttgaat

SEQ ID NO: 224074 - DNA, 20 bp, Artificial Sequence
  chemically synthesized
tattttaactcattcaacag

SEQ ID NO: 224075 - DNA, 20 bp, Artificial Sequence
  chemically synthesized
ttaactcattcaacagaaga

SEQ ID NO: 224076 - DNA, 20 bp, Artificial Sequence
  chemically synthesized
actcattcaacagaagaaag

SEQ ID NO: 224077 - DNA, 20 bp, Artificial Sequence
  chemically synthesized
ctcattcaacagaagaaaga

SEQ ID NO: 224078 - DNA, 20 bp, Artificial Sequence
  chemically synthesized
attcaacagaagaaagaagg

SEQ ID NO: 224079 - DNA, 20 bp, Artificial Sequence
  chemically synthesized
ttcaacagaagaaagaaggc

SEQ ID NO: 224080 - DNA, 20 bp, Artificial Sequence
  chemically synthesized
aaaacctgaaattatagagg

SEQ ID NO: 224081 - DNA, 20 bp, Artificial Sequence
  chemically synthesized
aagaaaacctgaaattatag

SEQ ID NO: 224082 - DNA, 20 bp, Artificial Sequence
  chemically synthesized
gaagaaaacctgaaattata

SEQ ID NO: 224083 - DNA, 20 bp, Artificial Sequence
  chemically synthesized
gataacttcctctataattt

SEQ ID NO: 224084 - DNA, 20 bp, Artificial Sequence
  chemically synthesized
ataacttcctctataatttc

SEQ ID NO: 224085 - DNA, 20 bp, Artificial Sequence
  chemically synthesized
ctgaagaaaacctgaaatta

SEQ ID NO: 224086 - DNA, 20 bp, Artificial Sequence
  chemically synthesized
ctataatttcaggttttctt

SEQ ID NO: 224087 - DNA, 20 bp, Artificial Sequence
  chemically synthesized
tataatttcaggttttcttc

SEQ ID NO: 224088 - DNA, 20 bp, Artificial Sequence
  chemically synthesized
catatgtggtatgcatcctg

SEQ ID NO: 224089 - DNA, 20 bp, Artificial Sequence
  chemically synthesized
ttcaggatgcataccacata

SEQ ID NO: 224090 - DNA, 20 bp, Artificial Sequence
  chemically synthesized
tcaggatgcataccacatat

SEQ ID NO: 224091 - DNA, 20 bp, Artificial Sequence
  chemically synthesized
attgtaatgtagcccatatg

SEQ ID NO: 224092 - DNA, 20 bp, Artificial Sequence
  chemically synthesized
ctggagggaacattgtaatg

SEQ ID NO: 224093 - DNA, 20 bp, Artificial Sequence
  chemically synthesized
ctacattacaatgttccctc

SEQ ID NO: 224094 - DNA, 20 bp, Artificial Sequence
  chemically synthesized
tacattacaatgttccctcc

SEQ ID NO: 224095 - DNA, 20 bp, Artificial Sequence
  chemically synthesized
attacaatgttccctccagg

SEQ ID NO: 224096 - DNA, 20 bp, Artificial Sequence
  chemically synthesized
gaacatatttgctacctgga

SEQ ID NO: 224097 - DNA, 20 bp, Artificial Sequence
  chemically synthesized
tgaacatatttgctacctgg

SEQ ID NO: 224098 - DNA, 20 bp, Artificial Sequence
  chemically synthesized
ttgaacatatttgctacctg

SEQ ID NO: 224099 - DNA, 20 bp, Artificial Sequence
  chemically synthesized
aattgaacatatttgctacc

SEQ ID NO: 224100 - DNA, 20 bp, Artificial Sequence
  chemically synthesized
agcaaatatgttcaatttta

SEQ ID NO: 224101 - DNA, 20 bp, Artificial Sequence
  chemically synthesized
aaatatgttcaattttaaag

SEQ ID NO: 224102 - DNA, 20 bp, Artificial Sequence
  chemically synthesized
attttaaagtagacaactgt

SEQ ID NO: 224103 - DNA, 20 bp, Artificial Sequence
  chemically synthesized
tttaaaaaatcaatttccga

SEQ ID NO: 224104 - DNA, 20 bp, Artificial Sequence
  chemically synthesized
tgtcggaaattgatttttta

SEQ ID NO: 224105 - DNA, 20 bp, Artificial Sequence
  chemically synthesized
ggaaattgattttttaaaga

SEQ ID NO: 224106 - DNA, 20 bp, Artificial Sequence
  chemically synthesized
gaaattgattttttaaagat

SEQ ID NO: 224107 - DNA, 20 bp, Artificial Sequence
  chemically synthesized
aaattgattttttaaagatg

SEQ ID NO: 224108 - DNA, 20 bp, Artificial Sequence
  chemically synthesized
aattgattttttaaagatgg

SEQ ID NO: 224109 - DNA, 20 bp, Artificial Sequence
  chemically synthesized
attgattttttaaagatggg

SEQ ID NO: 224110 - DNA, 20 bp, Artificial Sequence
  chemically synthesized
gattttttaaagatgggggg

SEQ ID NO: 224111 - DNA, 20 bp, Artificial Sequence
  chemically synthesized
attttttaaagatggggggt

SEQ ID NO: 224112 - DNA, 20 bp, Artificial Sequence
  chemically synthesized
aaagatggggggtgggcgtt

SEQ ID NO: 224113 - DNA, 20 bp, Artificial Sequence
  chemically synthesized
tttgcaatatacaagcataa

SEQ ID NO: 224114 - DNA, 20 bp, Artificial Sequence
  chemically synthesized
ttacagcatttgcaatatac

SEQ ID NO: 224115 - DNA, 20 bp, Artificial Sequence
  chemically synthesized
ttttaaaaaaataatagtta

SEQ ID NO: 224116 - DNA, 20 bp, Artificial Sequence
  chemically synthesized
caagtcttttaaaaaaataa

SEQ ID NO: 224117 - DNA, 20 bp, Artificial Sequence
  chemically synthesized
tgtaactattatttttttaa

SEQ ID NO: 224118 - DNA, 20 bp, Artificial Sequence
  chemically synthesized
atttgttgttagtgaaagtc

SEQ ID NO: 224119 - DNA, 20 bp, Artificial Sequence
  chemically synthesized
agaaaatttgttgttagtga

SEQ ID NO: 224120 - DNA, 20 bp, Artificial Sequence
  chemically synthesized
taaagaagaaaatttgttgt

SEQ ID NO: 224121 - DNA, 20 bp, Artificial Sequence
  chemically synthesized
atcagtatattcatataaag

SEQ ID NO: 224122 - DNA, 20 bp, Artificial Sequence
  chemically synthesized
gagatcagtatattcatata

SEQ ID NO: 224123 - DNA, 20 bp, Artificial Sequence
  chemically synthesized
actatgatccgatgggagat

SEQ ID NO: 224124 - DNA, 20 bp, Artificial Sequence
  chemically synthesized
tgaatatactgatctcccat

SEQ ID NO: 224125 - DNA, 20 bp, Artificial Sequence
  chemically synthesized
ccaacactatgatccgatgg

SEQ ID NO: 224126 - DNA, 20 bp, Artificial Sequence
  chemically synthesized
gtccaacactatgatccgat

SEQ ID NO: 224127 - DNA, 20 bp, Artificial Sequence
  chemically synthesized
tgtccaacactatgatccga

SEQ ID NO: 224128 - DNA, 20 bp, Artificial Sequence
  chemically synthesized
actgatctcccatcggatca

SEQ ID NO: 224129 - DNA, 20 bp, Artificial Sequence
  chemically synthesized
ctcccatcggatcatagtgt

SEQ ID NO: 224130 - DNA, 20 bp, Artificial Sequence
  chemically synthesized
catcggatcatagtgttgga

SEQ ID NO: 224131 - DNA, 20 bp, Artificial Sequence
  chemically synthesized
ctcttatctcaaggtacatt

SEQ ID NO: 224132 - DNA, 20 bp, Artificial Sequence
  chemically synthesized
tctcttatctcaaggtacat

SEQ ID NO: 224133 - DNA, 20 bp, Artificial Sequence
  chemically synthesized
gacagttcctaatgtacctt

SEQ ID NO: 224134 - DNA, 20 bp, Artificial Sequence
  chemically synthesized
ttcctaatgtaccttgagat

SEQ ID NO: 224135 - DNA, 20 bp, Artificial Sequence
  chemically synthesized
cttgagcatctcttatctca

SEQ ID NO: 224136 - DNA, 20 bp, Artificial Sequence
  chemically synthesized
cctaatgtaccttgagataa

SEQ ID NO: 224137 - DNA, 20 bp, Artificial Sequence
  chemically synthesized
ccttgagcatctcttatctc

SEQ ID NO: 224138 - DNA, 20 bp, Artificial Sequence
  chemically synthesized
ccttgagataagagatgctc

SEQ ID NO: 224139 - DNA, 20 bp, Artificial Sequence
  chemically synthesized
cttgagataagagatgctca

SEQ ID NO: 224140 - DNA, 20 bp, Artificial Sequence
  chemically synthesized
ttgagataagagatgctcaa

SEQ ID NO: 224141 - DNA, 20 bp, Artificial Sequence
  chemically synthesized
aaaaatctaatgaaaccctt

SEQ ID NO: 224142 - DNA, 20 bp, Artificial Sequence
  chemically synthesized
gagatgctcaagggtttcat

SEQ ID NO: 224143 - DNA, 20 bp, Artificial Sequence
  chemically synthesized
caagggtttcattagatttt

SEQ ID NO: 224144 - DNA, 20 bp, Artificial Sequence
  chemically synthesized
agggtttcattagattttta

SEQ ID NO: 224145 - DNA, 20 bp, Artificial Sequence
  chemically synthesized
ggtttcattagatttttaga

SEQ ID NO: 224146 - DNA, 20 bp, Artificial Sequence
  chemically synthesized
tttcattagatttttagaga

SEQ ID NO: 224147 - DNA, 20 bp, Artificial Sequence
  chemically synthesized
tagatttttagagagagtaa

SEQ ID NO: 224148 - DNA, 20 bp, Artificial Sequence
  chemically synthesized
tttttagagagagtaaaagc

SEQ ID NO: 224149 - DNA, 20 bp, Artificial Sequence
  chemically synthesized
ttttagagagagtaaaagcc

SEQ ID NO: 224150 - DNA, 20 bp, Artificial Sequence
  chemically synthesized
atccaggaacattttcagcc

SEQ ID NO: 224151 - DNA, 20 bp, Artificial Sequence
  chemically synthesized
atagaatccaggaacatttt

SEQ ID NO: 224152 - DNA, 20 bp, Artificial Sequence
  chemically synthesized
agccaggctgaaaatgttcc

SEQ ID NO: 224153 - DNA, 20 bp, Artificial Sequence
  chemically synthesized
aagagacaaatatagaatcc

SEQ ID NO: 224154 - DNA, 20 bp, Artificial Sequence
  chemically synthesized
gaagagacaaatatagaatc

SEQ ID NO: 224155 - DNA, 20 bp, Artificial Sequence
  chemically synthesized
gataagtgaagagacaaata

SEQ ID NO: 224156 - DNA, 20 bp, Artificial Sequence
  chemically synthesized
ttattaaaaagataagtgaa

SEQ ID NO: 224157 - DNA, 20 bp, Artificial Sequence
  chemically synthesized
tgttattaaaaagataagtg

SEQ ID NO: 224158 - DNA, 20 bp, Artificial Sequence
  chemically synthesized
gtgagtgttattaaaaagat

SEQ ID NO: 224159 - DNA, 20 bp, Artificial Sequence
  chemically synthesized
tgtgtgtgagtgttattaaa

SEQ ID NO: 224160 - DNA, 20 bp, Artificial Sequence
  chemically synthesized
tttttaataacactcacaca

SEQ ID NO: 224161 - DNA, 20 bp, Artificial Sequence
  chemically synthesized
ataaaaatgtgtctgtgtgt

SEQ ID NO: 224162 - DNA, 20 bp, Artificial Sequence
  chemically synthesized
gcatacttttatttgaagtt

SEQ ID NO: 224163 - DNA, 20 bp, Artificial Sequence
  chemically synthesized
ttatactcaacttcaaataa

SEQ ID NO: 224164 - DNA, 20 bp, Artificial Sequence
  chemically synthesized
gcagggcatacttttatttg

SEQ ID NO: 224165 - DNA, 20 bp, Artificial Sequence
  chemically synthesized
tatcagcaaaagaaagggca

SEQ ID NO: 224166 - DNA, 20 bp, Artificial Sequence
  chemically synthesized
ttatcagcaaaagaaagggc

SEQ ID NO: 224167 - DNA, 20 bp, Artificial Sequence
  chemically synthesized
attatcagcaaaagaaaggg

SEQ ID NO: 224168 - DNA, 20 bp, Artificial Sequence
  chemically synthesized
tttattatcagcaaaagaaa

SEQ ID NO: 224169 - DNA, 20 bp, Artificial Sequence
  chemically synthesized
atttattatcagcaaaagaa

SEQ ID NO: 224170 - DNA, 20 bp, Artificial Sequence
  chemically synthesized
tatttattatcagcaaaaga

SEQ ID NO: 224171 - DNA, 20 bp, Artificial Sequence
  chemically synthesized
cacatatttattatcagcaa

SEQ ID NO: 224172 - DNA, 20 bp, Artificial Sequence
  chemically synthesized
accatccacatatttattat

SEQ ID NO: 224173 - DNA, 20 bp, Artificial Sequence
  chemically synthesized
ttttgctgataataaatatg

SEQ ID NO: 224174 - DNA, 20 bp, Artificial Sequence
  chemically synthesized
gctgataataaatatgtgga

SEQ ID NO: 224175 - DNA, 20 bp, Artificial Sequence
  chemically synthesized
taataaatatgtggatggta

SEQ ID NO: 224176 - DNA, 20 bp, Artificial Sequence
  chemically synthesized
tatgtggatggtatagtctc

SEQ ID NO: 224177 - DNA, 20 bp, Artificial Sequence
  chemically synthesized
tgtggatggtatagtctcca

SEQ ID NO: 224178 - DNA, 20 bp, Artificial Sequence
  chemically synthesized
tggatggtatagtctccaga

SEQ ID NO: 224179 - DNA, 20 bp, Artificial Sequence
  chemically synthesized
aagggcactttcgctctctg

SEQ ID NO: 224180 - DNA, 20 bp, Artificial Sequence
  chemically synthesized
ttaagggcactttcgctctc

SEQ ID NO: 224181 - DNA, 20 bp, Artificial Sequence
  chemically synthesized
gtatagtctccagagagcga

SEQ ID NO: 224182 - DNA, 20 bp, Artificial Sequence
  chemically synthesized
atcttaaaacaaatgtttaa

SEQ ID NO: 224183 - DNA, 20 bp, Artificial Sequence
  chemically synthesized
gatcttaaaacaaatgttta

SEQ ID NO: 224184 - DNA, 20 bp, Artificial Sequence
  chemically synthesized
tgatcttaaaacaaatgttt

SEQ ID NO: 224185 - DNA, 20 bp, Artificial Sequence
  chemically synthesized
tgcccttaaacatttgtttt

SEQ ID NO: 224186 - DNA, 20 bp, Artificial Sequence
  chemically synthesized
ttctactttaaaaataacag

SEQ ID NO: 224187 - DNA, 20 bp, Artificial Sequence
  chemically synthesized
tttttctactttaaaaataa

SEQ ID NO: 224188 - DNA, 20 bp, Artificial Sequence
  chemically synthesized
aaaaactactgttattttta

SEQ ID NO: 224189 - DNA, 20 bp, Artificial Sequence
  chemically synthesized
aactactgttatttttaaag

SEQ ID NO: 224190 - DNA, 20 bp, Artificial Sequence
  chemically synthesized
ttttacaatttcaatattca

SEQ ID NO: 224191 - DNA, 20 bp, Artificial Sequence
  chemically synthesized
aatattgaaattgtaaaatc

SEQ ID NO: 224192 - DNA, 20 bp, Artificial Sequence
  chemically synthesized
atattgaaattgtaaaatca

SEQ ID NO: 224193 - DNA, 20 bp, Artificial Sequence
  chemically synthesized
tattgaaattgtaaaatcaa

SEQ ID NO: 224194 - DNA, 20 bp, Artificial Sequence
  chemically synthesized
aaattgtaaaatcaagggaa

SEQ ID NO: 224195 - DNA, 20 bp, Artificial Sequence
  chemically synthesized
aaaatcaagggaaaagaaaa

SEQ ID NO: 224196 - DNA, 20 bp, Artificial Sequence
  chemically synthesized
gaaaatagttttaaatattt

SEQ ID NO: 224197 - DNA, 20 bp, Artificial Sequence
  chemically synthesized
aaaatagttttaaatatttt

SEQ ID NO: 224198 - DNA, 20 bp, Artificial Sequence
  chemically synthesized
attttgggcaaaatcttctt

SEQ ID NO: 224199 - DNA, 20 bp, Artificial Sequence
  chemically synthesized
aggacattctttttcttaag

SEQ ID NO: 224200 - DNA, 20 bp, Artificial Sequence
  chemically synthesized
ggcaaaatcttcttaagaaa

SEQ ID NO: 224201 - DNA, 20 bp, Artificial Sequence
  chemically synthesized
aataggacattctttttctt

SEQ ID NO: 224202 - DNA, 20 bp, Artificial Sequence
  chemically synthesized
gtgccagagtcattggaaat

SEQ ID NO: 224203 - DNA, 20 bp, Artificial Sequence
  chemically synthesized
cgtgccagagtcattggaaa

SEQ ID NO: 224204 - DNA, 20 bp, Artificial Sequence
  chemically synthesized
tgtcctatttccaatgactc

SEQ ID NO: 224205 - DNA, 20 bp, Artificial Sequence
  chemically synthesized
tttaaacgtgccagagtcat

SEQ ID NO: 224206 - DNA, 20 bp, Artificial Sequence
  chemically synthesized
tcctatgtttaaacgtgcca

SEQ ID NO: 224207 - DNA, 20 bp, Artificial Sequence
  chemically synthesized
tttcctatgtttaaacgtgc

SEQ ID NO: 224208 - DNA, 20 bp, Artificial Sequence
  chemically synthesized
gactctggcacgtttaaaca

SEQ ID NO: 224209 - DNA, 20 bp, Artificial Sequence
  chemically synthesized
actctggcacgtttaaacat

SEQ ID NO: 224210 - DNA, 20 bp, Artificial Sequence
  chemically synthesized
tggcacgtttaaacatagga

SEQ ID NO: 224211 - DNA, 20 bp, Artificial Sequence
  chemically synthesized
gtttaaacataggaaagaat

SEQ ID NO: 224212 - DNA, 20 bp, Artificial Sequence
  chemically synthesized
aagaattagaaaaacaattt

SEQ ID NO: 224213 - DNA, 20 bp, Artificial Sequence
  chemically synthesized
aaaacaattttagtatattt

SEQ ID NO: 224214 - DNA, 20 bp, Artificial Sequence
  chemically synthesized
tgttttacttaaattttaaa

SEQ ID NO: 224215 - DNA, 20 bp, Artificial Sequence
  chemically synthesized
atgttttacttaaattttaa

SEQ ID NO: 224216 - DNA, 20 bp, Artificial Sequence
  chemically synthesized
aatgttttacttaaatttta

SEQ ID NO: 224217 - DNA, 20 bp, Artificial Sequence
  chemically synthesized
ttttggaccctttaaaattt

SEQ ID NO: 224218 - DNA, 20 bp, Artificial Sequence
  chemically synthesized
taaaatttaagtaaaacatt

SEQ ID NO: 224219 - DNA, 20 bp, Artificial Sequence
  chemically synthesized
ttatcacatattcaaagtaa

SEQ ID NO: 224220 - DNA, 20 bp, Artificial Sequence
  chemically synthesized
attatcacatattcaaagta

SEQ ID NO: 224221 - DNA, 20 bp, Artificial Sequence
  chemically synthesized
ggagaattatcacatattca

SEQ ID NO: 224222 - DNA, 20 bp, Artificial Sequence
  chemically synthesized
ttgtattctatggagtaaag

SEQ ID NO: 224223 - DNA, 20 bp, Artificial Sequence
  chemically synthesized
ttttgtattctatggagtaa

SEQ ID NO: 224224 - DNA, 20 bp, Artificial Sequence
  chemically synthesized
gataattctcctttactcca

SEQ ID NO: 224225 - DNA, 20 bp, Artificial Sequence
  chemically synthesized
tttttgtattctatggagta

SEQ ID NO: 224226 - DNA, 20 bp, Artificial Sequence
  chemically synthesized
cagagtttttgtattctatg

SEQ ID NO: 224227 - DNA, 20 bp, Artificial Sequence
  chemically synthesized
tgcagagtttttgtattcta

SEQ ID NO: 224228 - DNA, 20 bp, Artificial Sequence
  chemically synthesized
ttaagataatgatatttgca

SEQ ID NO: 224229 - DNA, 20 bp, Artificial Sequence
  chemically synthesized
ttttaagataatgatatttg

SEQ ID NO: 224230 - DNA, 20 bp, Artificial Sequence
  chemically synthesized
atatatacaaatacattttt

SEQ ID NO: 224231 - DNA, 20 bp, Artificial Sequence
  chemically synthesized
ttaaattgaatctttctaat

SEQ ID NO: 224232 - DNA, 20 bp, Artificial Sequence
  chemically synthesized
taaattgaatctttctaatg

SEQ ID NO: 224233 - DNA, 20 bp, Artificial Sequence
  chemically synthesized
cgttaactttcctcattaga

SEQ ID NO: 224234 - DNA, 20 bp, Artificial Sequence
  chemically synthesized
ttgaatctttctaatgagga

SEQ ID NO: 224235 - DNA, 20 bp, Artificial Sequence
  chemically synthesized
tgaacgttaactttcctcat

SEQ ID NO: 224236 - DNA, 20 bp, Artificial Sequence
  chemically synthesized
ggaaagttaacgttcactct

SEQ ID NO: 224237 - DNA, 20 bp, Artificial Sequence
  chemically synthesized
gaaagttaacgttcactctc

SEQ ID NO: 224238 - DNA, 20 bp, Artificial Sequence
  chemically synthesized
atctgataagaacaacctga

SEQ ID NO: 224239 - DNA, 20 bp, Artificial Sequence
  chemically synthesized
tcatctgataagaacaacct

SEQ ID NO: 224240 - DNA, 20 bp, Artificial Sequence
  chemically synthesized
cactctcaggttgttcttat

SEQ ID NO: 224241 - DNA, 20 bp, Artificial Sequence
  chemically synthesized
tcaggttgttcttatcagat

SEQ ID NO: 224242 - DNA, 20 bp, Artificial Sequence
  chemically synthesized
caactacaaactcatctgat

SEQ ID NO: 224243 - DNA, 20 bp, Artificial Sequence
  chemically synthesized
gttcttatcagatgagtttg

SEQ ID NO: 224244 - DNA, 20 bp, Artificial Sequence
  chemically synthesized
gagtttgtagttgtattatg

SEQ ID NO: 224245 - DNA, 20 bp, Artificial Sequence
  chemically synthesized
agctaatagagacgtcagta

SEQ ID NO: 224246 - DNA, 20 bp, Artificial Sequence
  chemically synthesized
aagctaatagagacgtcagt

SEQ ID NO: 224247 - DNA, 20 bp, Artificial Sequence
  chemically synthesized
aactaagctaatagagacgt

SEQ ID NO: 224248 - DNA, 20 bp, Artificial Sequence
  chemically synthesized
ttccttactgacgtctctat

SEQ ID NO: 224249 - DNA, 20 bp, Artificial Sequence
  chemically synthesized
ctgaaataactaagctaata

SEQ ID NO: 224250 - DNA, 20 bp, Artificial Sequence
  chemically synthesized
tactgacgtctctattagct

SEQ ID NO: 224251 - DNA, 20 bp, Artificial Sequence
  chemically synthesized
aactgaaataactaagctaa

SEQ ID NO: 224252 - DNA, 20 bp, Artificial Sequence
  chemically synthesized
tgttctcaactgaaataact

SEQ ID NO: 224253 - DNA, 20 bp, Artificial Sequence
  chemically synthesized
ctctattagcttagttattt

SEQ ID NO: 224254 - DNA, 20 bp, Artificial Sequence
  chemically synthesized
ttagcttagttatttcagtt

SEQ ID NO: 224255 - DNA, 20 bp, Artificial Sequence
  chemically synthesized
tagttatttcagttgagaac

SEQ ID NO: 224256 - DNA, 20 bp, Artificial Sequence
  chemically synthesized
agttatttcagttgagaaca

SEQ ID NO: 224257 - DNA, 20 bp, Artificial Sequence
  chemically synthesized
gttatttcagttgagaacaa

SEQ ID NO: 224258 - DNA, 20 bp, Artificial Sequence
  chemically synthesized
ttgagaacaagggaaaacat

SEQ ID NO: 224259 - DNA, 20 bp, Artificial Sequence
  chemically synthesized
aacaagggaaaacataagaa

SEQ ID NO: 224260 - DNA, 20 bp, Artificial Sequence
  chemically synthesized
aaacataagaatggtattat

SEQ ID NO: 224261 - DNA, 20 bp, Artificial Sequence
  chemically synthesized
acataagaatggtattattg

SEQ ID NO: 224262 - DNA, 20 bp, Artificial Sequence
  chemically synthesized
tgtgatgtgaataaaatgta

SEQ ID NO: 224263 - DNA, 20 bp, Artificial Sequence
  chemically synthesized
tatacattttattcacatca

SEQ ID NO: 224264 - DNA, 20 bp, Artificial Sequence
  chemically synthesized
ttttatatttctcttttttt

SEQ ID NO: 224265 - DNA, 20 bp, Artificial Sequence
  chemically synthesized
tgtgtacaaacttaaaaaaa

SEQ ID NO: 224266 - DNA, 20 bp, Artificial Sequence
  chemically synthesized
tctgtgtacaaacttaaaaa

SEQ ID NO: 224267 - DNA, 20 bp, Artificial Sequence
  chemically synthesized
tctttttttaagtttgtaca

SEQ ID NO: 224268 - DNA, 20 bp, Artificial Sequence
  chemically synthesized
ttgtacacagacaatatctc

SEQ ID NO: 224269 - DNA, 20 bp, Artificial Sequence
  chemically synthesized
ccttaataaaaataattcca

SEQ ID NO: 224270 - DNA, 20 bp, Artificial Sequence
  chemically synthesized
tcccttaataaaaataattc

SEQ ID NO: 224271 - DNA, 20 bp, Artificial Sequence
  chemically synthesized
tctctggaattatttttatt

SEQ ID NO: 224272 - DNA, 20 bp, Artificial Sequence
  chemically synthesized
ctctggaattatttttatta

SEQ ID NO: 224273 - DNA, 20 bp, Artificial Sequence
  chemically synthesized
tctggaattatttttattaa

SEQ ID NO: 224274 - DNA, 20 bp, Artificial Sequence
  chemically synthesized
gggatatttaatgattaaat

SEQ ID NO: 224275 - DNA, 20 bp, Artificial Sequence
  chemically synthesized
aatgattaaataagcactct

SEQ ID NO: 224276 - DNA, 20 bp, Artificial Sequence
  chemically synthesized
ttaaataagcactcttagcg

SEQ ID NO: 224277 - DNA, 20 bp, Artificial Sequence
  chemically synthesized
cacttaaaggtcttcgctaa

SEQ ID NO: 224278 - DNA, 20 bp, Artificial Sequence
  chemically synthesized
aacacttaaaggtcttcgct

SEQ ID NO: 224279 - DNA, 20 bp, Artificial Sequence
  chemically synthesized
cactcttagcgaagaccttt

SEQ ID NO: 224280 - DNA, 20 bp, Artificial Sequence
  chemically synthesized
tggtaaaaaataacacttaa

SEQ ID NO: 224281 - DNA, 20 bp, Artificial Sequence
  chemically synthesized
ttggtaaaaaataacactta

SEQ ID NO: 224282 - DNA, 20 bp, Artificial Sequence
  chemically synthesized
tgtggaagctatatacgatt

SEQ ID NO: 224283 - DNA, 20 bp, Artificial Sequence
  chemically synthesized
attttttaccaaatcgtata

SEQ ID NO: 224284 - DNA, 20 bp, Artificial Sequence
  chemically synthesized
aatgtttgcattgtatgtgg

SEQ ID NO: 224285 - DNA, 20 bp, Artificial Sequence
  chemically synthesized
tggaatgtttgcattgtatg

SEQ ID NO: 224286 - DNA, 20 bp, Artificial Sequence
  chemically synthesized
cacatacaatgcaaacattc

SEQ ID NO: 224287 - DNA, 20 bp, Artificial Sequence
  chemically synthesized
atgcaaacattccagtactg

SEQ ID NO: 224288 - DNA, 20 bp, Artificial Sequence
  chemically synthesized
ctgtatattatctgcagtac

SEQ ID NO: 224289 - DNA, 20 bp, Artificial Sequence
  chemically synthesized
gtacccctgtatattatctg

SEQ ID NO: 224290 - DNA, 20 bp, Artificial Sequence
  chemically synthesized
ccagtactgcagataatata

SEQ ID NO: 224291 - DNA, 20 bp, Artificial Sequence
  chemically synthesized
cagtactgcagataatatac

SEQ ID NO: 224292 - DNA, 20 bp, Artificial Sequence
  chemically synthesized
agtactgcagataatataca

SEQ ID NO: 224293 - DNA, 20 bp, Artificial Sequence
  chemically synthesized
gtactgcagataatatacag

SEQ ID NO: 224294 - DNA, 20 bp, Artificial Sequence
  chemically synthesized
agataatatacaggggtaca

SEQ ID NO: 224295 - DNA, 20 bp, Artificial Sequence
  chemically synthesized
gataatatacaggggtacac

SEQ ID NO: 224296 - DNA, 20 bp, Artificial Sequence
  chemically synthesized
tacaggggtacacaggtttg

SEQ ID NO: 224297 - DNA, 20 bp, Artificial Sequence
  chemically synthesized
aggggtacacaggtttgaag

SEQ ID NO: 224298 - DNA, 20 bp, Artificial Sequence
  chemically synthesized
ggtacacaggtttgaagtag

SEQ ID NO: 224299 - DNA, 20 bp, Artificial Sequence
  chemically synthesized
tacacaggtttgaagtagtg

SEQ ID NO: 224300 - DNA, 20 bp, Artificial Sequence
  chemically synthesized
cacaggtttgaagtagtgga

SEQ ID NO: 224301 - DNA, 20 bp, Artificial Sequence
  chemically synthesized
tgaagtagtggagagactga

SEQ ID NO: 224302 - DNA, 20 bp, Artificial Sequence
  chemically synthesized
atttatggcttatggtccat

SEQ ID NO: 224303 - DNA, 20 bp, Artificial Sequence
  chemically synthesized
tggagagactgatggaccat

SEQ ID NO: 224304 - DNA, 20 bp, Artificial Sequence
  chemically synthesized
ttaaaaagatttatggctta

SEQ ID NO: 224305 - DNA, 20 bp, Artificial Sequence
  chemically synthesized
gatttttttaaaaagattta

SEQ ID NO: 224306 - DNA, 20 bp, Artificial Sequence
  chemically synthesized
attttggtgatttttttaaa

SEQ ID NO: 224307 - DNA, 20 bp, Artificial Sequence
  chemically synthesized
taaaaaaatcaccaaaatct

SEQ ID NO: 224308 - DNA, 20 bp, Artificial Sequence
  chemically synthesized
caagattatagctgagattt

SEQ ID NO: 224309 - DNA, 20 bp, Artificial Sequence
  chemically synthesized
gtatgatcaagattatagct

SEQ ID NO: 224310 - DNA, 20 bp, Artificial Sequence
  chemically synthesized
attttgtatgatcaagatta

SEQ ID NO: 224311 - DNA, 20 bp, Artificial Sequence
  chemically synthesized
tctttttattttgtatgatc

SEQ ID NO: 224312 - DNA, 20 bp, Artificial Sequence
  chemically synthesized
tcttgatcatacaaaataaa

SEQ ID NO: 224313 - DNA, 20 bp, Artificial Sequence
  chemically synthesized
ttgatcatacaaaataaaaa

SEQ ID NO: 224314 - DNA, 20 bp, Artificial Sequence
  chemically synthesized
tgatcatacaaaataaaaag

SEQ ID NO: 224315 - DNA, 20 bp, Artificial Sequence
  chemically synthesized
atcatacaaaataaaaagag

SEQ ID NO: 224316 - DNA, 20 bp, Artificial Sequence
  chemically synthesized
aaataaaaagaggagctcta

SEQ ID NO: 224317 - DNA, 20 bp, Artificial Sequence
  chemically synthesized
ttttttgctttatttcttta

SEQ ID NO: 224318 - DNA, 20 bp, Artificial Sequence
  chemically synthesized
ttttttttgctttatttctt

SEQ ID NO: 224319 - DNA, 20 bp, Artificial Sequence
  chemically synthesized
agaggagctctaaagaaata

SEQ ID NO: 224320 - DNA, 20 bp, Artificial Sequence
  chemically synthesized
actagatgattgcagtaatg

SEQ ID NO: 224321 - DNA, 20 bp, Artificial Sequence
  chemically synthesized
tttcacaaactagatgattg

SEQ ID NO: 224322 - DNA, 20 bp, Artificial Sequence
  chemically synthesized
tccacattactgcaatcatc

SEQ ID NO: 224323 - DNA, 20 bp, Artificial Sequence
  chemically synthesized
catactcttctttcacaaac

SEQ ID NO: 224324 - DNA, 20 bp, Artificial Sequence
  chemically synthesized
tgcaatcatctagtttgtga

SEQ ID NO: 224325 - DNA, 20 bp, Artificial Sequence
  chemically synthesized
aatcatctagtttgtgaaag

SEQ ID NO: 224326 - DNA, 20 bp, Artificial Sequence
  chemically synthesized
tcatctagtttgtgaaagaa

SEQ ID NO: 224327 - DNA, 20 bp, Artificial Sequence
  chemically synthesized
aacaaaatatcaaatcatta

SEQ ID NO: 224328 - DNA, 20 bp, Artificial Sequence
  chemically synthesized
aaacaaaatatcaaatcatt

SEQ ID NO: 224329 - DNA, 20 bp, Artificial Sequence
  chemically synthesized
atgatttgatattttgtttt

SEQ ID NO: 224330 - DNA, 20 bp, Artificial Sequence
  chemically synthesized
gtttttggaacttcacaacc

SEQ ID NO: 224331 - DNA, 20 bp, Artificial Sequence
  chemically synthesized
ttaggatagtcttggttgtg

SEQ ID NO: 224332 - DNA, 20 bp, Artificial Sequence
  chemically synthesized
tgaattccttaggatagtct

SEQ ID NO: 224333 - DNA, 20 bp, Artificial Sequence
  chemically synthesized
ttcacaaccaagactatcct

SEQ ID NO: 224334 - DNA, 20 bp, Artificial Sequence
  chemically synthesized
tcacaaccaagactatccta

SEQ ID NO: 224335 - DNA, 20 bp, Artificial Sequence
  chemically synthesized
aagctctgaattccttagga

SEQ ID NO: 224336 - DNA, 20 bp, Artificial Sequence
  chemically synthesized
aggaaagctctgaattcctt

SEQ ID NO: 224337 - DNA, 20 bp, Artificial Sequence
  chemically synthesized
caagactatcctaaggaatt

SEQ ID NO: 224338 - DNA, 20 bp, Artificial Sequence
  chemically synthesized
gaggaaagctctgaattcct

SEQ ID NO: 224339 - DNA, 20 bp, Artificial Sequence
  chemically synthesized
agactatcctaaggaattca

SEQ ID NO: 224340 - DNA, 20 bp, Artificial Sequence
  chemically synthesized
gaattcagagctttcctcac

SEQ ID NO: 224341 - DNA, 20 bp, Artificial Sequence
  chemically synthesized
ttgctttggtcttgtgagga

SEQ ID NO: 224342 - DNA, 20 bp, Artificial Sequence
  chemically synthesized
actgttgctttggtcttgtg

SEQ ID NO: 224343 - DNA, 20 bp, Artificial Sequence
  chemically synthesized
cactgttgctttggtcttgt

SEQ ID NO: 224344 - DNA, 20 bp, Artificial Sequence
  chemically synthesized
gagctttcctcacaagacca

SEQ ID NO: 224345 - DNA, 20 bp, Artificial Sequence
  chemically synthesized
tcctcacaagaccaaagcaa

SEQ ID NO: 224346 - DNA, 20 bp, Artificial Sequence
  chemically synthesized
aatttcatgcactgttgctt

SEQ ID NO: 224347 - DNA, 20 bp, Artificial Sequence
  chemically synthesized
tgcatgaaattgaactcaaa

SEQ ID NO: 224348 - DNA, 20 bp, Artificial Sequence
  chemically synthesized
catgaaattgaactcaaaaa

SEQ ID NO: 224349 - DNA, 20 bp, Artificial Sequence
  chemically synthesized
acagaatggtggctcttttt

SEQ ID NO: 224350 - DNA, 20 bp, Artificial Sequence
  chemically synthesized
caagaagtcacacagaatgg

SEQ ID NO: 224351 - DNA, 20 bp, Artificial Sequence
  chemically synthesized
agccaagaagtcacacagaa

SEQ ID NO: 224352 - DNA, 20 bp, Artificial Sequence
  chemically synthesized
gtgtcagccaagaagtcaca

SEQ ID NO: 224353 - DNA, 20 bp, Artificial Sequence
  chemically synthesized
caccattctgtgtgacttct

SEQ ID NO: 224354 - DNA, 20 bp, Artificial Sequence
  chemically synthesized
tctaaattgtgtcagccaag

SEQ ID NO: 224355 - DNA, 20 bp, Artificial Sequence
  chemically synthesized
atatctaaattgtgtcagcc

SEQ ID NO: 224356 - DNA, 20 bp, Artificial Sequence
  chemically synthesized
tataaatatctaaattgtgt

SEQ ID NO: 224357 - DNA, 20 bp, Artificial Sequence
  chemically synthesized
acttcttggctgacacaatt

SEQ ID NO: 224358 - DNA, 20 bp, Artificial Sequence
  chemically synthesized
tgacacaatttagatattta

SEQ ID NO: 224359 - DNA, 20 bp, Artificial Sequence
  chemically synthesized
gatatttatagctttacgaa

SEQ ID NO: 224360 - DNA, 20 bp, Artificial Sequence
  chemically synthesized
atatttatagctttacgaat

SEQ ID NO: 224361 - DNA, 20 bp, Artificial Sequence
  chemically synthesized
tctccagtggcccattcgta

SEQ ID NO: 224362 - DNA, 20 bp, Artificial Sequence
  chemically synthesized
tagctttacgaatgggccac

SEQ ID NO: 224363 - DNA, 20 bp, Artificial Sequence
  chemically synthesized
gctttacgaatgggccactg

SEQ ID NO: 224364 - DNA, 20 bp, Artificial Sequence
  chemically synthesized
ttacgaatgggccactggag

SEQ ID NO: 224365 - DNA, 20 bp, Artificial Sequence
  chemically synthesized
agcttcaagttcttctccag

SEQ ID NO: 224366 - DNA, 20 bp, Artificial Sequence
  chemically synthesized
gaaagcttcaagttcttctc

SEQ ID NO: 224367 - DNA, 20 bp, Artificial Sequence
  chemically synthesized
ggccactggagaagaacttg

SEQ ID NO: 224368 - DNA, 20 bp, Artificial Sequence
  chemically synthesized
tcctggctagagaaagcttc

SEQ ID NO: 224369 - DNA, 20 bp, Artificial Sequence
  chemically synthesized
gaagaacttgaagctttctc

SEQ ID NO: 224370 - DNA, 20 bp, Artificial Sequence
  chemically synthesized
taatccttcctggctagaga

SEQ ID NO: 224371 - DNA, 20 bp, Artificial Sequence
  chemically synthesized
aacttgaagctttctctagc

SEQ ID NO: 224372 - DNA, 20 bp, Artificial Sequence
  chemically synthesized
acttgaagctttctctagcc

SEQ ID NO: 224373 - DNA, 20 bp, Artificial Sequence
  chemically synthesized
tcattaatccttcctggcta

SEQ ID NO: 224374 - DNA, 20 bp, Artificial Sequence
  chemically synthesized
tgaagctttctctagccagg

SEQ ID NO: 224375 - DNA, 20 bp, Artificial Sequence
  chemically synthesized
gaagctttctctagccagga

SEQ ID NO: 224376 - DNA, 20 bp, Artificial Sequence
  chemically synthesized
gttcattaatccttcctggc

SEQ ID NO: 224377 - DNA, 20 bp, Artificial Sequence
  chemically synthesized
gcacgttcattaatccttcc

SEQ ID NO: 224378 - DNA, 20 bp, Artificial Sequence
  chemically synthesized
gattaatgaacgtgcgcacc

SEQ ID NO: 224379 - DNA, 20 bp, Artificial Sequence
  chemically synthesized
gatggagtggtgtaattacc

SEQ ID NO: 224380 - DNA, 20 bp, Artificial Sequence
  chemically synthesized
agatggagtggtgtaattac

SEQ ID NO: 224381 - DNA, 20 bp, Artificial Sequence
  chemically synthesized
gggctttcaggaagatggag

SEQ ID NO: 224382 - DNA, 20 bp, Artificial Sequence
  chemically synthesized
tgagggctttcaggaagatg

SEQ ID NO: 224383 - DNA, 20 bp, Artificial Sequence
  chemically synthesized
cgtgagggctttcaggaaga

SEQ ID NO: 224384 - DNA, 20 bp, Artificial Sequence
  chemically synthesized
acaccactccatcttcctga

SEQ ID NO: 224385 - DNA, 20 bp, Artificial Sequence
  chemically synthesized
gcagcgtgagggctttcagg

SEQ ID NO: 224386 - DNA, 20 bp, Artificial Sequence
  chemically synthesized
gaggcagcgtgagggctttc

SEQ ID NO: 224387 - DNA, 20 bp, Artificial Sequence
  chemically synthesized
ggaggcagcgtgagggcttt

SEQ ID NO: 224388 - DNA, 20 bp, Artificial Sequence
  chemically synthesized
ctgccatggaggcagcgtga

SEQ ID NO: 224389 - DNA, 20 bp, Artificial Sequence
  chemically synthesized
tctgccatggaggcagcgtg

SEQ ID NO: 224390 - DNA, 20 bp, Artificial Sequence
  chemically synthesized
ttctgccatggaggcagcgt

SEQ ID NO: 224391 - DNA, 20 bp, Artificial Sequence
  chemically synthesized
aagccctcacgctgcctcca

SEQ ID NO: 224392 - DNA, 20 bp, Artificial Sequence
  chemically synthesized
tatagtttctgccatggagg

SEQ ID NO: 224393 - DNA, 20 bp, Artificial Sequence
  chemically synthesized
ccctcacgctgcctccatgg

SEQ ID NO: 224394 - DNA, 20 bp, Artificial Sequence
  chemically synthesized
cattatagtttctgccatgg

SEQ ID NO: 224395 - DNA, 20 bp, Artificial Sequence
  chemically synthesized
tcattatagtttctgccatg

SEQ ID NO: 224396 - DNA, 20 bp, Artificial Sequence
  chemically synthesized
tttcattatagtttctgcca

SEQ ID NO: 224397 - DNA, 20 bp, Artificial Sequence
  chemically synthesized
ttttcaatgcattttcatta

SEQ ID NO: 224398 - DNA, 20 bp, Artificial Sequence
  chemically synthesized
tagatttaattgtagaattg

SEQ ID NO: 224399 - DNA, 20 bp, Artificial Sequence
  chemically synthesized
ttattatttagatttaattg

SEQ ID NO: 224400 - DNA, 20 bp, Artificial Sequence
  chemically synthesized
agataccaagttttattatt

SEQ ID NO: 224401 - DNA, 20 bp, Artificial Sequence
  chemically synthesized
taaatctaaataataaaact

SEQ ID NO: 224402 - DNA, 20 bp, Artificial Sequence
  chemically synthesized
gtgtggggagaaaagatacc

SEQ ID NO: 224403 - DNA, 20 bp, Artificial Sequence
  chemically synthesized
tctggaatgtgtggggagaa

SEQ ID NO: 224404 - DNA, 20 bp, Artificial Sequence
  chemically synthesized
tcacatctggaatgtgtggg

SEQ ID NO: 224405 - DNA, 20 bp, Artificial Sequence
  chemically synthesized
tatcacatctggaatgtgtg

SEQ ID NO: 224406 - DNA, 20 bp, Artificial Sequence
  chemically synthesized
ttatcacatctggaatgtgt

SEQ ID NO: 224407 - DNA, 20 bp, Artificial Sequence
  chemically synthesized
tcttttctccccacacattc

SEQ ID NO: 224408 - DNA, 20 bp, Artificial Sequence
  chemically synthesized
tttatcacatctggaatgtg

SEQ ID NO: 224409 - DNA, 20 bp, Artificial Sequence
  chemically synthesized
tgtctgtgttttatcacatc

SEQ ID NO: 224410 - DNA, 20 bp, Artificial Sequence
  chemically synthesized
attccagatgtgataaaaca

SEQ ID NO: 224411 - DNA, 20 bp, Artificial Sequence
  chemically synthesized
cagatgtgataaaacacaga

SEQ ID NO: 224412 - DNA, 20 bp, Artificial Sequence
  chemically synthesized
cagcatttaaatttaaaaca

SEQ ID NO: 224413 - DNA, 20 bp, Artificial Sequence
  chemically synthesized
catttaaatttaaaacatag

SEQ ID NO: 224414 - DNA, 20 bp, Artificial Sequence
  chemically synthesized
aaaacatagaagctgaatgt

SEQ ID NO: 224415 - DNA, 20 bp, Artificial Sequence
  chemically synthesized
ttcaaaaataggctgacatt

SEQ ID NO: 224416 - DNA, 20 bp, Artificial Sequence
  chemically synthesized
aatgaggcatgttcaaaaat

SEQ ID NO: 224417 - DNA, 20 bp, Artificial Sequence
  chemically synthesized
aaatgaggcatgttcaaaaa

SEQ ID NO: 224418 - DNA, 20 bp, Artificial Sequence
  chemically synthesized
tgaggtttactttggaaatg

SEQ ID NO: 224419 - DNA, 20 bp, Artificial Sequence
  chemically synthesized
ttgaacatgcctcatttcca

SEQ ID NO: 224420 - DNA, 20 bp, Artificial Sequence
  chemically synthesized
gtgaggtttactttggaaat

SEQ ID NO: 224421 - DNA, 20 bp, Artificial Sequence
  chemically synthesized
ttctcttgtgaggtttactt

SEQ ID NO: 224422 - DNA, 20 bp, Artificial Sequence
  chemically synthesized
atttccaaagtaaacctcac

SEQ ID NO: 224423 - DNA, 20 bp, Artificial Sequence
  chemically synthesized
ttccaaagtaaacctcacaa

SEQ ID NO: 224424 - DNA, 20 bp, Artificial Sequence
  chemically synthesized
aacctcttttttctcttgtg

SEQ ID NO: 224425 - DNA, 20 bp, Artificial Sequence
  chemically synthesized
taacctcttttttctcttgt

SEQ ID NO: 224426 - DNA, 20 bp, Artificial Sequence
  chemically synthesized
gtaaacctcacaagagaaaa

SEQ ID NO: 224427 - DNA, 20 bp, Artificial Sequence
  chemically synthesized
aaacctcacaagagaaaaaa

SEQ ID NO: 224428 - DNA, 20 bp, Artificial Sequence
  chemically synthesized
aacctcacaagagaaaaaag

SEQ ID NO: 224429 - DNA, 20 bp, Artificial Sequence
  chemically synthesized
aaaaaagaggttattaaata

SEQ ID NO: 224430 - DNA, 20 bp, Artificial Sequence
  chemically synthesized
aacaacattcaaatgtgcaa

SEQ ID NO: 224431 - DNA, 20 bp, Artificial Sequence
  chemically synthesized
caacattcaaatgtgcaaca

SEQ ID NO: 224432 - DNA, 20 bp, Artificial Sequence
  chemically synthesized
aataaagggaaaacagttat

SEQ ID NO: 224433 - DNA, 20 bp, Artificial Sequence
  chemically synthesized
taataaagggaaaacagtta

SEQ ID NO: 224434 - DNA, 20 bp, Artificial Sequence
  chemically synthesized
gtgttttaataaagggaaaa

SEQ ID NO: 224435 - DNA, 20 bp, Artificial Sequence
  chemically synthesized
gtatgctgtgttttaataaa

SEQ ID NO: 224436 - DNA, 20 bp, Artificial Sequence
  chemically synthesized
tgtatgctgtgttttaataa

SEQ ID NO: 224437 - DNA, 20 bp, Artificial Sequence
  chemically synthesized
gtgtatgctgtgttttaata

SEQ ID NO: 224438 - DNA, 20 bp, Artificial Sequence
  chemically synthesized
gttttccctttattaaaaca

SEQ ID NO: 224439 - DNA, 20 bp, Artificial Sequence
  chemically synthesized
taaaacacagcatacaccat

SEQ ID NO: 224440 - DNA, 20 bp, Artificial Sequence
  chemically synthesized
tgaagtaaatgcatcactta

SEQ ID NO: 224441 - DNA, 20 bp, Artificial Sequence
  chemically synthesized
taagtgatgcatttacttca

SEQ ID NO: 224442 - DNA, 20 bp, Artificial Sequence
  chemically synthesized
gtgatgcatttacttcaaag

SEQ ID NO: 224443 - DNA, 20 bp, Artificial Sequence
  chemically synthesized
gatgcatttacttcaaagca

SEQ ID NO: 224444 - DNA, 20 bp, Artificial Sequence
  chemically synthesized
attgaaatgcctctgctttg

SEQ ID NO: 224445 - DNA, 20 bp, Artificial Sequence
  chemically synthesized
atgcatttacttcaaagcag

SEQ ID NO: 224446 - DNA, 20 bp, Artificial Sequence
  chemically synthesized
caatgattaaatcacaaccg

SEQ ID NO: 224447 - DNA, 20 bp, Artificial Sequence
  chemically synthesized
aattttacctttgtacactt

SEQ ID NO: 224448 - DNA, 20 bp, Artificial Sequence
  chemically synthesized
aatcacaaccgaagtgtaca

SEQ ID NO: 224449 - DNA, 20 bp, Artificial Sequence
  chemically synthesized
atcacaaccgaagtgtacaa

SEQ ID NO: 224450 - DNA, 20 bp, Artificial Sequence
  chemically synthesized
aagtgtacaaaggtaaaatt

SEQ ID NO: 224451 - DNA, 20 bp, Artificial Sequence
  chemically synthesized
tgtacaaaggtaaaatttag

SEQ ID NO: 224452 - DNA, 20 bp, Artificial Sequence
  chemically synthesized
aggtaaaatttagaagtgca

SEQ ID NO: 224453 - DNA, 20 bp, Artificial Sequence
  chemically synthesized
ggtaaaatttagaagtgcaa

SEQ ID NO: 224454 - DNA, 20 bp, Artificial Sequence
  chemically synthesized
gtaactggacttggaagata

SEQ ID NO: 224455 - DNA, 20 bp, Artificial Sequence
  chemically synthesized
caaaggtatctttatcttcc

SEQ ID NO: 224456 - DNA, 20 bp, Artificial Sequence
  chemically synthesized
gtatctttatcttccaagtc

SEQ ID NO: 224457 - DNA, 20 bp, Artificial Sequence
  chemically synthesized
gaacaagtaactggacttgg

SEQ ID NO: 224458 - DNA, 20 bp, Artificial Sequence
  chemically synthesized
ccagaacaagtaactggact

SEQ ID NO: 224459 - DNA, 20 bp, Artificial Sequence
  chemically synthesized
aaatagccagaacaagtaac

SEQ ID NO: 224460 - DNA, 20 bp, Artificial Sequence
  chemically synthesized
ccaagtccagttacttgttc

SEQ ID NO: 224461 - DNA, 20 bp, Artificial Sequence
  chemically synthesized
ttagaaaaaatagccagaac

SEQ ID NO: 224462 - DNA, 20 bp, Artificial Sequence
  chemically synthesized
aagagtttagaaaaaatagc

SEQ ID NO: 224463 - DNA, 20 bp, Artificial Sequence
  chemically synthesized
cagtaagagtttagaaaaaa

SEQ ID NO: 224464 - DNA, 20 bp, Artificial Sequence
  chemically synthesized
ttttcctttcagtaagagtt

SEQ ID NO: 224465 - DNA, 20 bp, Artificial Sequence
  chemically synthesized
tttttctaaactcttactga

SEQ ID NO: 224466 - DNA, 20 bp, Artificial Sequence
  chemically synthesized
tgaggttttcctttcagtaa

SEQ ID NO: 224467 - DNA, 20 bp, Artificial Sequence
  chemically synthesized
ttttctaaactcttactgaa

SEQ ID NO: 224468 - DNA, 20 bp, Artificial Sequence
  chemically synthesized
agtgaggttttcctttcagt

SEQ ID NO: 224469 - DNA, 20 bp, Artificial Sequence
  chemically synthesized
attaagtgaggttttccttt

SEQ ID NO: 224470 - DNA, 20 bp, Artificial Sequence
  chemically synthesized
tttttaaaagttattaagtg

SEQ ID NO: 224471 - DNA, 20 bp, Artificial Sequence
  chemically synthesized
atttttaaaagttattaagt

SEQ ID NO: 224472 - DNA, 20 bp, Artificial Sequence
  chemically synthesized
ttatatttttaaaagttatt

SEQ ID NO: 224473 - DNA, 20 bp, Artificial Sequence
  chemically synthesized
ttttttatttatatttttaa

SEQ ID NO: 224474 - DNA, 20 bp, Artificial Sequence
  chemically synthesized
taacatacggttatgtaaag

SEQ ID NO: 224475 - DNA, 20 bp, Artificial Sequence
  chemically synthesized
aattaacatacggttatgta

SEQ ID NO: 224476 - DNA, 20 bp, Artificial Sequence
  chemically synthesized
gtaattttgcaattaacata

SEQ ID NO: 224477 - DNA, 20 bp, Artificial Sequence
  chemically synthesized
ttgcaaaattacttgaacta

SEQ ID NO: 224478 - DNA, 20 bp, Artificial Sequence
  chemically synthesized
atcgtatatctctttagttc

SEQ ID NO: 224479 - DNA, 20 bp, Artificial Sequence
  chemically synthesized
gcaaaattacttgaactaaa

SEQ ID NO: 224480 - DNA, 20 bp, Artificial Sequence
  chemically synthesized
tatgtcatcgtatatctctt

SEQ ID NO: 224481 - DNA, 20 bp, Artificial Sequence
  chemically synthesized
taaagagatatacgatgaca

SEQ ID NO: 224482 - DNA, 20 bp, Artificial Sequence
  chemically synthesized
ttctttgtaacaagttattt

SEQ ID NO: 224483 - DNA, 20 bp, Artificial Sequence
  chemically synthesized
aactcaaataacttgttaca

SEQ ID NO: 224484 - DNA, 20 bp, Artificial Sequence
  chemically synthesized
gatgaaaatttctttgtaac

SEQ ID NO: 224485 - DNA, 20 bp, Artificial Sequence
  chemically synthesized
gtttgatttgttcaagtttt

SEQ ID NO: 224486 - DNA, 20 bp, Artificial Sequence
  chemically synthesized
agtttgatttgttcaagttt

SEQ ID NO: 224487 - DNA, 20 bp, Artificial Sequence
  chemically synthesized
gcaaaaagtttgatttgttc

SEQ ID NO: 224488 - DNA, 20 bp, Artificial Sequence
  chemically synthesized
tgaacaaatcaaactttttg

SEQ ID NO: 224489 - DNA, 20 bp, Artificial Sequence
  chemically synthesized
acaaatcaaactttttgcag

SEQ ID NO: 224490 - DNA, 20 bp, Artificial Sequence
  chemically synthesized
gagaaaaatactactgcaaa

SEQ ID NO: 224491 - DNA, 20 bp, Artificial Sequence
  chemically synthesized
ttttgcagtagtatttttct

SEQ ID NO: 224492 - DNA, 20 bp, Artificial Sequence
  chemically synthesized
ctctatactgtgttttatct

SEQ ID NO: 224493 - DNA, 20 bp, Artificial Sequence
  chemically synthesized
tatttttctcagataaaaca

SEQ ID NO: 224494 - DNA, 20 bp, Artificial Sequence
  chemically synthesized
ttctcagataaaacacagta

SEQ ID NO: 224495 - DNA, 20 bp, Artificial Sequence
  chemically synthesized
ctcagataaaacacagtata

SEQ ID NO: 224496 - DNA, 20 bp, Artificial Sequence
  chemically synthesized
tcagataaaacacagtatag

SEQ ID NO: 224497 - DNA, 20 bp, Artificial Sequence
  chemically synthesized
cacagtatagaggttcaacc

SEQ ID NO: 224498 - DNA, 20 bp, Artificial Sequence
  chemically synthesized
gtgtcacattaagaaacact

SEQ ID NO: 224499 - DNA, 20 bp, Artificial Sequence
  chemically synthesized
tgtgtcacattaagaaacac

SEQ ID NO: 224500 - DNA, 20 bp, Artificial Sequence
  chemically synthesized
aaattgctttgtgtcacatt

SEQ ID NO: 224501 - DNA, 20 bp, Artificial Sequence
  chemically synthesized
gtgtttcttaatgtgacaca

SEQ ID NO: 224502 - DNA, 20 bp, Artificial Sequence
  chemically synthesized
acaaagcaatttgatattcc

SEQ ID NO: 224503 - DNA, 20 bp, Artificial Sequence
  chemically synthesized
caaagcaatttgatattcca

SEQ ID NO: 224504 - DNA, 20 bp, Artificial Sequence
  chemically synthesized
agcaatttgatattccaagg

SEQ ID NO: 224505 - DNA, 20 bp, Artificial Sequence
  chemically synthesized
gcaatttgatattccaagga

SEQ ID NO: 224506 - DNA, 20 bp, Artificial Sequence
  chemically synthesized
atttgatattccaaggaagg

SEQ ID NO: 224507 - DNA, 20 bp, Artificial Sequence
  chemically synthesized
atatacatagctgccttcct

SEQ ID NO: 224508 - DNA, 20 bp, Artificial Sequence
  chemically synthesized
cttctcagtttatatataca

SEQ ID NO: 224509 - DNA, 20 bp, Artificial Sequence
  chemically synthesized
cagctatgtatatataaact

SEQ ID NO: 224510 - DNA, 20 bp, Artificial Sequence
  chemically synthesized
ctatgtatatataaactgag

SEQ ID NO: 224511 - DNA, 20 bp, Artificial Sequence
  chemically synthesized
tatgtatatataaactgaga

SEQ ID NO: 224512 - DNA, 20 bp, Artificial Sequence
  chemically synthesized
ttttctgaaagcagccttct

SEQ ID NO: 224513 - DNA, 20 bp, Artificial Sequence
  chemically synthesized
taaactgagaaggctgcttt

SEQ ID NO: 224514 - DNA, 20 bp, Artificial Sequence
  chemically synthesized
ccttgattgttttctgaaag

SEQ ID NO: 224515 - DNA, 20 bp, Artificial Sequence
  chemically synthesized
gaaccttgattgttttctga

SEQ ID NO: 224516 - DNA, 20 bp, Artificial Sequence
  chemically synthesized
gctgctttcagaaaacaatc

SEQ ID NO: 224517 - DNA, 20 bp, Artificial Sequence
  chemically synthesized
ctgctttcagaaaacaatca

SEQ ID NO: 224518 - DNA, 20 bp, Artificial Sequence
  chemically synthesized
gaaaacaatcaaggttctct

SEQ ID NO: 224519 - DNA, 20 bp, Artificial Sequence
  chemically synthesized
caatcaaggttctctaagca

SEQ ID NO: 224520 - DNA, 20 bp, Artificial Sequence
  chemically synthesized
ataaaaccctgctttgctta

SEQ ID NO: 224521 - DNA, 20 bp, Artificial Sequence
  chemically synthesized
tcaaggttctctaagcaaag

SEQ ID NO: 224522 - DNA, 20 bp, Artificial Sequence
  chemically synthesized
tcataaaaccctgctttgct

SEQ ID NO: 224523 - DNA, 20 bp, Artificial Sequence
  chemically synthesized
caaggttctctaagcaaagc

SEQ ID NO: 224524 - DNA, 20 bp, Artificial Sequence
  chemically synthesized
aaggttctctaagcaaagca

SEQ ID NO: 224525 - DNA, 20 bp, Artificial Sequence
  chemically synthesized
caaagcagggttttatgata

SEQ ID NO: 224526 - DNA, 20 bp, Artificial Sequence
  chemically synthesized
ggttttatgataaagtttca

SEQ ID NO: 224527 - DNA, 20 bp, Artificial Sequence
  chemically synthesized
cagtcattaaaattcagtgt

SEQ ID NO: 224528 - DNA, 20 bp, Artificial Sequence
  chemically synthesized
ctaaagcagtcattaaaatt

SEQ ID NO: 224529 - DNA, 20 bp, Artificial Sequence
  chemically synthesized
ctgaattttaatgactgctt

SEQ ID NO: 224530 - DNA, 20 bp, Artificial Sequence
  chemically synthesized
ctctttctgctttactaaag

SEQ ID NO: 224531 - DNA, 20 bp, Artificial Sequence
  chemically synthesized
ttttaatgactgctttagta

SEQ ID NO: 224532 - DNA, 20 bp, Artificial Sequence
  chemically synthesized
tctctctttctgctttacta

SEQ ID NO: 224533 - DNA, 20 bp, Artificial Sequence
  chemically synthesized
taatgactgctttagtaaag

SEQ ID NO: 224534 - DNA, 20 bp, Artificial Sequence
  chemically synthesized
gactgctttagtaaagcaga

SEQ ID NO: 224535 - DNA, 20 bp, Artificial Sequence
  chemically synthesized
ctgctttagtaaagcagaaa

SEQ ID NO: 224536 - DNA, 20 bp, Artificial Sequence
  chemically synthesized
gctttagtaaagcagaaaga

SEQ ID NO: 224537 - DNA, 20 bp, Artificial Sequence
  chemically synthesized
aaagagagaaaatttaatgt

SEQ ID NO: 224538 - DNA, 20 bp, Artificial Sequence
  chemically synthesized
aatgtaagcactgatactaa

SEQ ID NO: 224539 - DNA, 20 bp, Artificial Sequence
  chemically synthesized
cggcaattaacttttagtat

SEQ ID NO: 224540 - DNA, 20 bp, Artificial Sequence
  chemically synthesized
ttaagacggcaattaacttt

SEQ ID NO: 224541 - DNA, 20 bp, Artificial Sequence
  chemically synthesized
ttggcgcctgtgtgttaaga

SEQ ID NO: 224542 - DNA, 20 bp, Artificial Sequence
  chemically synthesized
ttaattgccgtcttaacaca

SEQ ID NO: 224543 - DNA, 20 bp, Artificial Sequence
  chemically synthesized
taattgccgtcttaacacac

SEQ ID NO: 224544 - DNA, 20 bp, Artificial Sequence
  chemically synthesized
aatcttggcgcctgtgtgtt

SEQ ID NO: 224545 - DNA, 20 bp, Artificial Sequence
  chemically synthesized
cgtcttaacacacaggcgcc

SEQ ID NO: 224546 - DNA, 20 bp, Artificial Sequence
  chemically synthesized
gactcctgctaggggaatct

SEQ ID NO: 224547 - DNA, 20 bp, Artificial Sequence
  chemically synthesized
cacaggcgccaagattcccc

SEQ ID NO: 224548 - DNA, 20 bp, Artificial Sequence
  chemically synthesized
aggcgccaagattcccctag

SEQ ID NO: 224549 - DNA, 20 bp, Artificial Sequence
  chemically synthesized
ggcgccaagattcccctagc

SEQ ID NO: 224550 - DNA, 20 bp, Artificial Sequence
  chemically synthesized
cgccaagattcccctagcag

SEQ ID NO: 224551 - DNA, 20 bp, Artificial Sequence
  chemically synthesized
ttttaagagactcctgctag

SEQ ID NO: 224552 - DNA, 20 bp, Artificial Sequence
  chemically synthesized
tttttaagagactcctgcta

SEQ ID NO: 224553 - DNA, 20 bp, Artificial Sequence
  chemically synthesized
ttttttaagagactcctgct

SEQ ID NO: 224554 - DNA, 20 bp, Artificial Sequence
  chemically synthesized
gttttttaagagactcctgc

SEQ ID NO: 224555 - DNA, 20 bp, Artificial Sequence
  chemically synthesized
cgtttaaaggtgttttttaa

SEQ ID NO: 224556 - DNA, 20 bp, Artificial Sequence
  chemically synthesized
tgcgtttaaaggtgtttttt

SEQ ID NO: 224557 - DNA, 20 bp, Artificial Sequence
  chemically synthesized
ttaaaaaacacctttaaacg

SEQ ID NO: 224558 - DNA, 20 bp, Artificial Sequence
  chemically synthesized
gtgccctcttctgcgtttaa

SEQ ID NO: 224559 - DNA, 20 bp, Artificial Sequence
  chemically synthesized
tgtgccctcttctgcgttta

SEQ ID NO: 224560 - DNA, 20 bp, Artificial Sequence
  chemically synthesized
aaaaacacctttaaacgcag

SEQ ID NO: 224561 - DNA, 20 bp, Artificial Sequence
  chemically synthesized
aaacacctttaaacgcagaa

SEQ ID NO: 224562 - DNA, 20 bp, Artificial Sequence
  chemically synthesized
aacacctttaaacgcagaag

SEQ ID NO: 224563 - DNA, 20 bp, Artificial Sequence
  chemically synthesized
acacctttaaacgcagaaga

SEQ ID NO: 224564 - DNA, 20 bp, Artificial Sequence
  chemically synthesized
ttaaacgcagaagagggcac

SEQ ID NO: 224565 - DNA, 20 bp, Artificial Sequence
  chemically synthesized
gcaattttttttttttttca

SEQ ID NO: 224566 - DNA, 20 bp, Artificial Sequence
  chemically synthesized
caatagagtttaacagtaac

SEQ ID NO: 224567 - DNA, 20 bp, Artificial Sequence
  chemically synthesized
acaatagagtttaacagtaa

SEQ ID NO: 224568 - DNA, 20 bp, Artificial Sequence
  chemically synthesized
cagggaacaatagagtttaa

SEQ ID NO: 224569 - DNA, 20 bp, Artificial Sequence
  chemically synthesized
tactccatcagggaacaata

SEQ ID NO: 224570 - DNA, 20 bp, Artificial Sequence
  chemically synthesized
tatactccatcagggaacaa

SEQ ID NO: 224571 - DNA, 20 bp, Artificial Sequence
  chemically synthesized
taaactctattgttccctga

SEQ ID NO: 224572 - DNA, 20 bp, Artificial Sequence
  chemically synthesized
aactctattgttccctgatg

SEQ ID NO: 224573 - DNA, 20 bp, Artificial Sequence
  chemically synthesized
ctttcttctatactccatca

SEQ ID NO: 224574 - DNA, 20 bp, Artificial Sequence
  chemically synthesized
tctttcttctatactccatc

SEQ ID NO: 224575 - DNA, 20 bp, Artificial Sequence
  chemically synthesized
ttctttcttctatactccat

SEQ ID NO: 224576 - DNA, 20 bp, Artificial Sequence
  chemically synthesized
tattgttccctgatggagta

SEQ ID NO: 224577 - DNA, 20 bp, Artificial Sequence
  chemically synthesized
tgttccctgatggagtatag

SEQ ID NO: 224578 - DNA, 20 bp, Artificial Sequence
  chemically synthesized
ccctgatggagtatagaaga

SEQ ID NO: 224579 - DNA, 20 bp, Artificial Sequence
  chemically synthesized
tatagaagaaagaaatgctc

SEQ ID NO: 224580 - DNA, 20 bp, Artificial Sequence
  chemically synthesized
atagaagaaagaaatgctcc

SEQ ID NO: 224581 - DNA, 20 bp, Artificial Sequence
  chemically synthesized
agaagaaagaaatgctccag

SEQ ID NO: 224582 - DNA, 20 bp, Artificial Sequence
  chemically synthesized
aagaaagaaatgctccagga

SEQ ID NO: 224583 - DNA, 20 bp, Artificial Sequence
  chemically synthesized
agaaagaaatgctccaggag

SEQ ID NO: 224584 - DNA, 20 bp, Artificial Sequence
  chemically synthesized
gaaagaaatgctccaggaga

SEQ ID NO: 224585 - DNA, 20 bp, Artificial Sequence
  chemically synthesized
atatccacttccctctcctg

SEQ ID NO: 224586 - DNA, 20 bp, Artificial Sequence
  chemically synthesized
tcatatccacttccctctcc

SEQ ID NO: 224587 - DNA, 20 bp, Artificial Sequence
  chemically synthesized
agaaatgctccaggagaggg

SEQ ID NO: 224588 - DNA, 20 bp, Artificial Sequence
  chemically synthesized
aatgctccaggagagggaag

SEQ ID NO: 224589 - DNA, 20 bp, Artificial Sequence
  chemically synthesized
tggatatgaattgccccctc

SEQ ID NO: 224590 - DNA, 20 bp, Artificial Sequence
  chemically synthesized
gatatgaattgccccctcca

SEQ ID NO: 224591 - DNA, 20 bp, Artificial Sequence
  chemically synthesized
atatgaattgccccctccag

SEQ ID NO: 224592 - DNA, 20 bp, Artificial Sequence
  chemically synthesized
ttgtttggctcctctggagg

SEQ ID NO: 224593 - DNA, 20 bp, Artificial Sequence
  chemically synthesized
tttgtttggctcctctggag

SEQ ID NO: 224594 - DNA, 20 bp, Artificial Sequence
  chemically synthesized
atgaattgccccctccagag

SEQ ID NO: 224595 - DNA, 20 bp, Artificial Sequence
  chemically synthesized
atttgtttggctcctctgga

SEQ ID NO: 224596 - DNA, 20 bp, Artificial Sequence
  chemically synthesized
aatttgtttggctcctctgg

SEQ ID NO: 224597 - DNA, 20 bp, Artificial Sequence
  chemically synthesized
caatttgtttggctcctctg

SEQ ID NO: 224598 - DNA, 20 bp, Artificial Sequence
  chemically synthesized
gccaatttgtttggctcctc

SEQ ID NO: 224599 - DNA, 20 bp, Artificial Sequence
  chemically synthesized
tccagaggagccaaacaaat

SEQ ID NO: 224600 - DNA, 20 bp, Artificial Sequence
  chemically synthesized
cttcctacagccaatttgtt

SEQ ID NO: 224601 - DNA, 20 bp, Artificial Sequence
  chemically synthesized
ggagccaaacaaattggctg

SEQ ID NO: 224602 - DNA, 20 bp, Artificial Sequence
  chemically synthesized
gagccaaacaaattggctgt

SEQ ID NO: 224603 - DNA, 20 bp, Artificial Sequence
  chemically synthesized
ccaaacaaattggctgtagg

SEQ ID NO: 224604 - DNA, 20 bp, Artificial Sequence
  chemically synthesized
cagcttttgaagtcttccta

SEQ ID NO: 224605 - DNA, 20 bp, Artificial Sequence
  chemically synthesized
tggctgtaggaagacttcaa

SEQ ID NO: 224606 - DNA, 20 bp, Artificial Sequence
  chemically synthesized
tgtaggaagacttcaaaagc

SEQ ID NO: 224607 - DNA, 20 bp, Artificial Sequence
  chemically synthesized
ctctgttcgtccagcttttg

SEQ ID NO: 224608 - DNA, 20 bp, Artificial Sequence
  chemically synthesized
gacttcaaaagctggacgaa

SEQ ID NO: 224609 - DNA, 20 bp, Artificial Sequence
  chemically synthesized
tttgagcttctctgttcgtc

SEQ ID NO: 224610 - DNA, 20 bp, Artificial Sequence
  chemically synthesized
cttcaaaagctggacgaaca

SEQ ID NO: 224611 - DNA, 20 bp, Artificial Sequence
  chemically synthesized
caaaagctggacgaacagag

SEQ ID NO: 224612 - DNA, 20 bp, Artificial Sequence
  chemically synthesized
tggacgaacagagaagctca

SEQ ID NO: 224613 - DNA, 20 bp, Artificial Sequence
  chemically synthesized
cccaaatctgtaaggtcttt

SEQ ID NO: 224614 - DNA, 20 bp, Artificial Sequence
  chemically synthesized
agagaagctcaaagacctta

SEQ ID NO: 224615 - DNA, 20 bp, Artificial Sequence
  chemically synthesized
gcaagtagcccaaatctgta

SEQ ID NO: 224616 - DNA, 20 bp, Artificial Sequence
  chemically synthesized
gctcaaagaccttacagatt

SEQ ID NO: 224617 - DNA, 20 bp, Artificial Sequence
  chemically synthesized
ggcaagtagcccaaatctgt

SEQ ID NO: 224618 - DNA, 20 bp, Artificial Sequence
  chemically synthesized
ctcaaagaccttacagattt

SEQ ID NO: 224619 - DNA, 20 bp, Artificial Sequence
  chemically synthesized
aaaaacacagcaagggcaag

SEQ ID NO: 224620 - DNA, 20 bp, Artificial Sequence
  chemically synthesized
aaaaaaaacacagcaagggc

SEQ ID NO: 224621 - DNA, 20 bp, Artificial Sequence
  chemically synthesized
aaaaaaaaaaaacacagcaa

SEQ ID NO: 224622 - DNA, 20 bp, Artificial Sequence
  chemically synthesized
aaaaaaaaaaaaacacagca

SEQ ID NO: 224623 - DNA, 20 bp, Artificial Sequence
  chemically synthesized
aaaaaaaaaaaaaacacagc

SEQ ID NO: 224624 - DNA, 20 bp, Artificial Sequence
  chemically synthesized
ttaaaaaaaaaaaaaaaaca

SEQ ID NO: 224625 - DNA, 20 bp, Artificial Sequence
  chemically synthesized
tttttttttttaatttcccc

SEQ ID NO: 224626 - DNA, 20 bp, Artificial Sequence
  chemically synthesized
ttaaaccatattcattctag

SEQ ID NO: 224627 - DNA, 20 bp, Artificial Sequence
  chemically synthesized
gttaaaccatattcattcta

SEQ ID NO: 224628 - DNA, 20 bp, Artificial Sequence
  chemically synthesized
agttaaaccatattcattct

SEQ ID NO: 224629 - DNA, 20 bp, Artificial Sequence
  chemically synthesized
aagttaaaccatattcattc

SEQ ID NO: 224630 - DNA, 20 bp, Artificial Sequence
  chemically synthesized
aatttcccctagaatgaata

SEQ ID NO: 224631 - DNA, 20 bp, Artificial Sequence
  chemically synthesized
gaatgaatatggtttaactt

SEQ ID NO: 224632 - DNA, 20 bp, Artificial Sequence
  chemically synthesized
atgaatatggtttaacttga

SEQ ID NO: 224633 - DNA, 20 bp, Artificial Sequence
  chemically synthesized
tccttccattatttgctctc

SEQ ID NO: 224634 - DNA, 20 bp, Artificial Sequence
  chemically synthesized
tttaacttgagagcaaataa

SEQ ID NO: 224635 - DNA, 20 bp, Artificial Sequence
  chemically synthesized
aacttgagagcaaataatgg

SEQ ID NO: 224636 - DNA, 20 bp, Artificial Sequence
  chemically synthesized
acttgagagcaaataatgga

SEQ ID NO: 224637 - DNA, 20 bp, Artificial Sequence
  chemically synthesized
tttttaaatgctttgattcc

SEQ ID NO: 224638 - DNA, 20 bp, Artificial Sequence
  chemically synthesized
gaataaaaagctgggaatca

SEQ ID NO: 224639 - DNA, 20 bp, Artificial Sequence
  chemically synthesized
tagaggcagaataaaaagct

SEQ ID NO: 224640 - DNA, 20 bp, Artificial Sequence
  chemically synthesized
ttagaggcagaataaaaagc

SEQ ID NO: 224641 - DNA, 20 bp, Artificial Sequence
  chemically synthesized
ctagttagaggcagaataaa

SEQ ID NO: 224642 - DNA, 20 bp, Artificial Sequence
  chemically synthesized
ttgtaatagctagttagagg

SEQ ID NO: 224643 - DNA, 20 bp, Artificial Sequence
  chemically synthesized
ctttttattctgcctctaac

SEQ ID NO: 224644 - DNA, 20 bp, Artificial Sequence
  chemically synthesized
gtattgtaatagctagttag

SEQ ID NO: 224645 - DNA, 20 bp, Artificial Sequence
  chemically synthesized
ggtattgtaatagctagtta

SEQ ID NO: 224646 - DNA, 20 bp, Artificial Sequence
  chemically synthesized
gtggtattgtaatagctagt

SEQ ID NO: 224647 - DNA, 20 bp, Artificial Sequence
  chemically synthesized
ttaagtggtattgtaatagc

SEQ ID NO: 224648 - DNA, 20 bp, Artificial Sequence
  chemically synthesized
cggattaagtggtattgtaa

SEQ ID NO: 224649 - DNA, 20 bp, Artificial Sequence
  chemically synthesized
tattacaataccacttaatc

SEQ ID NO: 224650 - DNA, 20 bp, Artificial Sequence
  chemically synthesized
atgctgaggtccggattaag

SEQ ID NO: 224651 - DNA, 20 bp, Artificial Sequence
  chemically synthesized
ggaatgctgaggtccggatt

SEQ ID NO: 224652 - DNA, 20 bp, Artificial Sequence
  chemically synthesized
ataccacttaatccggacct

SEQ ID NO: 224653 - DNA, 20 bp, Artificial Sequence
  chemically synthesized
gtacttggaatgctgaggtc

SEQ ID NO: 224654 - DNA, 20 bp, Artificial Sequence
  chemically synthesized
ctttggtacttggaatgctg

SEQ ID NO: 224655 - DNA, 20 bp, Artificial Sequence
  chemically synthesized
gctttggtacttggaatgct

SEQ ID NO: 224656 - DNA, 20 bp, Artificial Sequence
  chemically synthesized
aatccggacctcagcattcc

SEQ ID NO: 224657 - DNA, 20 bp, Artificial Sequence
  chemically synthesized
cctcagcattccaagtacca

SEQ ID NO: 224658 - DNA, 20 bp, Artificial Sequence
  chemically synthesized
ggaggagatgctttggtact

SEQ ID NO: 224659 - DNA, 20 bp, Artificial Sequence
  chemically synthesized
gtgggtgggaggagatgctt

SEQ ID NO: 224660 - DNA, 20 bp, Artificial Sequence
  chemically synthesized
gtgtgagcagtgggtgggag

SEQ ID NO: 224661 - DNA, 20 bp, Artificial Sequence
  chemically synthesized
gcgtgtgagcagtgggtggg

SEQ ID NO: 224662 - DNA, 20 bp, Artificial Sequence
  chemically synthesized
agcgtgtgagcagtgggtgg

SEQ ID NO: 224663 - DNA, 20 bp, Artificial Sequence
  chemically synthesized
ggagcgtgtgagcagtgggt

SEQ ID NO: 224664 - DNA, 20 bp, Artificial Sequence
  chemically synthesized
aggagcgtgtgagcagtggg

SEQ ID NO: 224665 - DNA, 20 bp, Artificial Sequence
  chemically synthesized
tgcaggagcgtgtgagcagt

SEQ ID NO: 224666 - DNA, 20 bp, Artificial Sequence
  chemically synthesized
atgcaggagcgtgtgagcag

SEQ ID NO: 224667 - DNA, 20 bp, Artificial Sequence
  chemically synthesized
ctgatgcaggagcgtgtgag

SEQ ID NO: 224668 - DNA, 20 bp, Artificial Sequence
  chemically synthesized
attctgatgcaggagcgtgt

SEQ ID NO: 224669 - DNA, 20 bp, Artificial Sequence
  chemically synthesized
ctgctcacacgctcctgcat

SEQ ID NO: 224670 - DNA, 20 bp, Artificial Sequence
  chemically synthesized
agtcttctattctgatgcag

SEQ ID NO: 224671 - DNA, 20 bp, Artificial Sequence
  chemically synthesized
taagtcttctattctgatgc

SEQ ID NO: 224672 - DNA, 20 bp, Artificial Sequence
  chemically synthesized
gtaagtcttctattctgatg

SEQ ID NO: 224673 - DNA, 20 bp, Artificial Sequence
  chemically synthesized
cacacgctcctgcatcagaa

SEQ ID NO: 224674 - DNA, 20 bp, Artificial Sequence
  chemically synthesized
acgctcctgcatcagaatag

SEQ ID NO: 224675 - DNA, 20 bp, Artificial Sequence
  chemically synthesized
gcatcagaatagaagactta

SEQ ID NO: 224676 - DNA, 20 bp, Artificial Sequence
  chemically synthesized
agaatagaagacttacagaa

SEQ ID NO: 224677 - DNA, 20 bp, Artificial Sequence
  chemically synthesized
gggtctggcagcttttctgt

SEQ ID NO: 224678 - DNA, 20 bp, Artificial Sequence
  chemically synthesized
aagacttacagaaaagctgc

SEQ ID NO: 224679 - DNA, 20 bp, Artificial Sequence
  chemically synthesized
gtgctcttctgtgggtctgg

SEQ ID NO: 224680 - DNA, 20 bp, Artificial Sequence
  chemically synthesized
cagaaaagctgccagaccca

SEQ ID NO: 224681 - DNA, 20 bp, Artificial Sequence
  chemically synthesized
aaagtgctcttctgtgggtc

SEQ ID NO: 224682 - DNA, 20 bp, Artificial Sequence
  chemically synthesized
aaaagctgccagacccacag

SEQ ID NO: 224683 - DNA, 20 bp, Artificial Sequence
  chemically synthesized
aagctgccagacccacagaa

SEQ ID NO: 224684 - DNA, 20 bp, Artificial Sequence
  chemically synthesized
agaggaaagtgctcttctgt

SEQ ID NO: 224685 - DNA, 20 bp, Artificial Sequence
  chemically synthesized
gagaggaaagtgctcttctg

SEQ ID NO: 224686 - DNA, 20 bp, Artificial Sequence
  chemically synthesized
gaagacatctgttgagagga

SEQ ID NO: 224687 - DNA, 20 bp, Artificial Sequence
  chemically synthesized
gaagagcactttcctctcaa

SEQ ID NO: 224688 - DNA, 20 bp, Artificial Sequence
  chemically synthesized
gctggaagacatctgttgag

SEQ ID NO: 224689 - DNA, 20 bp, Artificial Sequence
  chemically synthesized
agctggaagacatctgttga

SEQ ID NO: 224690 - DNA, 20 bp, Artificial Sequence
  chemically synthesized
aaagctggaagacatctgtt

SEQ ID NO: 224691 - DNA, 20 bp, Artificial Sequence
  chemically synthesized
tcctctcaacagatgtcttc

SEQ ID NO: 224692 - DNA, 20 bp, Artificial Sequence
  chemically synthesized
tgtgtgtgcctaaaagctgg

SEQ ID NO: 224693 - DNA, 20 bp, Artificial Sequence
  chemically synthesized
aacagatgtcttccagcttt

SEQ ID NO: 224694 - DNA, 20 bp, Artificial Sequence
  chemically synthesized
acagatgtcttccagctttt

SEQ ID NO: 224695 - DNA, 20 bp, Artificial Sequence
  chemically synthesized
gtgtgtgtgtgcctaaaagc

SEQ ID NO: 224696 - DNA, 20 bp, Artificial Sequence
  chemically synthesized
ctgagtgtgtgtgtgcctaa

SEQ ID NO: 224697 - DNA, 20 bp, Artificial Sequence
  chemically synthesized
cttttaggcacacacacact

SEQ ID NO: 224698 - DNA, 20 bp, Artificial Sequence
  chemically synthesized
taaggtaggcaagtgtgtct

SEQ ID NO: 224699 - DNA, 20 bp, Artificial Sequence
  chemically synthesized
cacaccttattaaggtaggc

SEQ ID NO: 224700 - DNA, 20 bp, Artificial Sequence
  chemically synthesized
tttgcacaccttattaaggt

SEQ ID NO: 224701 - DNA, 20 bp, Artificial Sequence
  chemically synthesized
acacacttgcctaccttaat

SEQ ID NO: 224702 - DNA, 20 bp, Artificial Sequence
  chemically synthesized
ttttgcacaccttattaagg

SEQ ID NO: 224703 - DNA, 20 bp, Artificial Sequence
  chemically synthesized
cacacttgcctaccttaata

SEQ ID NO: 224704 - DNA, 20 bp, Artificial Sequence
  chemically synthesized
ggtttttgcacaccttatta

SEQ ID NO: 224705 - DNA, 20 bp, Artificial Sequence
  chemically synthesized
aggtttttgcacaccttatt

SEQ ID NO: 224706 - DNA, 20 bp, Artificial Sequence
  chemically synthesized
aggtgtgcaaaaacctcttt

SEQ ID NO: 224707 - DNA, 20 bp, Artificial Sequence
  chemically synthesized
gcatccgtggggaccgaaag

SEQ ID NO: 224708 - DNA, 20 bp, Artificial Sequence
  chemically synthesized
agcatccgtggggaccgaaa

SEQ ID NO: 224709 - DNA, 20 bp, Artificial Sequence
  chemically synthesized
aaagcatccgtggggaccga

SEQ ID NO: 224710 - DNA, 20 bp, Artificial Sequence
  chemically synthesized
aaaacctctttcggtcccca

SEQ ID NO: 224711 - DNA, 20 bp, Artificial Sequence
  chemically synthesized
ctgaactaaaagcatccgtg

SEQ ID NO: 224712 - DNA, 20 bp, Artificial Sequence
  chemically synthesized
tctgaactaaaagcatccgt

SEQ ID NO: 224713 - DNA, 20 bp, Artificial Sequence
  chemically synthesized
ctctgaactaaaagcatccg

SEQ ID NO: 224714 - DNA, 20 bp, Artificial Sequence
  chemically synthesized
tcggtccccacggatgcttt

SEQ ID NO: 224715 - DNA, 20 bp, Artificial Sequence
  chemically synthesized
ccccacggatgcttttagtt

SEQ ID NO: 224716 - DNA, 20 bp, Artificial Sequence
  chemically synthesized
tgctggctgctctgaactaa

SEQ ID NO: 224717 - DNA, 20 bp, Artificial Sequence
  chemically synthesized
ccacggatgcttttagttca

SEQ ID NO: 224718 - DNA, 20 bp, Artificial Sequence
  chemically synthesized
cggatgcttttagttcagag

SEQ ID NO: 224719 - DNA, 20 bp, Artificial Sequence
  chemically synthesized
tgcttttagttcagagcagc

SEQ ID NO: 224720 - DNA, 20 bp, Artificial Sequence
  chemically synthesized
gctttgtgcggaggcattgc

SEQ ID NO: 224721 - DNA, 20 bp, Artificial Sequence
  chemically synthesized
gccagcaatgcctccgcaca

SEQ ID NO: 224722 - DNA, 20 bp, Artificial Sequence
  chemically synthesized
aatggcaaagctttgtgcgg

SEQ ID NO: 224723 - DNA, 20 bp, Artificial Sequence
  chemically synthesized
caatggcaaagctttgtgcg

SEQ ID NO: 224724 - DNA, 20 bp, Artificial Sequence
  chemically synthesized
agcaatggcaaagctttgtg

SEQ ID NO: 224725 - DNA, 20 bp, Artificial Sequence
  chemically synthesized
tcttcacactagcaatggca

SEQ ID NO: 224726 - DNA, 20 bp, Artificial Sequence
  chemically synthesized
gcacaaagctttgccattgc

SEQ ID NO: 224727 - DNA, 20 bp, Artificial Sequence
  chemically synthesized
ctttctcttcacactagcaa

SEQ ID NO: 224728 - DNA, 20 bp, Artificial Sequence
  chemically synthesized
gctttgccattgctagtgtg

SEQ ID NO: 224729 - DNA, 20 bp, Artificial Sequence
  chemically synthesized
tttgccattgctagtgtgaa

SEQ ID NO: 224730 - DNA, 20 bp, Artificial Sequence
  chemically synthesized
gcagctctttctcttcacac

SEQ ID NO: 224731 - DNA, 20 bp, Artificial Sequence
  chemically synthesized
ccattgctagtgtgaagaga

SEQ ID NO: 224732 - DNA, 20 bp, Artificial Sequence
  chemically synthesized
attgctagtgtgaagagaaa

SEQ ID NO: 224733 - DNA, 20 bp, Artificial Sequence
  chemically synthesized
gtgtgaagagaaagagctgc

SEQ ID NO: 224734 - DNA, 20 bp, Artificial Sequence
  chemically synthesized
tgtgaagagaaagagctgct

SEQ ID NO: 224735 - DNA, 20 bp, Artificial Sequence
  chemically synthesized
tgtgccattcagcatcccag

SEQ ID NO: 224736 - DNA, 20 bp, Artificial Sequence
  chemically synthesized
tgatgtgccattcagcatcc

SEQ ID NO: 224737 - DNA, 20 bp, Artificial Sequence
  chemically synthesized
agagctgctgggatgctgaa

SEQ ID NO: 224738 - DNA, 20 bp, Artificial Sequence
  chemically synthesized
aagttggctgatgtgccatt

SEQ ID NO: 224739 - DNA, 20 bp, Artificial Sequence
  chemically synthesized
tgggatgctgaatggcacat

SEQ ID NO: 224740 - DNA, 20 bp, Artificial Sequence
  chemically synthesized
gcctttgctacacacaaagt

SEQ ID NO: 224741 - DNA, 20 bp, Artificial Sequence
  chemically synthesized
acatcagccaactttgtgtg

SEQ ID NO: 224742 - DNA, 20 bp, Artificial Sequence
  chemically synthesized
tagagcctttgctacacaca

SEQ ID NO: 224743 - DNA, 20 bp, Artificial Sequence
  chemically synthesized
agccaactttgtgtgtagca

SEQ ID NO: 224744 - DNA, 20 bp, Artificial Sequence
  chemically synthesized
gccaactttgtgtgtagcaa

SEQ ID NO: 224745 - DNA, 20 bp, Artificial Sequence
  chemically synthesized
tgtgtgtagcaaaggctcta

SEQ ID NO: 224746 - DNA, 20 bp, Artificial Sequence
  chemically synthesized
ttcagcccaggatttcttta

SEQ ID NO: 224747 - DNA, 20 bp, Artificial Sequence
  chemically synthesized
gtttcagcccaggatttctt

SEQ ID NO: 224748 - DNA, 20 bp, Artificial Sequence
  chemically synthesized
caaaggctctaaagaaatcc

SEQ ID NO: 224749 - DNA, 20 bp, Artificial Sequence
  chemically synthesized
aaaggctctaaagaaatcct

SEQ ID NO: 224750 - DNA, 20 bp, Artificial Sequence
  chemically synthesized
atccagcagagtttcagccc

SEQ ID NO: 224751 - DNA, 20 bp, Artificial Sequence
  chemically synthesized
gatccagcagagtttcagcc

SEQ ID NO: 224752 - DNA, 20 bp, Artificial Sequence
  chemically synthesized
tccatgatccagcagagttt

SEQ ID NO: 224753 - DNA, 20 bp, Artificial Sequence
  chemically synthesized
atcctgggctgaaactctgc

SEQ ID NO: 224754 - DNA, 20 bp, Artificial Sequence
  chemically synthesized
gtccaatccatgatccagca

SEQ ID NO: 224755 - DNA, 20 bp, Artificial Sequence
  chemically synthesized
gagtccaatccatgatccag

SEQ ID NO: 224756 - DNA, 20 bp, Artificial Sequence
  chemically synthesized
gctgaaactctgctggatca

SEQ ID NO: 224757 - DNA, 20 bp, Artificial Sequence
  chemically synthesized
attgagtccaatccatgatc

SEQ ID NO: 224758 - DNA, 20 bp, Artificial Sequence
  chemically synthesized
aactctgctggatcatggat

SEQ ID NO: 224759 - DNA, 20 bp, Artificial Sequence
  chemically synthesized
actgtgtgtggagtgaaatt

SEQ ID NO: 224760 - DNA, 20 bp, Artificial Sequence
  chemically synthesized
actcaatttcactccacaca

SEQ ID NO: 224761 - DNA, 20 bp, Artificial Sequence
  chemically synthesized
ggtaatgcagactgtgtgtg

SEQ ID NO: 224762 - DNA, 20 bp, Artificial Sequence
  chemically synthesized
caggtaatgcagactgtgtg

SEQ ID NO: 224763 - DNA, 20 bp, Artificial Sequence
  chemically synthesized
ataatctccatcaggtaatg

SEQ ID NO: 224764 - DNA, 20 bp, Artificial Sequence
  chemically synthesized
acacagtctgcattacctga

SEQ ID NO: 224765 - DNA, 20 bp, Artificial Sequence
  chemically synthesized
acagtctgcattacctgatg

SEQ ID NO: 224766 - DNA, 20 bp, Artificial Sequence
  chemically synthesized
ttccagaaataatctccatc

SEQ ID NO: 224767 - DNA, 20 bp, Artificial Sequence
  chemically synthesized
cttccagaaataatctccat

SEQ ID NO: 224768 - DNA, 20 bp, Artificial Sequence
  chemically synthesized
tacctgatggagattatttc

SEQ ID NO: 224769 - DNA, 20 bp, Artificial Sequence
  chemically synthesized
ctgatggagattatttctgg

SEQ ID NO: 224770 - DNA, 20 bp, Artificial Sequence
  chemically synthesized
aaacatgccctaagtgcttc

SEQ ID NO: 224771 - DNA, 20 bp, Artificial Sequence
  chemically synthesized
agattatttctggaagcact

SEQ ID NO: 224772 - DNA, 20 bp, Artificial Sequence
  chemically synthesized
gattatttctggaagcactt

SEQ ID NO: 224773 - DNA, 20 bp, Artificial Sequence
  chemically synthesized
attatttctggaagcactta

SEQ ID NO: 224774 - DNA, 20 bp, Artificial Sequence
  chemically synthesized
tttgtagacaaacatgccct

SEQ ID NO: 224775 - DNA, 20 bp, Artificial Sequence
  chemically synthesized
agggcatgtttgtctacaaa

SEQ ID NO: 224776 - DNA, 20 bp, Artificial Sequence
  chemically synthesized
aaaaaggccctatctttttg

SEQ ID NO: 224777 - DNA, 20 bp, Artificial Sequence
  chemically synthesized
catgtttgtctacaaaaaga

SEQ ID NO: 224778 - DNA, 20 bp, Artificial Sequence
  chemically synthesized
atgtttgtctacaaaaagat

SEQ ID NO: 224779 - DNA, 20 bp, Artificial Sequence
  chemically synthesized
tgtttgtctacaaaaagata

SEQ ID NO: 224780 - DNA, 20 bp, Artificial Sequence
  chemically synthesized
aaattgttaaggaaagaaaa

SEQ ID NO: 224781 - DNA, 20 bp, Artificial Sequence
  chemically synthesized
taaattgttaaggaaagaaa

SEQ ID NO: 224782 - DNA, 20 bp, Artificial Sequence
  chemically synthesized
attttttaaattgttaagga

SEQ ID NO: 224783 - DNA, 20 bp, Artificial Sequence
  chemically synthesized
ccgtattttttaaattgtta

SEQ ID NO: 224784 - DNA, 20 bp, Artificial Sequence
  chemically synthesized
accgtattttttaaattgtt

SEQ ID NO: 224785 - DNA, 20 bp, Artificial Sequence
  chemically synthesized
ccttaacaatttaaaaaata

SEQ ID NO: 224786 - DNA, 20 bp, Artificial Sequence
  chemically synthesized
taaaaaatacggtaacaaac

SEQ ID NO: 224787 - DNA, 20 bp, Artificial Sequence
  chemically synthesized
aaaaatacggtaacaaacca

SEQ ID NO: 224788 - DNA, 20 bp, Artificial Sequence
  chemically synthesized
tccttaaagtatcaggtctc

SEQ ID NO: 224789 - DNA, 20 bp, Artificial Sequence
  chemically synthesized
atgatcttccttaaagtatc

SEQ ID NO: 224790 - DNA, 20 bp, Artificial Sequence
  chemically synthesized
aaccagagacctgatacttt

SEQ ID NO: 224791 - DNA, 20 bp, Artificial Sequence
  chemically synthesized
aatgatcttccttaaagtat

SEQ ID NO: 224792 - DNA, 20 bp, Artificial Sequence
  chemically synthesized
accagagacctgatacttta

SEQ ID NO: 224793 - DNA, 20 bp, Artificial Sequence
  chemically synthesized
agagacctgatactttaagg

SEQ ID NO: 224794 - DNA, 20 bp, Artificial Sequence
  chemically synthesized
acaataaatgatcttcctta

SEQ ID NO: 224795 - DNA, 20 bp, Artificial Sequence
  chemically synthesized
taaggaagatcatttattgt

SEQ ID NO: 224796 - DNA, 20 bp, Artificial Sequence
  chemically synthesized
tcatttattgtgagctccat

SEQ ID NO: 224797 - DNA, 20 bp, Artificial Sequence
  chemically synthesized
catttattgtgagctccatg

SEQ ID NO: 224798 - DNA, 20 bp, Artificial Sequence
  chemically synthesized
atttattgtgagctccatga

SEQ ID NO: 224799 - DNA, 20 bp, Artificial Sequence
  chemically synthesized
agaccattgaggccctcatg

SEQ ID NO: 224800 - DNA, 20 bp, Artificial Sequence
  chemically synthesized
acagaccattgaggccctca

SEQ ID NO: 224801 - DNA, 20 bp, Artificial Sequence
  chemically synthesized
gagctccatgagggcctcaa

SEQ ID NO: 224802 - DNA, 20 bp, Artificial Sequence
  chemically synthesized
aatttcgaaacagaccattg

SEQ ID NO: 224803 - DNA, 20 bp, Artificial Sequence
  chemically synthesized
caatttcgaaacagaccatt

SEQ ID NO: 224804 - DNA, 20 bp, Artificial Sequence
  chemically synthesized
ctggggctgcaatttcgaaa

SEQ ID NO: 224805 - DNA, 20 bp, Artificial Sequence
  chemically synthesized
aatggtctgtttcgaaattg

SEQ ID NO: 224806 - DNA, 20 bp, Artificial Sequence
  chemically synthesized
ctgtttcgaaattgcagccc

SEQ ID NO: 224807 - DNA, 20 bp, Artificial Sequence
  chemically synthesized
gaaattgcagccccagcatc

SEQ ID NO: 224808 - DNA, 20 bp, Artificial Sequence
  chemically synthesized
tgactgtgttctagatgctg

SEQ ID NO: 224809 - DNA, 20 bp, Artificial Sequence
  chemically synthesized
ctgactgtgttctagatgct

SEQ ID NO: 224810 - DNA, 20 bp, Artificial Sequence
  chemically synthesized
gctgactgtgttctagatgc

SEQ ID NO: 224811 - DNA, 20 bp, Artificial Sequence
  chemically synthesized
cagccccagcatctagaaca

SEQ ID NO: 224812 - DNA, 20 bp, Artificial Sequence
  chemically synthesized
atcaagtgctgactgtgttc

SEQ ID NO: 224813 - DNA, 20 bp, Artificial Sequence
  chemically synthesized
cccagcatctagaacacagt

SEQ ID NO: 224814 - DNA, 20 bp, Artificial Sequence
  chemically synthesized
tatttagccaaatatttatc

SEQ ID NO: 224815 - DNA, 20 bp, Artificial Sequence
  chemically synthesized
gtcagcacttgataaatatt

SEQ ID NO: 224816 - DNA, 20 bp, Artificial Sequence
  chemically synthesized
tcaattgagcatttaatatt

SEQ ID NO: 224817 - DNA, 20 bp, Artificial Sequence
  chemically synthesized
atttgaacctgatatcaatt

SEQ ID NO: 224818 - DNA, 20 bp, Artificial Sequence
  chemically synthesized
attaaatgctcaattgatat

SEQ ID NO: 224819 - DNA, 20 bp, Artificial Sequence
  chemically synthesized
ttaaatgctcaattgatatc

SEQ ID NO: 224820 - DNA, 20 bp, Artificial Sequence
  chemically synthesized
aattgatatcaggttcaaat

SEQ ID NO: 224821 - DNA, 20 bp, Artificial Sequence
  chemically synthesized
attacagtgtgtaaataatt

SEQ ID NO: 224822 - DNA, 20 bp, Artificial Sequence
  chemically synthesized
ttatttacacactgtaatga

SEQ ID NO: 224823 - DNA, 20 bp, Artificial Sequence
  chemically synthesized
tgcattttttactttcatta

SEQ ID NO: 224824 - DNA, 20 bp, Artificial Sequence
  chemically synthesized
gtaatgaaagtaaaaaatgc

SEQ ID NO: 224825 - DNA, 20 bp, Artificial Sequence
  chemically synthesized
taatgaaagtaaaaaatgca

SEQ ID NO: 224826 - DNA, 20 bp, Artificial Sequence
  chemically synthesized
aaaatgcaaggtttgctgaa

SEQ ID NO: 224827 - DNA, 20 bp, Artificial Sequence
  chemically synthesized
attaaccctctggagctgtt

SEQ ID NO: 224828 - DNA, 20 bp, Artificial Sequence
  chemically synthesized
caaggtttgctgaacagctc

SEQ ID NO: 224829 - DNA, 20 bp, Artificial Sequence
  chemically synthesized
aggtttgctgaacagctcca

SEQ ID NO: 224830 - DNA, 20 bp, Artificial Sequence
  chemically synthesized
ggtttgctgaacagctccag

SEQ ID NO: 224831 - DNA, 20 bp, Artificial Sequence
  chemically synthesized
gtttgctgaacagctccaga

SEQ ID NO: 224832 - DNA, 20 bp, Artificial Sequence
  chemically synthesized
acactcttattaaccctctg

SEQ ID NO: 224833 - DNA, 20 bp, Artificial Sequence
  chemically synthesized
acacactcttattaaccctc

SEQ ID NO: 224834 - DNA, 20 bp, Artificial Sequence
  chemically synthesized
aacagctccagagggttaat

SEQ ID NO: 224835 - DNA, 20 bp, Artificial Sequence
  chemically synthesized
cagctccagagggttaataa

SEQ ID NO: 224836 - DNA, 20 bp, Artificial Sequence
  chemically synthesized
tgtgtgtgttgaatgacaaa

SEQ ID NO: 224837 - DNA, 20 bp, Artificial Sequence
  chemically synthesized
gtgtgtgtgttgaatgacaa

SEQ ID NO: 224838 - DNA, 20 bp, Artificial Sequence
  chemically synthesized
cacacacacacacacctgta

SEQ ID NO: 224839 - DNA, 20 bp, Artificial Sequence
  chemically synthesized
atatttatcatcagctatac

SEQ ID NO: 224840 - DNA, 20 bp, Artificial Sequence
  chemically synthesized
tatatttatcatcagctata

SEQ ID NO: 224841 - DNA, 20 bp, Artificial Sequence
  chemically synthesized
atataatgtatatttatcat

SEQ ID NO: 224842 - DNA, 20 bp, Artificial Sequence
  chemically synthesized
taaatatacattatatcaat

SEQ ID NO: 224843 - DNA, 20 bp, Artificial Sequence
  chemically synthesized
tatatcaatgagttaaaata

SEQ ID NO: 224844 - DNA, 20 bp, Artificial Sequence
  chemically synthesized
cccattgctcagtgaatgaa

SEQ ID NO: 224845 - DNA, 20 bp, Artificial Sequence
  chemically synthesized
aagtgtgctattcattcact

SEQ ID NO: 224846 - DNA, 20 bp, Artificial Sequence
  chemically synthesized
gctattcattcactgagcaa

SEQ ID NO: 224847 - DNA, 20 bp, Artificial Sequence
  chemically synthesized
ctattcattcactgagcaat

SEQ ID NO: 224848 - DNA, 20 bp, Artificial Sequence
  chemically synthesized
tattcattcactgagcaatg

SEQ ID NO: 224849 - DNA, 20 bp, Artificial Sequence
  chemically synthesized
caggcaatagccccattgct

SEQ ID NO: 224850 - DNA, 20 bp, Artificial Sequence
  chemically synthesized
tgagcaatggggctattgcc

SEQ ID NO: 224851 - DNA, 20 bp, Artificial Sequence
  chemically synthesized
gagcaatggggctattgcct

SEQ ID NO: 224852 - DNA, 20 bp, Artificial Sequence
  chemically synthesized
gagccaccgtgcccaggcaa

SEQ ID NO: 224853 - DNA, 20 bp, Artificial Sequence
  chemically synthesized
atggggctattgcctgggca

SEQ ID NO: 224854 - DNA, 20 bp, Artificial Sequence
  chemically synthesized
aggcgtgagccaccgtgccc

SEQ ID NO: 224855 - DNA, 20 bp, Artificial Sequence
  chemically synthesized
gggctattgcctgggcacgg

SEQ ID NO: 224856 - DNA, 20 bp, Artificial Sequence
  chemically synthesized
caggcgtgagccaccgtgcc

SEQ ID NO: 224857 - DNA, 20 bp, Artificial Sequence
  chemically synthesized
agtgctgggtttacaggcgt

SEQ ID NO: 224858 - DNA, 20 bp, Artificial Sequence
  chemically synthesized
gtggctcacgcctgtaaacc

SEQ ID NO: 224859 - DNA, 20 bp, Artificial Sequence
  chemically synthesized
tcccaaagtgctgggtttac

SEQ ID NO: 224860 - DNA, 20 bp, Artificial Sequence
  chemically synthesized
ctcccaaagtgctgggttta

SEQ ID NO: 224861 - DNA, 20 bp, Artificial Sequence
  chemically synthesized
cgcctgtaaacccagcactt

SEQ ID NO: 224862 - DNA, 20 bp, Artificial Sequence
  chemically synthesized
cctcagcctcccaaagtgct

SEQ ID NO: 224863 - DNA, 20 bp, Artificial Sequence
  chemically synthesized
gcctgtaaacccagcacttt

SEQ ID NO: 224864 - DNA, 20 bp, Artificial Sequence
  chemically synthesized
gcctcagcctcccaaagtgc

SEQ ID NO: 224865 - DNA, 20 bp, Artificial Sequence
  chemically synthesized
ctgtaaacccagcactttgg

SEQ ID NO: 224866 - DNA, 20 bp, Artificial Sequence
  chemically synthesized
tgtaaacccagcactttggg

SEQ ID NO: 224867 - DNA, 20 bp, Artificial Sequence
  chemically synthesized
ccatctgcctcagcctccca

SEQ ID NO: 224868 - DNA, 20 bp, Artificial Sequence
  chemically synthesized
acccagcactttgggaggct

SEQ ID NO: 224869 - DNA, 20 bp, Artificial Sequence
  chemically synthesized
cccagcactttgggaggctg

SEQ ID NO: 224870 - DNA, 20 bp, Artificial Sequence
  chemically synthesized
agcactttgggaggctgagg

SEQ ID NO: 224871 - DNA, 20 bp, Artificial Sequence
  chemically synthesized
ctttgggaggctgaggcaga

SEQ ID NO: 224872 - DNA, 20 bp, Artificial Sequence
  chemically synthesized
accttgtgatccatctgcct

SEQ ID NO: 224873 - DNA, 20 bp, Artificial Sequence
  chemically synthesized
ggctgaggcagatggatcac

SEQ ID NO: 224874 - DNA, 20 bp, Artificial Sequence
  chemically synthesized
gctgaggcagatggatcaca

SEQ ID NO: 224875 - DNA, 20 bp, Artificial Sequence
  chemically synthesized
ggcagatggatcacaaggtc

SEQ ID NO: 224876 - DNA, 20 bp, Artificial Sequence
  chemically synthesized
cagatggatcacaaggtcaa

SEQ ID NO: 224877 - DNA, 20 bp, Artificial Sequence
  chemically synthesized
gatcacaaggtcaagagatc

SEQ ID NO: 224878 - DNA, 20 bp, Artificial Sequence
  chemically synthesized
tcaagagatcgagactgtcc

SEQ ID NO: 224879 - DNA, 20 bp, Artificial Sequence
  chemically synthesized
tttcaccatgttggccagga

SEQ ID NO: 224880 - DNA, 20 bp, Artificial Sequence
  chemically synthesized
gggttttcaccatgttggcc

SEQ ID NO: 224881 - DNA, 20 bp, Artificial Sequence
  chemically synthesized
cgagactgtcctggccaaca

SEQ ID NO: 224882 - DNA, 20 bp, Artificial Sequence
  chemically synthesized
cgggttttcaccatgttggc

SEQ ID NO: 224883 - DNA, 20 bp, Artificial Sequence
  chemically synthesized
gagacgggttttcaccatgt

SEQ ID NO: 224884 - DNA, 20 bp, Artificial Sequence
  chemically synthesized
tttgtatttttagtagagac

SEQ ID NO: 224885 - DNA, 20 bp, Artificial Sequence
  chemically synthesized
ttttgtatttttagtagaga

SEQ ID NO: 224886 - DNA, 20 bp, Artificial Sequence
  chemically synthesized
taatttttgtatttttagta

SEQ ID NO: 224887 - DNA, 20 bp, Artificial Sequence
  chemically synthesized
tctaatttttgtatttttag

SEQ ID NO: 224888 - DNA, 20 bp, Artificial Sequence
  chemically synthesized
ccatctaatttttgtatttt

SEQ ID NO: 224889 - DNA, 20 bp, Artificial Sequence
  chemically synthesized
tctactaaaaatacaaaaat

SEQ ID NO: 224890 - DNA, 20 bp, Artificial Sequence
  chemically synthesized
ctaaaaatacaaaaattaga

SEQ ID NO: 224891 - DNA, 20 bp, Artificial Sequence
  chemically synthesized
taaaaatacaaaaattagat

SEQ ID NO: 224892 - DNA, 20 bp, Artificial Sequence
  chemically synthesized
atacaaaaattagatgggca

SEQ ID NO: 224893 - DNA, 20 bp, Artificial Sequence
  chemically synthesized
gtgacgcacacctgtaatct

SEQ ID NO: 224894 - DNA, 20 bp, Artificial Sequence
  chemically synthesized
tcccgagtagctgagattac

SEQ ID NO: 224895 - DNA, 20 bp, Artificial Sequence
  chemically synthesized
ctcccgagtagctgagatta

SEQ ID NO: 224896 - DNA, 20 bp, Artificial Sequence
  chemically synthesized
cacctgtaatctcagctact

SEQ ID NO: 224897 - DNA, 20 bp, Artificial Sequence
  chemically synthesized
cctcagcctcccgagtagct

SEQ ID NO: 224898 - DNA, 20 bp, Artificial Sequence
  chemically synthesized
acctgtaatctcagctactc

SEQ ID NO: 224899 - DNA, 20 bp, Artificial Sequence
  chemically synthesized
ctgtaatctcagctactcgg

SEQ ID NO: 224900 - DNA, 20 bp, Artificial Sequence
  chemically synthesized
tgtaatctcagctactcggg

SEQ ID NO: 224901 - DNA, 20 bp, Artificial Sequence
  chemically synthesized
tcctacctcagcctcccgag

SEQ ID NO: 224902 - DNA, 20 bp, Artificial Sequence
  chemically synthesized
ttctcctacctcagcctccc

SEQ ID NO: 224903 - DNA, 20 bp, Artificial Sequence
  chemically synthesized
tctcagctactcgggaggct

SEQ ID NO: 224904 - DNA, 20 bp, Artificial Sequence
  chemically synthesized
ctcagctactcgggaggctg

SEQ ID NO: 224905 - DNA, 20 bp, Artificial Sequence
  chemically synthesized
agctactcgggaggctgagg

SEQ ID NO: 224906 - DNA, 20 bp, Artificial Sequence
  chemically synthesized
gctactcgggaggctgaggt

SEQ ID NO: 224907 - DNA, 20 bp, Artificial Sequence
  chemically synthesized
tactcgggaggctgaggtag

SEQ ID NO: 224908 - DNA, 20 bp, Artificial Sequence
  chemically synthesized
ttcaaaagattctcctacct

SEQ ID NO: 224909 - DNA, 20 bp, Artificial Sequence
  chemically synthesized
gtaggagaatcttttgaacc

SEQ ID NO: 224910 - DNA, 20 bp, Artificial Sequence
  chemically synthesized
ccactgcctcccgggttcaa

SEQ ID NO: 224911 - DNA, 20 bp, Artificial Sequence
  chemically synthesized
taggagaatcttttgaaccc

SEQ ID NO: 224912 - DNA, 20 bp, Artificial Sequence
  chemically synthesized
ggagaatcttttgaacccgg

SEQ ID NO: 224913 - DNA, 20 bp, Artificial Sequence
  chemically synthesized
gagaatcttttgaacccggg

SEQ ID NO: 224914 - DNA, 20 bp, Artificial Sequence
  chemically synthesized
aatcttttgaacccgggagg

SEQ ID NO: 224915 - DNA, 20 bp, Artificial Sequence
  chemically synthesized
cactgcaaccactgcctccc

SEQ ID NO: 224916 - DNA, 20 bp, Artificial Sequence
  chemically synthesized
tcactgcaaccactgcctcc

SEQ ID NO: 224917 - DNA, 20 bp, Artificial Sequence
  chemically synthesized
cttttgaacccgggaggcag

SEQ ID NO: 224918 - DNA, 20 bp, Artificial Sequence
  chemically synthesized
aacccgggaggcagtggttg

SEQ ID NO: 224919 - DNA, 20 bp, Artificial Sequence
  chemically synthesized
cgggaggcagtggttgcagt

SEQ ID NO: 224920 - DNA, 20 bp, Artificial Sequence
  chemically synthesized
ggcagtggttgcagtgagcc

SEQ ID NO: 224921 - DNA, 20 bp, Artificial Sequence
  chemically synthesized
ggagtgcagtggtgcaatct

SEQ ID NO: 224922 - DNA, 20 bp, Artificial Sequence
  chemically synthesized
gtcgccaggctggagtgcag

SEQ ID NO: 224923 - DNA, 20 bp, Artificial Sequence
  chemically synthesized
gagattgcaccactgcactc

SEQ ID NO: 224924 - DNA, 20 bp, Artificial Sequence
  chemically synthesized
tctgtcgccaggctggagtg

SEQ ID NO: 224925 - DNA, 20 bp, Artificial Sequence
  chemically synthesized
tgcaccactgcactccagcc

SEQ ID NO: 224926 - DNA, 20 bp, Artificial Sequence
  chemically synthesized
ctcgctctgtcgccaggctg

SEQ ID NO: 224927 - DNA, 20 bp, Artificial Sequence
  chemically synthesized
gtctcgctctgtcgccaggc

SEQ ID NO: 224928 - DNA, 20 bp, Artificial Sequence
  chemically synthesized
actgcactccagcctggcga

SEQ ID NO: 224929 - DNA, 20 bp, Artificial Sequence
  chemically synthesized
tgcactccagcctggcgaca

SEQ ID NO: 224930 - DNA, 20 bp, Artificial Sequence
  chemically synthesized
cgaagtctcgctctgtcgcc

SEQ ID NO: 224931 - DNA, 20 bp, Artificial Sequence
  chemically synthesized
acgaagtctcgctctgtcgc

SEQ ID NO: 224932 - DNA, 20 bp, Artificial Sequence
  chemically synthesized
ctccagcctggcgacagagc

SEQ ID NO: 224933 - DNA, 20 bp, Artificial Sequence
  chemically synthesized
ttatttatttttttgagacg

SEQ ID NO: 224934 - DNA, 20 bp, Artificial Sequence
  chemically synthesized
acaaatttatttattttttt

SEQ ID NO: 224935 - DNA, 20 bp, Artificial Sequence
  chemically synthesized
aataaataaatttgtaaaaa

SEQ ID NO: 224936 - DNA, 20 bp, Artificial Sequence
  chemically synthesized
aaatttgtaaaaaaagattt

SEQ ID NO: 224937 - DNA, 20 bp, Artificial Sequence
  chemically synthesized
ttctaagtattgttatcagt

SEQ ID NO: 224938 - DNA, 20 bp, Artificial Sequence
  chemically synthesized
tttctaagtattgttatcag

SEQ ID NO: 224939 - DNA, 20 bp, Artificial Sequence
  chemically synthesized
aactttctaagtattgttat

SEQ ID NO: 224940 - DNA, 20 bp, Artificial Sequence
  chemically synthesized
aacccactgataacaatact

SEQ ID NO: 224941 - DNA, 20 bp, Artificial Sequence
  chemically synthesized
cactgataacaatacttaga

SEQ ID NO: 224942 - DNA, 20 bp, Artificial Sequence
  chemically synthesized
cggttttcaacaaactttct

SEQ ID NO: 224943 - DNA, 20 bp, Artificial Sequence
  chemically synthesized
caataagcaaataatacata

SEQ ID NO: 224944 - DNA, 20 bp, Artificial Sequence
  chemically synthesized
ttagaaattgtcagggcaat

SEQ ID NO: 224945 - DNA, 20 bp, Artificial Sequence
  chemically synthesized
tatgatattagaaattgtca

SEQ ID NO: 224946 - DNA, 20 bp, Artificial Sequence
  chemically synthesized
ttatgatattagaaattgtc

SEQ ID NO: 224947 - DNA, 20 bp, Artificial Sequence
  chemically synthesized
attatgatattagaaattgt

SEQ ID NO: 224948 - DNA, 20 bp, Artificial Sequence
  chemically synthesized
ataatgaactattatgatat

SEQ ID NO: 224949 - DNA, 20 bp, Artificial Sequence
  chemically synthesized
gacaatttctaatatcataa

SEQ ID NO: 224950 - DNA, 20 bp, Artificial Sequence
  chemically synthesized
atcataatagttcattataa

SEQ ID NO: 224951 - DNA, 20 bp, Artificial Sequence
  chemically synthesized
cattataatagcccattcct

SEQ ID NO: 224952 - DNA, 20 bp, Artificial Sequence
  chemically synthesized
ctattcattcactgaggaat

SEQ ID NO: 224953 - DNA, 20 bp, Artificial Sequence
  chemically synthesized
gctattcattcactgaggaa

SEQ ID NO: 224954 - DNA, 20 bp, Artificial Sequence
  chemically synthesized
agtgtgctattcattcactg

SEQ ID NO: 224955 - DNA, 20 bp, Artificial Sequence
  chemically synthesized
aagtgtgctattcattcact

SEQ ID NO: 224956 - DNA, 20 bp, Artificial Sequence
  chemically synthesized
cccattcctcagtgaatgaa

SEQ ID NO: 224957 - DNA, 20 bp, Artificial Sequence
  chemically synthesized
tgtatcaatgagttcaaatg

SEQ ID NO: 224958 - DNA, 20 bp, Artificial Sequence
  chemically synthesized
taaatatacattgtatcaat

SEQ ID NO: 224959 - DNA, 20 bp, Artificial Sequence
  chemically synthesized
atacaatgtatatttatcat

SEQ ID NO: 224960 - DNA, 20 bp, Artificial Sequence
  chemically synthesized
tatatttatcatcagctgta

SEQ ID NO: 224961 - DNA, 20 bp, Artificial Sequence
  chemically synthesized
atatttatcatcagctgtac

SEQ ID NO: 224962 - DNA, 20 bp, Artificial Sequence
  chemically synthesized
cgtatacacacacacctgta

SEQ ID NO: 224963 - DNA, 20 bp, Artificial Sequence
  chemically synthesized
tgtatccttttgtcattcaa

SEQ ID NO: 224964 - DNA, 20 bp, Artificial Sequence
  chemically synthesized
cgtatacttttgaatgacaa

SEQ ID NO: 224965 - DNA, 20 bp, Artificial Sequence
  chemically synthesized
gtatacttttgaatgacaaa

SEQ ID NO: 224966 - DNA, 20 bp, Artificial Sequence
  chemically synthesized
gcacgcaattattaaccttc

SEQ ID NO: 224967 - DNA, 20 bp, Artificial Sequence
  chemically synthesized
acgcaattattaaccttctg

SEQ ID NO: 224968 - DNA, 20 bp, Artificial Sequence
  chemically synthesized
gcttggtgaacagctccaga

SEQ ID NO: 224969 - DNA, 20 bp, Artificial Sequence
  chemically synthesized
ggcttggtgaacagctccag

SEQ ID NO: 224970 - DNA, 20 bp, Artificial Sequence
  chemically synthesized
caaggcttggtgaacagctc

SEQ ID NO: 224971 - DNA, 20 bp, Artificial Sequence
  chemically synthesized
accttctggagctgttcacc

SEQ ID NO: 224972 - DNA, 20 bp, Artificial Sequence
  chemically synthesized
ttaatgcaaggcttggtgaa

SEQ ID NO: 224973 - DNA, 20 bp, Artificial Sequence
  chemically synthesized
tccaggtttaatgcaaggct

SEQ ID NO: 224974 - DNA, 20 bp, Artificial Sequence
  chemically synthesized
ttcaatccaggtttaatgca

SEQ ID NO: 224975 - DNA, 20 bp, Artificial Sequence
  chemically synthesized
attcaatccaggtttaatgc

SEQ ID NO: 224976 - DNA, 20 bp, Artificial Sequence
  chemically synthesized
accaagccttgcattaaacc

SEQ ID NO: 224977 - DNA, 20 bp, Artificial Sequence
  chemically synthesized
gggagtcttttattcaatcc

SEQ ID NO: 224978 - DNA, 20 bp, Artificial Sequence
  chemically synthesized
tgggagtcttttattcaatc

SEQ ID NO: 224979 - DNA, 20 bp, Artificial Sequence
  chemically synthesized
attaaacctggattgaataa

SEQ ID NO: 224980 - DNA, 20 bp, Artificial Sequence
  chemically synthesized
aaaatttccttgaggaatgg

SEQ ID NO: 224981 - DNA, 20 bp, Artificial Sequence
  chemically synthesized
ataaaagactcccattcctc

SEQ ID NO: 224982 - DNA, 20 bp, Artificial Sequence
  chemically synthesized
gtaaaatttccttgaggaat

SEQ ID NO: 224983 - DNA, 20 bp, Artificial Sequence
  chemically synthesized
taaaagactcccattcctca

SEQ ID NO: 224984 - DNA, 20 bp, Artificial Sequence
  chemically synthesized
agtaaaatttccttgaggaa

SEQ ID NO: 224985 - DNA, 20 bp, Artificial Sequence
  chemically synthesized
gaagaagtaaaatttccttg

SEQ ID NO: 224986 - DNA, 20 bp, Artificial Sequence
  chemically synthesized
agaagaagtaaaatttcctt

SEQ ID NO: 224987 - DNA, 20 bp, Artificial Sequence
  chemically synthesized
ggaaattttacttcttctat

SEQ ID NO: 224988 - DNA, 20 bp, Artificial Sequence
  chemically synthesized
ctgagaagtcctcatagaag

SEQ ID NO: 224989 - DNA, 20 bp, Artificial Sequence
  chemically synthesized
gaaattttacttcttctatg

SEQ ID NO: 224990 - DNA, 20 bp, Artificial Sequence
  chemically synthesized
ttactgagaagtcctcatag

SEQ ID NO: 224991 - DNA, 20 bp, Artificial Sequence
  chemically synthesized
gggttactgagaagtcctca

SEQ ID NO: 224992 - DNA, 20 bp, Artificial Sequence
  chemically synthesized
cttcttctatgaggacttct

SEQ ID NO: 224993 - DNA, 20 bp, Artificial Sequence
  chemically synthesized
gtgaatttagggttactgag

SEQ ID NO: 224994 - DNA, 20 bp, Artificial Sequence
  chemically synthesized
cctgtgaatttagggttact

SEQ ID NO: 224995 - DNA, 20 bp, Artificial Sequence
  chemically synthesized
agaatatgcctgtgaattta

SEQ ID NO: 224996 - DNA, 20 bp, Artificial Sequence
  chemically synthesized
tctcagtaaccctaaattca

SEQ ID NO: 224997 - DNA, 20 bp, Artificial Sequence
  chemically synthesized
aagaatatgcctgtgaattt

SEQ ID NO: 224998 - DNA, 20 bp, Artificial Sequence
  chemically synthesized
ctcagtaaccctaaattcac

SEQ ID NO: 224999 - DNA, 20 bp, Artificial Sequence
  chemically synthesized
aaagaatatgcctgtgaatt

SEQ ID NO: 225000 - DNA, 20 bp, Artificial Sequence
  chemically synthesized
ctttgggacagtaacatgta

SEQ ID NO: 225001 - DNA, 20 bp, Artificial Sequence
  chemically synthesized
ctttacatgttactgtccca

SEQ ID NO: 225002 - DNA, 20 bp, Artificial Sequence
  chemically synthesized
gcttgcattttgctttggga

SEQ ID NO: 225003 - DNA, 20 bp, Artificial Sequence
  chemically synthesized
gccagcttgcattttgcttt

SEQ ID NO: 225004 - DNA, 20 bp, Artificial Sequence
  chemically synthesized
tgccagcttgcattttgctt

SEQ ID NO: 225005 - DNA, 20 bp, Artificial Sequence
  chemically synthesized
actgtcccaaagcaaaatgc

SEQ ID NO: 225006 - DNA, 20 bp, Artificial Sequence
  chemically synthesized
tcccaaagcaaaatgcaagc

SEQ ID NO: 225007 - DNA, 20 bp, Artificial Sequence
  chemically synthesized
aagcaaaatgcaagctggca

SEQ ID NO: 225008 - DNA, 20 bp, Artificial Sequence
  chemically synthesized
ctctgggcttggttccatgc

SEQ ID NO: 225009 - DNA, 20 bp, Artificial Sequence
  chemically synthesized
atgcaagctggcatggaacc

SEQ ID NO: 225010 - DNA, 20 bp, Artificial Sequence
  chemically synthesized
agctggcatggaaccaagcc

SEQ ID NO: 225011 - DNA, 20 bp, Artificial Sequence
  chemically synthesized
ctggcatggaaccaagccca

SEQ ID NO: 225012 - DNA, 20 bp, Artificial Sequence
  chemically synthesized
tggcatggaaccaagcccag

SEQ ID NO: 225013 - DNA, 20 bp, Artificial Sequence
  chemically synthesized
caggaattaacctctgggct

SEQ ID NO: 225014 - DNA, 20 bp, Artificial Sequence
  chemically synthesized
agcttcaggaattaacctct

SEQ ID NO: 225015 - DNA, 20 bp, Artificial Sequence
  chemically synthesized
tagcttcaggaattaacctc

SEQ ID NO: 225016 - DNA, 20 bp, Artificial Sequence
  chemically synthesized
agcccagaggttaattcctg

SEQ ID NO: 225017 - DNA, 20 bp, Artificial Sequence
  chemically synthesized
cagaggttaattcctgaagc

SEQ ID NO: 225018 - DNA, 20 bp, Artificial Sequence
  chemically synthesized
gaggttaattcctgaagcta

SEQ ID NO: 225019 - DNA, 20 bp, Artificial Sequence
  chemically synthesized
gaaccttttcctctagcttc

SEQ ID NO: 225020 - DNA, 20 bp, Artificial Sequence
  chemically synthesized
aggttaattcctgaagctag

SEQ ID NO: 225021 - DNA, 20 bp, Artificial Sequence
  chemically synthesized
ggaaccttttcctctagctt

SEQ ID NO: 225022 - DNA, 20 bp, Artificial Sequence
  chemically synthesized
aattcctgaagctagaggaa

SEQ ID NO: 225023 - DNA, 20 bp, Artificial Sequence
  chemically synthesized
attcctgaagctagaggaaa

SEQ ID NO: 225024 - DNA, 20 bp, Artificial Sequence
  chemically synthesized
cactttggaaccttttcctc

SEQ ID NO: 225025 - DNA, 20 bp, Artificial Sequence
  chemically synthesized
agctagaggaaaaggttcca

SEQ ID NO: 225026 - DNA, 20 bp, Artificial Sequence
  chemically synthesized
ccttgggatgtagggcactt

SEQ ID NO: 225027 - DNA, 20 bp, Artificial Sequence
  chemically synthesized
ttgggcgaccttgggatgta

SEQ ID NO: 225028 - DNA, 20 bp, Artificial Sequence
  chemically synthesized
tccaaagtgccctacatccc

SEQ ID NO: 225029 - DNA, 20 bp, Artificial Sequence
  chemically synthesized
gttgggcgaccttgggatgt

SEQ ID NO: 225030 - DNA, 20 bp, Artificial Sequence
  chemically synthesized
ccaaagtgccctacatccca

SEQ ID NO: 225031 - DNA, 20 bp, Artificial Sequence
  chemically synthesized
tgttgggcgaccttgggatg

SEQ ID NO: 225032 - DNA, 20 bp, Artificial Sequence
  chemically synthesized
tggatctgttgggcgacctt

SEQ ID NO: 225033 - DNA, 20 bp, Artificial Sequence
  chemically synthesized
gtggatctgttgggcgacct

SEQ ID NO: 225034 - DNA, 20 bp, Artificial Sequence
  chemically synthesized
tacatcccaaggtcgcccaa

SEQ ID NO: 225035 - DNA, 20 bp, Artificial Sequence
  chemically synthesized
cttccaggtgtggatctgtt

SEQ ID NO: 225036 - DNA, 20 bp, Artificial Sequence
  chemically synthesized
gcttccaggtgtggatctgt

SEQ ID NO: 225037 - DNA, 20 bp, Artificial Sequence
  chemically synthesized
tcgcccaacagatccacacc

SEQ ID NO: 225038 - DNA, 20 bp, Artificial Sequence
  chemically synthesized
cccaacagatccacacctgg

SEQ ID NO: 225039 - DNA, 20 bp, Artificial Sequence
  chemically synthesized
gcggagattgcttccaggtg

SEQ ID NO: 225040 - DNA, 20 bp, Artificial Sequence
  chemically synthesized
gcttggcggagattgcttcc

SEQ ID NO: 225041 - DNA, 20 bp, Artificial Sequence
  chemically synthesized
cgcttggcggagattgcttc

SEQ ID NO: 225042 - DNA, 20 bp, Artificial Sequence
  chemically synthesized
acctggaagcaatctccgcc

SEQ ID NO: 225043 - DNA, 20 bp, Artificial Sequence
  chemically synthesized
ctgtaaataggcgcttggcg

SEQ ID NO: 225044 - DNA, 20 bp, Artificial Sequence
  chemically synthesized
gcctgtaaataggcgcttgg

SEQ ID NO: 225045 - DNA, 20 bp, Artificial Sequence
  chemically synthesized
tgtgcctgtaaataggcgct

SEQ ID NO: 225046 - DNA, 20 bp, Artificial Sequence
  chemically synthesized
ctccgccaagcgcctattta

SEQ ID NO: 225047 - DNA, 20 bp, Artificial Sequence
  chemically synthesized
tccgccaagcgcctatttac

SEQ ID NO: 225048 - DNA, 20 bp, Artificial Sequence
  chemically synthesized
acacacctgtgcctgtaaat

SEQ ID NO: 225049 - DNA, 20 bp, Artificial Sequence
  chemically synthesized
cacacacctgtgcctgtaaa

SEQ ID NO: 225050 - DNA, 20 bp, Artificial Sequence
  chemically synthesized
caagcgcctatttacaggca

SEQ ID NO: 225051 - DNA, 20 bp, Artificial Sequence
  chemically synthesized
aagcgcctatttacaggcac

SEQ ID NO: 225052 - DNA, 20 bp, Artificial Sequence
  chemically synthesized
aggcacaggtgtgtgcctat

SEQ ID NO: 225053 - DNA, 20 bp, Artificial Sequence
  chemically synthesized
ggcacaggtgtgtgcctatc

SEQ ID NO: 225054 - DNA, 20 bp, Artificial Sequence
  chemically synthesized
caggtgtgtgcctatcggga

SEQ ID NO: 225055 - DNA, 20 bp, Artificial Sequence
  chemically synthesized
tgttcctcagctgtcccgat

SEQ ID NO: 225056 - DNA, 20 bp, Artificial Sequence
  chemically synthesized
gtgttcctcagctgtcccga

SEQ ID NO: 225057 - DNA, 20 bp, Artificial Sequence
  chemically synthesized
gtgtgcctatcgggacagct

SEQ ID NO: 225058 - DNA, 20 bp, Artificial Sequence
  chemically synthesized
tgtgcctatcgggacagctg

SEQ ID NO: 225059 - DNA, 20 bp, Artificial Sequence
  chemically synthesized
atcaaattaggtgtgttcct

SEQ ID NO: 225060 - DNA, 20 bp, Artificial Sequence
  chemically synthesized
gaggaacacacctaatttga

SEQ ID NO: 225061 - DNA, 20 bp, Artificial Sequence
  chemically synthesized
agaatgtcatctatcaaatt

SEQ ID NO: 225062 - DNA, 20 bp, Artificial Sequence
  chemically synthesized
cagaatgtcatctatcaaat

SEQ ID NO: 225063 - DNA, 20 bp, Artificial Sequence
  chemically synthesized
tgatagatgacattctgatg

SEQ ID NO: 225064 - DNA, 20 bp, Artificial Sequence
  chemically synthesized
tagatgacattctgatgtgg

SEQ ID NO: 225065 - DNA, 20 bp, Artificial Sequence
  chemically synthesized
agatgacattctgatgtggc

SEQ ID NO: 225066 - DNA, 20 bp, Artificial Sequence
  chemically synthesized
cacaataaagcctgccacat

SEQ ID NO: 225067 - DNA, 20 bp, Artificial Sequence
  chemically synthesized
ttgtcataaacagcacaata

SEQ ID NO: 225068 - DNA, 20 bp, Artificial Sequence
  chemically synthesized
tctgcagatattgtcataaa

SEQ ID NO: 225069 - DNA, 20 bp, Artificial Sequence
  chemically synthesized
gctgtttatgacaatatctg

SEQ ID NO: 225070 - DNA, 20 bp, Artificial Sequence
  chemically synthesized
aacaagcacatcataatctg

SEQ ID NO: 225071 - DNA, 20 bp, Artificial Sequence
  chemically synthesized
aattacgctgtttattaaac

SEQ ID NO: 225072 - DNA, 20 bp, Artificial Sequence
  chemically synthesized
tgatgtgcttgtttaataaa

SEQ ID NO: 225073 - DNA, 20 bp, Artificial Sequence
  chemically synthesized
gtttaataaacagcgtaatt

SEQ ID NO: 225074 - DNA, 20 bp, Artificial Sequence
  chemically synthesized
taagcacacacaaaacaaaa

SEQ ID NO: 225075 - DNA, 20 bp, Artificial Sequence
  chemically synthesized
aagcacacacaaaacaaaac

SEQ ID NO: 225076 - DNA, 20 bp, Artificial Sequence
  chemically synthesized
cacacacaaaacaaaacagg

SEQ ID NO: 225077 - DNA, 20 bp, Artificial Sequence
  chemically synthesized
aaaacaggaagttaatacct

SEQ ID NO: 225078 - DNA, 20 bp, Artificial Sequence
  chemically synthesized
acaggaagttaatacctaag

SEQ ID NO: 225079 - DNA, 20 bp, Artificial Sequence
  chemically synthesized
taaacacgtcagcaccactt

SEQ ID NO: 225080 - DNA, 20 bp, Artificial Sequence
  chemically synthesized
ataaacacgtcagcaccact

SEQ ID NO: 225081 - DNA, 20 bp, Artificial Sequence
  chemically synthesized
gttgtggtacataaacacgt

SEQ ID NO: 225082 - DNA, 20 bp, Artificial Sequence
  chemically synthesized
aagaatacactagtcagttg

SEQ ID NO: 225083 - DNA, 20 bp, Artificial Sequence
  chemically synthesized
gtttatgtaccacaactgac

SEQ ID NO: 225084 - DNA, 20 bp, Artificial Sequence
  chemically synthesized
gcagtaaagaatacactagt

SEQ ID NO: 225085 - DNA, 20 bp, Artificial Sequence
  chemically synthesized
ataggcagtaaagaatacac

SEQ ID NO: 225086 - DNA, 20 bp, Artificial Sequence
  chemically synthesized
aagtggagtaataggcagta

SEQ ID NO: 225087 - DNA, 20 bp, Artificial Sequence
  chemically synthesized
ttaagaagtggagtaatagg

SEQ ID NO: 225088 - DNA, 20 bp, Artificial Sequence
  chemically synthesized
atattaagaagtggagtaat

SEQ ID NO: 225089 - DNA, 20 bp, Artificial Sequence
  chemically synthesized
gatattaagaagtggagtaa

SEQ ID NO: 225090 - DNA, 20 bp, Artificial Sequence
  chemically synthesized
tcagtggatattaagaagtg

SEQ ID NO: 225091 - DNA, 20 bp, Artificial Sequence
  chemically synthesized
cttcagtggatattaagaag

SEQ ID NO: 225092 - DNA, 20 bp, Artificial Sequence
  chemically synthesized
ttccttcagtggatattaag

SEQ ID NO: 225093 - DNA, 20 bp, Artificial Sequence
  chemically synthesized
ggattccttcagtggatatt

SEQ ID NO: 225094 - DNA, 20 bp, Artificial Sequence
  chemically synthesized
ccacttcttaatatccactg

SEQ ID NO: 225095 - DNA, 20 bp, Artificial Sequence
  chemically synthesized
cacttcttaatatccactga

SEQ ID NO: 225096 - DNA, 20 bp, Artificial Sequence
  chemically synthesized
cagactgaggattccttcag

SEQ ID NO: 225097 - DNA, 20 bp, Artificial Sequence
  chemically synthesized
atacagactgaggattcctt

SEQ ID NO: 225098 - DNA, 20 bp, Artificial Sequence
  chemically synthesized
atatccactgaaggaatcct

SEQ ID NO: 225099 - DNA, 20 bp, Artificial Sequence
  chemically synthesized
agatgtgtgtatacagactg

SEQ ID NO: 225100 - DNA, 20 bp, Artificial Sequence
  chemically synthesized
gagatgtgtgtatacagact

SEQ ID NO: 225101 - DNA, 20 bp, Artificial Sequence
  chemically synthesized
aacttggagatgtgtgtata

SEQ ID NO: 225102 - DNA, 20 bp, Artificial Sequence
  chemically synthesized
gtctgtatacacacatctcc

SEQ ID NO: 225103 - DNA, 20 bp, Artificial Sequence
  chemically synthesized
aagttgatgttcataacttg

SEQ ID NO: 225104 - DNA, 20 bp, Artificial Sequence
  chemically synthesized
tgaagttgatgttcataact

SEQ ID NO: 225105 - DNA, 20 bp, Artificial Sequence
  chemically synthesized
tctttctgaggatatgcatg

SEQ ID NO: 225106 - DNA, 20 bp, Artificial Sequence
  chemically synthesized
atcaacttcatgcatatcct

SEQ ID NO: 225107 - DNA, 20 bp, Artificial Sequence
  chemically synthesized
acttcatgcatatcctcaga

SEQ ID NO: 225108 - DNA, 20 bp, Artificial Sequence
  chemically synthesized
ggtgtaagtaggtctttctg

SEQ ID NO: 225109 - DNA, 20 bp, Artificial Sequence
  chemically synthesized
aggtgtaagtaggtctttct

SEQ ID NO: 225110 - DNA, 20 bp, Artificial Sequence
  chemically synthesized
gtgaggctgcaggtgtaagt

SEQ ID NO: 225111 - DNA, 20 bp, Artificial Sequence
  chemically synthesized
ggtgaggctgcaggtgtaag

SEQ ID NO: 225112 - DNA, 20 bp, Artificial Sequence
  chemically synthesized
gaaagacctacttacacctg

SEQ ID NO: 225113 - DNA, 20 bp, Artificial Sequence
  chemically synthesized
tgtggtgaggctgcaggtgt

SEQ ID NO: 225114 - DNA, 20 bp, Artificial Sequence
  chemically synthesized
gatatatgtggtgaggctgc

SEQ ID NO: 225115 - DNA, 20 bp, Artificial Sequence
  chemically synthesized
agatatatgtggtgaggctg

SEQ ID NO: 225116 - DNA, 20 bp, Artificial Sequence
  chemically synthesized
gggtgtagatatatgtggtg

SEQ ID NO: 225117 - DNA, 20 bp, Artificial Sequence
  chemically synthesized
agggtgtagatatatgtggt

SEQ ID NO: 225118 - DNA, 20 bp, Artificial Sequence
  chemically synthesized
gttaagggtgtagatatatg

SEQ ID NO: 225119 - DNA, 20 bp, Artificial Sequence
  chemically synthesized
ttgaatgcctgttaagggtg

SEQ ID NO: 225120 - DNA, 20 bp, Artificial Sequence
  chemically synthesized
acatatatctacacccttaa

SEQ ID NO: 225121 - DNA, 20 bp, Artificial Sequence
  chemically synthesized
catatatctacacccttaac

SEQ ID NO: 225122 - DNA, 20 bp, Artificial Sequence
  chemically synthesized
atttattgaatgcctgttaa

SEQ ID NO: 225123 - DNA, 20 bp, Artificial Sequence
  chemically synthesized
tatttattgaatgcctgtta

SEQ ID NO: 225124 - DNA, 20 bp, Artificial Sequence
  chemically synthesized
gtatttattgaatgcctgtt

SEQ ID NO: 225125 - DNA, 20 bp, Artificial Sequence
  chemically synthesized
catttatctgatcatttgac

SEQ ID NO: 225126 - DNA, 20 bp, Artificial Sequence
  chemically synthesized
ataaatacttgtcaaatgat

SEQ ID NO: 225127 - DNA, 20 bp, Artificial Sequence
  chemically synthesized
gatcagataaatgataaatg

SEQ ID NO: 225128 - DNA, 20 bp, Artificial Sequence
  chemically synthesized
atcagataaatgataaatga

SEQ ID NO: 225129 - DNA, 20 bp, Artificial Sequence
  chemically synthesized
cagataaatgataaatgaag

SEQ ID NO: 225130 - DNA, 20 bp, Artificial Sequence
  chemically synthesized
aatcttgaagatataaatat

SEQ ID NO: 225131 - DNA, 20 bp, Artificial Sequence
  chemically synthesized
ataccaatatttatatcttc

SEQ ID NO: 225132 - DNA, 20 bp, Artificial Sequence
  chemically synthesized
tgcccataggagcaatcttg

SEQ ID NO: 225133 - DNA, 20 bp, Artificial Sequence
  chemically synthesized
tatcttcaagattgctccta

SEQ ID NO: 225134 - DNA, 20 bp, Artificial Sequence
  chemically synthesized
atcttcaagattgctcctat

SEQ ID NO: 225135 - DNA, 20 bp, Artificial Sequence
  chemically synthesized
gtaaaattatatgcccatag

SEQ ID NO: 225136 - DNA, 20 bp, Artificial Sequence
  chemically synthesized
ctgtaaaattatatgcccat

SEQ ID NO: 225137 - DNA, 20 bp, Artificial Sequence
  chemically synthesized
cctgtaaaattatatgccca

SEQ ID NO: 225138 - DNA, 20 bp, Artificial Sequence
  chemically synthesized
cctatgggcatataatttta

SEQ ID NO: 225139 - DNA, 20 bp, Artificial Sequence
  chemically synthesized
ctatgggcatataattttac

SEQ ID NO: 225140 - DNA, 20 bp, Artificial Sequence
  chemically synthesized
atgggcatataattttacag

SEQ ID NO: 225141 - DNA, 20 bp, Artificial Sequence
  chemically synthesized
attttacaggagttgctact

SEQ ID NO: 225142 - DNA, 20 bp, Artificial Sequence
  chemically synthesized
gaaaagatagacaatccaag

SEQ ID NO: 225143 - DNA, 20 bp, Artificial Sequence
  chemically synthesized
actgaaaagatagacaatcc

SEQ ID NO: 225144 - DNA, 20 bp, Artificial Sequence
  chemically synthesized
acttggattgtctatctttt

SEQ ID NO: 225145 - DNA, 20 bp, Artificial Sequence
  chemically synthesized
aaaaatgtagactgaaaaga

SEQ ID NO: 225146 - DNA, 20 bp, Artificial Sequence
  chemically synthesized
gagaaaaaatgtagactgaa

SEQ ID NO: 225147 - DNA, 20 bp, Artificial Sequence
  chemically synthesized
tatattttagagaaaaaatg

SEQ ID NO: 225148 - DNA, 20 bp, Artificial Sequence
  chemically synthesized
caactgccaattatatttta

SEQ ID NO: 225149 - DNA, 20 bp, Artificial Sequence
  chemically synthesized
ggcaactgccaattatattt

SEQ ID NO: 225150 - DNA, 20 bp, Artificial Sequence
  chemically synthesized
ttttttctctaaaatataat

SEQ ID NO: 225151 - DNA, 20 bp, Artificial Sequence
  chemically synthesized
tttctctaaaatataattgg

SEQ ID NO: 225152 - DNA, 20 bp, Artificial Sequence
  chemically synthesized
tataattggcagttgcctta

SEQ ID NO: 225153 - DNA, 20 bp, Artificial Sequence
  chemically synthesized
attggcagttgccttatgga

SEQ ID NO: 225154 - DNA, 20 bp, Artificial Sequence
  chemically synthesized
tcaaatttaatctatccata

SEQ ID NO: 225155 - DNA, 20 bp, Artificial Sequence
  chemically synthesized
atcaaatttaatctatccat

SEQ ID NO: 225156 - DNA, 20 bp, Artificial Sequence
  chemically synthesized
tatggatagattaaatttga

SEQ ID NO: 225157 - DNA, 20 bp, Artificial Sequence
  chemically synthesized
tggatagattaaatttgata

SEQ ID NO: 225158 - DNA, 20 bp, Artificial Sequence
  chemically synthesized
agattaaatttgatagagcc

SEQ ID NO: 225159 - DNA, 20 bp, Artificial Sequence
  chemically synthesized
tttgatagagcctggtactt

SEQ ID NO: 225160 - DNA, 20 bp, Artificial Sequence
  chemically synthesized
gaaatagcacctcaagtacc

SEQ ID NO: 225161 - DNA, 20 bp, Artificial Sequence
  chemically synthesized
ttgatagagcctggtacttg

SEQ ID NO: 225162 - DNA, 20 bp, Artificial Sequence
  chemically synthesized
tgaaatagcacctcaagtac

SEQ ID NO: 225163 - DNA, 20 bp, Artificial Sequence
  chemically synthesized
tggtgctgaaatagcacctc

SEQ ID NO: 225164 - DNA, 20 bp, Artificial Sequence
  chemically synthesized
tggtacttgaggtgctattt

SEQ ID NO: 225165 - DNA, 20 bp, Artificial Sequence
  chemically synthesized
ttacagaaatggtgctgaaa

SEQ ID NO: 225166 - DNA, 20 bp, Artificial Sequence
  chemically synthesized
tagttccagaattacagaaa

SEQ ID NO: 225167 - DNA, 20 bp, Artificial Sequence
  chemically synthesized
cagcaccatttctgtaattc

SEQ ID NO: 225168 - DNA, 20 bp, Artificial Sequence
  chemically synthesized
gataactagttccagaatta

SEQ ID NO: 225169 - DNA, 20 bp, Artificial Sequence
  chemically synthesized
catttctgtaattctggaac

SEQ ID NO: 225170 - DNA, 20 bp, Artificial Sequence
  chemically synthesized
ccaagcctgataactagttc

SEQ ID NO: 225171 - DNA, 20 bp, Artificial Sequence
  chemically synthesized
gtaattctggaactagttat

SEQ ID NO: 225172 - DNA, 20 bp, Artificial Sequence
  chemically synthesized
taattctggaactagttatc

SEQ ID NO: 225173 - DNA, 20 bp, Artificial Sequence
  chemically synthesized
catctgccaagcctgataac

SEQ ID NO: 225174 - DNA, 20 bp, Artificial Sequence
  chemically synthesized
ctggaactagttatcaggct

SEQ ID NO: 225175 - DNA, 20 bp, Artificial Sequence
  chemically synthesized
gaactagttatcaggcttgg

SEQ ID NO: 225176 - DNA, 20 bp, Artificial Sequence
  chemically synthesized
tgcatacatttgcatctgcc

SEQ ID NO: 225177 - DNA, 20 bp, Artificial Sequence
  chemically synthesized
ttggcagatgcaaatgtatg

SEQ ID NO: 225178 - DNA, 20 bp, Artificial Sequence
  chemically synthesized
gcagttagagagtcgggaag

SEQ ID NO: 225179 - DNA, 20 bp, Artificial Sequence
  chemically synthesized
tctgcagttagagagtcggg

SEQ ID NO: 225180 - DNA, 20 bp, Artificial Sequence
  chemically synthesized
aaatctgcagttagagagtc

SEQ ID NO: 225181 - DNA, 20 bp, Artificial Sequence
  chemically synthesized
aaaatctgcagttagagagt

SEQ ID NO: 225182 - DNA, 20 bp, Artificial Sequence
  chemically synthesized
ttgtaaaatctgcagttaga

SEQ ID NO: 225183 - DNA, 20 bp, Artificial Sequence
  chemically synthesized
tcttcccgactctctaactg

SEQ ID NO: 225184 - DNA, 20 bp, Artificial Sequence
  chemically synthesized
agttgtaaaatctgcagtta

SEQ ID NO: 225185 - DNA, 20 bp, Artificial Sequence
  chemically synthesized
tcagttgtaaaatctgcagt

SEQ ID NO: 225186 - DNA, 20 bp, Artificial Sequence
  chemically synthesized
ttcttcagttgtaaaatctg

SEQ ID NO: 225187 - DNA, 20 bp, Artificial Sequence
  chemically synthesized
aactgcagattttacaactg

SEQ ID NO: 225188 - DNA, 20 bp, Artificial Sequence
  chemically synthesized
gcagattttacaactgaaga

SEQ ID NO: 225189 - DNA, 20 bp, Artificial Sequence
  chemically synthesized
aaagttccccttgctttctt

SEQ ID NO: 225190 - DNA, 20 bp, Artificial Sequence
  chemically synthesized
attttacaactgaagaaagc

SEQ ID NO: 225191 - DNA, 20 bp, Artificial Sequence
  chemically synthesized
ttttacaactgaagaaagca

SEQ ID NO: 225192 - DNA, 20 bp, Artificial Sequence
  chemically synthesized
tttacaactgaagaaagcaa

SEQ ID NO: 225193 - DNA, 20 bp, Artificial Sequence
  chemically synthesized
ttacaactgaagaaagcaag

SEQ ID NO: 225194 - DNA, 20 bp, Artificial Sequence
  chemically synthesized
tatcgattatttataaataa

SEQ ID NO: 225195 - DNA, 20 bp, Artificial Sequence
  chemically synthesized
taatcgatacaatttgtaaa

SEQ ID NO: 225196 - DNA, 20 bp, Artificial Sequence
  chemically synthesized
tgtgagctgctcagagggaa

SEQ ID NO: 225197 - DNA, 20 bp, Artificial Sequence
  chemically synthesized
aatagaaatcctttccctct

SEQ ID NO: 225198 - DNA, 20 bp, Artificial Sequence
  chemically synthesized
ctgtgagctgctcagaggga

SEQ ID NO: 225199 - DNA, 20 bp, Artificial Sequence
  chemically synthesized
agaaatcctttccctctgag

SEQ ID NO: 225200 - DNA, 20 bp, Artificial Sequence
  chemically synthesized
ctggctgtgagctgctcaga

SEQ ID NO: 225201 - DNA, 20 bp, Artificial Sequence
  chemically synthesized
gctggctgtgagctgctcag

SEQ ID NO: 225202 - DNA, 20 bp, Artificial Sequence
  chemically synthesized
ggctggctgtgagctgctca

SEQ ID NO: 225203 - DNA, 20 bp, Artificial Sequence
  chemically synthesized
ctggctggctgtgagctgct

SEQ ID NO: 225204 - DNA, 20 bp, Artificial Sequence
  chemically synthesized
ctttccctctgagcagctca

SEQ ID NO: 225205 - DNA, 20 bp, Artificial Sequence
  chemically synthesized
ccctctgagcagctcacagc

SEQ ID NO: 225206 - DNA, 20 bp, Artificial Sequence
  chemically synthesized
tctgagagctggctggctgt

SEQ ID NO: 225207 - DNA, 20 bp, Artificial Sequence
  chemically synthesized
ctgagcagctcacagccagc

SEQ ID NO: 225208 - DNA, 20 bp, Artificial Sequence
  chemically synthesized
accttcatctgagagctggc

SEQ ID NO: 225209 - DNA, 20 bp, Artificial Sequence
  chemically synthesized
gctcacagccagccagctct

SEQ ID NO: 225210 - DNA, 20 bp, Artificial Sequence
  chemically synthesized
acgtaccttcatctgagagc

SEQ ID NO: 225211 - DNA, 20 bp, Artificial Sequence
  chemically synthesized
agccagccagctctcagatg

SEQ ID NO: 225212 - DNA, 20 bp, Artificial Sequence
  chemically synthesized
gctgacgtaccttcatctga

SEQ ID NO: 225213 - DNA, 20 bp, Artificial Sequence
  chemically synthesized
gccagccagctctcagatga

SEQ ID NO: 225214 - DNA, 20 bp, Artificial Sequence
  chemically synthesized
gagctgacgtaccttcatct

SEQ ID NO: 225215 - DNA, 20 bp, Artificial Sequence
  chemically synthesized
gctctcagatgaaggtacgt

SEQ ID NO: 225216 - DNA, 20 bp, Artificial Sequence
  chemically synthesized
ccacaccattagtcaagaga

SEQ ID NO: 225217 - DNA, 20 bp, Artificial Sequence
  chemically synthesized
gaccacaccattagtcaaga

SEQ ID NO: 225218 - DNA, 20 bp, Artificial Sequence
  chemically synthesized
cagaccacaccattagtcaa

SEQ ID NO: 225219 - DNA, 20 bp, Artificial Sequence
  chemically synthesized
gtcagctctctcttgactaa

SEQ ID NO: 225220 - DNA, 20 bp, Artificial Sequence
  chemically synthesized
tgcagaccacaccattagtc

SEQ ID NO: 225221 - DNA, 20 bp, Artificial Sequence
  chemically synthesized
ctctctcttgactaatggtg

SEQ ID NO: 225222 - DNA, 20 bp, Artificial Sequence
  chemically synthesized
catgatgcagaccacaccat

SEQ ID NO: 225223 - DNA, 20 bp, Artificial Sequence
  chemically synthesized
taatggtgtggtctgcatca

SEQ ID NO: 225224 - DNA, 20 bp, Artificial Sequence
  chemically synthesized
atggtgtggtctgcatcatg

SEQ ID NO: 225225 - DNA, 20 bp, Artificial Sequence
  chemically synthesized
gtctggtaacctccatgatg

SEQ ID NO: 225226 - DNA, 20 bp, Artificial Sequence
  chemically synthesized
tggtgtggtctgcatcatgg

SEQ ID NO: 225227 - DNA, 20 bp, Artificial Sequence
  chemically synthesized
gtctgcatcatggaggttac

SEQ ID NO: 225228 - DNA, 20 bp, Artificial Sequence
  chemically synthesized
gcattctgccaaggaatgtc

SEQ ID NO: 225229 - DNA, 20 bp, Artificial Sequence
  chemically synthesized
ggaggttaccagacattcct

SEQ ID NO: 225230 - DNA, 20 bp, Artificial Sequence
  chemically synthesized
ggttaccagacattccttgg

SEQ ID NO: 225231 - DNA, 20 bp, Artificial Sequence
  chemically synthesized
gtttgatttgcattctgcca

SEQ ID NO: 225232 - DNA, 20 bp, Artificial Sequence
  chemically synthesized
tgtttgatttgcattctgcc

SEQ ID NO: 225233 - DNA, 20 bp, Artificial Sequence
  chemically synthesized
tgcaaatcaaacatcttgaa

SEQ ID NO: 225234 - DNA, 20 bp, Artificial Sequence
  chemically synthesized
ctttgatccttttgccattc

SEQ ID NO: 225235 - DNA, 20 bp, Artificial Sequence
  chemically synthesized
tcaaacatcttgaatggcaa

SEQ ID NO: 225236 - DNA, 20 bp, Artificial Sequence
  chemically synthesized
caaacatcttgaatggcaaa

SEQ ID NO: 225237 - DNA, 20 bp, Artificial Sequence
  chemically synthesized
cttgaatggcaaaaggatca

SEQ ID NO: 225238 - DNA, 20 bp, Artificial Sequence
  chemically synthesized
atggcaaaaggatcaaagca

SEQ ID NO: 225239 - DNA, 20 bp, Artificial Sequence
  chemically synthesized
cagcaggtctgagcaatgtt

SEQ ID NO: 225240 - DNA, 20 bp, Artificial Sequence
  chemically synthesized
cacggcatctaaacattgct

SEQ ID NO: 225241 - DNA, 20 bp, Artificial Sequence
  chemically synthesized
aaaatatgaacagcaggtct

SEQ ID NO: 225242 - DNA, 20 bp, Artificial Sequence
  chemically synthesized
tgcataaaaatatgaacagc

SEQ ID NO: 225243 - DNA, 20 bp, Artificial Sequence
  chemically synthesized
atgcataaaaatatgaacag

SEQ ID NO: 225244 - DNA, 20 bp, Artificial Sequence
  chemically synthesized
ctgatgcataaaaatatgaa

SEQ ID NO: 225245 - DNA, 20 bp, Artificial Sequence
  chemically synthesized
ctgttcatatttttatgcat

SEQ ID NO: 225246 - DNA, 20 bp, Artificial Sequence
  chemically synthesized
ttatgcatcagaaaacttga

SEQ ID NO: 225247 - DNA, 20 bp, Artificial Sequence
  chemically synthesized
atgcatcagaaaacttgaaa

SEQ ID NO: 225248 - DNA, 20 bp, Artificial Sequence
  chemically synthesized
tcaattctaatttctctttc

SEQ ID NO: 225249 - DNA, 20 bp, Artificial Sequence
  chemically synthesized
agaaaacttgaaagagaaat

SEQ ID NO: 225250 - DNA, 20 bp, Artificial Sequence
  chemically synthesized
gaaagagaaattagaattga

SEQ ID NO: 225251 - DNA, 20 bp, Artificial Sequence
  chemically synthesized
ttatacactttggaaggtgc

SEQ ID NO: 225252 - DNA, 20 bp, Artificial Sequence
  chemically synthesized
attatacactttggaaggtg

SEQ ID NO: 225253 - DNA, 20 bp, Artificial Sequence
  chemically synthesized
taatgcacctgcaccttcca

SEQ ID NO: 225254 - DNA, 20 bp, Artificial Sequence
  chemically synthesized
tcaatattatacactttgga

SEQ ID NO: 225255 - DNA, 20 bp, Artificial Sequence
  chemically synthesized
ctcaatattatacactttgg

SEQ ID NO: 225256 - DNA, 20 bp, Artificial Sequence
  chemically synthesized
aatctcaatattatacactt

SEQ ID NO: 225257 - DNA, 20 bp, Artificial Sequence
  chemically synthesized
cttccaaagtgtataatatt

SEQ ID NO: 225258 - DNA, 20 bp, Artificial Sequence
  chemically synthesized
gtgtataatattgagatttt

SEQ ID NO: 225259 - DNA, 20 bp, Artificial Sequence
  chemically synthesized
ttttagcatatttgtccctc

SEQ ID NO: 225260 - DNA, 20 bp, Artificial Sequence
  chemically synthesized
tttagcatatttgtccctct

SEQ ID NO: 225261 - DNA, 20 bp, Artificial Sequence
  chemically synthesized
taaaatatactaatcccaga

SEQ ID NO: 225262 - DNA, 20 bp, Artificial Sequence
  chemically synthesized
catatttgtccctctgggat

SEQ ID NO: 225263 - DNA, 20 bp, Artificial Sequence
  chemically synthesized
ataaaatatactaatcccag

SEQ ID NO: 225264 - DNA, 20 bp, Artificial Sequence
  chemically synthesized
aataaaatatactaatccca

SEQ ID NO: 225265 - DNA, 20 bp, Artificial Sequence
  chemically synthesized
ggaataaaatatactaatcc

SEQ ID NO: 225266 - DNA, 20 bp, Artificial Sequence
  chemically synthesized
tagtatattttattccattg

SEQ ID NO: 225267 - DNA, 20 bp, Artificial Sequence
  chemically synthesized
agtatattttattccattgt

SEQ ID NO: 225268 - DNA, 20 bp, Artificial Sequence
  chemically synthesized
gtatattttattccattgta

SEQ ID NO: 225269 - DNA, 20 bp, Artificial Sequence
  chemically synthesized
gttcagctgctgccctacaa

SEQ ID NO: 225270 - DNA, 20 bp, Artificial Sequence
  chemically synthesized
tattttattccattgtaggg

SEQ ID NO: 225271 - DNA, 20 bp, Artificial Sequence
  chemically synthesized
tttattccattgtagggcag

SEQ ID NO: 225272 - DNA, 20 bp, Artificial Sequence
  chemically synthesized
attgtagggcagcagctgaa

SEQ ID NO: 225273 - DNA, 20 bp, Artificial Sequence
  chemically synthesized
ttgtagggcagcagctgaac

SEQ ID NO: 225274 - DNA, 20 bp, Artificial Sequence
  chemically synthesized
tgtagggcagcagctgaaca

SEQ ID NO: 225275 - DNA, 20 bp, Artificial Sequence
  chemically synthesized
gtagggcagcagctgaacag

SEQ ID NO: 225276 - DNA, 20 bp, Artificial Sequence
  chemically synthesized
tgcctccacaaacccctgtt

SEQ ID NO: 225277 - DNA, 20 bp, Artificial Sequence
  chemically synthesized
agcagctgaacaggggtttg

SEQ ID NO: 225278 - DNA, 20 bp, Artificial Sequence
  chemically synthesized
cagctgaacaggggtttgtg

SEQ ID NO: 225279 - DNA, 20 bp, Artificial Sequence
  chemically synthesized
agctgaacaggggtttgtgg

SEQ ID NO: 225280 - DNA, 20 bp, Artificial Sequence
  chemically synthesized
tgaacaggggtttgtggagg

SEQ ID NO: 225281 - DNA, 20 bp, Artificial Sequence
  chemically synthesized
acaggggtttgtggaggcag

SEQ ID NO: 225282 - DNA, 20 bp, Artificial Sequence
  chemically synthesized
tttgtggaggcagaagactt

SEQ ID NO: 225283 - DNA, 20 bp, Artificial Sequence
  chemically synthesized
tgtggaggcagaagacttga

SEQ ID NO: 225284 - DNA, 20 bp, Artificial Sequence
  chemically synthesized
agttgagccaagaggctctc

SEQ ID NO: 225285 - DNA, 20 bp, Artificial Sequence
  chemically synthesized
cagaagacttgagagcctct

SEQ ID NO: 225286 - DNA, 20 bp, Artificial Sequence
  chemically synthesized
ttacaggtagttgagccaag

SEQ ID NO: 225287 - DNA, 20 bp, Artificial Sequence
  chemically synthesized
cttacaggtagttgagccaa

SEQ ID NO: 225288 - DNA, 20 bp, Artificial Sequence
  chemically synthesized
agcttacaggtagttgagcc

SEQ ID NO: 225289 - DNA, 20 bp, Artificial Sequence
  chemically synthesized
caaacagcttacaggtagtt

SEQ ID NO: 225290 - DNA, 20 bp, Artificial Sequence
  chemically synthesized
ctcttggctcaactacctgt

SEQ ID NO: 225291 - DNA, 20 bp, Artificial Sequence
  chemically synthesized
aaggtcaaacagcttacagg

SEQ ID NO: 225292 - DNA, 20 bp, Artificial Sequence
  chemically synthesized
tacaaggtcaaacagcttac

SEQ ID NO: 225293 - DNA, 20 bp, Artificial Sequence
  chemically synthesized
gtacaaggtcaaacagctta

SEQ ID NO: 225294 - DNA, 20 bp, Artificial Sequence
  chemically synthesized
atgacttgtacaaggtcaaa

SEQ ID NO: 225295 - DNA, 20 bp, Artificial Sequence
  chemically synthesized
taagctgtttgaccttgtac

SEQ ID NO: 225296 - DNA, 20 bp, Artificial Sequence
  chemically synthesized
aagtttaaatgacttgtaca

SEQ ID NO: 225297 - DNA, 20 bp, Artificial Sequence
  chemically synthesized
aaagtttaaatgacttgtac

SEQ ID NO: 225298 - DNA, 20 bp, Artificial Sequence
  chemically synthesized
tacaagtcatttaaactttc

SEQ ID NO: 225299 - DNA, 20 bp, Artificial Sequence
  chemically synthesized
atgtggaagttgaagccaga

SEQ ID NO: 225300 - DNA, 20 bp, Artificial Sequence
  chemically synthesized
atggatgtggaagttgaagc

SEQ ID NO: 225301 - DNA, 20 bp, Artificial Sequence
  chemically synthesized
acttatggatgtggaagttg

SEQ ID NO: 225302 - DNA, 20 bp, Artificial Sequence
  chemically synthesized
aattccacttatggatgtgg

SEQ ID NO: 225303 - DNA, 20 bp, Artificial Sequence
  chemically synthesized
gcttcaacttccacatccat

SEQ ID NO: 225304 - DNA, 20 bp, Artificial Sequence
  chemically synthesized
attaattccacttatggatg

SEQ ID NO: 225305 - DNA, 20 bp, Artificial Sequence
  chemically synthesized
tcaacttccacatccataag

SEQ ID NO: 225306 - DNA, 20 bp, Artificial Sequence
  chemically synthesized
ggtattattaattccactta

SEQ ID NO: 225307 - DNA, 20 bp, Artificial Sequence
  chemically synthesized
ggaattaataatacctcatc

SEQ ID NO: 225308 - DNA, 20 bp, Artificial Sequence
  chemically synthesized
tccattctcatcacttgatg

SEQ ID NO: 225309 - DNA, 20 bp, Artificial Sequence
  chemically synthesized
ttccattctcatcacttgat

SEQ ID NO: 225310 - DNA, 20 bp, Artificial Sequence
  chemically synthesized
ataatacctcatcaagtgat

SEQ ID NO: 225311 - DNA, 20 bp, Artificial Sequence
  chemically synthesized
acctcatcaagtgatgagaa

SEQ ID NO: 225312 - DNA, 20 bp, Artificial Sequence
  chemically synthesized
atcaagtgatgagaatggaa

SEQ ID NO: 225313 - DNA, 20 bp, Artificial Sequence
  chemically synthesized
tgagaatggaatagatatta

SEQ ID NO: 225314 - DNA, 20 bp, Artificial Sequence
  chemically synthesized
tcacattaaattttgaggag

SEQ ID NO: 225315 - DNA, 20 bp, Artificial Sequence
  chemically synthesized
gtatcacattaaattttgag

SEQ ID NO: 225316 - DNA, 20 bp, Artificial Sequence
  chemically synthesized
ttgtatcacattaaattttg

SEQ ID NO: 225317 - DNA, 20 bp, Artificial Sequence
  chemically synthesized
cttgtatcacattaaatttt

SEQ ID NO: 225318 - DNA, 20 bp, Artificial Sequence
  chemically synthesized
ctcaaaatttaatgtgatac

SEQ ID NO: 225319 - DNA, 20 bp, Artificial Sequence
  chemically synthesized
aaatttaatgtgatacaagc

SEQ ID NO: 225320 - DNA, 20 bp, Artificial Sequence
  chemically synthesized
aatttaatgtgatacaagcc

SEQ ID NO: 225321 - DNA, 20 bp, Artificial Sequence
  chemically synthesized
aatgtgatacaagccaggtg

SEQ ID NO: 225322 - DNA, 20 bp, Artificial Sequence
  chemically synthesized
gtgatacaagccaggtgtgg

SEQ ID NO: 225323 - DNA, 20 bp, Artificial Sequence
  chemically synthesized
cagatgtgagccaccacacc

SEQ ID NO: 225324 - DNA, 20 bp, Artificial Sequence
  chemically synthesized
gtagctgggatcacagatgt

SEQ ID NO: 225325 - DNA, 20 bp, Artificial Sequence
  chemically synthesized
gtggctcacatctgtgatcc

SEQ ID NO: 225326 - DNA, 20 bp, Artificial Sequence
  chemically synthesized
ctcctaagtagctgggatca

SEQ ID NO: 225327 - DNA, 20 bp, Artificial Sequence
  chemically synthesized
catctgtgatcccagctact

SEQ ID NO: 225328 - DNA, 20 bp, Artificial Sequence
  chemically synthesized
cctcagcctcctaagtagct

SEQ ID NO: 225329 - DNA, 20 bp, Artificial Sequence
  chemically synthesized
atctgtgatcccagctactt

SEQ ID NO: 225330 - DNA, 20 bp, Artificial Sequence
  chemically synthesized
acctcagcctcctaagtagc

SEQ ID NO: 225331 - DNA, 20 bp, Artificial Sequence
  chemically synthesized
ctgtgatcccagctacttag

SEQ ID NO: 225332 - DNA, 20 bp, Artificial Sequence
  chemically synthesized
tgtgatcccagctacttagg

SEQ ID NO: 225333 - DNA, 20 bp, Artificial Sequence
  chemically synthesized
tcccacctcagcctcctaag

SEQ ID NO: 225334 - DNA, 20 bp, Artificial Sequence
  chemically synthesized
tcctcccacctcagcctcct

SEQ ID NO: 225335 - DNA, 20 bp, Artificial Sequence
  chemically synthesized
tcccagctacttaggaggct

SEQ ID NO: 225336 - DNA, 20 bp, Artificial Sequence
  chemically synthesized
cccagctacttaggaggctg

SEQ ID NO: 225337 - DNA, 20 bp, Artificial Sequence
  chemically synthesized
agctacttaggaggctgagg

SEQ ID NO: 225338 - DNA, 20 bp, Artificial Sequence
  chemically synthesized
gctacttaggaggctgaggt

SEQ ID NO: 225339 - DNA, 20 bp, Artificial Sequence
  chemically synthesized
tacttaggaggctgaggtgg

SEQ ID NO: 225340 - DNA, 20 bp, Artificial Sequence
  chemically synthesized
acttaggaggctgaggtggg

SEQ ID NO: 225341 - DNA, 20 bp, Artificial Sequence
  chemically synthesized
ctcaaatgatcctcccacct

SEQ ID NO: 225342 - DNA, 20 bp, Artificial Sequence
  chemically synthesized
ctgaggtgggaggatcattt

SEQ ID NO: 225343 - DNA, 20 bp, Artificial Sequence
  chemically synthesized
gtgggaggatcatttgagct

SEQ ID NO: 225344 - DNA, 20 bp, Artificial Sequence
  chemically synthesized
tgggaggatcatttgagctc

SEQ ID NO: 225345 - DNA, 20 bp, Artificial Sequence
  chemically synthesized
ggaggatcatttgagctcag

SEQ ID NO: 225346 - DNA, 20 bp, Artificial Sequence
  chemically synthesized
gagtctggtcacaaactcct

SEQ ID NO: 225347 - DNA, 20 bp, Artificial Sequence
  chemically synthesized
tgagctcaggagtttgtgac

SEQ ID NO: 225348 - DNA, 20 bp, Artificial Sequence
  chemically synthesized
caggagtttgtgaccagact

SEQ ID NO: 225349 - DNA, 20 bp, Artificial Sequence
  chemically synthesized
tcttgctattttgccgagtc

SEQ ID NO: 225350 - DNA, 20 bp, Artificial Sequence
  chemically synthesized
tgtgaccagactcggcaaaa

SEQ ID NO: 225351 - DNA, 20 bp, Artificial Sequence
  chemically synthesized
tggggtcttgctattttgcc

SEQ ID NO: 225352 - DNA, 20 bp, Artificial Sequence
  chemically synthesized
accagactcggcaaaatagc

SEQ ID NO: 225353 - DNA, 20 bp, Artificial Sequence
  chemically synthesized
ctttatttgtttttgagatg

SEQ ID NO: 225354 - DNA, 20 bp, Artificial Sequence
  chemically synthesized
tctttatttgtttttgagat

SEQ ID NO: 225355 - DNA, 20 bp, Artificial Sequence
  chemically synthesized
ttctttatttgtttttgaga

SEQ ID NO: 225356 - DNA, 20 bp, Artificial Sequence
  chemically synthesized
atttttctttatttgttttt

SEQ ID NO: 225357 - DNA, 20 bp, Artificial Sequence
  chemically synthesized
ccccatctcaaaaacaaata

SEQ ID NO: 225358 - DNA, 20 bp, Artificial Sequence
  chemically synthesized
aataaagaaaaatgcatcga

SEQ ID NO: 225359 - DNA, 20 bp, Artificial Sequence
  chemically synthesized
agaaaaatgcatcgaaagta

SEQ ID NO: 225360 - DNA, 20 bp, Artificial Sequence
  chemically synthesized
tgcatcgaaagtaaagaaaa

SEQ ID NO: 225361 - DNA, 20 bp, Artificial Sequence
  chemically synthesized
aatacaaatgaccttaaaaa

SEQ ID NO: 225362 - DNA, 20 bp, Artificial Sequence
  chemically synthesized
attaaactctgcttttttta

SEQ ID NO: 225363 - DNA, 20 bp, Artificial Sequence
  chemically synthesized
aattaaactctgcttttttt

SEQ ID NO: 225364 - DNA, 20 bp, Artificial Sequence
  chemically synthesized
acaaatgaccttaaaaaaag

SEQ ID NO: 225365 - DNA, 20 bp, Artificial Sequence
  chemically synthesized
aaatgaccttaaaaaaagca

SEQ ID NO: 225366 - DNA, 20 bp, Artificial Sequence
  chemically synthesized
aaaagcagagtttaattcat

SEQ ID NO: 225367 - DNA, 20 bp, Artificial Sequence
  chemically synthesized
agtttaattcattggacctg

SEQ ID NO: 225368 - DNA, 20 bp, Artificial Sequence
  chemically synthesized
ttaattcattggacctgcgg

SEQ ID NO: 225369 - DNA, 20 bp, Artificial Sequence
  chemically synthesized
agactctcaggcaccaccgc

SEQ ID NO: 225370 - DNA, 20 bp, Artificial Sequence
  chemically synthesized
gagactctcaggcaccaccg

SEQ ID NO: 225371 - DNA, 20 bp, Artificial Sequence
  chemically synthesized
ttggacctgcggtggtgcct

SEQ ID NO: 225372 - DNA, 20 bp, Artificial Sequence
  chemically synthesized
ggacctgcggtggtgcctga

SEQ ID NO: 225373 - DNA, 20 bp, Artificial Sequence
  chemically synthesized
tattggaaatggagactctc

SEQ ID NO: 225374 - DNA, 20 bp, Artificial Sequence
  chemically synthesized
ttattggaaatggagactct

SEQ ID NO: 225375 - DNA, 20 bp, Artificial Sequence
  chemically synthesized
ttgggagcttattggaaatg

SEQ ID NO: 225376 - DNA, 20 bp, Artificial Sequence
  chemically synthesized
acttgggagcttattggaaa

SEQ ID NO: 225377 - DNA, 20 bp, Artificial Sequence
  chemically synthesized
tgagagtctccatttccaat

SEQ ID NO: 225378 - DNA, 20 bp, Artificial Sequence
  chemically synthesized
agtaccacttgggagcttat

SEQ ID NO: 225379 - DNA, 20 bp, Artificial Sequence
  chemically synthesized
tccatttccaataagctccc

SEQ ID NO: 225380 - DNA, 20 bp, Artificial Sequence
  chemically synthesized
atttccaataagctcccaag

SEQ ID NO: 225381 - DNA, 20 bp, Artificial Sequence
  chemically synthesized
agagcagcagtaccacttgg

SEQ ID NO: 225382 - DNA, 20 bp, Artificial Sequence
  chemically synthesized
acagagcagcagtaccactt

SEQ ID NO: 225383 - DNA, 20 bp, Artificial Sequence
  chemically synthesized
cacagagcagcagtaccact

SEQ ID NO: 225384 - DNA, 20 bp, Artificial Sequence
  chemically synthesized
cagtggggtccacagagcag

SEQ ID NO: 225385 - DNA, 20 bp, Artificial Sequence
  chemically synthesized
caagtggtactgctgctctg

SEQ ID NO: 225386 - DNA, 20 bp, Artificial Sequence
  chemically synthesized
acacagtggggtccacagag

SEQ ID NO: 225387 - DNA, 20 bp, Artificial Sequence
  chemically synthesized
tacacacagtggggtccaca

SEQ ID NO: 225388 - DNA, 20 bp, Artificial Sequence
  chemically synthesized
gctacacacagtggggtcca

SEQ ID NO: 225389 - DNA, 20 bp, Artificial Sequence
  chemically synthesized
gatatttgctacacacagtg

SEQ ID NO: 225390 - DNA, 20 bp, Artificial Sequence
  chemically synthesized
tgatatttgctacacacagt

SEQ ID NO: 225391 - DNA, 20 bp, Artificial Sequence
  chemically synthesized
tctgtggaccccactgtgtg

SEQ ID NO: 225392 - DNA, 20 bp, Artificial Sequence
  chemically synthesized
ctgatatttgctacacacag

SEQ ID NO: 225393 - DNA, 20 bp, Artificial Sequence
  chemically synthesized
ccactgatatttgctacaca

SEQ ID NO: 225394 - DNA, 20 bp, Artificial Sequence
  chemically synthesized
ccactgtgtgtagcaaatat

SEQ ID NO: 225395 - DNA, 20 bp, Artificial Sequence
  chemically synthesized
ctgtgtgtagcaaatatcag

SEQ ID NO: 225396 - DNA, 20 bp, Artificial Sequence
  chemically synthesized
actatcatttggaagaataa

SEQ ID NO: 225397 - DNA, 20 bp, Artificial Sequence
  chemically synthesized
acaaattcactatcatttgg

SEQ ID NO: 225398 - DNA, 20 bp, Artificial Sequence
  chemically synthesized
actgttattcttccaaatga

SEQ ID NO: 225399 - DNA, 20 bp, Artificial Sequence
  chemically synthesized
gacacaaattcactatcatt

SEQ ID NO: 225400 - DNA, 20 bp, Artificial Sequence
  chemically synthesized
caccaaataaaaatggcaat

SEQ ID NO: 225401 - DNA, 20 bp, Artificial Sequence
  chemically synthesized
gcaccaaataaaaatggcaa

SEQ ID NO: 225402 - DNA, 20 bp, Artificial Sequence
  chemically synthesized
aaacatgcaccaaataaaaa

SEQ ID NO: 225403 - DNA, 20 bp, Artificial Sequence
  chemically synthesized
gtcctattgccatttttatt

SEQ ID NO: 225404 - DNA, 20 bp, Artificial Sequence
  chemically synthesized
atttggtgcatgttttccct

SEQ ID NO: 225405 - DNA, 20 bp, Artificial Sequence
  chemically synthesized
gacggttgggtagatactga

SEQ ID NO: 225406 - DNA, 20 bp, Artificial Sequence
  chemically synthesized
tgacggttgggtagatactg

SEQ ID NO: 225407 - DNA, 20 bp, Artificial Sequence
  chemically synthesized
ttgacggttgggtagatact

SEQ ID NO: 225408 - DNA, 20 bp, Artificial Sequence
  chemically synthesized
tctagtaattgacggttggg

SEQ ID NO: 225409 - DNA, 20 bp, Artificial Sequence
  chemically synthesized
gcatctagtaattgacggtt

SEQ ID NO: 225410 - DNA, 20 bp, Artificial Sequence
  chemically synthesized
agcatctagtaattgacggt

SEQ ID NO: 225411 - DNA, 20 bp, Artificial Sequence
  chemically synthesized
gacaagcatctagtaattga

SEQ ID NO: 225412 - DNA, 20 bp, Artificial Sequence
  chemically synthesized
tctacccaaccgtcaattac

SEQ ID NO: 225413 - DNA, 20 bp, Artificial Sequence
  chemically synthesized
acctgccgtagacaagcatc

SEQ ID NO: 225414 - DNA, 20 bp, Artificial Sequence
  chemically synthesized
aattactagatgcttgtcta

SEQ ID NO: 225415 - DNA, 20 bp, Artificial Sequence
  chemically synthesized
gcacatcacctgccgtagac

SEQ ID NO: 225416 - DNA, 20 bp, Artificial Sequence
  chemically synthesized
tactagatgcttgtctacgg

SEQ ID NO: 225417 - DNA, 20 bp, Artificial Sequence
  chemically synthesized
actagatgcttgtctacggc

SEQ ID NO: 225418 - DNA, 20 bp, Artificial Sequence
  chemically synthesized
gtcctgcacatcacctgccg

SEQ ID NO: 225419 - DNA, 20 bp, Artificial Sequence
  chemically synthesized
tgtctacggcaggtgatgtg

SEQ ID NO: 225420 - DNA, 20 bp, Artificial Sequence
  chemically synthesized
gtctacggcaggtgatgtgc

SEQ ID NO: 225421 - DNA, 20 bp, Artificial Sequence
  chemically synthesized
ggcaggtgatgtgcaggaca

SEQ ID NO: 225422 - DNA, 20 bp, Artificial Sequence
  chemically synthesized
tgcaggacatagatatttta

SEQ ID NO: 225423 - DNA, 20 bp, Artificial Sequence
  chemically synthesized
tagatattttaaagtttaca

SEQ ID NO: 225424 - DNA, 20 bp, Artificial Sequence
  chemically synthesized
caaagacattgccctgtcct

SEQ ID NO: 225425 - DNA, 20 bp, Artificial Sequence
  chemically synthesized
aaagacattgccctgtcctc

SEQ ID NO: 225426 - DNA, 20 bp, Artificial Sequence
  chemically synthesized
ttgaaagcttcctgaggaca

SEQ ID NO: 225427 - DNA, 20 bp, Artificial Sequence
  chemically synthesized
attgaaagcttcctgaggac

SEQ ID NO: 225428 - DNA, 20 bp, Artificial Sequence
  chemically synthesized
gattgaaagcttcctgagga

SEQ ID NO: 225429 - DNA, 20 bp, Artificial Sequence
  chemically synthesized
gacattgccctgtcctcagg

SEQ ID NO: 225430 - DNA, 20 bp, Artificial Sequence
  chemically synthesized
catagattgaaagcttcctg

SEQ ID NO: 225431 - DNA, 20 bp, Artificial Sequence
  chemically synthesized
acatagattgaaagcttcct

SEQ ID NO: 225432 - DNA, 20 bp, Artificial Sequence
  chemically synthesized
ttcattctcacatagattga

SEQ ID NO: 225433 - DNA, 20 bp, Artificial Sequence
  chemically synthesized
aggaagctttcaatctatgt

SEQ ID NO: 225434 - DNA, 20 bp, Artificial Sequence
  chemically synthesized
aagtgatcttcattctcaca

SEQ ID NO: 225435 - DNA, 20 bp, Artificial Sequence
  chemically synthesized
tttcaatctatgtgagaatg

SEQ ID NO: 225436 - DNA, 20 bp, Artificial Sequence
  chemically synthesized
tccaaactgtttgtagtggt

SEQ ID NO: 225437 - DNA, 20 bp, Artificial Sequence
  chemically synthesized
agatcacttaccactacaaa

SEQ ID NO: 225438 - DNA, 20 bp, Artificial Sequence
  chemically synthesized
catgtccaaactgtttgtag

SEQ ID NO: 225439 - DNA, 20 bp, Artificial Sequence
  chemically synthesized
ctccatgtccaaactgtttg

SEQ ID NO: 225440 - DNA, 20 bp, Artificial Sequence
  chemically synthesized
acttaccactacaaacagtt

SEQ ID NO: 225441 - DNA, 20 bp, Artificial Sequence
  chemically synthesized
cactacaaacagtttggaca

SEQ ID NO: 225442 - DNA, 20 bp, Artificial Sequence
  chemically synthesized
ctacaaacagtttggacatg

SEQ ID NO: 225443 - DNA, 20 bp, Artificial Sequence
  chemically synthesized
tacaaacagtttggacatgg

SEQ ID NO: 225444 - DNA, 20 bp, Artificial Sequence
  chemically synthesized
agtttggacatggaggacca

SEQ ID NO: 225445 - DNA, 20 bp, Artificial Sequence
  chemically synthesized
gcataaggggtaggtagctt

SEQ ID NO: 225446 - DNA, 20 bp, Artificial Sequence
  chemically synthesized
atgtgagcataaggggtagg

SEQ ID NO: 225447 - DNA, 20 bp, Artificial Sequence
  chemically synthesized
gctatgtgagcataaggggt

SEQ ID NO: 225448 - DNA, 20 bp, Artificial Sequence
  chemically synthesized
agctatgtgagcataagggg

SEQ ID NO: 225449 - DNA, 20 bp, Artificial Sequence
  chemically synthesized
gccagctatgtgagcataag

SEQ ID NO: 225450 - DNA, 20 bp, Artificial Sequence
  chemically synthesized
agccagctatgtgagcataa

SEQ ID NO: 225451 - DNA, 20 bp, Artificial Sequence
  chemically synthesized
cagccagctatgtgagcata

SEQ ID NO: 225452 - DNA, 20 bp, Artificial Sequence
  chemically synthesized
acagccagctatgtgagcat

SEQ ID NO: 225453 - DNA, 20 bp, Artificial Sequence
  chemically synthesized
acctaccccttatgctcaca

SEQ ID NO: 225454 - DNA, 20 bp, Artificial Sequence
  chemically synthesized
accccttatgctcacatagc

SEQ ID NO: 225455 - DNA, 20 bp, Artificial Sequence
  chemically synthesized
atgtcgacagccagctatgt

SEQ ID NO: 225456 - DNA, 20 bp, Artificial Sequence
  chemically synthesized
accatgttaatgtcgacagc

SEQ ID NO: 225457 - DNA, 20 bp, Artificial Sequence
  chemically synthesized
gtaaaccatgttaatgtcga

SEQ ID NO: 225458 - DNA, 20 bp, Artificial Sequence
  chemically synthesized
gctggctgtcgacattaaca

SEQ ID NO: 225459 - DNA, 20 bp, Artificial Sequence
  chemically synthesized
tgctaatgaagacaatggaa

SEQ ID NO: 225460 - DNA, 20 bp, Artificial Sequence
  chemically synthesized
atgctaatgaagacaatgga

SEQ ID NO: 225461 - DNA, 20 bp, Artificial Sequence
  chemically synthesized
agttatgctaatgaagacaa

SEQ ID NO: 225462 - DNA, 20 bp, Artificial Sequence
  chemically synthesized
tacctttccattgtcttcat

SEQ ID NO: 225463 - DNA, 20 bp, Artificial Sequence
  chemically synthesized
ataggaaagttatgctaatg

SEQ ID NO: 225464 - DNA, 20 bp, Artificial Sequence
  chemically synthesized
aagagttatctgtaatagga

SEQ ID NO: 225465 - DNA, 20 bp, Artificial Sequence
  chemically synthesized
ttagcataactttcctatta

SEQ ID NO: 225466 - DNA, 20 bp, Artificial Sequence
  chemically synthesized
ggccaagagttatctgtaat

SEQ ID NO: 225467 - DNA, 20 bp, Artificial Sequence
  chemically synthesized
tggccaagagttatctgtaa

SEQ ID NO: 225468 - DNA, 20 bp, Artificial Sequence
  chemically synthesized
ttcctattacagataactct

SEQ ID NO: 225469 - DNA, 20 bp, Artificial Sequence
  chemically synthesized
tattacagataactcttggc

SEQ ID NO: 225470 - DNA, 20 bp, Artificial Sequence
  chemically synthesized
attacagataactcttggcc

SEQ ID NO: 225471 - DNA, 20 bp, Artificial Sequence
  chemically synthesized
caaattatttgcctggccaa

SEQ ID NO: 225472 - DNA, 20 bp, Artificial Sequence
  chemically synthesized
gtcaaattatttgcctggcc

SEQ ID NO: 225473 - DNA, 20 bp, Artificial Sequence
  chemically synthesized
gaacagtcaaattatttgcc

SEQ ID NO: 225474 - DNA, 20 bp, Artificial Sequence
  chemically synthesized
aataatttgactgttcacta

SEQ ID NO: 225475 - DNA, 20 bp, Artificial Sequence
  chemically synthesized
ggggaagttactttagtgaa

SEQ ID NO: 225476 - DNA, 20 bp, Artificial Sequence
  chemically synthesized
ggagtttggggaagttactt

SEQ ID NO: 225477 - DNA, 20 bp, Artificial Sequence
  chemically synthesized
gagttgatgggagtttgggg

SEQ ID NO: 225478 - DNA, 20 bp, Artificial Sequence
  chemically synthesized
gaagagttgatgggagtttg

SEQ ID NO: 225479 - DNA, 20 bp, Artificial Sequence
  chemically synthesized
tgaagagttgatgggagttt

SEQ ID NO: 225480 - DNA, 20 bp, Artificial Sequence
  chemically synthesized
ttgaagagttgatgggagtt

SEQ ID NO: 225481 - DNA, 20 bp, Artificial Sequence
  chemically synthesized
ttttgttgaagagttgatgg

SEQ ID NO: 225482 - DNA, 20 bp, Artificial Sequence
  chemically synthesized
ttttttgttgaagagttgat

SEQ ID NO: 225483 - DNA, 20 bp, Artificial Sequence
  chemically synthesized
gttttttgttgaagagttga

SEQ ID NO: 225484 - DNA, 20 bp, Artificial Sequence
  chemically synthesized
tattgatgttttttgttgaa

SEQ ID NO: 225485 - DNA, 20 bp, Artificial Sequence
  chemically synthesized
tctattgatgttttttgttg

SEQ ID NO: 225486 - DNA, 20 bp, Artificial Sequence
  chemically synthesized
tcttcaacaaaaaacatcaa

SEQ ID NO: 225487 - DNA, 20 bp, Artificial Sequence
  chemically synthesized
ttcaacaaaaaacatcaata

SEQ ID NO: 225488 - DNA, 20 bp, Artificial Sequence
  chemically synthesized
caatagagttcacaccttaa

SEQ ID NO: 225489 - DNA, 20 bp, Artificial Sequence
  chemically synthesized
aagaggctcagagactatta

SEQ ID NO: 225490 - DNA, 20 bp, Artificial Sequence
  chemically synthesized
caagaggctcagagactatt

SEQ ID NO: 225491 - DNA, 20 bp, Artificial Sequence
  chemically synthesized
ttcacaccttaatagtctct

SEQ ID NO: 225492 - DNA, 20 bp, Artificial Sequence
  chemically synthesized
atttctagccaagaggctca

SEQ ID NO: 225493 - DNA, 20 bp, Artificial Sequence
  chemically synthesized
ttaatagtctctgagcctct

SEQ ID NO: 225494 - DNA, 20 bp, Artificial Sequence
  chemically synthesized
agatttctagccaagaggct

SEQ ID NO: 225495 - DNA, 20 bp, Artificial Sequence
  chemically synthesized
tagtctctgagcctcttggc

SEQ ID NO: 225496 - DNA, 20 bp, Artificial Sequence
  chemically synthesized
agtgaagatttctagccaag

SEQ ID NO: 225497 - DNA, 20 bp, Artificial Sequence
  chemically synthesized
cagtgaagatttctagccaa

SEQ ID NO: 225498 - DNA, 20 bp, Artificial Sequence
  chemically synthesized
cacagtgaagatttctagcc

SEQ ID NO: 225499 - DNA, 20 bp, Artificial Sequence
  chemically synthesized
aacagcacagtgaagatttc

SEQ ID NO: 225500 - DNA, 20 bp, Artificial Sequence
  chemically synthesized
ttggtggaaacagcacagtg

SEQ ID NO: 225501 - DNA, 20 bp, Artificial Sequence
  chemically synthesized
ttagtttggtggaaacagca

SEQ ID NO: 225502 - DNA, 20 bp, Artificial Sequence
  chemically synthesized
acaacttagtttggtggaaa

SEQ ID NO: 225503 - DNA, 20 bp, Artificial Sequence
  chemically synthesized
tgtgctgtttccaccaaact

SEQ ID NO: 225504 - DNA, 20 bp, Artificial Sequence
  chemically synthesized
ggtattacaacttagtttgg

SEQ ID NO: 225505 - DNA, 20 bp, Artificial Sequence
  chemically synthesized
catggtattacaacttagtt

SEQ ID NO: 225506 - DNA, 20 bp, Artificial Sequence
  chemically synthesized
aggatcatggtattacaact

SEQ ID NO: 225507 - DNA, 20 bp, Artificial Sequence
  chemically synthesized
ttaggattgggtaaggatca

SEQ ID NO: 225508 - DNA, 20 bp, Artificial Sequence
  chemically synthesized
ggcacaattaggattgggta

SEQ ID NO: 225509 - DNA, 20 bp, Artificial Sequence
  chemically synthesized
gggcacaattaggattgggt

SEQ ID NO: 225510 - DNA, 20 bp, Artificial Sequence
  chemically synthesized
gtgggggcacaattaggatt

SEQ ID NO: 225511 - DNA, 20 bp, Artificial Sequence
  chemically synthesized
tgtgggggcacaattaggat

SEQ ID NO: 225512 - DNA, 20 bp, Artificial Sequence
  chemically synthesized
ttcactgtgggggcacaatt

SEQ ID NO: 225513 - DNA, 20 bp, Artificial Sequence
  chemically synthesized
tttcactgtgggggcacaat

SEQ ID NO: 225514 - DNA, 20 bp, Artificial Sequence
  chemically synthesized
caatcctaattgtgccccca

SEQ ID NO: 225515 - DNA, 20 bp, Artificial Sequence
  chemically synthesized
agattggtctttcactgtgg

SEQ ID NO: 225516 - DNA, 20 bp, Artificial Sequence
  chemically synthesized
aagattggtctttcactgtg

SEQ ID NO: 225517 - DNA, 20 bp, Artificial Sequence
  chemically synthesized
taattgtgcccccacagtga

SEQ ID NO: 225518 - DNA, 20 bp, Artificial Sequence
  chemically synthesized
taagattggtctttcactgt

SEQ ID NO: 225519 - DNA, 20 bp, Artificial Sequence
  chemically synthesized
ttaagattggtctttcactg

SEQ ID NO: 225520 - DNA, 20 bp, Artificial Sequence
  chemically synthesized
tatgaagcttggtttaagat

SEQ ID NO: 225521 - DNA, 20 bp, Artificial Sequence
  chemically synthesized
tgaaagaccaatcttaaacc

SEQ ID NO: 225522 - DNA, 20 bp, Artificial Sequence
  chemically synthesized
gggagtatgaagcttggttt

SEQ ID NO: 225523 - DNA, 20 bp, Artificial Sequence
  chemically synthesized
ttcattgggagtatgaagct

SEQ ID NO: 225524 - DNA, 20 bp, Artificial Sequence
  chemically synthesized
tggatttcattgggagtatg

SEQ ID NO: 225525 - DNA, 20 bp, Artificial Sequence
  chemically synthesized
gtgaggttggatttcattgg

SEQ ID NO: 225526 - DNA, 20 bp, Artificial Sequence
  chemically synthesized
aggtgaggttggatttcatt

SEQ ID NO: 225527 - DNA, 20 bp, Artificial Sequence
  chemically synthesized
aaggtgaggttggatttcat

SEQ ID NO: 225528 - DNA, 20 bp, Artificial Sequence
  chemically synthesized
cataaggagaaaggtgaggt

SEQ ID NO: 225529 - DNA, 20 bp, Artificial Sequence
  chemically synthesized
atttcataaggagaaaggtg

SEQ ID NO: 225530 - DNA, 20 bp, Artificial Sequence
  chemically synthesized
tatttcataaggagaaaggt

SEQ ID NO: 225531 - DNA, 20 bp, Artificial Sequence
  chemically synthesized
gtagtatttcataaggagaa

SEQ ID NO: 225532 - DNA, 20 bp, Artificial Sequence
  chemically synthesized
ggtagtatttcataaggaga

SEQ ID NO: 225533 - DNA, 20 bp, Artificial Sequence
  chemically synthesized
ctttggtagtatttcataag

SEQ ID NO: 225534 - DNA, 20 bp, Artificial Sequence
  chemically synthesized
agctttggtagtatttcata

SEQ ID NO: 225535 - DNA, 20 bp, Artificial Sequence
  chemically synthesized
aagctttggtagtatttcat

SEQ ID NO: 225536 - DNA, 20 bp, Artificial Sequence
  chemically synthesized
ctccttatgaaatactacca

SEQ ID NO: 225537 - DNA, 20 bp, Artificial Sequence
  chemically synthesized
cagcctggacaaagctttgg

SEQ ID NO: 225538 - DNA, 20 bp, Artificial Sequence
  chemically synthesized
ccacagcctggacaaagctt

SEQ ID NO: 225539 - DNA, 20 bp, Artificial Sequence
  chemically synthesized
aatactaccaaagctttgtc

SEQ ID NO: 225540 - DNA, 20 bp, Artificial Sequence
  chemically synthesized
atactaccaaagctttgtcc

SEQ ID NO: 225541 - DNA, 20 bp, Artificial Sequence
  chemically synthesized
gaaagaccacagcctggaca

SEQ ID NO: 225542 - DNA, 20 bp, Artificial Sequence
  chemically synthesized
ccaaagctttgtccaggctg

SEQ ID NO: 225543 - DNA, 20 bp, Artificial Sequence
  chemically synthesized
tggtaagaaagaccacagcc

SEQ ID NO: 225544 - DNA, 20 bp, Artificial Sequence
  chemically synthesized
tactatggtaagaaagacca

SEQ ID NO: 225545 - DNA, 20 bp, Artificial Sequence
  chemically synthesized
tattgcttactatggtaaga

SEQ ID NO: 225546 - DNA, 20 bp, Artificial Sequence
  chemically synthesized
ggctgtggtctttcttacca

SEQ ID NO: 225547 - DNA, 20 bp, Artificial Sequence
  chemically synthesized
aatttattgcttactatggt

SEQ ID NO: 225548 - DNA, 20 bp, Artificial Sequence
  chemically synthesized
gtggtctttcttaccatagt

SEQ ID NO: 225549 - DNA, 20 bp, Artificial Sequence
  chemically synthesized
gttaaatttattgcttacta

SEQ ID NO: 225550 - DNA, 20 bp, Artificial Sequence
  chemically synthesized
tacaacctgttgataagaca

SEQ ID NO: 225551 - DNA, 20 bp, Artificial Sequence
  chemically synthesized
atttaactttgtcttatcaa

SEQ ID NO: 225552 - DNA, 20 bp, Artificial Sequence
  chemically synthesized
tttaactttgtcttatcaac

SEQ ID NO: 225553 - DNA, 20 bp, Artificial Sequence
  chemically synthesized
caccaatacaacctgttgat

SEQ ID NO: 225554 - DNA, 20 bp, Artificial Sequence
  chemically synthesized
gtcttatcaacaggttgtat

SEQ ID NO: 225555 - DNA, 20 bp, Artificial Sequence
  chemically synthesized
caggttgtattggtgatgtt

SEQ ID NO: 225556 - DNA, 20 bp, Artificial Sequence
  chemically synthesized
aggttgtattggtgatgttt

SEQ ID NO: 225557 - DNA, 20 bp, Artificial Sequence
  chemically synthesized
ggttgtattggtgatgttta

SEQ ID NO: 225558 - DNA, 20 bp, Artificial Sequence
  chemically synthesized
ttgtattggtgatgtttagg

SEQ ID NO: 225559 - DNA, 20 bp, Artificial Sequence
  chemically synthesized
ttcttccatatgggaaattt

SEQ ID NO: 225560 - DNA, 20 bp, Artificial Sequence
  chemically synthesized
gggagctgaaatttcccata

SEQ ID NO: 225561 - DNA, 20 bp, Artificial Sequence
  chemically synthesized
agctgaaatttcccatatgg

SEQ ID NO: 225562 - DNA, 20 bp, Artificial Sequence
  chemically synthesized
catgtctatttcttccatat

SEQ ID NO: 225563 - DNA, 20 bp, Artificial Sequence
  chemically synthesized
ccatgtctatttcttccata

SEQ ID NO: 225564 - DNA, 20 bp, Artificial Sequence
  chemically synthesized
aatttcccatatggaagaaa

SEQ ID NO: 225565 - DNA, 20 bp, Artificial Sequence
  chemically synthesized
ccatatggaagaaatagaca

SEQ ID NO: 225566 - DNA, 20 bp, Artificial Sequence
  chemically synthesized
catatggaagaaatagacat

SEQ ID NO: 225567 - DNA, 20 bp, Artificial Sequence
  chemically synthesized
gggaatcaaacgtatgttac

SEQ ID NO: 225568 - DNA, 20 bp, Artificial Sequence
  chemically synthesized
ggaatcaaacgtatgttaca

SEQ ID NO: 225569 - DNA, 20 bp, Artificial Sequence
  chemically synthesized
aatcaaacgtatgttacaag

SEQ ID NO: 225570 - DNA, 20 bp, Artificial Sequence
  chemically synthesized
aacgtatgttacaaggagat

SEQ ID NO: 225571 - DNA, 20 bp, Artificial Sequence
  chemically synthesized
gtatgttacaaggagataag

SEQ ID NO: 225572 - DNA, 20 bp, Artificial Sequence
  chemically synthesized
tgttacaaggagataagcag

SEQ ID NO: 225573 - DNA, 20 bp, Artificial Sequence
  chemically synthesized
aggagataagcagtggtgcc

SEQ ID NO: 225574 - DNA, 20 bp, Artificial Sequence
  chemically synthesized
ggagataagcagtggtgcca

SEQ ID NO: 225575 - DNA, 20 bp, Artificial Sequence
  chemically synthesized
gagataagcagtggtgccaa

SEQ ID NO: 225576 - DNA, 20 bp, Artificial Sequence
  chemically synthesized
agataagcagtggtgccaag

SEQ ID NO: 225577 - DNA, 20 bp, Artificial Sequence
  chemically synthesized
taagcagtggtgccaagggg

SEQ ID NO: 225578 - DNA, 20 bp, Artificial Sequence
  chemically synthesized
gagtcttttaatccacccct

SEQ ID NO: 225579 - DNA, 20 bp, Artificial Sequence
  chemically synthesized
ggtgccaaggggtggattaa

SEQ ID NO: 225580 - DNA, 20 bp, Artificial Sequence
  chemically synthesized
aggggtggattaaaagactc

SEQ ID NO: 225581 - DNA, 20 bp, Artificial Sequence
  chemically synthesized
ttatgacaaaaaaggagcta

SEQ ID NO: 225582 - DNA, 20 bp, Artificial Sequence
  chemically synthesized
tgttatgacaaaaaaggagc

SEQ ID NO: 225583 - DNA, 20 bp, Artificial Sequence
  chemically synthesized
tatttgttatgacaaaaaag

SEQ ID NO: 225584 - DNA, 20 bp, Artificial Sequence
  chemically synthesized
tttatttgttatgacaaaaa

SEQ ID NO: 225585 - DNA, 20 bp, Artificial Sequence
  chemically synthesized
gtttatttgttatgacaaaa

SEQ ID NO: 225586 - DNA, 20 bp, Artificial Sequence
  chemically synthesized
tgtactgattataattaaat

SEQ ID NO: 225587 - DNA, 20 bp, Artificial Sequence
  chemically synthesized
acatccaatttaattataat

SEQ ID NO: 225588 - DNA, 20 bp, Artificial Sequence
  chemically synthesized
gttgttaaactaagtttgca

SEQ ID NO: 225589 - DNA, 20 bp, Artificial Sequence
  chemically synthesized
acattttttctctgcaaact

SEQ ID NO: 225590 - DNA, 20 bp, Artificial Sequence
  chemically synthesized
ttgttgttaaactaagtttg

SEQ ID NO: 225591 - DNA, 20 bp, Artificial Sequence
  chemically synthesized
aggggacttgttgttaaact

SEQ ID NO: 225592 - DNA, 20 bp, Artificial Sequence
  chemically synthesized
tgcaaacttagtttaacaac

SEQ ID NO: 225593 - DNA, 20 bp, Artificial Sequence
  chemically synthesized
agtaaataagaggagaatag

SEQ ID NO: 225594 - DNA, 20 bp, Artificial Sequence
  chemically synthesized
gagtaaataagaggagaata

SEQ ID NO: 225595 - DNA, 20 bp, Artificial Sequence
  chemically synthesized
tgagtaaataagaggagaat

SEQ ID NO: 225596 - DNA, 20 bp, Artificial Sequence
  chemically synthesized
gtgagtaaataagaggagaa

SEQ ID NO: 225597 - DNA, 20 bp, Artificial Sequence
  chemically synthesized
cctgggtgagtaaataagag

SEQ ID NO: 225598 - DNA, 20 bp, Artificial Sequence
  chemically synthesized
tgcctgggtgagtaaataag

SEQ ID NO: 225599 - DNA, 20 bp, Artificial Sequence
  chemically synthesized
atgcctgggtgagtaaataa

SEQ ID NO: 225600 - DNA, 20 bp, Artificial Sequence
  chemically synthesized
aaatgcctgggtgagtaaat

SEQ ID NO: 225601 - DNA, 20 bp, Artificial Sequence
  chemically synthesized
tctcctcttatttactcacc

SEQ ID NO: 225602 - DNA, 20 bp, Artificial Sequence
  chemically synthesized
ctcctcttatttactcaccc

SEQ ID NO: 225603 - DNA, 20 bp, Artificial Sequence
  chemically synthesized
taacatccaaatgcctgggt

SEQ ID NO: 225604 - DNA, 20 bp, Artificial Sequence
  chemically synthesized
tatttactcacccaggcatt

SEQ ID NO: 225605 - DNA, 20 bp, Artificial Sequence
  chemically synthesized
gtgataacatccaaatgcct

SEQ ID NO: 225606 - DNA, 20 bp, Artificial Sequence
  chemically synthesized
agtgataacatccaaatgcc

SEQ ID NO: 225607 - DNA, 20 bp, Artificial Sequence
  chemically synthesized
aggcatttggatgttatcac

SEQ ID NO: 225608 - DNA, 20 bp, Artificial Sequence
  chemically synthesized
atcacaatcaatgatggcac

SEQ ID NO: 225609 - DNA, 20 bp, Artificial Sequence
  chemically synthesized
tattttatcacaatcaatga

SEQ ID NO: 225610 - DNA, 20 bp, Artificial Sequence
  chemically synthesized
attgtgataaaatatttgat

SEQ ID NO: 225611 - DNA, 20 bp, Artificial Sequence
  chemically synthesized
atactgttaatgaagcattg

SEQ ID NO: 225612 - DNA, 20 bp, Artificial Sequence
  chemically synthesized
tatactgttaatgaagcatt

SEQ ID NO: 225613 - DNA, 20 bp, Artificial Sequence
  chemically synthesized
tgtcctcaatgcttcattaa

SEQ ID NO: 225614 - DNA, 20 bp, Artificial Sequence
  chemically synthesized
catgtattatactgttaatg

SEQ ID NO: 225615 - DNA, 20 bp, Artificial Sequence
  chemically synthesized
tcattaacagtataatacat

SEQ ID NO: 225616 - DNA, 20 bp, Artificial Sequence
  chemically synthesized
attaacagtataatacatga

SEQ ID NO: 225617 - DNA, 20 bp, Artificial Sequence
  chemically synthesized
acatgagagtgacattaacc

SEQ ID NO: 225618 - DNA, 20 bp, Artificial Sequence
  chemically synthesized
gagtgacattaaccaagatt

SEQ ID NO: 225619 - DNA, 20 bp, Artificial Sequence
  chemically synthesized
agtgacattaaccaagatta

SEQ ID NO: 225620 - DNA, 20 bp, Artificial Sequence
  chemically synthesized
gtgacattaaccaagattaa

SEQ ID NO: 225621 - DNA, 20 bp, Artificial Sequence
  chemically synthesized
ttccccttctcccttaatct

SEQ ID NO: 225622 - DNA, 20 bp, Artificial Sequence
  chemically synthesized
gacattaaccaagattaagg

SEQ ID NO: 225623 - DNA, 20 bp, Artificial Sequence
  chemically synthesized
attaaccaagattaagggag

SEQ ID NO: 225624 - DNA, 20 bp, Artificial Sequence
  chemically synthesized
ttaaccaagattaagggaga

SEQ ID NO: 225625 - DNA, 20 bp, Artificial Sequence
  chemically synthesized
taaccaagattaagggagaa

SEQ ID NO: 225626 - DNA, 20 bp, Artificial Sequence
  chemically synthesized
aaccaagattaagggagaag

SEQ ID NO: 225627 - DNA, 20 bp, Artificial Sequence
  chemically synthesized
agggagaaggggaaatcttt

SEQ ID NO: 225628 - DNA, 20 bp, Artificial Sequence
  chemically synthesized
gagaaggggaaatcttttgg

SEQ ID NO: 225629 - DNA, 20 bp, Artificial Sequence
  chemically synthesized
tttgacatcacaaccaccaa

SEQ ID NO: 225630 - DNA, 20 bp, Artificial Sequence
  chemically synthesized
ctgggcctccatgtagtttt

SEQ ID NO: 225631 - DNA, 20 bp, Artificial Sequence
  chemically synthesized
tctgggcctccatgtagttt

SEQ ID NO: 225632 - DNA, 20 bp, Artificial Sequence
  chemically synthesized
atgtcaaacctaaaactaca

SEQ ID NO: 225633 - DNA, 20 bp, Artificial Sequence
  chemically synthesized
gtcaaacctaaaactacatg

SEQ ID NO: 225634 - DNA, 20 bp, Artificial Sequence
  chemically synthesized
tcaaacctaaaactacatgg

SEQ ID NO: 225635 - DNA, 20 bp, Artificial Sequence
  chemically synthesized
cctaattctgggcctccatg

SEQ ID NO: 225636 - DNA, 20 bp, Artificial Sequence
  chemically synthesized
cctaaaactacatggaggcc

SEQ ID NO: 225637 - DNA, 20 bp, Artificial Sequence
  chemically synthesized
actacatggaggcccagaat

SEQ ID NO: 225638 - DNA, 20 bp, Artificial Sequence
  chemically synthesized
ctacatggaggcccagaatt

SEQ ID NO: 225639 - DNA, 20 bp, Artificial Sequence
  chemically synthesized
tacatggaggcccagaatta

SEQ ID NO: 225640 - DNA, 20 bp, Artificial Sequence
  chemically synthesized
gctgaattttccctaattct

SEQ ID NO: 225641 - DNA, 20 bp, Artificial Sequence
  chemically synthesized
tgctgaattttccctaattc

SEQ ID NO: 225642 - DNA, 20 bp, Artificial Sequence
  chemically synthesized
gcccagaattagggaaaatt

SEQ ID NO: 225643 - DNA, 20 bp, Artificial Sequence
  chemically synthesized
attagggaaaattcagcatc

SEQ ID NO: 225644 - DNA, 20 bp, Artificial Sequence
  chemically synthesized
gggaaaattcagcatccaga

SEQ ID NO: 225645 - DNA, 20 bp, Artificial Sequence
  chemically synthesized
gtgatcttacattgtctgtc

SEQ ID NO: 225646 - DNA, 20 bp, Artificial Sequence
  chemically synthesized
agcatccagacagacaatgt

SEQ ID NO: 225647 - DNA, 20 bp, Artificial Sequence
  chemically synthesized
agacagacaatgtaagatca

SEQ ID NO: 225648 - DNA, 20 bp, Artificial Sequence
  chemically synthesized
atgtaagatcacggtatttt

SEQ ID NO: 225649 - DNA, 20 bp, Artificial Sequence
  chemically synthesized
tgtaagatcacggtattttc

SEQ ID NO: 225650 - DNA, 20 bp, Artificial Sequence
  chemically synthesized
gtaagatcacggtattttca

SEQ ID NO: 225651 - DNA, 20 bp, Artificial Sequence
  chemically synthesized
tttcagggaaaaacatgaac

SEQ ID NO: 225652 - DNA, 20 bp, Artificial Sequence
  chemically synthesized
tcagggaaaaacatgaaccg

SEQ ID NO: 225653 - DNA, 20 bp, Artificial Sequence
  chemically synthesized
aaaaacatgaaccggagcaa

SEQ ID NO: 225654 - DNA, 20 bp, Artificial Sequence
  chemically synthesized
cccattttgagcttttgctc

SEQ ID NO: 225655 - DNA, 20 bp, Artificial Sequence
  chemically synthesized
accggagcaaaagctcaaaa

SEQ ID NO: 225656 - DNA, 20 bp, Artificial Sequence
  chemically synthesized
ccggagcaaaagctcaaaat

SEQ ID NO: 225657 - DNA, 20 bp, Artificial Sequence
  chemically synthesized
cggagcaaaagctcaaaatg

SEQ ID NO: 225658 - DNA, 20 bp, Artificial Sequence
  chemically synthesized
tctcgctctttccccatttt

SEQ ID NO: 225659 - DNA, 20 bp, Artificial Sequence
  chemically synthesized
gcaaaagctcaaaatgggga

SEQ ID NO: 225660 - DNA, 20 bp, Artificial Sequence
  chemically synthesized
aaaagctcaaaatggggaaa

SEQ ID NO: 225661 - DNA, 20 bp, Artificial Sequence
  chemically synthesized
gctcaaaatggggaaagagc

SEQ ID NO: 225662 - DNA, 20 bp, Artificial Sequence
  chemically synthesized
tcaaaatggggaaagagcga

SEQ ID NO: 225663 - DNA, 20 bp, Artificial Sequence
  chemically synthesized
aaaatggggaaagagcgaga

SEQ ID NO: 225664 - DNA, 20 bp, Artificial Sequence
  chemically synthesized
gaaagagcgagagagaaact

SEQ ID NO: 225665 - DNA, 20 bp, Artificial Sequence
  chemically synthesized
aaagagcgagagagaaacta

SEQ ID NO: 225666 - DNA, 20 bp, Artificial Sequence
  chemically synthesized
aagagcgagagagaaactaa

SEQ ID NO: 225667 - DNA, 20 bp, Artificial Sequence
  chemically synthesized
taaaagactgtttagaccct

SEQ ID NO: 225668 - DNA, 20 bp, Artificial Sequence
  chemically synthesized
agagaaactaagggtctaaa

SEQ ID NO: 225669 - DNA, 20 bp, Artificial Sequence
  chemically synthesized
acttgacataaaagactgtt

SEQ ID NO: 225670 - DNA, 20 bp, Artificial Sequence
  chemically synthesized
tctaaacagtcttttatgtc

SEQ ID NO: 225671 - DNA, 20 bp, Artificial Sequence
  chemically synthesized
agccacttaacttgacataa

SEQ ID NO: 225672 - DNA, 20 bp, Artificial Sequence
  chemically synthesized
acagtcttttatgtcaagtt

SEQ ID NO: 225673 - DNA, 20 bp, Artificial Sequence
  chemically synthesized
gtcttttatgtcaagttaag

SEQ ID NO: 225674 - DNA, 20 bp, Artificial Sequence
  chemically synthesized
actttgggtagcaaagacat

SEQ ID NO: 225675 - DNA, 20 bp, Artificial Sequence
  chemically synthesized
agaccatactttgggtagca

SEQ ID NO: 225676 - DNA, 20 bp, Artificial Sequence
  chemically synthesized
gcttatgtctttgctaccca

SEQ ID NO: 225677 - DNA, 20 bp, Artificial Sequence
  chemically synthesized
cctgcagaccatactttggg

SEQ ID NO: 225678 - DNA, 20 bp, Artificial Sequence
  chemically synthesized
tgtctttgctacccaaagta

SEQ ID NO: 225679 - DNA, 20 bp, Artificial Sequence
  chemically synthesized
tggcctgcagaccatacttt

SEQ ID NO: 225680 - DNA, 20 bp, Artificial Sequence
  chemically synthesized
ttggcctgcagaccatactt

SEQ ID NO: 225681 - DNA, 20 bp, Artificial Sequence
  chemically synthesized
gctacccaaagtatggtctg

SEQ ID NO: 225682 - DNA, 20 bp, Artificial Sequence
  chemically synthesized
ctacccaaagtatggtctgc

SEQ ID NO: 225683 - DNA, 20 bp, Artificial Sequence
  chemically synthesized
atagcaatgattttggcctg

SEQ ID NO: 225684 - DNA, 20 bp, Artificial Sequence
  chemically synthesized
cagggttatagcaatgattt

SEQ ID NO: 225685 - DNA, 20 bp, Artificial Sequence
  chemically synthesized
aaaatcattgctataaccct

SEQ ID NO: 225686 - DNA, 20 bp, Artificial Sequence
  chemically synthesized
ctagcaagtgctcagggtta

SEQ ID NO: 225687 - DNA, 20 bp, Artificial Sequence
  chemically synthesized
gcatttctagcaagtgctca

SEQ ID NO: 225688 - DNA, 20 bp, Artificial Sequence
  chemically synthesized
tgcatttctagcaagtgctc

SEQ ID NO: 225689 - DNA, 20 bp, Artificial Sequence
  chemically synthesized
ctgcatttctagcaagtgct

SEQ ID NO: 225690 - DNA, 20 bp, Artificial Sequence
  chemically synthesized
ctataaccctgagcacttgc

SEQ ID NO: 225691 - DNA, 20 bp, Artificial Sequence
  chemically synthesized
tgagattctgcatttctagc

SEQ ID NO: 225692 - DNA, 20 bp, Artificial Sequence
  chemically synthesized
ctgagcacttgctagaaatg

SEQ ID NO: 225693 - DNA, 20 bp, Artificial Sequence
  chemically synthesized
tgtctgagattctgcatttc

SEQ ID NO: 225694 - DNA, 20 bp, Artificial Sequence
  chemically synthesized
ttgctagaaatgcagaatct

SEQ ID NO: 225695 - DNA, 20 bp, Artificial Sequence
  chemically synthesized
gtaggtctggggtattgtct

SEQ ID NO: 225696 - DNA, 20 bp, Artificial Sequence
  chemically synthesized
cagaatctcagacaataccc

SEQ ID NO: 225697 - DNA, 20 bp, Artificial Sequence
  chemically synthesized
atgctgattcagtaggtctg

SEQ ID NO: 225698 - DNA, 20 bp, Artificial Sequence
  chemically synthesized
gatgctgattcagtaggtct

SEQ ID NO: 225699 - DNA, 20 bp, Artificial Sequence
  chemically synthesized
tgatgctgattcagtaggtc

SEQ ID NO: 225700 - DNA, 20 bp, Artificial Sequence
  chemically synthesized
ataccccagacctactgaat

SEQ ID NO: 225701 - DNA, 20 bp, Artificial Sequence
  chemically synthesized
ttaactgatgctgattcagt

SEQ ID NO: 225702 - DNA, 20 bp, Artificial Sequence
  chemically synthesized
attaactgatgctgattcag

SEQ ID NO: 225703 - DNA, 20 bp, Artificial Sequence
  chemically synthesized
ttaattaactgatgctgatt

SEQ ID NO: 225704 - DNA, 20 bp, Artificial Sequence
  chemically synthesized
cagacctactgaatcagcat

SEQ ID NO: 225705 - DNA, 20 bp, Artificial Sequence
  chemically synthesized
tgaatcagcatcagttaatt

SEQ ID NO: 225706 - DNA, 20 bp, Artificial Sequence
  chemically synthesized
cagttaattaagaaaatccc

SEQ ID NO: 225707 - DNA, 20 bp, Artificial Sequence
  chemically synthesized
agttaattaagaaaatcccc

SEQ ID NO: 225708 - DNA, 20 bp, Artificial Sequence
  chemically synthesized
atgtgcatcagaatcacctg

SEQ ID NO: 225709 - DNA, 20 bp, Artificial Sequence
  chemically synthesized
gatgtgcatcagaatcacct

SEQ ID NO: 225710 - DNA, 20 bp, Artificial Sequence
  chemically synthesized
tgatgtgcatcagaatcacc

SEQ ID NO: 225711 - DNA, 20 bp, Artificial Sequence
  chemically synthesized
tctcaaactttgatgtgcat

SEQ ID NO: 225712 - DNA, 20 bp, Artificial Sequence
  chemically synthesized
ggtgattctgatgcacatca

SEQ ID NO: 225713 - DNA, 20 bp, Artificial Sequence
  chemically synthesized
tctgatgcacatcaaagttt

SEQ ID NO: 225714 - DNA, 20 bp, Artificial Sequence
  chemically synthesized
gatgcacatcaaagtttgag

SEQ ID NO: 225715 - DNA, 20 bp, Artificial Sequence
  chemically synthesized
ctccagcatattattttgaa

SEQ ID NO: 225716 - DNA, 20 bp, Artificial Sequence
  chemically synthesized
cactattcaaaataatatgc

SEQ ID NO: 225717 - DNA, 20 bp, Artificial Sequence
  chemically synthesized
ctattcaaaataatatgctg

SEQ ID NO: 225718 - DNA, 20 bp, Artificial Sequence
  chemically synthesized
tattcaaaataatatgctgg

SEQ ID NO: 225719 - DNA, 20 bp, Artificial Sequence
  chemically synthesized
aaataatatgctggaggcta

SEQ ID NO: 225720 - DNA, 20 bp, Artificial Sequence
  chemically synthesized
cagtagcttcccgtagcctc

SEQ ID NO: 225721 - DNA, 20 bp, Artificial Sequence
  chemically synthesized
aataatatgctggaggctac

SEQ ID NO: 225722 - DNA, 20 bp, Artificial Sequence
  chemically synthesized
aatatgctggaggctacggg

SEQ ID NO: 225723 - DNA, 20 bp, Artificial Sequence
  chemically synthesized
aatccttcagtagcttcccg

SEQ ID NO: 225724 - DNA, 20 bp, Artificial Sequence
  chemically synthesized
gaggctacgggaagctactg

SEQ ID NO: 225725 - DNA, 20 bp, Artificial Sequence
  chemically synthesized
aggctacgggaagctactga

SEQ ID NO: 225726 - DNA, 20 bp, Artificial Sequence
  chemically synthesized
cccttcttaaaatccttcag

SEQ ID NO: 225727 - DNA, 20 bp, Artificial Sequence
  chemically synthesized
cttcccttcttaaaatcctt

SEQ ID NO: 225728 - DNA, 20 bp, Artificial Sequence
  chemically synthesized
ggaagctactgaaggatttt

SEQ ID NO: 225729 - DNA, 20 bp, Artificial Sequence
  chemically synthesized
agctactgaaggattttaag

SEQ ID NO: 225730 - DNA, 20 bp, Artificial Sequence
  chemically synthesized
gctactgaaggattttaaga

SEQ ID NO: 225731 - DNA, 20 bp, Artificial Sequence
  chemically synthesized
ctactgaaggattttaagaa

SEQ ID NO: 225732 - DNA, 20 bp, Artificial Sequence
  chemically synthesized
ctgaaggattttaagaaggg

SEQ ID NO: 225733 - DNA, 20 bp, Artificial Sequence
  chemically synthesized
acataattgaatttgcattt

SEQ ID NO: 225734 - DNA, 20 bp, Artificial Sequence
  chemically synthesized
tgaaggaatgaatggacaca

SEQ ID NO: 225735 - DNA, 20 bp, Artificial Sequence
  chemically synthesized
cctgaaggaatgaatggaca

SEQ ID NO: 225736 - DNA, 20 bp, Artificial Sequence
  chemically synthesized
atatatcctgaaggaatgaa

SEQ ID NO: 225737 - DNA, 20 bp, Artificial Sequence
  chemically synthesized
tctgtgtccattcattcctt

SEQ ID NO: 225738 - DNA, 20 bp, Artificial Sequence
  chemically synthesized
ctgtgtccattcattccttc

SEQ ID NO: 225739 - DNA, 20 bp, Artificial Sequence
  chemically synthesized
gcttggcatatatatcctga

SEQ ID NO: 225740 - DNA, 20 bp, Artificial Sequence
  chemically synthesized
tgcttggcatatatatcctg

SEQ ID NO: 225741 - DNA, 20 bp, Artificial Sequence
  chemically synthesized
tccttcaggatatatatgcc

SEQ ID NO: 225742 - DNA, 20 bp, Artificial Sequence
  chemically synthesized
ccagctctaaggtcaatgct

SEQ ID NO: 225743 - DNA, 20 bp, Artificial Sequence
  chemically synthesized
tatatgccaagcattgacct

SEQ ID NO: 225744 - DNA, 20 bp, Artificial Sequence
  chemically synthesized
tatgccaagcattgacctta

SEQ ID NO: 225745 - DNA, 20 bp, Artificial Sequence
  chemically synthesized
ccaagcattgaccttagagc

SEQ ID NO: 225746 - DNA, 20 bp, Artificial Sequence
  chemically synthesized
gtgctgaatttccagctcta

SEQ ID NO: 225747 - DNA, 20 bp, Artificial Sequence
  chemically synthesized
agtgctgaatttccagctct

SEQ ID NO: 225748 - DNA, 20 bp, Artificial Sequence
  chemically synthesized
tgaccttagagctggaaatt

SEQ ID NO: 225749 - DNA, 20 bp, Artificial Sequence
  chemically synthesized
tcaaaatagtgctgaatttc

SEQ ID NO: 225750 - DNA, 20 bp, Artificial Sequence
  chemically synthesized
tggaaattcagcactatttt

SEQ ID NO: 225751 - DNA, 20 bp, Artificial Sequence
  chemically synthesized
aaattcagcactattttgag

SEQ ID NO: 225752 - DNA, 20 bp, Artificial Sequence
  chemically synthesized
ttcagctaatccactcaaaa

SEQ ID NO: 225753 - DNA, 20 bp, Artificial Sequence
  chemically synthesized
cagcactattttgagtggat

SEQ ID NO: 225754 - DNA, 20 bp, Artificial Sequence
  chemically synthesized
gaatactgaatagggagttt

SEQ ID NO: 225755 - DNA, 20 bp, Artificial Sequence
  chemically synthesized
attagctgaaactccctatt

SEQ ID NO: 225756 - DNA, 20 bp, Artificial Sequence
  chemically synthesized
ttgaatgaatactgaatagg

SEQ ID NO: 225757 - DNA, 20 bp, Artificial Sequence
  chemically synthesized
cattgaatgaatactgaata

SEQ ID NO: 225758 - DNA, 20 bp, Artificial Sequence
  chemically synthesized
tcattgaatgaatactgaat

SEQ ID NO: 225759 - DNA, 20 bp, Artificial Sequence
  chemically synthesized
ttcattgaatgaatactgaa

SEQ ID NO: 225760 - DNA, 20 bp, Artificial Sequence
  chemically synthesized
catttattgcattccaactt

SEQ ID NO: 225761 - DNA, 20 bp, Artificial Sequence
  chemically synthesized
aaaaaaaaaaaaaccaaagt

SEQ ID NO: 225762 - DNA, 20 bp, Artificial Sequence
  chemically synthesized
aacaaaaaaaaaaaaaacca

SEQ ID NO: 225763 - DNA, 20 bp, Artificial Sequence
  chemically synthesized
gtttgttttttgcttttttg

SEQ ID NO: 225764 - DNA, 20 bp, Artificial Sequence
  chemically synthesized
gtgagaccctgtcttcaaaa

SEQ ID NO: 225765 - DNA, 20 bp, Artificial Sequence
  chemically synthesized
gttttttgcttttttgaaga

SEQ ID NO: 225766 - DNA, 20 bp, Artificial Sequence
  chemically synthesized
ttttttgcttttttgaagac

SEQ ID NO: 225767 - DNA, 20 bp, Artificial Sequence
  chemically synthesized
tttttgcttttttgaagaca

SEQ ID NO: 225768 - DNA, 20 bp, Artificial Sequence
  chemically synthesized
tccagcccacatgacagagt

SEQ ID NO: 225769 - DNA, 20 bp, Artificial Sequence
  chemically synthesized
cagggtctcactctgtcatg

SEQ ID NO: 225770 - DNA, 20 bp, Artificial Sequence
  chemically synthesized
gcactccagcccacatgaca

SEQ ID NO: 225771 - DNA, 20 bp, Artificial Sequence
  chemically synthesized
agggtctcactctgtcatgt

SEQ ID NO: 225772 - DNA, 20 bp, Artificial Sequence
  chemically synthesized
ctgcactccagcccacatga

SEQ ID NO: 225773 - DNA, 20 bp, Artificial Sequence
  chemically synthesized
tctcactctgtcatgtgggc

SEQ ID NO: 225774 - DNA, 20 bp, Artificial Sequence
  chemically synthesized
tcactctgtcatgtgggctg

SEQ ID NO: 225775 - DNA, 20 bp, Artificial Sequence
  chemically synthesized
ctgtcatgtgggctggagtg

SEQ ID NO: 225776 - DNA, 20 bp, Artificial Sequence
  chemically synthesized
gggatcatgccactgcactc

SEQ ID NO: 225777 - DNA, 20 bp, Artificial Sequence
  chemically synthesized
tcatgtgggctggagtgcag

SEQ ID NO: 225778 - DNA, 20 bp, Artificial Sequence
  chemically synthesized
ggagtgcagtggcatgatcc

SEQ ID NO: 225779 - DNA, 20 bp, Artificial Sequence
  chemically synthesized
ggcagaggttgcagtgagcc

SEQ ID NO: 225780 - DNA, 20 bp, Artificial Sequence
  chemically synthesized
aggcagaggttgcagtgagc

SEQ ID NO: 225781 - DNA, 20 bp, Artificial Sequence
  chemically synthesized
cgggaggcagaggttgcagt

SEQ ID NO: 225782 - DNA, 20 bp, Artificial Sequence
  chemically synthesized
aactcgggaggcagaggttg

SEQ ID NO: 225783 - DNA, 20 bp, Artificial Sequence
  chemically synthesized
cacttgaactcgggaggcag

SEQ ID NO: 225784 - DNA, 20 bp, Artificial Sequence
  chemically synthesized
tcacttgaactcgggaggca

SEQ ID NO: 225785 - DNA, 20 bp, Artificial Sequence
  chemically synthesized
cactgcaacctctgcctccc

SEQ ID NO: 225786 - DNA, 20 bp, Artificial Sequence
  chemically synthesized
aatcacttgaactcgggagg

SEQ ID NO: 225787 - DNA, 20 bp, Artificial Sequence
  chemically synthesized
gagaatcacttgaactcggg

SEQ ID NO: 225788 - DNA, 20 bp, Artificial Sequence
  chemically synthesized
cgagaatcacttgaactcgg

SEQ ID NO: 225789 - DNA, 20 bp, Artificial Sequence
  chemically synthesized
aacctctgcctcccgagttc

SEQ ID NO: 225790 - DNA, 20 bp, Artificial Sequence
  chemically synthesized
cacgagaatcacttgaactc

SEQ ID NO: 225791 - DNA, 20 bp, Artificial Sequence
  chemically synthesized
gcacgagaatcacttgaact

SEQ ID NO: 225792 - DNA, 20 bp, Artificial Sequence
  chemically synthesized
ttcaagtgattctcgtgcct

SEQ ID NO: 225793 - DNA, 20 bp, Artificial Sequence
  chemically synthesized
tcaagtgattctcgtgcctc

SEQ ID NO: 225794 - DNA, 20 bp, Artificial Sequence
  chemically synthesized
tactcaggagcctgaggcac

SEQ ID NO: 225795 - DNA, 20 bp, Artificial Sequence
  chemically synthesized
cccagctactcaggagcctg

SEQ ID NO: 225796 - DNA, 20 bp, Artificial Sequence
  chemically synthesized
tcccagctactcaggagcct

SEQ ID NO: 225797 - DNA, 20 bp, Artificial Sequence
  chemically synthesized
ttctcgtgcctcaggctcct

SEQ ID NO: 225798 - DNA, 20 bp, Artificial Sequence
  chemically synthesized
tcgtgcctcaggctcctgag

SEQ ID NO: 225799 - DNA, 20 bp, Artificial Sequence
  chemically synthesized
ttgtaatcccagctactcag

SEQ ID NO: 225800 - DNA, 20 bp, Artificial Sequence
  chemically synthesized
gcctcaggctcctgagtagc

SEQ ID NO: 225801 - DNA, 20 bp, Artificial Sequence
  chemically synthesized
gcttgtaatcccagctactc

SEQ ID NO: 225802 - DNA, 20 bp, Artificial Sequence
  chemically synthesized
cctcaggctcctgagtagct

SEQ ID NO: 225803 - DNA, 20 bp, Artificial Sequence
  chemically synthesized
tgcttgtaatcccagctact

SEQ ID NO: 225804 - DNA, 20 bp, Artificial Sequence
  chemically synthesized
tcctgagtagctgggattac

SEQ ID NO: 225805 - DNA, 20 bp, Artificial Sequence
  chemically synthesized
gtggtgcatgcttgtaatcc

SEQ ID NO: 225806 - DNA, 20 bp, Artificial Sequence
  chemically synthesized
attacaagcatgcaccacaa

SEQ ID NO: 225807 - DNA, 20 bp, Artificial Sequence
  chemically synthesized
caagcatgcaccacaaaagc

SEQ ID NO: 225808 - DNA, 20 bp, Artificial Sequence
  chemically synthesized
caaaaattagctggcttttg

SEQ ID NO: 225809 - DNA, 20 bp, Artificial Sequence
  chemically synthesized
ctaaaaatacaaaaattagc

SEQ ID NO: 225810 - DNA, 20 bp, Artificial Sequence
  chemically synthesized
tctactaaaaatacaaaaat

SEQ ID NO: 225811 - DNA, 20 bp, Artificial Sequence
  chemically synthesized
ccagctaatttttgtatttt

SEQ ID NO: 225812 - DNA, 20 bp, Artificial Sequence
  chemically synthesized
gctaatttttgtatttttag

SEQ ID NO: 225813 - DNA, 20 bp, Artificial Sequence
  chemically synthesized
taatttttgtatttttagta

SEQ ID NO: 225814 - DNA, 20 bp, Artificial Sequence
  chemically synthesized
ttttgtatttttagtagaga

SEQ ID NO: 225815 - DNA, 20 bp, Artificial Sequence
  chemically synthesized
tttgtatttttagtagagat

SEQ ID NO: 225816 - DNA, 20 bp, Artificial Sequence
  chemically synthesized
ttgtatttttagtagagatg

SEQ ID NO: 225817 - DNA, 20 bp, Artificial Sequence
  chemically synthesized
tgtatttttagtagagatgg

SEQ ID NO: 225818 - DNA, 20 bp, Artificial Sequence
  chemically synthesized
agatgggggttttaccacgt

SEQ ID NO: 225819 - DNA, 20 bp, Artificial Sequence
  chemically synthesized
gggggttttaccacgttggc

SEQ ID NO: 225820 - DNA, 20 bp, Artificial Sequence
  chemically synthesized
cgagaccagcctggccaacg

SEQ ID NO: 225821 - DNA, 20 bp, Artificial Sequence
  chemically synthesized
ggggttttaccacgttggcc

SEQ ID NO: 225822 - DNA, 20 bp, Artificial Sequence
  chemically synthesized
ttttaccacgttggccaggc

SEQ ID NO: 225823 - DNA, 20 bp, Artificial Sequence
  chemically synthesized
tcaggagttcgagaccagcc

SEQ ID NO: 225824 - DNA, 20 bp, Artificial Sequence
  chemically synthesized
tgaggtcaggagttcgagac

SEQ ID NO: 225825 - DNA, 20 bp, Artificial Sequence
  chemically synthesized
tcacctgaggtcaggagttc

SEQ ID NO: 225826 - DNA, 20 bp, Artificial Sequence
  chemically synthesized
tggtctcgaactcctgacct

SEQ ID NO: 225827 - DNA, 20 bp, Artificial Sequence
  chemically synthesized
ggcggatcacctgaggtcag

SEQ ID NO: 225828 - DNA, 20 bp, Artificial Sequence
  chemically synthesized
ggtctcgaactcctgacctc

SEQ ID NO: 225829 - DNA, 20 bp, Artificial Sequence
  chemically synthesized
caggcggatcacctgaggtc

SEQ ID NO: 225830 - DNA, 20 bp, Artificial Sequence
  chemically synthesized
gcaggcggatcacctgaggt

SEQ ID NO: 225831 - DNA, 20 bp, Artificial Sequence
  chemically synthesized
tgaggcaggcggatcacctg

SEQ ID NO: 225832 - DNA, 20 bp, Artificial Sequence
  chemically synthesized
ctgaggcaggcggatcacct

SEQ ID NO: 225833 - DNA, 20 bp, Artificial Sequence
  chemically synthesized
ctcaggtgatccgcctgcct

SEQ ID NO: 225834 - DNA, 20 bp, Artificial Sequence
  chemically synthesized
ctttgggatgctgaggcagg

SEQ ID NO: 225835 - DNA, 20 bp, Artificial Sequence
  chemically synthesized
gcactttgggatgctgaggc

SEQ ID NO: 225836 - DNA, 20 bp, Artificial Sequence
  chemically synthesized
agcactttgggatgctgagg

SEQ ID NO: 225837 - DNA, 20 bp, Artificial Sequence
  chemically synthesized
ctcagcactttgggatgctg

SEQ ID NO: 225838 - DNA, 20 bp, Artificial Sequence
  chemically synthesized
tctcagcactttgggatgct

SEQ ID NO: 225839 - DNA, 20 bp, Artificial Sequence
  chemically synthesized
ccgcctgcctcagcatccca

SEQ ID NO: 225840 - DNA, 20 bp, Artificial Sequence
  chemically synthesized
gcctgtaatctcagcacttt

SEQ ID NO: 225841 - DNA, 20 bp, Artificial Sequence
  chemically synthesized
cctcagcatcccaaagtgct

SEQ ID NO: 225842 - DNA, 20 bp, Artificial Sequence
  chemically synthesized
tgcctgtaatctcagcactt

SEQ ID NO: 225843 - DNA, 20 bp, Artificial Sequence
  chemically synthesized
atcccaaagtgctgagatta

SEQ ID NO: 225844 - DNA, 20 bp, Artificial Sequence
  chemically synthesized
tcccaaagtgctgagattac

SEQ ID NO: 225845 - DNA, 20 bp, Artificial Sequence
  chemically synthesized
gtggttcatgcctgtaatct

SEQ ID NO: 225846 - DNA, 20 bp, Artificial Sequence
  chemically synthesized
tgcaagcaggtggggcatgg

SEQ ID NO: 225847 - DNA, 20 bp, Artificial Sequence
  chemically synthesized
gtttgcaagcaggtggggca

SEQ ID NO: 225848 - DNA, 20 bp, Artificial Sequence
  chemically synthesized
tgaaagtttgcaagcaggtg

SEQ ID NO: 225849 - DNA, 20 bp, Artificial Sequence
  chemically synthesized
atgaaagtttgcaagcaggt

SEQ ID NO: 225850 - DNA, 20 bp, Artificial Sequence
  chemically synthesized
aatgaaagtttgcaagcagg

SEQ ID NO: 225851 - DNA, 20 bp, Artificial Sequence
  chemically synthesized
tcaaatgaaagtttgcaagc

SEQ ID NO: 225852 - DNA, 20 bp, Artificial Sequence
  chemically synthesized
gtcaaatgaaagtttgcaag

SEQ ID NO: 225853 - DNA, 20 bp, Artificial Sequence
  chemically synthesized
aaagtcaaatgaaagtttgc

SEQ ID NO: 225854 - DNA, 20 bp, Artificial Sequence
  chemically synthesized
cttttggaaaagtcaaatga

SEQ ID NO: 225855 - DNA, 20 bp, Artificial Sequence
  chemically synthesized
ctttcatttgacttttccaa

SEQ ID NO: 225856 - DNA, 20 bp, Artificial Sequence
  chemically synthesized
tccaaatcaagcttttggaa

SEQ ID NO: 225857 - DNA, 20 bp, Artificial Sequence
  chemically synthesized
ttatttccaaatcaagcttt

SEQ ID NO: 225858 - DNA, 20 bp, Artificial Sequence
  chemically synthesized
acttttccaaaagcttgatt

SEQ ID NO: 225859 - DNA, 20 bp, Artificial Sequence
  chemically synthesized
tgtgggattatttccaaatc

SEQ ID NO: 225860 - DNA, 20 bp, Artificial Sequence
  chemically synthesized
tggaaataatcccacactga

SEQ ID NO: 225861 - DNA, 20 bp, Artificial Sequence
  chemically synthesized
aaaaacatagccatcagtgt

SEQ ID NO: 225862 - DNA, 20 bp, Artificial Sequence
  chemically synthesized
taaaaacatagccatcagtg

SEQ ID NO: 225863 - DNA, 20 bp, Artificial Sequence
  chemically synthesized
tccattaaaaacatagccat

SEQ ID NO: 225864 - DNA, 20 bp, Artificial Sequence
  chemically synthesized
ggttgactccattaaaaaca

SEQ ID NO: 225865 - DNA, 20 bp, Artificial Sequence
  chemically synthesized
actgatggctatgtttttaa

SEQ ID NO: 225866 - DNA, 20 bp, Artificial Sequence
  chemically synthesized
tgatggctatgtttttaatg

SEQ ID NO: 225867 - DNA, 20 bp, Artificial Sequence
  chemically synthesized
ttatttgtcctggacaacaa

SEQ ID NO: 225868 - DNA, 20 bp, Artificial Sequence
  chemically synthesized
tggagtcaacctttgttgtc

SEQ ID NO: 225869 - DNA, 20 bp, Artificial Sequence
  chemically synthesized
gttatttgtcctggacaaca

SEQ ID NO: 225870 - DNA, 20 bp, Artificial Sequence
  chemically synthesized
ggagtcaacctttgttgtcc

SEQ ID NO: 225871 - DNA, 20 bp, Artificial Sequence
  chemically synthesized
ttcttaacagttatttgtcc

SEQ ID NO: 225872 - DNA, 20 bp, Artificial Sequence
  chemically synthesized
gtccaggacaaataactgtt

SEQ ID NO: 225873 - DNA, 20 bp, Artificial Sequence
  chemically synthesized
gtatgctagaagattcttaa

SEQ ID NO: 225874 - DNA, 20 bp, Artificial Sequence
  chemically synthesized
aataactgttaagaatcttc

SEQ ID NO: 225875 - DNA, 20 bp, Artificial Sequence
  chemically synthesized
ctttgagtacagtatgctag

SEQ ID NO: 225876 - DNA, 20 bp, Artificial Sequence
  chemically synthesized
ggactttgagtacagtatgc

SEQ ID NO: 225877 - DNA, 20 bp, Artificial Sequence
  chemically synthesized
cttctagcatactgtactca

SEQ ID NO: 225878 - DNA, 20 bp, Artificial Sequence
  chemically synthesized
agtgctaaggactttgagta

SEQ ID NO: 225879 - DNA, 20 bp, Artificial Sequence
  chemically synthesized
ctgatagtgctaaggacttt

SEQ ID NO: 225880 - DNA, 20 bp, Artificial Sequence
  chemically synthesized
catactgtactcaaagtcct

SEQ ID NO: 225881 - DNA, 20 bp, Artificial Sequence
  chemically synthesized
ccaacagcctgatagtgcta

SEQ ID NO: 225882 - DNA, 20 bp, Artificial Sequence
  chemically synthesized
gccaacagcctgatagtgct

SEQ ID NO: 225883 - DNA, 20 bp, Artificial Sequence
  chemically synthesized
ctcaaagtccttagcactat

SEQ ID NO: 225884 - DNA, 20 bp, Artificial Sequence
  chemically synthesized
tcaaagtccttagcactatc

SEQ ID NO: 225885 - DNA, 20 bp, Artificial Sequence
  chemically synthesized
tgtttgagccaacagcctga

SEQ ID NO: 225886 - DNA, 20 bp, Artificial Sequence
  chemically synthesized
ccttagcactatcaggctgt

SEQ ID NO: 225887 - DNA, 20 bp, Artificial Sequence
  chemically synthesized
acctttcatgtttgagccaa

SEQ ID NO: 225888 - DNA, 20 bp, Artificial Sequence
  chemically synthesized
caaaaaaacctttcatgttt

SEQ ID NO: 225889 - DNA, 20 bp, Artificial Sequence
  chemically synthesized
ggctgttggctcaaacatga

SEQ ID NO: 225890 - DNA, 20 bp, Artificial Sequence
  chemically synthesized
gctgttggctcaaacatgaa

SEQ ID NO: 225891 - DNA, 20 bp, Artificial Sequence
  chemically synthesized
catgaaaggtttttttgatg

SEQ ID NO: 225892 - DNA, 20 bp, Artificial Sequence
  chemically synthesized
gtttttttgatgtagttttg

SEQ ID NO: 225893 - DNA, 20 bp, Artificial Sequence
  chemically synthesized
ttgtagaattgttattgcaa

SEQ ID NO: 225894 - DNA, 20 bp, Artificial Sequence
  chemically synthesized
tgcaatggtatttgctgtat

SEQ ID NO: 225895 - DNA, 20 bp, Artificial Sequence
  chemically synthesized
ctgtgggtcaaattccaata

SEQ ID NO: 225896 - DNA, 20 bp, Artificial Sequence
  chemically synthesized
ctgtattggaatttgaccca

SEQ ID NO: 225897 - DNA, 20 bp, Artificial Sequence
  chemically synthesized
tggaatttgacccacagtac

SEQ ID NO: 225898 - DNA, 20 bp, Artificial Sequence
  chemically synthesized
tgtactataacttgtactgt

SEQ ID NO: 225899 - DNA, 20 bp, Artificial Sequence
  chemically synthesized
ttgtactataacttgtactg

SEQ ID NO: 225900 - DNA, 20 bp, Artificial Sequence
  chemically synthesized
ttgacccacagtacaagtta

SEQ ID NO: 225901 - DNA, 20 bp, Artificial Sequence
  chemically synthesized
cacagtacaagttatagtac

SEQ ID NO: 225902 - DNA, 20 bp, Artificial Sequence
  chemically synthesized
taacaaaaaacaatattgat

SEQ ID NO: 225903 - DNA, 20 bp, Artificial Sequence
  chemically synthesized
tttttgttaatgaacaacat

SEQ ID NO: 225904 - DNA, 20 bp, Artificial Sequence
  chemically synthesized
aatgaacaacataagatgta

SEQ ID NO: 225905 - DNA, 20 bp, Artificial Sequence
  chemically synthesized
tattaaagtttagatttggc

SEQ ID NO: 225906 - DNA, 20 bp, Artificial Sequence
  chemically synthesized
ctaatattaaagtttagatt

SEQ ID NO: 225907 - DNA, 20 bp, Artificial Sequence
  chemically synthesized
taatctctaatattaaagtt

SEQ ID NO: 225908 - DNA, 20 bp, Artificial Sequence
  chemically synthesized
ccaaatctaaactttaatat

SEQ ID NO: 225909 - DNA, 20 bp, Artificial Sequence
  chemically synthesized
tcctataatctctaatatta

SEQ ID NO: 225910 - DNA, 20 bp, Artificial Sequence
  chemically synthesized
aaatctaaactttaatatta

SEQ ID NO: 225911 - DNA, 20 bp, Artificial Sequence
  chemically synthesized
aactttaatattagagatta

SEQ ID NO: 225912 - DNA, 20 bp, Artificial Sequence
  chemically synthesized
actttaatattagagattat

SEQ ID NO: 225913 - DNA, 20 bp, Artificial Sequence
  chemically synthesized
aatattagagattataggat

SEQ ID NO: 225914 - DNA, 20 bp, Artificial Sequence
  chemically synthesized
ctgcataggttagcaaaaaa

SEQ ID NO: 225915 - DNA, 20 bp, Artificial Sequence
  chemically synthesized
ccattttttgctaacctatg

SEQ ID NO: 225916 - DNA, 20 bp, Artificial Sequence
  chemically synthesized
ggacaatcctctgcataggt

SEQ ID NO: 225917 - DNA, 20 bp, Artificial Sequence
  chemically synthesized
attttttgctaacctatgca

SEQ ID NO: 225918 - DNA, 20 bp, Artificial Sequence
  chemically synthesized
ttttttgctaacctatgcag

SEQ ID NO: 225919 - DNA, 20 bp, Artificial Sequence
  chemically synthesized
caaaggacaatcctctgcat

SEQ ID NO: 225920 - DNA, 20 bp, Artificial Sequence
  chemically synthesized
ccaaaggacaatcctctgca

SEQ ID NO: 225921 - DNA, 20 bp, Artificial Sequence
  chemically synthesized
ctatgcagaggattgtcctt

SEQ ID NO: 225922 - DNA, 20 bp, Artificial Sequence
  chemically synthesized
ttttccttttcagtcaccaa

SEQ ID NO: 225923 - DNA, 20 bp, Artificial Sequence
  chemically synthesized
gttttccttttcagtcacca

SEQ ID NO: 225924 - DNA, 20 bp, Artificial Sequence
  chemically synthesized
attgtcctttggtgactgaa

SEQ ID NO: 225925 - DNA, 20 bp, Artificial Sequence
  chemically synthesized
ttgtcctttggtgactgaaa

SEQ ID NO: 225926 - DNA, 20 bp, Artificial Sequence
  chemically synthesized
gaatttattgttttcctttt

SEQ ID NO: 225927 - DNA, 20 bp, Artificial Sequence
  chemically synthesized
acaataaattcctacttatg

SEQ ID NO: 225928 - DNA, 20 bp, Artificial Sequence
  chemically synthesized
gacagagactccacataagt

SEQ ID NO: 225929 - DNA, 20 bp, Artificial Sequence
  chemically synthesized
agacagagactccacataag

SEQ ID NO: 225930 - DNA, 20 bp, Artificial Sequence
  chemically synthesized
aataaattcctacttatgtg

SEQ ID NO: 225931 - DNA, 20 bp, Artificial Sequence
  chemically synthesized
aaaagacagagactccacat

SEQ ID NO: 225932 - DNA, 20 bp, Artificial Sequence
  chemically synthesized
tgactattattaaaaagaca

SEQ ID NO: 225933 - DNA, 20 bp, Artificial Sequence
  chemically synthesized
actgactattattaaaaaga

SEQ ID NO: 225934 - DNA, 20 bp, Artificial Sequence
  chemically synthesized
agacactgactattattaaa

SEQ ID NO: 225935 - DNA, 20 bp, Artificial Sequence
  chemically synthesized
agtctctgtctttttaataa

SEQ ID NO: 225936 - DNA, 20 bp, Artificial Sequence
  chemically synthesized
tctgtctttttaataatagt

SEQ ID NO: 225937 - DNA, 20 bp, Artificial Sequence
  chemically synthesized
aataatagtcagtgtcttat

SEQ ID NO: 225938 - DNA, 20 bp, Artificial Sequence
  chemically synthesized
aagtctttgtgagttccaat

SEQ ID NO: 225939 - DNA, 20 bp, Artificial Sequence
  chemically synthesized
gtgtcttattggaactcaca

SEQ ID NO: 225940 - DNA, 20 bp, Artificial Sequence
  chemically synthesized
tcttcacaccaagtctttgt

SEQ ID NO: 225941 - DNA, 20 bp, Artificial Sequence
  chemically synthesized
tattggaactcacaaagact

SEQ ID NO: 225942 - DNA, 20 bp, Artificial Sequence
  chemically synthesized
actcacaaagacttggtgtg

SEQ ID NO: 225943 - DNA, 20 bp, Artificial Sequence
  chemically synthesized
ttgtcagagctcttcacacc

SEQ ID NO: 225944 - DNA, 20 bp, Artificial Sequence
  chemically synthesized
tcacaaagacttggtgtgaa

SEQ ID NO: 225945 - DNA, 20 bp, Artificial Sequence
  chemically synthesized
ttggtgtgaagagctctgac

SEQ ID NO: 225946 - DNA, 20 bp, Artificial Sequence
  chemically synthesized
ataggctaactagcttgtca

SEQ ID NO: 225947 - DNA, 20 bp, Artificial Sequence
  chemically synthesized
tgtgaagagctctgacaagc

SEQ ID NO: 225948 - DNA, 20 bp, Artificial Sequence
  chemically synthesized
aaataggctaactagcttgt

SEQ ID NO: 225949 - DNA, 20 bp, Artificial Sequence
  chemically synthesized
aagagctctgacaagctagt

SEQ ID NO: 225950 - DNA, 20 bp, Artificial Sequence
  chemically synthesized
caagcataaaataggctaac

SEQ ID NO: 225951 - DNA, 20 bp, Artificial Sequence
  chemically synthesized
gaataaaacaagcataaaat

SEQ ID NO: 225952 - DNA, 20 bp, Artificial Sequence
  chemically synthesized
agaataaaacaagcataaaa

SEQ ID NO: 225953 - DNA, 20 bp, Artificial Sequence
  chemically synthesized
ataggaagcaagaataaaac

SEQ ID NO: 225954 - DNA, 20 bp, Artificial Sequence
  chemically synthesized
tatgtttgcatataggaagc

SEQ ID NO: 225955 - DNA, 20 bp, Artificial Sequence
  chemically synthesized
tcactatgtttgcatatagg

SEQ ID NO: 225956 - DNA, 20 bp, Artificial Sequence
  chemically synthesized
ccttcactatgtttgcatat

SEQ ID NO: 225957 - DNA, 20 bp, Artificial Sequence
  chemically synthesized
tccttcactatgtttgcata

SEQ ID NO: 225958 - DNA, 20 bp, Artificial Sequence
  chemically synthesized
ttgcttcctatatgcaaaca

SEQ ID NO: 225959 - DNA, 20 bp, Artificial Sequence
  chemically synthesized
tcctatatgcaaacatagtg

SEQ ID NO: 225960 - DNA, 20 bp, Artificial Sequence
  chemically synthesized
cctatatgcaaacatagtga

SEQ ID NO: 225961 - DNA, 20 bp, Artificial Sequence
  chemically synthesized
tatgcaaacatagtgaagga

SEQ ID NO: 225962 - DNA, 20 bp, Artificial Sequence
  chemically synthesized
gcaaacatagtgaaggacag

SEQ ID NO: 225963 - DNA, 20 bp, Artificial Sequence
  chemically synthesized
caaacatagtgaaggacagc

SEQ ID NO: 225964 - DNA, 20 bp, Artificial Sequence
  chemically synthesized
agtgaaggacagcgggcaat

SEQ ID NO: 225965 - DNA, 20 bp, Artificial Sequence
  chemically synthesized
aatcgctaaaatagaagtgc

SEQ ID NO: 225966 - DNA, 20 bp, Artificial Sequence
  chemically synthesized
atgagctcgcacttctattt

SEQ ID NO: 225967 - DNA, 20 bp, Artificial Sequence
  chemically synthesized
acccagaatcgctaaaatag

SEQ ID NO: 225968 - DNA, 20 bp, Artificial Sequence
  chemically synthesized
gtaacccagaatcgctaaaa

SEQ ID NO: 225969 - DNA, 20 bp, Artificial Sequence
  chemically synthesized
cacttctattttagcgattc

SEQ ID NO: 225970 - DNA, 20 bp, Artificial Sequence
  chemically synthesized
acttctattttagcgattct

SEQ ID NO: 225971 - DNA, 20 bp, Artificial Sequence
  chemically synthesized
tttagcgattctgggttact

SEQ ID NO: 225972 - DNA, 20 bp, Artificial Sequence
  chemically synthesized
tagaggcagcccgagtaacc

SEQ ID NO: 225973 - DNA, 20 bp, Artificial Sequence
  chemically synthesized
ttagcgattctgggttactc

SEQ ID NO: 225974 - DNA, 20 bp, Artificial Sequence
  chemically synthesized
tggtagattagaggcagccc

SEQ ID NO: 225975 - DNA, 20 bp, Artificial Sequence
  chemically synthesized
ctggcttggtagattagagg

SEQ ID NO: 225976 - DNA, 20 bp, Artificial Sequence
  chemically synthesized
atcctggcttggtagattag

SEQ ID NO: 225977 - DNA, 20 bp, Artificial Sequence
  chemically synthesized
aatcctggcttggtagatta

SEQ ID NO: 225978 - DNA, 20 bp, Artificial Sequence
  chemically synthesized
cgggctgcctctaatctacc

SEQ ID NO: 225979 - DNA, 20 bp, Artificial Sequence
  chemically synthesized
ataatcctggcttggtagat

SEQ ID NO: 225980 - DNA, 20 bp, Artificial Sequence
  chemically synthesized
ctgcctctaatctaccaagc

SEQ ID NO: 225981 - DNA, 20 bp, Artificial Sequence
  chemically synthesized
tgcctctaatctaccaagcc

SEQ ID NO: 225982 - DNA, 20 bp, Artificial Sequence
  chemically synthesized
ttataataatcctggcttgg

SEQ ID NO: 225983 - DNA, 20 bp, Artificial Sequence
  chemically synthesized
tccttataataatcctggct

SEQ ID NO: 225984 - DNA, 20 bp, Artificial Sequence
  chemically synthesized
tattttccttataataatcc

SEQ ID NO: 225985 - DNA, 20 bp, Artificial Sequence
  chemically synthesized
taccaagccaggattattat

SEQ ID NO: 225986 - DNA, 20 bp, Artificial Sequence
  chemically synthesized
accaagccaggattattata

SEQ ID NO: 225987 - DNA, 20 bp, Artificial Sequence
  chemically synthesized
tataaggaaaataaccaatg

SEQ ID NO: 225988 - DNA, 20 bp, Artificial Sequence
  chemically synthesized
gactttatctttagctacat

SEQ ID NO: 225989 - DNA, 20 bp, Artificial Sequence
  chemically synthesized
gaaaataaccaatgtagcta

SEQ ID NO: 225990 - DNA, 20 bp, Artificial Sequence
  chemically synthesized
aaccaatgtagctaaagata

SEQ ID NO: 225991 - DNA, 20 bp, Artificial Sequence
  chemically synthesized
ggaagtgatgactttatctt

SEQ ID NO: 225992 - DNA, 20 bp, Artificial Sequence
  chemically synthesized
acaaaggaattgagttaggg

SEQ ID NO: 225993 - DNA, 20 bp, Artificial Sequence
  chemically synthesized
gctacaaaggaattgagtta

SEQ ID NO: 225994 - DNA, 20 bp, Artificial Sequence
  chemically synthesized
agctacaaaggaattgagtt

SEQ ID NO: 225995 - DNA, 20 bp, Artificial Sequence
  chemically synthesized
cagctacaaaggaattgagt

SEQ ID NO: 225996 - DNA, 20 bp, Artificial Sequence
  chemically synthesized
cctgcagctacaaaggaatt

SEQ ID NO: 225997 - DNA, 20 bp, Artificial Sequence
  chemically synthesized
tccctaactcaattcctttg

SEQ ID NO: 225998 - DNA, 20 bp, Artificial Sequence
  chemically synthesized
tagtgttcctgcagctacaa

SEQ ID NO: 225999 - DNA, 20 bp, Artificial Sequence
  chemically synthesized
ttagtgttcctgcagctaca

SEQ ID NO: 226000 - DNA, 20 bp, Artificial Sequence
  chemically synthesized
actcaattcctttgtagctg

SEQ ID NO: 226001 - DNA, 20 bp, Artificial Sequence
  chemically synthesized
ctcaattcctttgtagctgc

SEQ ID NO: 226002 - DNA, 20 bp, Artificial Sequence
  chemically synthesized
aatgaaatttagtgttcctg

SEQ ID NO: 226003 - DNA, 20 bp, Artificial Sequence
  chemically synthesized
ttagaattctgaatgaaatt

SEQ ID NO: 226004 - DNA, 20 bp, Artificial Sequence
  chemically synthesized
caggaacactaaatttcatt

SEQ ID NO: 226005 - DNA, 20 bp, Artificial Sequence
  chemically synthesized
ttacccagctttttgggagt

SEQ ID NO: 226006 - DNA, 20 bp, Artificial Sequence
  chemically synthesized
tcagaattctaactcccaaa

SEQ ID NO: 226007 - DNA, 20 bp, Artificial Sequence
  chemically synthesized
tagattacccagctttttgg

SEQ ID NO: 226008 - DNA, 20 bp, Artificial Sequence
  chemically synthesized
aattctaactcccaaaaagc

SEQ ID NO: 226009 - DNA, 20 bp, Artificial Sequence
  chemically synthesized
cttagattacccagcttttt

SEQ ID NO: 226010 - DNA, 20 bp, Artificial Sequence
  chemically synthesized
attctaactcccaaaaagct

SEQ ID NO: 226011 - DNA, 20 bp, Artificial Sequence
  chemically synthesized
tcttagattacccagctttt

SEQ ID NO: 226012 - DNA, 20 bp, Artificial Sequence
  chemically synthesized
attaagggtcttagattacc

SEQ ID NO: 226013 - DNA, 20 bp, Artificial Sequence
  chemically synthesized
cccaaaaagctgggtaatct

SEQ ID NO: 226014 - DNA, 20 bp, Artificial Sequence
  chemically synthesized
aagaaaaccattaagggtct

SEQ ID NO: 226015 - DNA, 20 bp, Artificial Sequence
  chemically synthesized
gggtaatctaagacccttaa

SEQ ID NO: 226016 - DNA, 20 bp, Artificial Sequence
  chemically synthesized
ggctataagaaaaccattaa

SEQ ID NO: 226017 - DNA, 20 bp, Artificial Sequence
  chemically synthesized
aggctataagaaaaccatta

SEQ ID NO: 226018 - DNA, 20 bp, Artificial Sequence
  chemically synthesized
gaggctataagaaaaccatt

SEQ ID NO: 226019 - DNA, 20 bp, Artificial Sequence
  chemically synthesized
gacccttaatggttttctta

SEQ ID NO: 226020 - DNA, 20 bp, Artificial Sequence
  chemically synthesized
gccaaaccctatgaggctat

SEQ ID NO: 226021 - DNA, 20 bp, Artificial Sequence
  chemically synthesized
atggttttcttatagcctca

SEQ ID NO: 226022 - DNA, 20 bp, Artificial Sequence
  chemically synthesized
tggttttcttatagcctcat

SEQ ID NO: 226023 - DNA, 20 bp, Artificial Sequence
  chemically synthesized
ggttttcttatagcctcata

SEQ ID NO: 226024 - DNA, 20 bp, Artificial Sequence
  chemically synthesized
ggcacctgccaaaccctatg

SEQ ID NO: 226025 - DNA, 20 bp, Artificial Sequence
  chemically synthesized
gggcacctgccaaaccctat

SEQ ID NO: 226026 - DNA, 20 bp, Artificial Sequence
  chemically synthesized
tcttatagcctcatagggtt

SEQ ID NO: 226027 - DNA, 20 bp, Artificial Sequence
  chemically synthesized
tatagcctcatagggtttgg

SEQ ID NO: 226028 - DNA, 20 bp, Artificial Sequence
  chemically synthesized
atagcctcatagggtttggc

SEQ ID NO: 226029 - DNA, 20 bp, Artificial Sequence
  chemically synthesized
atagggtttggcaggtgccc

SEQ ID NO: 226030 - DNA, 20 bp, Artificial Sequence
  chemically synthesized
gggaatctgccagatgtcca

SEQ ID NO: 226031 - DNA, 20 bp, Artificial Sequence
  chemically synthesized
tggcaggtgccctggacatc

SEQ ID NO: 226032 - DNA, 20 bp, Artificial Sequence
  chemically synthesized
agggaatctgccagatgtcc

SEQ ID NO: 226033 - DNA, 20 bp, Artificial Sequence
  chemically synthesized
cagggaatctgccagatgtc

SEQ ID NO: 226034 - DNA, 20 bp, Artificial Sequence
  chemically synthesized
caggtgccctggacatctgg

SEQ ID NO: 226035 - DNA, 20 bp, Artificial Sequence
  chemically synthesized
tgttctctcagggaatctgc

SEQ ID NO: 226036 - DNA, 20 bp, Artificial Sequence
  chemically synthesized
ggacatctggcagattccct

SEQ ID NO: 226037 - DNA, 20 bp, Artificial Sequence
  chemically synthesized
acatctggcagattccctga

SEQ ID NO: 226038 - DNA, 20 bp, Artificial Sequence
  chemically synthesized
tctgagtttttgttctctca

SEQ ID NO: 226039 - DNA, 20 bp, Artificial Sequence
  chemically synthesized
ttctgagtttttgttctctc

SEQ ID NO: 226040 - DNA, 20 bp, Artificial Sequence
  chemically synthesized
cttctgagtttttgttctct

SEQ ID NO: 226041 - DNA, 20 bp, Artificial Sequence
  chemically synthesized
tccctgagagaacaaaaact

SEQ ID NO: 226042 - DNA, 20 bp, Artificial Sequence
  chemically synthesized
ctgagagaacaaaaactcag

SEQ ID NO: 226043 - DNA, 20 bp, Artificial Sequence
  chemically synthesized
ttcaatctttggtagcttct

SEQ ID NO: 226044 - DNA, 20 bp, Artificial Sequence
  chemically synthesized
caaaaactcagaagctacca

SEQ ID NO: 226045 - DNA, 20 bp, Artificial Sequence
  chemically synthesized
gggagtatttcaatctttgg

SEQ ID NO: 226046 - DNA, 20 bp, Artificial Sequence
  chemically synthesized
gaagggagtatttcaatctt

SEQ ID NO: 226047 - DNA, 20 bp, Artificial Sequence
  chemically synthesized
tagttggtgggtattgaagg

SEQ ID NO: 226048 - DNA, 20 bp, Artificial Sequence
  chemically synthesized
cctagttggtgggtattgaa

SEQ ID NO: 226049 - DNA, 20 bp, Artificial Sequence
  chemically synthesized
ccctagttggtgggtattga

SEQ ID NO: 226050 - DNA, 20 bp, Artificial Sequence
  chemically synthesized
cccctagttggtgggtattg

SEQ ID NO: 226051 - DNA, 20 bp, Artificial Sequence
  chemically synthesized
tcccttcaatacccaccaac

SEQ ID NO: 226052 - DNA, 20 bp, Artificial Sequence
  chemically synthesized
cccttcaatacccaccaact

SEQ ID NO: 226053 - DNA, 20 bp, Artificial Sequence
  chemically synthesized
tataagctcccctagttggt

SEQ ID NO: 226054 - DNA, 20 bp, Artificial Sequence
  chemically synthesized
ccttcaatacccaccaacta

SEQ ID NO: 226055 - DNA, 20 bp, Artificial Sequence
  chemically synthesized
gtataagctcccctagttgg

SEQ ID NO: 226056 - DNA, 20 bp, Artificial Sequence
  chemically synthesized
cttcaatacccaccaactag

SEQ ID NO: 226057 - DNA, 20 bp, Artificial Sequence
  chemically synthesized
tcaatacccaccaactaggg

SEQ ID NO: 226058 - DNA, 20 bp, Artificial Sequence
  chemically synthesized
cttgtataagctcccctagt

SEQ ID NO: 226059 - DNA, 20 bp, Artificial Sequence
  chemically synthesized
cggtcttgtataagctcccc

SEQ ID NO: 226060 - DNA, 20 bp, Artificial Sequence
  chemically synthesized
ccaactaggggagcttatac

SEQ ID NO: 226061 - DNA, 20 bp, Artificial Sequence
  chemically synthesized
agaaacccacggtcttgtat

SEQ ID NO: 226062 - DNA, 20 bp, Artificial Sequence
  chemically synthesized
ggggagcttatacaagaccg

SEQ ID NO: 226063 - DNA, 20 bp, Artificial Sequence
  chemically synthesized
gggagcttatacaagaccgt

SEQ ID NO: 226064 - DNA, 20 bp, Artificial Sequence
  chemically synthesized
acaaagtagaaagaaaccca

SEQ ID NO: 226065 - DNA, 20 bp, Artificial Sequence
  chemically synthesized
aaataaaagaacaaagtaga

SEQ ID NO: 226066 - DNA, 20 bp, Artificial Sequence
  chemically synthesized
atgtaaataaaagaacaaag

SEQ ID NO: 226067 - DNA, 20 bp, Artificial Sequence
  chemically synthesized
attatgtaaataaaagaaca

SEQ ID NO: 226068 - DNA, 20 bp, Artificial Sequence
  chemically synthesized
cattgctattatgtaaataa

SEQ ID NO: 226069 - DNA, 20 bp, Artificial Sequence
  chemically synthesized
ttgttcttttatttacataa

SEQ ID NO: 226070 - DNA, 20 bp, Artificial Sequence
  chemically synthesized
caatgataatatctttgttg

SEQ ID NO: 226071 - DNA, 20 bp, Artificial Sequence
  chemically synthesized
ctccgagtaattctacaaca

SEQ ID NO: 226072 - DNA, 20 bp, Artificial Sequence
  chemically synthesized
atctttgttgtagaattact

SEQ ID NO: 226073 - DNA, 20 bp, Artificial Sequence
  chemically synthesized
ctttgttgtagaattactcg

SEQ ID NO: 226074 - DNA, 20 bp, Artificial Sequence
  chemically synthesized
tttgttgtagaattactcgg

SEQ ID NO: 226075 - DNA, 20 bp, Artificial Sequence
  chemically synthesized
tttcttgtatttaatcctcc

SEQ ID NO: 226076 - DNA, 20 bp, Artificial Sequence
  chemically synthesized
ttactcggaggattaaatac

SEQ ID NO: 226077 - DNA, 20 bp, Artificial Sequence
  chemically synthesized
taaatacaagaaaatattta

SEQ ID NO: 226078 - DNA, 20 bp, Artificial Sequence
  chemically synthesized
aagaaaatatttacagtacc

SEQ ID NO: 226079 - DNA, 20 bp, Artificial Sequence
  chemically synthesized
ttgagagtttattaagtgct

SEQ ID NO: 226080 - DNA, 20 bp, Artificial Sequence
  chemically synthesized
attgagagtttattaagtgc

SEQ ID NO: 226081 - DNA, 20 bp, Artificial Sequence
  chemically synthesized
atatatattgagagtttatt

SEQ ID NO: 226082 - DNA, 20 bp, Artificial Sequence
  chemically synthesized
ggaaaattaatatatattga

SEQ ID NO: 226083 - DNA, 20 bp, Artificial Sequence
  chemically synthesized
ggggaaaattaatatatatt

SEQ ID NO: 226084 - DNA, 20 bp, Artificial Sequence
  chemically synthesized
tagtaacccagaagggagtg

SEQ ID NO: 226085 - DNA, 20 bp, Artificial Sequence
  chemically synthesized
ttagtaacccagaagggagt

SEQ ID NO: 226086 - DNA, 20 bp, Artificial Sequence
  chemically synthesized
cttagtaacccagaagggag

SEQ ID NO: 226087 - DNA, 20 bp, Artificial Sequence
  chemically synthesized
taattttccccactcccttc

SEQ ID NO: 226088 - DNA, 20 bp, Artificial Sequence
  chemically synthesized
aattttccccactcccttct

SEQ ID NO: 226089 - DNA, 20 bp, Artificial Sequence
  chemically synthesized
ggtcttagtaacccagaagg

SEQ ID NO: 226090 - DNA, 20 bp, Artificial Sequence
  chemically synthesized
ggggtcttagtaacccagaa

SEQ ID NO: 226091 - DNA, 20 bp, Artificial Sequence
  chemically synthesized
aggggtcttagtaacccaga

SEQ ID NO: 226092 - DNA, 20 bp, Artificial Sequence
  chemically synthesized
taggggtcttagtaacccag

SEQ ID NO: 226093 - DNA, 20 bp, Artificial Sequence
  chemically synthesized
ccactcccttctgggttact

SEQ ID NO: 226094 - DNA, 20 bp, Artificial Sequence
  chemically synthesized
ttataggggtcttagtaacc

SEQ ID NO: 226095 - DNA, 20 bp, Artificial Sequence
  chemically synthesized
tttgcattttataggggtct

SEQ ID NO: 226096 - DNA, 20 bp, Artificial Sequence
  chemically synthesized
aataaatttgcattttatag

SEQ ID NO: 226097 - DNA, 20 bp, Artificial Sequence
  chemically synthesized
aaataaatttgcattttata

SEQ ID NO: 226098 - DNA, 20 bp, Artificial Sequence
  chemically synthesized
taaataaatttgcattttat

SEQ ID NO: 226099 - DNA, 20 bp, Artificial Sequence
  chemically synthesized
gtaaataaatttgcatttta

SEQ ID NO: 226100 - DNA, 20 bp, Artificial Sequence
  chemically synthesized
atgcaaatttatttacatca

SEQ ID NO: 226101 - DNA, 20 bp, Artificial Sequence
  chemically synthesized
caaatttatttacatcacag

SEQ ID NO: 226102 - DNA, 20 bp, Artificial Sequence
  chemically synthesized
actcaacttttcaaaaatat

SEQ ID NO: 226103 - DNA, 20 bp, Artificial Sequence
  chemically synthesized
tagtcactaatatttttgaa

SEQ ID NO: 226104 - DNA, 20 bp, Artificial Sequence
  chemically synthesized
actaatatttttgaaaagtt

SEQ ID NO: 226105 - DNA, 20 bp, Artificial Sequence
  chemically synthesized
aaaagttgagttaattgaat

SEQ ID NO: 226106 - DNA, 20 bp, Artificial Sequence
  chemically synthesized
aaagttgagttaattgaatt

SEQ ID NO: 226107 - DNA, 20 bp, Artificial Sequence
  chemically synthesized
gttgagttaattgaattagg

SEQ ID NO: 226108 - DNA, 20 bp, Artificial Sequence
  chemically synthesized
gaattaggaagcctgttata

SEQ ID NO: 226109 - DNA, 20 bp, Artificial Sequence
  chemically synthesized
cagggcttattctttataac

SEQ ID NO: 226110 - DNA, 20 bp, Artificial Sequence
  chemically synthesized
tcagggcttattctttataa

SEQ ID NO: 226111 - DNA, 20 bp, Artificial Sequence
  chemically synthesized
ggaagcctgttataaagaat

SEQ ID NO: 226112 - DNA, 20 bp, Artificial Sequence
  chemically synthesized
tgttataaagaataagccct

SEQ ID NO: 226113 - DNA, 20 bp, Artificial Sequence
  chemically synthesized
taaagaataagccctgagta

SEQ ID NO: 226114 - DNA, 20 bp, Artificial Sequence
  chemically synthesized
atacacatcctctttactca

SEQ ID NO: 226115 - DNA, 20 bp, Artificial Sequence
  chemically synthesized
aagaataagccctgagtaaa

SEQ ID NO: 226116 - DNA, 20 bp, Artificial Sequence
  chemically synthesized
aatacacatcctctttactc

SEQ ID NO: 226117 - DNA, 20 bp, Artificial Sequence
  chemically synthesized
agaataagccctgagtaaag

SEQ ID NO: 226118 - DNA, 20 bp, Artificial Sequence
  chemically synthesized
taatacacatcctctttact

SEQ ID NO: 226119 - DNA, 20 bp, Artificial Sequence
  chemically synthesized
ggatgtgtattatgttctct

SEQ ID NO: 226120 - DNA, 20 bp, Artificial Sequence
  chemically synthesized
gatgtgtattatgttctcta

SEQ ID NO: 226121 - DNA, 20 bp, Artificial Sequence
  chemically synthesized
cacacacttcacatacctta

SEQ ID NO: 226122 - DNA, 20 bp, Artificial Sequence
  chemically synthesized
ttcacacacttcacatacct

SEQ ID NO: 226123 - DNA, 20 bp, Artificial Sequence
  chemically synthesized
tatgttctctaaggtatgtg

SEQ ID NO: 226124 - DNA, 20 bp, Artificial Sequence
  chemically synthesized
aggtatgtgaagtgtgtgaa

SEQ ID NO: 226125 - DNA, 20 bp, Artificial Sequence
  chemically synthesized
tatgtgaagtgtgtgaaaag

SEQ ID NO: 226126 - DNA, 20 bp, Artificial Sequence
  chemically synthesized
atgtgaagtgtgtgaaaaga

SEQ ID NO: 226127 - DNA, 20 bp, Artificial Sequence
  chemically synthesized
tgtgaaaagaaggtccaaaa

SEQ ID NO: 226128 - DNA, 20 bp, Artificial Sequence
  chemically synthesized
gtgaaaagaaggtccaaaaa

SEQ ID NO: 226129 - DNA, 20 bp, Artificial Sequence
  chemically synthesized
gaaaagaaggtccaaaaaag

SEQ ID NO: 226130 - DNA, 20 bp, Artificial Sequence
  chemically synthesized
aaaagaaggtccaaaaaagg

SEQ ID NO: 226131 - DNA, 20 bp, Artificial Sequence
  chemically synthesized
tcaagcaagccctccttttt

SEQ ID NO: 226132 - DNA, 20 bp, Artificial Sequence
  chemically synthesized
aaagaaggtccaaaaaagga

SEQ ID NO: 226133 - DNA, 20 bp, Artificial Sequence
  chemically synthesized
caaaaaaggagggcttgctt

SEQ ID NO: 226134 - DNA, 20 bp, Artificial Sequence
  chemically synthesized
ggatatcagtcatctcaagc

SEQ ID NO: 226135 - DNA, 20 bp, Artificial Sequence
  chemically synthesized
tcttggatatcagtcatctc

SEQ ID NO: 226136 - DNA, 20 bp, Artificial Sequence
  chemically synthesized
gcttgagatgactgatatcc

SEQ ID NO: 226137 - DNA, 20 bp, Artificial Sequence
  chemically synthesized
tgtactatcttcttggatat

SEQ ID NO: 226138 - DNA, 20 bp, Artificial Sequence
  chemically synthesized
tgagatgactgatatccaag

SEQ ID NO: 226139 - DNA, 20 bp, Artificial Sequence
  chemically synthesized
atgactgatatccaagaaga

SEQ ID NO: 226140 - DNA, 20 bp, Artificial Sequence
  chemically synthesized
gctagggtgtactatcttct

SEQ ID NO: 226141 - DNA, 20 bp, Artificial Sequence
  chemically synthesized
tccaagaagatagtacaccc

SEQ ID NO: 226142 - DNA, 20 bp, Artificial Sequence
  chemically synthesized
agatagtacaccctagctgt

SEQ ID NO: 226143 - DNA, 20 bp, Artificial Sequence
  chemically synthesized
gtcaatggttctgacagcta

SEQ ID NO: 226144 - DNA, 20 bp, Artificial Sequence
  chemically synthesized
agtcaatggttctgacagct

SEQ ID NO: 226145 - DNA, 20 bp, Artificial Sequence
  chemically synthesized
aagtcaatggttctgacagc

SEQ ID NO: 226146 - DNA, 20 bp, Artificial Sequence
  chemically synthesized
cttaaagtcaatggttctga

SEQ ID NO: 226147 - DNA, 20 bp, Artificial Sequence
  chemically synthesized
tcttcagcccttaaagtcaa

SEQ ID NO: 226148 - DNA, 20 bp, Artificial Sequence
  chemically synthesized
ctgtcagaaccattgacttt

SEQ ID NO: 226149 - DNA, 20 bp, Artificial Sequence
  chemically synthesized
tgtcagaaccattgacttta

SEQ ID NO: 226150 - DNA, 20 bp, Artificial Sequence
  chemically synthesized
gtcagaaccattgactttaa

SEQ ID NO: 226151 - DNA, 20 bp, Artificial Sequence
  chemically synthesized
tatgatatcttcagccctta

SEQ ID NO: 226152 - DNA, 20 bp, Artificial Sequence
  chemically synthesized
accattgactttaagggctg

SEQ ID NO: 226153 - DNA, 20 bp, Artificial Sequence
  chemically synthesized
ggatagttttatgatatctt

SEQ ID NO: 226154 - DNA, 20 bp, Artificial Sequence
  chemically synthesized
gtcctcatctgcaaaatgga

SEQ ID NO: 226155 - DNA, 20 bp, Artificial Sequence
  chemically synthesized
tcataaaactatccattttg

SEQ ID NO: 226156 - DNA, 20 bp, Artificial Sequence
  chemically synthesized
cagtgtcctcatctgcaaaa

SEQ ID NO: 226157 - DNA, 20 bp, Artificial Sequence
  chemically synthesized
aaactatccattttgcagat

SEQ ID NO: 226158 - DNA, 20 bp, Artificial Sequence
  chemically synthesized
aactatccattttgcagatg

SEQ ID NO: 226159 - DNA, 20 bp, Artificial Sequence
  chemically synthesized
attttgcagatgaggacact

SEQ ID NO: 226160 - DNA, 20 bp, Artificial Sequence
  chemically synthesized
ttttgcagatgaggacactg

SEQ ID NO: 226161 - DNA, 20 bp, Artificial Sequence
  chemically synthesized
cagatgaggacactgaggct

SEQ ID NO: 226162 - DNA, 20 bp, Artificial Sequence
  chemically synthesized
tatttcaccgaacttagcct

SEQ ID NO: 226163 - DNA, 20 bp, Artificial Sequence
  chemically synthesized
gaggacactgaggctaagtt

SEQ ID NO: 226164 - DNA, 20 bp, Artificial Sequence
  chemically synthesized
gcaagttatttcaccgaact

SEQ ID NO: 226165 - DNA, 20 bp, Artificial Sequence
  chemically synthesized
gttcggtgaaataacttgcc

SEQ ID NO: 226166 - DNA, 20 bp, Artificial Sequence
  chemically synthesized
ttcggtgaaataacttgcct

SEQ ID NO: 226167 - DNA, 20 bp, Artificial Sequence
  chemically synthesized
tctaactctaaggcctaggc

SEQ ID NO: 226168 - DNA, 20 bp, Artificial Sequence
  chemically synthesized
gaaataacttgcctaggcct

SEQ ID NO: 226169 - DNA, 20 bp, Artificial Sequence
  chemically synthesized
gtgttctaactctaaggcct

SEQ ID NO: 226170 - DNA, 20 bp, Artificial Sequence
  chemically synthesized
aataacttgcctaggcctta

SEQ ID NO: 226171 - DNA, 20 bp, Artificial Sequence
  chemically synthesized
agtgttctaactctaaggcc

SEQ ID NO: 226172 - DNA, 20 bp, Artificial Sequence
  chemically synthesized
acttgcctaggccttagagt

SEQ ID NO: 226173 - DNA, 20 bp, Artificial Sequence
  chemically synthesized
ttgctagtgttctaactcta

SEQ ID NO: 226174 - DNA, 20 bp, Artificial Sequence
  chemically synthesized
cttgctagtgttctaactct

SEQ ID NO: 226175 - DNA, 20 bp, Artificial Sequence
  chemically synthesized
aggccttagagttagaacac

SEQ ID NO: 226176 - DNA, 20 bp, Artificial Sequence
  chemically synthesized
cttagagttagaacactagc

SEQ ID NO: 226177 - DNA, 20 bp, Artificial Sequence
  chemically synthesized
ttagagttagaacactagca

SEQ ID NO: 226178 - DNA, 20 bp, Artificial Sequence
  chemically synthesized
gagttagaacactagcaagg

SEQ ID NO: 226179 - DNA, 20 bp, Artificial Sequence
  chemically synthesized
agttagaacactagcaaggc

SEQ ID NO: 226180 - DNA, 20 bp, Artificial Sequence
  chemically synthesized
aggtttcaatcctgccttgc

SEQ ID NO: 226181 - DNA, 20 bp, Artificial Sequence
  chemically synthesized
agcaaggcaggattgaaacc

SEQ ID NO: 226182 - DNA, 20 bp, Artificial Sequence
  chemically synthesized
aggattgaaacctagtgaat

SEQ ID NO: 226183 - DNA, 20 bp, Artificial Sequence
  chemically synthesized
tttgaagcctctcattcact

SEQ ID NO: 226184 - DNA, 20 bp, Artificial Sequence
  chemically synthesized
ttttgaagcctctcattcac

SEQ ID NO: 226185 - DNA, 20 bp, Artificial Sequence
  chemically synthesized
gattgaaacctagtgaatga

SEQ ID NO: 226186 - DNA, 20 bp, Artificial Sequence
  chemically synthesized
attgaaacctagtgaatgag

SEQ ID NO: 226187 - DNA, 20 bp, Artificial Sequence
  chemically synthesized
agtgaatgagaggcttcaaa

SEQ ID NO: 226188 - DNA, 20 bp, Artificial Sequence
  chemically synthesized
cattgttttctttctttttg

SEQ ID NO: 226189 - DNA, 20 bp, Artificial Sequence
  chemically synthesized
aatgagaggcttcaaaaaga

SEQ ID NO: 226190 - DNA, 20 bp, Artificial Sequence
  chemically synthesized
caaaaagaaagaaaacaatg

SEQ ID NO: 226191 - DNA, 20 bp, Artificial Sequence
  chemically synthesized
gaaagaaaacaatgtggaca

SEQ ID NO: 226192 - DNA, 20 bp, Artificial Sequence
  chemically synthesized
aaagaaaacaatgtggacac

SEQ ID NO: 226193 - DNA, 20 bp, Artificial Sequence
  chemically synthesized
aagaaaacaatgtggacaca

SEQ ID NO: 226194 - DNA, 20 bp, Artificial Sequence
  chemically synthesized
aacaatgtggacacagggaa

SEQ ID NO: 226195 - DNA, 20 bp, Artificial Sequence
  chemically synthesized
acaatgtggacacagggaaa

SEQ ID NO: 226196 - DNA, 20 bp, Artificial Sequence
  chemically synthesized
tgtggacacagggaaaaggt

SEQ ID NO: 226197 - DNA, 20 bp, Artificial Sequence
  chemically synthesized
gtggacacagggaaaaggtg

SEQ ID NO: 226198 - DNA, 20 bp, Artificial Sequence
  chemically synthesized
tggacacagggaaaaggtga

SEQ ID NO: 226199 - DNA, 20 bp, Artificial Sequence
  chemically synthesized
gacacagggaaaaggtgagg

SEQ ID NO: 226200 - DNA, 20 bp, Artificial Sequence
  chemically synthesized
cacagggaaaaggtgaggga

SEQ ID NO: 226201 - DNA, 20 bp, Artificial Sequence
  chemically synthesized
gaaaaggtgagggagagcat

SEQ ID NO: 226202 - DNA, 20 bp, Artificial Sequence
  chemically synthesized
aaaaggtgagggagagcatt

SEQ ID NO: 226203 - DNA, 20 bp, Artificial Sequence
  chemically synthesized
ttttaagccccacatgcatt

SEQ ID NO: 226204 - DNA, 20 bp, Artificial Sequence
  chemically synthesized
ggacaaatacctaatgcatg

SEQ ID NO: 226205 - DNA, 20 bp, Artificial Sequence
  chemically synthesized
gttttaagccccacatgcat

SEQ ID NO: 226206 - DNA, 20 bp, Artificial Sequence
  chemically synthesized
gacaaatacctaatgcatgt

SEQ ID NO: 226207 - DNA, 20 bp, Artificial Sequence
  chemically synthesized
acaaatacctaatgcatgtg

SEQ ID NO: 226208 - DNA, 20 bp, Artificial Sequence
  chemically synthesized
tgcatgtggggcttaaaacc

SEQ ID NO: 226209 - DNA, 20 bp, Artificial Sequence
  chemically synthesized
caacccgtcatctaggtttt

SEQ ID NO: 226210 - DNA, 20 bp, Artificial Sequence
  chemically synthesized
ggggcttaaaacctagatga

SEQ ID NO: 226211 - DNA, 20 bp, Artificial Sequence
  chemically synthesized
gggcttaaaacctagatgac

SEQ ID NO: 226212 - DNA, 20 bp, Artificial Sequence
  chemically synthesized
cacccatcaacccgtcatct

SEQ ID NO: 226213 - DNA, 20 bp, Artificial Sequence
  chemically synthesized
gcacccatcaacccgtcatc

SEQ ID NO: 226214 - DNA, 20 bp, Artificial Sequence
  chemically synthesized
aaacctagatgacgggttga

SEQ ID NO: 226215 - DNA, 20 bp, Artificial Sequence
  chemically synthesized
aacctagatgacgggttgat

SEQ ID NO: 226216 - DNA, 20 bp, Artificial Sequence
  chemically synthesized
agatgacgggttgatgggtg

SEQ ID NO: 226217 - DNA, 20 bp, Artificial Sequence
  chemically synthesized
atgggtgcagcaaaccaccg

SEQ ID NO: 226218 - DNA, 20 bp, Artificial Sequence
  chemically synthesized
taggtatacatttgccacgg

SEQ ID NO: 226219 - DNA, 20 bp, Artificial Sequence
  chemically synthesized
acataggtatacatttgcca

SEQ ID NO: 226220 - DNA, 20 bp, Artificial Sequence
  chemically synthesized
aatgtacaggtttgttacat

SEQ ID NO: 226221 - DNA, 20 bp, Artificial Sequence
  chemically synthesized
gaatgtacaggtttgttaca

SEQ ID NO: 226222 - DNA, 20 bp, Artificial Sequence
  chemically synthesized
gatacacgtgcagaatgtac

SEQ ID NO: 226223 - DNA, 20 bp, Artificial Sequence
  chemically synthesized
ggatacacgtgcagaatgta

SEQ ID NO: 226224 - DNA, 20 bp, Artificial Sequence
  chemically synthesized
taagttctgggatacacgtg

SEQ ID NO: 226225 - DNA, 20 bp, Artificial Sequence
  chemically synthesized
tacattctgcacgtgtatcc

SEQ ID NO: 226226 - DNA, 20 bp, Artificial Sequence
  chemically synthesized
attattatactttaagttct

SEQ ID NO: 226227 - DNA, 20 bp, Artificial Sequence
  chemically synthesized
cacgtgtatcccagaactta

SEQ ID NO: 226228 - DNA, 20 bp, Artificial Sequence
  chemically synthesized
tattattatactttaagttc

SEQ ID NO: 226229 - DNA, 20 bp, Artificial Sequence
  chemically synthesized
cttttttattattatacttt

SEQ ID NO: 226230 - DNA, 20 bp, Artificial Sequence
  chemically synthesized
cttaaagtataataataaaa

SEQ ID NO: 226231 - DNA, 20 bp, Artificial Sequence
  chemically synthesized
aagtataataataaaaaaga

SEQ ID NO: 226232 - DNA, 20 bp, Artificial Sequence
  chemically synthesized
tataataataaaaaagaaag

SEQ ID NO: 226233 - DNA, 20 bp, Artificial Sequence
  chemically synthesized
ataataataaaaaagaaaga

SEQ ID NO: 226234 - DNA, 20 bp, Artificial Sequence
  chemically synthesized
gaaagaaggaaaacaatgtg

SEQ ID NO: 226235 - DNA, 20 bp, Artificial Sequence
  chemically synthesized
gaaaacaatgtgaagaatga

SEQ ID NO: 226236 - DNA, 20 bp, Artificial Sequence
  chemically synthesized
aacaatgtgaagaatgaaag

SEQ ID NO: 226237 - DNA, 20 bp, Artificial Sequence
  chemically synthesized
acaatgtgaagaatgaaagc

SEQ ID NO: 226238 - DNA, 20 bp, Artificial Sequence
  chemically synthesized
tgtgaagaatgaaagcagga

SEQ ID NO: 226239 - DNA, 20 bp, Artificial Sequence
  chemically synthesized
gtgaagaatgaaagcaggat

SEQ ID NO: 226240 - DNA, 20 bp, Artificial Sequence
  chemically synthesized
tgaagaatgaaagcaggata

SEQ ID NO: 226241 - DNA, 20 bp, Artificial Sequence
  chemically synthesized
agaatgaaagcaggataggg

SEQ ID NO: 226242 - DNA, 20 bp, Artificial Sequence
  chemically synthesized
gaatgaaagcaggataggga

SEQ ID NO: 226243 - DNA, 20 bp, Artificial Sequence
  chemically synthesized
atgaaagcaggatagggaag

SEQ ID NO: 226244 - DNA, 20 bp, Artificial Sequence
  chemically synthesized
tgaaagcaggatagggaagg

SEQ ID NO: 226245 - DNA, 20 bp, Artificial Sequence
  chemically synthesized
gaaagcaggatagggaagga

SEQ ID NO: 226246 - DNA, 20 bp, Artificial Sequence
  chemically synthesized
aagcaggatagggaaggagg

SEQ ID NO: 226247 - DNA, 20 bp, Artificial Sequence
  chemically synthesized
tagggaaggagggagcgcta

SEQ ID NO: 226248 - DNA, 20 bp, Artificial Sequence
  chemically synthesized
aaggagggagcgctacagct

SEQ ID NO: 226249 - DNA, 20 bp, Artificial Sequence
  chemically synthesized
aggagggagcgctacagctc

SEQ ID NO: 226250 - DNA, 20 bp, Artificial Sequence
  chemically synthesized
ggagggagcgctacagctca

SEQ ID NO: 226251 - DNA, 20 bp, Artificial Sequence
  chemically synthesized
caagacttcaccctgagctg

SEQ ID NO: 226252 - DNA, 20 bp, Artificial Sequence
  chemically synthesized
gagcgctacagctcagggtg

SEQ ID NO: 226253 - DNA, 20 bp, Artificial Sequence
  chemically synthesized
gggatacaagacttcaccct

SEQ ID NO: 226254 - DNA, 20 bp, Artificial Sequence
  chemically synthesized
gacagaggcaaaggggatac

SEQ ID NO: 226255 - DNA, 20 bp, Artificial Sequence
  chemically synthesized
ctaaggggacagaggcaaag

SEQ ID NO: 226256 - DNA, 20 bp, Artificial Sequence
  chemically synthesized
actaaggggacagaggcaaa

SEQ ID NO: 226257 - DNA, 20 bp, Artificial Sequence
  chemically synthesized
tactaaggggacagaggcaa

SEQ ID NO: 226258 - DNA, 20 bp, Artificial Sequence
  chemically synthesized
ctactaaggggacagaggca

SEQ ID NO: 226259 - DNA, 20 bp, Artificial Sequence
  chemically synthesized
atttactactaaggggacag

SEQ ID NO: 226260 - DNA, 20 bp, Artificial Sequence
  chemically synthesized
tatttactactaaggggaca

SEQ ID NO: 226261 - DNA, 20 bp, Artificial Sequence
  chemically synthesized
cccctttgcctctgtcccct

SEQ ID NO: 226262 - DNA, 20 bp, Artificial Sequence
  chemically synthesized
aatatttactactaagggga

SEQ ID NO: 226263 - DNA, 20 bp, Artificial Sequence
  chemically synthesized
ctttgcctctgtccccttag

SEQ ID NO: 226264 - DNA, 20 bp, Artificial Sequence
  chemically synthesized
gagaaatatttactactaag

SEQ ID NO: 226265 - DNA, 20 bp, Artificial Sequence
  chemically synthesized
cgagaaatatttactactaa

SEQ ID NO: 226266 - DNA, 20 bp, Artificial Sequence
  chemically synthesized
ccgagaaatatttactacta

SEQ ID NO: 226267 - DNA, 20 bp, Artificial Sequence
  chemically synthesized
cccgagaaatatttactact

SEQ ID NO: 226268 - DNA, 20 bp, Artificial Sequence
  chemically synthesized
ccttagtagtaaatatttct

SEQ ID NO: 226269 - DNA, 20 bp, Artificial Sequence
  chemically synthesized
cttagtagtaaatatttctc

SEQ ID NO: 226270 - DNA, 20 bp, Artificial Sequence
  chemically synthesized
ttagtagtaaatatttctcg

SEQ ID NO: 226271 - DNA, 20 bp, Artificial Sequence
  chemically synthesized
ggatgttactgattcacccc

SEQ ID NO: 226272 - DNA, 20 bp, Artificial Sequence
  chemically synthesized
aaatatttctcggggtgaat

SEQ ID NO: 226273 - DNA, 20 bp, Artificial Sequence
  chemically synthesized
ggtgaatcagtaacatccct

SEQ ID NO: 226274 - DNA, 20 bp, Artificial Sequence
  chemically synthesized
acttctgtatgagaggctga

SEQ ID NO: 226275 - DNA, 20 bp, Artificial Sequence
  chemically synthesized
cacttctgtatgagaggctg

SEQ ID NO: 226276 - DNA, 20 bp, Artificial Sequence
  chemically synthesized
gcacttctgtatgagaggct

SEQ ID NO: 226277 - DNA, 20 bp, Artificial Sequence
  chemically synthesized
acatccctcagcctctcata

SEQ ID NO: 226278 - DNA, 20 bp, Artificial Sequence
  chemically synthesized
ctctggcacttctgtatgag

SEQ ID NO: 226279 - DNA, 20 bp, Artificial Sequence
  chemically synthesized
actctggcacttctgtatga

SEQ ID NO: 226280 - DNA, 20 bp, Artificial Sequence
  chemically synthesized
tccctcagcctctcatacag

SEQ ID NO: 226281 - DNA, 20 bp, Artificial Sequence
  chemically synthesized
acactctggcacttctgtat

SEQ ID NO: 226282 - DNA, 20 bp, Artificial Sequence
  chemically synthesized
agcctctcatacagaagtgc

SEQ ID NO: 226283 - DNA, 20 bp, Artificial Sequence
  chemically synthesized
cctctcatacagaagtgcca

SEQ ID NO: 226284 - DNA, 20 bp, Artificial Sequence
  chemically synthesized
agaatagccagatcacactc

SEQ ID NO: 226285 - DNA, 20 bp, Artificial Sequence
  chemically synthesized
agaagtgccagagtgtgatc

SEQ ID NO: 226286 - DNA, 20 bp, Artificial Sequence
  chemically synthesized
atgtttaatggcagaatagc

SEQ ID NO: 226287 - DNA, 20 bp, Artificial Sequence
  chemically synthesized
ttgaatgtttaatggcagaa

SEQ ID NO: 226288 - DNA, 20 bp, Artificial Sequence
  chemically synthesized
ggatcttgaatgtttaatgg

SEQ ID NO: 226289 - DNA, 20 bp, Artificial Sequence
  chemically synthesized
agaggatcttgaatgtttaa

SEQ ID NO: 226290 - DNA, 20 bp, Artificial Sequence
  chemically synthesized
tattctgccattaaacattc

SEQ ID NO: 226291 - DNA, 20 bp, Artificial Sequence
  chemically synthesized
ttctatgttcatggttgtag

SEQ ID NO: 226292 - DNA, 20 bp, Artificial Sequence
  chemically synthesized
cttctatgttcatggttgta

SEQ ID NO: 226293 - DNA, 20 bp, Artificial Sequence
  chemically synthesized
ttcttctatgttcatggttg

SEQ ID NO: 226294 - DNA, 20 bp, Artificial Sequence
  chemically synthesized
atcctctacaaccatgaaca

SEQ ID NO: 226295 - DNA, 20 bp, Artificial Sequence
  chemically synthesized
aaatcattcttctatgttca

SEQ ID NO: 226296 - DNA, 20 bp, Artificial Sequence
  chemically synthesized
ctctacaaccatgaacatag

SEQ ID NO: 226297 - DNA, 20 bp, Artificial Sequence
  chemically synthesized
tttgatacagcaagaacata

SEQ ID NO: 226298 - DNA, 20 bp, Artificial Sequence
  chemically synthesized
ctttgatacagcaagaacat

SEQ ID NO: 226299 - DNA, 20 bp, Artificial Sequence
  chemically synthesized
ctgagagtctttgatacagc

SEQ ID NO: 226300 - DNA, 20 bp, Artificial Sequence
  chemically synthesized
cttatgttcttgctgtatca

SEQ ID NO: 226301 - DNA, 20 bp, Artificial Sequence
  chemically synthesized
atctctgagagtctttgata

SEQ ID NO: 226302 - DNA, 20 bp, Artificial Sequence
  chemically synthesized
cttgctgtatcaaagactct

SEQ ID NO: 226303 - DNA, 20 bp, Artificial Sequence
  chemically synthesized
tgctgtatcaaagactctca

SEQ ID NO: 226304 - DNA, 20 bp, Artificial Sequence
  chemically synthesized
atgtctctgaaaatctctga

SEQ ID NO: 226305 - DNA, 20 bp, Artificial Sequence
  chemically synthesized
gcatgtctctgaaaatctct

SEQ ID NO: 226306 - DNA, 20 bp, Artificial Sequence
  chemically synthesized
caaagactctcagagatttt

SEQ ID NO: 226307 - DNA, 20 bp, Artificial Sequence
  chemically synthesized
aagactctcagagattttca

SEQ ID NO: 226308 - DNA, 20 bp, Artificial Sequence
  chemically synthesized
ttcattgatcagtatggaaa

SEQ ID NO: 226309 - DNA, 20 bp, Artificial Sequence
  chemically synthesized
cttcattgatcagtatggaa

SEQ ID NO: 226310 - DNA, 20 bp, Artificial Sequence
  chemically synthesized
cccatcttcattgatcagta

SEQ ID NO: 226311 - DNA, 20 bp, Artificial Sequence
  chemically synthesized
cttttccatactgatcaatg

SEQ ID NO: 226312 - DNA, 20 bp, Artificial Sequence
  chemically synthesized
ggtgacccatcttcattgat

SEQ ID NO: 226313 - DNA, 20 bp, Artificial Sequence
  chemically synthesized
tccatactgatcaatgaaga

SEQ ID NO: 226314 - DNA, 20 bp, Artificial Sequence
  chemically synthesized
ccatactgatcaatgaagat

SEQ ID NO: 226315 - DNA, 20 bp, Artificial Sequence
  chemically synthesized
gatcaatgaagatgggtcac

SEQ ID NO: 226316 - DNA, 20 bp, Artificial Sequence
  chemically synthesized
cactttgactacgatgtttc

SEQ ID NO: 226317 - DNA, 20 bp, Artificial Sequence
  chemically synthesized
atgggtcaccagaaacatcg

SEQ ID NO: 226318 - DNA, 20 bp, Artificial Sequence
  chemically synthesized
caccagaaacatcgtagtca

SEQ ID NO: 226319 - DNA, 20 bp, Artificial Sequence
  chemically synthesized
aaacatcgtagtcaaagtga

SEQ ID NO: 226320 - DNA, 20 bp, Artificial Sequence
  chemically synthesized
cagtttttgtactgccttcc

SEQ ID NO: 226321 - DNA, 20 bp, Artificial Sequence
  chemically synthesized
tgtaaaattatctgggaagg

SEQ ID NO: 226322 - DNA, 20 bp, Artificial Sequence
  chemically synthesized
gtctgtaaaattatctggga

SEQ ID NO: 226323 - DNA, 20 bp, Artificial Sequence
  chemically synthesized
agtctgtaaaattatctggg

SEQ ID NO: 226324 - DNA, 20 bp, Artificial Sequence
  chemically synthesized
gtcagtctgtaaaattatct

SEQ ID NO: 226325 - DNA, 20 bp, Artificial Sequence
  chemically synthesized
tgtcagtctgtaaaattatc

SEQ ID NO: 226326 - DNA, 20 bp, Artificial Sequence
  chemically synthesized
tgccttcccagataatttta

SEQ ID NO: 226327 - DNA, 20 bp, Artificial Sequence
  chemically synthesized
ttgttgcttcaaattcatgt

SEQ ID NO: 226328 - DNA, 20 bp, Artificial Sequence
  chemically synthesized
tacagactgacatgaatttg

SEQ ID NO: 226329 - DNA, 20 bp, Artificial Sequence
  chemically synthesized
tgacatgaatttgaagcaac

SEQ ID NO: 226330 - DNA, 20 bp, Artificial Sequence
  chemically synthesized
aaaaaaaaaaaaaaaaaaaa

SEQ ID NO: 226331 - DNA, 20 bp, Artificial Sequence
  chemically synthesized
tttttttttttttttttttt

SEQ ID NO: 226332 - DNA, 20 bp, Artificial Sequence
  chemically synthesized
tttttttttttttttttttg

SEQ ID NO: 226333 - DNA, 20 bp, Artificial Sequence
  chemically synthesized
ttttttttttttttttgagg

SEQ ID NO: 226334 - DNA, 20 bp, Artificial Sequence
  chemically synthesized
ttttttttttttttgaggcg

SEQ ID NO: 226335 - DNA, 20 bp, Artificial Sequence
  chemically synthesized
cattccagcctgggcaacaa

SEQ ID NO: 226336 - DNA, 20 bp, Artificial Sequence
  chemically synthesized
ggagttttgctcttgttgcc

SEQ ID NO: 226337 - DNA, 20 bp, Artificial Sequence
  chemically synthesized
gagttttgctcttgttgccc

SEQ ID NO: 226338 - DNA, 20 bp, Artificial Sequence
  chemically synthesized
tgcattccagcctgggcaac

SEQ ID NO: 226339 - DNA, 20 bp, Artificial Sequence
  chemically synthesized
tttgctcttgttgcccaggc

SEQ ID NO: 226340 - DNA, 20 bp, Artificial Sequence
  chemically synthesized
gtgccattgcattccagcct

SEQ ID NO: 226341 - DNA, 20 bp, Artificial Sequence
  chemically synthesized
tgtgccattgcattccagcc

SEQ ID NO: 226342 - DNA, 20 bp, Artificial Sequence
  chemically synthesized
aagattgtgccattgcattc

SEQ ID NO: 226343 - DNA, 20 bp, Artificial Sequence
  chemically synthesized
ttgcccaggctggaatgcaa

SEQ ID NO: 226344 - DNA, 20 bp, Artificial Sequence
  chemically synthesized
ggaatgcaatggcacaatct

SEQ ID NO: 226345 - DNA, 20 bp, Artificial Sequence
  chemically synthesized
tgaggcaggagaattgagcc

SEQ ID NO: 226346 - DNA, 20 bp, Artificial Sequence
  chemically synthesized
gaggctgaggcaggagaatt

SEQ ID NO: 226347 - DNA, 20 bp, Artificial Sequence
  chemically synthesized
ttggctcaattctcctgcct

SEQ ID NO: 226348 - DNA, 20 bp, Artificial Sequence
  chemically synthesized
tacttgggaggctgaggcag

SEQ ID NO: 226349 - DNA, 20 bp, Artificial Sequence
  chemically synthesized
ggtacttgggaggctgaggc

SEQ ID NO: 226350 - DNA, 20 bp, Artificial Sequence
  chemically synthesized
aggtacttgggaggctgagg

SEQ ID NO: 226351 - DNA, 20 bp, Artificial Sequence
  chemically synthesized
cccaggtacttgggaggctg

SEQ ID NO: 226352 - DNA, 20 bp, Artificial Sequence
  chemically synthesized
tcccaggtacttgggaggct

SEQ ID NO: 226353 - DNA, 20 bp, Artificial Sequence
  chemically synthesized
ttctcctgcctcagcctccc

SEQ ID NO: 226354 - DNA, 20 bp, Artificial Sequence
  chemically synthesized
tgtaatcccaggtacttggg

SEQ ID NO: 226355 - DNA, 20 bp, Artificial Sequence
  chemically synthesized
ctgtaatcccaggtacttgg

SEQ ID NO: 226356 - DNA, 20 bp, Artificial Sequence
  chemically synthesized
gcctcagcctcccaagtacc

SEQ ID NO: 226357 - DNA, 20 bp, Artificial Sequence
  chemically synthesized
gcctgtaatcccaggtactt

SEQ ID NO: 226358 - DNA, 20 bp, Artificial Sequence
  chemically synthesized
cctcagcctcccaagtacct

SEQ ID NO: 226359 - DNA, 20 bp, Artificial Sequence
  chemically synthesized
tgcctgtaatcccaggtact

SEQ ID NO: 226360 - DNA, 20 bp, Artificial Sequence
  chemically synthesized
ctcccaagtacctgggatta

SEQ ID NO: 226361 - DNA, 20 bp, Artificial Sequence
  chemically synthesized
tggcacatgcctgtaatccc

SEQ ID NO: 226362 - DNA, 20 bp, Artificial Sequence
  chemically synthesized
tcccaagtacctgggattac

SEQ ID NO: 226363 - DNA, 20 bp, Artificial Sequence
  chemically synthesized
gtggcacatgcctgtaatcc

SEQ ID NO: 226364 - DNA, 20 bp, Artificial Sequence
  chemically synthesized
caggcatgtgccacaacgcc

SEQ ID NO: 226365 - DNA, 20 bp, Artificial Sequence
  chemically synthesized
aaaaagttagctgggcgttg

SEQ ID NO: 226366 - DNA, 20 bp, Artificial Sequence
  chemically synthesized
aaaaaaaaaaaaagttagct

SEQ ID NO: 226367 - DNA, 20 bp, Artificial Sequence
  chemically synthesized
caaaaaaaaaaaaagttagc

SEQ ID NO: 226368 - DNA, 20 bp, Artificial Sequence
  chemically synthesized
aatacaaaaaaaaaaaaagt

SEQ ID NO: 226369 - DNA, 20 bp, Artificial Sequence
  chemically synthesized
taaaaatacaaaaaaaaaaa

SEQ ID NO: 226370 - DNA, 20 bp, Artificial Sequence
  chemically synthesized
tttttttttttttgtatttt

SEQ ID NO: 226371 - DNA, 20 bp, Artificial Sequence
  chemically synthesized
ttttttttttgtatttttag

SEQ ID NO: 226372 - DNA, 20 bp, Artificial Sequence
  chemically synthesized
ttttttttgtatttttagta

SEQ ID NO: 226373 - DNA, 20 bp, Artificial Sequence
  chemically synthesized
ttttgtatttttagtagaga

SEQ ID NO: 226374 - DNA, 20 bp, Artificial Sequence
  chemically synthesized
tttgtatttttagtagagat

SEQ ID NO: 226375 - DNA, 20 bp, Artificial Sequence
  chemically synthesized
ttgtatttttagtagagatg

SEQ ID NO: 226376 - DNA, 20 bp, Artificial Sequence
  chemically synthesized
tgtatttttagtagagatgg

SEQ ID NO: 226377 - DNA, 20 bp, Artificial Sequence
  chemically synthesized
agtagagatgggggttcacc

SEQ ID NO: 226378 - DNA, 20 bp, Artificial Sequence
  chemically synthesized
tgggggttcaccaagttgat

SEQ ID NO: 226379 - DNA, 20 bp, Artificial Sequence
  chemically synthesized
tgagaccagcctgatcaact

SEQ ID NO: 226380 - DNA, 20 bp, Artificial Sequence
  chemically synthesized
gggggttcaccaagttgatc

SEQ ID NO: 226381 - DNA, 20 bp, Artificial Sequence
  chemically synthesized
gttcaccaagttgatcaggc

SEQ ID NO: 226382 - DNA, 20 bp, Artificial Sequence
  chemically synthesized
tgaggtcaggagtttgagac

SEQ ID NO: 226383 - DNA, 20 bp, Artificial Sequence
  chemically synthesized
acacttgaggtcaggagttt

SEQ ID NO: 226384 - DNA, 20 bp, Artificial Sequence
  chemically synthesized
ggtggaacacttgaggtcag

SEQ ID NO: 226385 - DNA, 20 bp, Artificial Sequence
  chemically synthesized
ggtctcaaactcctgacctc

SEQ ID NO: 226386 - DNA, 20 bp, Artificial Sequence
  chemically synthesized
tgggtggaacacttgaggtc

SEQ ID NO: 226387 - DNA, 20 bp, Artificial Sequence
  chemically synthesized
gtgggtggaacacttgaggt

SEQ ID NO: 226388 - DNA, 20 bp, Artificial Sequence
  chemically synthesized
tgaggtgggtggaacacttg

SEQ ID NO: 226389 - DNA, 20 bp, Artificial Sequence
  chemically synthesized
ctgaggtgggtggaacactt

SEQ ID NO: 226390 - DNA, 20 bp, Artificial Sequence
  chemically synthesized
ctcaagtgttccacccacct

SEQ ID NO: 226391 - DNA, 20 bp, Artificial Sequence
  chemically synthesized
ctttgggagtctgaggtggg

SEQ ID NO: 226392 - DNA, 20 bp, Artificial Sequence
  chemically synthesized
gcactttgggagtctgaggt

SEQ ID NO: 226393 - DNA, 20 bp, Artificial Sequence
  chemically synthesized
agcactttgggagtctgagg

SEQ ID NO: 226394 - DNA, 20 bp, Artificial Sequence
  chemically synthesized
cccagcactttgggagtctg

SEQ ID NO: 226395 - DNA, 20 bp, Artificial Sequence
  chemically synthesized
tcccagcactttgggagtct

SEQ ID NO: 226396 - DNA, 20 bp, Artificial Sequence
  chemically synthesized
ccacccacctcagactccca

SEQ ID NO: 226397 - DNA, 20 bp, Artificial Sequence
  chemically synthesized
ctgtaatcccagcactttgg

SEQ ID NO: 226398 - DNA, 20 bp, Artificial Sequence
  chemically synthesized
acctcagactcccaaagtgc

SEQ ID NO: 226399 - DNA, 20 bp, Artificial Sequence
  chemically synthesized
gcctgtaatcccagcacttt

SEQ ID NO: 226400 - DNA, 20 bp, Artificial Sequence
  chemically synthesized
cctcagactcccaaagtgct

SEQ ID NO: 226401 - DNA, 20 bp, Artificial Sequence
  chemically synthesized
tgcctgtaatcccagcactt

SEQ ID NO: 226402 - DNA, 20 bp, Artificial Sequence
  chemically synthesized
ctcccaaagtgctgggatta

SEQ ID NO: 226403 - DNA, 20 bp, Artificial Sequence
  chemically synthesized
tcccaaagtgctgggattac

SEQ ID NO: 226404 - DNA, 20 bp, Artificial Sequence
  chemically synthesized
ttgttgcatgcctgtaatcc

SEQ ID NO: 226405 - DNA, 20 bp, Artificial Sequence
  chemically synthesized
tgggattacaggcatgcaac

SEQ ID NO: 226406 - DNA, 20 bp, Artificial Sequence
  chemically synthesized
atgcaacaagcatttttatg

SEQ ID NO: 226407 - DNA, 20 bp, Artificial Sequence
  chemically synthesized
aatgaatggctattcaggca

SEQ ID NO: 226408 - DNA, 20 bp, Artificial Sequence
  chemically synthesized
ttatgaagaccctgcctgaa

SEQ ID NO: 226409 - DNA, 20 bp, Artificial Sequence
  chemically synthesized
gaatgaatggctattcaggc

SEQ ID NO: 226410 - DNA, 20 bp, Artificial Sequence
  chemically synthesized
ggaatgaatggctattcagg

SEQ ID NO: 226411 - DNA, 20 bp, Artificial Sequence
  chemically synthesized
cttggaatgaatggctattc

SEQ ID NO: 226412 - DNA, 20 bp, Artificial Sequence
  chemically synthesized
ccttggaatgaatggctatt

SEQ ID NO: 226413 - DNA, 20 bp, Artificial Sequence
  chemically synthesized
tcaagtccccttggaatgaa

SEQ ID NO: 226414 - DNA, 20 bp, Artificial Sequence
  chemically synthesized
cctgaatagccattcattcc

SEQ ID NO: 226415 - DNA, 20 bp, Artificial Sequence
  chemically synthesized
ctgaatagccattcattcca

SEQ ID NO: 226416 - DNA, 20 bp, Artificial Sequence
  chemically synthesized
tgaatagccattcattccaa

SEQ ID NO: 226417 - DNA, 20 bp, Artificial Sequence
  chemically synthesized
gaatagccattcattccaag

SEQ ID NO: 226418 - DNA, 20 bp, Artificial Sequence
  chemically synthesized
tattcaaattcaagtcccct

SEQ ID NO: 226419 - DNA, 20 bp, Artificial Sequence
  chemically synthesized
tggaggtattattcaaattc

SEQ ID NO: 226420 - DNA, 20 bp, Artificial Sequence
  chemically synthesized
atttgaataatacctccaca

SEQ ID NO: 226421 - DNA, 20 bp, Artificial Sequence
  chemically synthesized
tttgagagtcatctgtgtgg

SEQ ID NO: 226422 - DNA, 20 bp, Artificial Sequence
  chemically synthesized
atttgagagtcatctgtgtg

SEQ ID NO: 226423 - DNA, 20 bp, Artificial Sequence
  chemically synthesized
agatttgagagtcatctgtg

SEQ ID NO: 226424 - DNA, 20 bp, Artificial Sequence
  chemically synthesized
tgctagagatgcagatttga

SEQ ID NO: 226425 - DNA, 20 bp, Artificial Sequence
  chemically synthesized
tgtgctagagatgcagattt

SEQ ID NO: 226426 - DNA, 20 bp, Artificial Sequence
  chemically synthesized
gactctcaaatctgcatctc

SEQ ID NO: 226427 - DNA, 20 bp, Artificial Sequence
  chemically synthesized
agaagtatgtgctagagatg

SEQ ID NO: 226428 - DNA, 20 bp, Artificial Sequence
  chemically synthesized
cagggaagaagtatgtgcta

SEQ ID NO: 226429 - DNA, 20 bp, Artificial Sequence
  chemically synthesized
ttcagggaagaagtatgtgc

SEQ ID NO: 226430 - DNA, 20 bp, Artificial Sequence
  chemically synthesized
aagtatgggattcagggaag

SEQ ID NO: 226431 - DNA, 20 bp, Artificial Sequence
  chemically synthesized
tgaaagtatgggattcaggg

SEQ ID NO: 226432 - DNA, 20 bp, Artificial Sequence
  chemically synthesized
ggatgaaagtatgggattca

SEQ ID NO: 226433 - DNA, 20 bp, Artificial Sequence
  chemically synthesized
tggatgaaagtatgggattc

SEQ ID NO: 226434 - DNA, 20 bp, Artificial Sequence
  chemically synthesized
ttggatgaaagtatgggatt

SEQ ID NO: 226435 - DNA, 20 bp, Artificial Sequence
  chemically synthesized
gtgcagttggatgaaagtat

SEQ ID NO: 226436 - DNA, 20 bp, Artificial Sequence
  chemically synthesized
agtgcagttggatgaaagta

SEQ ID NO: 226437 - DNA, 20 bp, Artificial Sequence
  chemically synthesized
caaagagtgcagttggatga

SEQ ID NO: 226438 - DNA, 20 bp, Artificial Sequence
  chemically synthesized
aaagtcacaaagagtgcagt

SEQ ID NO: 226439 - DNA, 20 bp, Artificial Sequence
  chemically synthesized
cagtaaagtcacaaagagtg

SEQ ID NO: 226440 - DNA, 20 bp, Artificial Sequence
  chemically synthesized
catcccagtaaagtcacaaa

SEQ ID NO: 226441 - DNA, 20 bp, Artificial Sequence
  chemically synthesized
gacatcccagtaaagtcaca

SEQ ID NO: 226442 - DNA, 20 bp, Artificial Sequence
  chemically synthesized
tgcactctttgtgactttac

SEQ ID NO: 226443 - DNA, 20 bp, Artificial Sequence
  chemically synthesized
gcactctttgtgactttact

SEQ ID NO: 226444 - DNA, 20 bp, Artificial Sequence
  chemically synthesized
tcttgttagacatcccagta

SEQ ID NO: 226445 - DNA, 20 bp, Artificial Sequence
  chemically synthesized
tgaaatcttgttagacatcc

SEQ ID NO: 226446 - DNA, 20 bp, Artificial Sequence
  chemically synthesized
actttactgggatgtctaac

SEQ ID NO: 226447 - DNA, 20 bp, Artificial Sequence
  chemically synthesized
tgttaggtttgaaatcttgt

SEQ ID NO: 226448 - DNA, 20 bp, Artificial Sequence
  chemically synthesized
aattttgttttggaattgtt

SEQ ID NO: 226449 - DNA, 20 bp, Artificial Sequence
  chemically synthesized
taattttgttttggaattgt

SEQ ID NO: 226450 - DNA, 20 bp, Artificial Sequence
  chemically synthesized
tggaagcaataattttgttt

SEQ ID NO: 226451 - DNA, 20 bp, Artificial Sequence
  chemically synthesized
tggtagaggggtaaaggtgg

SEQ ID NO: 226452 - DNA, 20 bp, Artificial Sequence
  chemically synthesized
agatggtagaggggtaaagg

SEQ ID NO: 226453 - DNA, 20 bp, Artificial Sequence
  chemically synthesized
gttagatggtagaggggtaa

SEQ ID NO: 226454 - DNA, 20 bp, Artificial Sequence
  chemically synthesized
agttagatggtagaggggta

SEQ ID NO: 226455 - DNA, 20 bp, Artificial Sequence
  chemically synthesized
gatcaagttagatggtagag

SEQ ID NO: 226456 - DNA, 20 bp, Artificial Sequence
  chemically synthesized
ggatcaagttagatggtaga

SEQ ID NO: 226457 - DNA, 20 bp, Artificial Sequence
  chemically synthesized
aggatcaagttagatggtag

SEQ ID NO: 226458 - DNA, 20 bp, Artificial Sequence
  chemically synthesized
aaggatcaagttagatggta

SEQ ID NO: 226459 - DNA, 20 bp, Artificial Sequence
  chemically synthesized
agaaggatcaagttagatgg

SEQ ID NO: 226460 - DNA, 20 bp, Artificial Sequence
  chemically synthesized
ggtagaaggatcaagttaga

SEQ ID NO: 226461 - DNA, 20 bp, Artificial Sequence
  chemically synthesized
aaatggtagaaggatcaagt

SEQ ID NO: 226462 - DNA, 20 bp, Artificial Sequence
  chemically synthesized
gagaaaatggtagaaggatc

SEQ ID NO: 226463 - DNA, 20 bp, Artificial Sequence
  chemically synthesized
agaattgagaaaatggtaga

SEQ ID NO: 226464 - DNA, 20 bp, Artificial Sequence
  chemically synthesized
tagaattgagaaaatggtag

SEQ ID NO: 226465 - DNA, 20 bp, Artificial Sequence
  chemically synthesized
gaatagaattgagaaaatgg

SEQ ID NO: 226466 - DNA, 20 bp, Artificial Sequence
  chemically synthesized
ggtgaatagaattgagaaaa

SEQ ID NO: 226467 - DNA, 20 bp, Artificial Sequence
  chemically synthesized
tggataaggtgaatagaatt

SEQ ID NO: 226468 - DNA, 20 bp, Artificial Sequence
  chemically synthesized
tccaaggtggataaggtgaa

SEQ ID NO: 226469 - DNA, 20 bp, Artificial Sequence
  chemically synthesized
ggatgagtccaaggtggata

SEQ ID NO: 226470 - DNA, 20 bp, Artificial Sequence
  chemically synthesized
aggatgagtccaaggtggat

SEQ ID NO: 226471 - DNA, 20 bp, Artificial Sequence
  chemically synthesized
tctattcaccttatccacct

SEQ ID NO: 226472 - DNA, 20 bp, Artificial Sequence
  chemically synthesized
agcccaggatgagtccaagg

SEQ ID NO: 226473 - DNA, 20 bp, Artificial Sequence
  chemically synthesized
aagagcccaggatgagtcca

SEQ ID NO: 226474 - DNA, 20 bp, Artificial Sequence
  chemically synthesized
gaagagcccaggatgagtcc

SEQ ID NO: 226475 - DNA, 20 bp, Artificial Sequence
  chemically synthesized
tatccaccttggactcatcc

SEQ ID NO: 226476 - DNA, 20 bp, Artificial Sequence
  chemically synthesized
atccaccttggactcatcct

SEQ ID NO: 226477 - DNA, 20 bp, Artificial Sequence
  chemically synthesized
gaaagagaagagcccaggat

SEQ ID NO: 226478 - DNA, 20 bp, Artificial Sequence
  chemically synthesized
ggaaagaaagagaagagccc

SEQ ID NO: 226479 - DNA, 20 bp, Artificial Sequence
  chemically synthesized
gggaaagaaagagaagagcc

SEQ ID NO: 226480 - DNA, 20 bp, Artificial Sequence
  chemically synthesized
ggggtgggaaagaaagagaa

SEQ ID NO: 226481 - DNA, 20 bp, Artificial Sequence
  chemically synthesized
atggggtgggaaagaaagag

SEQ ID NO: 226482 - DNA, 20 bp, Artificial Sequence
  chemically synthesized
ggtatggggtgggaaagaaa

SEQ ID NO: 226483 - DNA, 20 bp, Artificial Sequence
  chemically synthesized
ggggtatggggtgggaaaga

SEQ ID NO: 226484 - DNA, 20 bp, Artificial Sequence
  chemically synthesized
gaatggggtatggggtggga

SEQ ID NO: 226485 - DNA, 20 bp, Artificial Sequence
  chemically synthesized
tgatgaatggggtatggggt

SEQ ID NO: 226486 - DNA, 20 bp, Artificial Sequence
  chemically synthesized
ctgatgaatggggtatgggg

SEQ ID NO: 226487 - DNA, 20 bp, Artificial Sequence
  chemically synthesized
ttgctgatgaatggggtatg

SEQ ID NO: 226488 - DNA, 20 bp, Artificial Sequence
  chemically synthesized
tttgctgatgaatggggtat

SEQ ID NO: 226489 - DNA, 20 bp, Artificial Sequence
  chemically synthesized
gtttgctgatgaatggggta

SEQ ID NO: 226490 - DNA, 20 bp, Artificial Sequence
  chemically synthesized
ccaccccataccccattcat

SEQ ID NO: 226491 - DNA, 20 bp, Artificial Sequence
  chemically synthesized
accaggtttgctgatgaatg

SEQ ID NO: 226492 - DNA, 20 bp, Artificial Sequence
  chemically synthesized
taccaggtttgctgatgaat

SEQ ID NO: 226493 - DNA, 20 bp, Artificial Sequence
  chemically synthesized
ctaccaggtttgctgatgaa

SEQ ID NO: 226494 - DNA, 20 bp, Artificial Sequence
  chemically synthesized
accccattcatcagcaaacc

SEQ ID NO: 226495 - DNA, 20 bp, Artificial Sequence
  chemically synthesized
ccattcatcagcaaacctgg

SEQ ID NO: 226496 - DNA, 20 bp, Artificial Sequence
  chemically synthesized
ttttggaaggtagcactacc

SEQ ID NO: 226497 - DNA, 20 bp, Artificial Sequence
  chemically synthesized
tttttggaaggtagcactac

SEQ ID NO: 226498 - DNA, 20 bp, Artificial Sequence
  chemically synthesized
ttctgggtatttttggaagg

SEQ ID NO: 226499 - DNA, 20 bp, Artificial Sequence
  chemically synthesized
ggattctgggtatttttgga

SEQ ID NO: 226500 - DNA, 20 bp, Artificial Sequence
  chemically synthesized
tggattctgggtatttttgg

SEQ ID NO: 226501 - DNA, 20 bp, Artificial Sequence
  chemically synthesized
acatggattctgggtatttt

SEQ ID NO: 226502 - DNA, 20 bp, Artificial Sequence
  chemically synthesized
tgctaccttccaaaaatacc

SEQ ID NO: 226503 - DNA, 20 bp, Artificial Sequence
  chemically synthesized
atgagaggtacatggattct

SEQ ID NO: 226504 - DNA, 20 bp, Artificial Sequence
  chemically synthesized
aatgagaggtacatggattc

SEQ ID NO: 226505 - DNA, 20 bp, Artificial Sequence
  chemically synthesized
tgaaaacaatgagaggtaca

SEQ ID NO: 226506 - DNA, 20 bp, Artificial Sequence
  chemically synthesized
ctttcagtgaaaacaatgag

SEQ ID NO: 226507 - DNA, 20 bp, Artificial Sequence
  chemically synthesized
gctttcagtgaaaacaatga

SEQ ID NO: 226508 - DNA, 20 bp, Artificial Sequence
  chemically synthesized
aagctttcagtgaaaacaat

SEQ ID NO: 226509 - DNA, 20 bp, Artificial Sequence
  chemically synthesized
cctctcattgttttcactga

SEQ ID NO: 226510 - DNA, 20 bp, Artificial Sequence
  chemically synthesized
attctaaaccaggaagcttt

SEQ ID NO: 226511 - DNA, 20 bp, Artificial Sequence
  chemically synthesized
tgttttcactgaaagcttcc

SEQ ID NO: 226512 - DNA, 20 bp, Artificial Sequence
  chemically synthesized
tcactgaaagcttcctggtt

SEQ ID NO: 226513 - DNA, 20 bp, Artificial Sequence
  chemically synthesized
aatggtgattctaaaccagg

SEQ ID NO: 226514 - DNA, 20 bp, Artificial Sequence
  chemically synthesized
aataatggtgattctaaacc

SEQ ID NO: 226515 - DNA, 20 bp, Artificial Sequence
  chemically synthesized
aaataatggtgattctaaac

SEQ ID NO: 226516 - DNA, 20 bp, Artificial Sequence
  chemically synthesized
ataattcaaatgagaaataa

SEQ ID NO: 226517 - DNA, 20 bp, Artificial Sequence
  chemically synthesized
gtcattgcaataattcaaat

SEQ ID NO: 226518 - DNA, 20 bp, Artificial Sequence
  chemically synthesized
agtacctattgaagcagagg

SEQ ID NO: 226519 - DNA, 20 bp, Artificial Sequence
  chemically synthesized
agagtacctattgaagcaga

SEQ ID NO: 226520 - DNA, 20 bp, Artificial Sequence
  chemically synthesized
aagagtacctattgaagcag

SEQ ID NO: 226521 - DNA, 20 bp, Artificial Sequence
  chemically synthesized
taagagtacctattgaagca

SEQ ID NO: 226522 - DNA, 20 bp, Artificial Sequence
  chemically synthesized
aatgactccctctgcttcaa

SEQ ID NO: 226523 - DNA, 20 bp, Artificial Sequence
  chemically synthesized
atgactccctctgcttcaat

SEQ ID NO: 226524 - DNA, 20 bp, Artificial Sequence
  chemically synthesized
agtaagagtacctattgaag

SEQ ID NO: 226525 - DNA, 20 bp, Artificial Sequence
  chemically synthesized
gagagtaagagtacctattg

SEQ ID NO: 226526 - DNA, 20 bp, Artificial Sequence
  chemically synthesized
gagtggagaacagagagtaa

SEQ ID NO: 226527 - DNA, 20 bp, Artificial Sequence
  chemically synthesized
cggagtggagaacagagagt

SEQ ID NO: 226528 - DNA, 20 bp, Artificial Sequence
  chemically synthesized
gccacggagtggagaacaga

SEQ ID NO: 226529 - DNA, 20 bp, Artificial Sequence
  chemically synthesized
tagccacggagtggagaaca

SEQ ID NO: 226530 - DNA, 20 bp, Artificial Sequence
  chemically synthesized
tctagccacggagtggagaa

SEQ ID NO: 226531 - DNA, 20 bp, Artificial Sequence
  chemically synthesized
actctctgttctccactccg

SEQ ID NO: 226532 - DNA, 20 bp, Artificial Sequence
  chemically synthesized
attgttctagccacggagtg

SEQ ID NO: 226533 - DNA, 20 bp, Artificial Sequence
  chemically synthesized
gaattgttctagccacggag

SEQ ID NO: 226534 - DNA, 20 bp, Artificial Sequence
  chemically synthesized
tctgttctccactccgtggc

SEQ ID NO: 226535 - DNA, 20 bp, Artificial Sequence
  chemically synthesized
gatgaattgttctagccacg

SEQ ID NO: 226536 - DNA, 20 bp, Artificial Sequence
  chemically synthesized
gagatgaattgttctagcca

SEQ ID NO: 226537 - DNA, 20 bp, Artificial Sequence
  chemically synthesized
agaaaggagatgaattgttc

SEQ ID NO: 226538 - DNA, 20 bp, Artificial Sequence
  chemically synthesized
actcatttggggaaagaaag

SEQ ID NO: 226539 - DNA, 20 bp, Artificial Sequence
  chemically synthesized
aaactcatttggggaaagaa

SEQ ID NO: 226540 - DNA, 20 bp, Artificial Sequence
  chemically synthesized
taaactcatttggggaaaga

SEQ ID NO: 226541 - DNA, 20 bp, Artificial Sequence
  chemically synthesized
taagtaaactcatttgggga

SEQ ID NO: 226542 - DNA, 20 bp, Artificial Sequence
  chemically synthesized
tctcctttctttccccaaat

SEQ ID NO: 226543 - DNA, 20 bp, Artificial Sequence
  chemically synthesized
tttctaagtaaactcatttg

SEQ ID NO: 226544 - DNA, 20 bp, Artificial Sequence
  chemically synthesized
ttttctaagtaaactcattt

SEQ ID NO: 226545 - DNA, 20 bp, Artificial Sequence
  chemically synthesized
gttttctaagtaaactcatt

SEQ ID NO: 226546 - DNA, 20 bp, Artificial Sequence
  chemically synthesized
tttccccaaatgagtttact

SEQ ID NO: 226547 - DNA, 20 bp, Artificial Sequence
  chemically synthesized
tcttttcaagggagttttct

SEQ ID NO: 226548 - DNA, 20 bp, Artificial Sequence
  chemically synthesized
acttagaaaactcccttgaa

SEQ ID NO: 226549 - DNA, 20 bp, Artificial Sequence
  chemically synthesized
atgattttgtcttttcaagg

SEQ ID NO: 226550 - DNA, 20 bp, Artificial Sequence
  chemically synthesized
ctatgattttgtcttttcaa

SEQ ID NO: 226551 - DNA, 20 bp, Artificial Sequence
  chemically synthesized
tctatgattttgtcttttca

SEQ ID NO: 226552 - DNA, 20 bp, Artificial Sequence
  chemically synthesized
ctctatgattttgtcttttc

SEQ ID NO: 226553 - DNA, 20 bp, Artificial Sequence
  chemically synthesized
cccttgaaaagacaaaatca

SEQ ID NO: 226554 - DNA, 20 bp, Artificial Sequence
  chemically synthesized
cttgaaaagacaaaatcata

SEQ ID NO: 226555 - DNA, 20 bp, Artificial Sequence
  chemically synthesized
aaaagacaaaatcatagaga

SEQ ID NO: 226556 - DNA, 20 bp, Artificial Sequence
  chemically synthesized
aagacaaaatcatagagatg

SEQ ID NO: 226557 - DNA, 20 bp, Artificial Sequence
  chemically synthesized
aaaatcatagagatggagaa

SEQ ID NO: 226558 - DNA, 20 bp, Artificial Sequence
  chemically synthesized
catagagatggagaacagat

SEQ ID NO: 226559 - DNA, 20 bp, Artificial Sequence
  chemically synthesized
atagagatggagaacagatt

SEQ ID NO: 226560 - DNA, 20 bp, Artificial Sequence
  chemically synthesized
tagagatggagaacagatta

SEQ ID NO: 226561 - DNA, 20 bp, Artificial Sequence
  chemically synthesized
agagatggagaacagattag

SEQ ID NO: 226562 - DNA, 20 bp, Artificial Sequence
  chemically synthesized
gagaacagattaggggttgc

SEQ ID NO: 226563 - DNA, 20 bp, Artificial Sequence
  chemically synthesized
attaggggttgctagtgatt

SEQ ID NO: 226564 - DNA, 20 bp, Artificial Sequence
  chemically synthesized
ttaggggttgctagtgattc

SEQ ID NO: 226565 - DNA, 20 bp, Artificial Sequence
  chemically synthesized
cattctacttcctgaatcac

SEQ ID NO: 226566 - DNA, 20 bp, Artificial Sequence
  chemically synthesized
ggggttgctagtgattcagg

SEQ ID NO: 226567 - DNA, 20 bp, Artificial Sequence
  chemically synthesized
gttgctagtgattcaggaag

SEQ ID NO: 226568 - DNA, 20 bp, Artificial Sequence
  chemically synthesized
tagtgattcaggaagtagaa

SEQ ID NO: 226569 - DNA, 20 bp, Artificial Sequence
  chemically synthesized
agtgattcaggaagtagaat

SEQ ID NO: 226570 - DNA, 20 bp, Artificial Sequence
  chemically synthesized
tgattcaggaagtagaatgg

SEQ ID NO: 226571 - DNA, 20 bp, Artificial Sequence
  chemically synthesized
caggaagtagaatgggagat

SEQ ID NO: 226572 - DNA, 20 bp, Artificial Sequence
  chemically synthesized
aagtagaatgggagattgga

SEQ ID NO: 226573 - DNA, 20 bp, Artificial Sequence
  chemically synthesized
agtagaatgggagattggat

SEQ ID NO: 226574 - DNA, 20 bp, Artificial Sequence
  chemically synthesized
ttggatgggtgtgacaatta

SEQ ID NO: 226575 - DNA, 20 bp, Artificial Sequence
  chemically synthesized
tggatgggtgtgacaattaa

SEQ ID NO: 226576 - DNA, 20 bp, Artificial Sequence
  chemically synthesized
ggatgggtgtgacaattaaa

SEQ ID NO: 226577 - DNA, 20 bp, Artificial Sequence
  chemically synthesized
tgggtgtgacaattaaaggg

SEQ ID NO: 226578 - DNA, 20 bp, Artificial Sequence
  chemically synthesized
tgacaattaaagggtggctt

SEQ ID NO: 226579 - DNA, 20 bp, Artificial Sequence
  chemically synthesized
aattaaagggtggcttgaga

SEQ ID NO: 226580 - DNA, 20 bp, Artificial Sequence
  chemically synthesized
cgtcacaaaggaactatctc

SEQ ID NO: 226581 - DNA, 20 bp, Artificial Sequence
  chemically synthesized
gaatagttccagcgtcacaa

SEQ ID NO: 226582 - DNA, 20 bp, Artificial Sequence
  chemically synthesized
tgaatagttccagcgtcaca

SEQ ID NO: 226583 - DNA, 20 bp, Artificial Sequence
  chemically synthesized
agatagttcctttgtgacgc

SEQ ID NO: 226584 - DNA, 20 bp, Artificial Sequence
  chemically synthesized
tacatggtactgaatagttc

SEQ ID NO: 226585 - DNA, 20 bp, Artificial Sequence
  chemically synthesized
tttgtgacgctggaactatt

SEQ ID NO: 226586 - DNA, 20 bp, Artificial Sequence
  chemically synthesized
ttttgatacatggtactgaa

SEQ ID NO: 226587 - DNA, 20 bp, Artificial Sequence
  chemically synthesized
actacccctattttgataca

SEQ ID NO: 226588 - DNA, 20 bp, Artificial Sequence
  chemically synthesized
ttcagtaccatgtatcaaaa

SEQ ID NO: 226589 - DNA, 20 bp, Artificial Sequence
  chemically synthesized
tcagtaccatgtatcaaaat

SEQ ID NO: 226590 - DNA, 20 bp, Artificial Sequence
  chemically synthesized
cagtaccatgtatcaaaata

SEQ ID NO: 226591 - DNA, 20 bp, Artificial Sequence
  chemically synthesized
agtaccatgtatcaaaatag

SEQ ID NO: 226592 - DNA, 20 bp, Artificial Sequence
  chemically synthesized
accatgtatcaaaatagggg

SEQ ID NO: 226593 - DNA, 20 bp, Artificial Sequence
  chemically synthesized
ttgttatatgactctaaaca

SEQ ID NO: 226594 - DNA, 20 bp, Artificial Sequence
  chemically synthesized
gcaattttataccatgttta

SEQ ID NO: 226595 - DNA, 20 bp, Artificial Sequence
  chemically synthesized
atgcaattttataccatgtt

SEQ ID NO: 226596 - DNA, 20 bp, Artificial Sequence
  chemically synthesized
aaacatggtataaaattgca

SEQ ID NO: 226597 - DNA, 20 bp, Artificial Sequence
  chemically synthesized
tataaaattgcatagaatga

SEQ ID NO: 226598 - DNA, 20 bp, Artificial Sequence
  chemically synthesized
attgcatagaatgacagaca

SEQ ID NO: 226599 - DNA, 20 bp, Artificial Sequence
  chemically synthesized
atagaatgacagacacagat

SEQ ID NO: 226600 - DNA, 20 bp, Artificial Sequence
  chemically synthesized
acacagataagtgcatgtaa

SEQ ID NO: 226601 - DNA, 20 bp, Artificial Sequence
  chemically synthesized
agataagtgcatgtaaaagc

SEQ ID NO: 226602 - DNA, 20 bp, Artificial Sequence
  chemically synthesized
aagtgcatgtaaaagctggt

SEQ ID NO: 226603 - DNA, 20 bp, Artificial Sequence
  chemically synthesized
atgccttattcagatctcac

SEQ ID NO: 226604 - DNA, 20 bp, Artificial Sequence
  chemically synthesized
aaagctggtgagatctgaat

SEQ ID NO: 226605 - DNA, 20 bp, Artificial Sequence
  chemically synthesized
aagctggtgagatctgaata

SEQ ID NO: 226606 - DNA, 20 bp, Artificial Sequence
  chemically synthesized
aacacaatctatgccttatt

SEQ ID NO: 226607 - DNA, 20 bp, Artificial Sequence
  chemically synthesized
ggtgagatctgaataaggca

SEQ ID NO: 226608 - DNA, 20 bp, Artificial Sequence
  chemically synthesized
ttgtgttaatatcaatttcc

SEQ ID NO: 226609 - DNA, 20 bp, Artificial Sequence
  chemically synthesized
ctatgcacaatataaaaacc

SEQ ID NO: 226610 - DNA, 20 bp, Artificial Sequence
  chemically synthesized
gctatgcacaatataaaaac

SEQ ID NO: 226611 - DNA, 20 bp, Artificial Sequence
  chemically synthesized
cctggtttttatattgtgca

SEQ ID NO: 226612 - DNA, 20 bp, Artificial Sequence
  chemically synthesized
tatattgtgcatagctatgt

SEQ ID NO: 226613 - DNA, 20 bp, Artificial Sequence
  chemically synthesized
ttcagatctcacatcttaca

SEQ ID NO: 226614 - DNA, 20 bp, Artificial Sequence
  chemically synthesized
tgcatagctatgtaagatgt

SEQ ID NO: 226615 - DNA, 20 bp, Artificial Sequence
  chemically synthesized
taagatgtgagatctgaata

SEQ ID NO: 226616 - DNA, 20 bp, Artificial Sequence
  chemically synthesized
gatacaatctatgctttatt

SEQ ID NO: 226617 - DNA, 20 bp, Artificial Sequence
  chemically synthesized
tgtgagatctgaataaagca

SEQ ID NO: 226618 - DNA, 20 bp, Artificial Sequence
  chemically synthesized
ttgtatcaacatcaatttcc

SEQ ID NO: 226619 - DNA, 20 bp, Artificial Sequence
  chemically synthesized
acatcaatttcctggtttcc

SEQ ID NO: 226620 - DNA, 20 bp, Artificial Sequence
  chemically synthesized
aatatcaaagccaggaaacc

SEQ ID NO: 226621 - DNA, 20 bp, Artificial Sequence
  chemically synthesized
taatatcaaagccaggaaac

SEQ ID NO: 226622 - DNA, 20 bp, Artificial Sequence
  chemically synthesized
ttatatgtaatatcaaagcc

SEQ ID NO: 226623 - DNA, 20 bp, Artificial Sequence
  chemically synthesized
attatatgtaatatcaaagc

SEQ ID NO: 226624 - DNA, 20 bp, Artificial Sequence
  chemically synthesized
cataattatatgtaatatca

SEQ ID NO: 226625 - DNA, 20 bp, Artificial Sequence
  chemically synthesized
gatattacatataattatgt

SEQ ID NO: 226626 - DNA, 20 bp, Artificial Sequence
  chemically synthesized
attatgtaagatgtaaccat

SEQ ID NO: 226627 - DNA, 20 bp, Artificial Sequence
  chemically synthesized
taagatgtaaccattagctg

SEQ ID NO: 226628 - DNA, 20 bp, Artificial Sequence
  chemically synthesized
cttcactcatcttcagctaa

SEQ ID NO: 226629 - DNA, 20 bp, Artificial Sequence
  chemically synthesized
tgtaaccattagctgaagat

SEQ ID NO: 226630 - DNA, 20 bp, Artificial Sequence
  chemically synthesized
gagtacccttcactcatctt

SEQ ID NO: 226631 - DNA, 20 bp, Artificial Sequence
  chemically synthesized
ccattagctgaagatgagtg

SEQ ID NO: 226632 - DNA, 20 bp, Artificial Sequence
  chemically synthesized
cattagctgaagatgagtga

SEQ ID NO: 226633 - DNA, 20 bp, Artificial Sequence
  chemically synthesized
attagctgaagatgagtgaa

SEQ ID NO: 226634 - DNA, 20 bp, Artificial Sequence
  chemically synthesized
aaagtattaagaaagatcat

SEQ ID NO: 226635 - DNA, 20 bp, Artificial Sequence
  chemically synthesized
aagttgcaaaagtattaaga

SEQ ID NO: 226636 - DNA, 20 bp, Artificial Sequence
  chemically synthesized
caggaagttgcaaaagtatt

SEQ ID NO: 226637 - DNA, 20 bp, Artificial Sequence
  chemically synthesized
acacttacaggaagttgcaa

SEQ ID NO: 226638 - DNA, 20 bp, Artificial Sequence
  chemically synthesized
atacttttgcaacttcctgt

SEQ ID NO: 226639 - DNA, 20 bp, Artificial Sequence
  chemically synthesized
aatacatatacacttacagg

SEQ ID NO: 226640 - DNA, 20 bp, Artificial Sequence
  chemically synthesized
tgaaatacatatacacttac

SEQ ID NO: 226641 - DNA, 20 bp, Artificial Sequence
  chemically synthesized
ttgaaatacatatacactta

SEQ ID NO: 226642 - DNA, 20 bp, Artificial Sequence
  chemically synthesized
tatatgtatttcaaaataac

SEQ ID NO: 226643 - DNA, 20 bp, Artificial Sequence
  chemically synthesized
tgaggaatgccgtgtatatg

SEQ ID NO: 226644 - DNA, 20 bp, Artificial Sequence
  chemically synthesized
tgaaaaatactgcatataca

SEQ ID NO: 226645 - DNA, 20 bp, Artificial Sequence
  chemically synthesized
gcatatacacggcattcctc

SEQ ID NO: 226646 - DNA, 20 bp, Artificial Sequence
  chemically synthesized
acagaaaatccgtagtcttg

SEQ ID NO: 226647 - DNA, 20 bp, Artificial Sequence
  chemically synthesized
cacggcattcctcaagacta

SEQ ID NO: 226648 - DNA, 20 bp, Artificial Sequence
  chemically synthesized
aacagaaaatccgtagtctt

SEQ ID NO: 226649 - DNA, 20 bp, Artificial Sequence
  chemically synthesized
tagaagaaacagaaaatccg

SEQ ID NO: 226650 - DNA, 20 bp, Artificial Sequence
  chemically synthesized
agcattccaggtagaagaaa

SEQ ID NO: 226651 - DNA, 20 bp, Artificial Sequence
  chemically synthesized
gattttctgtttcttctacc

SEQ ID NO: 226652 - DNA, 20 bp, Artificial Sequence
  chemically synthesized
ggaaagagcattccaggtag

SEQ ID NO: 226653 - DNA, 20 bp, Artificial Sequence
  chemically synthesized
tggggaaagagcattccagg

SEQ ID NO: 226654 - DNA, 20 bp, Artificial Sequence
  chemically synthesized
atttggggaaagagcattcc

SEQ ID NO: 226655 - DNA, 20 bp, Artificial Sequence
  chemically synthesized
tatttggggaaagagcattc

SEQ ID NO: 226656 - DNA, 20 bp, Artificial Sequence
  chemically synthesized
catttacatatttggggaaa

SEQ ID NO: 226657 - DNA, 20 bp, Artificial Sequence
  chemically synthesized
tccatttacatatttgggga

SEQ ID NO: 226658 - DNA, 20 bp, Artificial Sequence
  chemically synthesized
attatccatttacatatttg

SEQ ID NO: 226659 - DNA, 20 bp, Artificial Sequence
  chemically synthesized
aattatccatttacatattt

SEQ ID NO: 226660 - DNA, 20 bp, Artificial Sequence
  chemically synthesized
aaattatccatttacatatt

SEQ ID NO: 226661 - DNA, 20 bp, Artificial Sequence
  chemically synthesized
tctttccccaaatatgtaaa

SEQ ID NO: 226662 - DNA, 20 bp, Artificial Sequence
  chemically synthesized
acagaaatctcaaggaaggg

SEQ ID NO: 226663 - DNA, 20 bp, Artificial Sequence
  chemically synthesized
gataatttctccccttcctt

SEQ ID NO: 226664 - DNA, 20 bp, Artificial Sequence
  chemically synthesized
gaacagaaatctcaaggaag

SEQ ID NO: 226665 - DNA, 20 bp, Artificial Sequence
  chemically synthesized
tgaacagaaatctcaaggaa

SEQ ID NO: 226666 - DNA, 20 bp, Artificial Sequence
  chemically synthesized
ttgaacagaaatctcaagga

SEQ ID NO: 226667 - DNA, 20 bp, Artificial Sequence
  chemically synthesized
tttgaacagaaatctcaagg

SEQ ID NO: 226668 - DNA, 20 bp, Artificial Sequence
  chemically synthesized
acatttgaacagaaatctca

SEQ ID NO: 226669 - DNA, 20 bp, Artificial Sequence
  chemically synthesized
gacatttgaacagaaatctc

SEQ ID NO: 226670 - DNA, 20 bp, Artificial Sequence
  chemically synthesized
tctatgaggtgacatttgaa

SEQ ID NO: 226671 - DNA, 20 bp, Artificial Sequence
  chemically synthesized
tctgttcaaatgtcacctca

SEQ ID NO: 226672 - DNA, 20 bp, Artificial Sequence
  chemically synthesized
tgttcaaatgtcacctcata

SEQ ID NO: 226673 - DNA, 20 bp, Artificial Sequence
  chemically synthesized
gttcaaatgtcacctcatag

SEQ ID NO: 226674 - DNA, 20 bp, Artificial Sequence
  chemically synthesized
actctgggcagacctctatg

SEQ ID NO: 226675 - DNA, 20 bp, Artificial Sequence
  chemically synthesized
cactctgggcagacctctat

SEQ ID NO: 226676 - DNA, 20 bp, Artificial Sequence
  chemically synthesized
tcacctcatagaggtctgcc

SEQ ID NO: 226677 - DNA, 20 bp, Artificial Sequence
  chemically synthesized
acctcatagaggtctgccca

SEQ ID NO: 226678 - DNA, 20 bp, Artificial Sequence
  chemically synthesized
tttatgtatgacactctggg

SEQ ID NO: 226679 - DNA, 20 bp, Artificial Sequence
  chemically synthesized
tattttatgtatgacactct

SEQ ID NO: 226680 - DNA, 20 bp, Artificial Sequence
  chemically synthesized
atattttatgtatgacactc

SEQ ID NO: 226681 - DNA, 20 bp, Artificial Sequence
  chemically synthesized
catacataaaatatcaattt

SEQ ID NO: 226682 - DNA, 20 bp, Artificial Sequence
  chemically synthesized
ataaaatatcaattttggct

SEQ ID NO: 226683 - DNA, 20 bp, Artificial Sequence
  chemically synthesized
tcaattttggctcggcacaa

SEQ ID NO: 226684 - DNA, 20 bp, Artificial Sequence
  chemically synthesized
cagacatggtccattgtgcc

SEQ ID NO: 226685 - DNA, 20 bp, Artificial Sequence
  chemically synthesized
aagtgctgaaattacagaca

SEQ ID NO: 226686 - DNA, 20 bp, Artificial Sequence
  chemically synthesized
atggaccatgtctgtaattt

SEQ ID NO: 226687 - DNA, 20 bp, Artificial Sequence
  chemically synthesized
cccctaaagtgctgaaatta

SEQ ID NO: 226688 - DNA, 20 bp, Artificial Sequence
  chemically synthesized
tgtctgtaatttcagcactt

SEQ ID NO: 226689 - DNA, 20 bp, Artificial Sequence
  chemically synthesized
gtctgtaatttcagcacttt

SEQ ID NO: 226690 - DNA, 20 bp, Artificial Sequence
  chemically synthesized
tctgtaatttcagcacttta

SEQ ID NO: 226691 - DNA, 20 bp, Artificial Sequence
  chemically synthesized
ctgtaatttcagcactttag

SEQ ID NO: 226692 - DNA, 20 bp, Artificial Sequence
  chemically synthesized
taatttcagcactttagggg

SEQ ID NO: 226693 - DNA, 20 bp, Artificial Sequence
  chemically synthesized
tctgcttgcctccaccccta

SEQ ID NO: 226694 - DNA, 20 bp, Artificial Sequence
  chemically synthesized
atttcagcactttaggggtg

SEQ ID NO: 226695 - DNA, 20 bp, Artificial Sequence
  chemically synthesized
tttcagcactttaggggtgg

SEQ ID NO: 226696 - DNA, 20 bp, Artificial Sequence
  chemically synthesized
agcactttaggggtggaggc

SEQ ID NO: 226697 - DNA, 20 bp, Artificial Sequence
  chemically synthesized
actttaggggtggaggcaag

SEQ ID NO: 226698 - DNA, 20 bp, Artificial Sequence
  chemically synthesized
tggaggcaagcagatcgctt

SEQ ID NO: 226699 - DNA, 20 bp, Artificial Sequence
  chemically synthesized
gcaagcagatcgcttgagcg

SEQ ID NO: 226700 - DNA, 20 bp, Artificial Sequence
  chemically synthesized
caagcagatcgcttgagcgc

SEQ ID NO: 226701 - DNA, 20 bp, Artificial Sequence
  chemically synthesized
tggtcttaactcctgcgctc

SEQ ID NO: 226702 - DNA, 20 bp, Artificial Sequence
  chemically synthesized
agcagatcgcttgagcgcag

SEQ ID NO: 226703 - DNA, 20 bp, Artificial Sequence
  chemically synthesized
atcgcttgagcgcaggagtt

SEQ ID NO: 226704 - DNA, 20 bp, Artificial Sequence
  chemically synthesized
ttgagcgcaggagttaagac

SEQ ID NO: 226705 - DNA, 20 bp, Artificial Sequence
  chemically synthesized
agcgcaggagttaagaccag

SEQ ID NO: 226706 - DNA, 20 bp, Artificial Sequence
  chemically synthesized
cctcactacctcagtaccac

SEQ ID NO: 226707 - DNA, 20 bp, Artificial Sequence
  chemically synthesized
gagttaagaccagtggtact

SEQ ID NO: 226708 - DNA, 20 bp, Artificial Sequence
  chemically synthesized
agttaagaccagtggtactg

SEQ ID NO: 226709 - DNA, 20 bp, Artificial Sequence
  chemically synthesized
taagaccagtggtactgagg

SEQ ID NO: 226710 - DNA, 20 bp, Artificial Sequence
  chemically synthesized
accagtggtactgaggtagt

SEQ ID NO: 226711 - DNA, 20 bp, Artificial Sequence
  chemically synthesized
atagcagtacctcactacct

SEQ ID NO: 226712 - DNA, 20 bp, Artificial Sequence
  chemically synthesized
ccagtggtactgaggtagtg

SEQ ID NO: 226713 - DNA, 20 bp, Artificial Sequence
  chemically synthesized
ggtagtgaggtactgctata

SEQ ID NO: 226714 - DNA, 20 bp, Artificial Sequence
  chemically synthesized
attttcaagtatctttatag

SEQ ID NO: 226715 - DNA, 20 bp, Artificial Sequence
  chemically synthesized
cacattttcaagtatcttta

SEQ ID NO: 226716 - DNA, 20 bp, Artificial Sequence
  chemically synthesized
tataaagatacttgaaaatg

SEQ ID NO: 226717 - DNA, 20 bp, Artificial Sequence
  chemically synthesized
aaagttgcttccacattttc

SEQ ID NO: 226718 - DNA, 20 bp, Artificial Sequence
  chemically synthesized
aaagatacttgaaaatgtgg

SEQ ID NO: 226719 - DNA, 20 bp, Artificial Sequence
  chemically synthesized
tgaaaatgtggaagcaactt

SEQ ID NO: 226720 - DNA, 20 bp, Artificial Sequence
  chemically synthesized
tgtggaagcaactttagaac

SEQ ID NO: 226721 - DNA, 20 bp, Artificial Sequence
  chemically synthesized
gtggaagcaactttagaact

SEQ ID NO: 226722 - DNA, 20 bp, Artificial Sequence
  chemically synthesized
ctgcctattacccagttcta

SEQ ID NO: 226723 - DNA, 20 bp, Artificial Sequence
  chemically synthesized
gcaactttagaactgggtaa

SEQ ID NO: 226724 - DNA, 20 bp, Artificial Sequence
  chemically synthesized
caactttagaactgggtaat

SEQ ID NO: 226725 - DNA, 20 bp, Artificial Sequence
  chemically synthesized
tccaacccctgcctattacc

SEQ ID NO: 226726 - DNA, 20 bp, Artificial Sequence
  chemically synthesized
ctttagaactgggtaatagg

SEQ ID NO: 226727 - DNA, 20 bp, Artificial Sequence
  chemically synthesized
tttagaactgggtaataggc

SEQ ID NO: 226728 - DNA, 20 bp, Artificial Sequence
  chemically synthesized
ttagaactgggtaataggca

SEQ ID NO: 226729 - DNA, 20 bp, Artificial Sequence
  chemically synthesized
tagaactgggtaataggcag

SEQ ID NO: 226730 - DNA, 20 bp, Artificial Sequence
  chemically synthesized
actgggtaataggcaggggt

SEQ ID NO: 226731 - DNA, 20 bp, Artificial Sequence
  chemically synthesized
gtaataggcaggggttggaa

SEQ ID NO: 226732 - DNA, 20 bp, Artificial Sequence
  chemically synthesized
taggcaggggttggaacagt

SEQ ID NO: 226733 - DNA, 20 bp, Artificial Sequence
  chemically synthesized
aggcaggggttggaacagtt

SEQ ID NO: 226734 - DNA, 20 bp, Artificial Sequence
  chemically synthesized
gcaggggttggaacagttag

SEQ ID NO: 226735 - DNA, 20 bp, Artificial Sequence
  chemically synthesized
caggggttggaacagttagg

SEQ ID NO: 226736 - DNA, 20 bp, Artificial Sequence
  chemically synthesized
gttggaacagttaggaggct

SEQ ID NO: 226737 - DNA, 20 bp, Artificial Sequence
  chemically synthesized
ggaacagttaggaggctcag

SEQ ID NO: 226738 - DNA, 20 bp, Artificial Sequence
  chemically synthesized
acagttaggaggctcagaag

SEQ ID NO: 226739 - DNA, 20 bp, Artificial Sequence
  chemically synthesized
acattttcctgtcttcttct

SEQ ID NO: 226740 - DNA, 20 bp, Artificial Sequence
  chemically synthesized
ttaggaggctcagaagaaga

SEQ ID NO: 226741 - DNA, 20 bp, Artificial Sequence
  chemically synthesized
taggaggctcagaagaagac

SEQ ID NO: 226742 - DNA, 20 bp, Artificial Sequence
  chemically synthesized
cagaagaagacaggaaaatg

SEQ ID NO: 226743 - DNA, 20 bp, Artificial Sequence
  chemically synthesized
gaagacaggaaaatgtggaa

SEQ ID NO: 226744 - DNA, 20 bp, Artificial Sequence
  chemically synthesized
caggaaaatgtggaaaagtt

SEQ ID NO: 226745 - DNA, 20 bp, Artificial Sequence
  chemically synthesized
tggaaaagtttggaacttcc

SEQ ID NO: 226746 - DNA, 20 bp, Artificial Sequence
  chemically synthesized
gaaaagtttggaacttccta

SEQ ID NO: 226747 - DNA, 20 bp, Artificial Sequence
  chemically synthesized
ccattcaacaagtctctagg

SEQ ID NO: 226748 - DNA, 20 bp, Artificial Sequence
  chemically synthesized
aaaccattcaacaagtctct

SEQ ID NO: 226749 - DNA, 20 bp, Artificial Sequence
  chemically synthesized
aaaaccattcaacaagtctc

SEQ ID NO: 226750 - DNA, 20 bp, Artificial Sequence
  chemically synthesized
cttcctagagacttgttgaa

SEQ ID NO: 226751 - DNA, 20 bp, Artificial Sequence
  chemically synthesized
tttggtcaaaaccattcaac

SEQ ID NO: 226752 - DNA, 20 bp, Artificial Sequence
  chemically synthesized
tcgtatcactatcagcattt

SEQ ID NO: 226753 - DNA, 20 bp, Artificial Sequence
  chemically synthesized
ggttttgaccaaaatgctga

SEQ ID NO: 226754 - DNA, 20 bp, Artificial Sequence
  chemically synthesized
ttcagtgttcgtatcactat

SEQ ID NO: 226755 - DNA, 20 bp, Artificial Sequence
  chemically synthesized
tgatagtgatacgaacactg

SEQ ID NO: 226756 - DNA, 20 bp, Artificial Sequence
  chemically synthesized
gtgatacgaacactgaagtc

SEQ ID NO: 226757 - DNA, 20 bp, Artificial Sequence
  chemically synthesized
tgatacgaacactgaagtcc

SEQ ID NO: 226758 - DNA, 20 bp, Artificial Sequence
  chemically synthesized
gaccacctctgcctggactt

SEQ ID NO: 226759 - DNA, 20 bp, Artificial Sequence
  chemically synthesized
tacgaacactgaagtccagg

SEQ ID NO: 226760 - DNA, 20 bp, Artificial Sequence
  chemically synthesized
cgaacactgaagtccaggca

SEQ ID NO: 226761 - DNA, 20 bp, Artificial Sequence
  chemically synthesized
gaacactgaagtccaggcag

SEQ ID NO: 226762 - DNA, 20 bp, Artificial Sequence
  chemically synthesized
catctgagaccacctctgcc

SEQ ID NO: 226763 - DNA, 20 bp, Artificial Sequence
  chemically synthesized
cactgaagtccaggcagagg

SEQ ID NO: 226764 - DNA, 20 bp, Artificial Sequence
  chemically synthesized
agtccaggcagaggtggtct

SEQ ID NO: 226765 - DNA, 20 bp, Artificial Sequence
  chemically synthesized
caggcagaggtggtctcaga

SEQ ID NO: 226766 - DNA, 20 bp, Artificial Sequence
  chemically synthesized
ggcagaggtggtctcagatg

SEQ ID NO: 226767 - DNA, 20 bp, Artificial Sequence
  chemically synthesized
taagttcttcatctccatct

SEQ ID NO: 226768 - DNA, 20 bp, Artificial Sequence
  chemically synthesized
ggtggtctcagatggagatg

SEQ ID NO: 226769 - DNA, 20 bp, Artificial Sequence
  chemically synthesized
gatggagatgaagaacttat

SEQ ID NO: 226770 - DNA, 20 bp, Artificial Sequence
  chemically synthesized
cctttactccagttaccaat

SEQ ID NO: 226771 - DNA, 20 bp, Artificial Sequence
  chemically synthesized
atgaagaacttattggtaac

SEQ ID NO: 226772 - DNA, 20 bp, Artificial Sequence
  chemically synthesized
gaagaacttattggtaactg

SEQ ID NO: 226773 - DNA, 20 bp, Artificial Sequence
  chemically synthesized
acttattggtaactggagta

SEQ ID NO: 226774 - DNA, 20 bp, Artificial Sequence
  chemically synthesized
cttattggtaactggagtaa

SEQ ID NO: 226775 - DNA, 20 bp, Artificial Sequence
  chemically synthesized
agcaagaatgacctttactc

SEQ ID NO: 226776 - DNA, 20 bp, Artificial Sequence
  chemically synthesized
gtctctttgttagtcatagc

SEQ ID NO: 226777 - DNA, 20 bp, Artificial Sequence
  chemically synthesized
gccagtctctttgttagtca

SEQ ID NO: 226778 - DNA, 20 bp, Artificial Sequence
  chemically synthesized
cattcttgctatgactaaca

SEQ ID NO: 226779 - DNA, 20 bp, Artificial Sequence
  chemically synthesized
ttcttgctatgactaacaaa

SEQ ID NO: 226780 - DNA, 20 bp, Artificial Sequence
  chemically synthesized
aatgatgccagtctctttgt

SEQ ID NO: 226781 - DNA, 20 bp, Artificial Sequence
  chemically synthesized
gctatgactaacaaagagac

SEQ ID NO: 226782 - DNA, 20 bp, Artificial Sequence
  chemically synthesized
ggtcagggtcaaaatgatgc

SEQ ID NO: 226783 - DNA, 20 bp, Artificial Sequence
  chemically synthesized
gcatcattttgaccctgacc

SEQ ID NO: 226784 - DNA, 20 bp, Artificial Sequence
  chemically synthesized
atcattttgaccctgaccta

SEQ ID NO: 226785 - DNA, 20 bp, Artificial Sequence
  chemically synthesized
ttccacagatctctaggtca

SEQ ID NO: 226786 - DNA, 20 bp, Artificial Sequence
  chemically synthesized
gttccacagatctctaggtc

SEQ ID NO: 226787 - DNA, 20 bp, Artificial Sequence
  chemically synthesized
agttccacagatctctaggt

SEQ ID NO: 226788 - DNA, 20 bp, Artificial Sequence
  chemically synthesized
tcaaagttccacagatctct

SEQ ID NO: 226789 - DNA, 20 bp, Artificial Sequence
  chemically synthesized
ttcaaagttccacagatctc

SEQ ID NO: 226790 - DNA, 20 bp, Artificial Sequence
  chemically synthesized
gaccctgacctagagatctg

SEQ ID NO: 226791 - DNA, 20 bp, Artificial Sequence
  chemically synthesized
ctctcaagttcaaagttcca

SEQ ID NO: 226792 - DNA, 20 bp, Artificial Sequence
  chemically synthesized
atctgtggaactttgaactt

SEQ ID NO: 226793 - DNA, 20 bp, Artificial Sequence
  chemically synthesized
taaatcatctctcaagttca

SEQ ID NO: 226794 - DNA, 20 bp, Artificial Sequence
  chemically synthesized
ctgtggaactttgaacttga

SEQ ID NO: 226795 - DNA, 20 bp, Artificial Sequence
  chemically synthesized
gataccttaaatcatctctc

SEQ ID NO: 226796 - DNA, 20 bp, Artificial Sequence
  chemically synthesized
ttgaacttgagagatgattt

SEQ ID NO: 226797 - DNA, 20 bp, Artificial Sequence
  chemically synthesized
tgaacttgagagatgattta

SEQ ID NO: 226798 - DNA, 20 bp, Artificial Sequence
  chemically synthesized
agatgatttaaggtatctga

SEQ ID NO: 226799 - DNA, 20 bp, Artificial Sequence
  chemically synthesized
tgatttaaggtatctgacag

SEQ ID NO: 226800 - DNA, 20 bp, Artificial Sequence
  chemically synthesized
tgcttagaaatttcttctgt

SEQ ID NO: 226801 - DNA, 20 bp, Artificial Sequence
  chemically synthesized
atctgacagaagaaatttct

SEQ ID NO: 226802 - DNA, 20 bp, Artificial Sequence
  chemically synthesized
tgacagaagaaatttctaag

SEQ ID NO: 226803 - DNA, 20 bp, Artificial Sequence
  chemically synthesized
gaagaaatttctaagcagca

SEQ ID NO: 226804 - DNA, 20 bp, Artificial Sequence
  chemically synthesized
ctcttgaatgctttgctgct

SEQ ID NO: 226805 - DNA, 20 bp, Artificial Sequence
  chemically synthesized
ttctaagcagcaaagcattc

SEQ ID NO: 226806 - DNA, 20 bp, Artificial Sequence
  chemically synthesized
ctaagcagcaaagcattcaa

SEQ ID NO: 226807 - DNA, 20 bp, Artificial Sequence
  chemically synthesized
taagcagcaaagcattcaag

SEQ ID NO: 226808 - DNA, 20 bp, Artificial Sequence
  chemically synthesized
gcaaagcattcaagaggtca

SEQ ID NO: 226809 - DNA, 20 bp, Artificial Sequence
  chemically synthesized
aaagcattcaagaggtcaca

SEQ ID NO: 226810 - DNA, 20 bp, Artificial Sequence
  chemically synthesized
caagaggtcacagagcataa

SEQ ID NO: 226811 - DNA, 20 bp, Artificial Sequence
  chemically synthesized
aaatttgcaacctgacaatg

SEQ ID NO: 226812 - DNA, 20 bp, Artificial Sequence
  chemically synthesized
ttcttttctactgcattgtc

SEQ ID NO: 226813 - DNA, 20 bp, Artificial Sequence
  chemically synthesized
tttcttttctactgcattgt

SEQ ID NO: 226814 - DNA, 20 bp, Artificial Sequence
  chemically synthesized
tttgcaacctgacaatgcag

SEQ ID NO: 226815 - DNA, 20 bp, Artificial Sequence
  chemically synthesized
aacctgacaatgcagtagaa

SEQ ID NO: 226816 - DNA, 20 bp, Artificial Sequence
  chemically synthesized
gaaaagaaaaacccattttc

SEQ ID NO: 226817 - DNA, 20 bp, Artificial Sequence
  chemically synthesized
agccagcctctccagaaaat

SEQ ID NO: 226818 - DNA, 20 bp, Artificial Sequence
  chemically synthesized
aaagaaaaacccattttctg

SEQ ID NO: 226819 - DNA, 20 bp, Artificial Sequence
  chemically synthesized
cagccagcctctccagaaaa

SEQ ID NO: 226820 - DNA, 20 bp, Artificial Sequence
  chemically synthesized
agaaaaacccattttctgga

SEQ ID NO: 226821 - DNA, 20 bp, Artificial Sequence
  chemically synthesized
gaaaaacccattttctggag

SEQ ID NO: 226822 - DNA, 20 bp, Artificial Sequence
  chemically synthesized
aacccattttctggagaggc

SEQ ID NO: 226823 - DNA, 20 bp, Artificial Sequence
  chemically synthesized
atttctacagccagcctctc

SEQ ID NO: 226824 - DNA, 20 bp, Artificial Sequence
  chemically synthesized
ttttctggagaggctggctg

SEQ ID NO: 226825 - DNA, 20 bp, Artificial Sequence
  chemically synthesized
aatatgcaaatttctacagc

SEQ ID NO: 226826 - DNA, 20 bp, Artificial Sequence
  chemically synthesized
gttaaatatgcaaatttcta

SEQ ID NO: 226827 - DNA, 20 bp, Artificial Sequence
  chemically synthesized
tagaaatttgcatatttaac

SEQ ID NO: 226828 - DNA, 20 bp, Artificial Sequence
  chemically synthesized
agaaatttgcatatttaaca

SEQ ID NO: 226829 - DNA, 20 bp, Artificial Sequence
  chemically synthesized
aaatttgcatatttaacaag

SEQ ID NO: 226830 - DNA, 20 bp, Artificial Sequence
  chemically synthesized
ttgtcttgcctattaacatt

SEQ ID NO: 226831 - DNA, 20 bp, Artificial Sequence
  chemically synthesized
aacaaggagcccaatgttaa

SEQ ID NO: 226832 - DNA, 20 bp, Artificial Sequence
  chemically synthesized
attgtcttgcctattaacat

SEQ ID NO: 226833 - DNA, 20 bp, Artificial Sequence
  chemically synthesized
acaaggagcccaatgttaat

SEQ ID NO: 226834 - DNA, 20 bp, Artificial Sequence
  chemically synthesized
ggagcccaatgttaataggc

SEQ ID NO: 226835 - DNA, 20 bp, Artificial Sequence
  chemically synthesized
aatgttaataggcaagacaa

SEQ ID NO: 226836 - DNA, 20 bp, Artificial Sequence
  chemically synthesized
atgttaataggcaagacaat

SEQ ID NO: 226837 - DNA, 20 bp, Artificial Sequence
  chemically synthesized
tgttaataggcaagacaatg

SEQ ID NO: 226838 - DNA, 20 bp, Artificial Sequence
  chemically synthesized
gacaatggggaaaatgtctc

SEQ ID NO: 226839 - DNA, 20 bp, Artificial Sequence
  chemically synthesized
acaatggggaaaatgtctcc

SEQ ID NO: 226840 - DNA, 20 bp, Artificial Sequence
  chemically synthesized
caatggggaaaatgtctcca

SEQ ID NO: 226841 - DNA, 20 bp, Artificial Sequence
  chemically synthesized
ggggaaaatgtctccagggc

SEQ ID NO: 226842 - DNA, 20 bp, Artificial Sequence
  chemically synthesized
aaggtctctgacttgccctg

SEQ ID NO: 226843 - DNA, 20 bp, Artificial Sequence
  chemically synthesized
tgaaggtctctgacttgccc

SEQ ID NO: 226844 - DNA, 20 bp, Artificial Sequence
  chemically synthesized
aaaatgtctccagggcaagt

SEQ ID NO: 226845 - DNA, 20 bp, Artificial Sequence
  chemically synthesized
aatgtctccagggcaagtca

SEQ ID NO: 226846 - DNA, 20 bp, Artificial Sequence
  chemically synthesized
caagtcagagaccttcattg

SEQ ID NO: 226847 - DNA, 20 bp, Artificial Sequence
  chemically synthesized
gatgggaggagccgcaatga

SEQ ID NO: 226848 - DNA, 20 bp, Artificial Sequence
  chemically synthesized
tgatgggaggagccgcaatg

SEQ ID NO: 226849 - DNA, 20 bp, Artificial Sequence
  chemically synthesized
ctctgggtctgtgatgggag

SEQ ID NO: 226850 - DNA, 20 bp, Artificial Sequence
  chemically synthesized
cattgcggctcctcccatca

SEQ ID NO: 226851 - DNA, 20 bp, Artificial Sequence
  chemically synthesized
acctctgggtctgtgatggg

SEQ ID NO: 226852 - DNA, 20 bp, Artificial Sequence
  chemically synthesized
gacctctgggtctgtgatgg

SEQ ID NO: 226853 - DNA, 20 bp, Artificial Sequence
  chemically synthesized
tagacctctgggtctgtgat

SEQ ID NO: 226854 - DNA, 20 bp, Artificial Sequence
  chemically synthesized
ctagacctctgggtctgtga

SEQ ID NO: 226855 - DNA, 20 bp, Artificial Sequence
  chemically synthesized
ggctcctcccatcacagacc

SEQ ID NO: 226856 - DNA, 20 bp, Artificial Sequence
  chemically synthesized
ctcctcccatcacagaccca

SEQ ID NO: 226857 - DNA, 20 bp, Artificial Sequence
  chemically synthesized
tcctcccatcacagacccag

SEQ ID NO: 226858 - DNA, 20 bp, Artificial Sequence
  chemically synthesized
ccatcacagacccagaggtc

SEQ ID NO: 226859 - DNA, 20 bp, Artificial Sequence
  chemically synthesized
tttttgcctcctagacctct

SEQ ID NO: 226860 - DNA, 20 bp, Artificial Sequence
  chemically synthesized
catcacagacccagaggtct

SEQ ID NO: 226861 - DNA, 20 bp, Artificial Sequence
  chemically synthesized
atttttgcctcctagacctc

SEQ ID NO: 226862 - DNA, 20 bp, Artificial Sequence
  chemically synthesized
tcacagacccagaggtctag

SEQ ID NO: 226863 - DNA, 20 bp, Artificial Sequence
  chemically synthesized
cacagacccagaggtctagg

SEQ ID NO: 226864 - DNA, 20 bp, Artificial Sequence
  chemically synthesized
acgaaaccatttttgcctcc

SEQ ID NO: 226865 - DNA, 20 bp, Artificial Sequence
  chemically synthesized
agaggtctaggaggcaaaaa

SEQ ID NO: 226866 - DNA, 20 bp, Artificial Sequence
  chemically synthesized
aggaggcaaaaatggtttcg

SEQ ID NO: 226867 - DNA, 20 bp, Artificial Sequence
  chemically synthesized
gcaaaaatggtttcgtggac

SEQ ID NO: 226868 - DNA, 20 bp, Artificial Sequence
  chemically synthesized
caaaaatggtttcgtggacc

SEQ ID NO: 226869 - DNA, 20 bp, Artificial Sequence
  chemically synthesized
gtggggttgggggggggacc

SEQ ID NO: 226870 - DNA, 20 bp, Artificial Sequence
  chemically synthesized
acagtggtggggttgggggg

SEQ ID NO: 226871 - DNA, 20 bp, Artificial Sequence
  chemically synthesized
cacagtggtggggttggggg

SEQ ID NO: 226872 - DNA, 20 bp, Artificial Sequence
  chemically synthesized
acacagtggtggggttgggg

SEQ ID NO: 226873 - DNA, 20 bp, Artificial Sequence
  chemically synthesized
cacacagtggtggggttggg

SEQ ID NO: 226874 - DNA, 20 bp, Artificial Sequence
  chemically synthesized
gcacacagtggtggggttgg

SEQ ID NO: 226875 - DNA, 20 bp, Artificial Sequence
  chemically synthesized
cgcacacagtggtggggttg

SEQ ID NO: 226876 - DNA, 20 bp, Artificial Sequence
  chemically synthesized
ccgcacacagtggtggggtt

SEQ ID NO: 226877 - DNA, 20 bp, Artificial Sequence
  chemically synthesized
gccgcacacagtggtggggt

SEQ ID NO: 226878 - DNA, 20 bp, Artificial Sequence
  chemically synthesized
tgatgccgcacacagtggtg

SEQ ID NO: 226879 - DNA, 20 bp, Artificial Sequence
  chemically synthesized
ctgatgccgcacacagtggt

SEQ ID NO: 226880 - DNA, 20 bp, Artificial Sequence
  chemically synthesized
cctgatgccgcacacagtgg

SEQ ID NO: 226881 - DNA, 20 bp, Artificial Sequence
  chemically synthesized
cccaaccccaccactgtgtg

SEQ ID NO: 226882 - DNA, 20 bp, Artificial Sequence
  chemically synthesized
agtcctgatgccgcacacag

SEQ ID NO: 226883 - DNA, 20 bp, Artificial Sequence
  chemically synthesized
ccaagtcctgatgccgcaca

SEQ ID NO: 226884 - DNA, 20 bp, Artificial Sequence
  chemically synthesized
cccaccactgtgtgcggcat

SEQ ID NO: 226885 - DNA, 20 bp, Artificial Sequence
  chemically synthesized
ccaccactgtgtgcggcatc

SEQ ID NO: 226886 - DNA, 20 bp, Artificial Sequence
  chemically synthesized
ctgtgtgcggcatcaggact

SEQ ID NO: 226887 - DNA, 20 bp, Artificial Sequence
  chemically synthesized
tggctgggacacaaggcacc

SEQ ID NO: 226888 - DNA, 20 bp, Artificial Sequence
  chemically synthesized
ggacttggtgccttgtgtcc

SEQ ID NO: 226889 - DNA, 20 bp, Artificial Sequence
  chemically synthesized
gctggagtggctgggacaca

SEQ ID NO: 226890 - DNA, 20 bp, Artificial Sequence
  chemically synthesized
ggctggagtggctgggacac

SEQ ID NO: 226891 - DNA, 20 bp, Artificial Sequence
  chemically synthesized
tatccatggctggagtggct

SEQ ID NO: 226892 - DNA, 20 bp, Artificial Sequence
  chemically synthesized
gccttgtgtcccagccactc

SEQ ID NO: 226893 - DNA, 20 bp, Artificial Sequence
  chemically synthesized
ttatccatggctggagtggc

SEQ ID NO: 226894 - DNA, 20 bp, Artificial Sequence
  chemically synthesized
ccttttatccatggctggag

SEQ ID NO: 226895 - DNA, 20 bp, Artificial Sequence
  chemically synthesized
tgtcccagccactccagcca

SEQ ID NO: 226896 - DNA, 20 bp, Artificial Sequence
  chemically synthesized
gccccttttatccatggctg

SEQ ID NO: 226897 - DNA, 20 bp, Artificial Sequence
  chemically synthesized
tggccccttttatccatggc

SEQ ID NO: 226898 - DNA, 20 bp, Artificial Sequence
  chemically synthesized
gccactccagccatggataa

SEQ ID NO: 226899 - DNA, 20 bp, Artificial Sequence
  chemically synthesized
accttggccccttttatcca

SEQ ID NO: 226900 - DNA, 20 bp, Artificial Sequence
  chemically synthesized
ccactccagccatggataaa

SEQ ID NO: 226901 - DNA, 20 bp, Artificial Sequence
  chemically synthesized
cactccagccatggataaaa

SEQ ID NO: 226902 - DNA, 20 bp, Artificial Sequence
  chemically synthesized
actccagccatggataaaag

SEQ ID NO: 226903 - DNA, 20 bp, Artificial Sequence
  chemically synthesized
agccatggataaaaggggcc

SEQ ID NO: 226904 - DNA, 20 bp, Artificial Sequence
  chemically synthesized
gccatggataaaaggggcca

SEQ ID NO: 226905 - DNA, 20 bp, Artificial Sequence
  chemically synthesized
ggataaaaggggccaaggta

SEQ ID NO: 226906 - DNA, 20 bp, Artificial Sequence
  chemically synthesized
caatggtccgaactgtacct

SEQ ID NO: 226907 - DNA, 20 bp, Artificial Sequence
  chemically synthesized
aaaggggccaaggtacagtt

SEQ ID NO: 226908 - DNA, 20 bp, Artificial Sequence
  chemically synthesized
tacagttcggaccattgctt

SEQ ID NO: 226909 - DNA, 20 bp, Artificial Sequence
  chemically synthesized
acttgctccctctgaagcaa

SEQ ID NO: 226910 - DNA, 20 bp, Artificial Sequence
  chemically synthesized
cagttcggaccattgcttca

SEQ ID NO: 226911 - DNA, 20 bp, Artificial Sequence
  chemically synthesized
agttcggaccattgcttcag

SEQ ID NO: 226912 - DNA, 20 bp, Artificial Sequence
  chemically synthesized
gttcggaccattgcttcaga

SEQ ID NO: 226913 - DNA, 20 bp, Artificial Sequence
  chemically synthesized
tcggaccattgcttcagagg

SEQ ID NO: 226914 - DNA, 20 bp, Artificial Sequence
  chemically synthesized
cttgggacttgctccctctg

SEQ ID NO: 226915 - DNA, 20 bp, Artificial Sequence
  chemically synthesized
accattgcttcagagggagc

SEQ ID NO: 226916 - DNA, 20 bp, Artificial Sequence
  chemically synthesized
cttcagagggagcaagtccc

SEQ ID NO: 226917 - DNA, 20 bp, Artificial Sequence
  chemically synthesized
agggagcaagtcccaagctt

SEQ ID NO: 226918 - DNA, 20 bp, Artificial Sequence
  chemically synthesized
cgtggcagttgccaaagctt

SEQ ID NO: 226919 - DNA, 20 bp, Artificial Sequence
  chemically synthesized
acgtggcagttgccaaagct

SEQ ID NO: 226920 - DNA, 20 bp, Artificial Sequence
  chemically synthesized
acaccacgtggcagttgcca

SEQ ID NO: 226921 - DNA, 20 bp, Artificial Sequence
  chemically synthesized
aagctttggcaactgccacg

SEQ ID NO: 226922 - DNA, 20 bp, Artificial Sequence
  chemically synthesized
acagactcaacaccacgtgg

SEQ ID NO: 226923 - DNA, 20 bp, Artificial Sequence
  chemically synthesized
tccacagactcaacaccacg

SEQ ID NO: 226924 - DNA, 20 bp, Artificial Sequence
  chemically synthesized
ggcaactgccacgtggtgtt

SEQ ID NO: 226925 - DNA, 20 bp, Artificial Sequence
  chemically synthesized
gccacgtggtgttgagtctg

SEQ ID NO: 226926 - DNA, 20 bp, Artificial Sequence
  chemically synthesized
tcttgaattctgtgtatcca

SEQ ID NO: 226927 - DNA, 20 bp, Artificial Sequence
  chemically synthesized
gtgttgagtctgtggataca

SEQ ID NO: 226928 - DNA, 20 bp, Artificial Sequence
  chemically synthesized
tctgtggatacacagaattc

SEQ ID NO: 226929 - DNA, 20 bp, Artificial Sequence
  chemically synthesized
tacacagaattcaagaattg

SEQ ID NO: 226930 - DNA, 20 bp, Artificial Sequence
  chemically synthesized
agaattcaagaattgaagtt

SEQ ID NO: 226931 - DNA, 20 bp, Artificial Sequence
  chemically synthesized
gaattcaagaattgaagttt

SEQ ID NO: 226932 - DNA, 20 bp, Artificial Sequence
  chemically synthesized
gaagtttgggaacctctgcc

SEQ ID NO: 226933 - DNA, 20 bp, Artificial Sequence
  chemically synthesized
atcctctgaaatctaggcag

SEQ ID NO: 226934 - DNA, 20 bp, Artificial Sequence
  chemically synthesized
catcctctgaaatctaggca

SEQ ID NO: 226935 - DNA, 20 bp, Artificial Sequence
  chemically synthesized
tacatcctctgaaatctagg

SEQ ID NO: 226936 - DNA, 20 bp, Artificial Sequence
  chemically synthesized
gggaacctctgcctagattt

SEQ ID NO: 226937 - DNA, 20 bp, Artificial Sequence
  chemically synthesized
ccatacatcctctgaaatct

SEQ ID NO: 226938 - DNA, 20 bp, Artificial Sequence
  chemically synthesized
gaacctctgcctagatttca

SEQ ID NO: 226939 - DNA, 20 bp, Artificial Sequence
  chemically synthesized
tccatacatcctctgaaatc

SEQ ID NO: 226940 - DNA, 20 bp, Artificial Sequence
  chemically synthesized
aacctctgcctagatttcag

SEQ ID NO: 226941 - DNA, 20 bp, Artificial Sequence
  chemically synthesized
cctagatttcagaggatgta

SEQ ID NO: 226942 - DNA, 20 bp, Artificial Sequence
  chemically synthesized
agaggatgtatggaaactcc

SEQ ID NO: 226943 - DNA, 20 bp, Artificial Sequence
  chemically synthesized
acttctgcctggacatccag

SEQ ID NO: 226944 - DNA, 20 bp, Artificial Sequence
  chemically synthesized
tatggaaactcctggatgtc

SEQ ID NO: 226945 - DNA, 20 bp, Artificial Sequence
  chemically synthesized
agacttctgcctggacatcc

SEQ ID NO: 226946 - DNA, 20 bp, Artificial Sequence
  chemically synthesized
atggaaactcctggatgtcc

SEQ ID NO: 226947 - DNA, 20 bp, Artificial Sequence
  chemically synthesized
cagacttctgcctggacatc

SEQ ID NO: 226948 - DNA, 20 bp, Artificial Sequence
  chemically synthesized
gaaactcctggatgtccagg

SEQ ID NO: 226949 - DNA, 20 bp, Artificial Sequence
  chemically synthesized
actcctggatgtccaggcag

SEQ ID NO: 226950 - DNA, 20 bp, Artificial Sequence
  chemically synthesized
tcctgcagcagacttctgcc

SEQ ID NO: 226951 - DNA, 20 bp, Artificial Sequence
  chemically synthesized
gtccaggcagaagtctgctg

SEQ ID NO: 226952 - DNA, 20 bp, Artificial Sequence
  chemically synthesized
tccaggcagaagtctgctgc

SEQ ID NO: 226953 - DNA, 20 bp, Artificial Sequence
  chemically synthesized
tgaggtcttcattcctgcag

SEQ ID NO: 226954 - DNA, 20 bp, Artificial Sequence
  chemically synthesized
ccatgaggtcttcattcctg

SEQ ID NO: 226955 - DNA, 20 bp, Artificial Sequence
  chemically synthesized
agaagtctgctgcaggaatg

SEQ ID NO: 226956 - DNA, 20 bp, Artificial Sequence
  chemically synthesized
ctgcaggaatgaagacctca

SEQ ID NO: 226957 - DNA, 20 bp, Artificial Sequence
  chemically synthesized
gcaggaatgaagacctcatg

SEQ ID NO: 226958 - DNA, 20 bp, Artificial Sequence
  chemically synthesized
cctagccgaggttctccatg

SEQ ID NO: 226959 - DNA, 20 bp, Artificial Sequence
  chemically synthesized
tcctagccgaggttctccat

SEQ ID NO: 226960 - DNA, 20 bp, Artificial Sequence
  chemically synthesized
gaagacctcatggagaacct

SEQ ID NO: 226961 - DNA, 20 bp, Artificial Sequence
  chemically synthesized
acctcatggagaacctcggc

SEQ ID NO: 226962 - DNA, 20 bp, Artificial Sequence
  chemically synthesized
cctcatggagaacctcggct

SEQ ID NO: 226963 - DNA, 20 bp, Artificial Sequence
  chemically synthesized
cttccacactgtcctagccg

SEQ ID NO: 226964 - DNA, 20 bp, Artificial Sequence
  chemically synthesized
ccttccacactgtcctagcc

SEQ ID NO: 226965 - DNA, 20 bp, Artificial Sequence
  chemically synthesized
atggagaacctcggctagga

SEQ ID NO: 226966 - DNA, 20 bp, Artificial Sequence
  chemically synthesized
atttcccttccacactgtcc

SEQ ID NO: 226967 - DNA, 20 bp, Artificial Sequence
  chemically synthesized
gaacctcggctaggacagtg

SEQ ID NO: 226968 - DNA, 20 bp, Artificial Sequence
  chemically synthesized
cctcggctaggacagtgtgg

SEQ ID NO: 226969 - DNA, 20 bp, Artificial Sequence
  chemically synthesized
ctcggctaggacagtgtgga

SEQ ID NO: 226970 - DNA, 20 bp, Artificial Sequence
  chemically synthesized
tcggctaggacagtgtggaa

SEQ ID NO: 226971 - DNA, 20 bp, Artificial Sequence
  chemically synthesized
gacagtgtggaagggaaatg

SEQ ID NO: 226972 - DNA, 20 bp, Artificial Sequence
  chemically synthesized
acagtgtggaagggaaatgt

SEQ ID NO: 226973 - DNA, 20 bp, Artificial Sequence
  chemically synthesized
cagtgtggaagggaaatgtg

SEQ ID NO: 226974 - DNA, 20 bp, Artificial Sequence
  chemically synthesized
gtggaagggaaatgtggggt

SEQ ID NO: 226975 - DNA, 20 bp, Artificial Sequence
  chemically synthesized
ggaagggaaatgtggggttg

SEQ ID NO: 226976 - DNA, 20 bp, Artificial Sequence
  chemically synthesized
gtggggttggagccccaaca

SEQ ID NO: 226977 - DNA, 20 bp, Artificial Sequence
  chemically synthesized
ggggttggagccccaacaca

SEQ ID NO: 226978 - DNA, 20 bp, Artificial Sequence
  chemically synthesized
ccagtggggactctgtgttg

SEQ ID NO: 226979 - DNA, 20 bp, Artificial Sequence
  chemically synthesized
cccagtggggactctgtgtt

SEQ ID NO: 226980 - DNA, 20 bp, Artificial Sequence
  chemically synthesized
ccccagtggggactctgtgt

SEQ ID NO: 226981 - DNA, 20 bp, Artificial Sequence
  chemically synthesized
ccccaacacagagtccccac

SEQ ID NO: 226982 - DNA, 20 bp, Artificial Sequence
  chemically synthesized
cccaacacagagtccccact

SEQ ID NO: 226983 - DNA, 20 bp, Artificial Sequence
  chemically synthesized
ccaacacagagtccccactg

SEQ ID NO: 226984 - DNA, 20 bp, Artificial Sequence
  chemically synthesized
cgctaggcagtgccccagtg

SEQ ID NO: 226985 - DNA, 20 bp, Artificial Sequence
  chemically synthesized
ccgctaggcagtgccccagt

SEQ ID NO: 226986 - DNA, 20 bp, Artificial Sequence
  chemically synthesized
tccgctaggcagtgccccag

SEQ ID NO: 226987 - DNA, 20 bp, Artificial Sequence
  chemically synthesized
agctccgctaggcagtgccc

SEQ ID NO: 226988 - DNA, 20 bp, Artificial Sequence
  chemically synthesized
gtccccactggggcactgcc

SEQ ID NO: 226989 - DNA, 20 bp, Artificial Sequence
  chemically synthesized
cccactggggcactgcctag

SEQ ID NO: 226990 - DNA, 20 bp, Artificial Sequence
  chemically synthesized
cactggggcactgcctagcg

SEQ ID NO: 226991 - DNA, 20 bp, Artificial Sequence
  chemically synthesized
cttctcatagctccgctagg

SEQ ID NO: 226992 - DNA, 20 bp, Artificial Sequence
  chemically synthesized
cctcttctcatagctccgct

SEQ ID NO: 226993 - DNA, 20 bp, Artificial Sequence
  chemically synthesized
ccctcttctcatagctccgc

SEQ ID NO: 226994 - DNA, 20 bp, Artificial Sequence
  chemically synthesized
gcactgcctagcggagctat

SEQ ID NO: 226995 - DNA, 20 bp, Artificial Sequence
  chemically synthesized
ctgcctagcggagctatgag

SEQ ID NO: 226996 - DNA, 20 bp, Artificial Sequence
  chemically synthesized
gcctagcggagctatgagaa

SEQ ID NO: 226997 - DNA, 20 bp, Artificial Sequence
  chemically synthesized
cctagcggagctatgagaag

SEQ ID NO: 226998 - DNA, 20 bp, Artificial Sequence
  chemically synthesized
ggacagtggccctcttctca

SEQ ID NO: 226999 - DNA, 20 bp, Artificial Sequence
  chemically synthesized
ctagcggagctatgagaaga

SEQ ID NO: 227000 - DNA, 20 bp, Artificial Sequence
  chemically synthesized
ttgtggggtctggtggacag

SEQ ID NO: 227001 - DNA, 20 bp, Artificial Sequence
  chemically synthesized
agaagagggccactgtccac

SEQ ID NO: 227002 - DNA, 20 bp, Artificial Sequence
  chemically synthesized
ccattgtggggtctggtgga

SEQ ID NO: 227003 - DNA, 20 bp, Artificial Sequence
  chemically synthesized
tctaccattgtggggtctgg

SEQ ID NO: 227004 - DNA, 20 bp, Artificial Sequence
  chemically synthesized
cgctctaccattgtggggtc

SEQ ID NO: 227005 - DNA, 20 bp, Artificial Sequence
  chemically synthesized
ctgtccaccagaccccacaa

SEQ ID NO: 227006 - DNA, 20 bp, Artificial Sequence
  chemically synthesized
ttgatcgctctaccattgtg

SEQ ID NO: 227007 - DNA, 20 bp, Artificial Sequence
  chemically synthesized
tccaccagaccccacaatgg

SEQ ID NO: 227008 - DNA, 20 bp, Artificial Sequence
  chemically synthesized
gttgatcgctctaccattgt

SEQ ID NO: 227009 - DNA, 20 bp, Artificial Sequence
  chemically synthesized
tgttgatcgctctaccattg

SEQ ID NO: 227010 - DNA, 20 bp, Artificial Sequence
  chemically synthesized
caccagaccccacaatggta

SEQ ID NO: 227011 - DNA, 20 bp, Artificial Sequence
  chemically synthesized
cacaatggtagagcgatcaa

SEQ ID NO: 227012 - DNA, 20 bp, Artificial Sequence
  chemically synthesized
cttttccaggcacgtggtgc

SEQ ID NO: 227013 - DNA, 20 bp, Artificial Sequence
  chemically synthesized
aacagcttgcaccacgtgcc

SEQ ID NO: 227014 - DNA, 20 bp, Artificial Sequence
  chemically synthesized
ctgcagcttttccaggcacg

SEQ ID NO: 227015 - DNA, 20 bp, Artificial Sequence
  chemically synthesized
cttgcaccacgtgcctggaa

SEQ ID NO: 227016 - DNA, 20 bp, Artificial Sequence
  chemically synthesized
tgagtgtctgcagcttttcc

SEQ ID NO: 227017 - DNA, 20 bp, Artificial Sequence
  chemically synthesized
ttgagtgtctgcagcttttc

SEQ ID NO: 227018 - DNA, 20 bp, Artificial Sequence
  chemically synthesized
ccacgtgcctggaaaagctg

SEQ ID NO: 227019 - DNA, 20 bp, Artificial Sequence
  chemically synthesized
aggctggcattgagtgtctg

SEQ ID NO: 227020 - DNA, 20 bp, Artificial Sequence
  chemically synthesized
aagctgcagacactcaatgc

SEQ ID NO: 227021 - DNA, 20 bp, Artificial Sequence
  chemically synthesized
tgcttttacaggctggcatt

SEQ ID NO: 227022 - DNA, 20 bp, Artificial Sequence
  chemically synthesized
tcctggctgcttttacaggc

SEQ ID NO: 227023 - DNA, 20 bp, Artificial Sequence
  chemically synthesized
cactcaatgccagcctgtaa

SEQ ID NO: 227024 - DNA, 20 bp, Artificial Sequence
  chemically synthesized
tcaatgccagcctgtaaaag

SEQ ID NO: 227025 - DNA, 20 bp, Artificial Sequence
  chemically synthesized
cctctcctggctgcttttac

SEQ ID NO: 227026 - DNA, 20 bp, Artificial Sequence
  chemically synthesized
ccctctcctggctgctttta

SEQ ID NO: 227027 - DNA, 20 bp, Artificial Sequence
  chemically synthesized
tgccagcctgtaaaagcagc

SEQ ID NO: 227028 - DNA, 20 bp, Artificial Sequence
  chemically synthesized
gccagcctgtaaaagcagcc

SEQ ID NO: 227029 - DNA, 20 bp, Artificial Sequence
  chemically synthesized
cagcctgtaaaagcagccag

SEQ ID NO: 227030 - DNA, 20 bp, Artificial Sequence
  chemically synthesized
gcctgtaaaagcagccagga

SEQ ID NO: 227031 - DNA, 20 bp, Artificial Sequence
  chemically synthesized
cctgtaaaagcagccaggag

SEQ ID NO: 227032 - DNA, 20 bp, Artificial Sequence
  chemically synthesized
ctgtaaaagcagccaggaga

SEQ ID NO: 227033 - DNA, 20 bp, Artificial Sequence
  chemically synthesized
tgtaaaagcagccaggagag

SEQ ID NO: 227034 - DNA, 20 bp, Artificial Sequence
  chemically synthesized
gcagggtagagcccctctcc

SEQ ID NO: 227035 - DNA, 20 bp, Artificial Sequence
  chemically synthesized
ccctgtgggtttgcagggta

SEQ ID NO: 227036 - DNA, 20 bp, Artificial Sequence
  chemically synthesized
acccctgtgggtttgcaggg

SEQ ID NO: 227037 - DNA, 20 bp, Artificial Sequence
  chemically synthesized
tccacccctgtgggtttgca

SEQ ID NO: 227038 - DNA, 20 bp, Artificial Sequence
  chemically synthesized
ctccacccctgtgggtttgc

SEQ ID NO: 227039 - DNA, 20 bp, Artificial Sequence
  chemically synthesized
gctccacccctgtgggtttg

SEQ ID NO: 227040 - DNA, 20 bp, Artificial Sequence
  chemically synthesized
ggctctaccctgcaaaccca

SEQ ID NO: 227041 - DNA, 20 bp, Artificial Sequence
  chemically synthesized
gctctaccctgcaaacccac

SEQ ID NO: 227042 - DNA, 20 bp, Artificial Sequence
  chemically synthesized
ctctaccctgcaaacccaca

SEQ ID NO: 227043 - DNA, 20 bp, Artificial Sequence
  chemically synthesized
tctaccctgcaaacccacag

SEQ ID NO: 227044 - DNA, 20 bp, Artificial Sequence
  chemically synthesized
accctgcaaacccacagggg

SEQ ID NO: 227045 - DNA, 20 bp, Artificial Sequence
  chemically synthesized
ttggtaagctccacccctgt

SEQ ID NO: 227046 - DNA, 20 bp, Artificial Sequence
  chemically synthesized
cttggtaagctccacccctg

SEQ ID NO: 227047 - DNA, 20 bp, Artificial Sequence
  chemically synthesized
cctgcaaacccacaggggtg

SEQ ID NO: 227048 - DNA, 20 bp, Artificial Sequence
  chemically synthesized
ccacaggggtggagcttacc

SEQ ID NO: 227049 - DNA, 20 bp, Artificial Sequence
  chemically synthesized
tgggttcccatggtcttggt

SEQ ID NO: 227050 - DNA, 20 bp, Artificial Sequence
  chemically synthesized
ggtggagcttaccaagacca

SEQ ID NO: 227051 - DNA, 20 bp, Artificial Sequence
  chemically synthesized
gtggagcttaccaagaccat

SEQ ID NO: 227052 - DNA, 20 bp, Artificial Sequence
  chemically synthesized
gaggtgggttcccatggtct

SEQ ID NO: 227053 - DNA, 20 bp, Artificial Sequence
  chemically synthesized
atgcaagaggtgggttccca

SEQ ID NO: 227054 - DNA, 20 bp, Artificial Sequence
  chemically synthesized
gtaacactgatgcaagaggt

SEQ ID NO: 227055 - DNA, 20 bp, Artificial Sequence
  chemically synthesized
ggtaacactgatgcaagagg

SEQ ID NO: 227056 - DNA, 20 bp, Artificial Sequence
  chemically synthesized
tgggaacccacctcttgcat

SEQ ID NO: 227057 - DNA, 20 bp, Artificial Sequence
  chemically synthesized
ccaggtaacactgatgcaag

SEQ ID NO: 227058 - DNA, 20 bp, Artificial Sequence
  chemically synthesized
tccaggtaacactgatgcaa

SEQ ID NO: 227059 - DNA, 20 bp, Artificial Sequence
  chemically synthesized
catccaggtaacactgatgc

SEQ ID NO: 227060 - DNA, 20 bp, Artificial Sequence
  chemically synthesized
cctcttgcatcagtgttacc

SEQ ID NO: 227061 - DNA, 20 bp, Artificial Sequence
  chemically synthesized
catcagtgttacctggatgt

SEQ ID NO: 227062 - DNA, 20 bp, Artificial Sequence
  chemically synthesized
tgactccatttctcacatcc

SEQ ID NO: 227063 - DNA, 20 bp, Artificial Sequence
  chemically synthesized
ttgactccatttctcacatc

SEQ ID NO: 227064 - DNA, 20 bp, Artificial Sequence
  chemically synthesized
tgttacctggatgtgagaaa

SEQ ID NO: 227065 - DNA, 20 bp, Artificial Sequence
  chemically synthesized
ttacctggatgtgagaaatg

SEQ ID NO: 227066 - DNA, 20 bp, Artificial Sequence
  chemically synthesized
ggatgtgagaaatggagtca

SEQ ID NO: 227067 - DNA, 20 bp, Artificial Sequence
  chemically synthesized
gatgtgagaaatggagtcaa

SEQ ID NO: 227068 - DNA, 20 bp, Artificial Sequence
  chemically synthesized
tgtgagaaatggagtcaaag

SEQ ID NO: 227069 - DNA, 20 bp, Artificial Sequence
  chemically synthesized
ggagtcaaaggagacaactt

SEQ ID NO: 227070 - DNA, 20 bp, Artificial Sequence
  chemically synthesized
agtcaaaggagacaacttca

SEQ ID NO: 227071 - DNA, 20 bp, Artificial Sequence
  chemically synthesized
agtcaaatcttacagctctg

SEQ ID NO: 227072 - DNA, 20 bp, Artificial Sequence
  chemically synthesized
ggagacaacttcagagctgt

SEQ ID NO: 227073 - DNA, 20 bp, Artificial Sequence
  chemically synthesized
atcagggcagtcaaatctta

SEQ ID NO: 227074 - DNA, 20 bp, Artificial Sequence
  chemically synthesized
gtaagatttgactgccctga

SEQ ID NO: 227075 - DNA, 20 bp, Artificial Sequence
  chemically synthesized
cagtccaaaatctatcaggg

SEQ ID NO: 227076 - DNA, 20 bp, Artificial Sequence
  chemically synthesized
agccagtccaaaatctatca

SEQ ID NO: 227077 - DNA, 20 bp, Artificial Sequence
  chemically synthesized
aagccagtccaaaatctatc

SEQ ID NO: 227078 - DNA, 20 bp, Artificial Sequence
  chemically synthesized
caagccagtccaaaatctat

SEQ ID NO: 227079 - DNA, 20 bp, Artificial Sequence
  chemically synthesized
ttgactgccctgatagattt

SEQ ID NO: 227080 - DNA, 20 bp, Artificial Sequence
  chemically synthesized
tgccctgatagattttggac

SEQ ID NO: 227081 - DNA, 20 bp, Artificial Sequence
  chemically synthesized
tgatagattttggactggct

SEQ ID NO: 227082 - DNA, 20 bp, Artificial Sequence
  chemically synthesized
gatagattttggactggctt

SEQ ID NO: 227083 - DNA, 20 bp, Artificial Sequence
  chemically synthesized
atagattttggactggcttg

SEQ ID NO: 227084 - DNA, 20 bp, Artificial Sequence
  chemically synthesized
aggggctacaggccccaagc

SEQ ID NO: 227085 - DNA, 20 bp, Artificial Sequence
  chemically synthesized
atgaaggggctacaggcccc

SEQ ID NO: 227086 - DNA, 20 bp, Artificial Sequence
  chemically synthesized
ttggactggcttggggcctg

SEQ ID NO: 227087 - DNA, 20 bp, Artificial Sequence
  chemically synthesized
agccaaaatgaaggggctac

SEQ ID NO: 227088 - DNA, 20 bp, Artificial Sequence
  chemically synthesized
tagccaaaatgaaggggcta

SEQ ID NO: 227089 - DNA, 20 bp, Artificial Sequence
  chemically synthesized
agaaattagccaaaatgaag

SEQ ID NO: 227090 - DNA, 20 bp, Artificial Sequence
  chemically synthesized
ggcctgtagccccttcattt

SEQ ID NO: 227091 - DNA, 20 bp, Artificial Sequence
  chemically synthesized
gagaaattagccaaaatgaa

SEQ ID NO: 227092 - DNA, 20 bp, Artificial Sequence
  chemically synthesized
ggagaaattagccaaaatga

SEQ ID NO: 227093 - DNA, 20 bp, Artificial Sequence
  chemically synthesized
gggagaaattagccaaaatg

SEQ ID NO: 227094 - DNA, 20 bp, Artificial Sequence
  chemically synthesized
ccattacaaatgggagaaat

SEQ ID NO: 227095 - DNA, 20 bp, Artificial Sequence
  chemically synthesized
aatatacccattacaaatgg

SEQ ID NO: 227096 - DNA, 20 bp, Artificial Sequence
  chemically synthesized
taaatatacccattacaaat

SEQ ID NO: 227097 - DNA, 20 bp, Artificial Sequence
  chemically synthesized
ctaatttctcccatttgtaa

SEQ ID NO: 227098 - DNA, 20 bp, Artificial Sequence
  chemically synthesized
gtaaatatacccattacaaa

SEQ ID NO: 227099 - DNA, 20 bp, Artificial Sequence
  chemically synthesized
taatttctcccatttgtaat

SEQ ID NO: 227100 - DNA, 20 bp, Artificial Sequence
  chemically synthesized
ttgtaatgggtatatttacc

SEQ ID NO: 227101 - DNA, 20 bp, Artificial Sequence
  chemically synthesized
aaaatggaagcacaggcact

SEQ ID NO: 227102 - DNA, 20 bp, Artificial Sequence
  chemically synthesized
taaaatggaagcacaggcac

SEQ ID NO: 227103 - DNA, 20 bp, Artificial Sequence
  chemically synthesized
cctagataaaatggaagcac

SEQ ID NO: 227104 - DNA, 20 bp, Artificial Sequence
  chemically synthesized
tcctagataaaatggaagca

SEQ ID NO: 227105 - DNA, 20 bp, Artificial Sequence
  chemically synthesized
ttacttcctagataaaatgg

SEQ ID NO: 227106 - DNA, 20 bp, Artificial Sequence
  chemically synthesized
gcctgtgcttccattttatc

SEQ ID NO: 227107 - DNA, 20 bp, Artificial Sequence
  chemically synthesized
tagttacttcctagataaaa

SEQ ID NO: 227108 - DNA, 20 bp, Artificial Sequence
  chemically synthesized
cctgtgcttccattttatct

SEQ ID NO: 227109 - DNA, 20 bp, Artificial Sequence
  chemically synthesized
gtgcttccattttatctagg

SEQ ID NO: 227110 - DNA, 20 bp, Artificial Sequence
  chemically synthesized
aaagcaagttagttacttcc

SEQ ID NO: 227111 - DNA, 20 bp, Artificial Sequence
  chemically synthesized
ctgtaaaatcaaaagcaagt

SEQ ID NO: 227112 - DNA, 20 bp, Artificial Sequence
  chemically synthesized
gagcctgtaaaatcaaaagc

SEQ ID NO: 227113 - DNA, 20 bp, Artificial Sequence
  chemically synthesized
ctgtgagcctgtaaaatcaa

SEQ ID NO: 227114 - DNA, 20 bp, Artificial Sequence
  chemically synthesized
ctaacttgcttttgatttta

SEQ ID NO: 227115 - DNA, 20 bp, Artificial Sequence
  chemically synthesized
taacttgcttttgattttac

SEQ ID NO: 227116 - DNA, 20 bp, Artificial Sequence
  chemically synthesized
cttttgattttacaggctca

SEQ ID NO: 227117 - DNA, 20 bp, Artificial Sequence
  chemically synthesized
ttttgattttacaggctcac

SEQ ID NO: 227118 - DNA, 20 bp, Artificial Sequence
  chemically synthesized
tgattttacaggctcacagg

SEQ ID NO: 227119 - DNA, 20 bp, Artificial Sequence
  chemically synthesized
ggcaagtctgttctgcctgt

SEQ ID NO: 227120 - DNA, 20 bp, Artificial Sequence
  chemically synthesized
ttacaggctcacaggcagaa

SEQ ID NO: 227121 - DNA, 20 bp, Artificial Sequence
  chemically synthesized
agtctcatctgagacaaggc

SEQ ID NO: 227122 - DNA, 20 bp, Artificial Sequence
  chemically synthesized
agaacagacttgccttgtct

SEQ ID NO: 227123 - DNA, 20 bp, Artificial Sequence
  chemically synthesized
ccaaagtctcatctgagaca

SEQ ID NO: 227124 - DNA, 20 bp, Artificial Sequence
  chemically synthesized
tccaaagtctcatctgagac

SEQ ID NO: 227125 - DNA, 20 bp, Artificial Sequence
  chemically synthesized
agacttgccttgtctcagat

SEQ ID NO: 227126 - DNA, 20 bp, Artificial Sequence
  chemically synthesized
ccaagtccaaagtctcatct

SEQ ID NO: 227127 - DNA, 20 bp, Artificial Sequence
  chemically synthesized
ccttgtctcagatgagactt

SEQ ID NO: 227128 - DNA, 20 bp, Artificial Sequence
  chemically synthesized
ctcagatgagactttggact

SEQ ID NO: 227129 - DNA, 20 bp, Artificial Sequence
  chemically synthesized
aacccaaaagtccaagtcca

SEQ ID NO: 227130 - DNA, 20 bp, Artificial Sequence
  chemically synthesized
agactttggacttggacttt

SEQ ID NO: 227131 - DNA, 20 bp, Artificial Sequence
  chemically synthesized
cagcattaacccaaaagtcc

SEQ ID NO: 227132 - DNA, 20 bp, Artificial Sequence
  chemically synthesized
gactttggacttggactttt

SEQ ID NO: 227133 - DNA, 20 bp, Artificial Sequence
  chemically synthesized
tcatttcagcattaacccaa

SEQ ID NO: 227134 - DNA, 20 bp, Artificial Sequence
  chemically synthesized
tccaaagtattaattcattt

SEQ ID NO: 227135 - DNA, 20 bp, Artificial Sequence
  chemically synthesized
gctgaaatgaattaatactt

SEQ ID NO: 227136 - DNA, 20 bp, Artificial Sequence
  chemically synthesized
tgaaatgaattaatactttg

SEQ ID NO: 227137 - DNA, 20 bp, Artificial Sequence
  chemically synthesized
gccttgacaacagtactcca

SEQ ID NO: 227138 - DNA, 20 bp, Artificial Sequence
  chemically synthesized
tactttggagtactgttgtc

SEQ ID NO: 227139 - DNA, 20 bp, Artificial Sequence
  chemically synthesized
actttggagtactgttgtca

SEQ ID NO: 227140 - DNA, 20 bp, Artificial Sequence
  chemically synthesized
aaccaatcatgccttgacaa

SEQ ID NO: 227141 - DNA, 20 bp, Artificial Sequence
  chemically synthesized
tactgttgtcaaggcatgat

SEQ ID NO: 227142 - DNA, 20 bp, Artificial Sequence
  chemically synthesized
tgattggttttgaaatgtga

SEQ ID NO: 227143 - DNA, 20 bp, Artificial Sequence
  chemically synthesized
gattggttttgaaatgtgaa

SEQ ID NO: 227144 - DNA, 20 bp, Artificial Sequence
  chemically synthesized
attggttttgaaatgtgaaa

SEQ ID NO: 227145 - DNA, 20 bp, Artificial Sequence
  chemically synthesized
ttgaaatgtgaaagggacat

SEQ ID NO: 227146 - DNA, 20 bp, Artificial Sequence
  chemically synthesized
tgtgaaagggacatgagatt

SEQ ID NO: 227147 - DNA, 20 bp, Artificial Sequence
  chemically synthesized
gtgaaagggacatgagattt

SEQ ID NO: 227148 - DNA, 20 bp, Artificial Sequence
  chemically synthesized
gaaagggacatgagatttgg

SEQ ID NO: 227149 - DNA, 20 bp, Artificial Sequence
  chemically synthesized
aaagggacatgagatttggg

SEQ ID NO: 227150 - DNA, 20 bp, Artificial Sequence
  chemically synthesized
aagggacatgagatttggga

SEQ ID NO: 227151 - DNA, 20 bp, Artificial Sequence
  chemically synthesized
agggacatgagatttgggag

SEQ ID NO: 227152 - DNA, 20 bp, Artificial Sequence
  chemically synthesized
acatgagatttgggaggggc

SEQ ID NO: 227153 - DNA, 20 bp, Artificial Sequence
  chemically synthesized
catgagatttgggaggggcc

SEQ ID NO: 227154 - DNA, 20 bp, Artificial Sequence
  chemically synthesized
tgagatttgggaggggccag

SEQ ID NO: 227155 - DNA, 20 bp, Artificial Sequence
  chemically synthesized
caaacatatcattttgctcc

SEQ ID NO: 227156 - DNA, 20 bp, Artificial Sequence
  chemically synthesized
caggagcaaaatgatatgtt

SEQ ID NO: 227157 - DNA, 20 bp, Artificial Sequence
  chemically synthesized
aggagcaaaatgatatgttt

SEQ ID NO: 227158 - DNA, 20 bp, Artificial Sequence
  chemically synthesized
gagatttgggtggggacaca

SEQ ID NO: 227159 - DNA, 20 bp, Artificial Sequence
  chemically synthesized
ttcaagatgagatttgggtg

SEQ ID NO: 227160 - DNA, 20 bp, Artificial Sequence
  chemically synthesized
attcaagatgagatttgggt

SEQ ID NO: 227161 - DNA, 20 bp, Artificial Sequence
  chemically synthesized
aattcaagatgagatttggg

SEQ ID NO: 227162 - DNA, 20 bp, Artificial Sequence
  chemically synthesized
tacaattcaagatgagattt

SEQ ID NO: 227163 - DNA, 20 bp, Artificial Sequence
  chemically synthesized
ttacaattcaagatgagatt

SEQ ID NO: 227164 - DNA, 20 bp, Artificial Sequence
  chemically synthesized
taaggattacaattcaagat

SEQ ID NO: 227165 - DNA, 20 bp, Artificial Sequence
  chemically synthesized
gattataaggattacaattc

SEQ ID NO: 227166 - DNA, 20 bp, Artificial Sequence
  chemically synthesized
tggggattatggggattata

SEQ ID NO: 227167 - DNA, 20 bp, Artificial Sequence
  chemically synthesized
ctggggattatggggattat

SEQ ID NO: 227168 - DNA, 20 bp, Artificial Sequence
  chemically synthesized
tttgacacctggggattatg

SEQ ID NO: 227169 - DNA, 20 bp, Artificial Sequence
  chemically synthesized
ctttgacacctggggattat

SEQ ID NO: 227170 - DNA, 20 bp, Artificial Sequence
  chemically synthesized
cttataatccccataatccc

SEQ ID NO: 227171 - DNA, 20 bp, Artificial Sequence
  chemically synthesized
cctttgacacctggggatta

SEQ ID NO: 227172 - DNA, 20 bp, Artificial Sequence
  chemically synthesized
ttataatccccataatcccc

SEQ ID NO: 227173 - DNA, 20 bp, Artificial Sequence
  chemically synthesized
agcctctcctttgacacctg

SEQ ID NO: 227174 - DNA, 20 bp, Artificial Sequence
  chemically synthesized
tagcctctcctttgacacct

SEQ ID NO: 227175 - DNA, 20 bp, Artificial Sequence
  chemically synthesized
cccataatccccaggtgtca

SEQ ID NO: 227176 - DNA, 20 bp, Artificial Sequence
  chemically synthesized
atagcctctcctttgacacc

SEQ ID NO: 227177 - DNA, 20 bp, Artificial Sequence
  chemically synthesized
ccataatccccaggtgtcaa

SEQ ID NO: 227178 - DNA, 20 bp, Artificial Sequence
  chemically synthesized
ataatccccaggtgtcaaag

SEQ ID NO: 227179 - DNA, 20 bp, Artificial Sequence
  chemically synthesized
aatccccaggtgtcaaagga

SEQ ID NO: 227180 - DNA, 20 bp, Artificial Sequence
  chemically synthesized
atccccaggtgtcaaaggag

SEQ ID NO: 227181 - DNA, 20 bp, Artificial Sequence
  chemically synthesized
gtgtcaaaggagaggctatg

SEQ ID NO: 227182 - DNA, 20 bp, Artificial Sequence
  chemically synthesized
gtcaaaggagaggctatgtg

SEQ ID NO: 227183 - DNA, 20 bp, Artificial Sequence
  chemically synthesized
tcaaaggagaggctatgtgg

SEQ ID NO: 227184 - DNA, 20 bp, Artificial Sequence
  chemically synthesized
atgattcaattacctccaca

SEQ ID NO: 227185 - DNA, 20 bp, Artificial Sequence
  chemically synthesized
atgtggaggtaattgaatca

SEQ ID NO: 227186 - DNA, 20 bp, Artificial Sequence
  chemically synthesized
tgtggaggtaattgaatcat

SEQ ID NO: 227187 - DNA, 20 bp, Artificial Sequence
  chemically synthesized
gtggaggtaattgaatcatg

SEQ ID NO: 227188 - DNA, 20 bp, Artificial Sequence
  chemically synthesized
aggtaattgaatcatggggt

SEQ ID NO: 227189 - DNA, 20 bp, Artificial Sequence
  chemically synthesized
tcatgagaacagcatggggg

SEQ ID NO: 227190 - DNA, 20 bp, Artificial Sequence
  chemically synthesized
ctatcatgagaacagcatgg

SEQ ID NO: 227191 - DNA, 20 bp, Artificial Sequence
  chemically synthesized
actatcatgagaacagcatg

SEQ ID NO: 227192 - DNA, 20 bp, Artificial Sequence
  chemically synthesized
cactatcatgagaacagcat

SEQ ID NO: 227193 - DNA, 20 bp, Artificial Sequence
  chemically synthesized
tcactatcatgagaacagca

SEQ ID NO: 227194 - DNA, 20 bp, Artificial Sequence
  chemically synthesized
ttcactcactatcatgagaa

SEQ ID NO: 227195 - DNA, 20 bp, Artificial Sequence
  chemically synthesized
cccccatgctgttctcatga

SEQ ID NO: 227196 - DNA, 20 bp, Artificial Sequence
  chemically synthesized
gagaattcactcactatcat

SEQ ID NO: 227197 - DNA, 20 bp, Artificial Sequence
  chemically synthesized
catgctgttctcatgatagt

SEQ ID NO: 227198 - DNA, 20 bp, Artificial Sequence
  chemically synthesized
ataaaaccatcagattttgg

SEQ ID NO: 227199 - DNA, 20 bp, Artificial Sequence
  chemically synthesized
ttataaaaccatcagatttt

SEQ ID NO: 227200 - DNA, 20 bp, Artificial Sequence
  chemically synthesized
cttataaaaccatcagattt

SEQ ID NO: 227201 - DNA, 20 bp, Artificial Sequence
  chemically synthesized
tgaattctcccaaaatctga

SEQ ID NO: 227202 - DNA, 20 bp, Artificial Sequence
  chemically synthesized
agagacccttataaaaccat

SEQ ID NO: 227203 - DNA, 20 bp, Artificial Sequence
  chemically synthesized
ccaaaatctgatggttttat

SEQ ID NO: 227204 - DNA, 20 bp, Artificial Sequence
  chemically synthesized
caaaatctgatggttttata

SEQ ID NO: 227205 - DNA, 20 bp, Artificial Sequence
  chemically synthesized
aaaatctgatggttttataa

SEQ ID NO: 227206 - DNA, 20 bp, Artificial Sequence
  chemically synthesized
agtactgaggaaagggggaa

SEQ ID NO: 227207 - DNA, 20 bp, Artificial Sequence
  chemically synthesized
gaagtactgaggaaaggggg

SEQ ID NO: 227208 - DNA, 20 bp, Artificial Sequence
  chemically synthesized
ggagaagtactgaggaaagg

SEQ ID NO: 227209 - DNA, 20 bp, Artificial Sequence
  chemically synthesized
gggtctcttccccctttcct

SEQ ID NO: 227210 - DNA, 20 bp, Artificial Sequence
  chemically synthesized
aggagaagtactgaggaaag

SEQ ID NO: 227211 - DNA, 20 bp, Artificial Sequence
  chemically synthesized
aaggagaagtactgaggaaa

SEQ ID NO: 227212 - DNA, 20 bp, Artificial Sequence
  chemically synthesized
gaaggagaagtactgaggaa

SEQ ID NO: 227213 - DNA, 20 bp, Artificial Sequence
  chemically synthesized
ggaaggagaagtactgagga

SEQ ID NO: 227214 - DNA, 20 bp, Artificial Sequence
  chemically synthesized
ggcaggaaggagaagtactg

SEQ ID NO: 227215 - DNA, 20 bp, Artificial Sequence
  chemically synthesized
tggcaggaaggagaagtact

SEQ ID NO: 227216 - DNA, 20 bp, Artificial Sequence
  chemically synthesized
cacaaggtggcaggaaggag

SEQ ID NO: 227217 - DNA, 20 bp, Artificial Sequence
  chemically synthesized
cttcacaaggtggcaggaag

SEQ ID NO: 227218 - DNA, 20 bp, Artificial Sequence
  chemically synthesized
ttcttcacaaggtggcagga

SEQ ID NO: 227219 - DNA, 20 bp, Artificial Sequence
  chemically synthesized
cttcttcacaaggtggcagg

SEQ ID NO: 227220 - DNA, 20 bp, Artificial Sequence
  chemically synthesized
caccttcttcacaaggtggc

SEQ ID NO: 227221 - DNA, 20 bp, Artificial Sequence
  chemically synthesized
gcaccttcttcacaaggtgg

SEQ ID NO: 227222 - DNA, 20 bp, Artificial Sequence
  chemically synthesized
ctccttcctgccaccttgtg

SEQ ID NO: 227223 - DNA, 20 bp, Artificial Sequence
  chemically synthesized
gaggcaccttcttcacaagg

SEQ ID NO: 227224 - DNA, 20 bp, Artificial Sequence
  chemically synthesized
cttcctgccaccttgtgaag

SEQ ID NO: 227225 - DNA, 20 bp, Artificial Sequence
  chemically synthesized
agcgaggcaccttcttcaca

SEQ ID NO: 227226 - DNA, 20 bp, Artificial Sequence
  chemically synthesized
ttcctgccaccttgtgaaga

SEQ ID NO: 227227 - DNA, 20 bp, Artificial Sequence
  chemically synthesized
aagcgaggcaccttcttcac

SEQ ID NO: 227228 - DNA, 20 bp, Artificial Sequence
  chemically synthesized
cagaaaatgaaggggaagcg

SEQ ID NO: 227229 - DNA, 20 bp, Artificial Sequence
  chemically synthesized
gcagaaaatgaaggggaagc

SEQ ID NO: 227230 - DNA, 20 bp, Artificial Sequence
  chemically synthesized
catggcagaaaatgaagggg

SEQ ID NO: 227231 - DNA, 20 bp, Artificial Sequence
  chemically synthesized
aatcatggcagaaaatgaag

SEQ ID NO: 227232 - DNA, 20 bp, Artificial Sequence
  chemically synthesized
aaatcatggcagaaaatgaa

SEQ ID NO: 227233 - DNA, 20 bp, Artificial Sequence
  chemically synthesized
aaaatcatggcagaaaatga

SEQ ID NO: 227234 - DNA, 20 bp, Artificial Sequence
  chemically synthesized
taaaatcatggcagaaaatg

SEQ ID NO: 227235 - DNA, 20 bp, Artificial Sequence
  chemically synthesized
caggaaacttaaaatcatgg

SEQ ID NO: 227236 - DNA, 20 bp, Artificial Sequence
  chemically synthesized
tcattttctgccatgatttt

SEQ ID NO: 227237 - DNA, 20 bp, Artificial Sequence
  chemically synthesized
cctcaggaaacttaaaatca

SEQ ID NO: 227238 - DNA, 20 bp, Artificial Sequence
  chemically synthesized
gccatgattttaagtttcct

SEQ ID NO: 227239 - DNA, 20 bp, Artificial Sequence
  chemically synthesized
ccatgattttaagtttcctg

SEQ ID NO: 227240 - DNA, 20 bp, Artificial Sequence
  chemically synthesized
aatatggctggggaggcctc

SEQ ID NO: 227241 - DNA, 20 bp, Artificial Sequence
  chemically synthesized
caatatggctggggaggcct

SEQ ID NO: 227242 - DNA, 20 bp, Artificial Sequence
  chemically synthesized
taagtttcctgaggcctccc

SEQ ID NO: 227243 - DNA, 20 bp, Artificial Sequence
  chemically synthesized
acagttcaatatggctgggg

SEQ ID NO: 227244 - DNA, 20 bp, Artificial Sequence
  chemically synthesized
cacagttcaatatggctggg

SEQ ID NO: 227245 - DNA, 20 bp, Artificial Sequence
  chemically synthesized
ctcacagttcaatatggctg

SEQ ID NO: 227246 - DNA, 20 bp, Artificial Sequence
  chemically synthesized
actcacagttcaatatggct

SEQ ID NO: 227247 - DNA, 20 bp, Artificial Sequence
  chemically synthesized
gactcacagttcaatatggc

SEQ ID NO: 227248 - DNA, 20 bp, Artificial Sequence
  chemically synthesized
aattgactcacagttcaata

SEQ ID NO: 227249 - DNA, 20 bp, Artificial Sequence
  chemically synthesized
ccccagccatattgaactgt

SEQ ID NO: 227250 - DNA, 20 bp, Artificial Sequence
  chemically synthesized
aaagaggtttaattgactca

SEQ ID NO: 227251 - DNA, 20 bp, Artificial Sequence
  chemically synthesized
gggtaatttataaaggaaag

SEQ ID NO: 227252 - DNA, 20 bp, Artificial Sequence
  chemically synthesized
tgggtaatttataaaggaaa

SEQ ID NO: 227253 - DNA, 20 bp, Artificial Sequence
  chemically synthesized
attgggtaatttataaagga

SEQ ID NO: 227254 - DNA, 20 bp, Artificial Sequence
  chemically synthesized
cgagattgggtaatttataa

SEQ ID NO: 227255 - DNA, 20 bp, Artificial Sequence
  chemically synthesized
ccgagattgggtaatttata

SEQ ID NO: 227256 - DNA, 20 bp, Artificial Sequence
  chemically synthesized
ctttataaattacccaatct

SEQ ID NO: 227257 - DNA, 20 bp, Artificial Sequence
  chemically synthesized
tttataaattacccaatctc

SEQ ID NO: 227258 - DNA, 20 bp, Artificial Sequence
  chemically synthesized
agaaagaactgcccgagatt

SEQ ID NO: 227259 - DNA, 20 bp, Artificial Sequence
  chemically synthesized
tagaaagaactgcccgagat

SEQ ID NO: 227260 - DNA, 20 bp, Artificial Sequence
  chemically synthesized
ataaattacccaatctcggg

SEQ ID NO: 227261 - DNA, 20 bp, Artificial Sequence
  chemically synthesized
accgctagaaagaactgccc

SEQ ID NO: 227262 - DNA, 20 bp, Artificial Sequence
  chemically synthesized
caatctcgggcagttctttc

SEQ ID NO: 227263 - DNA, 20 bp, Artificial Sequence
  chemically synthesized
tctcgggcagttctttctag

SEQ ID NO: 227264 - DNA, 20 bp, Artificial Sequence
  chemically synthesized
cccgttttcataccgctaga

SEQ ID NO: 227265 - DNA, 20 bp, Artificial Sequence
  chemically synthesized
ttagcccgttttcataccgc

SEQ ID NO: 227266 - DNA, 20 bp, Artificial Sequence
  chemically synthesized
tctttctagcggtatgaaaa

SEQ ID NO: 227267 - DNA, 20 bp, Artificial Sequence
  chemically synthesized
ctttctagcggtatgaaaac

SEQ ID NO: 227268 - DNA, 20 bp, Artificial Sequence
  chemically synthesized
tctcaagagagggagtgtat

SEQ ID NO: 227269 - DNA, 20 bp, Artificial Sequence
  chemically synthesized
aacagaaatctcaagagagg

SEQ ID NO: 227270 - DNA, 20 bp, Artificial Sequence
  chemically synthesized
gctaatacactccctctctt

SEQ ID NO: 227271 - DNA, 20 bp, Artificial Sequence
  chemically synthesized
tgaacagaaatctcaagaga

SEQ ID NO: 227272 - DNA, 20 bp, Artificial Sequence
  chemically synthesized
ttgaacagaaatctcaagag

SEQ ID NO: 227273 - DNA, 20 bp, Artificial Sequence
  chemically synthesized
tttgaacagaaatctcaaga

SEQ ID NO: 227274 - DNA, 20 bp, Artificial Sequence
  chemically synthesized
tatttgaacagaaatctcaa

SEQ ID NO: 227275 - DNA, 20 bp, Artificial Sequence
  chemically synthesized
gatatttgaacagaaatctc

SEQ ID NO: 227276 - DNA, 20 bp, Artificial Sequence
  chemically synthesized
tctttgatgtgatatttgaa

SEQ ID NO: 227277 - DNA, 20 bp, Artificial Sequence
  chemically synthesized
tctgttcaaatatcacatca

SEQ ID NO: 227278 - DNA, 20 bp, Artificial Sequence
  chemically synthesized
tgttcaaatatcacatcaaa

SEQ ID NO: 227279 - DNA, 20 bp, Artificial Sequence
  chemically synthesized
gttcaaatatcacatcaaag

SEQ ID NO: 227280 - DNA, 20 bp, Artificial Sequence
  chemically synthesized
tcacatcaaagaggtctgcc

SEQ ID NO: 227281 - DNA, 20 bp, Artificial Sequence
  chemically synthesized
tttatatatggcagtctggg

SEQ ID NO: 227282 - DNA, 20 bp, Artificial Sequence
  chemically synthesized
tgttttatatatggcagtct

SEQ ID NO: 227283 - DNA, 20 bp, Artificial Sequence
  chemically synthesized
atgttttatatatggcagtc

SEQ ID NO: 227284 - DNA, 20 bp, Artificial Sequence
  chemically synthesized
aattgatgttttatatatgg

SEQ ID NO: 227285 - DNA, 20 bp, Artificial Sequence
  chemically synthesized
cgaaattgatgttttatata

SEQ ID NO: 227286 - DNA, 20 bp, Artificial Sequence
  chemically synthesized
catatataaaacatcaattt

SEQ ID NO: 227287 - DNA, 20 bp, Artificial Sequence
  chemically synthesized
tataaaacatcaatttcggc

SEQ ID NO: 227288 - DNA, 20 bp, Artificial Sequence
  chemically synthesized
ataaaacatcaatttcggct

SEQ ID NO: 227289 - DNA, 20 bp, Artificial Sequence
  chemically synthesized
acatcaatttcggctgggca

SEQ ID NO: 227290 - DNA, 20 bp, Artificial Sequence
  chemically synthesized
tcaatttcggctgggcatgg

SEQ ID NO: 227291 - DNA, 20 bp, Artificial Sequence
  chemically synthesized
caggcatgaaccaccatgcc

SEQ ID NO: 227292 - DNA, 20 bp, Artificial Sequence
  chemically synthesized
gtggttcatgcctgtaattc

SEQ ID NO: 227293 - DNA, 20 bp, Artificial Sequence
  chemically synthesized
tcctaaggtgctggaattac

SEQ ID NO: 227294 - DNA, 20 bp, Artificial Sequence
  chemically synthesized
ctcctaaggtgctggaatta

SEQ ID NO: 227295 - DNA, 20 bp, Artificial Sequence
  chemically synthesized
tgcctgtaattccagcacct

SEQ ID NO: 227296 - DNA, 20 bp, Artificial Sequence
  chemically synthesized
gcctgtaattccagcacctt

SEQ ID NO: 227297 - DNA, 20 bp, Artificial Sequence
  chemically synthesized
acatctacctcctaaggtgc

SEQ ID NO: 227298 - DNA, 20 bp, Artificial Sequence
  chemically synthesized
ctgtaattccagcaccttag

SEQ ID NO: 227299 - DNA, 20 bp, Artificial Sequence
  chemically synthesized
tgtaattccagcaccttagg

SEQ ID NO: 227300 - DNA, 20 bp, Artificial Sequence
  chemically synthesized
aattccagcaccttaggagg

SEQ ID NO: 227301 - DNA, 20 bp, Artificial Sequence
  chemically synthesized
ccacccacatctacctccta

SEQ ID NO: 227302 - DNA, 20 bp, Artificial Sequence
  chemically synthesized
tccacccacatctacctcct

SEQ ID NO: 227303 - DNA, 20 bp, Artificial Sequence
  chemically synthesized
agcaccttaggaggtagatg

SEQ ID NO: 227304 - DNA, 20 bp, Artificial Sequence
  chemically synthesized
gcaccttaggaggtagatgt

SEQ ID NO: 227305 - DNA, 20 bp, Artificial Sequence
  chemically synthesized
ccttaggaggtagatgtggg

SEQ ID NO: 227306 - DNA, 20 bp, Artificial Sequence
  chemically synthesized
tagatgtgggtggactgctt

SEQ ID NO: 227307 - DNA, 20 bp, Artificial Sequence
  chemically synthesized
cttgaactccggggctcaag

SEQ ID NO: 227308 - DNA, 20 bp, Artificial Sequence
  chemically synthesized
tgggtggactgcttgagccc

SEQ ID NO: 227309 - DNA, 20 bp, Artificial Sequence
  chemically synthesized
gttcttgaactccggggctc

SEQ ID NO: 227310 - DNA, 20 bp, Artificial Sequence
  chemically synthesized
ggtggactgcttgagccccg

SEQ ID NO: 227311 - DNA, 20 bp, Artificial Sequence
  chemically synthesized
caggctgttcttgaactccg

SEQ ID NO: 227312 - DNA, 20 bp, Artificial Sequence
  chemically synthesized
ctgcttgagccccggagttc

SEQ ID NO: 227313 - DNA, 20 bp, Artificial Sequence
  chemically synthesized
ccaggctgttcttgaactcc

SEQ ID NO: 227314 - DNA, 20 bp, Artificial Sequence
  chemically synthesized
cccaggctgttcttgaactc

SEQ ID NO: 227315 - DNA, 20 bp, Artificial Sequence
  chemically synthesized
tgagccccggagttcaagaa

SEQ ID NO: 227316 - DNA, 20 bp, Artificial Sequence
  chemically synthesized
cccggagttcaagaacagcc

SEQ ID NO: 227317 - DNA, 20 bp, Artificial Sequence
  chemically synthesized
ccggagttcaagaacagcct

SEQ ID NO: 227318 - DNA, 20 bp, Artificial Sequence
  chemically synthesized
agagtctcactgtgttgccc

SEQ ID NO: 227319 - DNA, 20 bp, Artificial Sequence
  chemically synthesized
caagaacagcctgggcaaca

SEQ ID NO: 227320 - DNA, 20 bp, Artificial Sequence
  chemically synthesized
cagagtctcactgtgttgcc

SEQ ID NO: 227321 - DNA, 20 bp, Artificial Sequence
  chemically synthesized
aacagcctgggcaacacagt

SEQ ID NO: 227322 - DNA, 20 bp, Artificial Sequence
  chemically synthesized
tttcttttcttatagagaca

SEQ ID NO: 227323 - DNA, 20 bp, Artificial Sequence
  chemically synthesized
cagtgagactctgtctctat

SEQ ID NO: 227324 - DNA, 20 bp, Artificial Sequence
  chemically synthesized
gttttcttttcttatagaga

SEQ ID NO: 227325 - DNA, 20 bp, Artificial Sequence
  chemically synthesized
acacgttttcttttcttata

SEQ ID NO: 227326 - DNA, 20 bp, Artificial Sequence
  chemically synthesized
agactctgtctctataagaa

SEQ ID NO: 227327 - DNA, 20 bp, Artificial Sequence
  chemically synthesized
taacacgttttcttttctta

SEQ ID NO: 227328 - DNA, 20 bp, Artificial Sequence
  chemically synthesized
tataagaaaagaaaacgtgt

SEQ ID NO: 227329 - DNA, 20 bp, Artificial Sequence
  chemically synthesized
agaaaagaaaacgtgttagc

SEQ ID NO: 227330 - DNA, 20 bp, Artificial Sequence
  chemically synthesized
gaaaagaaaacgtgttagct

SEQ ID NO: 227331 - DNA, 20 bp, Artificial Sequence
  chemically synthesized
aacgtgttagctgggtatcg

SEQ ID NO: 227332 - DNA, 20 bp, Artificial Sequence
  chemically synthesized
caggcatgtaccacgatacc

SEQ ID NO: 227333 - DNA, 20 bp, Artificial Sequence
  chemically synthesized
ggtatcgtggtacatgcctg

SEQ ID NO: 227334 - DNA, 20 bp, Artificial Sequence
  chemically synthesized
gtggtacatgcctgtagacc

SEQ ID NO: 227335 - DNA, 20 bp, Artificial Sequence
  chemically synthesized
tcccaagtagccaggtctac

SEQ ID NO: 227336 - DNA, 20 bp, Artificial Sequence
  chemically synthesized
ctcccaagtagccaggtcta

SEQ ID NO: 227337 - DNA, 20 bp, Artificial Sequence
  chemically synthesized
tgcctgtagacctggctact

SEQ ID NO: 227338 - DNA, 20 bp, Artificial Sequence
  chemically synthesized
catcagcctcccaagtagcc

SEQ ID NO: 227339 - DNA, 20 bp, Artificial Sequence
  chemically synthesized
gcctgtagacctggctactt

SEQ ID NO: 227340 - DNA, 20 bp, Artificial Sequence
  chemically synthesized
acatcagcctcccaagtagc

SEQ ID NO: 227341 - DNA, 20 bp, Artificial Sequence
  chemically synthesized
ctgtagacctggctacttgg

SEQ ID NO: 227342 - DNA, 20 bp, Artificial Sequence
  chemically synthesized
tgtagacctggctacttggg

SEQ ID NO: 227343 - DNA, 20 bp, Artificial Sequence
  chemically synthesized
tcccacatcagcctcccaag

SEQ ID NO: 227344 - DNA, 20 bp, Artificial Sequence
  chemically synthesized
tcctcccacatcagcctccc

SEQ ID NO: 227345 - DNA, 20 bp, Artificial Sequence
  chemically synthesized
ggctacttgggaggctgatg

SEQ ID NO: 227346 - DNA, 20 bp, Artificial Sequence
  chemically synthesized
gctacttgggaggctgatgt

SEQ ID NO: 227347 - DNA, 20 bp, Artificial Sequence
  chemically synthesized
tacttgggaggctgatgtgg

SEQ ID NO: 227348 - DNA, 20 bp, Artificial Sequence
  chemically synthesized
acttgggaggctgatgtggg

SEQ ID NO: 227349 - DNA, 20 bp, Artificial Sequence
  chemically synthesized
ctcagatgatcctcccacat

SEQ ID NO: 227350 - DNA, 20 bp, Artificial Sequence
  chemically synthesized
ctgatgtgggaggatcatct

SEQ ID NO: 227351 - DNA, 20 bp, Artificial Sequence
  chemically synthesized
gtgggaggatcatctgagcc

SEQ ID NO: 227352 - DNA, 20 bp, Artificial Sequence
  chemically synthesized
tgggaggatcatctgagccc

SEQ ID NO: 227353 - DNA, 20 bp, Artificial Sequence
  chemically synthesized
gggaggatcatctgagccca

SEQ ID NO: 227354 - DNA, 20 bp, Artificial Sequence
  chemically synthesized
agccttgacctccctgggct

SEQ ID NO: 227355 - DNA, 20 bp, Artificial Sequence
  chemically synthesized
gaggatcatctgagcccagg

SEQ ID NO: 227356 - DNA, 20 bp, Artificial Sequence
  chemically synthesized
aggatcatctgagcccaggg

SEQ ID NO: 227357 - DNA, 20 bp, Artificial Sequence
  chemically synthesized
actgcagccttgacctccct

SEQ ID NO: 227358 - DNA, 20 bp, Artificial Sequence
  chemically synthesized
cactgcagccttgacctccc

SEQ ID NO: 227359 - DNA, 20 bp, Artificial Sequence
  chemically synthesized
catctgagcccagggaggtc

SEQ ID NO: 227360 - DNA, 20 bp, Artificial Sequence
  chemically synthesized
atctgagcccagggaggtca

SEQ ID NO: 227361 - DNA, 20 bp, Artificial Sequence
  chemically synthesized
gcccagggaggtcaaggctg

SEQ ID NO: 227362 - DNA, 20 bp, Artificial Sequence
  chemically synthesized
agggaggtcaaggctgcagt

SEQ ID NO: 227363 - DNA, 20 bp, Artificial Sequence
  chemically synthesized
gacgtgatcatggctcactg

SEQ ID NO: 227364 - DNA, 20 bp, Artificial Sequence
  chemically synthesized
ggtgtgcagtgacgtgatca

SEQ ID NO: 227365 - DNA, 20 bp, Artificial Sequence
  chemically synthesized
atgatcacgtcactgcacac

SEQ ID NO: 227366 - DNA, 20 bp, Artificial Sequence
  chemically synthesized
ctgttgcctaagctggtgtg

SEQ ID NO: 227367 - DNA, 20 bp, Artificial Sequence
  chemically synthesized
cacgtcactgcacaccagct

SEQ ID NO: 227368 - DNA, 20 bp, Artificial Sequence
  chemically synthesized
acgtcactgcacaccagctt

SEQ ID NO: 227369 - DNA, 20 bp, Artificial Sequence
  chemically synthesized
tctcattctgttgcctaagc

SEQ ID NO: 227370 - DNA, 20 bp, Artificial Sequence
  chemically synthesized
ctgcacaccagcttaggcaa

SEQ ID NO: 227371 - DNA, 20 bp, Artificial Sequence
  chemically synthesized
agggtctcattctgttgcct

SEQ ID NO: 227372 - DNA, 20 bp, Artificial Sequence
  chemically synthesized
accagcttaggcaacagaat

SEQ ID NO: 227373 - DNA, 20 bp, Artificial Sequence
  chemically synthesized
tatatatattttttgagaca

SEQ ID NO: 227374 - DNA, 20 bp, Artificial Sequence
  chemically synthesized
ttatatatattttttgagac

SEQ ID NO: 227375 - DNA, 20 bp, Artificial Sequence
  chemically synthesized
tttatatatattttttgaga

SEQ ID NO: 227376 - DNA, 20 bp, Artificial Sequence
  chemically synthesized
tttatttatatatatttttt

SEQ ID NO: 227377 - DNA, 20 bp, Artificial Sequence
  chemically synthesized
caagatagggaaaaagtgac

SEQ ID NO: 227378 - DNA, 20 bp, Artificial Sequence
  chemically synthesized
acaagatagggaaaaagtga

SEQ ID NO: 227379 - DNA, 20 bp, Artificial Sequence
  chemically synthesized
aaactaacaagatagggaaa

SEQ ID NO: 227380 - DNA, 20 bp, Artificial Sequence
  chemically synthesized
aaagagaaactaacaagata

SEQ ID NO: 227381 - DNA, 20 bp, Artificial Sequence
  chemically synthesized
tcactttttccctatcttgt

SEQ ID NO: 227382 - DNA, 20 bp, Artificial Sequence
  chemically synthesized
aaaagagaaactaacaagat

SEQ ID NO: 227383 - DNA, 20 bp, Artificial Sequence
  chemically synthesized
gaaaagagaaactaacaaga

SEQ ID NO: 227384 - DNA, 20 bp, Artificial Sequence
  chemically synthesized
agaagaaaagagaaactaac

SEQ ID NO: 227385 - DNA, 20 bp, Artificial Sequence
  chemically synthesized
ttaaagtgttaagaagaaaa

SEQ ID NO: 227386 - DNA, 20 bp, Artificial Sequence
  chemically synthesized
tattaaagtgttaagaagaa

SEQ ID NO: 227387 - DNA, 20 bp, Artificial Sequence
  chemically synthesized
ggaagtattaaagtgttaag

SEQ ID NO: 227388 - DNA, 20 bp, Artificial Sequence
  chemically synthesized
aatggaagtattaaagtgtt

SEQ ID NO: 227389 - DNA, 20 bp, Artificial Sequence
  chemically synthesized
tatttcaaatggaagtatta

SEQ ID NO: 227390 - DNA, 20 bp, Artificial Sequence
  chemically synthesized
atatgtggtatttcaaatgg

SEQ ID NO: 227391 - DNA, 20 bp, Artificial Sequence
  chemically synthesized
taaatatgtggtatttcaaa

SEQ ID NO: 227392 - DNA, 20 bp, Artificial Sequence
  chemically synthesized
gaaaggagaaaataaatatg

SEQ ID NO: 227393 - DNA, 20 bp, Artificial Sequence
  chemically synthesized
gtaatgggaagttaggaaag

SEQ ID NO: 227394 - DNA, 20 bp, Artificial Sequence
  chemically synthesized
tagtaatgggaagttaggaa

SEQ ID NO: 227395 - DNA, 20 bp, Artificial Sequence
  chemically synthesized
atagtaatgggaagttagga

SEQ ID NO: 227396 - DNA, 20 bp, Artificial Sequence
  chemically synthesized
tcatatagtaatgggaagtt

SEQ ID NO: 227397 - DNA, 20 bp, Artificial Sequence
  chemically synthesized
ctcatatagtaatgggaagt

SEQ ID NO: 227398 - DNA, 20 bp, Artificial Sequence
  chemically synthesized
ggagctcatatagtaatggg

SEQ ID NO: 227399 - DNA, 20 bp, Artificial Sequence
  chemically synthesized
caaggagctcatatagtaat

SEQ ID NO: 227400 - DNA, 20 bp, Artificial Sequence
  chemically synthesized
tcaaggagctcatatagtaa

SEQ ID NO: 227401 - DNA, 20 bp, Artificial Sequence
  chemically synthesized
ctaacttcccattactatat

SEQ ID NO: 227402 - DNA, 20 bp, Artificial Sequence
  chemically synthesized
gtcctttcaaggagctcata

SEQ ID NO: 227403 - DNA, 20 bp, Artificial Sequence
  chemically synthesized
ttactatatgagctccttga

SEQ ID NO: 227404 - DNA, 20 bp, Artificial Sequence
  chemically synthesized
tactatatgagctccttgaa

SEQ ID NO: 227405 - DNA, 20 bp, Artificial Sequence
  chemically synthesized
acaaacgctgtcctttcaag

SEQ ID NO: 227406 - DNA, 20 bp, Artificial Sequence
  chemically synthesized
agacaaacgctgtcctttca

SEQ ID NO: 227407 - DNA, 20 bp, Artificial Sequence
  chemically synthesized
atatgagctccttgaaagga

SEQ ID NO: 227408 - DNA, 20 bp, Artificial Sequence
  chemically synthesized
cagacaaacgctgtcctttc

SEQ ID NO: 227409 - DNA, 20 bp, Artificial Sequence
  chemically synthesized
ggacagcgtttgtctgtttt

SEQ ID NO: 227410 - DNA, 20 bp, Artificial Sequence
  chemically synthesized
ggcacaaggataaccaaaaa

SEQ ID NO: 227411 - DNA, 20 bp, Artificial Sequence
  chemically synthesized
cacatactaatataggcaca

SEQ ID NO: 227412 - DNA, 20 bp, Artificial Sequence
  chemically synthesized
ccacatactaatataggcac

SEQ ID NO: 227413 - DNA, 20 bp, Artificial Sequence
  chemically synthesized
ggttatccttgtgcctatat

SEQ ID NO: 227414 - DNA, 20 bp, Artificial Sequence
  chemically synthesized
tgtgtgccacatactaatat

SEQ ID NO: 227415 - DNA, 20 bp, Artificial Sequence
  chemically synthesized
ttgtgtgccacatactaata

SEQ ID NO: 227416 - DNA, 20 bp, Artificial Sequence
  chemically synthesized
cttgtgcctatattagtatg

SEQ ID NO: 227417 - DNA, 20 bp, Artificial Sequence
  chemically synthesized
tattagtatgtggcacacaa

SEQ ID NO: 227418 - DNA, 20 bp, Artificial Sequence
  chemically synthesized
taattcatcaaatatttgta

SEQ ID NO: 227419 - DNA, 20 bp, Artificial Sequence
  chemically synthesized
attaattcatcaaatatttg

SEQ ID NO: 227420 - DNA, 20 bp, Artificial Sequence
  chemically synthesized
tatttgatgaattaataaat

SEQ ID NO: 227421 - DNA, 20 bp, Artificial Sequence
  chemically synthesized
tgaattaataaatgagtgaa

SEQ ID NO: 227422 - DNA, 20 bp, Artificial Sequence
  chemically synthesized
gaattaataaatgagtgaac

SEQ ID NO: 227423 - DNA, 20 bp, Artificial Sequence
  chemically synthesized
aataaatgagtgaacaggta

SEQ ID NO: 227424 - DNA, 20 bp, Artificial Sequence
  chemically synthesized
aatgagtgaacaggtaaagc

SEQ ID NO: 227425 - DNA, 20 bp, Artificial Sequence
  chemically synthesized
gagtgaacaggtaaagctag

SEQ ID NO: 227426 - DNA, 20 bp, Artificial Sequence
  chemically synthesized
tgaacaggtaaagctagtag

SEQ ID NO: 227427 - DNA, 20 bp, Artificial Sequence
  chemically synthesized
gaacaggtaaagctagtaga

SEQ ID NO: 227428 - DNA, 20 bp, Artificial Sequence
  chemically synthesized
tgcatgactgttccttctac

SEQ ID NO: 227429 - DNA, 20 bp, Artificial Sequence
  chemically synthesized
ggtaaagctagtagaaggaa

SEQ ID NO: 227430 - DNA, 20 bp, Artificial Sequence
  chemically synthesized
tagtagaaggaacagtcatg

SEQ ID NO: 227431 - DNA, 20 bp, Artificial Sequence
  chemically synthesized
gaaggaacagtcatgcagat

SEQ ID NO: 227432 - DNA, 20 bp, Artificial Sequence
  chemically synthesized
agtcatgcagattggcttaa

SEQ ID NO: 227433 - DNA, 20 bp, Artificial Sequence
  chemically synthesized
gtcatgcagattggcttaat

SEQ ID NO: 227434 - DNA, 20 bp, Artificial Sequence
  chemically synthesized
tcagacttgtatttcctatt

SEQ ID NO: 227435 - DNA, 20 bp, Artificial Sequence
  chemically synthesized
attggcttaataggaaatac

SEQ ID NO: 227436 - DNA, 20 bp, Artificial Sequence
  chemically synthesized
gccaaggaatgtgattttgt

SEQ ID NO: 227437 - DNA, 20 bp, Artificial Sequence
  chemically synthesized
tctgacaaaatcacattcct

SEQ ID NO: 227438 - DNA, 20 bp, Artificial Sequence
  chemically synthesized
gacaaaatcacattccttgg

SEQ ID NO: 227439 - DNA, 20 bp, Artificial Sequence
  chemically synthesized
agtttttttaagtactgcca

SEQ ID NO: 227440 - DNA, 20 bp, Artificial Sequence
  chemically synthesized
cagtttttttaagtactgcc

SEQ ID NO: 227441 - DNA, 20 bp, Artificial Sequence
  chemically synthesized
ttttccttcccagttttttt

SEQ ID NO: 227442 - DNA, 20 bp, Artificial Sequence
  chemically synthesized
ttggcagtacttaaaaaaac

SEQ ID NO: 227443 - DNA, 20 bp, Artificial Sequence
  chemically synthesized
tggcagtacttaaaaaaact

SEQ ID NO: 227444 - DNA, 20 bp, Artificial Sequence
  chemically synthesized
cagtacttaaaaaaactggg

SEQ ID NO: 227445 - DNA, 20 bp, Artificial Sequence
  chemically synthesized
agtacttaaaaaaactggga

SEQ ID NO: 227446 - DNA, 20 bp, Artificial Sequence
  chemically synthesized
caagttttctttttccttcc

SEQ ID NO: 227447 - DNA, 20 bp, Artificial Sequence
  chemically synthesized
taaaaaaactgggaaggaaa

SEQ ID NO: 227448 - DNA, 20 bp, Artificial Sequence
  chemically synthesized
atcacagaagcagcaggagc

SEQ ID NO: 227449 - DNA, 20 bp, Artificial Sequence
  chemically synthesized
ttgtatcacagaagcagcag

SEQ ID NO: 227450 - DNA, 20 bp, Artificial Sequence
  chemically synthesized
ctttgtatcacagaagcagc

SEQ ID NO: 227451 - DNA, 20 bp, Artificial Sequence
  chemically synthesized
tctttgtatcacagaagcag

SEQ ID NO: 227452 - DNA, 20 bp, Artificial Sequence
  chemically synthesized
ttttctttgtatcacagaag

SEQ ID NO: 227453 - DNA, 20 bp, Artificial Sequence
  chemically synthesized
ggtttttctttgtatcacag

SEQ ID NO: 227454 - DNA, 20 bp, Artificial Sequence
  chemically synthesized
cctgctgcttctgtgataca

SEQ ID NO: 227455 - DNA, 20 bp, Artificial Sequence
  chemically synthesized
tgaggtttttctttgtatca

SEQ ID NO: 227456 - DNA, 20 bp, Artificial Sequence
  chemically synthesized
acaaagaaaaacctcattat

SEQ ID NO: 227457 - DNA, 20 bp, Artificial Sequence
  chemically synthesized
taaaaaaactgctaataatg

SEQ ID NO: 227458 - DNA, 20 bp, Artificial Sequence
  chemically synthesized
ttaaaaaaactgctaataat

SEQ ID NO: 227459 - DNA, 20 bp, Artificial Sequence
  chemically synthesized
aagaaaaacctcattattag

SEQ ID NO: 227460 - DNA, 20 bp, Artificial Sequence
  chemically synthesized
agcagtttttttaaataata

SEQ ID NO: 227461 - DNA, 20 bp, Artificial Sequence
  chemically synthesized
tttttttaaataataaagtt

SEQ ID NO: 227462 - DNA, 20 bp, Artificial Sequence
  chemically synthesized
taaagttgagcattaccatg

SEQ ID NO: 227463 - DNA, 20 bp, Artificial Sequence
  chemically synthesized
ttgagcattaccatgtagaa

SEQ ID NO: 227464 - DNA, 20 bp, Artificial Sequence
  chemically synthesized
gtccataataccattctaca

SEQ ID NO: 227465 - DNA, 20 bp, Artificial Sequence
  chemically synthesized
taccatgtagaatggtatta

SEQ ID NO: 227466 - DNA, 20 bp, Artificial Sequence
  chemically synthesized
atgtagaatggtattatgga

SEQ ID NO: 227467 - DNA, 20 bp, Artificial Sequence
  chemically synthesized
tacttatttttatacatatg

SEQ ID NO: 227468 - DNA, 20 bp, Artificial Sequence
  chemically synthesized
caccacatatgtataaaaat

SEQ ID NO: 227469 - DNA, 20 bp, Artificial Sequence
  chemically synthesized
ataaaaataagtaacttccc

SEQ ID NO: 227470 - DNA, 20 bp, Artificial Sequence
  chemically synthesized
taaaaataagtaacttccct

SEQ ID NO: 227471 - DNA, 20 bp, Artificial Sequence
  chemically synthesized
aaataagtaacttccctggg

SEQ ID NO: 227472 - DNA, 20 bp, Artificial Sequence
  chemically synthesized
tgtattgattcttcccaggg

SEQ ID NO: 227473 - DNA, 20 bp, Artificial Sequence
  chemically synthesized
atctgtattgattcttccca

SEQ ID NO: 227474 - DNA, 20 bp, Artificial Sequence
  chemically synthesized
tatctgtattgattcttccc

SEQ ID NO: 227475 - DNA, 20 bp, Artificial Sequence
  chemically synthesized
ctatctgtattgattcttcc

SEQ ID NO: 227476 - DNA, 20 bp, Artificial Sequence
  chemically synthesized
ttccctgggaagaatcaata

SEQ ID NO: 227477 - DNA, 20 bp, Artificial Sequence
  chemically synthesized
ctgggaagaatcaatacaga

SEQ ID NO: 227478 - DNA, 20 bp, Artificial Sequence
  chemically synthesized
gaatcaatacagatagtccc

SEQ ID NO: 227479 - DNA, 20 bp, Artificial Sequence
  chemically synthesized
cacaactcatttgtaatcta

SEQ ID NO: 227480 - DNA, 20 bp, Artificial Sequence
  chemically synthesized
acacaactcatttgtaatct

SEQ ID NO: 227481 - DNA, 20 bp, Artificial Sequence
  chemically synthesized
aacacaactcatttgtaatc

SEQ ID NO: 227482 - DNA, 20 bp, Artificial Sequence
  chemically synthesized
atagtccctagattacaaat

SEQ ID NO: 227483 - DNA, 20 bp, Artificial Sequence
  chemically synthesized
gcagctgtctttcaaatgtg

SEQ ID NO: 227484 - DNA, 20 bp, Artificial Sequence
  chemically synthesized
gttgtgttctgcacatttga

SEQ ID NO: 227485 - DNA, 20 bp, Artificial Sequence
  chemically synthesized
tgttctgcacatttgaaaga

SEQ ID NO: 227486 - DNA, 20 bp, Artificial Sequence
  chemically synthesized
gcatcgagcagatcattaag

SEQ ID NO: 227487 - DNA, 20 bp, Artificial Sequence
  chemically synthesized
agagcatcgagcagatcatt

SEQ ID NO: 227488 - DNA, 20 bp, Artificial Sequence
  chemically synthesized
aaaatttagagagcatcgag

SEQ ID NO: 227489 - DNA, 20 bp, Artificial Sequence
  chemically synthesized
cagaaaatttagagagcatc

SEQ ID NO: 227490 - DNA, 20 bp, Artificial Sequence
  chemically synthesized
acccggtcagaaaatttaga

SEQ ID NO: 227491 - DNA, 20 bp, Artificial Sequence
  chemically synthesized
gaacccggtcagaaaattta

SEQ ID NO: 227492 - DNA, 20 bp, Artificial Sequence
  chemically synthesized
gtgaacccggtcagaaaatt

SEQ ID NO: 227493 - DNA, 20 bp, Artificial Sequence
  chemically synthesized
tgctctctaaattttctgac

SEQ ID NO: 227494 - DNA, 20 bp, Artificial Sequence
  chemically synthesized
gctctctaaattttctgacc

SEQ ID NO: 227495 - DNA, 20 bp, Artificial Sequence
  chemically synthesized
aggggtgaagtgaacccggt

SEQ ID NO: 227496 - DNA, 20 bp, Artificial Sequence
  chemically synthesized
aggtaggggtgaagtgaacc

SEQ ID NO: 227497 - DNA, 20 bp, Artificial Sequence
  chemically synthesized
tgaatgcacaggtaggggtg

SEQ ID NO: 227498 - DNA, 20 bp, Artificial Sequence
  chemically synthesized
atgactgaatgcacaggtag

SEQ ID NO: 227499 - DNA, 20 bp, Artificial Sequence
  chemically synthesized
tatgactgaatgcacaggta

SEQ ID NO: 227500 - DNA, 20 bp, Artificial Sequence
  chemically synthesized
gtatgactgaatgcacaggt

SEQ ID NO: 227501 - DNA, 20 bp, Artificial Sequence
  chemically synthesized
agtatgactgaatgcacagg

SEQ ID NO: 227502 - DNA, 20 bp, Artificial Sequence
  chemically synthesized
ttcacccctacctgtgcatt

SEQ ID NO: 227503 - DNA, 20 bp, Artificial Sequence
  chemically synthesized
tagagtatgactgaatgcac

SEQ ID NO: 227504 - DNA, 20 bp, Artificial Sequence
  chemically synthesized
atagagtatgactgaatgca

SEQ ID NO: 227505 - DNA, 20 bp, Artificial Sequence
  chemically synthesized
ttcagtcatactctattccc

SEQ ID NO: 227506 - DNA, 20 bp, Artificial Sequence
  chemically synthesized
tttggtgattccagggaata

SEQ ID NO: 227507 - DNA, 20 bp, Artificial Sequence
  chemically synthesized
ggtttggtgattccagggaa

SEQ ID NO: 227508 - DNA, 20 bp, Artificial Sequence
  chemically synthesized
gtacaggtttggtgattcca

SEQ ID NO: 227509 - DNA, 20 bp, Artificial Sequence
  chemically synthesized
ggtacaggtttggtgattcc

SEQ ID NO: 227510 - DNA, 20 bp, Artificial Sequence
  chemically synthesized
aggtacaggtttggtgattc

SEQ ID NO: 227511 - DNA, 20 bp, Artificial Sequence
  chemically synthesized
tcctctgttaggtacaggtt

SEQ ID NO: 227512 - DNA, 20 bp, Artificial Sequence
  chemically synthesized
tgaattcctctgttaggtac

SEQ ID NO: 227513 - DNA, 20 bp, Artificial Sequence
  chemically synthesized
atcaccaaacctgtacctaa

SEQ ID NO: 227514 - DNA, 20 bp, Artificial Sequence
  chemically synthesized
ttgaattcctctgttaggta

SEQ ID NO: 227515 - DNA, 20 bp, Artificial Sequence
  chemically synthesized
caccaaacctgtacctaaca

SEQ ID NO: 227516 - DNA, 20 bp, Artificial Sequence
  chemically synthesized
accaaacctgtacctaacag

SEQ ID NO: 227517 - DNA, 20 bp, Artificial Sequence
  chemically synthesized
ccacattgaattcctctgtt

SEQ ID NO: 227518 - DNA, 20 bp, Artificial Sequence
  chemically synthesized
accacattgaattcctctgt

SEQ ID NO: 227519 - DNA, 20 bp, Artificial Sequence
  chemically synthesized
cctaacagaggaattcaatg

SEQ ID NO: 227520 - DNA, 20 bp, Artificial Sequence
  chemically synthesized
ttcaatgtggttacatttca

SEQ ID NO: 227521 - DNA, 20 bp, Artificial Sequence
  chemically synthesized
tcaatgtggttacatttcat

SEQ ID NO: 227522 - DNA, 20 bp, Artificial Sequence
  chemically synthesized
tgtggttacatttcataggt

SEQ ID NO: 227523 - DNA, 20 bp, Artificial Sequence
  chemically synthesized
ataagtgaactattattttg

SEQ ID NO: 227524 - DNA, 20 bp, Artificial Sequence
  chemically synthesized
taggttagtccacaaaataa

SEQ ID NO: 227525 - DNA, 20 bp, Artificial Sequence
  chemically synthesized
ataatagttcacttataaac

SEQ ID NO: 227526 - DNA, 20 bp, Artificial Sequence
  chemically synthesized
ctatacttcagctcgtttat

SEQ ID NO: 227527 - DNA, 20 bp, Artificial Sequence
  chemically synthesized
gttcacttataaacgagctg

SEQ ID NO: 227528 - DNA, 20 bp, Artificial Sequence
  chemically synthesized
cttataaacgagctgaagta

SEQ ID NO: 227529 - DNA, 20 bp, Artificial Sequence
  chemically synthesized
gcattatttacactatactt

SEQ ID NO: 227530 - DNA, 20 bp, Artificial Sequence
  chemically synthesized
aagtatagtgtaaataatgc

SEQ ID NO: 227531 - DNA, 20 bp, Artificial Sequence
  chemically synthesized
acaacgtgcagagttaaaac

SEQ ID NO: 227532 - DNA, 20 bp, Artificial Sequence
  chemically synthesized
tgaattacttacaacgtgca

SEQ ID NO: 227533 - DNA, 20 bp, Artificial Sequence
  chemically synthesized
tttgaattacttacaacgtg

SEQ ID NO: 227534 - DNA, 20 bp, Artificial Sequence
  chemically synthesized
gttttaactctgcacgttgt

SEQ ID NO: 227535 - DNA, 20 bp, Artificial Sequence
  chemically synthesized
ttgtaagtaattcaaatgct

SEQ ID NO: 227536 - DNA, 20 bp, Artificial Sequence
  chemically synthesized
gtaagtaattcaaatgctta

SEQ ID NO: 227537 - DNA, 20 bp, Artificial Sequence
  chemically synthesized
attaaatgtgatacaactct

SEQ ID NO: 227538 - DNA, 20 bp, Artificial Sequence
  chemically synthesized
tagagttgtatcacatttaa

SEQ ID NO: 227539 - DNA, 20 bp, Artificial Sequence
  chemically synthesized
atttaatggtatatttacct

SEQ ID NO: 227540 - DNA, 20 bp, Artificial Sequence
  chemically synthesized
aatggtatatttacctgaga

SEQ ID NO: 227541 - DNA, 20 bp, Artificial Sequence
  chemically synthesized
atggtatatttacctgagaa

SEQ ID NO: 227542 - DNA, 20 bp, Artificial Sequence
  chemically synthesized
cgtttaatattgcctttctc

SEQ ID NO: 227543 - DNA, 20 bp, Artificial Sequence
  chemically synthesized
acgtttaatattgcctttct

SEQ ID NO: 227544 - DNA, 20 bp, Artificial Sequence
  chemically synthesized
aaaggcaatattaaacgtgc

SEQ ID NO: 227545 - DNA, 20 bp, Artificial Sequence
  chemically synthesized
aaggcaatattaaacgtgca

SEQ ID NO: 227546 - DNA, 20 bp, Artificial Sequence
  chemically synthesized
attaaacgtgcaaggaaatg

SEQ ID NO: 227547 - DNA, 20 bp, Artificial Sequence
  chemically synthesized
ttaaacgtgcaaggaaatgt

SEQ ID NO: 227548 - DNA, 20 bp, Artificial Sequence
  chemically synthesized
gcaaggaaatgtgggccttg

SEQ ID NO: 227549 - DNA, 20 bp, Artificial Sequence
  chemically synthesized
gaaatgtgggccttgaagtc

SEQ ID NO: 227550 - DNA, 20 bp, Artificial Sequence
  chemically synthesized
tcaaagtgtacttgacttca

SEQ ID NO: 227551 - DNA, 20 bp, Artificial Sequence
  chemically synthesized
ttcaaagtgtacttgacttc

SEQ ID NO: 227552 - DNA, 20 bp, Artificial Sequence
  chemically synthesized
agagtgacagtttgatttca

SEQ ID NO: 227553 - DNA, 20 bp, Artificial Sequence
  chemically synthesized
caaaggtagcatcagagtga

SEQ ID NO: 227554 - DNA, 20 bp, Artificial Sequence
  chemically synthesized
acatcacaaaggtagcatca

SEQ ID NO: 227555 - DNA, 20 bp, Artificial Sequence
  chemically synthesized
caacatcacaaaggtagcat

SEQ ID NO: 227556 - DNA, 20 bp, Artificial Sequence
  chemically synthesized
ctggaccaacatcacaaagg

SEQ ID NO: 227557 - DNA, 20 bp, Artificial Sequence
  chemically synthesized
aaactggaccaacatcacaa

SEQ ID NO: 227558 - DNA, 20 bp, Artificial Sequence
  chemically synthesized
gaaactggaccaacatcaca

SEQ ID NO: 227559 - DNA, 20 bp, Artificial Sequence
  chemically synthesized
tgatgctacctttgtgatgt

SEQ ID NO: 227560 - DNA, 20 bp, Artificial Sequence
  chemically synthesized
ctacctttgtgatgttggtc

SEQ ID NO: 227561 - DNA, 20 bp, Artificial Sequence
  chemically synthesized
gcttcaagaagttaagaaac

SEQ ID NO: 227562 - DNA, 20 bp, Artificial Sequence
  chemically synthesized
aattaaggcttcaagaagtt

SEQ ID NO: 227563 - DNA, 20 bp, Artificial Sequence
  chemically synthesized
tccagtttcttaacttcttg

SEQ ID NO: 227564 - DNA, 20 bp, Artificial Sequence
  chemically synthesized
gaggaaattaaggcttcaag

SEQ ID NO: 227565 - DNA, 20 bp, Artificial Sequence
  chemically synthesized
gttgaggaaattaaggcttc

SEQ ID NO: 227566 - DNA, 20 bp, Artificial Sequence
  chemically synthesized
agtcacagttgaggaaatta

SEQ ID NO: 227567 - DNA, 20 bp, Artificial Sequence
  chemically synthesized
aagtcacagttgaggaaatt

SEQ ID NO: 227568 - DNA, 20 bp, Artificial Sequence
  chemically synthesized
tcatctccaagtcacagttg

SEQ ID NO: 227569 - DNA, 20 bp, Artificial Sequence
  chemically synthesized
atcatctccaagtcacagtt

SEQ ID NO: 227570 - DNA, 20 bp, Artificial Sequence
  chemically synthesized
taatttcctcaactgtgact

SEQ ID NO: 227571 - DNA, 20 bp, Artificial Sequence
  chemically synthesized
atttcctcaactgtgacttg

SEQ ID NO: 227572 - DNA, 20 bp, Artificial Sequence
  chemically synthesized
caatgatcatctccaagtca

SEQ ID NO: 227573 - DNA, 20 bp, Artificial Sequence
  chemically synthesized
tagtctcaatgatcatctcc

SEQ ID NO: 227574 - DNA, 20 bp, Artificial Sequence
  chemically synthesized
gtgacttggagatgatcatt

SEQ ID NO: 227575 - DNA, 20 bp, Artificial Sequence
  chemically synthesized
tgatcattgagactacccac

SEQ ID NO: 227576 - DNA, 20 bp, Artificial Sequence
  chemically synthesized
gatcattgagactacccacc

SEQ ID NO: 227577 - DNA, 20 bp, Artificial Sequence
  chemically synthesized
cctaaaacaatcctggtggg

SEQ ID NO: 227578 - DNA, 20 bp, Artificial Sequence
  chemically synthesized
aatcctaaaacaatcctggt

SEQ ID NO: 227579 - DNA, 20 bp, Artificial Sequence
  chemically synthesized
taatcctaaaacaatcctgg

SEQ ID NO: 227580 - DNA, 20 bp, Artificial Sequence
  chemically synthesized
ctttaatcctaaaacaatcc

SEQ ID NO: 227581 - DNA, 20 bp, Artificial Sequence
  chemically synthesized
actacccaccaggattgttt

SEQ ID NO: 227582 - DNA, 20 bp, Artificial Sequence
  chemically synthesized
ctacccaccaggattgtttt

SEQ ID NO: 227583 - DNA, 20 bp, Artificial Sequence
  chemically synthesized
ccaggattgttttaggatta

SEQ ID NO: 227584 - DNA, 20 bp, Artificial Sequence
  chemically synthesized
caggattgttttaggattaa

SEQ ID NO: 227585 - DNA, 20 bp, Artificial Sequence
  chemically synthesized
ggattgttttaggattaaag

SEQ ID NO: 227586 - DNA, 20 bp, Artificial Sequence
  chemically synthesized
gttttaggattaaaggagat

SEQ ID NO: 227587 - DNA, 20 bp, Artificial Sequence
  chemically synthesized
gattaaaggagataagtctt

SEQ ID NO: 227588 - DNA, 20 bp, Artificial Sequence
  chemically synthesized
aaggagataagtcttcagca

SEQ ID NO: 227589 - DNA, 20 bp, Artificial Sequence
  chemically synthesized
ggaacactaagtctgtgctg

SEQ ID NO: 227590 - DNA, 20 bp, Artificial Sequence
  chemically synthesized
ataagtcttcagcacagact

SEQ ID NO: 227591 - DNA, 20 bp, Artificial Sequence
  chemically synthesized
atgtaatgttatggaacact

SEQ ID NO: 227592 - DNA, 20 bp, Artificial Sequence
  chemically synthesized
tataataagatgtaatgtta

SEQ ID NO: 227593 - DNA, 20 bp, Artificial Sequence
  chemically synthesized
ctggaagtgctcaatataat

SEQ ID NO: 227594 - DNA, 20 bp, Artificial Sequence
  chemically synthesized
acattacatcttattatatt

SEQ ID NO: 227595 - DNA, 20 bp, Artificial Sequence
  chemically synthesized
cttattatattgagcacttc

SEQ ID NO: 227596 - DNA, 20 bp, Artificial Sequence
  chemically synthesized
ttatattgagcacttccagt

SEQ ID NO: 227597 - DNA, 20 bp, Artificial Sequence
  chemically synthesized
ttgtaactcagactaactgg

SEQ ID NO: 227598 - DNA, 20 bp, Artificial Sequence
  chemically synthesized
catttgtaactcagactaac

SEQ ID NO: 227599 - DNA, 20 bp, Artificial Sequence
  chemically synthesized
tgagcacttccagttagtct

SEQ ID NO: 227600 - DNA, 20 bp, Artificial Sequence
  chemically synthesized
gtaaaatatcatttgtaact

SEQ ID NO: 227601 - DNA, 20 bp, Artificial Sequence
  chemically synthesized
tacacatcatcgtaaaccaa

SEQ ID NO: 227602 - DNA, 20 bp, Artificial Sequence
  chemically synthesized
cagggacgttgttagaccgt

SEQ ID NO: 227603 - DNA, 20 bp, Artificial Sequence
  chemically synthesized
ccgtgtatcagggacgttgt

SEQ ID NO: 227604 - DNA, 20 bp, Artificial Sequence
  chemically synthesized
ctaacaacgtccctgataca

SEQ ID NO: 227605 - DNA, 20 bp, Artificial Sequence
  chemically synthesized
ttagcattaaccgtgtatca

SEQ ID NO: 227606 - DNA, 20 bp, Artificial Sequence
  chemically synthesized
tttagcattaaccgtgtatc

SEQ ID NO: 227607 - DNA, 20 bp, Artificial Sequence
  chemically synthesized
atttagcattaaccgtgtat

SEQ ID NO: 227608 - DNA, 20 bp, Artificial Sequence
  chemically synthesized
acggttaatgctaaatatgt

SEQ ID NO: 227609 - DNA, 20 bp, Artificial Sequence
  chemically synthesized
attcattcacctcacatatt

SEQ ID NO: 227610 - DNA, 20 bp, Artificial Sequence
  chemically synthesized
cggttaatgctaaatatgtg

SEQ ID NO: 227611 - DNA, 20 bp, Artificial Sequence
  chemically synthesized
gaggtgaatgaatatttaac

SEQ ID NO: 227612 - DNA, 20 bp, Artificial Sequence
  chemically synthesized
aagtacattgattcacatac

SEQ ID NO: 227613 - DNA, 20 bp, Artificial Sequence
  chemically synthesized
gtacattgattcacatactg

SEQ ID NO: 227614 - DNA, 20 bp, Artificial Sequence
  chemically synthesized
acattgattcacatactgga

SEQ ID NO: 227615 - DNA, 20 bp, Artificial Sequence
  chemically synthesized
cattgattcacatactggag

SEQ ID NO: 227616 - DNA, 20 bp, Artificial Sequence
  chemically synthesized
attgattcacatactggaga

SEQ ID NO: 227617 - DNA, 20 bp, Artificial Sequence
  chemically synthesized
catgcctattcatccctctc

SEQ ID NO: 227618 - DNA, 20 bp, Artificial Sequence
  chemically synthesized
acatactggagagggatgaa

SEQ ID NO: 227619 - DNA, 20 bp, Artificial Sequence
  chemically synthesized
catactggagagggatgaat

SEQ ID NO: 227620 - DNA, 20 bp, Artificial Sequence
  chemically synthesized
gagagggatgaataggcatg

SEQ ID NO: 227621 - DNA, 20 bp, Artificial Sequence
  chemically synthesized
agagggatgaataggcatga

SEQ ID NO: 227622 - DNA, 20 bp, Artificial Sequence
  chemically synthesized
ggatgaataggcatgaagga

SEQ ID NO: 227623 - DNA, 20 bp, Artificial Sequence
  chemically synthesized
gatgaataggcatgaaggac

SEQ ID NO: 227624 - DNA, 20 bp, Artificial Sequence
  chemically synthesized
aggcatgaaggacaggcacg

SEQ ID NO: 227625 - DNA, 20 bp, Artificial Sequence
  chemically synthesized
ggcatgaaggacaggcacga

SEQ ID NO: 227626 - DNA, 20 bp, Artificial Sequence
  chemically synthesized
gataggctcacaaacattaa

SEQ ID NO: 227627 - DNA, 20 bp, Artificial Sequence
  chemically synthesized
ggataggctcacaaacatta

SEQ ID NO: 227628 - DNA, 20 bp, Artificial Sequence
  chemically synthesized
cgaaggcctttaatgtttgt

SEQ ID NO: 227629 - DNA, 20 bp, Artificial Sequence
  chemically synthesized
ggaaaacatcatagatggat

SEQ ID NO: 227630 - DNA, 20 bp, Artificial Sequence
  chemically synthesized
aggaaaacatcatagatgga

SEQ ID NO: 227631 - DNA, 20 bp, Artificial Sequence
  chemically synthesized
taaaaggaaaacatcataga

SEQ ID NO: 227632 - DNA, 20 bp, Artificial Sequence
  chemically synthesized
aaggtaaaaggaaaacatca

SEQ ID NO: 227633 - DNA, 20 bp, Artificial Sequence
  chemically synthesized
ggtaatgggaggaaggtaaa

SEQ ID NO: 227634 - DNA, 20 bp, Artificial Sequence
  chemically synthesized
aggtaatgggaggaaggtaa

SEQ ID NO: 227635 - DNA, 20 bp, Artificial Sequence
  chemically synthesized
attagaaggtaatgggagga

SEQ ID NO: 227636 - DNA, 20 bp, Artificial Sequence
  chemically synthesized
aattagaaggtaatgggagg

SEQ ID NO: 227637 - DNA, 20 bp, Artificial Sequence
  chemically synthesized
gagaattagaaggtaatggg

SEQ ID NO: 227638 - DNA, 20 bp, Artificial Sequence
  chemically synthesized
agagaattagaaggtaatgg

SEQ ID NO: 227639 - DNA, 20 bp, Artificial Sequence
  chemically synthesized
gtagagaattagaaggtaat

SEQ ID NO: 227640 - DNA, 20 bp, Artificial Sequence
  chemically synthesized
agtagagaattagaaggtaa

SEQ ID NO: 227641 - DNA, 20 bp, Artificial Sequence
  chemically synthesized
cctgtgagtagagaattaga

SEQ ID NO: 227642 - DNA, 20 bp, Artificial Sequence
  chemically synthesized
acctgtgagtagagaattag

SEQ ID NO: 227643 - DNA, 20 bp, Artificial Sequence
  chemically synthesized
caaacctgtgagtagagaat

SEQ ID NO: 227644 - DNA, 20 bp, Artificial Sequence
  chemically synthesized
accttctaattctctactca

SEQ ID NO: 227645 - DNA, 20 bp, Artificial Sequence
  chemically synthesized
ccttctaattctctactcac

SEQ ID NO: 227646 - DNA, 20 bp, Artificial Sequence
  chemically synthesized
ttttagcaaacctgtgagta

SEQ ID NO: 227647 - DNA, 20 bp, Artificial Sequence
  chemically synthesized
tcttttagcaaacctgtgag

SEQ ID NO: 227648 - DNA, 20 bp, Artificial Sequence
  chemically synthesized
agatcttttagcaaacctgt

SEQ ID NO: 227649 - DNA, 20 bp, Artificial Sequence
  chemically synthesized
tctactcacaggtttgctaa

SEQ ID NO: 227650 - DNA, 20 bp, Artificial Sequence
  chemically synthesized
gtggtggaagagagatcttt

SEQ ID NO: 227651 - DNA, 20 bp, Artificial Sequence
  chemically synthesized
caaggagtggtggtggaaga

SEQ ID NO: 227652 - DNA, 20 bp, Artificial Sequence
  chemically synthesized
gacaaggagtggtggtggaa

SEQ ID NO: 227653 - DNA, 20 bp, Artificial Sequence
  chemically synthesized
gggacaaggagtggtggtgg

SEQ ID NO: 227654 - DNA, 20 bp, Artificial Sequence
  chemically synthesized
gtggggacaaggagtggtgg

SEQ ID NO: 227655 - DNA, 20 bp, Artificial Sequence
  chemically synthesized
actgtggggacaaggagtgg

SEQ ID NO: 227656 - DNA, 20 bp, Artificial Sequence
  chemically synthesized
cccactgtggggacaaggag

SEQ ID NO: 227657 - DNA, 20 bp, Artificial Sequence
  chemically synthesized
cctcccactgtggggacaag

SEQ ID NO: 227658 - DNA, 20 bp, Artificial Sequence
  chemically synthesized
ctcctcccactgtggggaca

SEQ ID NO: 227659 - DNA, 20 bp, Artificial Sequence
  chemically synthesized
accaccactccttgtcccca

SEQ ID NO: 227660 - DNA, 20 bp, Artificial Sequence
  chemically synthesized
gctcctcccactgtggggac

SEQ ID NO: 227661 - DNA, 20 bp, Artificial Sequence
  chemically synthesized
accactccttgtccccacag

SEQ ID NO: 227662 - DNA, 20 bp, Artificial Sequence
  chemically synthesized
ccactccttgtccccacagt

SEQ ID NO: 227663 - DNA, 20 bp, Artificial Sequence
  chemically synthesized
ctcatgctcctcccactgtg

SEQ ID NO: 227664 - DNA, 20 bp, Artificial Sequence
  chemically synthesized
actccttgtccccacagtgg

SEQ ID NO: 227665 - DNA, 20 bp, Artificial Sequence
  chemically synthesized
cctcatgctcctcccactgt

SEQ ID NO: 227666 - DNA, 20 bp, Artificial Sequence
  chemically synthesized
ctccttgtccccacagtggg

SEQ ID NO: 227667 - DNA, 20 bp, Artificial Sequence
  chemically synthesized
ccctcatgctcctcccactg

SEQ ID NO: 227668 - DNA, 20 bp, Artificial Sequence
  chemically synthesized
ccttgtccccacagtgggag

SEQ ID NO: 227669 - DNA, 20 bp, Artificial Sequence
  chemically synthesized
ccccacagtgggaggagcat

SEQ ID NO: 227670 - DNA, 20 bp, Artificial Sequence
  chemically synthesized
cccacagtgggaggagcatg

SEQ ID NO: 227671 - DNA, 20 bp, Artificial Sequence
  chemically synthesized
ccacagtgggaggagcatga

SEQ ID NO: 227672 - DNA, 20 bp, Artificial Sequence
  chemically synthesized
aaaaataaataccacttatg

SEQ ID NO: 227673 - DNA, 20 bp, Artificial Sequence
  chemically synthesized
accaaaaaatgctacataag

SEQ ID NO: 227674 - DNA, 20 bp, Artificial Sequence
  chemically synthesized
ccaaccaaaaaatgctacat

SEQ ID NO: 227675 - DNA, 20 bp, Artificial Sequence
  chemically synthesized
accacttatgtagcattttt

SEQ ID NO: 227676 - DNA, 20 bp, Artificial Sequence
  chemically synthesized
cttatgtagcattttttggt

SEQ ID NO: 227677 - DNA, 20 bp, Artificial Sequence
  chemically synthesized
gcattttttggttggaattt

SEQ ID NO: 227678 - DNA, 20 bp, Artificial Sequence
  chemically synthesized
cattttttggttggaatttt

SEQ ID NO: 227679 - DNA, 20 bp, Artificial Sequence
  chemically synthesized
attttttggttggaatttta

SEQ ID NO: 227680 - DNA, 20 bp, Artificial Sequence
  chemically synthesized
ggaattttagggtcaatatt

SEQ ID NO: 227681 - DNA, 20 bp, Artificial Sequence
  chemically synthesized
aaatgtacattttcattaaa

SEQ ID NO: 227682 - DNA, 20 bp, Artificial Sequence
  chemically synthesized
tacattttcattaaaaagaa

SEQ ID NO: 227683 - DNA, 20 bp, Artificial Sequence
  chemically synthesized
aaagaaaacatgatttatac

SEQ ID NO: 227684 - DNA, 20 bp, Artificial Sequence
  chemically synthesized
aaacatgatttatacaagat

SEQ ID NO: 227685 - DNA, 20 bp, Artificial Sequence
  chemically synthesized
aaaaagatgcagcagtgaag

SEQ ID NO: 227686 - DNA, 20 bp, Artificial Sequence
  chemically synthesized
gtcaaaaagatgcagcagtg

SEQ ID NO: 227687 - DNA, 20 bp, Artificial Sequence
  chemically synthesized
ctaaggtcaaaaagatgcag

SEQ ID NO: 227688 - DNA, 20 bp, Artificial Sequence
  chemically synthesized
aaactaaggtcaaaaagatg

SEQ ID NO: 227689 - DNA, 20 bp, Artificial Sequence
  chemically synthesized
ttctataaactaaggtcaaa

SEQ ID NO: 227690 - DNA, 20 bp, Artificial Sequence
  chemically synthesized
ctgctgcatctttttgacct

SEQ ID NO: 227691 - DNA, 20 bp, Artificial Sequence
  chemically synthesized
atctttttgaccttagttta

SEQ ID NO: 227692 - DNA, 20 bp, Artificial Sequence
  chemically synthesized
agttgagattctataaacta

SEQ ID NO: 227693 - DNA, 20 bp, Artificial Sequence
  chemically synthesized
cagttgagattctataaact

SEQ ID NO: 227694 - DNA, 20 bp, Artificial Sequence
  chemically synthesized
agtttatagaatctcaactg

SEQ ID NO: 227695 - DNA, 20 bp, Artificial Sequence
  chemically synthesized
gcaggccccaggctgcagtt

SEQ ID NO: 227696 - DNA, 20 bp, Artificial Sequence
  chemically synthesized
atagaatctcaactgcagcc

SEQ ID NO: 227697 - DNA, 20 bp, Artificial Sequence
  chemically synthesized
tagaatctcaactgcagcct

SEQ ID NO: 227698 - DNA, 20 bp, Artificial Sequence
  chemically synthesized
agaatctcaactgcagcctg

SEQ ID NO: 227699 - DNA, 20 bp, Artificial Sequence
  chemically synthesized
atggggcaggccccaggctg

SEQ ID NO: 227700 - DNA, 20 bp, Artificial Sequence
  chemically synthesized
tcagagatggggcaggcccc

SEQ ID NO: 227701 - DNA, 20 bp, Artificial Sequence
  chemically synthesized
ttcagagatggggcaggccc

SEQ ID NO: 227702 - DNA, 20 bp, Artificial Sequence
  chemically synthesized
acggtcttcagagatggggc

SEQ ID NO: 227703 - DNA, 20 bp, Artificial Sequence
  chemically synthesized
cacggtcttcagagatgggg

SEQ ID NO: 227704 - DNA, 20 bp, Artificial Sequence
  chemically synthesized
cagcacggtcttcagagatg

SEQ ID NO: 227705 - DNA, 20 bp, Artificial Sequence
  chemically synthesized
tggggcctgccccatctctg

SEQ ID NO: 227706 - DNA, 20 bp, Artificial Sequence
  chemically synthesized
gcagcacggtcttcagagat

SEQ ID NO: 227707 - DNA, 20 bp, Artificial Sequence
  chemically synthesized
ggcagcacggtcttcagaga

SEQ ID NO: 227708 - DNA, 20 bp, Artificial Sequence
  chemically synthesized
tttgggcagcacggtcttca

SEQ ID NO: 227709 - DNA, 20 bp, Artificial Sequence
  chemically synthesized
cctttgggcagcacggtctt

SEQ ID NO: 227710 - DNA, 20 bp, Artificial Sequence
  chemically synthesized
tcctcatcctttgggcagca

SEQ ID NO: 227711 - DNA, 20 bp, Artificial Sequence
  chemically synthesized
tctgaagaccgtgctgccca

SEQ ID NO: 227712 - DNA, 20 bp, Artificial Sequence
  chemically synthesized
ctgaagaccgtgctgcccaa

SEQ ID NO: 227713 - DNA, 20 bp, Artificial Sequence
  chemically synthesized
tcatatcctcatcctttggg

SEQ ID NO: 227714 - DNA, 20 bp, Artificial Sequence
  chemically synthesized
gaccgtgctgcccaaaggat

SEQ ID NO: 227715 - DNA, 20 bp, Artificial Sequence
  chemically synthesized
acttcatatcctcatccttt

SEQ ID NO: 227716 - DNA, 20 bp, Artificial Sequence
  chemically synthesized
accgtgctgcccaaaggatg

SEQ ID NO: 227717 - DNA, 20 bp, Artificial Sequence
  chemically synthesized
tacttcatatcctcatcctt

SEQ ID NO: 227718 - DNA, 20 bp, Artificial Sequence
  chemically synthesized
gcccaaaggatgaggatatg

SEQ ID NO: 227719 - DNA, 20 bp, Artificial Sequence
  chemically synthesized
ggatatgaagtaccctgtta

SEQ ID NO: 227720 - DNA, 20 bp, Artificial Sequence
  chemically synthesized
gccaatgaattactttaaca

SEQ ID NO: 227721 - DNA, 20 bp, Artificial Sequence
  chemically synthesized
tgccaatgaattactttaac

SEQ ID NO: 227722 - DNA, 20 bp, Artificial Sequence
  chemically synthesized
atgccaatgaattactttaa

SEQ ID NO: 227723 - DNA, 20 bp, Artificial Sequence
  chemically synthesized
accctgttaaagtaattcat

SEQ ID NO: 227724 - DNA, 20 bp, Artificial Sequence
  chemically synthesized
aattcattggcatgactgct

SEQ ID NO: 227725 - DNA, 20 bp, Artificial Sequence
  chemically synthesized
ttaatccaggacaaaccaag

SEQ ID NO: 227726 - DNA, 20 bp, Artificial Sequence
  chemically synthesized
tgattaatccaggacaaacc

SEQ ID NO: 227727 - DNA, 20 bp, Artificial Sequence
  chemically synthesized
catgactgcttggtttgtcc

SEQ ID NO: 227728 - DNA, 20 bp, Artificial Sequence
  chemically synthesized
ttgagagagatgattaatcc

SEQ ID NO: 227729 - DNA, 20 bp, Artificial Sequence
  chemically synthesized
cttgagagagatgattaatc

SEQ ID NO: 227730 - DNA, 20 bp, Artificial Sequence
  chemically synthesized
ctggattaatcatctctctc

SEQ ID NO: 227731 - DNA, 20 bp, Artificial Sequence
  chemically synthesized
tggattaatcatctctctca

SEQ ID NO: 227732 - DNA, 20 bp, Artificial Sequence
  chemically synthesized
gattaatcatctctctcaag

SEQ ID NO: 227733 - DNA, 20 bp, Artificial Sequence
  chemically synthesized
gggctaaaatctccttgaga

SEQ ID NO: 227734 - DNA, 20 bp, Artificial Sequence
  chemically synthesized
atgggctaaaatctccttga

SEQ ID NO: 227735 - DNA, 20 bp, Artificial Sequence
  chemically synthesized
cgatgggctaaaatctcctt

SEQ ID NO: 227736 - DNA, 20 bp, Artificial Sequence
  chemically synthesized
catctctctcaaggagattt

SEQ ID NO: 227737 - DNA, 20 bp, Artificial Sequence
  chemically synthesized
tcaaggagattttagcccat

SEQ ID NO: 227738 - DNA, 20 bp, Artificial Sequence
  chemically synthesized
ttgcacaggaatgggccgat

SEQ ID NO: 227739 - DNA, 20 bp, Artificial Sequence
  chemically synthesized
cttgcacaggaatgggccga

SEQ ID NO: 227740 - DNA, 20 bp, Artificial Sequence
  chemically synthesized
taggcatcttgcacaggaat

SEQ ID NO: 227741 - DNA, 20 bp, Artificial Sequence
  chemically synthesized
ttaggcatcttgcacaggaa

SEQ ID NO: 227742 - DNA, 20 bp, Artificial Sequence
  chemically synthesized
ccatcggcccattcctgtgc

SEQ ID NO: 227743 - DNA, 20 bp, Artificial Sequence
  chemically synthesized
tcaggttaggcatcttgcac

SEQ ID NO: 227744 - DNA, 20 bp, Artificial Sequence
  chemically synthesized
atcaggttaggcatcttgca

SEQ ID NO: 227745 - DNA, 20 bp, Artificial Sequence
  chemically synthesized
gggagcctaggaatcaggtt

SEQ ID NO: 227746 - DNA, 20 bp, Artificial Sequence
  chemically synthesized
tgggagcctaggaatcaggt

SEQ ID NO: 227747 - DNA, 20 bp, Artificial Sequence
  chemically synthesized
aagatgcctaacctgattcc

SEQ ID NO: 227748 - DNA, 20 bp, Artificial Sequence
  chemically synthesized
agatgcctaacctgattcct

SEQ ID NO: 227749 - DNA, 20 bp, Artificial Sequence
  chemically synthesized
agcttgggagcctaggaatc

SEQ ID NO: 227750 - DNA, 20 bp, Artificial Sequence
  chemically synthesized
tagcttgggagcctaggaat

SEQ ID NO: 227751 - DNA, 20 bp, Artificial Sequence
  chemically synthesized
tcattctagcttgggagcct

SEQ ID NO: 227752 - DNA, 20 bp, Artificial Sequence
  chemically synthesized
aacctgattcctaggctccc

SEQ ID NO: 227753 - DNA, 20 bp, Artificial Sequence
  chemically synthesized
ttcattctagcttgggagcc

SEQ ID NO: 227754 - DNA, 20 bp, Artificial Sequence
  chemically synthesized
tgattcctaggctcccaagc

SEQ ID NO: 227755 - DNA, 20 bp, Artificial Sequence
  chemically synthesized
gtatcttcattctagcttgg

SEQ ID NO: 227756 - DNA, 20 bp, Artificial Sequence
  chemically synthesized
tagtatcttcattctagctt

SEQ ID NO: 227757 - DNA, 20 bp, Artificial Sequence
  chemically synthesized
ctagtatcttcattctagct

SEQ ID NO: 227758 - DNA, 20 bp, Artificial Sequence
  chemically synthesized
taggctcccaagctagaatg

SEQ ID NO: 227759 - DNA, 20 bp, Artificial Sequence
  chemically synthesized
tgtagctagtatcttcattc

SEQ ID NO: 227760 - DNA, 20 bp, Artificial Sequence
  chemically synthesized
ccaagctagaatgaagatac

SEQ ID NO: 227761 - DNA, 20 bp, Artificial Sequence
  chemically synthesized
agaatgaagatactagctac

SEQ ID NO: 227762 - DNA, 20 bp, Artificial Sequence
  chemically synthesized
cattggggaggacttgtagc

SEQ ID NO: 227763 - DNA, 20 bp, Artificial Sequence
  chemically synthesized
ctagcattggggaggacttg

SEQ ID NO: 227764 - DNA, 20 bp, Artificial Sequence
  chemically synthesized
atgttagtctagcattgggg

SEQ ID NO: 227765 - DNA, 20 bp, Artificial Sequence
  chemically synthesized
tatgttagtctagcattggg

SEQ ID NO: 227766 - DNA, 20 bp, Artificial Sequence
  chemically synthesized
ctacaagtcctccccaatgc

SEQ ID NO: 227767 - DNA, 20 bp, Artificial Sequence
  chemically synthesized
tgtatgttagtctagcattg

SEQ ID NO: 227768 - DNA, 20 bp, Artificial Sequence
  chemically synthesized
ttgtatgttagtctagcatt

SEQ ID NO: 227769 - DNA, 20 bp, Artificial Sequence
  chemically synthesized
attgtatgttagtctagcat

SEQ ID NO: 227770 - DNA, 20 bp, Artificial Sequence
  chemically synthesized
atcaaaattgtatgttagtc

SEQ ID NO: 227771 - DNA, 20 bp, Artificial Sequence
  chemically synthesized
cagagatcaaaattgtatgt

SEQ ID NO: 227772 - DNA, 20 bp, Artificial Sequence
  chemically synthesized
taacatacaattttgatctc

SEQ ID NO: 227773 - DNA, 20 bp, Artificial Sequence
  chemically synthesized
gatcattgactagaattcca

SEQ ID NO: 227774 - DNA, 20 bp, Artificial Sequence
  chemically synthesized
aattttgatctctggaattc

SEQ ID NO: 227775 - DNA, 20 bp, Artificial Sequence
  chemically synthesized
aggatcattgactagaattc

SEQ ID NO: 227776 - DNA, 20 bp, Artificial Sequence
  chemically synthesized
acattggtaggatcattgac

SEQ ID NO: 227777 - DNA, 20 bp, Artificial Sequence
  chemically synthesized
gaggtagagctcacattggt

SEQ ID NO: 227778 - DNA, 20 bp, Artificial Sequence
  chemically synthesized
gtcaatgatcctaccaatgt

SEQ ID NO: 227779 - DNA, 20 bp, Artificial Sequence
  chemically synthesized
agaggtagagctcacattgg

SEQ ID NO: 227780 - DNA, 20 bp, Artificial Sequence
  chemically synthesized
tgaagaggtagagctcacat

SEQ ID NO: 227781 - DNA, 20 bp, Artificial Sequence
  chemically synthesized
ttaggggccatgaagaggta

SEQ ID NO: 227782 - DNA, 20 bp, Artificial Sequence
  chemically synthesized
gtttaggggccatgaagagg

SEQ ID NO: 227783 - DNA, 20 bp, Artificial Sequence
  chemically synthesized
atgtgagctctacctcttca

SEQ ID NO: 227784 - DNA, 20 bp, Artificial Sequence
  chemically synthesized
agcgtttaggggccatgaag

SEQ ID NO: 227785 - DNA, 20 bp, Artificial Sequence
  chemically synthesized
cagcgtttaggggccatgaa

SEQ ID NO: 227786 - DNA, 20 bp, Artificial Sequence
  chemically synthesized
atcagcgtttaggggccatg

SEQ ID NO: 227787 - DNA, 20 bp, Artificial Sequence
  chemically synthesized
aagcagatatcagcgtttag

SEQ ID NO: 227788 - DNA, 20 bp, Artificial Sequence
  chemically synthesized
aaagcagatatcagcgttta

SEQ ID NO: 227789 - DNA, 20 bp, Artificial Sequence
  chemically synthesized
gaaagcagatatcagcgttt

SEQ ID NO: 227790 - DNA, 20 bp, Artificial Sequence
  chemically synthesized
tgaaagcagatatcagcgtt

SEQ ID NO: 227791 - DNA, 20 bp, Artificial Sequence
  chemically synthesized
gtaaggctgaaagcagatat

SEQ ID NO: 227792 - DNA, 20 bp, Artificial Sequence
  chemically synthesized
taaacgctgatatctgcttt

SEQ ID NO: 227793 - DNA, 20 bp, Artificial Sequence
  chemically synthesized
ttatatggtaaggctgaaag

SEQ ID NO: 227794 - DNA, 20 bp, Artificial Sequence
  chemically synthesized
gcattatatggtaaggctga

SEQ ID NO: 227795 - DNA, 20 bp, Artificial Sequence
  chemically synthesized
cataagagcattatatggta

SEQ ID NO: 227796 - DNA, 20 bp, Artificial Sequence
  chemically synthesized
gcataagagcattatatggt

SEQ ID NO: 227797 - DNA, 20 bp, Artificial Sequence
  chemically synthesized
aagagcataagagcattata

SEQ ID NO: 227798 - DNA, 20 bp, Artificial Sequence
  chemically synthesized
tttcaagaggaagagcataa

SEQ ID NO: 227799 - DNA, 20 bp, Artificial Sequence
  chemically synthesized
tgtttcaagaggaagagcat

SEQ ID NO: 227800 - DNA, 20 bp, Artificial Sequence
  chemically synthesized
aacatgtgtttcaagaggaa

SEQ ID NO: 227801 - DNA, 20 bp, Artificial Sequence
  chemically synthesized
ttaacatgtgtttcaagagg

SEQ ID NO: 227802 - DNA, 20 bp, Artificial Sequence
  chemically synthesized
ttcttaacatgtgtttcaag

SEQ ID NO: 227803 - DNA, 20 bp, Artificial Sequence
  chemically synthesized
attcttaacatgtgtttcaa

SEQ ID NO: 227804 - DNA, 20 bp, Artificial Sequence
  chemically synthesized
tcattcttaacatgtgtttc

SEQ ID NO: 227805 - DNA, 20 bp, Artificial Sequence
  chemically synthesized
ttcctcttgaaacacatgtt

SEQ ID NO: 227806 - DNA, 20 bp, Artificial Sequence
  chemically synthesized
aactcttccaaagggaagat

SEQ ID NO: 227807 - DNA, 20 bp, Artificial Sequence
  chemically synthesized
aaactcttccaaagggaaga

SEQ ID NO: 227808 - DNA, 20 bp, Artificial Sequence
  chemically synthesized
agaatgacccatcttccctt

SEQ ID NO: 227809 - DNA, 20 bp, Artificial Sequence
  chemically synthesized
gcttaaactcttccaaaggg

SEQ ID NO: 227810 - DNA, 20 bp, Artificial Sequence
  chemically synthesized
atgacccatcttccctttgg

SEQ ID NO: 227811 - DNA, 20 bp, Artificial Sequence
  chemically synthesized
gacccatcttccctttggaa

SEQ ID NO: 227812 - DNA, 20 bp, Artificial Sequence
  chemically synthesized
actgcttaaactcttccaaa

SEQ ID NO: 227813 - DNA, 20 bp, Artificial Sequence
  chemically synthesized
aactgcttaaactcttccaa

SEQ ID NO: 227814 - DNA, 20 bp, Artificial Sequence
  chemically synthesized
aaactgcttaaactcttcca

SEQ ID NO: 227815 - DNA, 20 bp, Artificial Sequence
  chemically synthesized
tcttccctttggaagagttt

SEQ ID NO: 227816 - DNA, 20 bp, Artificial Sequence
  chemically synthesized
tccctttggaagagtttaag

SEQ ID NO: 227817 - DNA, 20 bp, Artificial Sequence
  chemically synthesized
gccagtcaaatttttttaaa

SEQ ID NO: 227818 - DNA, 20 bp, Artificial Sequence
  chemically synthesized
atgccagtcaaattttttta

SEQ ID NO: 227819 - DNA, 20 bp, Artificial Sequence
  chemically synthesized
tctctttaaaaaaatttgac

SEQ ID NO: 227820 - DNA, 20 bp, Artificial Sequence
  chemically synthesized
gtcagagcttgatttgatgc

SEQ ID NO: 227821 - DNA, 20 bp, Artificial Sequence
  chemically synthesized
aatttgactggcatcaaatc

SEQ ID NO: 227822 - DNA, 20 bp, Artificial Sequence
  chemically synthesized
tttataactgtcattggtca

SEQ ID NO: 227823 - DNA, 20 bp, Artificial Sequence
  chemically synthesized
tttttataactgtcattggt

SEQ ID NO: 227824 - DNA, 20 bp, Artificial Sequence
  chemically synthesized
aatcaagctctgaccaatga

SEQ ID NO: 227825 - DNA, 20 bp, Artificial Sequence
  chemically synthesized
tttttttttataactgtcat

SEQ ID NO: 227826 - DNA, 20 bp, Artificial Sequence
  chemically synthesized
agggaatttagtttttttgt

SEQ ID NO: 227827 - DNA, 20 bp, Artificial Sequence
  chemically synthesized
ctgttttctctgagggaatt

SEQ ID NO: 227828 - DNA, 20 bp, Artificial Sequence
  chemically synthesized
acaaaaaaactaaattccct

SEQ ID NO: 227829 - DNA, 20 bp, Artificial Sequence
  chemically synthesized
aaaaaaactaaattccctca

SEQ ID NO: 227830 - DNA, 20 bp, Artificial Sequence
  chemically synthesized
tactttcctgttttctctga

SEQ ID NO: 227831 - DNA, 20 bp, Artificial Sequence
  chemically synthesized
atactttcctgttttctctg

SEQ ID NO: 227832 - DNA, 20 bp, Artificial Sequence
  chemically synthesized
catactttcctgttttctct

SEQ ID NO: 227833 - DNA, 20 bp, Artificial Sequence
  chemically synthesized
ctaaattccctcagagaaaa

SEQ ID NO: 227834 - DNA, 20 bp, Artificial Sequence
  chemically synthesized
taaattccctcagagaaaac

SEQ ID NO: 227835 - DNA, 20 bp, Artificial Sequence
  chemically synthesized
ttccctcagagaaaacagga

SEQ ID NO: 227836 - DNA, 20 bp, Artificial Sequence
  chemically synthesized
tcagagaaaacaggaaagta

SEQ ID NO: 227837 - DNA, 20 bp, Artificial Sequence
  chemically synthesized
cagagaaaacaggaaagtat

SEQ ID NO: 227838 - DNA, 20 bp, Artificial Sequence
  chemically synthesized
gagaaaacaggaaagtatgg

SEQ ID NO: 227839 - DNA, 20 bp, Artificial Sequence
  chemically synthesized
gaaagtatgggagcaacttt

SEQ ID NO: 227840 - DNA, 20 bp, Artificial Sequence
  chemically synthesized
ttattccaagtgttttctta

SEQ ID NO: 227841 - DNA, 20 bp, Artificial Sequence
  chemically synthesized
agcaactttaagaaaacact

SEQ ID NO: 227842 - DNA, 20 bp, Artificial Sequence
  chemically synthesized
taacagtttgttattattcc

SEQ ID NO: 227843 - DNA, 20 bp, Artificial Sequence
  chemically synthesized
ataggttaaatattaagtaa

SEQ ID NO: 227844 - DNA, 20 bp, Artificial Sequence
  chemically synthesized
gaaaagataggttaaatatt

SEQ ID NO: 227845 - DNA, 20 bp, Artificial Sequence
  chemically synthesized
gagcccttcggggaaaagat

SEQ ID NO: 227846 - DNA, 20 bp, Artificial Sequence
  chemically synthesized
tgagcccttcggggaaaaga

SEQ ID NO: 227847 - DNA, 20 bp, Artificial Sequence
  chemically synthesized
tttaacctatcttttccccg

SEQ ID NO: 227848 - DNA, 20 bp, Artificial Sequence
  chemically synthesized
agcttgagcccttcggggaa

SEQ ID NO: 227849 - DNA, 20 bp, Artificial Sequence
  chemically synthesized
ttaacctatcttttccccga

SEQ ID NO: 227850 - DNA, 20 bp, Artificial Sequence
  chemically synthesized
taacctatcttttccccgaa

SEQ ID NO: 227851 - DNA, 20 bp, Artificial Sequence
  chemically synthesized
taatcagcttgagcccttcg

SEQ ID NO: 227852 - DNA, 20 bp, Artificial Sequence
  chemically synthesized
ataatcagcttgagcccttc

SEQ ID NO: 227853 - DNA, 20 bp, Artificial Sequence
  chemically synthesized
aataatcagcttgagccctt

SEQ ID NO: 227854 - DNA, 20 bp, Artificial Sequence
  chemically synthesized
atcttttccccgaagggctc

SEQ ID NO: 227855 - DNA, 20 bp, Artificial Sequence
  chemically synthesized
agcaagaaaataatcagctt

SEQ ID NO: 227856 - DNA, 20 bp, Artificial Sequence
  chemically synthesized
gtcaaaagcaagaaaataat

SEQ ID NO: 227857 - DNA, 20 bp, Artificial Sequence
  chemically synthesized
tttcactagccgtcaaaagc

SEQ ID NO: 227858 - DNA, 20 bp, Artificial Sequence
  chemically synthesized
gattattttcttgcttttga

SEQ ID NO: 227859 - DNA, 20 bp, Artificial Sequence
  chemically synthesized
ttattttcactagccgtcaa

SEQ ID NO: 227860 - DNA, 20 bp, Artificial Sequence
  chemically synthesized
attttcttgcttttgacggc

SEQ ID NO: 227861 - DNA, 20 bp, Artificial Sequence
  chemically synthesized
gaggaaccaattattttcac

SEQ ID NO: 227862 - DNA, 20 bp, Artificial Sequence
  chemically synthesized
tgacggctagtgaaaataat

SEQ ID NO: 227863 - DNA, 20 bp, Artificial Sequence
  chemically synthesized
aaggaggtgacaaagaagag

SEQ ID NO: 227864 - DNA, 20 bp, Artificial Sequence
  chemically synthesized
caaggaggtgacaaagaaga

SEQ ID NO: 227865 - DNA, 20 bp, Artificial Sequence
  chemically synthesized
ttcaaggaggtgacaaagaa

SEQ ID NO: 227866 - DNA, 20 bp, Artificial Sequence
  chemically synthesized
agttcaaggaggtgacaaag

SEQ ID NO: 227867 - DNA, 20 bp, Artificial Sequence
  chemically synthesized
aatagttcaaggaggtgaca

SEQ ID NO: 227868 - DNA, 20 bp, Artificial Sequence
  chemically synthesized
gaaaacttaatagttcaagg

SEQ ID NO: 227869 - DNA, 20 bp, Artificial Sequence
  chemically synthesized
ggaaaacttaatagttcaag

SEQ ID NO: 227870 - DNA, 20 bp, Artificial Sequence
  chemically synthesized
agggaaaacttaatagttca

SEQ ID NO: 227871 - DNA, 20 bp, Artificial Sequence
  chemically synthesized
aagggaaaacttaatagttc

SEQ ID NO: 227872 - DNA, 20 bp, Artificial Sequence
  chemically synthesized
tgtcacctccttgaactatt

SEQ ID NO: 227873 - DNA, 20 bp, Artificial Sequence
  chemically synthesized
aacatcaagggaaaacttaa

SEQ ID NO: 227874 - DNA, 20 bp, Artificial Sequence
  chemically synthesized
catgcatgagaaaacatcaa

SEQ ID NO: 227875 - DNA, 20 bp, Artificial Sequence
  chemically synthesized
tcatgcatgagaaaacatca

SEQ ID NO: 227876 - DNA, 20 bp, Artificial Sequence
  chemically synthesized
ttcatgcatgagaaaacatc

SEQ ID NO: 227877 - DNA, 20 bp, Artificial Sequence
  chemically synthesized
gtactggcatattcatgcat

SEQ ID NO: 227878 - DNA, 20 bp, Artificial Sequence
  chemically synthesized
tttctcatgcatgaatatgc

SEQ ID NO: 227879 - DNA, 20 bp, Artificial Sequence
  chemically synthesized
aagacctgtgtaagtggtac

SEQ ID NO: 227880 - DNA, 20 bp, Artificial Sequence
  chemically synthesized
atatgccagtaccacttaca

SEQ ID NO: 227881 - DNA, 20 bp, Artificial Sequence
  chemically synthesized
tatgccagtaccacttacac

SEQ ID NO: 227882 - DNA, 20 bp, Artificial Sequence
  chemically synthesized
gtttacaagacctgtgtaag

SEQ ID NO: 227883 - DNA, 20 bp, Artificial Sequence
  chemically synthesized
cttgtttacaagacctgtgt

SEQ ID NO: 227884 - DNA, 20 bp, Artificial Sequence
  chemically synthesized
cttacacaggtcttgtaaac

SEQ ID NO: 227885 - DNA, 20 bp, Artificial Sequence
  chemically synthesized
agcttttgaaacttgtttac

SEQ ID NO: 227886 - DNA, 20 bp, Artificial Sequence
  chemically synthesized
gtcttgtaaacaagtttcaa

SEQ ID NO: 227887 - DNA, 20 bp, Artificial Sequence
  chemically synthesized
aaacaagtttcaaaagctat

SEQ ID NO: 227888 - DNA, 20 bp, Artificial Sequence
  chemically synthesized
tgtaatttatgtgggtctaa

SEQ ID NO: 227889 - DNA, 20 bp, Artificial Sequence
  chemically synthesized
atattttgtgtaatttatgt

SEQ ID NO: 227890 - DNA, 20 bp, Artificial Sequence
  chemically synthesized
catattttgtgtaatttatg

SEQ ID NO: 227891 - DNA, 20 bp, Artificial Sequence
  chemically synthesized
aaattacacaaaatatgttt

SEQ ID NO: 227892 - DNA, 20 bp, Artificial Sequence
  chemically synthesized
tggctttaggaaatttggta

SEQ ID NO: 227893 - DNA, 20 bp, Artificial Sequence
  chemically synthesized
atggctttaggaaatttggt

SEQ ID NO: 227894 - DNA, 20 bp, Artificial Sequence
  chemically synthesized
tatggctttaggaaatttgg

SEQ ID NO: 227895 - DNA, 20 bp, Artificial Sequence
  chemically synthesized
aactatggctttaggaaatt

SEQ ID NO: 227896 - DNA, 20 bp, Artificial Sequence
  chemically synthesized
agtccctaccaaatttccta

SEQ ID NO: 227897 - DNA, 20 bp, Artificial Sequence
  chemically synthesized
taccaaatttcctaaagcca

SEQ ID NO: 227898 - DNA, 20 bp, Artificial Sequence
  chemically synthesized
gacagacgaactatggcttt

SEQ ID NO: 227899 - DNA, 20 bp, Artificial Sequence
  chemically synthesized
ggacagacgaactatggctt

SEQ ID NO: 227900 - DNA, 20 bp, Artificial Sequence
  chemically synthesized
tgatgtggacagacgaacta

SEQ ID NO: 227901 - DNA, 20 bp, Artificial Sequence
  chemically synthesized
agggagtgggttgatgtgga

SEQ ID NO: 227902 - DNA, 20 bp, Artificial Sequence
  chemically synthesized
aagaagggagtgggttgatg

SEQ ID NO: 227903 - DNA, 20 bp, Artificial Sequence
  chemically synthesized
ggataataaaagaagggagt

SEQ ID NO: 227904 - DNA, 20 bp, Artificial Sequence
  chemically synthesized
gggataataaaagaagggag

SEQ ID NO: 227905 - DNA, 20 bp, Artificial Sequence
  chemically synthesized
gcagggataataaaagaagg

SEQ ID NO: 227906 - DNA, 20 bp, Artificial Sequence
  chemically synthesized
aagcagggataataaaagaa

SEQ ID NO: 227907 - DNA, 20 bp, Artificial Sequence
  chemically synthesized
aaagcagggataataaaaga

SEQ ID NO: 227908 - DNA, 20 bp, Artificial Sequence
  chemically synthesized
taaagcagggataataaaag

SEQ ID NO: 227909 - DNA, 20 bp, Artificial Sequence
  chemically synthesized
agctaaagcagggataataa

SEQ ID NO: 227910 - DNA, 20 bp, Artificial Sequence
  chemically synthesized
ttcttttattatccctgctt

SEQ ID NO: 227911 - DNA, 20 bp, Artificial Sequence
  chemically synthesized
gtgacaaggtagctaaagca

SEQ ID NO: 227912 - DNA, 20 bp, Artificial Sequence
  chemically synthesized
agtgacaaggtagctaaagc

SEQ ID NO: 227913 - DNA, 20 bp, Artificial Sequence
  chemically synthesized
gagtgacaaggtagctaaag

SEQ ID NO: 227914 - DNA, 20 bp, Artificial Sequence
  chemically synthesized
tttgagtgacaaggtagcta

SEQ ID NO: 227915 - DNA, 20 bp, Artificial Sequence
  chemically synthesized
agtttatttgagtgacaagg

SEQ ID NO: 227916 - DNA, 20 bp, Artificial Sequence
  chemically synthesized
cacagtttatttgagtgaca

SEQ ID NO: 227917 - DNA, 20 bp, Artificial Sequence
  chemically synthesized
acacagtttatttgagtgac

SEQ ID NO: 227918 - DNA, 20 bp, Artificial Sequence
  chemically synthesized
gtgaattacacagtttattt

SEQ ID NO: 227919 - DNA, 20 bp, Artificial Sequence
  chemically synthesized
caaagcaggtgtgaattaca

SEQ ID NO: 227920 - DNA, 20 bp, Artificial Sequence
  chemically synthesized
gtgtaattcacacctgcttt

SEQ ID NO: 227921 - DNA, 20 bp, Artificial Sequence
  chemically synthesized
tcaaccaatcagctcaaagc

SEQ ID NO: 227922 - DNA, 20 bp, Artificial Sequence
  chemically synthesized
atcaaccaatcagctcaaag

SEQ ID NO: 227923 - DNA, 20 bp, Artificial Sequence
  chemically synthesized
cagatcaaccaatcagctca

SEQ ID NO: 227924 - DNA, 20 bp, Artificial Sequence
  chemically synthesized
cacacctgctttgagctgat

SEQ ID NO: 227925 - DNA, 20 bp, Artificial Sequence
  chemically synthesized
tcaaggacagatcaaccaat

SEQ ID NO: 227926 - DNA, 20 bp, Artificial Sequence
  chemically synthesized
ccacctgggacaatcaagga

SEQ ID NO: 227927 - DNA, 20 bp, Artificial Sequence
  chemically synthesized
aaatccacctgggacaatca

SEQ ID NO: 227928 - DNA, 20 bp, Artificial Sequence
  chemically synthesized
taaatccacctgggacaatc

SEQ ID NO: 227929 - DNA, 20 bp, Artificial Sequence
  chemically synthesized
tgatctgtccttgattgtcc

SEQ ID NO: 227930 - DNA, 20 bp, Artificial Sequence
  chemically synthesized
gatctgtccttgattgtccc

SEQ ID NO: 227931 - DNA, 20 bp, Artificial Sequence
  chemically synthesized
ctgtccttgattgtcccagg

SEQ ID NO: 227932 - DNA, 20 bp, Artificial Sequence
  chemically synthesized
aagggagaataaatccacct

SEQ ID NO: 227933 - DNA, 20 bp, Artificial Sequence
  chemically synthesized
taagggagaataaatccacc

SEQ ID NO: 227934 - DNA, 20 bp, Artificial Sequence
  chemically synthesized
aggtggatttattctccctt

SEQ ID NO: 227935 - DNA, 20 bp, Artificial Sequence
  chemically synthesized
ttcctacctgaagcttaagg

SEQ ID NO: 227936 - DNA, 20 bp, Artificial Sequence
  chemically synthesized
gattcctacctgaagcttaa

SEQ ID NO: 227937 - DNA, 20 bp, Artificial Sequence
  chemically synthesized
atttattctcccttaagctt

SEQ ID NO: 227938 - DNA, 20 bp, Artificial Sequence
  chemically synthesized
ggattcctacctgaagctta

SEQ ID NO: 227939 - DNA, 20 bp, Artificial Sequence
  chemically synthesized
tttattctcccttaagcttc

SEQ ID NO: 227940 - DNA, 20 bp, Artificial Sequence
  chemically synthesized
aggattcctacctgaagctt

SEQ ID NO: 227941 - DNA, 20 bp, Artificial Sequence
  chemically synthesized
attctcccttaagcttcagg

SEQ ID NO: 227942 - DNA, 20 bp, Artificial Sequence
  chemically synthesized
ttctcccttaagcttcaggt

SEQ ID NO: 227943 - DNA, 20 bp, Artificial Sequence
  chemically synthesized
acctgcaggattcctacctg

SEQ ID NO: 227944 - DNA, 20 bp, Artificial Sequence
  chemically synthesized
agcttcaggtaggaatcctg

SEQ ID NO: 227945 - DNA, 20 bp, Artificial Sequence
  chemically synthesized
gcttcaggtaggaatcctgc

SEQ ID NO: 227946 - DNA, 20 bp, Artificial Sequence
  chemically synthesized
ttctccaggtatgaacctgc

SEQ ID NO: 227947 - DNA, 20 bp, Artificial Sequence
  chemically synthesized
cttctccaggtatgaacctg

SEQ ID NO: 227948 - DNA, 20 bp, Artificial Sequence
  chemically synthesized
gaatcctgcaggttcatacc

SEQ ID NO: 227949 - DNA, 20 bp, Artificial Sequence
  chemically synthesized
atcctgcaggttcatacctg

SEQ ID NO: 227950 - DNA, 20 bp, Artificial Sequence
  chemically synthesized
ctgcaggttcatacctggag

SEQ ID NO: 227951 - DNA, 20 bp, Artificial Sequence
  chemically synthesized
tgcaggttcatacctggaga

SEQ ID NO: 227952 - DNA, 20 bp, Artificial Sequence
  chemically synthesized
caggttcatacctggagaag

SEQ ID NO: 227953 - DNA, 20 bp, Artificial Sequence
  chemically synthesized
ataggtttatctccttctcc

SEQ ID NO: 227954 - DNA, 20 bp, Artificial Sequence
  chemically synthesized
cataggtttatctccttctc

SEQ ID NO: 227955 - DNA, 20 bp, Artificial Sequence
  chemically synthesized
gaacattgcatttaaggcat

SEQ ID NO: 227956 - DNA, 20 bp, Artificial Sequence
  chemically synthesized
tgaacattgcatttaaggca

SEQ ID NO: 227957 - DNA, 20 bp, Artificial Sequence
  chemically synthesized
attaatgaacattgcattta

SEQ ID NO: 227958 - DNA, 20 bp, Artificial Sequence
  chemically synthesized
cattaatgaacattgcattt

SEQ ID NO: 227959 - DNA, 20 bp, Artificial Sequence
  chemically synthesized
ttaaatgcaatgttcattaa

SEQ ID NO: 227960 - DNA, 20 bp, Artificial Sequence
  chemically synthesized
ttaatggataaattcataac

SEQ ID NO: 227961 - DNA, 20 bp, Artificial Sequence
  chemically synthesized
gataaattcataactggcaa

SEQ ID NO: 227962 - DNA, 20 bp, Artificial Sequence
  chemically synthesized
gtaactcttggtaccattgc

SEQ ID NO: 227963 - DNA, 20 bp, Artificial Sequence
  chemically synthesized
tcataactggcaatggtacc

SEQ ID NO: 227964 - DNA, 20 bp, Artificial Sequence
  chemically synthesized
ataactggcaatggtaccaa

SEQ ID NO: 227965 - DNA, 20 bp, Artificial Sequence
  chemically synthesized
ggcaatggtaccaagagtta

SEQ ID NO: 227966 - DNA, 20 bp, Artificial Sequence
  chemically synthesized
gaggaagatgctgtaactct

SEQ ID NO: 227967 - DNA, 20 bp, Artificial Sequence
  chemically synthesized
tgctctgcttttaatagagg

SEQ ID NO: 227968 - DNA, 20 bp, Artificial Sequence
  chemically synthesized
acagcatcttcctctattaa

SEQ ID NO: 227969 - DNA, 20 bp, Artificial Sequence
  chemically synthesized
ggctgctctgcttttaatag

SEQ ID NO: 227970 - DNA, 20 bp, Artificial Sequence
  chemically synthesized
aggctgctctgcttttaata

SEQ ID NO: 227971 - DNA, 20 bp, Artificial Sequence
  chemically synthesized
gcatcttcctctattaaaag

SEQ ID NO: 227972 - DNA, 20 bp, Artificial Sequence
  chemically synthesized
ataggctgctctgcttttaa

SEQ ID NO: 227973 - DNA, 20 bp, Artificial Sequence
  chemically synthesized
atcttcctctattaaaagca

SEQ ID NO: 227974 - DNA, 20 bp, Artificial Sequence
  chemically synthesized
ttcctctattaaaagcagag

SEQ ID NO: 227975 - DNA, 20 bp, Artificial Sequence
  chemically synthesized
attaaaagcagagcagccta

SEQ ID NO: 227976 - DNA, 20 bp, Artificial Sequence
  chemically synthesized
ttaaaagcagagcagcctat

SEQ ID NO: 227977 - DNA, 20 bp, Artificial Sequence
  chemically synthesized
aagcagagcagcctatggga

SEQ ID NO: 227978 - DNA, 20 bp, Artificial Sequence
  chemically synthesized
caaggacttggccatcccat

SEQ ID NO: 227979 - DNA, 20 bp, Artificial Sequence
  chemically synthesized
tcaaggacttggccatccca

SEQ ID NO: 227980 - DNA, 20 bp, Artificial Sequence
  chemically synthesized
gagcagcctatgggatggcc

SEQ ID NO: 227981 - DNA, 20 bp, Artificial Sequence
  chemically synthesized
ccctgtcaccttcaaggact

SEQ ID NO: 227982 - DNA, 20 bp, Artificial Sequence
  chemically synthesized
atgggatggccaagtccttg

SEQ ID NO: 227983 - DNA, 20 bp, Artificial Sequence
  chemically synthesized
tgggatggccaagtccttga

SEQ ID NO: 227984 - DNA, 20 bp, Artificial Sequence
  chemically synthesized
tcaaatccctgtcaccttca

SEQ ID NO: 227985 - DNA, 20 bp, Artificial Sequence
  chemically synthesized
gtcaaatccctgtcaccttc

SEQ ID NO: 227986 - DNA, 20 bp, Artificial Sequence
  chemically synthesized
ggccaagtccttgaaggtga

SEQ ID NO: 227987 - DNA, 20 bp, Artificial Sequence
  chemically synthesized
gccaagtccttgaaggtgac

SEQ ID NO: 227988 - DNA, 20 bp, Artificial Sequence
  chemically synthesized
ccaagtccttgaaggtgaca

SEQ ID NO: 227989 - DNA, 20 bp, Artificial Sequence
  chemically synthesized
tgacagggatttgacaaaaa

SEQ ID NO: 227990 - DNA, 20 bp, Artificial Sequence
  chemically synthesized
acagggatttgacaaaaatg

SEQ ID NO: 227991 - DNA, 20 bp, Artificial Sequence
  chemically synthesized
cagggatttgacaaaaatgg

SEQ ID NO: 227992 - DNA, 20 bp, Artificial Sequence
  chemically synthesized
agggatttgacaaaaatgga

SEQ ID NO: 227993 - DNA, 20 bp, Artificial Sequence
  chemically synthesized
acaaaaatggagggtatgaa

SEQ ID NO: 227994 - DNA, 20 bp, Artificial Sequence
  chemically synthesized
caaaaatggagggtatgaat

SEQ ID NO: 227995 - DNA, 20 bp, Artificial Sequence
  chemically synthesized
ggtatgaatgggctatatta

SEQ ID NO: 227996 - DNA, 20 bp, Artificial Sequence
  chemically synthesized
tcaaatcattaactataata

SEQ ID NO: 227997 - DNA, 20 bp, Artificial Sequence
  chemically synthesized
aatgatttgaaatcattgtt

SEQ ID NO: 227998 - DNA, 20 bp, Artificial Sequence
  chemically synthesized
attgtttagaaataattgcc

SEQ ID NO: 227999 - DNA, 20 bp, Artificial Sequence
  chemically synthesized
ttagaaataattgcctagac

SEQ ID NO: 228000 - DNA, 20 bp, Artificial Sequence
  chemically synthesized
tcagttaacttatcttgtct

SEQ ID NO: 228001 - DNA, 20 bp, Artificial Sequence
  chemically synthesized
atcagttaacttatcttgtc

SEQ ID NO: 228002 - DNA, 20 bp, Artificial Sequence
  chemically synthesized
aataattgcctagacaagat

SEQ ID NO: 228003 - DNA, 20 bp, Artificial Sequence
  chemically synthesized
taatgcaagtttgtagagat

SEQ ID NO: 228004 - DNA, 20 bp, Artificial Sequence
  chemically synthesized
atatataatgcaagtttgta

SEQ ID NO: 228005 - DNA, 20 bp, Artificial Sequence
  chemically synthesized
atatatataatgcaagtttg

SEQ ID NO: 228006 - DNA, 20 bp, Artificial Sequence
  chemically synthesized
atgagaaatatatataatgc

SEQ ID NO: 228007 - DNA, 20 bp, Artificial Sequence
  chemically synthesized
taaaaattatgcatagtgat

SEQ ID NO: 228008 - DNA, 20 bp, Artificial Sequence
  chemically synthesized
tctataataaaaattatgca

SEQ ID NO: 228009 - DNA, 20 bp, Artificial Sequence
  chemically synthesized
actatgcataatttttatta

SEQ ID NO: 228010 - DNA, 20 bp, Artificial Sequence
  chemically synthesized
ttattatagatttgtccctt

SEQ ID NO: 228011 - DNA, 20 bp, Artificial Sequence
  chemically synthesized
tattatagatttgtcccttg

SEQ ID NO: 228012 - DNA, 20 bp, Artificial Sequence
  chemically synthesized
tttgtgcttctggacctcaa

SEQ ID NO: 228013 - DNA, 20 bp, Artificial Sequence
  chemically synthesized
tagatttgtcccttgaggtc

SEQ ID NO: 228014 - DNA, 20 bp, Artificial Sequence
  chemically synthesized
ctttgtgcttctggacctca

SEQ ID NO: 228015 - DNA, 20 bp, Artificial Sequence
  chemically synthesized
gctttgtgcttctggacctc

SEQ ID NO: 228016 - DNA, 20 bp, Artificial Sequence
  chemically synthesized
atttgtcccttgaggtccag

SEQ ID NO: 228017 - DNA, 20 bp, Artificial Sequence
  chemically synthesized
atgagaatgctttgtgcttc

SEQ ID NO: 228018 - DNA, 20 bp, Artificial Sequence
  chemically synthesized
ccttgaggtccagaagcaca

SEQ ID NO: 228019 - DNA, 20 bp, Artificial Sequence
  chemically synthesized
agaagcacaaagcattctca

SEQ ID NO: 228020 - DNA, 20 bp, Artificial Sequence
  chemically synthesized
gatgcctgttgggggactat

SEQ ID NO: 228021 - DNA, 20 bp, Artificial Sequence
  chemically synthesized
gcattctcatagtcccccaa

SEQ ID NO: 228022 - DNA, 20 bp, Artificial Sequence
  chemically synthesized
cattctcatagtcccccaac

SEQ ID NO: 228023 - DNA, 20 bp, Artificial Sequence
  chemically synthesized
taaagaaagatgcctgttgg

SEQ ID NO: 228024 - DNA, 20 bp, Artificial Sequence
  chemically synthesized
ttaaagaaagatgcctgttg

SEQ ID NO: 228025 - DNA, 20 bp, Artificial Sequence
  chemically synthesized
cttaaagaaagatgcctgtt

SEQ ID NO: 228026 - DNA, 20 bp, Artificial Sequence
  chemically synthesized
tcttaaagaaagatgcctgt

SEQ ID NO: 228027 - DNA, 20 bp, Artificial Sequence
  chemically synthesized
cccaacaggcatctttcttt

SEQ ID NO: 228028 - DNA, 20 bp, Artificial Sequence
  chemically synthesized
caacaggcatctttctttaa

SEQ ID NO: 228029 - DNA, 20 bp, Artificial Sequence
  chemically synthesized
cttgctttgtctcttaaaga

SEQ ID NO: 228030 - DNA, 20 bp, Artificial Sequence
  chemically synthesized
ttgccttgctttgtctctta

SEQ ID NO: 228031 - DNA, 20 bp, Artificial Sequence
  chemically synthesized
gcatctttctttaagagaca

SEQ ID NO: 228032 - DNA, 20 bp, Artificial Sequence
  chemically synthesized
ctttctttaagagacaaagc

SEQ ID NO: 228033 - DNA, 20 bp, Artificial Sequence
  chemically synthesized
tttctttaagagacaaagca

SEQ ID NO: 228034 - DNA, 20 bp, Artificial Sequence
  chemically synthesized
gagacaaagcaaggcaataa

SEQ ID NO: 228035 - DNA, 20 bp, Artificial Sequence
  chemically synthesized
agacaaagcaaggcaataaa

SEQ ID NO: 228036 - DNA, 20 bp, Artificial Sequence
  chemically synthesized
gacaaagcaaggcaataaaa

SEQ ID NO: 228037 - DNA, 20 bp, Artificial Sequence
  chemically synthesized
acaaagcaaggcaataaaag

SEQ ID NO: 228038 - DNA, 20 bp, Artificial Sequence
  chemically synthesized
caaagcaaggcaataaaagg

SEQ ID NO: 228039 - DNA, 20 bp, Artificial Sequence
  chemically synthesized
aaagcaaggcaataaaaggg

SEQ ID NO: 228040 - DNA, 20 bp, Artificial Sequence
  chemically synthesized
tttatttatcgcccaattca

SEQ ID NO: 228041 - DNA, 20 bp, Artificial Sequence
  chemically synthesized
agacagaaatgctgtgaatt

SEQ ID NO: 228042 - DNA, 20 bp, Artificial Sequence
  chemically synthesized
aagacagaaatgctgtgaat

SEQ ID NO: 228043 - DNA, 20 bp, Artificial Sequence
  chemically synthesized
tacacttctcagagtcaaga

SEQ ID NO: 228044 - DNA, 20 bp, Artificial Sequence
  chemically synthesized
agcatttctgtcttgactct

SEQ ID NO: 228045 - DNA, 20 bp, Artificial Sequence
  chemically synthesized
aatttacacttctcagagtc

SEQ ID NO: 228046 - DNA, 20 bp, Artificial Sequence
  chemically synthesized
atttctgtcttgactctgag

SEQ ID NO: 228047 - DNA, 20 bp, Artificial Sequence
  chemically synthesized
ttatgaatttacacttctca

SEQ ID NO: 228048 - DNA, 20 bp, Artificial Sequence
  chemically synthesized
tgttatgaatttacacttct

SEQ ID NO: 228049 - DNA, 20 bp, Artificial Sequence
  chemically synthesized
tgagaagtgtaaattcataa

SEQ ID NO: 228050 - DNA, 20 bp, Artificial Sequence
  chemically synthesized
gagaagtgtaaattcataac

SEQ ID NO: 228051 - DNA, 20 bp, Artificial Sequence
  chemically synthesized
gaagtgtaaattcataacag

SEQ ID NO: 228052 - DNA, 20 bp, Artificial Sequence
  chemically synthesized
aagtgtaaattcataacagg

SEQ ID NO: 228053 - DNA, 20 bp, Artificial Sequence
  chemically synthesized
aattcataacaggaggtttc

SEQ ID NO: 228054 - DNA, 20 bp, Artificial Sequence
  chemically synthesized
tcaccttctatatgtatgtc

SEQ ID NO: 228055 - DNA, 20 bp, Artificial Sequence
  chemically synthesized
gaggtttctagacatacata

SEQ ID NO: 228056 - DNA, 20 bp, Artificial Sequence
  chemically synthesized
gtttctagacatacatatag

SEQ ID NO: 228057 - DNA, 20 bp, Artificial Sequence
  chemically synthesized
tttctagacatacatataga

SEQ ID NO: 228058 - DNA, 20 bp, Artificial Sequence
  chemically synthesized
atacatatagaaggtgatgc

SEQ ID NO: 228059 - DNA, 20 bp, Artificial Sequence
  chemically synthesized
gtcaatattttttggatcac

SEQ ID NO: 228060 - DNA, 20 bp, Artificial Sequence
  chemically synthesized
tatcaattgtcaatattttt

SEQ ID NO: 228061 - DNA, 20 bp, Artificial Sequence
  chemically synthesized
aaaaatattgacaattgata

SEQ ID NO: 228062 - DNA, 20 bp, Artificial Sequence
  chemically synthesized
caattgataaagaaatgctg

SEQ ID NO: 228063 - DNA, 20 bp, Artificial Sequence
  chemically synthesized
aattgataaagaaatgctga

SEQ ID NO: 228064 - DNA, 20 bp, Artificial Sequence
  chemically synthesized
ttgataaagaaatgctgaag

SEQ ID NO: 228065 - DNA, 20 bp, Artificial Sequence
  chemically synthesized
tgataaagaaatgctgaagg

SEQ ID NO: 228066 - DNA, 20 bp, Artificial Sequence
  chemically synthesized
agtaatagtgacacctcctt

SEQ ID NO: 228067 - DNA, 20 bp, Artificial Sequence
  chemically synthesized
gaaggaggtgtcactattac

SEQ ID NO: 228068 - DNA, 20 bp, Artificial Sequence
  chemically synthesized
ggaggtgtcactattactag

SEQ ID NO: 228069 - DNA, 20 bp, Artificial Sequence
  chemically synthesized
aaaacttttacttctagtaa

SEQ ID NO: 228070 - DNA, 20 bp, Artificial Sequence
  chemically synthesized
gtcactattactagaagtaa

SEQ ID NO: 228071 - DNA, 20 bp, Artificial Sequence
  chemically synthesized
attgttaaaacttttacttc

SEQ ID NO: 228072 - DNA, 20 bp, Artificial Sequence
  chemically synthesized
ttttaacaataacaataaat

SEQ ID NO: 228073 - DNA, 20 bp, Artificial Sequence
  chemically synthesized
tttaacaataacaataaatg

SEQ ID NO: 228074 - DNA, 20 bp, Artificial Sequence
  chemically synthesized
ggacagatggacacagaaag

SEQ ID NO: 228075 - DNA, 20 bp, Artificial Sequence
  chemically synthesized
tggacagatggacacagaaa

SEQ ID NO: 228076 - DNA, 20 bp, Artificial Sequence
  chemically synthesized
tgtggacagatggacacaga

SEQ ID NO: 228077 - DNA, 20 bp, Artificial Sequence
  chemically synthesized
ggattgtggacagatggaca

SEQ ID NO: 228078 - DNA, 20 bp, Artificial Sequence
  chemically synthesized
ggcatgggattgtggacaga

SEQ ID NO: 228079 - DNA, 20 bp, Artificial Sequence
  chemically synthesized
agatggcatgggattgtgga

SEQ ID NO: 228080 - DNA, 20 bp, Artificial Sequence
  chemically synthesized
gggtagatggcatgggattg

SEQ ID NO: 228081 - DNA, 20 bp, Artificial Sequence
  chemically synthesized
agagaaggggtagatggcat

SEQ ID NO: 228082 - DNA, 20 bp, Artificial Sequence
  chemically synthesized
tagagaaggggtagatggca

SEQ ID NO: 228083 - DNA, 20 bp, Artificial Sequence
  chemically synthesized
aactctagagaaggggtaga

SEQ ID NO: 228084 - DNA, 20 bp, Artificial Sequence
  chemically synthesized
tggcaactctagagaagggg

SEQ ID NO: 228085 - DNA, 20 bp, Artificial Sequence
  chemically synthesized
catgccatctaccccttctc

SEQ ID NO: 228086 - DNA, 20 bp, Artificial Sequence
  chemically synthesized
ccatggcaactctagagaag

SEQ ID NO: 228087 - DNA, 20 bp, Artificial Sequence
  chemically synthesized
tgccatctaccccttctcta

SEQ ID NO: 228088 - DNA, 20 bp, Artificial Sequence
  chemically synthesized
tccatggcaactctagagaa

SEQ ID NO: 228089 - DNA, 20 bp, Artificial Sequence
  chemically synthesized
ttccatggcaactctagaga

SEQ ID NO: 228090 - DNA, 20 bp, Artificial Sequence
  chemically synthesized
cttccatggcaactctagag

SEQ ID NO: 228091 - DNA, 20 bp, Artificial Sequence
  chemically synthesized
tctcttccatggcaactcta

SEQ ID NO: 228092 - DNA, 20 bp, Artificial Sequence
  chemically synthesized
tttctcttccatggcaactc

SEQ ID NO: 228093 - DNA, 20 bp, Artificial Sequence
  chemically synthesized
ccccttctctagagttgcca

SEQ ID NO: 228094 - DNA, 20 bp, Artificial Sequence
  chemically synthesized
cttctctagagttgccatgg

SEQ ID NO: 228095 - DNA, 20 bp, Artificial Sequence
  chemically synthesized
tctctagagttgccatggaa

SEQ ID NO: 228096 - DNA, 20 bp, Artificial Sequence
  chemically synthesized
tagtggaactttctcttcca

SEQ ID NO: 228097 - DNA, 20 bp, Artificial Sequence
  chemically synthesized
tagagttgccatggaagaga

SEQ ID NO: 228098 - DNA, 20 bp, Artificial Sequence
  chemically synthesized
aagagaaagttccactactt

SEQ ID NO: 228099 - DNA, 20 bp, Artificial Sequence
  chemically synthesized
aaatgacgtaactgaagtag

SEQ ID NO: 228100 - DNA, 20 bp, Artificial Sequence
  chemically synthesized
tagaaatgacgtaactgaag

SEQ ID NO: 228101 - DNA, 20 bp, Artificial Sequence
  chemically synthesized
aaatagaaatgacgtaactg

SEQ ID NO: 228102 - DNA, 20 bp, Artificial Sequence
  chemically synthesized
tcagttacgtcatttctatt

SEQ ID NO: 228103 - DNA, 20 bp, Artificial Sequence
  chemically synthesized
agttacgtcatttctatttg

SEQ ID NO: 228104 - DNA, 20 bp, Artificial Sequence
  chemically synthesized
gttacgtcatttctatttgg

SEQ ID NO: 228105 - DNA, 20 bp, Artificial Sequence
  chemically synthesized
acccccatctttcctccaaa

SEQ ID NO: 228106 - DNA, 20 bp, Artificial Sequence
  chemically synthesized
cgtcatttctatttggagga

SEQ ID NO: 228107 - DNA, 20 bp, Artificial Sequence
  chemically synthesized
atttctatttggaggaaaga

SEQ ID NO: 228108 - DNA, 20 bp, Artificial Sequence
  chemically synthesized
tttctatttggaggaaagat

SEQ ID NO: 228109 - DNA, 20 bp, Artificial Sequence
  chemically synthesized
ttctatttggaggaaagatg

SEQ ID NO: 228110 - DNA, 20 bp, Artificial Sequence
  chemically synthesized
tctatttggaggaaagatgg

SEQ ID NO: 228111 - DNA, 20 bp, Artificial Sequence
  chemically synthesized
ggggtcattttttctaattg

SEQ ID NO: 228112 - DNA, 20 bp, Artificial Sequence
  chemically synthesized
ggtcattttttctaattgaa

SEQ ID NO: 228113 - DNA, 20 bp, Artificial Sequence
  chemically synthesized
atgtcacaacactcttcaat

SEQ ID NO: 228114 - DNA, 20 bp, Artificial Sequence
  chemically synthesized
aaatgaaatgaaacaatgcg

SEQ ID NO: 228115 - DNA, 20 bp, Artificial Sequence
  chemically synthesized
gaaatgaaatgaaacaatgc

SEQ ID NO: 228116 - DNA, 20 bp, Artificial Sequence
  chemically synthesized
ttataagtgggaaaaaagat

SEQ ID NO: 228117 - DNA, 20 bp, Artificial Sequence
  chemically synthesized
gcacattataagtgggaaaa

SEQ ID NO: 228118 - DNA, 20 bp, Artificial Sequence
  chemically synthesized
ataatatgcacattataagt

SEQ ID NO: 228119 - DNA, 20 bp, Artificial Sequence
  chemically synthesized
aataatatgcacattataag

SEQ ID NO: 228120 - DNA, 20 bp, Artificial Sequence
  chemically synthesized
aaaaataatatgcacattat

SEQ ID NO: 228121 - DNA, 20 bp, Artificial Sequence
  chemically synthesized
gcatattattttttgacatc

SEQ ID NO: 228122 - DNA, 20 bp, Artificial Sequence
  chemically synthesized
acatcaagataatgacaata

SEQ ID NO: 228123 - DNA, 20 bp, Artificial Sequence
  chemically synthesized
tttaaaattgagaagacagt

SEQ ID NO: 228124 - DNA, 20 bp, Artificial Sequence
  chemically synthesized
ttcttttaaaattgagaaga

SEQ ID NO: 228125 - DNA, 20 bp, Artificial Sequence
  chemically synthesized
ttttttcttttaaaattgag

SEQ ID NO: 228126 - DNA, 20 bp, Artificial Sequence
  chemically synthesized
ctattttttcttttaaaatt

SEQ ID NO: 228127 - DNA, 20 bp, Artificial Sequence
  chemically synthesized
cactgtcttctcaattttaa

SEQ ID NO: 228128 - DNA, 20 bp, Artificial Sequence
  chemically synthesized
ctcaattttaaaagaaaaaa

SEQ ID NO: 228129 - DNA, 20 bp, Artificial Sequence
  chemically synthesized
attttaaaagaaaaaatagc

SEQ ID NO: 228130 - DNA, 20 bp, Artificial Sequence
  chemically synthesized
ttttaaaagaaaaaatagca

SEQ ID NO: 228131 - DNA, 20 bp, Artificial Sequence
  chemically synthesized
aaatagcaaggaaaaatgat

SEQ ID NO: 228132 - DNA, 20 bp, Artificial Sequence
  chemically synthesized
caaggaaaaatgatcagcta

SEQ ID NO: 228133 - DNA, 20 bp, Artificial Sequence
  chemically synthesized
aaggaaaaatgatcagctaa

SEQ ID NO: 228134 - DNA, 20 bp, Artificial Sequence
  chemically synthesized
aacattaaaattaaatcctt

SEQ ID NO: 228135 - DNA, 20 bp, Artificial Sequence
  chemically synthesized
tttaattttaatgttgtgat

SEQ ID NO: 228136 - DNA, 20 bp, Artificial Sequence
  chemically synthesized
tggaaaatcatttagaaaaa

SEQ ID NO: 228137 - DNA, 20 bp, Artificial Sequence
  chemically synthesized
agattatgtggaaaatcatt

SEQ ID NO: 228138 - DNA, 20 bp, Artificial Sequence
  chemically synthesized
ttgctaaagcacagattatg

SEQ ID NO: 228139 - DNA, 20 bp, Artificial Sequence
  chemically synthesized
tttccacataatctgtgctt

SEQ ID NO: 228140 - DNA, 20 bp, Artificial Sequence
  chemically synthesized
agaagatctttgctaaagca

SEQ ID NO: 228141 - DNA, 20 bp, Artificial Sequence
  chemically synthesized
acataatctgtgctttagca

SEQ ID NO: 228142 - DNA, 20 bp, Artificial Sequence
  chemically synthesized
aaaagagaagatctttgcta

SEQ ID NO: 228143 - DNA, 20 bp, Artificial Sequence
  chemically synthesized
ggaaactagaaaaaaaagag

SEQ ID NO: 228144 - DNA, 20 bp, Artificial Sequence
  chemically synthesized
gatggaaactagaaaaaaaa

SEQ ID NO: 228145 - DNA, 20 bp, Artificial Sequence
  chemically synthesized
aagatcttctcttttttttc

SEQ ID NO: 228146 - DNA, 20 bp, Artificial Sequence
  chemically synthesized
cagatggaaactagaaaaaa

SEQ ID NO: 228147 - DNA, 20 bp, Artificial Sequence
  chemically synthesized
atctaatctcagatggaaac

SEQ ID NO: 228148 - DNA, 20 bp, Artificial Sequence
  chemically synthesized
tttttttctagtttccatct

SEQ ID NO: 228149 - DNA, 20 bp, Artificial Sequence
  chemically synthesized
gcccattatctaatctcaga

SEQ ID NO: 228150 - DNA, 20 bp, Artificial Sequence
  chemically synthesized
ttctagtttccatctgagat

SEQ ID NO: 228151 - DNA, 20 bp, Artificial Sequence
  chemically synthesized
tacagcccattatctaatct

SEQ ID NO: 228152 - DNA, 20 bp, Artificial Sequence
  chemically synthesized
ttccatctgagattagataa

SEQ ID NO: 228153 - DNA, 20 bp, Artificial Sequence
  chemically synthesized
tccatctgagattagataat

SEQ ID NO: 228154 - DNA, 20 bp, Artificial Sequence
  chemically synthesized
agcatgcacataatgggata

SEQ ID NO: 228155 - DNA, 20 bp, Artificial Sequence
  chemically synthesized
agttacagcatgcacataat

SEQ ID NO: 228156 - DNA, 20 bp, Artificial Sequence
  chemically synthesized
gagttacagcatgcacataa

SEQ ID NO: 228157 - DNA, 20 bp, Artificial Sequence
  chemically synthesized
taacaggtgtggtggagtta

SEQ ID NO: 228158 - DNA, 20 bp, Artificial Sequence
  chemically synthesized
caaaagtaacaggtgtggtg

SEQ ID NO: 228159 - DNA, 20 bp, Artificial Sequence
  chemically synthesized
gtcaaaagtaacaggtgtgg

SEQ ID NO: 228160 - DNA, 20 bp, Artificial Sequence
  chemically synthesized
tatgtcaaaagtaacaggtg

SEQ ID NO: 228161 - DNA, 20 bp, Artificial Sequence
  chemically synthesized
aaaaatatgtcaaaagtaac

SEQ ID NO: 228162 - DNA, 20 bp, Artificial Sequence
  chemically synthesized
taaaaatatgtcaaaagtaa

SEQ ID NO: 228163 - DNA, 20 bp, Artificial Sequence
  chemically synthesized
gaaatataaaaatatgtcaa

SEQ ID NO: 228164 - DNA, 20 bp, Artificial Sequence
  chemically synthesized
ctctttcttttttaattatt

SEQ ID NO: 228165 - DNA, 20 bp, Artificial Sequence
  chemically synthesized
atatttctcaataattaaaa

SEQ ID NO: 228166 - DNA, 20 bp, Artificial Sequence
  chemically synthesized
ttctcaataattaaaaaaga

SEQ ID NO: 228167 - DNA, 20 bp, Artificial Sequence
  chemically synthesized
ctcaataattaaaaaagaaa

SEQ ID NO: 228168 - DNA, 20 bp, Artificial Sequence
  chemically synthesized
aataattaaaaaagaaagag

SEQ ID NO: 228169 - DNA, 20 bp, Artificial Sequence
  chemically synthesized
ataattaaaaaagaaagagt

SEQ ID NO: 228170 - DNA, 20 bp, Artificial Sequence
  chemically synthesized
ttaaaaaagaaagagtgggc

SEQ ID NO: 228171 - DNA, 20 bp, Artificial Sequence
  chemically synthesized
taaaaaagaaagagtgggcc

SEQ ID NO: 228172 - DNA, 20 bp, Artificial Sequence
  chemically synthesized
aagaaagagtgggccaggtg

SEQ ID NO: 228173 - DNA, 20 bp, Artificial Sequence
  chemically synthesized
aaagagtgggccaggtgtgg

SEQ ID NO: 228174 - DNA, 20 bp, Artificial Sequence
  chemically synthesized
caggcatgagccaccacacc

SEQ ID NO: 228175 - DNA, 20 bp, Artificial Sequence
  chemically synthesized
agtgctgggattacaggcat

SEQ ID NO: 228176 - DNA, 20 bp, Artificial Sequence
  chemically synthesized
gtggctcatgcctgtaatcc

SEQ ID NO: 228177 - DNA, 20 bp, Artificial Sequence
  chemically synthesized
tcccaaagtgctgggattac

SEQ ID NO: 228178 - DNA, 20 bp, Artificial Sequence
  chemically synthesized
ctcccaaagtgctgggatta

SEQ ID NO: 228179 - DNA, 20 bp, Artificial Sequence
  chemically synthesized
tgcctgtaatcccagcactt

SEQ ID NO: 228180 - DNA, 20 bp, Artificial Sequence
  chemically synthesized
cctcagcctcccaaagtgct

SEQ ID NO: 228181 - DNA, 20 bp, Artificial Sequence
  chemically synthesized
gcctgtaatcccagcacttt

SEQ ID NO: 228182 - DNA, 20 bp, Artificial Sequence
  chemically synthesized
acctcagcctcccaaagtgc

SEQ ID NO: 228183 - DNA, 20 bp, Artificial Sequence
  chemically synthesized
ctgtaatcccagcactttgg

SEQ ID NO: 228184 - DNA, 20 bp, Artificial Sequence
  chemically synthesized
tgtaatcccagcactttggg

SEQ ID NO: 228185 - DNA, 20 bp, Artificial Sequence
  chemically synthesized
ccatccacctcagcctccca

SEQ ID NO: 228186 - DNA, 20 bp, Artificial Sequence
  chemically synthesized
tcccagcactttgggaggct

SEQ ID NO: 228187 - DNA, 20 bp, Artificial Sequence
  chemically synthesized
cccagcactttgggaggctg

SEQ ID NO: 228188 - DNA, 20 bp, Artificial Sequence
  chemically synthesized
agcactttgggaggctgagg

SEQ ID NO: 228189 - DNA, 20 bp, Artificial Sequence
  chemically synthesized
ctttgggaggctgaggtgga

SEQ ID NO: 228190 - DNA, 20 bp, Artificial Sequence
  chemically synthesized
ctcagatgatccatccacct

SEQ ID NO: 228191 - DNA, 20 bp, Artificial Sequence
  chemically synthesized
ctgaggtggatggatcatct

SEQ ID NO: 228192 - DNA, 20 bp, Artificial Sequence
  chemically synthesized
tgaggtggatggatcatctg

SEQ ID NO: 228193 - DNA, 20 bp, Artificial Sequence
  chemically synthesized
gtggatggatcatctgaggt

SEQ ID NO: 228194 - DNA, 20 bp, Artificial Sequence
  chemically synthesized
tggatggatcatctgaggtc

SEQ ID NO: 228195 - DNA, 20 bp, Artificial Sequence
  chemically synthesized
gatggatcatctgaggtcag

SEQ ID NO: 228196 - DNA, 20 bp, Artificial Sequence
  chemically synthesized
tggtctcgaactcctgacct

SEQ ID NO: 228197 - DNA, 20 bp, Artificial Sequence
  chemically synthesized
tcatctgaggtcaggagttc

SEQ ID NO: 228198 - DNA, 20 bp, Artificial Sequence
  chemically synthesized
tgaggtcaggagttcgagac

SEQ ID NO: 228199 - DNA, 20 bp, Artificial Sequence
  chemically synthesized
tttcaccatgttggtcaggc

SEQ ID NO: 228200 - DNA, 20 bp, Artificial Sequence
  chemically synthesized
ggggtttcaccatgttggtc

SEQ ID NO: 228201 - DNA, 20 bp, Artificial Sequence
  chemically synthesized
cgagaccagcctgaccaaca

SEQ ID NO: 228202 - DNA, 20 bp, Artificial Sequence
  chemically synthesized
cggggtttcaccatgttggt

SEQ ID NO: 228203 - DNA, 20 bp, Artificial Sequence
  chemically synthesized
gaaacggggtttcaccatgt

SEQ ID NO: 228204 - DNA, 20 bp, Artificial Sequence
  chemically synthesized
ttgtatttttggtagaaacg

SEQ ID NO: 228205 - DNA, 20 bp, Artificial Sequence
  chemically synthesized
tttgtatttttggtagaaac

SEQ ID NO: 228206 - DNA, 20 bp, Artificial Sequence
  chemically synthesized
ttttgtatttttggtagaaa

SEQ ID NO: 228207 - DNA, 20 bp, Artificial Sequence
  chemically synthesized
ttaattttttgtatttttgg

SEQ ID NO: 228208 - DNA, 20 bp, Artificial Sequence
  chemically synthesized
cagttaattttttgtatttt

SEQ ID NO: 228209 - DNA, 20 bp, Artificial Sequence
  chemically synthesized
caaaaatacaaaaaattaac

SEQ ID NO: 228210 - DNA, 20 bp, Artificial Sequence
  chemically synthesized
aaaaatacaaaaaattaact

SEQ ID NO: 228211 - DNA, 20 bp, Artificial Sequence
  chemically synthesized
aaatacaaaaaattaactgg

SEQ ID NO: 228212 - DNA, 20 bp, Artificial Sequence
  chemically synthesized
aatacaaaaaattaactggg

SEQ ID NO: 228213 - DNA, 20 bp, Artificial Sequence
  chemically synthesized
atacaaaaaattaactggga

SEQ ID NO: 228214 - DNA, 20 bp, Artificial Sequence
  chemically synthesized
tacaaaaaattaactgggag

SEQ ID NO: 228215 - DNA, 20 bp, Artificial Sequence
  chemically synthesized
aaaaaattaactgggagggg

SEQ ID NO: 228216 - DNA, 20 bp, Artificial Sequence
  chemically synthesized
caggtgtgcaccacccctcc

SEQ ID NO: 228217 - DNA, 20 bp, Artificial Sequence
  chemically synthesized
gtggtgcacacctgtaatcc

SEQ ID NO: 228218 - DNA, 20 bp, Artificial Sequence
  chemically synthesized
tcctgaatagctgggattac

SEQ ID NO: 228219 - DNA, 20 bp, Artificial Sequence
  chemically synthesized
ctcctgaatagctgggatta

SEQ ID NO: 228220 - DNA, 20 bp, Artificial Sequence
  chemically synthesized
cacctgtaatcccagctatt

SEQ ID NO: 228221 - DNA, 20 bp, Artificial Sequence
  chemically synthesized
cctcagcctcctgaatagct

SEQ ID NO: 228222 - DNA, 20 bp, Artificial Sequence
  chemically synthesized
acctgtaatcccagctattc

SEQ ID NO: 228223 - DNA, 20 bp, Artificial Sequence
  chemically synthesized
gcctcagcctcctgaatagc

SEQ ID NO: 228224 - DNA, 20 bp, Artificial Sequence
  chemically synthesized
ctgtaatcccagctattcag

SEQ ID NO: 228225 - DNA, 20 bp, Artificial Sequence
  chemically synthesized
tgtaatcccagctattcagg

SEQ ID NO: 228226 - DNA, 20 bp, Artificial Sequence
  chemically synthesized
tcctgcctcagcctcctgaa

SEQ ID NO: 228227 - DNA, 20 bp, Artificial Sequence
  chemically synthesized
tcccagctattcaggaggct

SEQ ID NO: 228228 - DNA, 20 bp, Artificial Sequence
  chemically synthesized
cccagctattcaggaggctg

SEQ ID NO: 228229 - DNA, 20 bp, Artificial Sequence
  chemically synthesized
agctattcaggaggctgagg

SEQ ID NO: 228230 - DNA, 20 bp, Artificial Sequence
  chemically synthesized
gctattcaggaggctgaggc

SEQ ID NO: 228231 - DNA, 20 bp, Artificial Sequence
  chemically synthesized
tattcaggaggctgaggcag

SEQ ID NO: 228232 - DNA, 20 bp, Artificial Sequence
  chemically synthesized
ttcaagcgattctcctgcct

SEQ ID NO: 228233 - DNA, 20 bp, Artificial Sequence
  chemically synthesized
gcaggagaatcgcttgaatc

SEQ ID NO: 228234 - DNA, 20 bp, Artificial Sequence
  chemically synthesized
caggagaatcgcttgaatct

SEQ ID NO: 228235 - DNA, 20 bp, Artificial Sequence
  chemically synthesized
aacctctgcctcccagattc

SEQ ID NO: 228236 - DNA, 20 bp, Artificial Sequence
  chemically synthesized
ggagaatcgcttgaatctgg

SEQ ID NO: 228237 - DNA, 20 bp, Artificial Sequence
  chemically synthesized
gagaatcgcttgaatctggg

SEQ ID NO: 228238 - DNA, 20 bp, Artificial Sequence
  chemically synthesized
aatcgcttgaatctgggagg

SEQ ID NO: 228239 - DNA, 20 bp, Artificial Sequence
  chemically synthesized
tcgcttgaatctgggaggca

SEQ ID NO: 228240 - DNA, 20 bp, Artificial Sequence
  chemically synthesized
tcacttcaacctctgcctcc

SEQ ID NO: 228241 - DNA, 20 bp, Artificial Sequence
  chemically synthesized
cgcttgaatctgggaggcag

SEQ ID NO: 228242 - DNA, 20 bp, Artificial Sequence
  chemically synthesized
aatctgggaggcagaggttg

SEQ ID NO: 228243 - DNA, 20 bp, Artificial Sequence
  chemically synthesized
tgggaggcagaggttgaagt

SEQ ID NO: 228244 - DNA, 20 bp, Artificial Sequence
  chemically synthesized
ggcagaggttgaagtgagtc

SEQ ID NO: 228245 - DNA, 20 bp, Artificial Sequence
  chemically synthesized
ttgcccgggttggagtacaa

SEQ ID NO: 228246 - DNA, 20 bp, Artificial Sequence
  chemically synthesized
tgtaccattgtactccaacc

SEQ ID NO: 228247 - DNA, 20 bp, Artificial Sequence
  chemically synthesized
gtaccattgtactccaaccc

SEQ ID NO: 228248 - DNA, 20 bp, Artificial Sequence
  chemically synthesized
tcgctctgttgcccgggttg

SEQ ID NO: 228249 - DNA, 20 bp, Artificial Sequence
  chemically synthesized
tttcgctctgttgcccgggt

SEQ ID NO: 228250 - DNA, 20 bp, Artificial Sequence
  chemically synthesized
ttgtactccaacccgggcaa

SEQ ID NO: 228251 - DNA, 20 bp, Artificial Sequence
  chemically synthesized
ggagtttcgctctgttgccc

SEQ ID NO: 228252 - DNA, 20 bp, Artificial Sequence
  chemically synthesized
gtactccaacccgggcaaca

SEQ ID NO: 228253 - DNA, 20 bp, Artificial Sequence
  chemically synthesized
tggagtttcgctctgttgcc

SEQ ID NO: 228254 - DNA, 20 bp, Artificial Sequence
  chemically synthesized
tattattattatttgagatg

SEQ ID NO: 228255 - DNA, 20 bp, Artificial Sequence
  chemically synthesized
attattattattatttgaga

SEQ ID NO: 228256 - DNA, 20 bp, Artificial Sequence
  chemically synthesized
aattattattattattattt

SEQ ID NO: 228257 - DNA, 20 bp, Artificial Sequence
  chemically synthesized
attattattattattactat

SEQ ID NO: 228258 - DNA, 20 bp, Artificial Sequence
  chemically synthesized
taagctaccatttattctta

SEQ ID NO: 228259 - DNA, 20 bp, Artificial Sequence
  chemically synthesized
attattactataagaataaa

SEQ ID NO: 228260 - DNA, 20 bp, Artificial Sequence
  chemically synthesized
attactataagaataaatgg

SEQ ID NO: 228261 - DNA, 20 bp, Artificial Sequence
  chemically synthesized
tactacgtttaggtaaaaat

SEQ ID NO: 228262 - DNA, 20 bp, Artificial Sequence
  chemically synthesized
agcttatttttacctaaacg

SEQ ID NO: 228263 - DNA, 20 bp, Artificial Sequence
  chemically synthesized
atgaagccactactacgttt

SEQ ID NO: 228264 - DNA, 20 bp, Artificial Sequence
  chemically synthesized
ttatttttacctaaacgtag

SEQ ID NO: 228265 - DNA, 20 bp, Artificial Sequence
  chemically synthesized
catgaagccactactacgtt

SEQ ID NO: 228266 - DNA, 20 bp, Artificial Sequence
  chemically synthesized
tttttacctaaacgtagtag

SEQ ID NO: 228267 - DNA, 20 bp, Artificial Sequence
  chemically synthesized
gtagtagtggcttcatgcca

SEQ ID NO: 228268 - DNA, 20 bp, Artificial Sequence
  chemically synthesized
agattagcaactgtggcatg

SEQ ID NO: 228269 - DNA, 20 bp, Artificial Sequence
  chemically synthesized
ggctcagagattagcaactg

SEQ ID NO: 228270 - DNA, 20 bp, Artificial Sequence
  chemically synthesized
tgccacagttgctaatctct

SEQ ID NO: 228271 - DNA, 20 bp, Artificial Sequence
  chemically synthesized
tagtgagatggctcagagat

SEQ ID NO: 228272 - DNA, 20 bp, Artificial Sequence
  chemically synthesized
aaggatagtgagatggctca

SEQ ID NO: 228273 - DNA, 20 bp, Artificial Sequence
  chemically synthesized
caaaggatagtgagatggct

SEQ ID NO: 228274 - DNA, 20 bp, Artificial Sequence
  chemically synthesized
ctgaacaaaggatagtgaga

SEQ ID NO: 228275 - DNA, 20 bp, Artificial Sequence
  chemically synthesized
caagctgaacaaaggatagt

SEQ ID NO: 228276 - DNA, 20 bp, Artificial Sequence
  chemically synthesized
ttaacaagctgaacaaagga

SEQ ID NO: 228277 - DNA, 20 bp, Artificial Sequence
  chemically synthesized
ccatctcactatcctttgtt

SEQ ID NO: 228278 - DNA, 20 bp, Artificial Sequence
  chemically synthesized
acatttaacaagctgaacaa

SEQ ID NO: 228279 - DNA, 20 bp, Artificial Sequence
  chemically synthesized
gacatttaacaagctgaaca

SEQ ID NO: 228280 - DNA, 20 bp, Artificial Sequence
  chemically synthesized
aaagtatagagacatttaac

SEQ ID NO: 228281 - DNA, 20 bp, Artificial Sequence
  chemically synthesized
gaactagttacgaaagtata

SEQ ID NO: 228282 - DNA, 20 bp, Artificial Sequence
  chemically synthesized
aggaactagttacgaaagta

SEQ ID NO: 228283 - DNA, 20 bp, Artificial Sequence
  chemically synthesized
tgtctctatactttcgtaac

SEQ ID NO: 228284 - DNA, 20 bp, Artificial Sequence
  chemically synthesized
ctatgaggaactagttacga

SEQ ID NO: 228285 - DNA, 20 bp, Artificial Sequence
  chemically synthesized
aggaatttactatgaggaac

SEQ ID NO: 228286 - DNA, 20 bp, Artificial Sequence
  chemically synthesized
ctttcgtaactagttcctca

SEQ ID NO: 228287 - DNA, 20 bp, Artificial Sequence
  chemically synthesized
ggaagaaggaatttactatg

SEQ ID NO: 228288 - DNA, 20 bp, Artificial Sequence
  chemically synthesized
tggaagaaggaatttactat

SEQ ID NO: 228289 - DNA, 20 bp, Artificial Sequence
  chemically synthesized
tcatagtaaattccttcttc

SEQ ID NO: 228290 - DNA, 20 bp, Artificial Sequence
  chemically synthesized
ggaaacactggtctggaaga

SEQ ID NO: 228291 - DNA, 20 bp, Artificial Sequence
  chemically synthesized
gggaaacactggtctggaag

SEQ ID NO: 228292 - DNA, 20 bp, Artificial Sequence
  chemically synthesized
gtaaattccttcttccagac

SEQ ID NO: 228293 - DNA, 20 bp, Artificial Sequence
  chemically synthesized
gttgggaaacactggtctgg

SEQ ID NO: 228294 - DNA, 20 bp, Artificial Sequence
  chemically synthesized
gaggttgggaaacactggtc

SEQ ID NO: 228295 - DNA, 20 bp, Artificial Sequence
  chemically synthesized
gtggtgaggttgggaaacac

SEQ ID NO: 228296 - DNA, 20 bp, Artificial Sequence
  chemically synthesized
atgtcagttgtggtgaggtt

SEQ ID NO: 228297 - DNA, 20 bp, Artificial Sequence
  chemically synthesized
aatgtcagttgtggtgaggt

SEQ ID NO: 228298 - DNA, 20 bp, Artificial Sequence
  chemically synthesized
ccaaaatgtcagttgtggtg

SEQ ID NO: 228299 - DNA, 20 bp, Artificial Sequence
  chemically synthesized
tccaaaatgtcagttgtggt

SEQ ID NO: 228300 - DNA, 20 bp, Artificial Sequence
  chemically synthesized
tctgtccaaaatgtcagttg

SEQ ID NO: 228301 - DNA, 20 bp, Artificial Sequence
  chemically synthesized
cctcaccacaactgacattt

SEQ ID NO: 228302 - DNA, 20 bp, Artificial Sequence
  chemically synthesized
aattattctgtccaaaatgt

SEQ ID NO: 228303 - DNA, 20 bp, Artificial Sequence
  chemically synthesized
accacaactgacattttgga

SEQ ID NO: 228304 - DNA, 20 bp, Artificial Sequence
  chemically synthesized
acagaataattctttgttgt

SEQ ID NO: 228305 - DNA, 20 bp, Artificial Sequence
  chemically synthesized
caggaaagtctcttacaaca

SEQ ID NO: 228306 - DNA, 20 bp, Artificial Sequence
  chemically synthesized
agaataattctttgttgtaa

SEQ ID NO: 228307 - DNA, 20 bp, Artificial Sequence
  chemically synthesized
acactgtacaggacacagga

SEQ ID NO: 228308 - DNA, 20 bp, Artificial Sequence
  chemically synthesized
gtagacactgtacaggacac

SEQ ID NO: 228309 - DNA, 20 bp, Artificial Sequence
  chemically synthesized
ggtagacactgtacaggaca

SEQ ID NO: 228310 - DNA, 20 bp, Artificial Sequence
  chemically synthesized
agactttcctgtgtcctgta

SEQ ID NO: 228311 - DNA, 20 bp, Artificial Sequence
  chemically synthesized
gatattggtagacactgtac

SEQ ID NO: 228312 - DNA, 20 bp, Artificial Sequence
  chemically synthesized
agatattggtagacactgta

SEQ ID NO: 228313 - DNA, 20 bp, Artificial Sequence
  chemically synthesized
ggtagagacagagatattgg

SEQ ID NO: 228314 - DNA, 20 bp, Artificial Sequence
  chemically synthesized
tttggtagagacagagatat

SEQ ID NO: 228315 - DNA, 20 bp, Artificial Sequence
  chemically synthesized
gtattcatttggtagagaca

SEQ ID NO: 228316 - DNA, 20 bp, Artificial Sequence
  chemically synthesized
tggtattcatttggtagaga

SEQ ID NO: 228317 - DNA, 20 bp, Artificial Sequence
  chemically synthesized
ttactggtattcatttggta

SEQ ID NO: 228318 - DNA, 20 bp, Artificial Sequence
  chemically synthesized
tgttactggtattcatttgg

SEQ ID NO: 228319 - DNA, 20 bp, Artificial Sequence
  chemically synthesized
gagtgttactggtattcatt

SEQ ID NO: 228320 - DNA, 20 bp, Artificial Sequence
  chemically synthesized
tgtctctaccaaatgaatac

SEQ ID NO: 228321 - DNA, 20 bp, Artificial Sequence
  chemically synthesized
gacaattgcaggagtgttac

SEQ ID NO: 228322 - DNA, 20 bp, Artificial Sequence
  chemically synthesized
tttggttgtgacaattgcag

SEQ ID NO: 228323 - DNA, 20 bp, Artificial Sequence
  chemically synthesized
tttttggttgtgacaattgc

SEQ ID NO: 228324 - DNA, 20 bp, Artificial Sequence
  chemically synthesized
atttttggttgtgacaattg

SEQ ID NO: 228325 - DNA, 20 bp, Artificial Sequence
  chemically synthesized
gcaatttctggagacatttt

SEQ ID NO: 228326 - DNA, 20 bp, Artificial Sequence
  chemically synthesized
gtcacaaccaaaaatgtctc

SEQ ID NO: 228327 - DNA, 20 bp, Artificial Sequence
  chemically synthesized
ggataaattggcaatttctg

SEQ ID NO: 228328 - DNA, 20 bp, Artificial Sequence
  chemically synthesized
agggataaattggcaatttc

SEQ ID NO: 228329 - DNA, 20 bp, Artificial Sequence
  chemically synthesized
ctgcacgctgagggataaat

SEQ ID NO: 228330 - DNA, 20 bp, Artificial Sequence
  chemically synthesized
gaaattgccaatttatccct

SEQ ID NO: 228331 - DNA, 20 bp, Artificial Sequence
  chemically synthesized
gtgattctgctgcacgctga

SEQ ID NO: 228332 - DNA, 20 bp, Artificial Sequence
  chemically synthesized
ccaatttatccctcagcgtg

SEQ ID NO: 228333 - DNA, 20 bp, Artificial Sequence
  chemically synthesized
ggtgattctgctgcacgctg

SEQ ID NO: 228334 - DNA, 20 bp, Artificial Sequence
  chemically synthesized
gggtgattctgctgcacgct

SEQ ID NO: 228335 - DNA, 20 bp, Artificial Sequence
  chemically synthesized
atttatccctcagcgtgcag

SEQ ID NO: 228336 - DNA, 20 bp, Artificial Sequence
  chemically synthesized
gcgtgcagcagaatcacccc

SEQ ID NO: 228337 - DNA, 20 bp, Artificial Sequence
  chemically synthesized
cagcagaatcacccctggct

SEQ ID NO: 228338 - DNA, 20 bp, Artificial Sequence
  chemically synthesized
atacagtggttctcagccag

SEQ ID NO: 228339 - DNA, 20 bp, Artificial Sequence
  chemically synthesized
aatacagtggttctcagcca

SEQ ID NO: 228340 - DNA, 20 bp, Artificial Sequence
  chemically synthesized
taatacagtggttctcagcc

SEQ ID NO: 228341 - DNA, 20 bp, Artificial Sequence
  chemically synthesized
ctaatacagtggttctcagc

SEQ ID NO: 228342 - DNA, 20 bp, Artificial Sequence
  chemically synthesized
tagtctaatacagtggttct

SEQ ID NO: 228343 - DNA, 20 bp, Artificial Sequence
  chemically synthesized
ctggctgagaaccactgtat

SEQ ID NO: 228344 - DNA, 20 bp, Artificial Sequence
  chemically synthesized
gatcttctagtctaatacag

SEQ ID NO: 228345 - DNA, 20 bp, Artificial Sequence
  chemically synthesized
aaagatcttctagtctaata

SEQ ID NO: 228346 - DNA, 20 bp, Artificial Sequence
  chemically synthesized
tgagaaccactgtattagac

SEQ ID NO: 228347 - DNA, 20 bp, Artificial Sequence
  chemically synthesized
gaaccactgtattagactag

SEQ ID NO: 228348 - DNA, 20 bp, Artificial Sequence
  chemically synthesized
tcagaaaagtaaagatcttc

SEQ ID NO: 228349 - DNA, 20 bp, Artificial Sequence
  chemically synthesized
aggagtcagtcagaaaagta

SEQ ID NO: 228350 - DNA, 20 bp, Artificial Sequence
  chemically synthesized
cacttaggagtcagtcagaa

SEQ ID NO: 228351 - DNA, 20 bp, Artificial Sequence
  chemically synthesized
tatatcacttaggagtcagt

SEQ ID NO: 228352 - DNA, 20 bp, Artificial Sequence
  chemically synthesized
tacttttctgactgactcct

SEQ ID NO: 228353 - DNA, 20 bp, Artificial Sequence
  chemically synthesized
ggagtatatcacttaggagt

SEQ ID NO: 228354 - DNA, 20 bp, Artificial Sequence
  chemically synthesized
gaaaggagtatatcacttag

SEQ ID NO: 228355 - DNA, 20 bp, Artificial Sequence
  chemically synthesized
ttgaaaggagtatatcactt

SEQ ID NO: 228356 - DNA, 20 bp, Artificial Sequence
  chemically synthesized
cttgaaaggagtatatcact

SEQ ID NO: 228357 - DNA, 20 bp, Artificial Sequence
  chemically synthesized
ctaagtgatatactcctttc

SEQ ID NO: 228358 - DNA, 20 bp, Artificial Sequence
  chemically synthesized
tataaatatgcgcttgaaag

SEQ ID NO: 228359 - DNA, 20 bp, Artificial Sequence
  chemically synthesized
ggtataaatatgcgcttgaa

SEQ ID NO: 228360 - DNA, 20 bp, Artificial Sequence
  chemically synthesized
aggtataaatatgcgcttga

SEQ ID NO: 228361 - DNA, 20 bp, Artificial Sequence
  chemically synthesized
atcttatttttacatataac

SEQ ID NO: 228362 - DNA, 20 bp, Artificial Sequence
  chemically synthesized
aatcttatttttacatataa

SEQ ID NO: 228363 - DNA, 20 bp, Artificial Sequence
  chemically synthesized
tacctgttatatgtaaaaat

SEQ ID NO: 228364 - DNA, 20 bp, Artificial Sequence
  chemically synthesized
gttatatgtaaaaataagat

SEQ ID NO: 228365 - DNA, 20 bp, Artificial Sequence
  chemically synthesized
tttatagggacacagataga

SEQ ID NO: 228366 - DNA, 20 bp, Artificial Sequence
  chemically synthesized
taattttatagggacacaga

SEQ ID NO: 228367 - DNA, 20 bp, Artificial Sequence
  chemically synthesized
tgactaattttatagggaca

SEQ ID NO: 228368 - DNA, 20 bp, Artificial Sequence
  chemically synthesized
acagtatgactaattttata

SEQ ID NO: 228369 - DNA, 20 bp, Artificial Sequence
  chemically synthesized
tatctgtgtccctataaaat

SEQ ID NO: 228370 - DNA, 20 bp, Artificial Sequence
  chemically synthesized
cacagtatgactaattttat

SEQ ID NO: 228371 - DNA, 20 bp, Artificial Sequence
  chemically synthesized
ccacagtatgactaatttta

SEQ ID NO: 228372 - DNA, 20 bp, Artificial Sequence
  chemically synthesized
ctataaaattagtcatactg

SEQ ID NO: 228373 - DNA, 20 bp, Artificial Sequence
  chemically synthesized
tagagatgtagatatcacca

SEQ ID NO: 228374 - DNA, 20 bp, Artificial Sequence
  chemically synthesized
ttactagttttatagagatg

SEQ ID NO: 228375 - DNA, 20 bp, Artificial Sequence
  chemically synthesized
ccaatattactagttttata

SEQ ID NO: 228376 - DNA, 20 bp, Artificial Sequence
  chemically synthesized
tatctacatctctataaaac

SEQ ID NO: 228377 - DNA, 20 bp, Artificial Sequence
  chemically synthesized
taccaatattactagtttta

SEQ ID NO: 228378 - DNA, 20 bp, Artificial Sequence
  chemically synthesized
ctctataaaactagtaatat

SEQ ID NO: 228379 - DNA, 20 bp, Artificial Sequence
  chemically synthesized
ttattgtttaccaatattac

SEQ ID NO: 228380 - DNA, 20 bp, Artificial Sequence
  chemically synthesized
gtaatattggtaaacaataa

SEQ ID NO: 228381 - DNA, 20 bp, Artificial Sequence
  chemically synthesized
gtaaacaataaaagcttatt

SEQ ID NO: 228382 - DNA, 20 bp, Artificial Sequence
  chemically synthesized
aatatattcatttgctgaat

SEQ ID NO: 228383 - DNA, 20 bp, Artificial Sequence
  chemically synthesized
aatgaatatattgatatgaa

SEQ ID NO: 228384 - DNA, 20 bp, Artificial Sequence
  chemically synthesized
aaaagtagatcaaggttttg

SEQ ID NO: 228385 - DNA, 20 bp, Artificial Sequence
  chemically synthesized
attttggaaaaagtagatca

SEQ ID NO: 228386 - DNA, 20 bp, Artificial Sequence
  chemically synthesized
aattttggaaaaagtagatc

SEQ ID NO: 228387 - DNA, 20 bp, Artificial Sequence
  chemically synthesized
tgtattaattttggaaaaag

SEQ ID NO: 228388 - DNA, 20 bp, Artificial Sequence
  chemically synthesized
atatgtattaattttggaaa

SEQ ID NO: 228389 - DNA, 20 bp, Artificial Sequence
  chemically synthesized
aataaaatatgtattaattt

SEQ ID NO: 228390 - DNA, 20 bp, Artificial Sequence
  chemically synthesized
aatacatattttattttgtc

SEQ ID NO: 228391 - DNA, 20 bp, Artificial Sequence
  chemically synthesized
aaaatatattaaatattagc

SEQ ID NO: 228392 - DNA, 20 bp, Artificial Sequence
  chemically synthesized
aataaaaatatattaaatat

SEQ ID NO: 228393 - DNA, 20 bp, Artificial Sequence
  chemically synthesized
ttaatatatttttatttaat

SEQ ID NO: 228394 - DNA, 20 bp, Artificial Sequence
  chemically synthesized
ttttatttaattagccatca

SEQ ID NO: 228395 - DNA, 20 bp, Artificial Sequence
  chemically synthesized
tttatttaattagccatcat

SEQ ID NO: 228396 - DNA, 20 bp, Artificial Sequence
  chemically synthesized
ttatttaattagccatcata

SEQ ID NO: 228397 - DNA, 20 bp, Artificial Sequence
  chemically synthesized
ctatttcaaaggccctatga

SEQ ID NO: 228398 - DNA, 20 bp, Artificial Sequence
  chemically synthesized
ccatcatagggcctttgaaa

SEQ ID NO: 228399 - DNA, 20 bp, Artificial Sequence
  chemically synthesized
taatgtatgaactatttcaa

SEQ ID NO: 228400 - DNA, 20 bp, Artificial Sequence
  chemically synthesized
ataatgtatgaactatttca

SEQ ID NO: 228401 - DNA, 20 bp, Artificial Sequence
  chemically synthesized
tttactcactttagtatata

SEQ ID NO: 228402 - DNA, 20 bp, Artificial Sequence
  chemically synthesized
ttttactcactttagtatat

SEQ ID NO: 228403 - DNA, 20 bp, Artificial Sequence
  chemically synthesized
ttatgatgccttatatacta

SEQ ID NO: 228404 - DNA, 20 bp, Artificial Sequence
  chemically synthesized
gatgccttatatactaaagt

SEQ ID NO: 228405 - DNA, 20 bp, Artificial Sequence
  chemically synthesized
atgtttaattttactcactt

SEQ ID NO: 228406 - DNA, 20 bp, Artificial Sequence
  chemically synthesized
aaattaaacatctgttaata

SEQ ID NO: 228407 - DNA, 20 bp, Artificial Sequence
  chemically synthesized
ttctgtgtcagccgtattaa

SEQ ID NO: 228408 - DNA, 20 bp, Artificial Sequence
  chemically synthesized
atctgttaatacggctgaca

SEQ ID NO: 228409 - DNA, 20 bp, Artificial Sequence
  chemically synthesized
ctgactgtgtttttctgtgt

SEQ ID NO: 228410 - DNA, 20 bp, Artificial Sequence
  chemically synthesized
acggctgacacagaaaaaca

SEQ ID NO: 228411 - DNA, 20 bp, Artificial Sequence
  chemically synthesized
ctgacacagaaaaacacagt

SEQ ID NO: 228412 - DNA, 20 bp, Artificial Sequence
  chemically synthesized
cacagaaaaacacagtcaga

SEQ ID NO: 228413 - DNA, 20 bp, Artificial Sequence
  chemically synthesized
acagaaaaacacagtcagat

SEQ ID NO: 228414 - DNA, 20 bp, Artificial Sequence
  chemically synthesized
gaaaaacacagtcagatagg

SEQ ID NO: 228415 - DNA, 20 bp, Artificial Sequence
  chemically synthesized
cacagtcagataggcagttt

SEQ ID NO: 228416 - DNA, 20 bp, Artificial Sequence
  chemically synthesized
cagtcagataggcagtttta

SEQ ID NO: 228417 - DNA, 20 bp, Artificial Sequence
  chemically synthesized
gtcagataggcagttttaga

SEQ ID NO: 228418 - DNA, 20 bp, Artificial Sequence
  chemically synthesized
tcagataggcagttttagag

SEQ ID NO: 228419 - DNA, 20 bp, Artificial Sequence
  chemically synthesized
agataggcagttttagagag

SEQ ID NO: 228420 - DNA, 20 bp, Artificial Sequence
  chemically synthesized
agaggagaaatatacaataa

SEQ ID NO: 228421 - DNA, 20 bp, Artificial Sequence
  chemically synthesized
taatgtgaggtgggaaaaag

SEQ ID NO: 228422 - DNA, 20 bp, Artificial Sequence
  chemically synthesized
tcataatgtgaggtgggaaa

SEQ ID NO: 228423 - DNA, 20 bp, Artificial Sequence
  chemically synthesized
ccctgttcataatgtgaggt

SEQ ID NO: 228424 - DNA, 20 bp, Artificial Sequence
  chemically synthesized
tccctgttcataatgtgagg

SEQ ID NO: 228425 - DNA, 20 bp, Artificial Sequence
  chemically synthesized
acttccctgttcataatgtg

SEQ ID NO: 228426 - DNA, 20 bp, Artificial Sequence
  chemically synthesized
aacttccctgttcataatgt

SEQ ID NO: 228427 - DNA, 20 bp, Artificial Sequence
  chemically synthesized
ttcccacctcacattatgaa

SEQ ID NO: 228428 - DNA, 20 bp, Artificial Sequence
  chemically synthesized
tcccacctcacattatgaac

SEQ ID NO: 228429 - DNA, 20 bp, Artificial Sequence
  chemically synthesized
cccacctcacattatgaaca

SEQ ID NO: 228430 - DNA, 20 bp, Artificial Sequence
  chemically synthesized
acctcacattatgaacaggg

SEQ ID NO: 228431 - DNA, 20 bp, Artificial Sequence
  chemically synthesized
tgaacagggaagtttttcct

SEQ ID NO: 228432 - DNA, 20 bp, Artificial Sequence
  chemically synthesized
ttgctgagatgttagtgcta

SEQ ID NO: 228433 - DNA, 20 bp, Artificial Sequence
  chemically synthesized
attgctgagatgttagtgct

SEQ ID NO: 228434 - DNA, 20 bp, Artificial Sequence
  chemically synthesized
tttccttagcactaacatct

SEQ ID NO: 228435 - DNA, 20 bp, Artificial Sequence
  chemically synthesized
tttacgtattgctgagatgt

SEQ ID NO: 228436 - DNA, 20 bp, Artificial Sequence
  chemically synthesized
tgatatctttacgtattgct

SEQ ID NO: 228437 - DNA, 20 bp, Artificial Sequence
  chemically synthesized
taacatctcagcaatacgta

SEQ ID NO: 228438 - DNA, 20 bp, Artificial Sequence
  chemically synthesized
gattaataaatacaaaataa

SEQ ID NO: 228439 - DNA, 20 bp, Artificial Sequence
  chemically synthesized
ggattaataaatacaaaata

SEQ ID NO: 228440 - DNA, 20 bp, Artificial Sequence
  chemically synthesized
aggattaataaatacaaaat

SEQ ID NO: 228441 - DNA, 20 bp, Artificial Sequence
  chemically synthesized
gcaacagaagcattaaaaga

SEQ ID NO: 228442 - DNA, 20 bp, Artificial Sequence
  chemically synthesized
agcaacagaagcattaaaag

SEQ ID NO: 228443 - DNA, 20 bp, Artificial Sequence
  chemically synthesized
attagcaacagaagcattaa

SEQ ID NO: 228444 - DNA, 20 bp, Artificial Sequence
  chemically synthesized
aattaaaaaattagcaacag

SEQ ID NO: 228445 - DNA, 20 bp, Artificial Sequence
  chemically synthesized
gtcaattaaaaaattagcaa

SEQ ID NO: 228446 - DNA, 20 bp, Artificial Sequence
  chemically synthesized
gacaaagtcaattaaaaaat

SEQ ID NO: 228447 - DNA, 20 bp, Artificial Sequence
  chemically synthesized
actagtattcggtaaggaca

SEQ ID NO: 228448 - DNA, 20 bp, Artificial Sequence
  chemically synthesized
cctatcactagtattcggta

SEQ ID NO: 228449 - DNA, 20 bp, Artificial Sequence
  chemically synthesized
tcctatcactagtattcggt

SEQ ID NO: 228450 - DNA, 20 bp, Artificial Sequence
  chemically synthesized
actttgtccttaccgaatac

SEQ ID NO: 228451 - DNA, 20 bp, Artificial Sequence
  chemically synthesized
taaatcctatcactagtatt

SEQ ID NO: 228452 - DNA, 20 bp, Artificial Sequence
  chemically synthesized
tccttaccgaatactagtga

SEQ ID NO: 228453 - DNA, 20 bp, Artificial Sequence
  chemically synthesized
ccttaccgaatactagtgat

SEQ ID NO: 228454 - DNA, 20 bp, Artificial Sequence
  chemically synthesized
tcctttataaatcctatcac

SEQ ID NO: 228455 - DNA, 20 bp, Artificial Sequence
  chemically synthesized
tactagtgataggatttata

SEQ ID NO: 228456 - DNA, 20 bp, Artificial Sequence
  chemically synthesized
actagtgataggatttataa

SEQ ID NO: 228457 - DNA, 20 bp, Artificial Sequence
  chemically synthesized
aggatttataaaggatgatt

SEQ ID NO: 228458 - DNA, 20 bp, Artificial Sequence
  chemically synthesized
tataaaggatgattaagtca

SEQ ID NO: 228459 - DNA, 20 bp, Artificial Sequence
  chemically synthesized
gagttcaacaaagtttaaat

SEQ ID NO: 228460 - DNA, 20 bp, Artificial Sequence
  chemically synthesized
actgttatatgagttcaaca

SEQ ID NO: 228461 - DNA, 20 bp, Artificial Sequence
  chemically synthesized
actttgttgaactcatataa

SEQ ID NO: 228462 - DNA, 20 bp, Artificial Sequence
  chemically synthesized
attgaaactcactgttatat

SEQ ID NO: 228463 - DNA, 20 bp, Artificial Sequence
  chemically synthesized
tgttgaactcatataacagt

SEQ ID NO: 228464 - DNA, 20 bp, Artificial Sequence
  chemically synthesized
agtttcaatgaaatcacact

SEQ ID NO: 228465 - DNA, 20 bp, Artificial Sequence
  chemically synthesized
aaagcattacagagaattct

SEQ ID NO: 228466 - DNA, 20 bp, Artificial Sequence
  chemically synthesized
agctggaacaaagcattaca

SEQ ID NO: 228467 - DNA, 20 bp, Artificial Sequence
  chemically synthesized
atagctggaacaaagcatta

SEQ ID NO: 228468 - DNA, 20 bp, Artificial Sequence
  chemically synthesized
ttctctgtaatgctttgttc

SEQ ID NO: 228469 - DNA, 20 bp, Artificial Sequence
  chemically synthesized
gttttcttatagctggaaca

SEQ ID NO: 228470 - DNA, 20 bp, Artificial Sequence
  chemically synthesized
taatgctttgttccagctat

SEQ ID NO: 228471 - DNA, 20 bp, Artificial Sequence
  chemically synthesized
gggtattgttttcttatagc

SEQ ID NO: 228472 - DNA, 20 bp, Artificial Sequence
  chemically synthesized
aattgggtattgttttctta

SEQ ID NO: 228473 - DNA, 20 bp, Artificial Sequence
  chemically synthesized
ttcatctcttagatgaaatt

SEQ ID NO: 228474 - DNA, 20 bp, Artificial Sequence
  chemically synthesized
tttcatctcttagatgaaat

SEQ ID NO: 228475 - DNA, 20 bp, Artificial Sequence
  chemically synthesized
aacaatacccaatttcatct

SEQ ID NO: 228476 - DNA, 20 bp, Artificial Sequence
  chemically synthesized
caatacccaatttcatctaa

SEQ ID NO: 228477 - DNA, 20 bp, Artificial Sequence
  chemically synthesized
tttctttatttttcatctct

SEQ ID NO: 228478 - DNA, 20 bp, Artificial Sequence
  chemically synthesized
catctaagagatgaaaaata

SEQ ID NO: 228479 - DNA, 20 bp, Artificial Sequence
  chemically synthesized
taagagatgaaaaataaaga

SEQ ID NO: 228480 - DNA, 20 bp, Artificial Sequence
  chemically synthesized
aaaaataaagaaagtatgtg

SEQ ID NO: 228481 - DNA, 20 bp, Artificial Sequence
  chemically synthesized
gtgaagataatcatattcaa

SEQ ID NO: 228482 - DNA, 20 bp, Artificial Sequence
  chemically synthesized
attatgataatttgcatatg

SEQ ID NO: 228483 - DNA, 20 bp, Artificial Sequence
  chemically synthesized
aaaggtctatgtacatttca

SEQ ID NO: 228484 - DNA, 20 bp, Artificial Sequence
  chemically synthesized
taaaggtctatgtacatttc

SEQ ID NO: 228485 - DNA, 20 bp, Artificial Sequence
  chemically synthesized
agacatccttgaaatgtaca

SEQ ID NO: 228486 - DNA, 20 bp, Artificial Sequence
  chemically synthesized
atgtacatagacctttattc

SEQ ID NO: 228487 - DNA, 20 bp, Artificial Sequence
  chemically synthesized
atgggaaagatcttgaataa

SEQ ID NO: 228488 - DNA, 20 bp, Artificial Sequence
  chemically synthesized
tatgggaaagatcttgaata

SEQ ID NO: 228489 - DNA, 20 bp, Artificial Sequence
  chemically synthesized
gaattctgaaatgtatggga

SEQ ID NO: 228490 - DNA, 20 bp, Artificial Sequence
  chemically synthesized
aaacgaattctgaaatgtat

SEQ ID NO: 228491 - DNA, 20 bp, Artificial Sequence
  chemically synthesized
aagatctttcccatacattt

SEQ ID NO: 228492 - DNA, 20 bp, Artificial Sequence
  chemically synthesized
aaaacgaattctgaaatgta

SEQ ID NO: 228493 - DNA, 20 bp, Artificial Sequence
  chemically synthesized
acatttgataaacatatttt

SEQ ID NO: 228494 - DNA, 20 bp, Artificial Sequence
  chemically synthesized
agtatgcattacatgttgat

SEQ ID NO: 228495 - DNA, 20 bp, Artificial Sequence
  chemically synthesized
gatcaatattacacattgtt

SEQ ID NO: 228496 - DNA, 20 bp, Artificial Sequence
  chemically synthesized
tttggtagagtagcattgat

SEQ ID NO: 228497 - DNA, 20 bp, Artificial Sequence
  chemically synthesized
tacttttaattttggtagag

SEQ ID NO: 228498 - DNA, 20 bp, Artificial Sequence
  chemically synthesized
atctacttttaattttggta

SEQ ID NO: 228499 - DNA, 20 bp, Artificial Sequence
  chemically synthesized
tgatctacttttaattttgg

SEQ ID NO: 228500 - DNA, 20 bp, Artificial Sequence
  chemically synthesized
tgctactctaccaaaattaa

SEQ ID NO: 228501 - DNA, 20 bp, Artificial Sequence
  chemically synthesized
taatgatctacttttaattt

SEQ ID NO: 228502 - DNA, 20 bp, Artificial Sequence
  chemically synthesized
tactctaccaaaattaaaag

SEQ ID NO: 228503 - DNA, 20 bp, Artificial Sequence
  chemically synthesized
aaattaaaagtagatcatta

SEQ ID NO: 228504 - DNA, 20 bp, Artificial Sequence
  chemically synthesized
tgtttttctatgacattaag

SEQ ID NO: 228505 - DNA, 20 bp, Artificial Sequence
  chemically synthesized
atgtttttctatgacattaa

SEQ ID NO: 228506 - DNA, 20 bp, Artificial Sequence
  chemically synthesized
tcaaattcctcttaatgtca

SEQ ID NO: 228507 - DNA, 20 bp, Artificial Sequence
  chemically synthesized
gaatgtttttctatgacatt

SEQ ID NO: 228508 - DNA, 20 bp, Artificial Sequence
  chemically synthesized
gaaaaacattcttctctatt

SEQ ID NO: 228509 - DNA, 20 bp, Artificial Sequence
  chemically synthesized
tgtcctttatcttaatagag

SEQ ID NO: 228510 - DNA, 20 bp, Artificial Sequence
  chemically synthesized
agttgtcctttatcttaata

SEQ ID NO: 228511 - DNA, 20 bp, Artificial Sequence
  chemically synthesized
taagttgtcctttatcttaa

SEQ ID NO: 228512 - DNA, 20 bp, Artificial Sequence
  chemically synthesized
cattcttctctattaagata

SEQ ID NO: 228513 - DNA, 20 bp, Artificial Sequence
  chemically synthesized
attcttctctattaagataa

SEQ ID NO: 228514 - DNA, 20 bp, Artificial Sequence
  chemically synthesized
atgaaaatattagatttatt

SEQ ID NO: 228515 - DNA, 20 bp, Artificial Sequence
  chemically synthesized
tatatgagctatgaaaatat

SEQ ID NO: 228516 - DNA, 20 bp, Artificial Sequence
  chemically synthesized
taataaatctaatattttca

SEQ ID NO: 228517 - DNA, 20 bp, Artificial Sequence
  chemically synthesized
atattttcatagctcatata

SEQ ID NO: 228518 - DNA, 20 bp, Artificial Sequence
  chemically synthesized
ctatctatatttctttatat

SEQ ID NO: 228519 - DNA, 20 bp, Artificial Sequence
  chemically synthesized
atagctcatataaagaaata

SEQ ID NO: 228520 - DNA, 20 bp, Artificial Sequence
  chemically synthesized
ctcatataaagaaatataga

SEQ ID NO: 228521 - DNA, 20 bp, Artificial Sequence
  chemically synthesized
tcatataaagaaatatagat

SEQ ID NO: 228522 - DNA, 20 bp, Artificial Sequence
  chemically synthesized
taaagaaatatagataggat

SEQ ID NO: 228523 - DNA, 20 bp, Artificial Sequence
  chemically synthesized
tatagataggattagacaaa

SEQ ID NO: 228524 - DNA, 20 bp, Artificial Sequence
  chemically synthesized
agataggattagacaaatag

SEQ ID NO: 228525 - DNA, 20 bp, Artificial Sequence
  chemically synthesized
gataggattagacaaataga

SEQ ID NO: 228526 - DNA, 20 bp, Artificial Sequence
  chemically synthesized
caaatagaaggaacaaatga

SEQ ID NO: 228527 - DNA, 20 bp, Artificial Sequence
  chemically synthesized
agaaggaacaaatgaaagcc

SEQ ID NO: 228528 - DNA, 20 bp, Artificial Sequence
  chemically synthesized
aggaacaaatgaaagcccag

SEQ ID NO: 228529 - DNA, 20 bp, Artificial Sequence
  chemically synthesized
caaaacactggtaatctact

SEQ ID NO: 228530 - DNA, 20 bp, Artificial Sequence
  chemically synthesized
tcaaaacactggtaatctac

SEQ ID NO: 228531 - DNA, 20 bp, Artificial Sequence
  chemically synthesized
atgaaagcccagtagattac

SEQ ID NO: 228532 - DNA, 20 bp, Artificial Sequence
  chemically synthesized
cagtagattaccagtgtttt

SEQ ID NO: 228533 - DNA, 20 bp, Artificial Sequence
  chemically synthesized
taaattaaggctcaaaacac

SEQ ID NO: 228534 - DNA, 20 bp, Artificial Sequence
  chemically synthesized
cagtgttttgagccttaatt

SEQ ID NO: 228535 - DNA, 20 bp, Artificial Sequence
  chemically synthesized
agtgttttgagccttaattt

SEQ ID NO: 228536 - DNA, 20 bp, Artificial Sequence
  chemically synthesized
tttgataacttcctaaatta

SEQ ID NO: 228537 - DNA, 20 bp, Artificial Sequence
  chemically synthesized
atttgataacttcctaaatt

SEQ ID NO: 228538 - DNA, 20 bp, Artificial Sequence
  chemically synthesized
gttttgagccttaatttagg

SEQ ID NO: 228539 - DNA, 20 bp, Artificial Sequence
  chemically synthesized
tacaattccctgaaatgaat

SEQ ID NO: 228540 - DNA, 20 bp, Artificial Sequence
  chemically synthesized
aaatatgtacttattcattt

SEQ ID NO: 228541 - DNA, 20 bp, Artificial Sequence
  chemically synthesized
aatatgtacttattcatttc

SEQ ID NO: 228542 - DNA, 20 bp, Artificial Sequence
  chemically synthesized
atatgtacttattcatttca

SEQ ID NO: 228543 - DNA, 20 bp, Artificial Sequence
  chemically synthesized
attcatttcagggaattgta

SEQ ID NO: 228544 - DNA, 20 bp, Artificial Sequence
  chemically synthesized
ttcagggaattgtatggttt

SEQ ID NO: 228545 - DNA, 20 bp, Artificial Sequence
  chemically synthesized
aattgtatggtttcagaaat

SEQ ID NO: 228546 - DNA, 20 bp, Artificial Sequence
  chemically synthesized
tatggtttcagaaataagaa

SEQ ID NO: 228547 - DNA, 20 bp, Artificial Sequence
  chemically synthesized
taagaaaagcgacaacaaaa

SEQ ID NO: 228548 - DNA, 20 bp, Artificial Sequence
  chemically synthesized
gtcaaatttgcctgaatgat

SEQ ID NO: 228549 - DNA, 20 bp, Artificial Sequence
  chemically synthesized
acaaagctgaccaatcattc

SEQ ID NO: 228550 - DNA, 20 bp, Artificial Sequence
  chemically synthesized
aacaaagctgaccaatcatt

SEQ ID NO: 228551 - DNA, 20 bp, Artificial Sequence
  chemically synthesized
aatttgcctgaatgattggt

SEQ ID NO: 228552 - DNA, 20 bp, Artificial Sequence
  chemically synthesized
tattaagtttagaatgaaca

SEQ ID NO: 228553 - DNA, 20 bp, Artificial Sequence
  chemically synthesized
tagtaaaggattattaagtt

SEQ ID NO: 228554 - DNA, 20 bp, Artificial Sequence
  chemically synthesized
tgaattagtaaaggattatt

SEQ ID NO: 228555 - DNA, 20 bp, Artificial Sequence
  chemically synthesized
agactttgctgaattagtaa

SEQ ID NO: 228556 - DNA, 20 bp, Artificial Sequence
  chemically synthesized
aagactttgctgaattagta

SEQ ID NO: 228557 - DNA, 20 bp, Artificial Sequence
  chemically synthesized
ttaataatcctttactaatt

SEQ ID NO: 228558 - DNA, 20 bp, Artificial Sequence
  chemically synthesized
tttataagactttgctgaat

SEQ ID NO: 228559 - DNA, 20 bp, Artificial Sequence
  chemically synthesized
aatcctttactaattcagca

SEQ ID NO: 228560 - DNA, 20 bp, Artificial Sequence
  chemically synthesized
tgacctgataaattttttat

SEQ ID NO: 228561 - DNA, 20 bp, Artificial Sequence
  chemically synthesized
aagtcttataaaaaatttat

SEQ ID NO: 228562 - DNA, 20 bp, Artificial Sequence
  chemically synthesized
agtcttataaaaaatttatc

SEQ ID NO: 228563 - DNA, 20 bp, Artificial Sequence
  chemically synthesized
gtcattgttcataatgatat

SEQ ID NO: 228564 - DNA, 20 bp, Artificial Sequence
  chemically synthesized
ttcataatgatatgagcaaa

SEQ ID NO: 228565 - DNA, 20 bp, Artificial Sequence
  chemically synthesized
tcataatgatatgagcaaaa

SEQ ID NO: 228566 - DNA, 20 bp, Artificial Sequence
  chemically synthesized
tgatatgagcaaaaaggaaa

SEQ ID NO: 228567 - DNA, 20 bp, Artificial Sequence
  chemically synthesized
gagcaaaaaggaaatggaaa

SEQ ID NO: 228568 - DNA, 20 bp, Artificial Sequence
  chemically synthesized
aaggaaatggaaatagataa

SEQ ID NO: 228569 - DNA, 20 bp, Artificial Sequence
  chemically synthesized
aggaaatggaaatagataac

SEQ ID NO: 228570 - DNA, 20 bp, Artificial Sequence
  chemically synthesized
atagataacaggtcatatga

SEQ ID NO: 228571 - DNA, 20 bp, Artificial Sequence
  chemically synthesized
ggatttcattcaaatgttat

SEQ ID NO: 228572 - DNA, 20 bp, Artificial Sequence
  chemically synthesized
gatttcattcaaatgttata

SEQ ID NO: 228573 - DNA, 20 bp, Artificial Sequence
  chemically synthesized
tatttgtcattcatattaca

SEQ ID NO: 228574 - DNA, 20 bp, Artificial Sequence
  chemically synthesized
acatagaaatataatttatg

SEQ ID NO: 228575 - DNA, 20 bp, Artificial Sequence
  chemically synthesized
atagaaatataatttatgta

SEQ ID NO: 228576 - DNA, 20 bp, Artificial Sequence
  chemically synthesized
tagaaatataatttatgtag

SEQ ID NO: 228577 - DNA, 20 bp, Artificial Sequence
  chemically synthesized
gaaactgatgtttttaaaaa

SEQ ID NO: 228578 - DNA, 20 bp, Artificial Sequence
  chemically synthesized
cggaaactgatgtttttaaa

SEQ ID NO: 228579 - DNA, 20 bp, Artificial Sequence
  chemically synthesized
attactctttttaaaaacat

SEQ ID NO: 228580 - DNA, 20 bp, Artificial Sequence
  chemically synthesized
ttaagattctgtggcatatt

SEQ ID NO: 228581 - DNA, 20 bp, Artificial Sequence
  chemically synthesized
atcagtttccgaatatgcca

SEQ ID NO: 228582 - DNA, 20 bp, Artificial Sequence
  chemically synthesized
tcaatcaaattaagattctg

SEQ ID NO: 228583 - DNA, 20 bp, Artificial Sequence
  chemically synthesized
gagggcatttcaatcaaatt

SEQ ID NO: 228584 - DNA, 20 bp, Artificial Sequence
  chemically synthesized
gttgagagaagggagaggga

SEQ ID NO: 228585 - DNA, 20 bp, Artificial Sequence
  chemically synthesized
tgttgagagaagggagaggg

SEQ ID NO: 228586 - DNA, 20 bp, Artificial Sequence
  chemically synthesized
ctgttgagagaagggagagg

SEQ ID NO: 228587 - DNA, 20 bp, Artificial Sequence
  chemically synthesized
cactgttgagagaagggaga

SEQ ID NO: 228588 - DNA, 20 bp, Artificial Sequence
  chemically synthesized
tcactgttgagagaagggag

SEQ ID NO: 228589 - DNA, 20 bp, Artificial Sequence
  chemically synthesized
ctcactgttgagagaaggga

SEQ ID NO: 228590 - DNA, 20 bp, Artificial Sequence
  chemically synthesized
gactcactgttgagagaagg

SEQ ID NO: 228591 - DNA, 20 bp, Artificial Sequence
  chemically synthesized
aagactcactgttgagagaa

SEQ ID NO: 228592 - DNA, 20 bp, Artificial Sequence
  chemically synthesized
taagactcactgttgagaga

SEQ ID NO: 228593 - DNA, 20 bp, Artificial Sequence
  chemically synthesized
ctccctctcccttctctcaa

SEQ ID NO: 228594 - DNA, 20 bp, Artificial Sequence
  chemically synthesized
ataagactcactgttgagag

SEQ ID NO: 228595 - DNA, 20 bp, Artificial Sequence
  chemically synthesized
aaaataagactcactgttga

SEQ ID NO: 228596 - DNA, 20 bp, Artificial Sequence
  chemically synthesized
ctctcccttctctcaacagt

SEQ ID NO: 228597 - DNA, 20 bp, Artificial Sequence
  chemically synthesized
acaaaataagactcactgtt

SEQ ID NO: 228598 - DNA, 20 bp, Artificial Sequence
  chemically synthesized
gttgctattgaacacaaaat

SEQ ID NO: 228599 - DNA, 20 bp, Artificial Sequence
  chemically synthesized
gagtcttattttgtgttcaa

SEQ ID NO: 228600 - DNA, 20 bp, Artificial Sequence
  chemically synthesized
cttcacagtctggaaacatt

SEQ ID NO: 228601 - DNA, 20 bp, Artificial Sequence
  chemically synthesized
caatagcaactaaatgtttc

SEQ ID NO: 228602 - DNA, 20 bp, Artificial Sequence
  chemically synthesized
ctaaatgtttccagactgtg

SEQ ID NO: 228603 - DNA, 20 bp, Artificial Sequence
  chemically synthesized
ttgagaaaggcttcacagtc

SEQ ID NO: 228604 - DNA, 20 bp, Artificial Sequence
  chemically synthesized
gggacttgagaaaggcttca

SEQ ID NO: 228605 - DNA, 20 bp, Artificial Sequence
  chemically synthesized
cagactgtgaagcctttctc

SEQ ID NO: 228606 - DNA, 20 bp, Artificial Sequence
  chemically synthesized
cccgttgtgggacttgagaa

SEQ ID NO: 228607 - DNA, 20 bp, Artificial Sequence
  chemically synthesized
tcccgttgtgggacttgaga

SEQ ID NO: 228608 - DNA, 20 bp, Artificial Sequence
  chemically synthesized
taactcccgttgtgggactt

SEQ ID NO: 228609 - DNA, 20 bp, Artificial Sequence
  chemically synthesized
gcctttctcaagtcccacaa

SEQ ID NO: 228610 - DNA, 20 bp, Artificial Sequence
  chemically synthesized
cctttctcaagtcccacaac

SEQ ID NO: 228611 - DNA, 20 bp, Artificial Sequence
  chemically synthesized
tttctcaagtcccacaacgg

SEQ ID NO: 228612 - DNA, 20 bp, Artificial Sequence
  chemically synthesized
acagatataactcccgttgt

SEQ ID NO: 228613 - DNA, 20 bp, Artificial Sequence
  chemically synthesized
gacagatataactcccgttg

SEQ ID NO: 228614 - DNA, 20 bp, Artificial Sequence
  chemically synthesized
tgctgtgggatcataggtga

SEQ ID NO: 228615 - DNA, 20 bp, Artificial Sequence
  chemically synthesized
agagggtgctgtgggatcat

SEQ ID NO: 228616 - DNA, 20 bp, Artificial Sequence
  chemically synthesized
aagagggtgctgtgggatca

SEQ ID NO: 228617 - DNA, 20 bp, Artificial Sequence
  chemically synthesized
atctgtcacctatgatccca

SEQ ID NO: 228618 - DNA, 20 bp, Artificial Sequence
  chemically synthesized
gaggatgaagagggtgctgt

SEQ ID NO: 228619 - DNA, 20 bp, Artificial Sequence
  chemically synthesized
agaggatgaagagggtgctg

SEQ ID NO: 228620 - DNA, 20 bp, Artificial Sequence
  chemically synthesized
tttataatagaggatgaaga

SEQ ID NO: 228621 - DNA, 20 bp, Artificial Sequence
  chemically synthesized
ttttataatagaggatgaag

SEQ ID NO: 228622 - DNA, 20 bp, Artificial Sequence
  chemically synthesized
attttataatagaggatgaa

SEQ ID NO: 228623 - DNA, 20 bp, Artificial Sequence
  chemically synthesized
gtattttataatagaggatg

SEQ ID NO: 228624 - DNA, 20 bp, Artificial Sequence
  chemically synthesized
atggtagtattttataatag

SEQ ID NO: 228625 - DNA, 20 bp, Artificial Sequence
  chemically synthesized
aatggtagtattttataata

SEQ ID NO: 228626 - DNA, 20 bp, Artificial Sequence
  chemically synthesized
aaaatggtagtattttataa

SEQ ID NO: 228627 - DNA, 20 bp, Artificial Sequence
  chemically synthesized
attataaaatactaccattt

SEQ ID NO: 228628 - DNA, 20 bp, Artificial Sequence
  chemically synthesized
agagtataagtctaaaatgg

SEQ ID NO: 228629 - DNA, 20 bp, Artificial Sequence
  chemically synthesized
tatagagtataagtctaaaa

SEQ ID NO: 228630 - DNA, 20 bp, Artificial Sequence
  chemically synthesized
atcagaacactatagagtat

SEQ ID NO: 228631 - DNA, 20 bp, Artificial Sequence
  chemically synthesized
cattttagacttatactcta

SEQ ID NO: 228632 - DNA, 20 bp, Artificial Sequence
  chemically synthesized
ggcaaaatcagaacactata

SEQ ID NO: 228633 - DNA, 20 bp, Artificial Sequence
  chemically synthesized
tgggcaaaatcagaacacta

SEQ ID NO: 228634 - DNA, 20 bp, Artificial Sequence
  chemically synthesized
gttaggcatatgggcaaaat

SEQ ID NO: 228635 - DNA, 20 bp, Artificial Sequence
  chemically synthesized
catgtgtgagttaggcatat

SEQ ID NO: 228636 - DNA, 20 bp, Artificial Sequence
  chemically synthesized
tcatgtgtgagttaggcata

SEQ ID NO: 228637 - DNA, 20 bp, Artificial Sequence
  chemically synthesized
agtgatctcatgtgtgagtt

SEQ ID NO: 228638 - DNA, 20 bp, Artificial Sequence
  chemically synthesized
tagtgatctcatgtgtgagt

SEQ ID NO: 228639 - DNA, 20 bp, Artificial Sequence
  chemically synthesized
catatgcctaactcacacat

SEQ ID NO: 228640 - DNA, 20 bp, Artificial Sequence
  chemically synthesized
gccttagtgatctcatgtgt

SEQ ID NO: 228641 - DNA, 20 bp, Artificial Sequence
  chemically synthesized
aactcacacatgagatcact

SEQ ID NO: 228642 - DNA, 20 bp, Artificial Sequence
  chemically synthesized
actcacacatgagatcacta

SEQ ID NO: 228643 - DNA, 20 bp, Artificial Sequence
  chemically synthesized
acacatgagatcactaaggc

SEQ ID NO: 228644 - DNA, 20 bp, Artificial Sequence
  chemically synthesized
taacatatggtttctggcct

SEQ ID NO: 228645 - DNA, 20 bp, Artificial Sequence
  chemically synthesized
attgaataacatatggtttc

SEQ ID NO: 228646 - DNA, 20 bp, Artificial Sequence
  chemically synthesized
acagaaaattgaataacata

SEQ ID NO: 228647 - DNA, 20 bp, Artificial Sequence
  chemically synthesized
tattcaattttctgtttatg

SEQ ID NO: 228648 - DNA, 20 bp, Artificial Sequence
  chemically synthesized
taaggaactggccacataaa

SEQ ID NO: 228649 - DNA, 20 bp, Artificial Sequence
  chemically synthesized
caattttctgtttatgtggc

SEQ ID NO: 228650 - DNA, 20 bp, Artificial Sequence
  chemically synthesized
taagcaaggttgtaaggaac

SEQ ID NO: 228651 - DNA, 20 bp, Artificial Sequence
  chemically synthesized
tttatataagcaaggttgta

SEQ ID NO: 228652 - DNA, 20 bp, Artificial Sequence
  chemically synthesized
ctttatataagcaaggttgt

SEQ ID NO: 228653 - DNA, 20 bp, Artificial Sequence
  chemically synthesized
atgtcctctttatataagca

SEQ ID NO: 228654 - DNA, 20 bp, Artificial Sequence
  chemically synthesized
aatgtcctctttatataagc

SEQ ID NO: 228655 - DNA, 20 bp, Artificial Sequence
  chemically synthesized
cttacaaccttgcttatata

SEQ ID NO: 228656 - DNA, 20 bp, Artificial Sequence
  chemically synthesized
tacaaccttgcttatataaa

SEQ ID NO: 228657 - DNA, 20 bp, Artificial Sequence
  chemically synthesized
tgtgaatgtcctctttatat

SEQ ID NO: 228658 - DNA, 20 bp, Artificial Sequence
  chemically synthesized
acaaccttgcttatataaag

SEQ ID NO: 228659 - DNA, 20 bp, Artificial Sequence
  chemically synthesized
catgtttataaaattgaatt

SEQ ID NO: 228660 - DNA, 20 bp, Artificial Sequence
  chemically synthesized
gcaaactcattaaaaatttt

SEQ ID NO: 228661 - DNA, 20 bp, Artificial Sequence
  chemically synthesized
ttcagctgaaaatttttaat

SEQ ID NO: 228662 - DNA, 20 bp, Artificial Sequence
  chemically synthesized
atttttaatgagtttgcact

SEQ ID NO: 228663 - DNA, 20 bp, Artificial Sequence
  chemically synthesized
atgagtttgcactgagaaat

SEQ ID NO: 228664 - DNA, 20 bp, Artificial Sequence
  chemically synthesized
tcaagttttatctcatttct

SEQ ID NO: 228665 - DNA, 20 bp, Artificial Sequence
  chemically synthesized
gagaaatgagataaaacttg

SEQ ID NO: 228666 - DNA, 20 bp, Artificial Sequence
  chemically synthesized
agaaatgagataaaacttga

SEQ ID NO: 228667 - DNA, 20 bp, Artificial Sequence
  chemically synthesized
gttatcatgcaaataccttc

SEQ ID NO: 228668 - DNA, 20 bp, Artificial Sequence
  chemically synthesized
gtatttgcatgataactgaa

SEQ ID NO: 228669 - DNA, 20 bp, Artificial Sequence
  chemically synthesized
tgatttgatccacagctttt

SEQ ID NO: 228670 - DNA, 20 bp, Artificial Sequence
  chemically synthesized
gcatgataactgaaaagctg

SEQ ID NO: 228671 - DNA, 20 bp, Artificial Sequence
  chemically synthesized
atgatctttgatttgatcca

SEQ ID NO: 228672 - DNA, 20 bp, Artificial Sequence
  chemically synthesized
aaaagctgtggatcaaatca

SEQ ID NO: 228673 - DNA, 20 bp, Artificial Sequence
  chemically synthesized
gtggatcaaatcaaagatca

SEQ ID NO: 228674 - DNA, 20 bp, Artificial Sequence
  chemically synthesized
ggatcaaatcaaagatcata

SEQ ID NO: 228675 - DNA, 20 bp, Artificial Sequence
  chemically synthesized
gatcaaatcaaagatcatag

SEQ ID NO: 228676 - DNA, 20 bp, Artificial Sequence
  chemically synthesized
caaagatcatagaggtatct

SEQ ID NO: 228677 - DNA, 20 bp, Artificial Sequence
  chemically synthesized
tccaaactgtggtgtattcc

SEQ ID NO: 228678 - DNA, 20 bp, Artificial Sequence
  chemically synthesized
aggtatcttggaatacacca

SEQ ID NO: 228679 - DNA, 20 bp, Artificial Sequence
  chemically synthesized
tcttggaatacaccacagtt

SEQ ID NO: 228680 - DNA, 20 bp, Artificial Sequence
  chemically synthesized
ttggaatacaccacagtttg

SEQ ID NO: 228681 - DNA, 20 bp, Artificial Sequence
  chemically synthesized
attctgatacctccaaactg

SEQ ID NO: 228682 - DNA, 20 bp, Artificial Sequence
  chemically synthesized
tggaatacaccacagtttgg

SEQ ID NO: 228683 - DNA, 20 bp, Artificial Sequence
  chemically synthesized
acaccacagtttggaggtat

SEQ ID NO: 228684 - DNA, 20 bp, Artificial Sequence
  chemically synthesized
ttggaggtatcagaatgatc

SEQ ID NO: 228685 - DNA, 20 bp, Artificial Sequence
  chemically synthesized
ggtatcagaatgatctggct

SEQ ID NO: 228686 - DNA, 20 bp, Artificial Sequence
  chemically synthesized
tactgcaacaaatacttagc

SEQ ID NO: 228687 - DNA, 20 bp, Artificial Sequence
  chemically synthesized
cctatactgcaacaaatact

SEQ ID NO: 228688 - DNA, 20 bp, Artificial Sequence
  chemically synthesized
atctggctaagtatttgttg

SEQ ID NO: 228689 - DNA, 20 bp, Artificial Sequence
  chemically synthesized
gctaagtatttgttgcagta

SEQ ID NO: 228690 - DNA, 20 bp, Artificial Sequence
  chemically synthesized
ctaagtatttgttgcagtat

SEQ ID NO: 228691 - DNA, 20 bp, Artificial Sequence
  chemically synthesized
gcagtataggattttgtttt

SEQ ID NO: 228692 - DNA, 20 bp, Artificial Sequence
  chemically synthesized
cagtataggattttgtttta

SEQ ID NO: 228693 - DNA, 20 bp, Artificial Sequence
  chemically synthesized
ccaatttttttttaattgag

SEQ ID NO: 228694 - DNA, 20 bp, Artificial Sequence
  chemically synthesized
agtccaatttttttttaatt

SEQ ID NO: 228695 - DNA, 20 bp, Artificial Sequence
  chemically synthesized
ctgctcaattaaaaaaaaat

SEQ ID NO: 228696 - DNA, 20 bp, Artificial Sequence
  chemically synthesized
cacaagctgaaaataaaatt

SEQ ID NO: 228697 - DNA, 20 bp, Artificial Sequence
  chemically synthesized
attggactcaattttatttt

SEQ ID NO: 228698 - DNA, 20 bp, Artificial Sequence
  chemically synthesized
acaccaaaatcaggtatcac

SEQ ID NO: 228699 - DNA, 20 bp, Artificial Sequence
  chemically synthesized
cagcttgtgatacctgattt

SEQ ID NO: 228700 - DNA, 20 bp, Artificial Sequence
  chemically synthesized
cacacacacacaccaaaatc

SEQ ID NO: 228701 - DNA, 20 bp, Artificial Sequence
  chemically synthesized
acacacacacacaccaaaat

SEQ ID NO: 228702 - DNA, 20 bp, Artificial Sequence
  chemically synthesized
acatgctgctgaaaatgtaa

SEQ ID NO: 228703 - DNA, 20 bp, Artificial Sequence
  chemically synthesized
tgtgtgtacttttacatttt

SEQ ID NO: 228704 - DNA, 20 bp, Artificial Sequence
  chemically synthesized
gtgtacttttacattttcag

SEQ ID NO: 228705 - DNA, 20 bp, Artificial Sequence
  chemically synthesized
tttacattttcagcagcatg

SEQ ID NO: 228706 - DNA, 20 bp, Artificial Sequence
  chemically synthesized
acattttcagcagcatgtgg

SEQ ID NO: 228707 - DNA, 20 bp, Artificial Sequence
  chemically synthesized
cattttcagcagcatgtggc

SEQ ID NO: 228708 - DNA, 20 bp, Artificial Sequence
  chemically synthesized
tttcagcagcatgtggcagg

SEQ ID NO: 228709 - DNA, 20 bp, Artificial Sequence
  chemically synthesized
gcatgtggcaggtggctttt

SEQ ID NO: 228710 - DNA, 20 bp, Artificial Sequence
  chemically synthesized
catgtggcaggtggcttttt

SEQ ID NO: 228711 - DNA, 20 bp, Artificial Sequence
  chemically synthesized
atgtggcaggtggcttttta

SEQ ID NO: 228712 - DNA, 20 bp, Artificial Sequence
  chemically synthesized
caggaatagtgtaccctaaa

SEQ ID NO: 228713 - DNA, 20 bp, Artificial Sequence
  chemically synthesized
acgtcaacaggtcacaggaa

SEQ ID NO: 228714 - DNA, 20 bp, Artificial Sequence
  chemically synthesized
ttgtcacgtcaacaggtcac

SEQ ID NO: 228715 - DNA, 20 bp, Artificial Sequence
  chemically synthesized
tttgtcacgtcaacaggtca

SEQ ID NO: 228716 - DNA, 20 bp, Artificial Sequence
  chemically synthesized
gacctctttgtcacgtcaac

SEQ ID NO: 228717 - DNA, 20 bp, Artificial Sequence
  chemically synthesized
cgacctctttgtcacgtcaa

SEQ ID NO: 228718 - DNA, 20 bp, Artificial Sequence
  chemically synthesized
tgtgacctgttgacgtgaca

SEQ ID NO: 228719 - DNA, 20 bp, Artificial Sequence
  chemically synthesized
tgacctgttgacgtgacaaa

SEQ ID NO: 228720 - DNA, 20 bp, Artificial Sequence
  chemically synthesized
gacctgttgacgtgacaaag

SEQ ID NO: 228721 - DNA, 20 bp, Artificial Sequence
  chemically synthesized
tgacgtgacaaagaggtcgt

SEQ ID NO: 228722 - DNA, 20 bp, Artificial Sequence
  chemically synthesized
acgtgacaaagaggtcgttg

SEQ ID NO: 228723 - DNA, 20 bp, Artificial Sequence
  chemically synthesized
agaaaaaaatcactcctcat

SEQ ID NO: 228724 - DNA, 20 bp, Artificial Sequence
  chemically synthesized
gatactactgtactcatgag

SEQ ID NO: 228725 - DNA, 20 bp, Artificial Sequence
  chemically synthesized
gggatactactgtactcatg

SEQ ID NO: 228726 - DNA, 20 bp, Artificial Sequence
  chemically synthesized
aaaatcactcctcatgagta

SEQ ID NO: 228727 - DNA, 20 bp, Artificial Sequence
  chemically synthesized
tgggatactactgtactcat

SEQ ID NO: 228728 - DNA, 20 bp, Artificial Sequence
  chemically synthesized
atcactcctcatgagtacag

SEQ ID NO: 228729 - DNA, 20 bp, Artificial Sequence
  chemically synthesized
catgagtacagtagtatccc

SEQ ID NO: 228730 - DNA, 20 bp, Artificial Sequence
  chemically synthesized
tgagtacagtagtatcccaa

SEQ ID NO: 228731 - DNA, 20 bp, Artificial Sequence
  chemically synthesized
agtacagtagtatcccaaga

SEQ ID NO: 228732 - DNA, 20 bp, Artificial Sequence
  chemically synthesized
gtacagtagtatcccaagag

SEQ ID NO: 228733 - DNA, 20 bp, Artificial Sequence
  chemically synthesized
gagtgtgatctgcctctctt

SEQ ID NO: 228734 - DNA, 20 bp, Artificial Sequence
  chemically synthesized
cagtagtatcccaagagagg

SEQ ID NO: 228735 - DNA, 20 bp, Artificial Sequence
  chemically synthesized
tgagtgtgatctgcctctct

SEQ ID NO: 228736 - DNA, 20 bp, Artificial Sequence
  chemically synthesized
ttgattcttatgtcatgtgt

SEQ ID NO: 228737 - DNA, 20 bp, Artificial Sequence
  chemically synthesized
atcacactcacacatgacat

SEQ ID NO: 228738 - DNA, 20 bp, Artificial Sequence
  chemically synthesized
tcacacatgacataagaatc

SEQ ID NO: 228739 - DNA, 20 bp, Artificial Sequence
  chemically synthesized
aaaacacctctatgattttt

SEQ ID NO: 228740 - DNA, 20 bp, Artificial Sequence
  chemically synthesized
caagttttactgaaaaatca

SEQ ID NO: 228741 - DNA, 20 bp, Artificial Sequence
  chemically synthesized
agttttactgaaaaatcata

SEQ ID NO: 228742 - DNA, 20 bp, Artificial Sequence
  chemically synthesized
gttttactgaaaaatcatag

SEQ ID NO: 228743 - DNA, 20 bp, Artificial Sequence
  chemically synthesized
aaaaatcatagaggtgtttt

SEQ ID NO: 228744 - DNA, 20 bp, Artificial Sequence
  chemically synthesized
tcatagaggtgtttttagta

SEQ ID NO: 228745 - DNA, 20 bp, Artificial Sequence
  chemically synthesized
gtgtttttagtaaagcaatt

SEQ ID NO: 228746 - DNA, 20 bp, Artificial Sequence
  chemically synthesized
catcagaaatatataagaaa

SEQ ID NO: 228747 - DNA, 20 bp, Artificial Sequence
  chemically synthesized
aggaagcatcagaaatatat

SEQ ID NO: 228748 - DNA, 20 bp, Artificial Sequence
  chemically synthesized
taataatttttaggaagcat

SEQ ID NO: 228749 - DNA, 20 bp, Artificial Sequence
  chemically synthesized
tcataataataatttttagg

SEQ ID NO: 228750 - DNA, 20 bp, Artificial Sequence
  chemically synthesized
taatcataataataattttt

SEQ ID NO: 228751 - DNA, 20 bp, Artificial Sequence
  chemically synthesized
ataatcataataataatttt

SEQ ID NO: 228752 - DNA, 20 bp, Artificial Sequence
  chemically synthesized
ttatgattatgattattatt

SEQ ID NO: 228753 - DNA, 20 bp, Artificial Sequence
  chemically synthesized
gattatgattattattgaga

SEQ ID NO: 228754 - DNA, 20 bp, Artificial Sequence
  chemically synthesized
ttatgattattattgagacg

SEQ ID NO: 228755 - DNA, 20 bp, Artificial Sequence
  chemically synthesized
attattattgagacggagtc

SEQ ID NO: 228756 - DNA, 20 bp, Artificial Sequence
  chemically synthesized
ctccagcctggtgacagagc

SEQ ID NO: 228757 - DNA, 20 bp, Artificial Sequence
  chemically synthesized
acggagtctagctctgtcac

SEQ ID NO: 228758 - DNA, 20 bp, Artificial Sequence
  chemically synthesized
cggagtctagctctgtcacc

SEQ ID NO: 228759 - DNA, 20 bp, Artificial Sequence
  chemically synthesized
tgcactccagcctggtgaca

SEQ ID NO: 228760 - DNA, 20 bp, Artificial Sequence
  chemically synthesized
actgcactccagcctggtga

SEQ ID NO: 228761 - DNA, 20 bp, Artificial Sequence
  chemically synthesized
gtctagctctgtcaccaggc

SEQ ID NO: 228762 - DNA, 20 bp, Artificial Sequence
  chemically synthesized
ctagctctgtcaccaggctg

SEQ ID NO: 228763 - DNA, 20 bp, Artificial Sequence
  chemically synthesized
cgcgccactgcactccagcc

SEQ ID NO: 228764 - DNA, 20 bp, Artificial Sequence
  chemically synthesized
tctgtcaccaggctggagtg

SEQ ID NO: 228765 - DNA, 20 bp, Artificial Sequence
  chemically synthesized
gagatcgcgccactgcactc

SEQ ID NO: 228766 - DNA, 20 bp, Artificial Sequence
  chemically synthesized
gtcaccaggctggagtgcag

SEQ ID NO: 228767 - DNA, 20 bp, Artificial Sequence
  chemically synthesized
ggagtgcagtggcgcgatct

SEQ ID NO: 228768 - DNA, 20 bp, Artificial Sequence
  chemically synthesized
ggcggaggttgcagtgagcc

SEQ ID NO: 228769 - DNA, 20 bp, Artificial Sequence
  chemically synthesized
tgggaggcggaggttgcagt

SEQ ID NO: 228770 - DNA, 20 bp, Artificial Sequence
  chemically synthesized
aacctgggaggcggaggttg

SEQ ID NO: 228771 - DNA, 20 bp, Artificial Sequence
  chemically synthesized
cacttgaacctgggaggcgg

SEQ ID NO: 228772 - DNA, 20 bp, Artificial Sequence
  chemically synthesized
tcactgcaacctccgcctcc

SEQ ID NO: 228773 - DNA, 20 bp, Artificial Sequence
  chemically synthesized
tcacttgaacctgggaggcg

SEQ ID NO: 228774 - DNA, 20 bp, Artificial Sequence
  chemically synthesized
cactgcaacctccgcctccc

SEQ ID NO: 228775 - DNA, 20 bp, Artificial Sequence
  chemically synthesized
aatcacttgaacctgggagg

SEQ ID NO: 228776 - DNA, 20 bp, Artificial Sequence
  chemically synthesized
gagaatcacttgaacctggg

SEQ ID NO: 228777 - DNA, 20 bp, Artificial Sequence
  chemically synthesized
ggagaatcacttgaacctgg

SEQ ID NO: 228778 - DNA, 20 bp, Artificial Sequence
  chemically synthesized
aacctccgcctcccaggttc

SEQ ID NO: 228779 - DNA, 20 bp, Artificial Sequence
  chemically synthesized
caggagaatcacttgaacct

SEQ ID NO: 228780 - DNA, 20 bp, Artificial Sequence
  chemically synthesized
gcaggagaatcacttgaacc

SEQ ID NO: 228781 - DNA, 20 bp, Artificial Sequence
  chemically synthesized
ttcaagtgattctcctgcct

SEQ ID NO: 228782 - DNA, 20 bp, Artificial Sequence
  chemically synthesized
tactcgggaggctgaggcag

SEQ ID NO: 228783 - DNA, 20 bp, Artificial Sequence
  chemically synthesized
gctactcgggaggctgaggc

SEQ ID NO: 228784 - DNA, 20 bp, Artificial Sequence
  chemically synthesized
agctactcgggaggctgagg

SEQ ID NO: 228785 - DNA, 20 bp, Artificial Sequence
  chemically synthesized
cccagctactcgggaggctg

SEQ ID NO: 228786 - DNA, 20 bp, Artificial Sequence
  chemically synthesized
tcccagctactcgggaggct

SEQ ID NO: 228787 - DNA, 20 bp, Artificial Sequence
  chemically synthesized
ttctcctgcctcagcctccc

SEQ ID NO: 228788 - DNA, 20 bp, Artificial Sequence
  chemically synthesized
tcctgcctcagcctcccgag

SEQ ID NO: 228789 - DNA, 20 bp, Artificial Sequence
  chemically synthesized
tgtaatcccagctactcggg

SEQ ID NO: 228790 - DNA, 20 bp, Artificial Sequence
  chemically synthesized
ctgtaatcccagctactcgg

SEQ ID NO: 228791 - DNA, 20 bp, Artificial Sequence
  chemically synthesized
gcctcagcctcccgagtagc

SEQ ID NO: 228792 - DNA, 20 bp, Artificial Sequence
  chemically synthesized
gcctgtaatcccagctactc

SEQ ID NO: 228793 - DNA, 20 bp, Artificial Sequence
  chemically synthesized
cctcagcctcccgagtagct

SEQ ID NO: 228794 - DNA, 20 bp, Artificial Sequence
  chemically synthesized
tgcctgtaatcccagctact

SEQ ID NO: 228795 - DNA, 20 bp, Artificial Sequence
  chemically synthesized
ctcccgagtagctgggatta

SEQ ID NO: 228796 - DNA, 20 bp, Artificial Sequence
  chemically synthesized
tcccgagtagctgggattac

SEQ ID NO: 228797 - DNA, 20 bp, Artificial Sequence
  chemically synthesized
gcagcgcatgcctgtaatcc

SEQ ID NO: 228798 - DNA, 20 bp, Artificial Sequence
  chemically synthesized
caggcatgcgctgccatgca

SEQ ID NO: 228799 - DNA, 20 bp, Artificial Sequence
  chemically synthesized
caaaaattagccgtgcatgg

SEQ ID NO: 228800 - DNA, 20 bp, Artificial Sequence
  chemically synthesized
atacaaaaattagccgtgca

SEQ ID NO: 228801 - DNA, 20 bp, Artificial Sequence
  chemically synthesized
tctactaaaaatacaaaaat

SEQ ID NO: 228802 - DNA, 20 bp, Artificial Sequence
  chemically synthesized
acggctaatttttgtatttt

SEQ ID NO: 228803 - DNA, 20 bp, Artificial Sequence
  chemically synthesized
gctaatttttgtatttttag

SEQ ID NO: 228804 - DNA, 20 bp, Artificial Sequence
  chemically synthesized
taatttttgtatttttagta

SEQ ID NO: 228805 - DNA, 20 bp, Artificial Sequence
  chemically synthesized
ttttgtatttttagtagaga

SEQ ID NO: 228806 - DNA, 20 bp, Artificial Sequence
  chemically synthesized
ttgtatttttagtagagacg

SEQ ID NO: 228807 - DNA, 20 bp, Artificial Sequence
  chemically synthesized
gagacggagtttcaccgtgt

SEQ ID NO: 228808 - DNA, 20 bp, Artificial Sequence
  chemically synthesized
cggagtttcaccgtgttagc

SEQ ID NO: 228809 - DNA, 20 bp, Artificial Sequence
  chemically synthesized
cgagaccatcctggctaaca

SEQ ID NO: 228810 - DNA, 20 bp, Artificial Sequence
  chemically synthesized
ggagtttcaccgtgttagcc

SEQ ID NO: 228811 - DNA, 20 bp, Artificial Sequence
  chemically synthesized
tttcaccgtgttagccagga

SEQ ID NO: 228812 - DNA, 20 bp, Artificial Sequence
  chemically synthesized
tcaggaaatcgagaccatcc

SEQ ID NO: 228813 - DNA, 20 bp, Artificial Sequence
  chemically synthesized
gatcatgaggtcaggaaatc

SEQ ID NO: 228814 - DNA, 20 bp, Artificial Sequence
  chemically synthesized
ggtgggcagatcatgaggtc

SEQ ID NO: 228815 - DNA, 20 bp, Artificial Sequence
  chemically synthesized
aggtgggcagatcatgaggt

SEQ ID NO: 228816 - DNA, 20 bp, Artificial Sequence
  chemically synthesized
gccgaggtgggcagatcatg

SEQ ID NO: 228817 - DNA, 20 bp, Artificial Sequence
  chemically synthesized
ggccgaggtgggcagatcat

SEQ ID NO: 228818 - DNA, 20 bp, Artificial Sequence
  chemically synthesized
acctcatgatctgcccacct

SEQ ID NO: 228819 - DNA, 20 bp, Artificial Sequence
  chemically synthesized
ctttgggaggccgaggtggg

SEQ ID NO: 228820 - DNA, 20 bp, Artificial Sequence
  chemically synthesized
gcactttgggaggccgaggt

SEQ ID NO: 228821 - DNA, 20 bp, Artificial Sequence
  chemically synthesized
agcactttgggaggccgagg

SEQ ID NO: 228822 - DNA, 20 bp, Artificial Sequence
  chemically synthesized
cccagcactttgggaggccg

SEQ ID NO: 228823 - DNA, 20 bp, Artificial Sequence
  chemically synthesized
tcccagcactttgggaggcc

SEQ ID NO: 228824 - DNA, 20 bp, Artificial Sequence
  chemically synthesized
ctgcccacctcggcctccca

SEQ ID NO: 228825 - DNA, 20 bp, Artificial Sequence
  chemically synthesized
tgtaatcccagcactttggg

SEQ ID NO: 228826 - DNA, 20 bp, Artificial Sequence
  chemically synthesized
ctgtaatcccagcactttgg

SEQ ID NO: 228827 - DNA, 20 bp, Artificial Sequence
  chemically synthesized
acctcggcctcccaaagtgc

SEQ ID NO: 228828 - DNA, 20 bp, Artificial Sequence
  chemically synthesized
acctgtaatcccagcacttt

SEQ ID NO: 228829 - DNA, 20 bp, Artificial Sequence
  chemically synthesized
cctcggcctcccaaagtgct

SEQ ID NO: 228830 - DNA, 20 bp, Artificial Sequence
  chemically synthesized
cacctgtaatcccagcactt

SEQ ID NO: 228831 - DNA, 20 bp, Artificial Sequence
  chemically synthesized
ctcccaaagtgctgggatta

SEQ ID NO: 228832 - DNA, 20 bp, Artificial Sequence
  chemically synthesized
tcccaaagtgctgggattac

SEQ ID NO: 228833 - DNA, 20 bp, Artificial Sequence
  chemically synthesized
gtggctcacacctgtaatcc

SEQ ID NO: 228834 - DNA, 20 bp, Artificial Sequence
  chemically synthesized
agtgctgggattacaggtgt

SEQ ID NO: 228835 - DNA, 20 bp, Artificial Sequence
  chemically synthesized
caggtgtgagccaccgcaac

SEQ ID NO: 228836 - DNA, 20 bp, Artificial Sequence
  chemically synthesized
ttttaggaggctggttgcgg

SEQ ID NO: 228837 - DNA, 20 bp, Artificial Sequence
  chemically synthesized
aatttttaggaggctggttg

SEQ ID NO: 228838 - DNA, 20 bp, Artificial Sequence
  chemically synthesized
taagataatttttaggaggc

SEQ ID NO: 228839 - DNA, 20 bp, Artificial Sequence
  chemically synthesized
tttataagataatttttagg

SEQ ID NO: 228840 - DNA, 20 bp, Artificial Sequence
  chemically synthesized
atttataagataatttttag

SEQ ID NO: 228841 - DNA, 20 bp, Artificial Sequence
  chemically synthesized
ttatttataagataattttt

SEQ ID NO: 228842 - DNA, 20 bp, Artificial Sequence
  chemically synthesized
cttatttataagataatttt

SEQ ID NO: 228843 - DNA, 20 bp, Artificial Sequence
  chemically synthesized
ctaaaaattatcttataaat

SEQ ID NO: 228844 - DNA, 20 bp, Artificial Sequence
  chemically synthesized
aattgattagtcttatttat

SEQ ID NO: 228845 - DNA, 20 bp, Artificial Sequence
  chemically synthesized
tttaaaatattttaattgat

SEQ ID NO: 228846 - DNA, 20 bp, Artificial Sequence
  chemically synthesized
taatcaattaaaatatttta

SEQ ID NO: 228847 - DNA, 20 bp, Artificial Sequence
  chemically synthesized
atatttggaagtatagttag

SEQ ID NO: 228848 - DNA, 20 bp, Artificial Sequence
  chemically synthesized
taaatatttggaagtatagt

SEQ ID NO: 228849 - DNA, 20 bp, Artificial Sequence
  chemically synthesized
catataaatatttggaagta

SEQ ID NO: 228850 - DNA, 20 bp, Artificial Sequence
  chemically synthesized
gcatacatataaatatttgg

SEQ ID NO: 228851 - DNA, 20 bp, Artificial Sequence
  chemically synthesized
aaagcatacatataaatatt

SEQ ID NO: 228852 - DNA, 20 bp, Artificial Sequence
  chemically synthesized
aaatatttatatgtatgctt

SEQ ID NO: 228853 - DNA, 20 bp, Artificial Sequence
  chemically synthesized
aatatttatatgtatgcttt

SEQ ID NO: 228854 - DNA, 20 bp, Artificial Sequence
  chemically synthesized
cttaaaaactcaatttccta

SEQ ID NO: 228855 - DNA, 20 bp, Artificial Sequence
  chemically synthesized
tatgtatgctttaggaaatt

SEQ ID NO: 228856 - DNA, 20 bp, Artificial Sequence
  chemically synthesized
ctttaggaaattgagttttt

SEQ ID NO: 228857 - DNA, 20 bp, Artificial Sequence
  chemically synthesized
agtttttaagtgaaatatta

SEQ ID NO: 228858 - DNA, 20 bp, Artificial Sequence
  chemically synthesized
taatcaggtaacaggaaaat

SEQ ID NO: 228859 - DNA, 20 bp, Artificial Sequence
  chemically synthesized
atgaacagtaatcaggtaac

SEQ ID NO: 228860 - DNA, 20 bp, Artificial Sequence
  chemically synthesized
aatgaacagtaatcaggtaa

SEQ ID NO: 228861 - DNA, 20 bp, Artificial Sequence
  chemically synthesized
aggttgaatgaacagtaatc

SEQ ID NO: 228862 - DNA, 20 bp, Artificial Sequence
  chemically synthesized
caggttgaatgaacagtaat

SEQ ID NO: 228863 - DNA, 20 bp, Artificial Sequence
  chemically synthesized
acagcaacaggttgaatgaa

SEQ ID NO: 228864 - DNA, 20 bp, Artificial Sequence
  chemically synthesized
aaatggaacaatacagcaac

SEQ ID NO: 228865 - DNA, 20 bp, Artificial Sequence
  chemically synthesized
aaaatggaacaatacagcaa

SEQ ID NO: 228866 - DNA, 20 bp, Artificial Sequence
  chemically synthesized
catataaaaatggaacaata

SEQ ID NO: 228867 - DNA, 20 bp, Artificial Sequence
  chemically synthesized
tatggtatatcatataaaaa

SEQ ID NO: 228868 - DNA, 20 bp, Artificial Sequence
  chemically synthesized
atttttatatgatataccat

SEQ ID NO: 228869 - DNA, 20 bp, Artificial Sequence
  chemically synthesized
ttttatatgatataccataa

SEQ ID NO: 228870 - DNA, 20 bp, Artificial Sequence
  chemically synthesized
tttatatgatataccataag

SEQ ID NO: 228871 - DNA, 20 bp, Artificial Sequence
  chemically synthesized
tattcacacatagcctctta

SEQ ID NO: 228872 - DNA, 20 bp, Artificial Sequence
  chemically synthesized
tatattgccttattcacaca

SEQ ID NO: 228873 - DNA, 20 bp, Artificial Sequence
  chemically synthesized
ataagaggctatgtgtgaat

SEQ ID NO: 228874 - DNA, 20 bp, Artificial Sequence
  chemically synthesized
taagaggctatgtgtgaata

SEQ ID NO: 228875 - DNA, 20 bp, Artificial Sequence
  chemically synthesized
ataaggcaatatacatgatg

SEQ ID NO: 228876 - DNA, 20 bp, Artificial Sequence
  chemically synthesized
accttgaaaatgtgaataca

SEQ ID NO: 228877 - DNA, 20 bp, Artificial Sequence
  chemically synthesized
tactttgtattcacattttc

SEQ ID NO: 228878 - DNA, 20 bp, Artificial Sequence
  chemically synthesized
actttgtattcacattttca

SEQ ID NO: 228879 - DNA, 20 bp, Artificial Sequence
  chemically synthesized
attcacattttcaaggtgta

SEQ ID NO: 228880 - DNA, 20 bp, Artificial Sequence
  chemically synthesized
gtgtatagaaaatttttaaa

SEQ ID NO: 228881 - DNA, 20 bp, Artificial Sequence
  chemically synthesized
atttttaaaaagatgttaaa

SEQ ID NO: 228882 - DNA, 20 bp, Artificial Sequence
  chemically synthesized
tttttaaaaagatgttaaaa

SEQ ID NO: 228883 - DNA, 20 bp, Artificial Sequence
  chemically synthesized
aagatgttaaaaaggtaaat

SEQ ID NO: 228884 - DNA, 20 bp, Artificial Sequence
  chemically synthesized
aagttcattgttaattgtta

SEQ ID NO: 228885 - DNA, 20 bp, Artificial Sequence
  chemically synthesized
tcattgttaattgttataga

SEQ ID NO: 228886 - DNA, 20 bp, Artificial Sequence
  chemically synthesized
attgttaattgttatagaaa

SEQ ID NO: 228887 - DNA, 20 bp, Artificial Sequence
  chemically synthesized
gttaattgttatagaaagag

SEQ ID NO: 228888 - DNA, 20 bp, Artificial Sequence
  chemically synthesized
ttgttatagaaagagtagac

SEQ ID NO: 228889 - DNA, 20 bp, Artificial Sequence
  chemically synthesized
gttatagaaagagtagacaa

SEQ ID NO: 228890 - DNA, 20 bp, Artificial Sequence
  chemically synthesized
tatagaaagagtagacaaga

SEQ ID NO: 228891 - DNA, 20 bp, Artificial Sequence
  chemically synthesized
agaaagagtagacaagagag

SEQ ID NO: 228892 - DNA, 20 bp, Artificial Sequence
  chemically synthesized
agtagacaagagagaagact

SEQ ID NO: 228893 - DNA, 20 bp, Artificial Sequence
  chemically synthesized
tttttgccgaaatgtagact

SEQ ID NO: 228894 - DNA, 20 bp, Artificial Sequence
  chemically synthesized
agaagactgagtctacattt

SEQ ID NO: 228895 - DNA, 20 bp, Artificial Sequence
  chemically synthesized
gaagactttttgccgaaatg

SEQ ID NO: 228896 - DNA, 20 bp, Artificial Sequence
  chemically synthesized
tgagtctacatttcggcaaa

SEQ ID NO: 228897 - DNA, 20 bp, Artificial Sequence
  chemically synthesized
ccaattttctaatttttatg

SEQ ID NO: 228898 - DNA, 20 bp, Artificial Sequence
  chemically synthesized
caaaaagtcttcataaaaat

SEQ ID NO: 228899 - DNA, 20 bp, Artificial Sequence
  chemically synthesized
cttcataaaaattagaaaat

SEQ ID NO: 228900 - DNA, 20 bp, Artificial Sequence
  chemically synthesized
ataaaaattagaaaattggt

SEQ ID NO: 228901 - DNA, 20 bp, Artificial Sequence
  chemically synthesized
aaattagaaaattggtgagt

SEQ ID NO: 228902 - DNA, 20 bp, Artificial Sequence
  chemically synthesized
aattggtgagtaagtcaatg

SEQ ID NO: 228903 - DNA, 20 bp, Artificial Sequence
  chemically synthesized
aagtcaatgaagcattgtca

SEQ ID NO: 228904 - DNA, 20 bp, Artificial Sequence
  chemically synthesized
attgtcaaagtcacaaacaa

SEQ ID NO: 228905 - DNA, 20 bp, Artificial Sequence
  chemically synthesized
ttgtcaaagtcacaaacaaa

SEQ ID NO: 228906 - DNA, 20 bp, Artificial Sequence
  chemically synthesized
aggggaattataataatgtg

SEQ ID NO: 228907 - DNA, 20 bp, Artificial Sequence
  chemically synthesized
acaggggaattataataatg

SEQ ID NO: 228908 - DNA, 20 bp, Artificial Sequence
  chemically synthesized
cattattataattcccctgt

SEQ ID NO: 228909 - DNA, 20 bp, Artificial Sequence
  chemically synthesized
ccatgtctactttctgacag

SEQ ID NO: 228910 - DNA, 20 bp, Artificial Sequence
  chemically synthesized
attataattcccctgtcaga

SEQ ID NO: 228911 - DNA, 20 bp, Artificial Sequence
  chemically synthesized
gccatgtctactttctgaca

SEQ ID NO: 228912 - DNA, 20 bp, Artificial Sequence
  chemically synthesized
tgccatgtctactttctgac

SEQ ID NO: 228913 - DNA, 20 bp, Artificial Sequence
  chemically synthesized
ttgccatgtctactttctga

SEQ ID NO: 228914 - DNA, 20 bp, Artificial Sequence
  chemically synthesized
ataattcccctgtcagaaag

SEQ ID NO: 228915 - DNA, 20 bp, Artificial Sequence
  chemically synthesized
cccctgtcagaaagtagaca

SEQ ID NO: 228916 - DNA, 20 bp, Artificial Sequence
  chemically synthesized
ttttcagaggttgaagtcat

SEQ ID NO: 228917 - DNA, 20 bp, Artificial Sequence
  chemically synthesized
atcctcattttcagaggttg

SEQ ID NO: 228918 - DNA, 20 bp, Artificial Sequence
  chemically synthesized
tctgtgatcctcattttcag

SEQ ID NO: 228919 - DNA, 20 bp, Artificial Sequence
  chemically synthesized
tgacttcaacctctgaaaat

SEQ ID NO: 228920 - DNA, 20 bp, Artificial Sequence
  chemically synthesized
ctctgtgatcctcattttca

SEQ ID NO: 228921 - DNA, 20 bp, Artificial Sequence
  chemically synthesized
gacttcaacctctgaaaatg

SEQ ID NO: 228922 - DNA, 20 bp, Artificial Sequence
  chemically synthesized
tcctctgtgatcctcatttt

SEQ ID NO: 228923 - DNA, 20 bp, Artificial Sequence
  chemically synthesized
acctctgaaaatgaggatca

SEQ ID NO: 228924 - DNA, 20 bp, Artificial Sequence
  chemically synthesized
ctctgaaaatgaggatcaca

SEQ ID NO: 228925 - DNA, 20 bp, Artificial Sequence
  chemically synthesized
tctgaaaatgaggatcacag

SEQ ID NO: 228926 - DNA, 20 bp, Artificial Sequence
  chemically synthesized
tgaaaatgaggatcacagag

SEQ ID NO: 228927 - DNA, 20 bp, Artificial Sequence
  chemically synthesized
gaggatcacagaggagaaat

SEQ ID NO: 228928 - DNA, 20 bp, Artificial Sequence
  chemically synthesized
tcacagaggagaaataagac

SEQ ID NO: 228929 - DNA, 20 bp, Artificial Sequence
  chemically synthesized
ggagaaataagactggacaa

SEQ ID NO: 228930 - DNA, 20 bp, Artificial Sequence
  chemically synthesized
gagaaataagactggacaac

SEQ ID NO: 228931 - DNA, 20 bp, Artificial Sequence
  chemically synthesized
acagctggaagcctgttgtc

SEQ ID NO: 228932 - DNA, 20 bp, Artificial Sequence
  chemically synthesized
aagactggacaacaggcttc

SEQ ID NO: 228933 - DNA, 20 bp, Artificial Sequence
  chemically synthesized
cttgttagaaacacagctgg

SEQ ID NO: 228934 - DNA, 20 bp, Artificial Sequence
  chemically synthesized
atacttgttagaaacacagc

SEQ ID NO: 228935 - DNA, 20 bp, Artificial Sequence
  chemically synthesized
aattatacttgttagaaaca

SEQ ID NO: 228936 - DNA, 20 bp, Artificial Sequence
  chemically synthesized
cttccagctgtgtttctaac

SEQ ID NO: 228937 - DNA, 20 bp, Artificial Sequence
  chemically synthesized
accagtgtaattatacttgt

SEQ ID NO: 228938 - DNA, 20 bp, Artificial Sequence
  chemically synthesized
tctaacaagtataattacac

SEQ ID NO: 228939 - DNA, 20 bp, Artificial Sequence
  chemically synthesized
acaagtataattacactggt

SEQ ID NO: 228940 - DNA, 20 bp, Artificial Sequence
  chemically synthesized
agttaatgataatgtccaac

SEQ ID NO: 228941 - DNA, 20 bp, Artificial Sequence
  chemically synthesized
tatgagaagaattagaaatg

SEQ ID NO: 228942 - DNA, 20 bp, Artificial Sequence
  chemically synthesized
ttttgaattatgagaagaat

SEQ ID NO: 228943 - DNA, 20 bp, Artificial Sequence
  chemically synthesized
ctcactttttgaattatgag

SEQ ID NO: 228944 - DNA, 20 bp, Artificial Sequence
  chemically synthesized
tctctcactttttgaattat

SEQ ID NO: 228945 - DNA, 20 bp, Artificial Sequence
  chemically synthesized
aattcttctcataattcaaa

SEQ ID NO: 228946 - DNA, 20 bp, Artificial Sequence
  chemically synthesized
cttctcataattcaaaaagt

SEQ ID NO: 228947 - DNA, 20 bp, Artificial Sequence
  chemically synthesized
tctcataattcaaaaagtga

SEQ ID NO: 228948 - DNA, 20 bp, Artificial Sequence
  chemically synthesized
tcataattcaaaaagtgaga

SEQ ID NO: 228949 - DNA, 20 bp, Artificial Sequence
  chemically synthesized
ttcaaaaagtgagagagaaa

SEQ ID NO: 228950 - DNA, 20 bp, Artificial Sequence
  chemically synthesized
tcaaaaagtgagagagaaaa

SEQ ID NO: 228951 - DNA, 20 bp, Artificial Sequence
  chemically synthesized
aaaagtgagagagaaaaagg

SEQ ID NO: 228952 - DNA, 20 bp, Artificial Sequence
  chemically synthesized
aaagtgagagagaaaaagga

SEQ ID NO: 228953 - DNA, 20 bp, Artificial Sequence
  chemically synthesized
aagtgagagagaaaaaggaa

SEQ ID NO: 228954 - DNA, 20 bp, Artificial Sequence
  chemically synthesized
aaggaagggataactctttt

SEQ ID NO: 228955 - DNA, 20 bp, Artificial Sequence
  chemically synthesized
aggtactataacaccaaaaa

SEQ ID NO: 228956 - DNA, 20 bp, Artificial Sequence
  chemically synthesized
tgaggtactataacaccaaa

SEQ ID NO: 228957 - DNA, 20 bp, Artificial Sequence
  chemically synthesized
gataactctttttggtgtta

SEQ ID NO: 228958 - DNA, 20 bp, Artificial Sequence
  chemically synthesized
ggtgttatagtacctcattg

SEQ ID NO: 228959 - DNA, 20 bp, Artificial Sequence
  chemically synthesized
gtgttatagtacctcattgt

SEQ ID NO: 228960 - DNA, 20 bp, Artificial Sequence
  chemically synthesized
gtttttggaaacctacaatg

SEQ ID NO: 228961 - DNA, 20 bp, Artificial Sequence
  chemically synthesized
tgtttttggaaacctacaat

SEQ ID NO: 228962 - DNA, 20 bp, Artificial Sequence
  chemically synthesized
cattgtaggtttccaaaaac

SEQ ID NO: 228963 - DNA, 20 bp, Artificial Sequence
  chemically synthesized
tgtcaggagtcacttgtttt

SEQ ID NO: 228964 - DNA, 20 bp, Artificial Sequence
  chemically synthesized
gagctaacagttgttgtcag

SEQ ID NO: 228965 - DNA, 20 bp, Artificial Sequence
  chemically synthesized
cagagctaacagttgttgtc

SEQ ID NO: 228966 - DNA, 20 bp, Artificial Sequence
  chemically synthesized
tcagagctaacagttgttgt

SEQ ID NO: 228967 - DNA, 20 bp, Artificial Sequence
  chemically synthesized
tgactcctgacaacaactgt

SEQ ID NO: 228968 - DNA, 20 bp, Artificial Sequence
  chemically synthesized
gactctcacttcagagctaa

SEQ ID NO: 228969 - DNA, 20 bp, Artificial Sequence
  chemically synthesized
gacaacaactgttagctctg

SEQ ID NO: 228970 - DNA, 20 bp, Artificial Sequence
  chemically synthesized
acaactgttagctctgaagt

SEQ ID NO: 228971 - DNA, 20 bp, Artificial Sequence
  chemically synthesized
gtttgcagactctcacttca

SEQ ID NO: 228972 - DNA, 20 bp, Artificial Sequence
  chemically synthesized
aactgttagctctgaagtga

SEQ ID NO: 228973 - DNA, 20 bp, Artificial Sequence
  chemically synthesized
cagtttgcagactctcactt

SEQ ID NO: 228974 - DNA, 20 bp, Artificial Sequence
  chemically synthesized
aagtgagagtctgcaaactg

SEQ ID NO: 228975 - DNA, 20 bp, Artificial Sequence
  chemically synthesized
ggcttgagggctgcagtttg

SEQ ID NO: 228976 - DNA, 20 bp, Artificial Sequence
  chemically synthesized
tagttacggcttgagggctg

SEQ ID NO: 228977 - DNA, 20 bp, Artificial Sequence
  chemically synthesized
gtctgcaaactgcagccctc

SEQ ID NO: 228978 - DNA, 20 bp, Artificial Sequence
  chemically synthesized
atgggctagttacggcttga

SEQ ID NO: 228979 - DNA, 20 bp, Artificial Sequence
  chemically synthesized
aatgggctagttacggcttg

SEQ ID NO: 228980 - DNA, 20 bp, Artificial Sequence
  chemically synthesized
caatgggctagttacggctt

SEQ ID NO: 228981 - DNA, 20 bp, Artificial Sequence
  chemically synthesized
tgcagccctcaagccgtaac

SEQ ID NO: 228982 - DNA, 20 bp, Artificial Sequence
  chemically synthesized
aaatggcaatgggctagtta

SEQ ID NO: 228983 - DNA, 20 bp, Artificial Sequence
  chemically synthesized
ttacaaaaatggcaatgggc

SEQ ID NO: 228984 - DNA, 20 bp, Artificial Sequence
  chemically synthesized
ttatttacaaaaatggcaat

SEQ ID NO: 228985 - DNA, 20 bp, Artificial Sequence
  chemically synthesized
tttatttacaaaaatggcaa

SEQ ID NO: 228986 - DNA, 20 bp, Artificial Sequence
  chemically synthesized
taaaactttatttacaaaaa

SEQ ID NO: 228987 - DNA, 20 bp, Artificial Sequence
  chemically synthesized
cattgccatttttgtaaata

SEQ ID NO: 228988 - DNA, 20 bp, Artificial Sequence
  chemically synthesized
ttttgtaaataaagttttat

SEQ ID NO: 228989 - DNA, 20 bp, Artificial Sequence
  chemically synthesized
tcatagacaatagagaaatg

SEQ ID NO: 228990 - DNA, 20 bp, Artificial Sequence
  chemically synthesized
tgaagcagtcatagacaata

SEQ ID NO: 228991 - DNA, 20 bp, Artificial Sequence
  chemically synthesized
gttgaagcagtcatagacaa

SEQ ID NO: 228992 - DNA, 20 bp, Artificial Sequence
  chemically synthesized
ttagaatgttgaagcagtca

SEQ ID NO: 228993 - DNA, 20 bp, Artificial Sequence
  chemically synthesized
ctgctgttagaatgttgaag

SEQ ID NO: 228994 - DNA, 20 bp, Artificial Sequence
  chemically synthesized
actctgctgttagaatgttg

SEQ ID NO: 228995 - DNA, 20 bp, Artificial Sequence
  chemically synthesized
tgactgcttcaacattctaa

SEQ ID NO: 228996 - DNA, 20 bp, Artificial Sequence
  chemically synthesized
ctgcttcaacattctaacag

SEQ ID NO: 228997 - DNA, 20 bp, Artificial Sequence
  chemically synthesized
gcttcaacattctaacagca

SEQ ID NO: 228998 - DNA, 20 bp, Artificial Sequence
  chemically synthesized
caactattcaactctgctgt

SEQ ID NO: 228999 - DNA, 20 bp, Artificial Sequence
  chemically synthesized
attctaacagcagagttgaa

SEQ ID NO: 229000 - DNA, 20 bp, Artificial Sequence
  chemically synthesized
gcagagttgaatagttgcaa

SEQ ID NO: 229001 - DNA, 20 bp, Artificial Sequence
  chemically synthesized
agagttgaatagttgcaaca

SEQ ID NO: 229002 - DNA, 20 bp, Artificial Sequence
  chemically synthesized
tgaatagttgcaacagagta

SEQ ID NO: 229003 - DNA, 20 bp, Artificial Sequence
  chemically synthesized
gcaacagagtatagaaaaca

SEQ ID NO: 229004 - DNA, 20 bp, Artificial Sequence
  chemically synthesized
ggccagagagtaaatatttt

SEQ ID NO: 229005 - DNA, 20 bp, Artificial Sequence
  chemically synthesized
gggccagagagtaaatattt

SEQ ID NO: 229006 - DNA, 20 bp, Artificial Sequence
  chemically synthesized
agcctaaaatatttactctc

SEQ ID NO: 229007 - DNA, 20 bp, Artificial Sequence
  chemically synthesized
tgtaaacgtaaagggccaga

SEQ ID NO: 229008 - DNA, 20 bp, Artificial Sequence
  chemically synthesized
aatgtaaacgtaaagggcca

SEQ ID NO: 229009 - DNA, 20 bp, Artificial Sequence
  chemically synthesized
gtaatgtaaacgtaaagggc

SEQ ID NO: 229010 - DNA, 20 bp, Artificial Sequence
  chemically synthesized
ttctgtaatgtaaacgtaaa

SEQ ID NO: 229011 - DNA, 20 bp, Artificial Sequence
  chemically synthesized
tttctgtaatgtaaacgtaa

SEQ ID NO: 229012 - DNA, 20 bp, Artificial Sequence
  chemically synthesized
ttttctgtaatgtaaacgta

SEQ ID NO: 229013 - DNA, 20 bp, Artificial Sequence
  chemically synthesized
ggccctttacgtttacatta

SEQ ID NO: 229014 - DNA, 20 bp, Artificial Sequence
  chemically synthesized
gttttatagtaggggttagc

SEQ ID NO: 229015 - DNA, 20 bp, Artificial Sequence
  chemically synthesized
cattgttttatagtaggggt

SEQ ID NO: 229016 - DNA, 20 bp, Artificial Sequence
  chemically synthesized
acaacattgttttatagtag

SEQ ID NO: 229017 - DNA, 20 bp, Artificial Sequence
  chemically synthesized
gacaacattgttttatagta

SEQ ID NO: 229018 - DNA, 20 bp, Artificial Sequence
  chemically synthesized
agacaacattgttttatagt

SEQ ID NO: 229019 - DNA, 20 bp, Artificial Sequence
  chemically synthesized
aagacaacattgttttatag

SEQ ID NO: 229020 - DNA, 20 bp, Artificial Sequence
  chemically synthesized
ccaaagacaacattgtttta

SEQ ID NO: 229021 - DNA, 20 bp, Artificial Sequence
  chemically synthesized
ctataaaacaatgttgtctt

SEQ ID NO: 229022 - DNA, 20 bp, Artificial Sequence
  chemically synthesized
taaaacaatgttgtctttgg

SEQ ID NO: 229023 - DNA, 20 bp, Artificial Sequence
  chemically synthesized
ttaatttaccatagcttcca

SEQ ID NO: 229024 - DNA, 20 bp, Artificial Sequence
  chemically synthesized
aatgttgtctttggaagcta

SEQ ID NO: 229025 - DNA, 20 bp, Artificial Sequence
  chemically synthesized
attctgtttttaatttacca

SEQ ID NO: 229026 - DNA, 20 bp, Artificial Sequence
  chemically synthesized
aagctatggtaaattaaaaa

SEQ ID NO: 229027 - DNA, 20 bp, Artificial Sequence
  chemically synthesized
aataaaatatacgtgagcaa

SEQ ID NO: 229028 - DNA, 20 bp, Artificial Sequence
  chemically synthesized
tttgaaaataaaatatacgt

SEQ ID NO: 229029 - DNA, 20 bp, Artificial Sequence
  chemically synthesized
tcacgtatattttattttca

SEQ ID NO: 229030 - DNA, 20 bp, Artificial Sequence
  chemically synthesized
atatctatagaaggggaaaa

SEQ ID NO: 229031 - DNA, 20 bp, Artificial Sequence
  chemically synthesized
attacttttttccccttcta

SEQ ID NO: 229032 - DNA, 20 bp, Artificial Sequence
  chemically synthesized
aaaaaaaatatctatagaag

SEQ ID NO: 229033 - DNA, 20 bp, Artificial Sequence
  chemically synthesized
aaaaaaaaatatctatagaa

SEQ ID NO: 229034 - DNA, 20 bp, Artificial Sequence
  chemically synthesized
aaaaaaaaaatatctataga

SEQ ID NO: 229035 - DNA, 20 bp, Artificial Sequence
  chemically synthesized
aaaaaaaaaaatatctatag

SEQ ID NO: 229036 - DNA, 20 bp, Artificial Sequence
  chemically synthesized
ggaaaaaaaaaaaatatcta

SEQ ID NO: 229037 - DNA, 20 bp, Artificial Sequence
  chemically synthesized
tagatattttttttttttcc

SEQ ID NO: 229038 - DNA, 20 bp, Artificial Sequence
  chemically synthesized
atattttttttttttcctgg

SEQ ID NO: 229039 - DNA, 20 bp, Artificial Sequence
  chemically synthesized
tattttttttttttcctgga

SEQ ID NO: 229040 - DNA, 20 bp, Artificial Sequence
  chemically synthesized
ttttttttttttcctggaag

SEQ ID NO: 229041 - DNA, 20 bp, Artificial Sequence
  chemically synthesized
tgaaattggaagctccttcc

SEQ ID NO: 229042 - DNA, 20 bp, Artificial Sequence
  chemically synthesized
ttgaaattggaagctccttc

SEQ ID NO: 229043 - DNA, 20 bp, Artificial Sequence
  chemically synthesized
ctgttcttgcttgaaattgg

SEQ ID NO: 229044 - DNA, 20 bp, Artificial Sequence
  chemically synthesized
tggaaggagcttccaatttc

SEQ ID NO: 229045 - DNA, 20 bp, Artificial Sequence
  chemically synthesized
cttctgttcttgcttgaaat

SEQ ID NO: 229046 - DNA, 20 bp, Artificial Sequence
  chemically synthesized
aggagcttccaatttcaagc

SEQ ID NO: 229047 - DNA, 20 bp, Artificial Sequence
  chemically synthesized
cttccaatttcaagcaagaa

SEQ ID NO: 229048 - DNA, 20 bp, Artificial Sequence
  chemically synthesized
ccaatttcaagcaagaacag

SEQ ID NO: 229049 - DNA, 20 bp, Artificial Sequence
  chemically synthesized
atttcaagcaagaacagaag

SEQ ID NO: 229050 - DNA, 20 bp, Artificial Sequence
  chemically synthesized
tcaagcaagaacagaagcag

SEQ ID NO: 229051 - DNA, 20 bp, Artificial Sequence
  chemically synthesized
agaagcagaagcactccaat

SEQ ID NO: 229052 - DNA, 20 bp, Artificial Sequence
  chemically synthesized
gtaaccaagcacacttattg

SEQ ID NO: 229053 - DNA, 20 bp, Artificial Sequence
  chemically synthesized
atgtaaccaagcacacttat

SEQ ID NO: 229054 - DNA, 20 bp, Artificial Sequence
  chemically synthesized
agcactccaataagtgtgct

SEQ ID NO: 229055 - DNA, 20 bp, Artificial Sequence
  chemically synthesized
cacaagttattcatgtaacc

SEQ ID NO: 229056 - DNA, 20 bp, Artificial Sequence
  chemically synthesized
gttacatgaataacttgtga

SEQ ID NO: 229057 - DNA, 20 bp, Artificial Sequence
  chemically synthesized
aagtatatccaaaccatcac

SEQ ID NO: 229058 - DNA, 20 bp, Artificial Sequence
  chemically synthesized
atgaataacttgtgatggtt

SEQ ID NO: 229059 - DNA, 20 bp, Artificial Sequence
  chemically synthesized
gatggtttggatatacttcc

SEQ ID NO: 229060 - DNA, 20 bp, Artificial Sequence
  chemically synthesized
taacattgcgtgttgccagg

SEQ ID NO: 229061 - DNA, 20 bp, Artificial Sequence
  chemically synthesized
ttctaacattgcgtgttgcc

SEQ ID NO: 229062 - DNA, 20 bp, Artificial Sequence
  chemically synthesized
tttctaacattgcgtgttgc

SEQ ID NO: 229063 - DNA, 20 bp, Artificial Sequence
  chemically synthesized
ttcctggcaacacgcaatgt

SEQ ID NO: 229064 - DNA, 20 bp, Artificial Sequence
  chemically synthesized
aacacgcaatgttagaaacc

SEQ ID NO: 229065 - DNA, 20 bp, Artificial Sequence
  chemically synthesized
taccaggcagacatatttct

SEQ ID NO: 229066 - DNA, 20 bp, Artificial Sequence
  chemically synthesized
gtaccaggcagacatatttc

SEQ ID NO: 229067 - DNA, 20 bp, Artificial Sequence
  chemically synthesized
aacctagaaatatgtctgcc

SEQ ID NO: 229068 - DNA, 20 bp, Artificial Sequence
  chemically synthesized
ttccccttaaaagtaccagg

SEQ ID NO: 229069 - DNA, 20 bp, Artificial Sequence
  chemically synthesized
atattccccttaaaagtacc

SEQ ID NO: 229070 - DNA, 20 bp, Artificial Sequence
  chemically synthesized
tatattccccttaaaagtac

SEQ ID NO: 229071 - DNA, 20 bp, Artificial Sequence
  chemically synthesized
tatgtctgcctggtactttt

SEQ ID NO: 229072 - DNA, 20 bp, Artificial Sequence
  chemically synthesized
atgtctgcctggtactttta

SEQ ID NO: 229073 - DNA, 20 bp, Artificial Sequence
  chemically synthesized
tgtctgcctggtacttttaa

SEQ ID NO: 229074 - DNA, 20 bp, Artificial Sequence
  chemically synthesized
gtctgcctggtacttttaag

SEQ ID NO: 229075 - DNA, 20 bp, Artificial Sequence
  chemically synthesized
tctctatatattccccttaa

SEQ ID NO: 229076 - DNA, 20 bp, Artificial Sequence
  chemically synthesized
gtacttttaaggggaatata

SEQ ID NO: 229077 - DNA, 20 bp, Artificial Sequence
  chemically synthesized
acttttaaggggaatatata

SEQ ID NO: 229078 - DNA, 20 bp, Artificial Sequence
  chemically synthesized
ttttaaggggaatatataga

SEQ ID NO: 229079 - DNA, 20 bp, Artificial Sequence
  chemically synthesized
tcttttcaaagtttcaaaag

SEQ ID NO: 229080 - DNA, 20 bp, Artificial Sequence
  chemically synthesized
atcttttcaaagtttcaaaa

SEQ ID NO: 229081 - DNA, 20 bp, Artificial Sequence
  chemically synthesized
aaatcttttcaaagtttcaa

SEQ ID NO: 229082 - DNA, 20 bp, Artificial Sequence
  chemically synthesized
gcctcttttgaaactttgaa

SEQ ID NO: 229083 - DNA, 20 bp, Artificial Sequence
  chemically synthesized
atagaaaataaatcttttca

SEQ ID NO: 229084 - DNA, 20 bp, Artificial Sequence
  chemically synthesized
aaaagatttattttctattc

SEQ ID NO: 229085 - DNA, 20 bp, Artificial Sequence
  chemically synthesized
aagatttattttctattctg

SEQ ID NO: 229086 - DNA, 20 bp, Artificial Sequence
  chemically synthesized
atactaaaatgtctccagaa

SEQ ID NO: 229087 - DNA, 20 bp, Artificial Sequence
  chemically synthesized
tctccatactaaaatgtctc

SEQ ID NO: 229088 - DNA, 20 bp, Artificial Sequence
  chemically synthesized
tttctattctggagacattt

SEQ ID NO: 229089 - DNA, 20 bp, Artificial Sequence
  chemically synthesized
attctggagacattttagta

SEQ ID NO: 229090 - DNA, 20 bp, Artificial Sequence
  chemically synthesized
tctggagacattttagtatg

SEQ ID NO: 229091 - DNA, 20 bp, Artificial Sequence
  chemically synthesized
tggagacattttagtatgga

SEQ ID NO: 229092 - DNA, 20 bp, Artificial Sequence
  chemically synthesized
cattttagtatggagagttg

SEQ ID NO: 229093 - DNA, 20 bp, Artificial Sequence
  chemically synthesized
attttagtatggagagttga

SEQ ID NO: 229094 - DNA, 20 bp, Artificial Sequence
  chemically synthesized
ttgaaggttgcataaaaata

SEQ ID NO: 229095 - DNA, 20 bp, Artificial Sequence
  chemically synthesized
tgcataaaaatacagcaact

SEQ ID NO: 229096 - DNA, 20 bp, Artificial Sequence
  chemically synthesized
taaaaatacagcaactaaga

SEQ ID NO: 229097 - DNA, 20 bp, Artificial Sequence
  chemically synthesized
aatacagcaactaagatagt

SEQ ID NO: 229098 - DNA, 20 bp, Artificial Sequence
  chemically synthesized
aataactattccaactatct

SEQ ID NO: 229099 - DNA, 20 bp, Artificial Sequence
  chemically synthesized
agcaactaagatagttggaa

SEQ ID NO: 229100 - DNA, 20 bp, Artificial Sequence
  chemically synthesized
tagttggaatagttattctc

SEQ ID NO: 229101 - DNA, 20 bp, Artificial Sequence
  chemically synthesized
agttggaatagttattctct

SEQ ID NO: 229102 - DNA, 20 bp, Artificial Sequence
  chemically synthesized
gttggaatagttattctcta

SEQ ID NO: 229103 - DNA, 20 bp, Artificial Sequence
  chemically synthesized
tagggccaaatgtttcccta

SEQ ID NO: 229104 - DNA, 20 bp, Artificial Sequence
  chemically synthesized
cttagggccaaatgtttccc

SEQ ID NO: 229105 - DNA, 20 bp, Artificial Sequence
  chemically synthesized
ttattctctagggaaacatt

SEQ ID NO: 229106 - DNA, 20 bp, Artificial Sequence
  chemically synthesized
ctagggaaacatttggccct

SEQ ID NO: 229107 - DNA, 20 bp, Artificial Sequence
  chemically synthesized
gaaacatttggccctaagac

SEQ ID NO: 229108 - DNA, 20 bp, Artificial Sequence
  chemically synthesized
ttccaacatgtcttgtctta

SEQ ID NO: 229109 - DNA, 20 bp, Artificial Sequence
  chemically synthesized
tttccaacatgtcttgtctt

SEQ ID NO: 229110 - DNA, 20 bp, Artificial Sequence
  chemically synthesized
gtttccaacatgtcttgtct

SEQ ID NO: 229111 - DNA, 20 bp, Artificial Sequence
  chemically synthesized
ggccctaagacaagacatgt

SEQ ID NO: 229112 - DNA, 20 bp, Artificial Sequence
  chemically synthesized
catgttggaaacacataaac

SEQ ID NO: 229113 - DNA, 20 bp, Artificial Sequence
  chemically synthesized
cataaacaagcaaataaaat

SEQ ID NO: 229114 - DNA, 20 bp, Artificial Sequence
  chemically synthesized
caaataaaattggcaaatgt

SEQ ID NO: 229115 - DNA, 20 bp, Artificial Sequence
  chemically synthesized
cattaagaatatagtttcac

SEQ ID NO: 229116 - DNA, 20 bp, Artificial Sequence
  chemically synthesized
tctcaatagcattaagaata

SEQ ID NO: 229117 - DNA, 20 bp, Artificial Sequence
  chemically synthesized
cctcacctctcaatagcatt

SEQ ID NO: 229118 - DNA, 20 bp, Artificial Sequence
  chemically synthesized
actatattcttaatgctatt

SEQ ID NO: 229119 - DNA, 20 bp, Artificial Sequence
  chemically synthesized
tatattcttaatgctattga

SEQ ID NO: 229120 - DNA, 20 bp, Artificial Sequence
  chemically synthesized
atattcttaatgctattgag

SEQ ID NO: 229121 - DNA, 20 bp, Artificial Sequence
  chemically synthesized
cagctggcctcacctctcaa

SEQ ID NO: 229122 - DNA, 20 bp, Artificial Sequence
  chemically synthesized
tcttaatgctattgagaggt

SEQ ID NO: 229123 - DNA, 20 bp, Artificial Sequence
  chemically synthesized
cttaatgctattgagaggtg

SEQ ID NO: 229124 - DNA, 20 bp, Artificial Sequence
  chemically synthesized
atgctattgagaggtgaggc

SEQ ID NO: 229125 - DNA, 20 bp, Artificial Sequence
  chemically synthesized
tattgagaggtgaggccagc

SEQ ID NO: 229126 - DNA, 20 bp, Artificial Sequence
  chemically synthesized
ctcgacccagaaagtccagc

SEQ ID NO: 229127 - DNA, 20 bp, Artificial Sequence
  chemically synthesized
gtgaggccagctggactttc

SEQ ID NO: 229128 - DNA, 20 bp, Artificial Sequence
  chemically synthesized
cccactcgacccagaaagtc

SEQ ID NO: 229129 - DNA, 20 bp, Artificial Sequence
  chemically synthesized
tgaggccagctggactttct

SEQ ID NO: 229130 - DNA, 20 bp, Artificial Sequence
  chemically synthesized
aagtccccactcgacccaga

SEQ ID NO: 229131 - DNA, 20 bp, Artificial Sequence
  chemically synthesized
ccagctggactttctgggtc

SEQ ID NO: 229132 - DNA, 20 bp, Artificial Sequence
  chemically synthesized
gctggactttctgggtcgag

SEQ ID NO: 229133 - DNA, 20 bp, Artificial Sequence
  chemically synthesized
ccccaagtccccactcgacc

SEQ ID NO: 229134 - DNA, 20 bp, Artificial Sequence
  chemically synthesized
ctggactttctgggtcgagt

SEQ ID NO: 229135 - DNA, 20 bp, Artificial Sequence
  chemically synthesized
tggactttctgggtcgagtg

SEQ ID NO: 229136 - DNA, 20 bp, Artificial Sequence
  chemically synthesized
ttctgggtcgagtggggact

SEQ ID NO: 229137 - DNA, 20 bp, Artificial Sequence
  chemically synthesized
tctgggtcgagtggggactt

SEQ ID NO: 229138 - DNA, 20 bp, Artificial Sequence
  chemically synthesized
ctgggtcgagtggggacttg

SEQ ID NO: 229139 - DNA, 20 bp, Artificial Sequence
  chemically synthesized
gtaagacagaaaagttcccc

SEQ ID NO: 229140 - DNA, 20 bp, Artificial Sequence
  chemically synthesized
aatcctcttgtaagacagaa

SEQ ID NO: 229141 - DNA, 20 bp, Artificial Sequence
  chemically synthesized
ggggaacttttctgtcttac

SEQ ID NO: 229142 - DNA, 20 bp, Artificial Sequence
  chemically synthesized
tttacaatcctcttgtaaga

SEQ ID NO: 229143 - DNA, 20 bp, Artificial Sequence
  chemically synthesized
ggaacttttctgtcttacaa

SEQ ID NO: 229144 - DNA, 20 bp, Artificial Sequence
  chemically synthesized
gaacttttctgtcttacaag

SEQ ID NO: 229145 - DNA, 20 bp, Artificial Sequence
  chemically synthesized
gcgttttacaatcctcttgt

SEQ ID NO: 229146 - DNA, 20 bp, Artificial Sequence
  chemically synthesized
ggattgtaaaacgcaccaat

SEQ ID NO: 229147 - DNA, 20 bp, Artificial Sequence
  chemically synthesized
gattgtaaaacgcaccaatc

SEQ ID NO: 229148 - DNA, 20 bp, Artificial Sequence
  chemically synthesized
aagacgggaaggttcctgat

SEQ ID NO: 229149 - DNA, 20 bp, Artificial Sequence
  chemically synthesized
aatcctcttgtaagacggga

SEQ ID NO: 229150 - DNA, 20 bp, Artificial Sequence
  chemically synthesized
caatcctcttgtaagacggg

SEQ ID NO: 229151 - DNA, 20 bp, Artificial Sequence
  chemically synthesized
caggaaccttcccgtcttac

SEQ ID NO: 229152 - DNA, 20 bp, Artificial Sequence
  chemically synthesized
ttacaatcctcttgtaagac

SEQ ID NO: 229153 - DNA, 20 bp, Artificial Sequence
  chemically synthesized
tttacaatcctcttgtaaga

SEQ ID NO: 229154 - DNA, 20 bp, Artificial Sequence
  chemically synthesized
ggaaccttcccgtcttacaa

SEQ ID NO: 229155 - DNA, 20 bp, Artificial Sequence
  chemically synthesized
gaaccttcccgtcttacaag

SEQ ID NO: 229156 - DNA, 20 bp, Artificial Sequence
  chemically synthesized
gcgttttacaatcctcttgt

SEQ ID NO: 229157 - DNA, 20 bp, Artificial Sequence
  chemically synthesized
ggattgtaaaacgcaccaat

SEQ ID NO: 229158 - DNA, 20 bp, Artificial Sequence
  chemically synthesized
gcattttacagagcgctgat

SEQ ID NO: 229159 - DNA, 20 bp, Artificial Sequence
  chemically synthesized
actgattggtgcattttaca

SEQ ID NO: 229160 - DNA, 20 bp, Artificial Sequence
  chemically synthesized
ctactgattggtgcatttta

SEQ ID NO: 229161 - DNA, 20 bp, Artificial Sequence
  chemically synthesized
gctctgtaaaatgcaccaat

SEQ ID NO: 229162 - DNA, 20 bp, Artificial Sequence
  chemically synthesized
ctgtaaaatgcaccaatcag

SEQ ID NO: 229163 - DNA, 20 bp, Artificial Sequence
  chemically synthesized
tgtaaaatgcaccaatcagt

SEQ ID NO: 229164 - DNA, 20 bp, Artificial Sequence
  chemically synthesized
acttttagaatcctactgat

SEQ ID NO: 229165 - DNA, 20 bp, Artificial Sequence
  chemically synthesized
accaatcagtaggattctaa

SEQ ID NO: 229166 - DNA, 20 bp, Artificial Sequence
  chemically synthesized
aatcagtaggattctaaaag

SEQ ID NO: 229167 - DNA, 20 bp, Artificial Sequence
  chemically synthesized
tccccacgattggctacttt

SEQ ID NO: 229168 - DNA, 20 bp, Artificial Sequence
  chemically synthesized
attctaaaagtagccaatcg

SEQ ID NO: 229169 - DNA, 20 bp, Artificial Sequence
  chemically synthesized
ttctaaaagtagccaatcgt

SEQ ID NO: 229170 - DNA, 20 bp, Artificial Sequence
  chemically synthesized
tctaaaagtagccaatcgtg

SEQ ID NO: 229171 - DNA, 20 bp, Artificial Sequence
  chemically synthesized
ttttcaatcctccccacgat

SEQ ID NO: 229172 - DNA, 20 bp, Artificial Sequence
  chemically synthesized
taaaagtagccaatcgtggg

SEQ ID NO: 229173 - DNA, 20 bp, Artificial Sequence
  chemically synthesized
aaaagtagccaatcgtgggg

SEQ ID NO: 229174 - DNA, 20 bp, Artificial Sequence
  chemically synthesized
atcgtggggaggattgaaaa

SEQ ID NO: 229175 - DNA, 20 bp, Artificial Sequence
  chemically synthesized
tcgtggggaggattgaaaaa

SEQ ID NO: 229176 - DNA, 20 bp, Artificial Sequence
  chemically synthesized
cgtggggaggattgaaaaaa

SEQ ID NO: 229177 - DNA, 20 bp, Artificial Sequence
  chemically synthesized
ttgaaaaaagggcactctga

SEQ ID NO: 229178 - DNA, 20 bp, Artificial Sequence
  chemically synthesized
tgaaaaaagggcactctgat

SEQ ID NO: 229179 - DNA, 20 bp, Artificial Sequence
  chemically synthesized
gttccatttctgtcctatca

SEQ ID NO: 229180 - DNA, 20 bp, Artificial Sequence
  chemically synthesized
aaaagggcactctgatagga

SEQ ID NO: 229181 - DNA, 20 bp, Artificial Sequence
  chemically synthesized
atgttccatttctgtcctat

SEQ ID NO: 229182 - DNA, 20 bp, Artificial Sequence
  chemically synthesized
gcactctgataggacagaaa

SEQ ID NO: 229183 - DNA, 20 bp, Artificial Sequence
  chemically synthesized
gataggacagaaatggaaca

SEQ ID NO: 229184 - DNA, 20 bp, Artificial Sequence
  chemically synthesized
ataggacagaaatggaacat

SEQ ID NO: 229185 - DNA, 20 bp, Artificial Sequence
  chemically synthesized
aggacagaaatggaacatgg

SEQ ID NO: 229186 - DNA, 20 bp, Artificial Sequence
  chemically synthesized
ggacagaaatggaacatggg

SEQ ID NO: 229187 - DNA, 20 bp, Artificial Sequence
  chemically synthesized
gacagaaatggaacatggga

SEQ ID NO: 229188 - DNA, 20 bp, Artificial Sequence
  chemically synthesized
acagaaatggaacatgggag

SEQ ID NO: 229189 - DNA, 20 bp, Artificial Sequence
  chemically synthesized
aaatggaacatgggagggga

SEQ ID NO: 229190 - DNA, 20 bp, Artificial Sequence
  chemically synthesized
ggaacatgggaggggacagt

SEQ ID NO: 229191 - DNA, 20 bp, Artificial Sequence
  chemically synthesized
gaacatgggaggggacagta

SEQ ID NO: 229192 - DNA, 20 bp, Artificial Sequence
  chemically synthesized
aacatgggaggggacagtaa

SEQ ID NO: 229193 - DNA, 20 bp, Artificial Sequence
  chemically synthesized
aggggacagtaagggaataa

SEQ ID NO: 229194 - DNA, 20 bp, Artificial Sequence
  chemically synthesized
gacagtaagggaataaaagc

SEQ ID NO: 229195 - DNA, 20 bp, Artificial Sequence
  chemically synthesized
ggaataaaagctggccaccc

SEQ ID NO: 229196 - DNA, 20 bp, Artificial Sequence
  chemically synthesized
ccgctgctggcttgggtggc

SEQ ID NO: 229197 - DNA, 20 bp, Artificial Sequence
  chemically synthesized
taaaagctggccacccaagc

SEQ ID NO: 229198 - DNA, 20 bp, Artificial Sequence
  chemically synthesized
gttgccgctgctggcttggg

SEQ ID NO: 229199 - DNA, 20 bp, Artificial Sequence
  chemically synthesized
aagctggccacccaagccag

SEQ ID NO: 229200 - DNA, 20 bp, Artificial Sequence
  chemically synthesized
caggttgccgctgctggctt

SEQ ID NO: 229201 - DNA, 20 bp, Artificial Sequence
  chemically synthesized
gcaggttgccgctgctggct

SEQ ID NO: 229202 - DNA, 20 bp, Artificial Sequence
  chemically synthesized
ctggccacccaagccagcag

SEQ ID NO: 229203 - DNA, 20 bp, Artificial Sequence
  chemically synthesized
cccaagcaggttgccgctgc

SEQ ID NO: 229204 - DNA, 20 bp, Artificial Sequence
  chemically synthesized
gccagcagcggcaacctgct

SEQ ID NO: 229205 - DNA, 20 bp, Artificial Sequence
  chemically synthesized
ccagcagcggcaacctgctt

SEQ ID NO: 229206 - DNA, 20 bp, Artificial Sequence
  chemically synthesized
acgtggaaggggacccaagc

SEQ ID NO: 229207 - DNA, 20 bp, Artificial Sequence
  chemically synthesized
aacgtggaaggggacccaag

SEQ ID NO: 229208 - DNA, 20 bp, Artificial Sequence
  chemically synthesized
cacaacgtggaaggggaccc

SEQ ID NO: 229209 - DNA, 20 bp, Artificial Sequence
  chemically synthesized
aagcttccacaacgtggaag

SEQ ID NO: 229210 - DNA, 20 bp, Artificial Sequence
  chemically synthesized
aaagcttccacaacgtggaa

SEQ ID NO: 229211 - DNA, 20 bp, Artificial Sequence
  chemically synthesized
caaagcttccacaacgtgga

SEQ ID NO: 229212 - DNA, 20 bp, Artificial Sequence
  chemically synthesized
acaaagcttccacaacgtgg

SEQ ID NO: 229213 - DNA, 20 bp, Artificial Sequence
  chemically synthesized
ttgggtccccttccacgttg

SEQ ID NO: 229214 - DNA, 20 bp, Artificial Sequence
  chemically synthesized
agaacaaagcttccacaacg

SEQ ID NO: 229215 - DNA, 20 bp, Artificial Sequence
  chemically synthesized
ggtccccttccacgttgtgg

SEQ ID NO: 229216 - DNA, 20 bp, Artificial Sequence
  chemically synthesized
ttgtgaagagcaaaagaaca

SEQ ID NO: 229217 - DNA, 20 bp, Artificial Sequence
  chemically synthesized
agatttattgtgaagagcaa

SEQ ID NO: 229218 - DNA, 20 bp, Artificial Sequence
  chemically synthesized
gcagcaagatttattgtgaa

SEQ ID NO: 229219 - DNA, 20 bp, Artificial Sequence
  chemically synthesized
cagcagcaagatttattgtg

SEQ ID NO: 229220 - DNA, 20 bp, Artificial Sequence
  chemically synthesized
cccaaacagcgagcagcagc

SEQ ID NO: 229221 - DNA, 20 bp, Artificial Sequence
  chemically synthesized
cgaacccaaacagcgagcag

SEQ ID NO: 229222 - DNA, 20 bp, Artificial Sequence
  chemically synthesized
gcacgaacccaaacagcgag

SEQ ID NO: 229223 - DNA, 20 bp, Artificial Sequence
  chemically synthesized
tcttgctgctgctcgctgtt

SEQ ID NO: 229224 - DNA, 20 bp, Artificial Sequence
  chemically synthesized
cttgctgctgctcgctgttt

SEQ ID NO: 229225 - DNA, 20 bp, Artificial Sequence
  chemically synthesized
gtggcacgaacccaaacagc

SEQ ID NO: 229226 - DNA, 20 bp, Artificial Sequence
  chemically synthesized
aaaggtggcacgaacccaaa

SEQ ID NO: 229227 - DNA, 20 bp, Artificial Sequence
  chemically synthesized
tttgggttcgtgccaccttt

SEQ ID NO: 229228 - DNA, 20 bp, Artificial Sequence
  chemically synthesized
tgggttcgtgccacctttaa

SEQ ID NO: 229229 - DNA, 20 bp, Artificial Sequence
  chemically synthesized
actgttacagctcttaaagg

SEQ ID NO: 229230 - DNA, 20 bp, Artificial Sequence
  chemically synthesized
gtgactgttacagctcttaa

SEQ ID NO: 229231 - DNA, 20 bp, Artificial Sequence
  chemically synthesized
ggtgactgttacagctctta

SEQ ID NO: 229232 - DNA, 20 bp, Artificial Sequence
  chemically synthesized
gccacctttaagagctgtaa

SEQ ID NO: 229233 - DNA, 20 bp, Artificial Sequence
  chemically synthesized
gacctctgcggtgactgtta

SEQ ID NO: 229234 - DNA, 20 bp, Artificial Sequence
  chemically synthesized
aagagctgtaacagtcaccg

SEQ ID NO: 229235 - DNA, 20 bp, Artificial Sequence
  chemically synthesized
gagctgtaacagtcaccgca

SEQ ID NO: 229236 - DNA, 20 bp, Artificial Sequence
  chemically synthesized
agctgtaacagtcaccgcag

SEQ ID NO: 229237 - DNA, 20 bp, Artificial Sequence
  chemically synthesized
aacgaagccacggacctctg

SEQ ID NO: 229238 - DNA, 20 bp, Artificial Sequence
  chemically synthesized
acagtcaccgcagaggtccg

SEQ ID NO: 229239 - DNA, 20 bp, Artificial Sequence
  chemically synthesized
tgacttcaagaacgaagcca

SEQ ID NO: 229240 - DNA, 20 bp, Artificial Sequence
  chemically synthesized
tctcgctgacttcaagaacg

SEQ ID NO: 229241 - DNA, 20 bp, Artificial Sequence
  chemically synthesized
ggtccgtggcttcgttcttg

SEQ ID NO: 229242 - DNA, 20 bp, Artificial Sequence
  chemically synthesized
cgtggcttcgttcttgaagt

SEQ ID NO: 229243 - DNA, 20 bp, Artificial Sequence
  chemically synthesized
ttcgtggtctcgctgacttc

SEQ ID NO: 229244 - DNA, 20 bp, Artificial Sequence
  chemically synthesized
gcttcgttcttgaagtcagc

SEQ ID NO: 229245 - DNA, 20 bp, Artificial Sequence
  chemically synthesized
ggttcccgccggtgggttcg

SEQ ID NO: 229246 - DNA, 20 bp, Artificial Sequence
  chemically synthesized
cagcgagaccacgaacccac

SEQ ID NO: 229247 - DNA, 20 bp, Artificial Sequence
  chemically synthesized
cgagaccacgaacccaccgg

SEQ ID NO: 229248 - DNA, 20 bp, Artificial Sequence
  chemically synthesized
gagaccacgaacccaccggc

SEQ ID NO: 229249 - DNA, 20 bp, Artificial Sequence
  chemically synthesized
cagagttggttcccgccggt

SEQ ID NO: 229250 - DNA, 20 bp, Artificial Sequence
  chemically synthesized
ccagagttggttcccgccgg

SEQ ID NO: 229251 - DNA, 20 bp, Artificial Sequence
  chemically synthesized
tgtccagagttggttcccgc

SEQ ID NO: 229252 - DNA, 20 bp, Artificial Sequence
  chemically synthesized
ccaccggcgggaaccaactc

SEQ ID NO: 229253 - DNA, 20 bp, Artificial Sequence
  chemically synthesized
ggtcatagtgtgtccagagt

SEQ ID NO: 229254 - DNA, 20 bp, Artificial Sequence
  chemically synthesized
ttaaggtcatagtgtgtcca

SEQ ID NO: 229255 - DNA, 20 bp, Artificial Sequence
  chemically synthesized
acttaaggtcatagtgtgtc

SEQ ID NO: 229256 - DNA, 20 bp, Artificial Sequence
  chemically synthesized
tctggacacactatgacctt

SEQ ID NO: 229257 - DNA, 20 bp, Artificial Sequence
  chemically synthesized
gacagacttacttaaggtca

SEQ ID NO: 229258 - DNA, 20 bp, Artificial Sequence
  chemically synthesized
gacacactatgaccttaagt

SEQ ID NO: 229259 - DNA, 20 bp, Artificial Sequence
  chemically synthesized
catgaagacagacttactta

SEQ ID NO: 229260 - DNA, 20 bp, Artificial Sequence
  chemically synthesized
ccatgaagacagacttactt

SEQ ID NO: 229261 - DNA, 20 bp, Artificial Sequence
  chemically synthesized
cttaagtaagtctgtcttca

SEQ ID NO: 229262 - DNA, 20 bp, Artificial Sequence
  chemically synthesized
atatctaggatccatgaaga

SEQ ID NO: 229263 - DNA, 20 bp, Artificial Sequence
  chemically synthesized
ggaaatatctaggatccatg

SEQ ID NO: 229264 - DNA, 20 bp, Artificial Sequence
  chemically synthesized
aagtctgtcttcatggatcc

SEQ ID NO: 229265 - DNA, 20 bp, Artificial Sequence
  chemically synthesized
acaaaggctaggaaatatct

SEQ ID NO: 229266 - DNA, 20 bp, Artificial Sequence
  chemically synthesized
tacaaaggctaggaaatatc

SEQ ID NO: 229267 - DNA, 20 bp, Artificial Sequence
  chemically synthesized
catggatcctagatatttcc

SEQ ID NO: 229268 - DNA, 20 bp, Artificial Sequence
  chemically synthesized
ttaaggaagatacaaaggct

SEQ ID NO: 229269 - DNA, 20 bp, Artificial Sequence
  chemically synthesized
tttaaggaagatacaaaggc

SEQ ID NO: 229270 - DNA, 20 bp, Artificial Sequence
  chemically synthesized
aacctttaaggaagatacaa

SEQ ID NO: 229271 - DNA, 20 bp, Artificial Sequence
  chemically synthesized
taacctttaaggaagataca

SEQ ID NO: 229272 - DNA, 20 bp, Artificial Sequence
  chemically synthesized
tagcctttgtatcttcctta

SEQ ID NO: 229273 - DNA, 20 bp, Artificial Sequence
  chemically synthesized
agcctttgtatcttccttaa

SEQ ID NO: 229274 - DNA, 20 bp, Artificial Sequence
  chemically synthesized
cctgaaggtaacctttaagg

SEQ ID NO: 229275 - DNA, 20 bp, Artificial Sequence
  chemically synthesized
gcacctgaaggtaaccttta

SEQ ID NO: 229276 - DNA, 20 bp, Artificial Sequence
  chemically synthesized
agcacctgaaggtaaccttt

SEQ ID NO: 229277 - DNA, 20 bp, Artificial Sequence
  chemically synthesized
tcttccttaaaggttacctt

SEQ ID NO: 229278 - DNA, 20 bp, Artificial Sequence
  chemically synthesized
cttccttaaaggttaccttc

SEQ ID NO: 229279 - DNA, 20 bp, Artificial Sequence
  chemically synthesized
acaacttcaaaagcacctga

SEQ ID NO: 229280 - DNA, 20 bp, Artificial Sequence
  chemically synthesized
aacaacttcaaaagcacctg

SEQ ID NO: 229281 - DNA, 20 bp, Artificial Sequence
  chemically synthesized
gttaccttcaggtgcttttg

SEQ ID NO: 229282 - DNA, 20 bp, Artificial Sequence
  chemically synthesized
tgtggtcataacaacttcaa

SEQ ID NO: 229283 - DNA, 20 bp, Artificial Sequence
  chemically synthesized
agttgttatgaccacatgta

SEQ ID NO: 229284 - DNA, 20 bp, Artificial Sequence
  chemically synthesized
aaaggtaaggactgtacatg

SEQ ID NO: 229285 - DNA, 20 bp, Artificial Sequence
  chemically synthesized
agtttcatgtacaaaaggta

SEQ ID NO: 229286 - DNA, 20 bp, Artificial Sequence
  chemically synthesized
gagtttcatgtacaaaaggt

SEQ ID NO: 229287 - DNA, 20 bp, Artificial Sequence
  chemically synthesized
agttgagtttcatgtacaaa

SEQ ID NO: 229288 - DNA, 20 bp, Artificial Sequence
  chemically synthesized
aagttgagtttcatgtacaa

SEQ ID NO: 229289 - DNA, 20 bp, Artificial Sequence
  chemically synthesized
taaaataggaatcaaaagtt

SEQ ID NO: 229290 - DNA, 20 bp, Artificial Sequence
  chemically synthesized
aaacataaaataggaatcaa

SEQ ID NO: 229291 - DNA, 20 bp, Artificial Sequence
  chemically synthesized
atctaatggaaacataaaat

SEQ ID NO: 229292 - DNA, 20 bp, Artificial Sequence
  chemically synthesized
catctaatggaaacataaaa

SEQ ID NO: 229293 - DNA, 20 bp, Artificial Sequence
  chemically synthesized
ttcctattttatgtttccat

SEQ ID NO: 229294 - DNA, 20 bp, Artificial Sequence
  chemically synthesized
tattttatgtttccattaga

SEQ ID NO: 229295 - DNA, 20 bp, Artificial Sequence
  chemically synthesized
ttacatacgtagccatctaa

SEQ ID NO: 229296 - DNA, 20 bp, Artificial Sequence
  chemically synthesized
actttttttgtttacatacg

SEQ ID NO: 229297 - DNA, 20 bp, Artificial Sequence
  chemically synthesized
gctacgtatgtaaacaaaaa

SEQ ID NO: 229298 - DNA, 20 bp, Artificial Sequence
  chemically synthesized
aaaaaagtttttgtgacact

SEQ ID NO: 229299 - DNA, 20 bp, Artificial Sequence
  chemically synthesized
aaaaagtttttgtgacactc

SEQ ID NO: 229300 - DNA, 20 bp, Artificial Sequence
  chemically synthesized
ctccctccgtagtaatgcct

SEQ ID NO: 229301 - DNA, 20 bp, Artificial Sequence
  chemically synthesized
gtgacactcaggcattacta

SEQ ID NO: 229302 - DNA, 20 bp, Artificial Sequence
  chemically synthesized
gacactcaggcattactacg

SEQ ID NO: 229303 - DNA, 20 bp, Artificial Sequence
  chemically synthesized
acactcaggcattactacgg

SEQ ID NO: 229304 - DNA, 20 bp, Artificial Sequence
  chemically synthesized
cactcaggcattactacgga

SEQ ID NO: 229305 - DNA, 20 bp, Artificial Sequence
  chemically synthesized
ctcaggcattactacggagg

SEQ ID NO: 229306 - DNA, 20 bp, Artificial Sequence
  chemically synthesized
tcaggcattactacggaggg

SEQ ID NO: 229307 - DNA, 20 bp, Artificial Sequence
  chemically synthesized
tgaacgttcacctccctccg

SEQ ID NO: 229308 - DNA, 20 bp, Artificial Sequence
  chemically synthesized
gagggaggtgaacgttcatt

SEQ ID NO: 229309 - DNA, 20 bp, Artificial Sequence
  chemically synthesized
ttcttctggatgcaatattt

SEQ ID NO: 229310 - DNA, 20 bp, Artificial Sequence
  chemically synthesized
tttatctcaaatattgcatc

SEQ ID NO: 229311 - DNA, 20 bp, Artificial Sequence
  chemically synthesized
atctcaaatattgcatccag

SEQ ID NO: 229312 - DNA, 20 bp, Artificial Sequence
  chemically synthesized
tattcttagtgtcattcttc

SEQ ID NO: 229313 - DNA, 20 bp, Artificial Sequence
  chemically synthesized
gcatccagaagaatgacact

SEQ ID NO: 229314 - DNA, 20 bp, Artificial Sequence
  chemically synthesized
acttcaattgagtttattct

SEQ ID NO: 229315 - DNA, 20 bp, Artificial Sequence
  chemically synthesized
actaagaataaactcaattg

SEQ ID NO: 229316 - DNA, 20 bp, Artificial Sequence
  chemically synthesized
cattatctcatacttcaatt

SEQ ID NO: 229317 - DNA, 20 bp, Artificial Sequence
  chemically synthesized
aataaactcaattgaagtat

SEQ ID NO: 229318 - DNA, 20 bp, Artificial Sequence
  chemically synthesized
gtatgagataatgtgcttca

SEQ ID NO: 229319 - DNA, 20 bp, Artificial Sequence
  chemically synthesized
atttagtcccttagtctttg

SEQ ID NO: 229320 - DNA, 20 bp, Artificial Sequence
  chemically synthesized
gataatgtgcttcaaagact

SEQ ID NO: 229321 - DNA, 20 bp, Artificial Sequence
  chemically synthesized
ataatgtgcttcaaagacta

SEQ ID NO: 229322 - DNA, 20 bp, Artificial Sequence
  chemically synthesized
taatgtgcttcaaagactaa

SEQ ID NO: 229323 - DNA, 20 bp, Artificial Sequence
  chemically synthesized
ggatgagttatttagtccct

SEQ ID NO: 229324 - DNA, 20 bp, Artificial Sequence
  chemically synthesized
taggaagaggatgagttatt

SEQ ID NO: 229325 - DNA, 20 bp, Artificial Sequence
  chemically synthesized
aaggtaattaggaagaggat

SEQ ID NO: 229326 - DNA, 20 bp, Artificial Sequence
  chemically synthesized
tctataaggtaattaggaag

SEQ ID NO: 229327 - DNA, 20 bp, Artificial Sequence
  chemically synthesized
atctataaggtaattaggaa

SEQ ID NO: 229328 - DNA, 20 bp, Artificial Sequence
  chemically synthesized
gtatctataaggtaattagg

SEQ ID NO: 229329 - DNA, 20 bp, Artificial Sequence
  chemically synthesized
aaggtatctataaggtaatt

SEQ ID NO: 229330 - DNA, 20 bp, Artificial Sequence
  chemically synthesized
taaggtatctataaggtaat

SEQ ID NO: 229331 - DNA, 20 bp, Artificial Sequence
  chemically synthesized
tcctcttcctaattacctta

SEQ ID NO: 229332 - DNA, 20 bp, Artificial Sequence
  chemically synthesized
agagaactaaggtatctata

SEQ ID NO: 229333 - DNA, 20 bp, Artificial Sequence
  chemically synthesized
aagagaactaaggtatctat

SEQ ID NO: 229334 - DNA, 20 bp, Artificial Sequence
  chemically synthesized
taattaccttatagatacct

SEQ ID NO: 229335 - DNA, 20 bp, Artificial Sequence
  chemically synthesized
gagaaggataaagagaacta

SEQ ID NO: 229336 - DNA, 20 bp, Artificial Sequence
  chemically synthesized
ggagaaggataaagagaact

SEQ ID NO: 229337 - DNA, 20 bp, Artificial Sequence
  chemically synthesized
gtatgttggagaaggataaa

SEQ ID NO: 229338 - DNA, 20 bp, Artificial Sequence
  chemically synthesized
ttgtatgttggagaaggata

SEQ ID NO: 229339 - DNA, 20 bp, Artificial Sequence
  chemically synthesized
ctagctttgtatgttggaga

SEQ ID NO: 229340 - DNA, 20 bp, Artificial Sequence
  chemically synthesized
actagctttgtatgttggag

SEQ ID NO: 229341 - DNA, 20 bp, Artificial Sequence
  chemically synthesized
tgaactagctttgtatgttg

SEQ ID NO: 229342 - DNA, 20 bp, Artificial Sequence
  chemically synthesized
ttatccttctccaacataca

SEQ ID NO: 229343 - DNA, 20 bp, Artificial Sequence
  chemically synthesized
aatgaactagctttgtatgt

SEQ ID NO: 229344 - DNA, 20 bp, Artificial Sequence
  chemically synthesized
ccttctccaacatacaaagc

SEQ ID NO: 229345 - DNA, 20 bp, Artificial Sequence
  chemically synthesized
caaagaccttaaaaatgaac

SEQ ID NO: 229346 - DNA, 20 bp, Artificial Sequence
  chemically synthesized
tacaaagctagttcattttt

SEQ ID NO: 229347 - DNA, 20 bp, Artificial Sequence
  chemically synthesized
acaaagctagttcattttta

SEQ ID NO: 229348 - DNA, 20 bp, Artificial Sequence
  chemically synthesized
catttttaaggtctttgcat

SEQ ID NO: 229349 - DNA, 20 bp, Artificial Sequence
  chemically synthesized
cacaagggacagcttatgca

SEQ ID NO: 229350 - DNA, 20 bp, Artificial Sequence
  chemically synthesized
agcattccgggcacaaggga

SEQ ID NO: 229351 - DNA, 20 bp, Artificial Sequence
  chemically synthesized
cataagctgtcccttgtgcc

SEQ ID NO: 229352 - DNA, 20 bp, Artificial Sequence
  chemically synthesized
gcaaagcattccgggcacaa

SEQ ID NO: 229353 - DNA, 20 bp, Artificial Sequence
  chemically synthesized
ggcaaagcattccgggcaca

SEQ ID NO: 229354 - DNA, 20 bp, Artificial Sequence
  chemically synthesized
gggcaaagcattccgggcac

SEQ ID NO: 229355 - DNA, 20 bp, Artificial Sequence
  chemically synthesized
atgtaggggcaaagcattcc

SEQ ID NO: 229356 - DNA, 20 bp, Artificial Sequence
  chemically synthesized
gatgtaggggcaaagcattc

SEQ ID NO: 229357 - DNA, 20 bp, Artificial Sequence
  chemically synthesized
catgtaatgatgtaggggca

SEQ ID NO: 229358 - DNA, 20 bp, Artificial Sequence
  chemically synthesized
tcagccatgtaatgatgtag

SEQ ID NO: 229359 - DNA, 20 bp, Artificial Sequence
  chemically synthesized
gtcagccatgtaatgatgta

SEQ ID NO: 229360 - DNA, 20 bp, Artificial Sequence
  chemically synthesized
agtcagccatgtaatgatgt

SEQ ID NO: 229361 - DNA, 20 bp, Artificial Sequence
  chemically synthesized
gagtcagccatgtaatgatg

SEQ ID NO: 229362 - DNA, 20 bp, Artificial Sequence
  chemically synthesized
tttgcccctacatcattaca

SEQ ID NO: 229363 - DNA, 20 bp, Artificial Sequence
  chemically synthesized
catcattacatggctgactc

SEQ ID NO: 229364 - DNA, 20 bp, Artificial Sequence
  chemically synthesized
actgatggacaaactagagt

SEQ ID NO: 229365 - DNA, 20 bp, Artificial Sequence
  chemically synthesized
aagaactgatggacaaacta

SEQ ID NO: 229366 - DNA, 20 bp, Artificial Sequence
  chemically synthesized
agaagaactgatggacaaac

SEQ ID NO: 229367 - DNA, 20 bp, Artificial Sequence
  chemically synthesized
gctgactctagtttgtccat

SEQ ID NO: 229368 - DNA, 20 bp, Artificial Sequence
  chemically synthesized
tgattttgaagaagaactga

SEQ ID NO: 229369 - DNA, 20 bp, Artificial Sequence
  chemically synthesized
cttggaaggtgattttgaag

SEQ ID NO: 229370 - DNA, 20 bp, Artificial Sequence
  chemically synthesized
tcacttggaaggtgattttg

SEQ ID NO: 229371 - DNA, 20 bp, Artificial Sequence
  chemically synthesized
cttcttcaaaatcaccttcc

SEQ ID NO: 229372 - DNA, 20 bp, Artificial Sequence
  chemically synthesized
ttcaaaatcaccttccaagt

SEQ ID NO: 229373 - DNA, 20 bp, Artificial Sequence
  chemically synthesized
tcttcaatacctcacttgga

SEQ ID NO: 229374 - DNA, 20 bp, Artificial Sequence
  chemically synthesized
tcaaaatcaccttccaagtg

SEQ ID NO: 229375 - DNA, 20 bp, Artificial Sequence
  chemically synthesized
gtcttcaatacctcacttgg

SEQ ID NO: 229376 - DNA, 20 bp, Artificial Sequence
  chemically synthesized
aaagtcttcaatacctcact

SEQ ID NO: 229377 - DNA, 20 bp, Artificial Sequence
  chemically synthesized
accttccaagtgaggtattg

SEQ ID NO: 229378 - DNA, 20 bp, Artificial Sequence
  chemically synthesized
gaggtattgaagactttttc

SEQ ID NO: 229379 - DNA, 20 bp, Artificial Sequence
  chemically synthesized
aaaagagaaaaatcttgaaa

SEQ ID NO: 229380 - DNA, 20 bp, Artificial Sequence
  chemically synthesized
tgcacagaattaataaaaaa

SEQ ID NO: 229381 - DNA, 20 bp, Artificial Sequence
  chemically synthesized
tatgcacagaattaataaaa

SEQ ID NO: 229382 - DNA, 20 bp, Artificial Sequence
  chemically synthesized
aaagtgggaaatattatgca

SEQ ID NO: 229383 - DNA, 20 bp, Artificial Sequence
  chemically synthesized
aggaaaacaatttagaaagt

SEQ ID NO: 229384 - DNA, 20 bp, Artificial Sequence
  chemically synthesized
aaggaaaacaatttagaaag

SEQ ID NO: 229385 - DNA, 20 bp, Artificial Sequence
  chemically synthesized
agaaaggaaaacaatttaga

SEQ ID NO: 229386 - DNA, 20 bp, Artificial Sequence
  chemically synthesized
actgagaaaggaaaacaatt

SEQ ID NO: 229387 - DNA, 20 bp, Artificial Sequence
  chemically synthesized
tctaaattgttttcctttct

SEQ ID NO: 229388 - DNA, 20 bp, Artificial Sequence
  chemically synthesized
gataggatacaaactgagaa

SEQ ID NO: 229389 - DNA, 20 bp, Artificial Sequence
  chemically synthesized
ggataggatacaaactgaga

SEQ ID NO: 229390 - DNA, 20 bp, Artificial Sequence
  chemically synthesized
gcagggataggatacaaact

SEQ ID NO: 229391 - DNA, 20 bp, Artificial Sequence
  chemically synthesized
taattttagtaagcagggat

SEQ ID NO: 229392 - DNA, 20 bp, Artificial Sequence
  chemically synthesized
gtaattttagtaagcaggga

SEQ ID NO: 229393 - DNA, 20 bp, Artificial Sequence
  chemically synthesized
aactgtaattttagtaagca

SEQ ID NO: 229394 - DNA, 20 bp, Artificial Sequence
  chemically synthesized
aaactgtaattttagtaagc

SEQ ID NO: 229395 - DNA, 20 bp, Artificial Sequence
  chemically synthesized
gaaactgtaattttagtaag

SEQ ID NO: 229396 - DNA, 20 bp, Artificial Sequence
  chemically synthesized
catgaaactgtaattttagt

SEQ ID NO: 229397 - DNA, 20 bp, Artificial Sequence
  chemically synthesized
atccctgcttactaaaatta

SEQ ID NO: 229398 - DNA, 20 bp, Artificial Sequence
  chemically synthesized
tgctcatgaaactgtaattt

SEQ ID NO: 229399 - DNA, 20 bp, Artificial Sequence
  chemically synthesized
tactaaaattacagtttcat

SEQ ID NO: 229400 - DNA, 20 bp, Artificial Sequence
  chemically synthesized
attacagtttcatgagcaca

SEQ ID NO: 229401 - DNA, 20 bp, Artificial Sequence
  chemically synthesized
ttacagtttcatgagcacac

SEQ ID NO: 229402 - DNA, 20 bp, Artificial Sequence
  chemically synthesized
cactacgtacaaggaagcat

SEQ ID NO: 229403 - DNA, 20 bp, Artificial Sequence
  chemically synthesized
acactacgtacaaggaagca

SEQ ID NO: 229404 - DNA, 20 bp, Artificial Sequence
  chemically synthesized
cctgcacactacgtacaagg

SEQ ID NO: 229405 - DNA, 20 bp, Artificial Sequence
  chemically synthesized
gacctatgcttccttgtacg

SEQ ID NO: 229406 - DNA, 20 bp, Artificial Sequence
  chemically synthesized
tatcctgcacactacgtaca

SEQ ID NO: 229407 - DNA, 20 bp, Artificial Sequence
  chemically synthesized
atatcctgcacactacgtac

SEQ ID NO: 229408 - DNA, 20 bp, Artificial Sequence
  chemically synthesized
gcttccttgtacgtagtgtg

SEQ ID NO: 229409 - DNA, 20 bp, Artificial Sequence
  chemically synthesized
cttccttgtacgtagtgtgc

SEQ ID NO: 229410 - DNA, 20 bp, Artificial Sequence
  chemically synthesized
gtagtgtgcaggatattact

SEQ ID NO: 229411 - DNA, 20 bp, Artificial Sequence
  chemically synthesized
gcaggatattacttggaata

SEQ ID NO: 229412 - DNA, 20 bp, Artificial Sequence
  chemically synthesized
ttgggtgcccactatattcc

SEQ ID NO: 229413 - DNA, 20 bp, Artificial Sequence
  chemically synthesized
ggatattacttggaatatag

SEQ ID NO: 229414 - DNA, 20 bp, Artificial Sequence
  chemically synthesized
gatattacttggaatatagt

SEQ ID NO: 229415 - DNA, 20 bp, Artificial Sequence
  chemically synthesized
attgtattcattaatatatt

SEQ ID NO: 229416 - DNA, 20 bp, Artificial Sequence
  chemically synthesized
gattgtattcattaatatat

SEQ ID NO: 229417 - DNA, 20 bp, Artificial Sequence
  chemically synthesized
attaatgaatacaatcattg

SEQ ID NO: 229418 - DNA, 20 bp, Artificial Sequence
  chemically synthesized
atgaatacaatcattgtaga

SEQ ID NO: 229419 - DNA, 20 bp, Artificial Sequence
  chemically synthesized
attgtagaaagttaaatcca

SEQ ID NO: 229420 - DNA, 20 bp, Artificial Sequence
  chemically synthesized
gtagaaagttaaatccacag

SEQ ID NO: 229421 - DNA, 20 bp, Artificial Sequence
  chemically synthesized
acaccacatctggaccactg

SEQ ID NO: 229422 - DNA, 20 bp, Artificial Sequence
  chemically synthesized
aagttaaatccacagtggtc

SEQ ID NO: 229423 - DNA, 20 bp, Artificial Sequence
  chemically synthesized
aatccacagtggtccagatg

SEQ ID NO: 229424 - DNA, 20 bp, Artificial Sequence
  chemically synthesized
ttcatgcttaacaccacatc

SEQ ID NO: 229425 - DNA, 20 bp, Artificial Sequence
  chemically synthesized
agtggtccagatgtggtgtt

SEQ ID NO: 229426 - DNA, 20 bp, Artificial Sequence
  chemically synthesized
accttgaaggtagaagattt

SEQ ID NO: 229427 - DNA, 20 bp, Artificial Sequence
  chemically synthesized
caccttgaaggtagaagatt

SEQ ID NO: 229428 - DNA, 20 bp, Artificial Sequence
  chemically synthesized
taggagcaccttgaaggtag

SEQ ID NO: 229429 - DNA, 20 bp, Artificial Sequence
  chemically synthesized
aacctaaatcttctaccttc

SEQ ID NO: 229430 - DNA, 20 bp, Artificial Sequence
  chemically synthesized
acctaaatcttctaccttca

SEQ ID NO: 229431 - DNA, 20 bp, Artificial Sequence
  chemically synthesized
tattaggagcaccttgaagg

SEQ ID NO: 229432 - DNA, 20 bp, Artificial Sequence
  chemically synthesized
ccatattaggagcaccttga

SEQ ID NO: 229433 - DNA, 20 bp, Artificial Sequence
  chemically synthesized
accatattaggagcaccttg

SEQ ID NO: 229434 - DNA, 20 bp, Artificial Sequence
  chemically synthesized
ccttcaaggtgctcctaata

SEQ ID NO: 229435 - DNA, 20 bp, Artificial Sequence
  chemically synthesized
catcaacccaaccatattag

SEQ ID NO: 229436 - DNA, 20 bp, Artificial Sequence
  chemically synthesized
atcatcaacccaaccatatt

SEQ ID NO: 229437 - DNA, 20 bp, Artificial Sequence
  chemically synthesized
caaggtgctcctaatatggt

SEQ ID NO: 229438 - DNA, 20 bp, Artificial Sequence
  chemically synthesized
gatcatcaacccaaccatat

SEQ ID NO: 229439 - DNA, 20 bp, Artificial Sequence
  chemically synthesized
aaggtgctcctaatatggtt

SEQ ID NO: 229440 - DNA, 20 bp, Artificial Sequence
  chemically synthesized
gttgatgatcacatacaaat

SEQ ID NO: 229441 - DNA, 20 bp, Artificial Sequence
  chemically synthesized
atcagataattataccactt

SEQ ID NO: 229442 - DNA, 20 bp, Artificial Sequence
  chemically synthesized
tcagataattataccacttg

SEQ ID NO: 229443 - DNA, 20 bp, Artificial Sequence
  chemically synthesized
taaacctaatgttcctcaag

SEQ ID NO: 229444 - DNA, 20 bp, Artificial Sequence
  chemically synthesized
ttgtaaacctaatgttcctc

SEQ ID NO: 229445 - DNA, 20 bp, Artificial Sequence
  chemically synthesized
ttataccacttgaggaacat

SEQ ID NO: 229446 - DNA, 20 bp, Artificial Sequence
  chemically synthesized
tataccacttgaggaacatt

SEQ ID NO: 229447 - DNA, 20 bp, Artificial Sequence
  chemically synthesized
gaacattaggtttacaaact

SEQ ID NO: 229448 - DNA, 20 bp, Artificial Sequence
  chemically synthesized
taaaatgatataataatgct

SEQ ID NO: 229449 - DNA, 20 bp, Artificial Sequence
  chemically synthesized
ttattaaaatgtattcatat

SEQ ID NO: 229450 - DNA, 20 bp, Artificial Sequence
  chemically synthesized
aaaatgtattcatatcagta

SEQ ID NO: 229451 - DNA, 20 bp, Artificial Sequence
  chemically synthesized
atgtattcatatcagtaaag

SEQ ID NO: 229452 - DNA, 20 bp, Artificial Sequence
  chemically synthesized
tgtattcatatcagtaaagt

SEQ ID NO: 229453 - DNA, 20 bp, Artificial Sequence
  chemically synthesized
gtattcatatcagtaaagtg

SEQ ID NO: 229454 - DNA, 20 bp, Artificial Sequence
  chemically synthesized
tcatatcagtaaagtgggga

SEQ ID NO: 229455 - DNA, 20 bp, Artificial Sequence
  chemically synthesized
tatcagtaaagtggggacgg

SEQ ID NO: 229456 - DNA, 20 bp, Artificial Sequence
  chemically synthesized
tcagtaaagtggggacggtg

SEQ ID NO: 229457 - DNA, 20 bp, Artificial Sequence
  chemically synthesized
aaagtggggacggtggagtc

SEQ ID NO: 229458 - DNA, 20 bp, Artificial Sequence
  chemically synthesized
aagtggggacggtggagtca

SEQ ID NO: 229459 - DNA, 20 bp, Artificial Sequence
  chemically synthesized
tggggacggtggagtcaagg

SEQ ID NO: 229460 - DNA, 20 bp, Artificial Sequence
  chemically synthesized
ggacggtggagtcaaggaag

SEQ ID NO: 229461 - DNA, 20 bp, Artificial Sequence
  chemically synthesized
gagtcaaggaagaagtattg

SEQ ID NO: 229462 - DNA, 20 bp, Artificial Sequence
  chemically synthesized
agtcaaggaagaagtattgt

SEQ ID NO: 229463 - DNA, 20 bp, Artificial Sequence
  chemically synthesized
aagtattgtaggtgacattt

SEQ ID NO: 229464 - DNA, 20 bp, Artificial Sequence
  chemically synthesized
ttgtaggtgacattttagct

SEQ ID NO: 229465 - DNA, 20 bp, Artificial Sequence
  chemically synthesized
ggtgacattttagctgagta

SEQ ID NO: 229466 - DNA, 20 bp, Artificial Sequence
  chemically synthesized
ctaacctccctttctatact

SEQ ID NO: 229467 - DNA, 20 bp, Artificial Sequence
  chemically synthesized
acattttagctgagtataga

SEQ ID NO: 229468 - DNA, 20 bp, Artificial Sequence
  chemically synthesized
cattttagctgagtatagaa

SEQ ID NO: 229469 - DNA, 20 bp, Artificial Sequence
  chemically synthesized
attttagctgagtatagaaa

SEQ ID NO: 229470 - DNA, 20 bp, Artificial Sequence
  chemically synthesized
tttagctgagtatagaaagg

SEQ ID NO: 229471 - DNA, 20 bp, Artificial Sequence
  chemically synthesized
ttagctgagtatagaaaggg

SEQ ID NO: 229472 - DNA, 20 bp, Artificial Sequence
  chemically synthesized
ctgagtatagaaagggaggt

SEQ ID NO: 229473 - DNA, 20 bp, Artificial Sequence
  chemically synthesized
tgagtatagaaagggaggtt

SEQ ID NO: 229474 - DNA, 20 bp, Artificial Sequence
  chemically synthesized
gagtatagaaagggaggtta

SEQ ID NO: 229475 - DNA, 20 bp, Artificial Sequence
  chemically synthesized
agaaagggaggttagggatg

SEQ ID NO: 229476 - DNA, 20 bp, Artificial Sequence
  chemically synthesized
ggaggttagggatgaagcac

SEQ ID NO: 229477 - DNA, 20 bp, Artificial Sequence
  chemically synthesized
gaggttagggatgaagcacc

SEQ ID NO: 229478 - DNA, 20 bp, Artificial Sequence
  chemically synthesized
acttgtgacaagcatttgcc

SEQ ID NO: 229479 - DNA, 20 bp, Artificial Sequence
  chemically synthesized
accaggcaaatgcttgtcac

SEQ ID NO: 229480 - DNA, 20 bp, Artificial Sequence
  chemically synthesized
ctcacaaggtcacttgtgac

SEQ ID NO: 229481 - DNA, 20 bp, Artificial Sequence
  chemically synthesized
cttgtcacaagtgaccttgt

SEQ ID NO: 229482 - DNA, 20 bp, Artificial Sequence
  chemically synthesized
catgtcacaagtgactcaca

SEQ ID NO: 229483 - DNA, 20 bp, Artificial Sequence
  chemically synthesized
tcatgtcacaagtgactcac

SEQ ID NO: 229484 - DNA, 20 bp, Artificial Sequence
  chemically synthesized
agtgactcacttcatgtcac

SEQ ID NO: 229485 - DNA, 20 bp, Artificial Sequence
  chemically synthesized
tgtgagtcacttgtgacatg

SEQ ID NO: 229486 - DNA, 20 bp, Artificial Sequence
  chemically synthesized
agtcacttgtgacatgaagt

SEQ ID NO: 229487 - DNA, 20 bp, Artificial Sequence
  chemically synthesized
gttatacagcttcatgtcac

SEQ ID NO: 229488 - DNA, 20 bp, Artificial Sequence
  chemically synthesized
agtgagtcacttgtgacatg

SEQ ID NO: 229489 - DNA, 20 bp, Artificial Sequence
  chemically synthesized
cttcctctaagcacgttata

SEQ ID NO: 229490 - DNA, 20 bp, Artificial Sequence
  chemically synthesized
atgaagctgtataacgtgct

SEQ ID NO: 229491 - DNA, 20 bp, Artificial Sequence
  chemically synthesized
gaagctgtataacgtgctta

SEQ ID NO: 229492 - DNA, 20 bp, Artificial Sequence
  chemically synthesized
aagctgtataacgtgcttag

SEQ ID NO: 229493 - DNA, 20 bp, Artificial Sequence
  chemically synthesized
ctgtataacgtgcttagagg

SEQ ID NO: 229494 - DNA, 20 bp, Artificial Sequence
  chemically synthesized
tgaactgtatgtcttcctct

SEQ ID NO: 229495 - DNA, 20 bp, Artificial Sequence
  chemically synthesized
cgtgcttagaggaagacata

SEQ ID NO: 229496 - DNA, 20 bp, Artificial Sequence
  chemically synthesized
ggaagacatacagttcatca

SEQ ID NO: 229497 - DNA, 20 bp, Artificial Sequence
  chemically synthesized
aatgtggatgtcaggacgaa

SEQ ID NO: 229498 - DNA, 20 bp, Artificial Sequence
  chemically synthesized
gaatgtggatgtcaggacga

SEQ ID NO: 229499 - DNA, 20 bp, Artificial Sequence
  chemically synthesized
gagaaatgaatgtggatgtc

SEQ ID NO: 229500 - DNA, 20 bp, Artificial Sequence
  chemically synthesized
agagaaatgaatgtggatgt

SEQ ID NO: 229501 - DNA, 20 bp, Artificial Sequence
  chemically synthesized
ggtagtcagagaaatgaatg

SEQ ID NO: 229502 - DNA, 20 bp, Artificial Sequence
  chemically synthesized
agtgaggggttgggtagtca

SEQ ID NO: 229503 - DNA, 20 bp, Artificial Sequence
  chemically synthesized
caagtgaggggttgggtagt

SEQ ID NO: 229504 - DNA, 20 bp, Artificial Sequence
  chemically synthesized
aatccaagtgaggggttggg

SEQ ID NO: 229505 - DNA, 20 bp, Artificial Sequence
  chemically synthesized
aaaaatccaagtgaggggtt

SEQ ID NO: 229506 - DNA, 20 bp, Artificial Sequence
  chemically synthesized
gaaaaatccaagtgaggggt

SEQ ID NO: 229507 - DNA, 20 bp, Artificial Sequence
  chemically synthesized
tgactacccaacccctcact

SEQ ID NO: 229508 - DNA, 20 bp, Artificial Sequence
  chemically synthesized
ctttgaaaaatccaagtgag

SEQ ID NO: 229509 - DNA, 20 bp, Artificial Sequence
  chemically synthesized
cctttgaaaaatccaagtga

SEQ ID NO: 229510 - DNA, 20 bp, Artificial Sequence
  chemically synthesized
acctttgaaaaatccaagtg

SEQ ID NO: 229511 - DNA, 20 bp, Artificial Sequence
  chemically synthesized
tacctttgaaaaatccaagt

SEQ ID NO: 229512 - DNA, 20 bp, Artificial Sequence
  chemically synthesized
gagatacctttgaaaaatcc

SEQ ID NO: 229513 - DNA, 20 bp, Artificial Sequence
  chemically synthesized
cccctcacttggatttttca

SEQ ID NO: 229514 - DNA, 20 bp, Artificial Sequence
  chemically synthesized
ccctcacttggatttttcaa

SEQ ID NO: 229515 - DNA, 20 bp, Artificial Sequence
  chemically synthesized
attttggatgtgttaatttt

SEQ ID NO: 229516 - DNA, 20 bp, Artificial Sequence
  chemically synthesized
gaaagagagtaaacgtattt

SEQ ID NO: 229517 - DNA, 20 bp, Artificial Sequence
  chemically synthesized
aaaagagttgcagagaaaga

SEQ ID NO: 229518 - DNA, 20 bp, Artificial Sequence
  chemically synthesized
ggaaaagagttgcagagaaa

SEQ ID NO: 229519 - DNA, 20 bp, Artificial Sequence
  chemically synthesized
gaggaaaagagttgcagaga

SEQ ID NO: 229520 - DNA, 20 bp, Artificial Sequence
  chemically synthesized
gggagaggaaaagagttgca

SEQ ID NO: 229521 - DNA, 20 bp, Artificial Sequence
  chemically synthesized
aggggagaggaaaagagttg

SEQ ID NO: 229522 - DNA, 20 bp, Artificial Sequence
  chemically synthesized
tgcataaggggagaggaaaa

SEQ ID NO: 229523 - DNA, 20 bp, Artificial Sequence
  chemically synthesized
aatgcataaggggagaggaa

SEQ ID NO: 229524 - DNA, 20 bp, Artificial Sequence
  chemically synthesized
ggttaaatgcataaggggag

SEQ ID NO: 229525 - DNA, 20 bp, Artificial Sequence
  chemically synthesized
tggttaaatgcataagggga

SEQ ID NO: 229526 - DNA, 20 bp, Artificial Sequence
  chemically synthesized
aatggttaaatgcataaggg

SEQ ID NO: 229527 - DNA, 20 bp, Artificial Sequence
  chemically synthesized
tgaatggttaaatgcataag

SEQ ID NO: 229528 - DNA, 20 bp, Artificial Sequence
  chemically synthesized
atgaatggttaaatgcataa

SEQ ID NO: 229529 - DNA, 20 bp, Artificial Sequence
  chemically synthesized
aatgaatggttaaatgcata

SEQ ID NO: 229530 - DNA, 20 bp, Artificial Sequence
  chemically synthesized
taatgaatggttaaatgcat

SEQ ID NO: 229531 - DNA, 20 bp, Artificial Sequence
  chemically synthesized
gtattggataaaataatgaa

SEQ ID NO: 229532 - DNA, 20 bp, Artificial Sequence
  chemically synthesized
agtgatcagtaagtacgtat

SEQ ID NO: 229533 - DNA, 20 bp, Artificial Sequence
  chemically synthesized
gaaaataataagtgatcagt

SEQ ID NO: 229534 - DNA, 20 bp, Artificial Sequence
  chemically synthesized
atgggaaaataataagtgat

SEQ ID NO: 229535 - DNA, 20 bp, Artificial Sequence
  chemically synthesized
ttttgaaatgggaaaataat

SEQ ID NO: 229536 - DNA, 20 bp, Artificial Sequence
  chemically synthesized
ttattattttcccatttcaa

SEQ ID NO: 229537 - DNA, 20 bp, Artificial Sequence
  chemically synthesized
actgccatttcttttgaaat

SEQ ID NO: 229538 - DNA, 20 bp, Artificial Sequence
  chemically synthesized
cactgccatttcttttgaaa

SEQ ID NO: 229539 - DNA, 20 bp, Artificial Sequence
  chemically synthesized
ttttcccatttcaaaagaaa

SEQ ID NO: 229540 - DNA, 20 bp, Artificial Sequence
  chemically synthesized
tcccatttcaaaagaaatgg

SEQ ID NO: 229541 - DNA, 20 bp, Artificial Sequence
  chemically synthesized
agaaatggcagtgttatctc

SEQ ID NO: 229542 - DNA, 20 bp, Artificial Sequence
  chemically synthesized
aaatggcagtgttatctcca

SEQ ID NO: 229543 - DNA, 20 bp, Artificial Sequence
  chemically synthesized
aatggcagtgttatctccag

SEQ ID NO: 229544 - DNA, 20 bp, Artificial Sequence
  chemically synthesized
tctgatgtcatacacctctg

SEQ ID NO: 229545 - DNA, 20 bp, Artificial Sequence
  chemically synthesized
tttctgatgtcatacacctc

SEQ ID NO: 229546 - DNA, 20 bp, Artificial Sequence
  chemically synthesized
tctccagaggtgtatgacat

SEQ ID NO: 229547 - DNA, 20 bp, Artificial Sequence
  chemically synthesized
aggtgtatgacatcagaaac

SEQ ID NO: 229548 - DNA, 20 bp, Artificial Sequence
  chemically synthesized
ggtgtatgacatcagaaact

SEQ ID NO: 229549 - DNA, 20 bp, Artificial Sequence
  chemically synthesized
aaagtgtcatatatcattcc

SEQ ID NO: 229550 - DNA, 20 bp, Artificial Sequence
  chemically synthesized
tgcagagttgaatttgagga

SEQ ID NO: 229551 - DNA, 20 bp, Artificial Sequence
  chemically synthesized
cgattgcagagttgaatttg

SEQ ID NO: 229552 - DNA, 20 bp, Artificial Sequence
  chemically synthesized
acgattgcagagttgaattt

SEQ ID NO: 229553 - DNA, 20 bp, Artificial Sequence
  chemically synthesized
tgttaagttgaacgattgca

SEQ ID NO: 229554 - DNA, 20 bp, Artificial Sequence
  chemically synthesized
agtgttaagttgaacgattg

SEQ ID NO: 229555 - DNA, 20 bp, Artificial Sequence
  chemically synthesized
aattgacgggggttagtgtt

SEQ ID NO: 229556 - DNA, 20 bp, Artificial Sequence
  chemically synthesized
gagacgtaattgacgggggt

SEQ ID NO: 229557 - DNA, 20 bp, Artificial Sequence
  chemically synthesized
acaggagacgtaattgacgg

SEQ ID NO: 229558 - DNA, 20 bp, Artificial Sequence
  chemically synthesized
tacaggagacgtaattgacg

SEQ ID NO: 229559 - DNA, 20 bp, Artificial Sequence
  chemically synthesized
atacaggagacgtaattgac

SEQ ID NO: 229560 - DNA, 20 bp, Artificial Sequence
  chemically synthesized
aatacaggagacgtaattga

SEQ ID NO: 229561 - DNA, 20 bp, Artificial Sequence
  chemically synthesized
caaacctgagaaaaatacag

SEQ ID NO: 229562 - DNA, 20 bp, Artificial Sequence
  chemically synthesized
aacaaacctgagaaaaatac

SEQ ID NO: 229563 - DNA, 20 bp, Artificial Sequence
  chemically synthesized
caacaaacctgagaaaaata

SEQ ID NO: 229564 - DNA, 20 bp, Artificial Sequence
  chemically synthesized
tacgtctcctgtatttttct

SEQ ID NO: 229565 - DNA, 20 bp, Artificial Sequence
  chemically synthesized
acgtctcctgtatttttctc

SEQ ID NO: 229566 - DNA, 20 bp, Artificial Sequence
  chemically synthesized
gagaatgtgacaacaaacct

SEQ ID NO: 229567 - DNA, 20 bp, Artificial Sequence
  chemically synthesized
gtttgttgtcacattctcac

SEQ ID NO: 229568 - DNA, 20 bp, Artificial Sequence
  chemically synthesized
ttgactaaaatagttctagt

SEQ ID NO: 229569 - DNA, 20 bp, Artificial Sequence
  chemically synthesized
ggtcttgactaaaatagttc

SEQ ID NO: 229570 - DNA, 20 bp, Artificial Sequence
  chemically synthesized
cattctcactagaactattt

SEQ ID NO: 229571 - DNA, 20 bp, Artificial Sequence
  chemically synthesized
gatggtggtcttgactaaaa

SEQ ID NO: 229572 - DNA, 20 bp, Artificial Sequence
  chemically synthesized
tcactagaactattttagtc

SEQ ID NO: 229573 - DNA, 20 bp, Artificial Sequence
  chemically synthesized
atcttggcaagaagcgatgg

SEQ ID NO: 229574 - DNA, 20 bp, Artificial Sequence
  chemically synthesized
gtaatcttggcaagaagcga

SEQ ID NO: 229575 - DNA, 20 bp, Artificial Sequence
  chemically synthesized
gaccaccatcgcttcttgcc

SEQ ID NO: 229576 - DNA, 20 bp, Artificial Sequence
  chemically synthesized
attattgtaatcttggcaag

SEQ ID NO: 229577 - DNA, 20 bp, Artificial Sequence
  chemically synthesized
gttattattgtaatcttggc

SEQ ID NO: 229578 - DNA, 20 bp, Artificial Sequence
  chemically synthesized
agaggttattattgtaatct

SEQ ID NO: 229579 - DNA, 20 bp, Artificial Sequence
  chemically synthesized
caaatctgaatggacaaaag

SEQ ID NO: 229580 - DNA, 20 bp, Artificial Sequence
  chemically synthesized
gcaaatctgaatggacaaaa

SEQ ID NO: 229581 - DNA, 20 bp, Artificial Sequence
  chemically synthesized
aagcaaatctgaatggacaa

SEQ ID NO: 229582 - DNA, 20 bp, Artificial Sequence
  chemically synthesized
aataacctcttttgtccatt

SEQ ID NO: 229583 - DNA, 20 bp, Artificial Sequence
  chemically synthesized
cagagagaagcaaatctgaa

SEQ ID NO: 229584 - DNA, 20 bp, Artificial Sequence
  chemically synthesized
gtggagaatggttcagagag

SEQ ID NO: 229585 - DNA, 20 bp, Artificial Sequence
  chemically synthesized
agtgtggagaatggttcaga

SEQ ID NO: 229586 - DNA, 20 bp, Artificial Sequence
  chemically synthesized
gaagtgtggagaatggttca

SEQ ID NO: 229587 - DNA, 20 bp, Artificial Sequence
  chemically synthesized
ctgaagtgtggagaatggtt

SEQ ID NO: 229588 - DNA, 20 bp, Artificial Sequence
  chemically synthesized
tttcgctgaagtgtggagaa

SEQ ID NO: 229589 - DNA, 20 bp, Artificial Sequence
  chemically synthesized
ctgaaccattctccacactt

SEQ ID NO: 229590 - DNA, 20 bp, Artificial Sequence
  chemically synthesized
acttctttcgctgaagtgtg

SEQ ID NO: 229591 - DNA, 20 bp, Artificial Sequence
  chemically synthesized
agacttctttcgctgaagtg

SEQ ID NO: 229592 - DNA, 20 bp, Artificial Sequence
  chemically synthesized
cattctccacacttcagcga

SEQ ID NO: 229593 - DNA, 20 bp, Artificial Sequence
  chemically synthesized
ttcagagacttctttcgctg

SEQ ID NO: 229594 - DNA, 20 bp, Artificial Sequence
  chemically synthesized
tctccacacttcagcgaaag

SEQ ID NO: 229595 - DNA, 20 bp, Artificial Sequence
  chemically synthesized
cgaaagaagtctctgaatca

SEQ ID NO: 229596 - DNA, 20 bp, Artificial Sequence
  chemically synthesized
atgattagagctttgattca

SEQ ID NO: 229597 - DNA, 20 bp, Artificial Sequence
  chemically synthesized
tcatgattagagctttgatt

SEQ ID NO: 229598 - DNA, 20 bp, Artificial Sequence
  chemically synthesized
tcaggaaagagtcatgatta

SEQ ID NO: 229599 - DNA, 20 bp, Artificial Sequence
  chemically synthesized
tgtcaggaaagagtcatgat

SEQ ID NO: 229600 - DNA, 20 bp, Artificial Sequence
  chemically synthesized
gtcacgtggttgtcaggaaa

SEQ ID NO: 229601 - DNA, 20 bp, Artificial Sequence
  chemically synthesized
ttgtcacgtggttgtcagga

SEQ ID NO: 229602 - DNA, 20 bp, Artificial Sequence
  chemically synthesized
ggctttgtcacgtggttgtc

SEQ ID NO: 229603 - DNA, 20 bp, Artificial Sequence
  chemically synthesized
gggctttgtcacgtggttgt

SEQ ID NO: 229604 - DNA, 20 bp, Artificial Sequence
  chemically synthesized
ttcctgacaaccacgtgaca

SEQ ID NO: 229605 - DNA, 20 bp, Artificial Sequence
  chemically synthesized
cccagaagggctttgtcacg

SEQ ID NO: 229606 - DNA, 20 bp, Artificial Sequence
  chemically synthesized
accacgtgacaaagcccttc

SEQ ID NO: 229607 - DNA, 20 bp, Artificial Sequence
  chemically synthesized
ccacgtgacaaagcccttct

SEQ ID NO: 229608 - DNA, 20 bp, Artificial Sequence
  chemically synthesized
cgtgacaaagcccttctggg

SEQ ID NO: 229609 - DNA, 20 bp, Artificial Sequence
  chemically synthesized
agttttttctctgcccagaa

SEQ ID NO: 229610 - DNA, 20 bp, Artificial Sequence
  chemically synthesized
gagttttttctctgcccaga

SEQ ID NO: 229611 - DNA, 20 bp, Artificial Sequence
  chemically synthesized
tgacaaagcccttctgggca

SEQ ID NO: 229612 - DNA, 20 bp, Artificial Sequence
  chemically synthesized
ggagttttttctctgcccag

SEQ ID NO: 229613 - DNA, 20 bp, Artificial Sequence
  chemically synthesized
ttgggagttttttctctgcc

SEQ ID NO: 229614 - DNA, 20 bp, Artificial Sequence
  chemically synthesized
ggcagagaaaaaactcccaa

SEQ ID NO: 229615 - DNA, 20 bp, Artificial Sequence
  chemically synthesized
gcagagaaaaaactcccaac

SEQ ID NO: 229616 - DNA, 20 bp, Artificial Sequence
  chemically synthesized
ggtccttcgggtcctgttgg

SEQ ID NO: 229617 - DNA, 20 bp, Artificial Sequence
  chemically synthesized
agggtccttcgggtcctgtt

SEQ ID NO: 229618 - DNA, 20 bp, Artificial Sequence
  chemically synthesized
gagggtccttcgggtcctgt

SEQ ID NO: 229619 - DNA, 20 bp, Artificial Sequence
  chemically synthesized
aaaactcccaacaggacccg

SEQ ID NO: 229620 - DNA, 20 bp, Artificial Sequence
  chemically synthesized
aaactcccaacaggacccga

SEQ ID NO: 229621 - DNA, 20 bp, Artificial Sequence
  chemically synthesized
tagaacctggagggtccttc

SEQ ID NO: 229622 - DNA, 20 bp, Artificial Sequence
  chemically synthesized
ctagaacctggagggtcctt

SEQ ID NO: 229623 - DNA, 20 bp, Artificial Sequence
  chemically synthesized
acaggacccgaaggaccctc

SEQ ID NO: 229624 - DNA, 20 bp, Artificial Sequence
  chemically synthesized
caggacccgaaggaccctcc

SEQ ID NO: 229625 - DNA, 20 bp, Artificial Sequence
  chemically synthesized
agatggggctagaacctgga

SEQ ID NO: 229626 - DNA, 20 bp, Artificial Sequence
  chemically synthesized
gagatggggctagaacctgg

SEQ ID NO: 229627 - DNA, 20 bp, Artificial Sequence
  chemically synthesized
ccgaaggaccctccaggttc

SEQ ID NO: 229628 - DNA, 20 bp, Artificial Sequence
  chemically synthesized
ggagatggggctagaacctg

SEQ ID NO: 229629 - DNA, 20 bp, Artificial Sequence
  chemically synthesized
gaggagatggggctagaacc

SEQ ID NO: 229630 - DNA, 20 bp, Artificial Sequence
  chemically synthesized
agctaaagaggagatggggc

SEQ ID NO: 229631 - DNA, 20 bp, Artificial Sequence
  chemically synthesized
accaagctaaagaggagatg

SEQ ID NO: 229632 - DNA, 20 bp, Artificial Sequence
  chemically synthesized
gaccaagctaaagaggagat

SEQ ID NO: 229633 - DNA, 20 bp, Artificial Sequence
  chemically synthesized
agaccaagctaaagaggaga

SEQ ID NO: 229634 - DNA, 20 bp, Artificial Sequence
  chemically synthesized
ttctagccccatctcctctt

SEQ ID NO: 229635 - DNA, 20 bp, Artificial Sequence
  chemically synthesized
caagagaccaagctaaagag

SEQ ID NO: 229636 - DNA, 20 bp, Artificial Sequence
  chemically synthesized
ttcaagagaccaagctaaag

SEQ ID NO: 229637 - DNA, 20 bp, Artificial Sequence
  chemically synthesized
gccccatctcctctttagct

SEQ ID NO: 229638 - DNA, 20 bp, Artificial Sequence
  chemically synthesized
gttcaagagaccaagctaaa

SEQ ID NO: 229639 - DNA, 20 bp, Artificial Sequence
  chemically synthesized
atgttcaagagaccaagcta

SEQ ID NO: 229640 - DNA, 20 bp, Artificial Sequence
  chemically synthesized
agaaagatgttcaagagacc

SEQ ID NO: 229641 - DNA, 20 bp, Artificial Sequence
  chemically synthesized
tttggaagaaagatgttcaa

SEQ ID NO: 229642 - DNA, 20 bp, Artificial Sequence
  chemically synthesized
tgtttggaagaaagatgttc

SEQ ID NO: 229643 - DNA, 20 bp, Artificial Sequence
  chemically synthesized
agcagattatgtttggaaga

SEQ ID NO: 229644 - DNA, 20 bp, Artificial Sequence
  chemically synthesized
tgacagcagattatgtttgg

SEQ ID NO: 229645 - DNA, 20 bp, Artificial Sequence
  chemically synthesized
atgtgacagcagattatgtt

SEQ ID NO: 229646 - DNA, 20 bp, Artificial Sequence
  chemically synthesized
gaacagaaagaatgtgacag

SEQ ID NO: 229647 - DNA, 20 bp, Artificial Sequence
  chemically synthesized
aaggaacagaaagaatgtga

SEQ ID NO: 229648 - DNA, 20 bp, Artificial Sequence
  chemically synthesized
gtcagagataaaggaacaga

SEQ ID NO: 229649 - DNA, 20 bp, Artificial Sequence
  chemically synthesized
gagtgtcagagataaaggaa

SEQ ID NO: 229650 - DNA, 20 bp, Artificial Sequence
  chemically synthesized
cctgagagtgtcagagataa

SEQ ID NO: 229651 - DNA, 20 bp, Artificial Sequence
  chemically synthesized
gcctgagagtgtcagagata

SEQ ID NO: 229652 - DNA, 20 bp, Artificial Sequence
  chemically synthesized
agctaagcctgagagtgtca

SEQ ID NO: 229653 - DNA, 20 bp, Artificial Sequence
  chemically synthesized
tcctttatctctgacactct

SEQ ID NO: 229654 - DNA, 20 bp, Artificial Sequence
  chemically synthesized
agagctaagcctgagagtgt

SEQ ID NO: 229655 - DNA, 20 bp, Artificial Sequence
  chemically synthesized
cctttatctctgacactctc

SEQ ID NO: 229656 - DNA, 20 bp, Artificial Sequence
  chemically synthesized
atctctgacactctcaggct

SEQ ID NO: 229657 - DNA, 20 bp, Artificial Sequence
  chemically synthesized
atttaaagagctaagcctga

SEQ ID NO: 229658 - DNA, 20 bp, Artificial Sequence
  chemically synthesized
acatttaaagagctaagcct

SEQ ID NO: 229659 - DNA, 20 bp, Artificial Sequence
  chemically synthesized
agtaccacatttaaagagct

SEQ ID NO: 229660 - DNA, 20 bp, Artificial Sequence
  chemically synthesized
tgcagagtaccacatttaaa

SEQ ID NO: 229661 - DNA, 20 bp, Artificial Sequence
  chemically synthesized
caggcttagctctttaaatg

SEQ ID NO: 229662 - DNA, 20 bp, Artificial Sequence
  chemically synthesized
tatgcagagtaccacattta

SEQ ID NO: 229663 - DNA, 20 bp, Artificial Sequence
  chemically synthesized
tttaaatgtggtactctgca

SEQ ID NO: 229664 - DNA, 20 bp, Artificial Sequence
  chemically synthesized
ggtggaaatttttctatgca

SEQ ID NO: 229665 - DNA, 20 bp, Artificial Sequence
  chemically synthesized
gtggtggaaatttttctatg

SEQ ID NO: 229666 - DNA, 20 bp, Artificial Sequence
  chemically synthesized
caaaactaccgtgaaggtgg

SEQ ID NO: 229667 - DNA, 20 bp, Artificial Sequence
  chemically synthesized
aaaaatttccaccaccttca

SEQ ID NO: 229668 - DNA, 20 bp, Artificial Sequence
  chemically synthesized
acacaaaactaccgtgaagg

SEQ ID NO: 229669 - DNA, 20 bp, Artificial Sequence
  chemically synthesized
aatttccaccaccttcacgg

SEQ ID NO: 229670 - DNA, 20 bp, Artificial Sequence
  chemically synthesized
gccacacaaaactaccgtga

SEQ ID NO: 229671 - DNA, 20 bp, Artificial Sequence
  chemically synthesized
ggccacacaaaactaccgtg

SEQ ID NO: 229672 - DNA, 20 bp, Artificial Sequence
  chemically synthesized
accttcacggtagttttgtg

SEQ ID NO: 229673 - DNA, 20 bp, Artificial Sequence
  chemically synthesized
cacggtagttttgtgtggcc

SEQ ID NO: 229674 - DNA, 20 bp, Artificial Sequence
  chemically synthesized
gtgaagaagtgatatagact

SEQ ID NO: 229675 - DNA, 20 bp, Artificial Sequence
  chemically synthesized
gcttctgtgaagaagtgata

SEQ ID NO: 229676 - DNA, 20 bp, Artificial Sequence
  chemically synthesized
aagtctatatcacttcttca

SEQ ID NO: 229677 - DNA, 20 bp, Artificial Sequence
  chemically synthesized
caccaaaagcttctgtgaag

SEQ ID NO: 229678 - DNA, 20 bp, Artificial Sequence
  chemically synthesized
tctatatcacttcttcacag

SEQ ID NO: 229679 - DNA, 20 bp, Artificial Sequence
  chemically synthesized
ggtcaccaaaagcttctgtg

SEQ ID NO: 229680 - DNA, 20 bp, Artificial Sequence
  chemically synthesized
cacttcttcacagaagcttt

SEQ ID NO: 229681 - DNA, 20 bp, Artificial Sequence
  chemically synthesized
attagtatctgggtcaccaa

SEQ ID NO: 229682 - DNA, 20 bp, Artificial Sequence
  chemically synthesized
cacagaagcttttggtgacc

SEQ ID NO: 229683 - DNA, 20 bp, Artificial Sequence
  chemically synthesized
agaaatttgaattagtatct

SEQ ID NO: 229684 - DNA, 20 bp, Artificial Sequence
  chemically synthesized
tagaaatttgaattagtatc

SEQ ID NO: 229685 - DNA, 20 bp, Artificial Sequence
  chemically synthesized
tccgagttagaaatttgaat

SEQ ID NO: 229686 - DNA, 20 bp, Artificial Sequence
  chemically synthesized
actaattcaaatttctaact

SEQ ID NO: 229687 - DNA, 20 bp, Artificial Sequence
  chemically synthesized
ggaaccactggtgtccgagt

SEQ ID NO: 229688 - DNA, 20 bp, Artificial Sequence
  chemically synthesized
caaatttctaactcggacac

SEQ ID NO: 229689 - DNA, 20 bp, Artificial Sequence
  chemically synthesized
aaggggaaccactggtgtcc

SEQ ID NO: 229690 - DNA, 20 bp, Artificial Sequence
  chemically synthesized
atttctaactcggacaccag

SEQ ID NO: 229691 - DNA, 20 bp, Artificial Sequence
  chemically synthesized
gagagagaaaggggaaccac

SEQ ID NO: 229692 - DNA, 20 bp, Artificial Sequence
  chemically synthesized
attgagagagagagagaaag

SEQ ID NO: 229693 - DNA, 20 bp, Artificial Sequence
  chemically synthesized
gattgagagagagagagaaa

SEQ ID NO: 229694 - DNA, 20 bp, Artificial Sequence
  chemically synthesized
agattgagagagagagagaa

SEQ ID NO: 229695 - DNA, 20 bp, Artificial Sequence
  chemically synthesized
gagattgagagagagagaga

SEQ ID NO: 229696 - DNA, 20 bp, Artificial Sequence
  chemically synthesized
gagagagattgagagagaga

SEQ ID NO: 229697 - DNA, 20 bp, Artificial Sequence
  chemically synthesized
gagagagagattgagagaga

SEQ ID NO: 229698 - DNA, 20 bp, Artificial Sequence
  chemically synthesized
gagagagagagattgagaga

SEQ ID NO: 229699 - DNA, 20 bp, Artificial Sequence
  chemically synthesized
gagagagagagagattgaga

SEQ ID NO: 229700 - DNA, 20 bp, Artificial Sequence
  chemically synthesized
gagagagagagagagattga

SEQ ID NO: 229701 - DNA, 20 bp, Artificial Sequence
  chemically synthesized
gagagagagagagagagatt

SEQ ID NO: 229702 - DNA, 20 bp, Artificial Sequence
  chemically synthesized
gattctgagagagagagaga

SEQ ID NO: 229703 - DNA, 20 bp, Artificial Sequence
  chemically synthesized
gagattctgagagagagaga

SEQ ID NO: 229704 - DNA, 20 bp, Artificial Sequence
  chemically synthesized
atgagattctgagagagaga

SEQ ID NO: 229705 - DNA, 20 bp, Artificial Sequence
  chemically synthesized
caatctctctctctctctct

SEQ ID NO: 229706 - DNA, 20 bp, Artificial Sequence
  chemically synthesized
tcatgagattctgagagaga

SEQ ID NO: 229707 - DNA, 20 bp, Artificial Sequence
  chemically synthesized
tctcatgagattctgagaga

SEQ ID NO: 229708 - DNA, 20 bp, Artificial Sequence
  chemically synthesized
aatctcatgagattctgaga

SEQ ID NO: 229709 - DNA, 20 bp, Artificial Sequence
  chemically synthesized
tgaatctcatgagattctga

SEQ ID NO: 229710 - DNA, 20 bp, Artificial Sequence
  chemically synthesized
gatgaatctcatgagattct

SEQ ID NO: 229711 - DNA, 20 bp, Artificial Sequence
  chemically synthesized
tctctctctcagaatctcat

SEQ ID NO: 229712 - DNA, 20 bp, Artificial Sequence
  chemically synthesized
tcaaccatgatgaatctcat

SEQ ID NO: 229713 - DNA, 20 bp, Artificial Sequence
  chemically synthesized
gaatctcatgagattcatca

SEQ ID NO: 229714 - DNA, 20 bp, Artificial Sequence
  chemically synthesized
catggttgattacttgcata

SEQ ID NO: 229715 - DNA, 20 bp, Artificial Sequence
  chemically synthesized
agggatgtcagactttatgc

SEQ ID NO: 229716 - DNA, 20 bp, Artificial Sequence
  chemically synthesized
cataatcccagcagggatgt

SEQ ID NO: 229717 - DNA, 20 bp, Artificial Sequence
  chemically synthesized
ataaagtctgacatccctgc

SEQ ID NO: 229718 - DNA, 20 bp, Artificial Sequence
  chemically synthesized
taaagtctgacatccctgct

SEQ ID NO: 229719 - DNA, 20 bp, Artificial Sequence
  chemically synthesized
tgacagacataatcccagca

SEQ ID NO: 229720 - DNA, 20 bp, Artificial Sequence
  chemically synthesized
atgacagacataatcccagc

SEQ ID NO: 229721 - DNA, 20 bp, Artificial Sequence
  chemically synthesized
catgacagacataatcccag

SEQ ID NO: 229722 - DNA, 20 bp, Artificial Sequence
  chemically synthesized
gaacatgacagacataatcc

SEQ ID NO: 229723 - DNA, 20 bp, Artificial Sequence
  chemically synthesized
gcatacagaagtgaacatga

SEQ ID NO: 229724 - DNA, 20 bp, Artificial Sequence
  chemically synthesized
actagatgctgagcatacag

SEQ ID NO: 229725 - DNA, 20 bp, Artificial Sequence
  chemically synthesized
catgttcacttctgtatgct

SEQ ID NO: 229726 - DNA, 20 bp, Artificial Sequence
  chemically synthesized
ataactagatgctgagcata

SEQ ID NO: 229727 - DNA, 20 bp, Artificial Sequence
  chemically synthesized
acttctgtatgctcagcatc

SEQ ID NO: 229728 - DNA, 20 bp, Artificial Sequence
  chemically synthesized
attaattataactagatgct

SEQ ID NO: 229729 - DNA, 20 bp, Artificial Sequence
  chemically synthesized
ttattattattaattataac

SEQ ID NO: 229730 - DNA, 20 bp, Artificial Sequence
  chemically synthesized
taataataatactaattact

SEQ ID NO: 229731 - DNA, 20 bp, Artificial Sequence
  chemically synthesized
aataataatactaattactg

SEQ ID NO: 229732 - DNA, 20 bp, Artificial Sequence
  chemically synthesized
tatttagctccctcagtaat

SEQ ID NO: 229733 - DNA, 20 bp, Artificial Sequence
  chemically synthesized
ataataatactaattactga

SEQ ID NO: 229734 - DNA, 20 bp, Artificial Sequence
  chemically synthesized
aataatactaattactgagg

SEQ ID NO: 229735 - DNA, 20 bp, Artificial Sequence
  chemically synthesized
aaataagtatttagctccct

SEQ ID NO: 229736 - DNA, 20 bp, Artificial Sequence
  chemically synthesized
tcatccaacaaataagtatt

SEQ ID NO: 229737 - DNA, 20 bp, Artificial Sequence
  chemically synthesized
ggagctaaatacttatttgt

SEQ ID NO: 229738 - DNA, 20 bp, Artificial Sequence
  chemically synthesized
caatcactcatccaacaaat

SEQ ID NO: 229739 - DNA, 20 bp, Artificial Sequence
  chemically synthesized
taaatacttatttgttggat

SEQ ID NO: 229740 - DNA, 20 bp, Artificial Sequence
  chemically synthesized
atttgttggatgagtgattg

SEQ ID NO: 229741 - DNA, 20 bp, Artificial Sequence
  chemically synthesized
gaaaatgaaatgatgtaaaa

SEQ ID NO: 229742 - DNA, 20 bp, Artificial Sequence
  chemically synthesized
aatgaaatgatgtaaaatag

SEQ ID NO: 229743 - DNA, 20 bp, Artificial Sequence
  chemically synthesized
aaaatagtggaatgataaaa

SEQ ID NO: 229744 - DNA, 20 bp, Artificial Sequence
  chemically synthesized
aatagtggaatgataaaaca

SEQ ID NO: 229745 - DNA, 20 bp, Artificial Sequence
  chemically synthesized
agagtgttgaaaatgttgat

SEQ ID NO: 229746 - DNA, 20 bp, Artificial Sequence
  chemically synthesized
agtgttgaaaatgttgatga

SEQ ID NO: 229747 - DNA, 20 bp, Artificial Sequence
  chemically synthesized
ttgaaaatgttgatgagagc

SEQ ID NO: 229748 - DNA, 20 bp, Artificial Sequence
  chemically synthesized
ttctcaaagcatttataatc

SEQ ID NO: 229749 - DNA, 20 bp, Artificial Sequence
  chemically synthesized
agccagattataaatgcttt

SEQ ID NO: 229750 - DNA, 20 bp, Artificial Sequence
  chemically synthesized
agcctctgaaatatttctca

SEQ ID NO: 229751 - DNA, 20 bp, Artificial Sequence
  chemically synthesized
aaatgctttgagaaatattt

SEQ ID NO: 229752 - DNA, 20 bp, Artificial Sequence
  chemically synthesized
atgctttgagaaatatttca

SEQ ID NO: 229753 - DNA, 20 bp, Artificial Sequence
  chemically synthesized
tgctttgagaaatatttcag

SEQ ID NO: 229754 - DNA, 20 bp, Artificial Sequence
  chemically synthesized
tatttcagaggctgtgctga

SEQ ID NO: 229755 - DNA, 20 bp, Artificial Sequence
  chemically synthesized
atttcagaggctgtgctgac

SEQ ID NO: 229756 - DNA, 20 bp, Artificial Sequence
  chemically synthesized
ctaccaaaatcctgtcagca

SEQ ID NO: 229757 - DNA, 20 bp, Artificial Sequence
  chemically synthesized
aatctctaccaaaatcctgt

SEQ ID NO: 229758 - DNA, 20 bp, Artificial Sequence
  chemically synthesized
aggctgtgctgacaggattt

SEQ ID NO: 229759 - DNA, 20 bp, Artificial Sequence
  chemically synthesized
ctgtgctgacaggattttgg

SEQ ID NO: 229760 - DNA, 20 bp, Artificial Sequence
  chemically synthesized
gtgctgacaggattttggta

SEQ ID NO: 229761 - DNA, 20 bp, Artificial Sequence
  chemically synthesized
acaggattttggtagagatt

SEQ ID NO: 229762 - DNA, 20 bp, Artificial Sequence
  chemically synthesized
caggattttggtagagattt

SEQ ID NO: 229763 - DNA, 20 bp, Artificial Sequence
  chemically synthesized
tggtagagatttgggcaata

SEQ ID NO: 229764 - DNA, 20 bp, Artificial Sequence
  chemically synthesized
gtagagatttgggcaataaa

SEQ ID NO: 229765 - DNA, 20 bp, Artificial Sequence
  chemically synthesized
agatttgggcaataaagagc

SEQ ID NO: 229766 - DNA, 20 bp, Artificial Sequence
  chemically synthesized
tgggcaataaagagccagaa

SEQ ID NO: 229767 - DNA, 20 bp, Artificial Sequence
  chemically synthesized
caataaagagccagaatgga

SEQ ID NO: 229768 - DNA, 20 bp, Artificial Sequence
  chemically synthesized
tcatatatccctatccattc

SEQ ID NO: 229769 - DNA, 20 bp, Artificial Sequence
  chemically synthesized
aataaagagccagaatggat

SEQ ID NO: 229770 - DNA, 20 bp, Artificial Sequence
  chemically synthesized
ataaagagccagaatggata

SEQ ID NO: 229771 - DNA, 20 bp, Artificial Sequence
  chemically synthesized
atagggatatatgataactg

SEQ ID NO: 229772 - DNA, 20 bp, Artificial Sequence
  chemically synthesized
tagggatatatgataactgc

SEQ ID NO: 229773 - DNA, 20 bp, Artificial Sequence
  chemically synthesized
agggatatatgataactgca

SEQ ID NO: 229774 - DNA, 20 bp, Artificial Sequence
  chemically synthesized
actttctctgaaaaaccctg

SEQ ID NO: 229775 - DNA, 20 bp, Artificial Sequence
  chemically synthesized
atgataactgcagggttttt

SEQ ID NO: 229776 - DNA, 20 bp, Artificial Sequence
  chemically synthesized
gataactgcagggtttttca

SEQ ID NO: 229777 - DNA, 20 bp, Artificial Sequence
  chemically synthesized
actgcagggtttttcagaga

SEQ ID NO: 229778 - DNA, 20 bp, Artificial Sequence
  chemically synthesized
aaagtgaattataaatccat

SEQ ID NO: 229779 - DNA, 20 bp, Artificial Sequence
  chemically synthesized
gcatttcttatattgactga

SEQ ID NO: 229780 - DNA, 20 bp, Artificial Sequence
  chemically synthesized
ataaatccatcagtcaatat

SEQ ID NO: 229781 - DNA, 20 bp, Artificial Sequence
  chemically synthesized
atcagtcaatataagaaatg

SEQ ID NO: 229782 - DNA, 20 bp, Artificial Sequence
  chemically synthesized
gtcaatataagaaatgcaga

SEQ ID NO: 229783 - DNA, 20 bp, Artificial Sequence
  chemically synthesized
cagaaagaaaaacaatgttg

SEQ ID NO: 229784 - DNA, 20 bp, Artificial Sequence
  chemically synthesized
aaaaacaatgttgcggatgt

SEQ ID NO: 229785 - DNA, 20 bp, Artificial Sequence
  chemically synthesized
acaatgttgcggatgttaga

SEQ ID NO: 229786 - DNA, 20 bp, Artificial Sequence
  chemically synthesized
caatgttgcggatgttagaa

SEQ ID NO: 229787 - DNA, 20 bp, Artificial Sequence
  chemically synthesized
tgcggatgttagaaaggatt

SEQ ID NO: 229788 - DNA, 20 bp, Artificial Sequence
  chemically synthesized
cggatgttagaaaggattga

SEQ ID NO: 229789 - DNA, 20 bp, Artificial Sequence
  chemically synthesized
gaaaggattgagagattctg

SEQ ID NO: 229790 - DNA, 20 bp, Artificial Sequence
  chemically synthesized
attgagagattctgaagtga

SEQ ID NO: 229791 - DNA, 20 bp, Artificial Sequence
  chemically synthesized
ttgagagattctgaagtgat

SEQ ID NO: 229792 - DNA, 20 bp, Artificial Sequence
  chemically synthesized
tcctgaacatcccatcactt

SEQ ID NO: 229793 - DNA, 20 bp, Artificial Sequence
  chemically synthesized
ttctgaagtgatgggatgtt

SEQ ID NO: 229794 - DNA, 20 bp, Artificial Sequence
  chemically synthesized
tctgaagtgatgggatgttc

SEQ ID NO: 229795 - DNA, 20 bp, Artificial Sequence
  chemically synthesized
atgggatgttcaggaaatcg

SEQ ID NO: 229796 - DNA, 20 bp, Artificial Sequence
  chemically synthesized
atgttcaggaaatcgaagtt

SEQ ID NO: 229797 - DNA, 20 bp, Artificial Sequence
  chemically synthesized
gaaatcgaagttaagatatc

SEQ ID NO: 229798 - DNA, 20 bp, Artificial Sequence
  chemically synthesized
atcgaagttaagatatctag

SEQ ID NO: 229799 - DNA, 20 bp, Artificial Sequence
  chemically synthesized
tcgaagttaagatatctagt

SEQ ID NO: 229800 - DNA, 20 bp, Artificial Sequence
  chemically synthesized
agttaagatatctagtaggc

SEQ ID NO: 229801 - DNA, 20 bp, Artificial Sequence
  chemically synthesized
gtaggtttctgcttgcctac

SEQ ID NO: 229802 - DNA, 20 bp, Artificial Sequence
  chemically synthesized
taagatatctagtaggcaag

SEQ ID NO: 229803 - DNA, 20 bp, Artificial Sequence
  chemically synthesized
gcaagcagaaacctacctta

SEQ ID NO: 229804 - DNA, 20 bp, Artificial Sequence
  chemically synthesized
gaatgttctggccataaggt

SEQ ID NO: 229805 - DNA, 20 bp, Artificial Sequence
  chemically synthesized
agaatgttctggccataagg

SEQ ID NO: 229806 - DNA, 20 bp, Artificial Sequence
  chemically synthesized
gcagaaacctaccttatggc

SEQ ID NO: 229807 - DNA, 20 bp, Artificial Sequence
  chemically synthesized
cagagaatgttctggccata

SEQ ID NO: 229808 - DNA, 20 bp, Artificial Sequence
  chemically synthesized
tcagagaatgttctggccat

SEQ ID NO: 229809 - DNA, 20 bp, Artificial Sequence
  chemically synthesized
ttttgggtcagagaatgttc

SEQ ID NO: 229810 - DNA, 20 bp, Artificial Sequence
  chemically synthesized
gtcttgagacttttgggtca

SEQ ID NO: 229811 - DNA, 20 bp, Artificial Sequence
  chemically synthesized
cagaacattctctgacccaa

SEQ ID NO: 229812 - DNA, 20 bp, Artificial Sequence
  chemically synthesized
tggtcttgagacttttgggt

SEQ ID NO: 229813 - DNA, 20 bp, Artificial Sequence
  chemically synthesized
aaaatggtcttgagactttt

SEQ ID NO: 229814 - DNA, 20 bp, Artificial Sequence
  chemically synthesized
aaaaatggtcttgagacttt

SEQ ID NO: 229815 - DNA, 20 bp, Artificial Sequence
  chemically synthesized
ttctctgacccaaaagtctc

SEQ ID NO: 229816 - DNA, 20 bp, Artificial Sequence
  chemically synthesized
aaaaaaaaaaaaatggtctt

SEQ ID NO: 229817 - DNA, 20 bp, Artificial Sequence
  chemically synthesized
agttgtaaaaaaaaaaaaaa

SEQ ID NO: 229818 - DNA, 20 bp, Artificial Sequence
  chemically synthesized
gaaaagtagtttattgacat

SEQ ID NO: 229819 - DNA, 20 bp, Artificial Sequence
  chemically synthesized
tttctagtgtacatgaaaag

SEQ ID NO: 229820 - DNA, 20 bp, Artificial Sequence
  chemically synthesized
tcatttctagtgtacatgaa

SEQ ID NO: 229821 - DNA, 20 bp, Artificial Sequence
  chemically synthesized
aaactacttttcatgtacac

SEQ ID NO: 229822 - DNA, 20 bp, Artificial Sequence
  chemically synthesized
ttcatgtacactagaaatga

SEQ ID NO: 229823 - DNA, 20 bp, Artificial Sequence
  chemically synthesized
atatttcacactatcatttc

SEQ ID NO: 229824 - DNA, 20 bp, Artificial Sequence
  chemically synthesized
atagtgtgaaatatattaat

SEQ ID NO: 229825 - DNA, 20 bp, Artificial Sequence
  chemically synthesized
tagtgtgaaatatattaatg

SEQ ID NO: 229826 - DNA, 20 bp, Artificial Sequence
  chemically synthesized
catattctgatttttaacaa

SEQ ID NO: 229827 - DNA, 20 bp, Artificial Sequence
  chemically synthesized
ggttaactattgttaaaaat

SEQ ID NO: 229828 - DNA, 20 bp, Artificial Sequence
  chemically synthesized
ttattttacaaacacatatt

SEQ ID NO: 229829 - DNA, 20 bp, Artificial Sequence
  chemically synthesized
tttattttacaaacacatat

SEQ ID NO: 229830 - DNA, 20 bp, Artificial Sequence
  chemically synthesized
aaattttattgtatatattt

SEQ ID NO: 229831 - DNA, 20 bp, Artificial Sequence
  chemically synthesized
aattttattgtatatattta

SEQ ID NO: 229832 - DNA, 20 bp, Artificial Sequence
  chemically synthesized
attttattgtatatatttaa

SEQ ID NO: 229833 - DNA, 20 bp, Artificial Sequence
  chemically synthesized
atttaagggataccacataa

SEQ ID NO: 229834 - DNA, 20 bp, Artificial Sequence
  chemically synthesized
atgcatcttacaccattatg

SEQ ID NO: 229835 - DNA, 20 bp, Artificial Sequence
  chemically synthesized
gggataccacataatggtgt

SEQ ID NO: 229836 - DNA, 20 bp, Artificial Sequence
  chemically synthesized
acataatggtgtaagatgca

SEQ ID NO: 229837 - DNA, 20 bp, Artificial Sequence
  chemically synthesized
tgcatagatatttatatata

SEQ ID NO: 229838 - DNA, 20 bp, Artificial Sequence
  chemically synthesized
tttatatatatagtgtaaaa

SEQ ID NO: 229839 - DNA, 20 bp, Artificial Sequence
  chemically synthesized
gtgtaaaatagttaccattg

SEQ ID NO: 229840 - DNA, 20 bp, Artificial Sequence
  chemically synthesized
gtaaaatagttaccattgtg

SEQ ID NO: 229841 - DNA, 20 bp, Artificial Sequence
  chemically synthesized
tatgataatgttctccacaa

SEQ ID NO: 229842 - DNA, 20 bp, Artificial Sequence
  chemically synthesized
aatgggtaactgtgaaatga

SEQ ID NO: 229843 - DNA, 20 bp, Artificial Sequence
  chemically synthesized
ttatcatatctatcatttca

SEQ ID NO: 229844 - DNA, 20 bp, Artificial Sequence
  chemically synthesized
cttgccacagagtgaaaaat

SEQ ID NO: 229845 - DNA, 20 bp, Artificial Sequence
  chemically synthesized
tcttgccacagagtgaaaaa

SEQ ID NO: 229846 - DNA, 20 bp, Artificial Sequence
  chemically synthesized
gttacccatttttcactctg

SEQ ID NO: 229847 - DNA, 20 bp, Artificial Sequence
  chemically synthesized
cccatttttcactctgtggc

SEQ ID NO: 229848 - DNA, 20 bp, Artificial Sequence
  chemically synthesized
ttatagctgttcttgccaca

SEQ ID NO: 229849 - DNA, 20 bp, Artificial Sequence
  chemically synthesized
gattatagctgttcttgcca

SEQ ID NO: 229850 - DNA, 20 bp, Artificial Sequence
  chemically synthesized
ttttcactctgtggcaagaa

SEQ ID NO: 229851 - DNA, 20 bp, Artificial Sequence
  chemically synthesized
tttgataaatgaatagatta

SEQ ID NO: 229852 - DNA, 20 bp, Artificial Sequence
  chemically synthesized
caagatttttgataaatgaa

SEQ ID NO: 229853 - DNA, 20 bp, Artificial Sequence
  chemically synthesized
gttaataatagtgtgtattc

SEQ ID NO: 229854 - DNA, 20 bp, Artificial Sequence
  chemically synthesized
atgaggactacagttaataa

SEQ ID NO: 229855 - DNA, 20 bp, Artificial Sequence
  chemically synthesized
atacacactattattaactg

SEQ ID NO: 229856 - DNA, 20 bp, Artificial Sequence
  chemically synthesized
aatatacatcatgaggacta

SEQ ID NO: 229857 - DNA, 20 bp, Artificial Sequence
  chemically synthesized
aagatataatatacatcatg

SEQ ID NO: 229858 - DNA, 20 bp, Artificial Sequence
  chemically synthesized
aaagatataatatacatcat

SEQ ID NO: 229859 - DNA, 20 bp, Artificial Sequence
  chemically synthesized
aaaatatattaatatattaa

SEQ ID NO: 229860 - DNA, 20 bp, Artificial Sequence
  chemically synthesized
aatggggcaatgtaggtcat

SEQ ID NO: 229861 - DNA, 20 bp, Artificial Sequence
  chemically synthesized
aaatggggcaatgtaggtca

SEQ ID NO: 229862 - DNA, 20 bp, Artificial Sequence
  chemically synthesized
gtgaggaaatggggcaatgt

SEQ ID NO: 229863 - DNA, 20 bp, Artificial Sequence
  chemically synthesized
tgtgaggaaatggggcaatg

SEQ ID NO: 229864 - DNA, 20 bp, Artificial Sequence
  chemically synthesized
agggtagttgtgaggaaatg

SEQ ID NO: 229865 - DNA, 20 bp, Artificial Sequence
  chemically synthesized
cagggtagttgtgaggaaat

SEQ ID NO: 229866 - DNA, 20 bp, Artificial Sequence
  chemically synthesized
tcagggtagttgtgaggaaa

SEQ ID NO: 229867 - DNA, 20 bp, Artificial Sequence
  chemically synthesized
ccagggtcagggtagttgtg

SEQ ID NO: 229868 - DNA, 20 bp, Artificial Sequence
  chemically synthesized
accagggtcagggtagttgt

SEQ ID NO: 229869 - DNA, 20 bp, Artificial Sequence
  chemically synthesized
agtggttaccagggtcaggg

SEQ ID NO: 229870 - DNA, 20 bp, Artificial Sequence
  chemically synthesized
cctcacaactaccctgaccc

SEQ ID NO: 229871 - DNA, 20 bp, Artificial Sequence
  chemically synthesized
aacagtggttaccagggtca

SEQ ID NO: 229872 - DNA, 20 bp, Artificial Sequence
  chemically synthesized
aaacagtggttaccagggtc

SEQ ID NO: 229873 - DNA, 20 bp, Artificial Sequence
  chemically synthesized
taaacagtggttaccagggt

SEQ ID NO: 229874 - DNA, 20 bp, Artificial Sequence
  chemically synthesized
gaattaaacagtggttacca

SEQ ID NO: 229875 - DNA, 20 bp, Artificial Sequence
  chemically synthesized
tgaattaaacagtggttacc

SEQ ID NO: 229876 - DNA, 20 bp, Artificial Sequence
  chemically synthesized
gtgaattaaacagtggttac

SEQ ID NO: 229877 - DNA, 20 bp, Artificial Sequence
  chemically synthesized
acagatagtgaattaaacag

SEQ ID NO: 229878 - DNA, 20 bp, Artificial Sequence
  chemically synthesized
tatacagatagtgaattaaa

SEQ ID NO: 229879 - DNA, 20 bp, Artificial Sequence
  chemically synthesized
aaaggtcaaatatatacaga

SEQ ID NO: 229880 - DNA, 20 bp, Artificial Sequence
  chemically synthesized
taaaaaaggtcaaatatata

SEQ ID NO: 229881 - DNA, 20 bp, Artificial Sequence
  chemically synthesized
atggaatctttttttaaaaa

SEQ ID NO: 229882 - DNA, 20 bp, Artificial Sequence
  chemically synthesized
tatggaatctttttttaaaa

SEQ ID NO: 229883 - DNA, 20 bp, Artificial Sequence
  chemically synthesized
tatttgaccttttttaaaaa

SEQ ID NO: 229884 - DNA, 20 bp, Artificial Sequence
  chemically synthesized
taaaaaaagattccatatat

SEQ ID NO: 229885 - DNA, 20 bp, Artificial Sequence
  chemically synthesized
tgtatgatctcacttatata

SEQ ID NO: 229886 - DNA, 20 bp, Artificial Sequence
  chemically synthesized
aaaagattccatatataagt

SEQ ID NO: 229887 - DNA, 20 bp, Artificial Sequence
  chemically synthesized
catacaatatttttctttct

SEQ ID NO: 229888 - DNA, 20 bp, Artificial Sequence
  chemically synthesized
tgaaataagccagaccaaga

SEQ ID NO: 229889 - DNA, 20 bp, Artificial Sequence
  chemically synthesized
aatatttttctttcttggtc

SEQ ID NO: 229890 - DNA, 20 bp, Artificial Sequence
  chemically synthesized
taaatgaaataagccagacc

SEQ ID NO: 229891 - DNA, 20 bp, Artificial Sequence
  chemically synthesized
ttatgctaaatgaaataagc

SEQ ID NO: 229892 - DNA, 20 bp, Artificial Sequence
  chemically synthesized
gaccttatgctaaatgaaat

SEQ ID NO: 229893 - DNA, 20 bp, Artificial Sequence
  chemically synthesized
ttggtctggcttatttcatt

SEQ ID NO: 229894 - DNA, 20 bp, Artificial Sequence
  chemically synthesized
tggcttatttcatttagcat

SEQ ID NO: 229895 - DNA, 20 bp, Artificial Sequence
  chemically synthesized
ggcttatttcatttagcata

SEQ ID NO: 229896 - DNA, 20 bp, Artificial Sequence
  chemically synthesized
tcatttagcataaggtcctc

SEQ ID NO: 229897 - DNA, 20 bp, Artificial Sequence
  chemically synthesized
catttagcataaggtcctcc

SEQ ID NO: 229898 - DNA, 20 bp, Artificial Sequence
  chemically synthesized
cccaacatggatggacctgg

SEQ ID NO: 229899 - DNA, 20 bp, Artificial Sequence
  chemically synthesized
tcccaacatggatggacctg

SEQ ID NO: 229900 - DNA, 20 bp, Artificial Sequence
  chemically synthesized
tgtcccaacatggatggacc

SEQ ID NO: 229901 - DNA, 20 bp, Artificial Sequence
  chemically synthesized
tcctccaggtccatccatgt

SEQ ID NO: 229902 - DNA, 20 bp, Artificial Sequence
  chemically synthesized
gtcatttgtcccaacatgga

SEQ ID NO: 229903 - DNA, 20 bp, Artificial Sequence
  chemically synthesized
cctccaggtccatccatgtt

SEQ ID NO: 229904 - DNA, 20 bp, Artificial Sequence
  chemically synthesized
atctgtcatttgtcccaaca

SEQ ID NO: 229905 - DNA, 20 bp, Artificial Sequence
  chemically synthesized
atccatgttgggacaaatga

SEQ ID NO: 229906 - DNA, 20 bp, Artificial Sequence
  chemically synthesized
ttttcagccttaaaaagaag

SEQ ID NO: 229907 - DNA, 20 bp, Artificial Sequence
  chemically synthesized
tgacagatcttcttcttttt

SEQ ID NO: 229908 - DNA, 20 bp, Artificial Sequence
  chemically synthesized
gacagatcttcttcttttta

SEQ ID NO: 229909 - DNA, 20 bp, Artificial Sequence
  chemically synthesized
tatttttcagccttaaaaag

SEQ ID NO: 229910 - DNA, 20 bp, Artificial Sequence
  chemically synthesized
gaatatttttcagccttaaa

SEQ ID NO: 229911 - DNA, 20 bp, Artificial Sequence
  chemically synthesized
acaccccctggaatattttt

SEQ ID NO: 229912 - DNA, 20 bp, Artificial Sequence
  chemically synthesized
tttaaggctgaaaaatattc

SEQ ID NO: 229913 - DNA, 20 bp, Artificial Sequence
  chemically synthesized
ttaaggctgaaaaatattcc

SEQ ID NO: 229914 - DNA, 20 bp, Artificial Sequence
  chemically synthesized
taaggctgaaaaatattcca

SEQ ID NO: 229915 - DNA, 20 bp, Artificial Sequence
  chemically synthesized
aaggctgaaaaatattccag

SEQ ID NO: 229916 - DNA, 20 bp, Artificial Sequence
  chemically synthesized
aggctgaaaaatattccagg

SEQ ID NO: 229917 - DNA, 20 bp, Artificial Sequence
  chemically synthesized
acacacacacacacaccccc

SEQ ID NO: 229918 - DNA, 20 bp, Artificial Sequence
  chemically synthesized
gtgtgtgtacacacgattct

SEQ ID NO: 229919 - DNA, 20 bp, Artificial Sequence
  chemically synthesized
tttacaaagaaatatggtcc

SEQ ID NO: 229920 - DNA, 20 bp, Artificial Sequence
  chemically synthesized
aaacagtttacaaagaaata

SEQ ID NO: 229921 - DNA, 20 bp, Artificial Sequence
  chemically synthesized
tatgtagaaaacagtttaca

SEQ ID NO: 229922 - DNA, 20 bp, Artificial Sequence
  chemically synthesized
ggctaagaatatgtagaaaa

SEQ ID NO: 229923 - DNA, 20 bp, Artificial Sequence
  chemically synthesized
atggaagggctaagaatatg

SEQ ID NO: 229924 - DNA, 20 bp, Artificial Sequence
  chemically synthesized
aactgttttctacatattct

SEQ ID NO: 229925 - DNA, 20 bp, Artificial Sequence
  chemically synthesized
ggggtttctatggaagggct

SEQ ID NO: 229926 - DNA, 20 bp, Artificial Sequence
  chemically synthesized
acatattcttagcccttcca

SEQ ID NO: 229927 - DNA, 20 bp, Artificial Sequence
  chemically synthesized
aatctggggtttctatggaa

SEQ ID NO: 229928 - DNA, 20 bp, Artificial Sequence
  chemically synthesized
gaatctggggtttctatgga

SEQ ID NO: 229929 - DNA, 20 bp, Artificial Sequence
  chemically synthesized
agaatctggggtttctatgg

SEQ ID NO: 229930 - DNA, 20 bp, Artificial Sequence
  chemically synthesized
gagagaatctggggtttcta

SEQ ID NO: 229931 - DNA, 20 bp, Artificial Sequence
  chemically synthesized
tagcccttccatagaaaccc

SEQ ID NO: 229932 - DNA, 20 bp, Artificial Sequence
  chemically synthesized
agagagagagagagaatctg

SEQ ID NO: 229933 - DNA, 20 bp, Artificial Sequence
  chemically synthesized
gagagagagagagagaatct

SEQ ID NO: 229934 - DNA, 20 bp, Artificial Sequence
  chemically synthesized
agagagagagagagagaatc

SEQ ID NO: 229935 - DNA, 20 bp, Artificial Sequence
  chemically synthesized
gagagagagagagagagaga

SEQ ID NO: 229936 - DNA, 20 bp, Artificial Sequence
  chemically synthesized
gagagagagagagagagaga

SEQ ID NO: 229937 - DNA, 20 bp, Artificial Sequence
  chemically synthesized
gagagagagagagagagaga

SEQ ID NO: 229938 - DNA, 20 bp, Artificial Sequence
  chemically synthesized
gagagagagagagagagaga

SEQ ID NO: 229939 - DNA, 20 bp, Artificial Sequence
  chemically synthesized
gagagagagagagagagaga

SEQ ID NO: 229940 - DNA, 20 bp, Artificial Sequence
  chemically synthesized
gagagagagagagagagaga

SEQ ID NO: 229941 - DNA, 20 bp, Artificial Sequence
  chemically synthesized
gagagagagagagagagaga

SEQ ID NO: 229942 - DNA, 20 bp, Artificial Sequence
  chemically synthesized
gagagagagagagagagaga

SEQ ID NO: 229943 - DNA, 20 bp, Artificial Sequence
  chemically synthesized
gagagagagagagagagaga

SEQ ID NO: 229944 - DNA, 20 bp, Artificial Sequence
  chemically synthesized
gagagagagagagagagaga

SEQ ID NO: 229945 - DNA, 20 bp, Artificial Sequence
  chemically synthesized
gggagagagagagagagaga

SEQ ID NO: 229946 - DNA, 20 bp, Artificial Sequence
  chemically synthesized
gagggagagagagagagaga

SEQ ID NO: 229947 - DNA, 20 bp, Artificial Sequence
  chemically synthesized
gagagggagagagagagaga

SEQ ID NO: 229948 - DNA, 20 bp, Artificial Sequence
  chemically synthesized
aggagagggagagagagaga

SEQ ID NO: 229949 - DNA, 20 bp, Artificial Sequence
  chemically synthesized
ggaggagagggagagagaga

SEQ ID NO: 229950 - DNA, 20 bp, Artificial Sequence
  chemically synthesized
caggaggagagggagagaga

SEQ ID NO: 229951 - DNA, 20 bp, Artificial Sequence
  chemically synthesized
agcaggaggagagggagaga

SEQ ID NO: 229952 - DNA, 20 bp, Artificial Sequence
  chemically synthesized
ggagcaggaggagagggaga

SEQ ID NO: 229953 - DNA, 20 bp, Artificial Sequence
  chemically synthesized
gaggagcaggaggagaggga

SEQ ID NO: 229954 - DNA, 20 bp, Artificial Sequence
  chemically synthesized
aggaggagcaggaggagagg

SEQ ID NO: 229955 - DNA, 20 bp, Artificial Sequence
  chemically synthesized
ggaggaggagcaggaggaga

SEQ ID NO: 229956 - DNA, 20 bp, Artificial Sequence
  chemically synthesized
aggaggaggagcaggaggag

SEQ ID NO: 229957 - DNA, 20 bp, Artificial Sequence
  chemically synthesized
gaggaggaggagcaggagga

SEQ ID NO: 229958 - DNA, 20 bp, Artificial Sequence
  chemically synthesized
aggaggaggaggagcaggag

SEQ ID NO: 229959 - DNA, 20 bp, Artificial Sequence
  chemically synthesized
gcaggaggaggaggagcagg

SEQ ID NO: 229960 - DNA, 20 bp, Artificial Sequence
  chemically synthesized
ggcaggaggaggaggagcag

SEQ ID NO: 229961 - DNA, 20 bp, Artificial Sequence
  chemically synthesized
taggcaggaggaggaggagc

SEQ ID NO: 229962 - DNA, 20 bp, Artificial Sequence
  chemically synthesized
gtaggcaggaggaggaggag

SEQ ID NO: 229963 - DNA, 20 bp, Artificial Sequence
  chemically synthesized
gatgtaggcaggaggaggag

SEQ ID NO: 229964 - DNA, 20 bp, Artificial Sequence
  chemically synthesized
gagatgtaggcaggaggagg

SEQ ID NO: 229965 - DNA, 20 bp, Artificial Sequence
  chemically synthesized
agagatgtaggcaggaggag

SEQ ID NO: 229966 - DNA, 20 bp, Artificial Sequence
  chemically synthesized
agagagatgtaggcaggagg

SEQ ID NO: 229967 - DNA, 20 bp, Artificial Sequence
  chemically synthesized
gagagagatgtaggcaggag

SEQ ID NO: 229968 - DNA, 20 bp, Artificial Sequence
  chemically synthesized
gagagagagatgtaggcagg

SEQ ID NO: 229969 - DNA, 20 bp, Artificial Sequence
  chemically synthesized
ggagagagagatgtaggcag

SEQ ID NO: 229970 - DNA, 20 bp, Artificial Sequence
  chemically synthesized
agggagagagagatgtaggc

SEQ ID NO: 229971 - DNA, 20 bp, Artificial Sequence
  chemically synthesized
aagggagagagagatgtagg

SEQ ID NO: 229972 - DNA, 20 bp, Artificial Sequence
  chemically synthesized
aggaagggagagagagatgt

SEQ ID NO: 229973 - DNA, 20 bp, Artificial Sequence
  chemically synthesized
gaggaagggagagagagatg

SEQ ID NO: 229974 - DNA, 20 bp, Artificial Sequence
  chemically synthesized
ctttaagaggaagggagaga

SEQ ID NO: 229975 - DNA, 20 bp, Artificial Sequence
  chemically synthesized
tactttaagaggaagggaga

SEQ ID NO: 229976 - DNA, 20 bp, Artificial Sequence
  chemically synthesized
gttactttaagaggaaggga

SEQ ID NO: 229977 - DNA, 20 bp, Artificial Sequence
  chemically synthesized
gagttactttaagaggaagg

SEQ ID NO: 229978 - DNA, 20 bp, Artificial Sequence
  chemically synthesized
tagagttactttaagaggaa

SEQ ID NO: 229979 - DNA, 20 bp, Artificial Sequence
  chemically synthesized
ttagagttactttaagagga

SEQ ID NO: 229980 - DNA, 20 bp, Artificial Sequence
  chemically synthesized
ctctctctcccttcctctta

SEQ ID NO: 229981 - DNA, 20 bp, Artificial Sequence
  chemically synthesized
tttagagttactttaagagg

SEQ ID NO: 229982 - DNA, 20 bp, Artificial Sequence
  chemically synthesized
tattttagagttactttaag

SEQ ID NO: 229983 - DNA, 20 bp, Artificial Sequence
  chemically synthesized
atattttagagttactttaa

SEQ ID NO: 229984 - DNA, 20 bp, Artificial Sequence
  chemically synthesized
ttatattttagagttacttt

SEQ ID NO: 229985 - DNA, 20 bp, Artificial Sequence
  chemically synthesized
atatttaaaattatatttta

SEQ ID NO: 229986 - DNA, 20 bp, Artificial Sequence
  chemically synthesized
gaatatttaaaattatattt

SEQ ID NO: 229987 - DNA, 20 bp, Artificial Sequence
  chemically synthesized
agtctggcaccagacaaaat

SEQ ID NO: 229988 - DNA, 20 bp, Artificial Sequence
  chemically synthesized
ttaaatattcttattttgtc

SEQ ID NO: 229989 - DNA, 20 bp, Artificial Sequence
  chemically synthesized
attcttattttgtctggtgc

SEQ ID NO: 229990 - DNA, 20 bp, Artificial Sequence
  chemically synthesized
tgtccaaaacagtctggcac

SEQ ID NO: 229991 - DNA, 20 bp, Artificial Sequence
  chemically synthesized
ggctagtgtccaaaacagtc

SEQ ID NO: 229992 - DNA, 20 bp, Artificial Sequence
  chemically synthesized
tgtctggtgccagactgttt

SEQ ID NO: 229993 - DNA, 20 bp, Artificial Sequence
  chemically synthesized
tttatggctagtgtccaaaa

SEQ ID NO: 229994 - DNA, 20 bp, Artificial Sequence
  chemically synthesized
tgccagactgttttggacac

SEQ ID NO: 229995 - DNA, 20 bp, Artificial Sequence
  chemically synthesized
agctaaaaatattttatggc

SEQ ID NO: 229996 - DNA, 20 bp, Artificial Sequence
  chemically synthesized
acacagctaaaaatatttta

SEQ ID NO: 229997 - DNA, 20 bp, Artificial Sequence
  chemically synthesized
cactagccataaaatatttt

SEQ ID NO: 229998 - DNA, 20 bp, Artificial Sequence
  chemically synthesized
tatggtagcttaaatgaaca

SEQ ID NO: 229999 - DNA, 20 bp, Artificial Sequence
  chemically synthesized
atttttagctgtgttcattt

SEQ ID NO: 230000 - DNA, 20 bp, Artificial Sequence
  chemically synthesized
gttcatttaagctaccatac

SEQ ID NO: 230001 - DNA, 20 bp, Artificial Sequence
  chemically synthesized
gtagcgcctggcttgtatgg

SEQ ID NO: 230002 - DNA, 20 bp, Artificial Sequence
  chemically synthesized
atttaagctaccatacaagc

SEQ ID NO: 230003 - DNA, 20 bp, Artificial Sequence
  chemically synthesized
gatgtagcgcctggcttgta

SEQ ID NO: 230004 - DNA, 20 bp, Artificial Sequence
  chemically synthesized
tttaagctaccatacaagcc

SEQ ID NO: 230005 - DNA, 20 bp, Artificial Sequence
  chemically synthesized
tgttctgtagatgtagcgcc

SEQ ID NO: 230006 - DNA, 20 bp, Artificial Sequence
  chemically synthesized
caagccaggcgctacatcta

SEQ ID NO: 230007 - DNA, 20 bp, Artificial Sequence
  chemically synthesized
agaaaggtgttctgtagatg

SEQ ID NO: 230008 - DNA, 20 bp, Artificial Sequence
  chemically synthesized
gtaaaaagaaaggtgttctg

SEQ ID NO: 230009 - DNA, 20 bp, Artificial Sequence
  chemically synthesized
aacttacaaagtaaaaagaa

SEQ ID NO: 230010 - DNA, 20 bp, Artificial Sequence
  chemically synthesized
gaacttacaaagtaaaaaga

SEQ ID NO: 230011 - DNA, 20 bp, Artificial Sequence
  chemically synthesized
aaaagaacttacaaagtaaa

SEQ ID NO: 230012 - DNA, 20 bp, Artificial Sequence
  chemically synthesized
cacctttctttttactttgt

SEQ ID NO: 230013 - DNA, 20 bp, Artificial Sequence
  chemically synthesized
atattataaaagaacttaca

SEQ ID NO: 230014 - DNA, 20 bp, Artificial Sequence
  chemically synthesized
caccacatccaatattataa

SEQ ID NO: 230015 - DNA, 20 bp, Artificial Sequence
  chemically synthesized
tgtaagttcttttataatat

SEQ ID NO: 230016 - DNA, 20 bp, Artificial Sequence
  chemically synthesized
ttcttttataatattggatg

SEQ ID NO: 230017 - DNA, 20 bp, Artificial Sequence
  chemically synthesized
ataatattggatgtggtgat

SEQ ID NO: 230018 - DNA, 20 bp, Artificial Sequence
  chemically synthesized
ttggatgtggtgatgagata

SEQ ID NO: 230019 - DNA, 20 bp, Artificial Sequence
  chemically synthesized
tgtggtgatgagataaagaa

SEQ ID NO: 230020 - DNA, 20 bp, Artificial Sequence
  chemically synthesized
tggtgatgagataaagaaaa

SEQ ID NO: 230021 - DNA, 20 bp, Artificial Sequence
  chemically synthesized
gatgagataaagaaaagagt

SEQ ID NO: 230022 - DNA, 20 bp, Artificial Sequence
  chemically synthesized
atgagataaagaaaagagtg

SEQ ID NO: 230023 - DNA, 20 bp, Artificial Sequence
  chemically synthesized
aagaaaagagtgaggtataa

SEQ ID NO: 230024 - DNA, 20 bp, Artificial Sequence
  chemically synthesized
gtgaggtataatggtcttcc

SEQ ID NO: 230025 - DNA, 20 bp, Artificial Sequence
  chemically synthesized
tgaggtataatggtcttcct

SEQ ID NO: 230026 - DNA, 20 bp, Artificial Sequence
  chemically synthesized
agaaaattctgatacctagg

SEQ ID NO: 230027 - DNA, 20 bp, Artificial Sequence
  chemically synthesized
ataatggtcttcctaggtat

SEQ ID NO: 230028 - DNA, 20 bp, Artificial Sequence
  chemically synthesized
aaaagaaaattctgatacct

SEQ ID NO: 230029 - DNA, 20 bp, Artificial Sequence
  chemically synthesized
aaaaagaaaattctgatacc

SEQ ID NO: 230030 - DNA, 20 bp, Artificial Sequence
  chemically synthesized
ggtatcagaattttcttttt

SEQ ID NO: 230031 - DNA, 20 bp, Artificial Sequence
  chemically synthesized
aagaaaaacagtttctcaaa

SEQ ID NO: 230032 - DNA, 20 bp, Artificial Sequence
  chemically synthesized
cgttactaaaggaagaaaaa

SEQ ID NO: 230033 - DNA, 20 bp, Artificial Sequence
  chemically synthesized
agaaactgtttttcttcctt

SEQ ID NO: 230034 - DNA, 20 bp, Artificial Sequence
  chemically synthesized
cttgttttcgttactaaagg

SEQ ID NO: 230035 - DNA, 20 bp, Artificial Sequence
  chemically synthesized
gctcttgttttcgttactaa

SEQ ID NO: 230036 - DNA, 20 bp, Artificial Sequence
  chemically synthesized
ggctcttgttttcgttacta

SEQ ID NO: 230037 - DNA, 20 bp, Artificial Sequence
  chemically synthesized
cttcctttagtaacgaaaac

SEQ ID NO: 230038 - DNA, 20 bp, Artificial Sequence
  chemically synthesized
tcctttagtaacgaaaacaa

SEQ ID NO: 230039 - DNA, 20 bp, Artificial Sequence
  chemically synthesized
cagaactcagatcattatgt

SEQ ID NO: 230040 - DNA, 20 bp, Artificial Sequence
  chemically synthesized
aagagccaacataatgatct

SEQ ID NO: 230041 - DNA, 20 bp, Artificial Sequence
  chemically synthesized
acacactcattatcagaact

SEQ ID NO: 230042 - DNA, 20 bp, Artificial Sequence
  chemically synthesized
atgatctgagttctgataat

SEQ ID NO: 230043 - DNA, 20 bp, Artificial Sequence
  chemically synthesized
tgccaaaacacactcattat

SEQ ID NO: 230044 - DNA, 20 bp, Artificial Sequence
  chemically synthesized
ttctgataatgagtgtgttt

SEQ ID NO: 230045 - DNA, 20 bp, Artificial Sequence
  chemically synthesized
gttacctttgattcatgtga

SEQ ID NO: 230046 - DNA, 20 bp, Artificial Sequence
  chemically synthesized
acaaactgtcacatgaatca

SEQ ID NO: 230047 - DNA, 20 bp, Artificial Sequence
  chemically synthesized
caaactgtcacatgaatcaa

SEQ ID NO: 230048 - DNA, 20 bp, Artificial Sequence
  chemically synthesized
atgttaatttatacatgttc

SEQ ID NO: 230049 - DNA, 20 bp, Artificial Sequence
  chemically synthesized
atgtataaattaacattcca

SEQ ID NO: 230050 - DNA, 20 bp, Artificial Sequence
  chemically synthesized
ataaattaacattccacagc

SEQ ID NO: 230051 - DNA, 20 bp, Artificial Sequence
  chemically synthesized
atctaaatattttctggctg

SEQ ID NO: 230052 - DNA, 20 bp, Artificial Sequence
  chemically synthesized
tagtgaatctaaatattttc

SEQ ID NO: 230053 - DNA, 20 bp, Artificial Sequence
  chemically synthesized
ttccacagccagaaaatatt

SEQ ID NO: 230054 - DNA, 20 bp, Artificial Sequence
  chemically synthesized
tttgcttagagtaacagatt

SEQ ID NO: 230055 - DNA, 20 bp, Artificial Sequence
  chemically synthesized
ttcactaaatctgttactct

SEQ ID NO: 230056 - DNA, 20 bp, Artificial Sequence
  chemically synthesized
ctgaattttgcttagagtaa

SEQ ID NO: 230057 - DNA, 20 bp, Artificial Sequence
  chemically synthesized
taactcctgaattttgctta

SEQ ID NO: 230058 - DNA, 20 bp, Artificial Sequence
  chemically synthesized
cttaactcctgaattttgct

SEQ ID NO: 230059 - DNA, 20 bp, Artificial Sequence
  chemically synthesized
ctgttactctaagcaaaatt

SEQ ID NO: 230060 - DNA, 20 bp, Artificial Sequence
  chemically synthesized
tgttactctaagcaaaattc

SEQ ID NO: 230061 - DNA, 20 bp, Artificial Sequence
  chemically synthesized
ttactctaagcaaaattcag

SEQ ID NO: 230062 - DNA, 20 bp, Artificial Sequence
  chemically synthesized
ctaagcaaaattcaggagtt

SEQ ID NO: 230063 - DNA, 20 bp, Artificial Sequence
  chemically synthesized
ttcaggagttaagtcaatga

SEQ ID NO: 230064 - DNA, 20 bp, Artificial Sequence
  chemically synthesized
ggagttaagtcaatgataga

SEQ ID NO: 230065 - DNA, 20 bp, Artificial Sequence
  chemically synthesized
tcaatgatagatggccattt

SEQ ID NO: 230066 - DNA, 20 bp, Artificial Sequence
  chemically synthesized
ctaagatccagacaccaaaa

SEQ ID NO: 230067 - DNA, 20 bp, Artificial Sequence
  chemically synthesized
tagatggccattttggtgtc

SEQ ID NO: 230068 - DNA, 20 bp, Artificial Sequence
  chemically synthesized
ccattttggtgtctggatct

SEQ ID NO: 230069 - DNA, 20 bp, Artificial Sequence
  chemically synthesized
cattttggtgtctggatctt

SEQ ID NO: 230070 - DNA, 20 bp, Artificial Sequence
  chemically synthesized
tcctattttctcctaagatc

SEQ ID NO: 230071 - DNA, 20 bp, Artificial Sequence
  chemically synthesized
ttttggtgtctggatcttag

SEQ ID NO: 230072 - DNA, 20 bp, Artificial Sequence
  chemically synthesized
ttatggtcctattttctcct

SEQ ID NO: 230073 - DNA, 20 bp, Artificial Sequence
  chemically synthesized
gtctggatcttaggagaaaa

SEQ ID NO: 230074 - DNA, 20 bp, Artificial Sequence
  chemically synthesized
tctggatcttaggagaaaat

SEQ ID NO: 230075 - DNA, 20 bp, Artificial Sequence
  chemically synthesized
ttaggagaaaataggaccat

SEQ ID NO: 230076 - DNA, 20 bp, Artificial Sequence
  chemically synthesized
aggacagtgtttatttctta

SEQ ID NO: 230077 - DNA, 20 bp, Artificial Sequence
  chemically synthesized
agtttatttctttgtaagga

SEQ ID NO: 230078 - DNA, 20 bp, Artificial Sequence
  chemically synthesized
aaataaacactgtccttaca

SEQ ID NO: 230079 - DNA, 20 bp, Artificial Sequence
  chemically synthesized
caaaagtttatttctttgta

SEQ ID NO: 230080 - DNA, 20 bp, Artificial Sequence
  chemically synthesized
acaaaagtttatttctttgt

SEQ ID NO: 230081 - DNA, 20 bp, Artificial Sequence
  chemically synthesized
aaagaaataaacttttgtcc

SEQ ID NO: 230082 - DNA, 20 bp, Artificial Sequence
  chemically synthesized
accatttaactccaggacaa

SEQ ID NO: 230083 - DNA, 20 bp, Artificial Sequence
  chemically synthesized
agaaataaacttttgtcctg

SEQ ID NO: 230084 - DNA, 20 bp, Artificial Sequence
  chemically synthesized
cctttttaccatttaactcc

SEQ ID NO: 230085 - DNA, 20 bp, Artificial Sequence
  chemically synthesized
tcctttttaccatttaactc

SEQ ID NO: 230086 - DNA, 20 bp, Artificial Sequence
  chemically synthesized
acttttgtcctggagttaaa

SEQ ID NO: 230087 - DNA, 20 bp, Artificial Sequence
  chemically synthesized
tcctggagttaaatggtaaa

SEQ ID NO: 230088 - DNA, 20 bp, Artificial Sequence
  chemically synthesized
cctggagttaaatggtaaaa

SEQ ID NO: 230089 - DNA, 20 bp, Artificial Sequence
  chemically synthesized
tggtaaaaaggacgccccct

SEQ ID NO: 230090 - DNA, 20 bp, Artificial Sequence
  chemically synthesized
ggtaaaaaggacgccccctc

SEQ ID NO: 230091 - DNA, 20 bp, Artificial Sequence
  chemically synthesized
gtaaaaaggacgccccctca

SEQ ID NO: 230092 - DNA, 20 bp, Artificial Sequence
  chemically synthesized
taaaaaggacgccccctcag

SEQ ID NO: 230093 - DNA, 20 bp, Artificial Sequence
  chemically synthesized
caaggtatgctcccctgagg

SEQ ID NO: 230094 - DNA, 20 bp, Artificial Sequence
  chemically synthesized
aaaaggacgccccctcaggg

SEQ ID NO: 230095 - DNA, 20 bp, Artificial Sequence
  chemically synthesized
tcaaggtatgctcccctgag

SEQ ID NO: 230096 - DNA, 20 bp, Artificial Sequence
  chemically synthesized
atcaaggtatgctcccctga

SEQ ID NO: 230097 - DNA, 20 bp, Artificial Sequence
  chemically synthesized
tatcaaggtatgctcccctg

SEQ ID NO: 230098 - DNA, 20 bp, Artificial Sequence
  chemically synthesized
ttatcaaggtatgctcccct

SEQ ID NO: 230099 - DNA, 20 bp, Artificial Sequence
  chemically synthesized
ttggatgatcaatattatca

SEQ ID NO: 230100 - DNA, 20 bp, Artificial Sequence
  chemically synthesized
tttggatgatcaatattatc

SEQ ID NO: 230101 - DNA, 20 bp, Artificial Sequence
  chemically synthesized
gataatattgatcatccaaa

SEQ ID NO: 230102 - DNA, 20 bp, Artificial Sequence
  chemically synthesized
ataatattgatcatccaaat

SEQ ID NO: 230103 - DNA, 20 bp, Artificial Sequence
  chemically synthesized
ccaaaccatatcatcctatt

SEQ ID NO: 230104 - DNA, 20 bp, Artificial Sequence
  chemically synthesized
atcatccaaataggatgata

SEQ ID NO: 230105 - DNA, 20 bp, Artificial Sequence
  chemically synthesized
ccaaataggatgatatggtt

SEQ ID NO: 230106 - DNA, 20 bp, Artificial Sequence
  chemically synthesized
atgagatttggatggggaca

SEQ ID NO: 230107 - DNA, 20 bp, Artificial Sequence
  chemically synthesized
ttcaagatgagatttggatg

SEQ ID NO: 230108 - DNA, 20 bp, Artificial Sequence
  chemically synthesized
attcaagatgagatttggat

SEQ ID NO: 230109 - DNA, 20 bp, Artificial Sequence
  chemically synthesized
aattcaagatgagatttgga

SEQ ID NO: 230110 - DNA, 20 bp, Artificial Sequence
  chemically synthesized
ctacaattcaagatgagatt

SEQ ID NO: 230111 - DNA, 20 bp, Artificial Sequence
  chemically synthesized
tgggagctacaattcaagat

SEQ ID NO: 230112 - DNA, 20 bp, Artificial Sequence
  chemically synthesized
ccaaatctcatcttgaattg

SEQ ID NO: 230113 - DNA, 20 bp, Artificial Sequence
  chemically synthesized
gattatgggagctacaattc

SEQ ID NO: 230114 - DNA, 20 bp, Artificial Sequence
  chemically synthesized
atgacacatggggattatgg

SEQ ID NO: 230115 - DNA, 20 bp, Artificial Sequence
  chemically synthesized
ccatgacacatggggattat

SEQ ID NO: 230116 - DNA, 20 bp, Artificial Sequence
  chemically synthesized
cccatgacacatggggatta

SEQ ID NO: 230117 - DNA, 20 bp, Artificial Sequence
  chemically synthesized
ggtcactcccatgacacatg

SEQ ID NO: 230118 - DNA, 20 bp, Artificial Sequence
  chemically synthesized
aggtcactcccatgacacat

SEQ ID NO: 230119 - DNA, 20 bp, Artificial Sequence
  chemically synthesized
cccataatccccatgtgtca

SEQ ID NO: 230120 - DNA, 20 bp, Artificial Sequence
  chemically synthesized
caggtcactcccatgacaca

SEQ ID NO: 230121 - DNA, 20 bp, Artificial Sequence
  chemically synthesized
ccataatccccatgtgtcat

SEQ ID NO: 230122 - DNA, 20 bp, Artificial Sequence
  chemically synthesized
ataatccccatgtgtcatgg

SEQ ID NO: 230123 - DNA, 20 bp, Artificial Sequence
  chemically synthesized
catgtgtcatgggagtgacc

SEQ ID NO: 230124 - DNA, 20 bp, Artificial Sequence
  chemically synthesized
gtgtcatgggagtgacctgg

SEQ ID NO: 230125 - DNA, 20 bp, Artificial Sequence
  chemically synthesized
tgtcatgggagtgacctggt

SEQ ID NO: 230126 - DNA, 20 bp, Artificial Sequence
  chemically synthesized
tcatgggagtgacctggtgg

SEQ ID NO: 230127 - DNA, 20 bp, Artificial Sequence
  chemically synthesized
catgggagtgacctggtggg

SEQ ID NO: 230128 - DNA, 20 bp, Artificial Sequence
  chemically synthesized
tgattcaattacctcccacc

SEQ ID NO: 230129 - DNA, 20 bp, Artificial Sequence
  chemically synthesized
gtgattcaattacctcccac

SEQ ID NO: 230130 - DNA, 20 bp, Artificial Sequence
  chemically synthesized
ggtgggaggtaattgaatca

SEQ ID NO: 230131 - DNA, 20 bp, Artificial Sequence
  chemically synthesized
gtgggaggtaattgaatcac

SEQ ID NO: 230132 - DNA, 20 bp, Artificial Sequence
  chemically synthesized
tgggaggtaattgaatcacg

SEQ ID NO: 230133 - DNA, 20 bp, Artificial Sequence
  chemically synthesized
aggtaattgaatcacgggga

SEQ ID NO: 230134 - DNA, 20 bp, Artificial Sequence
  chemically synthesized
cacggggatggttctgtgct

SEQ ID NO: 230135 - DNA, 20 bp, Artificial Sequence
  chemically synthesized
acggggatggttctgtgctg

SEQ ID NO: 230136 - DNA, 20 bp, Artificial Sequence
  chemically synthesized
cggggatggttctgtgctga

SEQ ID NO: 230137 - DNA, 20 bp, Artificial Sequence
  chemically synthesized
agtatttagctccctcagca

SEQ ID NO: 230138 - DNA, 20 bp, Artificial Sequence
  chemically synthesized
gggatggttctgtgctgagg

SEQ ID NO: 230139 - DNA, 20 bp, Artificial Sequence
  chemically synthesized
gcacaagtatttagctccct

SEQ ID NO: 230140 - DNA, 20 bp, Artificial Sequence
  chemically synthesized
ataaggacagcacaagtatt

SEQ ID NO: 230141 - DNA, 20 bp, Artificial Sequence
  chemically synthesized
cactgccataaggacagcac

SEQ ID NO: 230142 - DNA, 20 bp, Artificial Sequence
  chemically synthesized
aaatacttgtgctgtcctta

SEQ ID NO: 230143 - DNA, 20 bp, Artificial Sequence
  chemically synthesized
cttattcactgccataagga

SEQ ID NO: 230144 - DNA, 20 bp, Artificial Sequence
  chemically synthesized
tacttgtgctgtccttatgg

SEQ ID NO: 230145 - DNA, 20 bp, Artificial Sequence
  chemically synthesized
gagacttattcactgccata

SEQ ID NO: 230146 - DNA, 20 bp, Artificial Sequence
  chemically synthesized
tgagacttattcactgccat

SEQ ID NO: 230147 - DNA, 20 bp, Artificial Sequence
  chemically synthesized
ctgtccttatggcagtgaat

SEQ ID NO: 230148 - DNA, 20 bp, Artificial Sequence
  chemically synthesized
ttatggcagtgaataagtct

SEQ ID NO: 230149 - DNA, 20 bp, Artificial Sequence
  chemically synthesized
tatggcagtgaataagtctc

SEQ ID NO: 230150 - DNA, 20 bp, Artificial Sequence
  chemically synthesized
tggcagtgaataagtctcag

SEQ ID NO: 230151 - DNA, 20 bp, Artificial Sequence
  chemically synthesized
ataaaaccatcagatctcct

SEQ ID NO: 230152 - DNA, 20 bp, Artificial Sequence
  chemically synthesized
ataagtctcaggagatctga

SEQ ID NO: 230153 - DNA, 20 bp, Artificial Sequence
  chemically synthesized
attgccctttataaaaccat

SEQ ID NO: 230154 - DNA, 20 bp, Artificial Sequence
  chemically synthesized
ggagatctgatggttttata

SEQ ID NO: 230155 - DNA, 20 bp, Artificial Sequence
  chemically synthesized
gagatctgatggttttataa

SEQ ID NO: 230156 - DNA, 20 bp, Artificial Sequence
  chemically synthesized
agatctgatggttttataaa

SEQ ID NO: 230157 - DNA, 20 bp, Artificial Sequence
  chemically synthesized
tggcaggcaagagcgtgtgc

SEQ ID NO: 230158 - DNA, 20 bp, Artificial Sequence
  chemically synthesized
gtggcaggcaagagcgtgtg

SEQ ID NO: 230159 - DNA, 20 bp, Artificial Sequence
  chemically synthesized
gcttacatggtggcaggcaa

SEQ ID NO: 230160 - DNA, 20 bp, Artificial Sequence
  chemically synthesized
tggcttacatggtggcaggc

SEQ ID NO: 230161 - DNA, 20 bp, Artificial Sequence
  chemically synthesized
ggcatggcttacatggtggc

SEQ ID NO: 230162 - DNA, 20 bp, Artificial Sequence
  chemically synthesized
aggcatggcttacatggtgg

SEQ ID NO: 230163 - DNA, 20 bp, Artificial Sequence
  chemically synthesized
gctcttgcctgccaccatgt

SEQ ID NO: 230164 - DNA, 20 bp, Artificial Sequence
  chemically synthesized
caaaggcatggcttacatgg

SEQ ID NO: 230165 - DNA, 20 bp, Artificial Sequence
  chemically synthesized
tagcaaaggcatggcttaca

SEQ ID NO: 230166 - DNA, 20 bp, Artificial Sequence
  chemically synthesized
gtgaaggggtagcaaaggca

SEQ ID NO: 230167 - DNA, 20 bp, Artificial Sequence
  chemically synthesized
ggaaggtgaaggggtagcaa

SEQ ID NO: 230168 - DNA, 20 bp, Artificial Sequence
  chemically synthesized
tggaaggtgaaggggtagca

SEQ ID NO: 230169 - DNA, 20 bp, Artificial Sequence
  chemically synthesized
catggtggaaggtgaagggg

SEQ ID NO: 230170 - DNA, 20 bp, Artificial Sequence
  chemically synthesized
aatcatggtggaaggtgaag

SEQ ID NO: 230171 - DNA, 20 bp, Artificial Sequence
  chemically synthesized
caatcatggtggaaggtgaa

SEQ ID NO: 230172 - DNA, 20 bp, Artificial Sequence
  chemically synthesized
acaatcatggtggaaggtga

SEQ ID NO: 230173 - DNA, 20 bp, Artificial Sequence
  chemically synthesized
cacaatcatggtggaaggtg

SEQ ID NO: 230174 - DNA, 20 bp, Artificial Sequence
  chemically synthesized
ggcctcacaatcatggtgga

SEQ ID NO: 230175 - DNA, 20 bp, Artificial Sequence
  chemically synthesized
aggcctcacaatcatggtgg

SEQ ID NO: 230176 - DNA, 20 bp, Artificial Sequence
  chemically synthesized
gggaggcctcacaatcatgg

SEQ ID NO: 230177 - DNA, 20 bp, Artificial Sequence
  chemically synthesized
tcaccttccaccatgattgt

SEQ ID NO: 230178 - DNA, 20 bp, Artificial Sequence
  chemically synthesized
ctagggaggcctcacaatca

SEQ ID NO: 230179 - DNA, 20 bp, Artificial Sequence
  chemically synthesized
caccttccaccatgattgtg

SEQ ID NO: 230180 - DNA, 20 bp, Artificial Sequence
  chemically synthesized
ccatgattgtgaggcctccc

SEQ ID NO: 230181 - DNA, 20 bp, Artificial Sequence
  chemically synthesized
acagtctcacatgactaggg

SEQ ID NO: 230182 - DNA, 20 bp, Artificial Sequence
  chemically synthesized
cacagtctcacatgactagg

SEQ ID NO: 230183 - DNA, 20 bp, Artificial Sequence
  chemically synthesized
ctcacagtctcacatgacta

SEQ ID NO: 230184 - DNA, 20 bp, Artificial Sequence
  chemically synthesized
actcacagtctcacatgact

SEQ ID NO: 230185 - DNA, 20 bp, Artificial Sequence
  chemically synthesized
tgaggcctccctagtcatgt

SEQ ID NO: 230186 - DNA, 20 bp, Artificial Sequence
  chemically synthesized
gactcacagtctcacatgac

SEQ ID NO: 230187 - DNA, 20 bp, Artificial Sequence
  chemically synthesized
ccctagtcatgtgagactgt

SEQ ID NO: 230188 - DNA, 20 bp, Artificial Sequence
  chemically synthesized
aaagaggcttaatggactca

SEQ ID NO: 230189 - DNA, 20 bp, Artificial Sequence
  chemically synthesized
tgtgagactgtgagtccatt

SEQ ID NO: 230190 - DNA, 20 bp, Artificial Sequence
  chemically synthesized
ataagtaaaaagaggcttaa

SEQ ID NO: 230191 - DNA, 20 bp, Artificial Sequence
  chemically synthesized
ggtaatttataagtaaaaag

SEQ ID NO: 230192 - DNA, 20 bp, Artificial Sequence
  chemically synthesized
gggtaatttataagtaaaaa

SEQ ID NO: 230193 - DNA, 20 bp, Artificial Sequence
  chemically synthesized
ctgggtaatttataagtaaa

SEQ ID NO: 230194 - DNA, 20 bp, Artificial Sequence
  chemically synthesized
cccaagactgggtaatttat

SEQ ID NO: 230195 - DNA, 20 bp, Artificial Sequence
  chemically synthesized
ctttttacttataaattacc

SEQ ID NO: 230196 - DNA, 20 bp, Artificial Sequence
  chemically synthesized
acttataaattacccagtct

SEQ ID NO: 230197 - DNA, 20 bp, Artificial Sequence
  chemically synthesized
cttataaattacccagtctt

SEQ ID NO: 230198 - DNA, 20 bp, Artificial Sequence
  chemically synthesized
atgaagaaatacccaagact

SEQ ID NO: 230199 - DNA, 20 bp, Artificial Sequence
  chemically synthesized
tatgaagaaatacccaagac

SEQ ID NO: 230200 - DNA, 20 bp, Artificial Sequence
  chemically synthesized
actgctatgaagaaataccc

SEQ ID NO: 230201 - DNA, 20 bp, Artificial Sequence
  chemically synthesized
cagtcttgggtatttcttca

SEQ ID NO: 230202 - DNA, 20 bp, Artificial Sequence
  chemically synthesized
tcttgggtatttcttcatag

SEQ ID NO: 230203 - DNA, 20 bp, Artificial Sequence
  chemically synthesized
ttcattttcctactgctatg

SEQ ID NO: 230204 - DNA, 20 bp, Artificial Sequence
  chemically synthesized
tgggtatttcttcatagcag

SEQ ID NO: 230205 - DNA, 20 bp, Artificial Sequence
  chemically synthesized
gggtatttcttcatagcagt

SEQ ID NO: 230206 - DNA, 20 bp, Artificial Sequence
  chemically synthesized
taggaaaatgaactaataca

SEQ ID NO: 230207 - DNA, 20 bp, Artificial Sequence
  chemically synthesized
aggaaaatgaactaatacat

SEQ ID NO: 230208 - DNA, 20 bp, Artificial Sequence
  chemically synthesized
ttctcaataatcctatgtat

SEQ ID NO: 230209 - DNA, 20 bp, Artificial Sequence
  chemically synthesized
aactaatacataggattatt

SEQ ID NO: 230210 - DNA, 20 bp, Artificial Sequence
  chemically synthesized
gtctccatcagacatcaatc

SEQ ID NO: 230211 - DNA, 20 bp, Artificial Sequence
  chemically synthesized
ttttctcgattgatgtctga

SEQ ID NO: 230212 - DNA, 20 bp, Artificial Sequence
  chemically synthesized
ttctcgattgatgtctgatg

SEQ ID NO: 230213 - DNA, 20 bp, Artificial Sequence
  chemically synthesized
attaagcacttagtctccat

SEQ ID NO: 230214 - DNA, 20 bp, Artificial Sequence
  chemically synthesized
attgatgtctgatggagact

SEQ ID NO: 230215 - DNA, 20 bp, Artificial Sequence
  chemically synthesized
ctgttttcatattaagcact

SEQ ID NO: 230216 - DNA, 20 bp, Artificial Sequence
  chemically synthesized
atgagttctgttttcatatt

SEQ ID NO: 230217 - DNA, 20 bp, Artificial Sequence
  chemically synthesized
ctaagtgcttaatatgaaaa

SEQ ID NO: 230218 - DNA, 20 bp, Artificial Sequence
  chemically synthesized
taatatgaaaacagaactca

SEQ ID NO: 230219 - DNA, 20 bp, Artificial Sequence
  chemically synthesized
tccgcagaagaaaacaccat

SEQ ID NO: 230220 - DNA, 20 bp, Artificial Sequence
  chemically synthesized
actcatggtgttttcttctg

SEQ ID NO: 230221 - DNA, 20 bp, Artificial Sequence
  chemically synthesized
atggtgttttcttctgcgga

SEQ ID NO: 230222 - DNA, 20 bp, Artificial Sequence
  chemically synthesized
cactaacttgctttccgcag

SEQ ID NO: 230223 - DNA, 20 bp, Artificial Sequence
  chemically synthesized
ctacactaacttgctttccg

SEQ ID NO: 230224 - DNA, 20 bp, Artificial Sequence
  chemically synthesized
tgttttcttctgcggaaagc

SEQ ID NO: 230225 - DNA, 20 bp, Artificial Sequence
  chemically synthesized
ttcttctgcggaaagcaagt

SEQ ID NO: 230226 - DNA, 20 bp, Artificial Sequence
  chemically synthesized
ctgcggaaagcaagttagtg

SEQ ID NO: 230227 - DNA, 20 bp, Artificial Sequence
  chemically synthesized
gaaagcaagttagtgtagtc

SEQ ID NO: 230228 - DNA, 20 bp, Artificial Sequence
  chemically synthesized
aaagcaagttagtgtagtcc

SEQ ID NO: 230229 - DNA, 20 bp, Artificial Sequence
  chemically synthesized
ataccagcaagttacaagcc

SEQ ID NO: 230230 - DNA, 20 bp, Artificial Sequence
  chemically synthesized
ttcttataccagcaagttac

SEQ ID NO: 230231 - DNA, 20 bp, Artificial Sequence
  chemically synthesized
agtccaggcttgtaacttgc

SEQ ID NO: 230232 - DNA, 20 bp, Artificial Sequence
  chemically synthesized
ggatcttttcttataccagc

SEQ ID NO: 230233 - DNA, 20 bp, Artificial Sequence
  chemically synthesized
ggcttgtaacttgctggtat

SEQ ID NO: 230234 - DNA, 20 bp, Artificial Sequence
  chemically synthesized
tctaggatcttttcttatac

SEQ ID NO: 230235 - DNA, 20 bp, Artificial Sequence
  chemically synthesized
gtaacttgctggtataagaa

SEQ ID NO: 230236 - DNA, 20 bp, Artificial Sequence
  chemically synthesized
gctggtataagaaaagatcc

SEQ ID NO: 230237 - DNA, 20 bp, Artificial Sequence
  chemically synthesized
tttttccctttggaaagtct

SEQ ID NO: 230238 - DNA, 20 bp, Artificial Sequence
  chemically synthesized
atttttccctttggaaagtc

SEQ ID NO: 230239 - DNA, 20 bp, Artificial Sequence
  chemically synthesized
aaaagatcctagactttcca

SEQ ID NO: 230240 - DNA, 20 bp, Artificial Sequence
  chemically synthesized
aaagatcctagactttccaa

SEQ ID NO: 230241 - DNA, 20 bp, Artificial Sequence
  chemically synthesized
aagatcctagactttccaaa

SEQ ID NO: 230242 - DNA, 20 bp, Artificial Sequence
  chemically synthesized
tgtccatttttccctttgga

SEQ ID NO: 230243 - DNA, 20 bp, Artificial Sequence
  chemically synthesized
cttctgtccatttttccctt

SEQ ID NO: 230244 - DNA, 20 bp, Artificial Sequence
  chemically synthesized
agactttccaaagggaaaaa

SEQ ID NO: 230245 - DNA, 20 bp, Artificial Sequence
  chemically synthesized
tttccaaagggaaaaatgga

SEQ ID NO: 230246 - DNA, 20 bp, Artificial Sequence
  chemically synthesized
ccaaagggaaaaatggacag

SEQ ID NO: 230247 - DNA, 20 bp, Artificial Sequence
  chemically synthesized
caaagggaaaaatggacaga

SEQ ID NO: 230248 - DNA, 20 bp, Artificial Sequence
  chemically synthesized
atggacagaaggttacatcg

SEQ ID NO: 230249 - DNA, 20 bp, Artificial Sequence
  chemically synthesized
tggacagaaggttacatcgt

SEQ ID NO: 230250 - DNA, 20 bp, Artificial Sequence
  chemically synthesized
ggacagaaggttacatcgta

SEQ ID NO: 230251 - DNA, 20 bp, Artificial Sequence
  chemically synthesized
agaaggttacatcgtagggt

SEQ ID NO: 230252 - DNA, 20 bp, Artificial Sequence
  chemically synthesized
aggttacatcgtagggtcag

SEQ ID NO: 230253 - DNA, 20 bp, Artificial Sequence
  chemically synthesized
tcgtagggtcagcagtttct

SEQ ID NO: 230254 - DNA, 20 bp, Artificial Sequence
  chemically synthesized
ggtcagcagtttcttagatg

SEQ ID NO: 230255 - DNA, 20 bp, Artificial Sequence
  chemically synthesized
ataaccagatgaccacatct

SEQ ID NO: 230256 - DNA, 20 bp, Artificial Sequence
  chemically synthesized
gtttcttagatgtggtcatc

SEQ ID NO: 230257 - DNA, 20 bp, Artificial Sequence
  chemically synthesized
tagatgtggtcatctggtta

SEQ ID NO: 230258 - DNA, 20 bp, Artificial Sequence
  chemically synthesized
tttcagagtaatactataac

SEQ ID NO: 230259 - DNA, 20 bp, Artificial Sequence
  chemically synthesized
tagaaggaggtaatatttca

SEQ ID NO: 230260 - DNA, 20 bp, Artificial Sequence
  chemically synthesized
cctagaaggaggtaatattt

SEQ ID NO: 230261 - DNA, 20 bp, Artificial Sequence
  chemically synthesized
tctgaaatattacctccttc

SEQ ID NO: 230262 - DNA, 20 bp, Artificial Sequence
  chemically synthesized
ctgaaatattacctccttct

SEQ ID NO: 230263 - DNA, 20 bp, Artificial Sequence
  chemically synthesized
cctatcaaaaacctagaagg

SEQ ID NO: 230264 - DNA, 20 bp, Artificial Sequence
  chemically synthesized
tcctatcaaaaacctagaag

SEQ ID NO: 230265 - DNA, 20 bp, Artificial Sequence
  chemically synthesized
actcctatcaaaaacctaga

SEQ ID NO: 230266 - DNA, 20 bp, Artificial Sequence
  chemically synthesized
cactcctatcaaaaacctag

SEQ ID NO: 230267 - DNA, 20 bp, Artificial Sequence
  chemically synthesized
tcccactcctatcaaaaacc

SEQ ID NO: 230268 - DNA, 20 bp, Artificial Sequence
  chemically synthesized
acctccttctaggtttttga

SEQ ID NO: 230269 - DNA, 20 bp, Artificial Sequence
  chemically synthesized
cctccttctaggtttttgat

SEQ ID NO: 230270 - DNA, 20 bp, Artificial Sequence
  chemically synthesized
tccttctaggtttttgatag

SEQ ID NO: 230271 - DNA, 20 bp, Artificial Sequence
  chemically synthesized
ttctaggtttttgataggag

SEQ ID NO: 230272 - DNA, 20 bp, Artificial Sequence
  chemically synthesized
tctaggtttttgataggagt

SEQ ID NO: 230273 - DNA, 20 bp, Artificial Sequence
  chemically synthesized
ttttgataggagtgggattg

SEQ ID NO: 230274 - DNA, 20 bp, Artificial Sequence
  chemically synthesized
gtgggattgcagacaatttg

SEQ ID NO: 230275 - DNA, 20 bp, Artificial Sequence
  chemically synthesized
caggctttcatcataaagta

SEQ ID NO: 230276 - DNA, 20 bp, Artificial Sequence
  chemically synthesized
accaggctttcatcataaag

SEQ ID NO: 230277 - DNA, 20 bp, Artificial Sequence
  chemically synthesized
ctcaccaggctttcatcata

SEQ ID NO: 230278 - DNA, 20 bp, Artificial Sequence
  chemically synthesized
gaagctctactttatgatga

SEQ ID NO: 230279 - DNA, 20 bp, Artificial Sequence
  chemically synthesized
tctactttatgatgaaagcc

SEQ ID NO: 230280 - DNA, 20 bp, Artificial Sequence
  chemically synthesized
ctttatgatgaaagcctggt

SEQ ID NO: 230281 - DNA, 20 bp, Artificial Sequence
  chemically synthesized
tttctcaattagagctcacc

SEQ ID NO: 230282 - DNA, 20 bp, Artificial Sequence
  chemically synthesized
atttctcaattagagctcac

SEQ ID NO: 230283 - DNA, 20 bp, Artificial Sequence
  chemically synthesized
aagcctggtgagctctaatt

SEQ ID NO: 230284 - DNA, 20 bp, Artificial Sequence
  chemically synthesized
aggtctgtatttctcaatta

SEQ ID NO: 230285 - DNA, 20 bp, Artificial Sequence
  chemically synthesized
ccaggtctgtatttctcaat

SEQ ID NO: 230286 - DNA, 20 bp, Artificial Sequence
  chemically synthesized
tgagctctaattgagaaata

SEQ ID NO: 230287 - DNA, 20 bp, Artificial Sequence
  chemically synthesized
ctaattgagaaatacagacc

SEQ ID NO: 230288 - DNA, 20 bp, Artificial Sequence
  chemically synthesized
tgagaaatacagacctggtt

SEQ ID NO: 230289 - DNA, 20 bp, Artificial Sequence
  chemically synthesized
actcatttagtatccaaacc

SEQ ID NO: 230290 - DNA, 20 bp, Artificial Sequence
  chemically synthesized
tactcatttagtatccaaac

SEQ ID NO: 230291 - DNA, 20 bp, Artificial Sequence
  chemically synthesized
acctggtttggatactaaat

SEQ ID NO: 230292 - DNA, 20 bp, Artificial Sequence
  chemically synthesized
tggtttggatactaaatgag

SEQ ID NO: 230293 - DNA, 20 bp, Artificial Sequence
  chemically synthesized
ggtttggatactaaatgagt

SEQ ID NO: 230294 - DNA, 20 bp, Artificial Sequence
  chemically synthesized
ttaataaacacctactcatt

SEQ ID NO: 230295 - DNA, 20 bp, Artificial Sequence
  chemically synthesized
ggtgtttattaacacactgt

SEQ ID NO: 230296 - DNA, 20 bp, Artificial Sequence
  chemically synthesized
gtgtttattaacacactgtt

SEQ ID NO: 230297 - DNA, 20 bp, Artificial Sequence
  chemically synthesized
agaattctcaattttcctaa

SEQ ID NO: 230298 - DNA, 20 bp, Artificial Sequence
  chemically synthesized
aacacactgttaggaaaatt

SEQ ID NO: 230299 - DNA, 20 bp, Artificial Sequence
  chemically synthesized
gttaggaaaattgagaattc

SEQ ID NO: 230300 - DNA, 20 bp, Artificial Sequence
  chemically synthesized
aggaaaattgagaattctgg

SEQ ID NO: 230301 - DNA, 20 bp, Artificial Sequence
  chemically synthesized
ggaaaattgagaattctggc

SEQ ID NO: 230302 - DNA, 20 bp, Artificial Sequence
  chemically synthesized
ctttgagcactaaaacctgc

SEQ ID NO: 230303 - DNA, 20 bp, Artificial Sequence
  chemically synthesized
ttgagaattctggcaggttt

SEQ ID NO: 230304 - DNA, 20 bp, Artificial Sequence
  chemically synthesized
ctggcaggttttagtgctca

SEQ ID NO: 230305 - DNA, 20 bp, Artificial Sequence
  chemically synthesized
aatgggaaaggttttacttt

SEQ ID NO: 230306 - DNA, 20 bp, Artificial Sequence
  chemically synthesized
cctctctctgtaaatgggaa

SEQ ID NO: 230307 - DNA, 20 bp, Artificial Sequence
  chemically synthesized
acctctctctgtaaatggga

SEQ ID NO: 230308 - DNA, 20 bp, Artificial Sequence
  chemically synthesized
agtaaaacctttcccattta

SEQ ID NO: 230309 - DNA, 20 bp, Artificial Sequence
  chemically synthesized
taaaacctttcccatttaca

SEQ ID NO: 230310 - DNA, 20 bp, Artificial Sequence
  chemically synthesized
gcccacctctctctgtaaat

SEQ ID NO: 230311 - DNA, 20 bp, Artificial Sequence
  chemically synthesized
agcccacctctctctgtaaa

SEQ ID NO: 230312 - DNA, 20 bp, Artificial Sequence
  chemically synthesized
aaacctttcccatttacaga

SEQ ID NO: 230313 - DNA, 20 bp, Artificial Sequence
  chemically synthesized
acctttcccatttacagaga

SEQ ID NO: 230314 - DNA, 20 bp, Artificial Sequence
  chemically synthesized
cctttcccatttacagagag

SEQ ID NO: 230315 - DNA, 20 bp, Artificial Sequence
  chemically synthesized
ttcccatttacagagagagg

SEQ ID NO: 230316 - DNA, 20 bp, Artificial Sequence
  chemically synthesized
tcccatttacagagagaggt

SEQ ID NO: 230317 - DNA, 20 bp, Artificial Sequence
  chemically synthesized
tttacagagagaggtgggct

SEQ ID NO: 230318 - DNA, 20 bp, Artificial Sequence
  chemically synthesized
tacagagagaggtgggcttg

SEQ ID NO: 230319 - DNA, 20 bp, Artificial Sequence
  chemically synthesized
cagagagaggtgggcttgga

SEQ ID NO: 230320 - DNA, 20 bp, Artificial Sequence
  chemically synthesized
tcattctgaagggtctctcc

SEQ ID NO: 230321 - DNA, 20 bp, Artificial Sequence
  chemically synthesized
gtgggcttggagagaccctt

SEQ ID NO: 230322 - DNA, 20 bp, Artificial Sequence
  chemically synthesized
aggtcccaactcattctgaa

SEQ ID NO: 230323 - DNA, 20 bp, Artificial Sequence
  chemically synthesized
ttggagagacccttcagaat

SEQ ID NO: 230324 - DNA, 20 bp, Artificial Sequence
  chemically synthesized
aaggtcccaactcattctga

SEQ ID NO: 230325 - DNA, 20 bp, Artificial Sequence
  chemically synthesized
gaaggtcccaactcattctg

SEQ ID NO: 230326 - DNA, 20 bp, Artificial Sequence
  chemically synthesized
agagacccttcagaatgagt

SEQ ID NO: 230327 - DNA, 20 bp, Artificial Sequence
  chemically synthesized
gagacccttcagaatgagtt

SEQ ID NO: 230328 - DNA, 20 bp, Artificial Sequence
  chemically synthesized
aatgagttgggaccttcctg

SEQ ID NO: 230329 - DNA, 20 bp, Artificial Sequence
  chemically synthesized
ccagagctccttcttcagga

SEQ ID NO: 230330 - DNA, 20 bp, Artificial Sequence
  chemically synthesized
gagttgggaccttcctgaag

SEQ ID NO: 230331 - DNA, 20 bp, Artificial Sequence
  chemically synthesized
tccagagctccttcttcagg

SEQ ID NO: 230332 - DNA, 20 bp, Artificial Sequence
  chemically synthesized
agttgggaccttcctgaaga

SEQ ID NO: 230333 - DNA, 20 bp, Artificial Sequence
  chemically synthesized
ttgggaccttcctgaagaag

SEQ ID NO: 230334 - DNA, 20 bp, Artificial Sequence
  chemically synthesized
ggatccagagctccttcttc

SEQ ID NO: 230335 - DNA, 20 bp, Artificial Sequence
  chemically synthesized
cggatccagagctccttctt

SEQ ID NO: 230336 - DNA, 20 bp, Artificial Sequence
  chemically synthesized
ccttcctgaagaaggagctc

SEQ ID NO: 230337 - DNA, 20 bp, Artificial Sequence
  chemically synthesized
gtgatgcttgaacggatcca

SEQ ID NO: 230338 - DNA, 20 bp, Artificial Sequence
  chemically synthesized
cagtgatgcttgaacggatc

SEQ ID NO: 230339 - DNA, 20 bp, Artificial Sequence
  chemically synthesized
aaggagctctggatccgttc

SEQ ID NO: 230340 - DNA, 20 bp, Artificial Sequence
  chemically synthesized
aagtcacagtgatgcttgaa

SEQ ID NO: 230341 - DNA, 20 bp, Artificial Sequence
  chemically synthesized
gacgtgtctctcagaagtca

SEQ ID NO: 230342 - DNA, 20 bp, Artificial Sequence
  chemically synthesized
caagcatcactgtgacttct

SEQ ID NO: 230343 - DNA, 20 bp, Artificial Sequence
  chemically synthesized
agcatcactgtgacttctga

SEQ ID NO: 230344 - DNA, 20 bp, Artificial Sequence
  chemically synthesized
aatagagacgtgtctctcag

SEQ ID NO: 230345 - DNA, 20 bp, Artificial Sequence
  chemically synthesized
actaatagagacgtgtctct

SEQ ID NO: 230346 - DNA, 20 bp, Artificial Sequence
  chemically synthesized
tctgagagacacgtctctat

SEQ ID NO: 230347 - DNA, 20 bp, Artificial Sequence
  chemically synthesized
agtatgaaaatggactaata

SEQ ID NO: 230348 - DNA, 20 bp, Artificial Sequence
  chemically synthesized
gcagtatgaaaatggactaa

SEQ ID NO: 230349 - DNA, 20 bp, Artificial Sequence
  chemically synthesized
tctttatagcagtatgaaaa

SEQ ID NO: 230350 - DNA, 20 bp, Artificial Sequence
  chemically synthesized
tccattttcatactgctata

SEQ ID NO: 230351 - DNA, 20 bp, Artificial Sequence
  chemically synthesized
tctcaggcagttctttatag

SEQ ID NO: 230352 - DNA, 20 bp, Artificial Sequence
  chemically synthesized
cagtctcaggcagttcttta

SEQ ID NO: 230353 - DNA, 20 bp, Artificial Sequence
  chemically synthesized
actgctataaagaactgcct

SEQ ID NO: 230354 - DNA, 20 bp, Artificial Sequence
  chemically synthesized
ataaattacccagtctcagg

SEQ ID NO: 230355 - DNA, 20 bp, Artificial Sequence
  chemically synthesized
tataaagaactgcctgagac

SEQ ID NO: 230356 - DNA, 20 bp, Artificial Sequence
  chemically synthesized
ataaagaactgcctgagact

SEQ ID NO: 230357 - DNA, 20 bp, Artificial Sequence
  chemically synthesized
tttataaattacccagtctc

SEQ ID NO: 230358 - DNA, 20 bp, Artificial Sequence
  chemically synthesized
ttttataaattacccagtct

SEQ ID NO: 230359 - DNA, 20 bp, Artificial Sequence
  chemically synthesized
tctttcttttataaattacc

SEQ ID NO: 230360 - DNA, 20 bp, Artificial Sequence
  chemically synthesized
tgagactgggtaatttataa

SEQ ID NO: 230361 - DNA, 20 bp, Artificial Sequence
  chemically synthesized
actgggtaatttataaaaga

SEQ ID NO: 230362 - DNA, 20 bp, Artificial Sequence
  chemically synthesized
tgggtaatttataaaagaaa

SEQ ID NO: 230363 - DNA, 20 bp, Artificial Sequence
  chemically synthesized
gggtaatttataaaagaaag

SEQ ID NO: 230364 - DNA, 20 bp, Artificial Sequence
  chemically synthesized
aaagaggtttaattgacaca

SEQ ID NO: 230365 - DNA, 20 bp, Artificial Sequence
  chemically synthesized
ggtttaattgacacacagtt

SEQ ID NO: 230366 - DNA, 20 bp, Artificial Sequence
  chemically synthesized
aattgacacacagttcagca

SEQ ID NO: 230367 - DNA, 20 bp, Artificial Sequence
  chemically synthesized
gacacacagttcagcatggc

SEQ ID NO: 230368 - DNA, 20 bp, Artificial Sequence
  chemically synthesized
acacacagttcagcatggct

SEQ ID NO: 230369 - DNA, 20 bp, Artificial Sequence
  chemically synthesized
cacacagttcagcatggctg

SEQ ID NO: 230370 - DNA, 20 bp, Artificial Sequence
  chemically synthesized
cacagttcagcatggctggg

SEQ ID NO: 230371 - DNA, 20 bp, Artificial Sequence
  chemically synthesized
acagttcagcatggctgggg

SEQ ID NO: 230372 - DNA, 20 bp, Artificial Sequence
  chemically synthesized
taagtttcctgaggcctccc

SEQ ID NO: 230373 - DNA, 20 bp, Artificial Sequence
  chemically synthesized
cagcatggctggggaggcct

SEQ ID NO: 230374 - DNA, 20 bp, Artificial Sequence
  chemically synthesized
agcatggctggggaggcctc

SEQ ID NO: 230375 - DNA, 20 bp, Artificial Sequence
  chemically synthesized
ccacgatggtaagtttcctg

SEQ ID NO: 230376 - DNA, 20 bp, Artificial Sequence
  chemically synthesized
gccacgatggtaagtttcct

SEQ ID NO: 230377 - DNA, 20 bp, Artificial Sequence
  chemically synthesized
cctcaggaaacttaccatcg

SEQ ID NO: 230378 - DNA, 20 bp, Artificial Sequence
  chemically synthesized
tcaccttatgccacgatggt

SEQ ID NO: 230379 - DNA, 20 bp, Artificial Sequence
  chemically synthesized
cttctcaccttatgccacga

SEQ ID NO: 230380 - DNA, 20 bp, Artificial Sequence
  chemically synthesized
gaaacttaccatcgtggcat

SEQ ID NO: 230381 - DNA, 20 bp, Artificial Sequence
  chemically synthesized
aaacttaccatcgtggcata

SEQ ID NO: 230382 - DNA, 20 bp, Artificial Sequence
  chemically synthesized
ttaccatcgtggcataaggt

SEQ ID NO: 230383 - DNA, 20 bp, Artificial Sequence
  chemically synthesized
ccatcgtggcataaggtgag

SEQ ID NO: 230384 - DNA, 20 bp, Artificial Sequence
  chemically synthesized
catcgtggcataaggtgaga

SEQ ID NO: 230385 - DNA, 20 bp, Artificial Sequence
  chemically synthesized
tcgtggcataaggtgagaag

SEQ ID NO: 230386 - DNA, 20 bp, Artificial Sequence
  chemically synthesized
ggcataaggtgagaaggagc

SEQ ID NO: 230387 - DNA, 20 bp, Artificial Sequence
  chemically synthesized
cctgccacctgtgaagaagg

SEQ ID NO: 230388 - DNA, 20 bp, Artificial Sequence
  chemically synthesized
ggagcaagccaccttcttca

SEQ ID NO: 230389 - DNA, 20 bp, Artificial Sequence
  chemically synthesized
gagcaagccaccttcttcac

SEQ ID NO: 230390 - DNA, 20 bp, Artificial Sequence
  chemically synthesized
cttcctgccacctgtgaaga

SEQ ID NO: 230391 - DNA, 20 bp, Artificial Sequence
  chemically synthesized
tcttcctgccacctgtgaag

SEQ ID NO: 230392 - DNA, 20 bp, Artificial Sequence
  chemically synthesized
caagccaccttcttcacagg

SEQ ID NO: 230393 - DNA, 20 bp, Artificial Sequence
  chemically synthesized
acttcttcctgccacctgtg

SEQ ID NO: 230394 - DNA, 20 bp, Artificial Sequence
  chemically synthesized
gccaccttcttcacaggtgg

SEQ ID NO: 230395 - DNA, 20 bp, Artificial Sequence
  chemically synthesized
ccaccttcttcacaggtggc

SEQ ID NO: 230396 - DNA, 20 bp, Artificial Sequence
  chemically synthesized
ccttcttcacaggtggcagg

SEQ ID NO: 230397 - DNA, 20 bp, Artificial Sequence
  chemically synthesized
tcttcacaggtggcaggaag

SEQ ID NO: 230398 - DNA, 20 bp, Artificial Sequence
  chemically synthesized
aggtggcaggaagaagtgcc

SEQ ID NO: 230399 - DNA, 20 bp, Artificial Sequence
  chemically synthesized
gcaggaagaagtgcccagtg

SEQ ID NO: 230400 - DNA, 20 bp, Artificial Sequence
  chemically synthesized
ggaagaagtgcccagtgaag

SEQ ID NO: 230401 - DNA, 20 bp, Artificial Sequence
  chemically synthesized
ggggctcttcctgcttcact

SEQ ID NO: 230402 - DNA, 20 bp, Artificial Sequence
  chemically synthesized
gaagaagtgcccagtgaagc

SEQ ID NO: 230403 - DNA, 20 bp, Artificial Sequence
  chemically synthesized
aggggctcttcctgcttcac

SEQ ID NO: 230404 - DNA, 20 bp, Artificial Sequence
  chemically synthesized
gaagtgcccagtgaagcagg

SEQ ID NO: 230405 - DNA, 20 bp, Artificial Sequence
  chemically synthesized
agtgcccagtgaagcaggaa

SEQ ID NO: 230406 - DNA, 20 bp, Artificial Sequence
  chemically synthesized
agatctgattgttttataag

SEQ ID NO: 230407 - DNA, 20 bp, Artificial Sequence
  chemically synthesized
aagatctgattgttttataa

SEQ ID NO: 230408 - DNA, 20 bp, Artificial Sequence
  chemically synthesized
caagatctgattgttttata

SEQ ID NO: 230409 - DNA, 20 bp, Artificial Sequence
  chemically synthesized
acaagatctgattgttttat

SEQ ID NO: 230410 - DNA, 20 bp, Artificial Sequence
  chemically synthesized
agagccccttataaaacaat

SEQ ID NO: 230411 - DNA, 20 bp, Artificial Sequence
  chemically synthesized
ataaaacaatcagatcttgt

SEQ ID NO: 230412 - DNA, 20 bp, Artificial Sequence
  chemically synthesized
gatagtgagtgagttctcac

SEQ ID NO: 230413 - DNA, 20 bp, Artificial Sequence
  chemically synthesized
ctgttctcctgatagtgagt

SEQ ID NO: 230414 - DNA, 20 bp, Artificial Sequence
  chemically synthesized
tgtgagaactcactcactat

SEQ ID NO: 230415 - DNA, 20 bp, Artificial Sequence
  chemically synthesized
gtgagaactcactcactatc

SEQ ID NO: 230416 - DNA, 20 bp, Artificial Sequence
  chemically synthesized
catgctgttctcctgatagt

SEQ ID NO: 230417 - DNA, 20 bp, Artificial Sequence
  chemically synthesized
gagaactcactcactatcag

SEQ ID NO: 230418 - DNA, 20 bp, Artificial Sequence
  chemically synthesized
ctcccatgctgttctcctga

SEQ ID NO: 230419 - DNA, 20 bp, Artificial Sequence
  chemically synthesized
ctcactcactatcaggagaa

SEQ ID NO: 230420 - DNA, 20 bp, Artificial Sequence
  chemically synthesized
tcactatcaggagaacagca

SEQ ID NO: 230421 - DNA, 20 bp, Artificial Sequence
  chemically synthesized
cactatcaggagaacagcat

SEQ ID NO: 230422 - DNA, 20 bp, Artificial Sequence
  chemically synthesized
ctatcaggagaacagcatgg

SEQ ID NO: 230423 - DNA, 20 bp, Artificial Sequence
  chemically synthesized
tggaggtaactgaatcatgg

SEQ ID NO: 230424 - DNA, 20 bp, Artificial Sequence
  chemically synthesized
gagaaattgctcccatgatt

SEQ ID NO: 230425 - DNA, 20 bp, Artificial Sequence
  chemically synthesized
ggtggaggtaactgaatcat

SEQ ID NO: 230426 - DNA, 20 bp, Artificial Sequence
  chemically synthesized
aggtggaggtaactgaatca

SEQ ID NO: 230427 - DNA, 20 bp, Artificial Sequence
  chemically synthesized
atgattcagttacctccacc

SEQ ID NO: 230428 - DNA, 20 bp, Artificial Sequence
  chemically synthesized
aagggagagagaccaggtgg

SEQ ID NO: 230429 - DNA, 20 bp, Artificial Sequence
  chemically synthesized
caagggagagagaccaggtg

SEQ ID NO: 230430 - DNA, 20 bp, Artificial Sequence
  chemically synthesized
gtcaagggagagagaccagg

SEQ ID NO: 230431 - DNA, 20 bp, Artificial Sequence
  chemically synthesized
catgtcaagggagagagacc

SEQ ID NO: 230432 - DNA, 20 bp, Artificial Sequence
  chemically synthesized
acatgtcaagggagagagac

SEQ ID NO: 230433 - DNA, 20 bp, Artificial Sequence
  chemically synthesized
tccccacatgtcaagggaga

SEQ ID NO: 230434 - DNA, 20 bp, Artificial Sequence
  chemically synthesized
aatccccacatgtcaaggga

SEQ ID NO: 230435 - DNA, 20 bp, Artificial Sequence
  chemically synthesized
acaatccccacatgtcaagg

SEQ ID NO: 230436 - DNA, 20 bp, Artificial Sequence
  chemically synthesized
ccacaatccccacatgtcaa

SEQ ID NO: 230437 - DNA, 20 bp, Artificial Sequence
  chemically synthesized
ggtctctctcccttgacatg

SEQ ID NO: 230438 - DNA, 20 bp, Artificial Sequence
  chemically synthesized
cccacaatccccacatgtca

SEQ ID NO: 230439 - DNA, 20 bp, Artificial Sequence
  chemically synthesized
gtctctctcccttgacatgt

SEQ ID NO: 230440 - DNA, 20 bp, Artificial Sequence
  chemically synthesized
ccccacaatccccacatgtc

SEQ ID NO: 230441 - DNA, 20 bp, Artificial Sequence
  chemically synthesized
tctctctcccttgacatgtg

SEQ ID NO: 230442 - DNA, 20 bp, Artificial Sequence
  chemically synthesized
cccttgacatgtggggattg

SEQ ID NO: 230443 - DNA, 20 bp, Artificial Sequence
  chemically synthesized
ccttgacatgtggggattgt

SEQ ID NO: 230444 - DNA, 20 bp, Artificial Sequence
  chemically synthesized
cttgacatgtggggattgtg

SEQ ID NO: 230445 - DNA, 20 bp, Artificial Sequence
  chemically synthesized
tggggattacaattcaaaat

SEQ ID NO: 230446 - DNA, 20 bp, Artificial Sequence
  chemically synthesized
ttacaattcaaaatgagatt

SEQ ID NO: 230447 - DNA, 20 bp, Artificial Sequence
  chemically synthesized
tacaattcaaaatgagattt

SEQ ID NO: 230448 - DNA, 20 bp, Artificial Sequence
  chemically synthesized
aattcaaaatgagatttggg

SEQ ID NO: 230449 - DNA, 20 bp, Artificial Sequence
  chemically synthesized
attcaaaatgagatttgggt

SEQ ID NO: 230450 - DNA, 20 bp, Artificial Sequence
  chemically synthesized
ttcaaaatgagatttgggtg

SEQ ID NO: 230451 - DNA, 20 bp, Artificial Sequence
  chemically synthesized
gagatttgggtggggacaca

SEQ ID NO: 230452 - DNA, 20 bp, Artificial Sequence
  chemically synthesized
ggggacacaaagccaaacca

SEQ ID NO: 230453 - DNA, 20 bp, Artificial Sequence
  chemically synthesized
gggacacaaagccaaaccat

SEQ ID NO: 230454 - DNA, 20 bp, Artificial Sequence
  chemically synthesized
atttgatggatcctatggtt

SEQ ID NO: 230455 - DNA, 20 bp, Artificial Sequence
  chemically synthesized
ctgggatttgatggatccta

SEQ ID NO: 230456 - DNA, 20 bp, Artificial Sequence
  chemically synthesized
accatcatcctgggatttga

SEQ ID NO: 230457 - DNA, 20 bp, Artificial Sequence
  chemically synthesized
ccataggatccatcaaatcc

SEQ ID NO: 230458 - DNA, 20 bp, Artificial Sequence
  chemically synthesized
cataggatccatcaaatccc

SEQ ID NO: 230459 - DNA, 20 bp, Artificial Sequence
  chemically synthesized
tccatcaaatcccaggatga

SEQ ID NO: 230460 - DNA, 20 bp, Artificial Sequence
  chemically synthesized
ggatggagaaccatcatcct

SEQ ID NO: 230461 - DNA, 20 bp, Artificial Sequence
  chemically synthesized
gggatggagaaccatcatcc

SEQ ID NO: 230462 - DNA, 20 bp, Artificial Sequence
  chemically synthesized
ttgcacacattgtggggatg

SEQ ID NO: 230463 - DNA, 20 bp, Artificial Sequence
  chemically synthesized
tattgcacacattgtgggga

SEQ ID NO: 230464 - DNA, 20 bp, Artificial Sequence
  chemically synthesized
aaaatattgcacacattgtg

SEQ ID NO: 230465 - DNA, 20 bp, Artificial Sequence
  chemically synthesized
taaaatattgcacacattgt

SEQ ID NO: 230466 - DNA, 20 bp, Artificial Sequence
  chemically synthesized
ctaaaatattgcacacattg

SEQ ID NO: 230467 - DNA, 20 bp, Artificial Sequence
  chemically synthesized
ccacaatgtgtgcaatattt

SEQ ID NO: 230468 - DNA, 20 bp, Artificial Sequence
  chemically synthesized
cacaatgtgtgcaatatttt

SEQ ID NO: 230469 - DNA, 20 bp, Artificial Sequence
  chemically synthesized
caatgtgtgcaatattttag

SEQ ID NO: 230470 - DNA, 20 bp, Artificial Sequence
  chemically synthesized
ttagctattatgagtaacaa

SEQ ID NO: 230471 - DNA, 20 bp, Artificial Sequence
  chemically synthesized
gagtcttttgttactcataa

SEQ ID NO: 230472 - DNA, 20 bp, Artificial Sequence
  chemically synthesized
atctgtactttagctattat

SEQ ID NO: 230473 - DNA, 20 bp, Artificial Sequence
  chemically synthesized
tttgttactcataatagcta

SEQ ID NO: 230474 - DNA, 20 bp, Artificial Sequence
  chemically synthesized
tactcataatagctaaagta

SEQ ID NO: 230475 - DNA, 20 bp, Artificial Sequence
  chemically synthesized
acttgcaaagatctgtactt

SEQ ID NO: 230476 - DNA, 20 bp, Artificial Sequence
  chemically synthesized
gctaaagtacagatctttgc

SEQ ID NO: 230477 - DNA, 20 bp, Artificial Sequence
  chemically synthesized
aaagtacagatctttgcaag

SEQ ID NO: 230478 - DNA, 20 bp, Artificial Sequence
  chemically synthesized
ggaagatgaaactacttgca

SEQ ID NO: 230479 - DNA, 20 bp, Artificial Sequence
  chemically synthesized
caagtagtttcatcttccac

SEQ ID NO: 230480 - DNA, 20 bp, Artificial Sequence
  chemically synthesized
gaatctgctttcactcgtgg

SEQ ID NO: 230481 - DNA, 20 bp, Artificial Sequence
  chemically synthesized
gtttcatcttccacgagtga

SEQ ID NO: 230482 - DNA, 20 bp, Artificial Sequence
  chemically synthesized
tttgaatctgctttcactcg

SEQ ID NO: 230483 - DNA, 20 bp, Artificial Sequence
  chemically synthesized
tcatcttccacgagtgaaag

SEQ ID NO: 230484 - DNA, 20 bp, Artificial Sequence
  chemically synthesized
aaaacgtatgatgcaggtga

SEQ ID NO: 230485 - DNA, 20 bp, Artificial Sequence
  chemically synthesized
cgaaaacgtatgatgcaggt

SEQ ID NO: 230486 - DNA, 20 bp, Artificial Sequence
  chemically synthesized
ctctcgaaaacgtatgatgc

SEQ ID NO: 230487 - DNA, 20 bp, Artificial Sequence
  chemically synthesized
actctcgaaaacgtatgatg

SEQ ID NO: 230488 - DNA, 20 bp, Artificial Sequence
  chemically synthesized
cacctgcatcatacgttttc

SEQ ID NO: 230489 - DNA, 20 bp, Artificial Sequence
  chemically synthesized
cctgcatcatacgttttcga

SEQ ID NO: 230490 - DNA, 20 bp, Artificial Sequence
  chemically synthesized
catcatacgttttcgagagt

SEQ ID NO: 230491 - DNA, 20 bp, Artificial Sequence
  chemically synthesized
catacgttttcgagagtgag

SEQ ID NO: 230492 - DNA, 20 bp, Artificial Sequence
  chemically synthesized
ttcgagagtgagcagtgtgc

SEQ ID NO: 230493 - DNA, 20 bp, Artificial Sequence
  chemically synthesized
gcatgggttggggcaatttc

SEQ ID NO: 230494 - DNA, 20 bp, Artificial Sequence
  chemically synthesized
acataaaacagcatgggttg

SEQ ID NO: 230495 - DNA, 20 bp, Artificial Sequence
  chemically synthesized
tacataaaacagcatgggtt

SEQ ID NO: 230496 - DNA, 20 bp, Artificial Sequence
  chemically synthesized
ttacataaaacagcatgggt

SEQ ID NO: 230497 - DNA, 20 bp, Artificial Sequence
  chemically synthesized
tggcttacataaaacagcat

SEQ ID NO: 230498 - DNA, 20 bp, Artificial Sequence
  chemically synthesized
atggcttacataaaacagca

SEQ ID NO: 230499 - DNA, 20 bp, Artificial Sequence
  chemically synthesized
ggactatggcttacataaaa

SEQ ID NO: 230500 - DNA, 20 bp, Artificial Sequence
  chemically synthesized
caacccatgctgttttatgt

SEQ ID NO: 230501 - DNA, 20 bp, Artificial Sequence
  chemically synthesized
atgctgttttatgtaagcca

SEQ ID NO: 230502 - DNA, 20 bp, Artificial Sequence
  chemically synthesized
tttatgtaagccatagtcct

SEQ ID NO: 230503 - DNA, 20 bp, Artificial Sequence
  chemically synthesized
tacctacattctaaggacta

SEQ ID NO: 230504 - DNA, 20 bp, Artificial Sequence
  chemically synthesized
aagccatagtccttagaatg

SEQ ID NO: 230505 - DNA, 20 bp, Artificial Sequence
  chemically synthesized
ctctgagtacctacattcta

SEQ ID NO: 230506 - DNA, 20 bp, Artificial Sequence
  chemically synthesized
agccatagtccttagaatgt

SEQ ID NO: 230507 - DNA, 20 bp, Artificial Sequence
  chemically synthesized
tctctgagtacctacattct

SEQ ID NO: 230508 - DNA, 20 bp, Artificial Sequence
  chemically synthesized
gtccttagaatgtaggtact

SEQ ID NO: 230509 - DNA, 20 bp, Artificial Sequence
  chemically synthesized
ccttagaatgtaggtactca

SEQ ID NO: 230510 - DNA, 20 bp, Artificial Sequence
  chemically synthesized
tagaatgtaggtactcagag

SEQ ID NO: 230511 - DNA, 20 bp, Artificial Sequence
  chemically synthesized
gaatgtaggtactcagagaa

SEQ ID NO: 230512 - DNA, 20 bp, Artificial Sequence
  chemically synthesized
aaaagtacctgctcttctct

SEQ ID NO: 230513 - DNA, 20 bp, Artificial Sequence
  chemically synthesized
tgtaggtactcagagaagag

SEQ ID NO: 230514 - DNA, 20 bp, Artificial Sequence
  chemically synthesized
gtaggtactcagagaagagc

SEQ ID NO: 230515 - DNA, 20 bp, Artificial Sequence
  chemically synthesized
tgtttcttcctagcacaaaa

SEQ ID NO: 230516 - DNA, 20 bp, Artificial Sequence
  chemically synthesized
gagcaggtacttttttgtgc

SEQ ID NO: 230517 - DNA, 20 bp, Artificial Sequence
  chemically synthesized
agcaggtacttttttgtgct

SEQ ID NO: 230518 - DNA, 20 bp, Artificial Sequence
  chemically synthesized
aggtacttttttgtgctagg

SEQ ID NO: 230519 - DNA, 20 bp, Artificial Sequence
  chemically synthesized
tgcttggccatgtttcttcc

SEQ ID NO: 230520 - DNA, 20 bp, Artificial Sequence
  chemically synthesized
ttttgtgctaggaagaaaca

SEQ ID NO: 230521 - DNA, 20 bp, Artificial Sequence
  chemically synthesized
tgctaggaagaaacatggcc

SEQ ID NO: 230522 - DNA, 20 bp, Artificial Sequence
  chemically synthesized
cgtcagatagcagtattgct

SEQ ID NO: 230523 - DNA, 20 bp, Artificial Sequence
  chemically synthesized
acagcttcctcgtcagatag

SEQ ID NO: 230524 - DNA, 20 bp, Artificial Sequence
  chemically synthesized
aagcaatactgctatctgac

SEQ ID NO: 230525 - DNA, 20 bp, Artificial Sequence
  chemically synthesized
agcaatactgctatctgacg

SEQ ID NO: 230526 - DNA, 20 bp, Artificial Sequence
  chemically synthesized
acaacagcttcctcgtcaga

SEQ ID NO: 230527 - DNA, 20 bp, Artificial Sequence
  chemically synthesized
aatactgctatctgacgagg

SEQ ID NO: 230528 - DNA, 20 bp, Artificial Sequence
  chemically synthesized
aagaacaacagcttcctcgt

SEQ ID NO: 230529 - DNA, 20 bp, Artificial Sequence
  chemically synthesized
tggtccaggttaaagaacaa

SEQ ID NO: 230530 - DNA, 20 bp, Artificial Sequence
  chemically synthesized
gaagctgttgttctttaacc

SEQ ID NO: 230531 - DNA, 20 bp, Artificial Sequence
  chemically synthesized
tctgaaaatggtccaggtta

SEQ ID NO: 230532 - DNA, 20 bp, Artificial Sequence
  chemically synthesized
gcctactctgaaaatggtcc

SEQ ID NO: 230533 - DNA, 20 bp, Artificial Sequence
  chemically synthesized
tgcctactctgaaaatggtc

SEQ ID NO: 230534 - DNA, 20 bp, Artificial Sequence
  chemically synthesized
tctttaacctggaccatttt

SEQ ID NO: 230535 - DNA, 20 bp, Artificial Sequence
  chemically synthesized
tttaacctggaccattttca

SEQ ID NO: 230536 - DNA, 20 bp, Artificial Sequence
  chemically synthesized
taaaatgcctactctgaaaa

SEQ ID NO: 230537 - DNA, 20 bp, Artificial Sequence
  chemically synthesized
aacctggaccattttcagag

SEQ ID NO: 230538 - DNA, 20 bp, Artificial Sequence
  chemically synthesized
acctggaccattttcagagt

SEQ ID NO: 230539 - DNA, 20 bp, Artificial Sequence
  chemically synthesized
tttcagagtaggcattttaa

SEQ ID NO: 230540 - DNA, 20 bp, Artificial Sequence
  chemically synthesized
cattttaaaagctgcctgat

SEQ ID NO: 230541 - DNA, 20 bp, Artificial Sequence
  chemically synthesized
ttcaaaaagttctcatcagg

SEQ ID NO: 230542 - DNA, 20 bp, Artificial Sequence
  chemically synthesized
agtttcaaaaagttctcatc

SEQ ID NO: 230543 - DNA, 20 bp, Artificial Sequence
  chemically synthesized
cagtttcaaaaagttctcat

SEQ ID NO: 230544 - DNA, 20 bp, Artificial Sequence
  chemically synthesized
agctctgctacagtttcaaa

SEQ ID NO: 230545 - DNA, 20 bp, Artificial Sequence
  chemically synthesized
atgagaactttttgaaactg

SEQ ID NO: 230546 - DNA, 20 bp, Artificial Sequence
  chemically synthesized
agaactttttgaaactgtag

SEQ ID NO: 230547 - DNA, 20 bp, Artificial Sequence
  chemically synthesized
aactttttgaaactgtagca

SEQ ID NO: 230548 - DNA, 20 bp, Artificial Sequence
  chemically synthesized
tatccatggaagctctgcta

SEQ ID NO: 230549 - DNA, 20 bp, Artificial Sequence
  chemically synthesized
aaactgtagcagagcttcca

SEQ ID NO: 230550 - DNA, 20 bp, Artificial Sequence
  chemically synthesized
tccaatcagaatatccatgg

SEQ ID NO: 230551 - DNA, 20 bp, Artificial Sequence
  chemically synthesized
atatccaatcagaatatcca

SEQ ID NO: 230552 - DNA, 20 bp, Artificial Sequence
  chemically synthesized
gcttccatggatattctgat

SEQ ID NO: 230553 - DNA, 20 bp, Artificial Sequence
  chemically synthesized
gaagcaatgatatatccaat

SEQ ID NO: 230554 - DNA, 20 bp, Artificial Sequence
  chemically synthesized
atatatcattgcttcctgct

SEQ ID NO: 230555 - DNA, 20 bp, Artificial Sequence
  chemically synthesized
atcttagcaagctgagcagg

SEQ ID NO: 230556 - DNA, 20 bp, Artificial Sequence
  chemically synthesized
gttatcttagcaagctgagc

SEQ ID NO: 230557 - DNA, 20 bp, Artificial Sequence
  chemically synthesized
agttatcttagcaagctgag

SEQ ID NO: 230558 - DNA, 20 bp, Artificial Sequence
  chemically synthesized
tcaagttatcttagcaagct

SEQ ID NO: 230559 - DNA, 20 bp, Artificial Sequence
  chemically synthesized
tgcttcctgctcagcttgct

SEQ ID NO: 230560 - DNA, 20 bp, Artificial Sequence
  chemically synthesized
tgttttcaagttatcttagc

SEQ ID NO: 230561 - DNA, 20 bp, Artificial Sequence
  chemically synthesized
tttctgttttcaagttatct

SEQ ID NO: 230562 - DNA, 20 bp, Artificial Sequence
  chemically synthesized
ttgctaagataacttgaaaa

SEQ ID NO: 230563 - DNA, 20 bp, Artificial Sequence
  chemically synthesized
caaaaggattttctgttttc

SEQ ID NO: 230564 - DNA, 20 bp, Artificial Sequence
  chemically synthesized
aaacagaaaatccttttgtc

SEQ ID NO: 230565 - DNA, 20 bp, Artificial Sequence
  chemically synthesized
aaatacctactccagacaaa

SEQ ID NO: 230566 - DNA, 20 bp, Artificial Sequence
  chemically synthesized
acagaaaatccttttgtctg

SEQ ID NO: 230567 - DNA, 20 bp, Artificial Sequence
  chemically synthesized
taaatacctactccagacaa

SEQ ID NO: 230568 - DNA, 20 bp, Artificial Sequence
  chemically synthesized
gaaaatccttttgtctggag

SEQ ID NO: 230569 - DNA, 20 bp, Artificial Sequence
  chemically synthesized
aaaatccttttgtctggagt

SEQ ID NO: 230570 - DNA, 20 bp, Artificial Sequence
  chemically synthesized
ggttaattaaatacctactc

SEQ ID NO: 230571 - DNA, 20 bp, Artificial Sequence
  chemically synthesized
tatttaattaaccaaatgtt

SEQ ID NO: 230572 - DNA, 20 bp, Artificial Sequence
  chemically synthesized
aatacacaatacttaacatt

SEQ ID NO: 230573 - DNA, 20 bp, Artificial Sequence
  chemically synthesized
ttaagtattgtgtatttttt

SEQ ID NO: 230574 - DNA, 20 bp, Artificial Sequence
  chemically synthesized
gtgtattttttcagttgctt

SEQ ID NO: 230575 - DNA, 20 bp, Artificial Sequence
  chemically synthesized
tattttttcagttgcttaag

SEQ ID NO: 230576 - DNA, 20 bp, Artificial Sequence
  chemically synthesized
ttttcagttgcttaagtgga

SEQ ID NO: 230577 - DNA, 20 bp, Artificial Sequence
  chemically synthesized
gtaataatgtctttccactt

SEQ ID NO: 230578 - DNA, 20 bp, Artificial Sequence
  chemically synthesized
aagacattattacctgaata

SEQ ID NO: 230579 - DNA, 20 bp, Artificial Sequence
  chemically synthesized
ttcataaaaaaactatattc

SEQ ID NO: 230580 - DNA, 20 bp, Artificial Sequence
  chemically synthesized
gttcataaaaaaactatatt

SEQ ID NO: 230581 - DNA, 20 bp, Artificial Sequence
  chemically synthesized
tagtttttttatgaacaacc

SEQ ID NO: 230582 - DNA, 20 bp, Artificial Sequence
  chemically synthesized
ctttaacccggtaatattct

SEQ ID NO: 230583 - DNA, 20 bp, Artificial Sequence
  chemically synthesized
cctttaacccggtaatattc

SEQ ID NO: 230584 - DNA, 20 bp, Artificial Sequence
  chemically synthesized
tgaacaacccagaatattac

SEQ ID NO: 230585 - DNA, 20 bp, Artificial Sequence
  chemically synthesized
gaacaacccagaatattacc

SEQ ID NO: 230586 - DNA, 20 bp, Artificial Sequence
  chemically synthesized
cccagaatattaccgggtta

SEQ ID NO: 230587 - DNA, 20 bp, Artificial Sequence
  chemically synthesized
ccagaatattaccgggttaa

SEQ ID NO: 230588 - DNA, 20 bp, Artificial Sequence
  chemically synthesized
taaaccaatgacctttaacc

SEQ ID NO: 230589 - DNA, 20 bp, Artificial Sequence
  chemically synthesized
attaccgggttaaaggtcat

SEQ ID NO: 230590 - DNA, 20 bp, Artificial Sequence
  chemically synthesized
aaagcaattatttttaggtt

SEQ ID NO: 230591 - DNA, 20 bp, Artificial Sequence
  chemically synthesized
atgtcaaagcaattattttt

SEQ ID NO: 230592 - DNA, 20 bp, Artificial Sequence
  chemically synthesized
tatgtcaaagcaattatttt

SEQ ID NO: 230593 - DNA, 20 bp, Artificial Sequence
  chemically synthesized
acaatattccatatatgtca

SEQ ID NO: 230594 - DNA, 20 bp, Artificial Sequence
  chemically synthesized
aataattgctttgacatata

SEQ ID NO: 230595 - DNA, 20 bp, Artificial Sequence
  chemically synthesized
tgaagttatcaaaaaataat

SEQ ID NO: 230596 - DNA, 20 bp, Artificial Sequence
  chemically synthesized
tcattattttttgataactt

SEQ ID NO: 230597 - DNA, 20 bp, Artificial Sequence
  chemically synthesized
ttattttttgataacttcag

SEQ ID NO: 230598 - DNA, 20 bp, Artificial Sequence
  chemically synthesized
attttttgataacttcagaa

SEQ ID NO: 230599 - DNA, 20 bp, Artificial Sequence
  chemically synthesized
cgattatattagctcttctg

SEQ ID NO: 230600 - DNA, 20 bp, Artificial Sequence
  chemically synthesized
ttcagaagagctaatataat

SEQ ID NO: 230601 - DNA, 20 bp, Artificial Sequence
  chemically synthesized
agatctgcctccgattatat

SEQ ID NO: 230602 - DNA, 20 bp, Artificial Sequence
  chemically synthesized
cagaagagctaatataatcg

SEQ ID NO: 230603 - DNA, 20 bp, Artificial Sequence
  chemically synthesized
agaagagctaatataatcgg

SEQ ID NO: 230604 - DNA, 20 bp, Artificial Sequence
  chemically synthesized
agagctaatataatcggagg

SEQ ID NO: 230605 - DNA, 20 bp, Artificial Sequence
  chemically synthesized
tataatcggaggcagatcta

SEQ ID NO: 230606 - DNA, 20 bp, Artificial Sequence
  chemically synthesized
aatcggaggcagatctacag

SEQ ID NO: 230607 - DNA, 20 bp, Artificial Sequence
  chemically synthesized
ctgaattccctattccactg

SEQ ID NO: 230608 - DNA, 20 bp, Artificial Sequence
  chemically synthesized
gaggcagatctacagtggaa

SEQ ID NO: 230609 - DNA, 20 bp, Artificial Sequence
  chemically synthesized
aggcagatctacagtggaat

SEQ ID NO: 230610 - DNA, 20 bp, Artificial Sequence
  chemically synthesized
ggcagatctacagtggaata

SEQ ID NO: 230611 - DNA, 20 bp, Artificial Sequence
  chemically synthesized
ctacagtggaatagggaatt

SEQ ID NO: 230612 - DNA, 20 bp, Artificial Sequence
  chemically synthesized
attcagaatttatattctaa

SEQ ID NO: 230613 - DNA, 20 bp, Artificial Sequence
  chemically synthesized
gaatttatattctaacagaa

SEQ ID NO: 230614 - DNA, 20 bp, Artificial Sequence
  chemically synthesized
aatttatattctaacagaaa

SEQ ID NO: 230615 - DNA, 20 bp, Artificial Sequence
  chemically synthesized
attactgtatccttttctgt

SEQ ID NO: 230616 - DNA, 20 bp, Artificial Sequence
  chemically synthesized
tattctaacagaaaaggata

SEQ ID NO: 230617 - DNA, 20 bp, Artificial Sequence
  chemically synthesized
aaaggatacagtaatatgac

SEQ ID NO: 230618 - DNA, 20 bp, Artificial Sequence
  chemically synthesized
aaggatacagtaatatgaca

SEQ ID NO: 230619 - DNA, 20 bp, Artificial Sequence
  chemically synthesized
caaggaaattcctaaaaata

SEQ ID NO: 230620 - DNA, 20 bp, Artificial Sequence
  chemically synthesized
ggaaaatatactatattttt

SEQ ID NO: 230621 - DNA, 20 bp, Artificial Sequence
  chemically synthesized
tggaaaatatactatatttt

SEQ ID NO: 230622 - DNA, 20 bp, Artificial Sequence
  chemically synthesized
tctggaaatatgttttcaca

SEQ ID NO: 230623 - DNA, 20 bp, Artificial Sequence
  chemically synthesized
tccatgtgaaaacatatttc

SEQ ID NO: 230624 - DNA, 20 bp, Artificial Sequence
  chemically synthesized
tcattcttttgaaattggtc

SEQ ID NO: 230625 - DNA, 20 bp, Artificial Sequence
  chemically synthesized
tatttccagaccaatttcaa

SEQ ID NO: 230626 - DNA, 20 bp, Artificial Sequence
  chemically synthesized
agctatcattcttttgaaat

SEQ ID NO: 230627 - DNA, 20 bp, Artificial Sequence
  chemically synthesized
gaccaatttcaaaagaatga

SEQ ID NO: 230628 - DNA, 20 bp, Artificial Sequence
  chemically synthesized
atttcaaaagaatgatagct

SEQ ID NO: 230629 - DNA, 20 bp, Artificial Sequence
  chemically synthesized
actgcagcagagaggaatct

SEQ ID NO: 230630 - DNA, 20 bp, Artificial Sequence
  chemically synthesized
tatagcttactgcagcagag

SEQ ID NO: 230631 - DNA, 20 bp, Artificial Sequence
  chemically synthesized
gcttagattcctctctgctg

SEQ ID NO: 230632 - DNA, 20 bp, Artificial Sequence
  chemically synthesized
atatagcttactgcagcaga

SEQ ID NO: 230633 - DNA, 20 bp, Artificial Sequence
  chemically synthesized
ggatatagcttactgcagca

SEQ ID NO: 230634 - DNA, 20 bp, Artificial Sequence
  chemically synthesized
agattcctctctgctgcagt

SEQ ID NO: 230635 - DNA, 20 bp, Artificial Sequence
  chemically synthesized
ggggatatagcttactgcag

SEQ ID NO: 230636 - DNA, 20 bp, Artificial Sequence
  chemically synthesized
gtgggggatatagcttactg

SEQ ID NO: 230637 - DNA, 20 bp, Artificial Sequence
  chemically synthesized
tgtatttcaagtgggggata

SEQ ID NO: 230638 - DNA, 20 bp, Artificial Sequence
  chemically synthesized
gtgggatgtatttcaagtgg

SEQ ID NO: 230639 - DNA, 20 bp, Artificial Sequence
  chemically synthesized
ggtgggatgtatttcaagtg

SEQ ID NO: 230640 - DNA, 20 bp, Artificial Sequence
  chemically synthesized
aggtgggatgtatttcaagt

SEQ ID NO: 230641 - DNA, 20 bp, Artificial Sequence
  chemically synthesized
aaggtgggatgtatttcaag

SEQ ID NO: 230642 - DNA, 20 bp, Artificial Sequence
  chemically synthesized
ggaaaggtgggatgtatttc

SEQ ID NO: 230643 - DNA, 20 bp, Artificial Sequence
  chemically synthesized
gaggtaattataggaaaggt

SEQ ID NO: 230644 - DNA, 20 bp, Artificial Sequence
  chemically synthesized
agaggtaattataggaaagg

SEQ ID NO: 230645 - DNA, 20 bp, Artificial Sequence
  chemically synthesized
ggaagaggtaattataggaa

SEQ ID NO: 230646 - DNA, 20 bp, Artificial Sequence
  chemically synthesized
tggaagaggtaattatagga

SEQ ID NO: 230647 - DNA, 20 bp, Artificial Sequence
  chemically synthesized
ctggtggaagaggtaattat

SEQ ID NO: 230648 - DNA, 20 bp, Artificial Sequence
  chemically synthesized
tctggtggaagaggtaatta

SEQ ID NO: 230649 - DNA, 20 bp, Artificial Sequence
  chemically synthesized
cctataattacctcttccac

SEQ ID NO: 230650 - DNA, 20 bp, Artificial Sequence
  chemically synthesized
aattgcaattctggtggaag

SEQ ID NO: 230651 - DNA, 20 bp, Artificial Sequence
  chemically synthesized
taattgcaattctggtggaa

SEQ ID NO: 230652 - DNA, 20 bp, Artificial Sequence
  chemically synthesized
tataattgcaattctggtgg

SEQ ID NO: 230653 - DNA, 20 bp, Artificial Sequence
  chemically synthesized
atgtataattgcaattctgg

SEQ ID NO: 230654 - DNA, 20 bp, Artificial Sequence
  chemically synthesized
gaaatgtataattgcaattc

SEQ ID NO: 230655 - DNA, 20 bp, Artificial Sequence
  chemically synthesized
tttgaaaagtaaaagattaa

SEQ ID NO: 230656 - DNA, 20 bp, Artificial Sequence
  chemically synthesized
ccattatttttgaaaagtaa

SEQ ID NO: 230657 - DNA, 20 bp, Artificial Sequence
  chemically synthesized
aaatttccattatttttgaa

SEQ ID NO: 230658 - DNA, 20 bp, Artificial Sequence
  chemically synthesized
cttttacttttcaaaaataa

SEQ ID NO: 230659 - DNA, 20 bp, Artificial Sequence
  chemically synthesized
aaaataatggaaatttaaat

SEQ ID NO: 230660 - DNA, 20 bp, Artificial Sequence
  chemically synthesized
aaataatggaaatttaaatt

SEQ ID NO: 230661 - DNA, 20 bp, Artificial Sequence
  chemically synthesized
ggaaatttaaattgggaatt

SEQ ID NO: 230662 - DNA, 20 bp, Artificial Sequence
  chemically synthesized
attaagttgcatttaatttc

SEQ ID NO: 230663 - DNA, 20 bp, Artificial Sequence
  chemically synthesized
caaagattaaaatgcgaaac

SEQ ID NO: 230664 - DNA, 20 bp, Artificial Sequence
  chemically synthesized
cgcattttaatctttgaaaa

SEQ ID NO: 230665 - DNA, 20 bp, Artificial Sequence
  chemically synthesized
ctgtggctaggctattttca

SEQ ID NO: 230666 - DNA, 20 bp, Artificial Sequence
  chemically synthesized
tttaatctttgaaaatagcc

SEQ ID NO: 230667 - DNA, 20 bp, Artificial Sequence
  chemically synthesized
ctttgaaaatagcctagcca

SEQ ID NO: 230668 - DNA, 20 bp, Artificial Sequence
  chemically synthesized
tttgaaaatagcctagccac

SEQ ID NO: 230669 - DNA, 20 bp, Artificial Sequence
  chemically synthesized
gctgcaccttgcctgtggct

SEQ ID NO: 230670 - DNA, 20 bp, Artificial Sequence
  chemically synthesized
agctgcaccttgcctgtggc

SEQ ID NO: 230671 - DNA, 20 bp, Artificial Sequence
  chemically synthesized
aaaatagcctagccacaggc

SEQ ID NO: 230672 - DNA, 20 bp, Artificial Sequence
  chemically synthesized
aaatagcctagccacaggca

SEQ ID NO: 230673 - DNA, 20 bp, Artificial Sequence
  chemically synthesized
tttcagctgcaccttgcctg

SEQ ID NO: 230674 - DNA, 20 bp, Artificial Sequence
  chemically synthesized
gcctagccacaggcaaggtg

SEQ ID NO: 230675 - DNA, 20 bp, Artificial Sequence
  chemically synthesized
cacaggcaaggtgcagctga

SEQ ID NO: 230676 - DNA, 20 bp, Artificial Sequence
  chemically synthesized
tgtgctgtcattgaagcttt

SEQ ID NO: 230677 - DNA, 20 bp, Artificial Sequence
  chemically synthesized
gcagctgaaagcttcaatga

SEQ ID NO: 230678 - DNA, 20 bp, Artificial Sequence
  chemically synthesized
ttttaggtgtgctgtcattg

SEQ ID NO: 230679 - DNA, 20 bp, Artificial Sequence
  chemically synthesized
caatgacagcacacctaaaa

SEQ ID NO: 230680 - DNA, 20 bp, Artificial Sequence
  chemically synthesized
aatgacagcacacctaaaat

SEQ ID NO: 230681 - DNA, 20 bp, Artificial Sequence
  chemically synthesized
tgacagcacacctaaaatgg

SEQ ID NO: 230682 - DNA, 20 bp, Artificial Sequence
  chemically synthesized
tctgacaggcctcccatttt

SEQ ID NO: 230683 - DNA, 20 bp, Artificial Sequence
  chemically synthesized
gacagcacacctaaaatggg

SEQ ID NO: 230684 - DNA, 20 bp, Artificial Sequence
  chemically synthesized
atctgacaggcctcccattt

SEQ ID NO: 230685 - DNA, 20 bp, Artificial Sequence
  chemically synthesized
acctaaaatgggaggcctgt

SEQ ID NO: 230686 - DNA, 20 bp, Artificial Sequence
  chemically synthesized
cttcatatgtcaaatctgac

SEQ ID NO: 230687 - DNA, 20 bp, Artificial Sequence
  chemically synthesized
acttcatatgtcaaatctga

SEQ ID NO: 230688 - DNA, 20 bp, Artificial Sequence
  chemically synthesized
cctgtcagatttgacatatg

SEQ ID NO: 230689 - DNA, 20 bp, Artificial Sequence
  chemically synthesized
gtcagatttgacatatgaag

SEQ ID NO: 230690 - DNA, 20 bp, Artificial Sequence
  chemically synthesized
agatttgacatatgaagtgg

SEQ ID NO: 230691 - DNA, 20 bp, Artificial Sequence
  chemically synthesized
tgacatatgaagtggtggtt

SEQ ID NO: 230692 - DNA, 20 bp, Artificial Sequence
  chemically synthesized
tgaagtggtggtttggcttc

SEQ ID NO: 230693 - DNA, 20 bp, Artificial Sequence
  chemically synthesized
tggtggtttggcttccagca

SEQ ID NO: 230694 - DNA, 20 bp, Artificial Sequence
  chemically synthesized
aatggacaaagctttgctgg

SEQ ID NO: 230695 - DNA, 20 bp, Artificial Sequence
  chemically synthesized
cataatggacaaagctttgc

SEQ ID NO: 230696 - DNA, 20 bp, Artificial Sequence
  chemically synthesized
gagagggagcataatggaca

SEQ ID NO: 230697 - DNA, 20 bp, Artificial Sequence
  chemically synthesized
gaacaagagagggagcataa

SEQ ID NO: 230698 - DNA, 20 bp, Artificial Sequence
  chemically synthesized
ggagaggtgaacaagagagg

SEQ ID NO: 230699 - DNA, 20 bp, Artificial Sequence
  chemically synthesized
agggagaggtgaacaagaga

SEQ ID NO: 230700 - DNA, 20 bp, Artificial Sequence
  chemically synthesized
gagggagaggtgaacaagag

SEQ ID NO: 230701 - DNA, 20 bp, Artificial Sequence
  chemically synthesized
agagggagaggtgaacaaga

SEQ ID NO: 230702 - DNA, 20 bp, Artificial Sequence
  chemically synthesized
ctagagggagaggtgaacaa

SEQ ID NO: 230703 - DNA, 20 bp, Artificial Sequence
  chemically synthesized
agctagagggagaggtgaac

SEQ ID NO: 230704 - DNA, 20 bp, Artificial Sequence
  chemically synthesized
ctcttgttcacctctccctc

SEQ ID NO: 230705 - DNA, 20 bp, Artificial Sequence
  chemically synthesized
ggaagaaaagctagagggag

SEQ ID NO: 230706 - DNA, 20 bp, Artificial Sequence
  chemically synthesized
tggaagaaaagctagaggga

SEQ ID NO: 230707 - DNA, 20 bp, Artificial Sequence
  chemically synthesized
agtggaagaaaagctagagg

SEQ ID NO: 230708 - DNA, 20 bp, Artificial Sequence
  chemically synthesized
acagtggaagaaaagctaga

SEQ ID NO: 230709 - DNA, 20 bp, Artificial Sequence
  chemically synthesized
gacagtggaagaaaagctag

SEQ ID NO: 230710 - DNA, 20 bp, Artificial Sequence
  chemically synthesized
tgacagtggaagaaaagcta

SEQ ID NO: 230711 - DNA, 20 bp, Artificial Sequence
  chemically synthesized
tctgacagtggaagaaaagc

SEQ ID NO: 230712 - DNA, 20 bp, Artificial Sequence
  chemically synthesized
gctctctgacagtggaagaa

SEQ ID NO: 230713 - DNA, 20 bp, Artificial Sequence
  chemically synthesized
tctagcttttcttccactgt

SEQ ID NO: 230714 - DNA, 20 bp, Artificial Sequence
  chemically synthesized
tttcagctctctgacagtgg

SEQ ID NO: 230715 - DNA, 20 bp, Artificial Sequence
  chemically synthesized
tagcttttcttccactgtca

SEQ ID NO: 230716 - DNA, 20 bp, Artificial Sequence
  chemically synthesized
gcatttcagctctctgacag

SEQ ID NO: 230717 - DNA, 20 bp, Artificial Sequence
  chemically synthesized
gcttttcttccactgtcaga

SEQ ID NO: 230718 - DNA, 20 bp, Artificial Sequence
  chemically synthesized
ttcgcatttcagctctctga

SEQ ID NO: 230719 - DNA, 20 bp, Artificial Sequence
  chemically synthesized
gagtagaattattcgcattt

SEQ ID NO: 230720 - DNA, 20 bp, Artificial Sequence
  chemically synthesized
aaatgcgaataattctactc

SEQ ID NO: 230721 - DNA, 20 bp, Artificial Sequence
  chemically synthesized
aatgcgaataattctactcc

SEQ ID NO: 230722 - DNA, 20 bp, Artificial Sequence
  chemically synthesized
gtgaaatatgtttcctggag

SEQ ID NO: 230723 - DNA, 20 bp, Artificial Sequence
  chemically synthesized
tatgtgaaatatgtttcctg

SEQ ID NO: 230724 - DNA, 20 bp, Artificial Sequence
  chemically synthesized
attatgtgaaatatgtttcc

SEQ ID NO: 230725 - DNA, 20 bp, Artificial Sequence
  chemically synthesized
aggcttttcatttggtgtta

SEQ ID NO: 230726 - DNA, 20 bp, Artificial Sequence
  chemically synthesized
tttctataacaccaaatgaa

SEQ ID NO: 230727 - DNA, 20 bp, Artificial Sequence
  chemically synthesized
tagtctaaaggcttttcatt

SEQ ID NO: 230728 - DNA, 20 bp, Artificial Sequence
  chemically synthesized
aacaccaaatgaaaagcctt

SEQ ID NO: 230729 - DNA, 20 bp, Artificial Sequence
  chemically synthesized
tctatgataatatagtctaa

SEQ ID NO: 230730 - DNA, 20 bp, Artificial Sequence
  chemically synthesized
ttctatgataatatagtcta

SEQ ID NO: 230731 - DNA, 20 bp, Artificial Sequence
  chemically synthesized
gactagcttctatgataata

SEQ ID NO: 230732 - DNA, 20 bp, Artificial Sequence
  chemically synthesized
gcctttagactatattatca

SEQ ID NO: 230733 - DNA, 20 bp, Artificial Sequence
  chemically synthesized
tttagactatattatcatag

SEQ ID NO: 230734 - DNA, 20 bp, Artificial Sequence
  chemically synthesized
gactatattatcatagaagc

SEQ ID NO: 230735 - DNA, 20 bp, Artificial Sequence
  chemically synthesized
atctggtgttaaataaggac

SEQ ID NO: 230736 - DNA, 20 bp, Artificial Sequence
  chemically synthesized
ataaaatctggtgttaaata

SEQ ID NO: 230737 - DNA, 20 bp, Artificial Sequence
  chemically synthesized
aataaaatctggtgttaaat

SEQ ID NO: 230738 - DNA, 20 bp, Artificial Sequence
  chemically synthesized
agctagtccttatttaacac

SEQ ID NO: 230739 - DNA, 20 bp, Artificial Sequence
  chemically synthesized
attacatatccaataaaatc

SEQ ID NO: 230740 - DNA, 20 bp, Artificial Sequence
  chemically synthesized
tatttaacaccagattttat

SEQ ID NO: 230741 - DNA, 20 bp, Artificial Sequence
  chemically synthesized
gtatttctgtatttaggtag

SEQ ID NO: 230742 - DNA, 20 bp, Artificial Sequence
  chemically synthesized
agtatttctgtatttaggta

SEQ ID NO: 230743 - DNA, 20 bp, Artificial Sequence
  chemically synthesized
aaagtatttctgtatttagg

SEQ ID NO: 230744 - DNA, 20 bp, Artificial Sequence
  chemically synthesized
tacatacctctacctaaata

SEQ ID NO: 230745 - DNA, 20 bp, Artificial Sequence
  chemically synthesized
tgtaaagtatttctgtattt

SEQ ID NO: 230746 - DNA, 20 bp, Artificial Sequence
  chemically synthesized
ctgtaaagtatttctgtatt

SEQ ID NO: 230747 - DNA, 20 bp, Artificial Sequence
  chemically synthesized
ctaaatacagaaatacttta

SEQ ID NO: 230748 - DNA, 20 bp, Artificial Sequence
  chemically synthesized
ttacacataataaggctgta

SEQ ID NO: 230749 - DNA, 20 bp, Artificial Sequence
  chemically synthesized
tttttttattacacataata

SEQ ID NO: 230750 - DNA, 20 bp, Artificial Sequence
  chemically synthesized
atttttttattacacataat

SEQ ID NO: 230751 - DNA, 20 bp, Artificial Sequence
  chemically synthesized
aatgtggcttgagaagatgt

SEQ ID NO: 230752 - DNA, 20 bp, Artificial Sequence
  chemically synthesized
aaaaaatctaacatcttctc

SEQ ID NO: 230753 - DNA, 20 bp, Artificial Sequence
  chemically synthesized
catctgcaatgtggcttgag

SEQ ID NO: 230754 - DNA, 20 bp, Artificial Sequence
  chemically synthesized
taccatctgcaatgtggctt

SEQ ID NO: 230755 - DNA, 20 bp, Artificial Sequence
  chemically synthesized
catcttctcaagccacattg

SEQ ID NO: 230756 - DNA, 20 bp, Artificial Sequence
  chemically synthesized
taatactaccatctgcaatg

SEQ ID NO: 230757 - DNA, 20 bp, Artificial Sequence
  chemically synthesized
ttctcaagccacattgcaga

SEQ ID NO: 230758 - DNA, 20 bp, Artificial Sequence
  chemically synthesized
tcaagccacattgcagatgg

SEQ ID NO: 230759 - DNA, 20 bp, Artificial Sequence
  chemically synthesized
ttgcagatggtagtattatc

SEQ ID NO: 230760 - DNA, 20 bp, Artificial Sequence
  chemically synthesized
agatggtagtattatctgga

SEQ ID NO: 230761 - DNA, 20 bp, Artificial Sequence
  chemically synthesized
tttgttcatgaggcaccatc

SEQ ID NO: 230762 - DNA, 20 bp, Artificial Sequence
  chemically synthesized
ccttttgaagtttgttcatg

SEQ ID NO: 230763 - DNA, 20 bp, Artificial Sequence
  chemically synthesized
tccttttgaagtttgttcat

SEQ ID NO: 230764 - DNA, 20 bp, Artificial Sequence
  chemically synthesized
gcctcatgaacaaacttcaa

SEQ ID NO: 230765 - DNA, 20 bp, Artificial Sequence
  chemically synthesized
cctcatgaacaaacttcaaa

SEQ ID NO: 230766 - DNA, 20 bp, Artificial Sequence
  chemically synthesized
cacatcaacatttccttttg

SEQ ID NO: 230767 - DNA, 20 bp, Artificial Sequence
  chemically synthesized
tcaaaaggaaatgttgatgt

SEQ ID NO: 230768 - DNA, 20 bp, Artificial Sequence
  chemically synthesized
aaaggaaatgttgatgtgag

SEQ ID NO: 230769 - DNA, 20 bp, Artificial Sequence
  chemically synthesized
ttgatgtgagaagattccta

SEQ ID NO: 230770 - DNA, 20 bp, Artificial Sequence
  chemically synthesized
tgagaagattcctatggttc

SEQ ID NO: 230771 - DNA, 20 bp, Artificial Sequence
  chemically synthesized
tagagtcttaccagaaccat

SEQ ID NO: 230772 - DNA, 20 bp, Artificial Sequence
  chemically synthesized
gtagagtcttaccagaacca

SEQ ID NO: 230773 - DNA, 20 bp, Artificial Sequence
  chemically synthesized
aagattcctatggttctggt

SEQ ID NO: 230774 - DNA, 20 bp, Artificial Sequence
  chemically synthesized
agggggatgtagagtcttac

SEQ ID NO: 230775 - DNA, 20 bp, Artificial Sequence
  chemically synthesized
cctggggggagggggatgta

SEQ ID NO: 230776 - DNA, 20 bp, Artificial Sequence
  chemically synthesized
gacctggggggagggggatg

SEQ ID NO: 230777 - DNA, 20 bp, Artificial Sequence
  chemically synthesized
tccacagacctggggggagg

SEQ ID NO: 230778 - DNA, 20 bp, Artificial Sequence
  chemically synthesized
actctacatccccctccccc

SEQ ID NO: 230779 - DNA, 20 bp, Artificial Sequence
  chemically synthesized
ttccacagacctggggggag

SEQ ID NO: 230780 - DNA, 20 bp, Artificial Sequence
  chemically synthesized
ctctacatccccctcccccc

SEQ ID NO: 230781 - DNA, 20 bp, Artificial Sequence
  chemically synthesized
attccacagacctgggggga

SEQ ID NO: 230782 - DNA, 20 bp, Artificial Sequence
  chemically synthesized
tattccacagacctgggggg

SEQ ID NO: 230783 - DNA, 20 bp, Artificial Sequence
  chemically synthesized
ttattccacagacctggggg

SEQ ID NO: 230784 - DNA, 20 bp, Artificial Sequence
  chemically synthesized
cattattccacagacctggg

SEQ ID NO: 230785 - DNA, 20 bp, Artificial Sequence
  chemically synthesized
acattattccacagacctgg

SEQ ID NO: 230786 - DNA, 20 bp, Artificial Sequence
  chemically synthesized
tacattattccacagacctg

SEQ ID NO: 230787 - DNA, 20 bp, Artificial Sequence
  chemically synthesized
tccccctccccccaggtctg

SEQ ID NO: 230788 - DNA, 20 bp, Artificial Sequence
  chemically synthesized
atacattattccacagacct

SEQ ID NO: 230789 - DNA, 20 bp, Artificial Sequence
  chemically synthesized
tatacattattccacagacc

SEQ ID NO: 230790 - DNA, 20 bp, Artificial Sequence
  chemically synthesized
tatgcctatacattattcca

SEQ ID NO: 230791 - DNA, 20 bp, Artificial Sequence
  chemically synthesized
caggtctgtggaataatgta

SEQ ID NO: 230792 - DNA, 20 bp, Artificial Sequence
  chemically synthesized
aggtctgtggaataatgtat

SEQ ID NO: 230793 - DNA, 20 bp, Artificial Sequence
  chemically synthesized
ataatgtataggcatataaa

SEQ ID NO: 230794 - DNA, 20 bp, Artificial Sequence
  chemically synthesized
gcatataaacagtacataca

SEQ ID NO: 230795 - DNA, 20 bp, Artificial Sequence
  chemically synthesized
aacacgcacacacatatata

SEQ ID NO: 230796 - DNA, 20 bp, Artificial Sequence
  chemically synthesized
cgtgtttaaattgtattaat

SEQ ID NO: 230797 - DNA, 20 bp, Artificial Sequence
  chemically synthesized
ataagatttttttatacact

SEQ ID NO: 230798 - DNA, 20 bp, Artificial Sequence
  chemically synthesized
gttagacactgttaggtgct

SEQ ID NO: 230799 - DNA, 20 bp, Artificial Sequence
  chemically synthesized
tttatacactcagcacctaa

SEQ ID NO: 230800 - DNA, 20 bp, Artificial Sequence
  chemically synthesized
aaaatgtgttagacactgtt

SEQ ID NO: 230801 - DNA, 20 bp, Artificial Sequence
  chemically synthesized
taaaatgtgttagacactgt

SEQ ID NO: 230802 - DNA, 20 bp, Artificial Sequence
  chemically synthesized
ttggaagatataaaatgtgt

SEQ ID NO: 230803 - DNA, 20 bp, Artificial Sequence
  chemically synthesized
ttgcttcattcatttattgg

SEQ ID NO: 230804 - DNA, 20 bp, Artificial Sequence
  chemically synthesized
catttgcttcattcatttat

SEQ ID NO: 230805 - DNA, 20 bp, Artificial Sequence
  chemically synthesized
tatcttccaataaatgaatg

SEQ ID NO: 230806 - DNA, 20 bp, Artificial Sequence
  chemically synthesized
aatgaagcaaatgaaaacat

SEQ ID NO: 230807 - DNA, 20 bp, Artificial Sequence
  chemically synthesized
caaatgaaaacatcagtaaa

SEQ ID NO: 230808 - DNA, 20 bp, Artificial Sequence
  chemically synthesized
catcagtaaacagaaaaaaa

SEQ ID NO: 230809 - DNA, 20 bp, Artificial Sequence
  chemically synthesized
atcagtaaacagaaaaaaac

SEQ ID NO: 230810 - DNA, 20 bp, Artificial Sequence
  chemically synthesized
aaaaaaacaggcattttatt

SEQ ID NO: 230811 - DNA, 20 bp, Artificial Sequence
  chemically synthesized
tattcagtttactttaattt

SEQ ID NO: 230812 - DNA, 20 bp, Artificial Sequence
  chemically synthesized
accaaacaccactcaaatta

SEQ ID NO: 230813 - DNA, 20 bp, Artificial Sequence
  chemically synthesized
tcagtttactttaatttgag

SEQ ID NO: 230814 - DNA, 20 bp, Artificial Sequence
  chemically synthesized
actttaatttgagtggtgtt

SEQ ID NO: 230815 - DNA, 20 bp, Artificial Sequence
  chemically synthesized
ttggttgtaatatctgacaa

SEQ ID NO: 230816 - DNA, 20 bp, Artificial Sequence
  chemically synthesized
taaatagcactaacttttgt

SEQ ID NO: 230817 - DNA, 20 bp, Artificial Sequence
  chemically synthesized
ttgtaatatctgacaaaagt

SEQ ID NO: 230818 - DNA, 20 bp, Artificial Sequence
  chemically synthesized
caaaagttagtgctatttaa

SEQ ID NO: 230819 - DNA, 20 bp, Artificial Sequence
  chemically synthesized
aattattttaaaccattaaa

SEQ ID NO: 230820 - DNA, 20 bp, Artificial Sequence
  chemically synthesized
gtttaaaataatttaatgtg

SEQ ID NO: 230821 - DNA, 20 bp, Artificial Sequence
  chemically synthesized
aatgtgtagttttccccttt

SEQ ID NO: 230822 - DNA, 20 bp, Artificial Sequence
  chemically synthesized
atacagggcaaaacttaaag

SEQ ID NO: 230823 - DNA, 20 bp, Artificial Sequence
  chemically synthesized
gatacagggcaaaacttaaa

SEQ ID NO: 230824 - DNA, 20 bp, Artificial Sequence
  chemically synthesized
agatacagggcaaaacttaa

SEQ ID NO: 230825 - DNA, 20 bp, Artificial Sequence
  chemically synthesized
aagatacagggcaaaactta

SEQ ID NO: 230826 - DNA, 20 bp, Artificial Sequence
  chemically synthesized
agaccatagcaaaagataca

SEQ ID NO: 230827 - DNA, 20 bp, Artificial Sequence
  chemically synthesized
cagaccatagcaaaagatac

SEQ ID NO: 230828 - DNA, 20 bp, Artificial Sequence
  chemically synthesized
acagaccatagcaaaagata

SEQ ID NO: 230829 - DNA, 20 bp, Artificial Sequence
  chemically synthesized
ttgccctgtatcttttgcta

SEQ ID NO: 230830 - DNA, 20 bp, Artificial Sequence
  chemically synthesized
tagctgacagaccatagcaa

SEQ ID NO: 230831 - DNA, 20 bp, Artificial Sequence
  chemically synthesized
aaattatagctgacagacca

SEQ ID NO: 230832 - DNA, 20 bp, Artificial Sequence
  chemically synthesized
tatcttttgctatggtctgt

SEQ ID NO: 230833 - DNA, 20 bp, Artificial Sequence
  chemically synthesized
attgaacaaattatagctga

SEQ ID NO: 230834 - DNA, 20 bp, Artificial Sequence
  chemically synthesized
acaaaagattgaacaaatta

SEQ ID NO: 230835 - DNA, 20 bp, Artificial Sequence
  chemically synthesized
aatttgttcaatcttttgtg

SEQ ID NO: 230836 - DNA, 20 bp, Artificial Sequence
  chemically synthesized
ctgggaagaaagctacacaa

SEQ ID NO: 230837 - DNA, 20 bp, Artificial Sequence
  chemically synthesized
cttttgtgtagctttcttcc

SEQ ID NO: 230838 - DNA, 20 bp, Artificial Sequence
  chemically synthesized
gacttgtaagactgggaaga

SEQ ID NO: 230839 - DNA, 20 bp, Artificial Sequence
  chemically synthesized
attagacttgtaagactggg

SEQ ID NO: 230840 - DNA, 20 bp, Artificial Sequence
  chemically synthesized
ccaattagacttgtaagact

SEQ ID NO: 230841 - DNA, 20 bp, Artificial Sequence
  chemically synthesized
agctttcttcccagtcttac

SEQ ID NO: 230842 - DNA, 20 bp, Artificial Sequence
  chemically synthesized
cccaattagacttgtaagac

SEQ ID NO: 230843 - DNA, 20 bp, Artificial Sequence
  chemically synthesized
ctttccccaattagacttgt

SEQ ID NO: 230844 - DNA, 20 bp, Artificial Sequence
  chemically synthesized
cccagtcttacaagtctaat

SEQ ID NO: 230845 - DNA, 20 bp, Artificial Sequence
  chemically synthesized
ccagtcttacaagtctaatt

SEQ ID NO: 230846 - DNA, 20 bp, Artificial Sequence
  chemically synthesized
cagtcttacaagtctaattg

SEQ ID NO: 230847 - DNA, 20 bp, Artificial Sequence
  chemically synthesized
attcccttactttccccaat

SEQ ID NO: 230848 - DNA, 20 bp, Artificial Sequence
  chemically synthesized
cttacaagtctaattgggga

SEQ ID NO: 230849 - DNA, 20 bp, Artificial Sequence
  chemically synthesized
caagtctaattggggaaagt

SEQ ID NO: 230850 - DNA, 20 bp, Artificial Sequence
  chemically synthesized
aagtctaattggggaaagta

SEQ ID NO: 230851 - DNA, 20 bp, Artificial Sequence
  chemically synthesized
agtctaattggggaaagtaa

SEQ ID NO: 230852 - DNA, 20 bp, Artificial Sequence
  chemically synthesized
agggaattaacaatgatcaa

SEQ ID NO: 230853 - DNA, 20 bp, Artificial Sequence
  chemically synthesized
gtgaatgtttagaaaaagaa

SEQ ID NO: 230854 - DNA, 20 bp, Artificial Sequence
  chemically synthesized
gatatgtgaatgtttagaaa

SEQ ID NO: 230855 - DNA, 20 bp, Artificial Sequence
  chemically synthesized
ttcaaagatatgtgaatgtt

SEQ ID NO: 230856 - DNA, 20 bp, Artificial Sequence
  chemically synthesized
aggattcctgtagagattca

SEQ ID NO: 230857 - DNA, 20 bp, Artificial Sequence
  chemically synthesized
cacatatctttgaatctcta

SEQ ID NO: 230858 - DNA, 20 bp, Artificial Sequence
  chemically synthesized
acatatctttgaatctctac

SEQ ID NO: 230859 - DNA, 20 bp, Artificial Sequence
  chemically synthesized
tcttttccaggattcctgta

SEQ ID NO: 230860 - DNA, 20 bp, Artificial Sequence
  chemically synthesized
cctcttttccaggattcctg

SEQ ID NO: 230861 - DNA, 20 bp, Artificial Sequence
  chemically synthesized
ttgaatctctacaggaatcc

SEQ ID NO: 230862 - DNA, 20 bp, Artificial Sequence
  chemically synthesized
tctctacaggaatcctggaa

SEQ ID NO: 230863 - DNA, 20 bp, Artificial Sequence
  chemically synthesized
tctacaggaatcctggaaaa

SEQ ID NO: 230864 - DNA, 20 bp, Artificial Sequence
  chemically synthesized
ctacaggaatcctggaaaag

SEQ ID NO: 230865 - DNA, 20 bp, Artificial Sequence
  chemically synthesized
gcaaaatgatcctcttttcc

SEQ ID NO: 230866 - DNA, 20 bp, Artificial Sequence
  chemically synthesized
tgcaaaatgatcctcttttc

SEQ ID NO: 230867 - DNA, 20 bp, Artificial Sequence
  chemically synthesized
tggaaaagaggatcattttg

SEQ ID NO: 230868 - DNA, 20 bp, Artificial Sequence
  chemically synthesized
cattttgcagaaaaaaaaca

SEQ ID NO: 230869 - DNA, 20 bp, Artificial Sequence
  chemically synthesized
attttgcagaaaaaaaacat

SEQ ID NO: 230870 - DNA, 20 bp, Artificial Sequence
  chemically synthesized
tgcagaaaaaaaacataggc

SEQ ID NO: 230871 - DNA, 20 bp, Artificial Sequence
  chemically synthesized
cagaaaaaaaacataggcta

SEQ ID NO: 230872 - DNA, 20 bp, Artificial Sequence
  chemically synthesized
gacaaggtgttcagaaactc

SEQ ID NO: 230873 - DNA, 20 bp, Artificial Sequence
  chemically synthesized
tacctttgggacaaggtgtt

SEQ ID NO: 230874 - DNA, 20 bp, Artificial Sequence
  chemically synthesized
tttctgaacaccttgtccca

SEQ ID NO: 230875 - DNA, 20 bp, Artificial Sequence
  chemically synthesized
ctggctgtacctttgggaca

SEQ ID NO: 230876 - DNA, 20 bp, Artificial Sequence
  chemically synthesized
ttctgaacaccttgtcccaa

SEQ ID NO: 230877 - DNA, 20 bp, Artificial Sequence
  chemically synthesized
tctggctgtacctttgggac

SEQ ID NO: 230878 - DNA, 20 bp, Artificial Sequence
  chemically synthesized
aacaccttgtcccaaaggta

SEQ ID NO: 230879 - DNA, 20 bp, Artificial Sequence
  chemically synthesized
caaactctggctgtaccttt

SEQ ID NO: 230880 - DNA, 20 bp, Artificial Sequence
  chemically synthesized
tcaaactctggctgtacctt

SEQ ID NO: 230881 - DNA, 20 bp, Artificial Sequence
  chemically synthesized
ccttgtcccaaaggtacagc

SEQ ID NO: 230882 - DNA, 20 bp, Artificial Sequence
  chemically synthesized
ttgtcccaaaggtacagcca

SEQ ID NO: 230883 - DNA, 20 bp, Artificial Sequence
  chemically synthesized
actgacttggattcaaactc

SEQ ID NO: 230884 - DNA, 20 bp, Artificial Sequence
  chemically synthesized
tacagccagagtttgaatcc

SEQ ID NO: 230885 - DNA, 20 bp, Artificial Sequence
  chemically synthesized
gccagagtttgaatccaagt

SEQ ID NO: 230886 - DNA, 20 bp, Artificial Sequence
  chemically synthesized
tgtttggaattagactgact

SEQ ID NO: 230887 - DNA, 20 bp, Artificial Sequence
  chemically synthesized
aaaagatctatgtttggaat

SEQ ID NO: 230888 - DNA, 20 bp, Artificial Sequence
  chemically synthesized
agtcagtctaattccaaaca

SEQ ID NO: 230889 - DNA, 20 bp, Artificial Sequence
  chemically synthesized
ttgaggaaaagatctatgtt

SEQ ID NO: 230890 - DNA, 20 bp, Artificial Sequence
  chemically synthesized
aaatgttatggtttgaggaa

SEQ ID NO: 230891 - DNA, 20 bp, Artificial Sequence
  chemically synthesized
cttgaaaatgttatggtttg

SEQ ID NO: 230892 - DNA, 20 bp, Artificial Sequence
  chemically synthesized
tcttgaaaatgttatggttt

SEQ ID NO: 230893 - DNA, 20 bp, Artificial Sequence
  chemically synthesized
tacagttcttgaaaatgtta

SEQ ID NO: 230894 - DNA, 20 bp, Artificial Sequence
  chemically synthesized
cctcaaaccataacattttc

SEQ ID NO: 230895 - DNA, 20 bp, Artificial Sequence
  chemically synthesized
tcataagaaatgataaaata

SEQ ID NO: 230896 - DNA, 20 bp, Artificial Sequence
  chemically synthesized
agtaagttggcagggatcat

SEQ ID NO: 230897 - DNA, 20 bp, Artificial Sequence
  chemically synthesized
atattgtgagtaagttggca

SEQ ID NO: 230898 - DNA, 20 bp, Artificial Sequence
  chemically synthesized
aatattgtgagtaagttggc

SEQ ID NO: 230899 - DNA, 20 bp, Artificial Sequence
  chemically synthesized
taatattgtgagtaagttgg

SEQ ID NO: 230900 - DNA, 20 bp, Artificial Sequence
  chemically synthesized
tgataatattgtgagtaagt

SEQ ID NO: 230901 - DNA, 20 bp, Artificial Sequence
  chemically synthesized
ctactgataatattgtgagt

SEQ ID NO: 230902 - DNA, 20 bp, Artificial Sequence
  chemically synthesized
taggctactgataatattgt

SEQ ID NO: 230903 - DNA, 20 bp, Artificial Sequence
  chemically synthesized
caacttactcacaatattat

SEQ ID NO: 230904 - DNA, 20 bp, Artificial Sequence
  chemically synthesized
cttactcacaatattatcag

SEQ ID NO: 230905 - DNA, 20 bp, Artificial Sequence
  chemically synthesized
tcacaatattatcagtagcc

SEQ ID NO: 230906 - DNA, 20 bp, Artificial Sequence
  chemically synthesized
ttggcatttagtgaatgtct

SEQ ID NO: 230907 - DNA, 20 bp, Artificial Sequence
  chemically synthesized
gttggcatttagtgaatgtc

SEQ ID NO: 230908 - DNA, 20 bp, Artificial Sequence
  chemically synthesized
acttgttcacagttggcatt

SEQ ID NO: 230909 - DNA, 20 bp, Artificial Sequence
  chemically synthesized
aggcttcacttgttcacagt

SEQ ID NO: 230910 - DNA, 20 bp, Artificial Sequence
  chemically synthesized
actaaatgccaactgtgaac

SEQ ID NO: 230911 - DNA, 20 bp, Artificial Sequence
  chemically synthesized
ttaaaggcttcacttgttca

SEQ ID NO: 230912 - DNA, 20 bp, Artificial Sequence
  chemically synthesized
atgccaactgtgaacaagtg

SEQ ID NO: 230913 - DNA, 20 bp, Artificial Sequence
  chemically synthesized
tgtgaacaagtgaagccttt

SEQ ID NO: 230914 - DNA, 20 bp, Artificial Sequence
  chemically synthesized
caacaccatccaagtcttaa

SEQ ID NO: 230915 - DNA, 20 bp, Artificial Sequence
  chemically synthesized
caagtgaagcctttaagact

SEQ ID NO: 230916 - DNA, 20 bp, Artificial Sequence
  chemically synthesized
tcaacaccatccaagtctta

SEQ ID NO: 230917 - DNA, 20 bp, Artificial Sequence
  chemically synthesized
tgaagcctttaagacttgga

SEQ ID NO: 230918 - DNA, 20 bp, Artificial Sequence
  chemically synthesized
agggaacttcaacaccatcc

SEQ ID NO: 230919 - DNA, 20 bp, Artificial Sequence
  chemically synthesized
ttaagacttggatggtgttg

SEQ ID NO: 230920 - DNA, 20 bp, Artificial Sequence
  chemically synthesized
tggatggtgttgaagttccc

SEQ ID NO: 230921 - DNA, 20 bp, Artificial Sequence
  chemically synthesized
taaactgaaatatcacacca

SEQ ID NO: 230922 - DNA, 20 bp, Artificial Sequence
  chemically synthesized
gtaaactgaaatatcacacc

SEQ ID NO: 230923 - DNA, 20 bp, Artificial Sequence
  chemically synthesized
agtaaactgaaatatcacac

SEQ ID NO: 230924 - DNA, 20 bp, Artificial Sequence
  chemically synthesized
agttccctggtgtgatattt

SEQ ID NO: 230925 - DNA, 20 bp, Artificial Sequence
  chemically synthesized
gtgtgatatttcagtttact

SEQ ID NO: 230926 - DNA, 20 bp, Artificial Sequence
  chemically synthesized
cattcattcaggtgggtact

SEQ ID NO: 230927 - DNA, 20 bp, Artificial Sequence
  chemically synthesized
ttcaaagcattcattcaggt

SEQ ID NO: 230928 - DNA, 20 bp, Artificial Sequence
  chemically synthesized
cttcaaagcattcattcagg

SEQ ID NO: 230929 - DNA, 20 bp, Artificial Sequence
  chemically synthesized
tttcttcaaagcattcattc

SEQ ID NO: 230930 - DNA, 20 bp, Artificial Sequence
  chemically synthesized
ttttcttcaaagcattcatt

SEQ ID NO: 230931 - DNA, 20 bp, Artificial Sequence
  chemically synthesized
ccacctgaatgaatgctttg

SEQ ID NO: 230932 - DNA, 20 bp, Artificial Sequence
  chemically synthesized
tcacttgtttattttcttca

SEQ ID NO: 230933 - DNA, 20 bp, Artificial Sequence
  chemically synthesized
atgctttgaagaaaataaac

SEQ ID NO: 230934 - DNA, 20 bp, Artificial Sequence
  chemically synthesized
ttgaagaaaataaacaagtg

SEQ ID NO: 230935 - DNA, 20 bp, Artificial Sequence
  chemically synthesized
ataaacaagtgaagcttaat

SEQ ID NO: 230936 - DNA, 20 bp, Artificial Sequence
  chemically synthesized
aaacatttacttagctgatt

SEQ ID NO: 230937 - DNA, 20 bp, Artificial Sequence
  chemically synthesized
caagtgaagcttaatcagct

SEQ ID NO: 230938 - DNA, 20 bp, Artificial Sequence
  chemically synthesized
tttttatccaaacatttact

SEQ ID NO: 230939 - DNA, 20 bp, Artificial Sequence
  chemically synthesized
taatcagctaagtaaatgtt

SEQ ID NO: 230940 - DNA, 20 bp, Artificial Sequence
  chemically synthesized
aatgtttggataaaaaaatg

SEQ ID NO: 230941 - DNA, 20 bp, Artificial Sequence
  chemically synthesized
gggctttcccttatttaaac

SEQ ID NO: 230942 - DNA, 20 bp, Artificial Sequence
  chemically synthesized
aaaatgaagcttgtttaaat

SEQ ID NO: 230943 - DNA, 20 bp, Artificial Sequence
  chemically synthesized
aaatgaagcttgtttaaata

SEQ ID NO: 230944 - DNA, 20 bp, Artificial Sequence
  chemically synthesized
aatgaagcttgtttaaataa

SEQ ID NO: 230945 - DNA, 20 bp, Artificial Sequence
  chemically synthesized
aagcttgtttaaataaggga

SEQ ID NO: 230946 - DNA, 20 bp, Artificial Sequence
  chemically synthesized
agtagatcagagaagaataa

SEQ ID NO: 230947 - DNA, 20 bp, Artificial Sequence
  chemically synthesized
gagtagatcagagaagaata

SEQ ID NO: 230948 - DNA, 20 bp, Artificial Sequence
  chemically synthesized
tgagtagatcagagaagaat

SEQ ID NO: 230949 - DNA, 20 bp, Artificial Sequence
  chemically synthesized
cttaaatgagtagatcagag

SEQ ID NO: 230950 - DNA, 20 bp, Artificial Sequence
  chemically synthesized
tgacttaaatgagtagatca

SEQ ID NO: 230951 - DNA, 20 bp, Artificial Sequence
  chemically synthesized
tttgacttaaatgagtagat

SEQ ID NO: 230952 - DNA, 20 bp, Artificial Sequence
  chemically synthesized
cttctctgatctactcattt

SEQ ID NO: 230953 - DNA, 20 bp, Artificial Sequence
  chemically synthesized
aattgtttgacttaaatgag

SEQ ID NO: 230954 - DNA, 20 bp, Artificial Sequence
  chemically synthesized
ggtaattgtttgacttaaat

SEQ ID NO: 230955 - DNA, 20 bp, Artificial Sequence
  chemically synthesized
taagtcaaacaattaccata

SEQ ID NO: 230956 - DNA, 20 bp, Artificial Sequence
  chemically synthesized
aattttgagaattagcttta

SEQ ID NO: 230957 - DNA, 20 bp, Artificial Sequence
  chemically synthesized
gaaaacataattttgagaat

SEQ ID NO: 230958 - DNA, 20 bp, Artificial Sequence
  chemically synthesized
attaaagaaaacataatttt

SEQ ID NO: 230959 - DNA, 20 bp, Artificial Sequence
  chemically synthesized
ctaacccaattcaataatta

SEQ ID NO: 230960 - DNA, 20 bp, Artificial Sequence
  chemically synthesized
gttttctttaattattgaat

SEQ ID NO: 230961 - DNA, 20 bp, Artificial Sequence
  chemically synthesized
ttttctttaattattgaatt

SEQ ID NO: 230962 - DNA, 20 bp, Artificial Sequence
  chemically synthesized
ctttaattattgaattgggt

SEQ ID NO: 230963 - DNA, 20 bp, Artificial Sequence
  chemically synthesized
tggactaatgggtcaaagga

SEQ ID NO: 230964 - DNA, 20 bp, Artificial Sequence
  chemically synthesized
tatttggactaatgggtcaa

SEQ ID NO: 230965 - DNA, 20 bp, Artificial Sequence
  chemically synthesized
gtatttggactaatgggtca

SEQ ID NO: 230966 - DNA, 20 bp, Artificial Sequence
  chemically synthesized
agtactgtcctttgacccat

SEQ ID NO: 230967 - DNA, 20 bp, Artificial Sequence
  chemically synthesized
atgtgtgtatttggactaat

SEQ ID NO: 230968 - DNA, 20 bp, Artificial Sequence
  chemically synthesized
catgtgtgtatttggactaa

SEQ ID NO: 230969 - DNA, 20 bp, Artificial Sequence
  chemically synthesized
tagctgtgcatgtgtgtatt

SEQ ID NO: 230970 - DNA, 20 bp, Artificial Sequence
  chemically synthesized
agtccaaatacacacatgca

SEQ ID NO: 230971 - DNA, 20 bp, Artificial Sequence
  chemically synthesized
tatatatatatatatttgtg

SEQ ID NO: 230972 - DNA, 20 bp, Artificial Sequence
  chemically synthesized
tatatatatgtatgtataca

SEQ ID NO: 230973 - DNA, 20 bp, Artificial Sequence
  chemically synthesized
tatatatgtatgtatacata

SEQ ID NO: 230974 - DNA, 20 bp, Artificial Sequence
  chemically synthesized
tatatgtatgtatacataga

SEQ ID NO: 230975 - DNA, 20 bp, Artificial Sequence
  chemically synthesized
ttgtcagttagagtattttt

SEQ ID NO: 230976 - DNA, 20 bp, Artificial Sequence
  chemically synthesized
catctccatcttgtcagtta

SEQ ID NO: 230977 - DNA, 20 bp, Artificial Sequence
  chemically synthesized
taaaaaatactctaactgac

SEQ ID NO: 230978 - DNA, 20 bp, Artificial Sequence
  chemically synthesized
gtcatctccatcttgtcagt

SEQ ID NO: 230979 - DNA, 20 bp, Artificial Sequence
  chemically synthesized
aaatactctaactgacaaga

SEQ ID NO: 230980 - DNA, 20 bp, Artificial Sequence
  chemically synthesized
tagtgtcatctccatcttgt

SEQ ID NO: 230981 - DNA, 20 bp, Artificial Sequence
  chemically synthesized
atactctaactgacaagatg

SEQ ID NO: 230982 - DNA, 20 bp, Artificial Sequence
  chemically synthesized
gccctgatatatgcataaat

SEQ ID NO: 230983 - DNA, 20 bp, Artificial Sequence
  chemically synthesized
acactaatttatgcatatat

SEQ ID NO: 230984 - DNA, 20 bp, Artificial Sequence
  chemically synthesized
cactaatttatgcatatatc

SEQ ID NO: 230985 - DNA, 20 bp, Artificial Sequence
  chemically synthesized
actaatttatgcatatatca

SEQ ID NO: 230986 - DNA, 20 bp, Artificial Sequence
  chemically synthesized
agagataagctattaaaatg

SEQ ID NO: 230987 - DNA, 20 bp, Artificial Sequence
  chemically synthesized
tttcaatttctgcattttaa

SEQ ID NO: 230988 - DNA, 20 bp, Artificial Sequence
  chemically synthesized
agtttgcaaatatcagagat

SEQ ID NO: 230989 - DNA, 20 bp, Artificial Sequence
  chemically synthesized
ctcttagtttgcaaatatca

SEQ ID NO: 230990 - DNA, 20 bp, Artificial Sequence
  chemically synthesized
agctcttagtttgcaaatat

SEQ ID NO: 230991 - DNA, 20 bp, Artificial Sequence
  chemically synthesized
atctctgatatttgcaaact

SEQ ID NO: 230992 - DNA, 20 bp, Artificial Sequence
  chemically synthesized
ctctgatatttgcaaactaa

SEQ ID NO: 230993 - DNA, 20 bp, Artificial Sequence
  chemically synthesized
cagtctgtaaatgaagctct

SEQ ID NO: 230994 - DNA, 20 bp, Artificial Sequence
  chemically synthesized
caaactaagagcttcattta

SEQ ID NO: 230995 - DNA, 20 bp, Artificial Sequence
  chemically synthesized
acaagtacagtctgtaaatg

SEQ ID NO: 230996 - DNA, 20 bp, Artificial Sequence
  chemically synthesized
gggaactcatgatacaagta

SEQ ID NO: 230997 - DNA, 20 bp, Artificial Sequence
  chemically synthesized
acagactgtacttgtatcat

SEQ ID NO: 230998 - DNA, 20 bp, Artificial Sequence
  chemically synthesized
agtttgggaactcatgatac

SEQ ID NO: 230999 - DNA, 20 bp, Artificial Sequence
  chemically synthesized
aacatttgtagttgtagttt

SEQ ID NO: 231000 - DNA, 20 bp, Artificial Sequence
  chemically synthesized
aaacatttgtagttgtagtt

SEQ ID NO: 231001 - DNA, 20 bp, Artificial Sequence
  chemically synthesized
tatttaaacatttgtagttg

SEQ ID NO: 231002 - DNA, 20 bp, Artificial Sequence
  chemically synthesized
aaaagatatttaaacatttg

SEQ ID NO: 231003 - DNA, 20 bp, Artificial Sequence
  chemically synthesized
tcatgcacactcagtttaaa

SEQ ID NO: 231004 - DNA, 20 bp, Artificial Sequence
  chemically synthesized
tttaaatatctttttaaact

SEQ ID NO: 231005 - DNA, 20 bp, Artificial Sequence
  chemically synthesized
aaaaaacattcatgcacact

SEQ ID NO: 231006 - DNA, 20 bp, Artificial Sequence
  chemically synthesized
tgtgcatgaatgttttttat

SEQ ID NO: 231007 - DNA, 20 bp, Artificial Sequence
  chemically synthesized
gcatgaatgttttttatcag

SEQ ID NO: 231008 - DNA, 20 bp, Artificial Sequence
  chemically synthesized
tgatgctacttaaaagataa

SEQ ID NO: 231009 - DNA, 20 bp, Artificial Sequence
  chemically synthesized
aataattactattatctttt

SEQ ID NO: 231010 - DNA, 20 bp, Artificial Sequence
  chemically synthesized
aattactattatcttttaag

SEQ ID NO: 231011 - DNA, 20 bp, Artificial Sequence
  chemically synthesized
aacagcctgatgctacttaa

SEQ ID NO: 231012 - DNA, 20 bp, Artificial Sequence
  chemically synthesized
tattatcttttaagtagcat

SEQ ID NO: 231013 - DNA, 20 bp, Artificial Sequence
  chemically synthesized
attatcttttaagtagcatc

SEQ ID NO: 231014 - DNA, 20 bp, Artificial Sequence
  chemically synthesized
tttaagtagcatcaggctgt

SEQ ID NO: 231015 - DNA, 20 bp, Artificial Sequence
  chemically synthesized
tagttcctagcaaattccaa

SEQ ID NO: 231016 - DNA, 20 bp, Artificial Sequence
  chemically synthesized
atcaggctgttggaatttgc

SEQ ID NO: 231017 - DNA, 20 bp, Artificial Sequence
  chemically synthesized
tcaggctgttggaatttgct

SEQ ID NO: 231018 - DNA, 20 bp, Artificial Sequence
  chemically synthesized
aggtatttgttggtagttcc

SEQ ID NO: 231019 - DNA, 20 bp, Artificial Sequence
  chemically synthesized
taagagaaggtatttgttgg

SEQ ID NO: 231020 - DNA, 20 bp, Artificial Sequence
  chemically synthesized
ctttaagagaaggtatttgt

SEQ ID NO: 231021 - DNA, 20 bp, Artificial Sequence
  chemically synthesized
ccaacaaataccttctctta

SEQ ID NO: 231022 - DNA, 20 bp, Artificial Sequence
  chemically synthesized
tgatcagtatctttaagaga

SEQ ID NO: 231023 - DNA, 20 bp, Artificial Sequence
  chemically synthesized
ctgatcagtatctttaagag

SEQ ID NO: 231024 - DNA, 20 bp, Artificial Sequence
  chemically synthesized
tccctgatcagtatctttaa

SEQ ID NO: 231025 - DNA, 20 bp, Artificial Sequence
  chemically synthesized
gttccctgatcagtatcttt

SEQ ID NO: 231026 - DNA, 20 bp, Artificial Sequence
  chemically synthesized
cttctcttaaagatactgat

SEQ ID NO: 231027 - DNA, 20 bp, Artificial Sequence
  chemically synthesized
ttctcttaaagatactgatc

SEQ ID NO: 231028 - DNA, 20 bp, Artificial Sequence
  chemically synthesized
tctcttaaagatactgatca

SEQ ID NO: 231029 - DNA, 20 bp, Artificial Sequence
  chemically synthesized
aatgtttggagttccctgat

SEQ ID NO: 231030 - DNA, 20 bp, Artificial Sequence
  chemically synthesized
tacagaagcaagaatgtttg

SEQ ID NO: 231031 - DNA, 20 bp, Artificial Sequence
  chemically synthesized
gatacagaagcaagaatgtt

SEQ ID NO: 231032 - DNA, 20 bp, Artificial Sequence
  chemically synthesized
tttttaggggatacagaagc

SEQ ID NO: 231033 - DNA, 20 bp, Artificial Sequence
  chemically synthesized
agtctttttaggggatacag

SEQ ID NO: 231034 - DNA, 20 bp, Artificial Sequence
  chemically synthesized
aagagtctttttaggggata

SEQ ID NO: 231035 - DNA, 20 bp, Artificial Sequence
  chemically synthesized
ttgcttctgtatcccctaaa

SEQ ID NO: 231036 - DNA, 20 bp, Artificial Sequence
  chemically synthesized
tttttcaagagtctttttag

SEQ ID NO: 231037 - DNA, 20 bp, Artificial Sequence
  chemically synthesized
atttttcaagagtcttttta

SEQ ID NO: 231038 - DNA, 20 bp, Artificial Sequence
  chemically synthesized
catttttcaagagtcttttt

SEQ ID NO: 231039 - DNA, 20 bp, Artificial Sequence
  chemically synthesized
tcatttttcaagagtctttt

SEQ ID NO: 231040 - DNA, 20 bp, Artificial Sequence
  chemically synthesized
agggttgactcatttttcaa

SEQ ID NO: 231041 - DNA, 20 bp, Artificial Sequence
  chemically synthesized
taaaaagactcttgaaaaat

SEQ ID NO: 231042 - DNA, 20 bp, Artificial Sequence
  chemically synthesized
caagggttgactcatttttc

SEQ ID NO: 231043 - DNA, 20 bp, Artificial Sequence
  chemically synthesized
gaaaaatgagtcaacccttg

SEQ ID NO: 231044 - DNA, 20 bp, Artificial Sequence
  chemically synthesized
tgcggattttaaatctgcaa

SEQ ID NO: 231045 - DNA, 20 bp, Artificial Sequence
  chemically synthesized
atgcggattttaaatctgca

SEQ ID NO: 231046 - DNA, 20 bp, Artificial Sequence
  chemically synthesized
aatgcggattttaaatctgc

SEQ ID NO: 231047 - DNA, 20 bp, Artificial Sequence
  chemically synthesized
tgaaaagtacatttcgaatg

SEQ ID NO: 231048 - DNA, 20 bp, Artificial Sequence
  chemically synthesized
ttcagtcatttaagaatgaa

SEQ ID NO: 231049 - DNA, 20 bp, Artificial Sequence
  chemically synthesized
tatattattttcagtcattt

SEQ ID NO: 231050 - DNA, 20 bp, Artificial Sequence
  chemically synthesized
ccctcaaattatattatttt

SEQ ID NO: 231051 - DNA, 20 bp, Artificial Sequence
  chemically synthesized
gactgaaaataatataattt

SEQ ID NO: 231052 - DNA, 20 bp, Artificial Sequence
  chemically synthesized
actgaaaataatataatttg

SEQ ID NO: 231053 - DNA, 20 bp, Artificial Sequence
  chemically synthesized
ctgaaaataatataatttga

SEQ ID NO: 231054 - DNA, 20 bp, Artificial Sequence
  chemically synthesized
aatatcgatatcttaaaact

SEQ ID NO: 231055 - DNA, 20 bp, Artificial Sequence
  chemically synthesized
taaacatatatcttagtttt

SEQ ID NO: 231056 - DNA, 20 bp, Artificial Sequence
  chemically synthesized
tcaggcataaacatatatct

SEQ ID NO: 231057 - DNA, 20 bp, Artificial Sequence
  chemically synthesized
gtgatcaataagattttttc

SEQ ID NO: 231058 - DNA, 20 bp, Artificial Sequence
  chemically synthesized
ggtgatcaataagatttttt

SEQ ID NO: 231059 - DNA, 20 bp, Artificial Sequence
  chemically synthesized
aagtatactaggtgatcaat

SEQ ID NO: 231060 - DNA, 20 bp, Artificial Sequence
  chemically synthesized
aaaaaatcttattgatcacc

SEQ ID NO: 231061 - DNA, 20 bp, Artificial Sequence
  chemically synthesized
ctgtttaagaaaagtatact

SEQ ID NO: 231062 - DNA, 20 bp, Artificial Sequence
  chemically synthesized
actgtttaagaaaagtatac

SEQ ID NO: 231063 - DNA, 20 bp, Artificial Sequence
  chemically synthesized
gtatacatactgtttaagaa

SEQ ID NO: 231064 - DNA, 20 bp, Artificial Sequence
  chemically synthesized
cctagtatacttttcttaaa

SEQ ID NO: 231065 - DNA, 20 bp, Artificial Sequence
  chemically synthesized
attgtgtatacatactgttt

SEQ ID NO: 231066 - DNA, 20 bp, Artificial Sequence
  chemically synthesized
aaacagtatgtatacacaat

SEQ ID NO: 231067 - DNA, 20 bp, Artificial Sequence
  chemically synthesized
tgttttttttctgttactgt

SEQ ID NO: 231068 - DNA, 20 bp, Artificial Sequence
  chemically synthesized
acatttaggacttacagtaa

SEQ ID NO: 231069 - DNA, 20 bp, Artificial Sequence
  chemically synthesized
ttttttacatttaggactta

SEQ ID NO: 231070 - DNA, 20 bp, Artificial Sequence
  chemically synthesized
aaggtttgttttttacattt

SEQ ID NO: 231071 - DNA, 20 bp, Artificial Sequence
  chemically synthesized
aaaggtttgttttttacatt

SEQ ID NO: 231072 - DNA, 20 bp, Artificial Sequence
  chemically synthesized
taacaatacctcaattgaaa

SEQ ID NO: 231073 - DNA, 20 bp, Artificial Sequence
  chemically synthesized
aaaaacaaaccttttcaatt

SEQ ID NO: 231074 - DNA, 20 bp, Artificial Sequence
  chemically synthesized
gtaacaatacctcaattgaa

SEQ ID NO: 231075 - DNA, 20 bp, Artificial Sequence
  chemically synthesized
aaaacaaaccttttcaattg

SEQ ID NO: 231076 - DNA, 20 bp, Artificial Sequence
  chemically synthesized
ataatatacatatattgttt

SEQ ID NO: 231077 - DNA, 20 bp, Artificial Sequence
  chemically synthesized
ttgaaaatacatctcttaat

SEQ ID NO: 231078 - DNA, 20 bp, Artificial Sequence
  chemically synthesized
atacccatccatcttattaa

SEQ ID NO: 231079 - DNA, 20 bp, Artificial Sequence
  chemically synthesized
aaatacatctcttaataaga

SEQ ID NO: 231080 - DNA, 20 bp, Artificial Sequence
  chemically synthesized
aaatacccatccatcttatt

SEQ ID NO: 231081 - DNA, 20 bp, Artificial Sequence
  chemically synthesized
acatctcttaataagatgga

SEQ ID NO: 231082 - DNA, 20 bp, Artificial Sequence
  chemically synthesized
catctcttaataagatggat

SEQ ID NO: 231083 - DNA, 20 bp, Artificial Sequence
  chemically synthesized
tttaacaatttatacacctt

SEQ ID NO: 231084 - DNA, 20 bp, Artificial Sequence
  chemically synthesized
aacaatttatacaccttcag

SEQ ID NO: 231085 - DNA, 20 bp, Artificial Sequence
  chemically synthesized
attaatttatattcttctga

SEQ ID NO: 231086 - DNA, 20 bp, Artificial Sequence
  chemically synthesized
aattaatttatattcttctg

SEQ ID NO: 231087 - DNA, 20 bp, Artificial Sequence
  chemically synthesized
atataaattaattctacaat

SEQ ID NO: 231088 - DNA, 20 bp, Artificial Sequence
  chemically synthesized
tgctgaagcctttccaattg

SEQ ID NO: 231089 - DNA, 20 bp, Artificial Sequence
  chemically synthesized
aaattaattctacaattgga

SEQ ID NO: 231090 - DNA, 20 bp, Artificial Sequence
  chemically synthesized
aattaattctacaattggaa

SEQ ID NO: 231091 - DNA, 20 bp, Artificial Sequence
  chemically synthesized
ttctacaattggaaaggctt

SEQ ID NO: 231092 - DNA, 20 bp, Artificial Sequence
  chemically synthesized
tagggatagaattgatgctg

SEQ ID NO: 231093 - DNA, 20 bp, Artificial Sequence
  chemically synthesized
atacagacaaaaattaggga

SEQ ID NO: 231094 - DNA, 20 bp, Artificial Sequence
  chemically synthesized
atctatacagacaaaaatta

SEQ ID NO: 231095 - DNA, 20 bp, Artificial Sequence
  chemically synthesized
catctatacagacaaaaatt

SEQ ID NO: 231096 - DNA, 20 bp, Artificial Sequence
  chemically synthesized
acatctatacagacaaaaat

SEQ ID NO: 231097 - DNA, 20 bp, Artificial Sequence
  chemically synthesized
atccctaatttttgtctgta

SEQ ID NO: 231098 - DNA, 20 bp, Artificial Sequence
  chemically synthesized
tttcatcatttacatctata

SEQ ID NO: 231099 - DNA, 20 bp, Artificial Sequence
  chemically synthesized
gatgaaaaatcttattcaaa

SEQ ID NO: 231100 - DNA, 20 bp, Artificial Sequence
  chemically synthesized
ttctactcacctatttgaat

SEQ ID NO: 231101 - DNA, 20 bp, Artificial Sequence
  chemically synthesized
atgaaaaatcttattcaaat

SEQ ID NO: 231102 - DNA, 20 bp, Artificial Sequence
  chemically synthesized
aaaatcttattcaaataggt

SEQ ID NO: 231103 - DNA, 20 bp, Artificial Sequence
  chemically synthesized
atcttattcaaataggtgag

SEQ ID NO: 231104 - DNA, 20 bp, Artificial Sequence
  chemically synthesized
tattcaaataggtgagtaga

SEQ ID NO: 231105 - DNA, 20 bp, Artificial Sequence
  chemically synthesized
aataggtgagtagaaagaaa

SEQ ID NO: 231106 - DNA, 20 bp, Artificial Sequence
  chemically synthesized
aggtgagtagaaagaaacgg

SEQ ID NO: 231107 - DNA, 20 bp, Artificial Sequence
  chemically synthesized
ggtgagtagaaagaaacgga

SEQ ID NO: 231108 - DNA, 20 bp, Artificial Sequence
  chemically synthesized
aaacggaaggaattgtatta

SEQ ID NO: 231109 - DNA, 20 bp, Artificial Sequence
  chemically synthesized
cggaaggaattgtattatag

SEQ ID NO: 231110 - DNA, 20 bp, Artificial Sequence
  chemically synthesized
tagcaggagcacaaatgatt

SEQ ID NO: 231111 - DNA, 20 bp, Artificial Sequence
  chemically synthesized
aatcatttgtgctcctgcta

SEQ ID NO: 231112 - DNA, 20 bp, Artificial Sequence
  chemically synthesized
tttagcatatgccatagcag

SEQ ID NO: 231113 - DNA, 20 bp, Artificial Sequence
  chemically synthesized
cttttagcatatgccatagc

SEQ ID NO: 231114 - DNA, 20 bp, Artificial Sequence
  chemically synthesized
acttttagcatatgccatag

SEQ ID NO: 231115 - DNA, 20 bp, Artificial Sequence
  chemically synthesized
tgtacttttagcatatgcca

SEQ ID NO: 231116 - DNA, 20 bp, Artificial Sequence
  chemically synthesized
cctgctatggcatatgctaa

SEQ ID NO: 231117 - DNA, 20 bp, Artificial Sequence
  chemically synthesized
aagcaatcatcatgtacttt

SEQ ID NO: 231118 - DNA, 20 bp, Artificial Sequence
  chemically synthesized
cattaaaaatacgttttggt

SEQ ID NO: 231119 - DNA, 20 bp, Artificial Sequence
  chemically synthesized
agatcattaaaaatacgttt

SEQ ID NO: 231120 - DNA, 20 bp, Artificial Sequence
  chemically synthesized
acgtatttttaatgatctat

SEQ ID NO: 231121 - DNA, 20 bp, Artificial Sequence
  chemically synthesized
cctgataagttgtcagccga

SEQ ID NO: 231122 - DNA, 20 bp, Artificial Sequence
  chemically synthesized
gagaagacctgataagttgt

SEQ ID NO: 231123 - DNA, 20 bp, Artificial Sequence
  chemically synthesized
tctatcggctgacaacttat

SEQ ID NO: 231124 - DNA, 20 bp, Artificial Sequence
  chemically synthesized
ctatcggctgacaacttatc

SEQ ID NO: 231125 - DNA, 20 bp, Artificial Sequence
  chemically synthesized
acccgaagagaagacctgat

SEQ ID NO: 231126 - DNA, 20 bp, Artificial Sequence
  chemically synthesized
aacttatcaggtcttctctt

SEQ ID NO: 231127 - DNA, 20 bp, Artificial Sequence
  chemically synthesized
acttatcaggtcttctcttc

SEQ ID NO: 231128 - DNA, 20 bp, Artificial Sequence
  chemically synthesized
tttcaactgaacccgaagag

SEQ ID NO: 231129 - DNA, 20 bp, Artificial Sequence
  chemically synthesized
tgctttcaactgaacccgaa

SEQ ID NO: 231130 - DNA, 20 bp, Artificial Sequence
  chemically synthesized
tcaggtcttctcttcgggtt

SEQ ID NO: 231131 - DNA, 20 bp, Artificial Sequence
  chemically synthesized
tttgctttcaactgaacccg

SEQ ID NO: 231132 - DNA, 20 bp, Artificial Sequence
  chemically synthesized
ttctcttcgggttcagttga

SEQ ID NO: 231133 - DNA, 20 bp, Artificial Sequence
  chemically synthesized
ttcgggttcagttgaaagca

SEQ ID NO: 231134 - DNA, 20 bp, Artificial Sequence
  chemically synthesized
cgggttcagttgaaagcaaa

SEQ ID NO: 231135 - DNA, 20 bp, Artificial Sequence
  chemically synthesized
ttcagttgaaagcaaagagt

SEQ ID NO: 231136 - DNA, 20 bp, Artificial Sequence
  chemically synthesized
atagctttttgcaagaagag

SEQ ID NO: 231137 - DNA, 20 bp, Artificial Sequence
  chemically synthesized
aacatagctttttgcaagaa

SEQ ID NO: 231138 - DNA, 20 bp, Artificial Sequence
  chemically synthesized
gcaacatagctttttgcaag

SEQ ID NO: 231139 - DNA, 20 bp, Artificial Sequence
  chemically synthesized
gcaaccactcttcttgcaaa

SEQ ID NO: 231140 - DNA, 20 bp, Artificial Sequence
  chemically synthesized
agggcaacatagctttttgc

SEQ ID NO: 231141 - DNA, 20 bp, Artificial Sequence
  chemically synthesized
actttcatgacagggcaaca

SEQ ID NO: 231142 - DNA, 20 bp, Artificial Sequence
  chemically synthesized
catgaatgactttcatgaca

SEQ ID NO: 231143 - DNA, 20 bp, Artificial Sequence
  chemically synthesized
gctatgttgccctgtcatga

SEQ ID NO: 231144 - DNA, 20 bp, Artificial Sequence
  chemically synthesized
gcatgaatgactttcatgac

SEQ ID NO: 231145 - DNA, 20 bp, Artificial Sequence
  chemically synthesized
agcatgaatgactttcatga

SEQ ID NO: 231146 - DNA, 20 bp, Artificial Sequence
  chemically synthesized
actaaggcttcaaacaaaag

SEQ ID NO: 231147 - DNA, 20 bp, Artificial Sequence
  chemically synthesized
attcatgcttcttttgtttg

SEQ ID NO: 231148 - DNA, 20 bp, Artificial Sequence
  chemically synthesized
cttactaaggcttcaaacaa

SEQ ID NO: 231149 - DNA, 20 bp, Artificial Sequence
  chemically synthesized
gcttcttttgtttgaagcct

SEQ ID NO: 231150 - DNA, 20 bp, Artificial Sequence
  chemically synthesized
cttttgtttgaagccttagt

SEQ ID NO: 231151 - DNA, 20 bp, Artificial Sequence
  chemically synthesized
atccaactctgatcttacta

SEQ ID NO: 231152 - DNA, 20 bp, Artificial Sequence
  chemically synthesized
catccaactctgatcttact

SEQ ID NO: 231153 - DNA, 20 bp, Artificial Sequence
  chemically synthesized
gtttgaagccttagtaagat

SEQ ID NO: 231154 - DNA, 20 bp, Artificial Sequence
  chemically synthesized
ttgaagccttagtaagatca

SEQ ID NO: 231155 - DNA, 20 bp, Artificial Sequence
  chemically synthesized
agccttagtaagatcagagt

SEQ ID NO: 231156 - DNA, 20 bp, Artificial Sequence
  chemically synthesized
atcagagttggatgaaatat

SEQ ID NO: 231157 - DNA, 20 bp, Artificial Sequence
  chemically synthesized
tcagagttggatgaaatata

SEQ ID NO: 231158 - DNA, 20 bp, Artificial Sequence
  chemically synthesized
ttctcccaatttaagaaaaa

SEQ ID NO: 231159 - DNA, 20 bp, Artificial Sequence
  chemically synthesized
taaggctttttttcttaaat

SEQ ID NO: 231160 - DNA, 20 bp, Artificial Sequence
  chemically synthesized
aaggctttttttcttaaatt

SEQ ID NO: 231161 - DNA, 20 bp, Artificial Sequence
  chemically synthesized
ggctttttttcttaaattgg

SEQ ID NO: 231162 - DNA, 20 bp, Artificial Sequence
  chemically synthesized
ctaaccacttctcccaattt

SEQ ID NO: 231163 - DNA, 20 bp, Artificial Sequence
  chemically synthesized
tttttttcttaaattgggag

SEQ ID NO: 231164 - DNA, 20 bp, Artificial Sequence
  chemically synthesized
ttttcttaaattgggagaag

SEQ ID NO: 231165 - DNA, 20 bp, Artificial Sequence
  chemically synthesized
cttaaattgggagaagtggt

SEQ ID NO: 231166 - DNA, 20 bp, Artificial Sequence
  chemically synthesized
attgggagaagtggttagaa

SEQ ID NO: 231167 - DNA, 20 bp, Artificial Sequence
  chemically synthesized
ttgggagaagtggttagaaa

SEQ ID NO: 231168 - DNA, 20 bp, Artificial Sequence
  chemically synthesized
gagaagtggttagaaaaggc

SEQ ID NO: 231169 - DNA, 20 bp, Artificial Sequence
  chemically synthesized
aagtggttagaaaaggcaag

SEQ ID NO: 231170 - DNA, 20 bp, Artificial Sequence
  chemically synthesized
ggttagaaaaggcaagtggt

SEQ ID NO: 231171 - DNA, 20 bp, Artificial Sequence
  chemically synthesized
agaaaaggcaagtggttaga

SEQ ID NO: 231172 - DNA, 20 bp, Artificial Sequence
  chemically synthesized
gaaaaggcaagtggttagaa

SEQ ID NO: 231173 - DNA, 20 bp, Artificial Sequence
  chemically synthesized
aaaggcaagtggttagaaag

SEQ ID NO: 231174 - DNA, 20 bp, Artificial Sequence
  chemically synthesized
aagtggttagaaaggagaaa

SEQ ID NO: 231175 - DNA, 20 bp, Artificial Sequence
  chemically synthesized
ttagaaaggagaaacagcct

SEQ ID NO: 231176 - DNA, 20 bp, Artificial Sequence
  chemically synthesized
tagaaaggagaaacagcctg

SEQ ID NO: 231177 - DNA, 20 bp, Artificial Sequence
  chemically synthesized
acatctgtagtcaagacctc

SEQ ID NO: 231178 - DNA, 20 bp, Artificial Sequence
  chemically synthesized
gacatctgtagtcaagacct

SEQ ID NO: 231179 - DNA, 20 bp, Artificial Sequence
  chemically synthesized
acagcctgaggtcttgacta

SEQ ID NO: 231180 - DNA, 20 bp, Artificial Sequence
  chemically synthesized
aaaaaaagacatctgtagtc

SEQ ID NO: 231181 - DNA, 20 bp, Artificial Sequence
  chemically synthesized
aaaaaaaaaaaagacatctg

SEQ ID NO: 231182 - DNA, 20 bp, Artificial Sequence
  chemically synthesized
aaaaaaaaaaaaaaaaaaaa

SEQ ID NO: 231183 - DNA, 20 bp, Artificial Sequence
  chemically synthesized
tttttttttttttttttttt

SEQ ID NO: 231184 - DNA, 20 bp, Artificial Sequence
  chemically synthesized
tttttttttttttttttttc

SEQ ID NO: 231185 - DNA, 20 bp, Artificial Sequence
  chemically synthesized
tttttttttttcaggcaatt

SEQ ID NO: 231186 - DNA, 20 bp, Artificial Sequence
  chemically synthesized
ttttcaggcaattcagtttt

SEQ ID NO: 231187 - DNA, 20 bp, Artificial Sequence
  chemically synthesized
tttcaggcaattcagttttc

SEQ ID NO: 231188 - DNA, 20 bp, Artificial Sequence
  chemically synthesized
caggcaattcagttttcagg

SEQ ID NO: 231189 - DNA, 20 bp, Artificial Sequence
  chemically synthesized
ggcaattcagttttcaggaa

SEQ ID NO: 231190 - DNA, 20 bp, Artificial Sequence
  chemically synthesized
ttcaggaagagtacaaaata

SEQ ID NO: 231191 - DNA, 20 bp, Artificial Sequence
  chemically synthesized
aggaagagtacaaaataaag

SEQ ID NO: 231192 - DNA, 20 bp, Artificial Sequence
  chemically synthesized
aagagtacaaaataaagtag

SEQ ID NO: 231193 - DNA, 20 bp, Artificial Sequence
  chemically synthesized
acaaaataaagtagaagatc

SEQ ID NO: 231194 - DNA, 20 bp, Artificial Sequence
  chemically synthesized
gttttaagggaatttatttc

SEQ ID NO: 231195 - DNA, 20 bp, Artificial Sequence
  chemically synthesized
gtaggcacagatagttttaa

SEQ ID NO: 231196 - DNA, 20 bp, Artificial Sequence
  chemically synthesized
agtaggcacagatagtttta

SEQ ID NO: 231197 - DNA, 20 bp, Artificial Sequence
  chemically synthesized
gagtaggcacagatagtttt

SEQ ID NO: 231198 - DNA, 20 bp, Artificial Sequence
  chemically synthesized
ttccaaggagtaggcacaga

SEQ ID NO: 231199 - DNA, 20 bp, Artificial Sequence
  chemically synthesized
ggcattccaaggagtaggca

SEQ ID NO: 231200 - DNA, 20 bp, Artificial Sequence
  chemically synthesized
aactatctgtgcctactcct

SEQ ID NO: 231201 - DNA, 20 bp, Artificial Sequence
  chemically synthesized
atgaaggcattccaaggagt

SEQ ID NO: 231202 - DNA, 20 bp, Artificial Sequence
  chemically synthesized
catgaaggcattccaaggag

SEQ ID NO: 231203 - DNA, 20 bp, Artificial Sequence
  chemically synthesized
gtacatgaaggcattccaag

SEQ ID NO: 231204 - DNA, 20 bp, Artificial Sequence
  chemically synthesized
gagtacatgaaggcattcca

SEQ ID NO: 231205 - DNA, 20 bp, Artificial Sequence
  chemically synthesized
ggagtacatgaaggcattcc

SEQ ID NO: 231206 - DNA, 20 bp, Artificial Sequence
  chemically synthesized
agtaacctgggagtacatga

SEQ ID NO: 231207 - DNA, 20 bp, Artificial Sequence
  chemically synthesized
gagtaacctgggagtacatg

SEQ ID NO: 231208 - DNA, 20 bp, Artificial Sequence
  chemically synthesized
ggaatgccttcatgtactcc

SEQ ID NO: 231209 - DNA, 20 bp, Artificial Sequence
  chemically synthesized
gaatgccttcatgtactccc

SEQ ID NO: 231210 - DNA, 20 bp, Artificial Sequence
  chemically synthesized
ctcacagtggagtaacctgg

SEQ ID NO: 231211 - DNA, 20 bp, Artificial Sequence
  chemically synthesized
tcctcacagtggagtaacct

SEQ ID NO: 231212 - DNA, 20 bp, Artificial Sequence
  chemically synthesized
gtcctcacagtggagtaacc

SEQ ID NO: 231213 - DNA, 20 bp, Artificial Sequence
  chemically synthesized
ctcccaggttactccactgt

SEQ ID NO: 231214 - DNA, 20 bp, Artificial Sequence
  chemically synthesized
tcccaggttactccactgtg

SEQ ID NO: 231215 - DNA, 20 bp, Artificial Sequence
  chemically synthesized
aaacagctgtcctcacagtg

SEQ ID NO: 231216 - DNA, 20 bp, Artificial Sequence
  chemically synthesized
taaaacagctgtcctcacag

SEQ ID NO: 231217 - DNA, 20 bp, Artificial Sequence
  chemically synthesized
aggttactccactgtgagga

SEQ ID NO: 231218 - DNA, 20 bp, Artificial Sequence
  chemically synthesized
tcttaaaacagctgtcctca

SEQ ID NO: 231219 - DNA, 20 bp, Artificial Sequence
  chemically synthesized
actgtgaggacagctgtttt

SEQ ID NO: 231220 - DNA, 20 bp, Artificial Sequence
  chemically synthesized
tgattcgaaatttcttaaaa

SEQ ID NO: 231221 - DNA, 20 bp, Artificial Sequence
  chemically synthesized
ttcgaatcattacctgtgac

SEQ ID NO: 231222 - DNA, 20 bp, Artificial Sequence
  chemically synthesized
cagtttatatttcttgtcac

SEQ ID NO: 231223 - DNA, 20 bp, Artificial Sequence
  chemically synthesized
ccagtttatatttcttgtca

SEQ ID NO: 231224 - DNA, 20 bp, Artificial Sequence
  chemically synthesized
ctgtgacaagaaatataaac

SEQ ID NO: 231225 - DNA, 20 bp, Artificial Sequence
  chemically synthesized
agaaatataaactggcacat

SEQ ID NO: 231226 - DNA, 20 bp, Artificial Sequence
  chemically synthesized
atcaggagattctgatgtgc

SEQ ID NO: 231227 - DNA, 20 bp, Artificial Sequence
  chemically synthesized
gtggacacacaagttatcag

SEQ ID NO: 231228 - DNA, 20 bp, Artificial Sequence
  chemically synthesized
aagtggacacacaagttatc

SEQ ID NO: 231229 - DNA, 20 bp, Artificial Sequence
  chemically synthesized
gaagtggacacacaagttat

SEQ ID NO: 231230 - DNA, 20 bp, Artificial Sequence
  chemically synthesized
aactgaggaagtggacacac

SEQ ID NO: 231231 - DNA, 20 bp, Artificial Sequence
  chemically synthesized
aacttgtgtgtccacttcct

SEQ ID NO: 231232 - DNA, 20 bp, Artificial Sequence
  chemically synthesized
gtgaggtacaactgaggaag

SEQ ID NO: 231233 - DNA, 20 bp, Artificial Sequence
  chemically synthesized
gctgtgaggtacaactgagg

SEQ ID NO: 231234 - DNA, 20 bp, Artificial Sequence
  chemically synthesized
ttagctgtgaggtacaactg

SEQ ID NO: 231235 - DNA, 20 bp, Artificial Sequence
  chemically synthesized
tttagctgtgaggtacaact

SEQ ID NO: 231236 - DNA, 20 bp, Artificial Sequence
  chemically synthesized
acttcctcagttgtacctca

SEQ ID NO: 231237 - DNA, 20 bp, Artificial Sequence
  chemically synthesized
cagataactatttagctgtg

SEQ ID NO: 231238 - DNA, 20 bp, Artificial Sequence
  chemically synthesized
acagataactatttagctgt

SEQ ID NO: 231239 - DNA, 20 bp, Artificial Sequence
  chemically synthesized
agttgtacctcacagctaaa

SEQ ID NO: 231240 - DNA, 20 bp, Artificial Sequence
  chemically synthesized
tggtttaacagataactatt

SEQ ID NO: 231241 - DNA, 20 bp, Artificial Sequence
  chemically synthesized
aaatagttatctgttaaacc

SEQ ID NO: 231242 - DNA, 20 bp, Artificial Sequence
  chemically synthesized
tgcaacttctcttggtttaa

SEQ ID NO: 231243 - DNA, 20 bp, Artificial Sequence
  chemically synthesized
atagttatctgttaaaccaa

SEQ ID NO: 231244 - DNA, 20 bp, Artificial Sequence
  chemically synthesized
gttatctgttaaaccaagag

SEQ ID NO: 231245 - DNA, 20 bp, Artificial Sequence
  chemically synthesized
cccagaactgcaacttctct

SEQ ID NO: 231246 - DNA, 20 bp, Artificial Sequence
  chemically synthesized
tgttaaaccaagagaagttg

SEQ ID NO: 231247 - DNA, 20 bp, Artificial Sequence
  chemically synthesized
accaagagaagttgcagttc

SEQ ID NO: 231248 - DNA, 20 bp, Artificial Sequence
  chemically synthesized
ccaagagaagttgcagttct

SEQ ID NO: 231249 - DNA, 20 bp, Artificial Sequence
  chemically synthesized
caagagaagttgcagttctg

SEQ ID NO: 231250 - DNA, 20 bp, Artificial Sequence
  chemically synthesized
aagagaagttgcagttctgg

SEQ ID NO: 231251 - DNA, 20 bp, Artificial Sequence
  chemically synthesized
agttgcagttctgggggcaa

SEQ ID NO: 231252 - DNA, 20 bp, Artificial Sequence
  chemically synthesized
accaataaggctattgcccc

SEQ ID NO: 231253 - DNA, 20 bp, Artificial Sequence
  chemically synthesized
tctgggggcaatagccttat

SEQ ID NO: 231254 - DNA, 20 bp, Artificial Sequence
  chemically synthesized
ttcaggcacaaataccaata

SEQ ID NO: 231255 - DNA, 20 bp, Artificial Sequence
  chemically synthesized
attcaggcacaaataccaat

SEQ ID NO: 231256 - DNA, 20 bp, Artificial Sequence
  chemically synthesized
gggagttcagaattatattc

SEQ ID NO: 231257 - DNA, 20 bp, Artificial Sequence
  chemically synthesized
agggagttcagaattatatt

SEQ ID NO: 231258 - DNA, 20 bp, Artificial Sequence
  chemically synthesized
aaggtagaaaagagggagtt

SEQ ID NO: 231259 - DNA, 20 bp, Artificial Sequence
  chemically synthesized
cctagaaggtagaaaagagg

SEQ ID NO: 231260 - DNA, 20 bp, Artificial Sequence
  chemically synthesized
agcctagaaggtagaaaaga

SEQ ID NO: 231261 - DNA, 20 bp, Artificial Sequence
  chemically synthesized
aagcctagaaggtagaaaag

SEQ ID NO: 231262 - DNA, 20 bp, Artificial Sequence
  chemically synthesized
aaagcctagaaggtagaaaa

SEQ ID NO: 231263 - DNA, 20 bp, Artificial Sequence
  chemically synthesized
tcaaagcctagaaggtagaa

SEQ ID NO: 231264 - DNA, 20 bp, Artificial Sequence
  chemically synthesized
actccctcttttctaccttc

SEQ ID NO: 231265 - DNA, 20 bp, Artificial Sequence
  chemically synthesized
ctccctcttttctaccttct

SEQ ID NO: 231266 - DNA, 20 bp, Artificial Sequence
  chemically synthesized
tgaactcaaagcctagaagg

SEQ ID NO: 231267 - DNA, 20 bp, Artificial Sequence
  chemically synthesized
aaatgaactcaaagcctaga

SEQ ID NO: 231268 - DNA, 20 bp, Artificial Sequence
  chemically synthesized
taaatgaactcaaagcctag

SEQ ID NO: 231269 - DNA, 20 bp, Artificial Sequence
  chemically synthesized
ttttctaccttctaggcttt

SEQ ID NO: 231270 - DNA, 20 bp, Artificial Sequence
  chemically synthesized
aaataaatgaactcaaagcc

SEQ ID NO: 231271 - DNA, 20 bp, Artificial Sequence
  chemically synthesized
tgctgaaataaatgaactca

SEQ ID NO: 231272 - DNA, 20 bp, Artificial Sequence
  chemically synthesized
ggctttgagttcatttattt

SEQ ID NO: 231273 - DNA, 20 bp, Artificial Sequence
  chemically synthesized
tttgagttcatttatttcag

SEQ ID NO: 231274 - DNA, 20 bp, Artificial Sequence
  chemically synthesized
ttcatttatttcagcagcaa

SEQ ID NO: 231275 - DNA, 20 bp, Artificial Sequence
  chemically synthesized
atttcagcagcaaaagatgt

SEQ ID NO: 231276 - DNA, 20 bp, Artificial Sequence
  chemically synthesized
tttcagcagcaaaagatgtc

SEQ ID NO: 231277 - DNA, 20 bp, Artificial Sequence
  chemically synthesized
tcagcagcaaaagatgtcag

SEQ ID NO: 231278 - DNA, 20 bp, Artificial Sequence
  chemically synthesized
cagcaaaagatgtcaggagc

SEQ ID NO: 231279 - DNA, 20 bp, Artificial Sequence
  chemically synthesized
gcaaaagatgtcaggagcaa

SEQ ID NO: 231280 - DNA, 20 bp, Artificial Sequence
  chemically synthesized
caaaagatgtcaggagcaag

SEQ ID NO: 231281 - DNA, 20 bp, Artificial Sequence
  chemically synthesized
aagatgtcaggagcaagagg

SEQ ID NO: 231282 - DNA, 20 bp, Artificial Sequence
  chemically synthesized
gagcaagaggcagtcccaca

SEQ ID NO: 231283 - DNA, 20 bp, Artificial Sequence
  chemically synthesized
tcaatgaatctacactatgt

SEQ ID NO: 231284 - DNA, 20 bp, Artificial Sequence
  chemically synthesized
agaggcagtcccacatagtg

SEQ ID NO: 231285 - DNA, 20 bp, Artificial Sequence
  chemically synthesized
ttcaatgaatctacactatg

SEQ ID NO: 231286 - DNA, 20 bp, Artificial Sequence
  chemically synthesized
atagtgtagattcattgaat

SEQ ID NO: 231287 - DNA, 20 bp, Artificial Sequence
  chemically synthesized
tagtgtagattcattgaatg

SEQ ID NO: 231288 - DNA, 20 bp, Artificial Sequence
  chemically synthesized
agtgtagattcattgaatga

SEQ ID NO: 231289 - DNA, 20 bp, Artificial Sequence
  chemically synthesized
tgtagattcattgaatgagg

SEQ ID NO: 231290 - DNA, 20 bp, Artificial Sequence
  chemically synthesized
cattgaatgagggagccaaa

SEQ ID NO: 231291 - DNA, 20 bp, Artificial Sequence
  chemically synthesized
gttgtttctaaatcactgtt

SEQ ID NO: 231292 - DNA, 20 bp, Artificial Sequence
  chemically synthesized
gagggagccaaacagtgatt

SEQ ID NO: 231293 - DNA, 20 bp, Artificial Sequence
  chemically synthesized
tgatttagaaacaacattgc

SEQ ID NO: 231294 - DNA, 20 bp, Artificial Sequence
  chemically synthesized
aaggctaatcagatagttac

SEQ ID NO: 231295 - DNA, 20 bp, Artificial Sequence
  chemically synthesized
attgccagtaactatctgat

SEQ ID NO: 231296 - DNA, 20 bp, Artificial Sequence
  chemically synthesized
cttgcctaaggctaatcaga

SEQ ID NO: 231297 - DNA, 20 bp, Artificial Sequence
  chemically synthesized
gaaacttgcctaaggctaat

SEQ ID NO: 231298 - DNA, 20 bp, Artificial Sequence
  chemically synthesized
agtaactatctgattagcct

SEQ ID NO: 231299 - DNA, 20 bp, Artificial Sequence
  chemically synthesized
gtaactatctgattagcctt

SEQ ID NO: 231300 - DNA, 20 bp, Artificial Sequence
  chemically synthesized
ctatctgattagccttaggc

SEQ ID NO: 231301 - DNA, 20 bp, Artificial Sequence
  chemically synthesized
aaggttgagaaacttgccta

SEQ ID NO: 231302 - DNA, 20 bp, Artificial Sequence
  chemically synthesized
gaaggttgagaaacttgcct

SEQ ID NO: 231303 - DNA, 20 bp, Artificial Sequence
  chemically synthesized
gaaacagattcaggaaggtt

SEQ ID NO: 231304 - DNA, 20 bp, Artificial Sequence
  chemically synthesized
gtgaagaaacagattcagga

SEQ ID NO: 231305 - DNA, 20 bp, Artificial Sequence
  chemically synthesized
tgtgaagaaacagattcagg

SEQ ID NO: 231306 - DNA, 20 bp, Artificial Sequence
  chemically synthesized
tattgtgaagaaacagattc

SEQ ID NO: 231307 - DNA, 20 bp, Artificial Sequence
  chemically synthesized
ttattgtgaagaaacagatt

SEQ ID NO: 231308 - DNA, 20 bp, Artificial Sequence
  chemically synthesized
tgggagttattgtgaagaaa

SEQ ID NO: 231309 - DNA, 20 bp, Artificial Sequence
  chemically synthesized
ccagactgggagttattgtg

SEQ ID NO: 231310 - DNA, 20 bp, Artificial Sequence
  chemically synthesized
tgtttcttcacaataactcc

SEQ ID NO: 231311 - DNA, 20 bp, Artificial Sequence
  chemically synthesized
cttcacaataactcccagtc

SEQ ID NO: 231312 - DNA, 20 bp, Artificial Sequence
  chemically synthesized
cgaaggtgcagccagactgg

SEQ ID NO: 231313 - DNA, 20 bp, Artificial Sequence
  chemically synthesized
gtcgaaggtgcagccagact

SEQ ID NO: 231314 - DNA, 20 bp, Artificial Sequence
  chemically synthesized
agtcgaaggtgcagccagac

SEQ ID NO: 231315 - DNA, 20 bp, Artificial Sequence
  chemically synthesized
gtgtgagtcgaaggtgcagc

SEQ ID NO: 231316 - DNA, 20 bp, Artificial Sequence
  chemically synthesized
ctttgtgtgagtcgaaggtg

SEQ ID NO: 231317 - DNA, 20 bp, Artificial Sequence
  chemically synthesized
aagatctttgtgtgagtcga

SEQ ID NO: 231318 - DNA, 20 bp, Artificial Sequence
  chemically synthesized
aaagatctttgtgtgagtcg

SEQ ID NO: 231319 - DNA, 20 bp, Artificial Sequence
  chemically synthesized
ctgcaccttcgactcacaca

SEQ ID NO: 231320 - DNA, 20 bp, Artificial Sequence
  chemically synthesized
ctctttaaagatctttgtgt

SEQ ID NO: 231321 - DNA, 20 bp, Artificial Sequence
  chemically synthesized
gactcacacaaagatcttta

SEQ ID NO: 231322 - DNA, 20 bp, Artificial Sequence
  chemically synthesized
ctcacacaaagatctttaaa

SEQ ID NO: 231323 - DNA, 20 bp, Artificial Sequence
  chemically synthesized
tggacaacagtatctcttta

SEQ ID NO: 231324 - DNA, 20 bp, Artificial Sequence
  chemically synthesized
ttaaagagatactgttgtcc

SEQ ID NO: 231325 - DNA, 20 bp, Artificial Sequence
  chemically synthesized
tgggggcgatgcttggacaa

SEQ ID NO: 231326 - DNA, 20 bp, Artificial Sequence
  chemically synthesized
atattcctgggggcgatgct

SEQ ID NO: 231327 - DNA, 20 bp, Artificial Sequence
  chemically synthesized
tgttgtccaagcatcgcccc

SEQ ID NO: 231328 - DNA, 20 bp, Artificial Sequence
  chemically synthesized
gttgtccaagcatcgccccc

SEQ ID NO: 231329 - DNA, 20 bp, Artificial Sequence
  chemically synthesized
aatcaaatccatattcctgg

SEQ ID NO: 231330 - DNA, 20 bp, Artificial Sequence
  chemically synthesized
gaatcaaatccatattcctg

SEQ ID NO: 231331 - DNA, 20 bp, Artificial Sequence
  chemically synthesized
aagcatcgcccccaggaata

SEQ ID NO: 231332 - DNA, 20 bp, Artificial Sequence
  chemically synthesized
agaatcaaatccatattcct

SEQ ID NO: 231333 - DNA, 20 bp, Artificial Sequence
  chemically synthesized
gagaatcaaatccatattcc

SEQ ID NO: 231334 - DNA, 20 bp, Artificial Sequence
  chemically synthesized
cttcactttagaattaagca

SEQ ID NO: 231335 - DNA, 20 bp, Artificial Sequence
  chemically synthesized
gccttcactttagaattaag

SEQ ID NO: 231336 - DNA, 20 bp, Artificial Sequence
  chemically synthesized
tgattctctgcttaattcta

SEQ ID NO: 231337 - DNA, 20 bp, Artificial Sequence
  chemically synthesized
tttgccttcactttagaatt

SEQ ID NO: 231338 - DNA, 20 bp, Artificial Sequence
  chemically synthesized
ctctgcttaattctaaagtg

SEQ ID NO: 231339 - DNA, 20 bp, Artificial Sequence
  chemically synthesized
tctgcttaattctaaagtga

SEQ ID NO: 231340 - DNA, 20 bp, Artificial Sequence
  chemically synthesized
ttcctgttttgccttcactt

SEQ ID NO: 231341 - DNA, 20 bp, Artificial Sequence
  chemically synthesized
attctaaagtgaaggcaaaa

SEQ ID NO: 231342 - DNA, 20 bp, Artificial Sequence
  chemically synthesized
ttctaaagtgaaggcaaaac

SEQ ID NO: 231343 - DNA, 20 bp, Artificial Sequence
  chemically synthesized
aagtgaaggcaaaacaggaa

SEQ ID NO: 231344 - DNA, 20 bp, Artificial Sequence
  chemically synthesized
aggcaaaacaggaaaagtca

SEQ ID NO: 231345 - DNA, 20 bp, Artificial Sequence
  chemically synthesized
aaaacaggaaaagtcaaagt

SEQ ID NO: 231346 - DNA, 20 bp, Artificial Sequence
  chemically synthesized
agttagaatcattatccata

SEQ ID NO: 231347 - DNA, 20 bp, Artificial Sequence
  chemically synthesized
atattttttgaaagactata

SEQ ID NO: 231348 - DNA, 20 bp, Artificial Sequence
  chemically synthesized
acttattatatattttttga

SEQ ID NO: 231349 - DNA, 20 bp, Artificial Sequence
  chemically synthesized
tctttcaaaaaatatataat

SEQ ID NO: 231350 - DNA, 20 bp, Artificial Sequence
  chemically synthesized
atataataagtgcctatcat

SEQ ID NO: 231351 - DNA, 20 bp, Artificial Sequence
  chemically synthesized
cttgcaacactgctcatgat

SEQ ID NO: 231352 - DNA, 20 bp, Artificial Sequence
  chemically synthesized
taataagtgcctatcatgag

SEQ ID NO: 231353 - DNA, 20 bp, Artificial Sequence
  chemically synthesized
acttgcaacactgctcatga

SEQ ID NO: 231354 - DNA, 20 bp, Artificial Sequence
  chemically synthesized
cctatcatgagcagtgttgc

SEQ ID NO: 231355 - DNA, 20 bp, Artificial Sequence
  chemically synthesized
aatttgtagatattttaaca

SEQ ID NO: 231356 - DNA, 20 bp, Artificial Sequence
  chemically synthesized
ttctttagaagtataatttg

SEQ ID NO: 231357 - DNA, 20 bp, Artificial Sequence
  chemically synthesized
atctacaaattatacttcta

SEQ ID NO: 231358 - DNA, 20 bp, Artificial Sequence
  chemically synthesized
agcattcaatttttctttag

SEQ ID NO: 231359 - DNA, 20 bp, Artificial Sequence
  chemically synthesized
agtagcattcaatttttctt

SEQ ID NO: 231360 - DNA, 20 bp, Artificial Sequence
  chemically synthesized
tatcatttattgtattcaag

SEQ ID NO: 231361 - DNA, 20 bp, Artificial Sequence
  chemically synthesized
atgtatcatttattgtattc

SEQ ID NO: 231362 - DNA, 20 bp, Artificial Sequence
  chemically synthesized
atacaataaatgatacattt

SEQ ID NO: 231363 - DNA, 20 bp, Artificial Sequence
  chemically synthesized
aatgatacatttgagcttat

SEQ ID NO: 231364 - DNA, 20 bp, Artificial Sequence
  chemically synthesized
aaaggattttcaagactgat

SEQ ID NO: 231365 - DNA, 20 bp, Artificial Sequence
  chemically synthesized
tttttgaacaaaggattttc

SEQ ID NO: 231366 - DNA, 20 bp, Artificial Sequence
  chemically synthesized
tttgcatcgtttttgaacaa

SEQ ID NO: 231367 - DNA, 20 bp, Artificial Sequence
  chemically synthesized
ctttgcatcgtttttgaaca

SEQ ID NO: 231368 - DNA, 20 bp, Artificial Sequence
  chemically synthesized
ctttgttcaaaaacgatgca

SEQ ID NO: 231369 - DNA, 20 bp, Artificial Sequence
  chemically synthesized
tgttcaaaaacgatgcaaag

SEQ ID NO: 231370 - DNA, 20 bp, Artificial Sequence
  chemically synthesized
ttcaaaaacgatgcaaagta

SEQ ID NO: 231371 - DNA, 20 bp, Artificial Sequence
  chemically synthesized
caaaaacgatgcaaagtaga

SEQ ID NO: 231372 - DNA, 20 bp, Artificial Sequence
  chemically synthesized
aaaaacgatgcaaagtagag

SEQ ID NO: 231373 - DNA, 20 bp, Artificial Sequence
  chemically synthesized
aaaacgatgcaaagtagaga

SEQ ID NO: 231374 - DNA, 20 bp, Artificial Sequence
  chemically synthesized
gcaaagtagagagggcaatt

SEQ ID NO: 231375 - DNA, 20 bp, Artificial Sequence
  chemically synthesized
tttttaaataaaagtttttg

SEQ ID NO: 231376 - DNA, 20 bp, Artificial Sequence
  chemically synthesized
tattcagtttttttaaataa

SEQ ID NO: 231377 - DNA, 20 bp, Artificial Sequence
  chemically synthesized
atttaaaaaaactgaataaa

SEQ ID NO: 231378 - DNA, 20 bp, Artificial Sequence
  chemically synthesized
atgtgtctgtgctatttatt

SEQ ID NO: 231379 - DNA, 20 bp, Artificial Sequence
  chemically synthesized
aaaaaactgaataaatagca

SEQ ID NO: 231380 - DNA, 20 bp, Artificial Sequence
  chemically synthesized
atagcacagacacatccaaa

SEQ ID NO: 231381 - DNA, 20 bp, Artificial Sequence
  chemically synthesized
tttccatgctatacactttt

SEQ ID NO: 231382 - DNA, 20 bp, Artificial Sequence
  chemically synthesized
agacacatccaaaaagtgta

SEQ ID NO: 231383 - DNA, 20 bp, Artificial Sequence
  chemically synthesized
catccaaaaagtgtatagca

SEQ ID NO: 231384 - DNA, 20 bp, Artificial Sequence
  chemically synthesized
tggaaaaattcaataatgta

SEQ ID NO: 231385 - DNA, 20 bp, Artificial Sequence
  chemically synthesized
aaattcaataatgtatagca

SEQ ID NO: 231386 - DNA, 20 bp, Artificial Sequence
  chemically synthesized
attcaataatgtatagcaca

SEQ ID NO: 231387 - DNA, 20 bp, Artificial Sequence
  chemically synthesized
gataaacaacacaaatttgg

SEQ ID NO: 231388 - DNA, 20 bp, Artificial Sequence
  chemically synthesized
tgataaacaacacaaatttg

SEQ ID NO: 231389 - DNA, 20 bp, Artificial Sequence
  chemically synthesized
atgataaacaacacaaattt

SEQ ID NO: 231390 - DNA, 20 bp, Artificial Sequence
  chemically synthesized
catgataaacaacacaaatt

SEQ ID NO: 231391 - DNA, 20 bp, Artificial Sequence
  chemically synthesized
ttgtttatcatgttgcatca

SEQ ID NO: 231392 - DNA, 20 bp, Artificial Sequence
  chemically synthesized
gctacatgaaatgtggaatt

SEQ ID NO: 231393 - DNA, 20 bp, Artificial Sequence
  chemically synthesized
acattctgctacatgaaatg

SEQ ID NO: 231394 - DNA, 20 bp, Artificial Sequence
  chemically synthesized
tcttaattccacatttcatg

SEQ ID NO: 231395 - DNA, 20 bp, Artificial Sequence
  chemically synthesized
taattccacatttcatgtag

SEQ ID NO: 231396 - DNA, 20 bp, Artificial Sequence
  chemically synthesized
cttctggatctcaaaatgaa

SEQ ID NO: 231397 - DNA, 20 bp, Artificial Sequence
  chemically synthesized
agaatgtatcccttcatttt

SEQ ID NO: 231398 - DNA, 20 bp, Artificial Sequence
  chemically synthesized
ccttctggatctcaaaatga

SEQ ID NO: 231399 - DNA, 20 bp, Artificial Sequence
  chemically synthesized
tccttctggatctcaaaatg

SEQ ID NO: 231400 - DNA, 20 bp, Artificial Sequence
  chemically synthesized
tatcccttcattttgagatc

SEQ ID NO: 231401 - DNA, 20 bp, Artificial Sequence
  chemically synthesized
cccttcattttgagatccag

SEQ ID NO: 231402 - DNA, 20 bp, Artificial Sequence
  chemically synthesized
ccttcattttgagatccaga

SEQ ID NO: 231403 - DNA, 20 bp, Artificial Sequence
  chemically synthesized
gtgcaacccttttgtccttc

SEQ ID NO: 231404 - DNA, 20 bp, Artificial Sequence
  chemically synthesized
tttgagatccagaaggacaa

SEQ ID NO: 231405 - DNA, 20 bp, Artificial Sequence
  chemically synthesized
ttgagatccagaaggacaaa

SEQ ID NO: 231406 - DNA, 20 bp, Artificial Sequence
  chemically synthesized
tgagatccagaaggacaaaa

SEQ ID NO: 231407 - DNA, 20 bp, Artificial Sequence
  chemically synthesized
agaaggacaaaagggttgca

SEQ ID NO: 231408 - DNA, 20 bp, Artificial Sequence
  chemically synthesized
tctccgagaggcagaaaaag

SEQ ID NO: 231409 - DNA, 20 bp, Artificial Sequence
  chemically synthesized
atctccgagaggcagaaaaa

SEQ ID NO: 231410 - DNA, 20 bp, Artificial Sequence
  chemically synthesized
gatctccgagaggcagaaaa

SEQ ID NO: 231411 - DNA, 20 bp, Artificial Sequence
  chemically synthesized
agatctccgagaggcagaaa

SEQ ID NO: 231412 - DNA, 20 bp, Artificial Sequence
  chemically synthesized
gttcccctttttctgcctct

SEQ ID NO: 231413 - DNA, 20 bp, Artificial Sequence
  chemically synthesized
tcccctttttctgcctctcg

SEQ ID NO: 231414 - DNA, 20 bp, Artificial Sequence
  chemically synthesized
tttttaagatctccgagagg

SEQ ID NO: 231415 - DNA, 20 bp, Artificial Sequence
  chemically synthesized
tcatttttaagatctccgag

SEQ ID NO: 231416 - DNA, 20 bp, Artificial Sequence
  chemically synthesized
ttcatttttaagatctccga

SEQ ID NO: 231417 - DNA, 20 bp, Artificial Sequence
  chemically synthesized
cattcatttttaagatctcc

SEQ ID NO: 231418 - DNA, 20 bp, Artificial Sequence
  chemically synthesized
attgtttatcattcattttt

SEQ ID NO: 231419 - DNA, 20 bp, Artificial Sequence
  chemically synthesized
gataaacaattaattctacc

SEQ ID NO: 231420 - DNA, 20 bp, Artificial Sequence
  chemically synthesized
ataaacaattaattctaccc

SEQ ID NO: 231421 - DNA, 20 bp, Artificial Sequence
  chemically synthesized
attttcattggtatcctggg

SEQ ID NO: 231422 - DNA, 20 bp, Artificial Sequence
  chemically synthesized
tagattttcattggtatcct

SEQ ID NO: 231423 - DNA, 20 bp, Artificial Sequence
  chemically synthesized
atagattttcattggtatcc

SEQ ID NO: 231424 - DNA, 20 bp, Artificial Sequence
  chemically synthesized
aaaagaaaatagattttcat

SEQ ID NO: 231425 - DNA, 20 bp, Artificial Sequence
  chemically synthesized
ttgggaaaaagaaaagaaaa

SEQ ID NO: 231426 - DNA, 20 bp, Artificial Sequence
  chemically synthesized
tttttgtttgggaaaaagaa

SEQ ID NO: 231427 - DNA, 20 bp, Artificial Sequence
  chemically synthesized
tgaggtttttgtttgggaaa

SEQ ID NO: 231428 - DNA, 20 bp, Artificial Sequence
  chemically synthesized
gccttctgaggtttttgttt

SEQ ID NO: 231429 - DNA, 20 bp, Artificial Sequence
  chemically synthesized
tgccttctgaggtttttgtt

SEQ ID NO: 231430 - DNA, 20 bp, Artificial Sequence
  chemically synthesized
tttttcccaaacaaaaacct

SEQ ID NO: 231431 - DNA, 20 bp, Artificial Sequence
  chemically synthesized
ttcccaaacaaaaacctcag

SEQ ID NO: 231432 - DNA, 20 bp, Artificial Sequence
  chemically synthesized
tcccaaacaaaaacctcaga

SEQ ID NO: 231433 - DNA, 20 bp, Artificial Sequence
  chemically synthesized
gtcagtttacttgccttctg

SEQ ID NO: 231434 - DNA, 20 bp, Artificial Sequence
  chemically synthesized
aaacaaaaacctcagaaggc

SEQ ID NO: 231435 - DNA, 20 bp, Artificial Sequence
  chemically synthesized
ggtcagtttacttgccttct

SEQ ID NO: 231436 - DNA, 20 bp, Artificial Sequence
  chemically synthesized
atcttgttcatttaaaaggt

SEQ ID NO: 231437 - DNA, 20 bp, Artificial Sequence
  chemically synthesized
tcagatcttgttcatttaaa

SEQ ID NO: 231438 - DNA, 20 bp, Artificial Sequence
  chemically synthesized
gtcagatcttgttcatttaa

SEQ ID NO: 231439 - DNA, 20 bp, Artificial Sequence
  chemically synthesized
aactgaccttttaaatgaac

SEQ ID NO: 231440 - DNA, 20 bp, Artificial Sequence
  chemically synthesized
ttgggttagctcaatcatgt

SEQ ID NO: 231441 - DNA, 20 bp, Artificial Sequence
  chemically synthesized
gaacaagatctgacatgatt

SEQ ID NO: 231442 - DNA, 20 bp, Artificial Sequence
  chemically synthesized
tgacatgattgagctaaccc

SEQ ID NO: 231443 - DNA, 20 bp, Artificial Sequence
  chemically synthesized
gggaattttctttcttgggt

SEQ ID NO: 231444 - DNA, 20 bp, Artificial Sequence
  chemically synthesized
atgattgagctaacccaaga

SEQ ID NO: 231445 - DNA, 20 bp, Artificial Sequence
  chemically synthesized
agaggggaattttctttctt

SEQ ID NO: 231446 - DNA, 20 bp, Artificial Sequence
  chemically synthesized
cagaggggaattttctttct

SEQ ID NO: 231447 - DNA, 20 bp, Artificial Sequence
  chemically synthesized
agaaagaaaattcccctctg

SEQ ID NO: 231448 - DNA, 20 bp, Artificial Sequence
  chemically synthesized
aaaaattattcacttcagag

SEQ ID NO: 231449 - DNA, 20 bp, Artificial Sequence
  chemically synthesized
aaaaaattattcacttcaga

SEQ ID NO: 231450 - DNA, 20 bp, Artificial Sequence
  chemically synthesized
taaaaaattattcacttcag

SEQ ID NO: 231451 - DNA, 20 bp, Artificial Sequence
  chemically synthesized
ttaaaaaattattcacttca

SEQ ID NO: 231452 - DNA, 20 bp, Artificial Sequence
  chemically synthesized
aattaaaaaattattcactt

SEQ ID NO: 231453 - DNA, 20 bp, Artificial Sequence
  chemically synthesized
gtgaataattttttaattaa

SEQ ID NO: 231454 - DNA, 20 bp, Artificial Sequence
  chemically synthesized
tgaataattttttaattaaa

SEQ ID NO: 231455 - DNA, 20 bp, Artificial Sequence
  chemically synthesized
acaaaaccagtgtgatgtgt

SEQ ID NO: 231456 - DNA, 20 bp, Artificial Sequence
  chemically synthesized
tgaaatctgacacatcacac

SEQ ID NO: 231457 - DNA, 20 bp, Artificial Sequence
  chemically synthesized
aacaacaataataacaaaac

SEQ ID NO: 231458 - DNA, 20 bp, Artificial Sequence
  chemically synthesized
tacgagtgtgagattaatgg

SEQ ID NO: 231459 - DNA, 20 bp, Artificial Sequence
  chemically synthesized
tcttacgagtgtgagattaa

SEQ ID NO: 231460 - DNA, 20 bp, Artificial Sequence
  chemically synthesized
attttttttcttacgagtgt

SEQ ID NO: 231461 - DNA, 20 bp, Artificial Sequence
  chemically synthesized
tccattaatctcacactcgt

SEQ ID NO: 231462 - DNA, 20 bp, Artificial Sequence
  chemically synthesized
acactcattttttttcttac

SEQ ID NO: 231463 - DNA, 20 bp, Artificial Sequence
  chemically synthesized
acactcgtaagaaaaaaaat

SEQ ID NO: 231464 - DNA, 20 bp, Artificial Sequence
  chemically synthesized
ttatatatgactgtgtttta

SEQ ID NO: 231465 - DNA, 20 bp, Artificial Sequence
  chemically synthesized
atatatgcatctataaaaca

SEQ ID NO: 231466 - DNA, 20 bp, Artificial Sequence
  chemically synthesized
atggactgaaatggatagag

SEQ ID NO: 231467 - DNA, 20 bp, Artificial Sequence
  chemically synthesized
aagatggactgaaatggata

SEQ ID NO: 231468 - DNA, 20 bp, Artificial Sequence
  chemically synthesized
atattctactctatccattt

SEQ ID NO: 231469 - DNA, 20 bp, Artificial Sequence
  chemically synthesized
aaaagatggactgaaatgga

SEQ ID NO: 231470 - DNA, 20 bp, Artificial Sequence
  chemically synthesized
taagaaaagatggactgaaa

SEQ ID NO: 231471 - DNA, 20 bp, Artificial Sequence
  chemically synthesized
acaaatgcattaagaaaaga

SEQ ID NO: 231472 - DNA, 20 bp, Artificial Sequence
  chemically synthesized
caggacaaatgcattaagaa

SEQ ID NO: 231473 - DNA, 20 bp, Artificial Sequence
  chemically synthesized
agtgacaggacaaatgcatt

SEQ ID NO: 231474 - DNA, 20 bp, Artificial Sequence
  chemically synthesized
ttacagtgagtaaaagtgac

SEQ ID NO: 231475 - DNA, 20 bp, Artificial Sequence
  chemically synthesized
attacagtgagtaaaagtga

SEQ ID NO: 231476 - DNA, 20 bp, Artificial Sequence
  chemically synthesized
aattgaattacagtgagtaa

SEQ ID NO: 231477 - DNA, 20 bp, Artificial Sequence
  chemically synthesized
taacaaaattgaattacagt

SEQ ID NO: 231478 - DNA, 20 bp, Artificial Sequence
  chemically synthesized
ttcctaacaaaattgaatta

SEQ ID NO: 231479 - DNA, 20 bp, Artificial Sequence
  chemically synthesized
tcactgtaattcaattttgt

SEQ ID NO: 231480 - DNA, 20 bp, Artificial Sequence
  chemically synthesized
cactgtaattcaattttgtt

SEQ ID NO: 231481 - DNA, 20 bp, Artificial Sequence
  chemically synthesized
tatataaagcataaaacagc

SEQ ID NO: 231482 - DNA, 20 bp, Artificial Sequence
  chemically synthesized
gaaatatataaagcataaaa

SEQ ID NO: 231483 - DNA, 20 bp, Artificial Sequence
  chemically synthesized
tgcatcaggtgaaatatata

SEQ ID NO: 231484 - DNA, 20 bp, Artificial Sequence
  chemically synthesized
caggtagtccattttgcatc

SEQ ID NO: 231485 - DNA, 20 bp, Artificial Sequence
  chemically synthesized
tcaggtagtccattttgcat

SEQ ID NO: 231486 - DNA, 20 bp, Artificial Sequence
  chemically synthesized
atatttcacctgatgcaaaa

SEQ ID NO: 231487 - DNA, 20 bp, Artificial Sequence
  chemically synthesized
aaaatgcagaatcaatcagg

SEQ ID NO: 231488 - DNA, 20 bp, Artificial Sequence
  chemically synthesized
ctaaaaatgcagaatcaatc

SEQ ID NO: 231489 - DNA, 20 bp, Artificial Sequence
  chemically synthesized
actaaaaatgcagaatcaat

SEQ ID NO: 231490 - DNA, 20 bp, Artificial Sequence
  chemically synthesized
cctgattgattctgcatttt

SEQ ID NO: 231491 - DNA, 20 bp, Artificial Sequence
  chemically synthesized
tcaaaggtggactaaaaatg

SEQ ID NO: 231492 - DNA, 20 bp, Artificial Sequence
  chemically synthesized
tttatctataaattcaaagg

SEQ ID NO: 231493 - DNA, 20 bp, Artificial Sequence
  chemically synthesized
atctttatctataaattcaa

SEQ ID NO: 231494 - DNA, 20 bp, Artificial Sequence
  chemically synthesized
gatctttatctataaattca

SEQ ID NO: 231495 - DNA, 20 bp, Artificial Sequence
  chemically synthesized
ttagtccacctttgaattta

SEQ ID NO: 231496 - DNA, 20 bp, Artificial Sequence
  chemically synthesized
cacctttgaatttatagata

SEQ ID NO: 231497 - DNA, 20 bp, Artificial Sequence
  chemically synthesized
aaagatcaacaattaacttt

SEQ ID NO: 231498 - DNA, 20 bp, Artificial Sequence
  chemically synthesized
tttttttagcataatgctta

SEQ ID NO: 231499 - DNA, 20 bp, Artificial Sequence
  chemically synthesized
ccttctggctaagatttttt

SEQ ID NO: 231500 - DNA, 20 bp, Artificial Sequence
  chemically synthesized
gcattatgctaaaaaaatct

SEQ ID NO: 231501 - DNA, 20 bp, Artificial Sequence
  chemically synthesized
tatgctaaaaaaatcttagc

SEQ ID NO: 231502 - DNA, 20 bp, Artificial Sequence
  chemically synthesized
gctaaaaaaatcttagccag

SEQ ID NO: 231503 - DNA, 20 bp, Artificial Sequence
  chemically synthesized
ctaaaaaaatcttagccaga

SEQ ID NO: 231504 - DNA, 20 bp, Artificial Sequence
  chemically synthesized
aggaagcaatccttctggct

SEQ ID NO: 231505 - DNA, 20 bp, Artificial Sequence
  chemically synthesized
ttttcaggaagcaatccttc

SEQ ID NO: 231506 - DNA, 20 bp, Artificial Sequence
  chemically synthesized
caaattaaatcattttcagg

SEQ ID NO: 231507 - DNA, 20 bp, Artificial Sequence
  chemically synthesized
atacaaattaaatcattttc

SEQ ID NO: 231508 - DNA, 20 bp, Artificial Sequence
  chemically synthesized
aatacaaattaaatcatttt

SEQ ID NO: 231509 - DNA, 20 bp, Artificial Sequence
  chemically synthesized
cagggcattttattatattt

SEQ ID NO: 231510 - DNA, 20 bp, Artificial Sequence
  chemically synthesized
atataataaaatgccctgat

SEQ ID NO: 231511 - DNA, 20 bp, Artificial Sequence
  chemically synthesized
taataaaatgccctgataag

SEQ ID NO: 231512 - DNA, 20 bp, Artificial Sequence
  chemically synthesized
ttgttgattacttcttatca

SEQ ID NO: 231513 - DNA, 20 bp, Artificial Sequence
  chemically synthesized
attgttgattacttcttatc

SEQ ID NO: 231514 - DNA, 20 bp, Artificial Sequence
  chemically synthesized
aattgttgattacttcttat

SEQ ID NO: 231515 - DNA, 20 bp, Artificial Sequence
  chemically synthesized
gtaatcaacaattttgattc

SEQ ID NO: 231516 - DNA, 20 bp, Artificial Sequence
  chemically synthesized
gttcaaatcaaatggaaaac

SEQ ID NO: 231517 - DNA, 20 bp, Artificial Sequence
  chemically synthesized
atgtacatgttcaaatcaaa

SEQ ID NO: 231518 - DNA, 20 bp, Artificial Sequence
  chemically synthesized
tttgaacatgtacattattt

SEQ ID NO: 231519 - DNA, 20 bp, Artificial Sequence
  chemically synthesized
acatgtacattatttcagca

SEQ ID NO: 231520 - DNA, 20 bp, Artificial Sequence
  chemically synthesized
tgtacattatttcagcatgg

SEQ ID NO: 231521 - DNA, 20 bp, Artificial Sequence
  chemically synthesized
tggtggatgatacatatcta

SEQ ID NO: 231522 - DNA, 20 bp, Artificial Sequence
  chemically synthesized
aatgcacatatttcaagctg

SEQ ID NO: 231523 - DNA, 20 bp, Artificial Sequence
  chemically synthesized
ctccccaatgcacatatttc

SEQ ID NO: 231524 - DNA, 20 bp, Artificial Sequence
  chemically synthesized
acagcttgaaatatgtgcat

SEQ ID NO: 231525 - DNA, 20 bp, Artificial Sequence
  chemically synthesized
cagcttgaaatatgtgcatt

SEQ ID NO: 231526 - DNA, 20 bp, Artificial Sequence
  chemically synthesized
agcttgaaatatgtgcattg

SEQ ID NO: 231527 - DNA, 20 bp, Artificial Sequence
  chemically synthesized
cttgaaatatgtgcattggg

SEQ ID NO: 231528 - DNA, 20 bp, Artificial Sequence
  chemically synthesized
ttgaaatatgtgcattgggg

SEQ ID NO: 231529 - DNA, 20 bp, Artificial Sequence
  chemically synthesized
ggggaggttttgttgaatgc

SEQ ID NO: 231530 - DNA, 20 bp, Artificial Sequence
  chemically synthesized
actacagcaaaacagcaatc

SEQ ID NO: 231531 - DNA, 20 bp, Artificial Sequence
  chemically synthesized
taaatcaaactacagcaaaa

SEQ ID NO: 231532 - DNA, 20 bp, Artificial Sequence
  chemically synthesized
gctagattgctgttttgctg

SEQ ID NO: 231533 - DNA, 20 bp, Artificial Sequence
  chemically synthesized
cacacaaataaatcaaacta

SEQ ID NO: 231534 - DNA, 20 bp, Artificial Sequence
  chemically synthesized
gtagtttgatttatttgtgt

SEQ ID NO: 231535 - DNA, 20 bp, Artificial Sequence
  chemically synthesized
gatttatttgtgtgagttat

SEQ ID NO: 231536 - DNA, 20 bp, Artificial Sequence
  chemically synthesized
gtgagttattagcttgatat

SEQ ID NO: 231537 - DNA, 20 bp, Artificial Sequence
  chemically synthesized
tttagttactttccaatatc

SEQ ID NO: 231538 - DNA, 20 bp, Artificial Sequence
  chemically synthesized
gttattagcttgatattgga

SEQ ID NO: 231539 - DNA, 20 bp, Artificial Sequence
  chemically synthesized
gatatcatatattcaaattt

SEQ ID NO: 231540 - DNA, 20 bp, Artificial Sequence
  chemically synthesized
ctatatttatttcagaagca

SEQ ID NO: 231541 - DNA, 20 bp, Artificial Sequence
  chemically synthesized
cgctatatttatttcagaag

SEQ ID NO: 231542 - DNA, 20 bp, Artificial Sequence
  chemically synthesized
aatcgctatatttatttcag

SEQ ID NO: 231543 - DNA, 20 bp, Artificial Sequence
  chemically synthesized
ttcaatcgctatatttattt

SEQ ID NO: 231544 - DNA, 20 bp, Artificial Sequence
  chemically synthesized
ctctgcttctgaaataaata

SEQ ID NO: 231545 - DNA, 20 bp, Artificial Sequence
  chemically synthesized
ataaatatagcgattgaaaa

SEQ ID NO: 231546 - DNA, 20 bp, Artificial Sequence
  chemically synthesized
ccccactcaacgttcataaa

SEQ ID NO: 231547 - DNA, 20 bp, Artificial Sequence
  chemically synthesized
gccccactcaacgttcataa

SEQ ID NO: 231548 - DNA, 20 bp, Artificial Sequence
  chemically synthesized
atggaccttttatgaacgtt

SEQ ID NO: 231549 - DNA, 20 bp, Artificial Sequence
  chemically synthesized
gaccttttatgaacgttgag

SEQ ID NO: 231550 - DNA, 20 bp, Artificial Sequence
  chemically synthesized
accttttatgaacgttgagt

SEQ ID NO: 231551 - DNA, 20 bp, Artificial Sequence
  chemically synthesized
ccttttatgaacgttgagtg

SEQ ID NO: 231552 - DNA, 20 bp, Artificial Sequence
  chemically synthesized
acgttgagtggggcaatttc

SEQ ID NO: 231553 - DNA, 20 bp, Artificial Sequence
  chemically synthesized
ttgagtggggcaatttctgg

SEQ ID NO: 231554 - DNA, 20 bp, Artificial Sequence
  chemically synthesized
tgagtggggcaatttctggc

SEQ ID NO: 231555 - DNA, 20 bp, Artificial Sequence
  chemically synthesized
gtggggcaatttctggcagg

SEQ ID NO: 231556 - DNA, 20 bp, Artificial Sequence
  chemically synthesized
tggggcaatttctggcaggt

SEQ ID NO: 231557 - DNA, 20 bp, Artificial Sequence
  chemically synthesized
ggggcaatttctggcaggtg

SEQ ID NO: 231558 - DNA, 20 bp, Artificial Sequence
  chemically synthesized
ttactctcttccccacctgc

SEQ ID NO: 231559 - DNA, 20 bp, Artificial Sequence
  chemically synthesized
gcaatttctggcaggtgggg

SEQ ID NO: 231560 - DNA, 20 bp, Artificial Sequence
  chemically synthesized
aatttctggcaggtggggaa

SEQ ID NO: 231561 - DNA, 20 bp, Artificial Sequence
  chemically synthesized
tttctggcaggtggggaaga

SEQ ID NO: 231562 - DNA, 20 bp, Artificial Sequence
  chemically synthesized
ggcaggtggggaagagagta

SEQ ID NO: 231563 - DNA, 20 bp, Artificial Sequence
  chemically synthesized
aggtggggaagagagtaaag

SEQ ID NO: 231564 - DNA, 20 bp, Artificial Sequence
  chemically synthesized
aaagaagattcattgtatga

SEQ ID NO: 231565 - DNA, 20 bp, Artificial Sequence
  chemically synthesized
agattcattgtatgaaagca

SEQ ID NO: 231566 - DNA, 20 bp, Artificial Sequence
  chemically synthesized
gaaagcaaagcaaatacaca

SEQ ID NO: 231567 - DNA, 20 bp, Artificial Sequence
  chemically synthesized
gatatgttccgttaaattac

SEQ ID NO: 231568 - DNA, 20 bp, Artificial Sequence
  chemically synthesized
acatagaacttgtaatttaa

SEQ ID NO: 231569 - DNA, 20 bp, Artificial Sequence
  chemically synthesized
tgtaatttaacggaacatat

SEQ ID NO: 231570 - DNA, 20 bp, Artificial Sequence
  chemically synthesized
aatttaacggaacatatcag

SEQ ID NO: 231571 - DNA, 20 bp, Artificial Sequence
  chemically synthesized
acggaacatatcagcagatg

SEQ ID NO: 231572 - DNA, 20 bp, Artificial Sequence
  chemically synthesized
atatcagcagatgtggttct

SEQ ID NO: 231573 - DNA, 20 bp, Artificial Sequence
  chemically synthesized
gtaaatgtaagagtcattct

SEQ ID NO: 231574 - DNA, 20 bp, Artificial Sequence
  chemically synthesized
agtcattaatgtaaatgtaa

SEQ ID NO: 231575 - DNA, 20 bp, Artificial Sequence
  chemically synthesized
atagtcattaatgtaaatgt

SEQ ID NO: 231576 - DNA, 20 bp, Artificial Sequence
  chemically synthesized
tacattaatgactatctaaa

SEQ ID NO: 231577 - DNA, 20 bp, Artificial Sequence
  chemically synthesized
gctgtctaattctttttaga

SEQ ID NO: 231578 - DNA, 20 bp, Artificial Sequence
  chemically synthesized
cggtgctgtctaattctttt

SEQ ID NO: 231579 - DNA, 20 bp, Artificial Sequence
  chemically synthesized
aatgactatctaaaaagaat

SEQ ID NO: 231580 - DNA, 20 bp, Artificial Sequence
  chemically synthesized
actatctaaaaagaattaga

SEQ ID NO: 231581 - DNA, 20 bp, Artificial Sequence
  chemically synthesized
attttgaaaaaggaagttca

SEQ ID NO: 231582 - DNA, 20 bp, Artificial Sequence
  chemically synthesized
acttttaattttgaaaaagg

SEQ ID NO: 231583 - DNA, 20 bp, Artificial Sequence
  chemically synthesized
aaaacttttaattttgaaaa

SEQ ID NO: 231584 - DNA, 20 bp, Artificial Sequence
  chemically synthesized
aaaaacttttaattttgaaa

SEQ ID NO: 231585 - DNA, 20 bp, Artificial Sequence
  chemically synthesized
acttcctttttcaaaattaa

SEQ ID NO: 231586 - DNA, 20 bp, Artificial Sequence
  chemically synthesized
taaaagttttttttaaaata

SEQ ID NO: 231587 - DNA, 20 bp, Artificial Sequence
  chemically synthesized
aagttttttttaaaataaag

SEQ ID NO: 231588 - DNA, 20 bp, Artificial Sequence
  chemically synthesized
ttttttaaaataaagaagtt

SEQ ID NO: 231589 - DNA, 20 bp, Artificial Sequence
  chemically synthesized
aaataaagaagttcagattt

SEQ ID NO: 231590 - DNA, 20 bp, Artificial Sequence
  chemically synthesized
attttagcatcaactgacca

SEQ ID NO: 231591 - DNA, 20 bp, Artificial Sequence
  chemically synthesized
atggccccttatgctttggt

SEQ ID NO: 231592 - DNA, 20 bp, Artificial Sequence
  chemically synthesized
gcatcaactgaccaaagcat

SEQ ID NO: 231593 - DNA, 20 bp, Artificial Sequence
  chemically synthesized
catcaactgaccaaagcata

SEQ ID NO: 231594 - DNA, 20 bp, Artificial Sequence
  chemically synthesized
ttggatggccccttatgctt

SEQ ID NO: 231595 - DNA, 20 bp, Artificial Sequence
  chemically synthesized
atcaactgaccaaagcataa

SEQ ID NO: 231596 - DNA, 20 bp, Artificial Sequence
  chemically synthesized
tcaactgaccaaagcataag

SEQ ID NO: 231597 - DNA, 20 bp, Artificial Sequence
  chemically synthesized
caaagcataaggggccatcc

SEQ ID NO: 231598 - DNA, 20 bp, Artificial Sequence
  chemically synthesized
agattattttttttcttgga

SEQ ID NO: 231599 - DNA, 20 bp, Artificial Sequence
  chemically synthesized
cttcagattattttttttct

SEQ ID NO: 231600 - DNA, 20 bp, Artificial Sequence
  chemically synthesized
ccaagaaaaaaaataatctg

SEQ ID NO: 231601 - DNA, 20 bp, Artificial Sequence
  chemically synthesized
atcgttttatgaaagtgctt

SEQ ID NO: 231602 - DNA, 20 bp, Artificial Sequence
  chemically synthesized
tttgtaacatcgttttatga

SEQ ID NO: 231603 - DNA, 20 bp, Artificial Sequence
  chemically synthesized
gatgttacaaatcaatattt

SEQ ID NO: 231604 - DNA, 20 bp, Artificial Sequence
  chemically synthesized
tcaatattttagacactttg

SEQ ID NO: 231605 - DNA, 20 bp, Artificial Sequence
  chemically synthesized
aagcaaggagatgatcttca

SEQ ID NO: 231606 - DNA, 20 bp, Artificial Sequence
  chemically synthesized
tgtgaaggttgaaaagcaag

SEQ ID NO: 231607 - DNA, 20 bp, Artificial Sequence
  chemically synthesized
agtgtgaaggttgaaaagca

SEQ ID NO: 231608 - DNA, 20 bp, Artificial Sequence
  chemically synthesized
aagtgtgaaggttgaaaagc

SEQ ID NO: 231609 - DNA, 20 bp, Artificial Sequence
  chemically synthesized
tcggaagtgtgaaggttgaa

SEQ ID NO: 231610 - DNA, 20 bp, Artificial Sequence
  chemically synthesized
cccctgtctcggaagtgtga

SEQ ID NO: 231611 - DNA, 20 bp, Artificial Sequence
  chemically synthesized
tcccctgtctcggaagtgtg

SEQ ID NO: 231612 - DNA, 20 bp, Artificial Sequence
  chemically synthesized
ttttcaaccttcacacttcc

SEQ ID NO: 231613 - DNA, 20 bp, Artificial Sequence
  chemically synthesized
caaccttcacacttccgaga

SEQ ID NO: 231614 - DNA, 20 bp, Artificial Sequence
  chemically synthesized
aaccttcacacttccgagac

SEQ ID NO: 231615 - DNA, 20 bp, Artificial Sequence
  chemically synthesized
atatatatcccctgtctcgg

SEQ ID NO: 231616 - DNA, 20 bp, Artificial Sequence
  chemically synthesized
accttcacacttccgagaca

SEQ ID NO: 231617 - DNA, 20 bp, Artificial Sequence
  chemically synthesized
ccttcacacttccgagacag

SEQ ID NO: 231618 - DNA, 20 bp, Artificial Sequence
  chemically synthesized
aacatatatatcccctgtct

SEQ ID NO: 231619 - DNA, 20 bp, Artificial Sequence
  chemically synthesized
aatgatttattttagaaaaa

SEQ ID NO: 231620 - DNA, 20 bp, Artificial Sequence
  chemically synthesized
gaaatgatttattttagaaa

SEQ ID NO: 231621 - DNA, 20 bp, Artificial Sequence
  chemically synthesized
caatcagaaatgatttattt

SEQ ID NO: 231622 - DNA, 20 bp, Artificial Sequence
  chemically synthesized
aaaataaatcatttctgatt

SEQ ID NO: 231623 - DNA, 20 bp, Artificial Sequence
  chemically synthesized
ttctgtaaaagatgctcaat

SEQ ID NO: 231624 - DNA, 20 bp, Artificial Sequence
  chemically synthesized
ttctgattgagcatctttta

SEQ ID NO: 231625 - DNA, 20 bp, Artificial Sequence
  chemically synthesized
tgattgagcatcttttacag

SEQ ID NO: 231626 - DNA, 20 bp, Artificial Sequence
  chemically synthesized
tgcagtgggctcttctgtaa

SEQ ID NO: 231627 - DNA, 20 bp, Artificial Sequence
  chemically synthesized
attgagcatcttttacagaa

SEQ ID NO: 231628 - DNA, 20 bp, Artificial Sequence
  chemically synthesized
taaaaattgacatttgcagt

SEQ ID NO: 231629 - DNA, 20 bp, Artificial Sequence
  chemically synthesized
ataaaaattgacatttgcag

SEQ ID NO: 231630 - DNA, 20 bp, Artificial Sequence
  chemically synthesized
attataaaaattgacatttg

SEQ ID NO: 231631 - DNA, 20 bp, Artificial Sequence
  chemically synthesized
tgtcaatttttataattgcc

SEQ ID NO: 231632 - DNA, 20 bp, Artificial Sequence
  chemically synthesized
ttttcccacaagtatggtct

SEQ ID NO: 231633 - DNA, 20 bp, Artificial Sequence
  chemically synthesized
tttttcccacaagtatggtc

SEQ ID NO: 231634 - DNA, 20 bp, Artificial Sequence
  chemically synthesized
aattgcccagaccatacttg

SEQ ID NO: 231635 - DNA, 20 bp, Artificial Sequence
  chemically synthesized
attgcccagaccatacttgt

SEQ ID NO: 231636 - DNA, 20 bp, Artificial Sequence
  chemically synthesized
cttcatttttcccacaagta

SEQ ID NO: 231637 - DNA, 20 bp, Artificial Sequence
  chemically synthesized
tgtcccttcatttttcccac

SEQ ID NO: 231638 - DNA, 20 bp, Artificial Sequence
  chemically synthesized
ccatacttgtgggaaaaatg

SEQ ID NO: 231639 - DNA, 20 bp, Artificial Sequence
  chemically synthesized
catacttgtgggaaaaatga

SEQ ID NO: 231640 - DNA, 20 bp, Artificial Sequence
  chemically synthesized
atacttgtgggaaaaatgaa

SEQ ID NO: 231641 - DNA, 20 bp, Artificial Sequence
  chemically synthesized
tgtgggaaaaatgaagggac

SEQ ID NO: 231642 - DNA, 20 bp, Artificial Sequence
  chemically synthesized
tgggaaaaatgaagggacaa

SEQ ID NO: 231643 - DNA, 20 bp, Artificial Sequence
  chemically synthesized
gaaaaatgaagggacaagag

SEQ ID NO: 231644 - DNA, 20 bp, Artificial Sequence
  chemically synthesized
aaaaatgaagggacaagagt

SEQ ID NO: 231645 - DNA, 20 bp, Artificial Sequence
  chemically synthesized
aatgaagggacaagagtagg

SEQ ID NO: 231646 - DNA, 20 bp, Artificial Sequence
  chemically synthesized
atgaagggacaagagtagga

SEQ ID NO: 231647 - DNA, 20 bp, Artificial Sequence
  chemically synthesized
acaagagtaggaaggtcatt

SEQ ID NO: 231648 - DNA, 20 bp, Artificial Sequence
  chemically synthesized
caagagtaggaaggtcattc

SEQ ID NO: 231649 - DNA, 20 bp, Artificial Sequence
  chemically synthesized
aagagtaggaaggtcattca

SEQ ID NO: 231650 - DNA, 20 bp, Artificial Sequence
  chemically synthesized
tcctgtggtagaaatgtatt

SEQ ID NO: 231651 - DNA, 20 bp, Artificial Sequence
  chemically synthesized
cactgaatacatttctacca

SEQ ID NO: 231652 - DNA, 20 bp, Artificial Sequence
  chemically synthesized
actgaatacatttctaccac

SEQ ID NO: 231653 - DNA, 20 bp, Artificial Sequence
  chemically synthesized
gacgtaatgctttcctgtgg

SEQ ID NO: 231654 - DNA, 20 bp, Artificial Sequence
  chemically synthesized
aatacatttctaccacagga

SEQ ID NO: 231655 - DNA, 20 bp, Artificial Sequence
  chemically synthesized
aaagacgtaatgctttcctg

SEQ ID NO: 231656 - DNA, 20 bp, Artificial Sequence
  chemically synthesized
cttgaagaaataaagtgcaa

SEQ ID NO: 231657 - DNA, 20 bp, Artificial Sequence
  chemically synthesized
gggaatggcttgaagaaata

SEQ ID NO: 231658 - DNA, 20 bp, Artificial Sequence
  chemically synthesized
cttttgcactttatttcttc

SEQ ID NO: 231659 - DNA, 20 bp, Artificial Sequence
  chemically synthesized
tgttggaagggaatggcttg

SEQ ID NO: 231660 - DNA, 20 bp, Artificial Sequence
  chemically synthesized
tatgagatgttggaagggaa

SEQ ID NO: 231661 - DNA, 20 bp, Artificial Sequence
  chemically synthesized
agggatatgagatgttggaa

SEQ ID NO: 231662 - DNA, 20 bp, Artificial Sequence
  chemically synthesized
cagggatatgagatgttgga

SEQ ID NO: 231663 - DNA, 20 bp, Artificial Sequence
  chemically synthesized
acagggatatgagatgttgg

SEQ ID NO: 231664 - DNA, 20 bp, Artificial Sequence
  chemically synthesized
gggacagggatatgagatgt

SEQ ID NO: 231665 - DNA, 20 bp, Artificial Sequence
  chemically synthesized
ttctggggggacagggatat

SEQ ID NO: 231666 - DNA, 20 bp, Artificial Sequence
  chemically synthesized
tccaactttctggggggaca

SEQ ID NO: 231667 - DNA, 20 bp, Artificial Sequence
  chemically synthesized
atctcatatccctgtccccc

SEQ ID NO: 231668 - DNA, 20 bp, Artificial Sequence
  chemically synthesized
ctccaactttctggggggac

SEQ ID NO: 231669 - DNA, 20 bp, Artificial Sequence
  chemically synthesized
actccaactttctgggggga

SEQ ID NO: 231670 - DNA, 20 bp, Artificial Sequence
  chemically synthesized
catatccctgtccccccaga

SEQ ID NO: 231671 - DNA, 20 bp, Artificial Sequence
  chemically synthesized
tgtgactccaactttctggg

SEQ ID NO: 231672 - DNA, 20 bp, Artificial Sequence
  chemically synthesized
ctgtgactccaactttctgg

SEQ ID NO: 231673 - DNA, 20 bp, Artificial Sequence
  chemically synthesized
cctgtgactccaactttctg

SEQ ID NO: 231674 - DNA, 20 bp, Artificial Sequence
  chemically synthesized
tccctgtccccccagaaagt

SEQ ID NO: 231675 - DNA, 20 bp, Artificial Sequence
  chemically synthesized
acctgtgactccaactttct

SEQ ID NO: 231676 - DNA, 20 bp, Artificial Sequence
  chemically synthesized
cacctgtgactccaactttc

SEQ ID NO: 231677 - DNA, 20 bp, Artificial Sequence
  chemically synthesized
cctgtccccccagaaagttg

SEQ ID NO: 231678 - DNA, 20 bp, Artificial Sequence
  chemically synthesized
cccccagaaagttggagtca

SEQ ID NO: 231679 - DNA, 20 bp, Artificial Sequence
  chemically synthesized
ccccagaaagttggagtcac

SEQ ID NO: 231680 - DNA, 20 bp, Artificial Sequence
  chemically synthesized
agttggagtcacaggtgaca

SEQ ID NO: 231681 - DNA, 20 bp, Artificial Sequence
  chemically synthesized
ggagtcacaggtgacacagc

SEQ ID NO: 231682 - DNA, 20 bp, Artificial Sequence
  chemically synthesized
gagtcacaggtgacacagct

SEQ ID NO: 231683 - DNA, 20 bp, Artificial Sequence
  chemically synthesized
tttcataaagaaagttttcc

SEQ ID NO: 231684 - DNA, 20 bp, Artificial Sequence
  chemically synthesized
tgttaatcttttcataaaga

SEQ ID NO: 231685 - DNA, 20 bp, Artificial Sequence
  chemically synthesized
gggaaaactttctttatgaa

SEQ ID NO: 231686 - DNA, 20 bp, Artificial Sequence
  chemically synthesized
catgtgttaatcttttcata

SEQ ID NO: 231687 - DNA, 20 bp, Artificial Sequence
  chemically synthesized
agattaacacatgttttaaa

SEQ ID NO: 231688 - DNA, 20 bp, Artificial Sequence
  chemically synthesized
attaacacatgttttaaaaa

SEQ ID NO: 231689 - DNA, 20 bp, Artificial Sequence
  chemically synthesized
tatgtatgtcaaaattattc

SEQ ID NO: 231690 - DNA, 20 bp, Artificial Sequence
  chemically synthesized
cccttctgagaacagtgttc

SEQ ID NO: 231691 - DNA, 20 bp, Artificial Sequence
  chemically synthesized
ttattccagaacactgttct

SEQ ID NO: 231692 - DNA, 20 bp, Artificial Sequence
  chemically synthesized
ttccagaacactgttctcag

SEQ ID NO: 231693 - DNA, 20 bp, Artificial Sequence
  chemically synthesized
agttactgcccttctgagaa

SEQ ID NO: 231694 - DNA, 20 bp, Artificial Sequence
  chemically synthesized
tccagaacactgttctcaga

SEQ ID NO: 231695 - DNA, 20 bp, Artificial Sequence
  chemically synthesized
ccagaacactgttctcagaa

SEQ ID NO: 231696 - DNA, 20 bp, Artificial Sequence
  chemically synthesized
gaacactgttctcagaaggg

SEQ ID NO: 231697 - DNA, 20 bp, Artificial Sequence
  chemically synthesized
gttgcagttactgcccttct

SEQ ID NO: 231698 - DNA, 20 bp, Artificial Sequence
  chemically synthesized
gaagggcagtaactgcaacc

SEQ ID NO: 231699 - DNA, 20 bp, Artificial Sequence
  chemically synthesized
agcagaaactaacttggttg

SEQ ID NO: 231700 - DNA, 20 bp, Artificial Sequence
  chemically synthesized
ggcagtaactgcaaccaagt

SEQ ID NO: 231701 - DNA, 20 bp, Artificial Sequence
  chemically synthesized
ttcaatagcagaaactaact

SEQ ID NO: 231702 - DNA, 20 bp, Artificial Sequence
  chemically synthesized
ttcacattttgtttcaatag

SEQ ID NO: 231703 - DNA, 20 bp, Artificial Sequence
  chemically synthesized
agcttcacattttgtttcaa

SEQ ID NO: 231704 - DNA, 20 bp, Artificial Sequence
  chemically synthesized
tgctattgaaacaaaatgtg

SEQ ID NO: 231705 - DNA, 20 bp, Artificial Sequence
  chemically synthesized
gaaacaaaatgtgaagctca

SEQ ID NO: 231706 - DNA, 20 bp, Artificial Sequence
  chemically synthesized
aaacaaaatgtgaagctcat

SEQ ID NO: 231707 - DNA, 20 bp, Artificial Sequence
  chemically synthesized
aacaaaatgtgaagctcatg

SEQ ID NO: 231708 - DNA, 20 bp, Artificial Sequence
  chemically synthesized
ttgtgatgaaatttccccat

SEQ ID NO: 231709 - DNA, 20 bp, Artificial Sequence
  chemically synthesized
atggatttttaattcataga

SEQ ID NO: 231710 - DNA, 20 bp, Artificial Sequence
  chemically synthesized
ttaaatggatttttaattca

SEQ ID NO: 231711 - DNA, 20 bp, Artificial Sequence
  chemically synthesized
cttggaggctttatattaaa

SEQ ID NO: 231712 - DNA, 20 bp, Artificial Sequence
  chemically synthesized
ttaaaaatccatttaatata

SEQ ID NO: 231713 - DNA, 20 bp, Artificial Sequence
  chemically synthesized
ccatttaatataaagcctcc

SEQ ID NO: 231714 - DNA, 20 bp, Artificial Sequence
  chemically synthesized
aagttttctttgtttcttgg

SEQ ID NO: 231715 - DNA, 20 bp, Artificial Sequence
  chemically synthesized
caagttttctttgtttcttg

SEQ ID NO: 231716 - DNA, 20 bp, Artificial Sequence
  chemically synthesized
tataaagcctccaagaaaca

SEQ ID NO: 231717 - DNA, 20 bp, Artificial Sequence
  chemically synthesized
aacaagttttctttgtttct

SEQ ID NO: 231718 - DNA, 20 bp, Artificial Sequence
  chemically synthesized
cttctgtaaaaataaaaaac

SEQ ID NO: 231719 - DNA, 20 bp, Artificial Sequence
  chemically synthesized
aaacttgttttttattttta

SEQ ID NO: 231720 - DNA, 20 bp, Artificial Sequence
  chemically synthesized
cttgttttttatttttacag

SEQ ID NO: 231721 - DNA, 20 bp, Artificial Sequence
  chemically synthesized
aaattaggttaggggttaaa

SEQ ID NO: 231722 - DNA, 20 bp, Artificial Sequence
  chemically synthesized
ggtttaaaaaattaggttag

SEQ ID NO: 231723 - DNA, 20 bp, Artificial Sequence
  chemically synthesized
tggtttaaaaaattaggtta

SEQ ID NO: 231724 - DNA, 20 bp, Artificial Sequence
  chemically synthesized
ttggtttaaaaaattaggtt

SEQ ID NO: 231725 - DNA, 20 bp, Artificial Sequence
  chemically synthesized
tttggtttaaaaaattaggt

SEQ ID NO: 231726 - DNA, 20 bp, Artificial Sequence
  chemically synthesized
tggttttggtttaaaaaatt

SEQ ID NO: 231727 - DNA, 20 bp, Artificial Sequence
  chemically synthesized
ctggttttggtttaaaaaat

SEQ ID NO: 231728 - DNA, 20 bp, Artificial Sequence
  chemically synthesized
ctaattttttaaaccaaaac

SEQ ID NO: 231729 - DNA, 20 bp, Artificial Sequence
  chemically synthesized
aaaaaaaataattctggttt

SEQ ID NO: 231730 - DNA, 20 bp, Artificial Sequence
  chemically synthesized
aaagaaaaaaaaaataattc

SEQ ID NO: 231731 - DNA, 20 bp, Artificial Sequence
  chemically synthesized
aattattttttttttctttt

SEQ ID NO: 231732 - DNA, 20 bp, Artificial Sequence
  chemically synthesized
gtgcttcattgaaagctaaa

SEQ ID NO: 231733 - DNA, 20 bp, Artificial Sequence
  chemically synthesized
tttctttttagctttcaatg

SEQ ID NO: 231734 - DNA, 20 bp, Artificial Sequence
  chemically synthesized
atttgattgtgcttcattga

SEQ ID NO: 231735 - DNA, 20 bp, Artificial Sequence
  chemically synthesized
atgaagcacaatcaaattcc

SEQ ID NO: 231736 - DNA, 20 bp, Artificial Sequence
  chemically synthesized
gaagcacaatcaaattcctg

SEQ ID NO: 231737 - DNA, 20 bp, Artificial Sequence
  chemically synthesized
acaatcaaattcctggagaa

SEQ ID NO: 231738 - DNA, 20 bp, Artificial Sequence
  chemically synthesized
cgttttcccatcttttctcc

SEQ ID NO: 231739 - DNA, 20 bp, Artificial Sequence
  chemically synthesized
ccgttttcccatcttttctc

SEQ ID NO: 231740 - DNA, 20 bp, Artificial Sequence
  chemically synthesized
tcaaattcctggagaaaaga

SEQ ID NO: 231741 - DNA, 20 bp, Artificial Sequence
  chemically synthesized
caaattcctggagaaaagat

SEQ ID NO: 231742 - DNA, 20 bp, Artificial Sequence
  chemically synthesized
ctggagaaaagatgggaaaa

SEQ ID NO: 231743 - DNA, 20 bp, Artificial Sequence
  chemically synthesized
tgggaaaacggcataaaaca

SEQ ID NO: 231744 - DNA, 20 bp, Artificial Sequence
  chemically synthesized
cataaaacaaagcacgaaca

SEQ ID NO: 231745 - DNA, 20 bp, Artificial Sequence
  chemically synthesized
cgaacacggtatttaaatcc

SEQ ID NO: 231746 - DNA, 20 bp, Artificial Sequence
  chemically synthesized
tttacattttgtggcaaact

SEQ ID NO: 231747 - DNA, 20 bp, Artificial Sequence
  chemically synthesized
tgaaatacatttacattttg

SEQ ID NO: 231748 - DNA, 20 bp, Artificial Sequence
  chemically synthesized
cacaaaatgtaaatgtattt

SEQ ID NO: 231749 - DNA, 20 bp, Artificial Sequence
  chemically synthesized
gtatttcagtaaatgttcta

SEQ ID NO: 231750 - DNA, 20 bp, Artificial Sequence
  chemically synthesized
tatttcagtaaatgttctat

SEQ ID NO: 231751 - DNA, 20 bp, Artificial Sequence
  chemically synthesized
tcaattgtttacaaatccta

SEQ ID NO: 231752 - DNA, 20 bp, Artificial Sequence
  chemically synthesized
aggatttgtaaacaattgaa

SEQ ID NO: 231753 - DNA, 20 bp, Artificial Sequence
  chemically synthesized
tgcagttgtaaaagaaataa

SEQ ID NO: 231754 - DNA, 20 bp, Artificial Sequence
  chemically synthesized
ttattatgttgcagttgtaa

SEQ ID NO: 231755 - DNA, 20 bp, Artificial Sequence
  chemically synthesized
ttataatgtttattatgttg

SEQ ID NO: 231756 - DNA, 20 bp, Artificial Sequence
  chemically synthesized
attataataatatacctttc

SEQ ID NO: 231757 - DNA, 20 bp, Artificial Sequence
  chemically synthesized
attctatatcattaccagaa

SEQ ID NO: 231758 - DNA, 20 bp, Artificial Sequence
  chemically synthesized
aattctatatcattaccaga

SEQ ID NO: 231759 - DNA, 20 bp, Artificial Sequence
  chemically synthesized
aaaaaattctatatcattac

SEQ ID NO: 231760 - DNA, 20 bp, Artificial Sequence
  chemically synthesized
atacctttctggtaatgata

SEQ ID NO: 231761 - DNA, 20 bp, Artificial Sequence
  chemically synthesized
atgatatagaattttttatc

SEQ ID NO: 231762 - DNA, 20 bp, Artificial Sequence
  chemically synthesized
ttggcagaactatttgtcac

SEQ ID NO: 231763 - DNA, 20 bp, Artificial Sequence
  chemically synthesized
attttttatctggtgacaaa

SEQ ID NO: 231764 - DNA, 20 bp, Artificial Sequence
  chemically synthesized
gtgacaaatagttctgccaa

SEQ ID NO: 231765 - DNA, 20 bp, Artificial Sequence
  chemically synthesized
ttactttatctgtcttttgg

SEQ ID NO: 231766 - DNA, 20 bp, Artificial Sequence
  chemically synthesized
caaatagttctgccaaaaga

SEQ ID NO: 231767 - DNA, 20 bp, Artificial Sequence
  chemically synthesized
gatttactttatctgtcttt

SEQ ID NO: 231768 - DNA, 20 bp, Artificial Sequence
  chemically synthesized
gttctgccaaaagacagata

SEQ ID NO: 231769 - DNA, 20 bp, Artificial Sequence
  chemically synthesized
cagataaagtaaatcaaatg

SEQ ID NO: 231770 - DNA, 20 bp, Artificial Sequence
  chemically synthesized
agataaagtaaatcaaatgc

SEQ ID NO: 231771 - DNA, 20 bp, Artificial Sequence
  chemically synthesized
ggcgtaacatctatattatg

SEQ ID NO: 231772 - DNA, 20 bp, Artificial Sequence
  chemically synthesized
ctacacacatctacataata

SEQ ID NO: 231773 - DNA, 20 bp, Artificial Sequence
  chemically synthesized
ctatattatgtagatgtgtg

SEQ ID NO: 231774 - DNA, 20 bp, Artificial Sequence
  chemically synthesized
tagatgtgtgtagttattac

SEQ ID NO: 231775 - DNA, 20 bp, Artificial Sequence
  chemically synthesized
atgtgtgtagttattactag

SEQ ID NO: 231776 - DNA, 20 bp, Artificial Sequence
  chemically synthesized
gtgtgtagttattactagtg

SEQ ID NO: 231777 - DNA, 20 bp, Artificial Sequence
  chemically synthesized
taaatcatattaatctccac

SEQ ID NO: 231778 - DNA, 20 bp, Artificial Sequence
  chemically synthesized
aatatgatttattatgctta

SEQ ID NO: 231779 - DNA, 20 bp, Artificial Sequence
  chemically synthesized
atatgatttattatgcttat

SEQ ID NO: 231780 - DNA, 20 bp, Artificial Sequence
  chemically synthesized
aggtcaaacaaatgacctat

SEQ ID NO: 231781 - DNA, 20 bp, Artificial Sequence
  chemically synthesized
ggtcatttgtttgaccttta

SEQ ID NO: 231782 - DNA, 20 bp, Artificial Sequence
  chemically synthesized
gaaatggcattttactataa

SEQ ID NO: 231783 - DNA, 20 bp, Artificial Sequence
  chemically synthesized
tgaaatggcattttactata

SEQ ID NO: 231784 - DNA, 20 bp, Artificial Sequence
  chemically synthesized
tatgtaagaaggatatgaaa

SEQ ID NO: 231785 - DNA, 20 bp, Artificial Sequence
  chemically synthesized
aataataacaatatgtaaga

SEQ ID NO: 231786 - DNA, 20 bp, Artificial Sequence
  chemically synthesized
taataataacaatatgtaag

SEQ ID NO: 231787 - DNA, 20 bp, Artificial Sequence
  chemically synthesized
ggttaataataacaatatgt

SEQ ID NO: 231788 - DNA, 20 bp, Artificial Sequence
  chemically synthesized
ttgttattattaacctccat

SEQ ID NO: 231789 - DNA, 20 bp, Artificial Sequence
  chemically synthesized
caaaaatatatgactaatgg

SEQ ID NO: 231790 - DNA, 20 bp, Artificial Sequence
  chemically synthesized
acaaaaatatatgactaatg

SEQ ID NO: 231791 - DNA, 20 bp, Artificial Sequence
  chemically synthesized
ttacaaaaatatatgactaa

SEQ ID NO: 231792 - DNA, 20 bp, Artificial Sequence
  chemically synthesized
atatataatggatttagaga

SEQ ID NO: 231793 - DNA, 20 bp, Artificial Sequence
  chemically synthesized
aatatataatggatttagag

SEQ ID NO: 231794 - DNA, 20 bp, Artificial Sequence
  chemically synthesized
taaaatatataatggattta

SEQ ID NO: 231795 - DNA, 20 bp, Artificial Sequence
  chemically synthesized
tttaaaatatataatggatt

SEQ ID NO: 231796 - DNA, 20 bp, Artificial Sequence
  chemically synthesized
ccaagttttaaaatatataa

SEQ ID NO: 231797 - DNA, 20 bp, Artificial Sequence
  chemically synthesized
ccattatatattttaaaact

SEQ ID NO: 231798 - DNA, 20 bp, Artificial Sequence
  chemically synthesized
agcaaaataaatcataaacc

SEQ ID NO: 231799 - DNA, 20 bp, Artificial Sequence
  chemically synthesized
ttatgatttattttgctcta

SEQ ID NO: 231800 - DNA, 20 bp, Artificial Sequence
  chemically synthesized
tgatttattttgctctatgg

SEQ ID NO: 231801 - DNA, 20 bp, Artificial Sequence
  chemically synthesized
gatagtttaaagcttccata

SEQ ID NO: 231802 - DNA, 20 bp, Artificial Sequence
  chemically synthesized
ctgatagtttaaagcttcca

SEQ ID NO: 231803 - DNA, 20 bp, Artificial Sequence
  chemically synthesized
ctgaattaactgatagttta

SEQ ID NO: 231804 - DNA, 20 bp, Artificial Sequence
  chemically synthesized
ctatggaagctttaaactat

SEQ ID NO: 231805 - DNA, 20 bp, Artificial Sequence
  chemically synthesized
tggcagactgaattaactga

SEQ ID NO: 231806 - DNA, 20 bp, Artificial Sequence
  chemically synthesized
ctttaaactatcagttaatt

SEQ ID NO: 231807 - DNA, 20 bp, Artificial Sequence
  chemically synthesized
gacttaaaacataaaattgg

SEQ ID NO: 231808 - DNA, 20 bp, Artificial Sequence
  chemically synthesized
gaagacttaaaacataaaat

SEQ ID NO: 231809 - DNA, 20 bp, Artificial Sequence
  chemically synthesized
gtctgccaattttatgtttt

SEQ ID NO: 231810 - DNA, 20 bp, Artificial Sequence
  chemically synthesized
attttatgttttaagtcttc

SEQ ID NO: 231811 - DNA, 20 bp, Artificial Sequence
  chemically synthesized
ttttatgttttaagtcttcc

SEQ ID NO: 231812 - DNA, 20 bp, Artificial Sequence
  chemically synthesized
tggtaagtcaggaagcctgg

SEQ ID NO: 231813 - DNA, 20 bp, Artificial Sequence
  chemically synthesized
ttttggtaagtcaggaagcc

SEQ ID NO: 231814 - DNA, 20 bp, Artificial Sequence
  chemically synthesized
cagatttttggtaagtcagg

SEQ ID NO: 231815 - DNA, 20 bp, Artificial Sequence
  chemically synthesized
agacagatttttggtaagtc

SEQ ID NO: 231816 - DNA, 20 bp, Artificial Sequence
  chemically synthesized
gagacagatttttggtaagt

SEQ ID NO: 231817 - DNA, 20 bp, Artificial Sequence
  chemically synthesized
atgggagacagatttttggt

SEQ ID NO: 231818 - DNA, 20 bp, Artificial Sequence
  chemically synthesized
cttcatgggagacagatttt

SEQ ID NO: 231819 - DNA, 20 bp, Artificial Sequence
  chemically synthesized
tttataagcttcatgggaga

SEQ ID NO: 231820 - DNA, 20 bp, Artificial Sequence
  chemically synthesized
ccaaaaatctgtctcccatg

SEQ ID NO: 231821 - DNA, 20 bp, Artificial Sequence
  chemically synthesized
ggactttataagcttcatgg

SEQ ID NO: 231822 - DNA, 20 bp, Artificial Sequence
  chemically synthesized
taggactttataagcttcat

SEQ ID NO: 231823 - DNA, 20 bp, Artificial Sequence
  chemically synthesized
gtaggactttataagcttca

SEQ ID NO: 231824 - DNA, 20 bp, Artificial Sequence
  chemically synthesized
tgtctcccatgaagcttata

SEQ ID NO: 231825 - DNA, 20 bp, Artificial Sequence
  chemically synthesized
aggaaagtgtaggactttat

SEQ ID NO: 231826 - DNA, 20 bp, Artificial Sequence
  chemically synthesized
taaacaataaaggaaagtgt

SEQ ID NO: 231827 - DNA, 20 bp, Artificial Sequence
  chemically synthesized
ataaacaataaaggaaagtg

SEQ ID NO: 231828 - DNA, 20 bp, Artificial Sequence
  chemically synthesized
ttcatataaacaataaagga

SEQ ID NO: 231829 - DNA, 20 bp, Artificial Sequence
  chemically synthesized
taaattcatataaacaataa

SEQ ID NO: 231830 - DNA, 20 bp, Artificial Sequence
  chemically synthesized
ataaattcatataaacaata

SEQ ID NO: 231831 - DNA, 20 bp, Artificial Sequence
  chemically synthesized
tttatatgaatttatatttc

SEQ ID NO: 231832 - DNA, 20 bp, Artificial Sequence
  chemically synthesized
tatgaatttatatttctagt

SEQ ID NO: 231833 - DNA, 20 bp, Artificial Sequence
  chemically synthesized
tactagattaaggagctaac

SEQ ID NO: 231834 - DNA, 20 bp, Artificial Sequence
  chemically synthesized
ttctagttagctccttaatc

SEQ ID NO: 231835 - DNA, 20 bp, Artificial Sequence
  chemically synthesized
aaacgccctactagattaag

SEQ ID NO: 231836 - DNA, 20 bp, Artificial Sequence
  chemically synthesized
aaaaacgccctactagatta

SEQ ID NO: 231837 - DNA, 20 bp, Artificial Sequence
  chemically synthesized
tagttagctccttaatctag

SEQ ID NO: 231838 - DNA, 20 bp, Artificial Sequence
  chemically synthesized
aaaaaacgccctactagatt

SEQ ID NO: 231839 - DNA, 20 bp, Artificial Sequence
  chemically synthesized
agttagctccttaatctagt

SEQ ID NO: 231840 - DNA, 20 bp, Artificial Sequence
  chemically synthesized
gttagctccttaatctagta

SEQ ID NO: 231841 - DNA, 20 bp, Artificial Sequence
  chemically synthesized
agaccaaaaaaacgccctac

SEQ ID NO: 231842 - DNA, 20 bp, Artificial Sequence
  chemically synthesized
aatctagtagggcgtttttt

SEQ ID NO: 231843 - DNA, 20 bp, Artificial Sequence
  chemically synthesized
tagggcgtttttttggtcta

SEQ ID NO: 231844 - DNA, 20 bp, Artificial Sequence
  chemically synthesized
tgtacctataagtttaacta

SEQ ID NO: 231845 - DNA, 20 bp, Artificial Sequence
  chemically synthesized
ttggtctatagttaaactta

SEQ ID NO: 231846 - DNA, 20 bp, Artificial Sequence
  chemically synthesized
tggtctatagttaaacttat

SEQ ID NO: 231847 - DNA, 20 bp, Artificial Sequence
  chemically synthesized
ttgactattcatgtacctat

SEQ ID NO: 231848 - DNA, 20 bp, Artificial Sequence
  chemically synthesized
taaacttataggtacatgaa

SEQ ID NO: 231849 - DNA, 20 bp, Artificial Sequence
  chemically synthesized
gtacatgaatagtcaattac

SEQ ID NO: 231850 - DNA, 20 bp, Artificial Sequence
  chemically synthesized
attacgagacactatttatt

SEQ ID NO: 231851 - DNA, 20 bp, Artificial Sequence
  chemically synthesized
agcctatttcacttaataaa

SEQ ID NO: 231852 - DNA, 20 bp, Artificial Sequence
  chemically synthesized
acactatttattaagtgaaa

SEQ ID NO: 231853 - DNA, 20 bp, Artificial Sequence
  chemically synthesized
cactatttattaagtgaaat

SEQ ID NO: 231854 - DNA, 20 bp, Artificial Sequence
  chemically synthesized
agtgaaataggctatccaca

SEQ ID NO: 231855 - DNA, 20 bp, Artificial Sequence
  chemically synthesized
atattttagttctgtgtgga

SEQ ID NO: 231856 - DNA, 20 bp, Artificial Sequence
  chemically synthesized
ttggatattttagttctgtg

SEQ ID NO: 231857 - DNA, 20 bp, Artificial Sequence
  chemically synthesized
ccaaataagattggatattt

SEQ ID NO: 231858 - DNA, 20 bp, Artificial Sequence
  chemically synthesized
ggaaaacatccaaataagat

SEQ ID NO: 231859 - DNA, 20 bp, Artificial Sequence
  chemically synthesized
ctaaaatatccaatcttatt

SEQ ID NO: 231860 - DNA, 20 bp, Artificial Sequence
  chemically synthesized
gtccaggaaaacatccaaat

SEQ ID NO: 231861 - DNA, 20 bp, Artificial Sequence
  chemically synthesized
atcttatttggatgttttcc

SEQ ID NO: 231862 - DNA, 20 bp, Artificial Sequence
  chemically synthesized
tggtttacaagtgagagtcc

SEQ ID NO: 231863 - DNA, 20 bp, Artificial Sequence
  chemically synthesized
gtggtttacaagtgagagtc

SEQ ID NO: 231864 - DNA, 20 bp, Artificial Sequence
  chemically synthesized
ggttagtggtttacaagtga

SEQ ID NO: 231865 - DNA, 20 bp, Artificial Sequence
  chemically synthesized
tgggttagtggtttacaagt

SEQ ID NO: 231866 - DNA, 20 bp, Artificial Sequence
  chemically synthesized
gaaatgggttagtggtttac

SEQ ID NO: 231867 - DNA, 20 bp, Artificial Sequence
  chemically synthesized
aggctagagaaatgggttag

SEQ ID NO: 231868 - DNA, 20 bp, Artificial Sequence
  chemically synthesized
ataaggctagagaaatgggt

SEQ ID NO: 231869 - DNA, 20 bp, Artificial Sequence
  chemically synthesized
aaaccactaacccatttctc

SEQ ID NO: 231870 - DNA, 20 bp, Artificial Sequence
  chemically synthesized
tggcataaggctagagaaat

SEQ ID NO: 231871 - DNA, 20 bp, Artificial Sequence
  chemically synthesized
ctggcataaggctagagaaa

SEQ ID NO: 231872 - DNA, 20 bp, Artificial Sequence
  chemically synthesized
agtgtgctggcataaggcta

SEQ ID NO: 231873 - DNA, 20 bp, Artificial Sequence
  chemically synthesized
acagtgtgctggcataaggc

SEQ ID NO: 231874 - DNA, 20 bp, Artificial Sequence
  chemically synthesized
ccatttctctagccttatgc

SEQ ID NO: 231875 - DNA, 20 bp, Artificial Sequence
  chemically synthesized
aaccacagtgtgctggcata

SEQ ID NO: 231876 - DNA, 20 bp, Artificial Sequence
  chemically synthesized
aaaccacagtgtgctggcat

SEQ ID NO: 231877 - DNA, 20 bp, Artificial Sequence
  chemically synthesized
tgatcaaaaccacagtgtgc

SEQ ID NO: 231878 - DNA, 20 bp, Artificial Sequence
  chemically synthesized
agccttatgccagcacactg

SEQ ID NO: 231879 - DNA, 20 bp, Artificial Sequence
  chemically synthesized
agtaattgtgatcaaaacca

SEQ ID NO: 231880 - DNA, 20 bp, Artificial Sequence
  chemically synthesized
ttttgatcacaattacttca

SEQ ID NO: 231881 - DNA, 20 bp, Artificial Sequence
  chemically synthesized
atcacaattacttcaaagta

SEQ ID NO: 231882 - DNA, 20 bp, Artificial Sequence
  chemically synthesized
cagatttctactatactttg

SEQ ID NO: 231883 - DNA, 20 bp, Artificial Sequence
  chemically synthesized
acaattacttcaaagtatag

SEQ ID NO: 231884 - DNA, 20 bp, Artificial Sequence
  chemically synthesized
ttcaaagtatagtagaaatc

SEQ ID NO: 231885 - DNA, 20 bp, Artificial Sequence
  chemically synthesized
aaagtatagtagaaatctgg

SEQ ID NO: 231886 - DNA, 20 bp, Artificial Sequence
  chemically synthesized
atggcagcaacatacacttc

SEQ ID NO: 231887 - DNA, 20 bp, Artificial Sequence
  chemically synthesized
tattaataagcatattatgg

SEQ ID NO: 231888 - DNA, 20 bp, Artificial Sequence
  chemically synthesized
ttttattaataagcatatta

SEQ ID NO: 231889 - DNA, 20 bp, Artificial Sequence
  chemically synthesized
ttggaaacaattttattaat

SEQ ID NO: 231890 - DNA, 20 bp, Artificial Sequence
  chemically synthesized
gtgtatgtgtgtgtataaat

SEQ ID NO: 231891 - DNA, 20 bp, Artificial Sequence
  chemically synthesized
taatttaaagtttatataga

SEQ ID NO: 231892 - DNA, 20 bp, Artificial Sequence
  chemically synthesized
gtaatttaaagtttatatag

SEQ ID NO: 231893 - DNA, 20 bp, Artificial Sequence
  chemically synthesized
gatgtaatttaaagtttata

SEQ ID NO: 231894 - DNA, 20 bp, Artificial Sequence
  chemically synthesized
ataggcaatgatgtaattta

SEQ ID NO: 231895 - DNA, 20 bp, Artificial Sequence
  chemically synthesized
aatataatttcaaaggaaat

SEQ ID NO: 231896 - DNA, 20 bp, Artificial Sequence
  chemically synthesized
caatataatttcaaaggaaa

SEQ ID NO: 231897 - DNA, 20 bp, Artificial Sequence
  chemically synthesized
tgggggcaatataatttcaa

SEQ ID NO: 231898 - DNA, 20 bp, Artificial Sequence
  chemically synthesized
ttgggggcaatataatttca

SEQ ID NO: 231899 - DNA, 20 bp, Artificial Sequence
  chemically synthesized
aatgcttttgatgtgtttgg

SEQ ID NO: 231900 - DNA, 20 bp, Artificial Sequence
  chemically synthesized
gaatgcttttgatgtgtttg

SEQ ID NO: 231901 - DNA, 20 bp, Artificial Sequence
  chemically synthesized
agaatgcttttgatgtgttt

SEQ ID NO: 231902 - DNA, 20 bp, Artificial Sequence
  chemically synthesized
cagaatgcttttgatgtgtt

SEQ ID NO: 231903 - DNA, 20 bp, Artificial Sequence
  chemically synthesized
attgcccccaaacacatcaa

SEQ ID NO: 231904 - DNA, 20 bp, Artificial Sequence
  chemically synthesized
gaatttaatacagttataat

SEQ ID NO: 231905 - DNA, 20 bp, Artificial Sequence
  chemically synthesized
gttaacatttgaatttaata

SEQ ID NO: 231906 - DNA, 20 bp, Artificial Sequence
  chemically synthesized
attaaattcaaatgttaact

SEQ ID NO: 231907 - DNA, 20 bp, Artificial Sequence
  chemically synthesized
aattcaaatgttaacttggc

SEQ ID NO: 231908 - DNA, 20 bp, Artificial Sequence
  chemically synthesized
ttaaacttgcaataccagcc

SEQ ID NO: 231909 - DNA, 20 bp, Artificial Sequence
  chemically synthesized
gttaacttggctggtattgc

SEQ ID NO: 231910 - DNA, 20 bp, Artificial Sequence
  chemically synthesized
tgtcattaaacttgcaatac

SEQ ID NO: 231911 - DNA, 20 bp, Artificial Sequence
  chemically synthesized
gtaggattgttttaggattt

SEQ ID NO: 231912 - DNA, 20 bp, Artificial Sequence
  chemically synthesized
tgactacgtaggattgtttt

SEQ ID NO: 231913 - DNA, 20 bp, Artificial Sequence
  chemically synthesized
ttgactacgtaggattgttt

SEQ ID NO: 231914 - DNA, 20 bp, Artificial Sequence
  chemically synthesized
aatcctaaaacaatcctacg

SEQ ID NO: 231915 - DNA, 20 bp, Artificial Sequence
  chemically synthesized
aaagcaaaaattgactacgt

SEQ ID NO: 231916 - DNA, 20 bp, Artificial Sequence
  chemically synthesized
aaaagcaaaaattgactacg

SEQ ID NO: 231917 - DNA, 20 bp, Artificial Sequence
  chemically synthesized
ataaaaatatacataagaaa

SEQ ID NO: 231918 - DNA, 20 bp, Artificial Sequence
  chemically synthesized
aaaagcataaaaatatacat

SEQ ID NO: 231919 - DNA, 20 bp, Artificial Sequence
  chemically synthesized
ttgtagaccctataggtgaa

SEQ ID NO: 231920 - DNA, 20 bp, Artificial Sequence
  chemically synthesized
atttttatgcttttcaccta

SEQ ID NO: 231921 - DNA, 20 bp, Artificial Sequence
  chemically synthesized
tttttatgcttttcacctat

SEQ ID NO: 231922 - DNA, 20 bp, Artificial Sequence
  chemically synthesized
ttttatgcttttcacctata

SEQ ID NO: 231923 - DNA, 20 bp, Artificial Sequence
  chemically synthesized
ataaaaattgtagaccctat

SEQ ID NO: 231924 - DNA, 20 bp, Artificial Sequence
  chemically synthesized
aataaaaattgtagacccta

SEQ ID NO: 231925 - DNA, 20 bp, Artificial Sequence
  chemically synthesized
ttaaggaggaataaaaattg

SEQ ID NO: 231926 - DNA, 20 bp, Artificial Sequence
  chemically synthesized
tgacaatgtataaattaagg

SEQ ID NO: 231927 - DNA, 20 bp, Artificial Sequence
  chemically synthesized
atgacaatgtataaattaag

SEQ ID NO: 231928 - DNA, 20 bp, Artificial Sequence
  chemically synthesized
tgatgacaatgtataaatta

SEQ ID NO: 231929 - DNA, 20 bp, Artificial Sequence
  chemically synthesized
ctgatgacaatgtataaatt

SEQ ID NO: 231930 - DNA, 20 bp, Artificial Sequence
  chemically synthesized
cttaatttatacattgtcat

SEQ ID NO: 231931 - DNA, 20 bp, Artificial Sequence
  chemically synthesized
ttaatgactataaatgcaaa

SEQ ID NO: 231932 - DNA, 20 bp, Artificial Sequence
  chemically synthesized
aatatttccatttgcattta

SEQ ID NO: 231933 - DNA, 20 bp, Artificial Sequence
  chemically synthesized
atagtcattaatatgaataa

SEQ ID NO: 231934 - DNA, 20 bp, Artificial Sequence
  chemically synthesized
ctttatgaatagatacataa

SEQ ID NO: 231935 - DNA, 20 bp, Artificial Sequence
  chemically synthesized
ctattatgtatctattcata

SEQ ID NO: 231936 - DNA, 20 bp, Artificial Sequence
  chemically synthesized
ttttaaaaatactttatgaa

SEQ ID NO: 231937 - DNA, 20 bp, Artificial Sequence
  chemically synthesized
gtatttttaaaattatttca

SEQ ID NO: 231938 - DNA, 20 bp, Artificial Sequence
  chemically synthesized
atttcacagattttaaaatt

SEQ ID NO: 231939 - DNA, 20 bp, Artificial Sequence
  chemically synthesized
gattttaaaattgagtctcc

SEQ ID NO: 231940 - DNA, 20 bp, Artificial Sequence
  chemically synthesized
attttaaaattgagtctcct

SEQ ID NO: 231941 - DNA, 20 bp, Artificial Sequence
  chemically synthesized
attgtgcagagaaaacctag

SEQ ID NO: 231942 - DNA, 20 bp, Artificial Sequence
  chemically synthesized
ttattgtgcagagaaaacct

SEQ ID NO: 231943 - DNA, 20 bp, Artificial Sequence
  chemically synthesized
attattgtgcagagaaaacc

SEQ ID NO: 231944 - DNA, 20 bp, Artificial Sequence
  chemically synthesized
ttaaataggattattgtgca

SEQ ID NO: 231945 - DNA, 20 bp, Artificial Sequence
  chemically synthesized
tgttaaataggattattgtg

SEQ ID NO: 231946 - DNA, 20 bp, Artificial Sequence
  chemically synthesized
aagaaaaattattgttaaat

SEQ ID NO: 231947 - DNA, 20 bp, Artificial Sequence
  chemically synthesized
gaagaaaaattattgttaaa

SEQ ID NO: 231948 - DNA, 20 bp, Artificial Sequence
  chemically synthesized
aagaagaaatatttttaaag

SEQ ID NO: 231949 - DNA, 20 bp, Artificial Sequence
  chemically synthesized
ggaaagaagaaatattttta

SEQ ID NO: 231950 - DNA, 20 bp, Artificial Sequence
  chemically synthesized
tgataacctcaaaaggaaag

SEQ ID NO: 231951 - DNA, 20 bp, Artificial Sequence
  chemically synthesized
aatatttcttctttcctttt

SEQ ID NO: 231952 - DNA, 20 bp, Artificial Sequence
  chemically synthesized
taatgataacctcaaaagga

SEQ ID NO: 231953 - DNA, 20 bp, Artificial Sequence
  chemically synthesized
atatttcttctttccttttg

SEQ ID NO: 231954 - DNA, 20 bp, Artificial Sequence
  chemically synthesized
atagtaatgataacctcaaa

SEQ ID NO: 231955 - DNA, 20 bp, Artificial Sequence
  chemically synthesized
aatagtaatgataacctcaa

SEQ ID NO: 231956 - DNA, 20 bp, Artificial Sequence
  chemically synthesized
ctccacctctaaaataataa

SEQ ID NO: 231957 - DNA, 20 bp, Artificial Sequence
  chemically synthesized
tatcattactattattattt

SEQ ID NO: 231958 - DNA, 20 bp, Artificial Sequence
  chemically synthesized
tcattactattattatttta

SEQ ID NO: 231959 - DNA, 20 bp, Artificial Sequence
  chemically synthesized
cattactattattattttag

SEQ ID NO: 231960 - DNA, 20 bp, Artificial Sequence
  chemically synthesized
tactattattattttagagg

SEQ ID NO: 231961 - DNA, 20 bp, Artificial Sequence
  chemically synthesized
ctattattattttagaggtg

SEQ ID NO: 231962 - DNA, 20 bp, Artificial Sequence
  chemically synthesized
tattattattttagaggtgg

SEQ ID NO: 231963 - DNA, 20 bp, Artificial Sequence
  chemically synthesized
tgaaataagtcaaaagtagc

SEQ ID NO: 231964 - DNA, 20 bp, Artificial Sequence
  chemically synthesized
ctcatgaaataagtcaaaag

SEQ ID NO: 231965 - DNA, 20 bp, Artificial Sequence
  chemically synthesized
tagctcatgaaataagtcaa

SEQ ID NO: 231966 - DNA, 20 bp, Artificial Sequence
  chemically synthesized
ctacttttgacttatttcat

SEQ ID NO: 231967 - DNA, 20 bp, Artificial Sequence
  chemically synthesized
cttggtctagctcatgaaat

SEQ ID NO: 231968 - DNA, 20 bp, Artificial Sequence
  chemically synthesized
ttttgacttatttcatgagc

SEQ ID NO: 231969 - DNA, 20 bp, Artificial Sequence
  chemically synthesized
cttatttcatgagctagacc

SEQ ID NO: 231970 - DNA, 20 bp, Artificial Sequence
  chemically synthesized
caaatttgctttgcttggtc

SEQ ID NO: 231971 - DNA, 20 bp, Artificial Sequence
  chemically synthesized
ttcatgagctagaccaagca

SEQ ID NO: 231972 - DNA, 20 bp, Artificial Sequence
  chemically synthesized
gttttcaaatttgctttgct

SEQ ID NO: 231973 - DNA, 20 bp, Artificial Sequence
  chemically synthesized
tatcaaatttttatttttca

SEQ ID NO: 231974 - DNA, 20 bp, Artificial Sequence
  chemically synthesized
ataatttttaacgttgacaa

SEQ ID NO: 231975 - DNA, 20 bp, Artificial Sequence
  chemically synthesized
tgacaatggtgcttctttac

SEQ ID NO: 231976 - DNA, 20 bp, Artificial Sequence
  chemically synthesized
gacaatggtgcttctttact

SEQ ID NO: 231977 - DNA, 20 bp, Artificial Sequence
  chemically synthesized
ttgctgacaccctagtaaag

SEQ ID NO: 231978 - DNA, 20 bp, Artificial Sequence
  chemically synthesized
acaatggtgcttctttacta

SEQ ID NO: 231979 - DNA, 20 bp, Artificial Sequence
  chemically synthesized
agtttgctgacaccctagta

SEQ ID NO: 231980 - DNA, 20 bp, Artificial Sequence
  chemically synthesized
gtgcttctttactagggtgt

SEQ ID NO: 231981 - DNA, 20 bp, Artificial Sequence
  chemically synthesized
tttgtagtttgctgacaccc

SEQ ID NO: 231982 - DNA, 20 bp, Artificial Sequence
  chemically synthesized
agttgttttttttttttttg

SEQ ID NO: 231983 - DNA, 20 bp, Artificial Sequence
  chemically synthesized
aatacaaagtttgcaaaaca

SEQ ID NO: 231984 - DNA, 20 bp, Artificial Sequence
  chemically synthesized
aataaaattttataaataca

SEQ ID NO: 231985 - DNA, 20 bp, Artificial Sequence
  chemically synthesized
tatttataaaattttattga

SEQ ID NO: 231986 - DNA, 20 bp, Artificial Sequence
  chemically synthesized
ataaaattttattgaaagca

SEQ ID NO: 231987 - DNA, 20 bp, Artificial Sequence
  chemically synthesized
taaaattttattgaaagcac

SEQ ID NO: 231988 - DNA, 20 bp, Artificial Sequence
  chemically synthesized
tggacaatacttaaattagt

SEQ ID NO: 231989 - DNA, 20 bp, Artificial Sequence
  chemically synthesized
acaggcacacctactaattt

SEQ ID NO: 231990 - DNA, 20 bp, Artificial Sequence
  chemically synthesized
atggacaatacttaaattag

SEQ ID NO: 231991 - DNA, 20 bp, Artificial Sequence
  chemically synthesized
gctatggacaatacttaaat

SEQ ID NO: 231992 - DNA, 20 bp, Artificial Sequence
  chemically synthesized
actaatttaagtattgtcca

SEQ ID NO: 231993 - DNA, 20 bp, Artificial Sequence
  chemically synthesized
tgtggcattggaagcagcta

SEQ ID NO: 231994 - DNA, 20 bp, Artificial Sequence
  chemically synthesized
tgcagttgtggcattggaag

SEQ ID NO: 231995 - DNA, 20 bp, Artificial Sequence
  chemically synthesized
ttctgcagttgtggcattgg

SEQ ID NO: 231996 - DNA, 20 bp, Artificial Sequence
  chemically synthesized
tgattctgcagttgtggcat

SEQ ID NO: 231997 - DNA, 20 bp, Artificial Sequence
  chemically synthesized
tgcttccaatgccacaactg

SEQ ID NO: 231998 - DNA, 20 bp, Artificial Sequence
  chemically synthesized
tttacttgattctgcagttg

SEQ ID NO: 231999 - DNA, 20 bp, Artificial Sequence
  chemically synthesized
aatgccacaactgcagaatc

SEQ ID NO: 232000 - DNA, 20 bp, Artificial Sequence
  chemically synthesized
gtcacatttacttgattctg

SEQ ID NO: 232001 - DNA, 20 bp, Artificial Sequence
  chemically synthesized
gcagaatcaagtaaatgtga

SEQ ID NO: 232002 - DNA, 20 bp, Artificial Sequence
  chemically synthesized
agaatcaagtaaatgtgaca

SEQ ID NO: 232003 - DNA, 20 bp, Artificial Sequence
  chemically synthesized
taaatgtgacagagactatt

SEQ ID NO: 232004 - DNA, 20 bp, Artificial Sequence
  chemically synthesized
aaatgtgacagagactattt

SEQ ID NO: 232005 - DNA, 20 bp, Artificial Sequence
  chemically synthesized
tttaagttttgtggcccaaa

SEQ ID NO: 232006 - DNA, 20 bp, Artificial Sequence
  chemically synthesized
agtaaatattttaagttttg

SEQ ID NO: 232007 - DNA, 20 bp, Artificial Sequence
  chemically synthesized
gggcagatagtaaatatttt

SEQ ID NO: 232008 - DNA, 20 bp, Artificial Sequence
  chemically synthesized
ttcttctgtaatggggcaga

SEQ ID NO: 232009 - DNA, 20 bp, Artificial Sequence
  chemically synthesized
ttttttcttctgtaatgggg

SEQ ID NO: 232010 - DNA, 20 bp, Artificial Sequence
  chemically synthesized
atttactatctgccccatta

SEQ ID NO: 232011 - DNA, 20 bp, Artificial Sequence
  chemically synthesized
gcattttttcttctgtaatg

SEQ ID NO: 232012 - DNA, 20 bp, Artificial Sequence
  chemically synthesized
tactatctgccccattacag

SEQ ID NO: 232013 - DNA, 20 bp, Artificial Sequence
  chemically synthesized
tgcattttttcttctgtaat

SEQ ID NO: 232014 - DNA, 20 bp, Artificial Sequence
  chemically synthesized
ctgcattttttcttctgtaa

SEQ ID NO: 232015 - DNA, 20 bp, Artificial Sequence
  chemically synthesized
ccattacagaagaaaaaatg

SEQ ID NO: 232016 - DNA, 20 bp, Artificial Sequence
  chemically synthesized
aaaggaaggagaaggataaa

SEQ ID NO: 232017 - DNA, 20 bp, Artificial Sequence
  chemically synthesized
taaaaggaaggagaaggata

SEQ ID NO: 232018 - DNA, 20 bp, Artificial Sequence
  chemically synthesized
gcgtagtaaaaggaaggaga

SEQ ID NO: 232019 - DNA, 20 bp, Artificial Sequence
  chemically synthesized
tgcgtagtaaaaggaaggag

SEQ ID NO: 232020 - DNA, 20 bp, Artificial Sequence
  chemically synthesized
tgctgcgtagtaaaaggaag

SEQ ID NO: 232021 - DNA, 20 bp, Artificial Sequence
  chemically synthesized
cctgctgcgtagtaaaagga

SEQ ID NO: 232022 - DNA, 20 bp, Artificial Sequence
  chemically synthesized
gcctgctgcgtagtaaaagg

SEQ ID NO: 232023 - DNA, 20 bp, Artificial Sequence
  chemically synthesized
tatgcctgctgcgtagtaaa

SEQ ID NO: 232024 - DNA, 20 bp, Artificial Sequence
  chemically synthesized
gtatgcctgctgcgtagtaa

SEQ ID NO: 232025 - DNA, 20 bp, Artificial Sequence
  chemically synthesized
ttctccttccttttactacg

SEQ ID NO: 232026 - DNA, 20 bp, Artificial Sequence
  chemically synthesized
tccttccttttactacgcag

SEQ ID NO: 232027 - DNA, 20 bp, Artificial Sequence
  chemically synthesized
ccttccttttactacgcagc

SEQ ID NO: 232028 - DNA, 20 bp, Artificial Sequence
  chemically synthesized
ctagaagtatgcctgctgcg

SEQ ID NO: 232029 - DNA, 20 bp, Artificial Sequence
  chemically synthesized
ctacgcagcaggcatacttc

SEQ ID NO: 232030 - DNA, 20 bp, Artificial Sequence
  chemically synthesized
tacgcagcaggcatacttct

SEQ ID NO: 232031 - DNA, 20 bp, Artificial Sequence
  chemically synthesized
gaaaaaaaaaaaaatcctag

SEQ ID NO: 232032 - DNA, 20 bp, Artificial Sequence
  chemically synthesized
taggaaaaaaaaaaaaatcc

SEQ ID NO: 232033 - DNA, 20 bp, Artificial Sequence
  chemically synthesized
gaaataatatgtggttatat

SEQ ID NO: 232034 - DNA, 20 bp, Artificial Sequence
  chemically synthesized
ggaaataatatgtggttata

SEQ ID NO: 232035 - DNA, 20 bp, Artificial Sequence
  chemically synthesized
aactttgcggaaataatatg

SEQ ID NO: 232036 - DNA, 20 bp, Artificial Sequence
  chemically synthesized
aaccacatattatttccgca

SEQ ID NO: 232037 - DNA, 20 bp, Artificial Sequence
  chemically synthesized
tgtacttcctaataactttg

SEQ ID NO: 232038 - DNA, 20 bp, Artificial Sequence
  chemically synthesized
tattatttccgcaaagttat

SEQ ID NO: 232039 - DNA, 20 bp, Artificial Sequence
  chemically synthesized
attatttccgcaaagttatt

SEQ ID NO: 232040 - DNA, 20 bp, Artificial Sequence
  chemically synthesized
atttccgcaaagttattagg

SEQ ID NO: 232041 - DNA, 20 bp, Artificial Sequence
  chemically synthesized
caaagttattaggaagtaca

SEQ ID NO: 232042 - DNA, 20 bp, Artificial Sequence
  chemically synthesized
aaagttattaggaagtacat

SEQ ID NO: 232043 - DNA, 20 bp, Artificial Sequence
  chemically synthesized
aggaagtacatgggactttc

SEQ ID NO: 232044 - DNA, 20 bp, Artificial Sequence
  chemically synthesized
caatgtgaaatggggctgga

SEQ ID NO: 232045 - DNA, 20 bp, Artificial Sequence
  chemically synthesized
tatccaatgtgaaatggggc

SEQ ID NO: 232046 - DNA, 20 bp, Artificial Sequence
  chemically synthesized
gttttatccaatgtgaaatg

SEQ ID NO: 232047 - DNA, 20 bp, Artificial Sequence
  chemically synthesized
agttttatccaatgtgaaat

SEQ ID NO: 232048 - DNA, 20 bp, Artificial Sequence
  chemically synthesized
cagttttatccaatgtgaaa

SEQ ID NO: 232049 - DNA, 20 bp, Artificial Sequence
  chemically synthesized
tttccagccccatttcacat

SEQ ID NO: 232050 - DNA, 20 bp, Artificial Sequence
  chemically synthesized
atttcacattggataaaact

SEQ ID NO: 232051 - DNA, 20 bp, Artificial Sequence
  chemically synthesized
tttcacattggataaaactg

SEQ ID NO: 232052 - DNA, 20 bp, Artificial Sequence
  chemically synthesized
gacttagcttattcatgcct

SEQ ID NO: 232053 - DNA, 20 bp, Artificial Sequence
  chemically synthesized
gataaaactgaggcatgaat

SEQ ID NO: 232054 - DNA, 20 bp, Artificial Sequence
  chemically synthesized
aactgaggcatgaataagct

SEQ ID NO: 232055 - DNA, 20 bp, Artificial Sequence
  chemically synthesized
gtgacctttggcaggtgact

SEQ ID NO: 232056 - DNA, 20 bp, Artificial Sequence
  chemically synthesized
ataagctaagtcacctgcca

SEQ ID NO: 232057 - DNA, 20 bp, Artificial Sequence
  chemically synthesized
taagctaagtcacctgccaa

SEQ ID NO: 232058 - DNA, 20 bp, Artificial Sequence
  chemically synthesized
ccacccacgtgacctttggc

SEQ ID NO: 232059 - DNA, 20 bp, Artificial Sequence
  chemically synthesized
gccacccacgtgacctttgg

SEQ ID NO: 232060 - DNA, 20 bp, Artificial Sequence
  chemically synthesized
tttgccacccacgtgacctt

SEQ ID NO: 232061 - DNA, 20 bp, Artificial Sequence
  chemically synthesized
gtcacctgccaaaggtcacg

SEQ ID NO: 232062 - DNA, 20 bp, Artificial Sequence
  chemically synthesized
tcacctgccaaaggtcacgt

SEQ ID NO: 232063 - DNA, 20 bp, Artificial Sequence
  chemically synthesized
cctgccaaaggtcacgtggg

SEQ ID NO: 232064 - DNA, 20 bp, Artificial Sequence
  chemically synthesized
acgtgggtggcaaatatctt

SEQ ID NO: 232065 - DNA, 20 bp, Artificial Sequence
  chemically synthesized
ttggggtcaaaattttgctg

SEQ ID NO: 232066 - DNA, 20 bp, Artificial Sequence
  chemically synthesized
cagcaaaattttgaccccaa

SEQ ID NO: 232067 - DNA, 20 bp, Artificial Sequence
  chemically synthesized
aactcatagttaggcttttg

SEQ ID NO: 232068 - DNA, 20 bp, Artificial Sequence
  chemically synthesized
gaactcatagttaggctttt

SEQ ID NO: 232069 - DNA, 20 bp, Artificial Sequence
  chemically synthesized
tgaactcatagttaggcttt

SEQ ID NO: 232070 - DNA, 20 bp, Artificial Sequence
  chemically synthesized
gaccccaaaagcctaactat

SEQ ID NO: 232071 - DNA, 20 bp, Artificial Sequence
  chemically synthesized
acagttatgaactcatagtt

SEQ ID NO: 232072 - DNA, 20 bp, Artificial Sequence
  chemically synthesized
cacagttatgaactcatagt

SEQ ID NO: 232073 - DNA, 20 bp, Artificial Sequence
  chemically synthesized
actgcacagttatgaactca

SEQ ID NO: 232074 - DNA, 20 bp, Artificial Sequence
  chemically synthesized
actatgagttcataactgtg

SEQ ID NO: 232075 - DNA, 20 bp, Artificial Sequence
  chemically synthesized
atgagttcataactgtgcag

SEQ ID NO: 232076 - DNA, 20 bp, Artificial Sequence
  chemically synthesized
gatgaaagggttctactgca

SEQ ID NO: 232077 - DNA, 20 bp, Artificial Sequence
  chemically synthesized
ctatgggaccaaagatgaaa

SEQ ID NO: 232078 - DNA, 20 bp, Artificial Sequence
  chemically synthesized
gctatgggaccaaagatgaa

SEQ ID NO: 232079 - DNA, 20 bp, Artificial Sequence
  chemically synthesized
cagtagaaccctttcatctt

SEQ ID NO: 232080 - DNA, 20 bp, Artificial Sequence
  chemically synthesized
tgctatgggaccaaagatga

SEQ ID NO: 232081 - DNA, 20 bp, Artificial Sequence
  chemically synthesized
tgataagtgctatgggacca

SEQ ID NO: 232082 - DNA, 20 bp, Artificial Sequence
  chemically synthesized
ccctttcatctttggtccca

SEQ ID NO: 232083 - DNA, 20 bp, Artificial Sequence
  chemically synthesized
tacagtatgataagtgctat

SEQ ID NO: 232084 - DNA, 20 bp, Artificial Sequence
  chemically synthesized
atacagtatgataagtgcta

SEQ ID NO: 232085 - DNA, 20 bp, Artificial Sequence
  chemically synthesized
acaaaacaatacagtatgat

SEQ ID NO: 232086 - DNA, 20 bp, Artificial Sequence
  chemically synthesized
aaaaatgtaacaaaacaata

SEQ ID NO: 232087 - DNA, 20 bp, Artificial Sequence
  chemically synthesized
cattttttttattatacttt

SEQ ID NO: 232088 - DNA, 20 bp, Artificial Sequence
  chemically synthesized
ttttattatactttaagttc

SEQ ID NO: 232089 - DNA, 20 bp, Artificial Sequence
  chemically synthesized
cacatgtaccctagaactta

SEQ ID NO: 232090 - DNA, 20 bp, Artificial Sequence
  chemically synthesized
tttattatactttaagttct

SEQ ID NO: 232091 - DNA, 20 bp, Artificial Sequence
  chemically synthesized
ttattatactttaagttcta

SEQ ID NO: 232092 - DNA, 20 bp, Artificial Sequence
  chemically synthesized
catgttgtgcacatgtaccc

SEQ ID NO: 232093 - DNA, 20 bp, Artificial Sequence
  chemically synthesized
gggtacatgtgcacaacatg

SEQ ID NO: 232094 - DNA, 20 bp, Artificial Sequence
  chemically synthesized
ggtacatgtgcacaacatgc

SEQ ID NO: 232095 - DNA, 20 bp, Artificial Sequence
  chemically synthesized
cacatgtatacatatgtaac

SEQ ID NO: 232096 - DNA, 20 bp, Artificial Sequence
  chemically synthesized
acatatgtatacatgtgtaa

SEQ ID NO: 232097 - DNA, 20 bp, Artificial Sequence
  chemically synthesized
tatacatgtgtaatagactg

SEQ ID NO: 232098 - DNA, 20 bp, Artificial Sequence
  chemically synthesized
ggtatgtttacatatagcta

SEQ ID NO: 232099 - DNA, 20 bp, Artificial Sequence
  chemically synthesized
aaagctggtatgtttacata

SEQ ID NO: 232100 - DNA, 20 bp, Artificial Sequence
  chemically synthesized
gtagctatatgtaaacatac

SEQ ID NO: 232101 - DNA, 20 bp, Artificial Sequence
  chemically synthesized
tgtaaacataccagctttct

SEQ ID NO: 232102 - DNA, 20 bp, Artificial Sequence
  chemically synthesized
gaagtaacatctaagaaagc

SEQ ID NO: 232103 - DNA, 20 bp, Artificial Sequence
  chemically synthesized
tgaggaagtaacatctaaga

SEQ ID NO: 232104 - DNA, 20 bp, Artificial Sequence
  chemically synthesized
tttatgaggaagtaacatct

SEQ ID NO: 232105 - DNA, 20 bp, Artificial Sequence
  chemically synthesized
ttagatgttacttcctcata

SEQ ID NO: 232106 - DNA, 20 bp, Artificial Sequence
  chemically synthesized
agggggaggtctttatgagg

SEQ ID NO: 232107 - DNA, 20 bp, Artificial Sequence
  chemically synthesized
tctagggggaggtctttatg

SEQ ID NO: 232108 - DNA, 20 bp, Artificial Sequence
  chemically synthesized
gtctagggggaggtctttat

SEQ ID NO: 232109 - DNA, 20 bp, Artificial Sequence
  chemically synthesized
tcctcataaagacctccccc

SEQ ID NO: 232110 - DNA, 20 bp, Artificial Sequence
  chemically synthesized
aaaatcactggtctaggggg

SEQ ID NO: 232111 - DNA, 20 bp, Artificial Sequence
  chemically synthesized
gaaaatcactggtctagggg

SEQ ID NO: 232112 - DNA, 20 bp, Artificial Sequence
  chemically synthesized
ataaagacctccccctagac

SEQ ID NO: 232113 - DNA, 20 bp, Artificial Sequence
  chemically synthesized
ttgaaaatcactggtctagg

SEQ ID NO: 232114 - DNA, 20 bp, Artificial Sequence
  chemically synthesized
gttgaaaatcactggtctag

SEQ ID NO: 232115 - DNA, 20 bp, Artificial Sequence
  chemically synthesized
agttgaaaatcactggtcta

SEQ ID NO: 232116 - DNA, 20 bp, Artificial Sequence
  chemically synthesized
tagttgaaaatcactggtct

SEQ ID NO: 232117 - DNA, 20 bp, Artificial Sequence
  chemically synthesized
ctagttgaaaatcactggtc

SEQ ID NO: 232118 - DNA, 20 bp, Artificial Sequence
  chemically synthesized
catccctagttgaaaatcac

SEQ ID NO: 232119 - DNA, 20 bp, Artificial Sequence
  chemically synthesized
ctagaccagtgattttcaac

SEQ ID NO: 232120 - DNA, 20 bp, Artificial Sequence
  chemically synthesized
tagaccagtgattttcaact

SEQ ID NO: 232121 - DNA, 20 bp, Artificial Sequence
  chemically synthesized
agaccagtgattttcaacta

SEQ ID NO: 232122 - DNA, 20 bp, Artificial Sequence
  chemically synthesized
ttggggagcaaaatcatccc

SEQ ID NO: 232123 - DNA, 20 bp, Artificial Sequence
  chemically synthesized
tagggatgattttgctcccc

SEQ ID NO: 232124 - DNA, 20 bp, Artificial Sequence
  chemically synthesized
agggatgattttgctcccca

SEQ ID NO: 232125 - DNA, 20 bp, Artificial Sequence
  chemically synthesized
gggatgattttgctccccaa

SEQ ID NO: 232126 - DNA, 20 bp, Artificial Sequence
  chemically synthesized
atttccaaatgtcccttggg

SEQ ID NO: 232127 - DNA, 20 bp, Artificial Sequence
  chemically synthesized
acatttccaaatgtcccttg

SEQ ID NO: 232128 - DNA, 20 bp, Artificial Sequence
  chemically synthesized
gacatttccaaatgtccctt

SEQ ID NO: 232129 - DNA, 20 bp, Artificial Sequence
  chemically synthesized
agacatttccaaatgtccct

SEQ ID NO: 232130 - DNA, 20 bp, Artificial Sequence
  chemically synthesized
tttgctccccaagggacatt

SEQ ID NO: 232131 - DNA, 20 bp, Artificial Sequence
  chemically synthesized
aagggacatttggaaatgtc

SEQ ID NO: 232132 - DNA, 20 bp, Artificial Sequence
  chemically synthesized
agggacatttggaaatgtct

SEQ ID NO: 232133 - DNA, 20 bp, Artificial Sequence
  chemically synthesized
ctttaatcacaaatttgtcc

SEQ ID NO: 232134 - DNA, 20 bp, Artificial Sequence
  chemically synthesized
ctgggacaaatttgtgatta

SEQ ID NO: 232135 - DNA, 20 bp, Artificial Sequence
  chemically synthesized
ggacaaatttgtgattaaag

SEQ ID NO: 232136 - DNA, 20 bp, Artificial Sequence
  chemically synthesized
acaaatttgtgattaaagaa

SEQ ID NO: 232137 - DNA, 20 bp, Artificial Sequence
  chemically synthesized
aaatttgtgattaaagaaga

SEQ ID NO: 232138 - DNA, 20 bp, Artificial Sequence
  chemically synthesized
attaaagaagagagtactat

SEQ ID NO: 232139 - DNA, 20 bp, Artificial Sequence
  chemically synthesized
ctctgcccattagatgccaa

SEQ ID NO: 232140 - DNA, 20 bp, Artificial Sequence
  chemically synthesized
agagtactattggcatctaa

SEQ ID NO: 232141 - DNA, 20 bp, Artificial Sequence
  chemically synthesized
gagtactattggcatctaat

SEQ ID NO: 232142 - DNA, 20 bp, Artificial Sequence
  chemically synthesized
tactattggcatctaatggg

SEQ ID NO: 232143 - DNA, 20 bp, Artificial Sequence
  chemically synthesized
ctattggcatctaatgggca

SEQ ID NO: 232144 - DNA, 20 bp, Artificial Sequence
  chemically synthesized
cacaactgacctctgcccat

SEQ ID NO: 232145 - DNA, 20 bp, Artificial Sequence
  chemically synthesized
tattggcatctaatgggcag

SEQ ID NO: 232146 - DNA, 20 bp, Artificial Sequence
  chemically synthesized
ggcatctaatgggcagaggt

SEQ ID NO: 232147 - DNA, 20 bp, Artificial Sequence
  chemically synthesized
cctgtccactataggatgtt

SEQ ID NO: 232148 - DNA, 20 bp, Artificial Sequence
  chemically synthesized
ttgtgatgccaaacatccta

SEQ ID NO: 232149 - DNA, 20 bp, Artificial Sequence
  chemically synthesized
tgatgccaaacatcctatag

SEQ ID NO: 232150 - DNA, 20 bp, Artificial Sequence
  chemically synthesized
tggactgccctgtccactat

SEQ ID NO: 232151 - DNA, 20 bp, Artificial Sequence
  chemically synthesized
gccaaacatcctatagtgga

SEQ ID NO: 232152 - DNA, 20 bp, Artificial Sequence
  chemically synthesized
gtggactgccctgtccacta

SEQ ID NO: 232153 - DNA, 20 bp, Artificial Sequence
  chemically synthesized
ccaaacatcctatagtggac

SEQ ID NO: 232154 - DNA, 20 bp, Artificial Sequence
  chemically synthesized
caaacatcctatagtggaca

SEQ ID NO: 232155 - DNA, 20 bp, Artificial Sequence
  chemically synthesized
acatcctatagtggacaggg

SEQ ID NO: 232156 - DNA, 20 bp, Artificial Sequence
  chemically synthesized
caaatacatctttgttgtgg

SEQ ID NO: 232157 - DNA, 20 bp, Artificial Sequence
  chemically synthesized
cagggcagtccaccacaaca

SEQ ID NO: 232158 - DNA, 20 bp, Artificial Sequence
  chemically synthesized
agccaaatacatctttgttg

SEQ ID NO: 232159 - DNA, 20 bp, Artificial Sequence
  chemically synthesized
caccacaacaaagatgtatt

SEQ ID NO: 232160 - DNA, 20 bp, Artificial Sequence
  chemically synthesized
atgtatttggctcaaaacgt

SEQ ID NO: 232161 - DNA, 20 bp, Artificial Sequence
  chemically synthesized
ttctcaatctctgacgtttt

SEQ ID NO: 232162 - DNA, 20 bp, Artificial Sequence
  chemically synthesized
gtatttggctcaaaacgtca

SEQ ID NO: 232163 - DNA, 20 bp, Artificial Sequence
  chemically synthesized
ggctcaaaacgtcagagatt

SEQ ID NO: 232164 - DNA, 20 bp, Artificial Sequence
  chemically synthesized
gagattgagaaacattgccg

SEQ ID NO: 232165 - DNA, 20 bp, Artificial Sequence
  chemically synthesized
agaagatgacaattgatcta

SEQ ID NO: 232166 - DNA, 20 bp, Artificial Sequence
  chemically synthesized
gtgtaaacgtcaaagttcag

SEQ ID NO: 232167 - DNA, 20 bp, Artificial Sequence
  chemically synthesized
catgtgtaaacgtcaaagtt

SEQ ID NO: 232168 - DNA, 20 bp, Artificial Sequence
  chemically synthesized
agttgcatgtgtaaacgtca

SEQ ID NO: 232169 - DNA, 20 bp, Artificial Sequence
  chemically synthesized
atgttaaataattgtacaat

SEQ ID NO: 232170 - DNA, 20 bp, Artificial Sequence
  chemically synthesized
gaaagcagtgaatgggtgta

SEQ ID NO: 232171 - DNA, 20 bp, Artificial Sequence
  chemically synthesized
tagtggtgaaagcagtgaat

SEQ ID NO: 232172 - DNA, 20 bp, Artificial Sequence
  chemically synthesized
ctagtggtgaaagcagtgaa

SEQ ID NO: 232173 - DNA, 20 bp, Artificial Sequence
  chemically synthesized
tttcagtctagtggtgaaag

SEQ ID NO: 232174 - DNA, 20 bp, Artificial Sequence
  chemically synthesized
ccattcactgctttcaccac

SEQ ID NO: 232175 - DNA, 20 bp, Artificial Sequence
  chemically synthesized
gtttttcagtctagtggtga

SEQ ID NO: 232176 - DNA, 20 bp, Artificial Sequence
  chemically synthesized
gatggagtttttcagtctag

SEQ ID NO: 232177 - DNA, 20 bp, Artificial Sequence
  chemically synthesized
tctgatggagtttttcagtc

SEQ ID NO: 232178 - DNA, 20 bp, Artificial Sequence
  chemically synthesized
tggtctctgatggagttttt

SEQ ID NO: 232179 - DNA, 20 bp, Artificial Sequence
  chemically synthesized
actagactgaaaaactccat

SEQ ID NO: 232180 - DNA, 20 bp, Artificial Sequence
  chemically synthesized
tagactgaaaaactccatca

SEQ ID NO: 232181 - DNA, 20 bp, Artificial Sequence
  chemically synthesized
aacatatgtggtctctgatg

SEQ ID NO: 232182 - DNA, 20 bp, Artificial Sequence
  chemically synthesized
aaaacatatgtggtctctga

SEQ ID NO: 232183 - DNA, 20 bp, Artificial Sequence
  chemically synthesized
agcattgcacaaaacatatg

SEQ ID NO: 232184 - DNA, 20 bp, Artificial Sequence
  chemically synthesized
tgcggaaggcacaggcggta

SEQ ID NO: 232185 - DNA, 20 bp, Artificial Sequence
  chemically synthesized
cttattgcggaaggcacagg

SEQ ID NO: 232186 - DNA, 20 bp, Artificial Sequence
  chemically synthesized
tcacttattgcggaaggcac

SEQ ID NO: 232187 - DNA, 20 bp, Artificial Sequence
  chemically synthesized
gtcacttattgcggaaggca

SEQ ID NO: 232188 - DNA, 20 bp, Artificial Sequence
  chemically synthesized
gctgtgtcacttattgcgga

SEQ ID NO: 232189 - DNA, 20 bp, Artificial Sequence
  chemically synthesized
ccgcctgtgccttccgcaat

SEQ ID NO: 232190 - DNA, 20 bp, Artificial Sequence
  chemically synthesized
tgctgtgtcacttattgcgg

SEQ ID NO: 232191 - DNA, 20 bp, Artificial Sequence
  chemically synthesized
gtctgctgtgtcacttattg

SEQ ID NO: 232192 - DNA, 20 bp, Artificial Sequence
  chemically synthesized
gccttccgcaataagtgaca

SEQ ID NO: 232193 - DNA, 20 bp, Artificial Sequence
  chemically synthesized
ttccgcaataagtgacacag

SEQ ID NO: 232194 - DNA, 20 bp, Artificial Sequence
  chemically synthesized
tgacacagcagacactcatt

SEQ ID NO: 232195 - DNA, 20 bp, Artificial Sequence
  chemically synthesized
tcactaagcttatacttaat

SEQ ID NO: 232196 - DNA, 20 bp, Artificial Sequence
  chemically synthesized
agcagacactcattaagtat

SEQ ID NO: 232197 - DNA, 20 bp, Artificial Sequence
  chemically synthesized
acactcattaagtataagct

SEQ ID NO: 232198 - DNA, 20 bp, Artificial Sequence
  chemically synthesized
tcattaagtataagcttagt

SEQ ID NO: 232199 - DNA, 20 bp, Artificial Sequence
  chemically synthesized
ttatccactattcactcact

SEQ ID NO: 232200 - DNA, 20 bp, Artificial Sequence
  chemically synthesized
gtataagcttagtgagtgaa

SEQ ID NO: 232201 - DNA, 20 bp, Artificial Sequence
  chemically synthesized
taagcttagtgagtgaatag

SEQ ID NO: 232202 - DNA, 20 bp, Artificial Sequence
  chemically synthesized
agtgaatagtggataactta

SEQ ID NO: 232203 - DNA, 20 bp, Artificial Sequence
  chemically synthesized
tgtatacactataaaacttt

SEQ ID NO: 232204 - DNA, 20 bp, Artificial Sequence
  chemically synthesized
gtggataacttaaagtttta

SEQ ID NO: 232205 - DNA, 20 bp, Artificial Sequence
  chemically synthesized
aaagttttatagtgtataca

SEQ ID NO: 232206 - DNA, 20 bp, Artificial Sequence
  chemically synthesized
aagttttatagtgtatacat

SEQ ID NO: 232207 - DNA, 20 bp, Artificial Sequence
  chemically synthesized
gtgtatacatgggacttgtc

SEQ ID NO: 232208 - DNA, 20 bp, Artificial Sequence
  chemically synthesized
gtatacatgggacttgtcaa

SEQ ID NO: 232209 - DNA, 20 bp, Artificial Sequence
  chemically synthesized
gaaacacagagactcttgac

SEQ ID NO: 232210 - DNA, 20 bp, Artificial Sequence
  chemically synthesized
gacaatgtttatgaaacaca

SEQ ID NO: 232211 - DNA, 20 bp, Artificial Sequence
  chemically synthesized
acgacaatgtttatgaaaca

SEQ ID NO: 232212 - DNA, 20 bp, Artificial Sequence
  chemically synthesized
taaacattgtcgtcatattc

SEQ ID NO: 232213 - DNA, 20 bp, Artificial Sequence
  chemically synthesized
aaattttaaatatggttagc

SEQ ID NO: 232214 - DNA, 20 bp, Artificial Sequence
  chemically synthesized
tataaaattttaaatatggt

SEQ ID NO: 232215 - DNA, 20 bp, Artificial Sequence
  chemically synthesized
tatatataaaattttaaata

SEQ ID NO: 232216 - DNA, 20 bp, Artificial Sequence
  chemically synthesized
atatatatatatttcaccac

SEQ ID NO: 232217 - DNA, 20 bp, Artificial Sequence
  chemically synthesized
gcaccaccataaaaatcttg

SEQ ID NO: 232218 - DNA, 20 bp, Artificial Sequence
  chemically synthesized
atttcaccacaagattttta

SEQ ID NO: 232219 - DNA, 20 bp, Artificial Sequence
  chemically synthesized
tcaccacaagatttttatgg

SEQ ID NO: 232220 - DNA, 20 bp, Artificial Sequence
  chemically synthesized
tatggtggtgcttttatcca

SEQ ID NO: 232221 - DNA, 20 bp, Artificial Sequence
  chemically synthesized
gaacttataactgtggataa

SEQ ID NO: 232222 - DNA, 20 bp, Artificial Sequence
  chemically synthesized
gtgcttttatccacagttat

SEQ ID NO: 232223 - DNA, 20 bp, Artificial Sequence
  chemically synthesized
tcttaaagaacttataactg

SEQ ID NO: 232224 - DNA, 20 bp, Artificial Sequence
  chemically synthesized
tccacagttataagttcttt

SEQ ID NO: 232225 - DNA, 20 bp, Artificial Sequence
  chemically synthesized
cacagttataagttctttaa

SEQ ID NO: 232226 - DNA, 20 bp, Artificial Sequence
  chemically synthesized
atgatagaaaatatctctta

SEQ ID NO: 232227 - DNA, 20 bp, Artificial Sequence
  chemically synthesized
ataaatttattttttaatga

SEQ ID NO: 232228 - DNA, 20 bp, Artificial Sequence
  chemically synthesized
tcacaaatacttcagtaaat

SEQ ID NO: 232229 - DNA, 20 bp, Artificial Sequence
  chemically synthesized
aaatttatgcctatttactg

SEQ ID NO: 232230 - DNA, 20 bp, Artificial Sequence
  chemically synthesized
ttcacaaatacttcagtaaa

SEQ ID NO: 232231 - DNA, 20 bp, Artificial Sequence
  chemically synthesized
ggcttttttcacaaatactt

SEQ ID NO: 232232 - DNA, 20 bp, Artificial Sequence
  chemically synthesized
tactgaagtatttgtgaaaa

SEQ ID NO: 232233 - DNA, 20 bp, Artificial Sequence
  chemically synthesized
gtgaaaaaagcccaactgac

SEQ ID NO: 232234 - DNA, 20 bp, Artificial Sequence
  chemically synthesized
ttctaacctactcgtcagtt

SEQ ID NO: 232235 - DNA, 20 bp, Artificial Sequence
  chemically synthesized
gttctaacctactcgtcagt

SEQ ID NO: 232236 - DNA, 20 bp, Artificial Sequence
  chemically synthesized
aaaaaagcccaactgacgag

SEQ ID NO: 232237 - DNA, 20 bp, Artificial Sequence
  chemically synthesized
aaaaagcccaactgacgagt

SEQ ID NO: 232238 - DNA, 20 bp, Artificial Sequence
  chemically synthesized
gaatgttctaacctactcgt

SEQ ID NO: 232239 - DNA, 20 bp, Artificial Sequence
  chemically synthesized
agcccaactgacgagtaggt

SEQ ID NO: 232240 - DNA, 20 bp, Artificial Sequence
  chemically synthesized
gttagaacattcgaaatctt

SEQ ID NO: 232241 - DNA, 20 bp, Artificial Sequence
  chemically synthesized
ttagaacattcgaaatcttc

SEQ ID NO: 232242 - DNA, 20 bp, Artificial Sequence
  chemically synthesized
aacaaaactatcaaaacctg

SEQ ID NO: 232243 - DNA, 20 bp, Artificial Sequence
  chemically synthesized
tcgaaatcttcaggttttga

SEQ ID NO: 232244 - DNA, 20 bp, Artificial Sequence
  chemically synthesized
tttgttttacatccgtgtta

SEQ ID NO: 232245 - DNA, 20 bp, Artificial Sequence
  chemically synthesized
cagttaaaacatctttaaca

SEQ ID NO: 232246 - DNA, 20 bp, Artificial Sequence
  chemically synthesized
cgtgttaaagatgttttaac

SEQ ID NO: 232247 - DNA, 20 bp, Artificial Sequence
  chemically synthesized
cttagagaatgttgaagagc

SEQ ID NO: 232248 - DNA, 20 bp, Artificial Sequence
  chemically synthesized
cctacttagagaatgttgaa

SEQ ID NO: 232249 - DNA, 20 bp, Artificial Sequence
  chemically synthesized
tacctacttagagaatgttg

SEQ ID NO: 232250 - DNA, 20 bp, Artificial Sequence
  chemically synthesized
ctggctcttcaacattctct

SEQ ID NO: 232251 - DNA, 20 bp, Artificial Sequence
  chemically synthesized
gctcttcaacattctctaag

SEQ ID NO: 232252 - DNA, 20 bp, Artificial Sequence
  chemically synthesized
ctcttcaacattctctaagt

SEQ ID NO: 232253 - DNA, 20 bp, Artificial Sequence
  chemically synthesized
gagccagccctacctactta

SEQ ID NO: 232254 - DNA, 20 bp, Artificial Sequence
  chemically synthesized
ttcaacattctctaagtagg

SEQ ID NO: 232255 - DNA, 20 bp, Artificial Sequence
  chemically synthesized
tcaacattctctaagtaggt

SEQ ID NO: 232256 - DNA, 20 bp, Artificial Sequence
  chemically synthesized
tagagccagccctacctact

SEQ ID NO: 232257 - DNA, 20 bp, Artificial Sequence
  chemically synthesized
caacattctctaagtaggta

SEQ ID NO: 232258 - DNA, 20 bp, Artificial Sequence
  chemically synthesized
attctctaagtaggtagggc

SEQ ID NO: 232259 - DNA, 20 bp, Artificial Sequence
  chemically synthesized
taagtaggtagggctggctc

SEQ ID NO: 232260 - DNA, 20 bp, Artificial Sequence
  chemically synthesized
aagtaggtagggctggctct

SEQ ID NO: 232261 - DNA, 20 bp, Artificial Sequence
  chemically synthesized
ttcaggtgcttgcctagagc

SEQ ID NO: 232262 - DNA, 20 bp, Artificial Sequence
  chemically synthesized
aggtagggctggctctaggc

SEQ ID NO: 232263 - DNA, 20 bp, Artificial Sequence
  chemically synthesized
atacttcaggtgcttgccta

SEQ ID NO: 232264 - DNA, 20 bp, Artificial Sequence
  chemically synthesized
ctatacttcaggtgcttgcc

SEQ ID NO: 232265 - DNA, 20 bp, Artificial Sequence
  chemically synthesized
tggctctaggcaagcacctg

SEQ ID NO: 232266 - DNA, 20 bp, Artificial Sequence
  chemically synthesized
ctaggcaagcacctgaagta

SEQ ID NO: 232267 - DNA, 20 bp, Artificial Sequence
  chemically synthesized
tgaagctaactctatacttc

SEQ ID NO: 232268 - DNA, 20 bp, Artificial Sequence
  chemically synthesized
aggcaagcacctgaagtata

SEQ ID NO: 232269 - DNA, 20 bp, Artificial Sequence
  chemically synthesized
ctgaagctaactctatactt

SEQ ID NO: 232270 - DNA, 20 bp, Artificial Sequence
  chemically synthesized
aagcacctgaagtatagagt

SEQ ID NO: 232271 - DNA, 20 bp, Artificial Sequence
  chemically synthesized
ctgaagtatagagttagctt

SEQ ID NO: 232272 - DNA, 20 bp, Artificial Sequence
  chemically synthesized
tgaagtatagagttagcttc

SEQ ID NO: 232273 - DNA, 20 bp, Artificial Sequence
  chemically synthesized
agaaaaggaaggcagacctg

SEQ ID NO: 232274 - DNA, 20 bp, Artificial Sequence
  chemically synthesized
taaaggtaagaaaaggaagg

SEQ ID NO: 232275 - DNA, 20 bp, Artificial Sequence
  chemically synthesized
tcctaaaggtaagaaaagga

SEQ ID NO: 232276 - DNA, 20 bp, Artificial Sequence
  chemically synthesized
atcctaaaggtaagaaaagg

SEQ ID NO: 232277 - DNA, 20 bp, Artificial Sequence
  chemically synthesized
gaaatcctaaaggtaagaaa

SEQ ID NO: 232278 - DNA, 20 bp, Artificial Sequence
  chemically synthesized
ggaaatcctaaaggtaagaa

SEQ ID NO: 232279 - DNA, 20 bp, Artificial Sequence
  chemically synthesized
tgccttccttttcttacctt

SEQ ID NO: 232280 - DNA, 20 bp, Artificial Sequence
  chemically synthesized
gccttccttttcttaccttt

SEQ ID NO: 232281 - DNA, 20 bp, Artificial Sequence
  chemically synthesized
taccaggaaatcctaaaggt

SEQ ID NO: 232282 - DNA, 20 bp, Artificial Sequence
  chemically synthesized
aagataccaggaaatcctaa

SEQ ID NO: 232283 - DNA, 20 bp, Artificial Sequence
  chemically synthesized
aaagataccaggaaatccta

SEQ ID NO: 232284 - DNA, 20 bp, Artificial Sequence
  chemically synthesized
ttcttacctttaggatttcc

SEQ ID NO: 232285 - DNA, 20 bp, Artificial Sequence
  chemically synthesized
agaaataggataaagatacc

SEQ ID NO: 232286 - DNA, 20 bp, Artificial Sequence
  chemically synthesized
gagaaataggataaagatac

SEQ ID NO: 232287 - DNA, 20 bp, Artificial Sequence
  chemically synthesized
ggattgggagaaataggata

SEQ ID NO: 232288 - DNA, 20 bp, Artificial Sequence
  chemically synthesized
aagatgggattgggagaaat

SEQ ID NO: 232289 - DNA, 20 bp, Artificial Sequence
  chemically synthesized
gaagatgggattgggagaaa

SEQ ID NO: 232290 - DNA, 20 bp, Artificial Sequence
  chemically synthesized
agagcagaagatgggattgg

SEQ ID NO: 232291 - DNA, 20 bp, Artificial Sequence
  chemically synthesized
acagagcagaagatgggatt

SEQ ID NO: 232292 - DNA, 20 bp, Artificial Sequence
  chemically synthesized
tacagagcagaagatgggat

SEQ ID NO: 232293 - DNA, 20 bp, Artificial Sequence
  chemically synthesized
agaggtacagagcagaagat

SEQ ID NO: 232294 - DNA, 20 bp, Artificial Sequence
  chemically synthesized
gagaggtacagagcagaaga

SEQ ID NO: 232295 - DNA, 20 bp, Artificial Sequence
  chemically synthesized
acaagagaggtacagagcag

SEQ ID NO: 232296 - DNA, 20 bp, Artificial Sequence
  chemically synthesized
ccaacaagagaggtacagag

SEQ ID NO: 232297 - DNA, 20 bp, Artificial Sequence
  chemically synthesized
ttcccaacaagagaggtaca

SEQ ID NO: 232298 - DNA, 20 bp, Artificial Sequence
  chemically synthesized
atttcccaacaagagaggta

SEQ ID NO: 232299 - DNA, 20 bp, Artificial Sequence
  chemically synthesized
ctgctctgtacctctcttgt

SEQ ID NO: 232300 - DNA, 20 bp, Artificial Sequence
  chemically synthesized
gtcttatttcccaacaagag

SEQ ID NO: 232301 - DNA, 20 bp, Artificial Sequence
  chemically synthesized
tgctctgtacctctcttgtt

SEQ ID NO: 232302 - DNA, 20 bp, Artificial Sequence
  chemically synthesized
agtcttatttcccaacaaga

SEQ ID NO: 232303 - DNA, 20 bp, Artificial Sequence
  chemically synthesized
tgagtcttatttcccaacaa

SEQ ID NO: 232304 - DNA, 20 bp, Artificial Sequence
  chemically synthesized
tctgagtcttatttcccaac

SEQ ID NO: 232305 - DNA, 20 bp, Artificial Sequence
  chemically synthesized
tacctctcttgttgggaaat

SEQ ID NO: 232306 - DNA, 20 bp, Artificial Sequence
  chemically synthesized
tcttgttgggaaataagact

SEQ ID NO: 232307 - DNA, 20 bp, Artificial Sequence
  chemically synthesized
ggaaataagactcagaatca

SEQ ID NO: 232308 - DNA, 20 bp, Artificial Sequence
  chemically synthesized
ttctaagagtctgtgattct

SEQ ID NO: 232309 - DNA, 20 bp, Artificial Sequence
  chemically synthesized
gactcagaatcacagactct

SEQ ID NO: 232310 - DNA, 20 bp, Artificial Sequence
  chemically synthesized
aaagtcctgttgtgttctaa

SEQ ID NO: 232311 - DNA, 20 bp, Artificial Sequence
  chemically synthesized
ttaaagtcctgttgtgttct

SEQ ID NO: 232312 - DNA, 20 bp, Artificial Sequence
  chemically synthesized
cacagactcttagaacacaa

SEQ ID NO: 232313 - DNA, 20 bp, Artificial Sequence
  chemically synthesized
acagactcttagaacacaac

SEQ ID NO: 232314 - DNA, 20 bp, Artificial Sequence
  chemically synthesized
ttagaacacaacaggacttt

SEQ ID NO: 232315 - DNA, 20 bp, Artificial Sequence
  chemically synthesized
tagaacacaacaggacttta

SEQ ID NO: 232316 - DNA, 20 bp, Artificial Sequence
  chemically synthesized
gattaggagaggtggcctta

SEQ ID NO: 232317 - DNA, 20 bp, Artificial Sequence
  chemically synthesized
agttgggtgattaggagagg

SEQ ID NO: 232318 - DNA, 20 bp, Artificial Sequence
  chemically synthesized
atcagttgggtgattaggag

SEQ ID NO: 232319 - DNA, 20 bp, Artificial Sequence
  chemically synthesized
tatcagttgggtgattagga

SEQ ID NO: 232320 - DNA, 20 bp, Artificial Sequence
  chemically synthesized
tttatcagttgggtgattag

SEQ ID NO: 232321 - DNA, 20 bp, Artificial Sequence
  chemically synthesized
tgtttatcagttgggtgatt

SEQ ID NO: 232322 - DNA, 20 bp, Artificial Sequence
  chemically synthesized
ttgtttatcagttgggtgat

SEQ ID NO: 232323 - DNA, 20 bp, Artificial Sequence
  chemically synthesized
tgggaatttgtttatcagtt

SEQ ID NO: 232324 - DNA, 20 bp, Artificial Sequence
  chemically synthesized
atgggaatttgtttatcagt

SEQ ID NO: 232325 - DNA, 20 bp, Artificial Sequence
  chemically synthesized
atacatgggaatttgtttat

SEQ ID NO: 232326 - DNA, 20 bp, Artificial Sequence
  chemically synthesized
gggacctgggagttatacat

SEQ ID NO: 232327 - DNA, 20 bp, Artificial Sequence
  chemically synthesized
tgggacctgggagttataca

SEQ ID NO: 232328 - DNA, 20 bp, Artificial Sequence
  chemically synthesized
aaattcccatgtataactcc

SEQ ID NO: 232329 - DNA, 20 bp, Artificial Sequence
  chemically synthesized
aattcccatgtataactccc

SEQ ID NO: 232330 - DNA, 20 bp, Artificial Sequence
  chemically synthesized
aatgaaaaattgggacctgg

SEQ ID NO: 232331 - DNA, 20 bp, Artificial Sequence
  chemically synthesized
ataatgaaaaattgggacct

SEQ ID NO: 232332 - DNA, 20 bp, Artificial Sequence
  chemically synthesized
gataatgaaaaattgggacc

SEQ ID NO: 232333 - DNA, 20 bp, Artificial Sequence
  chemically synthesized
aggcaagataatgaaaaatt

SEQ ID NO: 232334 - DNA, 20 bp, Artificial Sequence
  chemically synthesized
taggcaagataatgaaaaat

SEQ ID NO: 232335 - DNA, 20 bp, Artificial Sequence
  chemically synthesized
tatgatacctgatcataggc

SEQ ID NO: 232336 - DNA, 20 bp, Artificial Sequence
  chemically synthesized
ttcattatcttgcctatgat

SEQ ID NO: 232337 - DNA, 20 bp, Artificial Sequence
  chemically synthesized
tcattatcttgcctatgatc

SEQ ID NO: 232338 - DNA, 20 bp, Artificial Sequence
  chemically synthesized
cacttatgatacctgatcat

SEQ ID NO: 232339 - DNA, 20 bp, Artificial Sequence
  chemically synthesized
gcacttatgatacctgatca

SEQ ID NO: 232340 - DNA, 20 bp, Artificial Sequence
  chemically synthesized
tgcctatgatcaggtatcat

SEQ ID NO: 232341 - DNA, 20 bp, Artificial Sequence
  chemically synthesized
tgatcaggtatcataagtgc

SEQ ID NO: 232342 - DNA, 20 bp, Artificial Sequence
  chemically synthesized
tcaattaatagtgtgttttc

SEQ ID NO: 232343 - DNA, 20 bp, Artificial Sequence
  chemically synthesized
tagaaaacacactattaatt

SEQ ID NO: 232344 - DNA, 20 bp, Artificial Sequence
  chemically synthesized
agaaaacacactattaattg

SEQ ID NO: 232345 - DNA, 20 bp, Artificial Sequence
  chemically synthesized
ggaactggtgcctcaattaa

SEQ ID NO: 232346 - DNA, 20 bp, Artificial Sequence
  chemically synthesized
cacactattaattgaggcac

SEQ ID NO: 232347 - DNA, 20 bp, Artificial Sequence
  chemically synthesized
gaactttcaaaagcaggaac

SEQ ID NO: 232348 - DNA, 20 bp, Artificial Sequence
  chemically synthesized
atatcagaactttcaaaagc

SEQ ID NO: 232349 - DNA, 20 bp, Artificial Sequence
  chemically synthesized
gcaccagttcctgcttttga

SEQ ID NO: 232350 - DNA, 20 bp, Artificial Sequence
  chemically synthesized
aatatcagaactttcaaaag

SEQ ID NO: 232351 - DNA, 20 bp, Artificial Sequence
  chemically synthesized
ctaaatatcagaactttcaa

SEQ ID NO: 232352 - DNA, 20 bp, Artificial Sequence
  chemically synthesized
cttttgaaagttctgatatt

SEQ ID NO: 232353 - DNA, 20 bp, Artificial Sequence
  chemically synthesized
acaaaaagccatctaaatat

SEQ ID NO: 232354 - DNA, 20 bp, Artificial Sequence
  chemically synthesized
tgaaagttctgatatttaga

SEQ ID NO: 232355 - DNA, 20 bp, Artificial Sequence
  chemically synthesized
tatttagatggctttttgtt

SEQ ID NO: 232356 - DNA, 20 bp, Artificial Sequence
  chemically synthesized
gtgacatttgactcaacaaa

SEQ ID NO: 232357 - DNA, 20 bp, Artificial Sequence
  chemically synthesized
tcaaatgtcaccccccactt

SEQ ID NO: 232358 - DNA, 20 bp, Artificial Sequence
  chemically synthesized
tcgatagaagctaaagtggg

SEQ ID NO: 232359 - DNA, 20 bp, Artificial Sequence
  chemically synthesized
ctcgatagaagctaaagtgg

SEQ ID NO: 232360 - DNA, 20 bp, Artificial Sequence
  chemically synthesized
tctcgatagaagctaaagtg

SEQ ID NO: 232361 - DNA, 20 bp, Artificial Sequence
  chemically synthesized
ctctcgatagaagctaaagt

SEQ ID NO: 232362 - DNA, 20 bp, Artificial Sequence
  chemically synthesized
tctctcgatagaagctaaag

SEQ ID NO: 232363 - DNA, 20 bp, Artificial Sequence
  chemically synthesized
cagtctctcgatagaagcta

SEQ ID NO: 232364 - DNA, 20 bp, Artificial Sequence
  chemically synthesized
cccccactttagcttctatc

SEQ ID NO: 232365 - DNA, 20 bp, Artificial Sequence
  chemically synthesized
cccactttagcttctatcga

SEQ ID NO: 232366 - DNA, 20 bp, Artificial Sequence
  chemically synthesized
ggtacacagtctctcgatag

SEQ ID NO: 232367 - DNA, 20 bp, Artificial Sequence
  chemically synthesized
agaggtacacagtctctcga

SEQ ID NO: 232368 - DNA, 20 bp, Artificial Sequence
  chemically synthesized
gaataattccaagaggtaca

SEQ ID NO: 232369 - DNA, 20 bp, Artificial Sequence
  chemically synthesized
tcgagagactgtgtacctct

SEQ ID NO: 232370 - DNA, 20 bp, Artificial Sequence
  chemically synthesized
ttgtgctgaataattccaag

SEQ ID NO: 232371 - DNA, 20 bp, Artificial Sequence
  chemically synthesized
cttgtgctgaataattccaa

SEQ ID NO: 232372 - DNA, 20 bp, Artificial Sequence
  chemically synthesized
aacttgtgctgaataattcc

SEQ ID NO: 232373 - DNA, 20 bp, Artificial Sequence
  chemically synthesized
gtgtacctcttggaattatt

SEQ ID NO: 232374 - DNA, 20 bp, Artificial Sequence
  chemically synthesized
ctcttggaattattcagcac

SEQ ID NO: 232375 - DNA, 20 bp, Artificial Sequence
  chemically synthesized
ttaaatttttgtgtccgtaa

SEQ ID NO: 232376 - DNA, 20 bp, Artificial Sequence
  chemically synthesized
aaatgtttgaaggactgtta

SEQ ID NO: 232377 - DNA, 20 bp, Artificial Sequence
  chemically synthesized
agttgtcttcaaatgtttga

SEQ ID NO: 232378 - DNA, 20 bp, Artificial Sequence
  chemically synthesized
tagttgtcttcaaatgtttg

SEQ ID NO: 232379 - DNA, 20 bp, Artificial Sequence
  chemically synthesized
aacagtccttcaaacatttg

SEQ ID NO: 232380 - DNA, 20 bp, Artificial Sequence
  chemically synthesized
agggagaagaagagagatga

SEQ ID NO: 232381 - DNA, 20 bp, Artificial Sequence
  chemically synthesized
gtttagcagggagaagaaga

SEQ ID NO: 232382 - DNA, 20 bp, Artificial Sequence
  chemically synthesized
aagtttagcagggagaagaa

SEQ ID NO: 232383 - DNA, 20 bp, Artificial Sequence
  chemically synthesized
ggaagtttagcagggagaag

SEQ ID NO: 232384 - DNA, 20 bp, Artificial Sequence
  chemically synthesized
tagggaagtttagcagggag

SEQ ID NO: 232385 - DNA, 20 bp, Artificial Sequence
  chemically synthesized
atctagggaagtttagcagg

SEQ ID NO: 232386 - DNA, 20 bp, Artificial Sequence
  chemically synthesized
agatctagggaagtttagca

SEQ ID NO: 232387 - DNA, 20 bp, Artificial Sequence
  chemically synthesized
aagatctagggaagtttagc

SEQ ID NO: 232388 - DNA, 20 bp, Artificial Sequence
  chemically synthesized
aaagatctagggaagtttag

SEQ ID NO: 232389 - DNA, 20 bp, Artificial Sequence
  chemically synthesized
atgaaagatctagggaagtt

SEQ ID NO: 232390 - DNA, 20 bp, Artificial Sequence
  chemically synthesized
ttctccctgctaaacttccc

SEQ ID NO: 232391 - DNA, 20 bp, Artificial Sequence
  chemically synthesized
aggtaatgaaagatctaggg

SEQ ID NO: 232392 - DNA, 20 bp, Artificial Sequence
  chemically synthesized
tctaggtaatgaaagatcta

SEQ ID NO: 232393 - DNA, 20 bp, Artificial Sequence
  chemically synthesized
atctaggtaatgaaagatct

SEQ ID NO: 232394 - DNA, 20 bp, Artificial Sequence
  chemically synthesized
catctaggtaatgaaagatc

SEQ ID NO: 232395 - DNA, 20 bp, Artificial Sequence
  chemically synthesized
ctgtgtcatctaggtaatga

SEQ ID NO: 232396 - DNA, 20 bp, Artificial Sequence
  chemically synthesized
tccctagatctttcattacc

SEQ ID NO: 232397 - DNA, 20 bp, Artificial Sequence
  chemically synthesized
gcctcgacgctgtgtcatct

SEQ ID NO: 232398 - DNA, 20 bp, Artificial Sequence
  chemically synthesized
ctttcattacctagatgaca

SEQ ID NO: 232399 - DNA, 20 bp, Artificial Sequence
  chemically synthesized
agcctcgacgctgtgtcatc

SEQ ID NO: 232400 - DNA, 20 bp, Artificial Sequence
  chemically synthesized
tacctagatgacacagcgtc

SEQ ID NO: 232401 - DNA, 20 bp, Artificial Sequence
  chemically synthesized
acctagatgacacagcgtcg

SEQ ID NO: 232402 - DNA, 20 bp, Artificial Sequence
  chemically synthesized
ttagttgttcatacattgag

SEQ ID NO: 232403 - DNA, 20 bp, Artificial Sequence
  chemically synthesized
tagttagttgttcatacatt

SEQ ID NO: 232404 - DNA, 20 bp, Artificial Sequence
  chemically synthesized
gagaaaagttggaagttagt

SEQ ID NO: 232405 - DNA, 20 bp, Artificial Sequence
  chemically synthesized
gtcagagaaaagttggaagt

SEQ ID NO: 232406 - DNA, 20 bp, Artificial Sequence
  chemically synthesized
accagtcagagaaaagttgg

SEQ ID NO: 232407 - DNA, 20 bp, Artificial Sequence
  chemically synthesized
taaaccagtcagagaaaagt

SEQ ID NO: 232408 - DNA, 20 bp, Artificial Sequence
  chemically synthesized
attttaaaccagtcagagaa

SEQ ID NO: 232409 - DNA, 20 bp, Artificial Sequence
  chemically synthesized
acttccaacttttctctgac

SEQ ID NO: 232410 - DNA, 20 bp, Artificial Sequence
  chemically synthesized
aagagattttaaaccagtca

SEQ ID NO: 232411 - DNA, 20 bp, Artificial Sequence
  chemically synthesized
acaagagattttaaaccagt

SEQ ID NO: 232412 - DNA, 20 bp, Artificial Sequence
  chemically synthesized
tcttacaagagattttaaac

SEQ ID NO: 232413 - DNA, 20 bp, Artificial Sequence
  chemically synthesized
actggtttaaaatctcttgt

SEQ ID NO: 232414 - DNA, 20 bp, Artificial Sequence
  chemically synthesized
taaacagtcaaatcttacaa

SEQ ID NO: 232415 - DNA, 20 bp, Artificial Sequence
  chemically synthesized
aataaacagtcaaatcttac

SEQ ID NO: 232416 - DNA, 20 bp, Artificial Sequence
  chemically synthesized
tccttcatgtaatgaataaa

SEQ ID NO: 232417 - DNA, 20 bp, Artificial Sequence
  chemically synthesized
gactgtttattcattacatg

SEQ ID NO: 232418 - DNA, 20 bp, Artificial Sequence
  chemically synthesized
actgtttattcattacatga

SEQ ID NO: 232419 - DNA, 20 bp, Artificial Sequence
  chemically synthesized
ttattcattacatgaaggaa

SEQ ID NO: 232420 - DNA, 20 bp, Artificial Sequence
  chemically synthesized
tcattacatgaaggaacagc

SEQ ID NO: 232421 - DNA, 20 bp, Artificial Sequence
  chemically synthesized
catgaaggaacagcgagaat

SEQ ID NO: 232422 - DNA, 20 bp, Artificial Sequence
  chemically synthesized
atgaaggaacagcgagaata

SEQ ID NO: 232423 - DNA, 20 bp, Artificial Sequence
  chemically synthesized
tgaaggaacagcgagaataa

SEQ ID NO: 232424 - DNA, 20 bp, Artificial Sequence
  chemically synthesized
gaaggaacagcgagaataag

SEQ ID NO: 232425 - DNA, 20 bp, Artificial Sequence
  chemically synthesized
cagcgagaataaggggataa

SEQ ID NO: 232426 - DNA, 20 bp, Artificial Sequence
  chemically synthesized
tgcattgaggagagaacaga

SEQ ID NO: 232427 - DNA, 20 bp, Artificial Sequence
  chemically synthesized
atgcattgaggagagaacag

SEQ ID NO: 232428 - DNA, 20 bp, Artificial Sequence
  chemically synthesized
tatgcattgaggagagaaca

SEQ ID NO: 232429 - DNA, 20 bp, Artificial Sequence
  chemically synthesized
aatatgcattgaggagagaa

SEQ ID NO: 232430 - DNA, 20 bp, Artificial Sequence
  chemically synthesized
caacaaatatgcattgagga

SEQ ID NO: 232431 - DNA, 20 bp, Artificial Sequence
  chemically synthesized
tacaacaaatatgcattgag

SEQ ID NO: 232432 - DNA, 20 bp, Artificial Sequence
  chemically synthesized
tatacaacaaatatgcattg

SEQ ID NO: 232433 - DNA, 20 bp, Artificial Sequence
  chemically synthesized
gtatacaacaaatatgcatt

SEQ ID NO: 232434 - DNA, 20 bp, Artificial Sequence
  chemically synthesized
atttgttgtatactctttgc

SEQ ID NO: 232435 - DNA, 20 bp, Artificial Sequence
  chemically synthesized
tttgttgtatactctttgcc

SEQ ID NO: 232436 - DNA, 20 bp, Artificial Sequence
  chemically synthesized
ctagcatagctcctggcaaa

SEQ ID NO: 232437 - DNA, 20 bp, Artificial Sequence
  chemically synthesized
tgttgtatactctttgccag

SEQ ID NO: 232438 - DNA, 20 bp, Artificial Sequence
  chemically synthesized
acctagcatagctcctggca

SEQ ID NO: 232439 - DNA, 20 bp, Artificial Sequence
  chemically synthesized
ccgggacctagcatagctcc

SEQ ID NO: 232440 - DNA, 20 bp, Artificial Sequence
  chemically synthesized
ctctttgccaggagctatgc

SEQ ID NO: 232441 - DNA, 20 bp, Artificial Sequence
  chemically synthesized
tctttgccaggagctatgct

SEQ ID NO: 232442 - DNA, 20 bp, Artificial Sequence
  chemically synthesized
cgtgttcccgggacctagca

SEQ ID NO: 232443 - DNA, 20 bp, Artificial Sequence
  chemically synthesized
ccaggagctatgctaggtcc

SEQ ID NO: 232444 - DNA, 20 bp, Artificial Sequence
  chemically synthesized
caggagctatgctaggtccc

SEQ ID NO: 232445 - DNA, 20 bp, Artificial Sequence
  chemically synthesized
aaaatcgtgttcccgggacc

SEQ ID NO: 232446 - DNA, 20 bp, Artificial Sequence
  chemically synthesized
ttgcccaaaatcgtgttccc

SEQ ID NO: 232447 - DNA, 20 bp, Artificial Sequence
  chemically synthesized
tttgcccaaaatcgtgttcc

SEQ ID NO: 232448 - DNA, 20 bp, Artificial Sequence
  chemically synthesized
aggtcccgggaacacgattt

SEQ ID NO: 232449 - DNA, 20 bp, Artificial Sequence
  chemically synthesized
ggtcccgggaacacgatttt

SEQ ID NO: 232450 - DNA, 20 bp, Artificial Sequence
  chemically synthesized
gaacacgattttgggcaaaa

SEQ ID NO: 232451 - DNA, 20 bp, Artificial Sequence
  chemically synthesized
acgattttgggcaaaataga

SEQ ID NO: 232452 - DNA, 20 bp, Artificial Sequence
  chemically synthesized
ttataagcagcaagagggaa

SEQ ID NO: 232453 - DNA, 20 bp, Artificial Sequence
  chemically synthesized
attataagcagcaagaggga

SEQ ID NO: 232454 - DNA, 20 bp, Artificial Sequence
  chemically synthesized
ttgtattataagcagcaaga

SEQ ID NO: 232455 - DNA, 20 bp, Artificial Sequence
  chemically synthesized
attgtattataagcagcaag

SEQ ID NO: 232456 - DNA, 20 bp, Artificial Sequence
  chemically synthesized
aattgtattataagcagcaa

SEQ ID NO: 232457 - DNA, 20 bp, Artificial Sequence
  chemically synthesized
acaattgtattataagcagc

SEQ ID NO: 232458 - DNA, 20 bp, Artificial Sequence
  chemically synthesized
agggacaattgtattataag

SEQ ID NO: 232459 - DNA, 20 bp, Artificial Sequence
  chemically synthesized
ctgagggacaattgtattat

SEQ ID NO: 232460 - DNA, 20 bp, Artificial Sequence
  chemically synthesized
cttataatacaattgtccct

SEQ ID NO: 232461 - DNA, 20 bp, Artificial Sequence
  chemically synthesized
caatcccccatggatactga

SEQ ID NO: 232462 - DNA, 20 bp, Artificial Sequence
  chemically synthesized
ccaatcccccatggatactg

SEQ ID NO: 232463 - DNA, 20 bp, Artificial Sequence
  chemically synthesized
accaatcccccatggatact

SEQ ID NO: 232464 - DNA, 20 bp, Artificial Sequence
  chemically synthesized
caattgtccctcagtatcca

SEQ ID NO: 232465 - DNA, 20 bp, Artificial Sequence
  chemically synthesized
aattgtccctcagtatccat

SEQ ID NO: 232466 - DNA, 20 bp, Artificial Sequence
  chemically synthesized
attgtccctcagtatccatg

SEQ ID NO: 232467 - DNA, 20 bp, Artificial Sequence
  chemically synthesized
ttgtccctcagtatccatgg

SEQ ID NO: 232468 - DNA, 20 bp, Artificial Sequence
  chemically synthesized
atcctggaaccaatccccca

SEQ ID NO: 232469 - DNA, 20 bp, Artificial Sequence
  chemically synthesized
cctcagtatccatgggggat

SEQ ID NO: 232470 - DNA, 20 bp, Artificial Sequence
  chemically synthesized
tatccatgggggattggttc

SEQ ID NO: 232471 - DNA, 20 bp, Artificial Sequence
  chemically synthesized
atccatgggggattggttcc

SEQ ID NO: 232472 - DNA, 20 bp, Artificial Sequence
  chemically synthesized
tttgctatccgtggggatcc

SEQ ID NO: 232473 - DNA, 20 bp, Artificial Sequence
  chemically synthesized
gattggttccaggatcccca

SEQ ID NO: 232474 - DNA, 20 bp, Artificial Sequence
  chemically synthesized
ggttccaggatccccacgga

SEQ ID NO: 232475 - DNA, 20 bp, Artificial Sequence
  chemically synthesized
ttgtggatttgctatccgtg

SEQ ID NO: 232476 - DNA, 20 bp, Artificial Sequence
  chemically synthesized
tttgtggatttgctatccgt

SEQ ID NO: 232477 - DNA, 20 bp, Artificial Sequence
  chemically synthesized
atttgtggatttgctatccg

SEQ ID NO: 232478 - DNA, 20 bp, Artificial Sequence
  chemically synthesized
atatgtcacttgaacatttg

SEQ ID NO: 232479 - DNA, 20 bp, Artificial Sequence
  chemically synthesized
tagcaaatccacaaatgttc

SEQ ID NO: 232480 - DNA, 20 bp, Artificial Sequence
  chemically synthesized
gtgtgtaggttgtatggaaa

SEQ ID NO: 232481 - DNA, 20 bp, Artificial Sequence
  chemically synthesized
gaggatgtgtgtaggttgta

SEQ ID NO: 232482 - DNA, 20 bp, Artificial Sequence
  chemically synthesized
gtatataggaggatgtgtgt

SEQ ID NO: 232483 - DNA, 20 bp, Artificial Sequence
  chemically synthesized
agtatataggaggatgtgtg

SEQ ID NO: 232484 - DNA, 20 bp, Artificial Sequence
  chemically synthesized
gatgttttaaagtatatagg

SEQ ID NO: 232485 - DNA, 20 bp, Artificial Sequence
  chemically synthesized
agatgttttaaagtatatag

SEQ ID NO: 232486 - DNA, 20 bp, Artificial Sequence
  chemically synthesized
agagatgttttaaagtatat

SEQ ID NO: 232487 - DNA, 20 bp, Artificial Sequence
  chemically synthesized
tagagatgttttaaagtata

SEQ ID NO: 232488 - DNA, 20 bp, Artificial Sequence
  chemically synthesized
agtaatctagagatgtttta

SEQ ID NO: 232489 - DNA, 20 bp, Artificial Sequence
  chemically synthesized
tatatactttaaaacatctc

SEQ ID NO: 232490 - DNA, 20 bp, Artificial Sequence
  chemically synthesized
taagtattataagtaatcta

SEQ ID NO: 232491 - DNA, 20 bp, Artificial Sequence
  chemically synthesized
attaagtattataagtaatc

SEQ ID NO: 232492 - DNA, 20 bp, Artificial Sequence
  chemically synthesized
tacattgtattaagtattat

SEQ ID NO: 232493 - DNA, 20 bp, Artificial Sequence
  chemically synthesized
tatagcatttacattgtatt

SEQ ID NO: 232494 - DNA, 20 bp, Artificial Sequence
  chemically synthesized
caatgtaataagtatttata

SEQ ID NO: 232495 - DNA, 20 bp, Artificial Sequence
  chemically synthesized
cctaaacagtacaatgtaat

SEQ ID NO: 232496 - DNA, 20 bp, Artificial Sequence
  chemically synthesized
acttattacattgtactgtt

SEQ ID NO: 232497 - DNA, 20 bp, Artificial Sequence
  chemically synthesized
cttattacattgtactgttt

SEQ ID NO: 232498 - DNA, 20 bp, Artificial Sequence
  chemically synthesized
ttattacattgtactgttta

SEQ ID NO: 232499 - DNA, 20 bp, Artificial Sequence
  chemically synthesized
tcttgtcattattccctaaa

SEQ ID NO: 232500 - DNA, 20 bp, Artificial Sequence
  chemically synthesized
actgtttagggaataatgac

SEQ ID NO: 232501 - DNA, 20 bp, Artificial Sequence
  chemically synthesized
cctctgtactgatgatttat

SEQ ID NO: 232502 - DNA, 20 bp, Artificial Sequence
  chemically synthesized
acctctgtactgatgattta

SEQ ID NO: 232503 - DNA, 20 bp, Artificial Sequence
  chemically synthesized
gaaaaacacctataaatcat

SEQ ID NO: 232504 - DNA, 20 bp, Artificial Sequence
  chemically synthesized
acacctataaatcatcagta

SEQ ID NO: 232505 - DNA, 20 bp, Artificial Sequence
  chemically synthesized
acctataaatcatcagtaca

SEQ ID NO: 232506 - DNA, 20 bp, Artificial Sequence
  chemically synthesized
cctataaatcatcagtacag

SEQ ID NO: 232507 - DNA, 20 bp, Artificial Sequence
  chemically synthesized
ataaatcatcagtacagagg

SEQ ID NO: 232508 - DNA, 20 bp, Artificial Sequence
  chemically synthesized
taaatcatcagtacagaggt

SEQ ID NO: 232509 - DNA, 20 bp, Artificial Sequence
  chemically synthesized
aaccatgcatcaaaaatatt

SEQ ID NO: 232510 - DNA, 20 bp, Artificial Sequence
  chemically synthesized
ttctgaatatttttgatgca

SEQ ID NO: 232511 - DNA, 20 bp, Artificial Sequence
  chemically synthesized
ttgatgcatggttgcattca

SEQ ID NO: 232512 - DNA, 20 bp, Artificial Sequence
  chemically synthesized
cattcacagatttgtaatcc

SEQ ID NO: 232513 - DNA, 20 bp, Artificial Sequence
  chemically synthesized
acaggggctcttcatattct

SEQ ID NO: 232514 - DNA, 20 bp, Artificial Sequence
  chemically synthesized
atttgtaatccaagaatatg

SEQ ID NO: 232515 - DNA, 20 bp, Artificial Sequence
  chemically synthesized
ttgtaatccaagaatatgaa

SEQ ID NO: 232516 - DNA, 20 bp, Artificial Sequence
  chemically synthesized
aatatgaagagcccctgtac

SEQ ID NO: 232517 - DNA, 20 bp, Artificial Sequence
  chemically synthesized
atatgaagagcccctgtacc

SEQ ID NO: 232518 - DNA, 20 bp, Artificial Sequence
  chemically synthesized
gtccctcttacctggtacag

SEQ ID NO: 232519 - DNA, 20 bp, Artificial Sequence
  chemically synthesized
tgtccctcttacctggtaca

SEQ ID NO: 232520 - DNA, 20 bp, Artificial Sequence
  chemically synthesized
atgtccctcttacctggtac

SEQ ID NO: 232521 - DNA, 20 bp, Artificial Sequence
  chemically synthesized
aatgtccctcttacctggta

SEQ ID NO: 232522 - DNA, 20 bp, Artificial Sequence
  chemically synthesized
gaagagcccctgtaccaggt

SEQ ID NO: 232523 - DNA, 20 bp, Artificial Sequence
  chemically synthesized
agagcccctgtaccaggtaa

SEQ ID NO: 232524 - DNA, 20 bp, Artificial Sequence
  chemically synthesized
gagcccctgtaccaggtaag

SEQ ID NO: 232525 - DNA, 20 bp, Artificial Sequence
  chemically synthesized
agcccctgtaccaggtaaga

SEQ ID NO: 232526 - DNA, 20 bp, Artificial Sequence
  chemically synthesized
ccatcaatgtccctcttacc

SEQ ID NO: 232527 - DNA, 20 bp, Artificial Sequence
  chemically synthesized
ccaggtaagagggacattga

SEQ ID NO: 232528 - DNA, 20 bp, Artificial Sequence
  chemically synthesized
ggacattgatggaaacatta

SEQ ID NO: 232529 - DNA, 20 bp, Artificial Sequence
  chemically synthesized
gaaacattacagttaaaact

SEQ ID NO: 232530 - DNA, 20 bp, Artificial Sequence
  chemically synthesized
aaacattacagttaaaactg

SEQ ID NO: 232531 - DNA, 20 bp, Artificial Sequence
  chemically synthesized
acttgtcgtatttgtaacct

SEQ ID NO: 232532 - DNA, 20 bp, Artificial Sequence
  chemically synthesized
actgaggttacaaatacgac

SEQ ID NO: 232533 - DNA, 20 bp, Artificial Sequence
  chemically synthesized
ttatatgctctcatagtttc

SEQ ID NO: 232534 - DNA, 20 bp, Artificial Sequence
  chemically synthesized
caagtgttgcctgaaactat

SEQ ID NO: 232535 - DNA, 20 bp, Artificial Sequence
  chemically synthesized
attatatgctctcatagttt

SEQ ID NO: 232536 - DNA, 20 bp, Artificial Sequence
  chemically synthesized
agtgttgcctgaaactatga

SEQ ID NO: 232537 - DNA, 20 bp, Artificial Sequence
  chemically synthesized
ccccttattatatgctctca

SEQ ID NO: 232538 - DNA, 20 bp, Artificial Sequence
  chemically synthesized
aaactatgagagcatataat

SEQ ID NO: 232539 - DNA, 20 bp, Artificial Sequence
  chemically synthesized
aactatgagagcatataata

SEQ ID NO: 232540 - DNA, 20 bp, Artificial Sequence
  chemically synthesized
actatgagagcatataataa

SEQ ID NO: 232541 - DNA, 20 bp, Artificial Sequence
  chemically synthesized
ctatgagagcatataataag

SEQ ID NO: 232542 - DNA, 20 bp, Artificial Sequence
  chemically synthesized
tatgagagcatataataagg

SEQ ID NO: 232543 - DNA, 20 bp, Artificial Sequence
  chemically synthesized
gagatgttacttttaaatat

SEQ ID NO: 232544 - DNA, 20 bp, Artificial Sequence
  chemically synthesized
ataagggggcctatatttaa

SEQ ID NO: 232545 - DNA, 20 bp, Artificial Sequence
  chemically synthesized
tgagatgttacttttaaata

SEQ ID NO: 232546 - DNA, 20 bp, Artificial Sequence
  chemically synthesized
ggtcattgtgaggattatgt

SEQ ID NO: 232547 - DNA, 20 bp, Artificial Sequence
  chemically synthesized
tgcatgtttgggtcattgtg

SEQ ID NO: 232548 - DNA, 20 bp, Artificial Sequence
  chemically synthesized
atgcatgtttgggtcattgt

SEQ ID NO: 232549 - DNA, 20 bp, Artificial Sequence
  chemically synthesized
taaggtgaaaatgcatgttt

SEQ ID NO: 232550 - DNA, 20 bp, Artificial Sequence
  chemically synthesized
ttaaggtgaaaatgcatgtt

SEQ ID NO: 232551 - DNA, 20 bp, Artificial Sequence
  chemically synthesized
tgcattttcaccttaaatat

SEQ ID NO: 232552 - DNA, 20 bp, Artificial Sequence
  chemically synthesized
attttgcttcctgatattta

SEQ ID NO: 232553 - DNA, 20 bp, Artificial Sequence
  chemically synthesized
gcattttcaccttaaatatc

SEQ ID NO: 232554 - DNA, 20 bp, Artificial Sequence
  chemically synthesized
aattttgcttcctgatattt

SEQ ID NO: 232555 - DNA, 20 bp, Artificial Sequence
  chemically synthesized
ttttcaccttaaatatcagg

SEQ ID NO: 232556 - DNA, 20 bp, Artificial Sequence
  chemically synthesized
tatcaggaagcaaaattgca

SEQ ID NO: 232557 - DNA, 20 bp, Artificial Sequence
  chemically synthesized
atcaggaagcaaaattgcac

SEQ ID NO: 232558 - DNA, 20 bp, Artificial Sequence
  chemically synthesized
ttgcacaggtattcttaaca

SEQ ID NO: 232559 - DNA, 20 bp, Artificial Sequence
  chemically synthesized
ccagacccggcatccatgtt

SEQ ID NO: 232560 - DNA, 20 bp, Artificial Sequence
  chemically synthesized
ggtattcttaacatggatgc

SEQ ID NO: 232561 - DNA, 20 bp, Artificial Sequence
  chemically synthesized
gtattcttaacatggatgcc

SEQ ID NO: 232562 - DNA, 20 bp, Artificial Sequence
  chemically synthesized
cttaacatggatgccgggtc

SEQ ID NO: 232563 - DNA, 20 bp, Artificial Sequence
  chemically synthesized
ttaacatggatgccgggtct

SEQ ID NO: 232564 - DNA, 20 bp, Artificial Sequence
  chemically synthesized
ttcttcttgaggcccagacc

SEQ ID NO: 232565 - DNA, 20 bp, Artificial Sequence
  chemically synthesized
ggatgccgggtctgggcctc

SEQ ID NO: 232566 - DNA, 20 bp, Artificial Sequence
  chemically synthesized
cagggattcttcttgaggcc

SEQ ID NO: 232567 - DNA, 20 bp, Artificial Sequence
  chemically synthesized
tgccgggtctgggcctcaag

SEQ ID NO: 232568 - DNA, 20 bp, Artificial Sequence
  chemically synthesized
ggaaccagggattcttcttg

SEQ ID NO: 232569 - DNA, 20 bp, Artificial Sequence
  chemically synthesized
aggaaccagggattcttctt

SEQ ID NO: 232570 - DNA, 20 bp, Artificial Sequence
  chemically synthesized
tgggcctcaagaagaatccc

SEQ ID NO: 232571 - DNA, 20 bp, Artificial Sequence
  chemically synthesized
ctcatagagtgaaggaacca

SEQ ID NO: 232572 - DNA, 20 bp, Artificial Sequence
  chemically synthesized
cctcatagagtgaaggaacc

SEQ ID NO: 232573 - DNA, 20 bp, Artificial Sequence
  chemically synthesized
ccctcatagagtgaaggaac

SEQ ID NO: 232574 - DNA, 20 bp, Artificial Sequence
  chemically synthesized
atacctccctcatagagtga

SEQ ID NO: 232575 - DNA, 20 bp, Artificial Sequence
  chemically synthesized
catacctccctcatagagtg

SEQ ID NO: 232576 - DNA, 20 bp, Artificial Sequence
  chemically synthesized
ccctggttccttcactctat

SEQ ID NO: 232577 - DNA, 20 bp, Artificial Sequence
  chemically synthesized
cctggttccttcactctatg

SEQ ID NO: 232578 - DNA, 20 bp, Artificial Sequence
  chemically synthesized
ctggttccttcactctatga

SEQ ID NO: 232579 - DNA, 20 bp, Artificial Sequence
  chemically synthesized
ggttccttcactctatgagg

SEQ ID NO: 232580 - DNA, 20 bp, Artificial Sequence
  chemically synthesized
ggtatcatacctccctcata

SEQ ID NO: 232581 - DNA, 20 bp, Artificial Sequence
  chemically synthesized
gttccttcactctatgaggg

SEQ ID NO: 232582 - DNA, 20 bp, Artificial Sequence
  chemically synthesized
tgggtatcatacctccctca

SEQ ID NO: 232583 - DNA, 20 bp, Artificial Sequence
  chemically synthesized
atgagggaggtatgataccc

SEQ ID NO: 232584 - DNA, 20 bp, Artificial Sequence
  chemically synthesized
catacttggctttgagtctt

SEQ ID NO: 232585 - DNA, 20 bp, Artificial Sequence
  chemically synthesized
ggtatgatacccaagactca

SEQ ID NO: 232586 - DNA, 20 bp, Artificial Sequence
  chemically synthesized
gcatacttggctttgagtct

SEQ ID NO: 232587 - DNA, 20 bp, Artificial Sequence
  chemically synthesized
gatacccaagactcaaagcc

SEQ ID NO: 232588 - DNA, 20 bp, Artificial Sequence
  chemically synthesized
gactatgcatacttggcttt

SEQ ID NO: 232589 - DNA, 20 bp, Artificial Sequence
  chemically synthesized
gagttaagactatgcatact

SEQ ID NO: 232590 - DNA, 20 bp, Artificial Sequence
  chemically synthesized
gactcaaagccaagtatgca

SEQ ID NO: 232591 - DNA, 20 bp, Artificial Sequence
  chemically synthesized
gtatgcatagtcttaactca

SEQ ID NO: 232592 - DNA, 20 bp, Artificial Sequence
  chemically synthesized
gtcagaaggaactatgagtt

SEQ ID NO: 232593 - DNA, 20 bp, Artificial Sequence
  chemically synthesized
atggtgtcagaaggaactat

SEQ ID NO: 232594 - DNA, 20 bp, Artificial Sequence
  chemically synthesized
gtagaaagcatggtgtcaga

SEQ ID NO: 232595 - DNA, 20 bp, Artificial Sequence
  chemically synthesized
ggtagaaagcatggtgtcag

SEQ ID NO: 232596 - DNA, 20 bp, Artificial Sequence
  chemically synthesized
tgtggtagaaagcatggtgt

SEQ ID NO: 232597 - DNA, 20 bp, Artificial Sequence
  chemically synthesized
ctagcctgtggtagaaagca

SEQ ID NO: 232598 - DNA, 20 bp, Artificial Sequence
  chemically synthesized
tgacaccatgctttctacca

SEQ ID NO: 232599 - DNA, 20 bp, Artificial Sequence
  chemically synthesized
gaatcctagcctgtggtaga

SEQ ID NO: 232600 - DNA, 20 bp, Artificial Sequence
  chemically synthesized
gacaccatgctttctaccac

SEQ ID NO: 232601 - DNA, 20 bp, Artificial Sequence
  chemically synthesized
ctttgaatcctagcctgtgg

SEQ ID NO: 232602 - DNA, 20 bp, Artificial Sequence
  chemically synthesized
ccatgctttctaccacaggc

SEQ ID NO: 232603 - DNA, 20 bp, Artificial Sequence
  chemically synthesized
catgctttctaccacaggct

SEQ ID NO: 232604 - DNA, 20 bp, Artificial Sequence
  chemically synthesized
tgactttgaatcctagcctg

SEQ ID NO: 232605 - DNA, 20 bp, Artificial Sequence
  chemically synthesized
ctaccacaggctaggattca

SEQ ID NO: 232606 - DNA, 20 bp, Artificial Sequence
  chemically synthesized
ttatggctgactttgaatcc

SEQ ID NO: 232607 - DNA, 20 bp, Artificial Sequence
  chemically synthesized
cacaggctaggattcaaagt

SEQ ID NO: 232608 - DNA, 20 bp, Artificial Sequence
  chemically synthesized
aggattcaaagtcagccata

SEQ ID NO: 232609 - DNA, 20 bp, Artificial Sequence
  chemically synthesized
tactcatttctggatcttta

SEQ ID NO: 232610 - DNA, 20 bp, Artificial Sequence
  chemically synthesized
caaagtcagccataaagatc

SEQ ID NO: 232611 - DNA, 20 bp, Artificial Sequence
  chemically synthesized
agccataaagatccagaaat

SEQ ID NO: 232612 - DNA, 20 bp, Artificial Sequence
  chemically synthesized
atgtatgttttactcatttc

SEQ ID NO: 232613 - DNA, 20 bp, Artificial Sequence
  chemically synthesized
aaatgagtaaaacatacatc

SEQ ID NO: 232614 - DNA, 20 bp, Artificial Sequence
  chemically synthesized
agtaaaacatacatctagtt

SEQ ID NO: 232615 - DNA, 20 bp, Artificial Sequence
  chemically synthesized
gtaaaacatacatctagtta

SEQ ID NO: 232616 - DNA, 20 bp, Artificial Sequence
  chemically synthesized
taaaacatacatctagttaa

SEQ ID NO: 232617 - DNA, 20 bp, Artificial Sequence
  chemically synthesized
aaaacatacatctagttaag

SEQ ID NO: 232618 - DNA, 20 bp, Artificial Sequence
  chemically synthesized
ttaagccttctccccttaac

SEQ ID NO: 232619 - DNA, 20 bp, Artificial Sequence
  chemically synthesized
aacatacatctagttaaggg

SEQ ID NO: 232620 - DNA, 20 bp, Artificial Sequence
  chemically synthesized
atacatctagttaaggggag

SEQ ID NO: 232621 - DNA, 20 bp, Artificial Sequence
  chemically synthesized
tacatctagttaaggggaga

SEQ ID NO: 232622 - DNA, 20 bp, Artificial Sequence
  chemically synthesized
tggcaacctagagagcaatt

SEQ ID NO: 232623 - DNA, 20 bp, Artificial Sequence
  chemically synthesized
gagaaggcttaattgctctc

SEQ ID NO: 232624 - DNA, 20 bp, Artificial Sequence
  chemically synthesized
agaaggcttaattgctctct

SEQ ID NO: 232625 - DNA, 20 bp, Artificial Sequence
  chemically synthesized
tttcatattggcaacctaga

SEQ ID NO: 232626 - DNA, 20 bp, Artificial Sequence
  chemically synthesized
catttcatattggcaaccta

SEQ ID NO: 232627 - DNA, 20 bp, Artificial Sequence
  chemically synthesized
ttcatttcatattggcaacc

SEQ ID NO: 232628 - DNA, 20 bp, Artificial Sequence
  chemically synthesized
cattctttttcatttcatat

SEQ ID NO: 232629 - DNA, 20 bp, Artificial Sequence
  chemically synthesized
gttgccaatatgaaatgaaa

SEQ ID NO: 232630 - DNA, 20 bp, Artificial Sequence
  chemically synthesized
caatatgaaatgaaaaagaa

SEQ ID NO: 232631 - DNA, 20 bp, Artificial Sequence
  chemically synthesized
acaatgctgagagatgtggt

SEQ ID NO: 232632 - DNA, 20 bp, Artificial Sequence
  chemically synthesized
gaatggctaaccacatctct

SEQ ID NO: 232633 - DNA, 20 bp, Artificial Sequence
  chemically synthesized
tttgacaatgctgagagatg

SEQ ID NO: 232634 - DNA, 20 bp, Artificial Sequence
  chemically synthesized
ggctattttgacaatgctga

SEQ ID NO: 232635 - DNA, 20 bp, Artificial Sequence
  chemically synthesized
ttggctattttgacaatgct

SEQ ID NO: 232636 - DNA, 20 bp, Artificial Sequence
  chemically synthesized
atctctcagcattgtcaaaa

SEQ ID NO: 232637 - DNA, 20 bp, Artificial Sequence
  chemically synthesized
ttgtcaaaatagccaatgaa

SEQ ID NO: 232638 - DNA, 20 bp, Artificial Sequence
  chemically synthesized
gtcaaaatagccaatgaaca

SEQ ID NO: 232639 - DNA, 20 bp, Artificial Sequence
  chemically synthesized
gcagtgctctctctgttcat

SEQ ID NO: 232640 - DNA, 20 bp, Artificial Sequence
  chemically synthesized
caaaatagccaatgaacaga

SEQ ID NO: 232641 - DNA, 20 bp, Artificial Sequence
  chemically synthesized
aaatagccaatgaacagaga

SEQ ID NO: 232642 - DNA, 20 bp, Artificial Sequence
  chemically synthesized
tgaacagagagagcactgca

SEQ ID NO: 232643 - DNA, 20 bp, Artificial Sequence
  chemically synthesized
aattgagttgggggtctttg

SEQ ID NO: 232644 - DNA, 20 bp, Artificial Sequence
  chemically synthesized
tgaagtctgaattgagttgg

SEQ ID NO: 232645 - DNA, 20 bp, Artificial Sequence
  chemically synthesized
atgaagtctgaattgagttg

SEQ ID NO: 232646 - DNA, 20 bp, Artificial Sequence
  chemically synthesized
aatgaagtctgaattgagtt

SEQ ID NO: 232647 - DNA, 20 bp, Artificial Sequence
  chemically synthesized
aaatgaagtctgaattgagt

SEQ ID NO: 232648 - DNA, 20 bp, Artificial Sequence
  chemically synthesized
caaagacccccaactcaatt

SEQ ID NO: 232649 - DNA, 20 bp, Artificial Sequence
  chemically synthesized
gtagaaatgaagtctgaatt

SEQ ID NO: 232650 - DNA, 20 bp, Artificial Sequence
  chemically synthesized
attccacataggtagaaatg

SEQ ID NO: 232651 - DNA, 20 bp, Artificial Sequence
  chemically synthesized
agacttcatttctacctatg

SEQ ID NO: 232652 - DNA, 20 bp, Artificial Sequence
  chemically synthesized
ctgcagcaattccacatagg

SEQ ID NO: 232653 - DNA, 20 bp, Artificial Sequence
  chemically synthesized
tggctgcagcaattccacat

SEQ ID NO: 232654 - DNA, 20 bp, Artificial Sequence
  chemically synthesized
ctggctgcagcaattccaca

SEQ ID NO: 232655 - DNA, 20 bp, Artificial Sequence
  chemically synthesized
ctacctatgtggaattgctg

SEQ ID NO: 232656 - DNA, 20 bp, Artificial Sequence
  chemically synthesized
ctatgtggaattgctgcagc

SEQ ID NO: 232657 - DNA, 20 bp, Artificial Sequence
  chemically synthesized
tttacttaaatttctggctg

SEQ ID NO: 232658 - DNA, 20 bp, Artificial Sequence
  chemically synthesized
attgctgcagccagaaattt

SEQ ID NO: 232659 - DNA, 20 bp, Artificial Sequence
  chemically synthesized
gtaacatttacttaaatttc

SEQ ID NO: 232660 - DNA, 20 bp, Artificial Sequence
  chemically synthesized
agtaaatgttacttaaatgt

SEQ ID NO: 232661 - DNA, 20 bp, Artificial Sequence
  chemically synthesized
ggtacatggctcttacattt

SEQ ID NO: 232662 - DNA, 20 bp, Artificial Sequence
  chemically synthesized
taaatgttacttaaatgtaa

SEQ ID NO: 232663 - DNA, 20 bp, Artificial Sequence
  chemically synthesized
ccacttaagagttaggtaca

SEQ ID NO: 232664 - DNA, 20 bp, Artificial Sequence
  chemically synthesized
gagccatgtacctaactctt

SEQ ID NO: 232665 - DNA, 20 bp, Artificial Sequence
  chemically synthesized
aggatatccacttaagagtt

SEQ ID NO: 232666 - DNA, 20 bp, Artificial Sequence
  chemically synthesized
gaggatatccacttaagagt

SEQ ID NO: 232667 - DNA, 20 bp, Artificial Sequence
  chemically synthesized
ccatgtacctaactcttaag

SEQ ID NO: 232668 - DNA, 20 bp, Artificial Sequence
  chemically synthesized
atttgaggatatccacttaa

SEQ ID NO: 232669 - DNA, 20 bp, Artificial Sequence
  chemically synthesized
gcatttgaggatatccactt

SEQ ID NO: 232670 - DNA, 20 bp, Artificial Sequence
  chemically synthesized
taaatggatatttgcatttg

SEQ ID NO: 232671 - DNA, 20 bp, Artificial Sequence
  chemically synthesized
ttaaatggatatttgcattt

SEQ ID NO: 232672 - DNA, 20 bp, Artificial Sequence
  chemically synthesized
taattcttgtatattttaaa

SEQ ID NO: 232673 - DNA, 20 bp, Artificial Sequence
  chemically synthesized
aatatccatttaaaatatac

SEQ ID NO: 232674 - DNA, 20 bp, Artificial Sequence
  chemically synthesized
acaagaattactgtgatata

SEQ ID NO: 232675 - DNA, 20 bp, Artificial Sequence
  chemically synthesized
gcaattgttactttatatca

SEQ ID NO: 232676 - DNA, 20 bp, Artificial Sequence
  chemically synthesized
cgacaaaagtaaaagataca

SEQ ID NO: 232677 - DNA, 20 bp, Artificial Sequence
  chemically synthesized
ccactgggcgacaaaagtaa

SEQ ID NO: 232678 - DNA, 20 bp, Artificial Sequence
  chemically synthesized
taaaggccactgggcgacaa

SEQ ID NO: 232679 - DNA, 20 bp, Artificial Sequence
  chemically synthesized
tatcttttacttttgtcgcc

SEQ ID NO: 232680 - DNA, 20 bp, Artificial Sequence
  chemically synthesized
cttttacttttgtcgcccag

SEQ ID NO: 232681 - DNA, 20 bp, Artificial Sequence
  chemically synthesized
tccagagtctaaaggccact

SEQ ID NO: 232682 - DNA, 20 bp, Artificial Sequence
  chemically synthesized
atccagagtctaaaggccac

SEQ ID NO: 232683 - DNA, 20 bp, Artificial Sequence
  chemically synthesized
ttttgtcgcccagtggcctt

SEQ ID NO: 232684 - DNA, 20 bp, Artificial Sequence
  chemically synthesized
aacatatatccagagtctaa

SEQ ID NO: 232685 - DNA, 20 bp, Artificial Sequence
  chemically synthesized
gcccagtggcctttagactc

SEQ ID NO: 232686 - DNA, 20 bp, Artificial Sequence
  chemically synthesized
taacatatatccagagtcta

SEQ ID NO: 232687 - DNA, 20 bp, Artificial Sequence
  chemically synthesized
tgccagttaacatatatcca

SEQ ID NO: 232688 - DNA, 20 bp, Artificial Sequence
  chemically synthesized
catgccagttaacatatatc

SEQ ID NO: 232689 - DNA, 20 bp, Artificial Sequence
  chemically synthesized
gactctggatatatgttaac

SEQ ID NO: 232690 - DNA, 20 bp, Artificial Sequence
  chemically synthesized
tggatatatgttaactggca

SEQ ID NO: 232691 - DNA, 20 bp, Artificial Sequence
  chemically synthesized
atattccaaagtagccatgc

SEQ ID NO: 232692 - DNA, 20 bp, Artificial Sequence
  chemically synthesized
gttaactggcatggctactt

SEQ ID NO: 232693 - DNA, 20 bp, Artificial Sequence
  chemically synthesized
tatgagtaaatattccaaag

SEQ ID NO: 232694 - DNA, 20 bp, Artificial Sequence
  chemically synthesized
atatatgagtaaatattcca

SEQ ID NO: 232695 - DNA, 20 bp, Artificial Sequence
  chemically synthesized
ccattatggtttacatatat

SEQ ID NO: 232696 - DNA, 20 bp, Artificial Sequence
  chemically synthesized
ctcatatatgtaaaccataa

SEQ ID NO: 232697 - DNA, 20 bp, Artificial Sequence
  chemically synthesized
tgtagtccttaaggccatta

SEQ ID NO: 232698 - DNA, 20 bp, Artificial Sequence
  chemically synthesized
atgtaaaccataatggcctt

SEQ ID NO: 232699 - DNA, 20 bp, Artificial Sequence
  chemically synthesized
tgtaaaccataatggcctta

SEQ ID NO: 232700 - DNA, 20 bp, Artificial Sequence
  chemically synthesized
agccttatctgtagtcctta

SEQ ID NO: 232701 - DNA, 20 bp, Artificial Sequence
  chemically synthesized
aagccttatctgtagtcctt

SEQ ID NO: 232702 - DNA, 20 bp, Artificial Sequence
  chemically synthesized
cataatggccttaaggacta

SEQ ID NO: 232703 - DNA, 20 bp, Artificial Sequence
  chemically synthesized
tggccttaaggactacagat

SEQ ID NO: 232704 - DNA, 20 bp, Artificial Sequence
  chemically synthesized
ggccttaaggactacagata

SEQ ID NO: 232705 - DNA, 20 bp, Artificial Sequence
  chemically synthesized
tatgaaagaagccttatctg

SEQ ID NO: 232706 - DNA, 20 bp, Artificial Sequence
  chemically synthesized
atagttgattaatatgaaag

SEQ ID NO: 232707 - DNA, 20 bp, Artificial Sequence
  chemically synthesized
aagatagttgattaatatga

SEQ ID NO: 232708 - DNA, 20 bp, Artificial Sequence
  chemically synthesized
gcggtacacattttgaaaga

SEQ ID NO: 232709 - DNA, 20 bp, Artificial Sequence
  chemically synthesized
gcctgcggtacacattttga

SEQ ID NO: 232710 - DNA, 20 bp, Artificial Sequence
  chemically synthesized
atctttcaaaatgtgtaccg

SEQ ID NO: 232711 - DNA, 20 bp, Artificial Sequence
  chemically synthesized
tctttcaaaatgtgtaccgc

SEQ ID NO: 232712 - DNA, 20 bp, Artificial Sequence
  chemically synthesized
tccattccgagaacagcctg

SEQ ID NO: 232713 - DNA, 20 bp, Artificial Sequence
  chemically synthesized
tgtgtaccgcaggctgttct

SEQ ID NO: 232714 - DNA, 20 bp, Artificial Sequence
  chemically synthesized
atctagctccattccgagaa

SEQ ID NO: 232715 - DNA, 20 bp, Artificial Sequence
  chemically synthesized
accgcaggctgttctcggaa

SEQ ID NO: 232716 - DNA, 20 bp, Artificial Sequence
  chemically synthesized
cgcaggctgttctcggaatg

SEQ ID NO: 232717 - DNA, 20 bp, Artificial Sequence
  chemically synthesized
ctgaaatctagctccattcc

SEQ ID NO: 232718 - DNA, 20 bp, Artificial Sequence
  chemically synthesized
ggctgttctcggaatggagc

SEQ ID NO: 232719 - DNA, 20 bp, Artificial Sequence
  chemically synthesized
ctcggaatggagctagattt

SEQ ID NO: 232720 - DNA, 20 bp, Artificial Sequence
  chemically synthesized
ctttgctaatggctgaaatc

SEQ ID NO: 232721 - DNA, 20 bp, Artificial Sequence
  chemically synthesized
tggagctagatttcagccat

SEQ ID NO: 232722 - DNA, 20 bp, Artificial Sequence
  chemically synthesized
ctagatttcagccattagca

SEQ ID NO: 232723 - DNA, 20 bp, Artificial Sequence
  chemically synthesized
tagatttcagccattagcaa

SEQ ID NO: 232724 - DNA, 20 bp, Artificial Sequence
  chemically synthesized
actttgtagacctttgctaa

SEQ ID NO: 232725 - DNA, 20 bp, Artificial Sequence
  chemically synthesized
gccattagcaaaggtctaca

SEQ ID NO: 232726 - DNA, 20 bp, Artificial Sequence
  chemically synthesized
gtaacagtgattttactttg

SEQ ID NO: 232727 - DNA, 20 bp, Artificial Sequence
  chemically synthesized
aaaataaaagttaacagtaa

SEQ ID NO: 232728 - DNA, 20 bp, Artificial Sequence
  chemically synthesized
atcagaaaaataaaagttaa

SEQ ID NO: 232729 - DNA, 20 bp, Artificial Sequence
  chemically synthesized
atgtttaatcagaaaaataa

SEQ ID NO: 232730 - DNA, 20 bp, Artificial Sequence
  chemically synthesized
aaatgatatccatgtttaat

SEQ ID NO: 232731 - DNA, 20 bp, Artificial Sequence
  chemically synthesized
tttatttttctgattaaaca

SEQ ID NO: 232732 - DNA, 20 bp, Artificial Sequence
  chemically synthesized
gattaaacatggatatcatt

SEQ ID NO: 232733 - DNA, 20 bp, Artificial Sequence
  chemically synthesized
ttcaagatgagatttgggcg

SEQ ID NO: 232734 - DNA, 20 bp, Artificial Sequence
  chemically synthesized
tttcaagatgagatttgggc

SEQ ID NO: 232735 - DNA, 20 bp, Artificial Sequence
  chemically synthesized
atttcaagatgagatttggg

SEQ ID NO: 232736 - DNA, 20 bp, Artificial Sequence
  chemically synthesized
tacatttcaagatgagattt

SEQ ID NO: 232737 - DNA, 20 bp, Artificial Sequence
  chemically synthesized
ttacatttcaagatgagatt

SEQ ID NO: 232738 - DNA, 20 bp, Artificial Sequence
  chemically synthesized
tgggaattacatttcaagat

SEQ ID NO: 232739 - DNA, 20 bp, Artificial Sequence
  chemically synthesized
aacactgggaattacatttc

SEQ ID NO: 232740 - DNA, 20 bp, Artificial Sequence
  chemically synthesized
tcatcttgaaatgtaattcc

SEQ ID NO: 232741 - DNA, 20 bp, Artificial Sequence
  chemically synthesized
tgaaatgtaattcccagtgt

SEQ ID NO: 232742 - DNA, 20 bp, Artificial Sequence
  chemically synthesized
aaatgtaattcccagtgttg

SEQ ID NO: 232743 - DNA, 20 bp, Artificial Sequence
  chemically synthesized
caggccccacctccaacact

SEQ ID NO: 232744 - DNA, 20 bp, Artificial Sequence
  chemically synthesized
aatgtaattcccagtgttgg

SEQ ID NO: 232745 - DNA, 20 bp, Artificial Sequence
  chemically synthesized
ccaggccccacctccaacac

SEQ ID NO: 232746 - DNA, 20 bp, Artificial Sequence
  chemically synthesized
gtaattcccagtgttggagg

SEQ ID NO: 232747 - DNA, 20 bp, Artificial Sequence
  chemically synthesized
taattcccagtgttggaggt

SEQ ID NO: 232748 - DNA, 20 bp, Artificial Sequence
  chemically synthesized
aattcccagtgttggaggtg

SEQ ID NO: 232749 - DNA, 20 bp, Artificial Sequence
  chemically synthesized
ccagtgttggaggtggggcc

SEQ ID NO: 232750 - DNA, 20 bp, Artificial Sequence
  chemically synthesized
gtgttggaggtggggcctgg

SEQ ID NO: 232751 - DNA, 20 bp, Artificial Sequence
  chemically synthesized
tgttggaggtggggcctggt

SEQ ID NO: 232752 - DNA, 20 bp, Artificial Sequence
  chemically synthesized
ttggaggtggggcctggtgg

SEQ ID NO: 232753 - DNA, 20 bp, Artificial Sequence
  chemically synthesized
tggaggtggggcctggtggg

SEQ ID NO: 232754 - DNA, 20 bp, Artificial Sequence
  chemically synthesized
tgatccagtcacctcccacc

SEQ ID NO: 232755 - DNA, 20 bp, Artificial Sequence
  chemically synthesized
atgatccagtcacctcccac

SEQ ID NO: 232756 - DNA, 20 bp, Artificial Sequence
  chemically synthesized
ggggcctggtgggaggtgac

SEQ ID NO: 232757 - DNA, 20 bp, Artificial Sequence
  chemically synthesized
agaaatccacacacatgatc

SEQ ID NO: 232758 - DNA, 20 bp, Artificial Sequence
  chemically synthesized
aggtgactggatcatgtgtg

SEQ ID NO: 232759 - DNA, 20 bp, Artificial Sequence
  chemically synthesized
gtgtgtggatttctcatgaa

SEQ ID NO: 232760 - DNA, 20 bp, Artificial Sequence
  chemically synthesized
gatggtgttaaaccattcat

SEQ ID NO: 232761 - DNA, 20 bp, Artificial Sequence
  chemically synthesized
atggtttaacaccatcctct

SEQ ID NO: 232762 - DNA, 20 bp, Artificial Sequence
  chemically synthesized
tgaggatggcaccaagagga

SEQ ID NO: 232763 - DNA, 20 bp, Artificial Sequence
  chemically synthesized
atcatgaggatggcaccaag

SEQ ID NO: 232764 - DNA, 20 bp, Artificial Sequence
  chemically synthesized
catcatgaggatggcaccaa

SEQ ID NO: 232765 - DNA, 20 bp, Artificial Sequence
  chemically synthesized
atcatcatgaggatggcacc

SEQ ID NO: 232766 - DNA, 20 bp, Artificial Sequence
  chemically synthesized
ctcactcatcatcatgagga

SEQ ID NO: 232767 - DNA, 20 bp, Artificial Sequence
  chemically synthesized
agaactcactcatcatcatg

SEQ ID NO: 232768 - DNA, 20 bp, Artificial Sequence
  chemically synthesized
gagaactcactcatcatcat

SEQ ID NO: 232769 - DNA, 20 bp, Artificial Sequence
  chemically synthesized
ggtgccatcctcatgatgat

SEQ ID NO: 232770 - DNA, 20 bp, Artificial Sequence
  chemically synthesized
ccatcctcatgatgatgagt

SEQ ID NO: 232771 - DNA, 20 bp, Artificial Sequence
  chemically synthesized
tgatgatgagtgagttctct

SEQ ID NO: 232772 - DNA, 20 bp, Artificial Sequence
  chemically synthesized
tgagtgagttctctgagatc

SEQ ID NO: 232773 - DNA, 20 bp, Artificial Sequence
  chemically synthesized
gtgtaaacagccagatctca

SEQ ID NO: 232774 - DNA, 20 bp, Artificial Sequence
  chemically synthesized
acgtgtaaacagccagatct

SEQ ID NO: 232775 - DNA, 20 bp, Artificial Sequence
  chemically synthesized
accacacacgtgtaaacagc

SEQ ID NO: 232776 - DNA, 20 bp, Artificial Sequence
  chemically synthesized
aagtaccacacacgtgtaaa

SEQ ID NO: 232777 - DNA, 20 bp, Artificial Sequence
  chemically synthesized
tctggctgtttacacgtgtg

SEQ ID NO: 232778 - DNA, 20 bp, Artificial Sequence
  chemically synthesized
ggagcaagagagacagaatg

SEQ ID NO: 232779 - DNA, 20 bp, Artificial Sequence
  chemically synthesized
tagagcaggagcaagagaga

SEQ ID NO: 232780 - DNA, 20 bp, Artificial Sequence
  chemically synthesized
tggctagagcaggagcaaga

SEQ ID NO: 232781 - DNA, 20 bp, Artificial Sequence
  chemically synthesized
cctggctagagcaggagcaa

SEQ ID NO: 232782 - DNA, 20 bp, Artificial Sequence
  chemically synthesized
cacctggctagagcaggagc

SEQ ID NO: 232783 - DNA, 20 bp, Artificial Sequence
  chemically synthesized
tgtctctcttgctcctgctc

SEQ ID NO: 232784 - DNA, 20 bp, Artificial Sequence
  chemically synthesized
acttcacctggctagagcag

SEQ ID NO: 232785 - DNA, 20 bp, Artificial Sequence
  chemically synthesized
gcacttcacctggctagagc

SEQ ID NO: 232786 - DNA, 20 bp, Artificial Sequence
  chemically synthesized
tctcttgctcctgctctagc

SEQ ID NO: 232787 - DNA, 20 bp, Artificial Sequence
  chemically synthesized
ggcacttcacctggctagag

SEQ ID NO: 232788 - DNA, 20 bp, Artificial Sequence
  chemically synthesized
ctcttgctcctgctctagcc

SEQ ID NO: 232789 - DNA, 20 bp, Artificial Sequence
  chemically synthesized
gcaggcacttcacctggcta

SEQ ID NO: 232790 - DNA, 20 bp, Artificial Sequence
  chemically synthesized
gagcaggcacttcacctggc

SEQ ID NO: 232791 - DNA, 20 bp, Artificial Sequence
  chemically synthesized
gctcctgctctagccaggtg

SEQ ID NO: 232792 - DNA, 20 bp, Artificial Sequence
  chemically synthesized
acgggagcaggcacttcacc

SEQ ID NO: 232793 - DNA, 20 bp, Artificial Sequence
  chemically synthesized
gcagaaggcagaacgggagc

SEQ ID NO: 232794 - DNA, 20 bp, Artificial Sequence
  chemically synthesized
ggcagaaggcagaacgggag

SEQ ID NO: 232795 - DNA, 20 bp, Artificial Sequence
  chemically synthesized
cgtggcagaaggcagaacgg

SEQ ID NO: 232796 - DNA, 20 bp, Artificial Sequence
  chemically synthesized
gtcgtggcagaaggcagaac

SEQ ID NO: 232797 - DNA, 20 bp, Artificial Sequence
  chemically synthesized
agtcgtggcagaaggcagaa

SEQ ID NO: 232798 - DNA, 20 bp, Artificial Sequence
  chemically synthesized
cttccagtcgtggcagaagg

SEQ ID NO: 232799 - DNA, 20 bp, Artificial Sequence
  chemically synthesized
aagcttccagtcgtggcaga

SEQ ID NO: 232800 - DNA, 20 bp, Artificial Sequence
  chemically synthesized
gaagcttccagtcgtggcag

SEQ ID NO: 232801 - DNA, 20 bp, Artificial Sequence
  chemically synthesized
gttctgccttctgccacgac

SEQ ID NO: 232802 - DNA, 20 bp, Artificial Sequence
  chemically synthesized
cgggaagcttccagtcgtgg

SEQ ID NO: 232803 - DNA, 20 bp, Artificial Sequence
  chemically synthesized
ctgccttctgccacgactgg

SEQ ID NO: 232804 - DNA, 20 bp, Artificial Sequence
  chemically synthesized
cttcgggaagcttccagtcg

SEQ ID NO: 232805 - DNA, 20 bp, Artificial Sequence
  chemically synthesized
tggaggcttcgggaagcttc

SEQ ID NO: 232806 - DNA, 20 bp, Artificial Sequence
  chemically synthesized
ccacgactggaagcttcccg

SEQ ID NO: 232807 - DNA, 20 bp, Artificial Sequence
  chemically synthesized
ccttctgtggaggcttcggg

SEQ ID NO: 232808 - DNA, 20 bp, Artificial Sequence
  chemically synthesized
tctccttctgtggaggcttc

SEQ ID NO: 232809 - DNA, 20 bp, Artificial Sequence
  chemically synthesized
atctccttctgtggaggctt

SEQ ID NO: 232810 - DNA, 20 bp, Artificial Sequence
  chemically synthesized
gaagcttcccgaagcctcca

SEQ ID NO: 232811 - DNA, 20 bp, Artificial Sequence
  chemically synthesized
gcttcccgaagcctccacag

SEQ ID NO: 232812 - DNA, 20 bp, Artificial Sequence
  chemically synthesized
cttcccgaagcctccacaga

SEQ ID NO: 232813 - DNA, 20 bp, Artificial Sequence
  chemically synthesized
agcagcatctccttctgtgg

SEQ ID NO: 232814 - DNA, 20 bp, Artificial Sequence
  chemically synthesized
tagcagcatctccttctgtg

SEQ ID NO: 232815 - DNA, 20 bp, Artificial Sequence
  chemically synthesized
tcccgaagcctccacagaag

SEQ ID NO: 232816 - DNA, 20 bp, Artificial Sequence
  chemically synthesized
catagcagcatctccttctg

SEQ ID NO: 232817 - DNA, 20 bp, Artificial Sequence
  chemically synthesized
aggctgtaccggaagcatag

SEQ ID NO: 232818 - DNA, 20 bp, Artificial Sequence
  chemically synthesized
aggagatgctgctatgcttc

SEQ ID NO: 232819 - DNA, 20 bp, Artificial Sequence
  chemically synthesized
tgcaggctgtaccggaagca

SEQ ID NO: 232820 - DNA, 20 bp, Artificial Sequence
  chemically synthesized
atgctgctatgcttccggta

SEQ ID NO: 232821 - DNA, 20 bp, Artificial Sequence
  chemically synthesized
agttctgcaggctgtaccgg

SEQ ID NO: 232822 - DNA, 20 bp, Artificial Sequence
  chemically synthesized
cacagttctgcaggctgtac

SEQ ID NO: 232823 - DNA, 20 bp, Artificial Sequence
  chemically synthesized
tatgcttccggtacagcctg

SEQ ID NO: 232824 - DNA, 20 bp, Artificial Sequence
  chemically synthesized
tacttggctcacagttctgc

SEQ ID NO: 232825 - DNA, 20 bp, Artificial Sequence
  chemically synthesized
ttacttggctcacagttctg

SEQ ID NO: 232826 - DNA, 20 bp, Artificial Sequence
  chemically synthesized
ggtacagcctgcagaactgt

SEQ ID NO: 232827 - DNA, 20 bp, Artificial Sequence
  chemically synthesized
agcctgcagaactgtgagcc

SEQ ID NO: 232828 - DNA, 20 bp, Artificial Sequence
  chemically synthesized
aaagacacttacttggctca

SEQ ID NO: 232829 - DNA, 20 bp, Artificial Sequence
  chemically synthesized
tgcagaactgtgagccaagt

SEQ ID NO: 232830 - DNA, 20 bp, Artificial Sequence
  chemically synthesized
gatgagaaaagacacttact

SEQ ID NO: 232831 - DNA, 20 bp, Artificial Sequence
  chemically synthesized
gactgggtaatggatgagaa

SEQ ID NO: 232832 - DNA, 20 bp, Artificial Sequence
  chemically synthesized
cctgagactgggtaatggat

SEQ ID NO: 232833 - DNA, 20 bp, Artificial Sequence
  chemically synthesized
gtcttttctcatccattacc

SEQ ID NO: 232834 - DNA, 20 bp, Artificial Sequence
  chemically synthesized
aaatacctgagactgggtaa

SEQ ID NO: 232835 - DNA, 20 bp, Artificial Sequence
  chemically synthesized
tctcatccattacccagtct

SEQ ID NO: 232836 - DNA, 20 bp, Artificial Sequence
  chemically synthesized
ctcatccattacccagtctc

SEQ ID NO: 232837 - DNA, 20 bp, Artificial Sequence
  chemically synthesized
ataaagaaatacctgagact

SEQ ID NO: 232838 - DNA, 20 bp, Artificial Sequence
  chemically synthesized
tataaagaaatacctgagac

SEQ ID NO: 232839 - DNA, 20 bp, Artificial Sequence
  chemically synthesized
attgctataaagaaatacct

SEQ ID NO: 232840 - DNA, 20 bp, Artificial Sequence
  chemically synthesized
cagtctcaggtatttcttta

SEQ ID NO: 232841 - DNA, 20 bp, Artificial Sequence
  chemically synthesized
tcttttcttgcattgctata

SEQ ID NO: 232842 - DNA, 20 bp, Artificial Sequence
  chemically synthesized
gtatttctttatagcaatgc

SEQ ID NO: 232843 - DNA, 20 bp, Artificial Sequence
  chemically synthesized
tctttatagcaatgcaagaa

SEQ ID NO: 232844 - DNA, 20 bp, Artificial Sequence
  chemically synthesized
gattaatataacacaacaca

SEQ ID NO: 232845 - DNA, 20 bp, Artificial Sequence
  chemically synthesized
tgttttaattagtgtattat

SEQ ID NO: 232846 - DNA, 20 bp, Artificial Sequence
  chemically synthesized
gttcaaaatattgttttaat

SEQ ID NO: 232847 - DNA, 20 bp, Artificial Sequence
  chemically synthesized
aaaacaatattttgaacatt

SEQ ID NO: 232848 - DNA, 20 bp, Artificial Sequence
  chemically synthesized
agacattcataaaattacat

SEQ ID NO: 232849 - DNA, 20 bp, Artificial Sequence
  chemically synthesized
aagacattcataaaattaca

SEQ ID NO: 232850 - DNA, 20 bp, Artificial Sequence
  chemically synthesized
atccctgaaaggatatacga

SEQ ID NO: 232851 - DNA, 20 bp, Artificial Sequence
  chemically synthesized
atgtctttcgtatatccttt

SEQ ID NO: 232852 - DNA, 20 bp, Artificial Sequence
  chemically synthesized
tgtctttcgtatatcctttc

SEQ ID NO: 232853 - DNA, 20 bp, Artificial Sequence
  chemically synthesized
gtctttcgtatatcctttca

SEQ ID NO: 232854 - DNA, 20 bp, Artificial Sequence
  chemically synthesized
atgaacgtccaatccctgaa

SEQ ID NO: 232855 - DNA, 20 bp, Artificial Sequence
  chemically synthesized
aatgaacgtccaatccctga

SEQ ID NO: 232856 - DNA, 20 bp, Artificial Sequence
  chemically synthesized
tcgtatatcctttcagggat

SEQ ID NO: 232857 - DNA, 20 bp, Artificial Sequence
  chemically synthesized
acaatatataagaggtatgt

SEQ ID NO: 232858 - DNA, 20 bp, Artificial Sequence
  chemically synthesized
attaatgcacaatatataag

SEQ ID NO: 232859 - DNA, 20 bp, Artificial Sequence
  chemically synthesized
aattaatgcacaatatataa

SEQ ID NO: 232860 - DNA, 20 bp, Artificial Sequence
  chemically synthesized
taaattaatgcacaatatat

SEQ ID NO: 232861 - DNA, 20 bp, Artificial Sequence
  chemically synthesized
gtgcattaatttaaaaaata

SEQ ID NO: 232862 - DNA, 20 bp, Artificial Sequence
  chemically synthesized
tgcattaatttaaaaaataa

SEQ ID NO: 232863 - DNA, 20 bp, Artificial Sequence
  chemically synthesized
tttaaaaaataaaggcttta

SEQ ID NO: 232864 - DNA, 20 bp, Artificial Sequence
  chemically synthesized
caggcagaggtgaagccata

SEQ ID NO: 232865 - DNA, 20 bp, Artificial Sequence
  chemically synthesized
tcaatacacaggcagaggtg

SEQ ID NO: 232866 - DNA, 20 bp, Artificial Sequence
  chemically synthesized
caccatcaatacacaggcag

SEQ ID NO: 232867 - DNA, 20 bp, Artificial Sequence
  chemically synthesized
gcaccatcaatacacaggca

SEQ ID NO: 232868 - DNA, 20 bp, Artificial Sequence
  chemically synthesized
aagcaccatcaatacacagg

SEQ ID NO: 232869 - DNA, 20 bp, Artificial Sequence
  chemically synthesized
taaaagcaccatcaatacac

SEQ ID NO: 232870 - DNA, 20 bp, Artificial Sequence
  chemically synthesized
ctaaaagcaccatcaataca

SEQ ID NO: 232871 - DNA, 20 bp, Artificial Sequence
  chemically synthesized
cacctctgcctgtgtattga

SEQ ID NO: 232872 - DNA, 20 bp, Artificial Sequence
  chemically synthesized
ctgtgtattgatggtgcttt

SEQ ID NO: 232873 - DNA, 20 bp, Artificial Sequence
  chemically synthesized
cagcaaaggtgaaacactaa

SEQ ID NO: 232874 - DNA, 20 bp, Artificial Sequence
  chemically synthesized
atatgttagcagaacagcaa

SEQ ID NO: 232875 - DNA, 20 bp, Artificial Sequence
  chemically synthesized
gatatgttagcagaacagca

SEQ ID NO: 232876 - DNA, 20 bp, Artificial Sequence
  chemically synthesized
ttgaggatatgttagcagaa

SEQ ID NO: 232877 - DNA, 20 bp, Artificial Sequence
  chemically synthesized
atttattgaggatatgttag

SEQ ID NO: 232878 - DNA, 20 bp, Artificial Sequence
  chemically synthesized
tcgatttattgaggatatgt

SEQ ID NO: 232879 - DNA, 20 bp, Artificial Sequence
  chemically synthesized
cacttgggatcgatttattg

SEQ ID NO: 232880 - DNA, 20 bp, Artificial Sequence
  chemically synthesized
gcacttgggatcgatttatt

SEQ ID NO: 232881 - DNA, 20 bp, Artificial Sequence
  chemically synthesized
atcctcaataaatcgatccc

SEQ ID NO: 232882 - DNA, 20 bp, Artificial Sequence
  chemically synthesized
aataaatcgatcccaagtgc

SEQ ID NO: 232883 - DNA, 20 bp, Artificial Sequence
  chemically synthesized
ttatttgctttctggcactt

SEQ ID NO: 232884 - DNA, 20 bp, Artificial Sequence
  chemically synthesized
gttatttgctttctggcact

SEQ ID NO: 232885 - DNA, 20 bp, Artificial Sequence
  chemically synthesized
aatcgatcccaagtgccaga

SEQ ID NO: 232886 - DNA, 20 bp, Artificial Sequence
  chemically synthesized
ataaagggttatttgctttc

SEQ ID NO: 232887 - DNA, 20 bp, Artificial Sequence
  chemically synthesized
ctaaatgtgcaaaaaataaa

SEQ ID NO: 232888 - DNA, 20 bp, Artificial Sequence
  chemically synthesized
tctaaatgtgcaaaaaataa

SEQ ID NO: 232889 - DNA, 20 bp, Artificial Sequence
  chemically synthesized
ttctaaatgtgcaaaaaata

SEQ ID NO: 232890 - DNA, 20 bp, Artificial Sequence
  chemically synthesized
ccctttattttttgcacatt

SEQ ID NO: 232891 - DNA, 20 bp, Artificial Sequence
  chemically synthesized
tttagaatgtttcccccaaa

SEQ ID NO: 232892 - DNA, 20 bp, Artificial Sequence
  chemically synthesized
ttagaatgtttcccccaaaa

SEQ ID NO: 232893 - DNA, 20 bp, Artificial Sequence
  chemically synthesized
accgtctccctcctttttgg

SEQ ID NO: 232894 - DNA, 20 bp, Artificial Sequence
  chemically synthesized
agaatgtttcccccaaaaag

SEQ ID NO: 232895 - DNA, 20 bp, Artificial Sequence
  chemically synthesized
taccgtctccctcctttttg

SEQ ID NO: 232896 - DNA, 20 bp, Artificial Sequence
  chemically synthesized
gaatgtttcccccaaaaagg

SEQ ID NO: 232897 - DNA, 20 bp, Artificial Sequence
  chemically synthesized
ctaccgtctccctccttttt

SEQ ID NO: 232898 - DNA, 20 bp, Artificial Sequence
  chemically synthesized
aatgtttcccccaaaaagga

SEQ ID NO: 232899 - DNA, 20 bp, Artificial Sequence
  chemically synthesized
cctaccgtctccctcctttt

SEQ ID NO: 232900 - DNA, 20 bp, Artificial Sequence
  chemically synthesized
tgtttcccccaaaaaggagg

SEQ ID NO: 232901 - DNA, 20 bp, Artificial Sequence
  chemically synthesized
tcccccaaaaaggagggaga

SEQ ID NO: 232902 - DNA, 20 bp, Artificial Sequence
  chemically synthesized
cccaaaaaggagggagacgg

SEQ ID NO: 232903 - DNA, 20 bp, Artificial Sequence
  chemically synthesized
ccaaaaaggagggagacggt

SEQ ID NO: 232904 - DNA, 20 bp, Artificial Sequence
  chemically synthesized
aggagggagacggtaggtat

SEQ ID NO: 232905 - DNA, 20 bp, Artificial Sequence
  chemically synthesized
gagggagacggtaggtatta

SEQ ID NO: 232906 - DNA, 20 bp, Artificial Sequence
  chemically synthesized
gggagacggtaggtattaga

SEQ ID NO: 232907 - DNA, 20 bp, Artificial Sequence
  chemically synthesized
attagagagtgcctactgcg

SEQ ID NO: 232908 - DNA, 20 bp, Artificial Sequence
  chemically synthesized
gtgattgaacaccacgcagt

SEQ ID NO: 232909 - DNA, 20 bp, Artificial Sequence
  chemically synthesized
tgtgattgaacaccacgcag

SEQ ID NO: 232910 - DNA, 20 bp, Artificial Sequence
  chemically synthesized
tattgtgattgaacaccacg

SEQ ID NO: 232911 - DNA, 20 bp, Artificial Sequence
  chemically synthesized
tgcgtggtgttcaatcacaa

SEQ ID NO: 232912 - DNA, 20 bp, Artificial Sequence
  chemically synthesized
gcgtggtgttcaatcacaat

SEQ ID NO: 232913 - DNA, 20 bp, Artificial Sequence
  chemically synthesized
atgaataaatattaatcgaa

SEQ ID NO: 232914 - DNA, 20 bp, Artificial Sequence
  chemically synthesized
aatgaataaatattaatcga

SEQ ID NO: 232915 - DNA, 20 bp, Artificial Sequence
  chemically synthesized
aaatgaataaatattaatcg

SEQ ID NO: 232916 - DNA, 20 bp, Artificial Sequence
  chemically synthesized
atcacagactagaacaagtt

SEQ ID NO: 232917 - DNA, 20 bp, Artificial Sequence
  chemically synthesized
catcacagactagaacaagt

SEQ ID NO: 232918 - DNA, 20 bp, Artificial Sequence
  chemically synthesized
tttgacatcccaacttgttc

SEQ ID NO: 232919 - DNA, 20 bp, Artificial Sequence
  chemically synthesized
accccatcacagactagaac

SEQ ID NO: 232920 - DNA, 20 bp, Artificial Sequence
  chemically synthesized
ttaaagaccccatcacagac

SEQ ID NO: 232921 - DNA, 20 bp, Artificial Sequence
  chemically synthesized
caacttgttctagtctgtga

SEQ ID NO: 232922 - DNA, 20 bp, Artificial Sequence
  chemically synthesized
aacttgttctagtctgtgat

SEQ ID NO: 232923 - DNA, 20 bp, Artificial Sequence
  chemically synthesized
acttgttctagtctgtgatg

SEQ ID NO: 232924 - DNA, 20 bp, Artificial Sequence
  chemically synthesized
ccaggttaaagaccccatca

SEQ ID NO: 232925 - DNA, 20 bp, Artificial Sequence
  chemically synthesized
ctgtgatggggtctttaacc

SEQ ID NO: 232926 - DNA, 20 bp, Artificial Sequence
  chemically synthesized
catccacagatgccaggtta

SEQ ID NO: 232927 - DNA, 20 bp, Artificial Sequence
  chemically synthesized
taatcccatccacagatgcc

SEQ ID NO: 232928 - DNA, 20 bp, Artificial Sequence
  chemically synthesized
ggtctttaacctggcatctg

SEQ ID NO: 232929 - DNA, 20 bp, Artificial Sequence
  chemically synthesized
ttaatcccatccacagatgc

SEQ ID NO: 232930 - DNA, 20 bp, Artificial Sequence
  chemically synthesized
tttaacctggcatctgtgga

SEQ ID NO: 232931 - DNA, 20 bp, Artificial Sequence
  chemically synthesized
ttaacctggcatctgtggat

SEQ ID NO: 232932 - DNA, 20 bp, Artificial Sequence
  chemically synthesized
acctcccttaatcccatcca

SEQ ID NO: 232933 - DNA, 20 bp, Artificial Sequence
  chemically synthesized
tggcatctgtggatgggatt

SEQ ID NO: 232934 - DNA, 20 bp, Artificial Sequence
  chemically synthesized
ggcatctgtggatgggatta

SEQ ID NO: 232935 - DNA, 20 bp, Artificial Sequence
  chemically synthesized
gcatctgtggatgggattaa

SEQ ID NO: 232936 - DNA, 20 bp, Artificial Sequence
  chemically synthesized
atctgtggatgggattaagg

SEQ ID NO: 232937 - DNA, 20 bp, Artificial Sequence
  chemically synthesized
tctgtggatgggattaaggg

SEQ ID NO: 232938 - DNA, 20 bp, Artificial Sequence
  chemically synthesized
gatgggattaagggaggtcc

SEQ ID NO: 232939 - DNA, 20 bp, Artificial Sequence
  chemically synthesized
atgggattaagggaggtccc

SEQ ID NO: 232940 - DNA, 20 bp, Artificial Sequence
  chemically synthesized
taagggaggtcccaggatcg

SEQ ID NO: 232941 - DNA, 20 bp, Artificial Sequence
  chemically synthesized
aatataattcctgcgatcct

SEQ ID NO: 232942 - DNA, 20 bp, Artificial Sequence
  chemically synthesized
aagggaggtcccaggatcgc

SEQ ID NO: 232943 - DNA, 20 bp, Artificial Sequence
  chemically synthesized
taatataattcctgcgatcc

SEQ ID NO: 232944 - DNA, 20 bp, Artificial Sequence
  chemically synthesized
tcgcaggaattatattacat

SEQ ID NO: 232945 - DNA, 20 bp, Artificial Sequence
  chemically synthesized
cgcaggaattatattacata

SEQ ID NO: 232946 - DNA, 20 bp, Artificial Sequence
  chemically synthesized
acacctgactcacaacgcaa

SEQ ID NO: 232947 - DNA, 20 bp, Artificial Sequence
  chemically synthesized
aacacctgactcacaacgca

SEQ ID NO: 232948 - DNA, 20 bp, Artificial Sequence
  chemically synthesized
ggtaaatacctttgcgttgt

SEQ ID NO: 232949 - DNA, 20 bp, Artificial Sequence
  chemically synthesized
aatacctttgcgttgtgagt

SEQ ID NO: 232950 - DNA, 20 bp, Artificial Sequence
  chemically synthesized
atacctttgcgttgtgagtc

SEQ ID NO: 232951 - DNA, 20 bp, Artificial Sequence
  chemically synthesized
aggtgttacattccatttca

SEQ ID NO: 232952 - DNA, 20 bp, Artificial Sequence
  chemically synthesized
aataatcttccactgtgaaa

SEQ ID NO: 232953 - DNA, 20 bp, Artificial Sequence
  chemically synthesized
tgttacattccatttcacag

SEQ ID NO: 232954 - DNA, 20 bp, Artificial Sequence
  chemically synthesized
tacattccatttcacagtgg

SEQ ID NO: 232955 - DNA, 20 bp, Artificial Sequence
  chemically synthesized
tttcacagtggaagattatt

SEQ ID NO: 232956 - DNA, 20 bp, Artificial Sequence
  chemically synthesized
agtggaagattattgagatc

SEQ ID NO: 232957 - DNA, 20 bp, Artificial Sequence
  chemically synthesized
caatgatgtgggtatgttgc

SEQ ID NO: 232958 - DNA, 20 bp, Artificial Sequence
  chemically synthesized
ctaccaattatcaatgatgt

SEQ ID NO: 232959 - DNA, 20 bp, Artificial Sequence
  chemically synthesized
tctaccaattatcaatgatg

SEQ ID NO: 232960 - DNA, 20 bp, Artificial Sequence
  chemically synthesized
atacccacatcattgataat

SEQ ID NO: 232961 - DNA, 20 bp, Artificial Sequence
  chemically synthesized
cccacatcattgataattgg

SEQ ID NO: 232962 - DNA, 20 bp, Artificial Sequence
  chemically synthesized
tcattgataattggtagaca

SEQ ID NO: 232963 - DNA, 20 bp, Artificial Sequence
  chemically synthesized
cattgataattggtagacat

SEQ ID NO: 232964 - DNA, 20 bp, Artificial Sequence
  chemically synthesized
attgataattggtagacatg

SEQ ID NO: 232965 - DNA, 20 bp, Artificial Sequence
  chemically synthesized
gtagacatggggttgtatac

SEQ ID NO: 232966 - DNA, 20 bp, Artificial Sequence
  chemically synthesized
gttttagagtaacacagagc

SEQ ID NO: 232967 - DNA, 20 bp, Artificial Sequence
  chemically synthesized
atgtgttttagagtaacaca

SEQ ID NO: 232968 - DNA, 20 bp, Artificial Sequence
  chemically synthesized
gcatgtgttttagagtaaca

SEQ ID NO: 232969 - DNA, 20 bp, Artificial Sequence
  chemically synthesized
tgaagcaagcatgtgtttta

SEQ ID NO: 232970 - DNA, 20 bp, Artificial Sequence
  chemically synthesized
gttgaagcaagcatgtgttt

SEQ ID NO: 232971 - DNA, 20 bp, Artificial Sequence
  chemically synthesized
gcagtgtggcatgttgaagc

SEQ ID NO: 232972 - DNA, 20 bp, Artificial Sequence
  chemically synthesized
gaaggcagtgtggcatgttg

SEQ ID NO: 232973 - DNA, 20 bp, Artificial Sequence
  chemically synthesized
agctctgtaagaaggcagtg

SEQ ID NO: 232974 - DNA, 20 bp, Artificial Sequence
  chemically synthesized
ttcacagctctgtaagaagg

SEQ ID NO: 232975 - DNA, 20 bp, Artificial Sequence
  chemically synthesized
catgccacactgccttctta

SEQ ID NO: 232976 - DNA, 20 bp, Artificial Sequence
  chemically synthesized
tgccacactgccttcttaca

SEQ ID NO: 232977 - DNA, 20 bp, Artificial Sequence
  chemically synthesized
ttcttcacagctctgtaaga

SEQ ID NO: 232978 - DNA, 20 bp, Artificial Sequence
  chemically synthesized
cttcttcacagctctgtaag

SEQ ID NO: 232979 - DNA, 20 bp, Artificial Sequence
  chemically synthesized
caacttcttcacagctctgt

SEQ ID NO: 232980 - DNA, 20 bp, Artificial Sequence
  chemically synthesized
tgccttcttacagagctgtg

SEQ ID NO: 232981 - DNA, 20 bp, Artificial Sequence
  chemically synthesized
cttcttacagagctgtgaag

SEQ ID NO: 232982 - DNA, 20 bp, Artificial Sequence
  chemically synthesized
tcgcgatttcaacttcttca

SEQ ID NO: 232983 - DNA, 20 bp, Artificial Sequence
  chemically synthesized
tgaagaagttgaaatcgcga

SEQ ID NO: 232984 - DNA, 20 bp, Artificial Sequence
  chemically synthesized
tgaaatcgcgaaagctatta

SEQ ID NO: 232985 - DNA, 20 bp, Artificial Sequence
  chemically synthesized
ttatctgccttgatctttaa

SEQ ID NO: 232986 - DNA, 20 bp, Artificial Sequence
  chemically synthesized
cgcgaaagctattaaagatc

SEQ ID NO: 232987 - DNA, 20 bp, Artificial Sequence
  chemically synthesized
gcgaaagctattaaagatca

SEQ ID NO: 232988 - DNA, 20 bp, Artificial Sequence
  chemically synthesized
aaagctattaaagatcaagg

SEQ ID NO: 232989 - DNA, 20 bp, Artificial Sequence
  chemically synthesized
caagaaggctgcataatatg

SEQ ID NO: 232990 - DNA, 20 bp, Artificial Sequence
  chemically synthesized
cagataaacttcatattatg

SEQ ID NO: 232991 - DNA, 20 bp, Artificial Sequence
  chemically synthesized
atattatgcagccttcttgt

SEQ ID NO: 232992 - DNA, 20 bp, Artificial Sequence
  chemically synthesized
tgaaagttatactcacaaga

SEQ ID NO: 232993 - DNA, 20 bp, Artificial Sequence
  chemically synthesized
ttgaaagttatactcacaag

SEQ ID NO: 232994 - DNA, 20 bp, Artificial Sequence
  chemically synthesized
taattgaaagttatactcac

SEQ ID NO: 232995 - DNA, 20 bp, Artificial Sequence
  chemically synthesized
aggttattggagataattga

SEQ ID NO: 232996 - DNA, 20 bp, Artificial Sequence
  chemically synthesized
gtatgtagttaaggttattg

SEQ ID NO: 232997 - DNA, 20 bp, Artificial Sequence
  chemically synthesized
ttgtatgtagttaaggttat

SEQ ID NO: 232998 - DNA, 20 bp, Artificial Sequence
  chemically synthesized
gatagttttgtatgtagtta

SEQ ID NO: 232999 - DNA, 20 bp, Artificial Sequence
  chemically synthesized
tgatagttttgtatgtagtt

SEQ ID NO: 233000 - DNA, 20 bp, Artificial Sequence
  chemically synthesized
atgtatgatagttttgtatg

SEQ ID NO: 233001 - DNA, 20 bp, Artificial Sequence
  chemically synthesized
tatccatcattgatgtatga

SEQ ID NO: 233002 - DNA, 20 bp, Artificial Sequence
  chemically synthesized
aaactatcatacatcaatga

SEQ ID NO: 233003 - DNA, 20 bp, Artificial Sequence
  chemically synthesized
tcatacatcaatgatggata

SEQ ID NO: 233004 - DNA, 20 bp, Artificial Sequence
  chemically synthesized
tttaaagatttgattcaaat

SEQ ID NO: 233005 - DNA, 20 bp, Artificial Sequence
  chemically synthesized
catttgaatcaaatctttaa

SEQ ID NO: 233006 - DNA, 20 bp, Artificial Sequence
  chemically synthesized
caacagttgaaattctttta

SEQ ID NO: 233007 - DNA, 20 bp, Artificial Sequence
  chemically synthesized
tgttttcaaaattatatcaa

SEQ ID NO: 233008 - DNA, 20 bp, Artificial Sequence
  chemically synthesized
ttttgaaaacaaactttttt

SEQ ID NO: 233009 - DNA, 20 bp, Artificial Sequence
  chemically synthesized
aattatgcctcaactgaaaa

SEQ ID NO: 233010 - DNA, 20 bp, Artificial Sequence
  chemically synthesized
aaaacaaacttttttcagtt

SEQ ID NO: 233011 - DNA, 20 bp, Artificial Sequence
  chemically synthesized
aaacaaacttttttcagttg

SEQ ID NO: 233012 - DNA, 20 bp, Artificial Sequence
  chemically synthesized
ggcataatttgcatataata

SEQ ID NO: 233013 - DNA, 20 bp, Artificial Sequence
  chemically synthesized
ttgcatataataaagtgcaa

SEQ ID NO: 233014 - DNA, 20 bp, Artificial Sequence
  chemically synthesized
ataataaagtgcaaaagtct

SEQ ID NO: 233015 - DNA, 20 bp, Artificial Sequence
  chemically synthesized
agtgcaaaagtctaagtgtt

SEQ ID NO: 233016 - DNA, 20 bp, Artificial Sequence
  chemically synthesized
aacacatccatccaaacact

SEQ ID NO: 233017 - DNA, 20 bp, Artificial Sequence
  chemically synthesized
caaaagtctaagtgtttgga

SEQ ID NO: 233018 - DNA, 20 bp, Artificial Sequence
  chemically synthesized
ttgttcaggtggtgaataca

SEQ ID NO: 233019 - DNA, 20 bp, Artificial Sequence
  chemically synthesized
tgttgtctattttgttcagg

SEQ ID NO: 233020 - DNA, 20 bp, Artificial Sequence
  chemically synthesized
aaatgttgtctattttgttc

SEQ ID NO: 233021 - DNA, 20 bp, Artificial Sequence
  chemically synthesized
tattcaccacctgaacaaaa

SEQ ID NO: 233022 - DNA, 20 bp, Artificial Sequence
  chemically synthesized
gaaatgttgtctattttgtt

SEQ ID NO: 233023 - DNA, 20 bp, Artificial Sequence
  chemically synthesized
tagtgactttttcggggtaa

SEQ ID NO: 233024 - DNA, 20 bp, Artificial Sequence
  chemically synthesized
acatttccattaccccgaaa

SEQ ID NO: 233025 - DNA, 20 bp, Artificial Sequence
  chemically synthesized
aggcattagtgactttttcg

SEQ ID NO: 233026 - DNA, 20 bp, Artificial Sequence
  chemically synthesized
gaggcattagtgactttttc

SEQ ID NO: 233027 - DNA, 20 bp, Artificial Sequence
  chemically synthesized
agaggcattagtgacttttt

SEQ ID NO: 233028 - DNA, 20 bp, Artificial Sequence
  chemically synthesized
aattgagtggacagaggcat

SEQ ID NO: 233029 - DNA, 20 bp, Artificial Sequence
  chemically synthesized
ggttggaattgagtggacag

SEQ ID NO: 233030 - DNA, 20 bp, Artificial Sequence
  chemically synthesized
gggttggaattgagtggaca

SEQ ID NO: 233031 - DNA, 20 bp, Artificial Sequence
  chemically synthesized
gagggttggaattgagtgga

SEQ ID NO: 233032 - DNA, 20 bp, Artificial Sequence
  chemically synthesized
gggtgagggttggaattgag

SEQ ID NO: 233033 - DNA, 20 bp, Artificial Sequence
  chemically synthesized
tctgggtgagggttggaatt

SEQ ID NO: 233034 - DNA, 20 bp, Artificial Sequence
  chemically synthesized
ggttacctctgggtgagggt

SEQ ID NO: 233035 - DNA, 20 bp, Artificial Sequence
  chemically synthesized
actcaattccaaccctcacc

SEQ ID NO: 233036 - DNA, 20 bp, Artificial Sequence
  chemically synthesized
tcaattccaaccctcaccca

SEQ ID NO: 233037 - DNA, 20 bp, Artificial Sequence
  chemically synthesized
aagtggttacctctgggtga

SEQ ID NO: 233038 - DNA, 20 bp, Artificial Sequence
  chemically synthesized
caattccaaccctcacccag

SEQ ID NO: 233039 - DNA, 20 bp, Artificial Sequence
  chemically synthesized
aaagtggttacctctgggtg

SEQ ID NO: 233040 - DNA, 20 bp, Artificial Sequence
  chemically synthesized
gaaagtggttacctctgggt

SEQ ID NO: 233041 - DNA, 20 bp, Artificial Sequence
  chemically synthesized
ttaagaaagtggttacctct

SEQ ID NO: 233042 - DNA, 20 bp, Artificial Sequence
  chemically synthesized
attaagaaagtggttacctc

SEQ ID NO: 233043 - DNA, 20 bp, Artificial Sequence
  chemically synthesized
cggtaatagaattaagaaag

SEQ ID NO: 233044 - DNA, 20 bp, Artificial Sequence
  chemically synthesized
ttacggtaatagaattaaga

SEQ ID NO: 233045 - DNA, 20 bp, Artificial Sequence
  chemically synthesized
tcaattacggtaatagaatt

SEQ ID NO: 233046 - DNA, 20 bp, Artificial Sequence
  chemically synthesized
gcaaaactcaattacggtaa

SEQ ID NO: 233047 - DNA, 20 bp, Artificial Sequence
  chemically synthesized
ttaattctattaccgtaatt

SEQ ID NO: 233048 - DNA, 20 bp, Artificial Sequence
  chemically synthesized
agcacagcaaaactcaatta

SEQ ID NO: 233049 - DNA, 20 bp, Artificial Sequence
  chemically synthesized
atttacatgaagttaaagca

SEQ ID NO: 233050 - DNA, 20 bp, Artificial Sequence
  chemically synthesized
tgggtatttacatgaagtta

SEQ ID NO: 233051 - DNA, 20 bp, Artificial Sequence
  chemically synthesized
caaatatgggtatttacatg

SEQ ID NO: 233052 - DNA, 20 bp, Artificial Sequence
  chemically synthesized
aaagtcatagacacaaatat

SEQ ID NO: 233053 - DNA, 20 bp, Artificial Sequence
  chemically synthesized
aaaagtcatagacacaaata

SEQ ID NO: 233054 - DNA, 20 bp, Artificial Sequence
  chemically synthesized
atatttgtgtctatgacttt

SEQ ID NO: 233055 - DNA, 20 bp, Artificial Sequence
  chemically synthesized
ttatgctgagccaaaagtca

SEQ ID NO: 233056 - DNA, 20 bp, Artificial Sequence
  chemically synthesized
tgtgtctatgacttttggct

SEQ ID NO: 233057 - DNA, 20 bp, Artificial Sequence
  chemically synthesized
aaaatattatgctgagccaa

SEQ ID NO: 233058 - DNA, 20 bp, Artificial Sequence
  chemically synthesized
aatgtcaaaaatattatgct

SEQ ID NO: 233059 - DNA, 20 bp, Artificial Sequence
  chemically synthesized
ttgacattcattcattcata

SEQ ID NO: 233060 - DNA, 20 bp, Artificial Sequence
  chemically synthesized
catatggttgcttttaccat

SEQ ID NO: 233061 - DNA, 20 bp, Artificial Sequence
  chemically synthesized
agaggaaaaaccaatggtaa

SEQ ID NO: 233062 - DNA, 20 bp, Artificial Sequence
  chemically synthesized
gtgaatagaggaaaaaccaa

SEQ ID NO: 233063 - DNA, 20 bp, Artificial Sequence
  chemically synthesized
ttttactcggcagtgaatag

SEQ ID NO: 233064 - DNA, 20 bp, Artificial Sequence
  chemically synthesized
attttactcggcagtgaata

SEQ ID NO: 233065 - DNA, 20 bp, Artificial Sequence
  chemically synthesized
gaattttactcggcagtgaa

SEQ ID NO: 233066 - DNA, 20 bp, Artificial Sequence
  chemically synthesized
tttttcctctattcactgcc

SEQ ID NO: 233067 - DNA, 20 bp, Artificial Sequence
  chemically synthesized
atgaatggaattttactcgg

SEQ ID NO: 233068 - DNA, 20 bp, Artificial Sequence
  chemically synthesized
accatgaatggaattttact

SEQ ID NO: 233069 - DNA, 20 bp, Artificial Sequence
  chemically synthesized
gccgagtaaaattccattca

SEQ ID NO: 233070 - DNA, 20 bp, Artificial Sequence
  chemically synthesized
tgcctctgttaaaccatgaa

SEQ ID NO: 233071 - DNA, 20 bp, Artificial Sequence
  chemically synthesized
aaattccattcatggtttaa

SEQ ID NO: 233072 - DNA, 20 bp, Artificial Sequence
  chemically synthesized
attccattcatggtttaaca

SEQ ID NO: 233073 - DNA, 20 bp, Artificial Sequence
  chemically synthesized
ttccattcatggtttaacag

SEQ ID NO: 233074 - DNA, 20 bp, Artificial Sequence
  chemically synthesized
cagaggcatcaactttttgt

SEQ ID NO: 233075 - DNA, 20 bp, Artificial Sequence
  chemically synthesized
agaggcatcaactttttgtg

SEQ ID NO: 233076 - DNA, 20 bp, Artificial Sequence
  chemically synthesized
ttccctcactacctcacaaa

SEQ ID NO: 233077 - DNA, 20 bp, Artificial Sequence
  chemically synthesized
ggcatcaactttttgtgagg

SEQ ID NO: 233078 - DNA, 20 bp, Artificial Sequence
  chemically synthesized
tcaactttttgtgaggtagt

SEQ ID NO: 233079 - DNA, 20 bp, Artificial Sequence
  chemically synthesized
caactttttgtgaggtagtg

SEQ ID NO: 233080 - DNA, 20 bp, Artificial Sequence
  chemically synthesized
aactttttgtgaggtagtga

SEQ ID NO: 233081 - DNA, 20 bp, Artificial Sequence
  chemically synthesized
tttttgtgaggtagtgaggg

SEQ ID NO: 233082 - DNA, 20 bp, Artificial Sequence
  chemically synthesized
ttttgtgaggtagtgaggga

SEQ ID NO: 233083 - DNA, 20 bp, Artificial Sequence
  chemically synthesized
ttgtgaggtagtgagggaag

SEQ ID NO: 233084 - DNA, 20 bp, Artificial Sequence
  chemically synthesized
tgtgaggtagtgagggaagg

SEQ ID NO: 233085 - DNA, 20 bp, Artificial Sequence
  chemically synthesized
tgaggtagtgagggaaggag

SEQ ID NO: 233086 - DNA, 20 bp, Artificial Sequence
  chemically synthesized
gaggtagtgagggaaggagg

SEQ ID NO: 233087 - DNA, 20 bp, Artificial Sequence
  chemically synthesized
aggtagtgagggaaggagga

SEQ ID NO: 233088 - DNA, 20 bp, Artificial Sequence
  chemically synthesized
tttacgtatcacatgaaatg

SEQ ID NO: 233089 - DNA, 20 bp, Artificial Sequence
  chemically synthesized
catttcatgtgatacgtaaa

SEQ ID NO: 233090 - DNA, 20 bp, Artificial Sequence
  chemically synthesized
tcatgtgatacgtaaatgga

SEQ ID NO: 233091 - DNA, 20 bp, Artificial Sequence
  chemically synthesized
tgtgatacgtaaatggaaag

SEQ ID NO: 233092 - DNA, 20 bp, Artificial Sequence
  chemically synthesized
cgtaaatggaaagaagcacc

SEQ ID NO: 233093 - DNA, 20 bp, Artificial Sequence
  chemically synthesized
ccttttctctttgtgtagct

SEQ ID NO: 233094 - DNA, 20 bp, Artificial Sequence
  chemically synthesized
tccttttctctttgtgtagc

SEQ ID NO: 233095 - DNA, 20 bp, Artificial Sequence
  chemically synthesized
aagaagcacctagctacaca

SEQ ID NO: 233096 - DNA, 20 bp, Artificial Sequence
  chemically synthesized
gaagcacctagctacacaaa

SEQ ID NO: 233097 - DNA, 20 bp, Artificial Sequence
  chemically synthesized
ctcttccttttctctttgtg

SEQ ID NO: 233098 - DNA, 20 bp, Artificial Sequence
  chemically synthesized
acctagctacacaaagagaa

SEQ ID NO: 233099 - DNA, 20 bp, Artificial Sequence
  chemically synthesized
cctagctacacaaagagaaa

SEQ ID NO: 233100 - DNA, 20 bp, Artificial Sequence
  chemically synthesized
agctacacaaagagaaaagg

SEQ ID NO: 233101 - DNA, 20 bp, Artificial Sequence
  chemically synthesized
ctacacaaagagaaaaggaa

SEQ ID NO: 233102 - DNA, 20 bp, Artificial Sequence
  chemically synthesized
agagaaaaggaagagcattc

SEQ ID NO: 233103 - DNA, 20 bp, Artificial Sequence
  chemically synthesized
gagaaaaggaagagcattct

SEQ ID NO: 233104 - DNA, 20 bp, Artificial Sequence
  chemically synthesized
aggaagagcattctgggtct

SEQ ID NO: 233105 - DNA, 20 bp, Artificial Sequence
  chemically synthesized
tgtttctctgttcttagacc

SEQ ID NO: 233106 - DNA, 20 bp, Artificial Sequence
  chemically synthesized
gagcattctgggtctaagaa

SEQ ID NO: 233107 - DNA, 20 bp, Artificial Sequence
  chemically synthesized
gcattctgggtctaagaaca

SEQ ID NO: 233108 - DNA, 20 bp, Artificial Sequence
  chemically synthesized
tgcacgtgtttctctgttct

SEQ ID NO: 233109 - DNA, 20 bp, Artificial Sequence
  chemically synthesized
agaacagagaaacacgtgca

SEQ ID NO: 233110 - DNA, 20 bp, Artificial Sequence
  chemically synthesized
gaacagagaaacacgtgcaa

SEQ ID NO: 233111 - DNA, 20 bp, Artificial Sequence
  chemically synthesized
gaaacacgtgcaaaggccct

SEQ ID NO: 233112 - DNA, 20 bp, Artificial Sequence
  chemically synthesized
tcactttctaaaacatctca

SEQ ID NO: 233113 - DNA, 20 bp, Artificial Sequence
  chemically synthesized
ctcactttctaaaacatctc

SEQ ID NO: 233114 - DNA, 20 bp, Artificial Sequence
  chemically synthesized
cctcactttctaaaacatct

SEQ ID NO: 233115 - DNA, 20 bp, Artificial Sequence
  chemically synthesized
gcaaaggccctgagatgttt

SEQ ID NO: 233116 - DNA, 20 bp, Artificial Sequence
  chemically synthesized
aggccctgagatgttttaga

SEQ ID NO: 233117 - DNA, 20 bp, Artificial Sequence
  chemically synthesized
cctgagatgttttagaaagt

SEQ ID NO: 233118 - DNA, 20 bp, Artificial Sequence
  chemically synthesized
ctgagatgttttagaaagtg

SEQ ID NO: 233119 - DNA, 20 bp, Artificial Sequence
  chemically synthesized
agatgttttagaaagtgagg

SEQ ID NO: 233120 - DNA, 20 bp, Artificial Sequence
  chemically synthesized
tccatataggataatcatat

SEQ ID NO: 233121 - DNA, 20 bp, Artificial Sequence
  chemically synthesized
actaatatgattatcctata

SEQ ID NO: 233122 - DNA, 20 bp, Artificial Sequence
  chemically synthesized
caacctttctcaatccatat

SEQ ID NO: 233123 - DNA, 20 bp, Artificial Sequence
  chemically synthesized
tcaacctttctcaatccata

SEQ ID NO: 233124 - DNA, 20 bp, Artificial Sequence
  chemically synthesized
atgattatcctatatggatt

SEQ ID NO: 233125 - DNA, 20 bp, Artificial Sequence
  chemically synthesized
ttatcctatatggattgaga

SEQ ID NO: 233126 - DNA, 20 bp, Artificial Sequence
  chemically synthesized
tatcctatatggattgagaa

SEQ ID NO: 233127 - DNA, 20 bp, Artificial Sequence
  chemically synthesized
ggattgagaaaggttgactt

SEQ ID NO: 233128 - DNA, 20 bp, Artificial Sequence
  chemically synthesized
ttgagaaaggttgacttaag

SEQ ID NO: 233129 - DNA, 20 bp, Artificial Sequence
  chemically synthesized
atctttaccattttcttctt

SEQ ID NO: 233130 - DNA, 20 bp, Artificial Sequence
  chemically synthesized
aggttgacttaagaagaaaa

SEQ ID NO: 233131 - DNA, 20 bp, Artificial Sequence
  chemically synthesized
gacttaagaagaaaatggta

SEQ ID NO: 233132 - DNA, 20 bp, Artificial Sequence
  chemically synthesized
taagaagaaaatggtaaaga

SEQ ID NO: 233133 - DNA, 20 bp, Artificial Sequence
  chemically synthesized
gttgtaattcattgtattct

SEQ ID NO: 233134 - DNA, 20 bp, Artificial Sequence
  chemically synthesized
cccaactctttattatggct

SEQ ID NO: 233135 - DNA, 20 bp, Artificial Sequence
  chemically synthesized
ttgtattctaagccataata

SEQ ID NO: 233136 - DNA, 20 bp, Artificial Sequence
  chemically synthesized
gtattctaagccataataaa

SEQ ID NO: 233137 - DNA, 20 bp, Artificial Sequence
  chemically synthesized
gaacacccaactctttatta

SEQ ID NO: 233138 - DNA, 20 bp, Artificial Sequence
  chemically synthesized
tctaagccataataaagagt

SEQ ID NO: 233139 - DNA, 20 bp, Artificial Sequence
  chemically synthesized
ctaagccataataaagagtt

SEQ ID NO: 233140 - DNA, 20 bp, Artificial Sequence
  chemically synthesized
agttgggtgttcatcctaat

SEQ ID NO: 233141 - DNA, 20 bp, Artificial Sequence
  chemically synthesized
cctcatggatttatcttatt

SEQ ID NO: 233142 - DNA, 20 bp, Artificial Sequence
  chemically synthesized
ccctcatggatttatcttat

SEQ ID NO: 233143 - DNA, 20 bp, Artificial Sequence
  chemically synthesized
tcctaataagataaatccat

SEQ ID NO: 233144 - DNA, 20 bp, Artificial Sequence
  chemically synthesized
cctaataagataaatccatg

SEQ ID NO: 233145 - DNA, 20 bp, Artificial Sequence
  chemically synthesized
ctaataagataaatccatga

SEQ ID NO: 233146 - DNA, 20 bp, Artificial Sequence
  chemically synthesized
ttctgtgcttaaggccctca

SEQ ID NO: 233147 - DNA, 20 bp, Artificial Sequence
  chemically synthesized
gataaatccatgagggcctt

SEQ ID NO: 233148 - DNA, 20 bp, Artificial Sequence
  chemically synthesized
atccatgagggccttaagca

SEQ ID NO: 233149 - DNA, 20 bp, Artificial Sequence
  chemically synthesized
taaaggcatttctgtgctta

SEQ ID NO: 233150 - DNA, 20 bp, Artificial Sequence
  chemically synthesized
ataaaggcatttctgtgctt

SEQ ID NO: 233151 - DNA, 20 bp, Artificial Sequence
  chemically synthesized
agcacagaaatgcctttatc

SEQ ID NO: 233152 - DNA, 20 bp, Artificial Sequence
  chemically synthesized
tcaaaatgtcagctagataa

SEQ ID NO: 233153 - DNA, 20 bp, Artificial Sequence
  chemically synthesized
ctcaaaatgtcagctagata

SEQ ID NO: 233154 - DNA, 20 bp, Artificial Sequence
  chemically synthesized
gatcttctcaaaatgtcagc

SEQ ID NO: 233155 - DNA, 20 bp, Artificial Sequence
  chemically synthesized
ctttatctagctgacatttt

SEQ ID NO: 233156 - DNA, 20 bp, Artificial Sequence
  chemically synthesized
aatggatcttctcaaaatgt

SEQ ID NO: 233157 - DNA, 20 bp, Artificial Sequence
  chemically synthesized
tatctagctgacattttgag

SEQ ID NO: 233158 - DNA, 20 bp, Artificial Sequence
  chemically synthesized
aatcctacaccgcagcaaaa

SEQ ID NO: 233159 - DNA, 20 bp, Artificial Sequence
  chemically synthesized
tgagaagatccattttgctg

SEQ ID NO: 233160 - DNA, 20 bp, Artificial Sequence
  chemically synthesized
agatccattttgctgcggtg

SEQ ID NO: 233161 - DNA, 20 bp, Artificial Sequence
  chemically synthesized
gatccattttgctgcggtgt

SEQ ID NO: 233162 - DNA, 20 bp, Artificial Sequence
  chemically synthesized
tcctattcaatcctacaccg

SEQ ID NO: 233163 - DNA, 20 bp, Artificial Sequence
  chemically synthesized
tgctgcggtgtaggattgaa

SEQ ID NO: 233164 - DNA, 20 bp, Artificial Sequence
  chemically synthesized
gctgcggtgtaggattgaat

SEQ ID NO: 233165 - DNA, 20 bp, Artificial Sequence
  chemically synthesized
gcggtgtaggattgaatagg

SEQ ID NO: 233166 - DNA, 20 bp, Artificial Sequence
  chemically synthesized
ggtgtaggattgaataggaa

SEQ ID NO: 233167 - DNA, 20 bp, Artificial Sequence
  chemically synthesized
gaataggaagagaataacaa

SEQ ID NO: 233168 - DNA, 20 bp, Artificial Sequence
  chemically synthesized
taggaagagaataacaacag

SEQ ID NO: 233169 - DNA, 20 bp, Artificial Sequence
  chemically synthesized
aagagaataacaacagtagt

SEQ ID NO: 233170 - DNA, 20 bp, Artificial Sequence
  chemically synthesized
gagaataacaacagtagtaa

SEQ ID NO: 233171 - DNA, 20 bp, Artificial Sequence
  chemically synthesized
taagagaatgtgacctaatc

SEQ ID NO: 233172 - DNA, 20 bp, Artificial Sequence
  chemically synthesized
ctctgccctcttgccagatt

SEQ ID NO: 233173 - DNA, 20 bp, Artificial Sequence
  chemically synthesized
agaatgtgacctaatctggc

SEQ ID NO: 233174 - DNA, 20 bp, Artificial Sequence
  chemically synthesized
cctctgccctcttgccagat

SEQ ID NO: 233175 - DNA, 20 bp, Artificial Sequence
  chemically synthesized
aatgtgacctaatctggcaa

SEQ ID NO: 233176 - DNA, 20 bp, Artificial Sequence
  chemically synthesized
atgtgacctaatctggcaag

SEQ ID NO: 233177 - DNA, 20 bp, Artificial Sequence
  chemically synthesized
tgtgacctaatctggcaaga

SEQ ID NO: 233178 - DNA, 20 bp, Artificial Sequence
  chemically synthesized
ggtcacctctgccctcttgc

SEQ ID NO: 233179 - DNA, 20 bp, Artificial Sequence
  chemically synthesized
gacctaatctggcaagaggg

SEQ ID NO: 233180 - DNA, 20 bp, Artificial Sequence
  chemically synthesized
cctaatctggcaagagggca

SEQ ID NO: 233181 - DNA, 20 bp, Artificial Sequence
  chemically synthesized
ctaatctggcaagagggcag

SEQ ID NO: 233182 - DNA, 20 bp, Artificial Sequence
  chemically synthesized
gcaagagggcagaggtgacc

SEQ ID NO: 233183 - DNA, 20 bp, Artificial Sequence
  chemically synthesized
gggcagaggtgacctggcct

SEQ ID NO: 233184 - DNA, 20 bp, Artificial Sequence
  chemically synthesized
catctcccccatcttaggcc

SEQ ID NO: 233185 - DNA, 20 bp, Artificial Sequence
  chemically synthesized
gcatctcccccatcttaggc

SEQ ID NO: 233186 - DNA, 20 bp, Artificial Sequence
  chemically synthesized
agaggtgacctggcctaaga

SEQ ID NO: 233187 - DNA, 20 bp, Artificial Sequence
  chemically synthesized
gaggtgacctggcctaagat

SEQ ID NO: 233188 - DNA, 20 bp, Artificial Sequence
  chemically synthesized
aggtgacctggcctaagatg

SEQ ID NO: 233189 - DNA, 20 bp, Artificial Sequence
  chemically synthesized
ggtgacctggcctaagatgg

SEQ ID NO: 233190 - DNA, 20 bp, Artificial Sequence
  chemically synthesized
ctctgcatctcccccatctt

SEQ ID NO: 233191 - DNA, 20 bp, Artificial Sequence
  chemically synthesized
cctctgcatctcccccatct

SEQ ID NO: 233192 - DNA, 20 bp, Artificial Sequence
  chemically synthesized
tgacctggcctaagatgggg

SEQ ID NO: 233193 - DNA, 20 bp, Artificial Sequence
  chemically synthesized
ggcctaagatgggggagatg

SEQ ID NO: 233194 - DNA, 20 bp, Artificial Sequence
  chemically synthesized
cctaagatgggggagatgca

SEQ ID NO: 233195 - DNA, 20 bp, Artificial Sequence
  chemically synthesized
ctaagatgggggagatgcag

SEQ ID NO: 233196 - DNA, 20 bp, Artificial Sequence
  chemically synthesized
agatgggggagatgcagagg

SEQ ID NO: 233197 - DNA, 20 bp, Artificial Sequence
  chemically synthesized
atgggggagatgcagaggaa

SEQ ID NO: 233198 - DNA, 20 bp, Artificial Sequence
  chemically synthesized
ggggagatgcagaggaagag

SEQ ID NO: 233199 - DNA, 20 bp, Artificial Sequence
  chemically synthesized
gggagatgcagaggaagaga

SEQ ID NO: 233200 - DNA, 20 bp, Artificial Sequence
  chemically synthesized
gcaaattcaaaataaatttt

SEQ ID NO: 233201 - DNA, 20 bp, Artificial Sequence
  chemically synthesized
aaattcaaaataaatttttg

SEQ ID NO: 233202 - DNA, 20 bp, Artificial Sequence
  chemically synthesized
tcaaaataaatttttggaga

SEQ ID NO: 233203 - DNA, 20 bp, Artificial Sequence
  chemically synthesized
aaataaatttttggagacag

SEQ ID NO: 233204 - DNA, 20 bp, Artificial Sequence
  chemically synthesized
tgcattgcattacttgctta

SEQ ID NO: 233205 - DNA, 20 bp, Artificial Sequence
  chemically synthesized
tttatatctaatctataagc

SEQ ID NO: 233206 - DNA, 20 bp, Artificial Sequence
  chemically synthesized
tgcattacttgcttatagat

SEQ ID NO: 233207 - DNA, 20 bp, Artificial Sequence
  chemically synthesized
ccattttatatctaatctat

SEQ ID NO: 233208 - DNA, 20 bp, Artificial Sequence
  chemically synthesized
cttatagattagatataaaa

SEQ ID NO: 233209 - DNA, 20 bp, Artificial Sequence
  chemically synthesized
ttatagattagatataaaat

SEQ ID NO: 233210 - DNA, 20 bp, Artificial Sequence
  chemically synthesized
atagattagatataaaatgg

SEQ ID NO: 233211 - DNA, 20 bp, Artificial Sequence
  chemically synthesized
ataaaatgggagataaatga

SEQ ID NO: 233212 - DNA, 20 bp, Artificial Sequence
  chemically synthesized
agataaatgatggaatcatg

SEQ ID NO: 233213 - DNA, 20 bp, Artificial Sequence
  chemically synthesized
atctacttgattggtaagca

SEQ ID NO: 233214 - DNA, 20 bp, Artificial Sequence
  chemically synthesized
ttatctacttgattggtaag

SEQ ID NO: 233215 - DNA, 20 bp, Artificial Sequence
  chemically synthesized
gtggactctgcttaccaatc

SEQ ID NO: 233216 - DNA, 20 bp, Artificial Sequence
  chemically synthesized
ttcttatctacttgattggt

SEQ ID NO: 233217 - DNA, 20 bp, Artificial Sequence
  chemically synthesized
gactctgcttaccaatcaag

SEQ ID NO: 233218 - DNA, 20 bp, Artificial Sequence
  chemically synthesized
cttcttcttatctacttgat

SEQ ID NO: 233219 - DNA, 20 bp, Artificial Sequence
  chemically synthesized
tgcttaccaatcaagtagat

SEQ ID NO: 233220 - DNA, 20 bp, Artificial Sequence
  chemically synthesized
ttaccaatcaagtagataag

SEQ ID NO: 233221 - DNA, 20 bp, Artificial Sequence
  chemically synthesized
ccaatcaagtagataagaag

SEQ ID NO: 233222 - DNA, 20 bp, Artificial Sequence
  chemically synthesized
agccctcatctatttcacag

SEQ ID NO: 233223 - DNA, 20 bp, Artificial Sequence
  chemically synthesized
aagaagatactactgtgaaa

SEQ ID NO: 233224 - DNA, 20 bp, Artificial Sequence
  chemically synthesized
cccagccctcatctatttca

SEQ ID NO: 233225 - DNA, 20 bp, Artificial Sequence
  chemically synthesized
gatactactgtgaaatagat

SEQ ID NO: 233226 - DNA, 20 bp, Artificial Sequence
  chemically synthesized
atactactgtgaaatagatg

SEQ ID NO: 233227 - DNA, 20 bp, Artificial Sequence
  chemically synthesized
tactactgtgaaatagatga

SEQ ID NO: 233228 - DNA, 20 bp, Artificial Sequence
  chemically synthesized
actgtgaaatagatgagggc

SEQ ID NO: 233229 - DNA, 20 bp, Artificial Sequence
  chemically synthesized
ctgtgaaatagatgagggct

SEQ ID NO: 233230 - DNA, 20 bp, Artificial Sequence
  chemically synthesized
tgtgaaatagatgagggctg

SEQ ID NO: 233231 - DNA, 20 bp, Artificial Sequence
  chemically synthesized
gaaatagatgagggctgggg

SEQ ID NO: 233232 - DNA, 20 bp, Artificial Sequence
  chemically synthesized
aaatagatgagggctgggga

SEQ ID NO: 233233 - DNA, 20 bp, Artificial Sequence
  chemically synthesized
aatagatgagggctggggaa

SEQ ID NO: 233234 - DNA, 20 bp, Artificial Sequence
  chemically synthesized
atagatgagggctggggaag

SEQ ID NO: 233235 - DNA, 20 bp, Artificial Sequence
  chemically synthesized
ttaaaatctttccccttccc

SEQ ID NO: 233236 - DNA, 20 bp, Artificial Sequence
  chemically synthesized
atgagggctggggaagggga

SEQ ID NO: 233237 - DNA, 20 bp, Artificial Sequence
  chemically synthesized
agattttaaataaaatgtca

SEQ ID NO: 233238 - DNA, 20 bp, Artificial Sequence
  chemically synthesized
aaatgtcaaagctgcatgtg

SEQ ID NO: 233239 - DNA, 20 bp, Artificial Sequence
  chemically synthesized
ttcattggctgccgcacatg

SEQ ID NO: 233240 - DNA, 20 bp, Artificial Sequence
  chemically synthesized
tgtcaaagctgcatgtgcgg

SEQ ID NO: 233241 - DNA, 20 bp, Artificial Sequence
  chemically synthesized
gagcatatgacacaattcat

SEQ ID NO: 233242 - DNA, 20 bp, Artificial Sequence
  chemically synthesized
aatgaattgtgtcatatgct

SEQ ID NO: 233243 - DNA, 20 bp, Artificial Sequence
  chemically synthesized
atgaattgtgtcatatgctc

SEQ ID NO: 233244 - DNA, 20 bp, Artificial Sequence
  chemically synthesized
ccaaacctgcttgttcacct

SEQ ID NO: 233245 - DNA, 20 bp, Artificial Sequence
  chemically synthesized
tgtcatatgctcaggtgaac

SEQ ID NO: 233246 - DNA, 20 bp, Artificial Sequence
  chemically synthesized
catatgctcaggtgaacaag

SEQ ID NO: 233247 - DNA, 20 bp, Artificial Sequence
  chemically synthesized
atatgctcaggtgaacaagc

SEQ ID NO: 233248 - DNA, 20 bp, Artificial Sequence
  chemically synthesized
ctcaggtgaacaagcaggtt

SEQ ID NO: 233249 - DNA, 20 bp, Artificial Sequence
  chemically synthesized
gaacaagcaggtttggaatc

SEQ ID NO: 233250 - DNA, 20 bp, Artificial Sequence
  chemically synthesized
acaagcaggtttggaatcaa

SEQ ID NO: 233251 - DNA, 20 bp, Artificial Sequence
  chemically synthesized
gtttggaatcaagagaaata

SEQ ID NO: 233252 - DNA, 20 bp, Artificial Sequence
  chemically synthesized
tttggaatcaagagaaatat

SEQ ID NO: 233253 - DNA, 20 bp, Artificial Sequence
  chemically synthesized
gaatcaagagaaatatggga

SEQ ID NO: 233254 - DNA, 20 bp, Artificial Sequence
  chemically synthesized
caagagaaatatgggatgga

SEQ ID NO: 233255 - DNA, 20 bp, Artificial Sequence
  chemically synthesized
agaaatatgggatggaaaga

SEQ ID NO: 233256 - DNA, 20 bp, Artificial Sequence
  chemically synthesized
aaatatgggatggaaagata

SEQ ID NO: 233257 - DNA, 20 bp, Artificial Sequence
  chemically synthesized
aatatgggatggaaagatag

SEQ ID NO: 233258 - DNA, 20 bp, Artificial Sequence
  chemically synthesized
tatgggatggaaagatagag

SEQ ID NO: 233259 - DNA, 20 bp, Artificial Sequence
  chemically synthesized
atagaggagttattcaacta

SEQ ID NO: 233260 - DNA, 20 bp, Artificial Sequence
  chemically synthesized
aggagttattcaactaaaga

SEQ ID NO: 233261 - DNA, 20 bp, Artificial Sequence
  chemically synthesized
agttattcaactaaagatgg

SEQ ID NO: 233262 - DNA, 20 bp, Artificial Sequence
  chemically synthesized
acggacttaactgccatctt

SEQ ID NO: 233263 - DNA, 20 bp, Artificial Sequence
  chemically synthesized
ttcaactaaagatggcagtt

SEQ ID NO: 233264 - DNA, 20 bp, Artificial Sequence
  chemically synthesized
aaagatggcagttaagtccg

SEQ ID NO: 233265 - DNA, 20 bp, Artificial Sequence
  chemically synthesized
ggcagttaagtccgtagaaa

SEQ ID NO: 233266 - DNA, 20 bp, Artificial Sequence
  chemically synthesized
ggtgatagcatccatttcta

SEQ ID NO: 233267 - DNA, 20 bp, Artificial Sequence
  chemically synthesized
tagaaatggatgctatcacc

SEQ ID NO: 233268 - DNA, 20 bp, Artificial Sequence
  chemically synthesized
agaaatggatgctatcacct

SEQ ID NO: 233269 - DNA, 20 bp, Artificial Sequence
  chemically synthesized
ttcgctctcctcctaggtga

SEQ ID NO: 233270 - DNA, 20 bp, Artificial Sequence
  chemically synthesized
aaatggatgctatcacctag

SEQ ID NO: 233271 - DNA, 20 bp, Artificial Sequence
  chemically synthesized
aatggatgctatcacctagg

SEQ ID NO: 233272 - DNA, 20 bp, Artificial Sequence
  chemically synthesized
tggatgctatcacctaggag

SEQ ID NO: 233273 - DNA, 20 bp, Artificial Sequence
  chemically synthesized
gatgctatcacctaggagga

SEQ ID NO: 233274 - DNA, 20 bp, Artificial Sequence
  chemically synthesized
tctggtttcgctctcctcct

SEQ ID NO: 233275 - DNA, 20 bp, Artificial Sequence
  chemically synthesized
ttctggtttcgctctcctcc

SEQ ID NO: 233276 - DNA, 20 bp, Artificial Sequence
  chemically synthesized
acctaggaggagagcgaaac

SEQ ID NO: 233277 - DNA, 20 bp, Artificial Sequence
  chemically synthesized
gagagcgaaaccagaaaccc

SEQ ID NO: 233278 - DNA, 20 bp, Artificial Sequence
  chemically synthesized
accttcaatcctagggtttc

SEQ ID NO: 233279 - DNA, 20 bp, Artificial Sequence
  chemically synthesized
agagcgaaaccagaaaccct

SEQ ID NO: 233280 - DNA, 20 bp, Artificial Sequence
  chemically synthesized
agactataccttcaatccta

SEQ ID NO: 233281 - DNA, 20 bp, Artificial Sequence
  chemically synthesized
aaccagaaaccctaggattg

SEQ ID NO: 233282 - DNA, 20 bp, Artificial Sequence
  chemically synthesized
gagactataccttcaatcct

SEQ ID NO: 233283 - DNA, 20 bp, Artificial Sequence
  chemically synthesized
accagaaaccctaggattga

SEQ ID NO: 233284 - DNA, 20 bp, Artificial Sequence
  chemically synthesized
tgagactataccttcaatcc

SEQ ID NO: 233285 - DNA, 20 bp, Artificial Sequence
  chemically synthesized
aaaccctaggattgaaggta

SEQ ID NO: 233286 - DNA, 20 bp, Artificial Sequence
  chemically synthesized
aggtaggtatgtcacagttt

SEQ ID NO: 233287 - DNA, 20 bp, Artificial Sequence
  chemically synthesized
cctcggaggtaggtatgtca

SEQ ID NO: 233288 - DNA, 20 bp, Artificial Sequence
  chemically synthesized
actgtgacatacctacctcc

SEQ ID NO: 233289 - DNA, 20 bp, Artificial Sequence
  chemically synthesized
ctgtgacatacctacctccg

SEQ ID NO: 233290 - DNA, 20 bp, Artificial Sequence
  chemically synthesized
gttccaaattcctcggaggt

SEQ ID NO: 233291 - DNA, 20 bp, Artificial Sequence
  chemically synthesized
tgttccaaattcctcggagg

SEQ ID NO: 233292 - DNA, 20 bp, Artificial Sequence
  chemically synthesized
agttgttccaaattcctcgg

SEQ ID NO: 233293 - DNA, 20 bp, Artificial Sequence
  chemically synthesized
gagttgttccaaattcctcg

SEQ ID NO: 233294 - DNA, 20 bp, Artificial Sequence
  chemically synthesized
atacctacctccgaggaatt

SEQ ID NO: 233295 - DNA, 20 bp, Artificial Sequence
  chemically synthesized
gtgagttgttccaaattcct

SEQ ID NO: 233296 - DNA, 20 bp, Artificial Sequence
  chemically synthesized
aggaatttggaacaactcac

SEQ ID NO: 233297 - DNA, 20 bp, Artificial Sequence
  chemically synthesized
ggaatttggaacaactcact

SEQ ID NO: 233298 - DNA, 20 bp, Artificial Sequence
  chemically synthesized
gttttcttttgtgtcccagt

SEQ ID NO: 233299 - DNA, 20 bp, Artificial Sequence
  chemically synthesized
cacagttttcttttgtgtcc

SEQ ID NO: 233300 - DNA, 20 bp, Artificial Sequence
  chemically synthesized
aacaactcactgggacacaa

SEQ ID NO: 233301 - DNA, 20 bp, Artificial Sequence
  chemically synthesized
aacacaaatagaagcattca

SEQ ID NO: 233302 - DNA, 20 bp, Artificial Sequence
  chemically synthesized
ataaatgcaaacacaaatag

SEQ ID NO: 233303 - DNA, 20 bp, Artificial Sequence
  chemically synthesized
aatataaatgcaaacacaaa

SEQ ID NO: 233304 - DNA, 20 bp, Artificial Sequence
  chemically synthesized
catgtaaacgtatgtgaaaa

SEQ ID NO: 233305 - DNA, 20 bp, Artificial Sequence
  chemically synthesized
ttcacatacgtttacatgct

SEQ ID NO: 233306 - DNA, 20 bp, Artificial Sequence
  chemically synthesized
aatcatatatgaatatgact

SEQ ID NO: 233307 - DNA, 20 bp, Artificial Sequence
  chemically synthesized
acaaataaatgtacattttg

SEQ ID NO: 233308 - DNA, 20 bp, Artificial Sequence
  chemically synthesized
caaataaatgtacattttgt

SEQ ID NO: 233309 - DNA, 20 bp, Artificial Sequence
  chemically synthesized
ataaatgtacattttgtggg

SEQ ID NO: 233310 - DNA, 20 bp, Artificial Sequence
  chemically synthesized
gtgggaagaaatgtgcttat

SEQ ID NO: 233311 - DNA, 20 bp, Artificial Sequence
  chemically synthesized
ctaattgaaacaaaacttat

SEQ ID NO: 233312 - DNA, 20 bp, Artificial Sequence
  chemically synthesized
cttataagttttgtttcaat

SEQ ID NO: 233313 - DNA, 20 bp, Artificial Sequence
  chemically synthesized
taagttttgtttcaattaga

SEQ ID NO: 233314 - DNA, 20 bp, Artificial Sequence
  chemically synthesized
gttttgtttcaattagaaag

SEQ ID NO: 233315 - DNA, 20 bp, Artificial Sequence
  chemically synthesized
gcaatgctcttcaaaatttc

SEQ ID NO: 233316 - DNA, 20 bp, Artificial Sequence
  chemically synthesized
aaagcagtcttgaaattttg

SEQ ID NO: 233317 - DNA, 20 bp, Artificial Sequence
  chemically synthesized
agcagtcttgaaattttgaa

SEQ ID NO: 233318 - DNA, 20 bp, Artificial Sequence
  chemically synthesized
aattttgaagagcattgcct

SEQ ID NO: 233319 - DNA, 20 bp, Artificial Sequence
  chemically synthesized
ttttgaagagcattgcctta

SEQ ID NO: 233320 - DNA, 20 bp, Artificial Sequence
  chemically synthesized
tttgaagagcattgccttag

SEQ ID NO: 233321 - DNA, 20 bp, Artificial Sequence
  chemically synthesized
cctccgcctcttgacctcta

SEQ ID NO: 233322 - DNA, 20 bp, Artificial Sequence
  chemically synthesized
agagcattgccttagaggtc

SEQ ID NO: 233323 - DNA, 20 bp, Artificial Sequence
  chemically synthesized
tcctccgcctcttgacctct

SEQ ID NO: 233324 - DNA, 20 bp, Artificial Sequence
  chemically synthesized
agcattgccttagaggtcaa

SEQ ID NO: 233325 - DNA, 20 bp, Artificial Sequence
  chemically synthesized
gcattgccttagaggtcaag

SEQ ID NO: 233326 - DNA, 20 bp, Artificial Sequence
  chemically synthesized
ttgccttagaggtcaagagg

SEQ ID NO: 233327 - DNA, 20 bp, Artificial Sequence
  chemically synthesized
gccttagaggtcaagaggcg

SEQ ID NO: 233328 - DNA, 20 bp, Artificial Sequence
  chemically synthesized
ccttagaggtcaagaggcgg

SEQ ID NO: 233329 - DNA, 20 bp, Artificial Sequence
  chemically synthesized
ttagaggtcaagaggcggag

SEQ ID NO: 233330 - DNA, 20 bp, Artificial Sequence
  chemically synthesized
tagaggtcaagaggcggagg

SEQ ID NO: 233331 - DNA, 20 bp, Artificial Sequence
  chemically synthesized
gaggtcaagaggcggaggag

SEQ ID NO: 233332 - DNA, 20 bp, Artificial Sequence
  chemically synthesized
tcaagaggcggaggaggagc

SEQ ID NO: 233333 - DNA, 20 bp, Artificial Sequence
  chemically synthesized
agaggcggaggaggagctag

SEQ ID NO: 233334 - DNA, 20 bp, Artificial Sequence
  chemically synthesized
ggaggaggagctagcagaaa

SEQ ID NO: 233335 - DNA, 20 bp, Artificial Sequence
  chemically synthesized
ttcttttcagctgtttctgc

SEQ ID NO: 233336 - DNA, 20 bp, Artificial Sequence
  chemically synthesized
agctagcagaaacagctgaa

SEQ ID NO: 233337 - DNA, 20 bp, Artificial Sequence
  chemically synthesized
tagcagaaacagctgaaaag

SEQ ID NO: 233338 - DNA, 20 bp, Artificial Sequence
  chemically synthesized
gaagctcactggcttctttt

SEQ ID NO: 233339 - DNA, 20 bp, Artificial Sequence
  chemically synthesized
agaaacagctgaaaagaagc

SEQ ID NO: 233340 - DNA, 20 bp, Artificial Sequence
  chemically synthesized
acagctgaaaagaagccagt

SEQ ID NO: 233341 - DNA, 20 bp, Artificial Sequence
  chemically synthesized
taacttctgttgaagctcac

SEQ ID NO: 233342 - DNA, 20 bp, Artificial Sequence
  chemically synthesized
aagaagccagtgagcttcaa

SEQ ID NO: 233343 - DNA, 20 bp, Artificial Sequence
  chemically synthesized
aagccagtgagcttcaacag

SEQ ID NO: 233344 - DNA, 20 bp, Artificial Sequence
  chemically synthesized
tgaaacaataacttctgttg

SEQ ID NO: 233345 - DNA, 20 bp, Artificial Sequence
  chemically synthesized
tcaacagaagttattgtttc

SEQ ID NO: 233346 - DNA, 20 bp, Artificial Sequence
  chemically synthesized
acagaagttattgtttcaag

SEQ ID NO: 233347 - DNA, 20 bp, Artificial Sequence
  chemically synthesized
aagttattgtttcaagaaga

SEQ ID NO: 233348 - DNA, 20 bp, Artificial Sequence
  chemically synthesized
agttattgtttcaagaagaa

SEQ ID NO: 233349 - DNA, 20 bp, Artificial Sequence
  chemically synthesized
gttattgtttcaagaagaaa

SEQ ID NO: 233350 - DNA, 20 bp, Artificial Sequence
  chemically synthesized
tattgtttcaagaagaaagg

SEQ ID NO: 233351 - DNA, 20 bp, Artificial Sequence
  chemically synthesized
cagatagaaagagggaacaa

SEQ ID NO: 233352 - DNA, 20 bp, Artificial Sequence
  chemically synthesized
caactgcacagatagaaaga

SEQ ID NO: 233353 - DNA, 20 bp, Artificial Sequence
  chemically synthesized
acaactgcacagatagaaag

SEQ ID NO: 233354 - DNA, 20 bp, Artificial Sequence
  chemically synthesized
cacaactgcacagatagaaa

SEQ ID NO: 233355 - DNA, 20 bp, Artificial Sequence
  chemically synthesized
cccacaactgcacagataga

SEQ ID NO: 233356 - DNA, 20 bp, Artificial Sequence
  chemically synthesized
gttccctctttctatctgtg

SEQ ID NO: 233357 - DNA, 20 bp, Artificial Sequence
  chemically synthesized
atttcccacaactgcacaga

SEQ ID NO: 233358 - DNA, 20 bp, Artificial Sequence
  chemically synthesized
tcacatttcccacaactgca

SEQ ID NO: 233359 - DNA, 20 bp, Artificial Sequence
  chemically synthesized
tctttctatctgtgcagttg

SEQ ID NO: 233360 - DNA, 20 bp, Artificial Sequence
  chemically synthesized
ctttctatctgtgcagttgt

SEQ ID NO: 233361 - DNA, 20 bp, Artificial Sequence
  chemically synthesized
ttgtgggaaatgtgaactca

SEQ ID NO: 233362 - DNA, 20 bp, Artificial Sequence
  chemically synthesized
gaccacacgagacaaactat

SEQ ID NO: 233363 - DNA, 20 bp, Artificial Sequence
  chemically synthesized
aactcatagtttgtctcgtg

SEQ ID NO: 233364 - DNA, 20 bp, Artificial Sequence
  chemically synthesized
catttggaacaggaccacac

SEQ ID NO: 233365 - DNA, 20 bp, Artificial Sequence
  chemically synthesized
gcaagtatggcatttggaac

SEQ ID NO: 233366 - DNA, 20 bp, Artificial Sequence
  chemically synthesized
agcaagtatggcatttggaa

SEQ ID NO: 233367 - DNA, 20 bp, Artificial Sequence
  chemically synthesized
tttccagcaagtatggcatt

SEQ ID NO: 233368 - DNA, 20 bp, Artificial Sequence
  chemically synthesized
gttccaaatgccatacttgc

SEQ ID NO: 233369 - DNA, 20 bp, Artificial Sequence
  chemically synthesized
cactctatttccagcaagta

SEQ ID NO: 233370 - DNA, 20 bp, Artificial Sequence
  chemically synthesized
ctctgcactctatttccagc

SEQ ID NO: 233371 - DNA, 20 bp, Artificial Sequence
  chemically synthesized
aatgccatacttgctggaaa

SEQ ID NO: 233372 - DNA, 20 bp, Artificial Sequence
  chemically synthesized
tgccatacttgctggaaata

SEQ ID NO: 233373 - DNA, 20 bp, Artificial Sequence
  chemically synthesized
gatgctctgcactctatttc

SEQ ID NO: 233374 - DNA, 20 bp, Artificial Sequence
  chemically synthesized
tacttgctggaaatagagtg

SEQ ID NO: 233375 - DNA, 20 bp, Artificial Sequence
  chemically synthesized
cttgctggaaatagagtgca

SEQ ID NO: 233376 - DNA, 20 bp, Artificial Sequence
  chemically synthesized
agtgcagagcatccataaaa

SEQ ID NO: 233377 - DNA, 20 bp, Artificial Sequence
  chemically synthesized
tagtcttatagactgtttta

SEQ ID NO: 233378 - DNA, 20 bp, Artificial Sequence
  chemically synthesized
gcatccataaaacagtctat

SEQ ID NO: 233379 - DNA, 20 bp, Artificial Sequence
  chemically synthesized
ataaaacagtctataagact

SEQ ID NO: 233380 - DNA, 20 bp, Artificial Sequence
  chemically synthesized
cttatatatgcttagtctta

SEQ ID NO: 233381 - DNA, 20 bp, Artificial Sequence
  chemically synthesized
ttggcagccttatatatgct

SEQ ID NO: 233382 - DNA, 20 bp, Artificial Sequence
  chemically synthesized
ctataagactaagcatatat

SEQ ID NO: 233383 - DNA, 20 bp, Artificial Sequence
  chemically synthesized
tataagactaagcatatata

SEQ ID NO: 233384 - DNA, 20 bp, Artificial Sequence
  chemically synthesized
aagcatatataaggctgcca

SEQ ID NO: 233385 - DNA, 20 bp, Artificial Sequence
  chemically synthesized
catatataaggctgccaaag

SEQ ID NO: 233386 - DNA, 20 bp, Artificial Sequence
  chemically synthesized
gtaacaaatgacttctttgg

SEQ ID NO: 233387 - DNA, 20 bp, Artificial Sequence
  chemically synthesized
atagtaacaaatgacttctt

SEQ ID NO: 233388 - DNA, 20 bp, Artificial Sequence
  chemically synthesized
aaaatgaatgggaagataga

SEQ ID NO: 233389 - DNA, 20 bp, Artificial Sequence
  chemically synthesized
tgagaaaatgaatgggaaga

SEQ ID NO: 233390 - DNA, 20 bp, Artificial Sequence
  chemically synthesized
gacttgagaaaatgaatggg

SEQ ID NO: 233391 - DNA, 20 bp, Artificial Sequence
  chemically synthesized
ctagacttgagaaaatgaat

SEQ ID NO: 233392 - DNA, 20 bp, Artificial Sequence
  chemically synthesized
actagacttgagaaaatgaa

SEQ ID NO: 233393 - DNA, 20 bp, Artificial Sequence
  chemically synthesized
atcttcccattcattttctc

SEQ ID NO: 233394 - DNA, 20 bp, Artificial Sequence
  chemically synthesized
cccattcattttctcaagtc

SEQ ID NO: 233395 - DNA, 20 bp, Artificial Sequence
  chemically synthesized
ccagcagaagaactagactt

SEQ ID NO: 233396 - DNA, 20 bp, Artificial Sequence
  chemically synthesized
ccacaggccagcagaagaac

SEQ ID NO: 233397 - DNA, 20 bp, Artificial Sequence
  chemically synthesized
ctcaagtctagttcttctgc

SEQ ID NO: 233398 - DNA, 20 bp, Artificial Sequence
  chemically synthesized
ccctaaccacaggccagcag

SEQ ID NO: 233399 - DNA, 20 bp, Artificial Sequence
  chemically synthesized
accccctaaccacaggccag

SEQ ID NO: 233400 - DNA, 20 bp, Artificial Sequence
  chemically synthesized
ctagttcttctgctggcctg

SEQ ID NO: 233401 - DNA, 20 bp, Artificial Sequence
  chemically synthesized
taaaccccctaaccacaggc

SEQ ID NO: 233402 - DNA, 20 bp, Artificial Sequence
  chemically synthesized
ttcttctgctggcctgtggt

SEQ ID NO: 233403 - DNA, 20 bp, Artificial Sequence
  chemically synthesized
tcttctgctggcctgtggtt

SEQ ID NO: 233404 - DNA, 20 bp, Artificial Sequence
  chemically synthesized
cttctgctggcctgtggtta

SEQ ID NO: 233405 - DNA, 20 bp, Artificial Sequence
  chemically synthesized
agaataaaccccctaaccac

SEQ ID NO: 233406 - DNA, 20 bp, Artificial Sequence
  chemically synthesized
ttctgctggcctgtggttag

SEQ ID NO: 233407 - DNA, 20 bp, Artificial Sequence
  chemically synthesized
cagaataaaccccctaacca

SEQ ID NO: 233408 - DNA, 20 bp, Artificial Sequence
  chemically synthesized
tctgctggcctgtggttagg

SEQ ID NO: 233409 - DNA, 20 bp, Artificial Sequence
  chemically synthesized
gtggttagggggtttattct

SEQ ID NO: 233410 - DNA, 20 bp, Artificial Sequence
  chemically synthesized
taaagacacagggaaatact

SEQ ID NO: 233411 - DNA, 20 bp, Artificial Sequence
  chemically synthesized
tgtgaagttttaaagacaca

SEQ ID NO: 233412 - DNA, 20 bp, Artificial Sequence
  chemically synthesized
atgtgaagttttaaagacac

SEQ ID NO: 233413 - DNA, 20 bp, Artificial Sequence
  chemically synthesized
aatgtgaagttttaaagaca

SEQ ID NO: 233414 - DNA, 20 bp, Artificial Sequence
  chemically synthesized
aatataaatgtgaagtttta

SEQ ID NO: 233415 - DNA, 20 bp, Artificial Sequence
  chemically synthesized
taccatcaaatataaatgtg

SEQ ID NO: 233416 - DNA, 20 bp, Artificial Sequence
  chemically synthesized
aacttcacatttatatttga

SEQ ID NO: 233417 - DNA, 20 bp, Artificial Sequence
  chemically synthesized
caagtaacctgatgatttca

SEQ ID NO: 233418 - DNA, 20 bp, Artificial Sequence
  chemically synthesized
atggtattccatgaaatcat

SEQ ID NO: 233419 - DNA, 20 bp, Artificial Sequence
  chemically synthesized
tggtattccatgaaatcatc

SEQ ID NO: 233420 - DNA, 20 bp, Artificial Sequence
  chemically synthesized
gaaatcatcaggttacttgt

SEQ ID NO: 233421 - DNA, 20 bp, Artificial Sequence
  chemically synthesized
aaatcatcaggttacttgtc

SEQ ID NO: 233422 - DNA, 20 bp, Artificial Sequence
  chemically synthesized
tgtaatatttgaaacctgac

SEQ ID NO: 233423 - DNA, 20 bp, Artificial Sequence
  chemically synthesized
aaatattacatgaactattt

SEQ ID NO: 233424 - DNA, 20 bp, Artificial Sequence
  chemically synthesized
atgtacatttttttccaaaa

SEQ ID NO: 233425 - DNA, 20 bp, Artificial Sequence
  chemically synthesized
ttggaaaaaaatgtacattt

SEQ ID NO: 233426 - DNA, 20 bp, Artificial Sequence
  chemically synthesized
tggaaaaaaatgtacatttc

SEQ ID NO: 233427 - DNA, 20 bp, Artificial Sequence
  chemically synthesized
gtacatttcaggctcatttc

SEQ ID NO: 233428 - DNA, 20 bp, Artificial Sequence
  chemically synthesized
tattgtttaggactggaaat

SEQ ID NO: 233429 - DNA, 20 bp, Artificial Sequence
  chemically synthesized
taatttatattgtttaggac

SEQ ID NO: 233430 - DNA, 20 bp, Artificial Sequence
  chemically synthesized
ggctataatttatattgttt

SEQ ID NO: 233431 - DNA, 20 bp, Artificial Sequence
  chemically synthesized
tggctataatttatattgtt

SEQ ID NO: 233432 - DNA, 20 bp, Artificial Sequence
  chemically synthesized
gtcctaaacaatataaatta

SEQ ID NO: 233433 - DNA, 20 bp, Artificial Sequence
  chemically synthesized
aaacaatataaattatagcc

SEQ ID NO: 233434 - DNA, 20 bp, Artificial Sequence
  chemically synthesized
atataaattatagccaagta

SEQ ID NO: 233435 - DNA, 20 bp, Artificial Sequence
  chemically synthesized
taatggctaaatgccatact

SEQ ID NO: 233436 - DNA, 20 bp, Artificial Sequence
  chemically synthesized
ttatagccaagtatggcatt

SEQ ID NO: 233437 - DNA, 20 bp, Artificial Sequence
  chemically synthesized
gaagtgaaagacagcattaa

SEQ ID NO: 233438 - DNA, 20 bp, Artificial Sequence
  chemically synthesized
tacattactgaagtgaaaga

SEQ ID NO: 233439 - DNA, 20 bp, Artificial Sequence
  chemically synthesized
attaatgctgtctttcactt

SEQ ID NO: 233440 - DNA, 20 bp, Artificial Sequence
  chemically synthesized
tctttacattactgaagtga

SEQ ID NO: 233441 - DNA, 20 bp, Artificial Sequence
  chemically synthesized
attatttctttacattactg

SEQ ID NO: 233442 - DNA, 20 bp, Artificial Sequence
  chemically synthesized
tctttcacttcagtaatgta

SEQ ID NO: 233443 - DNA, 20 bp, Artificial Sequence
  chemically synthesized
tcagtaatgtaaagaaataa

SEQ ID NO: 233444 - DNA, 20 bp, Artificial Sequence
  chemically synthesized
cagtaatgtaaagaaataat

SEQ ID NO: 233445 - DNA, 20 bp, Artificial Sequence
  chemically synthesized
tgtattatccaagttgtcat

SEQ ID NO: 233446 - DNA, 20 bp, Artificial Sequence
  chemically synthesized
ataataggcttatgacaact

SEQ ID NO: 233447 - DNA, 20 bp, Artificial Sequence
  chemically synthesized
gaagcttaaatgtattatcc

SEQ ID NO: 233448 - DNA, 20 bp, Artificial Sequence
  chemically synthesized
acaacttggataatacattt

SEQ ID NO: 233449 - DNA, 20 bp, Artificial Sequence
  chemically synthesized
tatctggagcaataatgtag

SEQ ID NO: 233450 - DNA, 20 bp, Artificial Sequence
  chemically synthesized
ttatatctggagcaataatg

SEQ ID NO: 233451 - DNA, 20 bp, Artificial Sequence
  chemically synthesized
aagcttctacattattgctc

SEQ ID NO: 233452 - DNA, 20 bp, Artificial Sequence
  chemically synthesized
aaaaattttttttatatctg

SEQ ID NO: 233453 - DNA, 20 bp, Artificial Sequence
  chemically synthesized
tgaaaaattttttttatatc

SEQ ID NO: 233454 - DNA, 20 bp, Artificial Sequence
  chemically synthesized
aaaaaaaatttttcacttca

SEQ ID NO: 233455 - DNA, 20 bp, Artificial Sequence
  chemically synthesized
aaaaaatttttcacttcaca

SEQ ID NO: 233456 - DNA, 20 bp, Artificial Sequence
  chemically synthesized
aaaaatttttcacttcacag

SEQ ID NO: 233457 - DNA, 20 bp, Artificial Sequence
  chemically synthesized
ttcaaggtagaacctctgtg

SEQ ID NO: 233458 - DNA, 20 bp, Artificial Sequence
  chemically synthesized
ttcacagaggttctaccttg

SEQ ID NO: 233459 - DNA, 20 bp, Artificial Sequence
  chemically synthesized
ctggttttctttcttcaagg

SEQ ID NO: 233460 - DNA, 20 bp, Artificial Sequence
  chemically synthesized
cagaggttctaccttgaaga

SEQ ID NO: 233461 - DNA, 20 bp, Artificial Sequence
  chemically synthesized
agcctggttttctttcttca

SEQ ID NO: 233462 - DNA, 20 bp, Artificial Sequence
  chemically synthesized
gagcctggttttctttcttc

SEQ ID NO: 233463 - DNA, 20 bp, Artificial Sequence
  chemically synthesized
ctaccttgaagaaagaaaac

SEQ ID NO: 233464 - DNA, 20 bp, Artificial Sequence
  chemically synthesized
taccttgaagaaagaaaacc

SEQ ID NO: 233465 - DNA, 20 bp, Artificial Sequence
  chemically synthesized
gaagaaagaaaaccaggctc

SEQ ID NO: 233466 - DNA, 20 bp, Artificial Sequence
  chemically synthesized
tcaggcttatatctggagcc

SEQ ID NO: 233467 - DNA, 20 bp, Artificial Sequence
  chemically synthesized
gaaaaccaggctccagatat

SEQ ID NO: 233468 - DNA, 20 bp, Artificial Sequence
  chemically synthesized
aagtttcaggcttatatctg

SEQ ID NO: 233469 - DNA, 20 bp, Artificial Sequence
  chemically synthesized
gaaagtttcaggcttatatc

SEQ ID NO: 233470 - DNA, 20 bp, Artificial Sequence
  chemically synthesized
cagaaactcaggaaagtttc

SEQ ID NO: 233471 - DNA, 20 bp, Artificial Sequence
  chemically synthesized
tcagaaactcaggaaagttt

SEQ ID NO: 233472 - DNA, 20 bp, Artificial Sequence
  chemically synthesized
tataagcctgaaactttcct

SEQ ID NO: 233473 - DNA, 20 bp, Artificial Sequence
  chemically synthesized
caaaagtcagaaactcagga

SEQ ID NO: 233474 - DNA, 20 bp, Artificial Sequence
  chemically synthesized
ctggcaaaagtcagaaactc

SEQ ID NO: 233475 - DNA, 20 bp, Artificial Sequence
  chemically synthesized
gctggcaaaagtcagaaact

SEQ ID NO: 233476 - DNA, 20 bp, Artificial Sequence
  chemically synthesized
atgaaatggctggcaaaagt

SEQ ID NO: 233477 - DNA, 20 bp, Artificial Sequence
  chemically synthesized
cctgagtttctgacttttgc

SEQ ID NO: 233478 - DNA, 20 bp, Artificial Sequence
  chemically synthesized
tgtgatgaaatggctggcaa

SEQ ID NO: 233479 - DNA, 20 bp, Artificial Sequence
  chemically synthesized
tgttagtgtgatgaaatggc

SEQ ID NO: 233480 - DNA, 20 bp, Artificial Sequence
  chemically synthesized
atgttgttagtgtgatgaaa

SEQ ID NO: 233481 - DNA, 20 bp, Artificial Sequence
  chemically synthesized
ctatttaaggtttatgttgt

SEQ ID NO: 233482 - DNA, 20 bp, Artificial Sequence
  chemically synthesized
ctaacaacataaaccttaaa

SEQ ID NO: 233483 - DNA, 20 bp, Artificial Sequence
  chemically synthesized
acatttgttttaactattta

SEQ ID NO: 233484 - DNA, 20 bp, Artificial Sequence
  chemically synthesized
tacatttgttttaactattt

SEQ ID NO: 233485 - DNA, 20 bp, Artificial Sequence
  chemically synthesized
taaatagttaaaacaaatgt

SEQ ID NO: 233486 - DNA, 20 bp, Artificial Sequence
  chemically synthesized
aaatagttaaaacaaatgta

SEQ ID NO: 233487 - DNA, 20 bp, Artificial Sequence
  chemically synthesized
atttatgttatatattcaaa

SEQ ID NO: 233488 - DNA, 20 bp, Artificial Sequence
  chemically synthesized
atattcaaatggatatacca

SEQ ID NO: 233489 - DNA, 20 bp, Artificial Sequence
  chemically synthesized
taataggttctttttttcca

SEQ ID NO: 233490 - DNA, 20 bp, Artificial Sequence
  chemically synthesized
atggatataccatggaaaaa

SEQ ID NO: 233491 - DNA, 20 bp, Artificial Sequence
  chemically synthesized
caaactaaatattcagtaat

SEQ ID NO: 233492 - DNA, 20 bp, Artificial Sequence
  chemically synthesized
gcaaactaaatattcagtaa

SEQ ID NO: 233493 - DNA, 20 bp, Artificial Sequence
  chemically synthesized
agaacctattactgaatatt

SEQ ID NO: 233494 - DNA, 20 bp, Artificial Sequence
  chemically synthesized
cctgaagcaaactaaatatt

SEQ ID NO: 233495 - DNA, 20 bp, Artificial Sequence
  chemically synthesized
actgaatatttagtttgctt

SEQ ID NO: 233496 - DNA, 20 bp, Artificial Sequence
  chemically synthesized
ctgaatatttagtttgcttc

SEQ ID NO: 233497 - DNA, 20 bp, Artificial Sequence
  chemically synthesized
tataatgattgcgaagcctg

SEQ ID NO: 233498 - DNA, 20 bp, Artificial Sequence
  chemically synthesized
tggaatctataatgattgcg

SEQ ID NO: 233499 - DNA, 20 bp, Artificial Sequence
  chemically synthesized
ttcaggcttcgcaatcatta

SEQ ID NO: 233500 - DNA, 20 bp, Artificial Sequence
  chemically synthesized
gcacatatatatattaaatg

SEQ ID NO: 233501 - DNA, 20 bp, Artificial Sequence
  chemically synthesized
aatatatatatgtgctgatt

SEQ ID NO: 233502 - DNA, 20 bp, Artificial Sequence
  chemically synthesized
aataatgaagacaactcaat

SEQ ID NO: 233503 - DNA, 20 bp, Artificial Sequence
  chemically synthesized
atattttataagaaataatg

SEQ ID NO: 233504 - DNA, 20 bp, Artificial Sequence
  chemically synthesized
gaacattggagatattttat

SEQ ID NO: 233505 - DNA, 20 bp, Artificial Sequence
  chemically synthesized
gatcaatagattgaacattg

SEQ ID NO: 233506 - DNA, 20 bp, Artificial Sequence
  chemically synthesized
atgatcaatagattgaacat

SEQ ID NO: 233507 - DNA, 20 bp, Artificial Sequence
  chemically synthesized
ttttctttcaacatgatcaa

SEQ ID NO: 233508 - DNA, 20 bp, Artificial Sequence
  chemically synthesized
caatctattgatcatgttga

SEQ ID NO: 233509 - DNA, 20 bp, Artificial Sequence
  chemically synthesized
attgatcatgttgaaagaaa

SEQ ID NO: 233510 - DNA, 20 bp, Artificial Sequence
  chemically synthesized
ttgatcatgttgaaagaaaa

SEQ ID NO: 233511 - DNA, 20 bp, Artificial Sequence
  chemically synthesized
tgatcatgttgaaagaaaaa

SEQ ID NO: 233512 - DNA, 20 bp, Artificial Sequence
  chemically synthesized
atgttgaaagaaaaagggtt

SEQ ID NO: 233513 - DNA, 20 bp, Artificial Sequence
  chemically synthesized
gaaagaaaaagggtttagat

SEQ ID NO: 233514 - DNA, 20 bp, Artificial Sequence
  chemically synthesized
agagtatatatgtatgtgta

SEQ ID NO: 233515 - DNA, 20 bp, Artificial Sequence
  chemically synthesized
tacacatacatatatactct

SEQ ID NO: 233516 - DNA, 20 bp, Artificial Sequence
  chemically synthesized
acacatacatatatactctc

SEQ ID NO: 233517 - DNA, 20 bp, Artificial Sequence
  chemically synthesized
ttgttttatcatgatcccga

SEQ ID NO: 233518 - DNA, 20 bp, Artificial Sequence
  chemically synthesized
tcttgttttatcatgatccc

SEQ ID NO: 233519 - DNA, 20 bp, Artificial Sequence
  chemically synthesized
tctcgggatcatgataaaac

SEQ ID NO: 233520 - DNA, 20 bp, Artificial Sequence
  chemically synthesized
gggatcatgataaaacaaga

SEQ ID NO: 233521 - DNA, 20 bp, Artificial Sequence
  chemically synthesized
ggatcatgataaaacaagac

SEQ ID NO: 233522 - DNA, 20 bp, Artificial Sequence
  chemically synthesized
tcatgataaaacaagacagg

SEQ ID NO: 233523 - DNA, 20 bp, Artificial Sequence
  chemically synthesized
ataaaacaagacaggtggcc

SEQ ID NO: 233524 - DNA, 20 bp, Artificial Sequence
  chemically synthesized
acaagacaggtggcctggca

SEQ ID NO: 233525 - DNA, 20 bp, Artificial Sequence
  chemically synthesized
agacaggtggcctggcacgg

SEQ ID NO: 233526 - DNA, 20 bp, Artificial Sequence
  chemically synthesized
caggcgtgagccaccgtgcc

SEQ ID NO: 233527 - DNA, 20 bp, Artificial Sequence
  chemically synthesized
acaggcgtgagccaccgtgc

SEQ ID NO: 233528 - DNA, 20 bp, Artificial Sequence
  chemically synthesized
agtgctgggattacaggcgt

SEQ ID NO: 233529 - DNA, 20 bp, Artificial Sequence
  chemically synthesized
gtggctcacgcctgtaatcc

SEQ ID NO: 233530 - DNA, 20 bp, Artificial Sequence
  chemically synthesized
tcccaaagtgctgggattac

SEQ ID NO: 233531 - DNA, 20 bp, Artificial Sequence
  chemically synthesized
ctcccaaagtgctgggatta

SEQ ID NO: 233532 - DNA, 20 bp, Artificial Sequence
  chemically synthesized
cgcctgtaatcccagcactt

SEQ ID NO: 233533 - DNA, 20 bp, Artificial Sequence
  chemically synthesized
ccttggcctcccaaagtgct

SEQ ID NO: 233534 - DNA, 20 bp, Artificial Sequence
  chemically synthesized
gcctgtaatcccagcacttt

SEQ ID NO: 233535 - DNA, 20 bp, Artificial Sequence
  chemically synthesized
accttggcctcccaaagtgc

SEQ ID NO: 233536 - DNA, 20 bp, Artificial Sequence
  chemically synthesized
ctgtaatcccagcactttgg

SEQ ID NO: 233537 - DNA, 20 bp, Artificial Sequence
  chemically synthesized
tgtaatcccagcactttggg

SEQ ID NO: 233538 - DNA, 20 bp, Artificial Sequence
  chemically synthesized
ctgcccaccttggcctccca

SEQ ID NO: 233539 - DNA, 20 bp, Artificial Sequence
  chemically synthesized
tcccagcactttgggaggcc

SEQ ID NO: 233540 - DNA, 20 bp, Artificial Sequence
  chemically synthesized
cccagcactttgggaggcca

SEQ ID NO: 233541 - DNA, 20 bp, Artificial Sequence
  chemically synthesized
agcactttgggaggccaagg

SEQ ID NO: 233542 - DNA, 20 bp, Artificial Sequence
  chemically synthesized
gcactttgggaggccaaggt

SEQ ID NO: 233543 - DNA, 20 bp, Artificial Sequence
  chemically synthesized
ctttgggaggccaaggtggg

SEQ ID NO: 233544 - DNA, 20 bp, Artificial Sequence
  chemically synthesized
acctcgtgatctgcccacct

SEQ ID NO: 233545 - DNA, 20 bp, Artificial Sequence
  chemically synthesized
ggccaaggtgggcagatcac

SEQ ID NO: 233546 - DNA, 20 bp, Artificial Sequence
  chemically synthesized
gccaaggtgggcagatcacg

SEQ ID NO: 233547 - DNA, 20 bp, Artificial Sequence
  chemically synthesized
aggtgggcagatcacgaggt

SEQ ID NO: 233548 - DNA, 20 bp, Artificial Sequence
  chemically synthesized
ggtgggcagatcacgaggtc

SEQ ID NO: 233549 - DNA, 20 bp, Artificial Sequence
  chemically synthesized
tgggcagatcacgaggtcag

SEQ ID NO: 233550 - DNA, 20 bp, Artificial Sequence
  chemically synthesized
gatcacgaggtcaggagatc

SEQ ID NO: 233551 - DNA, 20 bp, Artificial Sequence
  chemically synthesized
tcaggagatcgagaccatcc

SEQ ID NO: 233552 - DNA, 20 bp, Artificial Sequence
  chemically synthesized
tttcaccgtgttagccagga

SEQ ID NO: 233553 - DNA, 20 bp, Artificial Sequence
  chemically synthesized
ggggtttcaccgtgttagcc

SEQ ID NO: 233554 - DNA, 20 bp, Artificial Sequence
  chemically synthesized
cgagaccatcctggctaaca

SEQ ID NO: 233555 - DNA, 20 bp, Artificial Sequence
  chemically synthesized
cggggtttcaccgtgttagc

SEQ ID NO: 233556 - DNA, 20 bp, Artificial Sequence
  chemically synthesized
gagacggggtttcaccgtgt

SEQ ID NO: 233557 - DNA, 20 bp, Artificial Sequence
  chemically synthesized
ttgtatttttagtagagacg

SEQ ID NO: 233558 - DNA, 20 bp, Artificial Sequence
  chemically synthesized
tttgtatttttagtagagac

SEQ ID NO: 233559 - DNA, 20 bp, Artificial Sequence
  chemically synthesized
ttttgtatttttagtagaga

SEQ ID NO: 233560 - DNA, 20 bp, Artificial Sequence
  chemically synthesized
atttttttgtatttttagta

SEQ ID NO: 233561 - DNA, 20 bp, Artificial Sequence
  chemically synthesized
taatttttttgtatttttag

SEQ ID NO: 233562 - DNA, 20 bp, Artificial Sequence
  chemically synthesized
cgctaatttttttgtatttt

SEQ ID NO: 233563 - DNA, 20 bp, Artificial Sequence
  chemically synthesized
tactaaaaatacaaaaaaat

SEQ ID NO: 233564 - DNA, 20 bp, Artificial Sequence
  chemically synthesized
taaaaatacaaaaaaattag

SEQ ID NO: 233565 - DNA, 20 bp, Artificial Sequence
  chemically synthesized
aaaaatacaaaaaaattagc

SEQ ID NO: 233566 - DNA, 20 bp, Artificial Sequence
  chemically synthesized
aaaatacaaaaaaattagcg

SEQ ID NO: 233567 - DNA, 20 bp, Artificial Sequence
  chemically synthesized
acaaaaaaattagcggggcg

SEQ ID NO: 233568 - DNA, 20 bp, Artificial Sequence
  chemically synthesized
aaaaaattagcggggcgtgg

SEQ ID NO: 233569 - DNA, 20 bp, Artificial Sequence
  chemically synthesized
aattagcggggcgtggtagc

SEQ ID NO: 233570 - DNA, 20 bp, Artificial Sequence
  chemically synthesized
ggcgtggtagccagcgcctg

SEQ ID NO: 233571 - DNA, 20 bp, Artificial Sequence
  chemically synthesized
gtagctggtactacaggcgc

SEQ ID NO: 233572 - DNA, 20 bp, Artificial Sequence
  chemically synthesized
gtagccagcgcctgtagtac

SEQ ID NO: 233573 - DNA, 20 bp, Artificial Sequence
  chemically synthesized
tcccgagtagctggtactac

SEQ ID NO: 233574 - DNA, 20 bp, Artificial Sequence
  chemically synthesized
ctcccgagtagctggtacta

SEQ ID NO: 233575 - DNA, 20 bp, Artificial Sequence
  chemically synthesized
cgcctgtagtaccagctact

SEQ ID NO: 233576 - DNA, 20 bp, Artificial Sequence
  chemically synthesized
gcctgtagtaccagctactc

SEQ ID NO: 233577 - DNA, 20 bp, Artificial Sequence
  chemically synthesized
gcctcagcctcccgagtagc

SEQ ID NO: 233578 - DNA, 20 bp, Artificial Sequence
  chemically synthesized
ctgtagtaccagctactcgg

SEQ ID NO: 233579 - DNA, 20 bp, Artificial Sequence
  chemically synthesized
tgtagtaccagctactcggg

SEQ ID NO: 233580 - DNA, 20 bp, Artificial Sequence
  chemically synthesized
tcctgcctcagcctcccgag

SEQ ID NO: 233581 - DNA, 20 bp, Artificial Sequence
  chemically synthesized
ttctcctgcctcagcctccc

SEQ ID NO: 233582 - DNA, 20 bp, Artificial Sequence
  chemically synthesized
taccagctactcgggaggct

SEQ ID NO: 233583 - DNA, 20 bp, Artificial Sequence
  chemically synthesized
accagctactcgggaggctg

SEQ ID NO: 233584 - DNA, 20 bp, Artificial Sequence
  chemically synthesized
agctactcgggaggctgagg

SEQ ID NO: 233585 - DNA, 20 bp, Artificial Sequence
  chemically synthesized
gctactcgggaggctgaggc

SEQ ID NO: 233586 - DNA, 20 bp, Artificial Sequence
  chemically synthesized
tactcgggaggctgaggcag

SEQ ID NO: 233587 - DNA, 20 bp, Artificial Sequence
  chemically synthesized
tttacgccattctcctgcct

SEQ ID NO: 233588 - DNA, 20 bp, Artificial Sequence
  chemically synthesized
gggaggctgaggcaggagaa

SEQ ID NO: 233589 - DNA, 20 bp, Artificial Sequence
  chemically synthesized
gcaggagaatggcgtaaacc

SEQ ID NO: 233590 - DNA, 20 bp, Artificial Sequence
  chemically synthesized
caggagaatggcgtaaaccc

SEQ ID NO: 233591 - DNA, 20 bp, Artificial Sequence
  chemically synthesized
ggagaatggcgtaaacccgg

SEQ ID NO: 233592 - DNA, 20 bp, Artificial Sequence
  chemically synthesized
gagaatggcgtaaacccggg

SEQ ID NO: 233593 - DNA, 20 bp, Artificial Sequence
  chemically synthesized
aatggcgtaaacccgggagg

SEQ ID NO: 233594 - DNA, 20 bp, Artificial Sequence
  chemically synthesized
cactgcaagctctgcctccc

SEQ ID NO: 233595 - DNA, 20 bp, Artificial Sequence
  chemically synthesized
tggcgtaaacccgggaggca

SEQ ID NO: 233596 - DNA, 20 bp, Artificial Sequence
  chemically synthesized
tcactgcaagctctgcctcc

SEQ ID NO: 233597 - DNA, 20 bp, Artificial Sequence
  chemically synthesized
aacccgggaggcagagcttg

SEQ ID NO: 233598 - DNA, 20 bp, Artificial Sequence
  chemically synthesized
cgggaggcagagcttgcagt

SEQ ID NO: 233599 - DNA, 20 bp, Artificial Sequence
  chemically synthesized
gcgcgatcttggctcactgc

SEQ ID NO: 233600 - DNA, 20 bp, Artificial Sequence
  chemically synthesized
ggcagagcttgcagtgagcc

SEQ ID NO: 233601 - DNA, 20 bp, Artificial Sequence
  chemically synthesized
ggagtacagtggcgcgatct

SEQ ID NO: 233602 - DNA, 20 bp, Artificial Sequence
  chemically synthesized
caccccaggctggagtacag

SEQ ID NO: 233603 - DNA, 20 bp, Artificial Sequence
  chemically synthesized
aagatcgcgccactgtactc

SEQ ID NO: 233604 - DNA, 20 bp, Artificial Sequence
  chemically synthesized
tgtcaccccaggctggagta

SEQ ID NO: 233605 - DNA, 20 bp, Artificial Sequence
  chemically synthesized
cgcgccactgtactccagcc

SEQ ID NO: 233606 - DNA, 20 bp, Artificial Sequence
  chemically synthesized
gcgccactgtactccagcct

SEQ ID NO: 233607 - DNA, 20 bp, Artificial Sequence
  chemically synthesized
cgccactgtactccagcctg

SEQ ID NO: 233608 - DNA, 20 bp, Artificial Sequence
  chemically synthesized
cgctctgtcaccccaggctg

SEQ ID NO: 233609 - DNA, 20 bp, Artificial Sequence
  chemically synthesized
ctcgctctgtcaccccaggc

SEQ ID NO: 233610 - DNA, 20 bp, Artificial Sequence
  chemically synthesized
tgtactccagcctggggtga

SEQ ID NO: 233611 - DNA, 20 bp, Artificial Sequence
  chemically synthesized
gagtctcgctctgtcacccc

SEQ ID NO: 233612 - DNA, 20 bp, Artificial Sequence
  chemically synthesized
ggagtctcgctctgtcaccc

SEQ ID NO: 233613 - DNA, 20 bp, Artificial Sequence
  chemically synthesized
tactccagcctggggtgaca

SEQ ID NO: 233614 - DNA, 20 bp, Artificial Sequence
  chemically synthesized
ccagcctggggtgacagagc

SEQ ID NO: 233615 - DNA, 20 bp, Artificial Sequence
  chemically synthesized
ttttttttttttttgagatg

SEQ ID NO: 233616 - DNA, 20 bp, Artificial Sequence
  chemically synthesized
ttttttttttttttttgaga

SEQ ID NO: 233617 - DNA, 20 bp, Artificial Sequence
  chemically synthesized
gttttttttttttttttttt

SEQ ID NO: 233618 - DNA, 20 bp, Artificial Sequence
  chemically synthesized
aaaaaaaaaaacaaaaacaa

SEQ ID NO: 233619 - DNA, 20 bp, Artificial Sequence
  chemically synthesized
acaaaaacaaaagaaaaaac

SEQ ID NO: 233620 - DNA, 20 bp, Artificial Sequence
  chemically synthesized
aaacaaaagaaaaaacaaga

SEQ ID NO: 233621 - DNA, 20 bp, Artificial Sequence
  chemically synthesized
aacaaaagaaaaaacaagac

SEQ ID NO: 233622 - DNA, 20 bp, Artificial Sequence
  chemically synthesized
aacttgttcattaaaattca

SEQ ID NO: 233623 - DNA, 20 bp, Artificial Sequence
  chemically synthesized
gactttgaattttaatgaac

SEQ ID NO: 233624 - DNA, 20 bp, Artificial Sequence
  chemically synthesized
ttgaattttaatgaacaagt

SEQ ID NO: 233625 - DNA, 20 bp, Artificial Sequence
  chemically synthesized
taaaaccagatgttggggga

SEQ ID NO: 233626 - DNA, 20 bp, Artificial Sequence
  chemically synthesized
ttaaaaccagatgttggggg

SEQ ID NO: 233627 - DNA, 20 bp, Artificial Sequence
  chemically synthesized
tttaaaaccagatgttgggg

SEQ ID NO: 233628 - DNA, 20 bp, Artificial Sequence
  chemically synthesized
catttaaaaccagatgttgg

SEQ ID NO: 233629 - DNA, 20 bp, Artificial Sequence
  chemically synthesized
tagaaccctcccccaacatc

SEQ ID NO: 233630 - DNA, 20 bp, Artificial Sequence
  chemically synthesized
gcatttaaaaccagatgttg

SEQ ID NO: 233631 - DNA, 20 bp, Artificial Sequence
  chemically synthesized
agcatttaaaaccagatgtt

SEQ ID NO: 233632 - DNA, 20 bp, Artificial Sequence
  chemically synthesized
tagcatttaaaaccagatgt

SEQ ID NO: 233633 - DNA, 20 bp, Artificial Sequence
  chemically synthesized
aaagtaatagcatttaaaac

SEQ ID NO: 233634 - DNA, 20 bp, Artificial Sequence
  chemically synthesized
gttttaaatgctattacttt

SEQ ID NO: 233635 - DNA, 20 bp, Artificial Sequence
  chemically synthesized
gcaatacataccgaaagtaa

SEQ ID NO: 233636 - DNA, 20 bp, Artificial Sequence
  chemically synthesized
agataagcaatacataccga

SEQ ID NO: 233637 - DNA, 20 bp, Artificial Sequence
  chemically synthesized
ctcatcatacttattaagat

SEQ ID NO: 233638 - DNA, 20 bp, Artificial Sequence
  chemically synthesized
tatgtattgcttatcttaat

SEQ ID NO: 233639 - DNA, 20 bp, Artificial Sequence
  chemically synthesized
ttaagctcatcatacttatt

SEQ ID NO: 233640 - DNA, 20 bp, Artificial Sequence
  chemically synthesized
cttatcttaataagtatgat

SEQ ID NO: 233641 - DNA, 20 bp, Artificial Sequence
  chemically synthesized
agtatgatgagcttaaatat

SEQ ID NO: 233642 - DNA, 20 bp, Artificial Sequence
  chemically synthesized
ccgaagataagctaatattt

SEQ ID NO: 233643 - DNA, 20 bp, Artificial Sequence
  chemically synthesized
cttaaatattagcttatctt

SEQ ID NO: 233644 - DNA, 20 bp, Artificial Sequence
  chemically synthesized
ttaaatattagcttatcttc

SEQ ID NO: 233645 - DNA, 20 bp, Artificial Sequence
  chemically synthesized
aaagagagggacccgaagat

SEQ ID NO: 233646 - DNA, 20 bp, Artificial Sequence
  chemically synthesized
ataaaaaagagagggacccg

SEQ ID NO: 233647 - DNA, 20 bp, Artificial Sequence
  chemically synthesized
aaattaaaataaaaaagaga

SEQ ID NO: 233648 - DNA, 20 bp, Artificial Sequence
  chemically synthesized
aaaattaaaataaaaaagag

SEQ ID NO: 233649 - DNA, 20 bp, Artificial Sequence
  chemically synthesized
aaaaattaaaataaaaaaga

SEQ ID NO: 233650 - DNA, 20 bp, Artificial Sequence
  chemically synthesized
acaaaaattaaaataaaaaa

SEQ ID NO: 233651 - DNA, 20 bp, Artificial Sequence
  chemically synthesized
ccacaaaaattaaaataaaa

SEQ ID NO: 233652 - DNA, 20 bp, Artificial Sequence
  chemically synthesized
cttttttattttaatttttg

SEQ ID NO: 233653 - DNA, 20 bp, Artificial Sequence
  chemically synthesized
ttttttattttaatttttgt

SEQ ID NO: 233654 - DNA, 20 bp, Artificial Sequence
  chemically synthesized
taatttttgtgggtacatcg

SEQ ID NO: 233655 - DNA, 20 bp, Artificial Sequence
  chemically synthesized
aatttttgtgggtacatcgt

SEQ ID NO: 233656 - DNA, 20 bp, Artificial Sequence
  chemically synthesized
tttttgtgggtacatcgtag

SEQ ID NO: 233657 - DNA, 20 bp, Artificial Sequence
  chemically synthesized
atcgtaggagtatatatttg

SEQ ID NO: 233658 - DNA, 20 bp, Artificial Sequence
  chemically synthesized
tcgtaggagtatatatttgt

SEQ ID NO: 233659 - DNA, 20 bp, Artificial Sequence
  chemically synthesized
cgtaggagtatatatttgta

SEQ ID NO: 233660 - DNA, 20 bp, Artificial Sequence
  chemically synthesized
tatatatttgtagggtacat

SEQ ID NO: 233661 - DNA, 20 bp, Artificial Sequence
  chemically synthesized
gtacatgagatgttttgaca

SEQ ID NO: 233662 - DNA, 20 bp, Artificial Sequence
  chemically synthesized
tacatgagatgttttgacac

SEQ ID NO: 233663 - DNA, 20 bp, Artificial Sequence
  chemically synthesized
atgagatgttttgacacagg

SEQ ID NO: 233664 - DNA, 20 bp, Artificial Sequence
  chemically synthesized
tgagatgttttgacacaggc

SEQ ID NO: 233665 - DNA, 20 bp, Artificial Sequence
  chemically synthesized
gttttgacacaggcaggcaa

SEQ ID NO: 233666 - DNA, 20 bp, Artificial Sequence
  chemically synthesized
ttttgacacaggcaggcaat

SEQ ID NO: 233667 - DNA, 20 bp, Artificial Sequence
  chemically synthesized
aatgggtaataatcacatca

SEQ ID NO: 233668 - DNA, 20 bp, Artificial Sequence
  chemically synthesized
tgggtaataatcacatcatg

SEQ ID NO: 233669 - DNA, 20 bp, Artificial Sequence
  chemically synthesized
aataatcacatcatggagaa

SEQ ID NO: 233670 - DNA, 20 bp, Artificial Sequence
  chemically synthesized
ataatcacatcatggagaac

SEQ ID NO: 233671 - DNA, 20 bp, Artificial Sequence
  chemically synthesized
taatcacatcatggagaacg

SEQ ID NO: 233672 - DNA, 20 bp, Artificial Sequence
  chemically synthesized
aacggggtatccatcccttc

SEQ ID NO: 233673 - DNA, 20 bp, Artificial Sequence
  chemically synthesized
aggagaaatgcttgaaggga

SEQ ID NO: 233674 - DNA, 20 bp, Artificial Sequence
  chemically synthesized
acaaaggagaaatgcttgaa

SEQ ID NO: 233675 - DNA, 20 bp, Artificial Sequence
  chemically synthesized
cacaaaggagaaatgcttga

SEQ ID NO: 233676 - DNA, 20 bp, Artificial Sequence
  chemically synthesized
acacaaaggagaaatgcttg

SEQ ID NO: 233677 - DNA, 20 bp, Artificial Sequence
  chemically synthesized
ggattgtttgtaacacaaag

SEQ ID NO: 233678 - DNA, 20 bp, Artificial Sequence
  chemically synthesized
ttggattgtttgtaacacaa

SEQ ID NO: 233679 - DNA, 20 bp, Artificial Sequence
  chemically synthesized
attggattgtttgtaacaca

SEQ ID NO: 233680 - DNA, 20 bp, Artificial Sequence
  chemically synthesized
aataactaaaggagtgtgat

SEQ ID NO: 233681 - DNA, 20 bp, Artificial Sequence
  chemically synthesized
acaatccaatcacactcctt

SEQ ID NO: 233682 - DNA, 20 bp, Artificial Sequence
  chemically synthesized
acatttaaaaataactaaag

SEQ ID NO: 233683 - DNA, 20 bp, Artificial Sequence
  chemically synthesized
gtacatttaaaaataactaa

SEQ ID NO: 233684 - DNA, 20 bp, Artificial Sequence
  chemically synthesized
tgtacatttaaaaataacta

SEQ ID NO: 233685 - DNA, 20 bp, Artificial Sequence
  chemically synthesized
ttagttatttttaaatgtac

SEQ ID NO: 233686 - DNA, 20 bp, Artificial Sequence
  chemically synthesized
ggatgattatggttaataat

SEQ ID NO: 233687 - DNA, 20 bp, Artificial Sequence
  chemically synthesized
atcaaacaacgggatgatta

SEQ ID NO: 233688 - DNA, 20 bp, Artificial Sequence
  chemically synthesized
atttgatctgatcaaacaac

SEQ ID NO: 233689 - DNA, 20 bp, Artificial Sequence
  chemically synthesized
tatttgatctgatcaaacaa

SEQ ID NO: 233690 - DNA, 20 bp, Artificial Sequence
  chemically synthesized
taatcatcccgttgtttgat

SEQ ID NO: 233691 - DNA, 20 bp, Artificial Sequence
  chemically synthesized
cgttgtttgatcagatcaaa

SEQ ID NO: 233692 - DNA, 20 bp, Artificial Sequence
  chemically synthesized
aataattctacagggaaaat

SEQ ID NO: 233693 - DNA, 20 bp, Artificial Sequence
  chemically synthesized
agtgtgtcttattttccctg

SEQ ID NO: 233694 - DNA, 20 bp, Artificial Sequence
  chemically synthesized
aatttccaaataattctaca

SEQ ID NO: 233695 - DNA, 20 bp, Artificial Sequence
  chemically synthesized
aaatttccaaataattctac

SEQ ID NO: 233696 - DNA, 20 bp, Artificial Sequence
  chemically synthesized
aaaatttccaaataattcta

SEQ ID NO: 233697 - DNA, 20 bp, Artificial Sequence
  chemically synthesized
attttccctgtagaattatt

SEQ ID NO: 233698 - DNA, 20 bp, Artificial Sequence
  chemically synthesized
aaagctcatgaaaacataaa

SEQ ID NO: 233699 - DNA, 20 bp, Artificial Sequence
  chemically synthesized
ttttctgtttatgttttcat

SEQ ID NO: 233700 - DNA, 20 bp, Artificial Sequence
  chemically synthesized
gtttatgttttcatgagctt

SEQ ID NO: 233701 - DNA, 20 bp, Artificial Sequence
  chemically synthesized
tttatgttttcatgagcttt

SEQ ID NO: 233702 - DNA, 20 bp, Artificial Sequence
  chemically synthesized
ttttcatgagctttgggatt

SEQ ID NO: 233703 - DNA, 20 bp, Artificial Sequence
  chemically synthesized
aaattcttccccaaatccca

SEQ ID NO: 233704 - DNA, 20 bp, Artificial Sequence
  chemically synthesized
tttcatgagctttgggattt

SEQ ID NO: 233705 - DNA, 20 bp, Artificial Sequence
  chemically synthesized
ttcatgagctttgggatttg

SEQ ID NO: 233706 - DNA, 20 bp, Artificial Sequence
  chemically synthesized
atgagctttgggatttgggg

SEQ ID NO: 233707 - DNA, 20 bp, Artificial Sequence
  chemically synthesized
tgggatttggggaagaattt

SEQ ID NO: 233708 - DNA, 20 bp, Artificial Sequence
  chemically synthesized
aatttcagcatttttgactt

SEQ ID NO: 233709 - DNA, 20 bp, Artificial Sequence
  chemically synthesized
agcatttttgacttaagata

SEQ ID NO: 233710 - DNA, 20 bp, Artificial Sequence
  chemically synthesized
aagtgaaccaactatatctt

SEQ ID NO: 233711 - DNA, 20 bp, Artificial Sequence
  chemically synthesized
tttttgacttaagatatagt

SEQ ID NO: 233712 - DNA, 20 bp, Artificial Sequence
  chemically synthesized
taagatatagttggttcact

SEQ ID NO: 233713 - DNA, 20 bp, Artificial Sequence
  chemically synthesized
tatagttggttcacttagcc

SEQ ID NO: 233714 - DNA, 20 bp, Artificial Sequence
  chemically synthesized
agttggttcacttagcccag

SEQ ID NO: 233715 - DNA, 20 bp, Artificial Sequence
  chemically synthesized
ctgaagttcactgctgggct

SEQ ID NO: 233716 - DNA, 20 bp, Artificial Sequence
  chemically synthesized
accccctgaagttcactgct

SEQ ID NO: 233717 - DNA, 20 bp, Artificial Sequence
  chemically synthesized
gaccccctgaagttcactgc

SEQ ID NO: 233718 - DNA, 20 bp, Artificial Sequence
  chemically synthesized
cttagcccagcagtgaactt

SEQ ID NO: 233719 - DNA, 20 bp, Artificial Sequence
  chemically synthesized
ttagcccagcagtgaacttc

SEQ ID NO: 233720 - DNA, 20 bp, Artificial Sequence
  chemically synthesized
tagcccagcagtgaacttca

SEQ ID NO: 233721 - DNA, 20 bp, Artificial Sequence
  chemically synthesized
agcccagcagtgaacttcag

SEQ ID NO: 233722 - DNA, 20 bp, Artificial Sequence
  chemically synthesized
gcccagcagtgaacttcagg

SEQ ID NO: 233723 - DNA, 20 bp, Artificial Sequence
  chemically synthesized
tgcatgctattgaccccctg

SEQ ID NO: 233724 - DNA, 20 bp, Artificial Sequence
  chemically synthesized
agtgaacttcagggggtcaa

SEQ ID NO: 233725 - DNA, 20 bp, Artificial Sequence
  chemically synthesized
caataaatttttgatgttaa

SEQ ID NO: 233726 - DNA, 20 bp, Artificial Sequence
  chemically synthesized
tgttaacatcaaaaatttat

SEQ ID NO: 233727 - DNA, 20 bp, Artificial Sequence
  chemically synthesized
ttggacatttaatcttttaa

SEQ ID NO: 233728 - DNA, 20 bp, Artificial Sequence
  chemically synthesized
catgagatattttctgttaa

SEQ ID NO: 233729 - DNA, 20 bp, Artificial Sequence
  chemically synthesized
ttttaacagaaaatatctca

SEQ ID NO: 233730 - DNA, 20 bp, Artificial Sequence
  chemically synthesized
cacttttcatatgaaaccat

SEQ ID NO: 233731 - DNA, 20 bp, Artificial Sequence
  chemically synthesized
atctcatggtttcatatgaa

SEQ ID NO: 233732 - DNA, 20 bp, Artificial Sequence
  chemically synthesized
tcatggtttcatatgaaaag

SEQ ID NO: 233733 - DNA, 20 bp, Artificial Sequence
  chemically synthesized
tttgaaataaataaaatgtg

SEQ ID NO: 233734 - DNA, 20 bp, Artificial Sequence
  chemically synthesized
ttacatttatttttacttat

SEQ ID NO: 233735 - DNA, 20 bp, Artificial Sequence
  chemically synthesized
ttatattttccaattccaat

SEQ ID NO: 233736 - DNA, 20 bp, Artificial Sequence
  chemically synthesized
ttatttttacttattggaat

SEQ ID NO: 233737 - DNA, 20 bp, Artificial Sequence
  chemically synthesized
ttattggaattggaaaatat

SEQ ID NO: 233738 - DNA, 20 bp, Artificial Sequence
  chemically synthesized
acacattgtattgaaaaatg

SEQ ID NO: 233739 - DNA, 20 bp, Artificial Sequence
  chemically synthesized
ttgtattgaaaaatgtggac

SEQ ID NO: 233740 - DNA, 20 bp, Artificial Sequence
  chemically synthesized
gttaattagctcattttagc

SEQ ID NO: 233741 - DNA, 20 bp, Artificial Sequence
  chemically synthesized
aaatgtggactagctaaaat

SEQ ID NO: 233742 - DNA, 20 bp, Artificial Sequence
  chemically synthesized
atatgttaattagctcattt

SEQ ID NO: 233743 - DNA, 20 bp, Artificial Sequence
  chemically synthesized
gaggtaatgcatatgttaat

SEQ ID NO: 233744 - DNA, 20 bp, Artificial Sequence
  chemically synthesized
ccgcaaaaaaatagtatgtg

SEQ ID NO: 233745 - DNA, 20 bp, Artificial Sequence
  chemically synthesized
accgcaaaaaaatagtatgt

SEQ ID NO: 233746 - DNA, 20 bp, Artificial Sequence
  chemically synthesized
gtgttctcaccgcaaaaaaa

SEQ ID NO: 233747 - DNA, 20 bp, Artificial Sequence
  chemically synthesized
cctcacatactatttttttg

SEQ ID NO: 233748 - DNA, 20 bp, Artificial Sequence
  chemically synthesized
acatactatttttttgcggt

SEQ ID NO: 233749 - DNA, 20 bp, Artificial Sequence
  chemically synthesized
ttactaagagagtcgatttt

SEQ ID NO: 233750 - DNA, 20 bp, Artificial Sequence
  chemically synthesized
acacttaaaatcgactctct

SEQ ID NO: 233751 - DNA, 20 bp, Artificial Sequence
  chemically synthesized
gttttcgaaaattactaaga

SEQ ID NO: 233752 - DNA, 20 bp, Artificial Sequence
  chemically synthesized
atgttttcgaaaattactaa

SEQ ID NO: 233753 - DNA, 20 bp, Artificial Sequence
  chemically synthesized
atatgttttcgaaaattact

SEQ ID NO: 233754 - DNA, 20 bp, Artificial Sequence
  chemically synthesized
aaacatattattattaatta

SEQ ID NO: 233755 - DNA, 20 bp, Artificial Sequence
  chemically synthesized
atgagatcttttgtacgaca

SEQ ID NO: 233756 - DNA, 20 bp, Artificial Sequence
  chemically synthesized
atagtcactatgtcgtacaa

SEQ ID NO: 233757 - DNA, 20 bp, Artificial Sequence
  chemically synthesized
gataggagacataagttcat

SEQ ID NO: 233758 - DNA, 20 bp, Artificial Sequence
  chemically synthesized
ttcagttagataggagacat

SEQ ID NO: 233759 - DNA, 20 bp, Artificial Sequence
  chemically synthesized
acaaaatttcagttagatag

SEQ ID NO: 233760 - DNA, 20 bp, Artificial Sequence
  chemically synthesized
atacaaaatttcagttagat

SEQ ID NO: 233761 - DNA, 20 bp, Artificial Sequence
  chemically synthesized
gatacaaaatttcagttaga

SEQ ID NO: 233762 - DNA, 20 bp, Artificial Sequence
  chemically synthesized
agaggatacaaaatttcagt

SEQ ID NO: 233763 - DNA, 20 bp, Artificial Sequence
  chemically synthesized
ggtcagaggatacaaaattt

SEQ ID NO: 233764 - DNA, 20 bp, Artificial Sequence
  chemically synthesized
aaaagggctgtgttggtcag

SEQ ID NO: 233765 - DNA, 20 bp, Artificial Sequence
  chemically synthesized
caaaagggctgtgttggtca

SEQ ID NO: 233766 - DNA, 20 bp, Artificial Sequence
  chemically synthesized
tttgtatcctctgaccaaca

SEQ ID NO: 233767 - DNA, 20 bp, Artificial Sequence
  chemically synthesized
tacaaaagggctgtgttggt

SEQ ID NO: 233768 - DNA, 20 bp, Artificial Sequence
  chemically synthesized
aggatacaaaagggctgtgt

SEQ ID NO: 233769 - DNA, 20 bp, Artificial Sequence
  chemically synthesized
taaaatcaaaggatacaaaa

SEQ ID NO: 233770 - DNA, 20 bp, Artificial Sequence
  chemically synthesized
ttaaaatcaaaggatacaaa

SEQ ID NO: 233771 - DNA, 20 bp, Artificial Sequence
  chemically synthesized
tttaaaatcaaaggatacaa

SEQ ID NO: 233772 - DNA, 20 bp, Artificial Sequence
  chemically synthesized
aacgccttttttaaaatcaa

SEQ ID NO: 233773 - DNA, 20 bp, Artificial Sequence
  chemically synthesized
caacgccttttttaaaatca

SEQ ID NO: 233774 - DNA, 20 bp, Artificial Sequence
  chemically synthesized
tgtatcctttgattttaaaa

SEQ ID NO: 233775 - DNA, 20 bp, Artificial Sequence
  chemically synthesized
gtatcctttgattttaaaaa

SEQ ID NO: 233776 - DNA, 20 bp, Artificial Sequence
  chemically synthesized
aaggcgttgtttaattttaa

SEQ ID NO: 233777 - DNA, 20 bp, Artificial Sequence
  chemically synthesized
tgtttaattttaacagtgtc

SEQ ID NO: 233778 - DNA, 20 bp, Artificial Sequence
  chemically synthesized
tcaggacctggtatcattaa

SEQ ID NO: 233779 - DNA, 20 bp, Artificial Sequence
  chemically synthesized
gtcaagacttttaatgatac

SEQ ID NO: 233780 - DNA, 20 bp, Artificial Sequence
  chemically synthesized
tcaagacttttaatgatacc

SEQ ID NO: 233781 - DNA, 20 bp, Artificial Sequence
  chemically synthesized
agtctgacattttcaggacc

SEQ ID NO: 233782 - DNA, 20 bp, Artificial Sequence
  chemically synthesized
aaacacagtctgacattttc

SEQ ID NO: 233783 - DNA, 20 bp, Artificial Sequence
  chemically synthesized
ataccaggtcctgaaaatgt

SEQ ID NO: 233784 - DNA, 20 bp, Artificial Sequence
  chemically synthesized
gaaacacagtctgacatttt

SEQ ID NO: 233785 - DNA, 20 bp, Artificial Sequence
  chemically synthesized
aagaaactgtatgggaaaca

SEQ ID NO: 233786 - DNA, 20 bp, Artificial Sequence
  chemically synthesized
gtcagactgtgtttcccata

SEQ ID NO: 233787 - DNA, 20 bp, Artificial Sequence
  chemically synthesized
tcatgctaaagaaactgtat

SEQ ID NO: 233788 - DNA, 20 bp, Artificial Sequence
  chemically synthesized
ttcatgctaaagaaactgta

SEQ ID NO: 233789 - DNA, 20 bp, Artificial Sequence
  chemically synthesized
tgtttcccatacagtttctt

SEQ ID NO: 233790 - DNA, 20 bp, Artificial Sequence
  chemically synthesized
atacatcccctttcatgcta

SEQ ID NO: 233791 - DNA, 20 bp, Artificial Sequence
  chemically synthesized
atacagtttctttagcatga

SEQ ID NO: 233792 - DNA, 20 bp, Artificial Sequence
  chemically synthesized
tacagtttctttagcatgaa

SEQ ID NO: 233793 - DNA, 20 bp, Artificial Sequence
  chemically synthesized
acagtttctttagcatgaaa

SEQ ID NO: 233794 - DNA, 20 bp, Artificial Sequence
  chemically synthesized
cagtttctttagcatgaaag

SEQ ID NO: 233795 - DNA, 20 bp, Artificial Sequence
  chemically synthesized
ggatgtatgcatttgaaata

SEQ ID NO: 233796 - DNA, 20 bp, Artificial Sequence
  chemically synthesized
tgtatgcatttgaaatatag

SEQ ID NO: 233797 - DNA, 20 bp, Artificial Sequence
  chemically synthesized
agtagttgatgaacatcttt

SEQ ID NO: 233798 - DNA, 20 bp, Artificial Sequence
  chemically synthesized
aattctactgaaaaatctaa

SEQ ID NO: 233799 - DNA, 20 bp, Artificial Sequence
  chemically synthesized
tgaacatcttttagattttt

SEQ ID NO: 233800 - DNA, 20 bp, Artificial Sequence
  chemically synthesized
acatcttttagatttttcag

SEQ ID NO: 233801 - DNA, 20 bp, Artificial Sequence
  chemically synthesized
tttttcagtagaattaaaac

SEQ ID NO: 233802 - DNA, 20 bp, Artificial Sequence
  chemically synthesized
tgtgctgaatttttatcatc

SEQ ID NO: 233803 - DNA, 20 bp, Artificial Sequence
  chemically synthesized
aaaactggatgataaaaatt

SEQ ID NO: 233804 - DNA, 20 bp, Artificial Sequence
  chemically synthesized
ttttattgatttttggaata

SEQ ID NO: 233805 - DNA, 20 bp, Artificial Sequence
  chemically synthesized
taggcacttttattgatttt

SEQ ID NO: 233806 - DNA, 20 bp, Artificial Sequence
  chemically synthesized
tatattccaaaaatcaataa

SEQ ID NO: 233807 - DNA, 20 bp, Artificial Sequence
  chemically synthesized
caaaaatcaataaaagtgcc

SEQ ID NO: 233808 - DNA, 20 bp, Artificial Sequence
  chemically synthesized
aaaaatcaataaaagtgcct

SEQ ID NO: 233809 - DNA, 20 bp, Artificial Sequence
  chemically synthesized
aaatcaataaaagtgcctag

SEQ ID NO: 233810 - DNA, 20 bp, Artificial Sequence
  chemically synthesized
accttttaaatgtttctcct

SEQ ID NO: 233811 - DNA, 20 bp, Artificial Sequence
  chemically synthesized
aaccttttaaatgtttctcc

SEQ ID NO: 233812 - DNA, 20 bp, Artificial Sequence
  chemically synthesized
tgcctaggagaaacatttaa

SEQ ID NO: 233813 - DNA, 20 bp, Artificial Sequence
  chemically synthesized
gcctaggagaaacatttaaa

SEQ ID NO: 233814 - DNA, 20 bp, Artificial Sequence
  chemically synthesized
ggagaaacatttaaaaggtt

SEQ ID NO: 233815 - DNA, 20 bp, Artificial Sequence
  chemically synthesized
gagaaacatttaaaaggtta

SEQ ID NO: 233816 - DNA, 20 bp, Artificial Sequence
  chemically synthesized
tttaaaaggttaaggaaatt

SEQ ID NO: 233817 - DNA, 20 bp, Artificial Sequence
  chemically synthesized
ggttaaggaaattaagaaaa

SEQ ID NO: 233818 - DNA, 20 bp, Artificial Sequence
  chemically synthesized
aggaaattaagaaaatggat

SEQ ID NO: 233819 - DNA, 20 bp, Artificial Sequence
  chemically synthesized
aagaaaatggataagataat

SEQ ID NO: 233820 - DNA, 20 bp, Artificial Sequence
  chemically synthesized
ataagataataagataattt

SEQ ID NO: 233821 - DNA, 20 bp, Artificial Sequence
  chemically synthesized
aagaaaaattatccaaaact

SEQ ID NO: 233822 - DNA, 20 bp, Artificial Sequence
  chemically synthesized
tttgttttacttctaagttt

SEQ ID NO: 233823 - DNA, 20 bp, Artificial Sequence
  chemically synthesized
aaaaattatccaaaacttag

SEQ ID NO: 233824 - DNA, 20 bp, Artificial Sequence
  chemically synthesized
tcatcttttgttttacttct

SEQ ID NO: 233825 - DNA, 20 bp, Artificial Sequence
  chemically synthesized
aaaacttagaagtaaaacaa

SEQ ID NO: 233826 - DNA, 20 bp, Artificial Sequence
  chemically synthesized
tcgtgtgtgtttcaaaataa

SEQ ID NO: 233827 - DNA, 20 bp, Artificial Sequence
  chemically synthesized
tgtgtgtttcaaaataatgg

SEQ ID NO: 233828 - DNA, 20 bp, Artificial Sequence
  chemically synthesized
tgagggtgtgaggagtttgt

SEQ ID NO: 233829 - DNA, 20 bp, Artificial Sequence
  chemically synthesized
agctcttgtgagggtgtgag

SEQ ID NO: 233830 - DNA, 20 bp, Artificial Sequence
  chemically synthesized
gaagctcttgtgagggtgtg

SEQ ID NO: 233831 - DNA, 20 bp, Artificial Sequence
  chemically synthesized
tgaagctcttgtgagggtgt

SEQ ID NO: 233832 - DNA, 20 bp, Artificial Sequence
  chemically synthesized
caaactcctcacaccctcac

SEQ ID NO: 233833 - DNA, 20 bp, Artificial Sequence
  chemically synthesized
aactcctcacaccctcacaa

SEQ ID NO: 233834 - DNA, 20 bp, Artificial Sequence
  chemically synthesized
aaatattgaagctcttgtga

SEQ ID NO: 233835 - DNA, 20 bp, Artificial Sequence
  chemically synthesized
aaaatattgaagctcttgtg

SEQ ID NO: 233836 - DNA, 20 bp, Artificial Sequence
  chemically synthesized
gaaaatattgaagctcttgt

SEQ ID NO: 233837 - DNA, 20 bp, Artificial Sequence
  chemically synthesized
gctttactctgaaaatattg

SEQ ID NO: 233838 - DNA, 20 bp, Artificial Sequence
  chemically synthesized
cacaagagcttcaatatttt

SEQ ID NO: 233839 - DNA, 20 bp, Artificial Sequence
  chemically synthesized
caagagcttcaatattttca

SEQ ID NO: 233840 - DNA, 20 bp, Artificial Sequence
  chemically synthesized
gcttcaatattttcagagta

SEQ ID NO: 233841 - DNA, 20 bp, Artificial Sequence
  chemically synthesized
aaattaatagtaaacagtaa

SEQ ID NO: 233842 - DNA, 20 bp, Artificial Sequence
  chemically synthesized
ccaaattaatagtaaacagt

SEQ ID NO: 233843 - DNA, 20 bp, Artificial Sequence
  chemically synthesized
gggcccaaattaatagtaaa

SEQ ID NO: 233844 - DNA, 20 bp, Artificial Sequence
  chemically synthesized
cttactgtttactattaatt

SEQ ID NO: 233845 - DNA, 20 bp, Artificial Sequence
  chemically synthesized
ttactgtttactattaattt

SEQ ID NO: 233846 - DNA, 20 bp, Artificial Sequence
  chemically synthesized
catgtgtgggcccaaattaa

SEQ ID NO: 233847 - DNA, 20 bp, Artificial Sequence
  chemically synthesized
catagcgttgtaacatgtgt

SEQ ID NO: 233848 - DNA, 20 bp, Artificial Sequence
  chemically synthesized
tcatagcgttgtaacatgtg

SEQ ID NO: 233849 - DNA, 20 bp, Artificial Sequence
  chemically synthesized
acacatgttacaacgctatg

SEQ ID NO: 233850 - DNA, 20 bp, Artificial Sequence
  chemically synthesized
aaaatttgcattgaacttca

SEQ ID NO: 233851 - DNA, 20 bp, Artificial Sequence
  chemically synthesized
atgaagttcaatgcaaattt

SEQ ID NO: 233852 - DNA, 20 bp, Artificial Sequence
  chemically synthesized
aaaagtcatttacatcatat

SEQ ID NO: 233853 - DNA, 20 bp, Artificial Sequence
  chemically synthesized
gatgtaaatgactttttacc

SEQ ID NO: 233854 - DNA, 20 bp, Artificial Sequence
  chemically synthesized
tatatcctctactgggtaaa

SEQ ID NO: 233855 - DNA, 20 bp, Artificial Sequence
  chemically synthesized
gtaaatgactttttacccag

SEQ ID NO: 233856 - DNA, 20 bp, Artificial Sequence
  chemically synthesized
aaatgactttttacccagta

SEQ ID NO: 233857 - DNA, 20 bp, Artificial Sequence
  chemically synthesized
aatgactttttacccagtag

SEQ ID NO: 233858 - DNA, 20 bp, Artificial Sequence
  chemically synthesized
ttggggttatatcctctact

SEQ ID NO: 233859 - DNA, 20 bp, Artificial Sequence
  chemically synthesized
tttggggttatatcctctac

SEQ ID NO: 233860 - DNA, 20 bp, Artificial Sequence
  chemically synthesized
cagtagaggatataacccca

SEQ ID NO: 233861 - DNA, 20 bp, Artificial Sequence
  chemically synthesized
agtagaggatataaccccaa

SEQ ID NO: 233862 - DNA, 20 bp, Artificial Sequence
  chemically synthesized
ttgataccctacagcctttg

SEQ ID NO: 233863 - DNA, 20 bp, Artificial Sequence
  chemically synthesized
gttgataccctacagccttt

SEQ ID NO: 233864 - DNA, 20 bp, Artificial Sequence
  chemically synthesized
ggatataaccccaaaggctg

SEQ ID NO: 233865 - DNA, 20 bp, Artificial Sequence
  chemically synthesized
cgttgataccctacagcctt

SEQ ID NO: 233866 - DNA, 20 bp, Artificial Sequence
  chemically synthesized
gatataaccccaaaggctgt

SEQ ID NO: 233867 - DNA, 20 bp, Artificial Sequence
  chemically synthesized
atataaccccaaaggctgta

SEQ ID NO: 233868 - DNA, 20 bp, Artificial Sequence
  chemically synthesized
ctaaactcgttgatacccta

SEQ ID NO: 233869 - DNA, 20 bp, Artificial Sequence
  chemically synthesized
aaaggctgtagggtatcaac

SEQ ID NO: 233870 - DNA, 20 bp, Artificial Sequence
  chemically synthesized
ctgtagggtatcaacgagtt

SEQ ID NO: 233871 - DNA, 20 bp, Artificial Sequence
  chemically synthesized
ctggaataagattagtgaat

SEQ ID NO: 233872 - DNA, 20 bp, Artificial Sequence
  chemically synthesized
aaagtattctggaataagat

SEQ ID NO: 233873 - DNA, 20 bp, Artificial Sequence
  chemically synthesized
cttattcactaatcttattc

SEQ ID NO: 233874 - DNA, 20 bp, Artificial Sequence
  chemically synthesized
ttaaaaaagtattctggaat

SEQ ID NO: 233875 - DNA, 20 bp, Artificial Sequence
  chemically synthesized
gaatttttaaaaaagtattc

SEQ ID NO: 233876 - DNA, 20 bp, Artificial Sequence
  chemically synthesized
taatgagtgaatttttaaaa

SEQ ID NO: 233877 - DNA, 20 bp, Artificial Sequence
  chemically synthesized
ttttaaaaattcactcatta

SEQ ID NO: 233878 - DNA, 20 bp, Artificial Sequence
  chemically synthesized
taaaaattcactcattatag

SEQ ID NO: 233879 - DNA, 20 bp, Artificial Sequence
  chemically synthesized
gaaacaaatgcttctataat

SEQ ID NO: 233880 - DNA, 20 bp, Artificial Sequence
  chemically synthesized
actggttcaaaagagaatac

SEQ ID NO: 233881 - DNA, 20 bp, Artificial Sequence
  chemically synthesized
aagacaaaactggttcaaaa

SEQ ID NO: 233882 - DNA, 20 bp, Artificial Sequence
  chemically synthesized
tcttgtattctcttttgaac

SEQ ID NO: 233883 - DNA, 20 bp, Artificial Sequence
  chemically synthesized
ggaagacaaaactggttcaa

SEQ ID NO: 233884 - DNA, 20 bp, Artificial Sequence
  chemically synthesized
agctggtaggaagacaaaac

SEQ ID NO: 233885 - DNA, 20 bp, Artificial Sequence
  chemically synthesized
aaccagttttgtcttcctac

SEQ ID NO: 233886 - DNA, 20 bp, Artificial Sequence
  chemically synthesized
gtaattggagagctggtagg

SEQ ID NO: 233887 - DNA, 20 bp, Artificial Sequence
  chemically synthesized
acagtaattggagagctggt

SEQ ID NO: 233888 - DNA, 20 bp, Artificial Sequence
  chemically synthesized
tacagtaattggagagctgg

SEQ ID NO: 233889 - DNA, 20 bp, Artificial Sequence
  chemically synthesized
taatacagtaattggagagc

SEQ ID NO: 233890 - DNA, 20 bp, Artificial Sequence
  chemically synthesized
tatttaatacagtaattgga

SEQ ID NO: 233891 - DNA, 20 bp, Artificial Sequence
  chemically synthesized
tttatttaatacagtaattg

SEQ ID NO: 233892 - DNA, 20 bp, Artificial Sequence
  chemically synthesized
gttttatttaatacagtaat

SEQ ID NO: 233893 - DNA, 20 bp, Artificial Sequence
  chemically synthesized
acggtaggttttatttaata

SEQ ID NO: 233894 - DNA, 20 bp, Artificial Sequence
  chemically synthesized
tattaaataaaacctaccgt

SEQ ID NO: 233895 - DNA, 20 bp, Artificial Sequence
  chemically synthesized
aatcatagtgaactcacggt

SEQ ID NO: 233896 - DNA, 20 bp, Artificial Sequence
  chemically synthesized
aaatcatagtgaactcacgg

SEQ ID NO: 233897 - DNA, 20 bp, Artificial Sequence
  chemically synthesized
tgtaaatcatagtgaactca

SEQ ID NO: 233898 - DNA, 20 bp, Artificial Sequence
  chemically synthesized
cataattttcatgtaaatca

SEQ ID NO: 233899 - DNA, 20 bp, Artificial Sequence
  chemically synthesized
cagcacagtgaaattttatg

SEQ ID NO: 233900 - DNA, 20 bp, Artificial Sequence
  chemically synthesized
ataaaatttcactgtgctga

SEQ ID NO: 233901 - DNA, 20 bp, Artificial Sequence
  chemically synthesized
taaaatttcactgtgctgat

SEQ ID NO: 233902 - DNA, 20 bp, Artificial Sequence
  chemically synthesized
aattctaccacctatcagca

SEQ ID NO: 233903 - DNA, 20 bp, Artificial Sequence
  chemically synthesized
aatttcactgtgctgatagg

SEQ ID NO: 233904 - DNA, 20 bp, Artificial Sequence
  chemically synthesized
ttcataattctaccacctat

SEQ ID NO: 233905 - DNA, 20 bp, Artificial Sequence
  chemically synthesized
ttcactgtgctgataggtgg

SEQ ID NO: 233906 - DNA, 20 bp, Artificial Sequence
  chemically synthesized
gaataatggagaaaagtaca

SEQ ID NO: 233907 - DNA, 20 bp, Artificial Sequence
  chemically synthesized
acattttgaataatggagaa

SEQ ID NO: 233908 - DNA, 20 bp, Artificial Sequence
  chemically synthesized
tggggacattttgaataatg

SEQ ID NO: 233909 - DNA, 20 bp, Artificial Sequence
  chemically synthesized
actggggacattttgaataa

SEQ ID NO: 233910 - DNA, 20 bp, Artificial Sequence
  chemically synthesized
tccattattcaaaatgtccc

SEQ ID NO: 233911 - DNA, 20 bp, Artificial Sequence
  chemically synthesized
attttgttcagagtatactg

SEQ ID NO: 233912 - DNA, 20 bp, Artificial Sequence
  chemically synthesized
aattttgttcagagtatact

SEQ ID NO: 233913 - DNA, 20 bp, Artificial Sequence
  chemically synthesized
taattttgttcagagtatac

SEQ ID NO: 233914 - DNA, 20 bp, Artificial Sequence
  chemically synthesized
taaatgtttaattttgttca

SEQ ID NO: 233915 - DNA, 20 bp, Artificial Sequence
  chemically synthesized
attaaatgtttaattttgtt

SEQ ID NO: 233916 - DNA, 20 bp, Artificial Sequence
  chemically synthesized
aacaaaattaaacatttaat

SEQ ID NO: 233917 - DNA, 20 bp, Artificial Sequence
  chemically synthesized
aagctaaatagatttgcata

SEQ ID NO: 233918 - DNA, 20 bp, Artificial Sequence
  chemically synthesized
atgctatatgcaaatctatt

SEQ ID NO: 233919 - DNA, 20 bp, Artificial Sequence
  chemically synthesized
taaggcaacacgaagctaaa

SEQ ID NO: 233920 - DNA, 20 bp, Artificial Sequence
  chemically synthesized
tgcatacctaaggcaacacg

SEQ ID NO: 233921 - DNA, 20 bp, Artificial Sequence
  chemically synthesized
tatttagcttcgtgttgcct

SEQ ID NO: 233922 - DNA, 20 bp, Artificial Sequence
  chemically synthesized
atttagcttcgtgttgcctt

SEQ ID NO: 233923 - DNA, 20 bp, Artificial Sequence
  chemically synthesized
tgtaacgtcttgcataccta

SEQ ID NO: 233924 - DNA, 20 bp, Artificial Sequence
  chemically synthesized
atgtaacgtcttgcatacct

SEQ ID NO: 233925 - DNA, 20 bp, Artificial Sequence
  chemically synthesized
tcgtgttgccttaggtatgc

SEQ ID NO: 233926 - DNA, 20 bp, Artificial Sequence
  chemically synthesized
atatcatacaaaaaaaatct

SEQ ID NO: 233927 - DNA, 20 bp, Artificial Sequence
  chemically synthesized
ctgttttatctttggtggct

SEQ ID NO: 233928 - DNA, 20 bp, Artificial Sequence
  chemically synthesized
aaaaaaaatctaagccacca

SEQ ID NO: 233929 - DNA, 20 bp, Artificial Sequence
  chemically synthesized
caaaactgttttatctttgg

SEQ ID NO: 233930 - DNA, 20 bp, Artificial Sequence
  chemically synthesized
ttgcaaaactgttttatctt

SEQ ID NO: 233931 - DNA, 20 bp, Artificial Sequence
  chemically synthesized
ctaagccaccaaagataaaa

SEQ ID NO: 233932 - DNA, 20 bp, Artificial Sequence
  chemically synthesized
taaaacagttttgcaatcaa

SEQ ID NO: 233933 - DNA, 20 bp, Artificial Sequence
  chemically synthesized
tgctgctgatggaagagaaa

SEQ ID NO: 233934 - DNA, 20 bp, Artificial Sequence
  chemically synthesized
gtgctgctgatggaagagaa

SEQ ID NO: 233935 - DNA, 20 bp, Artificial Sequence
  chemically synthesized
tttttccttttctcttccat

SEQ ID NO: 233936 - DNA, 20 bp, Artificial Sequence
  chemically synthesized
tcgctgtgctgctgatggaa

SEQ ID NO: 233937 - DNA, 20 bp, Artificial Sequence
  chemically synthesized
ttccttttctcttccatcag

SEQ ID NO: 233938 - DNA, 20 bp, Artificial Sequence
  chemically synthesized
catcgctgtgctgctgatgg

SEQ ID NO: 233939 - DNA, 20 bp, Artificial Sequence
  chemically synthesized
gtacatcgctgtgctgctga

SEQ ID NO: 233940 - DNA, 20 bp, Artificial Sequence
  chemically synthesized
tttctcttccatcagcagca

SEQ ID NO: 233941 - DNA, 20 bp, Artificial Sequence
  chemically synthesized
gcagcacagcgatgtacaat

SEQ ID NO: 233942 - DNA, 20 bp, Artificial Sequence
  chemically synthesized
cagcacagcgatgtacaata

SEQ ID NO: 233943 - DNA, 20 bp, Artificial Sequence
  chemically synthesized
cgatgtacaataaggaaata

SEQ ID NO: 233944 - DNA, 20 bp, Artificial Sequence
  chemically synthesized
taaggaaataaagtaaactt

SEQ ID NO: 233945 - DNA, 20 bp, Artificial Sequence
  chemically synthesized
atacacatttcatatttcta

SEQ ID NO: 233946 - DNA, 20 bp, Artificial Sequence
  chemically synthesized
tttctcatcgcattcacaat

SEQ ID NO: 233947 - DNA, 20 bp, Artificial Sequence
  chemically synthesized
gtgcttattgtgaatgcgat

SEQ ID NO: 233948 - DNA, 20 bp, Artificial Sequence
  chemically synthesized
ttattgtgaatgcgatgaga

SEQ ID NO: 233949 - DNA, 20 bp, Artificial Sequence
  chemically synthesized
tattgtgaatgcgatgagaa

SEQ ID NO: 233950 - DNA, 20 bp, Artificial Sequence
  chemically synthesized
gtgaatgcgatgagaaaggc

SEQ ID NO: 233951 - DNA, 20 bp, Artificial Sequence
  chemically synthesized
atgcgatgagaaaggcaagt

SEQ ID NO: 233952 - DNA, 20 bp, Artificial Sequence
  chemically synthesized
tgcgatgagaaaggcaagtc

SEQ ID NO: 233953 - DNA, 20 bp, Artificial Sequence
  chemically synthesized
atgagaaaggcaagtcagga

SEQ ID NO: 233954 - DNA, 20 bp, Artificial Sequence
  chemically synthesized
gaaaggcaagtcaggacagt

SEQ ID NO: 233955 - DNA, 20 bp, Artificial Sequence
  chemically synthesized
aaggcaagtcaggacagtga

SEQ ID NO: 233956 - DNA, 20 bp, Artificial Sequence
  chemically synthesized
caagtcaggacagtgagagt

SEQ ID NO: 233957 - DNA, 20 bp, Artificial Sequence
  chemically synthesized
aagtcaggacagtgagagtc

SEQ ID NO: 233958 - DNA, 20 bp, Artificial Sequence
  chemically synthesized
tcatttatagtgtgagaatg

SEQ ID NO: 233959 - DNA, 20 bp, Artificial Sequence
  chemically synthesized
tactctttcatttatagtgt

SEQ ID NO: 233960 - DNA, 20 bp, Artificial Sequence
  chemically synthesized
cattctcacactataaatga

SEQ ID NO: 233961 - DNA, 20 bp, Artificial Sequence
  chemically synthesized
acttgctactctttcattta

SEQ ID NO: 233962 - DNA, 20 bp, Artificial Sequence
  chemically synthesized
ttctcacactataaatgaaa

SEQ ID NO: 233963 - DNA, 20 bp, Artificial Sequence
  chemically synthesized
tcacactataaatgaaagag

SEQ ID NO: 233964 - DNA, 20 bp, Artificial Sequence
  chemically synthesized
actataaatgaaagagtagc

SEQ ID NO: 233965 - DNA, 20 bp, Artificial Sequence
  chemically synthesized
aatgaaagagtagcaagtat

SEQ ID NO: 233966 - DNA, 20 bp, Artificial Sequence
  chemically synthesized
ccatggaagttattgaattt

SEQ ID NO: 233967 - DNA, 20 bp, Artificial Sequence
  chemically synthesized
ctaaaattcaataacttcca

SEQ ID NO: 233968 - DNA, 20 bp, Artificial Sequence
  chemically synthesized
agtaggtatcttggccatgg

SEQ ID NO: 233969 - DNA, 20 bp, Artificial Sequence
  chemically synthesized
attcaataacttccatggcc

SEQ ID NO: 233970 - DNA, 20 bp, Artificial Sequence
  chemically synthesized
tatagtaggtatcttggcca

SEQ ID NO: 233971 - DNA, 20 bp, Artificial Sequence
  chemically synthesized
tcaaattatagtaggtatct

SEQ ID NO: 233972 - DNA, 20 bp, Artificial Sequence
  chemically synthesized
atcaatgttcaaattatagt

SEQ ID NO: 233973 - DNA, 20 bp, Artificial Sequence
  chemically synthesized
aatcaatgttcaaattatag

SEQ ID NO: 233974 - DNA, 20 bp, Artificial Sequence
  chemically synthesized
gggaatcaatgttcaaatta

SEQ ID NO: 233975 - DNA, 20 bp, Artificial Sequence
  chemically synthesized
tttgaacattgattcccttt

SEQ ID NO: 233976 - DNA, 20 bp, Artificial Sequence
  chemically synthesized
gaacattgattccctttgag

SEQ ID NO: 233977 - DNA, 20 bp, Artificial Sequence
  chemically synthesized
tcaggagaaagcttctcaaa

SEQ ID NO: 233978 - DNA, 20 bp, Artificial Sequence
  chemically synthesized
ctcaggagaaagcttctcaa

SEQ ID NO: 233979 - DNA, 20 bp, Artificial Sequence
  chemically synthesized
cctcaggagaaagcttctca

SEQ ID NO: 233980 - DNA, 20 bp, Artificial Sequence
  chemically synthesized
cctttgagaagctttctcct

SEQ ID NO: 233981 - DNA, 20 bp, Artificial Sequence
  chemically synthesized
ctttgagaagctttctcctg

SEQ ID NO: 233982 - DNA, 20 bp, Artificial Sequence
  chemically synthesized
cttgatggtgcctcaggaga

SEQ ID NO: 233983 - DNA, 20 bp, Artificial Sequence
  chemically synthesized
ctgtcttgatggtgcctcag

SEQ ID NO: 233984 - DNA, 20 bp, Artificial Sequence
  chemically synthesized
atctgtcttgatggtgcctc

SEQ ID NO: 233985 - DNA, 20 bp, Artificial Sequence
  chemically synthesized
tatctgtcttgatggtgcct

SEQ ID NO: 233986 - DNA, 20 bp, Artificial Sequence
  chemically synthesized
ctttctcctgaggcaccatc

SEQ ID NO: 233987 - DNA, 20 bp, Artificial Sequence
  chemically synthesized
ctcctgaggcaccatcaaga

SEQ ID NO: 233988 - DNA, 20 bp, Artificial Sequence
  chemically synthesized
attattaatatctgtcttga

SEQ ID NO: 233989 - DNA, 20 bp, Artificial Sequence
  chemically synthesized
tcaagacagatattaataat

SEQ ID NO: 233990 - DNA, 20 bp, Artificial Sequence
  chemically synthesized
agacagatattaataattag

SEQ ID NO: 233991 - DNA, 20 bp, Artificial Sequence
  chemically synthesized
gatattaataattagtagtt

SEQ ID NO: 233992 - DNA, 20 bp, Artificial Sequence
  chemically synthesized
ttaataattagtagttcagc

SEQ ID NO: 233993 - DNA, 20 bp, Artificial Sequence
  chemically synthesized
taataattagtagttcagct

SEQ ID NO: 233994 - DNA, 20 bp, Artificial Sequence
  chemically synthesized
aataattagtagttcagcta

SEQ ID NO: 233995 - DNA, 20 bp, Artificial Sequence
  chemically synthesized
ataattagtagttcagctag

SEQ ID NO: 233996 - DNA, 20 bp, Artificial Sequence
  chemically synthesized
ttagtagttcagctaggggt

SEQ ID NO: 233997 - DNA, 20 bp, Artificial Sequence
  chemically synthesized
gatatttgtggtccaacccc

SEQ ID NO: 233998 - DNA, 20 bp, Artificial Sequence
  chemically synthesized
tttgttcaggttgatatttg

SEQ ID NO: 233999 - DNA, 20 bp, Artificial Sequence
  chemically synthesized
gggtgttctgtagtttgttc

SEQ ID NO: 234000 - DNA, 20 bp, Artificial Sequence
  chemically synthesized
agggtgttctgtagtttgtt

SEQ ID NO: 234001 - DNA, 20 bp, Artificial Sequence
  chemically synthesized
atatcaacctgaacaaacta

SEQ ID NO: 234002 - DNA, 20 bp, Artificial Sequence
  chemically synthesized
caaatgtggagggtgttctg

SEQ ID NO: 234003 - DNA, 20 bp, Artificial Sequence
  chemically synthesized
agtgctgaagcaaatgtgga

SEQ ID NO: 234004 - DNA, 20 bp, Artificial Sequence
  chemically synthesized
cagtgctgaagcaaatgtgg

SEQ ID NO: 234005 - DNA, 20 bp, Artificial Sequence
  chemically synthesized
tcagtgctgaagcaaatgtg

SEQ ID NO: 234006 - DNA, 20 bp, Artificial Sequence
  chemically synthesized
tgtcagtgctgaagcaaatg

SEQ ID NO: 234007 - DNA, 20 bp, Artificial Sequence
  chemically synthesized
aacaccctccacatttgctt

SEQ ID NO: 234008 - DNA, 20 bp, Artificial Sequence
  chemically synthesized
gttcaaaactgtcagtgctg

SEQ ID NO: 234009 - DNA, 20 bp, Artificial Sequence
  chemically synthesized
cacatttgcttcagcactga

SEQ ID NO: 234010 - DNA, 20 bp, Artificial Sequence
  chemically synthesized
cagggagtgttcaaaactgt

SEQ ID NO: 234011 - DNA, 20 bp, Artificial Sequence
  chemically synthesized
tgacagttttgaacactccc

SEQ ID NO: 234012 - DNA, 20 bp, Artificial Sequence
  chemically synthesized
cagttttgaacactccctgg

SEQ ID NO: 234013 - DNA, 20 bp, Artificial Sequence
  chemically synthesized
aagtgagtttggccaccagg

SEQ ID NO: 234014 - DNA, 20 bp, Artificial Sequence
  chemically synthesized
acaagtgagtttggccacca

SEQ ID NO: 234015 - DNA, 20 bp, Artificial Sequence
  chemically synthesized
aacaagtgagtttggccacc

SEQ ID NO: 234016 - DNA, 20 bp, Artificial Sequence
  chemically synthesized
aaacaagtgagtttggccac

SEQ ID NO: 234017 - DNA, 20 bp, Artificial Sequence
  chemically synthesized
aaggtgaaaacaagtgagtt

SEQ ID NO: 234018 - DNA, 20 bp, Artificial Sequence
  chemically synthesized
tttcaaaggtgaaaacaagt

SEQ ID NO: 234019 - DNA, 20 bp, Artificial Sequence
  chemically synthesized
ctcatttcaaaggtgaaaac

SEQ ID NO: 234020 - DNA, 20 bp, Artificial Sequence
  chemically synthesized
cttgttttcacctttgaaat

SEQ ID NO: 234021 - DNA, 20 bp, Artificial Sequence
  chemically synthesized
tgaaaactaactcatttcaa

SEQ ID NO: 234022 - DNA, 20 bp, Artificial Sequence
  chemically synthesized
gtgaaaactaactcatttca

SEQ ID NO: 234023 - DNA, 20 bp, Artificial Sequence
  chemically synthesized
ttttcacctttgaaatgagt

SEQ ID NO: 234024 - DNA, 20 bp, Artificial Sequence
  chemically synthesized
gaaatgagttagttttcact

SEQ ID NO: 234025 - DNA, 20 bp, Artificial Sequence
  chemically synthesized
gctcagtacccaacagcact

SEQ ID NO: 234026 - DNA, 20 bp, Artificial Sequence
  chemically synthesized
tagttttcactgagtgctgt

SEQ ID NO: 234027 - DNA, 20 bp, Artificial Sequence
  chemically synthesized
agttttcactgagtgctgtt

SEQ ID NO: 234028 - DNA, 20 bp, Artificial Sequence
  chemically synthesized
gctagtggctcagtacccaa

SEQ ID NO: 234029 - DNA, 20 bp, Artificial Sequence
  chemically synthesized
actgagtgctgttgggtact

SEQ ID NO: 234030 - DNA, 20 bp, Artificial Sequence
  chemically synthesized
gctgttgggtactgagccac

SEQ ID NO: 234031 - DNA, 20 bp, Artificial Sequence
  chemically synthesized
cctcacttctgctagtggct

SEQ ID NO: 234032 - DNA, 20 bp, Artificial Sequence
  chemically synthesized
gttgggtactgagccactag

SEQ ID NO: 234033 - DNA, 20 bp, Artificial Sequence
  chemically synthesized
gggtactgagccactagcag

SEQ ID NO: 234034 - DNA, 20 bp, Artificial Sequence
  chemically synthesized
cacatcctcacttctgctag

SEQ ID NO: 234035 - DNA, 20 bp, Artificial Sequence
  chemically synthesized
ctgcacatcctcacttctgc

SEQ ID NO: 234036 - DNA, 20 bp, Artificial Sequence
  chemically synthesized
actgagccactagcagaagt

SEQ ID NO: 234037 - DNA, 20 bp, Artificial Sequence
  chemically synthesized
ctgagccactagcagaagtg

SEQ ID NO: 234038 - DNA, 20 bp, Artificial Sequence
  chemically synthesized
ctagcagaagtgaggatgtg

SEQ ID NO: 234039 - DNA, 20 bp, Artificial Sequence
  chemically synthesized
ggcgtgcaaccgtgagtcat

SEQ ID NO: 234040 - DNA, 20 bp, Artificial Sequence
  chemically synthesized
atgtgcagtctgatgactca

SEQ ID NO: 234041 - DNA, 20 bp, Artificial Sequence
  chemically synthesized
atttagtggcgtgcaaccgt

SEQ ID NO: 234042 - DNA, 20 bp, Artificial Sequence
  chemically synthesized
gtgtaattggcagtatttag

SEQ ID NO: 234043 - DNA, 20 bp, Artificial Sequence
  chemically synthesized
tgtgtgtaattggcagtatt

SEQ ID NO: 234044 - DNA, 20 bp, Artificial Sequence
  chemically synthesized
ggaaaaatgtgtgtaattgg

SEQ ID NO: 234045 - DNA, 20 bp, Artificial Sequence
  chemically synthesized
aggggaaaaatgtgtgtaat

SEQ ID NO: 234046 - DNA, 20 bp, Artificial Sequence
  chemically synthesized
ccttccccaaaatttgcaag

SEQ ID NO: 234047 - DNA, 20 bp, Artificial Sequence
  chemically synthesized
cccttccccaaaatttgcaa

SEQ ID NO: 234048 - DNA, 20 bp, Artificial Sequence
  chemically synthesized
ccccttccccaaaatttgca

SEQ ID NO: 234049 - DNA, 20 bp, Artificial Sequence
  chemically synthesized
cccccttccccaaaatttgc

SEQ ID NO: 234050 - DNA, 20 bp, Artificial Sequence
  chemically synthesized
atttttccccttgcaaattt

SEQ ID NO: 234051 - DNA, 20 bp, Artificial Sequence
  chemically synthesized
tttttccccttgcaaatttt

SEQ ID NO: 234052 - DNA, 20 bp, Artificial Sequence
  chemically synthesized
ttttccccttgcaaattttg

SEQ ID NO: 234053 - DNA, 20 bp, Artificial Sequence
  chemically synthesized
tccccttgcaaattttgggg

SEQ ID NO: 234054 - DNA, 20 bp, Artificial Sequence
  chemically synthesized
ccccttgcaaattttgggga

SEQ ID NO: 234055 - DNA, 20 bp, Artificial Sequence
  chemically synthesized
cccttgcaaattttggggaa

SEQ ID NO: 234056 - DNA, 20 bp, Artificial Sequence
  chemically synthesized
ccttgcaaattttggggaag

SEQ ID NO: 234057 - DNA, 20 bp, Artificial Sequence
  chemically synthesized
cttgcaaattttggggaagg

SEQ ID NO: 234058 - DNA, 20 bp, Artificial Sequence
  chemically synthesized
tgcaaattttggggaagggg

SEQ ID NO: 234059 - DNA, 20 bp, Artificial Sequence
  chemically synthesized
gcaaattttggggaaggggg

SEQ ID NO: 234060 - DNA, 20 bp, Artificial Sequence
  chemically synthesized
caaattttggggaaggggga

SEQ ID NO: 234061 - DNA, 20 bp, Artificial Sequence
  chemically synthesized
aaattttggggaagggggag

SEQ ID NO: 234062 - DNA, 20 bp, Artificial Sequence
  chemically synthesized
ggggaagggggaggggtgtg

SEQ ID NO: 234063 - DNA, 20 bp, Artificial Sequence
  chemically synthesized
gggaagggggaggggtgtga

SEQ ID NO: 234064 - DNA, 20 bp, Artificial Sequence
  chemically synthesized
ggaagggggaggggtgtgaa

SEQ ID NO: 234065 - DNA, 20 bp, Artificial Sequence
  chemically synthesized
gaagggggaggggtgtgaag

SEQ ID NO: 234066 - DNA, 20 bp, Artificial Sequence
  chemically synthesized
aagggggaggggtgtgaagg

SEQ ID NO: 234067 - DNA, 20 bp, Artificial Sequence
  chemically synthesized
gggggaggggtgtgaagggg

SEQ ID NO: 234068 - DNA, 20 bp, Artificial Sequence
  chemically synthesized
ggggaggggtgtgaaggggg

SEQ ID NO: 234069 - DNA, 20 bp, Artificial Sequence
  chemically synthesized
gggaggggtgtgaaggggga

SEQ ID NO: 234070 - DNA, 20 bp, Artificial Sequence
  chemically synthesized
ggaggggtgtgaagggggag

SEQ ID NO: 234071 - DNA, 20 bp, Artificial Sequence
  chemically synthesized
tgtgaagggggaggggtgtg

SEQ ID NO: 234072 - DNA, 20 bp, Artificial Sequence
  chemically synthesized
gtgaagggggaggggtgtga

SEQ ID NO: 234073 - DNA, 20 bp, Artificial Sequence
  chemically synthesized
gaagggggaggggtgtgaag

SEQ ID NO: 234074 - DNA, 20 bp, Artificial Sequence
  chemically synthesized
aagggggaggggtgtgaagg

SEQ ID NO: 234075 - DNA, 20 bp, Artificial Sequence
  chemically synthesized
gggggaggggtgtgaaggag

SEQ ID NO: 234076 - DNA, 20 bp, Artificial Sequence
  chemically synthesized
ggggaggggtgtgaaggagg

SEQ ID NO: 234077 - DNA, 20 bp, Artificial Sequence
  chemically synthesized
gggaggggtgtgaaggagga

SEQ ID NO: 234078 - DNA, 20 bp, Artificial Sequence
  chemically synthesized
ggaggggtgtgaaggaggag

SEQ ID NO: 234079 - DNA, 20 bp, Artificial Sequence
  chemically synthesized
gtgtgaaggaggaggggtgt

SEQ ID NO: 234080 - DNA, 20 bp, Artificial Sequence
  chemically synthesized
tgaaggaggaggggtgtgag

SEQ ID NO: 234081 - DNA, 20 bp, Artificial Sequence
  chemically synthesized
gggtgtgagcagctgcatat

SEQ ID NO: 234082 - DNA, 20 bp, Artificial Sequence
  chemically synthesized
ggtgtgagcagctgcatata

SEQ ID NO: 234083 - DNA, 20 bp, Artificial Sequence
  chemically synthesized
gtataggcactccttatatg

SEQ ID NO: 234084 - DNA, 20 bp, Artificial Sequence
  chemically synthesized
tgtgagcagctgcatataag

SEQ ID NO: 234085 - DNA, 20 bp, Artificial Sequence
  chemically synthesized
aaagaaaagaaagaaagtat

SEQ ID NO: 234086 - DNA, 20 bp, Artificial Sequence
  chemically synthesized
aaaagaaaagaaagaaagta

SEQ ID NO: 234087 - DNA, 20 bp, Artificial Sequence
  chemically synthesized
aaaaaaaaagaaaagaaaga

SEQ ID NO: 234088 - DNA, 20 bp, Artificial Sequence
  chemically synthesized
ctcaaaaaaaaaagaaaaga

SEQ ID NO: 234089 - DNA, 20 bp, Artificial Sequence
  chemically synthesized
ctgtctcaaaaaaaaaagaa

SEQ ID NO: 234090 - DNA, 20 bp, Artificial Sequence
  chemically synthesized
taagactgtctcaaaaaaaa

SEQ ID NO: 234091 - DNA, 20 bp, Artificial Sequence
  chemically synthesized
ctttcttttctttttttttt

SEQ ID NO: 234092 - DNA, 20 bp, Artificial Sequence
  chemically synthesized
cttttcttttttttttgaga

SEQ ID NO: 234093 - DNA, 20 bp, Artificial Sequence
  chemically synthesized
tccgacctgggtgacagagt

SEQ ID NO: 234094 - DNA, 20 bp, Artificial Sequence
  chemically synthesized
gacagtcttactctgtcacc

SEQ ID NO: 234095 - DNA, 20 bp, Artificial Sequence
  chemically synthesized
gcactccgacctgggtgaca

SEQ ID NO: 234096 - DNA, 20 bp, Artificial Sequence
  chemically synthesized
acagtcttactctgtcaccc

SEQ ID NO: 234097 - DNA, 20 bp, Artificial Sequence
  chemically synthesized
ctgcactccgacctgggtga

SEQ ID NO: 234098 - DNA, 20 bp, Artificial Sequence
  chemically synthesized
tcttactctgtcacccaggt

SEQ ID NO: 234099 - DNA, 20 bp, Artificial Sequence
  chemically synthesized
ttactctgtcacccaggtcg

SEQ ID NO: 234100 - DNA, 20 bp, Artificial Sequence
  chemically synthesized
gcaccactgcactccgacct

SEQ ID NO: 234101 - DNA, 20 bp, Artificial Sequence
  chemically synthesized
agcaccactgcactccgacc

SEQ ID NO: 234102 - DNA, 20 bp, Artificial Sequence
  chemically synthesized
ctgtcacccaggtcggagtg

SEQ ID NO: 234103 - DNA, 20 bp, Artificial Sequence
  chemically synthesized
tcacccaggtcggagtgcag

SEQ ID NO: 234104 - DNA, 20 bp, Artificial Sequence
  chemically synthesized
ggagtgcagtggtgctatct

SEQ ID NO: 234105 - DNA, 20 bp, Artificial Sequence
  chemically synthesized
gaggttgcagtgagctgaga

SEQ ID NO: 234106 - DNA, 20 bp, Artificial Sequence
  chemically synthesized
gacagaggttgcagtgagct

SEQ ID NO: 234107 - DNA, 20 bp, Artificial Sequence
  chemically synthesized
tgggagacagaggttgcagt

SEQ ID NO: 234108 - DNA, 20 bp, Artificial Sequence
  chemically synthesized
aacctgggagacagaggttg

SEQ ID NO: 234109 - DNA, 20 bp, Artificial Sequence
  chemically synthesized
tgcttgaacctgggagacag

SEQ ID NO: 234110 - DNA, 20 bp, Artificial Sequence
  chemically synthesized
tcactgcaacctctgtctcc

SEQ ID NO: 234111 - DNA, 20 bp, Artificial Sequence
  chemically synthesized
ttgcttgaacctgggagaca

SEQ ID NO: 234112 - DNA, 20 bp, Artificial Sequence
  chemically synthesized
cactgcaacctctgtctccc

SEQ ID NO: 234113 - DNA, 20 bp, Artificial Sequence
  chemically synthesized
gattgcttgaacctgggaga

SEQ ID NO: 234114 - DNA, 20 bp, Artificial Sequence
  chemically synthesized
ggaagattgcttgaacctgg

SEQ ID NO: 234115 - DNA, 20 bp, Artificial Sequence
  chemically synthesized
aacctctgtctcccaggttc

SEQ ID NO: 234116 - DNA, 20 bp, Artificial Sequence
  chemically synthesized
cgggaagattgcttgaacct

SEQ ID NO: 234117 - DNA, 20 bp, Artificial Sequence
  chemically synthesized
gcgggaagattgcttgaacc

SEQ ID NO: 234118 - DNA, 20 bp, Artificial Sequence
  chemically synthesized
ttcaagcaatcttcccgcct

SEQ ID NO: 234119 - DNA, 20 bp, Artificial Sequence
  chemically synthesized
actcaggaggctgaggcggg

SEQ ID NO: 234120 - DNA, 20 bp, Artificial Sequence
  chemically synthesized
gctactcaggaggctgaggc

SEQ ID NO: 234121 - DNA, 20 bp, Artificial Sequence
  chemically synthesized
agctactcaggaggctgagg

SEQ ID NO: 234122 - DNA, 20 bp, Artificial Sequence
  chemically synthesized
cccagctactcaggaggctg

SEQ ID NO: 234123 - DNA, 20 bp, Artificial Sequence
  chemically synthesized
tcccagctactcaggaggct

SEQ ID NO: 234124 - DNA, 20 bp, Artificial Sequence
  chemically synthesized
tcttcccgcctcagcctcct

SEQ ID NO: 234125 - DNA, 20 bp, Artificial Sequence
  chemically synthesized
tcccgcctcagcctcctgag

SEQ ID NO: 234126 - DNA, 20 bp, Artificial Sequence
  chemically synthesized
gatagtcccagctactcagg

SEQ ID NO: 234127 - DNA, 20 bp, Artificial Sequence
  chemically synthesized
tgatagtcccagctactcag

SEQ ID NO: 234128 - DNA, 20 bp, Artificial Sequence
  chemically synthesized
gcctcagcctcctgagtagc

SEQ ID NO: 234129 - DNA, 20 bp, Artificial Sequence
  chemically synthesized
gctgatagtcccagctactc

SEQ ID NO: 234130 - DNA, 20 bp, Artificial Sequence
  chemically synthesized
cctcagcctcctgagtagct

SEQ ID NO: 234131 - DNA, 20 bp, Artificial Sequence
  chemically synthesized
tgctgatagtcccagctact

SEQ ID NO: 234132 - DNA, 20 bp, Artificial Sequence
  chemically synthesized
tcctgagtagctgggactat

SEQ ID NO: 234133 - DNA, 20 bp, Artificial Sequence
  chemically synthesized
gtggcgcttgctgatagtcc

SEQ ID NO: 234134 - DNA, 20 bp, Artificial Sequence
  chemically synthesized
gagtagctgggactatcagc

SEQ ID NO: 234135 - DNA, 20 bp, Artificial Sequence
  chemically synthesized
tgcgtggtggcgcttgctga

SEQ ID NO: 234136 - DNA, 20 bp, Artificial Sequence
  chemically synthesized
atcagcaagcgccaccacgc

SEQ ID NO: 234137 - DNA, 20 bp, Artificial Sequence
  chemically synthesized
tcagcaagcgccaccacgca

SEQ ID NO: 234138 - DNA, 20 bp, Artificial Sequence
  chemically synthesized
cacacaaaagccttgcgtgg

SEQ ID NO: 234139 - DNA, 20 bp, Artificial Sequence
  chemically synthesized
acacacacaaaagccttgcg

SEQ ID NO: 234140 - DNA, 20 bp, Artificial Sequence
  chemically synthesized
acacacacacacacacacaa

SEQ ID NO: 234141 - DNA, 20 bp, Artificial Sequence
  chemically synthesized
tgtgtgtgtgtgtgtatttt

SEQ ID NO: 234142 - DNA, 20 bp, Artificial Sequence
  chemically synthesized
gtgtgtgtgtgtatttttag

SEQ ID NO: 234143 - DNA, 20 bp, Artificial Sequence
  chemically synthesized
gtgtgtgtgtatttttagta

SEQ ID NO: 234144 - DNA, 20 bp, Artificial Sequence
  chemically synthesized
tgtgtgtgtatttttagtag

SEQ ID NO: 234145 - DNA, 20 bp, Artificial Sequence
  chemically synthesized
gtgtgtatttttagtagagg

SEQ ID NO: 234146 - DNA, 20 bp, Artificial Sequence
  chemically synthesized
gtgtatttttagtagaggtg

SEQ ID NO: 234147 - DNA, 20 bp, Artificial Sequence
  chemically synthesized
agaggtggagtttcaccctg

SEQ ID NO: 234148 - DNA, 20 bp, Artificial Sequence
  chemically synthesized
gaggtggagtttcaccctgt

SEQ ID NO: 234149 - DNA, 20 bp, Artificial Sequence
  chemically synthesized
tggagtttcaccctgtaggc

SEQ ID NO: 234150 - DNA, 20 bp, Artificial Sequence
  chemically synthesized
tgagtctagcctggcctaca

SEQ ID NO: 234151 - DNA, 20 bp, Artificial Sequence
  chemically synthesized
ggagtttcaccctgtaggcc

SEQ ID NO: 234152 - DNA, 20 bp, Artificial Sequence
  chemically synthesized
ttgagtctagcctggcctac

SEQ ID NO: 234153 - DNA, 20 bp, Artificial Sequence
  chemically synthesized
tttgagtctagcctggccta

SEQ ID NO: 234154 - DNA, 20 bp, Artificial Sequence
  chemically synthesized
tttcaccctgtaggccaggc

SEQ ID NO: 234155 - DNA, 20 bp, Artificial Sequence
  chemically synthesized
ccagaagtttgagtctagcc

SEQ ID NO: 234156 - DNA, 20 bp, Artificial Sequence
  chemically synthesized
tgagcccagaagtttgagtc

SEQ ID NO: 234157 - DNA, 20 bp, Artificial Sequence
  chemically synthesized
ccaggctagactcaaacttc

SEQ ID NO: 234158 - DNA, 20 bp, Artificial Sequence
  chemically synthesized
ttgcttgagcccagaagttt

SEQ ID NO: 234159 - DNA, 20 bp, Artificial Sequence
  chemically synthesized
caggctagactcaaacttct

SEQ ID NO: 234160 - DNA, 20 bp, Artificial Sequence
  chemically synthesized
agagtattgcttgagcccag

SEQ ID NO: 234161 - DNA, 20 bp, Artificial Sequence
  chemically synthesized
agactcaaacttctgggctc

SEQ ID NO: 234162 - DNA, 20 bp, Artificial Sequence
  chemically synthesized
gcgagagtattgcttgagcc

SEQ ID NO: 234163 - DNA, 20 bp, Artificial Sequence
  chemically synthesized
ctggggcgagagtattgctt

SEQ ID NO: 234164 - DNA, 20 bp, Artificial Sequence
  chemically synthesized
ctcaagcaatactctcgccc

SEQ ID NO: 234165 - DNA, 20 bp, Artificial Sequence
  chemically synthesized
actttgggaagctggggcga

SEQ ID NO: 234166 - DNA, 20 bp, Artificial Sequence
  chemically synthesized
gcactttgggaagctggggc

SEQ ID NO: 234167 - DNA, 20 bp, Artificial Sequence
  chemically synthesized
cccagcactttgggaagctg

SEQ ID NO: 234168 - DNA, 20 bp, Artificial Sequence
  chemically synthesized
tcccagcactttgggaagct

SEQ ID NO: 234169 - DNA, 20 bp, Artificial Sequence
  chemically synthesized
atcccagcactttgggaagc

SEQ ID NO: 234170 - DNA, 20 bp, Artificial Sequence
  chemically synthesized
actctcgccccagcttccca

SEQ ID NO: 234171 - DNA, 20 bp, Artificial Sequence
  chemically synthesized
tgtaatcccagcactttggg

SEQ ID NO: 234172 - DNA, 20 bp, Artificial Sequence
  chemically synthesized
gccccagcttcccaaagtgc

SEQ ID NO: 234173 - DNA, 20 bp, Artificial Sequence
  chemically synthesized
gcctgtaatcccagcacttt

SEQ ID NO: 234174 - DNA, 20 bp, Artificial Sequence
  chemically synthesized
ccccagcttcccaaagtgct

SEQ ID NO: 234175 - DNA, 20 bp, Artificial Sequence
  chemically synthesized
agcctgtaatcccagcactt

SEQ ID NO: 234176 - DNA, 20 bp, Artificial Sequence
  chemically synthesized
ttcccaaagtgctgggatta

SEQ ID NO: 234177 - DNA, 20 bp, Artificial Sequence
  chemically synthesized
tcccaaagtgctgggattac

SEQ ID NO: 234178 - DNA, 20 bp, Artificial Sequence
  chemically synthesized
gtggttcaagcctgtaatcc

SEQ ID NO: 234179 - DNA, 20 bp, Artificial Sequence
  chemically synthesized
ctggccaagcatggtggttc

SEQ ID NO: 234180 - DNA, 20 bp, Artificial Sequence
  chemically synthesized
caggcttgaaccaccatgct

SEQ ID NO: 234181 - DNA, 20 bp, Artificial Sequence
  chemically synthesized
gtgctcctggccaagcatgg

SEQ ID NO: 234182 - DNA, 20 bp, Artificial Sequence
  chemically synthesized
taggtgctcctggccaagca

SEQ ID NO: 234183 - DNA, 20 bp, Artificial Sequence
  chemically synthesized
cttgaaccaccatgcttggc

SEQ ID NO: 234184 - DNA, 20 bp, Artificial Sequence
  chemically synthesized
ttgaaccaccatgcttggcc

SEQ ID NO: 234185 - DNA, 20 bp, Artificial Sequence
  chemically synthesized
gaaccaccatgcttggccag

SEQ ID NO: 234186 - DNA, 20 bp, Artificial Sequence
  chemically synthesized
aactataggtgctcctggcc

SEQ ID NO: 234187 - DNA, 20 bp, Artificial Sequence
  chemically synthesized
gtagaaactataggtgctcc

SEQ ID NO: 234188 - DNA, 20 bp, Artificial Sequence
  chemically synthesized
tgcttggccaggagcaccta

SEQ ID NO: 234189 - DNA, 20 bp, Artificial Sequence
  chemically synthesized
gtttttgaggtagaaactat

SEQ ID NO: 234190 - DNA, 20 bp, Artificial Sequence
  chemically synthesized
tgtttttgaggtagaaacta

SEQ ID NO: 234191 - DNA, 20 bp, Artificial Sequence
  chemically synthesized
agggggctatgtttttgagg

SEQ ID NO: 234192 - DNA, 20 bp, Artificial Sequence
  chemically synthesized
tatagggggctatgtttttg

SEQ ID NO: 234193 - DNA, 20 bp, Artificial Sequence
  chemically synthesized
tagtttctacctcaaaaaca

SEQ ID NO: 234194 - DNA, 20 bp, Artificial Sequence
  chemically synthesized
gtatagggggctatgttttt

SEQ ID NO: 234195 - DNA, 20 bp, Artificial Sequence
  chemically synthesized
aatctgtggaaaggtatagg

SEQ ID NO: 234196 - DNA, 20 bp, Artificial Sequence
  chemically synthesized
taatctgtggaaaggtatag

SEQ ID NO: 234197 - DNA, 20 bp, Artificial Sequence
  chemically synthesized
ataatctgtggaaaggtata

SEQ ID NO: 234198 - DNA, 20 bp, Artificial Sequence
  chemically synthesized
tataatctgtggaaaggtat

SEQ ID NO: 234199 - DNA, 20 bp, Artificial Sequence
  chemically synthesized
atataatctgtggaaaggta

SEQ ID NO: 234200 - DNA, 20 bp, Artificial Sequence
  chemically synthesized
tagccccctatacctttcca

SEQ ID NO: 234201 - DNA, 20 bp, Artificial Sequence
  chemically synthesized
taacaatataatctgtggaa

SEQ ID NO: 234202 - DNA, 20 bp, Artificial Sequence
  chemically synthesized
gtaacaatataatctgtgga

SEQ ID NO: 234203 - DNA, 20 bp, Artificial Sequence
  chemically synthesized
aaaagtaacaatataatctg

SEQ ID NO: 234204 - DNA, 20 bp, Artificial Sequence
  chemically synthesized
gaaaagaagttcaatatcaa

SEQ ID NO: 234205 - DNA, 20 bp, Artificial Sequence
  chemically synthesized
caggcttttacaatgaaaag

SEQ ID NO: 234206 - DNA, 20 bp, Artificial Sequence
  chemically synthesized
ctccaggcttttacaatgaa

SEQ ID NO: 234207 - DNA, 20 bp, Artificial Sequence
  chemically synthesized
tgaacttcttttcattgtaa

SEQ ID NO: 234208 - DNA, 20 bp, Artificial Sequence
  chemically synthesized
ttcttttcattgtaaaagcc

SEQ ID NO: 234209 - DNA, 20 bp, Artificial Sequence
  chemically synthesized
cttttcattgtaaaagcctg

SEQ ID NO: 234210 - DNA, 20 bp, Artificial Sequence
  chemically synthesized
aacagccttaaattttctcc

SEQ ID NO: 234211 - DNA, 20 bp, Artificial Sequence
  chemically synthesized
aaacagccttaaattttctc

SEQ ID NO: 234212 - DNA, 20 bp, Artificial Sequence
  chemically synthesized
taaaagcctggagaaaattt

SEQ ID NO: 234213 - DNA, 20 bp, Artificial Sequence
  chemically synthesized
aaaagcctggagaaaattta

SEQ ID NO: 234214 - DNA, 20 bp, Artificial Sequence
  chemically synthesized
ttagaaaacagatatataaa

SEQ ID NO: 234215 - DNA, 20 bp, Artificial Sequence
  chemically synthesized
tggtgtgctgatttagaaaa

SEQ ID NO: 234216 - DNA, 20 bp, Artificial Sequence
  chemically synthesized
tatatatctgttttctaaat

SEQ ID NO: 234217 - DNA, 20 bp, Artificial Sequence
  chemically synthesized
tcacagttggtgtgctgatt

SEQ ID NO: 234218 - DNA, 20 bp, Artificial Sequence
  chemically synthesized
aaaagtgcagagttcacagt

SEQ ID NO: 234219 - DNA, 20 bp, Artificial Sequence
  chemically synthesized
attcaaaagtgcagagttca

SEQ ID NO: 234220 - DNA, 20 bp, Artificial Sequence
  chemically synthesized
catcccaattcaaaagtgca

SEQ ID NO: 234221 - DNA, 20 bp, Artificial Sequence
  chemically synthesized
ctcatcccaattcaaaagtg

SEQ ID NO: 234222 - DNA, 20 bp, Artificial Sequence
  chemically synthesized
tgaactctgcacttttgaat

SEQ ID NO: 234223 - DNA, 20 bp, Artificial Sequence
  chemically synthesized
gaactctgcacttttgaatt

SEQ ID NO: 234224 - DNA, 20 bp, Artificial Sequence
  chemically synthesized
attctctcatcccaattcaa

SEQ ID NO: 234225 - DNA, 20 bp, Artificial Sequence
  chemically synthesized
ctgcacttttgaattgggat

SEQ ID NO: 234226 - DNA, 20 bp, Artificial Sequence
  chemically synthesized
gcacttttgaattgggatga

SEQ ID NO: 234227 - DNA, 20 bp, Artificial Sequence
  chemically synthesized
tttgaattgggatgagagaa

SEQ ID NO: 234228 - DNA, 20 bp, Artificial Sequence
  chemically synthesized
aattgggatgagagaatgga

SEQ ID NO: 234229 - DNA, 20 bp, Artificial Sequence
  chemically synthesized
atgagagaatggaaagaaaa

SEQ ID NO: 234230 - DNA, 20 bp, Artificial Sequence
  chemically synthesized
tgagagaatggaaagaaaaa

SEQ ID NO: 234231 - DNA, 20 bp, Artificial Sequence
  chemically synthesized
agaatggaaagaaaaaaggt

SEQ ID NO: 234232 - DNA, 20 bp, Artificial Sequence
  chemically synthesized
gaatggaaagaaaaaaggtt

SEQ ID NO: 234233 - DNA, 20 bp, Artificial Sequence
  chemically synthesized
atggaaagaaaaaaggttgg

SEQ ID NO: 234234 - DNA, 20 bp, Artificial Sequence
  chemically synthesized
ggaaagaaaaaaggttggga

SEQ ID NO: 234235 - DNA, 20 bp, Artificial Sequence
  chemically synthesized
gaaagaaaaaaggttgggag

SEQ ID NO: 234236 - DNA, 20 bp, Artificial Sequence
  chemically synthesized
aagaaaaaaggttgggagag

SEQ ID NO: 234237 - DNA, 20 bp, Artificial Sequence
  chemically synthesized
aaaaaaggttgggagaggag

SEQ ID NO: 234238 - DNA, 20 bp, Artificial Sequence
  chemically synthesized
aaaaggttgggagaggagcg

SEQ ID NO: 234239 - DNA, 20 bp, Artificial Sequence
  chemically synthesized
ggttgggagaggagcggagc

SEQ ID NO: 234240 - DNA, 20 bp, Artificial Sequence
  chemically synthesized
gttgggagaggagcggagct

SEQ ID NO: 234241 - DNA, 20 bp, Artificial Sequence
  chemically synthesized
gggagaggagcggagctggg

SEQ ID NO: 234242 - DNA, 20 bp, Artificial Sequence
  chemically synthesized
gaggagcggagctgggaaga

SEQ ID NO: 234243 - DNA, 20 bp, Artificial Sequence
  chemically synthesized
aggagcggagctgggaagaa

SEQ ID NO: 234244 - DNA, 20 bp, Artificial Sequence
  chemically synthesized
ctagagatcacctttcttcc

SEQ ID NO: 234245 - DNA, 20 bp, Artificial Sequence
  chemically synthesized
ctgggaagaaaggtgatctc

SEQ ID NO: 234246 - DNA, 20 bp, Artificial Sequence
  chemically synthesized
gagcggaggaaaaaggacta

SEQ ID NO: 234247 - DNA, 20 bp, Artificial Sequence
  chemically synthesized
gggagcggaggaaaaaggac

SEQ ID NO: 234248 - DNA, 20 bp, Artificial Sequence
  chemically synthesized
gagcagggagcggaggaaaa

SEQ ID NO: 234249 - DNA, 20 bp, Artificial Sequence
  chemically synthesized
ggagcagggagcggaggaaa

SEQ ID NO: 234250 - DNA, 20 bp, Artificial Sequence
  chemically synthesized
tgagctggagcagggagcgg

SEQ ID NO: 234251 - DNA, 20 bp, Artificial Sequence
  chemically synthesized
gtgagctggagcagggagcg

SEQ ID NO: 234252 - DNA, 20 bp, Artificial Sequence
  chemically synthesized
aagtgagctggagcagggag

SEQ ID NO: 234253 - DNA, 20 bp, Artificial Sequence
  chemically synthesized
ttttcctccgctccctgctc

SEQ ID NO: 234254 - DNA, 20 bp, Artificial Sequence
  chemically synthesized
gaaaagtgagctggagcagg

SEQ ID NO: 234255 - DNA, 20 bp, Artificial Sequence
  chemically synthesized
tggaaaagtgagctggagca

SEQ ID NO: 234256 - DNA, 20 bp, Artificial Sequence
  chemically synthesized
ttggaaaagtgagctggagc

SEQ ID NO: 234257 - DNA, 20 bp, Artificial Sequence
  chemically synthesized
attggaaaagtgagctggag

SEQ ID NO: 234258 - DNA, 20 bp, Artificial Sequence
  chemically synthesized
ctgattggaaaagtgagctg

SEQ ID NO: 234259 - DNA, 20 bp, Artificial Sequence
  chemically synthesized
aactgattggaaaagtgagc

SEQ ID NO: 234260 - DNA, 20 bp, Artificial Sequence
  chemically synthesized
taaaaactgattggaaaagt

SEQ ID NO: 234261 - DNA, 20 bp, Artificial Sequence
  chemically synthesized
ctccagctcacttttccaat

SEQ ID NO: 234262 - DNA, 20 bp, Artificial Sequence
  chemically synthesized
attataaaaactgattggaa

SEQ ID NO: 234263 - DNA, 20 bp, Artificial Sequence
  chemically synthesized
tgcttattataaaaactgat

SEQ ID NO: 234264 - DNA, 20 bp, Artificial Sequence
  chemically synthesized
ttccaatcagtttttataat

SEQ ID NO: 234265 - DNA, 20 bp, Artificial Sequence
  chemically synthesized
cattatttattctcctacaa

SEQ ID NO: 234266 - DNA, 20 bp, Artificial Sequence
  chemically synthesized
aaactttgagacttttgtag

SEQ ID NO: 234267 - DNA, 20 bp, Artificial Sequence
  chemically synthesized
gtaaactttgagacttttgt

SEQ ID NO: 234268 - DNA, 20 bp, Artificial Sequence
  chemically synthesized
agtaaactttgagacttttg

SEQ ID NO: 234269 - DNA, 20 bp, Artificial Sequence
  chemically synthesized
attctcctacaaaagtctca

SEQ ID NO: 234270 - DNA, 20 bp, Artificial Sequence
  chemically synthesized
ttttataactagtaaacttt

SEQ ID NO: 234271 - DNA, 20 bp, Artificial Sequence
  chemically synthesized
acaaaagtctcaaagtttac

SEQ ID NO: 234272 - DNA, 20 bp, Artificial Sequence
  chemically synthesized
catcatgagttttttataac

SEQ ID NO: 234273 - DNA, 20 bp, Artificial Sequence
  chemically synthesized
cctatttaataaagcatcat

SEQ ID NO: 234274 - DNA, 20 bp, Artificial Sequence
  chemically synthesized
actcatgatgctttattaaa

SEQ ID NO: 234275 - DNA, 20 bp, Artificial Sequence
  chemically synthesized
caaatttaccctatttaata

SEQ ID NO: 234276 - DNA, 20 bp, Artificial Sequence
  chemically synthesized
ctcatgatgctttattaaat

SEQ ID NO: 234277 - DNA, 20 bp, Artificial Sequence
  chemically synthesized
tcatgatgctttattaaata

SEQ ID NO: 234278 - DNA, 20 bp, Artificial Sequence
  chemically synthesized
agggtaaatttgactttgta

SEQ ID NO: 234279 - DNA, 20 bp, Artificial Sequence
  chemically synthesized
tttgttatttttgctttaca

SEQ ID NO: 234280 - DNA, 20 bp, Artificial Sequence
  chemically synthesized
attatgcatgtgtgtaatgc

SEQ ID NO: 234281 - DNA, 20 bp, Artificial Sequence
  chemically synthesized
ttgcatacatatgcacgtgt

SEQ ID NO: 234282 - DNA, 20 bp, Artificial Sequence
  chemically synthesized
tgcatacatatgcacgtgtt

SEQ ID NO: 234283 - DNA, 20 bp, Artificial Sequence
  chemically synthesized
atcaatttcacatgtaacat

SEQ ID NO: 234284 - DNA, 20 bp, Artificial Sequence
  chemically synthesized
atataatttgaaatttttca

SEQ ID NO: 234285 - DNA, 20 bp, Artificial Sequence
  chemically synthesized
tcattttgcttttaaaaatg

SEQ ID NO: 234286 - DNA, 20 bp, Artificial Sequence
  chemically synthesized
tttcatagccacatttttaa

SEQ ID NO: 234287 - DNA, 20 bp, Artificial Sequence
  chemically synthesized
acatttttaaaagcaaaatg

SEQ ID NO: 234288 - DNA, 20 bp, Artificial Sequence
  chemically synthesized
ttaaaattatggttttatta

SEQ ID NO: 234289 - DNA, 20 bp, Artificial Sequence
  chemically synthesized
tttattgcatgttaaaatta

SEQ ID NO: 234290 - DNA, 20 bp, Artificial Sequence
  chemically synthesized
aattttaacatgcaataaat

SEQ ID NO: 234291 - DNA, 20 bp, Artificial Sequence
  chemically synthesized
atgagcatttacttcctttt

SEQ ID NO: 234292 - DNA, 20 bp, Artificial Sequence
  chemically synthesized
aatacttagaaccaaaaagg

SEQ ID NO: 234293 - DNA, 20 bp, Artificial Sequence
  chemically synthesized
ttgaatacttagaaccaaaa

SEQ ID NO: 234294 - DNA, 20 bp, Artificial Sequence
  chemically synthesized
tttgaatacttagaaccaaa

SEQ ID NO: 234295 - DNA, 20 bp, Artificial Sequence
  chemically synthesized
tttacttcctttttggttct

SEQ ID NO: 234296 - DNA, 20 bp, Artificial Sequence
  chemically synthesized
catgccagggtttgaatact

SEQ ID NO: 234297 - DNA, 20 bp, Artificial Sequence
  chemically synthesized
ggttctaagtattcaaaccc

SEQ ID NO: 234298 - DNA, 20 bp, Artificial Sequence
  chemically synthesized
tgagtataacacacatgcca

SEQ ID NO: 234299 - DNA, 20 bp, Artificial Sequence
  chemically synthesized
ctgagtataacacacatgcc

SEQ ID NO: 234300 - DNA, 20 bp, Artificial Sequence
  chemically synthesized
actgagtataacacacatgc

SEQ ID NO: 234301 - DNA, 20 bp, Artificial Sequence
  chemically synthesized
cctggcatgtgtgttatact

SEQ ID NO: 234302 - DNA, 20 bp, Artificial Sequence
  chemically synthesized
tactaattgagatgggcact

SEQ ID NO: 234303 - DNA, 20 bp, Artificial Sequence
  chemically synthesized
cggctagtactaattgagat

SEQ ID NO: 234304 - DNA, 20 bp, Artificial Sequence
  chemically synthesized
tactcagtgcccatctcaat

SEQ ID NO: 234305 - DNA, 20 bp, Artificial Sequence
  chemically synthesized
gcggctagtactaattgaga

SEQ ID NO: 234306 - DNA, 20 bp, Artificial Sequence
  chemically synthesized
aaatgcggctagtactaatt

SEQ ID NO: 234307 - DNA, 20 bp, Artificial Sequence
  chemically synthesized
gtgcccatctcaattagtac

SEQ ID NO: 234308 - DNA, 20 bp, Artificial Sequence
  chemically synthesized
ctgagctcttaaaatgcggc

SEQ ID NO: 234309 - DNA, 20 bp, Artificial Sequence
  chemically synthesized
attagtactagccgcatttt

SEQ ID NO: 234310 - DNA, 20 bp, Artificial Sequence
  chemically synthesized
gatactgagctcttaaaatg

SEQ ID NO: 234311 - DNA, 20 bp, Artificial Sequence
  chemically synthesized
tagtactagccgcattttaa

SEQ ID NO: 234312 - DNA, 20 bp, Artificial Sequence
  chemically synthesized
ctagccgcattttaagagct

SEQ ID NO: 234313 - DNA, 20 bp, Artificial Sequence
  chemically synthesized
ccctagccacataagatact

SEQ ID NO: 234314 - DNA, 20 bp, Artificial Sequence
  chemically synthesized
taagagctcagtatcttatg

SEQ ID NO: 234315 - DNA, 20 bp, Artificial Sequence
  chemically synthesized
agctcagtatcttatgtggc

SEQ ID NO: 234316 - DNA, 20 bp, Artificial Sequence
  chemically synthesized
tcagtgccccctagccacat

SEQ ID NO: 234317 - DNA, 20 bp, Artificial Sequence
  chemically synthesized
gctcagtatcttatgtggct

SEQ ID NO: 234318 - DNA, 20 bp, Artificial Sequence
  chemically synthesized
ctcagtatcttatgtggcta

SEQ ID NO: 234319 - DNA, 20 bp, Artificial Sequence
  chemically synthesized
tcagtatcttatgtggctag

SEQ ID NO: 234320 - DNA, 20 bp, Artificial Sequence
  chemically synthesized
cagtatcttatgtggctagg

SEQ ID NO: 234321 - DNA, 20 bp, Artificial Sequence
  chemically synthesized
aagtccaattcagtgccccc

SEQ ID NO: 234322 - DNA, 20 bp, Artificial Sequence
  chemically synthesized
gtggctagggggcactgaat

SEQ ID NO: 234323 - DNA, 20 bp, Artificial Sequence
  chemically synthesized
tagagctgcaaagtccaatt

SEQ ID NO: 234324 - DNA, 20 bp, Artificial Sequence
  chemically synthesized
gggcactgaattggactttg

SEQ ID NO: 234325 - DNA, 20 bp, Artificial Sequence
  chemically synthesized
ggtctctctttagagctgca

SEQ ID NO: 234326 - DNA, 20 bp, Artificial Sequence
  chemically synthesized
aattggactttgcagctcta

SEQ ID NO: 234327 - DNA, 20 bp, Artificial Sequence
  chemically synthesized
ttggactttgcagctctaaa

SEQ ID NO: 234328 - DNA, 20 bp, Artificial Sequence
  chemically synthesized
ggactttgcagctctaaaga

SEQ ID NO: 234329 - DNA, 20 bp, Artificial Sequence
  chemically synthesized
caatgtgaggtctctcttta

SEQ ID NO: 234330 - DNA, 20 bp, Artificial Sequence
  chemically synthesized
cacaatgtgaggtctctctt

SEQ ID NO: 234331 - DNA, 20 bp, Artificial Sequence
  chemically synthesized
acaataaaaatcacaatgtg

SEQ ID NO: 234332 - DNA, 20 bp, Artificial Sequence
  chemically synthesized
gacaataaaaatcacaatgt

SEQ ID NO: 234333 - DNA, 20 bp, Artificial Sequence
  chemically synthesized
cacattgtgatttttattgt

SEQ ID NO: 234334 - DNA, 20 bp, Artificial Sequence
  chemically synthesized
acattgtgatttttattgtc

SEQ ID NO: 234335 - DNA, 20 bp, Artificial Sequence
  chemically synthesized
ttcaaaattatttctctgct

SEQ ID NO: 234336 - DNA, 20 bp, Artificial Sequence
  chemically synthesized
cgtggtgcctcatccaagca

SEQ ID NO: 234337 - DNA, 20 bp, Artificial Sequence
  chemically synthesized
aattatttctctgcttggat

SEQ ID NO: 234338 - DNA, 20 bp, Artificial Sequence
  chemically synthesized
gacgtggtgcctcatccaag

SEQ ID NO: 234339 - DNA, 20 bp, Artificial Sequence
  chemically synthesized
attatttctctgcttggatg

SEQ ID NO: 234340 - DNA, 20 bp, Artificial Sequence
  chemically synthesized
tgagacgtggtgcctcatcc

SEQ ID NO: 234341 - DNA, 20 bp, Artificial Sequence
  chemically synthesized
tatttgcaaggagtgagacg

SEQ ID NO: 234342 - DNA, 20 bp, Artificial Sequence
  chemically synthesized
gtgatgtatttgcaaggagt

SEQ ID NO: 234343 - DNA, 20 bp, Artificial Sequence
  chemically synthesized
gagagtgatgtatttgcaag

SEQ ID NO: 234344 - DNA, 20 bp, Artificial Sequence
  chemically synthesized
gtgagagtgatgtatttgca

SEQ ID NO: 234345 - DNA, 20 bp, Artificial Sequence
  chemically synthesized
agtgagagtgatgtatttgc

SEQ ID NO: 234346 - DNA, 20 bp, Artificial Sequence
  chemically synthesized
aatccaggatttggtagtga

SEQ ID NO: 234347 - DNA, 20 bp, Artificial Sequence
  chemically synthesized
ctaatccaggatttggtagt

SEQ ID NO: 234348 - DNA, 20 bp, Artificial Sequence
  chemically synthesized
tgaactaatccaggatttgg

SEQ ID NO: 234349 - DNA, 20 bp, Artificial Sequence
  chemically synthesized
tcactctcactaccaaatcc

SEQ ID NO: 234350 - DNA, 20 bp, Artificial Sequence
  chemically synthesized
cactgaactaatccaggatt

SEQ ID NO: 234351 - DNA, 20 bp, Artificial Sequence
  chemically synthesized
ctcactaccaaatcctggat

SEQ ID NO: 234352 - DNA, 20 bp, Artificial Sequence
  chemically synthesized
catcaacactgaactaatcc

SEQ ID NO: 234353 - DNA, 20 bp, Artificial Sequence
  chemically synthesized
acatcaacactgaactaatc

SEQ ID NO: 234354 - DNA, 20 bp, Artificial Sequence
  chemically synthesized
taccaaatcctggattagtt

SEQ ID NO: 234355 - DNA, 20 bp, Artificial Sequence
  chemically synthesized
tgttgatgtcatattgttat

SEQ ID NO: 234356 - DNA, 20 bp, Artificial Sequence
  chemically synthesized
gtgaatgctacaggtgttgt

SEQ ID NO: 234357 - DNA, 20 bp, Artificial Sequence
  chemically synthesized
ttatgagctcacaacacctg

SEQ ID NO: 234358 - DNA, 20 bp, Artificial Sequence
  chemically synthesized
cctatttgtgtgaatgctac

SEQ ID NO: 234359 - DNA, 20 bp, Artificial Sequence
  chemically synthesized
tcctatttgtgtgaatgcta

SEQ ID NO: 234360 - DNA, 20 bp, Artificial Sequence
  chemically synthesized
acctgtagcattcacacaaa

SEQ ID NO: 234361 - DNA, 20 bp, Artificial Sequence
  chemically synthesized
cctgtagcattcacacaaat

SEQ ID NO: 234362 - DNA, 20 bp, Artificial Sequence
  chemically synthesized
gcattcacacaaataggata

SEQ ID NO: 234363 - DNA, 20 bp, Artificial Sequence
  chemically synthesized
ttcacacaaataggatacag

SEQ ID NO: 234364 - DNA, 20 bp, Artificial Sequence
  chemically synthesized
atgtatcccctacagataag

SEQ ID NO: 234365 - DNA, 20 bp, Artificial Sequence
  chemically synthesized
agtggtttaccccttatctg

SEQ ID NO: 234366 - DNA, 20 bp, Artificial Sequence
  chemically synthesized
aatgtatcccctacagataa

SEQ ID NO: 234367 - DNA, 20 bp, Artificial Sequence
  chemically synthesized
gtggtttaccccttatctgt

SEQ ID NO: 234368 - DNA, 20 bp, Artificial Sequence
  chemically synthesized
gaatgtatcccctacagata

SEQ ID NO: 234369 - DNA, 20 bp, Artificial Sequence
  chemically synthesized
tggtttaccccttatctgta

SEQ ID NO: 234370 - DNA, 20 bp, Artificial Sequence
  chemically synthesized
ggaatgtatcccctacagat

SEQ ID NO: 234371 - DNA, 20 bp, Artificial Sequence
  chemically synthesized
ggtttaccccttatctgtag

SEQ ID NO: 234372 - DNA, 20 bp, Artificial Sequence
  chemically synthesized
gtcttggaatgtatccccta

SEQ ID NO: 234373 - DNA, 20 bp, Artificial Sequence
  chemically synthesized
atctgtaggggatacattcc

SEQ ID NO: 234374 - DNA, 20 bp, Artificial Sequence
  chemically synthesized
gggatacattccaagactcc

SEQ ID NO: 234375 - DNA, 20 bp, Artificial Sequence
  chemically synthesized
cagacatccactgggagtct

SEQ ID NO: 234376 - DNA, 20 bp, Artificial Sequence
  chemically synthesized
atacattccaagactcccag

SEQ ID NO: 234377 - DNA, 20 bp, Artificial Sequence
  chemically synthesized
cagtttcagacatccactgg

SEQ ID NO: 234378 - DNA, 20 bp, Artificial Sequence
  chemically synthesized
tgcagtttcagacatccact

SEQ ID NO: 234379 - DNA, 20 bp, Artificial Sequence
  chemically synthesized
ctgcagtttcagacatccac

SEQ ID NO: 234380 - DNA, 20 bp, Artificial Sequence
  chemically synthesized
ccagtggatgtctgaaactg

SEQ ID NO: 234381 - DNA, 20 bp, Artificial Sequence
  chemically synthesized
ctcagtactatctgcagttt

SEQ ID NO: 234382 - DNA, 20 bp, Artificial Sequence
  chemically synthesized
tggatgtctgaaactgcaga

SEQ ID NO: 234383 - DNA, 20 bp, Artificial Sequence
  chemically synthesized
atagggctcagtactatctg

SEQ ID NO: 234384 - DNA, 20 bp, Artificial Sequence
  chemically synthesized
ctgaaactgcagatagtact

SEQ ID NO: 234385 - DNA, 20 bp, Artificial Sequence
  chemically synthesized
catatagtttatatagggct

SEQ ID NO: 234386 - DNA, 20 bp, Artificial Sequence
  chemically synthesized
aagtacatatagtttatata

SEQ ID NO: 234387 - DNA, 20 bp, Artificial Sequence
  chemically synthesized
caagtacatatagtttatat

SEQ ID NO: 234388 - DNA, 20 bp, Artificial Sequence
  chemically synthesized
acaagtacatatagtttata

SEQ ID NO: 234389 - DNA, 20 bp, Artificial Sequence
  chemically synthesized
aaatttatcacaagtacata

SEQ ID NO: 234390 - DNA, 20 bp, Artificial Sequence
  chemically synthesized
tataaattaaaatttatcac

SEQ ID NO: 234391 - DNA, 20 bp, Artificial Sequence
  chemically synthesized
taaattttaatttataaatt

SEQ ID NO: 234392 - DNA, 20 bp, Artificial Sequence
  chemically synthesized
tttaatttataaatttggcg

SEQ ID NO: 234393 - DNA, 20 bp, Artificial Sequence
  chemically synthesized
tttataaatttggcgcagtt

SEQ ID NO: 234394 - DNA, 20 bp, Artificial Sequence
  chemically synthesized
tataaatttggcgcagttaa

SEQ ID NO: 234395 - DNA, 20 bp, Artificial Sequence
  chemically synthesized
ttaaaaatcatgaataaaaa

SEQ ID NO: 234396 - DNA, 20 bp, Artificial Sequence
  chemically synthesized
tattttaagagagagaaaga

SEQ ID NO: 234397 - DNA, 20 bp, Artificial Sequence
  chemically synthesized
aagatattttaagagagaga

SEQ ID NO: 234398 - DNA, 20 bp, Artificial Sequence
  chemically synthesized
caataagatattttaagaga

SEQ ID NO: 234399 - DNA, 20 bp, Artificial Sequence
  chemically synthesized
tacaataagatattttaaga

SEQ ID NO: 234400 - DNA, 20 bp, Artificial Sequence
  chemically synthesized
aatacaataagatattttaa

SEQ ID NO: 234401 - DNA, 20 bp, Artificial Sequence
  chemically synthesized
acaatacaataagatatttt

SEQ ID NO: 234402 - DNA, 20 bp, Artificial Sequence
  chemically synthesized
ataggtgactacaatacaat

SEQ ID NO: 234403 - DNA, 20 bp, Artificial Sequence
  chemically synthesized
taaaatatcttattgtattg

SEQ ID NO: 234404 - DNA, 20 bp, Artificial Sequence
  chemically synthesized
gtattgtagtcacctatttt

SEQ ID NO: 234405 - DNA, 20 bp, Artificial Sequence
  chemically synthesized
gtcaactgctgtctgaaaat

SEQ ID NO: 234406 - DNA, 20 bp, Artificial Sequence
  chemically synthesized
ggtcaactgctgtctgaaaa

SEQ ID NO: 234407 - DNA, 20 bp, Artificial Sequence
  chemically synthesized
tgtagtcacctattttcaga

SEQ ID NO: 234408 - DNA, 20 bp, Artificial Sequence
  chemically synthesized
agtcacctattttcagacag

SEQ ID NO: 234409 - DNA, 20 bp, Artificial Sequence
  chemically synthesized
tttcagacagcagttgacca

SEQ ID NO: 234410 - DNA, 20 bp, Artificial Sequence
  chemically synthesized
ttcagacagcagttgaccat

SEQ ID NO: 234411 - DNA, 20 bp, Artificial Sequence
  chemically synthesized
tccccagtttcagtgaccca

SEQ ID NO: 234412 - DNA, 20 bp, Artificial Sequence
  chemically synthesized
tgaccatgggtcactgaaac

SEQ ID NO: 234413 - DNA, 20 bp, Artificial Sequence
  chemically synthesized
gaccatgggtcactgaaact

SEQ ID NO: 234414 - DNA, 20 bp, Artificial Sequence
  chemically synthesized
accatgggtcactgaaactg

SEQ ID NO: 234415 - DNA, 20 bp, Artificial Sequence
  chemically synthesized
agttttgctttccccagttt

SEQ ID NO: 234416 - DNA, 20 bp, Artificial Sequence
  chemically synthesized
tgggtcactgaaactgggga

SEQ ID NO: 234417 - DNA, 20 bp, Artificial Sequence
  chemically synthesized
atccacagttttgctttccc

SEQ ID NO: 234418 - DNA, 20 bp, Artificial Sequence
  chemically synthesized
aactggggaaagcaaaactg

SEQ ID NO: 234419 - DNA, 20 bp, Artificial Sequence
  chemically synthesized
gtggtggaacaaaatatcca

SEQ ID NO: 234420 - DNA, 20 bp, Artificial Sequence
  chemically synthesized
gatattttgttccaccactg

SEQ ID NO: 234421 - DNA, 20 bp, Artificial Sequence
  chemically synthesized
aatgtacatctccacagtgg

SEQ ID NO: 234422 - DNA, 20 bp, Artificial Sequence
  chemically synthesized
tattttgttccaccactgtg

SEQ ID NO: 234423 - DNA, 20 bp, Artificial Sequence
  chemically synthesized
cataatgtacatctccacag

SEQ ID NO: 234424 - DNA, 20 bp, Artificial Sequence
  chemically synthesized
agtcataatgtacatctcca

SEQ ID NO: 234425 - DNA, 20 bp, Artificial Sequence
  chemically synthesized
cacagatggtggtaatgatg

SEQ ID NO: 234426 - DNA, 20 bp, Artificial Sequence
  chemically synthesized
tacatcattaccaccatctg

SEQ ID NO: 234427 - DNA, 20 bp, Artificial Sequence
  chemically synthesized
taaaggaaaaccacagatgg

SEQ ID NO: 234428 - DNA, 20 bp, Artificial Sequence
  chemically synthesized
ccttaaaggaaaaccacaga

SEQ ID NO: 234429 - DNA, 20 bp, Artificial Sequence
  chemically synthesized
tcacccttaaaggaaaacca

SEQ ID NO: 234430 - DNA, 20 bp, Artificial Sequence
  chemically synthesized
accatctgtggttttccttt

SEQ ID NO: 234431 - DNA, 20 bp, Artificial Sequence
  chemically synthesized
ccatctgtggttttccttta

SEQ ID NO: 234432 - DNA, 20 bp, Artificial Sequence
  chemically synthesized
catctgtggttttcctttaa

SEQ ID NO: 234433 - DNA, 20 bp, Artificial Sequence
  chemically synthesized
ataaatagtctcacccttaa

SEQ ID NO: 234434 - DNA, 20 bp, Artificial Sequence
  chemically synthesized
tgtggttttcctttaagggt

SEQ ID NO: 234435 - DNA, 20 bp, Artificial Sequence
  chemically synthesized
tataaatagtctcaccctta

SEQ ID NO: 234436 - DNA, 20 bp, Artificial Sequence
  chemically synthesized
tgtttgaatttgcatataaa

SEQ ID NO: 234437 - DNA, 20 bp, Artificial Sequence
  chemically synthesized
ctccttgttggggggggggg

SEQ ID NO: 234438 - DNA, 20 bp, Artificial Sequence
  chemically synthesized
cctccttgttgggggggggg

SEQ ID NO: 234439 - DNA, 20 bp, Artificial Sequence
  chemically synthesized
gcctccttgttggggggggg

SEQ ID NO: 234440 - DNA, 20 bp, Artificial Sequence
  chemically synthesized
ggcctccttgttgggggggg

SEQ ID NO: 234441 - DNA, 20 bp, Artificial Sequence
  chemically synthesized
tggcctccttgttggggggg

SEQ ID NO: 234442 - DNA, 20 bp, Artificial Sequence
  chemically synthesized
atggcctccttgttgggggg

SEQ ID NO: 234443 - DNA, 20 bp, Artificial Sequence
  chemically synthesized
tatggcctccttgttggggg

SEQ ID NO: 234444 - DNA, 20 bp, Artificial Sequence
  chemically synthesized
acaccccccccccccccaac

SEQ ID NO: 234445 - DNA, 20 bp, Artificial Sequence
  chemically synthesized
atatggcctccttgttgggg

SEQ ID NO: 234446 - DNA, 20 bp, Artificial Sequence
  chemically synthesized
caccccccccccccccaaca

SEQ ID NO: 234447 - DNA, 20 bp, Artificial Sequence
  chemically synthesized
aatatggcctccttgttggg

SEQ ID NO: 234448 - DNA, 20 bp, Artificial Sequence
  chemically synthesized
aaatatggcctccttgttgg

SEQ ID NO: 234449 - DNA, 20 bp, Artificial Sequence
  chemically synthesized
ccccccccccccccaacaag

SEQ ID NO: 234450 - DNA, 20 bp, Artificial Sequence
  chemically synthesized
taaatatggcctccttgttg

SEQ ID NO: 234451 - DNA, 20 bp, Artificial Sequence
  chemically synthesized
cccccccccccccaacaagg

SEQ ID NO: 234452 - DNA, 20 bp, Artificial Sequence
  chemically synthesized
ctaaatatggcctccttgtt

SEQ ID NO: 234453 - DNA, 20 bp, Artificial Sequence
  chemically synthesized
tctaaatatggcctccttgt

SEQ ID NO: 234454 - DNA, 20 bp, Artificial Sequence
  chemically synthesized
cccaacaaggaggccatatt

SEQ ID NO: 234455 - DNA, 20 bp, Artificial Sequence
  chemically synthesized
tccaggaggtaatctaaata

SEQ ID NO: 234456 - DNA, 20 bp, Artificial Sequence
  chemically synthesized
gccatatttagattacctcc

SEQ ID NO: 234457 - DNA, 20 bp, Artificial Sequence
  chemically synthesized
tatttagattacctcctgga

SEQ ID NO: 234458 - DNA, 20 bp, Artificial Sequence
  chemically synthesized
gagttaagtaactttccagg

SEQ ID NO: 234459 - DNA, 20 bp, Artificial Sequence
  chemically synthesized
agagttaagtaactttccag

SEQ ID NO: 234460 - DNA, 20 bp, Artificial Sequence
  chemically synthesized
agagagttaagtaactttcc

SEQ ID NO: 234461 - DNA, 20 bp, Artificial Sequence
  chemically synthesized
cagagagttaagtaactttc

SEQ ID NO: 234462 - DNA, 20 bp, Artificial Sequence
  chemically synthesized
tggaaagttacttaactctc

SEQ ID NO: 234463 - DNA, 20 bp, Artificial Sequence
  chemically synthesized
aattcaaattccagagagtt

SEQ ID NO: 234464 - DNA, 20 bp, Artificial Sequence
  chemically synthesized
atttaaattcaaattccaga

SEQ ID NO: 234465 - DNA, 20 bp, Artificial Sequence
  chemically synthesized
ttatttaaattcaaattcca

SEQ ID NO: 234466 - DNA, 20 bp, Artificial Sequence
  chemically synthesized
ctttatttaaattcaaattc

SEQ ID NO: 234467 - DNA, 20 bp, Artificial Sequence
  chemically synthesized
ctggaatttgaatttaaata

SEQ ID NO: 234468 - DNA, 20 bp, Artificial Sequence
  chemically synthesized
ggaatttgaatttaaataaa

SEQ ID NO: 234469 - DNA, 20 bp, Artificial Sequence
  chemically synthesized
atttgaatttaaataaagag

SEQ ID NO: 234470 - DNA, 20 bp, Artificial Sequence
  chemically synthesized
aaaacccaaaatgaaataag

SEQ ID NO: 234471 - DNA, 20 bp, Artificial Sequence
  chemically synthesized
ctcaaaacccaaaatgaaat

SEQ ID NO: 234472 - DNA, 20 bp, Artificial Sequence
  chemically synthesized
gtagacttcttatttcattt

SEQ ID NO: 234473 - DNA, 20 bp, Artificial Sequence
  chemically synthesized
tagacttcttatttcatttt

SEQ ID NO: 234474 - DNA, 20 bp, Artificial Sequence
  chemically synthesized
cttatttcattttgggtttt

SEQ ID NO: 234475 - DNA, 20 bp, Artificial Sequence
  chemically synthesized
tgggttttgagaactatatc

SEQ ID NO: 234476 - DNA, 20 bp, Artificial Sequence
  chemically synthesized
ggttttgagaactatatcaa

SEQ ID NO: 234477 - DNA, 20 bp, Artificial Sequence
  chemically synthesized
aggatattgagctcttgata

SEQ ID NO: 234478 - DNA, 20 bp, Artificial Sequence
  chemically synthesized
tatttcattcacaggatatt

SEQ ID NO: 234479 - DNA, 20 bp, Artificial Sequence
  chemically synthesized
atgatcagtatttcattcac

SEQ ID NO: 234480 - DNA, 20 bp, Artificial Sequence
  chemically synthesized
catgatcagtatttcattca

SEQ ID NO: 234481 - DNA, 20 bp, Artificial Sequence
  chemically synthesized
tttggctgtgtttgcatgat

SEQ ID NO: 234482 - DNA, 20 bp, Artificial Sequence
  chemically synthesized
aaatactgatcatgcaaaca

SEQ ID NO: 234483 - DNA, 20 bp, Artificial Sequence
  chemically synthesized
tgatcatgcaaacacagcca

SEQ ID NO: 234484 - DNA, 20 bp, Artificial Sequence
  chemically synthesized
cattttccctagacaatctt

SEQ ID NO: 234485 - DNA, 20 bp, Artificial Sequence
  chemically synthesized
aaacacagccaaagattgtc

SEQ ID NO: 234486 - DNA, 20 bp, Artificial Sequence
  chemically synthesized
aacacagccaaagattgtct

SEQ ID NO: 234487 - DNA, 20 bp, Artificial Sequence
  chemically synthesized
acacagccaaagattgtcta

SEQ ID NO: 234488 - DNA, 20 bp, Artificial Sequence
  chemically synthesized
gttcccttcagcattttccc

SEQ ID NO: 234489 - DNA, 20 bp, Artificial Sequence
  chemically synthesized
attgtctagggaaaatgctg

SEQ ID NO: 234490 - DNA, 20 bp, Artificial Sequence
  chemically synthesized
ttgtctagggaaaatgctga

SEQ ID NO: 234491 - DNA, 20 bp, Artificial Sequence
  chemically synthesized
tgtctagggaaaatgctgaa

SEQ ID NO: 234492 - DNA, 20 bp, Artificial Sequence
  chemically synthesized
tggatttggaaagttccctt

SEQ ID NO: 234493 - DNA, 20 bp, Artificial Sequence
  chemically synthesized
agaactatagtggatttgga

SEQ ID NO: 234494 - DNA, 20 bp, Artificial Sequence
  chemically synthesized
aagaagaactatagtggatt

SEQ ID NO: 234495 - DNA, 20 bp, Artificial Sequence
  chemically synthesized
ggaactttccaaatccacta

SEQ ID NO: 234496 - DNA, 20 bp, Artificial Sequence
  chemically synthesized
gtaagaaagaagaactatag

SEQ ID NO: 234497 - DNA, 20 bp, Artificial Sequence
  chemically synthesized
atggtaagaaagaagaacta

SEQ ID NO: 234498 - DNA, 20 bp, Artificial Sequence
  chemically synthesized
taaatggaatggtaagaaag

SEQ ID NO: 234499 - DNA, 20 bp, Artificial Sequence
  chemically synthesized
ccataaatggaatggtaaga

SEQ ID NO: 234500 - DNA, 20 bp, Artificial Sequence
  chemically synthesized
cagcccataaatggaatggt

SEQ ID NO: 234501 - DNA, 20 bp, Artificial Sequence
  chemically synthesized
tggacagcccataaatggaa

SEQ ID NO: 234502 - DNA, 20 bp, Artificial Sequence
  chemically synthesized
ctttcttaccattccattta

SEQ ID NO: 234503 - DNA, 20 bp, Artificial Sequence
  chemically synthesized
tttcttaccattccatttat

SEQ ID NO: 234504 - DNA, 20 bp, Artificial Sequence
  chemically synthesized
gtaagtggacagcccataaa

SEQ ID NO: 234505 - DNA, 20 bp, Artificial Sequence
  chemically synthesized
gatgccagggagtaagtgga

SEQ ID NO: 234506 - DNA, 20 bp, Artificial Sequence
  chemically synthesized
gacagatgccagggagtaag

SEQ ID NO: 234507 - DNA, 20 bp, Artificial Sequence
  chemically synthesized
tgggctgtccacttactccc

SEQ ID NO: 234508 - DNA, 20 bp, Artificial Sequence
  chemically synthesized
caggacagatgccagggagt

SEQ ID NO: 234509 - DNA, 20 bp, Artificial Sequence
  chemically synthesized
ggcacaggacagatgccagg

SEQ ID NO: 234510 - DNA, 20 bp, Artificial Sequence
  chemically synthesized
ggggcacaggacagatgcca

SEQ ID NO: 234511 - DNA, 20 bp, Artificial Sequence
  chemically synthesized
aggggcacaggacagatgcc

SEQ ID NO: 234512 - DNA, 20 bp, Artificial Sequence
  chemically synthesized
aaggggcacaggacagatgc

SEQ ID NO: 234513 - DNA, 20 bp, Artificial Sequence
  chemically synthesized
aatcagaaaggggcacagga

SEQ ID NO: 234514 - DNA, 20 bp, Artificial Sequence
  chemically synthesized
ttacaatcagaaaggggcac

SEQ ID NO: 234515 - DNA, 20 bp, Artificial Sequence
  chemically synthesized
cttacaatcagaaaggggca

SEQ ID NO: 234516 - DNA, 20 bp, Artificial Sequence
  chemically synthesized
ctgtacttacaatcagaaag

SEQ ID NO: 234517 - DNA, 20 bp, Artificial Sequence
  chemically synthesized
actgtacttacaatcagaaa

SEQ ID NO: 234518 - DNA, 20 bp, Artificial Sequence
  chemically synthesized
gactgtacttacaatcagaa

SEQ ID NO: 234519 - DNA, 20 bp, Artificial Sequence
  chemically synthesized
tgactgtacttacaatcaga

SEQ ID NO: 234520 - DNA, 20 bp, Artificial Sequence
  chemically synthesized
ctgtgcccctttctgattgt

SEQ ID NO: 234521 - DNA, 20 bp, Artificial Sequence
  chemically synthesized
ttgttgactgtacttacaat

SEQ ID NO: 234522 - DNA, 20 bp, Artificial Sequence
  chemically synthesized
cccctttctgattgtaagta

SEQ ID NO: 234523 - DNA, 20 bp, Artificial Sequence
  chemically synthesized
aagtacagtcaacaatgata

SEQ ID NO: 234524 - DNA, 20 bp, Artificial Sequence
  chemically synthesized
agtacagtcaacaatgatac

SEQ ID NO: 234525 - DNA, 20 bp, Artificial Sequence
  chemically synthesized
agtcaacaatgatacaggca

SEQ ID NO: 234526 - DNA, 20 bp, Artificial Sequence
  chemically synthesized
ggagtcttaaagaaacagat

SEQ ID NO: 234527 - DNA, 20 bp, Artificial Sequence
  chemically synthesized
attcgcttatctgtttcttt

SEQ ID NO: 234528 - DNA, 20 bp, Artificial Sequence
  chemically synthesized
gcactggagtcttaaagaaa

SEQ ID NO: 234529 - DNA, 20 bp, Artificial Sequence
  chemically synthesized
atcattgcactggagtctta

SEQ ID NO: 234530 - DNA, 20 bp, Artificial Sequence
  chemically synthesized
tatctgtttctttaagactc

SEQ ID NO: 234531 - DNA, 20 bp, Artificial Sequence
  chemically synthesized
ctaattgtatcattgcactg

SEQ ID NO: 234532 - DNA, 20 bp, Artificial Sequence
  chemically synthesized
gtctaattgtatcattgcac

SEQ ID NO: 234533 - DNA, 20 bp, Artificial Sequence
  chemically synthesized
ctccagtgcaatgatacaat

SEQ ID NO: 234534 - DNA, 20 bp, Artificial Sequence
  chemically synthesized
tttgacttatgagaatttgg

SEQ ID NO: 234535 - DNA, 20 bp, Artificial Sequence
  chemically synthesized
ccttttgacttatgagaatt

SEQ ID NO: 234536 - DNA, 20 bp, Artificial Sequence
  chemically synthesized
ttagacttccaaattctcat

SEQ ID NO: 234537 - DNA, 20 bp, Artificial Sequence
  chemically synthesized
atttgtaccttttgacttat

SEQ ID NO: 234538 - DNA, 20 bp, Artificial Sequence
  chemically synthesized
tccaaattctcataagtcaa

SEQ ID NO: 234539 - DNA, 20 bp, Artificial Sequence
  chemically synthesized
ccaaattctcataagtcaaa

SEQ ID NO: 234540 - DNA, 20 bp, Artificial Sequence
  chemically synthesized
tactcattcagcagttttca

SEQ ID NO: 234541 - DNA, 20 bp, Artificial Sequence
  chemically synthesized
atactcattcagcagttttc

SEQ ID NO: 234542 - DNA, 20 bp, Artificial Sequence
  chemically synthesized
aatactcattcagcagtttt

SEQ ID NO: 234543 - DNA, 20 bp, Artificial Sequence
  chemically synthesized
atccctgaaaactgctgaat

SEQ ID NO: 234544 - DNA, 20 bp, Artificial Sequence
  chemically synthesized
acacttcaatactcattcag

SEQ ID NO: 234545 - DNA, 20 bp, Artificial Sequence
  chemically synthesized
ccaacacttcaatactcatt

SEQ ID NO: 234546 - DNA, 20 bp, Artificial Sequence
  chemically synthesized
aaactgctgaatgagtattg

SEQ ID NO: 234547 - DNA, 20 bp, Artificial Sequence
  chemically synthesized
ctgaatgagtattgaagtgt

SEQ ID NO: 234548 - DNA, 20 bp, Artificial Sequence
  chemically synthesized
aatgagtattgaagtgttgg

SEQ ID NO: 234549 - DNA, 20 bp, Artificial Sequence
  chemically synthesized
tattgaagtgttggcagtta

SEQ ID NO: 234550 - DNA, 20 bp, Artificial Sequence
  chemically synthesized
ttggcagttacagcttatga

SEQ ID NO: 234551 - DNA, 20 bp, Artificial Sequence
  chemically synthesized
gaaaataaaaattctatcat

SEQ ID NO: 234552 - DNA, 20 bp, Artificial Sequence
  chemically synthesized
gatagaatttttattttcaa

SEQ ID NO: 234553 - DNA, 20 bp, Artificial Sequence
  chemically synthesized
tagaatttttattttcaaaa

SEQ ID NO: 234554 - DNA, 20 bp, Artificial Sequence
  chemically synthesized
ttcaaaagagaaatttaatt

SEQ ID NO: 234555 - DNA, 20 bp, Artificial Sequence
  chemically synthesized
tcaaaagagaaatttaattc

SEQ ID NO: 234556 - DNA, 20 bp, Artificial Sequence
  chemically synthesized
caaaagagaaatttaattca

SEQ ID NO: 234557 - DNA, 20 bp, Artificial Sequence
  chemically synthesized
gaaataaaaggatatacgta

SEQ ID NO: 234558 - DNA, 20 bp, Artificial Sequence
  chemically synthesized
gttcccaaaaaggaaataaa

SEQ ID NO: 234559 - DNA, 20 bp, Artificial Sequence
  chemically synthesized
agttcccaaaaaggaaataa

SEQ ID NO: 234560 - DNA, 20 bp, Artificial Sequence
  chemically synthesized
atatccttttatttcctttt

SEQ ID NO: 234561 - DNA, 20 bp, Artificial Sequence
  chemically synthesized
tatccttttatttccttttt

SEQ ID NO: 234562 - DNA, 20 bp, Artificial Sequence
  chemically synthesized
ttcttatagagttcccaaaa

SEQ ID NO: 234563 - DNA, 20 bp, Artificial Sequence
  chemically synthesized
cttcttatagagttcccaaa

SEQ ID NO: 234564 - DNA, 20 bp, Artificial Sequence
  chemically synthesized
ttcctttttgggaactctat

SEQ ID NO: 234565 - DNA, 20 bp, Artificial Sequence
  chemically synthesized
ctttttgggaactctataag

SEQ ID NO: 234566 - DNA, 20 bp, Artificial Sequence
  chemically synthesized
aacaagtatggcttcttata

SEQ ID NO: 234567 - DNA, 20 bp, Artificial Sequence
  chemically synthesized
gaaacaagtatggcttctta

SEQ ID NO: 234568 - DNA, 20 bp, Artificial Sequence
  chemically synthesized
atccagcaatgaaacaagta

SEQ ID NO: 234569 - DNA, 20 bp, Artificial Sequence
  chemically synthesized
aagagatccagcaatgaaac

SEQ ID NO: 234570 - DNA, 20 bp, Artificial Sequence
  chemically synthesized
agccatacttgtttcattgc

SEQ ID NO: 234571 - DNA, 20 bp, Artificial Sequence
  chemically synthesized
attccaggaaataagagatc

SEQ ID NO: 234572 - DNA, 20 bp, Artificial Sequence
  chemically synthesized
agtattattccaggaaataa

SEQ ID NO: 234573 - DNA, 20 bp, Artificial Sequence
  chemically synthesized
ttgctggatctcttatttcc

SEQ ID NO: 234574 - DNA, 20 bp, Artificial Sequence
  chemically synthesized
caagtattattccaggaaat

SEQ ID NO: 234575 - DNA, 20 bp, Artificial Sequence
  chemically synthesized
tgtgtgacaagtattattcc

SEQ ID NO: 234576 - DNA, 20 bp, Artificial Sequence
  chemically synthesized
ctgtgtgacaagtattattc

SEQ ID NO: 234577 - DNA, 20 bp, Artificial Sequence
  chemically synthesized
ctggaataatacttgtcaca

SEQ ID NO: 234578 - DNA, 20 bp, Artificial Sequence
  chemically synthesized
ttgttgacctactgtgtgac

SEQ ID NO: 234579 - DNA, 20 bp, Artificial Sequence
  chemically synthesized
gaataatacttgtcacacag

SEQ ID NO: 234580 - DNA, 20 bp, Artificial Sequence
  chemically synthesized
aataatacttgtcacacagt

SEQ ID NO: 234581 - DNA, 20 bp, Artificial Sequence
  chemically synthesized
acagtaggtcaacaaatatt

SEQ ID NO: 234582 - DNA, 20 bp, Artificial Sequence
  chemically synthesized
atttggttaatttatgtatt

SEQ ID NO: 234583 - DNA, 20 bp, Artificial Sequence
  chemically synthesized
ttggttaatttatgtattga

SEQ ID NO: 234584 - DNA, 20 bp, Artificial Sequence
  chemically synthesized
tatgtattgagagaattgct

SEQ ID NO: 234585 - DNA, 20 bp, Artificial Sequence
  chemically synthesized
tgagagggttgaattgtgcc

SEQ ID NO: 234586 - DNA, 20 bp, Artificial Sequence
  chemically synthesized
ggcacaattcaaccctctca

SEQ ID NO: 234587 - DNA, 20 bp, Artificial Sequence
  chemically synthesized
cacctgcataaactttgaga

SEQ ID NO: 234588 - DNA, 20 bp, Artificial Sequence
  chemically synthesized
tcacctgcataaactttgag

SEQ ID NO: 234589 - DNA, 20 bp, Artificial Sequence
  chemically synthesized
ctcacctgcataaactttga

SEQ ID NO: 234590 - DNA, 20 bp, Artificial Sequence
  chemically synthesized
tgctcacctgcataaacttt

SEQ ID NO: 234591 - DNA, 20 bp, Artificial Sequence
  chemically synthesized
caaccctctcaaagtttatg

SEQ ID NO: 234592 - DNA, 20 bp, Artificial Sequence
  chemically synthesized
aaccctctcaaagtttatgc

SEQ ID NO: 234593 - DNA, 20 bp, Artificial Sequence
  chemically synthesized
ctctcaaagtttatgcaggt

SEQ ID NO: 234594 - DNA, 20 bp, Artificial Sequence
  chemically synthesized
ttatgcaggtgagcaccgtg

SEQ ID NO: 234595 - DNA, 20 bp, Artificial Sequence
  chemically synthesized
caggtgagcaccgtgcagta

SEQ ID NO: 234596 - DNA, 20 bp, Artificial Sequence
  chemically synthesized
ccaaaggagactatactgca

SEQ ID NO: 234597 - DNA, 20 bp, Artificial Sequence
  chemically synthesized
ccgtgcagtatagtctcctt

SEQ ID NO: 234598 - DNA, 20 bp, Artificial Sequence
  chemically synthesized
tgcagtatagtctcctttgg

SEQ ID NO: 234599 - DNA, 20 bp, Artificial Sequence
  chemically synthesized
ttaagctcttgctgccaaag

SEQ ID NO: 234600 - DNA, 20 bp, Artificial Sequence
  chemically synthesized
tattaagctcttgctgccaa

SEQ ID NO: 234601 - DNA, 20 bp, Artificial Sequence
  chemically synthesized
gtatagtctcctttggcagc

SEQ ID NO: 234602 - DNA, 20 bp, Artificial Sequence
  chemically synthesized
atattaagctcttgctgcca

SEQ ID NO: 234603 - DNA, 20 bp, Artificial Sequence
  chemically synthesized
atagtctcctttggcagcaa

SEQ ID NO: 234604 - DNA, 20 bp, Artificial Sequence
  chemically synthesized
ctctctcaaaatcagatatt

SEQ ID NO: 234605 - DNA, 20 bp, Artificial Sequence
  chemically synthesized
agagcttaatatctgatttt

SEQ ID NO: 234606 - DNA, 20 bp, Artificial Sequence
  chemically synthesized
agcttaatatctgattttga

SEQ ID NO: 234607 - DNA, 20 bp, Artificial Sequence
  chemically synthesized
attctcagctctctcaaaat

SEQ ID NO: 234608 - DNA, 20 bp, Artificial Sequence
  chemically synthesized
cttaatatctgattttgaga

SEQ ID NO: 234609 - DNA, 20 bp, Artificial Sequence
  chemically synthesized
tatctgattttgagagagct

SEQ ID NO: 234610 - DNA, 20 bp, Artificial Sequence
  chemically synthesized
gctgttttgcgtatcattct

SEQ ID NO: 234611 - DNA, 20 bp, Artificial Sequence
  chemically synthesized
gctgagaatgatacgcaaaa

SEQ ID NO: 234612 - DNA, 20 bp, Artificial Sequence
  chemically synthesized
aatgatacgcaaaacagcat

SEQ ID NO: 234613 - DNA, 20 bp, Artificial Sequence
  chemically synthesized
ctgtaattaaaaatataggg

SEQ ID NO: 234614 - DNA, 20 bp, Artificial Sequence
  chemically synthesized
ttactgtaattaaaaatata

SEQ ID NO: 234615 - DNA, 20 bp, Artificial Sequence
  chemically synthesized
attactgtaattaaaaatat

SEQ ID NO: 234616 - DNA, 20 bp, Artificial Sequence
  chemically synthesized
cattactgtaattaaaaata

SEQ ID NO: 234617 - DNA, 20 bp, Artificial Sequence
  chemically synthesized
cttccctatatttttaatta

SEQ ID NO: 234618 - DNA, 20 bp, Artificial Sequence
  chemically synthesized
aggagtcttattttaaaaga

SEQ ID NO: 234619 - DNA, 20 bp, Artificial Sequence
  chemically synthesized
gtaatgctgtcttttaaaat

SEQ ID NO: 234620 - DNA, 20 bp, Artificial Sequence
  chemically synthesized
actcaggagtcttattttaa

SEQ ID NO: 234621 - DNA, 20 bp, Artificial Sequence
  chemically synthesized
tcttttaaaataagactcct

SEQ ID NO: 234622 - DNA, 20 bp, Artificial Sequence
  chemically synthesized
tatgatcataaagtactcag

SEQ ID NO: 234623 - DNA, 20 bp, Artificial Sequence
  chemically synthesized
attatgatcataaagtactc

SEQ ID NO: 234624 - DNA, 20 bp, Artificial Sequence
  chemically synthesized
tattatgatcataaagtact

SEQ ID NO: 234625 - DNA, 20 bp, Artificial Sequence
  chemically synthesized
atggatttattatgatcata

SEQ ID NO: 234626 - DNA, 20 bp, Artificial Sequence
  chemically synthesized
agcagtgaatgcgattaaga

SEQ ID NO: 234627 - DNA, 20 bp, Artificial Sequence
  chemically synthesized
ataaagcagtgaatgcgatt

SEQ ID NO: 234628 - DNA, 20 bp, Artificial Sequence
  chemically synthesized
aaataaaaaagaaaataaag

SEQ ID NO: 234629 - DNA, 20 bp, Artificial Sequence
  chemically synthesized
aagaaataaaaaagaaaata

SEQ ID NO: 234630 - DNA, 20 bp, Artificial Sequence
  chemically synthesized
ctgtctcaaaagaaataaaa

SEQ ID NO: 234631 - DNA, 20 bp, Artificial Sequence
  chemically synthesized
ttttcttttttatttctttt

SEQ ID NO: 234632 - DNA, 20 bp, Artificial Sequence
  chemically synthesized
cttttttatttcttttgaga

SEQ ID NO: 234633 - DNA, 20 bp, Artificial Sequence
  chemically synthesized
agagtgagactctgtctcaa

SEQ ID NO: 234634 - DNA, 20 bp, Artificial Sequence
  chemically synthesized
tttttatttcttttgagaca

SEQ ID NO: 234635 - DNA, 20 bp, Artificial Sequence
  chemically synthesized
ctccagcctggcgacagagt

SEQ ID NO: 234636 - DNA, 20 bp, Artificial Sequence
  chemically synthesized
acagagtctcactctgtcgc

SEQ ID NO: 234637 - DNA, 20 bp, Artificial Sequence
  chemically synthesized
cagagtctcactctgtcgcc

SEQ ID NO: 234638 - DNA, 20 bp, Artificial Sequence
  chemically synthesized
tgcactccagcctggcgaca

SEQ ID NO: 234639 - DNA, 20 bp, Artificial Sequence
  chemically synthesized
actgcactccagcctggcga

SEQ ID NO: 234640 - DNA, 20 bp, Artificial Sequence
  chemically synthesized
gtctcactctgtcgccaggc

SEQ ID NO: 234641 - DNA, 20 bp, Artificial Sequence
  chemically synthesized
ctcactctgtcgccaggctg

SEQ ID NO: 234642 - DNA, 20 bp, Artificial Sequence
  chemically synthesized
cgtgccactgcactccagcc

SEQ ID NO: 234643 - DNA, 20 bp, Artificial Sequence
  chemically synthesized
tctgtcgccaggctggagtg

SEQ ID NO: 234644 - DNA, 20 bp, Artificial Sequence
  chemically synthesized
aagatcgtgccactgcactc

SEQ ID NO: 234645 - DNA, 20 bp, Artificial Sequence
  chemically synthesized
gtcgccaggctggagtgcag

SEQ ID NO: 234646 - DNA, 20 bp, Artificial Sequence
  chemically synthesized
ggagtgcagtggcacgatct

SEQ ID NO: 234647 - DNA, 20 bp, Artificial Sequence
  chemically synthesized
ggcggaggtcgcagtgagcc

SEQ ID NO: 234648 - DNA, 20 bp, Artificial Sequence
  chemically synthesized
cgagaggcggaggtcgcagt

SEQ ID NO: 234649 - DNA, 20 bp, Artificial Sequence
  chemically synthesized
aacccgagaggcggaggtcg

SEQ ID NO: 234650 - DNA, 20 bp, Artificial Sequence
  chemically synthesized
cgcttgaacccgagaggcgg

SEQ ID NO: 234651 - DNA, 20 bp, Artificial Sequence
  chemically synthesized
tcactgcgacctccgcctct

SEQ ID NO: 234652 - DNA, 20 bp, Artificial Sequence
  chemically synthesized
tcgcttgaacccgagaggcg

SEQ ID NO: 234653 - DNA, 20 bp, Artificial Sequence
  chemically synthesized
cactgcgacctccgcctctc

SEQ ID NO: 234654 - DNA, 20 bp, Artificial Sequence
  chemically synthesized
tatcgcttgaacccgagagg

SEQ ID NO: 234655 - DNA, 20 bp, Artificial Sequence
  chemically synthesized
gagtatcgcttgaacccgag

SEQ ID NO: 234656 - DNA, 20 bp, Artificial Sequence
  chemically synthesized
ggagtatcgcttgaacccga

SEQ ID NO: 234657 - DNA, 20 bp, Artificial Sequence
  chemically synthesized
gacctccgcctctcgggttc

SEQ ID NO: 234658 - DNA, 20 bp, Artificial Sequence
  chemically synthesized
caggagtatcgcttgaaccc

SEQ ID NO: 234659 - DNA, 20 bp, Artificial Sequence
  chemically synthesized
ttcaagcgatactcctgcct

SEQ ID NO: 234660 - DNA, 20 bp, Artificial Sequence
  chemically synthesized
tacttgggaggctgaggcag

SEQ ID NO: 234661 - DNA, 20 bp, Artificial Sequence
  chemically synthesized
gctacttgggaggctgaggc

SEQ ID NO: 234662 - DNA, 20 bp, Artificial Sequence
  chemically synthesized
agctacttgggaggctgagg

SEQ ID NO: 234663 - DNA, 20 bp, Artificial Sequence
  chemically synthesized
cccagctacttgggaggctg

SEQ ID NO: 234664 - DNA, 20 bp, Artificial Sequence
  chemically synthesized
tcccagctacttgggaggct

SEQ ID NO: 234665 - DNA, 20 bp, Artificial Sequence
  chemically synthesized
tactcctgcctcagcctccc

SEQ ID NO: 234666 - DNA, 20 bp, Artificial Sequence
  chemically synthesized
tcctgcctcagcctcccaag

SEQ ID NO: 234667 - DNA, 20 bp, Artificial Sequence
  chemically synthesized
tagagtcccagctacttggg

SEQ ID NO: 234668 - DNA, 20 bp, Artificial Sequence
  chemically synthesized
ctagagtcccagctacttgg

SEQ ID NO: 234669 - DNA, 20 bp, Artificial Sequence
  chemically synthesized
gcctcagcctcccaagtagc

SEQ ID NO: 234670 - DNA, 20 bp, Artificial Sequence
  chemically synthesized
gcctagagtcccagctactt

SEQ ID NO: 234671 - DNA, 20 bp, Artificial Sequence
  chemically synthesized
cctcagcctcccaagtagct

SEQ ID NO: 234672 - DNA, 20 bp, Artificial Sequence
  chemically synthesized
tgcctagagtcccagctact

SEQ ID NO: 234673 - DNA, 20 bp, Artificial Sequence
  chemically synthesized
ctcccaagtagctgggactc

SEQ ID NO: 234674 - DNA, 20 bp, Artificial Sequence
  chemically synthesized
tcccaagtagctgggactct

SEQ ID NO: 234675 - DNA, 20 bp, Artificial Sequence
  chemically synthesized
gtggtgcatgcctagagtcc

SEQ ID NO: 234676 - DNA, 20 bp, Artificial Sequence
  chemically synthesized
ggcgtggtggtgcatgccta

SEQ ID NO: 234677 - DNA, 20 bp, Artificial Sequence
  chemically synthesized
caggcgtggtggtgcatgcc

SEQ ID NO: 234678 - DNA, 20 bp, Artificial Sequence
  chemically synthesized
taggcatgcaccaccacgcc

SEQ ID NO: 234679 - DNA, 20 bp, Artificial Sequence
  chemically synthesized
tgaaaattagccaggcgtgg

SEQ ID NO: 234680 - DNA, 20 bp, Artificial Sequence
  chemically synthesized
atatgaaaattagccaggcg

SEQ ID NO: 234681 - DNA, 20 bp, Artificial Sequence
  chemically synthesized
taaaaatatgaaaattagcc

SEQ ID NO: 234682 - DNA, 20 bp, Artificial Sequence
  chemically synthesized
ctaaaaatatgaaaattagc

SEQ ID NO: 234683 - DNA, 20 bp, Artificial Sequence
  chemically synthesized
tctactaaaaatatgaaaat

SEQ ID NO: 234684 - DNA, 20 bp, Artificial Sequence
  chemically synthesized
ctggctaattttcatatttt

SEQ ID NO: 234685 - DNA, 20 bp, Artificial Sequence
  chemically synthesized
gctaattttcatatttttag

SEQ ID NO: 234686 - DNA, 20 bp, Artificial Sequence
  chemically synthesized
taattttcatatttttagta

SEQ ID NO: 234687 - DNA, 20 bp, Artificial Sequence
  chemically synthesized
tttcatatttttagtagaga

SEQ ID NO: 234688 - DNA, 20 bp, Artificial Sequence
  chemically synthesized
ttcatatttttagtagagat

SEQ ID NO: 234689 - DNA, 20 bp, Artificial Sequence
  chemically synthesized
tcatatttttagtagagatg

SEQ ID NO: 234690 - DNA, 20 bp, Artificial Sequence
  chemically synthesized
gagatggggtttcgccatgt

SEQ ID NO: 234691 - DNA, 20 bp, Artificial Sequence
  chemically synthesized
tggggtttcgccatgttggc

SEQ ID NO: 234692 - DNA, 20 bp, Artificial Sequence
  chemically synthesized
cgagaccatcctggccaaca

SEQ ID NO: 234693 - DNA, 20 bp, Artificial Sequence
  chemically synthesized
ggggtttcgccatgttggcc

SEQ ID NO: 234694 - DNA, 20 bp, Artificial Sequence
  chemically synthesized
tttcgccatgttggccagga

SEQ ID NO: 234695 - DNA, 20 bp, Artificial Sequence
  chemically synthesized
tcaagaaatcgagaccatcc

SEQ ID NO: 234696 - DNA, 20 bp, Artificial Sequence
  chemically synthesized
gatcactaggtcaagaaatc

SEQ ID NO: 234697 - DNA, 20 bp, Artificial Sequence
  chemically synthesized
atggtctcgatttcttgacc

SEQ ID NO: 234698 - DNA, 20 bp, Artificial Sequence
  chemically synthesized
ggcaggcagatcactaggtc

SEQ ID NO: 234699 - DNA, 20 bp, Artificial Sequence
  chemically synthesized
gccgaggcaggcagatcact

SEQ ID NO: 234700 - DNA, 20 bp, Artificial Sequence
  chemically synthesized
ggccgaggcaggcagatcac

SEQ ID NO: 234701 - DNA, 20 bp, Artificial Sequence
  chemically synthesized
acctagtgatctgcctgcct

SEQ ID NO: 234702 - DNA, 20 bp, Artificial Sequence
  chemically synthesized
ctttgggaggccgaggcagg

SEQ ID NO: 234703 - DNA, 20 bp, Artificial Sequence
  chemically synthesized
gcactttgggaggccgaggc

SEQ ID NO: 234704 - DNA, 20 bp, Artificial Sequence
  chemically synthesized
agcactttgggaggccgagg

SEQ ID NO: 234705 - DNA, 20 bp, Artificial Sequence
  chemically synthesized
cccagcactttgggaggccg

SEQ ID NO: 234706 - DNA, 20 bp, Artificial Sequence
  chemically synthesized
tcccagcactttgggaggcc

SEQ ID NO: 234707 - DNA, 20 bp, Artificial Sequence
  chemically synthesized
ctgcctgcctcggcctccca

SEQ ID NO: 234708 - DNA, 20 bp, Artificial Sequence
  chemically synthesized
tgtaatcccagcactttggg

SEQ ID NO: 234709 - DNA, 20 bp, Artificial Sequence
  chemically synthesized
ctgtaatcccagcactttgg

SEQ ID NO: 234710 - DNA, 20 bp, Artificial Sequence
  chemically synthesized
gcctcggcctcccaaagtgc

SEQ ID NO: 234711 - DNA, 20 bp, Artificial Sequence
  chemically synthesized
gcctgtaatcccagcacttt

SEQ ID NO: 234712 - DNA, 20 bp, Artificial Sequence
  chemically synthesized
cctcggcctcccaaagtgct

SEQ ID NO: 234713 - DNA, 20 bp, Artificial Sequence
  chemically synthesized
cgcctgtaatcccagcactt

SEQ ID NO: 234714 - DNA, 20 bp, Artificial Sequence
  chemically synthesized
ctcccaaagtgctgggatta

SEQ ID NO: 234715 - DNA, 20 bp, Artificial Sequence
  chemically synthesized
tcccaaagtgctgggattac

SEQ ID NO: 234716 - DNA, 20 bp, Artificial Sequence
  chemically synthesized
gtggctcacgcctgtaatcc

SEQ ID NO: 234717 - DNA, 20 bp, Artificial Sequence
  chemically synthesized
agtgctgggattacaggcgt

SEQ ID NO: 234718 - DNA, 20 bp, Artificial Sequence
  chemically synthesized
caggcgtgagccaccgcacc

SEQ ID NO: 234719 - DNA, 20 bp, Artificial Sequence
  chemically synthesized
aagcagtgggctgggtgcgg

SEQ ID NO: 234720 - DNA, 20 bp, Artificial Sequence
  chemically synthesized
ataaagcagtgggctgggtg

SEQ ID NO: 234721 - DNA, 20 bp, Artificial Sequence
  chemically synthesized
tgaaaataaagcagtgggct

SEQ ID NO: 234722 - DNA, 20 bp, Artificial Sequence
  chemically synthesized
ttgaaaataaagcagtgggc

SEQ ID NO: 234723 - DNA, 20 bp, Artificial Sequence
  chemically synthesized
ctgcttgaaaataaagcagt

SEQ ID NO: 234724 - DNA, 20 bp, Artificial Sequence
  chemically synthesized
tctgcttgaaaataaagcag

SEQ ID NO: 234725 - DNA, 20 bp, Artificial Sequence
  chemically synthesized
ttttctgcttgaaaataaag

SEQ ID NO: 234726 - DNA, 20 bp, Artificial Sequence
  chemically synthesized
cagcccactgctttattttc

SEQ ID NO: 234727 - DNA, 20 bp, Artificial Sequence
  chemically synthesized
atgttttctgcttgaaaata

SEQ ID NO: 234728 - DNA, 20 bp, Artificial Sequence
  chemically synthesized
cccactgctttattttcaag

SEQ ID NO: 234729 - DNA, 20 bp, Artificial Sequence
  chemically synthesized
gaaaacatacacaacacctt

SEQ ID NO: 234730 - DNA, 20 bp, Artificial Sequence
  chemically synthesized
acatacacaacaccttcaga

SEQ ID NO: 234731 - DNA, 20 bp, Artificial Sequence
  chemically synthesized
ctactttagcatccatctga

SEQ ID NO: 234732 - DNA, 20 bp, Artificial Sequence
  chemically synthesized
tctactttagcatccatctg

SEQ ID NO: 234733 - DNA, 20 bp, Artificial Sequence
  chemically synthesized
acaccttcagatggatgcta

SEQ ID NO: 234734 - DNA, 20 bp, Artificial Sequence
  chemically synthesized
ccttcagatggatgctaaag

SEQ ID NO: 234735 - DNA, 20 bp, Artificial Sequence
  chemically synthesized
taaacagtttatttctactt

SEQ ID NO: 234736 - DNA, 20 bp, Artificial Sequence
  chemically synthesized
acatgacaatcatttttaaa

SEQ ID NO: 234737 - DNA, 20 bp, Artificial Sequence
  chemically synthesized
gtttaaaaatgattgtcatg

SEQ ID NO: 234738 - DNA, 20 bp, Artificial Sequence
  chemically synthesized
gattgtcatgtggtatgtct

SEQ ID NO: 234739 - DNA, 20 bp, Artificial Sequence
  chemically synthesized
tgtcatgtggtatgtctgag

SEQ ID NO: 234740 - DNA, 20 bp, Artificial Sequence
  chemically synthesized
tgtgatgcttattttcttct

SEQ ID NO: 234741 - DNA, 20 bp, Artificial Sequence
  chemically synthesized
ggtatgtctgagaagaaaat

SEQ ID NO: 234742 - DNA, 20 bp, Artificial Sequence
  chemically synthesized
tgagaagaaaataagcatca

SEQ ID NO: 234743 - DNA, 20 bp, Artificial Sequence
  chemically synthesized
gagaagaaaataagcatcac

SEQ ID NO: 234744 - DNA, 20 bp, Artificial Sequence
  chemically synthesized
gattggagacagatatttaa

SEQ ID NO: 234745 - DNA, 20 bp, Artificial Sequence
  chemically synthesized
cttcaagtcatgattggaga

SEQ ID NO: 234746 - DNA, 20 bp, Artificial Sequence
  chemically synthesized
gcaacttcaagtcatgattg

SEQ ID NO: 234747 - DNA, 20 bp, Artificial Sequence
  chemically synthesized
gtgcaacttcaagtcatgat

SEQ ID NO: 234748 - DNA, 20 bp, Artificial Sequence
  chemically synthesized
ctgtctccaatcatgacttg

SEQ ID NO: 234749 - DNA, 20 bp, Artificial Sequence
  chemically synthesized
acttgaaagagtgcaacttc

SEQ ID NO: 234750 - DNA, 20 bp, Artificial Sequence
  chemically synthesized
acttgaagttgcactctttc

SEQ ID NO: 234751 - DNA, 20 bp, Artificial Sequence
  chemically synthesized
gcagtttagcatacttgaaa

SEQ ID NO: 234752 - DNA, 20 bp, Artificial Sequence
  chemically synthesized
ctgcagtttagcatacttga

SEQ ID NO: 234753 - DNA, 20 bp, Artificial Sequence
  chemically synthesized
ctttcaagtatgctaaactg

SEQ ID NO: 234754 - DNA, 20 bp, Artificial Sequence
  chemically synthesized
tttaaaggaaaactgcagtt

SEQ ID NO: 234755 - DNA, 20 bp, Artificial Sequence
  chemically synthesized
tgaactttaaaggaaaactg

SEQ ID NO: 234756 - DNA, 20 bp, Artificial Sequence
  chemically synthesized
taaactgcagttttccttta

SEQ ID NO: 234757 - DNA, 20 bp, Artificial Sequence
  chemically synthesized
aattacggtttgaactttaa

SEQ ID NO: 234758 - DNA, 20 bp, Artificial Sequence
  chemically synthesized
taattacggtttgaacttta

SEQ ID NO: 234759 - DNA, 20 bp, Artificial Sequence
  chemically synthesized
gggtttttacattataatta

SEQ ID NO: 234760 - DNA, 20 bp, Artificial Sequence
  chemically synthesized
gtaattataatgtaaaaacc

SEQ ID NO: 234761 - DNA, 20 bp, Artificial Sequence
  chemically synthesized
taattataatgtaaaaaccc

SEQ ID NO: 234762 - DNA, 20 bp, Artificial Sequence
  chemically synthesized
ttataatgtaaaaacccagg

SEQ ID NO: 234763 - DNA, 20 bp, Artificial Sequence
  chemically synthesized
cggtttgctgtatacttcct

SEQ ID NO: 234764 - DNA, 20 bp, Artificial Sequence
  chemically synthesized
acggtttgctgtatacttcc

SEQ ID NO: 234765 - DNA, 20 bp, Artificial Sequence
  chemically synthesized
gtaaaaacccaggaagtata

SEQ ID NO: 234766 - DNA, 20 bp, Artificial Sequence
  chemically synthesized
ggaagtatacagcaaaccgt

SEQ ID NO: 234767 - DNA, 20 bp, Artificial Sequence
  chemically synthesized
aagtttgtttaggatactta

SEQ ID NO: 234768 - DNA, 20 bp, Artificial Sequence
  chemically synthesized
ttcaagatttaagtttgttt

SEQ ID NO: 234769 - DNA, 20 bp, Artificial Sequence
  chemically synthesized
tttcaagatttaagtttgtt

SEQ ID NO: 234770 - DNA, 20 bp, Artificial Sequence
  chemically synthesized
atttgcacttttcaagattt

SEQ ID NO: 234771 - DNA, 20 bp, Artificial Sequence
  chemically synthesized
aaacaaacttaaatcttgaa

SEQ ID NO: 234772 - DNA, 20 bp, Artificial Sequence
  chemically synthesized
ggatgagatttgcacttttc

SEQ ID NO: 234773 - DNA, 20 bp, Artificial Sequence
  chemically synthesized
gagcaaaggcttttggggat

SEQ ID NO: 234774 - DNA, 20 bp, Artificial Sequence
  chemically synthesized
agtgcaaatctcatccccaa

SEQ ID NO: 234775 - DNA, 20 bp, Artificial Sequence
  chemically synthesized
tgtttgagcaaaggcttttg

SEQ ID NO: 234776 - DNA, 20 bp, Artificial Sequence
  chemically synthesized
gtgtttgagcaaaggctttt

SEQ ID NO: 234777 - DNA, 20 bp, Artificial Sequence
  chemically synthesized
tgtgtttgagcaaaggcttt

SEQ ID NO: 234778 - DNA, 20 bp, Artificial Sequence
  chemically synthesized
tgcagaatgtgtttgagcaa

SEQ ID NO: 234779 - DNA, 20 bp, Artificial Sequence
  chemically synthesized
ttgcagaatgtgtttgagca

SEQ ID NO: 234780 - DNA, 20 bp, Artificial Sequence
  chemically synthesized
cacagttgcagaatgtgttt

SEQ ID NO: 234781 - DNA, 20 bp, Artificial Sequence
  chemically synthesized
tcaaacacattctgcaactg

SEQ ID NO: 234782 - DNA, 20 bp, Artificial Sequence
  chemically synthesized
tagcctataaaccacagttg

SEQ ID NO: 234783 - DNA, 20 bp, Artificial Sequence
  chemically synthesized
cattctgcaactgtggttta

SEQ ID NO: 234784 - DNA, 20 bp, Artificial Sequence
  chemically synthesized
gtgttttagcctataaacca

SEQ ID NO: 234785 - DNA, 20 bp, Artificial Sequence
  chemically synthesized
attctgcaactgtggtttat

SEQ ID NO: 234786 - DNA, 20 bp, Artificial Sequence
  chemically synthesized
gtggtttataggctaaaaca

SEQ ID NO: 234787 - DNA, 20 bp, Artificial Sequence
  chemically synthesized
acacagacaagtctgtgttt

SEQ ID NO: 234788 - DNA, 20 bp, Artificial Sequence
  chemically synthesized
acattacacggtacacagac

SEQ ID NO: 234789 - DNA, 20 bp, Artificial Sequence
  chemically synthesized
aaaggacattacacggtaca

SEQ ID NO: 234790 - DNA, 20 bp, Artificial Sequence
  chemically synthesized
actttgcaaaggacattaca

SEQ ID NO: 234791 - DNA, 20 bp, Artificial Sequence
  chemically synthesized
accgtgtaatgtcctttgca

SEQ ID NO: 234792 - DNA, 20 bp, Artificial Sequence
  chemically synthesized
aggttaggaaaactttgcaa

SEQ ID NO: 234793 - DNA, 20 bp, Artificial Sequence
  chemically synthesized
taggttaggaaaactttgca

SEQ ID NO: 234794 - DNA, 20 bp, Artificial Sequence
  chemically synthesized
atgggccagacaggtaggtt

SEQ ID NO: 234795 - DNA, 20 bp, Artificial Sequence
  chemically synthesized
catgggccagacaggtaggt

SEQ ID NO: 234796 - DNA, 20 bp, Artificial Sequence
  chemically synthesized
gttttcctaacctacctgtc

SEQ ID NO: 234797 - DNA, 20 bp, Artificial Sequence
  chemically synthesized
atagcatgggccagacaggt

SEQ ID NO: 234798 - DNA, 20 bp, Artificial Sequence
  chemically synthesized
gatagcatgggccagacagg

SEQ ID NO: 234799 - DNA, 20 bp, Artificial Sequence
  chemically synthesized
ggtgatagcatgggccagac

SEQ ID NO: 234800 - DNA, 20 bp, Artificial Sequence
  chemically synthesized
gggtgatagcatgggccaga

SEQ ID NO: 234801 - DNA, 20 bp, Artificial Sequence
  chemically synthesized
tggagggtgatagcatgggc

SEQ ID NO: 234802 - DNA, 20 bp, Artificial Sequence
  chemically synthesized
cagatggagggtgatagcat

SEQ ID NO: 234803 - DNA, 20 bp, Artificial Sequence
  chemically synthesized
ccagatggagggtgatagca

SEQ ID NO: 234804 - DNA, 20 bp, Artificial Sequence
  chemically synthesized
ggcctccagatggagggtga

SEQ ID NO: 234805 - DNA, 20 bp, Artificial Sequence
  chemically synthesized
ccatgctatcaccctccatc

SEQ ID NO: 234806 - DNA, 20 bp, Artificial Sequence
  chemically synthesized
atcccaggcctccagatgga

SEQ ID NO: 234807 - DNA, 20 bp, Artificial Sequence
  chemically synthesized
atgctatcaccctccatctg

SEQ ID NO: 234808 - DNA, 20 bp, Artificial Sequence
  chemically synthesized
gatcccaggcctccagatgg

SEQ ID NO: 234809 - DNA, 20 bp, Artificial Sequence
  chemically synthesized
tgctatcaccctccatctgg

SEQ ID NO: 234810 - DNA, 20 bp, Artificial Sequence
  chemically synthesized
ggatcccaggcctccagatg

SEQ ID NO: 234811 - DNA, 20 bp, Artificial Sequence
  chemically synthesized
tgggatcccaggcctccaga

SEQ ID NO: 234812 - DNA, 20 bp, Artificial Sequence
  chemically synthesized
tcaccctccatctggaggcc

SEQ ID NO: 234813 - DNA, 20 bp, Artificial Sequence
  chemically synthesized
caccctccatctggaggcct

SEQ ID NO: 234814 - DNA, 20 bp, Artificial Sequence
  chemically synthesized
gctttgggatcccaggcctc

SEQ ID NO: 234815 - DNA, 20 bp, Artificial Sequence
  chemically synthesized
ggcaaaagctttgggatccc

SEQ ID NO: 234816 - DNA, 20 bp, Artificial Sequence
  chemically synthesized
tggcaaaagctttgggatcc

SEQ ID NO: 234817 - DNA, 20 bp, Artificial Sequence
  chemically synthesized
tctggaggcctgggatccca

SEQ ID NO: 234818 - DNA, 20 bp, Artificial Sequence
  chemically synthesized
tattaagtggcaaaagcttt

SEQ ID NO: 234819 - DNA, 20 bp, Artificial Sequence
  chemically synthesized
atattaagtggcaaaagctt

SEQ ID NO: 234820 - DNA, 20 bp, Artificial Sequence
  chemically synthesized
caaccaatattaagtggcaa

SEQ ID NO: 234821 - DNA, 20 bp, Artificial Sequence
  chemically synthesized
gaatggcaaccaatattaag

SEQ ID NO: 234822 - DNA, 20 bp, Artificial Sequence
  chemically synthesized
aagcttttgccacttaatat

SEQ ID NO: 234823 - DNA, 20 bp, Artificial Sequence
  chemically synthesized
ggagaatggcaaccaatatt

SEQ ID NO: 234824 - DNA, 20 bp, Artificial Sequence
  chemically synthesized
aatattggttgccattctcc

SEQ ID NO: 234825 - DNA, 20 bp, Artificial Sequence
  chemically synthesized
ggaaaagccagcttggagaa

SEQ ID NO: 234826 - DNA, 20 bp, Artificial Sequence
  chemically synthesized
ttggttgccattctccaagc

SEQ ID NO: 234827 - DNA, 20 bp, Artificial Sequence
  chemically synthesized
agtctggaaaagccagcttg

SEQ ID NO: 234828 - DNA, 20 bp, Artificial Sequence
  chemically synthesized
tcagtctggaaaagccagct

SEQ ID NO: 234829 - DNA, 20 bp, Artificial Sequence
  chemically synthesized
attctccaagctggcttttc

SEQ ID NO: 234830 - DNA, 20 bp, Artificial Sequence
  chemically synthesized
tgacctcagtctggaaaagc

SEQ ID NO: 234831 - DNA, 20 bp, Artificial Sequence
  chemically synthesized
gagatgacctcagtctggaa

SEQ ID NO: 234832 - DNA, 20 bp, Artificial Sequence
  chemically synthesized
caagctggcttttccagact

SEQ ID NO: 234833 - DNA, 20 bp, Artificial Sequence
  chemically synthesized
aagctggcttttccagactg

SEQ ID NO: 234834 - DNA, 20 bp, Artificial Sequence
  chemically synthesized
cagaagagatgacctcagtc

SEQ ID NO: 234835 - DNA, 20 bp, Artificial Sequence
  chemically synthesized
agaaacagaagagatgacct

SEQ ID NO: 234836 - DNA, 20 bp, Artificial Sequence
  chemically synthesized
aaagttttatagaaacagaa

SEQ ID NO: 234837 - DNA, 20 bp, Artificial Sequence
  chemically synthesized
taaaagttttatagaaacag

SEQ ID NO: 234838 - DNA, 20 bp, Artificial Sequence
  chemically synthesized
ttttaaaagttttatagaaa

SEQ ID NO: 234839 - DNA, 20 bp, Artificial Sequence
  chemically synthesized
actgtattttaaaagtttta

SEQ ID NO: 234840 - DNA, 20 bp, Artificial Sequence
  chemically synthesized
ccataataactgtattttaa

SEQ ID NO: 234841 - DNA, 20 bp, Artificial Sequence
  chemically synthesized
tctataaaacttttaaaata

SEQ ID NO: 234842 - DNA, 20 bp, Artificial Sequence
  chemically synthesized
cttttaaaatacagttatta

SEQ ID NO: 234843 - DNA, 20 bp, Artificial Sequence
  chemically synthesized
aaagttatgatatagcataa

SEQ ID NO: 234844 - DNA, 20 bp, Artificial Sequence
  chemically synthesized
taaacctcaaagttatgata

SEQ ID NO: 234845 - DNA, 20 bp, Artificial Sequence
  chemically synthesized
ttatgctatatcataacttt

SEQ ID NO: 234846 - DNA, 20 bp, Artificial Sequence
  chemically synthesized
tatgctatatcataactttg

SEQ ID NO: 234847 - DNA, 20 bp, Artificial Sequence
  chemically synthesized
agatagatacataaacctca

SEQ ID NO: 234848 - DNA, 20 bp, Artificial Sequence
  chemically synthesized
cagtctagtgcagggagaga

SEQ ID NO: 234849 - DNA, 20 bp, Artificial Sequence
  chemically synthesized
aagccagtctagtgcaggga

SEQ ID NO: 234850 - DNA, 20 bp, Artificial Sequence
  chemically synthesized
gtatctatctctccctgcac

SEQ ID NO: 234851 - DNA, 20 bp, Artificial Sequence
  chemically synthesized
gaaagccagtctagtgcagg

SEQ ID NO: 234852 - DNA, 20 bp, Artificial Sequence
  chemically synthesized
aagaaagccagtctagtgca

SEQ ID NO: 234853 - DNA, 20 bp, Artificial Sequence
  chemically synthesized
caagaaagccagtctagtgc

SEQ ID NO: 234854 - DNA, 20 bp, Artificial Sequence
  chemically synthesized
tcaagaaagccagtctagtg

SEQ ID NO: 234855 - DNA, 20 bp, Artificial Sequence
  chemically synthesized
tatctctccctgcactagac

SEQ ID NO: 234856 - DNA, 20 bp, Artificial Sequence
  chemically synthesized
agcactcaagaaagccagtc

SEQ ID NO: 234857 - DNA, 20 bp, Artificial Sequence
  chemically synthesized
tttccagcactcaagaaagc

SEQ ID NO: 234858 - DNA, 20 bp, Artificial Sequence
  chemically synthesized
tgcactagactggctttctt

SEQ ID NO: 234859 - DNA, 20 bp, Artificial Sequence
  chemically synthesized
catatttccagcactcaaga

SEQ ID NO: 234860 - DNA, 20 bp, Artificial Sequence
  chemically synthesized
agactggctttcttgagtgc

SEQ ID NO: 234861 - DNA, 20 bp, Artificial Sequence
  chemically synthesized
caatcatatttccagcactc

SEQ ID NO: 234862 - DNA, 20 bp, Artificial Sequence
  chemically synthesized
taaggaatcaatcatatttc

SEQ ID NO: 234863 - DNA, 20 bp, Artificial Sequence
  chemically synthesized
tgcctttatgtgagggaata

SEQ ID NO: 234864 - DNA, 20 bp, Artificial Sequence
  chemically synthesized
ctgcctttatgtgagggaat

SEQ ID NO: 234865 - DNA, 20 bp, Artificial Sequence
  chemically synthesized
attccttattccctcacata

SEQ ID NO: 234866 - DNA, 20 bp, Artificial Sequence
  chemically synthesized
agatgcctgcctttatgtga

SEQ ID NO: 234867 - DNA, 20 bp, Artificial Sequence
  chemically synthesized
ttccttattccctcacataa

SEQ ID NO: 234868 - DNA, 20 bp, Artificial Sequence
  chemically synthesized
cagatgcctgcctttatgtg

SEQ ID NO: 234869 - DNA, 20 bp, Artificial Sequence
  chemically synthesized
gcagatgcctgcctttatgt

SEQ ID NO: 234870 - DNA, 20 bp, Artificial Sequence
  chemically synthesized
cttattccctcacataaagg

SEQ ID NO: 234871 - DNA, 20 bp, Artificial Sequence
  chemically synthesized
ttattccctcacataaaggc

SEQ ID NO: 234872 - DNA, 20 bp, Artificial Sequence
  chemically synthesized
ccctacctcagtcagggagg

SEQ ID NO: 234873 - DNA, 20 bp, Artificial Sequence
  chemically synthesized
tgaccctacctcagtcaggg

SEQ ID NO: 234874 - DNA, 20 bp, Artificial Sequence
  chemically synthesized
aggcatctgcctccctgact

SEQ ID NO: 234875 - DNA, 20 bp, Artificial Sequence
  chemically synthesized
gtgaccctacctcagtcagg

SEQ ID NO: 234876 - DNA, 20 bp, Artificial Sequence
  chemically synthesized
ggcatctgcctccctgactg

SEQ ID NO: 234877 - DNA, 20 bp, Artificial Sequence
  chemically synthesized
cagtgaccctacctcagtca

SEQ ID NO: 234878 - DNA, 20 bp, Artificial Sequence
  chemically synthesized
gcagtgaccctacctcagtc

SEQ ID NO: 234879 - DNA, 20 bp, Artificial Sequence
  chemically synthesized
atctgcctccctgactgagg

SEQ ID NO: 234880 - DNA, 20 bp, Artificial Sequence
  chemically synthesized
tgcagtgaccctacctcagt

SEQ ID NO: 234881 - DNA, 20 bp, Artificial Sequence
  chemically synthesized
tctgcctccctgactgaggt

SEQ ID NO: 234882 - DNA, 20 bp, Artificial Sequence
  chemically synthesized
ctgcctccctgactgaggta

SEQ ID NO: 234883 - DNA, 20 bp, Artificial Sequence
  chemically synthesized
cttgtgcagtgaccctacct

SEQ ID NO: 234884 - DNA, 20 bp, Artificial Sequence
  chemically synthesized
ctgaggtagggtcactgcac

SEQ ID NO: 234885 - DNA, 20 bp, Artificial Sequence
  chemically synthesized
aggtagggtcactgcacaag

SEQ ID NO: 234886 - DNA, 20 bp, Artificial Sequence
  chemically synthesized
ggaaaacaatactacttgtg

SEQ ID NO: 234887 - DNA, 20 bp, Artificial Sequence
  chemically synthesized
gaccaaaagtttcaacattg

SEQ ID NO: 234888 - DNA, 20 bp, Artificial Sequence
  chemically synthesized
agaccaaaagtttcaacatt

SEQ ID NO: 234889 - DNA, 20 bp, Artificial Sequence
  chemically synthesized
ttcctcaatgttgaaacttt

SEQ ID NO: 234890 - DNA, 20 bp, Artificial Sequence
  chemically synthesized
aggacagtgctgcagaccaa

SEQ ID NO: 234891 - DNA, 20 bp, Artificial Sequence
  chemically synthesized
atgttgaaacttttggtctg

SEQ ID NO: 234892 - DNA, 20 bp, Artificial Sequence
  chemically synthesized
taagtttcaggacagtgctg

SEQ ID NO: 234893 - DNA, 20 bp, Artificial Sequence
  chemically synthesized
agttttcttaagtttcagga

SEQ ID NO: 234894 - DNA, 20 bp, Artificial Sequence
  chemically synthesized
gcagcactgtcctgaaactt

SEQ ID NO: 234895 - DNA, 20 bp, Artificial Sequence
  chemically synthesized
acatagttttcttaagtttc

SEQ ID NO: 234896 - DNA, 20 bp, Artificial Sequence
  chemically synthesized
aacatagttttcttaagttt

SEQ ID NO: 234897 - DNA, 20 bp, Artificial Sequence
  chemically synthesized
tcattcaacatagttttctt

SEQ ID NO: 234898 - DNA, 20 bp, Artificial Sequence
  chemically synthesized
cttctttggctcattcaaca

SEQ ID NO: 234899 - DNA, 20 bp, Artificial Sequence
  chemically synthesized
ttaagaaaactatgttgaat

SEQ ID NO: 234900 - DNA, 20 bp, Artificial Sequence
  chemically synthesized
aaactatgttgaatgagcca

SEQ ID NO: 234901 - DNA, 20 bp, Artificial Sequence
  chemically synthesized
ctatgttgaatgagccaaag

SEQ ID NO: 234902 - DNA, 20 bp, Artificial Sequence
  chemically synthesized
tatgttgaatgagccaaaga

SEQ ID NO: 234903 - DNA, 20 bp, Artificial Sequence
  chemically synthesized
ccctgaatatcagccttctt

SEQ ID NO: 234904 - DNA, 20 bp, Artificial Sequence
  chemically synthesized
agccaaagaaggctgatatt

SEQ ID NO: 234905 - DNA, 20 bp, Artificial Sequence
  chemically synthesized
gccaaagaaggctgatattc

SEQ ID NO: 234906 - DNA, 20 bp, Artificial Sequence
  chemically synthesized
ccaaagaaggctgatattca

SEQ ID NO: 234907 - DNA, 20 bp, Artificial Sequence
  chemically synthesized
atttactgttccctgaatat

SEQ ID NO: 234908 - DNA, 20 bp, Artificial Sequence
  chemically synthesized
gaaggctgatattcagggaa

SEQ ID NO: 234909 - DNA, 20 bp, Artificial Sequence
  chemically synthesized
ttcagggaacagtaaatttt

SEQ ID NO: 234910 - DNA, 20 bp, Artificial Sequence
  chemically synthesized
tcagggaacagtaaatttta

SEQ ID NO: 234911 - DNA, 20 bp, Artificial Sequence
  chemically synthesized
gaacagtaaattttaaggaa

SEQ ID NO: 234912 - DNA, 20 bp, Artificial Sequence
  chemically synthesized
cagtaaattttaaggaaaag

SEQ ID NO: 234913 - DNA, 20 bp, Artificial Sequence
  chemically synthesized
aggaaaagcagttttgcctg

SEQ ID NO: 234914 - DNA, 20 bp, Artificial Sequence
  chemically synthesized
ggaaaagcagttttgcctgt

SEQ ID NO: 234915 - DNA, 20 bp, Artificial Sequence
  chemically synthesized
gaaaagcagttttgcctgta

SEQ ID NO: 234916 - DNA, 20 bp, Artificial Sequence
  chemically synthesized
cataagacatggttccctac

SEQ ID NO: 234917 - DNA, 20 bp, Artificial Sequence
  chemically synthesized
ccataagacatggttcccta

SEQ ID NO: 234918 - DNA, 20 bp, Artificial Sequence
  chemically synthesized
ctgtagggaaccatgtctta

SEQ ID NO: 234919 - DNA, 20 bp, Artificial Sequence
  chemically synthesized
gaaaagcccaccataagaca

SEQ ID NO: 234920 - DNA, 20 bp, Artificial Sequence
  chemically synthesized
tagggaaccatgtcttatgg

SEQ ID NO: 234921 - DNA, 20 bp, Artificial Sequence
  chemically synthesized
agggaaccatgtcttatggt

SEQ ID NO: 234922 - DNA, 20 bp, Artificial Sequence
  chemically synthesized
tcaagagaaaagcccaccat

SEQ ID NO: 234923 - DNA, 20 bp, Artificial Sequence
  chemically synthesized
ttatggtgggcttttctctt

SEQ ID NO: 234924 - DNA, 20 bp, Artificial Sequence
  chemically synthesized
tcagaataccctcaagagaa

SEQ ID NO: 234925 - DNA, 20 bp, Artificial Sequence
  chemically synthesized
tatggtgggcttttctcttg

SEQ ID NO: 234926 - DNA, 20 bp, Artificial Sequence
  chemically synthesized
atggtgggcttttctcttga

SEQ ID NO: 234927 - DNA, 20 bp, Artificial Sequence
  chemically synthesized
ccctttcagaataccctcaa

SEQ ID NO: 234928 - DNA, 20 bp, Artificial Sequence
  chemically synthesized
ctccctttcagaataccctc

SEQ ID NO: 234929 - DNA, 20 bp, Artificial Sequence
  chemically synthesized
ttctcttgagggtattctga

SEQ ID NO: 234930 - DNA, 20 bp, Artificial Sequence
  chemically synthesized
tctcttgagggtattctgaa

SEQ ID NO: 234931 - DNA, 20 bp, Artificial Sequence
  chemically synthesized
ctcttgagggtattctgaaa

SEQ ID NO: 234932 - DNA, 20 bp, Artificial Sequence
  chemically synthesized
cttgagggtattctgaaagg

SEQ ID NO: 234933 - DNA, 20 bp, Artificial Sequence
  chemically synthesized
ttgagggtattctgaaaggg

SEQ ID NO: 234934 - DNA, 20 bp, Artificial Sequence
  chemically synthesized
tttagtaattgcctcccttt

SEQ ID NO: 234935 - DNA, 20 bp, Artificial Sequence
  chemically synthesized
ggaggcaattactaaatcct

SEQ ID NO: 234936 - DNA, 20 bp, Artificial Sequence
  chemically synthesized
gaagatcatagccaaggatt

SEQ ID NO: 234937 - DNA, 20 bp, Artificial Sequence
  chemically synthesized
ccctttgaagatcatagcca

SEQ ID NO: 234938 - DNA, 20 bp, Artificial Sequence
  chemically synthesized
gccctttgaagatcatagcc

SEQ ID NO: 234939 - DNA, 20 bp, Artificial Sequence
  chemically synthesized
cagaagccctttgaagatca

SEQ ID NO: 234940 - DNA, 20 bp, Artificial Sequence
  chemically synthesized
atccttggctatgatcttca

SEQ ID NO: 234941 - DNA, 20 bp, Artificial Sequence
  chemically synthesized
tccttggctatgatcttcaa

SEQ ID NO: 234942 - DNA, 20 bp, Artificial Sequence
  chemically synthesized
ccttggctatgatcttcaaa

SEQ ID NO: 234943 - DNA, 20 bp, Artificial Sequence
  chemically synthesized
cacagggcagaagccctttg

SEQ ID NO: 234944 - DNA, 20 bp, Artificial Sequence
  chemically synthesized
tcttggtttccacagggcag

SEQ ID NO: 234945 - DNA, 20 bp, Artificial Sequence
  chemically synthesized
ttcaaagggcttctgccctg

SEQ ID NO: 234946 - DNA, 20 bp, Artificial Sequence
  chemically synthesized
gcctcttggtttccacaggg

SEQ ID NO: 234947 - DNA, 20 bp, Artificial Sequence
  chemically synthesized
aaagcctcttggtttccaca

SEQ ID NO: 234948 - DNA, 20 bp, Artificial Sequence
  chemically synthesized
gaaagcctcttggtttccac

SEQ ID NO: 234949 - DNA, 20 bp, Artificial Sequence
  chemically synthesized
agaaagcctcttggtttcca

SEQ ID NO: 234950 - DNA, 20 bp, Artificial Sequence
  chemically synthesized
gcttctgccctgtggaaacc

SEQ ID NO: 234951 - DNA, 20 bp, Artificial Sequence
  chemically synthesized
ttctgccctgtggaaaccaa

SEQ ID NO: 234952 - DNA, 20 bp, Artificial Sequence
  chemically synthesized
tctgccctgtggaaaccaag

SEQ ID NO: 234953 - DNA, 20 bp, Artificial Sequence
  chemically synthesized
tggtctctaagaaagcctct

SEQ ID NO: 234954 - DNA, 20 bp, Artificial Sequence
  chemically synthesized
tggaaaccaagaggctttct

SEQ ID NO: 234955 - DNA, 20 bp, Artificial Sequence
  chemically synthesized
gaaaccaagaggctttctta

SEQ ID NO: 234956 - DNA, 20 bp, Artificial Sequence
  chemically synthesized
agggctgatggtctctaaga

SEQ ID NO: 234957 - DNA, 20 bp, Artificial Sequence
  chemically synthesized
ggcaagggctgatggtctct

SEQ ID NO: 234958 - DNA, 20 bp, Artificial Sequence
  chemically synthesized
gaggctttcttagagaccat

SEQ ID NO: 234959 - DNA, 20 bp, Artificial Sequence
  chemically synthesized
ttgtgtatggcaagggctga

SEQ ID NO: 234960 - DNA, 20 bp, Artificial Sequence
  chemically synthesized
cattggattgtgtatggcaa

SEQ ID NO: 234961 - DNA, 20 bp, Artificial Sequence
  chemically synthesized
gcattggattgtgtatggca

SEQ ID NO: 234962 - DNA, 20 bp, Artificial Sequence
  chemically synthesized
agcattggattgtgtatggc

SEQ ID NO: 234963 - DNA, 20 bp, Artificial Sequence
  chemically synthesized
catgagcattggattgtgta

SEQ ID NO: 234964 - DNA, 20 bp, Artificial Sequence
  chemically synthesized
caaatggaggacatgagcat

SEQ ID NO: 234965 - DNA, 20 bp, Artificial Sequence
  chemically synthesized
ggctgtcaaatggaggacat

SEQ ID NO: 234966 - DNA, 20 bp, Artificial Sequence
  chemically synthesized
agcaagcggctgtcaaatgg

SEQ ID NO: 234967 - DNA, 20 bp, Artificial Sequence
  chemically synthesized
tgctcatgtcctccatttga

SEQ ID NO: 234968 - DNA, 20 bp, Artificial Sequence
  chemically synthesized
tagcaagcggctgtcaaatg

SEQ ID NO: 234969 - DNA, 20 bp, Artificial Sequence
  chemically synthesized
tttagcaagcggctgtcaaa

SEQ ID NO: 234970 - DNA, 20 bp, Artificial Sequence
  chemically synthesized
tgacggaggaatttagcaag

SEQ ID NO: 234971 - DNA, 20 bp, Artificial Sequence
  chemically synthesized
aggtgacggaggaatttagc

SEQ ID NO: 234972 - DNA, 20 bp, Artificial Sequence
  chemically synthesized
actgaggtgacggaggaatt

SEQ ID NO: 234973 - DNA, 20 bp, Artificial Sequence
  chemically synthesized
ataggttactgaggtgacgg

SEQ ID NO: 234974 - DNA, 20 bp, Artificial Sequence
  chemically synthesized
cataggttactgaggtgacg

SEQ ID NO: 234975 - DNA, 20 bp, Artificial Sequence
  chemically synthesized
gctaaattcctccgtcacct

SEQ ID NO: 234976 - DNA, 20 bp, Artificial Sequence
  chemically synthesized
gacataggttactgaggtga

SEQ ID NO: 234977 - DNA, 20 bp, Artificial Sequence
  chemically synthesized
ctctaagacataggttactg

SEQ ID NO: 234978 - DNA, 20 bp, Artificial Sequence
  chemically synthesized
actctaagacataggttact

SEQ ID NO: 234979 - DNA, 20 bp, Artificial Sequence
  chemically synthesized
cacctcagtaacctatgtct

SEQ ID NO: 234980 - DNA, 20 bp, Artificial Sequence
  chemically synthesized
tctatatcactctaagacat

SEQ ID NO: 234981 - DNA, 20 bp, Artificial Sequence
  chemically synthesized
cctcagtaacctatgtctta

SEQ ID NO: 234982 - DNA, 20 bp, Artificial Sequence
  chemically synthesized
ttctatatcactctaagaca

SEQ ID NO: 234983 - DNA, 20 bp, Artificial Sequence
  chemically synthesized
ggcggattctatatcactct

SEQ ID NO: 234984 - DNA, 20 bp, Artificial Sequence
  chemically synthesized
acctatgtcttagagtgata

SEQ ID NO: 234985 - DNA, 20 bp, Artificial Sequence
  chemically synthesized
tgtttgatatatagatttgg

SEQ ID NO: 234986 - DNA, 20 bp, Artificial Sequence
  chemically synthesized
ctctgtttgatatatagatt

SEQ ID NO: 234987 - DNA, 20 bp, Artificial Sequence
  chemically synthesized
ggtaatctctgtttgatata

SEQ ID NO: 234988 - DNA, 20 bp, Artificial Sequence
  chemically synthesized
cgccaaatctatatatcaaa

SEQ ID NO: 234989 - DNA, 20 bp, Artificial Sequence
  chemically synthesized
ccaaatctatatatcaaaca

SEQ ID NO: 234990 - DNA, 20 bp, Artificial Sequence
  chemically synthesized
tatcaaacagagattaccat

SEQ ID NO: 234991 - DNA, 20 bp, Artificial Sequence
  chemically synthesized
tcaaacagagattaccatga

SEQ ID NO: 234992 - DNA, 20 bp, Artificial Sequence
  chemically synthesized
caattacattgttactctca

SEQ ID NO: 234993 - DNA, 20 bp, Artificial Sequence
  chemically synthesized
tgagagtaacaatgtaattg

SEQ ID NO: 234994 - DNA, 20 bp, Artificial Sequence
  chemically synthesized
gagagtaacaatgtaattga

SEQ ID NO: 234995 - DNA, 20 bp, Artificial Sequence
  chemically synthesized
aaagcacttcataatttaag

SEQ ID NO: 234996 - DNA, 20 bp, Artificial Sequence
  chemically synthesized
aacaaagcacttcataattt

SEQ ID NO: 234997 - DNA, 20 bp, Artificial Sequence
  chemically synthesized
aaggcacttcttaaattatg

SEQ ID NO: 234998 - DNA, 20 bp, Artificial Sequence
  chemically synthesized
acagtagtcataacataaca

SEQ ID NO: 234999 - DNA, 20 bp, Artificial Sequence
  chemically synthesized
gttgttgatgataataacag

SEQ ID NO: 235000 - DNA, 20 bp, Artificial Sequence
  chemically synthesized
agggttgttgatgataataa

SEQ ID NO: 235001 - DNA, 20 bp, Artificial Sequence
  chemically synthesized
tgttattagagatgatgtta

SEQ ID NO: 235002 - DNA, 20 bp, Artificial Sequence
  chemically synthesized
ttgttattagagatgatgtt

SEQ ID NO: 235003 - DNA, 20 bp, Artificial Sequence
  chemically synthesized
gttgttattagagatgatgt

SEQ ID NO: 235004 - DNA, 20 bp, Artificial Sequence
  chemically synthesized
gttaaaaggagttgttatta

SEQ ID NO: 235005 - DNA, 20 bp, Artificial Sequence
  chemically synthesized
atgttaaaaggagttgttat

SEQ ID NO: 235006 - DNA, 20 bp, Artificial Sequence
  chemically synthesized
taaaagaaggatgttaaaag

SEQ ID NO: 235007 - DNA, 20 bp, Artificial Sequence
  chemically synthesized
attaaaagaaggatgttaaa

SEQ ID NO: 235008 - DNA, 20 bp, Artificial Sequence
  chemically synthesized
tattaaaagaaggatgttaa

SEQ ID NO: 235009 - DNA, 20 bp, Artificial Sequence
  chemically synthesized
acccatagtgtattaaaaga

SEQ ID NO: 235010 - DNA, 20 bp, Artificial Sequence
  chemically synthesized
gacccatagtgtattaaaag

SEQ ID NO: 235011 - DNA, 20 bp, Artificial Sequence
  chemically synthesized
tttgacccatagtgtattaa

SEQ ID NO: 235012 - DNA, 20 bp, Artificial Sequence
  chemically synthesized
atccttcttttaatacacta

SEQ ID NO: 235013 - DNA, 20 bp, Artificial Sequence
  chemically synthesized
tccttcttttaatacactat

SEQ ID NO: 235014 - DNA, 20 bp, Artificial Sequence
  chemically synthesized
tataattataatttgaccca

SEQ ID NO: 235015 - DNA, 20 bp, Artificial Sequence
  chemically synthesized
atattgtcatcagtaaagtt

SEQ ID NO: 235016 - DNA, 20 bp, Artificial Sequence
  chemically synthesized
attttatattgtcatcagta

SEQ ID NO: 235017 - DNA, 20 bp, Artificial Sequence
  chemically synthesized
aacttattttatattgtcat

SEQ ID NO: 235018 - DNA, 20 bp, Artificial Sequence
  chemically synthesized
tactgatgacaatataaaat

SEQ ID NO: 235019 - DNA, 20 bp, Artificial Sequence
  chemically synthesized
caatataaaataagtttaat

SEQ ID NO: 235020 - DNA, 20 bp, Artificial Sequence
  chemically synthesized
atataaaataagtttaatta

SEQ ID NO: 235021 - DNA, 20 bp, Artificial Sequence
  chemically synthesized
atgttatttagttatgagta

SEQ ID NO: 235022 - DNA, 20 bp, Artificial Sequence
  chemically synthesized
aaatgttatttagttatgag

SEQ ID NO: 235023 - DNA, 20 bp, Artificial Sequence
  chemically synthesized
taaaaatgttatttagttat

SEQ ID NO: 235024 - DNA, 20 bp, Artificial Sequence
  chemically synthesized
ttattcataaaaatgttatt

SEQ ID NO: 235025 - DNA, 20 bp, Artificial Sequence
  chemically synthesized
aataacatttttatgaataa

SEQ ID NO: 235026 - DNA, 20 bp, Artificial Sequence
  chemically synthesized
aacatttttatgaataaaag

SEQ ID NO: 235027 - DNA, 20 bp, Artificial Sequence
  chemically synthesized
cttaaatatattaagtgatg

SEQ ID NO: 235028 - DNA, 20 bp, Artificial Sequence
  chemically synthesized
taagagaccttaaatatatt

SEQ ID NO: 235029 - DNA, 20 bp, Artificial Sequence
  chemically synthesized
cttcatcacttaatatattt

SEQ ID NO: 235030 - DNA, 20 bp, Artificial Sequence
  chemically synthesized
ttcatcacttaatatattta

SEQ ID NO: 235031 - DNA, 20 bp, Artificial Sequence
  chemically synthesized
ttaatatatttaaggtctct

SEQ ID NO: 235032 - DNA, 20 bp, Artificial Sequence
  chemically synthesized
taatatatttaaggtctctt

SEQ ID NO: 235033 - DNA, 20 bp, Artificial Sequence
  chemically synthesized
tatatttaaggtctcttagg

SEQ ID NO: 235034 - DNA, 20 bp, Artificial Sequence
  chemically synthesized
acaggacaaggtcttcctaa

SEQ ID NO: 235035 - DNA, 20 bp, Artificial Sequence
  chemically synthesized
ctacaggacaaggtcttcct

SEQ ID NO: 235036 - DNA, 20 bp, Artificial Sequence
  chemically synthesized
cttaggaagaccttgtcctg

SEQ ID NO: 235037 - DNA, 20 bp, Artificial Sequence
  chemically synthesized
ataccactgactacaggaca

SEQ ID NO: 235038 - DNA, 20 bp, Artificial Sequence
  chemically synthesized
aataccactgactacaggac

SEQ ID NO: 235039 - DNA, 20 bp, Artificial Sequence
  chemically synthesized
ggaagaccttgtcctgtagt

SEQ ID NO: 235040 - DNA, 20 bp, Artificial Sequence
  chemically synthesized
agaataataccactgactac

SEQ ID NO: 235041 - DNA, 20 bp, Artificial Sequence
  chemically synthesized
agaccttgtcctgtagtcag

SEQ ID NO: 235042 - DNA, 20 bp, Artificial Sequence
  chemically synthesized
aagaataataccactgacta

SEQ ID NO: 235043 - DNA, 20 bp, Artificial Sequence
  chemically synthesized
agtggtattattctttttat

SEQ ID NO: 235044 - DNA, 20 bp, Artificial Sequence
  chemically synthesized
atcttgaggaaactaataaa

SEQ ID NO: 235045 - DNA, 20 bp, Artificial Sequence
  chemically synthesized
ttctttttattagtttcctc

SEQ ID NO: 235046 - DNA, 20 bp, Artificial Sequence
  chemically synthesized
gctctgcctaataaatcttg

SEQ ID NO: 235047 - DNA, 20 bp, Artificial Sequence
  chemically synthesized
tgctctgcctaataaatctt

SEQ ID NO: 235048 - DNA, 20 bp, Artificial Sequence
  chemically synthesized
ttagtttcctcaagatttat

SEQ ID NO: 235049 - DNA, 20 bp, Artificial Sequence
  chemically synthesized
tagtttcctcaagatttatt

SEQ ID NO: 235050 - DNA, 20 bp, Artificial Sequence
  chemically synthesized
tttcctcaagatttattagg

SEQ ID NO: 235051 - DNA, 20 bp, Artificial Sequence
  chemically synthesized
tcctcaagatttattaggca

SEQ ID NO: 235052 - DNA, 20 bp, Artificial Sequence
  chemically synthesized
tcaagatttattaggcagag

SEQ ID NO: 235053 - DNA, 20 bp, Artificial Sequence
  chemically synthesized
aatgttaagccaaaaacatt

SEQ ID NO: 235054 - DNA, 20 bp, Artificial Sequence
  chemically synthesized
gagcagtgacttaatgtttt

SEQ ID NO: 235055 - DNA, 20 bp, Artificial Sequence
  chemically synthesized
agctagaagttagaaatgtt

SEQ ID NO: 235056 - DNA, 20 bp, Artificial Sequence
  chemically synthesized
ggcttaacatttctaacttc

SEQ ID NO: 235057 - DNA, 20 bp, Artificial Sequence
  chemically synthesized
actgttcatcagctagaagt

SEQ ID NO: 235058 - DNA, 20 bp, Artificial Sequence
  chemically synthesized
ttttactgttcatcagctag

SEQ ID NO: 235059 - DNA, 20 bp, Artificial Sequence
  chemically synthesized
tttttttactgttcatcagc

SEQ ID NO: 235060 - DNA, 20 bp, Artificial Sequence
  chemically synthesized
tctaacttctagctgatgaa

SEQ ID NO: 235061 - DNA, 20 bp, Artificial Sequence
  chemically synthesized
atattttttttactgttcat

SEQ ID NO: 235062 - DNA, 20 bp, Artificial Sequence
  chemically synthesized
gatgaacagtaaaaaaaata

SEQ ID NO: 235063 - DNA, 20 bp, Artificial Sequence
  chemically synthesized
aaaatatggtgtttgaatcc

SEQ ID NO: 235064 - DNA, 20 bp, Artificial Sequence
  chemically synthesized
agctaataaatgaagaatct

SEQ ID NO: 235065 - DNA, 20 bp, Artificial Sequence
  chemically synthesized
aagctaataaatgaagaatc

SEQ ID NO: 235066 - DNA, 20 bp, Artificial Sequence
  chemically synthesized
atcccagattcttcatttat

SEQ ID NO: 235067 - DNA, 20 bp, Artificial Sequence
  chemically synthesized
aatcataaagctaataaatg

SEQ ID NO: 235068 - DNA, 20 bp, Artificial Sequence
  chemically synthesized
catttattagctttatgatt

SEQ ID NO: 235069 - DNA, 20 bp, Artificial Sequence
  chemically synthesized
acgctttatcccaaatcata

SEQ ID NO: 235070 - DNA, 20 bp, Artificial Sequence
  chemically synthesized
atttattagctttatgattt

SEQ ID NO: 235071 - DNA, 20 bp, Artificial Sequence
  chemically synthesized
tagctttatgatttgggata

SEQ ID NO: 235072 - DNA, 20 bp, Artificial Sequence
  chemically synthesized
tcttagacaaaaatttcgga

SEQ ID NO: 235073 - DNA, 20 bp, Artificial Sequence
  chemically synthesized
taactcttagacaaaaattt

SEQ ID NO: 235074 - DNA, 20 bp, Artificial Sequence
  chemically synthesized
actttccgaaatttttgtct

SEQ ID NO: 235075 - DNA, 20 bp, Artificial Sequence
  chemically synthesized
tttccgaaatttttgtctaa

SEQ ID NO: 235076 - DNA, 20 bp, Artificial Sequence
  chemically synthesized
aaaggtattcttataactct

SEQ ID NO: 235077 - DNA, 20 bp, Artificial Sequence
  chemically synthesized
aatttttgtctaagagttat

SEQ ID NO: 235078 - DNA, 20 bp, Artificial Sequence
  chemically synthesized
cccagcaagataggtagaaa

SEQ ID NO: 235079 - DNA, 20 bp, Artificial Sequence
  chemically synthesized
tcccagcaagataggtagaa

SEQ ID NO: 235080 - DNA, 20 bp, Artificial Sequence
  chemically synthesized
aatactcccagcaagatagg

SEQ ID NO: 235081 - DNA, 20 bp, Artificial Sequence
  chemically synthesized
accttttctacctatcttgc

SEQ ID NO: 235082 - DNA, 20 bp, Artificial Sequence
  chemically synthesized
tgaaatactcccagcaagat

SEQ ID NO: 235083 - DNA, 20 bp, Artificial Sequence
  chemically synthesized
ccttttctacctatcttgct

SEQ ID NO: 235084 - DNA, 20 bp, Artificial Sequence
  chemically synthesized
ttgaaatactcccagcaaga

SEQ ID NO: 235085 - DNA, 20 bp, Artificial Sequence
  chemically synthesized
ttttctacctatcttgctgg

SEQ ID NO: 235086 - DNA, 20 bp, Artificial Sequence
  chemically synthesized
gattttgaaatactcccagc

SEQ ID NO: 235087 - DNA, 20 bp, Artificial Sequence
  chemically synthesized
atgtgattttgaaatactcc

SEQ ID NO: 235088 - DNA, 20 bp, Artificial Sequence
  chemically synthesized
gagtatttcaaaatcacatg

SEQ ID NO: 235089 - DNA, 20 bp, Artificial Sequence
  chemically synthesized
atcacatgaagtcatattct

SEQ ID NO: 235090 - DNA, 20 bp, Artificial Sequence
  chemically synthesized
atgctgttttaaaaattacc

SEQ ID NO: 235091 - DNA, 20 bp, Artificial Sequence
  chemically synthesized
attcttggtaatttttaaaa

SEQ ID NO: 235092 - DNA, 20 bp, Artificial Sequence
  chemically synthesized
atttttaaaacagcatgcaa

SEQ ID NO: 235093 - DNA, 20 bp, Artificial Sequence
  chemically synthesized
ttaaaacagcatgcaaaagc

SEQ ID NO: 235094 - DNA, 20 bp, Artificial Sequence
  chemically synthesized
taaaacagcatgcaaaagca

SEQ ID NO: 235095 - DNA, 20 bp, Artificial Sequence
  chemically synthesized
agtaatttataaagttggtt

SEQ ID NO: 235096 - DNA, 20 bp, Artificial Sequence
  chemically synthesized
attgcagtaatttataaagt

SEQ ID NO: 235097 - DNA, 20 bp, Artificial Sequence
  chemically synthesized
tttcattgcagtaatttata

SEQ ID NO: 235098 - DNA, 20 bp, Artificial Sequence
  chemically synthesized
atacaagatttatttcattg

SEQ ID NO: 235099 - DNA, 20 bp, Artificial Sequence
  chemically synthesized
tacacagaaagatgtaatac

SEQ ID NO: 235100 - DNA, 20 bp, Artificial Sequence
  chemically synthesized
tttacaagaatatacacaga

SEQ ID NO: 235101 - DNA, 20 bp, Artificial Sequence
  chemically synthesized
caactttacaagaatataca

SEQ ID NO: 235102 - DNA, 20 bp, Artificial Sequence
  chemically synthesized
tttctgtgtatattcttgta

SEQ ID NO: 235103 - DNA, 20 bp, Artificial Sequence
  chemically synthesized
tagtacaaaatcaactttac

SEQ ID NO: 235104 - DNA, 20 bp, Artificial Sequence
  chemically synthesized
aaactaatacttttggaaaa

SEQ ID NO: 235105 - DNA, 20 bp, Artificial Sequence
  chemically synthesized
gattttgtactattttccaa

SEQ ID NO: 235106 - DNA, 20 bp, Artificial Sequence
  chemically synthesized
gtactattttccaaaagtat

SEQ ID NO: 235107 - DNA, 20 bp, Artificial Sequence
  chemically synthesized
gttcagaaaactaatacttt

SEQ ID NO: 235108 - DNA, 20 bp, Artificial Sequence
  chemically synthesized
aaagtattagttttctgaac

SEQ ID NO: 235109 - DNA, 20 bp, Artificial Sequence
  chemically synthesized
agaaaattaagaagccagtt

SEQ ID NO: 235110 - DNA, 20 bp, Artificial Sequence
  chemically synthesized
gttttagaaaattaagaagc

SEQ ID NO: 235111 - DNA, 20 bp, Artificial Sequence
  chemically synthesized
ataagttttagaaaattaag

SEQ ID NO: 235112 - DNA, 20 bp, Artificial Sequence
  chemically synthesized
agtataagttttagaaaatt

SEQ ID NO: 235113 - DNA, 20 bp, Artificial Sequence
  chemically synthesized
gtgtaaggaagtataagttt

SEQ ID NO: 235114 - DNA, 20 bp, Artificial Sequence
  chemically synthesized
tggtgagtgtaaggaagtat

SEQ ID NO: 235115 - DNA, 20 bp, Artificial Sequence
  chemically synthesized
gtaatatggtgagtgtaagg

SEQ ID NO: 235116 - DNA, 20 bp, Artificial Sequence
  chemically synthesized
gttgtaatatggtgagtgta

SEQ ID NO: 235117 - DNA, 20 bp, Artificial Sequence
  chemically synthesized
ggttgtaatatggtgagtgt

SEQ ID NO: 235118 - DNA, 20 bp, Artificial Sequence
  chemically synthesized
tcacaaggttgtaatatggt

SEQ ID NO: 235119 - DNA, 20 bp, Artificial Sequence
  chemically synthesized
agtgtcacaaggttgtaata

SEQ ID NO: 235120 - DNA, 20 bp, Artificial Sequence
  chemically synthesized
atttctggttgagtgtcaca

SEQ ID NO: 235121 - DNA, 20 bp, Artificial Sequence
  chemically synthesized
gatttctggttgagtgtcac

SEQ ID NO: 235122 - DNA, 20 bp, Artificial Sequence
  chemically synthesized
acaaccttgtgacactcaac

SEQ ID NO: 235123 - DNA, 20 bp, Artificial Sequence
  chemically synthesized
gtgttgggtgatttctggtt

SEQ ID NO: 235124 - DNA, 20 bp, Artificial Sequence
  chemically synthesized
tgtgtgtgttgggtgatttc

SEQ ID NO: 235125 - DNA, 20 bp, Artificial Sequence
  chemically synthesized
tgtatgtgtatgtgtgtgtt

SEQ ID NO: 235126 - DNA, 20 bp, Artificial Sequence
  chemically synthesized
ttgtatgtgtatgtgtgtgt

SEQ ID NO: 235127 - DNA, 20 bp, Artificial Sequence
  chemically synthesized
acatacacatacaactgtgt

SEQ ID NO: 235128 - DNA, 20 bp, Artificial Sequence
  chemically synthesized
aatgcaagaagggactaaca

SEQ ID NO: 235129 - DNA, 20 bp, Artificial Sequence
  chemically synthesized
tctttatagcaatgcaagaa

SEQ ID NO: 235130 - DNA, 20 bp, Artificial Sequence
  chemically synthesized
ttctttatagcaatgcaaga

SEQ ID NO: 235131 - DNA, 20 bp, Artificial Sequence
  chemically synthesized
tttctttatagcaatgcaag

SEQ ID NO: 235132 - DNA, 20 bp, Artificial Sequence
  chemically synthesized
gtatttctttatagcaatgc

SEQ ID NO: 235133 - DNA, 20 bp, Artificial Sequence
  chemically synthesized
tcccttcttgcattgctata

SEQ ID NO: 235134 - DNA, 20 bp, Artificial Sequence
  chemically synthesized
cagtttcaggtatttcttta

SEQ ID NO: 235135 - DNA, 20 bp, Artificial Sequence
  chemically synthesized
tataaagaaatacctgaaac

SEQ ID NO: 235136 - DNA, 20 bp, Artificial Sequence
  chemically synthesized
ataaagaaatacctgaaact

SEQ ID NO: 235137 - DNA, 20 bp, Artificial Sequence
  chemically synthesized
tttttaaagcacccagtttc

SEQ ID NO: 235138 - DNA, 20 bp, Artificial Sequence
  chemically synthesized
ctttttaaagcacccagttt

SEQ ID NO: 235139 - DNA, 20 bp, Artificial Sequence
  chemically synthesized
ccttttctttttaaagcacc

SEQ ID NO: 235140 - DNA, 20 bp, Artificial Sequence
  chemically synthesized
ctgaaactgggtgctttaaa

SEQ ID NO: 235141 - DNA, 20 bp, Artificial Sequence
  chemically synthesized
gaaaaccccttttcttttta

SEQ ID NO: 235142 - DNA, 20 bp, Artificial Sequence
  chemically synthesized
actgggtgctttaaaaagaa

SEQ ID NO: 235143 - DNA, 20 bp, Artificial Sequence
  chemically synthesized
ctgggtgctttaaaaagaaa

SEQ ID NO: 235144 - DNA, 20 bp, Artificial Sequence
  chemically synthesized
tgggtgctttaaaaagaaaa

SEQ ID NO: 235145 - DNA, 20 bp, Artificial Sequence
  chemically synthesized
gggtgctttaaaaagaaaag

SEQ ID NO: 235146 - DNA, 20 bp, Artificial Sequence
  chemically synthesized
cctgcagaaccgtaagtcaa

SEQ ID NO: 235147 - DNA, 20 bp, Artificial Sequence
  chemically synthesized
aggggttttcttttgactta

SEQ ID NO: 235148 - DNA, 20 bp, Artificial Sequence
  chemically synthesized
tgtacagcctgcagaaccgt

SEQ ID NO: 235149 - DNA, 20 bp, Artificial Sequence
  chemically synthesized
tcttttgacttacggttctg

SEQ ID NO: 235150 - DNA, 20 bp, Artificial Sequence
  chemically synthesized
cttttgacttacggttctgc

SEQ ID NO: 235151 - DNA, 20 bp, Artificial Sequence
  chemically synthesized
catgcttcctgtacagcctg

SEQ ID NO: 235152 - DNA, 20 bp, Artificial Sequence
  chemically synthesized
ttacggttctgcaggctgta

SEQ ID NO: 235153 - DNA, 20 bp, Artificial Sequence
  chemically synthesized
tacggttctgcaggctgtac

SEQ ID NO: 235154 - DNA, 20 bp, Artificial Sequence
  chemically synthesized
ggttctgcaggctgtacagg

SEQ ID NO: 235155 - DNA, 20 bp, Artificial Sequence
  chemically synthesized
ccagtgacatgcttcctgta

SEQ ID NO: 235156 - DNA, 20 bp, Artificial Sequence
  chemically synthesized
ctgtacaggaagcatgtcac

SEQ ID NO: 235157 - DNA, 20 bp, Artificial Sequence
  chemically synthesized
ctctcaccagaagtagatgc

SEQ ID NO: 235158 - DNA, 20 bp, Artificial Sequence
  chemically synthesized
atgtcactggcatctacttc

SEQ ID NO: 235159 - DNA, 20 bp, Artificial Sequence
  chemically synthesized
cctgaggctctcaccagaag

SEQ ID NO: 235160 - DNA, 20 bp, Artificial Sequence
  chemically synthesized
cactggcatctacttctggt

SEQ ID NO: 235161 - DNA, 20 bp, Artificial Sequence
  chemically synthesized
ctggcatctacttctggtga

SEQ ID NO: 235162 - DNA, 20 bp, Artificial Sequence
  chemically synthesized
cttcctgaggctctcaccag

SEQ ID NO: 235163 - DNA, 20 bp, Artificial Sequence
  chemically synthesized
aaacttcctgaggctctcac

SEQ ID NO: 235164 - DNA, 20 bp, Artificial Sequence
  chemically synthesized
tctacttctggtgagagcct

SEQ ID NO: 235165 - DNA, 20 bp, Artificial Sequence
  chemically synthesized
ctacttctggtgagagcctc

SEQ ID NO: 235166 - DNA, 20 bp, Artificial Sequence
  chemically synthesized
cttctggtgagagcctcagg

SEQ ID NO: 235167 - DNA, 20 bp, Artificial Sequence
  chemically synthesized
ggttggttgtaaacttcctg

SEQ ID NO: 235168 - DNA, 20 bp, Artificial Sequence
  chemically synthesized
tggttggttgtaaacttcct

SEQ ID NO: 235169 - DNA, 20 bp, Artificial Sequence
  chemically synthesized
aggaagtttacaaccaacca

SEQ ID NO: 235170 - DNA, 20 bp, Artificial Sequence
  chemically synthesized
aagtttacaaccaaccatgg

SEQ ID NO: 235171 - DNA, 20 bp, Artificial Sequence
  chemically synthesized
cctttgccttccaccatggt

SEQ ID NO: 235172 - DNA, 20 bp, Artificial Sequence
  chemically synthesized
tttacaaccaaccatggtgg

SEQ ID NO: 235173 - DNA, 20 bp, Artificial Sequence
  chemically synthesized
ttacaaccaaccatggtgga

SEQ ID NO: 235174 - DNA, 20 bp, Artificial Sequence
  chemically synthesized
ctcccctttgccttccacca

SEQ ID NO: 235175 - DNA, 20 bp, Artificial Sequence
  chemically synthesized
accaaccatggtggaaggca

SEQ ID NO: 235176 - DNA, 20 bp, Artificial Sequence
  chemically synthesized
ccaaccatggtggaaggcaa

SEQ ID NO: 235177 - DNA, 20 bp, Artificial Sequence
  chemically synthesized
caaccatggtggaaggcaaa

SEQ ID NO: 235178 - DNA, 20 bp, Artificial Sequence
  chemically synthesized
aaccatggtggaaggcaaag

SEQ ID NO: 235179 - DNA, 20 bp, Artificial Sequence
  chemically synthesized
ccatggtggaaggcaaaggg

SEQ ID NO: 235180 - DNA, 20 bp, Artificial Sequence
  chemically synthesized
atggtggaaggcaaagggga

SEQ ID NO: 235181 - DNA, 20 bp, Artificial Sequence
  chemically synthesized
gtggaaggcaaaggggagag

SEQ ID NO: 235182 - DNA, 20 bp, Artificial Sequence
  chemically synthesized
tggaaggcaaaggggagagc

SEQ ID NO: 235183 - DNA, 20 bp, Artificial Sequence
  chemically synthesized
gcaaaggggagagcaggaaa

SEQ ID NO: 235184 - DNA, 20 bp, Artificial Sequence
  chemically synthesized
caaaggggagagcaggaaac

SEQ ID NO: 235185 - DNA, 20 bp, Artificial Sequence
  chemically synthesized
aggggagagcaggaaacagg

SEQ ID NO: 235186 - DNA, 20 bp, Artificial Sequence
  chemically synthesized
ggggagagcaggaaacaggt

SEQ ID NO: 235187 - DNA, 20 bp, Artificial Sequence
  chemically synthesized
gggagagcaggaaacaggtg

SEQ ID NO: 235188 - DNA, 20 bp, Artificial Sequence
  chemically synthesized
ggagagcaggaaacaggtgg

SEQ ID NO: 235189 - DNA, 20 bp, Artificial Sequence
  chemically synthesized
gcaggaaacaggtgggggtt

SEQ ID NO: 235190 - DNA, 20 bp, Artificial Sequence
  chemically synthesized
caggaaacaggtgggggttg

SEQ ID NO: 235191 - DNA, 20 bp, Artificial Sequence
  chemically synthesized
gtggttgtttaaaagagtat

SEQ ID NO: 235192 - DNA, 20 bp, Artificial Sequence
  chemically synthesized
ctatatgtggttgtttaaaa

SEQ ID NO: 235193 - DNA, 20 bp, Artificial Sequence
  chemically synthesized
tgctatatgtggttgtttaa

SEQ ID NO: 235194 - DNA, 20 bp, Artificial Sequence
  chemically synthesized
ctcttttaaacaaccacata

SEQ ID NO: 235195 - DNA, 20 bp, Artificial Sequence
  chemically synthesized
aagttagttcatgctatatg

SEQ ID NO: 235196 - DNA, 20 bp, Artificial Sequence
  chemically synthesized
tgatccctttggtgacaagt

SEQ ID NO: 235197 - DNA, 20 bp, Artificial Sequence
  chemically synthesized
catgaactaacttgtcacca

SEQ ID NO: 235198 - DNA, 20 bp, Artificial Sequence
  chemically synthesized
tgaatgatccctttggtgac

SEQ ID NO: 235199 - DNA, 20 bp, Artificial Sequence
  chemically synthesized
atgaactaacttgtcaccaa

SEQ ID NO: 235200 - DNA, 20 bp, Artificial Sequence
  chemically synthesized
tgaactaacttgtcaccaaa

SEQ ID NO: 235201 - DNA, 20 bp, Artificial Sequence
  chemically synthesized
tccttcatgaatgatccctt

SEQ ID NO: 235202 - DNA, 20 bp, Artificial Sequence
  chemically synthesized
caccaaagggatcattcatg

SEQ ID NO: 235203 - DNA, 20 bp, Artificial Sequence
  chemically synthesized
accaaagggatcattcatga

SEQ ID NO: 235204 - DNA, 20 bp, Artificial Sequence
  chemically synthesized
gtgtgattggatcatgtggg

SEQ ID NO: 235205 - DNA, 20 bp, Artificial Sequence
  chemically synthesized
taggtgtgattggatcatgt

SEQ ID NO: 235206 - DNA, 20 bp, Artificial Sequence
  chemically synthesized
gtaggtgtgattggatcatg

SEQ ID NO: 235207 - DNA, 20 bp, Artificial Sequence
  chemically synthesized
cagggcctggtaggtgtgat

SEQ ID NO: 235208 - DNA, 20 bp, Artificial Sequence
  chemically synthesized
catgatccaatcacacctac

SEQ ID NO: 235209 - DNA, 20 bp, Artificial Sequence
  chemically synthesized
atgatccaatcacacctacc

SEQ ID NO: 235210 - DNA, 20 bp, Artificial Sequence
  chemically synthesized
tgttggaggcagggcctggt

SEQ ID NO: 235211 - DNA, 20 bp, Artificial Sequence
  chemically synthesized
atgttggaggcagggcctgg

SEQ ID NO: 235212 - DNA, 20 bp, Artificial Sequence
  chemically synthesized
ccaatgttggaggcagggcc

SEQ ID NO: 235213 - DNA, 20 bp, Artificial Sequence
  chemically synthesized
gatttccaatgttggaggca

SEQ ID NO: 235214 - DNA, 20 bp, Artificial Sequence
  chemically synthesized
tgatttccaatgttggaggc

SEQ ID NO: 235215 - DNA, 20 bp, Artificial Sequence
  chemically synthesized
gtgatttccaatgttggagg

SEQ ID NO: 235216 - DNA, 20 bp, Artificial Sequence
  chemically synthesized
ccaggccctgcctccaacat

SEQ ID NO: 235217 - DNA, 20 bp, Artificial Sequence
  chemically synthesized
aatgtgatttccaatgttgg

SEQ ID NO: 235218 - DNA, 20 bp, Artificial Sequence
  chemically synthesized
aaatgtgatttccaatgttg

SEQ ID NO: 235219 - DNA, 20 bp, Artificial Sequence
  chemically synthesized
tgaaatgtgatttccaatgt

SEQ ID NO: 235220 - DNA, 20 bp, Artificial Sequence
  chemically synthesized
tggaaatcacatttcaatat

SEQ ID NO: 235221 - DNA, 20 bp, Artificial Sequence
  chemically synthesized
tcacatttcaatataagatt

SEQ ID NO: 235222 - DNA, 20 bp, Artificial Sequence
  chemically synthesized
acatttcaatataagattcg

SEQ ID NO: 235223 - DNA, 20 bp, Artificial Sequence
  chemically synthesized
catttcaatataagattcgg

SEQ ID NO: 235224 - DNA, 20 bp, Artificial Sequence
  chemically synthesized
ttcggaggtgataaacatcc

SEQ ID NO: 235225 - DNA, 20 bp, Artificial Sequence
  chemically synthesized
agagagagagagagatggct

SEQ ID NO: 235226 - DNA, 20 bp, Artificial Sequence
  chemically synthesized
gagagagagagagagagaga

SEQ ID NO: 235227 - DNA, 20 bp, Artificial Sequence
  chemically synthesized
gagagagagagagagagaga

SEQ ID NO: 235228 - DNA, 20 bp, Artificial Sequence
  chemically synthesized
gagagagagagagagagaga

SEQ ID NO: 235229 - DNA, 20 bp, Artificial Sequence
  chemically synthesized
gagagagagagagagagaga

SEQ ID NO: 235230 - DNA, 20 bp, Artificial Sequence
  chemically synthesized
gagagagagagagagagaga

SEQ ID NO: 235231 - DNA, 20 bp, Artificial Sequence
  chemically synthesized
gtgagagagagagagagaga

SEQ ID NO: 235232 - DNA, 20 bp, Artificial Sequence
  chemically synthesized
atgtgagagagagagagaga

SEQ ID NO: 235233 - DNA, 20 bp, Artificial Sequence
  chemically synthesized
gtatgtgagagagagagaga

SEQ ID NO: 235234 - DNA, 20 bp, Artificial Sequence
  chemically synthesized
gtgtatgtgagagagagaga

SEQ ID NO: 235235 - DNA, 20 bp, Artificial Sequence
  chemically synthesized
gtgtgtatgtgagagagaga

SEQ ID NO: 235236 - DNA, 20 bp, Artificial Sequence
  chemically synthesized
gtgtgtgtatgtgagagaga

SEQ ID NO: 235237 - DNA, 20 bp, Artificial Sequence
  chemically synthesized
gtgtgtgtgtatgtgagaga

SEQ ID NO: 235238 - DNA, 20 bp, Artificial Sequence
  chemically synthesized
gtgtgtgtgtgtatgtgaga

SEQ ID NO: 235239 - DNA, 20 bp, Artificial Sequence
  chemically synthesized
gtgtgtgtgtgtgtatgtga

SEQ ID NO: 235240 - DNA, 20 bp, Artificial Sequence
  chemically synthesized
gtgtgtgtgtgtgtgtatgt

SEQ ID NO: 235241 - DNA, 20 bp, Artificial Sequence
  chemically synthesized
aattgcgactgtgtgtgtgt

SEQ ID NO: 235242 - DNA, 20 bp, Artificial Sequence
  chemically synthesized
taattgcgactgtgtgtgtg

SEQ ID NO: 235243 - DNA, 20 bp, Artificial Sequence
  chemically synthesized
cacacacacccacacacaca

SEQ ID NO: 235244 - DNA, 20 bp, Artificial Sequence
  chemically synthesized
catcacaaatagatgtttca

SEQ ID NO: 235245 - DNA, 20 bp, Artificial Sequence
  chemically synthesized
atatcagcattcatcacaaa

SEQ ID NO: 235246 - DNA, 20 bp, Artificial Sequence
  chemically synthesized
tgaaacaaaatagaaaatat

SEQ ID NO: 235247 - DNA, 20 bp, Artificial Sequence
  chemically synthesized
tgatttttagtgaaacaaaa

SEQ ID NO: 235248 - DNA, 20 bp, Artificial Sequence
  chemically synthesized
ttttgtttcactaaaaatca

SEQ ID NO: 235249 - DNA, 20 bp, Artificial Sequence
  chemically synthesized
caacaccggcctttgatttt

SEQ ID NO: 235250 - DNA, 20 bp, Artificial Sequence
  chemically synthesized
tttgtttcactaaaaatcaa

SEQ ID NO: 235251 - DNA, 20 bp, Artificial Sequence
  chemically synthesized
tttcactaaaaatcaaaggc

SEQ ID NO: 235252 - DNA, 20 bp, Artificial Sequence
  chemically synthesized
ctcagtttgtggatcaacac

SEQ ID NO: 235253 - DNA, 20 bp, Artificial Sequence
  chemically synthesized
ccggtgttgatccacaaact

SEQ ID NO: 235254 - DNA, 20 bp, Artificial Sequence
  chemically synthesized
tgaatcataaactcagtttg

SEQ ID NO: 235255 - DNA, 20 bp, Artificial Sequence
  chemically synthesized
caaactgtgaatcataaact

SEQ ID NO: 235256 - DNA, 20 bp, Artificial Sequence
  chemically synthesized
caaactgagtttatgattca

SEQ ID NO: 235257 - DNA, 20 bp, Artificial Sequence
  chemically synthesized
tgagtttatgattcacagtt

SEQ ID NO: 235258 - DNA, 20 bp, Artificial Sequence
  chemically synthesized
acagtttggacaatgaacac

SEQ ID NO: 235259 - DNA, 20 bp, Artificial Sequence
  chemically synthesized
gacaatgaacactagcatac

SEQ ID NO: 235260 - DNA, 20 bp, Artificial Sequence
  chemically synthesized
attttttaaatctagtatgc

SEQ ID NO: 235261 - DNA, 20 bp, Artificial Sequence
  chemically synthesized
ttaatttcattttttaaatc

SEQ ID NO: 235262 - DNA, 20 bp, Artificial Sequence
  chemically synthesized
ttttattgttggttttgttt

SEQ ID NO: 235263 - DNA, 20 bp, Artificial Sequence
  chemically synthesized
gacattttttattttattgt

SEQ ID NO: 235264 - DNA, 20 bp, Artificial Sequence
  chemically synthesized
aataaaataaaaaatgtcct

SEQ ID NO: 235265 - DNA, 20 bp, Artificial Sequence
  chemically synthesized
aatggcacaaaataatgctg

SEQ ID NO: 235266 - DNA, 20 bp, Artificial Sequence
  chemically synthesized
aaatggcacaaaataatgct

SEQ ID NO: 235267 - DNA, 20 bp, Artificial Sequence
  chemically synthesized
gttggatgcatggaaagaaa

SEQ ID NO: 235268 - DNA, 20 bp, Artificial Sequence
  chemically synthesized
aagcgtgttggatgcatgga

SEQ ID NO: 235269 - DNA, 20 bp, Artificial Sequence
  chemically synthesized
tggtaagcgtgttggatgca

SEQ ID NO: 235270 - DNA, 20 bp, Artificial Sequence
  chemically synthesized
ggaactcttggtaagcgtgt

SEQ ID NO: 235271 - DNA, 20 bp, Artificial Sequence
  chemically synthesized
atgcatccaacacgcttacc

SEQ ID NO: 235272 - DNA, 20 bp, Artificial Sequence
  chemically synthesized
gcatccaacacgcttaccaa

SEQ ID NO: 235273 - DNA, 20 bp, Artificial Sequence
  chemically synthesized
agatgagaggaactcttggt

SEQ ID NO: 235274 - DNA, 20 bp, Artificial Sequence
  chemically synthesized
gacaagatgagaggaactct

SEQ ID NO: 235275 - DNA, 20 bp, Artificial Sequence
  chemically synthesized
tatgataatgacaagatgag

SEQ ID NO: 235276 - DNA, 20 bp, Artificial Sequence
  chemically synthesized
gtatgataatgacaagatga

SEQ ID NO: 235277 - DNA, 20 bp, Artificial Sequence
  chemically synthesized
tggtatgataatgacaagat

SEQ ID NO: 235278 - DNA, 20 bp, Artificial Sequence
  chemically synthesized
acttgtggtatgataatgac

SEQ ID NO: 235279 - DNA, 20 bp, Artificial Sequence
  chemically synthesized
tcttgtcattatcataccac

SEQ ID NO: 235280 - DNA, 20 bp, Artificial Sequence
  chemically synthesized
gatggtgtcagaaaaacttg

SEQ ID NO: 235281 - DNA, 20 bp, Artificial Sequence
  chemically synthesized
aagttgaaaagtgatggtgt

SEQ ID NO: 235282 - DNA, 20 bp, Artificial Sequence
  chemically synthesized
gagaaaaagttgaaaagtga

SEQ ID NO: 235283 - DNA, 20 bp, Artificial Sequence
  chemically synthesized
gaaaatgagaaaaagttgaa

SEQ ID NO: 235284 - DNA, 20 bp, Artificial Sequence
  chemically synthesized
aaatccatgaaaatgagaaa

SEQ ID NO: 235285 - DNA, 20 bp, Artificial Sequence
  chemically synthesized
tcaactttttctcattttca

SEQ ID NO: 235286 - DNA, 20 bp, Artificial Sequence
  chemically synthesized
aattgtaaatccatgaaaat

SEQ ID NO: 235287 - DNA, 20 bp, Artificial Sequence
  chemically synthesized
agcgatatgaaaataaggga

SEQ ID NO: 235288 - DNA, 20 bp, Artificial Sequence
  chemically synthesized
agagcgatatgaaaataagg

SEQ ID NO: 235289 - DNA, 20 bp, Artificial Sequence
  chemically synthesized
agagagcgatatgaaaataa

SEQ ID NO: 235290 - DNA, 20 bp, Artificial Sequence
  chemically synthesized
gagagagcgatatgaaaata

SEQ ID NO: 235291 - DNA, 20 bp, Artificial Sequence
  chemically synthesized
agagagagcgatatgaaaat

SEQ ID NO: 235292 - DNA, 20 bp, Artificial Sequence
  chemically synthesized
ttgggaaagcttcatagaga

SEQ ID NO: 235293 - DNA, 20 bp, Artificial Sequence
  chemically synthesized
ttcatatcgctctctctatg

SEQ ID NO: 235294 - DNA, 20 bp, Artificial Sequence
  chemically synthesized
aattgggaaagcttcataga

SEQ ID NO: 235295 - DNA, 20 bp, Artificial Sequence
  chemically synthesized
agaattgggaaagcttcata

SEQ ID NO: 235296 - DNA, 20 bp, Artificial Sequence
  chemically synthesized
gaagaattgggaaagcttca

SEQ ID NO: 235297 - DNA, 20 bp, Artificial Sequence
  chemically synthesized
actagccagaagaattggga

SEQ ID NO: 235298 - DNA, 20 bp, Artificial Sequence
  chemically synthesized
agtaactagccagaagaatt

SEQ ID NO: 235299 - DNA, 20 bp, Artificial Sequence
  chemically synthesized
tgaagctttcccaattcttc

SEQ ID NO: 235300 - DNA, 20 bp, Artificial Sequence
  chemically synthesized
gagtaactagccagaagaat

SEQ ID NO: 235301 - DNA, 20 bp, Artificial Sequence
  chemically synthesized
gctttcccaattcttctggc

SEQ ID NO: 235302 - DNA, 20 bp, Artificial Sequence
  chemically synthesized
cccaaagagtaactagccag

SEQ ID NO: 235303 - DNA, 20 bp, Artificial Sequence
  chemically synthesized
caacccaaagagtaactagc

SEQ ID NO: 235304 - DNA, 20 bp, Artificial Sequence
  chemically synthesized
gaggcaacccaaagagtaac

SEQ ID NO: 235305 - DNA, 20 bp, Artificial Sequence
  chemically synthesized
tcttctggctagttactctt

SEQ ID NO: 235306 - DNA, 20 bp, Artificial Sequence
  chemically synthesized
cttctggctagttactcttt

SEQ ID NO: 235307 - DNA, 20 bp, Artificial Sequence
  chemically synthesized
cagagcagaggcaacccaaa

SEQ ID NO: 235308 - DNA, 20 bp, Artificial Sequence
  chemically synthesized
gtcagagcagaggcaaccca

SEQ ID NO: 235309 - DNA, 20 bp, Artificial Sequence
  chemically synthesized
ccattgatgagtcagagcag

SEQ ID NO: 235310 - DNA, 20 bp, Artificial Sequence
  chemically synthesized
accattgatgagtcagagca

SEQ ID NO: 235311 - DNA, 20 bp, Artificial Sequence
  chemically synthesized
acaccattgatgagtcagag

SEQ ID NO: 235312 - DNA, 20 bp, Artificial Sequence
  chemically synthesized
ggtacaccattgatgagtca

SEQ ID NO: 235313 - DNA, 20 bp, Artificial Sequence
  chemically synthesized
tcggtacaccattgatgagt

SEQ ID NO: 235314 - DNA, 20 bp, Artificial Sequence
  chemically synthesized
cctctgctctgactcatcaa

SEQ ID NO: 235315 - DNA, 20 bp, Artificial Sequence
  chemically synthesized
gaggtcggtacaccattgat

SEQ ID NO: 235316 - DNA, 20 bp, Artificial Sequence
  chemically synthesized
ctaatagatataatagaggt

SEQ ID NO: 235317 - DNA, 20 bp, Artificial Sequence
  chemically synthesized
gcatctaatagatataatag

SEQ ID NO: 235318 - DNA, 20 bp, Artificial Sequence
  chemically synthesized
agcatctaatagatataata

SEQ ID NO: 235319 - DNA, 20 bp, Artificial Sequence
  chemically synthesized
atagcatctaatagatataa

SEQ ID NO: 235320 - DNA, 20 bp, Artificial Sequence
  chemically synthesized
ccgacctctattatatctat

SEQ ID NO: 235321 - DNA, 20 bp, Artificial Sequence
  chemically synthesized
gccataaaaatagcatctaa

SEQ ID NO: 235322 - DNA, 20 bp, Artificial Sequence
  chemically synthesized
tctattagatgctattttta

SEQ ID NO: 235323 - DNA, 20 bp, Artificial Sequence
  chemically synthesized
ggacatttaagccataaaaa

SEQ ID NO: 235324 - DNA, 20 bp, Artificial Sequence
  chemically synthesized
taattagcaaatggacattt

SEQ ID NO: 235325 - DNA, 20 bp, Artificial Sequence
  chemically synthesized
taagtggtataattagcaaa

SEQ ID NO: 235326 - DNA, 20 bp, Artificial Sequence
  chemically synthesized
aaacatttaagtggtataat

SEQ ID NO: 235327 - DNA, 20 bp, Artificial Sequence
  chemically synthesized
aaacaattgaaacatttaag

SEQ ID NO: 235328 - DNA, 20 bp, Artificial Sequence
  chemically synthesized
tttaaacaattgaaacattt

SEQ ID NO: 235329 - DNA, 20 bp, Artificial Sequence
  chemically synthesized
gtttaaatgtccatcaattt

SEQ ID NO: 235330 - DNA, 20 bp, Artificial Sequence
  chemically synthesized
ccaaggtttgctgaaattga

SEQ ID NO: 235331 - DNA, 20 bp, Artificial Sequence
  chemically synthesized
ccatcaatttcagcaaacct

SEQ ID NO: 235332 - DNA, 20 bp, Artificial Sequence
  chemically synthesized
acctattcacatataatcca

SEQ ID NO: 235333 - DNA, 20 bp, Artificial Sequence
  chemically synthesized
aacctattcacatataatcc

SEQ ID NO: 235334 - DNA, 20 bp, Artificial Sequence
  chemically synthesized
aaccttggattatatgtgaa

SEQ ID NO: 235335 - DNA, 20 bp, Artificial Sequence
  chemically synthesized
accttggattatatgtgaat

SEQ ID NO: 235336 - DNA, 20 bp, Artificial Sequence
  chemically synthesized
tggattatatgtgaataggt

SEQ ID NO: 235337 - DNA, 20 bp, Artificial Sequence
  chemically synthesized
ggattatatgtgaataggtt

SEQ ID NO: 235338 - DNA, 20 bp, Artificial Sequence
  chemically synthesized
tgtatcaatttcaatatcct

SEQ ID NO: 235339 - DNA, 20 bp, Artificial Sequence
  chemically synthesized
atttcaatatcctgagcacc

SEQ ID NO: 235340 - DNA, 20 bp, Artificial Sequence
  chemically synthesized
aggctctatgctaggtgctc

SEQ ID NO: 235341 - DNA, 20 bp, Artificial Sequence
  chemically synthesized
caggctctatgctaggtgct

SEQ ID NO: 235342 - DNA, 20 bp, Artificial Sequence
  chemically synthesized
aatatcctgagcacctagca

SEQ ID NO: 235343 - DNA, 20 bp, Artificial Sequence
  chemically synthesized
tatcctgagcacctagcata

SEQ ID NO: 235344 - DNA, 20 bp, Artificial Sequence
  chemically synthesized
tctgtgtcaggctctatgct

SEQ ID NO: 235345 - DNA, 20 bp, Artificial Sequence
  chemically synthesized
ctctgtgtcaggctctatgc

SEQ ID NO: 235346 - DNA, 20 bp, Artificial Sequence
  chemically synthesized
acctagcatagagcctgaca

SEQ ID NO: 235347 - DNA, 20 bp, Artificial Sequence
  chemically synthesized
ctagcatagagcctgacaca

SEQ ID NO: 235348 - DNA, 20 bp, Artificial Sequence
  chemically synthesized
ttttggagctgctctgtgtc

SEQ ID NO: 235349 - DNA, 20 bp, Artificial Sequence
  chemically synthesized
cttttggagctgctctgtgt

SEQ ID NO: 235350 - DNA, 20 bp, Artificial Sequence
  chemically synthesized
gcatagagcctgacacagag

SEQ ID NO: 235351 - DNA, 20 bp, Artificial Sequence
  chemically synthesized
ctgacacagagcagctccaa

SEQ ID NO: 235352 - DNA, 20 bp, Artificial Sequence
  chemically synthesized
tcagaaaacttttacttttg

SEQ ID NO: 235353 - DNA, 20 bp, Artificial Sequence
  chemically synthesized
cagagcagctccaaaagtaa

SEQ ID NO: 235354 - DNA, 20 bp, Artificial Sequence
  chemically synthesized
attcagaaaacttttacttt

SEQ ID NO: 235355 - DNA, 20 bp, Artificial Sequence
  chemically synthesized
ttaacatcaacacatttatt

SEQ ID NO: 235356 - DNA, 20 bp, Artificial Sequence
  chemically synthesized
gaataaatgtgttgatgtta

SEQ ID NO: 235357 - DNA, 20 bp, Artificial Sequence
  chemically synthesized
aataaatgtgttgatgttaa

SEQ ID NO: 235358 - DNA, 20 bp, Artificial Sequence
  chemically synthesized
aatgtgttgatgttaaaggt

SEQ ID NO: 235359 - DNA, 20 bp, Artificial Sequence
  chemically synthesized
atgtgttgatgttaaaggtt

SEQ ID NO: 235360 - DNA, 20 bp, Artificial Sequence
  chemically synthesized
gttaaaggttaggtgaaatg

SEQ ID NO: 235361 - DNA, 20 bp, Artificial Sequence
  chemically synthesized
taaaggttaggtgaaatgta

SEQ ID NO: 235362 - DNA, 20 bp, Artificial Sequence
  chemically synthesized
aggttaggtgaaatgtagag

SEQ ID NO: 235363 - DNA, 20 bp, Artificial Sequence
  chemically synthesized
tgaaatgtagagaagtgtca

SEQ ID NO: 235364 - DNA, 20 bp, Artificial Sequence
  chemically synthesized
agagaagtgtcaaagtacac

SEQ ID NO: 235365 - DNA, 20 bp, Artificial Sequence
  chemically synthesized
gtcaaagtacacaagatgtt

SEQ ID NO: 235366 - DNA, 20 bp, Artificial Sequence
  chemically synthesized
tcaaagtacacaagatgttc

SEQ ID NO: 235367 - DNA, 20 bp, Artificial Sequence
  chemically synthesized
acaagatgttcaggttttct

SEQ ID NO: 235368 - DNA, 20 bp, Artificial Sequence
  chemically synthesized
tgttcaggttttctaagata

SEQ ID NO: 235369 - DNA, 20 bp, Artificial Sequence
  chemically synthesized
gttcaggttttctaagataa

SEQ ID NO: 235370 - DNA, 20 bp, Artificial Sequence
  chemically synthesized
cagggagattacctttatct

SEQ ID NO: 235371 - DNA, 20 bp, Artificial Sequence
  chemically synthesized
taagataaaggtaatctccc

SEQ ID NO: 235372 - DNA, 20 bp, Artificial Sequence
  chemically synthesized
caggacagaatcacaccagg

SEQ ID NO: 235373 - DNA, 20 bp, Artificial Sequence
  chemically synthesized
tgcaggacagaatcacacca

SEQ ID NO: 235374 - DNA, 20 bp, Artificial Sequence
  chemically synthesized
gtgcaggacagaatcacacc

SEQ ID NO: 235375 - DNA, 20 bp, Artificial Sequence
  chemically synthesized
tgtgcaggacagaatcacac

SEQ ID NO: 235376 - DNA, 20 bp, Artificial Sequence
  chemically synthesized
tggtgtgattctgtcctgca

SEQ ID NO: 235377 - DNA, 20 bp, Artificial Sequence
  chemically synthesized
aagagaacagctgtgcagga

SEQ ID NO: 235378 - DNA, 20 bp, Artificial Sequence
  chemically synthesized
gctcaagagaacagctgtgc

SEQ ID NO: 235379 - DNA, 20 bp, Artificial Sequence
  chemically synthesized
tgctcaagagaacagctgtg

SEQ ID NO: 235380 - DNA, 20 bp, Artificial Sequence
  chemically synthesized
tcctgcacagctgttctctt

SEQ ID NO: 235381 - DNA, 20 bp, Artificial Sequence
  chemically synthesized
aggaccactgctcaagagaa

SEQ ID NO: 235382 - DNA, 20 bp, Artificial Sequence
  chemically synthesized
tgcacagctgttctcttgag

SEQ ID NO: 235383 - DNA, 20 bp, Artificial Sequence
  chemically synthesized
gataaaggaccactgctcaa

SEQ ID NO: 235384 - DNA, 20 bp, Artificial Sequence
  chemically synthesized
acagctgttctcttgagcag

SEQ ID NO: 235385 - DNA, 20 bp, Artificial Sequence
  chemically synthesized
atgataaaggaccactgctc

SEQ ID NO: 235386 - DNA, 20 bp, Artificial Sequence
  chemically synthesized
gagaaggcagatgatgataa

SEQ ID NO: 235387 - DNA, 20 bp, Artificial Sequence
  chemically synthesized
agagaaggcagatgatgata

SEQ ID NO: 235388 - DNA, 20 bp, Artificial Sequence
  chemically synthesized
cacttaggtgggagagaagg

SEQ ID NO: 235389 - DNA, 20 bp, Artificial Sequence
  chemically synthesized
acgcacttaggtgggagaga

SEQ ID NO: 235390 - DNA, 20 bp, Artificial Sequence
  chemically synthesized
gacgcacttaggtgggagag

SEQ ID NO: 235391 - DNA, 20 bp, Artificial Sequence
  chemically synthesized
caggacgcacttaggtggga

SEQ ID NO: 235392 - DNA, 20 bp, Artificial Sequence
  chemically synthesized
atctgccttctctcccacct

SEQ ID NO: 235393 - DNA, 20 bp, Artificial Sequence
  chemically synthesized
ggcaggacgcacttaggtgg

SEQ ID NO: 235394 - DNA, 20 bp, Artificial Sequence
  chemically synthesized
gtggcaggacgcacttaggt

SEQ ID NO: 235395 - DNA, 20 bp, Artificial Sequence
  chemically synthesized
ggtggcaggacgcacttagg

SEQ ID NO: 235396 - DNA, 20 bp, Artificial Sequence
  chemically synthesized
tcaggtggcaggacgcactt

SEQ ID NO: 235397 - DNA, 20 bp, Artificial Sequence
  chemically synthesized
atcaggtggcaggacgcact

SEQ ID NO: 235398 - DNA, 20 bp, Artificial Sequence
  chemically synthesized
atcatcgtccatcaggtggc

SEQ ID NO: 235399 - DNA, 20 bp, Artificial Sequence
  chemically synthesized
catcatcgtccatcaggtgg

SEQ ID NO: 235400 - DNA, 20 bp, Artificial Sequence
  chemically synthesized
aagtgcgtcctgccacctga

SEQ ID NO: 235401 - DNA, 20 bp, Artificial Sequence
  chemically synthesized
gtccatcatcgtccatcagg

SEQ ID NO: 235402 - DNA, 20 bp, Artificial Sequence
  chemically synthesized
catgtccatcatcgtccatc

SEQ ID NO: 235403 - DNA, 20 bp, Artificial Sequence
  chemically synthesized
tcatgtccatcatcgtccat

SEQ ID NO: 235404 - DNA, 20 bp, Artificial Sequence
  chemically synthesized
tgccacctgatggacgatga

SEQ ID NO: 235405 - DNA, 20 bp, Artificial Sequence
  chemically synthesized
tgatggacgatgatggacat

SEQ ID NO: 235406 - DNA, 20 bp, Artificial Sequence
  chemically synthesized
atgatggacatgagtcctct

SEQ ID NO: 235407 - DNA, 20 bp, Artificial Sequence
  chemically synthesized
tgatggacatgagtcctctg

SEQ ID NO: 235408 - DNA, 20 bp, Artificial Sequence
  chemically synthesized
agatagttttggggcctcag

SEQ ID NO: 235409 - DNA, 20 bp, Artificial Sequence
  chemically synthesized
aagatagttttggggcctca

SEQ ID NO: 235410 - DNA, 20 bp, Artificial Sequence
  chemically synthesized
aaaagatagttttggggcct

SEQ ID NO: 235411 - DNA, 20 bp, Artificial Sequence
  chemically synthesized
caaccaaaaagatagttttg

SEQ ID NO: 235412 - DNA, 20 bp, Artificial Sequence
  chemically synthesized
acaaccaaaaagatagtttt

SEQ ID NO: 235413 - DNA, 20 bp, Artificial Sequence
  chemically synthesized
cacaaccaaaaagatagttt

SEQ ID NO: 235414 - DNA, 20 bp, Artificial Sequence
  chemically synthesized
aggccccaaaactatctttt

SEQ ID NO: 235415 - DNA, 20 bp, Artificial Sequence
  chemically synthesized
ttagttcacaaccaaaaaga

SEQ ID NO: 235416 - DNA, 20 bp, Artificial Sequence
  chemically synthesized
gcctttagttcacaaccaaa

SEQ ID NO: 235417 - DNA, 20 bp, Artificial Sequence
  chemically synthesized
atctttttggttgtgaacta

SEQ ID NO: 235418 - DNA, 20 bp, Artificial Sequence
  chemically synthesized
tctttttggttgtgaactaa

SEQ ID NO: 235419 - DNA, 20 bp, Artificial Sequence
  chemically synthesized
tgatcatctttgtcggcctt

SEQ ID NO: 235420 - DNA, 20 bp, Artificial Sequence
  chemically synthesized
ttgtgaactaaaggccgaca

SEQ ID NO: 235421 - DNA, 20 bp, Artificial Sequence
  chemically synthesized
cttaaagtgatcatctttgt

SEQ ID NO: 235422 - DNA, 20 bp, Artificial Sequence
  chemically synthesized
ccgacaaagatgatcacttt

SEQ ID NO: 235423 - DNA, 20 bp, Artificial Sequence
  chemically synthesized
cgacaaagatgatcacttta

SEQ ID NO: 235424 - DNA, 20 bp, Artificial Sequence
  chemically synthesized
caaagatgatcactttaagg

SEQ ID NO: 235425 - DNA, 20 bp, Artificial Sequence
  chemically synthesized
tttcattattatccacctta

SEQ ID NO: 235426 - DNA, 20 bp, Artificial Sequence
  chemically synthesized
aggtggataataatgaaatt

SEQ ID NO: 235427 - DNA, 20 bp, Artificial Sequence
  chemically synthesized
ataataatgaaattgagcaa

SEQ ID NO: 235428 - DNA, 20 bp, Artificial Sequence
  chemically synthesized
attgagcaacagttatcttt

SEQ ID NO: 235429 - DNA, 20 bp, Artificial Sequence
  chemically synthesized
gcaacagttatctttaagaa

SEQ ID NO: 235430 - DNA, 20 bp, Artificial Sequence
  chemically synthesized
ccctaaactgaccgttctta

SEQ ID NO: 235431 - DNA, 20 bp, Artificial Sequence
  chemically synthesized
cagttatctttaagaacggt

SEQ ID NO: 235432 - DNA, 20 bp, Artificial Sequence
  chemically synthesized
atctttaagaacggtcagtt

SEQ ID NO: 235433 - DNA, 20 bp, Artificial Sequence
  chemically synthesized
tctttaagaacggtcagttt

SEQ ID NO: 235434 - DNA, 20 bp, Artificial Sequence
  chemically synthesized
ctttaagaacggtcagttta

SEQ ID NO: 235435 - DNA, 20 bp, Artificial Sequence
  chemically synthesized
tttaagaacggtcagtttag

SEQ ID NO: 235436 - DNA, 20 bp, Artificial Sequence
  chemically synthesized
agaacggtcagtttaggggc

SEQ ID NO: 235437 - DNA, 20 bp, Artificial Sequence
  chemically synthesized
gaacggtcagtttaggggct

SEQ ID NO: 235438 - DNA, 20 bp, Artificial Sequence
  chemically synthesized
aacggtcagtttaggggctg

SEQ ID NO: 235439 - DNA, 20 bp, Artificial Sequence
  chemically synthesized
tcagtttaggggctggggca

SEQ ID NO: 235440 - DNA, 20 bp, Artificial Sequence
  chemically synthesized
cagtttaggggctggggcaa

SEQ ID NO: 235441 - DNA, 20 bp, Artificial Sequence
  chemically synthesized
gtgcaatttatcctttgccc

SEQ ID NO: 235442 - DNA, 20 bp, Artificial Sequence
  chemically synthesized
ggataaattgcacattgttg

SEQ ID NO: 235443 - DNA, 20 bp, Artificial Sequence
  chemically synthesized
taaattgcacattgttgaag

SEQ ID NO: 235444 - DNA, 20 bp, Artificial Sequence
  chemically synthesized
aattgcacattgttgaagca

SEQ ID NO: 235445 - DNA, 20 bp, Artificial Sequence
  chemically synthesized
attgcacattgttgaagcag

SEQ ID NO: 235446 - DNA, 20 bp, Artificial Sequence
  chemically synthesized
attgttgaagcagaggcaat

SEQ ID NO: 235447 - DNA, 20 bp, Artificial Sequence
  chemically synthesized
agcagaggcaatgagttaca

SEQ ID NO: 235448 - DNA, 20 bp, Artificial Sequence
  chemically synthesized
gcagaggcaatgagttacaa

SEQ ID NO: 235449 - DNA, 20 bp, Artificial Sequence
  chemically synthesized
gaggcaatgagttacaaagg

SEQ ID NO: 235450 - DNA, 20 bp, Artificial Sequence
  chemically synthesized
ttacaaaggcagtccaatta

SEQ ID NO: 235451 - DNA, 20 bp, Artificial Sequence
  chemically synthesized
gctgccagtgttactttaat

SEQ ID NO: 235452 - DNA, 20 bp, Artificial Sequence
  chemically synthesized
cagtccaattaaagtaacac

SEQ ID NO: 235453 - DNA, 20 bp, Artificial Sequence
  chemically synthesized
tccaattaaagtaacactgg

SEQ ID NO: 235454 - DNA, 20 bp, Artificial Sequence
  chemically synthesized
acagacattttcaaagctgc

SEQ ID NO: 235455 - DNA, 20 bp, Artificial Sequence
  chemically synthesized
gggctgtacagacattttca

SEQ ID NO: 235456 - DNA, 20 bp, Artificial Sequence
  chemically synthesized
cagctttgaaaatgtctgta

SEQ ID NO: 235457 - DNA, 20 bp, Artificial Sequence
  chemically synthesized
aagggaaaccatgggctgta

SEQ ID NO: 235458 - DNA, 20 bp, Artificial Sequence
  chemically synthesized
gaaaatgtctgtacagccca

SEQ ID NO: 235459 - DNA, 20 bp, Artificial Sequence
  chemically synthesized
aagccctcaagggaaaccat

SEQ ID NO: 235460 - DNA, 20 bp, Artificial Sequence
  chemically synthesized
aaagccctcaagggaaacca

SEQ ID NO: 235461 - DNA, 20 bp, Artificial Sequence
  chemically synthesized
tacagcccatggtttccctt

SEQ ID NO: 235462 - DNA, 20 bp, Artificial Sequence
  chemically synthesized
acagcccatggtttcccttg

SEQ ID NO: 235463 - DNA, 20 bp, Artificial Sequence
  chemically synthesized
cagcccatggtttcccttga

SEQ ID NO: 235464 - DNA, 20 bp, Artificial Sequence
  chemically synthesized
tgttatttcaaagccctcaa

SEQ ID NO: 235465 - DNA, 20 bp, Artificial Sequence
  chemically synthesized
gtgttatttcaaagccctca

SEQ ID NO: 235466 - DNA, 20 bp, Artificial Sequence
  chemically synthesized
ggtgttatttcaaagccctc

SEQ ID NO: 235467 - DNA, 20 bp, Artificial Sequence
  chemically synthesized
ccactgatggtgttatttca

SEQ ID NO: 235468 - DNA, 20 bp, Artificial Sequence
  chemically synthesized
gggctttgaaataacaccat

SEQ ID NO: 235469 - DNA, 20 bp, Artificial Sequence
  chemically synthesized
ctttgaaataacaccatcag

SEQ ID NO: 235470 - DNA, 20 bp, Artificial Sequence
  chemically synthesized
ttcaaccgtaagaccactga

SEQ ID NO: 235471 - DNA, 20 bp, Artificial Sequence
  chemically synthesized
taacaccatcagtggtctta

SEQ ID NO: 235472 - DNA, 20 bp, Artificial Sequence
  chemically synthesized
catcagtggtcttacggttg

SEQ ID NO: 235473 - DNA, 20 bp, Artificial Sequence
  chemically synthesized
ctgaaccacacttcaaccgt

SEQ ID NO: 235474 - DNA, 20 bp, Artificial Sequence
  chemically synthesized
gtggtcttacggttgaagtg

SEQ ID NO: 235475 - DNA, 20 bp, Artificial Sequence
  chemically synthesized
cttacggttgaagtgtggtt

SEQ ID NO: 235476 - DNA, 20 bp, Artificial Sequence
  chemically synthesized
ttacggttgaagtgtggttc

SEQ ID NO: 235477 - DNA, 20 bp, Artificial Sequence
  chemically synthesized
tacggttgaagtgtggttca

SEQ ID NO: 235478 - DNA, 20 bp, Artificial Sequence
  chemically synthesized
gttgaagtgtggttcagggc

SEQ ID NO: 235479 - DNA, 20 bp, Artificial Sequence
  chemically synthesized
tgctgtccactcacatgcac

SEQ ID NO: 235480 - DNA, 20 bp, Artificial Sequence
  chemically synthesized
ggttcagggccagtgcatgt

SEQ ID NO: 235481 - DNA, 20 bp, Artificial Sequence
  chemically synthesized
tcagggccagtgcatgtgag

SEQ ID NO: 235482 - DNA, 20 bp, Artificial Sequence
  chemically synthesized
ggccagtgcatgtgagtgga

SEQ ID NO: 235483 - DNA, 20 bp, Artificial Sequence
  chemically synthesized
gcatgtgagtggacagcatt

SEQ ID NO: 235484 - DNA, 20 bp, Artificial Sequence
  chemically synthesized
tgtgagtggacagcatttag

SEQ ID NO: 235485 - DNA, 20 bp, Artificial Sequence
  chemically synthesized
agtggacagcatttagtagc

SEQ ID NO: 235486 - DNA, 20 bp, Artificial Sequence
  chemically synthesized
gtggacagcatttagtagct

SEQ ID NO: 235487 - DNA, 20 bp, Artificial Sequence
  chemically synthesized
tggacagcatttagtagctg

SEQ ID NO: 235488 - DNA, 20 bp, Artificial Sequence
  chemically synthesized
gacagcatttagtagctggg

SEQ ID NO: 235489 - DNA, 20 bp, Artificial Sequence
  chemically synthesized
acagcatttagtagctgggg

SEQ ID NO: 235490 - DNA, 20 bp, Artificial Sequence
  chemically synthesized
gcatttagtagctggggagg

SEQ ID NO: 235491 - DNA, 20 bp, Artificial Sequence
  chemically synthesized
tgactctgtatcttcctccc

SEQ ID NO: 235492 - DNA, 20 bp, Artificial Sequence
  chemically synthesized
agtagctggggaggaagata

SEQ ID NO: 235493 - DNA, 20 bp, Artificial Sequence
  chemically synthesized
tagctggggaggaagataca

SEQ ID NO: 235494 - DNA, 20 bp, Artificial Sequence
  chemically synthesized
tggggaggaagatacagagt

SEQ ID NO: 235495 - DNA, 20 bp, Artificial Sequence
  chemically synthesized
ggaggaagatacagagtcag

SEQ ID NO: 235496 - DNA, 20 bp, Artificial Sequence
  chemically synthesized
atacagagtcagaagacgaa

SEQ ID NO: 235497 - DNA, 20 bp, Artificial Sequence
  chemically synthesized
tacagagtcagaagacgaac

SEQ ID NO: 235498 - DNA, 20 bp, Artificial Sequence
  chemically synthesized
cagagtcagaagacgaacag

SEQ ID NO: 235499 - DNA, 20 bp, Artificial Sequence
  chemically synthesized
agagtcagaagacgaacagg

SEQ ID NO: 235500 - DNA, 20 bp, Artificial Sequence
  chemically synthesized
agtcagaagacgaacaggag

SEQ ID NO: 235501 - DNA, 20 bp, Artificial Sequence
  chemically synthesized
gtcagaagacgaacaggagg

SEQ ID NO: 235502 - DNA, 20 bp, Artificial Sequence
  chemically synthesized
gaggaggatgtgaaactcat

SEQ ID NO: 235503 - DNA, 20 bp, Artificial Sequence
  chemically synthesized
cgctttccagatatacttat

SEQ ID NO: 235504 - DNA, 20 bp, Artificial Sequence
  chemically synthesized
gtgaaactcataagtatatc

SEQ ID NO: 235505 - DNA, 20 bp, Artificial Sequence
  chemically synthesized
aactcataagtatatctgga

SEQ ID NO: 235506 - DNA, 20 bp, Artificial Sequence
  chemically synthesized
tccaggagcagatcgctttc

SEQ ID NO: 235507 - DNA, 20 bp, Artificial Sequence
  chemically synthesized
tctggaaagcgatctgctcc

SEQ ID NO: 235508 - DNA, 20 bp, Artificial Sequence
  chemically synthesized
tggaaagcgatctgctcctg

SEQ ID NO: 235509 - DNA, 20 bp, Artificial Sequence
  chemically synthesized
ggaaagcgatctgctcctgg

SEQ ID NO: 235510 - DNA, 20 bp, Artificial Sequence
  chemically synthesized
cttgctaccacctccaggag

SEQ ID NO: 235511 - DNA, 20 bp, Artificial Sequence
  chemically synthesized
aagcgatctgctcctggagg

SEQ ID NO: 235512 - DNA, 20 bp, Artificial Sequence
  chemically synthesized
aaccttgctaccacctccag

SEQ ID NO: 235513 - DNA, 20 bp, Artificial Sequence
  chemically synthesized
ggaaccttgctaccacctcc

SEQ ID NO: 235514 - DNA, 20 bp, Artificial Sequence
  chemically synthesized
cgatctgctcctggaggtgg

SEQ ID NO: 235515 - DNA, 20 bp, Artificial Sequence
  chemically synthesized
tggaaccttgctaccacctc

SEQ ID NO: 235516 - DNA, 20 bp, Artificial Sequence
  chemically synthesized
ctgctcctggaggtggtagc

SEQ ID NO: 235517 - DNA, 20 bp, Artificial Sequence
  chemically synthesized
tgctcctggaggtggtagca

SEQ ID NO: 235518 - DNA, 20 bp, Artificial Sequence
  chemically synthesized
gaggtggtagcaaggttcca

SEQ ID NO: 235519 - DNA, 20 bp, Artificial Sequence
  chemically synthesized
tagcaaggttccacagaaaa

SEQ ID NO: 235520 - DNA, 20 bp, Artificial Sequence
  chemically synthesized
gcaagttttacttttttctg

SEQ ID NO: 235521 - DNA, 20 bp, Artificial Sequence
  chemically synthesized
tcatcatcttcatcagcagc

SEQ ID NO: 235522 - DNA, 20 bp, Artificial Sequence
  chemically synthesized
agtaaaacttgctgctgatg

SEQ ID NO: 235523 - DNA, 20 bp, Artificial Sequence
  chemically synthesized
aaaatcatcatcttcatcag

SEQ ID NO: 235524 - DNA, 20 bp, Artificial Sequence
  chemically synthesized
atcaaaatcatcatcttcat

SEQ ID NO: 235525 - DNA, 20 bp, Artificial Sequence
  chemically synthesized
atgatgatgattttgatgat

SEQ ID NO: 235526 - DNA, 20 bp, Artificial Sequence
  chemically synthesized
tgatgatgattttgatgatg

SEQ ID NO: 235527 - DNA, 20 bp, Artificial Sequence
  chemically synthesized
ttttgatgatgaggaaactg

SEQ ID NO: 235528 - DNA, 20 bp, Artificial Sequence
  chemically synthesized
tgatgaggaaactgaagaaa

SEQ ID NO: 235529 - DNA, 20 bp, Artificial Sequence
  chemically synthesized
cttcactggcgctttttctt

SEQ ID NO: 235530 - DNA, 20 bp, Artificial Sequence
  chemically synthesized
ggaaactgaagaaaaagcgc

SEQ ID NO: 235531 - DNA, 20 bp, Artificial Sequence
  chemically synthesized
ctgaagaaaaagcgccagtg

SEQ ID NO: 235532 - DNA, 20 bp, Artificial Sequence
  chemically synthesized
tctcatatagatttcttcac

SEQ ID NO: 235533 - DNA, 20 bp, Artificial Sequence
  chemically synthesized
gccagtgaagaaatctatat

SEQ ID NO: 235534 - DNA, 20 bp, Artificial Sequence
  chemically synthesized
tttggctggagtatctcata

SEQ ID NO: 235535 - DNA, 20 bp, Artificial Sequence
  chemically synthesized
gaaatctatatgagatactc

SEQ ID NO: 235536 - DNA, 20 bp, Artificial Sequence
  chemically synthesized
cttttgtgcatttttggctg

SEQ ID NO: 235537 - DNA, 20 bp, Artificial Sequence
  chemically synthesized
gacttttgtgcatttttggc

SEQ ID NO: 235538 - DNA, 20 bp, Artificial Sequence
  chemically synthesized
atttgacttttgtgcatttt

SEQ ID NO: 235539 - DNA, 20 bp, Artificial Sequence
  chemically synthesized
ctccagccaaaaatgcacaa

SEQ ID NO: 235540 - DNA, 20 bp, Artificial Sequence
  chemically synthesized
aaaatgcacaaaagtcaaat

SEQ ID NO: 235541 - DNA, 20 bp, Artificial Sequence
  chemically synthesized
gcacaaaagtcaaatcggaa

SEQ ID NO: 235542 - DNA, 20 bp, Artificial Sequence
  chemically synthesized
aaagtcaaatcggaatggaa

SEQ ID NO: 235543 - DNA, 20 bp, Artificial Sequence
  chemically synthesized
atcttggtgttgacggtttt

SEQ ID NO: 235544 - DNA, 20 bp, Artificial Sequence
  chemically synthesized
ccttttgatcttggtgttga

SEQ ID NO: 235545 - DNA, 20 bp, Artificial Sequence
  chemically synthesized
gactcaaaaccgtcaacacc

SEQ ID NO: 235546 - DNA, 20 bp, Artificial Sequence
  chemically synthesized
accgtcaacaccaagatcaa

SEQ ID NO: 235547 - DNA, 20 bp, Artificial Sequence
  chemically synthesized
gattcttgtccttttgatct

SEQ ID NO: 235548 - DNA, 20 bp, Artificial Sequence
  chemically synthesized
ccgtcaacaccaagatcaaa

SEQ ID NO: 235549 - DNA, 20 bp, Artificial Sequence
  chemically synthesized
aacaccaagatcaaaaggac

SEQ ID NO: 235550 - DNA, 20 bp, Artificial Sequence
  chemically synthesized
ggacaagaatccttcaaaac

SEQ ID NO: 235551 - DNA, 20 bp, Artificial Sequence
  chemically synthesized
ggagtttttccttgttttga

SEQ ID NO: 235552 - DNA, 20 bp, Artificial Sequence
  chemically synthesized
gacaagaatccttcaaaaca

SEQ ID NO: 235553 - DNA, 20 bp, Artificial Sequence
  chemically synthesized
aggagtttttccttgttttg

SEQ ID NO: 235554 - DNA, 20 bp, Artificial Sequence
  chemically synthesized
aggtcctttgggtgttttag

SEQ ID NO: 235555 - DNA, 20 bp, Artificial Sequence
  chemically synthesized
ctaggtcctttgggtgtttt

SEQ ID NO: 235556 - DNA, 20 bp, Artificial Sequence
  chemically synthesized
actaggtcctttgggtgttt

SEQ ID NO: 235557 - DNA, 20 bp, Artificial Sequence
  chemically synthesized
aaaaactcctaaaacaccca

SEQ ID NO: 235558 - DNA, 20 bp, Artificial Sequence
  chemically synthesized
aaaactcctaaaacacccaa

SEQ ID NO: 235559 - DNA, 20 bp, Artificial Sequence
  chemically synthesized
tctacagaactaggtccttt

SEQ ID NO: 235560 - DNA, 20 bp, Artificial Sequence
  chemically synthesized
cctaaaacacccaaaggacc

SEQ ID NO: 235561 - DNA, 20 bp, Artificial Sequence
  chemically synthesized
ttctacagaactaggtcctt

SEQ ID NO: 235562 - DNA, 20 bp, Artificial Sequence
  chemically synthesized
acccaaaggacctagttctg

SEQ ID NO: 235563 - DNA, 20 bp, Artificial Sequence
  chemically synthesized
ttaatgtcttctacagaact

SEQ ID NO: 235564 - DNA, 20 bp, Artificial Sequence
  chemically synthesized
tttaatgtcttctacagaac

SEQ ID NO: 235565 - DNA, 20 bp, Artificial Sequence
  chemically synthesized
caaaggacctagttctgtag

SEQ ID NO: 235566 - DNA, 20 bp, Artificial Sequence
  chemically synthesized
ttttgctttaatgtcttcta

SEQ ID NO: 235567 - DNA, 20 bp, Artificial Sequence
  chemically synthesized
tagttctgtagaagacatta

SEQ ID NO: 235568 - DNA, 20 bp, Artificial Sequence
  chemically synthesized
agacattaaagcaaaaatgc

SEQ ID NO: 235569 - DNA, 20 bp, Artificial Sequence
  chemically synthesized
attaaagcaaaaatgcaagc

SEQ ID NO: 235570 - DNA, 20 bp, Artificial Sequence
  chemically synthesized
agcaaaaatgcaagcaagta

SEQ ID NO: 235571 - DNA, 20 bp, Artificial Sequence
  chemically synthesized
aatgcaagcaagtatagaaa

SEQ ID NO: 235572 - DNA, 20 bp, Artificial Sequence
  chemically synthesized
atgcaagcaagtatagaaaa

SEQ ID NO: 235573 - DNA, 20 bp, Artificial Sequence
  chemically synthesized
caagcaagtatagaaaaagg

SEQ ID NO: 235574 - DNA, 20 bp, Artificial Sequence
  chemically synthesized
aaaaggtggttctcttccta

SEQ ID NO: 235575 - DNA, 20 bp, Artificial Sequence
  chemically synthesized
cttggcttccactttaggaa

SEQ ID NO: 235576 - DNA, 20 bp, Artificial Sequence
  chemically synthesized
aggtggttctcttcctaaag

SEQ ID NO: 235577 - DNA, 20 bp, Artificial Sequence
  chemically synthesized
aacttggcttccactttagg

SEQ ID NO: 235578 - DNA, 20 bp, Artificial Sequence
  chemically synthesized
tggttctcttcctaaagtgg

SEQ ID NO: 235579 - DNA, 20 bp, Artificial Sequence
  chemically synthesized
atgaacttggcttccacttt

SEQ ID NO: 235580 - DNA, 20 bp, Artificial Sequence
  chemically synthesized
catgaacttggcttccactt

SEQ ID NO: 235581 - DNA, 20 bp, Artificial Sequence
  chemically synthesized
ctcttcctaaagtggaagcc

SEQ ID NO: 235582 - DNA, 20 bp, Artificial Sequence
  chemically synthesized
cttcacataattcatgaact

SEQ ID NO: 235583 - DNA, 20 bp, Artificial Sequence
  chemically synthesized
ccaagttcatgaattatgtg

SEQ ID NO: 235584 - DNA, 20 bp, Artificial Sequence
  chemically synthesized
attatgtgaagaattgcttc

SEQ ID NO: 235585 - DNA, 20 bp, Artificial Sequence
  chemically synthesized
gcctctggtcagtcatctgg

SEQ ID NO: 235586 - DNA, 20 bp, Artificial Sequence
  chemically synthesized
atagcctctggtcagtcatc

SEQ ID NO: 235587 - DNA, 20 bp, Artificial Sequence
  chemically synthesized
attgcttccagatgactgac

SEQ ID NO: 235588 - DNA, 20 bp, Artificial Sequence
  chemically synthesized
tgcttccagatgactgacca

SEQ ID NO: 235589 - DNA, 20 bp, Artificial Sequence
  chemically synthesized
gcttccagatgactgaccag

SEQ ID NO: 235590 - DNA, 20 bp, Artificial Sequence
  chemically synthesized
gatcttgaatagcctctggt

SEQ ID NO: 235591 - DNA, 20 bp, Artificial Sequence
  chemically synthesized
cagagatcttgaatagcctc

SEQ ID NO: 235592 - DNA, 20 bp, Artificial Sequence
  chemically synthesized
tgactgaccagaggctattc

SEQ ID NO: 235593 - DNA, 20 bp, Artificial Sequence
  chemically synthesized
ccactgccagagatcttgaa

SEQ ID NO: 235594 - DNA, 20 bp, Artificial Sequence
  chemically synthesized
cagaggctattcaagatctc

SEQ ID NO: 235595 - DNA, 20 bp, Artificial Sequence
  chemically synthesized
aggctattcaagatctctgg

SEQ ID NO: 235596 - DNA, 20 bp, Artificial Sequence
  chemically synthesized
ctattcaagatctctggcag

SEQ ID NO: 235597 - DNA, 20 bp, Artificial Sequence
  chemically synthesized
agagacttcctccactgcca

SEQ ID NO: 235598 - DNA, 20 bp, Artificial Sequence
  chemically synthesized
attcaagatctctggcagtg

SEQ ID NO: 235599 - DNA, 20 bp, Artificial Sequence
  chemically synthesized
ttcaagatctctggcagtgg

SEQ ID NO: 235600 - DNA, 20 bp, Artificial Sequence
  chemically synthesized
agagagacttcctccactgc

SEQ ID NO: 235601 - DNA, 20 bp, Artificial Sequence
  chemically synthesized
aagatctctggcagtggagg

SEQ ID NO: 235602 - DNA, 20 bp, Artificial Sequence
  chemically synthesized
gcagtggaggaagtctctct

SEQ ID NO: 235603 - DNA, 20 bp, Artificial Sequence
  chemically synthesized
gtttaaactattttcttaga

SEQ ID NO: 235604 - DNA, 20 bp, Artificial Sequence
  chemically synthesized
ttgtttaaactattttctta

SEQ ID NO: 235605 - DNA, 20 bp, Artificial Sequence
  chemically synthesized
aggaagtctctctaagaaaa

SEQ ID NO: 235606 - DNA, 20 bp, Artificial Sequence
  chemically synthesized
aattgtttaaactattttct

SEQ ID NO: 235607 - DNA, 20 bp, Artificial Sequence
  chemically synthesized
gttacagaaacgaaatcaga

SEQ ID NO: 235608 - DNA, 20 bp, Artificial Sequence
  chemically synthesized
aactgttacagaaacgaaat

SEQ ID NO: 235609 - DNA, 20 bp, Artificial Sequence
  chemically synthesized
atctgatttcgtttctgtaa

SEQ ID NO: 235610 - DNA, 20 bp, Artificial Sequence
  chemically synthesized
cagccagatatcaactgtta

SEQ ID NO: 235611 - DNA, 20 bp, Artificial Sequence
  chemically synthesized
tttctgtaacagttgatatc

SEQ ID NO: 235612 - DNA, 20 bp, Artificial Sequence
  chemically synthesized
tgcattatcaaaacgacagc

SEQ ID NO: 235613 - DNA, 20 bp, Artificial Sequence
  chemically synthesized
actctgcattatcaaaacga

SEQ ID NO: 235614 - DNA, 20 bp, Artificial Sequence
  chemically synthesized
tggctgtcgttttgataatg

SEQ ID NO: 235615 - DNA, 20 bp, Artificial Sequence
  chemically synthesized
gctgtcgttttgataatgca

SEQ ID NO: 235616 - DNA, 20 bp, Artificial Sequence
  chemically synthesized
tcgttttgataatgcagagt

SEQ ID NO: 235617 - DNA, 20 bp, Artificial Sequence
  chemically synthesized
tttatcaaacatggtaggga

SEQ ID NO: 235618 - DNA, 20 bp, Artificial Sequence
  chemically synthesized
atttatcaaacatggtaggg

SEQ ID NO: 235619 - DNA, 20 bp, Artificial Sequence
  chemically synthesized
aacatttatcaaacatggta

SEQ ID NO: 235620 - DNA, 20 bp, Artificial Sequence
  chemically synthesized
caacatttatcaaacatggt

SEQ ID NO: 235621 - DNA, 20 bp, Artificial Sequence
  chemically synthesized
acaacatttatcaaacatgg

SEQ ID NO: 235622 - DNA, 20 bp, Artificial Sequence
  chemically synthesized
tggacaacatttatcaaaca

SEQ ID NO: 235623 - DNA, 20 bp, Artificial Sequence
  chemically synthesized
catgtttgataaatgttgtc

SEQ ID NO: 235624 - DNA, 20 bp, Artificial Sequence
  chemically synthesized
acattcttggcaatggaatc

SEQ ID NO: 235625 - DNA, 20 bp, Artificial Sequence
  chemically synthesized
gttgtccagattccattgcc

SEQ ID NO: 235626 - DNA, 20 bp, Artificial Sequence
  chemically synthesized
ggacaacacattcttggcaa

SEQ ID NO: 235627 - DNA, 20 bp, Artificial Sequence
  chemically synthesized
cattttggacaacacattct

SEQ ID NO: 235628 - DNA, 20 bp, Artificial Sequence
  chemically synthesized
taaaaactaaacaggcattt

SEQ ID NO: 235629 - DNA, 20 bp, Artificial Sequence
  chemically synthesized
tgttgtccaaaatgcctgtt

SEQ ID NO: 235630 - DNA, 20 bp, Artificial Sequence
  chemically synthesized
tccatctttaaaaactaaac

SEQ ID NO: 235631 - DNA, 20 bp, Artificial Sequence
  chemically synthesized
ttccatctttaaaaactaaa

SEQ ID NO: 235632 - DNA, 20 bp, Artificial Sequence
  chemically synthesized
aaatgcctgtttagttttta

SEQ ID NO: 235633 - DNA, 20 bp, Artificial Sequence
  chemically synthesized
gcctgtttagtttttaaaga

SEQ ID NO: 235634 - DNA, 20 bp, Artificial Sequence
  chemically synthesized
ttaaaaccaagcaaagggtg

SEQ ID NO: 235635 - DNA, 20 bp, Artificial Sequence
  chemically synthesized
ccttaaaaccaagcaaaggg

SEQ ID NO: 235636 - DNA, 20 bp, Artificial Sequence
  chemically synthesized
atggaactccaccctttgct

SEQ ID NO: 235637 - DNA, 20 bp, Artificial Sequence
  chemically synthesized
catccttaaaaccaagcaaa

SEQ ID NO: 235638 - DNA, 20 bp, Artificial Sequence
  chemically synthesized
acatccttaaaaccaagcaa

SEQ ID NO: 235639 - DNA, 20 bp, Artificial Sequence
  chemically synthesized
tacatccttaaaaccaagca

SEQ ID NO: 235640 - DNA, 20 bp, Artificial Sequence
  chemically synthesized
tccaccctttgcttggtttt

SEQ ID NO: 235641 - DNA, 20 bp, Artificial Sequence
  chemically synthesized
ccaccctttgcttggtttta

SEQ ID NO: 235642 - DNA, 20 bp, Artificial Sequence
  chemically synthesized
ttccatacatccttaaaacc

SEQ ID NO: 235643 - DNA, 20 bp, Artificial Sequence
  chemically synthesized
tgcttggttttaaggatgta

SEQ ID NO: 235644 - DNA, 20 bp, Artificial Sequence
  chemically synthesized
ggatgtatggaatgttatgc

SEQ ID NO: 235645 - DNA, 20 bp, Artificial Sequence
  chemically synthesized
gatgtatggaatgttatgct

SEQ ID NO: 235646 - DNA, 20 bp, Artificial Sequence
  chemically synthesized
tggaatgttatgctaggaca

SEQ ID NO: 235647 - DNA, 20 bp, Artificial Sequence
  chemically synthesized
ccactgctactactatgtcc

SEQ ID NO: 235648 - DNA, 20 bp, Artificial Sequence
  chemically synthesized
aatgttatgctaggacatag

SEQ ID NO: 235649 - DNA, 20 bp, Artificial Sequence
  chemically synthesized
gttatgctaggacatagtag

SEQ ID NO: 235650 - DNA, 20 bp, Artificial Sequence
  chemically synthesized
atgctaggacatagtagtag

SEQ ID NO: 235651 - DNA, 20 bp, Artificial Sequence
  chemically synthesized
ctaggacatagtagtagcag

SEQ ID NO: 235652 - DNA, 20 bp, Artificial Sequence
  chemically synthesized
gacatagtagtagcagtggt

SEQ ID NO: 235653 - DNA, 20 bp, Artificial Sequence
  chemically synthesized
gtagtagcagtggtcagaca

SEQ ID NO: 235654 - DNA, 20 bp, Artificial Sequence
  chemically synthesized
gcagtggtcagacatggaaa

SEQ ID NO: 235655 - DNA, 20 bp, Artificial Sequence
  chemically synthesized
gtggtcagacatggaaatgg

SEQ ID NO: 235656 - DNA, 20 bp, Artificial Sequence
  chemically synthesized
tggtcagacatggaaatggt

SEQ ID NO: 235657 - DNA, 20 bp, Artificial Sequence
  chemically synthesized
tcagacatggaaatggtggg

SEQ ID NO: 235658 - DNA, 20 bp, Artificial Sequence
  chemically synthesized
tggaaatggtgggtagacaa

SEQ ID NO: 235659 - DNA, 20 bp, Artificial Sequence
  chemically synthesized
aaagtatacatgtaaaataa

SEQ ID NO: 235660 - DNA, 20 bp, Artificial Sequence
  chemically synthesized
aaaataaaagtattttaata

SEQ ID NO: 235661 - DNA, 20 bp, Artificial Sequence
  chemically synthesized
ataaagtaaaaaaaatgata

SEQ ID NO: 235662 - DNA, 20 bp, Artificial Sequence
  chemically synthesized
taaagtaaaaaaaatgataa

SEQ ID NO: 235663 - DNA, 20 bp, Artificial Sequence
  chemically synthesized
aatgataaaggtaatcacat

SEQ ID NO: 235664 - DNA, 20 bp, Artificial Sequence
  chemically synthesized
gataaaggtaatcacattag

SEQ ID NO: 235665 - DNA, 20 bp, Artificial Sequence
  chemically synthesized
acattagaagattcatctct

SEQ ID NO: 235666 - DNA, 20 bp, Artificial Sequence
  chemically synthesized
cattagaagattcatctctt

SEQ ID NO: 235667 - DNA, 20 bp, Artificial Sequence
  chemically synthesized
accctagctgttgcacccaa

SEQ ID NO: 235668 - DNA, 20 bp, Artificial Sequence
  chemically synthesized
ctaccctagctgttgcaccc

SEQ ID NO: 235669 - DNA, 20 bp, Artificial Sequence
  chemically synthesized
gattcatctcttgggtgcaa

SEQ ID NO: 235670 - DNA, 20 bp, Artificial Sequence
  chemically synthesized
catctcttgggtgcaacagc

SEQ ID NO: 235671 - DNA, 20 bp, Artificial Sequence
  chemically synthesized
atctcttgggtgcaacagct

SEQ ID NO: 235672 - DNA, 20 bp, Artificial Sequence
  chemically synthesized
tctcttgggtgcaacagcta

SEQ ID NO: 235673 - DNA, 20 bp, Artificial Sequence
  chemically synthesized
cttgggtgcaacagctaggg

SEQ ID NO: 235674 - DNA, 20 bp, Artificial Sequence
  chemically synthesized
cagggcttgggaggctaccc

SEQ ID NO: 235675 - DNA, 20 bp, Artificial Sequence
  chemically synthesized
aacagctagggtagcctccc

SEQ ID NO: 235676 - DNA, 20 bp, Artificial Sequence
  chemically synthesized
actaccacacagggcttggg

SEQ ID NO: 235677 - DNA, 20 bp, Artificial Sequence
  chemically synthesized
tactaccacacagggcttgg

SEQ ID NO: 235678 - DNA, 20 bp, Artificial Sequence
  chemically synthesized
actactaccacacagggctt

SEQ ID NO: 235679 - DNA, 20 bp, Artificial Sequence
  chemically synthesized
gactactaccacacagggct

SEQ ID NO: 235680 - DNA, 20 bp, Artificial Sequence
  chemically synthesized
gtagcctcccaagccctgtg

SEQ ID NO: 235681 - DNA, 20 bp, Artificial Sequence
  chemically synthesized
gcctcccaagccctgtgtgg

SEQ ID NO: 235682 - DNA, 20 bp, Artificial Sequence
  chemically synthesized
atactgactactaccacaca

SEQ ID NO: 235683 - DNA, 20 bp, Artificial Sequence
  chemically synthesized
gatactgactactaccacac

SEQ ID NO: 235684 - DNA, 20 bp, Artificial Sequence
  chemically synthesized
tgatactgactactaccaca

SEQ ID NO: 235685 - DNA, 20 bp, Artificial Sequence
  chemically synthesized
tcccaagccctgtgtggtag

SEQ ID NO: 235686 - DNA, 20 bp, Artificial Sequence
  chemically synthesized
aagccctgtgtggtagtagt

SEQ ID NO: 235687 - DNA, 20 bp, Artificial Sequence
  chemically synthesized
agtagtcagtatcactacta

SEQ ID NO: 235688 - DNA, 20 bp, Artificial Sequence
  chemically synthesized
gaaaaacattgaaaccatag

SEQ ID NO: 235689 - DNA, 20 bp, Artificial Sequence
  chemically synthesized
agggaaaaacattgaaacca

SEQ ID NO: 235690 - DNA, 20 bp, Artificial Sequence
  chemically synthesized
atttcaacatcagttttgga

SEQ ID NO: 235691 - DNA, 20 bp, Artificial Sequence
  chemically synthesized
aatttcaacatcagttttgg

SEQ ID NO: 235692 - DNA, 20 bp, Artificial Sequence
  chemically synthesized
aaatttcaacatcagttttg

SEQ ID NO: 235693 - DNA, 20 bp, Artificial Sequence
  chemically synthesized
ttaaatttcaacatcagttt

SEQ ID NO: 235694 - DNA, 20 bp, Artificial Sequence
  chemically synthesized
tggcaattaaatttcaacat

SEQ ID NO: 235695 - DNA, 20 bp, Artificial Sequence
  chemically synthesized
aaatttaattgccattgtga

SEQ ID NO: 235696 - DNA, 20 bp, Artificial Sequence
  chemically synthesized
accccttaatactgtcacaa

SEQ ID NO: 235697 - DNA, 20 bp, Artificial Sequence
  chemically synthesized
attgccattgtgacagtatt

SEQ ID NO: 235698 - DNA, 20 bp, Artificial Sequence
  chemically synthesized
ttgccattgtgacagtatta

SEQ ID NO: 235699 - DNA, 20 bp, Artificial Sequence
  chemically synthesized
tgccattgtgacagtattaa

SEQ ID NO: 235700 - DNA, 20 bp, Artificial Sequence
  chemically synthesized
gccattgtgacagtattaag

SEQ ID NO: 235701 - DNA, 20 bp, Artificial Sequence
  chemically synthesized
attgtgacagtattaagggg

SEQ ID NO: 235702 - DNA, 20 bp, Artificial Sequence
  chemically synthesized
ttgtgacagtattaaggggt

SEQ ID NO: 235703 - DNA, 20 bp, Artificial Sequence
  chemically synthesized
gtgacagtattaaggggtgg

SEQ ID NO: 235704 - DNA, 20 bp, Artificial Sequence
  chemically synthesized
gtattaaggggtgggagctt

SEQ ID NO: 235705 - DNA, 20 bp, Artificial Sequence
  chemically synthesized
tattaaggggtgggagcttt

SEQ ID NO: 235706 - DNA, 20 bp, Artificial Sequence
  chemically synthesized
ttaaggggtgggagctttag

SEQ ID NO: 235707 - DNA, 20 bp, Artificial Sequence
  chemically synthesized
taaggggtgggagctttagg

SEQ ID NO: 235708 - DNA, 20 bp, Artificial Sequence
  chemically synthesized
caatccttaatcacctccta

SEQ ID NO: 235709 - DNA, 20 bp, Artificial Sequence
  chemically synthesized
gggagctttaggaggtgatt

SEQ ID NO: 235710 - DNA, 20 bp, Artificial Sequence
  chemically synthesized
ggagctttaggaggtgatta

SEQ ID NO: 235711 - DNA, 20 bp, Artificial Sequence
  chemically synthesized
ttaggaggtgattaaggatt

SEQ ID NO: 235712 - DNA, 20 bp, Artificial Sequence
  chemically synthesized
taggaggtgattaaggattg

SEQ ID NO: 235713 - DNA, 20 bp, Artificial Sequence
  chemically synthesized
aggaggtgattaaggattga

SEQ ID NO: 235714 - DNA, 20 bp, Artificial Sequence
  chemically synthesized
caaacccactcgtgagggtg

SEQ ID NO: 235715 - DNA, 20 bp, Artificial Sequence
  chemically synthesized
attgagggctccaccctcac

SEQ ID NO: 235716 - DNA, 20 bp, Artificial Sequence
  chemically synthesized
accaaacccactcgtgaggg

SEQ ID NO: 235717 - DNA, 20 bp, Artificial Sequence
  chemically synthesized
gagggctccaccctcacgag

SEQ ID NO: 235718 - DNA, 20 bp, Artificial Sequence
  chemically synthesized
ggaaccaaacccactcgtga

SEQ ID NO: 235719 - DNA, 20 bp, Artificial Sequence
  chemically synthesized
agggctccaccctcacgagt

SEQ ID NO: 235720 - DNA, 20 bp, Artificial Sequence
  chemically synthesized
gggaaccaaacccactcgtg

SEQ ID NO: 235721 - DNA, 20 bp, Artificial Sequence
  chemically synthesized
agggaaccaaacccactcgt

SEQ ID NO: 235722 - DNA, 20 bp, Artificial Sequence
  chemically synthesized
tccaccctcacgagtgggtt

SEQ ID NO: 235723 - DNA, 20 bp, Artificial Sequence
  chemically synthesized
tgggtttggttcccttataa

SEQ ID NO: 235724 - DNA, 20 bp, Artificial Sequence
  chemically synthesized
ctgaactcccacttttataa

SEQ ID NO: 235725 - DNA, 20 bp, Artificial Sequence
  chemically synthesized
gctgaactcccacttttata

SEQ ID NO: 235726 - DNA, 20 bp, Artificial Sequence
  chemically synthesized
gtttggttcccttataaaag

SEQ ID NO: 235727 - DNA, 20 bp, Artificial Sequence
  chemically synthesized
ggctgaactcccacttttat

SEQ ID NO: 235728 - DNA, 20 bp, Artificial Sequence
  chemically synthesized
tttggttcccttataaaagt

SEQ ID NO: 235729 - DNA, 20 bp, Artificial Sequence
  chemically synthesized
tggttcccttataaaagtgg

SEQ ID NO: 235730 - DNA, 20 bp, Artificial Sequence
  chemically synthesized
cccttataaaagtgggagtt

SEQ ID NO: 235731 - DNA, 20 bp, Artificial Sequence
  chemically synthesized
gggcaagaaagatcaaaagg

SEQ ID NO: 235732 - DNA, 20 bp, Artificial Sequence
  chemically synthesized
agggcaagaaagatcaaaag

SEQ ID NO: 235733 - DNA, 20 bp, Artificial Sequence
  chemically synthesized
gagggcaagaaagatcaaaa

SEQ ID NO: 235734 - DNA, 20 bp, Artificial Sequence
  chemically synthesized
agagggcaagaaagatcaaa

SEQ ID NO: 235735 - DNA, 20 bp, Artificial Sequence
  chemically synthesized
tagagggcaagaaagatcaa

SEQ ID NO: 235736 - DNA, 20 bp, Artificial Sequence
  chemically synthesized
tggacgattagagggcaaga

SEQ ID NO: 235737 - DNA, 20 bp, Artificial Sequence
  chemically synthesized
atgatggacgattagagggc

SEQ ID NO: 235738 - DNA, 20 bp, Artificial Sequence
  chemically synthesized
tcacatgatggacgattaga

SEQ ID NO: 235739 - DNA, 20 bp, Artificial Sequence
  chemically synthesized
atcacatgatggacgattag

SEQ ID NO: 235740 - DNA, 20 bp, Artificial Sequence
  chemically synthesized
catcacatgatggacgatta

SEQ ID NO: 235741 - DNA, 20 bp, Artificial Sequence
  chemically synthesized
gtcatcacatgatggacgat

SEQ ID NO: 235742 - DNA, 20 bp, Artificial Sequence
  chemically synthesized
cttgatatgtcatcacatga

SEQ ID NO: 235743 - DNA, 20 bp, Artificial Sequence
  chemically synthesized
ccatcatgtgatgacatatc

SEQ ID NO: 235744 - DNA, 20 bp, Artificial Sequence
  chemically synthesized
tcatgtgatgacatatcaag

SEQ ID NO: 235745 - DNA, 20 bp, Artificial Sequence
  chemically synthesized
catgtgatgacatatcaagt

SEQ ID NO: 235746 - DNA, 20 bp, Artificial Sequence
  chemically synthesized
catatcaagtaggccctcgc

SEQ ID NO: 235747 - DNA, 20 bp, Artificial Sequence
  chemically synthesized
tatcaagtaggccctcgcca

SEQ ID NO: 235748 - DNA, 20 bp, Artificial Sequence
  chemically synthesized
atcaagtaggccctcgccag

SEQ ID NO: 235749 - DNA, 20 bp, Artificial Sequence
  chemically synthesized
aaggtgtcagcctctggcga

SEQ ID NO: 235750 - DNA, 20 bp, Artificial Sequence
  chemically synthesized
taaggtgtcagcctctggcg

SEQ ID NO: 235751 - DNA, 20 bp, Artificial Sequence
  chemically synthesized
ttaaggtgtcagcctctggc

SEQ ID NO: 235752 - DNA, 20 bp, Artificial Sequence
  chemically synthesized
aacattaaggtgtcagcctc

SEQ ID NO: 235753 - DNA, 20 bp, Artificial Sequence
  chemically synthesized
gaagtctaacattaaggtgt

SEQ ID NO: 235754 - DNA, 20 bp, Artificial Sequence
  chemically synthesized
agaggctgacaccttaatgt

SEQ ID NO: 235755 - DNA, 20 bp, Artificial Sequence
  chemically synthesized
gactaggaagtctaacatta

SEQ ID NO: 235756 - DNA, 20 bp, Artificial Sequence
  chemically synthesized
agactaggaagtctaacatt

SEQ ID NO: 235757 - DNA, 20 bp, Artificial Sequence
  chemically synthesized
caccttaatgttagacttcc

SEQ ID NO: 235758 - DNA, 20 bp, Artificial Sequence
  chemically synthesized
tcacagttctggagactagg

SEQ ID NO: 235759 - DNA, 20 bp, Artificial Sequence
  chemically synthesized
atgttagacttcctagtctc

SEQ ID NO: 235760 - DNA, 20 bp, Artificial Sequence
  chemically synthesized
ggctcacagttctggagact

SEQ ID NO: 235761 - DNA, 20 bp, Artificial Sequence
  chemically synthesized
tggctcacagttctggagac

SEQ ID NO: 235762 - DNA, 20 bp, Artificial Sequence
  chemically synthesized
tgtattggctcacagttctg

SEQ ID NO: 235763 - DNA, 20 bp, Artificial Sequence
  chemically synthesized
ttcctagtctccagaactgt

SEQ ID NO: 235764 - DNA, 20 bp, Artificial Sequence
  chemically synthesized
aatgtattggctcacagttc

SEQ ID NO: 235765 - DNA, 20 bp, Artificial Sequence
  chemically synthesized
aacaaaaatgtattggctca

SEQ ID NO: 235766 - DNA, 20 bp, Artificial Sequence
  chemically synthesized
tgtaatgaacaaaaatgtat

SEQ ID NO: 235767 - DNA, 20 bp, Artificial Sequence
  chemically synthesized
gttcattacaaattattacc

SEQ ID NO: 235768 - DNA, 20 bp, Artificial Sequence
  chemically synthesized
tacaaattattacctagtct

SEQ ID NO: 235769 - DNA, 20 bp, Artificial Sequence
  chemically synthesized
acaaattattacctagtctt

SEQ ID NO: 235770 - DNA, 20 bp, Artificial Sequence
  chemically synthesized
gtaacaaagtacctaagact

SEQ ID NO: 235771 - DNA, 20 bp, Artificial Sequence
  chemically synthesized
tgtaacaaagtacctaagac

SEQ ID NO: 235772 - DNA, 20 bp, Artificial Sequence
  chemically synthesized
gctgctgtaacaaagtacct

SEQ ID NO: 235773 - DNA, 20 bp, Artificial Sequence
  chemically synthesized
tagtcttaggtactttgtta

SEQ ID NO: 235774 - DNA, 20 bp, Artificial Sequence
  chemically synthesized
cgttttgtgctgctgtaaca

SEQ ID NO: 235775 - DNA, 20 bp, Artificial Sequence
  chemically synthesized
tcttaggtactttgttacag

SEQ ID NO: 235776 - DNA, 20 bp, Artificial Sequence
  chemically synthesized
acagcagcacaaaacgtatt

SEQ ID NO: 235777 - DNA, 20 bp, Artificial Sequence
  chemically synthesized
agcagcacaaaacgtattaa

SEQ ID NO: 235778 - DNA, 20 bp, Artificial Sequence
  chemically synthesized
cagcacaaaacgtattaaga

SEQ ID NO: 235779 - DNA, 20 bp, Artificial Sequence
  chemically synthesized
gatgttcagaaaagataagt

SEQ ID NO: 235780 - DNA, 20 bp, Artificial Sequence
  chemically synthesized
tgatgttcagaaaagataag

SEQ ID NO: 235781 - DNA, 20 bp, Artificial Sequence
  chemically synthesized
taatgatgttcagaaaagat

SEQ ID NO: 235782 - DNA, 20 bp, Artificial Sequence
  chemically synthesized
aattgtaatgatgttcagaa

SEQ ID NO: 235783 - DNA, 20 bp, Artificial Sequence
  chemically synthesized
aatggaattgtaatgatgtt

SEQ ID NO: 235784 - DNA, 20 bp, Artificial Sequence
  chemically synthesized
taagagcagaaattttgaaa

SEQ ID NO: 235785 - DNA, 20 bp, Artificial Sequence
  chemically synthesized
ccttgggatatcattaagag

SEQ ID NO: 235786 - DNA, 20 bp, Artificial Sequence
  chemically synthesized
tctccttgggatatcattaa

SEQ ID NO: 235787 - DNA, 20 bp, Artificial Sequence
  chemically synthesized
agtctccttgggatatcatt

SEQ ID NO: 235788 - DNA, 20 bp, Artificial Sequence
  chemically synthesized
tctgctcttaatgatatccc

SEQ ID NO: 235789 - DNA, 20 bp, Artificial Sequence
  chemically synthesized
ctgctcttaatgatatccca

SEQ ID NO: 235790 - DNA, 20 bp, Artificial Sequence
  chemically synthesized
gctcttaatgatatcccaag

SEQ ID NO: 235791 - DNA, 20 bp, Artificial Sequence
  chemically synthesized
aaatattttctagtctcctt

SEQ ID NO: 235792 - DNA, 20 bp, Artificial Sequence
  chemically synthesized
taatgatatcccaaggagac

SEQ ID NO: 235793 - DNA, 20 bp, Artificial Sequence
  chemically synthesized
gaaatattttctagtctcct

SEQ ID NO: 235794 - DNA, 20 bp, Artificial Sequence
  chemically synthesized
tgaactgttgaaatattttc

SEQ ID NO: 235795 - DNA, 20 bp, Artificial Sequence
  chemically synthesized
gagactagaaaatatttcaa

SEQ ID NO: 235796 - DNA, 20 bp, Artificial Sequence
  chemically synthesized
tagaaaatatttcaacagtt

SEQ ID NO: 235797 - DNA, 20 bp, Artificial Sequence
  chemically synthesized
aagataatttcattgaagag

SEQ ID NO: 235798 - DNA, 20 bp, Artificial Sequence
  chemically synthesized
cgcaagataatttcattgaa

SEQ ID NO: 235799 - DNA, 20 bp, Artificial Sequence
  chemically synthesized
cacgcaagataatttcattg

SEQ ID NO: 235800 - DNA, 20 bp, Artificial Sequence
  chemically synthesized
ttcaatgaaattatcttgcg

SEQ ID NO: 235801 - DNA, 20 bp, Artificial Sequence
  chemically synthesized
taacgagtacatgaccacgc

SEQ ID NO: 235802 - DNA, 20 bp, Artificial Sequence
  chemically synthesized
aatggtcagggcaatttaac

SEQ ID NO: 235803 - DNA, 20 bp, Artificial Sequence
  chemically synthesized
tatccttcaaagaatggtca

SEQ ID NO: 235804 - DNA, 20 bp, Artificial Sequence
  chemically synthesized
ctatccttcaaagaatggtc

SEQ ID NO: 235805 - DNA, 20 bp, Artificial Sequence
  chemically synthesized
gctatccttcaaagaatggt

SEQ ID NO: 235806 - DNA, 20 bp, Artificial Sequence
  chemically synthesized
attgccctgaccattctttg

SEQ ID NO: 235807 - DNA, 20 bp, Artificial Sequence
  chemically synthesized
cagtgctatccttcaaagaa

SEQ ID NO: 235808 - DNA, 20 bp, Artificial Sequence
  chemically synthesized
ttgccctgaccattctttga

SEQ ID NO: 235809 - DNA, 20 bp, Artificial Sequence
  chemically synthesized
cctgaccattctttgaagga

SEQ ID NO: 235810 - DNA, 20 bp, Artificial Sequence
  chemically synthesized
ataaccagtgctatccttca

SEQ ID NO: 235811 - DNA, 20 bp, Artificial Sequence
  chemically synthesized
cattctttgaaggatagcac

SEQ ID NO: 235812 - DNA, 20 bp, Artificial Sequence
  chemically synthesized
tgaaggatagcactggttat

SEQ ID NO: 235813 - DNA, 20 bp, Artificial Sequence
  chemically synthesized
ttcaaatttaatctcataac

SEQ ID NO: 235814 - DNA, 20 bp, Artificial Sequence
  chemically synthesized
ggttatgagattaaatttga

SEQ ID NO: 235815 - DNA, 20 bp, Artificial Sequence
  chemically synthesized
tcactcaactgatagttcat

SEQ ID NO: 235816 - DNA, 20 bp, Artificial Sequence
  chemically synthesized
ttcactcaactgatagttca

SEQ ID NO: 235817 - DNA, 20 bp, Artificial Sequence
  chemically synthesized
tgaaagttcctatgaactat

SEQ ID NO: 235818 - DNA, 20 bp, Artificial Sequence
  chemically synthesized
gttcctatgaactatcagtt

SEQ ID NO: 235819 - DNA, 20 bp, Artificial Sequence
  chemically synthesized
aagcaaattcactcaactga

SEQ ID NO: 235820 - DNA, 20 bp, Artificial Sequence
  chemically synthesized
ttgagtgaatttgcttatta

SEQ ID NO: 235821 - DNA, 20 bp, Artificial Sequence
  chemically synthesized
attaagatatatgctataat

SEQ ID NO: 235822 - DNA, 20 bp, Artificial Sequence
  chemically synthesized
aggcttatgaacatatgatt

SEQ ID NO: 235823 - DNA, 20 bp, Artificial Sequence
  chemically synthesized
tatcttaatcatatgttcat

SEQ ID NO: 235824 - DNA, 20 bp, Artificial Sequence
  chemically synthesized
tatgttcataagcctccatt

SEQ ID NO: 235825 - DNA, 20 bp, Artificial Sequence
  chemically synthesized
tgtgcagcctggcttaatgg

SEQ ID NO: 235826 - DNA, 20 bp, Artificial Sequence
  chemically synthesized
ctgtgcagcctggcttaatg

SEQ ID NO: 235827 - DNA, 20 bp, Artificial Sequence
  chemically synthesized
ttcataagcctccattaagc

SEQ ID NO: 235828 - DNA, 20 bp, Artificial Sequence
  chemically synthesized
tcataagcctccattaagcc

SEQ ID NO: 235829 - DNA, 20 bp, Artificial Sequence
  chemically synthesized
aactgtgcagcctggcttaa

SEQ ID NO: 235830 - DNA, 20 bp, Artificial Sequence
  chemically synthesized
ctccattaagccaggctgca

SEQ ID NO: 235831 - DNA, 20 bp, Artificial Sequence
  chemically synthesized
aaaaaataaactgtgcagcc

SEQ ID NO: 235832 - DNA, 20 bp, Artificial Sequence
  chemically synthesized
tgttaaaaaaataaactgtg

SEQ ID NO: 235833 - DNA, 20 bp, Artificial Sequence
  chemically synthesized
ttaacaattgcattgtttta

SEQ ID NO: 235834 - DNA, 20 bp, Artificial Sequence
  chemically synthesized
attgcattgttttaaagtta

SEQ ID NO: 235835 - DNA, 20 bp, Artificial Sequence
  chemically synthesized
ttttaaagttacagttgttt

SEQ ID NO: 235836 - DNA, 20 bp, Artificial Sequence
  chemically synthesized
ttgtttcagcaatccattac

SEQ ID NO: 235837 - DNA, 20 bp, Artificial Sequence
  chemically synthesized
gtacttttaaatactagtaa

SEQ ID NO: 235838 - DNA, 20 bp, Artificial Sequence
  chemically synthesized
atgtgtgtacttttaaatac

SEQ ID NO: 235839 - DNA, 20 bp, Artificial Sequence
  chemically synthesized
aatccattactagtatttaa

SEQ ID NO: 235840 - DNA, 20 bp, Artificial Sequence
  chemically synthesized
ctgttgtatgtatttacaaa

SEQ ID NO: 235841 - DNA, 20 bp, Artificial Sequence
  chemically synthesized
gctgttgtatgtatttacaa

SEQ ID NO: 235842 - DNA, 20 bp, Artificial Sequence
  chemically synthesized
ccttttgtaaatacatacaa

SEQ ID NO: 235843 - DNA, 20 bp, Artificial Sequence
  chemically synthesized
ttctatttttttataattta

SEQ ID NO: 235844 - DNA, 20 bp, Artificial Sequence
  chemically synthesized
agccataaattataaaaaaa

SEQ ID NO: 235845 - DNA, 20 bp, Artificial Sequence
  chemically synthesized
ttataaaaaaatagaaattc

SEQ ID NO: 235846 - DNA, 20 bp, Artificial Sequence
  chemically synthesized
tataaaaaaatagaaattca

SEQ ID NO: 235847 - DNA, 20 bp, Artificial Sequence
  chemically synthesized
gtttgaaaaatgtgttattt

SEQ ID NO: 235848 - DNA, 20 bp, Artificial Sequence
  chemically synthesized
aaaaatgtgttatttaagat

SEQ ID NO: 235849 - DNA, 20 bp, Artificial Sequence
  chemically synthesized
aatgtgttatttaagattag

SEQ ID NO: 235850 - DNA, 20 bp, Artificial Sequence
  chemically synthesized
tttaagattagcagtaaaat

SEQ ID NO: 235851 - DNA, 20 bp, Artificial Sequence
  chemically synthesized
tcaaataaatccatgttaac

SEQ ID NO: 235852 - DNA, 20 bp, Artificial Sequence
  chemically synthesized
attgtaaatcctagttaaca

SEQ ID NO: 235853 - DNA, 20 bp, Artificial Sequence
  chemically synthesized
caaataaatccatgttaact

SEQ ID NO: 235854 - DNA, 20 bp, Artificial Sequence
  chemically synthesized
caggcttgtattgtaaatcc

SEQ ID NO: 235855 - DNA, 20 bp, Artificial Sequence
  chemically synthesized
ttaactaggatttacaatac

SEQ ID NO: 235856 - DNA, 20 bp, Artificial Sequence
  chemically synthesized
acaatacaagcctgtactat

SEQ ID NO: 235857 - DNA, 20 bp, Artificial Sequence
  chemically synthesized
ggctttacaactcatagtac

SEQ ID NO: 235858 - DNA, 20 bp, Artificial Sequence
  chemically synthesized
tggctttacaactcatagta

SEQ ID NO: 235859 - DNA, 20 bp, Artificial Sequence
  chemically synthesized
aatcctggctttacaactca

SEQ ID NO: 235860 - DNA, 20 bp, Artificial Sequence
  chemically synthesized
agcctgtactatgagttgta

SEQ ID NO: 235861 - DNA, 20 bp, Artificial Sequence
  chemically synthesized
tgtactatgagttgtaaagc

SEQ ID NO: 235862 - DNA, 20 bp, Artificial Sequence
  chemically synthesized
gtactatgagttgtaaagcc

SEQ ID NO: 235863 - DNA, 20 bp, Artificial Sequence
  chemically synthesized
agttgtaaagccaggatttt

SEQ ID NO: 235864 - DNA, 20 bp, Artificial Sequence
  chemically synthesized
cagcatagttctcaaaatcc

SEQ ID NO: 235865 - DNA, 20 bp, Artificial Sequence
  chemically synthesized
ataaatttaatgtggcagca

SEQ ID NO: 235866 - DNA, 20 bp, Artificial Sequence
  chemically synthesized
aatgaataaatttaatgtgg

SEQ ID NO: 235867 - DNA, 20 bp, Artificial Sequence
  chemically synthesized
gaaaatgaataaatttaatg

SEQ ID NO: 235868 - DNA, 20 bp, Artificial Sequence
  chemically synthesized
attaaatttattcattttca

SEQ ID NO: 235869 - DNA, 20 bp, Artificial Sequence
  chemically synthesized
ttattcattttcacagcctg

SEQ ID NO: 235870 - DNA, 20 bp, Artificial Sequence
  chemically synthesized
tcaggcattaaaatgtctgc

SEQ ID NO: 235871 - DNA, 20 bp, Artificial Sequence
  chemically synthesized
ctcaggcattaaaatgtctg

SEQ ID NO: 235872 - DNA, 20 bp, Artificial Sequence
  chemically synthesized
ctgcagacattttaatgcct

SEQ ID NO: 235873 - DNA, 20 bp, Artificial Sequence
  chemically synthesized
cagacattttaatgcctgag

SEQ ID NO: 235874 - DNA, 20 bp, Artificial Sequence
  chemically synthesized
atttgttcttattgctactc

SEQ ID NO: 235875 - DNA, 20 bp, Artificial Sequence
  chemically synthesized
aatttgttcttattgctact

SEQ ID NO: 235876 - DNA, 20 bp, Artificial Sequence
  chemically synthesized
tttaatgcctgagtagcaat

SEQ ID NO: 235877 - DNA, 20 bp, Artificial Sequence
  chemically synthesized
taccctattaaaagtttttt

SEQ ID NO: 235878 - DNA, 20 bp, Artificial Sequence
  chemically synthesized
attaccaaaaaaacttttaa

SEQ ID NO: 235879 - DNA, 20 bp, Artificial Sequence
  chemically synthesized
ttaccaaaaaaacttttaat

SEQ ID NO: 235880 - DNA, 20 bp, Artificial Sequence
  chemically synthesized
taccaaaaaaacttttaata

SEQ ID NO: 235881 - DNA, 20 bp, Artificial Sequence
  chemically synthesized
aatttattataccctattaa

SEQ ID NO: 235882 - DNA, 20 bp, Artificial Sequence
  chemically synthesized
ttaatagggtataataaatt

SEQ ID NO: 235883 - DNA, 20 bp, Artificial Sequence
  chemically synthesized
tataataaattaagactgaa

SEQ ID NO: 235884 - DNA, 20 bp, Artificial Sequence
  chemically synthesized
cccacgtttgcattaccatt

SEQ ID NO: 235885 - DNA, 20 bp, Artificial Sequence
  chemically synthesized
actgaatggtaatgcaaacg

SEQ ID NO: 235886 - DNA, 20 bp, Artificial Sequence
  chemically synthesized
ctgaatggtaatgcaaacgt

SEQ ID NO: 235887 - DNA, 20 bp, Artificial Sequence
  chemically synthesized
taatgcaaacgtgggtacaa

SEQ ID NO: 235888 - DNA, 20 bp, Artificial Sequence
  chemically synthesized
aatgcaaacgtgggtacaac

SEQ ID NO: 235889 - DNA, 20 bp, Artificial Sequence
  chemically synthesized
gtgttgttgggtcattatat

SEQ ID NO: 235890 - DNA, 20 bp, Artificial Sequence
  chemically synthesized
tccacactctaagtgttgtt

SEQ ID NO: 235891 - DNA, 20 bp, Artificial Sequence
  chemically synthesized
ttccacactctaagtgttgt

SEQ ID NO: 235892 - DNA, 20 bp, Artificial Sequence
  chemically synthesized
tataatgacccaacaacact

SEQ ID NO: 235893 - DNA, 20 bp, Artificial Sequence
  chemically synthesized
taatgacccaacaacactta

SEQ ID NO: 235894 - DNA, 20 bp, Artificial Sequence
  chemically synthesized
acccaacaacacttagagtg

SEQ ID NO: 235895 - DNA, 20 bp, Artificial Sequence
  chemically synthesized
caacgttgtttccacactct

SEQ ID NO: 235896 - DNA, 20 bp, Artificial Sequence
  chemically synthesized
ttagagtgtggaaacaacgt

SEQ ID NO: 235897 - DNA, 20 bp, Artificial Sequence
  chemically synthesized
tggaaacaacgttggtattc

SEQ ID NO: 235898 - DNA, 20 bp, Artificial Sequence
  chemically synthesized
ggaaacaacgttggtattct

SEQ ID NO: 235899 - DNA, 20 bp, Artificial Sequence
  chemically synthesized
ttaaccgtggtcgtatatcc

SEQ ID NO: 235900 - DNA, 20 bp, Artificial Sequence
  chemically synthesized
tattctgggatatacgacca

SEQ ID NO: 235901 - DNA, 20 bp, Artificial Sequence
  chemically synthesized
aaaacaattaggattaaccg

SEQ ID NO: 235902 - DNA, 20 bp, Artificial Sequence
  chemically synthesized
ttgacaagggaaaaacaatt

SEQ ID NO: 235903 - DNA, 20 bp, Artificial Sequence
  chemically synthesized
tttgacaagggaaaaacaat

SEQ ID NO: 235904 - DNA, 20 bp, Artificial Sequence
  chemically synthesized
gtgcaatttctatttgacaa

SEQ ID NO: 235905 - DNA, 20 bp, Artificial Sequence
  chemically synthesized
attgtttttcccttgtcaaa

SEQ ID NO: 235906 - DNA, 20 bp, Artificial Sequence
  chemically synthesized
tgtgcaatttctatttgaca

SEQ ID NO: 235907 - DNA, 20 bp, Artificial Sequence
  chemically synthesized
atgtgcaatttctatttgac

SEQ ID NO: 235908 - DNA, 20 bp, Artificial Sequence
  chemically synthesized
gaaattgcacatcaatctca

SEQ ID NO: 235909 - DNA, 20 bp, Artificial Sequence
  chemically synthesized
tgaacagtttgtaatacttt

SEQ ID NO: 235910 - DNA, 20 bp, Artificial Sequence
  chemically synthesized
aaccatttgcatgtaatgaa

SEQ ID NO: 235911 - DNA, 20 bp, Artificial Sequence
  chemically synthesized
aactgttcattacatgcaaa

SEQ ID NO: 235912 - DNA, 20 bp, Artificial Sequence
  chemically synthesized
atgcaaatggttatgttctg

SEQ ID NO: 235913 - DNA, 20 bp, Artificial Sequence
  chemically synthesized
tgcaaatggttatgttctgc

SEQ ID NO: 235914 - DNA, 20 bp, Artificial Sequence
  chemically synthesized
gagtccccttggagagcctg

SEQ ID NO: 235915 - DNA, 20 bp, Artificial Sequence
  chemically synthesized
ttatgttctgcaggctctcc

SEQ ID NO: 235916 - DNA, 20 bp, Artificial Sequence
  chemically synthesized
tatgttctgcaggctctcca

SEQ ID NO: 235917 - DNA, 20 bp, Artificial Sequence
  chemically synthesized
atgttctgcaggctctccaa

SEQ ID NO: 235918 - DNA, 20 bp, Artificial Sequence
  chemically synthesized
tgttctgcaggctctccaag

SEQ ID NO: 235919 - DNA, 20 bp, Artificial Sequence
  chemically synthesized
gaaggttgagtccccttgga

SEQ ID NO: 235920 - DNA, 20 bp, Artificial Sequence
  chemically synthesized
aagaaggttgagtccccttg

SEQ ID NO: 235921 - DNA, 20 bp, Artificial Sequence
  chemically synthesized
taaagaaggttgagtcccct

SEQ ID NO: 235922 - DNA, 20 bp, Artificial Sequence
  chemically synthesized
ctccttttgtaaagaaggtt

SEQ ID NO: 235923 - DNA, 20 bp, Artificial Sequence
  chemically synthesized
cctggctccttttgtaaaga

SEQ ID NO: 235924 - DNA, 20 bp, Artificial Sequence
  chemically synthesized
gcctggctccttttgtaaag

SEQ ID NO: 235925 - DNA, 20 bp, Artificial Sequence
  chemically synthesized
ggactcaaccttctttacaa

SEQ ID NO: 235926 - DNA, 20 bp, Artificial Sequence
  chemically synthesized
gactcaaccttctttacaaa

SEQ ID NO: 235927 - DNA, 20 bp, Artificial Sequence
  chemically synthesized
ctagcctggctccttttgta

SEQ ID NO: 235928 - DNA, 20 bp, Artificial Sequence
  chemically synthesized
ctcaaccttctttacaaaag

SEQ ID NO: 235929 - DNA, 20 bp, Artificial Sequence
  chemically synthesized
accttctttacaaaaggagc

SEQ ID NO: 235930 - DNA, 20 bp, Artificial Sequence
  chemically synthesized
ccttctttacaaaaggagcc

SEQ ID NO: 235931 - DNA, 20 bp, Artificial Sequence
  chemically synthesized
ctttacaaaaggagccaggc

SEQ ID NO: 235932 - DNA, 20 bp, Artificial Sequence
  chemically synthesized
tacaaaaggagccaggctag

SEQ ID NO: 235933 - DNA, 20 bp, Artificial Sequence
  chemically synthesized
gagaaactctgcttctagcc

SEQ ID NO: 235934 - DNA, 20 bp, Artificial Sequence
  chemically synthesized
aaaaggagccaggctagaag

SEQ ID NO: 235935 - DNA, 20 bp, Artificial Sequence
  chemically synthesized
aaggagccaggctagaagca

SEQ ID NO: 235936 - DNA, 20 bp, Artificial Sequence
  chemically synthesized
cattagagaaactctgcttc

SEQ ID NO: 235937 - DNA, 20 bp, Artificial Sequence
  chemically synthesized
aagcagagtttctctaatga

SEQ ID NO: 235938 - DNA, 20 bp, Artificial Sequence
  chemically synthesized
atggatacttactgtcatta

SEQ ID NO: 235939 - DNA, 20 bp, Artificial Sequence
  chemically synthesized
taatggatacttactgtcat

SEQ ID NO: 235940 - DNA, 20 bp, Artificial Sequence
  chemically synthesized
agagtttctctaatgacagt

SEQ ID NO: 235941 - DNA, 20 bp, Artificial Sequence
  chemically synthesized
taatgacagtaagtatccat

SEQ ID NO: 235942 - DNA, 20 bp, Artificial Sequence
  chemically synthesized
atgacagtaagtatccatta

SEQ ID NO: 235943 - DNA, 20 bp, Artificial Sequence
  chemically synthesized
ttatatatgaggaactctaa

SEQ ID NO: 235944 - DNA, 20 bp, Artificial Sequence
  chemically synthesized
cattagagttcctcatatat

SEQ ID NO: 235945 - DNA, 20 bp, Artificial Sequence
  chemically synthesized
gtctctcttgcttatatatg

SEQ ID NO: 235946 - DNA, 20 bp, Artificial Sequence
  chemically synthesized
agtctctcttgcttatatat

SEQ ID NO: 235947 - DNA, 20 bp, Artificial Sequence
  chemically synthesized
agagttcctcatatataagc

SEQ ID NO: 235948 - DNA, 20 bp, Artificial Sequence
  chemically synthesized
agttcctcatatataagcaa

SEQ ID NO: 235949 - DNA, 20 bp, Artificial Sequence
  chemically synthesized
ttcctcatatataagcaaga

SEQ ID NO: 235950 - DNA, 20 bp, Artificial Sequence
  chemically synthesized
ctgactttgggaatcagagg

SEQ ID NO: 235951 - DNA, 20 bp, Artificial Sequence
  chemically synthesized
aacctgactttgggaatcag

SEQ ID NO: 235952 - DNA, 20 bp, Artificial Sequence
  chemically synthesized
aaacctgactttgggaatca

SEQ ID NO: 235953 - DNA, 20 bp, Artificial Sequence
  chemically synthesized
gagactgcctctgattccca

SEQ ID NO: 235954 - DNA, 20 bp, Artificial Sequence
  chemically synthesized
gaaaacctgactttgggaat

SEQ ID NO: 235955 - DNA, 20 bp, Artificial Sequence
  chemically synthesized
ctgcctctgattcccaaagt

SEQ ID NO: 235956 - DNA, 20 bp, Artificial Sequence
  chemically synthesized
tgcctctgattcccaaagtc

SEQ ID NO: 235957 - DNA, 20 bp, Artificial Sequence
  chemically synthesized
acttgggaaaacctgacttt

SEQ ID NO: 235958 - DNA, 20 bp, Artificial Sequence
  chemically synthesized
gacttgggaaaacctgactt

SEQ ID NO: 235959 - DNA, 20 bp, Artificial Sequence
  chemically synthesized
tcccaaagtcaggttttccc

SEQ ID NO: 235960 - DNA, 20 bp, Artificial Sequence
  chemically synthesized
aaagtcaggttttcccaagt

SEQ ID NO: 235961 - DNA, 20 bp, Artificial Sequence
  chemically synthesized
tgggatacctagtctgactt

SEQ ID NO: 235962 - DNA, 20 bp, Artificial Sequence
  chemically synthesized
ctgggatacctagtctgact

SEQ ID NO: 235963 - DNA, 20 bp, Artificial Sequence
  chemically synthesized
caggttttcccaagtcagac

SEQ ID NO: 235964 - DNA, 20 bp, Artificial Sequence
  chemically synthesized
aggttttcccaagtcagact

SEQ ID NO: 235965 - DNA, 20 bp, Artificial Sequence
  chemically synthesized
ccaagtcagactaggtatcc

SEQ ID NO: 235966 - DNA, 20 bp, Artificial Sequence
  chemically synthesized
cattacacctctgggatacc

SEQ ID NO: 235967 - DNA, 20 bp, Artificial Sequence
  chemically synthesized
aagtcagactaggtatccca

SEQ ID NO: 235968 - DNA, 20 bp, Artificial Sequence
  chemically synthesized
agtcagactaggtatcccag

SEQ ID NO: 235969 - DNA, 20 bp, Artificial Sequence
  chemically synthesized
cagtcctccattacacctct

SEQ ID NO: 235970 - DNA, 20 bp, Artificial Sequence
  chemically synthesized
acagtcctccattacacctc

SEQ ID NO: 235971 - DNA, 20 bp, Artificial Sequence
  chemically synthesized
taggtatcccagaggtgtaa

SEQ ID NO: 235972 - DNA, 20 bp, Artificial Sequence
  chemically synthesized
ggtatcccagaggtgtaatg

SEQ ID NO: 235973 - DNA, 20 bp, Artificial Sequence
  chemically synthesized
gtatcccagaggtgtaatgg

SEQ ID NO: 235974 - DNA, 20 bp, Artificial Sequence
  chemically synthesized
tgtaatggaggactgtcaat

SEQ ID NO: 235975 - DNA, 20 bp, Artificial Sequence
  chemically synthesized
gtaatggaggactgtcaatt

SEQ ID NO: 235976 - DNA, 20 bp, Artificial Sequence
  chemically synthesized
taatggaggactgtcaatta

SEQ ID NO: 235977 - DNA, 20 bp, Artificial Sequence
  chemically synthesized
ttttcctgccccctaattga

SEQ ID NO: 235978 - DNA, 20 bp, Artificial Sequence
  chemically synthesized
aatggaggactgtcaattag

SEQ ID NO: 235979 - DNA, 20 bp, Artificial Sequence
  chemically synthesized
atggaggactgtcaattagg

SEQ ID NO: 235980 - DNA, 20 bp, Artificial Sequence
  chemically synthesized
gaggactgtcaattaggggg

SEQ ID NO: 235981 - DNA, 20 bp, Artificial Sequence
  chemically synthesized
aggactgtcaattagggggc

SEQ ID NO: 235982 - DNA, 20 bp, Artificial Sequence
  chemically synthesized
ttagggggcaggaaaaataa

SEQ ID NO: 235983 - DNA, 20 bp, Artificial Sequence
  chemically synthesized
ggggcaggaaaaataacagc

SEQ ID NO: 235984 - DNA, 20 bp, Artificial Sequence
  chemically synthesized
caaatggtgggttgtttttc

SEQ ID NO: 235985 - DNA, 20 bp, Artificial Sequence
  chemically synthesized
tctggcctaggacaaatggt

SEQ ID NO: 235986 - DNA, 20 bp, Artificial Sequence
  chemically synthesized
atctggcctaggacaaatgg

SEQ ID NO: 235987 - DNA, 20 bp, Artificial Sequence
  chemically synthesized
aaacaacccaccatttgtcc

SEQ ID NO: 235988 - DNA, 20 bp, Artificial Sequence
  chemically synthesized
tggatctggcctaggacaaa

SEQ ID NO: 235989 - DNA, 20 bp, Artificial Sequence
  chemically synthesized
aacaacccaccatttgtcct

SEQ ID NO: 235990 - DNA, 20 bp, Artificial Sequence
  chemically synthesized
acccaccatttgtcctaggc

SEQ ID NO: 235991 - DNA, 20 bp, Artificial Sequence
  chemically synthesized
gaaagtactggatctggcct

SEQ ID NO: 235992 - DNA, 20 bp, Artificial Sequence
  chemically synthesized
agaaagtactggatctggcc

SEQ ID NO: 235993 - DNA, 20 bp, Artificial Sequence
  chemically synthesized
catttgtcctaggccagatc

SEQ ID NO: 235994 - DNA, 20 bp, Artificial Sequence
  chemically synthesized
actccagaaagtactggatc

SEQ ID NO: 235995 - DNA, 20 bp, Artificial Sequence
  chemically synthesized
gtaaacactccagaaagtac

SEQ ID NO: 235996 - DNA, 20 bp, Artificial Sequence
  chemically synthesized
aggccagatccagtactttc

SEQ ID NO: 235997 - DNA, 20 bp, Artificial Sequence
  chemically synthesized
gccagatccagtactttctg

SEQ ID NO: 235998 - DNA, 20 bp, Artificial Sequence
  chemically synthesized
cagtaagtaaacactccaga

SEQ ID NO: 235999 - DNA, 20 bp, Artificial Sequence
  chemically synthesized
agggcagtaagtaaacactc

SEQ ID NO: 236000 - DNA, 20 bp, Artificial Sequence
  chemically synthesized
cgtctaaagcaaagggcagt

SEQ ID NO: 236001 - DNA, 20 bp, Artificial Sequence
  chemically synthesized
acaacgtctaaagcaaaggg

SEQ ID NO: 236002 - DNA, 20 bp, Artificial Sequence
  chemically synthesized
ttacttactgccctttgctt

SEQ ID NO: 236003 - DNA, 20 bp, Artificial Sequence
  chemically synthesized
ggcacaacgtctaaagcaaa

SEQ ID NO: 236004 - DNA, 20 bp, Artificial Sequence
  chemically synthesized
aggcacaacgtctaaagcaa

SEQ ID NO: 236005 - DNA, 20 bp, Artificial Sequence
  chemically synthesized
aaggcacaacgtctaaagca

SEQ ID NO: 236006 - DNA, 20 bp, Artificial Sequence
  chemically synthesized
gtcttaaggcacaacgtcta

SEQ ID NO: 236007 - DNA, 20 bp, Artificial Sequence
  chemically synthesized
tgctttagacgttgtgcctt

SEQ ID NO: 236008 - DNA, 20 bp, Artificial Sequence
  chemically synthesized
ctcatgagttcaacgtctta

SEQ ID NO: 236009 - DNA, 20 bp, Artificial Sequence
  chemically synthesized
tctcatgagttcaacgtctt

SEQ ID NO: 236010 - DNA, 20 bp, Artificial Sequence
  chemically synthesized
ccttaagacgttgaactcat

SEQ ID NO: 236011 - DNA, 20 bp, Artificial Sequence
  chemically synthesized
ttatgagctcacagtctcat

SEQ ID NO: 236012 - DNA, 20 bp, Artificial Sequence
  chemically synthesized
cgttgaactcatgagactgt

SEQ ID NO: 236013 - DNA, 20 bp, Artificial Sequence
  chemically synthesized
cttttctctttatgagctca

SEQ ID NO: 236014 - DNA, 20 bp, Artificial Sequence
  chemically synthesized
catgagactgtgagctcata

SEQ ID NO: 236015 - DNA, 20 bp, Artificial Sequence
  chemically synthesized
tgagactgtgagctcataaa

SEQ ID NO: 236016 - DNA, 20 bp, Artificial Sequence
  chemically synthesized
agagctccttttctctttat

SEQ ID NO: 236017 - DNA, 20 bp, Artificial Sequence
  chemically synthesized
ctgtgagctcataaagagaa

SEQ ID NO: 236018 - DNA, 20 bp, Artificial Sequence
  chemically synthesized
tgtgagctcataaagagaaa

SEQ ID NO: 236019 - DNA, 20 bp, Artificial Sequence
  chemically synthesized
tgagctcataaagagaaaag

SEQ ID NO: 236020 - DNA, 20 bp, Artificial Sequence
  chemically synthesized
ataaagagaaaaggagctct

SEQ ID NO: 236021 - DNA, 20 bp, Artificial Sequence
  chemically synthesized
agagaaaaggagctcttagt

SEQ ID NO: 236022 - DNA, 20 bp, Artificial Sequence
  chemically synthesized
aggaatacagagctgactaa

SEQ ID NO: 236023 - DNA, 20 bp, Artificial Sequence
  chemically synthesized
ctaggaatacagagctgact

SEQ ID NO: 236024 - DNA, 20 bp, Artificial Sequence
  chemically synthesized
tgcttgctgctaggaataca

SEQ ID NO: 236025 - DNA, 20 bp, Artificial Sequence
  chemically synthesized
cttagtcagctctgtattcc

SEQ ID NO: 236026 - DNA, 20 bp, Artificial Sequence
  chemically synthesized
actgcttgctgctaggaata

SEQ ID NO: 236027 - DNA, 20 bp, Artificial Sequence
  chemically synthesized
agtcagctctgtattcctag

SEQ ID NO: 236028 - DNA, 20 bp, Artificial Sequence
  chemically synthesized
agctctgtattcctagcagc

SEQ ID NO: 236029 - DNA, 20 bp, Artificial Sequence
  chemically synthesized
agcagatactgcttgctgct

SEQ ID NO: 236030 - DNA, 20 bp, Artificial Sequence
  chemically synthesized
aagcagatactgcttgctgc

SEQ ID NO: 236031 - DNA, 20 bp, Artificial Sequence
  chemically synthesized
tctgtattcctagcagcaag

SEQ ID NO: 236032 - DNA, 20 bp, Artificial Sequence
  chemically synthesized
tgatcctactgtgtgcaaag

SEQ ID NO: 236033 - DNA, 20 bp, Artificial Sequence
  chemically synthesized
agcagtatctgctttgcaca

SEQ ID NO: 236034 - DNA, 20 bp, Artificial Sequence
  chemically synthesized
ttgtgatcctactgtgtgca

SEQ ID NO: 236035 - DNA, 20 bp, Artificial Sequence
  chemically synthesized
agtatctgctttgcacacag

SEQ ID NO: 236036 - DNA, 20 bp, Artificial Sequence
  chemically synthesized
gtatctgctttgcacacagt

SEQ ID NO: 236037 - DNA, 20 bp, Artificial Sequence
  chemically synthesized
cacaatatatgtttgttaca

SEQ ID NO: 236038 - DNA, 20 bp, Artificial Sequence
  chemically synthesized
acaatatatgtttgttacat

SEQ ID NO: 236039 - DNA, 20 bp, Artificial Sequence
  chemically synthesized
tatgtttgttacatgggttc

SEQ ID NO: 236040 - DNA, 20 bp, Artificial Sequence
  chemically synthesized
ttggagcatatgttaaatac

SEQ ID NO: 236041 - DNA, 20 bp, Artificial Sequence
  chemically synthesized
gtatttaacatatgctccaa

SEQ ID NO: 236042 - DNA, 20 bp, Artificial Sequence
  chemically synthesized
tatttaacatatgctccaat

SEQ ID NO: 236043 - DNA, 20 bp, Artificial Sequence
  chemically synthesized
ccctgttctcttacccattg

SEQ ID NO: 236044 - DNA, 20 bp, Artificial Sequence
  chemically synthesized
taacatatgctccaatgggt

SEQ ID NO: 236045 - DNA, 20 bp, Artificial Sequence
  chemically synthesized
ggccctgttctcttacccat

SEQ ID NO: 236046 - DNA, 20 bp, Artificial Sequence
  chemically synthesized
acatatgctccaatgggtaa

SEQ ID NO: 236047 - DNA, 20 bp, Artificial Sequence
  chemically synthesized
tgctccaatgggtaagagaa

SEQ ID NO: 236048 - DNA, 20 bp, Artificial Sequence
  chemically synthesized
gctccaatgggtaagagaac

SEQ ID NO: 236049 - DNA, 20 bp, Artificial Sequence
  chemically synthesized
ctccaatgggtaagagaaca

SEQ ID NO: 236050 - DNA, 20 bp, Artificial Sequence
  chemically synthesized
ctgatactttaacaatatga

SEQ ID NO: 236051 - DNA, 20 bp, Artificial Sequence
  chemically synthesized
acagggccatcatattgtta

SEQ ID NO: 236052 - DNA, 20 bp, Artificial Sequence
  chemically synthesized
ccatcatattgttaaagtat

SEQ ID NO: 236053 - DNA, 20 bp, Artificial Sequence
  chemically synthesized
catcatattgttaaagtatc

SEQ ID NO: 236054 - DNA, 20 bp, Artificial Sequence
  chemically synthesized
tcaggcaatgtgaaaatttt

SEQ ID NO: 236055 - DNA, 20 bp, Artificial Sequence
  chemically synthesized
aattttaagtgctctgtaca

SEQ ID NO: 236056 - DNA, 20 bp, Artificial Sequence
  chemically synthesized
cttcacctcttctgtgtaca

SEQ ID NO: 236057 - DNA, 20 bp, Artificial Sequence
  chemically synthesized
tttaagtgctctgtacacag

SEQ ID NO: 236058 - DNA, 20 bp, Artificial Sequence
  chemically synthesized
tccttcacctcttctgtgta

SEQ ID NO: 236059 - DNA, 20 bp, Artificial Sequence
  chemically synthesized
taagtgctctgtacacagaa

SEQ ID NO: 236060 - DNA, 20 bp, Artificial Sequence
  chemically synthesized
aagtgctctgtacacagaag

SEQ ID NO: 236061 - DNA, 20 bp, Artificial Sequence
  chemically synthesized
ctctgtacacagaagaggtg

SEQ ID NO: 236062 - DNA, 20 bp, Artificial Sequence
  chemically synthesized
tctgtacacagaagaggtga

SEQ ID NO: 236063 - DNA, 20 bp, Artificial Sequence
  chemically synthesized
gtacacagaagaggtgaagg

SEQ ID NO: 236064 - DNA, 20 bp, Artificial Sequence
  chemically synthesized
aggtgaaggaagctcaatgt

SEQ ID NO: 236065 - DNA, 20 bp, Artificial Sequence
  chemically synthesized
gtgaaggaagctcaatgtaa

SEQ ID NO: 236066 - DNA, 20 bp, Artificial Sequence
  chemically synthesized
aaaacattctctcttacatt

SEQ ID NO: 236067 - DNA, 20 bp, Artificial Sequence
  chemically synthesized
gaaggaagctcaatgtaaga

SEQ ID NO: 236068 - DNA, 20 bp, Artificial Sequence
  chemically synthesized
caatgtaagagagaatgttt

SEQ ID NO: 236069 - DNA, 20 bp, Artificial Sequence
  chemically synthesized
gagaatgttttggctatgaa

SEQ ID NO: 236070 - DNA, 20 bp, Artificial Sequence
  chemically synthesized
aagtttgtccttgcttttca

SEQ ID NO: 236071 - DNA, 20 bp, Artificial Sequence
  chemically synthesized
atgttttggctatgaaaagc

SEQ ID NO: 236072 - DNA, 20 bp, Artificial Sequence
  chemically synthesized
tgttttggctatgaaaagca

SEQ ID NO: 236073 - DNA, 20 bp, Artificial Sequence
  chemically synthesized
atgaaaagcaaggacaaact

SEQ ID NO: 236074 - DNA, 20 bp, Artificial Sequence
  chemically synthesized
tgaaaagcaaggacaaactt

SEQ ID NO: 236075 - DNA, 20 bp, Artificial Sequence
  chemically synthesized
gaaaagcaaggacaaacttg

SEQ ID NO: 236076 - DNA, 20 bp, Artificial Sequence
  chemically synthesized
acctgagacaaatgatcccc

SEQ ID NO: 236077 - DNA, 20 bp, Artificial Sequence
  chemically synthesized
aacttggggatcatttgtct

SEQ ID NO: 236078 - DNA, 20 bp, Artificial Sequence
  chemically synthesized
acttggggatcatttgtctc

SEQ ID NO: 236079 - DNA, 20 bp, Artificial Sequence
  chemically synthesized
atacttttattgtattacct

SEQ ID NO: 236080 - DNA, 20 bp, Artificial Sequence
  chemically synthesized
tgtctcaggtaatacaataa

SEQ ID NO: 236081 - DNA, 20 bp, Artificial Sequence
  chemically synthesized
attgaaaatgtaatattcag

SEQ ID NO: 236082 - DNA, 20 bp, Artificial Sequence
  chemically synthesized
tatattgaaaatgtaatatt

SEQ ID NO: 236083 - DNA, 20 bp, Artificial Sequence
  chemically synthesized
aatcaatttttctacgtacc

SEQ ID NO: 236084 - DNA, 20 bp, Artificial Sequence
  chemically synthesized
atcaatttttctacgtaccg

SEQ ID NO: 236085 - DNA, 20 bp, Artificial Sequence
  chemically synthesized
caccaatatacctcggtacg

SEQ ID NO: 236086 - DNA, 20 bp, Artificial Sequence
  chemically synthesized
tctcgatcaccaatatacct

SEQ ID NO: 236087 - DNA, 20 bp, Artificial Sequence
  chemically synthesized
ttctacgtaccgaggtatat

SEQ ID NO: 236088 - DNA, 20 bp, Artificial Sequence
  chemically synthesized
accgaggtatattggtgatc

SEQ ID NO: 236089 - DNA, 20 bp, Artificial Sequence
  chemically synthesized
aggtatattggtgatcgaga

SEQ ID NO: 236090 - DNA, 20 bp, Artificial Sequence
  chemically synthesized
attggtgatcgagaaagacc

SEQ ID NO: 236091 - DNA, 20 bp, Artificial Sequence
  chemically synthesized
atgaacatattttgggtact

SEQ ID NO: 236092 - DNA, 20 bp, Artificial Sequence
  chemically synthesized
cattagaatgaacatatttt

SEQ ID NO: 236093 - DNA, 20 bp, Artificial Sequence
  chemically synthesized
ccattagaatgaacatattt

SEQ ID NO: 236094 - DNA, 20 bp, Artificial Sequence
  chemically synthesized
ccaaaatatgttcattctaa

SEQ ID NO: 236095 - DNA, 20 bp, Artificial Sequence
  chemically synthesized
atatgttcattctaatggaa

SEQ ID NO: 236096 - DNA, 20 bp, Artificial Sequence
  chemically synthesized
atgtttattatcttttccat

SEQ ID NO: 236097 - DNA, 20 bp, Artificial Sequence
  chemically synthesized
aaacatgaaaacacatacta

SEQ ID NO: 236098 - DNA, 20 bp, Artificial Sequence
  chemically synthesized
gaaaacacatactacagttt

SEQ ID NO: 236099 - DNA, 20 bp, Artificial Sequence
  chemically synthesized
tctgtcacttgctgaaactg

SEQ ID NO: 236100 - DNA, 20 bp, Artificial Sequence
  chemically synthesized
acacatactacagtttcagc

SEQ ID NO: 236101 - DNA, 20 bp, Artificial Sequence
  chemically synthesized
actacagtttcagcaagtga

SEQ ID NO: 236102 - DNA, 20 bp, Artificial Sequence
  chemically synthesized
tacagtttcagcaagtgaca

SEQ ID NO: 236103 - DNA, 20 bp, Artificial Sequence
  chemically synthesized
cagcaagtgacagagttatg

SEQ ID NO: 236104 - DNA, 20 bp, Artificial Sequence
  chemically synthesized
aagtgacagagttatgaaga

SEQ ID NO: 236105 - DNA, 20 bp, Artificial Sequence
  chemically synthesized
acagagttatgaagaaagtt

SEQ ID NO: 236106 - DNA, 20 bp, Artificial Sequence
  chemically synthesized
gagttatgaagaaagttaag

SEQ ID NO: 236107 - DNA, 20 bp, Artificial Sequence
  chemically synthesized
agaaagttaagcagatctcc

SEQ ID NO: 236108 - DNA, 20 bp, Artificial Sequence
  chemically synthesized
agttaagcagatctcccaga

SEQ ID NO: 236109 - DNA, 20 bp, Artificial Sequence
  chemically synthesized
ttaagcagatctcccagaaa

SEQ ID NO: 236110 - DNA, 20 bp, Artificial Sequence
  chemically synthesized
caaaattgaactctttctgg

SEQ ID NO: 236111 - DNA, 20 bp, Artificial Sequence
  chemically synthesized
cacaaaattgaactctttct

SEQ ID NO: 236112 - DNA, 20 bp, Artificial Sequence
  chemically synthesized
acacaaaattgaactctttc

SEQ ID NO: 236113 - DNA, 20 bp, Artificial Sequence
  chemically synthesized
cgtacgtgtgtgctttcttt

SEQ ID NO: 236114 - DNA, 20 bp, Artificial Sequence
  chemically synthesized
taactcccccatcttaaaga

SEQ ID NO: 236115 - DNA, 20 bp, Artificial Sequence
  chemically synthesized
cgtgtgtgctttctttaaga

SEQ ID NO: 236116 - DNA, 20 bp, Artificial Sequence
  chemically synthesized
gtgtgtgctttctttaagat

SEQ ID NO: 236117 - DNA, 20 bp, Artificial Sequence
  chemically synthesized
tgtgtgctttctttaagatg

SEQ ID NO: 236118 - DNA, 20 bp, Artificial Sequence
  chemically synthesized
tttgtaactcccccatctta

SEQ ID NO: 236119 - DNA, 20 bp, Artificial Sequence
  chemically synthesized
gtgtgctttctttaagatgg

SEQ ID NO: 236120 - DNA, 20 bp, Artificial Sequence
  chemically synthesized
gtgctttctttaagatgggg

SEQ ID NO: 236121 - DNA, 20 bp, Artificial Sequence
  chemically synthesized
ttaagatgggggagttacaa

SEQ ID NO: 236122 - DNA, 20 bp, Artificial Sequence
  chemically synthesized
taagatgggggagttacaaa

SEQ ID NO: 236123 - DNA, 20 bp, Artificial Sequence
  chemically synthesized
gtgctctaattttatattca

SEQ ID NO: 236124 - DNA, 20 bp, Artificial Sequence
  chemically synthesized
catatctgtgaatataaaat

SEQ ID NO: 236125 - DNA, 20 bp, Artificial Sequence
  chemically synthesized
tatctgtgaatataaaatta

SEQ ID NO: 236126 - DNA, 20 bp, Artificial Sequence
  chemically synthesized
ttagagcacaaatatatata

SEQ ID NO: 236127 - DNA, 20 bp, Artificial Sequence
  chemically synthesized
tagagcacaaatatatataa

SEQ ID NO: 236128 - DNA, 20 bp, Artificial Sequence
  chemically synthesized
agagcacaaatatatataaa

SEQ ID NO: 236129 - DNA, 20 bp, Artificial Sequence
  chemically synthesized
gcacaaatatatataaaggg

SEQ ID NO: 236130 - DNA, 20 bp, Artificial Sequence
  chemically synthesized
gggaagtgtacaaaaattct

SEQ ID NO: 236131 - DNA, 20 bp, Artificial Sequence
  chemically synthesized
gaagtgtacaaaaattctga

SEQ ID NO: 236132 - DNA, 20 bp, Artificial Sequence
  chemically synthesized
aagtgtacaaaaattctgag

SEQ ID NO: 236133 - DNA, 20 bp, Artificial Sequence
  chemically synthesized
agtgtacaaaaattctgaga

SEQ ID NO: 236134 - DNA, 20 bp, Artificial Sequence
  chemically synthesized
tgtacaaaaattctgagagg

SEQ ID NO: 236135 - DNA, 20 bp, Artificial Sequence
  chemically synthesized
tgtcccaatctactccctct

SEQ ID NO: 236136 - DNA, 20 bp, Artificial Sequence
  chemically synthesized
acaaaaattctgagagggag

SEQ ID NO: 236137 - DNA, 20 bp, Artificial Sequence
  chemically synthesized
aattctgagagggagtagat

SEQ ID NO: 236138 - DNA, 20 bp, Artificial Sequence
  chemically synthesized
attctgagagggagtagatt

SEQ ID NO: 236139 - DNA, 20 bp, Artificial Sequence
  chemically synthesized
agagggagtagattgggaca

SEQ ID NO: 236140 - DNA, 20 bp, Artificial Sequence
  chemically synthesized
ggagtagattgggacatggt

SEQ ID NO: 236141 - DNA, 20 bp, Artificial Sequence
  chemically synthesized
attgggacatggtgagaaac

SEQ ID NO: 236142 - DNA, 20 bp, Artificial Sequence
  chemically synthesized
tgggacatggtgagaaactg

SEQ ID NO: 236143 - DNA, 20 bp, Artificial Sequence
  chemically synthesized
acatggtgagaaactggaga

SEQ ID NO: 236144 - DNA, 20 bp, Artificial Sequence
  chemically synthesized
catggtgagaaactggagat

SEQ ID NO: 236145 - DNA, 20 bp, Artificial Sequence
  chemically synthesized
atggtgagaaactggagata

SEQ ID NO: 236146 - DNA, 20 bp, Artificial Sequence
  chemically synthesized
agagggctctaccctatctc

SEQ ID NO: 236147 - DNA, 20 bp, Artificial Sequence
  chemically synthesized
gtgagaaactggagataggg

SEQ ID NO: 236148 - DNA, 20 bp, Artificial Sequence
  chemically synthesized
gagaaactggagatagggta

SEQ ID NO: 236149 - DNA, 20 bp, Artificial Sequence
  chemically synthesized
ggagatagggtagagccctc

SEQ ID NO: 236150 - DNA, 20 bp, Artificial Sequence
  chemically synthesized
gatagggtagagccctctgg

SEQ ID NO: 236151 - DNA, 20 bp, Artificial Sequence
  chemically synthesized
tagggtagagccctctggta

SEQ ID NO: 236152 - DNA, 20 bp, Artificial Sequence
  chemically synthesized
ttgcttttctctctaccaga

SEQ ID NO: 236153 - DNA, 20 bp, Artificial Sequence
  chemically synthesized
tttgcttttctctctaccag

SEQ ID NO: 236154 - DNA, 20 bp, Artificial Sequence
  chemically synthesized
gggtagagccctctggtaga

SEQ ID NO: 236155 - DNA, 20 bp, Artificial Sequence
  chemically synthesized
atttgcttttctctctacca

SEQ ID NO: 236156 - DNA, 20 bp, Artificial Sequence
  chemically synthesized
aaatttgcttttctctctac

SEQ ID NO: 236157 - DNA, 20 bp, Artificial Sequence
  chemically synthesized
gagccctctggtagagagaa

SEQ ID NO: 236158 - DNA, 20 bp, Artificial Sequence
  chemically synthesized
tagagagaaaagcaaattta

SEQ ID NO: 236159 - DNA, 20 bp, Artificial Sequence
  chemically synthesized
agagagaaaagcaaatttaa

SEQ ID NO: 236160 - DNA, 20 bp, Artificial Sequence
  chemically synthesized
gagaaaagcaaatttaaagg

SEQ ID NO: 236161 - DNA, 20 bp, Artificial Sequence
  chemically synthesized
gcaaatttaaaggtagaaac

SEQ ID NO: 236162 - DNA, 20 bp, Artificial Sequence
  chemically synthesized
aaaggtagaaacaagcattc

SEQ ID NO: 236163 - DNA, 20 bp, Artificial Sequence
  chemically synthesized
aaggtagaaacaagcattct

SEQ ID NO: 236164 - DNA, 20 bp, Artificial Sequence
  chemically synthesized
aggtagaaacaagcattcta

SEQ ID NO: 236165 - DNA, 20 bp, Artificial Sequence
  chemically synthesized
gaaacaagcattctagggaa

SEQ ID NO: 236166 - DNA, 20 bp, Artificial Sequence
  chemically synthesized
catcccttcttactgttccc

SEQ ID NO: 236167 - DNA, 20 bp, Artificial Sequence
  chemically synthesized
caagcattctagggaacagt

SEQ ID NO: 236168 - DNA, 20 bp, Artificial Sequence
  chemically synthesized
gcattctagggaacagtaag

SEQ ID NO: 236169 - DNA, 20 bp, Artificial Sequence
  chemically synthesized
cattctagggaacagtaaga

SEQ ID NO: 236170 - DNA, 20 bp, Artificial Sequence
  chemically synthesized
attctagggaacagtaagaa

SEQ ID NO: 236171 - DNA, 20 bp, Artificial Sequence
  chemically synthesized
acagtaagaagggatgtgaa

SEQ ID NO: 236172 - DNA, 20 bp, Artificial Sequence
  chemically synthesized
ggatgtgaaaagaaaacacg

SEQ ID NO: 236173 - DNA, 20 bp, Artificial Sequence
  chemically synthesized
agaaaacacgaagatcaata

SEQ ID NO: 236174 - DNA, 20 bp, Artificial Sequence
  chemically synthesized
aacacgaagatcaatatggc

SEQ ID NO: 236175 - DNA, 20 bp, Artificial Sequence
  chemically synthesized
attttgcaaggacgatgttc

SEQ ID NO: 236176 - DNA, 20 bp, Artificial Sequence
  chemically synthesized
tcatgaaataatattttgca

SEQ ID NO: 236177 - DNA, 20 bp, Artificial Sequence
  chemically synthesized
ttcatgaaataatattttgc

SEQ ID NO: 236178 - DNA, 20 bp, Artificial Sequence
  chemically synthesized
tgtaagattaaagttaatag

SEQ ID NO: 236179 - DNA, 20 bp, Artificial Sequence
  chemically synthesized
aaatgtaagattaaagttaa

SEQ ID NO: 236180 - DNA, 20 bp, Artificial Sequence
  chemically synthesized
tttaatgaaatgtaagatta

SEQ ID NO: 236181 - DNA, 20 bp, Artificial Sequence
  chemically synthesized
attgtcatttaatgaaatgt

SEQ ID NO: 236182 - DNA, 20 bp, Artificial Sequence
  chemically synthesized
attctggaagcaatgagaag

SEQ ID NO: 236183 - DNA, 20 bp, Artificial Sequence
  chemically synthesized
atcattctggaagcaatgag

SEQ ID NO: 236184 - DNA, 20 bp, Artificial Sequence
  chemically synthesized
accatcattctggaagcaat

SEQ ID NO: 236185 - DNA, 20 bp, Artificial Sequence
  chemically synthesized
tttctgcttctcattgcttc

SEQ ID NO: 236186 - DNA, 20 bp, Artificial Sequence
  chemically synthesized
actgcgcaccatcattctgg

SEQ ID NO: 236187 - DNA, 20 bp, Artificial Sequence
  chemically synthesized
tctcattgcttccagaatga

SEQ ID NO: 236188 - DNA, 20 bp, Artificial Sequence
  chemically synthesized
aaaactgcgcaccatcattc

SEQ ID NO: 236189 - DNA, 20 bp, Artificial Sequence
  chemically synthesized
gcttccagaatgatggtgcg

SEQ ID NO: 236190 - DNA, 20 bp, Artificial Sequence
  chemically synthesized
ttgttttgattttttctatt

SEQ ID NO: 236191 - DNA, 20 bp, Artificial Sequence
  chemically synthesized
tgctgattgcaaattccaaa

SEQ ID NO: 236192 - DNA, 20 bp, Artificial Sequence
  chemically synthesized
ttctatttggaatttgcaat

SEQ ID NO: 236193 - DNA, 20 bp, Artificial Sequence
  chemically synthesized
aagagactacaaaaaatgag

SEQ ID NO: 236194 - DNA, 20 bp, Artificial Sequence
  chemically synthesized
agtaagagactacaaaaaat

SEQ ID NO: 236195 - DNA, 20 bp, Artificial Sequence
  chemically synthesized
agcattcttctcattttttg

SEQ ID NO: 236196 - DNA, 20 bp, Artificial Sequence
  chemically synthesized
tgaaattatcaagagagtaa

SEQ ID NO: 236197 - DNA, 20 bp, Artificial Sequence
  chemically synthesized
catgaaattatcaagagagt

SEQ ID NO: 236198 - DNA, 20 bp, Artificial Sequence
  chemically synthesized
agagcatgaaattatcaaga

SEQ ID NO: 236199 - DNA, 20 bp, Artificial Sequence
  chemically synthesized
ttagagcatgaaattatcaa

SEQ ID NO: 236200 - DNA, 20 bp, Artificial Sequence
  chemically synthesized
tcttagagcatgaaattatc

SEQ ID NO: 236201 - DNA, 20 bp, Artificial Sequence
  chemically synthesized
tcttgataatttcatgctct

SEQ ID NO: 236202 - DNA, 20 bp, Artificial Sequence
  chemically synthesized
ataatttcatgctctaagaa

SEQ ID NO: 236203 - DNA, 20 bp, Artificial Sequence
  chemically synthesized
taatttcatgctctaagaat

SEQ ID NO: 236204 - DNA, 20 bp, Artificial Sequence
  chemically synthesized
ctaagggattcccattctta

SEQ ID NO: 236205 - DNA, 20 bp, Artificial Sequence
  chemically synthesized
ccctaagggattcccattct

SEQ ID NO: 236206 - DNA, 20 bp, Artificial Sequence
  chemically synthesized
ctctaagaatgggaatccct

SEQ ID NO: 236207 - DNA, 20 bp, Artificial Sequence
  chemically synthesized
tctaagaatgggaatccctt

SEQ ID NO: 236208 - DNA, 20 bp, Artificial Sequence
  chemically synthesized
ctaagaatgggaatccctta

SEQ ID NO: 236209 - DNA, 20 bp, Artificial Sequence
  chemically synthesized
gataaacatgtcatccctaa

SEQ ID NO: 236210 - DNA, 20 bp, Artificial Sequence
  chemically synthesized
ggataaacatgtcatcccta

SEQ ID NO: 236211 - DNA, 20 bp, Artificial Sequence
  chemically synthesized
aggataaacatgtcatccct

SEQ ID NO: 236212 - DNA, 20 bp, Artificial Sequence
  chemically synthesized
acatgtttatcctgcatttt

SEQ ID NO: 236213 - DNA, 20 bp, Artificial Sequence
  chemically synthesized
taaagaactgcttaaaatgc

SEQ ID NO: 236214 - DNA, 20 bp, Artificial Sequence
  chemically synthesized
gtaaagaactgcttaaaatg

SEQ ID NO: 236215 - DNA, 20 bp, Artificial Sequence
  chemically synthesized
tgtttatcctgcattttaag

SEQ ID NO: 236216 - DNA, 20 bp, Artificial Sequence
  chemically synthesized
ttttaagcagttctttaccg

SEQ ID NO: 236217 - DNA, 20 bp, Artificial Sequence
  chemically synthesized
ttactgtagtaaccacggta

SEQ ID NO: 236218 - DNA, 20 bp, Artificial Sequence
  chemically synthesized
ataacttactgtagtaacca

SEQ ID NO: 236219 - DNA, 20 bp, Artificial Sequence
  chemically synthesized
gttctttaccgtggttacta

SEQ ID NO: 236220 - DNA, 20 bp, Artificial Sequence
  chemically synthesized
tttaccgtggttactacagt

SEQ ID NO: 236221 - DNA, 20 bp, Artificial Sequence
  chemically synthesized
caaaaaaacataacttactg

SEQ ID NO: 236222 - DNA, 20 bp, Artificial Sequence
  chemically synthesized
atacattattggaaagaagc

SEQ ID NO: 236223 - DNA, 20 bp, Artificial Sequence
  chemically synthesized
tttcatacattattggaaag

SEQ ID NO: 236224 - DNA, 20 bp, Artificial Sequence
  chemically synthesized
gattttcatacattattgga

SEQ ID NO: 236225 - DNA, 20 bp, Artificial Sequence
  chemically synthesized
gacagattttcatacattat

SEQ ID NO: 236226 - DNA, 20 bp, Artificial Sequence
  chemically synthesized
tggcatgtttaagaagatga

SEQ ID NO: 236227 - DNA, 20 bp, Artificial Sequence
  chemically synthesized
tccagcatggcatgtttaag

SEQ ID NO: 236228 - DNA, 20 bp, Artificial Sequence
  chemically synthesized
ttgtccagcatggcatgttt

SEQ ID NO: 236229 - DNA, 20 bp, Artificial Sequence
  chemically synthesized
tcttcttaaacatgccatgc

SEQ ID NO: 236230 - DNA, 20 bp, Artificial Sequence
  chemically synthesized
tagacttccgttgtccagca

SEQ ID NO: 236231 - DNA, 20 bp, Artificial Sequence
  chemically synthesized
aaacatgccatgctggacaa

SEQ ID NO: 236232 - DNA, 20 bp, Artificial Sequence
  chemically synthesized
gttattagacttccgttgtc

SEQ ID NO: 236233 - DNA, 20 bp, Artificial Sequence
  chemically synthesized
catgccatgctggacaacgg

SEQ ID NO: 236234 - DNA, 20 bp, Artificial Sequence
  chemically synthesized
gacaacggaagtctaataac

SEQ ID NO: 236235 - DNA, 20 bp, Artificial Sequence
  chemically synthesized
taatttcagtggcttgttat

SEQ ID NO: 236236 - DNA, 20 bp, Artificial Sequence
  chemically synthesized
aaataattggataatttcag

SEQ ID NO: 236237 - DNA, 20 bp, Artificial Sequence
  chemically synthesized
ttaaaataattggataattt

SEQ ID NO: 236238 - DNA, 20 bp, Artificial Sequence
  chemically synthesized
aataagtatattaaaataat

SEQ ID NO: 236239 - DNA, 20 bp, Artificial Sequence
  chemically synthesized
caagtgtatctttcagaaat

SEQ ID NO: 236240 - DNA, 20 bp, Artificial Sequence
  chemically synthesized
tttaatatacttatttctga

SEQ ID NO: 236241 - DNA, 20 bp, Artificial Sequence
  chemically synthesized
tgcccatcaagtgtatcttt

SEQ ID NO: 236242 - DNA, 20 bp, Artificial Sequence
  chemically synthesized
tttctgaaagatacacttga

SEQ ID NO: 236243 - DNA, 20 bp, Artificial Sequence
  chemically synthesized
ttctgaaagatacacttgat

SEQ ID NO: 236244 - DNA, 20 bp, Artificial Sequence
  chemically synthesized
gaaagatacacttgatgggc

SEQ ID NO: 236245 - DNA, 20 bp, Artificial Sequence
  chemically synthesized
gctttcaatccttgcccatc

SEQ ID NO: 236246 - DNA, 20 bp, Artificial Sequence
  chemically synthesized
aaagatacacttgatgggca

SEQ ID NO: 236247 - DNA, 20 bp, Artificial Sequence
  chemically synthesized
acttgatgggcaaggattga

SEQ ID NO: 236248 - DNA, 20 bp, Artificial Sequence
  chemically synthesized
caaggattgaaagcccctct

SEQ ID NO: 236249 - DNA, 20 bp, Artificial Sequence
  chemically synthesized
ccaggcagaaattccgagag

SEQ ID NO: 236250 - DNA, 20 bp, Artificial Sequence
  chemically synthesized
accaggcagaaattccgaga

SEQ ID NO: 236251 - DNA, 20 bp, Artificial Sequence
  chemically synthesized
taccaggcagaaattccgag

SEQ ID NO: 236252 - DNA, 20 bp, Artificial Sequence
  chemically synthesized
gtaccaggcagaaattccga

SEQ ID NO: 236253 - DNA, 20 bp, Artificial Sequence
  chemically synthesized
tggtaccaggcagaaattcc

SEQ ID NO: 236254 - DNA, 20 bp, Artificial Sequence
  chemically synthesized
cccctctcggaatttctgcc

SEQ ID NO: 236255 - DNA, 20 bp, Artificial Sequence
  chemically synthesized
actgggagtgtggtaccagg

SEQ ID NO: 236256 - DNA, 20 bp, Artificial Sequence
  chemically synthesized
tttactgggagtgtggtacc

SEQ ID NO: 236257 - DNA, 20 bp, Artificial Sequence
  chemically synthesized
atttactgggagtgtggtac

SEQ ID NO: 236258 - DNA, 20 bp, Artificial Sequence
  chemically synthesized
tctgcctggtaccacactcc

SEQ ID NO: 236259 - DNA, 20 bp, Artificial Sequence
  chemically synthesized
taaccaatttactgggagtg

SEQ ID NO: 236260 - DNA, 20 bp, Artificial Sequence
  chemically synthesized
gtaaataaccaatttactgg

SEQ ID NO: 236261 - DNA, 20 bp, Artificial Sequence
  chemically synthesized
gtaccacactcccagtaaat

SEQ ID NO: 236262 - DNA, 20 bp, Artificial Sequence
  chemically synthesized
tagtaaataaccaatttact

SEQ ID NO: 236263 - DNA, 20 bp, Artificial Sequence
  chemically synthesized
gtagtaaataaccaatttac

SEQ ID NO: 236264 - DNA, 20 bp, Artificial Sequence
  chemically synthesized
cctatccatcttttcagaag

SEQ ID NO: 236265 - DNA, 20 bp, Artificial Sequence
  chemically synthesized
ggttatttactacttctgaa

SEQ ID NO: 236266 - DNA, 20 bp, Artificial Sequence
  chemically synthesized
gcccctatccatcttttcag

SEQ ID NO: 236267 - DNA, 20 bp, Artificial Sequence
  chemically synthesized
atttactacttctgaaaaga

SEQ ID NO: 236268 - DNA, 20 bp, Artificial Sequence
  chemically synthesized
ttggcccctatccatctttt

SEQ ID NO: 236269 - DNA, 20 bp, Artificial Sequence
  chemically synthesized
actacttctgaaaagatgga

SEQ ID NO: 236270 - DNA, 20 bp, Artificial Sequence
  chemically synthesized
ctacttctgaaaagatggat

SEQ ID NO: 236271 - DNA, 20 bp, Artificial Sequence
  chemically synthesized
tacttctgaaaagatggata

SEQ ID NO: 236272 - DNA, 20 bp, Artificial Sequence
  chemically synthesized
acttctgaaaagatggatag

SEQ ID NO: 236273 - DNA, 20 bp, Artificial Sequence
  chemically synthesized
aaagatggataggggccaaa

SEQ ID NO: 236274 - DNA, 20 bp, Artificial Sequence
  chemically synthesized
gaaactcctctgcaactttt

SEQ ID NO: 236275 - DNA, 20 bp, Artificial Sequence
  chemically synthesized
ggataggggccaaaaagttg

SEQ ID NO: 236276 - DNA, 20 bp, Artificial Sequence
  chemically synthesized
ataggggccaaaaagttgca

SEQ ID NO: 236277 - DNA, 20 bp, Artificial Sequence
  chemically synthesized
taggggccaaaaagttgcag

SEQ ID NO: 236278 - DNA, 20 bp, Artificial Sequence
  chemically synthesized
ggggccaaaaagttgcagag

SEQ ID NO: 236279 - DNA, 20 bp, Artificial Sequence
  chemically synthesized
aaagttgcagaggagtttcc

SEQ ID NO: 236280 - DNA, 20 bp, Artificial Sequence
  chemically synthesized
gttgcagaggagtttccaag

SEQ ID NO: 236281 - DNA, 20 bp, Artificial Sequence
  chemically synthesized
gttacccttttattgctgct

SEQ ID NO: 236282 - DNA, 20 bp, Artificial Sequence
  chemically synthesized
gagtttccaagcagcaataa

SEQ ID NO: 236283 - DNA, 20 bp, Artificial Sequence
  chemically synthesized
agtttccaagcagcaataaa

SEQ ID NO: 236284 - DNA, 20 bp, Artificial Sequence
  chemically synthesized
gtttccaagcagcaataaaa

SEQ ID NO: 236285 - DNA, 20 bp, Artificial Sequence
  chemically synthesized
aagggtaacaatatttacgc

SEQ ID NO: 236286 - DNA, 20 bp, Artificial Sequence
  chemically synthesized
agggtaacaatatttacgca

SEQ ID NO: 236287 - DNA, 20 bp, Artificial Sequence
  chemically synthesized
acaatatttacgcaaggatg

SEQ ID NO: 236288 - DNA, 20 bp, Artificial Sequence
  chemically synthesized
cttaatacagttaaacagtt

SEQ ID NO: 236289 - DNA, 20 bp, Artificial Sequence
  chemically synthesized
tcttaatacagttaaacagt

SEQ ID NO: 236290 - DNA, 20 bp, Artificial Sequence
  chemically synthesized
agtctcttaatacagttaaa

SEQ ID NO: 236291 - DNA, 20 bp, Artificial Sequence
  chemically synthesized
cccaactgtttaactgtatt

SEQ ID NO: 236292 - DNA, 20 bp, Artificial Sequence
  chemically synthesized
caactgtttaactgtattaa

SEQ ID NO: 236293 - DNA, 20 bp, Artificial Sequence
  chemically synthesized
gagagttaagtctcttaata

SEQ ID NO: 236294 - DNA, 20 bp, Artificial Sequence
  chemically synthesized
ctggtagtggcatgagagtt

SEQ ID NO: 236295 - DNA, 20 bp, Artificial Sequence
  chemically synthesized
attagctggtagtggcatga

SEQ ID NO: 236296 - DNA, 20 bp, Artificial Sequence
  chemically synthesized
ttattagctggtagtggcat

SEQ ID NO: 236297 - DNA, 20 bp, Artificial Sequence
  chemically synthesized
cttaactctcatgccactac

SEQ ID NO: 236298 - DNA, 20 bp, Artificial Sequence
  chemically synthesized
tcaaagttattagctggtag

SEQ ID NO: 236299 - DNA, 20 bp, Artificial Sequence
  chemically synthesized
ttttcaaagttattagctgg

SEQ ID NO: 236300 - DNA, 20 bp, Artificial Sequence
  chemically synthesized
agcttttcaaagttattagc

SEQ ID NO: 236301 - DNA, 20 bp, Artificial Sequence
  chemically synthesized
aatgagcttttcaaagttat

SEQ ID NO: 236302 - DNA, 20 bp, Artificial Sequence
  chemically synthesized
taccagctaataactttgaa

SEQ ID NO: 236303 - DNA, 20 bp, Artificial Sequence
  chemically synthesized
attttaaaatgagcttttca

SEQ ID NO: 236304 - DNA, 20 bp, Artificial Sequence
  chemically synthesized
gtgggaatacattttaaaat

SEQ ID NO: 236305 - DNA, 20 bp, Artificial Sequence
  chemically synthesized
ttacagcaatgtgtaagtgt

SEQ ID NO: 236306 - DNA, 20 bp, Artificial Sequence
  chemically synthesized
gttacagcaatgtgtaagtg

SEQ ID NO: 236307 - DNA, 20 bp, Artificial Sequence
  chemically synthesized
ttaaggttacagcaatgtgt

SEQ ID NO: 236308 - DNA, 20 bp, Artificial Sequence
  chemically synthesized
agtcacttactttaaggtta

SEQ ID NO: 236309 - DNA, 20 bp, Artificial Sequence
  chemically synthesized
tacacattgctgtaacctta

SEQ ID NO: 236310 - DNA, 20 bp, Artificial Sequence
  chemically synthesized
cattgctgtaaccttaaagt

SEQ ID NO: 236311 - DNA, 20 bp, Artificial Sequence
  chemically synthesized
gtctctagtcacttacttta

SEQ ID NO: 236312 - DNA, 20 bp, Artificial Sequence
  chemically synthesized
tgtctctagtcacttacttt

SEQ ID NO: 236313 - DNA, 20 bp, Artificial Sequence
  chemically synthesized
gtaaccttaaagtaagtgac

SEQ ID NO: 236314 - DNA, 20 bp, Artificial Sequence
  chemically synthesized
aaccttaaagtaagtgacta

SEQ ID NO: 236315 - DNA, 20 bp, Artificial Sequence
  chemically synthesized
ctgctaagagaatttgtctc

SEQ ID NO: 236316 - DNA, 20 bp, Artificial Sequence
  chemically synthesized
tgactagagacaaattctct

SEQ ID NO: 236317 - DNA, 20 bp, Artificial Sequence
  chemically synthesized
ctagagacaaattctcttag

SEQ ID NO: 236318 - DNA, 20 bp, Artificial Sequence
  chemically synthesized
gccggaaaatttactgctaa

SEQ ID NO: 236319 - DNA, 20 bp, Artificial Sequence
  chemically synthesized
cagccggaaaatttactgct

SEQ ID NO: 236320 - DNA, 20 bp, Artificial Sequence
  chemically synthesized
tctcttagcagtaaattttc

SEQ ID NO: 236321 - DNA, 20 bp, Artificial Sequence
  chemically synthesized
actagcataagggaatcagc

SEQ ID NO: 236322 - DNA, 20 bp, Artificial Sequence
  chemically synthesized
atacactagcataagggaat

SEQ ID NO: 236323 - DNA, 20 bp, Artificial Sequence
  chemically synthesized
tccggctgattcccttatgc

SEQ ID NO: 236324 - DNA, 20 bp, Artificial Sequence
  chemically synthesized
gaagacatacactagcataa

SEQ ID NO: 236325 - DNA, 20 bp, Artificial Sequence
  chemically synthesized
agaagacatacactagcata

SEQ ID NO: 236326 - DNA, 20 bp, Artificial Sequence
  chemically synthesized
tagaagacatacactagcat

SEQ ID NO: 236327 - DNA, 20 bp, Artificial Sequence
  chemically synthesized
tgtaactagaagacatacac

SEQ ID NO: 236328 - DNA, 20 bp, Artificial Sequence
  chemically synthesized
ttatgctagtgtatgtcttc

SEQ ID NO: 236329 - DNA, 20 bp, Artificial Sequence
  chemically synthesized
tagtgtatgtcttctagtta

SEQ ID NO: 236330 - DNA, 20 bp, Artificial Sequence
  chemically synthesized
atcctggtttctgtaactag

SEQ ID NO: 236331 - DNA, 20 bp, Artificial Sequence
  chemically synthesized
gctatcctggtttctgtaac

SEQ ID NO: 236332 - DNA, 20 bp, Artificial Sequence
  chemically synthesized
tgtcttctagttacagaaac

SEQ ID NO: 236333 - DNA, 20 bp, Artificial Sequence
  chemically synthesized
gtcttctagttacagaaacc

SEQ ID NO: 236334 - DNA, 20 bp, Artificial Sequence
  chemically synthesized
tctagttacagaaaccagga

SEQ ID NO: 236335 - DNA, 20 bp, Artificial Sequence
  chemically synthesized
ttgtggtcacaaagctatcc

SEQ ID NO: 236336 - DNA, 20 bp, Artificial Sequence
  chemically synthesized
gattttgttttgtggtcaca

SEQ ID NO: 236337 - DNA, 20 bp, Artificial Sequence
  chemically synthesized
tttcataagattttgttttg

SEQ ID NO: 236338 - DNA, 20 bp, Artificial Sequence
  chemically synthesized
cagcagtaataaaatttcat

SEQ ID NO: 236339 - DNA, 20 bp, Artificial Sequence
  chemically synthesized
ttatgaaattttattactgc

SEQ ID NO: 236340 - DNA, 20 bp, Artificial Sequence
  chemically synthesized
tatgaaattttattactgct

SEQ ID NO: 236341 - DNA, 20 bp, Artificial Sequence
  chemically synthesized
atgaaattttattactgctg

SEQ ID NO: 236342 - DNA, 20 bp, Artificial Sequence
  chemically synthesized
tgtcctttatatttccccag

SEQ ID NO: 236343 - DNA, 20 bp, Artificial Sequence
  chemically synthesized
gcttgtcctttatatttccc

SEQ ID NO: 236344 - DNA, 20 bp, Artificial Sequence
  chemically synthesized
attactgctggggaaatata

SEQ ID NO: 236345 - DNA, 20 bp, Artificial Sequence
  chemically synthesized
ttactgctggggaaatataa

SEQ ID NO: 236346 - DNA, 20 bp, Artificial Sequence
  chemically synthesized
gctggggaaatataaaggac

SEQ ID NO: 236347 - DNA, 20 bp, Artificial Sequence
  chemically synthesized
gaaatataaaggacaagcaa

SEQ ID NO: 236348 - DNA, 20 bp, Artificial Sequence
  chemically synthesized
gtatgaattattcttaacgt

SEQ ID NO: 236349 - DNA, 20 bp, Artificial Sequence
  chemically synthesized
tatgaattattcttaacgtt

SEQ ID NO: 236350 - DNA, 20 bp, Artificial Sequence
  chemically synthesized
atgaattattcttaacgtta

SEQ ID NO: 236351 - DNA, 20 bp, Artificial Sequence
  chemically synthesized
ttcactgggaccctaacgtt

SEQ ID NO: 236352 - DNA, 20 bp, Artificial Sequence
  chemically synthesized
tattcttaacgttagggtcc

SEQ ID NO: 236353 - DNA, 20 bp, Artificial Sequence
  chemically synthesized
ttaacgttagggtcccagtg

SEQ ID NO: 236354 - DNA, 20 bp, Artificial Sequence
  chemically synthesized
taacgttagggtcccagtga

SEQ ID NO: 236355 - DNA, 20 bp, Artificial Sequence
  chemically synthesized
aacgttagggtcccagtgaa

SEQ ID NO: 236356 - DNA, 20 bp, Artificial Sequence
  chemically synthesized
accatctgttgcccttcact

SEQ ID NO: 236357 - DNA, 20 bp, Artificial Sequence
  chemically synthesized
taccatctgttgcccttcac

SEQ ID NO: 236358 - DNA, 20 bp, Artificial Sequence
  chemically synthesized
agggtcccagtgaagggcaa

SEQ ID NO: 236359 - DNA, 20 bp, Artificial Sequence
  chemically synthesized
tcccagtgaagggcaacaga

SEQ ID NO: 236360 - DNA, 20 bp, Artificial Sequence
  chemically synthesized
cagtgaagggcaacagatgg

SEQ ID NO: 236361 - DNA, 20 bp, Artificial Sequence
  chemically synthesized
gatggtagaaatatttactc

SEQ ID NO: 236362 - DNA, 20 bp, Artificial Sequence
  chemically synthesized
ctttgatggaaaaatcactg

SEQ ID NO: 236363 - DNA, 20 bp, Artificial Sequence
  chemically synthesized
aactttgatggaaaaatcac

SEQ ID NO: 236364 - DNA, 20 bp, Artificial Sequence
  chemically synthesized
ctccagtgatttttccatca

SEQ ID NO: 236365 - DNA, 20 bp, Artificial Sequence
  chemically synthesized
aatgctgatagaaactttga

SEQ ID NO: 236366 - DNA, 20 bp, Artificial Sequence
  chemically synthesized
ttttccatcaaagtttctat

SEQ ID NO: 236367 - DNA, 20 bp, Artificial Sequence
  chemically synthesized
tgctgagattcaaatgctga

SEQ ID NO: 236368 - DNA, 20 bp, Artificial Sequence
  chemically synthesized
ttctatcagcatttgaatct

SEQ ID NO: 236369 - DNA, 20 bp, Artificial Sequence
  chemically synthesized
tatcagcatttgaatctcag

SEQ ID NO: 236370 - DNA, 20 bp, Artificial Sequence
  chemically synthesized
gcatttgaatctcagcagtg

SEQ ID NO: 236371 - DNA, 20 bp, Artificial Sequence
  chemically synthesized
ttcttaacagccacactgct

SEQ ID NO: 236372 - DNA, 20 bp, Artificial Sequence
  chemically synthesized
atctcagcagtgtggctgtt

SEQ ID NO: 236373 - DNA, 20 bp, Artificial Sequence
  chemically synthesized
tcagcagtgtggctgttaag

SEQ ID NO: 236374 - DNA, 20 bp, Artificial Sequence
  chemically synthesized
tgagtttgacggcttcttaa

SEQ ID NO: 236375 - DNA, 20 bp, Artificial Sequence
  chemically synthesized
tgttaagaagccgtcaaact

SEQ ID NO: 236376 - DNA, 20 bp, Artificial Sequence
  chemically synthesized
cagctggctgctgagtttga

SEQ ID NO: 236377 - DNA, 20 bp, Artificial Sequence
  chemically synthesized
taagaagccgtcaaactcag

SEQ ID NO: 236378 - DNA, 20 bp, Artificial Sequence
  chemically synthesized
aagccgtcaaactcagcagc

SEQ ID NO: 236379 - DNA, 20 bp, Artificial Sequence
  chemically synthesized
gatttcaccagctggctgct

SEQ ID NO: 236380 - DNA, 20 bp, Artificial Sequence
  chemically synthesized
cgtcaaactcagcagccagc

SEQ ID NO: 236381 - DNA, 20 bp, Artificial Sequence
  chemically synthesized
tacattgtgatttcaccagc

SEQ ID NO: 236382 - DNA, 20 bp, Artificial Sequence
  chemically synthesized
tttttacattgtgatttcac

SEQ ID NO: 236383 - DNA, 20 bp, Artificial Sequence
  chemically synthesized
caatgtaaaaactgactata

SEQ ID NO: 236384 - DNA, 20 bp, Artificial Sequence
  chemically synthesized
aagtatattttctgtatagt

SEQ ID NO: 236385 - DNA, 20 bp, Artificial Sequence
  chemically synthesized
acacaagtatattttctgta

SEQ ID NO: 236386 - DNA, 20 bp, Artificial Sequence
  chemically synthesized
gatgtaaaaaaatcagacac

SEQ ID NO: 236387 - DNA, 20 bp, Artificial Sequence
  chemically synthesized
ggcatatgatgtaaaaaaat

SEQ ID NO: 236388 - DNA, 20 bp, Artificial Sequence
  chemically synthesized
ttacatcatatgcctttttc

SEQ ID NO: 236389 - DNA, 20 bp, Artificial Sequence
  chemically synthesized
ttaaaggataatctagaaaa

SEQ ID NO: 236390 - DNA, 20 bp, Artificial Sequence
  chemically synthesized
attaaaggataatctagaaa

SEQ ID NO: 236391 - DNA, 20 bp, Artificial Sequence
  chemically synthesized
gattgaattaaaggataatc

SEQ ID NO: 236392 - DNA, 20 bp, Artificial Sequence
  chemically synthesized
attaatacagattgaattaa

SEQ ID NO: 236393 - DNA, 20 bp, Artificial Sequence
  chemically synthesized
tattaatacagattgaatta

SEQ ID NO: 236394 - DNA, 20 bp, Artificial Sequence
  chemically synthesized
taagtgaatttatattaata

SEQ ID NO: 236395 - DNA, 20 bp, Artificial Sequence
  chemically synthesized
caaagaactctataggaggt

SEQ ID NO: 236396 - DNA, 20 bp, Artificial Sequence
  chemically synthesized
ataaattcacttacctccta

SEQ ID NO: 236397 - DNA, 20 bp, Artificial Sequence
  chemically synthesized
aaattcacttacctcctata

SEQ ID NO: 236398 - DNA, 20 bp, Artificial Sequence
  chemically synthesized
gcctcaaagaactctatagg

SEQ ID NO: 236399 - DNA, 20 bp, Artificial Sequence
  chemically synthesized
tgcctcaaagaactctatag

SEQ ID NO: 236400 - DNA, 20 bp, Artificial Sequence
  chemically synthesized
actgcctcaaagaactctat

SEQ ID NO: 236401 - DNA, 20 bp, Artificial Sequence
  chemically synthesized
tactgcctcaaagaactcta

SEQ ID NO: 236402 - DNA, 20 bp, Artificial Sequence
  chemically synthesized
tacctcctatagagttcttt

SEQ ID NO: 236403 - DNA, 20 bp, Artificial Sequence
  chemically synthesized
acctcctatagagttctttg

SEQ ID NO: 236404 - DNA, 20 bp, Artificial Sequence
  chemically synthesized
tcctatagagttctttgagg

SEQ ID NO: 236405 - DNA, 20 bp, Artificial Sequence
  chemically synthesized
catggcaatctactgcctca

SEQ ID NO: 236406 - DNA, 20 bp, Artificial Sequence
  chemically synthesized
tatagagttctttgaggcag

SEQ ID NO: 236407 - DNA, 20 bp, Artificial Sequence
  chemically synthesized
gaggcagtagattgccatgt

SEQ ID NO: 236408 - DNA, 20 bp, Artificial Sequence
  chemically synthesized
aggcagtagattgccatgtt

SEQ ID NO: 236409 - DNA, 20 bp, Artificial Sequence
  chemically synthesized
ttattaggatacacctaaca

SEQ ID NO: 236410 - DNA, 20 bp, Artificial Sequence
  chemically synthesized
tgagttttcgtatttttatt

SEQ ID NO: 236411 - DNA, 20 bp, Artificial Sequence
  chemically synthesized
atgagttttcgtatttttat

SEQ ID NO: 236412 - DNA, 20 bp, Artificial Sequence
  chemically synthesized
cagtatctgctacagagaat

SEQ ID NO: 236413 - DNA, 20 bp, Artificial Sequence
  chemically synthesized
atacgaaaactcattctctg

SEQ ID NO: 236414 - DNA, 20 bp, Artificial Sequence
  chemically synthesized
cgaaaactcattctctgtag

SEQ ID NO: 236415 - DNA, 20 bp, Artificial Sequence
  chemically synthesized
cactgacagtatctgctaca

SEQ ID NO: 236416 - DNA, 20 bp, Artificial Sequence
  chemically synthesized
gtcactgacagtatctgcta

SEQ ID NO: 236417 - DNA, 20 bp, Artificial Sequence
  chemically synthesized
ttctctgtagcagatactgt

SEQ ID NO: 236418 - DNA, 20 bp, Artificial Sequence
  chemically synthesized
agatgtgcataggtcactga

SEQ ID NO: 236419 - DNA, 20 bp, Artificial Sequence
  chemically synthesized
agtgctgaatagatgtgcat

SEQ ID NO: 236420 - DNA, 20 bp, Artificial Sequence
  chemically synthesized
gagtgctgaatagatgtgca

SEQ ID NO: 236421 - DNA, 20 bp, Artificial Sequence
  chemically synthesized
gtgacctatgcacatctatt

SEQ ID NO: 236422 - DNA, 20 bp, Artificial Sequence
  chemically synthesized
caaaaatgatgagtgctgaa

SEQ ID NO: 236423 - DNA, 20 bp, Artificial Sequence
  chemically synthesized
ttgacttgtacaaaaatgat

SEQ ID NO: 236424 - DNA, 20 bp, Artificial Sequence
  chemically synthesized
agcactcatcatttttgtac

SEQ ID NO: 236425 - DNA, 20 bp, Artificial Sequence
  chemically synthesized
acaagtcaatgacctttcaa

SEQ ID NO: 236426 - DNA, 20 bp, Artificial Sequence
  chemically synthesized
taacaggtactgccgttgaa

SEQ ID NO: 236427 - DNA, 20 bp, Artificial Sequence
  chemically synthesized
agtcaatgacctttcaacgg

SEQ ID NO: 236428 - DNA, 20 bp, Artificial Sequence
  chemically synthesized
ctaacaggtactgccgttga

SEQ ID NO: 236429 - DNA, 20 bp, Artificial Sequence
  chemically synthesized
ctttcaacggcagtacctgt

SEQ ID NO: 236430 - DNA, 20 bp, Artificial Sequence
  chemically synthesized
aacggcagtacctgttagat

SEQ ID NO: 236431 - DNA, 20 bp, Artificial Sequence
  chemically synthesized
ccagaaagcccttatctaac

SEQ ID NO: 236432 - DNA, 20 bp, Artificial Sequence
  chemically synthesized
acggcagtacctgttagata

SEQ ID NO: 236433 - DNA, 20 bp, Artificial Sequence
  chemically synthesized
cccagaaagcccttatctaa

SEQ ID NO: 236434 - DNA, 20 bp, Artificial Sequence
  chemically synthesized
cggcagtacctgttagataa

SEQ ID NO: 236435 - DNA, 20 bp, Artificial Sequence
  chemically synthesized
cctgttagataagggctttc

SEQ ID NO: 236436 - DNA, 20 bp, Artificial Sequence
  chemically synthesized
ctgttagataagggctttct

SEQ ID NO: 236437 - DNA, 20 bp, Artificial Sequence
  chemically synthesized
ttcagcactcgcagcccaga

SEQ ID NO: 236438 - DNA, 20 bp, Artificial Sequence
  chemically synthesized
ataagggctttctgggctgc

SEQ ID NO: 236439 - DNA, 20 bp, Artificial Sequence
  chemically synthesized
tgctttcagcactcgcagcc

SEQ ID NO: 236440 - DNA, 20 bp, Artificial Sequence
  chemically synthesized
cgccttgctttcagcactcg

SEQ ID NO: 236441 - DNA, 20 bp, Artificial Sequence
  chemically synthesized
ttctgggctgcgagtgctga

SEQ ID NO: 236442 - DNA, 20 bp, Artificial Sequence
  chemically synthesized
gggctgcgagtgctgaaagc

SEQ ID NO: 236443 - DNA, 20 bp, Artificial Sequence
  chemically synthesized
ggctgcgagtgctgaaagca

SEQ ID NO: 236444 - DNA, 20 bp, Artificial Sequence
  chemically synthesized
cattcttctcgccttgcttt

SEQ ID NO: 236445 - DNA, 20 bp, Artificial Sequence
  chemically synthesized
gcgagtgctgaaagcaaggc

SEQ ID NO: 236446 - DNA, 20 bp, Artificial Sequence
  chemically synthesized
agtgctgaaagcaaggcgag

SEQ ID NO: 236447 - DNA, 20 bp, Artificial Sequence
  chemically synthesized
gaaagcaaggcgagaagaat

SEQ ID NO: 236448 - DNA, 20 bp, Artificial Sequence
  chemically synthesized
gcgagaagaatgagaaaacc

SEQ ID NO: 236449 - DNA, 20 bp, Artificial Sequence
  chemically synthesized
cgagaagaatgagaaaacct

SEQ ID NO: 236450 - DNA, 20 bp, Artificial Sequence
  chemically synthesized
tcctcttaatggaaataccc

SEQ ID NO: 236451 - DNA, 20 bp, Artificial Sequence
  chemically synthesized
ctcctcttaatggaaatacc

SEQ ID NO: 236452 - DNA, 20 bp, Artificial Sequence
  chemically synthesized
aaaacctgggtatttccatt

SEQ ID NO: 236453 - DNA, 20 bp, Artificial Sequence
  chemically synthesized
aacctgggtatttccattaa

SEQ ID NO: 236454 - DNA, 20 bp, Artificial Sequence
  chemically synthesized
acctgggtatttccattaag

SEQ ID NO: 236455 - DNA, 20 bp, Artificial Sequence
  chemically synthesized
ctgggtatttccattaagag

SEQ ID NO: 236456 - DNA, 20 bp, Artificial Sequence
  chemically synthesized
aaagaccgtcctcctcttaa

SEQ ID NO: 236457 - DNA, 20 bp, Artificial Sequence
  chemically synthesized
tgggtatttccattaagagg

SEQ ID NO: 236458 - DNA, 20 bp, Artificial Sequence
  chemically synthesized
tatttccattaagaggagga

SEQ ID NO: 236459 - DNA, 20 bp, Artificial Sequence
  chemically synthesized
agaggaggacggtcttttca

SEQ ID NO: 236460 - DNA, 20 bp, Artificial Sequence
  chemically synthesized
gagacaagcgagtccatgaa

SEQ ID NO: 236461 - DNA, 20 bp, Artificial Sequence
  chemically synthesized
ctcaaaagtttgagacaagc

SEQ ID NO: 236462 - DNA, 20 bp, Artificial Sequence
  chemically synthesized
cctgctcaaaagtttgagac

SEQ ID NO: 236463 - DNA, 20 bp, Artificial Sequence
  chemically synthesized
tgactcctgctcaaaagttt

SEQ ID NO: 236464 - DNA, 20 bp, Artificial Sequence
  chemically synthesized
ctcgcttgtctcaaactttt

SEQ ID NO: 236465 - DNA, 20 bp, Artificial Sequence
  chemically synthesized
gcttgtctcaaacttttgag

SEQ ID NO: 236466 - DNA, 20 bp, Artificial Sequence
  chemically synthesized
cttgtctcaaacttttgagc

SEQ ID NO: 236467 - DNA, 20 bp, Artificial Sequence
  chemically synthesized
ttggagtgactcctgctcaa

SEQ ID NO: 236468 - DNA, 20 bp, Artificial Sequence
  chemically synthesized
tgtctcaaacttttgagcag

SEQ ID NO: 236469 - DNA, 20 bp, Artificial Sequence
  chemically synthesized
cagagagcacaatggagttg

SEQ ID NO: 236470 - DNA, 20 bp, Artificial Sequence
  chemically synthesized
ttcagagagcacaatggagt

SEQ ID NO: 236471 - DNA, 20 bp, Artificial Sequence
  chemically synthesized
tagattcagagagcacaatg

SEQ ID NO: 236472 - DNA, 20 bp, Artificial Sequence
  chemically synthesized
tttagattcagagagcacaa

SEQ ID NO: 236473 - DNA, 20 bp, Artificial Sequence
  chemically synthesized
ctgaagagtttagattcaga

SEQ ID NO: 236474 - DNA, 20 bp, Artificial Sequence
  chemically synthesized
ttctgaagagtttagattca

SEQ ID NO: 236475 - DNA, 20 bp, Artificial Sequence
  chemically synthesized
aattctgaagagtttagatt

SEQ ID NO: 236476 - DNA, 20 bp, Artificial Sequence
  chemically synthesized
ctctctgaatctaaactctt

SEQ ID NO: 236477 - DNA, 20 bp, Artificial Sequence
  chemically synthesized
ggacccaattctgaagagtt

SEQ ID NO: 236478 - DNA, 20 bp, Artificial Sequence
  chemically synthesized
ttaaaggacccaattctgaa

SEQ ID NO: 236479 - DNA, 20 bp, Artificial Sequence
  chemically synthesized
gaatctaaactcttcagaat

SEQ ID NO: 236480 - DNA, 20 bp, Artificial Sequence
  chemically synthesized
aatctaaactcttcagaatt

SEQ ID NO: 236481 - DNA, 20 bp, Artificial Sequence
  chemically synthesized
ttttaaaggacccaattctg

SEQ ID NO: 236482 - DNA, 20 bp, Artificial Sequence
  chemically synthesized
tcagaattgggtcctttaaa

SEQ ID NO: 236483 - DNA, 20 bp, Artificial Sequence
  chemically synthesized
aattctaaagcactttttaa

SEQ ID NO: 236484 - DNA, 20 bp, Artificial Sequence
  chemically synthesized
aaattctaaagcacttttta

SEQ ID NO: 236485 - DNA, 20 bp, Artificial Sequence
  chemically synthesized
gggtcctttaaaaagtgctt

SEQ ID NO: 236486 - DNA, 20 bp, Artificial Sequence
  chemically synthesized
agtgattgaagaaaattcta

SEQ ID NO: 236487 - DNA, 20 bp, Artificial Sequence
  chemically synthesized
accatggttattagtgattg

SEQ ID NO: 236488 - DNA, 20 bp, Artificial Sequence
  chemically synthesized
tcttcaatcactaataacca

SEQ ID NO: 236489 - DNA, 20 bp, Artificial Sequence
  chemically synthesized
ctttaccttaccatggttat

SEQ ID NO: 236490 - DNA, 20 bp, Artificial Sequence
  chemically synthesized
caatcactaataaccatggt

SEQ ID NO: 236491 - DNA, 20 bp, Artificial Sequence
  chemically synthesized
aatcactaataaccatggta

SEQ ID NO: 236492 - DNA, 20 bp, Artificial Sequence
  chemically synthesized
tcttcagctttaccttacca

SEQ ID NO: 236493 - DNA, 20 bp, Artificial Sequence
  chemically synthesized
ctaataaccatggtaaggta

SEQ ID NO: 236494 - DNA, 20 bp, Artificial Sequence
  chemically synthesized
accatggtaaggtaaagctg

SEQ ID NO: 236495 - DNA, 20 bp, Artificial Sequence
  chemically synthesized
catggtaaggtaaagctgaa

SEQ ID NO: 236496 - DNA, 20 bp, Artificial Sequence
  chemically synthesized
ggtaaggtaaagctgaagag

SEQ ID NO: 236497 - DNA, 20 bp, Artificial Sequence
  chemically synthesized
ctctccctttagctgctctt

SEQ ID NO: 236498 - DNA, 20 bp, Artificial Sequence
  chemically synthesized
gtaaagctgaagagcagcta

SEQ ID NO: 236499 - DNA, 20 bp, Artificial Sequence
  chemically synthesized
taaagctgaagagcagctaa

SEQ ID NO: 236500 - DNA, 20 bp, Artificial Sequence
  chemically synthesized
aaagctgaagagcagctaaa

SEQ ID NO: 236501 - DNA, 20 bp, Artificial Sequence
  chemically synthesized
agctgaagagcagctaaagg

SEQ ID NO: 236502 - DNA, 20 bp, Artificial Sequence
  chemically synthesized
ctgaagagcagctaaaggga

SEQ ID NO: 236503 - DNA, 20 bp, Artificial Sequence
  chemically synthesized
ctgctcttcagctctccctt

SEQ ID NO: 236504 - DNA, 20 bp, Artificial Sequence
  chemically synthesized
agcagctaaagggagagctg

SEQ ID NO: 236505 - DNA, 20 bp, Artificial Sequence
  chemically synthesized
cagctaaagggagagctgaa

SEQ ID NO: 236506 - DNA, 20 bp, Artificial Sequence
  chemically synthesized
ctaaagggagagctgaagag

SEQ ID NO: 236507 - DNA, 20 bp, Artificial Sequence
  chemically synthesized
agccaagtttagctgctctt

SEQ ID NO: 236508 - DNA, 20 bp, Artificial Sequence
  chemically synthesized
agctgaagagcagctaaact

SEQ ID NO: 236509 - DNA, 20 bp, Artificial Sequence
  chemically synthesized
aaaaatgtcaaagccaagtt

SEQ ID NO: 236510 - DNA, 20 bp, Artificial Sequence
  chemically synthesized
agtacaaaaatgtcaaagcc

SEQ ID NO: 236511 - DNA, 20 bp, Artificial Sequence
  chemically synthesized
aaaagagtacaaaaatgtca

SEQ ID NO: 236512 - DNA, 20 bp, Artificial Sequence
  chemically synthesized
gttgagagaaggcaaaaaaa

SEQ ID NO: 236513 - DNA, 20 bp, Artificial Sequence
  chemically synthesized
gagttgagagaaggcaaaaa

SEQ ID NO: 236514 - DNA, 20 bp, Artificial Sequence
  chemically synthesized
ggtgctttggagttgagaga

SEQ ID NO: 236515 - DNA, 20 bp, Artificial Sequence
  chemically synthesized
tggtgctttggagttgagag

SEQ ID NO: 236516 - DNA, 20 bp, Artificial Sequence
  chemically synthesized
cactggtgctttggagttga

SEQ ID NO: 236517 - DNA, 20 bp, Artificial Sequence
  chemically synthesized
tttgccttctctcaactcca

SEQ ID NO: 236518 - DNA, 20 bp, Artificial Sequence
  chemically synthesized
cacactggtgctttggagtt

SEQ ID NO: 236519 - DNA, 20 bp, Artificial Sequence
  chemically synthesized
aagagcacactggtgctttg

SEQ ID NO: 236520 - DNA, 20 bp, Artificial Sequence
  chemically synthesized
ttctctcaactccaaagcac

SEQ ID NO: 236521 - DNA, 20 bp, Artificial Sequence
  chemically synthesized
gaaagagcacactggtgctt

SEQ ID NO: 236522 - DNA, 20 bp, Artificial Sequence
  chemically synthesized
gggagaaagaaagagcacac

SEQ ID NO: 236523 - DNA, 20 bp, Artificial Sequence
  chemically synthesized
gaacaaaagggagaaagaaa

SEQ ID NO: 236524 - DNA, 20 bp, Artificial Sequence
  chemically synthesized
aggaacaaaagggagaaaga

SEQ ID NO: 236525 - DNA, 20 bp, Artificial Sequence
  chemically synthesized
gatgaggaacaaaagggaga

SEQ ID NO: 236526 - DNA, 20 bp, Artificial Sequence
  chemically synthesized
ctcagatgaggaacaaaagg

SEQ ID NO: 236527 - DNA, 20 bp, Artificial Sequence
  chemically synthesized
ctctcagatgaggaacaaaa

SEQ ID NO: 236528 - DNA, 20 bp, Artificial Sequence
  chemically synthesized
tctctcagatgaggaacaaa

SEQ ID NO: 236529 - DNA, 20 bp, Artificial Sequence
  chemically synthesized
atctctcagatgaggaacaa

SEQ ID NO: 236530 - DNA, 20 bp, Artificial Sequence
  chemically synthesized
ctcccttttgttcctcatct

SEQ ID NO: 236531 - DNA, 20 bp, Artificial Sequence
  chemically synthesized
cccttttgttcctcatctga

SEQ ID NO: 236532 - DNA, 20 bp, Artificial Sequence
  chemically synthesized
ctgctgtgatctctcagatg

SEQ ID NO: 236533 - DNA, 20 bp, Artificial Sequence
  chemically synthesized
cctgctgtgatctctcagat

SEQ ID NO: 236534 - DNA, 20 bp, Artificial Sequence
  chemically synthesized
gtgaccctgctgtgatctct

SEQ ID NO: 236535 - DNA, 20 bp, Artificial Sequence
  chemically synthesized
gttcctcatctgagagatca

SEQ ID NO: 236536 - DNA, 20 bp, Artificial Sequence
  chemically synthesized
cctcatctgagagatcacag

SEQ ID NO: 236537 - DNA, 20 bp, Artificial Sequence
  chemically synthesized
ctcatctgagagatcacagc

SEQ ID NO: 236538 - DNA, 20 bp, Artificial Sequence
  chemically synthesized
tcatctgagagatcacagca

SEQ ID NO: 236539 - DNA, 20 bp, Artificial Sequence
  chemically synthesized
taaagcatgtagttatagca

SEQ ID NO: 236540 - DNA, 20 bp, Artificial Sequence
  chemically synthesized
acatataaagcatgtagtta

SEQ ID NO: 236541 - DNA, 20 bp, Artificial Sequence
  chemically synthesized
aaaattacatataaagcatg

SEQ ID NO: 236542 - DNA, 20 bp, Artificial Sequence
  chemically synthesized
agaatggaaaattacatata

SEQ ID NO: 236543 - DNA, 20 bp, Artificial Sequence
  chemically synthesized
atgtaattttccattctctc

SEQ ID NO: 236544 - DNA, 20 bp, Artificial Sequence
  chemically synthesized
tgtgaaatgtccagagagaa

SEQ ID NO: 236545 - DNA, 20 bp, Artificial Sequence
  chemically synthesized
tcaaatgtgaaatgtccaga

SEQ ID NO: 236546 - DNA, 20 bp, Artificial Sequence
  chemically synthesized
tctcaaatgtgaaatgtcca

SEQ ID NO: 236547 - DNA, 20 bp, Artificial Sequence
  chemically synthesized
tttctcaaatgtgaaatgtc

SEQ ID NO: 236548 - DNA, 20 bp, Artificial Sequence
  chemically synthesized
tctctggacatttcacattt

SEQ ID NO: 236549 - DNA, 20 bp, Artificial Sequence
  chemically synthesized
ggacatttcacatttgagaa

SEQ ID NO: 236550 - DNA, 20 bp, Artificial Sequence
  chemically synthesized
gacatttcacatttgagaaa

SEQ ID NO: 236551 - DNA, 20 bp, Artificial Sequence
  chemically synthesized
acatttcacatttgagaaaa

SEQ ID NO: 236552 - DNA, 20 bp, Artificial Sequence
  chemically synthesized
atttcacatttgagaaaagg

SEQ ID NO: 236553 - DNA, 20 bp, Artificial Sequence
  chemically synthesized
gggagtgtatttttcttcaa

SEQ ID NO: 236554 - DNA, 20 bp, Artificial Sequence
  chemically synthesized
tttaacgtcatattctattg

SEQ ID NO: 236555 - DNA, 20 bp, Artificial Sequence
  chemically synthesized
agaatatgacgttaaactat

SEQ ID NO: 236556 - DNA, 20 bp, Artificial Sequence
  chemically synthesized
atcaaatgttgaaaaactta

SEQ ID NO: 236557 - DNA, 20 bp, Artificial Sequence
  chemically synthesized
ataagtttttcaacatttga

SEQ ID NO: 236558 - DNA, 20 bp, Artificial Sequence
  chemically synthesized
agtttttcaacatttgatgg

SEQ ID NO: 236559 - DNA, 20 bp, Artificial Sequence
  chemically synthesized
gtttttcaacatttgatggt

SEQ ID NO: 236560 - DNA, 20 bp, Artificial Sequence
  chemically synthesized
gtcatattttaatgttcaca

SEQ ID NO: 236561 - DNA, 20 bp, Artificial Sequence
  chemically synthesized
tgagcatacagaagtaaata

SEQ ID NO: 236562 - DNA, 20 bp, Artificial Sequence
  chemically synthesized
cattgtcattgagcatacag

SEQ ID NO: 236563 - DNA, 20 bp, Artificial Sequence
  chemically synthesized
attcattgtcattgagcata

SEQ ID NO: 236564 - DNA, 20 bp, Artificial Sequence
  chemically synthesized
aaaatttattcattgtcatt

SEQ ID NO: 236565 - DNA, 20 bp, Artificial Sequence
  chemically synthesized
ctgtttactttgtgatatga

SEQ ID NO: 236566 - DNA, 20 bp, Artificial Sequence
  chemically synthesized
atttttactttcatatcaca

SEQ ID NO: 236567 - DNA, 20 bp, Artificial Sequence
  chemically synthesized
ctttcatatcacaaagtaaa

SEQ ID NO: 236568 - DNA, 20 bp, Artificial Sequence
  chemically synthesized
ttttttattacatttcttta

SEQ ID NO: 236569 - DNA, 20 bp, Artificial Sequence
  chemically synthesized
tatttatatatgttgctgta

SEQ ID NO: 236570 - DNA, 20 bp, Artificial Sequence
  chemically synthesized
tgcacatttaccatataaca

SEQ ID NO: 236571 - DNA, 20 bp, Artificial Sequence
  chemically synthesized
gctccataacctatgttata

SEQ ID NO: 236572 - DNA, 20 bp, Artificial Sequence
  chemically synthesized
gcacatttaccatataacat

SEQ ID NO: 236573 - DNA, 20 bp, Artificial Sequence
  chemically synthesized
ttaccatataacataggtta

SEQ ID NO: 236574 - DNA, 20 bp, Artificial Sequence
  chemically synthesized
accatataacataggttatg

SEQ ID NO: 236575 - DNA, 20 bp, Artificial Sequence
  chemically synthesized
atataacataggttatggag

SEQ ID NO: 236576 - DNA, 20 bp, Artificial Sequence
  chemically synthesized
tctggtatcttttgcaatgt

SEQ ID NO: 236577 - DNA, 20 bp, Artificial Sequence
  chemically synthesized
aaaacacactaacattgcaa

SEQ ID NO: 236578 - DNA, 20 bp, Artificial Sequence
  chemically synthesized
actaacattgcaaaagatac

SEQ ID NO: 236579 - DNA, 20 bp, Artificial Sequence
  chemically synthesized
ggttaagctaattggttttc

SEQ ID NO: 236580 - DNA, 20 bp, Artificial Sequence
  chemically synthesized
aaagataccagaaaaccaat

SEQ ID NO: 236581 - DNA, 20 bp, Artificial Sequence
  chemically synthesized
cttgttaaggttaagctaat

SEQ ID NO: 236582 - DNA, 20 bp, Artificial Sequence
  chemically synthesized
aatatagtcttgttaaggtt

SEQ ID NO: 236583 - DNA, 20 bp, Artificial Sequence
  chemically synthesized
ccaattagcttaaccttaac

SEQ ID NO: 236584 - DNA, 20 bp, Artificial Sequence
  chemically synthesized
gaaaaaatatagtcttgtta

SEQ ID NO: 236585 - DNA, 20 bp, Artificial Sequence
  chemically synthesized
ggaaaaaatatagtcttgtt

SEQ ID NO: 236586 - DNA, 20 bp, Artificial Sequence
  chemically synthesized
ctgtttttagggaaaaaata

SEQ ID NO: 236587 - DNA, 20 bp, Artificial Sequence
  chemically synthesized
ctatattttttccctaaaaa

SEQ ID NO: 236588 - DNA, 20 bp, Artificial Sequence
  chemically synthesized
tgaataaactgctgttttta

SEQ ID NO: 236589 - DNA, 20 bp, Artificial Sequence
  chemically synthesized
atgaataaactgctgttttt

SEQ ID NO: 236590 - DNA, 20 bp, Artificial Sequence
  chemically synthesized
tattttttccctaaaaacag

SEQ ID NO: 236591 - DNA, 20 bp, Artificial Sequence
  chemically synthesized
catgaataaactgctgtttt

SEQ ID NO: 236592 - DNA, 20 bp, Artificial Sequence
  chemically synthesized
aaacagcagtttattcatgt

SEQ ID NO: 236593 - DNA, 20 bp, Artificial Sequence
  chemically synthesized
ttcatgtcagaataacacac

SEQ ID NO: 236594 - DNA, 20 bp, Artificial Sequence
  chemically synthesized
agacatggggagcgaaacac

SEQ ID NO: 236595 - DNA, 20 bp, Artificial Sequence
  chemically synthesized
aaatgttaagcagacatggg

SEQ ID NO: 236596 - DNA, 20 bp, Artificial Sequence
  chemically synthesized
acaaatgttaagcagacatg

SEQ ID NO: 236597 - DNA, 20 bp, Artificial Sequence
  chemically synthesized
aacaaatgttaagcagacat

SEQ ID NO: 236598 - DNA, 20 bp, Artificial Sequence
  chemically synthesized
caacaaatgttaagcagaca

SEQ ID NO: 236599 - DNA, 20 bp, Artificial Sequence
  chemically synthesized
ttaaatcaacaaatgttaag

SEQ ID NO: 236600 - DNA, 20 bp, Artificial Sequence
  chemically synthesized
gctttaaatcaacaaatgtt

SEQ ID NO: 236601 - DNA, 20 bp, Artificial Sequence
  chemically synthesized
gcttaacatttgttgattta

SEQ ID NO: 236602 - DNA, 20 bp, Artificial Sequence
  chemically synthesized
ttgtttagatgaaatttttt

SEQ ID NO: 236603 - DNA, 20 bp, Artificial Sequence
  chemically synthesized
attgtttagatgaaattttt

SEQ ID NO: 236604 - DNA, 20 bp, Artificial Sequence
  chemically synthesized
ttaacagtagtggtattgtt

SEQ ID NO: 236605 - DNA, 20 bp, Artificial Sequence
  chemically synthesized
ccttaagacattaacagtag

SEQ ID NO: 236606 - DNA, 20 bp, Artificial Sequence
  chemically synthesized
cgaccttaagacattaacag

SEQ ID NO: 236607 - DNA, 20 bp, Artificial Sequence
  chemically synthesized
aatcgaccttaagacattaa

SEQ ID NO: 236608 - DNA, 20 bp, Artificial Sequence
  chemically synthesized
accactactgttaatgtctt

SEQ ID NO: 236609 - DNA, 20 bp, Artificial Sequence
  chemically synthesized
ccactactgttaatgtctta

SEQ ID NO: 236610 - DNA, 20 bp, Artificial Sequence
  chemically synthesized
ttccatttgaaatcgacctt

SEQ ID NO: 236611 - DNA, 20 bp, Artificial Sequence
  chemically synthesized
gtcttaaggtcgatttcaaa

SEQ ID NO: 236612 - DNA, 20 bp, Artificial Sequence
  chemically synthesized
gatttcaaatggaatacctt

SEQ ID NO: 236613 - DNA, 20 bp, Artificial Sequence
  chemically synthesized
cctgagaccctaaaatctta

SEQ ID NO: 236614 - DNA, 20 bp, Artificial Sequence
  chemically synthesized
aatggaataccttaagattt

SEQ ID NO: 236615 - DNA, 20 bp, Artificial Sequence
  chemically synthesized
gcctgagaccctaaaatctt

SEQ ID NO: 236616 - DNA, 20 bp, Artificial Sequence
  chemically synthesized
atggaataccttaagatttt

SEQ ID NO: 236617 - DNA, 20 bp, Artificial Sequence
  chemically synthesized
tggaataccttaagatttta

SEQ ID NO: 236618 - DNA, 20 bp, Artificial Sequence
  chemically synthesized
accttaagattttagggtct

SEQ ID NO: 236619 - DNA, 20 bp, Artificial Sequence
  chemically synthesized
ccttaagattttagggtctc

SEQ ID NO: 236620 - DNA, 20 bp, Artificial Sequence
  chemically synthesized
tgtcgcagacatacaagcct

SEQ ID NO: 236621 - DNA, 20 bp, Artificial Sequence
  chemically synthesized
gaacgttgtcgcagacatac

SEQ ID NO: 236622 - DNA, 20 bp, Artificial Sequence
  chemically synthesized
tttcctgcagaacgttgtcg

SEQ ID NO: 236623 - DNA, 20 bp, Artificial Sequence
  chemically synthesized
atgtctgcgacaacgttctg

SEQ ID NO: 236624 - DNA, 20 bp, Artificial Sequence
  chemically synthesized
tgtctgcgacaacgttctgc

SEQ ID NO: 236625 - DNA, 20 bp, Artificial Sequence
  chemically synthesized
aaaatgaccagtatttcctg

SEQ ID NO: 236626 - DNA, 20 bp, Artificial Sequence
  chemically synthesized
caacgttctgcaggaaatac

SEQ ID NO: 236627 - DNA, 20 bp, Artificial Sequence
  chemically synthesized
tgaaccatattaaaaatgac

SEQ ID NO: 236628 - DNA, 20 bp, Artificial Sequence
  chemically synthesized
aatactggtcatttttaata

SEQ ID NO: 236629 - DNA, 20 bp, Artificial Sequence
  chemically synthesized
catttttaatatggttcatt

SEQ ID NO: 236630 - DNA, 20 bp, Artificial Sequence
  chemically synthesized
ttttaatatggttcattcag

SEQ ID NO: 236631 - DNA, 20 bp, Artificial Sequence
  chemically synthesized
agcagcattatttcataaaa

SEQ ID NO: 236632 - DNA, 20 bp, Artificial Sequence
  chemically synthesized
aatatttttattaatggaaa

SEQ ID NO: 236633 - DNA, 20 bp, Artificial Sequence
  chemically synthesized
cagctgaatatttttattaa

SEQ ID NO: 236634 - DNA, 20 bp, Artificial Sequence
  chemically synthesized
tttccattaataaaaatatt

SEQ ID NO: 236635 - DNA, 20 bp, Artificial Sequence
  chemically synthesized
cattaataaaaatattcagc

SEQ ID NO: 236636 - DNA, 20 bp, Artificial Sequence
  chemically synthesized
attagattaagtatttaaac

SEQ ID NO: 236637 - DNA, 20 bp, Artificial Sequence
  chemically synthesized
ggtttaaatacttaatctaa

SEQ ID NO: 236638 - DNA, 20 bp, Artificial Sequence
  chemically synthesized
ataacaattaccattagatt

SEQ ID NO: 236639 - DNA, 20 bp, Artificial Sequence
  chemically synthesized
gaaacaataacaattaccat

SEQ ID NO: 236640 - DNA, 20 bp, Artificial Sequence
  chemically synthesized
gtaattgttattgtttctac

SEQ ID NO: 236641 - DNA, 20 bp, Artificial Sequence
  chemically synthesized
aaaatgtttgtagttgccag

SEQ ID NO: 236642 - DNA, 20 bp, Artificial Sequence
  chemically synthesized
tggaaaatgtttgtagttgc

SEQ ID NO: 236643 - DNA, 20 bp, Artificial Sequence
  chemically synthesized
aatgagatggaaaatgtttg

SEQ ID NO: 236644 - DNA, 20 bp, Artificial Sequence
  chemically synthesized
tgggctatgatagaatgaga

SEQ ID NO: 236645 - DNA, 20 bp, Artificial Sequence
  chemically synthesized
aacatgggctatgatagaat

SEQ ID NO: 236646 - DNA, 20 bp, Artificial Sequence
  chemically synthesized
ttttccatctcattctatca

SEQ ID NO: 236647 - DNA, 20 bp, Artificial Sequence
  chemically synthesized
ttttaaaacatgggctatga

SEQ ID NO: 236648 - DNA, 20 bp, Artificial Sequence
  chemically synthesized
aaaaataagttttaaaacat

SEQ ID NO: 236649 - DNA, 20 bp, Artificial Sequence
  chemically synthesized
aaaaaataagttttaaaaca

SEQ ID NO: 236650 - DNA, 20 bp, Artificial Sequence
  chemically synthesized
cttggagactaggaaaaaat

SEQ ID NO: 236651 - DNA, 20 bp, Artificial Sequence
  chemically synthesized
ttttaaaacttattttttcc

SEQ ID NO: 236652 - DNA, 20 bp, Artificial Sequence
  chemically synthesized
cttattttttcctagtctcc

SEQ ID NO: 236653 - DNA, 20 bp, Artificial Sequence
  chemically synthesized
ctagcatgttcttggagact

SEQ ID NO: 236654 - DNA, 20 bp, Artificial Sequence
  chemically synthesized
gctagcatgttcttggagac

SEQ ID NO: 236655 - DNA, 20 bp, Artificial Sequence
  chemically synthesized
ttaaagctagcatgttcttg

SEQ ID NO: 236656 - DNA, 20 bp, Artificial Sequence
  chemically synthesized
atttaaagctagcatgttct

SEQ ID NO: 236657 - DNA, 20 bp, Artificial Sequence
  chemically synthesized
cctagtctccaagaacatgc

SEQ ID NO: 236658 - DNA, 20 bp, Artificial Sequence
  chemically synthesized
aatgccctaacatttaaagc

SEQ ID NO: 236659 - DNA, 20 bp, Artificial Sequence
  chemically synthesized
aacatgctagctttaaatgt

SEQ ID NO: 236660 - DNA, 20 bp, Artificial Sequence
  chemically synthesized
ataaaatgccctaacattta

SEQ ID NO: 236661 - DNA, 20 bp, Artificial Sequence
  chemically synthesized
acatgctagctttaaatgtt

SEQ ID NO: 236662 - DNA, 20 bp, Artificial Sequence
  chemically synthesized
catgctagctttaaatgtta

SEQ ID NO: 236663 - DNA, 20 bp, Artificial Sequence
  chemically synthesized
cttcagtgaaaataggaaag

SEQ ID NO: 236664 - DNA, 20 bp, Artificial Sequence
  chemically synthesized
tcccttcagtgaaaatagga

SEQ ID NO: 236665 - DNA, 20 bp, Artificial Sequence
  chemically synthesized
caagtcccttcagtgaaaat

SEQ ID NO: 236666 - DNA, 20 bp, Artificial Sequence
  chemically synthesized
tcaagtcccttcagtgaaaa

SEQ ID NO: 236667 - DNA, 20 bp, Artificial Sequence
  chemically synthesized
ctactttcctattttcactg

SEQ ID NO: 236668 - DNA, 20 bp, Artificial Sequence
  chemically synthesized
tactttcctattttcactga

SEQ ID NO: 236669 - DNA, 20 bp, Artificial Sequence
  chemically synthesized
actttcctattttcactgaa

SEQ ID NO: 236670 - DNA, 20 bp, Artificial Sequence
  chemically synthesized
tgtgtgctttcaagtccctt

SEQ ID NO: 236671 - DNA, 20 bp, Artificial Sequence
  chemically synthesized
ttttcactgaagggacttga

SEQ ID NO: 236672 - DNA, 20 bp, Artificial Sequence
  chemically synthesized
gggtgaatttgtgtgctttc

SEQ ID NO: 236673 - DNA, 20 bp, Artificial Sequence
  chemically synthesized
tgttagctcatatattgaca

SEQ ID NO: 236674 - DNA, 20 bp, Artificial Sequence
  chemically synthesized
atgttagctcatatattgac

SEQ ID NO: 236675 - DNA, 20 bp, Artificial Sequence
  chemically synthesized
aatgttagctcatatattga

SEQ ID NO: 236676 - DNA, 20 bp, Artificial Sequence
  chemically synthesized
aattcaccctgtcaatatat

SEQ ID NO: 236677 - DNA, 20 bp, Artificial Sequence
  chemically synthesized
gaaagtgacacaaataatgt

SEQ ID NO: 236678 - DNA, 20 bp, Artificial Sequence
  chemically synthesized
atttgtgtcactttccttca

SEQ ID NO: 236679 - DNA, 20 bp, Artificial Sequence
  chemically synthesized
aagctgaacaccatgaagga

SEQ ID NO: 236680 - DNA, 20 bp, Artificial Sequence
  chemically synthesized
ggaaaagctgaacaccatga

SEQ ID NO: 236681 - DNA, 20 bp, Artificial Sequence
  chemically synthesized
aggaaaagctgaacaccatg

SEQ ID NO: 236682 - DNA, 20 bp, Artificial Sequence
  chemically synthesized
tcactttccttcatggtgtt

SEQ ID NO: 236683 - DNA, 20 bp, Artificial Sequence
  chemically synthesized
aatgggagttttcaaaggaa

SEQ ID NO: 236684 - DNA, 20 bp, Artificial Sequence
  chemically synthesized
atgttaatgggagttttcaa

SEQ ID NO: 236685 - DNA, 20 bp, Artificial Sequence
  chemically synthesized
aatgttaatgggagttttca

SEQ ID NO: 236686 - DNA, 20 bp, Artificial Sequence
  chemically synthesized
acaagaagaaatgttaatgg

SEQ ID NO: 236687 - DNA, 20 bp, Artificial Sequence
  chemically synthesized
taacaagaagaaatgttaat

SEQ ID NO: 236688 - DNA, 20 bp, Artificial Sequence
  chemically synthesized
ctaacaagaagaaatgttaa

SEQ ID NO: 236689 - DNA, 20 bp, Artificial Sequence
  chemically synthesized
ccattaacatttcttcttgt

SEQ ID NO: 236690 - DNA, 20 bp, Artificial Sequence
  chemically synthesized
ctcatttcctagctaacaag

SEQ ID NO: 236691 - DNA, 20 bp, Artificial Sequence
  chemically synthesized
taacatttcttcttgttagc

SEQ ID NO: 236692 - DNA, 20 bp, Artificial Sequence
  chemically synthesized
aacatttcttcttgttagct

SEQ ID NO: 236693 - DNA, 20 bp, Artificial Sequence
  chemically synthesized
ctactcatttcctagctaac

SEQ ID NO: 236694 - DNA, 20 bp, Artificial Sequence
  chemically synthesized
cttcttgttagctaggaaat

SEQ ID NO: 236695 - DNA, 20 bp, Artificial Sequence
  chemically synthesized
acttctgcctactcatttcc

SEQ ID NO: 236696 - DNA, 20 bp, Artificial Sequence
  chemically synthesized
cttgttagctaggaaatgag

SEQ ID NO: 236697 - DNA, 20 bp, Artificial Sequence
  chemically synthesized
ttgttagctaggaaatgagt

SEQ ID NO: 236698 - DNA, 20 bp, Artificial Sequence
  chemically synthesized
ttagctaggaaatgagtagg

SEQ ID NO: 236699 - DNA, 20 bp, Artificial Sequence
  chemically synthesized
gctaggaaatgagtaggcag

SEQ ID NO: 236700 - DNA, 20 bp, Artificial Sequence
  chemically synthesized
aaatgagtaggcagaagtgt

SEQ ID NO: 236701 - DNA, 20 bp, Artificial Sequence
  chemically synthesized
gaagtgtcagctatctgaaa

SEQ ID NO: 236702 - DNA, 20 bp, Artificial Sequence
  chemically synthesized
ccaaacgcatctgtttcaga

SEQ ID NO: 236703 - DNA, 20 bp, Artificial Sequence
  chemically synthesized
tcagccaaacgcatctgttt

SEQ ID NO: 236704 - DNA, 20 bp, Artificial Sequence
  chemically synthesized
ctatctgaaacagatgcgtt

SEQ ID NO: 236705 - DNA, 20 bp, Artificial Sequence
  chemically synthesized
acagatgcgtttggctgaat

SEQ ID NO: 236706 - DNA, 20 bp, Artificial Sequence
  chemically synthesized
aattgaggaaaattccaatt

SEQ ID NO: 236707 - DNA, 20 bp, Artificial Sequence
  chemically synthesized
ggctcttggattaggaattg

SEQ ID NO: 236708 - DNA, 20 bp, Artificial Sequence
  chemically synthesized
gggctcttggattaggaatt

SEQ ID NO: 236709 - DNA, 20 bp, Artificial Sequence
  chemically synthesized
ttttcctcaattcctaatcc

SEQ ID NO: 236710 - DNA, 20 bp, Artificial Sequence
  chemically synthesized
ttcctcaattcctaatccaa

SEQ ID NO: 236711 - DNA, 20 bp, Artificial Sequence
  chemically synthesized
agcataagggctcttggatt

SEQ ID NO: 236712 - DNA, 20 bp, Artificial Sequence
  chemically synthesized
aagcataagggctcttggat

SEQ ID NO: 236713 - DNA, 20 bp, Artificial Sequence
  chemically synthesized
tctcaaagcataagggctct

SEQ ID NO: 236714 - DNA, 20 bp, Artificial Sequence
  chemically synthesized
aatttcttctcaaagcataa

SEQ ID NO: 236715 - DNA, 20 bp, Artificial Sequence
  chemically synthesized
taatttcttctcaaagcata

SEQ ID NO: 236716 - DNA, 20 bp, Artificial Sequence
  chemically synthesized
tccaagagcccttatgcttt

SEQ ID NO: 236717 - DNA, 20 bp, Artificial Sequence
  chemically synthesized
ataatttcttctcaaagcat

SEQ ID NO: 236718 - DNA, 20 bp, Artificial Sequence
  chemically synthesized
aagagcccttatgctttgag

SEQ ID NO: 236719 - DNA, 20 bp, Artificial Sequence
  chemically synthesized
tgtagtataatttcttctca

SEQ ID NO: 236720 - DNA, 20 bp, Artificial Sequence
  chemically synthesized
cataaaaccttatttttatg

SEQ ID NO: 236721 - DNA, 20 bp, Artificial Sequence
  chemically synthesized
aaattatactacataaaaat

SEQ ID NO: 236722 - DNA, 20 bp, Artificial Sequence
  chemically synthesized
aattatactacataaaaata

SEQ ID NO: 236723 - DNA, 20 bp, Artificial Sequence
  chemically synthesized
ataaggttttatgaaatttc

SEQ ID NO: 236724 - DNA, 20 bp, Artificial Sequence
  chemically synthesized
taaggttttatgaaatttcc

SEQ ID NO: 236725 - DNA, 20 bp, Artificial Sequence
  chemically synthesized
gttttatgaaatttccaggt

SEQ ID NO: 236726 - DNA, 20 bp, Artificial Sequence
  chemically synthesized
acactgcagaaaaaccaacc

SEQ ID NO: 236727 - DNA, 20 bp, Artificial Sequence
  chemically synthesized
tttccaggttggtttttctg

SEQ ID NO: 236728 - DNA, 20 bp, Artificial Sequence
  chemically synthesized
aggttggtttttctgcagtg

SEQ ID NO: 236729 - DNA, 20 bp, Artificial Sequence
  chemically synthesized
gtctctaaacatccacactg

SEQ ID NO: 236730 - DNA, 20 bp, Artificial Sequence
  chemically synthesized
ttttctgcagtgtggatgtt

SEQ ID NO: 236731 - DNA, 20 bp, Artificial Sequence
  chemically synthesized
ttctgcagtgtggatgttta

SEQ ID NO: 236732 - DNA, 20 bp, Artificial Sequence
  chemically synthesized
gatgtttagagacgataatt

SEQ ID NO: 236733 - DNA, 20 bp, Artificial Sequence
  chemically synthesized
gagacgataattcagtaaat

SEQ ID NO: 236734 - DNA, 20 bp, Artificial Sequence
  chemically synthesized
ataattcagtaaataagtct

SEQ ID NO: 236735 - DNA, 20 bp, Artificial Sequence
  chemically synthesized
agttcatatcaatacaaact

SEQ ID NO: 236736 - DNA, 20 bp, Artificial Sequence
  chemically synthesized
aatcactctttataagtgat

SEQ ID NO: 236737 - DNA, 20 bp, Artificial Sequence
  chemically synthesized
atatgaactaatcacttata

SEQ ID NO: 236738 - DNA, 20 bp, Artificial Sequence
  chemically synthesized
atgaactaatcacttataaa

SEQ ID NO: 236739 - DNA, 20 bp, Artificial Sequence
  chemically synthesized
tataactaatcactctttat

SEQ ID NO: 236740 - DNA, 20 bp, Artificial Sequence
  chemically synthesized
aatcacttataaagagtgat

SEQ ID NO: 236741 - DNA, 20 bp, Artificial Sequence
  chemically synthesized
taaagagtgattagttataa

SEQ ID NO: 236742 - DNA, 20 bp, Artificial Sequence
  chemically synthesized
aaagagtgattagttataat

SEQ ID NO: 236743 - DNA, 20 bp, Artificial Sequence
  chemically synthesized
aagagtgattagttataata

SEQ ID NO: 236744 - DNA, 20 bp, Artificial Sequence
  chemically synthesized
agagtgattagttataatag

SEQ ID NO: 236745 - DNA, 20 bp, Artificial Sequence
  chemically synthesized
aataattactcattaaatgt

SEQ ID NO: 236746 - DNA, 20 bp, Artificial Sequence
  chemically synthesized
aataggggcttacatttaat

SEQ ID NO: 236747 - DNA, 20 bp, Artificial Sequence
  chemically synthesized
tttgtgcaaaatgctattcc

SEQ ID NO: 236748 - DNA, 20 bp, Artificial Sequence
  chemically synthesized
gtgcaaaatgctattccaag

SEQ ID NO: 236749 - DNA, 20 bp, Artificial Sequence
  chemically synthesized
gtgtataaagccacttggaa

SEQ ID NO: 236750 - DNA, 20 bp, Artificial Sequence
  chemically synthesized
gagatgtgtataaagccact

SEQ ID NO: 236751 - DNA, 20 bp, Artificial Sequence
  chemically synthesized
atataaatgagatgtgtata

SEQ ID NO: 236752 - DNA, 20 bp, Artificial Sequence
  chemically synthesized
tctaaaatggaaatataaat

SEQ ID NO: 236753 - DNA, 20 bp, Artificial Sequence
  chemically synthesized
tctcatttatatttccattt

SEQ ID NO: 236754 - DNA, 20 bp, Artificial Sequence
  chemically synthesized
tcatttatatttccatttta

SEQ ID NO: 236755 - DNA, 20 bp, Artificial Sequence
  chemically synthesized
ctgatttctcttctctaaaa

SEQ ID NO: 236756 - DNA, 20 bp, Artificial Sequence
  chemically synthesized
tttatatttccattttagag

SEQ ID NO: 236757 - DNA, 20 bp, Artificial Sequence
  chemically synthesized
tatatttccattttagagaa

SEQ ID NO: 236758 - DNA, 20 bp, Artificial Sequence
  chemically synthesized
ccattttagagaagagaaat

SEQ ID NO: 236759 - DNA, 20 bp, Artificial Sequence
  chemically synthesized
attttagagaagagaaatca

SEQ ID NO: 236760 - DNA, 20 bp, Artificial Sequence
  chemically synthesized
agagaaatcagagacatgaa

SEQ ID NO: 236761 - DNA, 20 bp, Artificial Sequence
  chemically synthesized
tcagagacatgaaaagaatt

SEQ ID NO: 236762 - DNA, 20 bp, Artificial Sequence
  chemically synthesized
aagaattaagatattttcac

SEQ ID NO: 236763 - DNA, 20 bp, Artificial Sequence
  chemically synthesized
gtcctttagcttaatagttg

SEQ ID NO: 236764 - DNA, 20 bp, Artificial Sequence
  chemically synthesized
cacaagattctacaactatt

SEQ ID NO: 236765 - DNA, 20 bp, Artificial Sequence
  chemically synthesized
tcccaggtcctttagcttaa

SEQ ID NO: 236766 - DNA, 20 bp, Artificial Sequence
  chemically synthesized
attctacaactattaagcta

SEQ ID NO: 236767 - DNA, 20 bp, Artificial Sequence
  chemically synthesized
ttctacaactattaagctaa

SEQ ID NO: 236768 - DNA, 20 bp, Artificial Sequence
  chemically synthesized
aactattaagctaaaggacc

SEQ ID NO: 236769 - DNA, 20 bp, Artificial Sequence
  chemically synthesized
gattcaaatcccaggtcctt

SEQ ID NO: 236770 - DNA, 20 bp, Artificial Sequence
  chemically synthesized
actattaagctaaaggacct

SEQ ID NO: 236771 - DNA, 20 bp, Artificial Sequence
  chemically synthesized
aaagattggattcaaatccc

SEQ ID NO: 236772 - DNA, 20 bp, Artificial Sequence
  chemically synthesized
gaaagattggattcaaatcc

SEQ ID NO: 236773 - DNA, 20 bp, Artificial Sequence
  chemically synthesized
aatgctggactcagaaagat

SEQ ID NO: 236774 - DNA, 20 bp, Artificial Sequence
  chemically synthesized
gatttgaatccaatctttct

SEQ ID NO: 236775 - DNA, 20 bp, Artificial Sequence
  chemically synthesized
ggttaaatgctggactcaga

SEQ ID NO: 236776 - DNA, 20 bp, Artificial Sequence
  chemically synthesized
gaatccaatctttctgagtc

SEQ ID NO: 236777 - DNA, 20 bp, Artificial Sequence
  chemically synthesized
aagtggttaaatgctggact

SEQ ID NO: 236778 - DNA, 20 bp, Artificial Sequence
  chemically synthesized
ggggttaagtggttaaatgc

SEQ ID NO: 236779 - DNA, 20 bp, Artificial Sequence
  chemically synthesized
agtttagaaagggggttaag

SEQ ID NO: 236780 - DNA, 20 bp, Artificial Sequence
  chemically synthesized
agaagtttagaaagggggtt

SEQ ID NO: 236781 - DNA, 20 bp, Artificial Sequence
  chemically synthesized
ctaatagaagtttagaaagg

SEQ ID NO: 236782 - DNA, 20 bp, Artificial Sequence
  chemically synthesized
tctaatagaagtttagaaag

SEQ ID NO: 236783 - DNA, 20 bp, Artificial Sequence
  chemically synthesized
ctctaatagaagtttagaaa

SEQ ID NO: 236784 - DNA, 20 bp, Artificial Sequence
  chemically synthesized
gctctaatagaagtttagaa

SEQ ID NO: 236785 - DNA, 20 bp, Artificial Sequence
  chemically synthesized
ggctctaatagaagtttaga

SEQ ID NO: 236786 - DNA, 20 bp, Artificial Sequence
  chemically synthesized
atgaggctctaatagaagtt

SEQ ID NO: 236787 - DNA, 20 bp, Artificial Sequence
  chemically synthesized
ccccctttctaaacttctat

SEQ ID NO: 236788 - DNA, 20 bp, Artificial Sequence
  chemically synthesized
ccctttctaaacttctatta

SEQ ID NO: 236789 - DNA, 20 bp, Artificial Sequence
  chemically synthesized
tccacatgaggctctaatag

SEQ ID NO: 236790 - DNA, 20 bp, Artificial Sequence
  chemically synthesized
caatccacatgaggctctaa

SEQ ID NO: 236791 - DNA, 20 bp, Artificial Sequence
  chemically synthesized
acttctattagagcctcatg

SEQ ID NO: 236792 - DNA, 20 bp, Artificial Sequence
  chemically synthesized
aaacagtgacaatccacatg

SEQ ID NO: 236793 - DNA, 20 bp, Artificial Sequence
  chemically synthesized
aaaacagtgacaatccacat

SEQ ID NO: 236794 - DNA, 20 bp, Artificial Sequence
  chemically synthesized
catgtggattgtcactgttt

SEQ ID NO: 236795 - DNA, 20 bp, Artificial Sequence
  chemically synthesized
gtggattgtcactgttttgg

SEQ ID NO: 236796 - DNA, 20 bp, Artificial Sequence
  chemically synthesized
agttttatcatccaccaaaa

SEQ ID NO: 236797 - DNA, 20 bp, Artificial Sequence
  chemically synthesized
agtaattgagtgcatataca

SEQ ID NO: 236798 - DNA, 20 bp, Artificial Sequence
  chemically synthesized
tcactaaacaagcagtaatt

SEQ ID NO: 236799 - DNA, 20 bp, Artificial Sequence
  chemically synthesized
gcactcaattactgcttgtt

SEQ ID NO: 236800 - DNA, 20 bp, Artificial Sequence
  chemically synthesized
taatgcattcactaaacaag

SEQ ID NO: 236801 - DNA, 20 bp, Artificial Sequence
  chemically synthesized
tcttaatgcattcactaaac

SEQ ID NO: 236802 - DNA, 20 bp, Artificial Sequence
  chemically synthesized
gcttgtttagtgaatgcatt

SEQ ID NO: 236803 - DNA, 20 bp, Artificial Sequence
  chemically synthesized
ttgtttagtgaatgcattaa

SEQ ID NO: 236804 - DNA, 20 bp, Artificial Sequence
  chemically synthesized
ttaaattcgttgaatgatat

SEQ ID NO: 236805 - DNA, 20 bp, Artificial Sequence
  chemically synthesized
cgaatttaataaaccaattt

SEQ ID NO: 236806 - DNA, 20 bp, Artificial Sequence
  chemically synthesized
atttaataaaccaatttgag

SEQ ID NO: 236807 - DNA, 20 bp, Artificial Sequence
  chemically synthesized
atgttatatgccactcaaat

SEQ ID NO: 236808 - DNA, 20 bp, Artificial Sequence
  chemically synthesized
aacatgatcaatatttttct

SEQ ID NO: 236809 - DNA, 20 bp, Artificial Sequence
  chemically synthesized
acatgatcaatatttttctc

SEQ ID NO: 236810 - DNA, 20 bp, Artificial Sequence
  chemically synthesized
aatatcccatttttttacct

SEQ ID NO: 236811 - DNA, 20 bp, Artificial Sequence
  chemically synthesized
atttttctcaggtaaaaaaa

SEQ ID NO: 236812 - DNA, 20 bp, Artificial Sequence
  chemically synthesized
tttttctcaggtaaaaaaat

SEQ ID NO: 236813 - DNA, 20 bp, Artificial Sequence
  chemically synthesized
gtaaaaaaatgggatatttt

SEQ ID NO: 236814 - DNA, 20 bp, Artificial Sequence
  chemically synthesized
aaaaaaatgggatattttta

SEQ ID NO: 236815 - DNA, 20 bp, Artificial Sequence
  chemically synthesized
aaaaatgggatatttttaga

SEQ ID NO: 236816 - DNA, 20 bp, Artificial Sequence
  chemically synthesized
aaaatgggatatttttagag

SEQ ID NO: 236817 - DNA, 20 bp, Artificial Sequence
  chemically synthesized
atttttagagaggttctcca

SEQ ID NO: 236818 - DNA, 20 bp, Artificial Sequence
  chemically synthesized
tttagagaggttctccatag

SEQ ID NO: 236819 - DNA, 20 bp, Artificial Sequence
  chemically synthesized
caatataccatgccactatg

SEQ ID NO: 236820 - DNA, 20 bp, Artificial Sequence
  chemically synthesized
agcaatataccatgccacta

SEQ ID NO: 236821 - DNA, 20 bp, Artificial Sequence
  chemically synthesized
agaggttctccatagtggca

SEQ ID NO: 236822 - DNA, 20 bp, Artificial Sequence
  chemically synthesized
agtggcatggtatattgctc

SEQ ID NO: 236823 - DNA, 20 bp, Artificial Sequence
  chemically synthesized
tgctttttgaagatattcca

SEQ ID NO: 236824 - DNA, 20 bp, Artificial Sequence
  chemically synthesized
agtgctttttgaagatattc

SEQ ID NO: 236825 - DNA, 20 bp, Artificial Sequence
  chemically synthesized
tgctctggaatatcttcaaa

SEQ ID NO: 236826 - DNA, 20 bp, Artificial Sequence
  chemically synthesized
acatgaattagtgctttttg

SEQ ID NO: 236827 - DNA, 20 bp, Artificial Sequence
  chemically synthesized
acaaaattaagtacatgaat

SEQ ID NO: 236828 - DNA, 20 bp, Artificial Sequence
  chemically synthesized
cgcaagtaaaagacaaaatt

SEQ ID NO: 236829 - DNA, 20 bp, Artificial Sequence
  chemically synthesized
ttttcctctgtcgcaagtaa

SEQ ID NO: 236830 - DNA, 20 bp, Artificial Sequence
  chemically synthesized
attttgtcttttacttgcga

SEQ ID NO: 236831 - DNA, 20 bp, Artificial Sequence
  chemically synthesized
tttgtcttttacttgcgaca

SEQ ID NO: 236832 - DNA, 20 bp, Artificial Sequence
  chemically synthesized
ttgtcttttacttgcgacag

SEQ ID NO: 236833 - DNA, 20 bp, Artificial Sequence
  chemically synthesized
tattttttttcctctgtcgc

SEQ ID NO: 236834 - DNA, 20 bp, Artificial Sequence
  chemically synthesized
ttgcgacagaggaaaaaaaa

SEQ ID NO: 236835 - DNA, 20 bp, Artificial Sequence
  chemically synthesized
gcgacagaggaaaaaaaata

SEQ ID NO: 236836 - DNA, 20 bp, Artificial Sequence
  chemically synthesized
ggaaaaaaaatagagttgca

SEQ ID NO: 236837 - DNA, 20 bp, Artificial Sequence
  chemically synthesized
aaaatagagttgcatggaac

SEQ ID NO: 236838 - DNA, 20 bp, Artificial Sequence
  chemically synthesized
atagcagtagaaagataatc

SEQ ID NO: 236839 - DNA, 20 bp, Artificial Sequence
  chemically synthesized
tgactgccaatagcagtaga

SEQ ID NO: 236840 - DNA, 20 bp, Artificial Sequence
  chemically synthesized
gattatctttctactgctat

SEQ ID NO: 236841 - DNA, 20 bp, Artificial Sequence
  chemically synthesized
atactgactgccaatagcag

SEQ ID NO: 236842 - DNA, 20 bp, Artificial Sequence
  chemically synthesized
tatctttctactgctattgg

SEQ ID NO: 236843 - DNA, 20 bp, Artificial Sequence
  chemically synthesized
aatatactgactgccaatag

SEQ ID NO: 236844 - DNA, 20 bp, Artificial Sequence
  chemically synthesized
caaaatatactgactgccaa

SEQ ID NO: 236845 - DNA, 20 bp, Artificial Sequence
  chemically synthesized
tttctactgctattggcagt

SEQ ID NO: 236846 - DNA, 20 bp, Artificial Sequence
  chemically synthesized
atattttgaatgataacact

SEQ ID NO: 236847 - DNA, 20 bp, Artificial Sequence
  chemically synthesized
tgaatgataacactaagtct

SEQ ID NO: 236848 - DNA, 20 bp, Artificial Sequence
  chemically synthesized
ttagtgctttaactgagact

SEQ ID NO: 236849 - DNA, 20 bp, Artificial Sequence
  chemically synthesized
ataacactaagtctcagtta

SEQ ID NO: 236850 - DNA, 20 bp, Artificial Sequence
  chemically synthesized
gagaatttagtgctttaact

SEQ ID NO: 236851 - DNA, 20 bp, Artificial Sequence
  chemically synthesized
tcactttaaagaagagaatt

SEQ ID NO: 236852 - DNA, 20 bp, Artificial Sequence
  chemically synthesized
gcactaaattctcttcttta

SEQ ID NO: 236853 - DNA, 20 bp, Artificial Sequence
  chemically synthesized
atttttttcactttaaagaa

SEQ ID NO: 236854 - DNA, 20 bp, Artificial Sequence
  chemically synthesized
atatttttttcactttaaag

SEQ ID NO: 236855 - DNA, 20 bp, Artificial Sequence
  chemically synthesized
atcatatttttttcacttta

SEQ ID NO: 236856 - DNA, 20 bp, Artificial Sequence
  chemically synthesized
tgcaatttgatcaaaataca

SEQ ID NO: 236857 - DNA, 20 bp, Artificial Sequence
  chemically synthesized
gcaatttgatcaaaatacat

SEQ ID NO: 236858 - DNA, 20 bp, Artificial Sequence
  chemically synthesized
caatttgatcaaaatacata

SEQ ID NO: 236859 - DNA, 20 bp, Artificial Sequence
  chemically synthesized
tgatcaaaatacatagggac

SEQ ID NO: 236860 - DNA, 20 bp, Artificial Sequence
  chemically synthesized
ttagatatgaaataaacaaa

SEQ ID NO: 236861 - DNA, 20 bp, Artificial Sequence
  chemically synthesized
tttgtttatttcatatctaa

SEQ ID NO: 236862 - DNA, 20 bp, Artificial Sequence
  chemically synthesized
ttcagtaaagaaataacttt

SEQ ID NO: 236863 - DNA, 20 bp, Artificial Sequence
  chemically synthesized
catatgtacaattttcagta

SEQ ID NO: 236864 - DNA, 20 bp, Artificial Sequence
  chemically synthesized
agcctcatatgtacaatttt

SEQ ID NO: 236865 - DNA, 20 bp, Artificial Sequence
  chemically synthesized
ttactgaaaattgtacatat

SEQ ID NO: 236866 - DNA, 20 bp, Artificial Sequence
  chemically synthesized
tactgaaaattgtacatatg

SEQ ID NO: 236867 - DNA, 20 bp, Artificial Sequence
  chemically synthesized
aaattgtacatatgaggctt

SEQ ID NO: 236868 - DNA, 20 bp, Artificial Sequence
  chemically synthesized
cagaagcacgttggagtctg

SEQ ID NO: 236869 - DNA, 20 bp, Artificial Sequence
  chemically synthesized
acacacgcagaagcacgttg

SEQ ID NO: 236870 - DNA, 20 bp, Artificial Sequence
  chemically synthesized
aaacacacgcagaagcacgt

SEQ ID NO: 236871 - DNA, 20 bp, Artificial Sequence
  chemically synthesized
tattaaacaaacacacgcag

SEQ ID NO: 236872 - DNA, 20 bp, Artificial Sequence
  chemically synthesized
atatattaaacaaacacacg

SEQ ID NO: 236873 - DNA, 20 bp, Artificial Sequence
  chemically synthesized
gcgtgtgtttgtttaatata

SEQ ID NO: 236874 - DNA, 20 bp, Artificial Sequence
  chemically synthesized
cgtgtgtttgtttaatatat

SEQ ID NO: 236875 - DNA, 20 bp, Artificial Sequence
  chemically synthesized
tgtttaatatatgggctgct

SEQ ID NO: 236876 - DNA, 20 bp, Artificial Sequence
  chemically synthesized
tgtgaaaaaaatcaaccaag

SEQ ID NO: 236877 - DNA, 20 bp, Artificial Sequence
  chemically synthesized
tactgtgaaaaaaatcaacc

SEQ ID NO: 236878 - DNA, 20 bp, Artificial Sequence
  chemically synthesized
tgcttggttgatttttttca

SEQ ID NO: 236879 - DNA, 20 bp, Artificial Sequence
  chemically synthesized
tttttcacagtaaccattac

SEQ ID NO: 236880 - DNA, 20 bp, Artificial Sequence
  chemically synthesized
tgtttggcatgagccagtaa

SEQ ID NO: 236881 - DNA, 20 bp, Artificial Sequence
  chemically synthesized
ggcaattgtttggcatgagc

SEQ ID NO: 236882 - DNA, 20 bp, Artificial Sequence
  chemically synthesized
agcaggcaattgtttggcat

SEQ ID NO: 236883 - DNA, 20 bp, Artificial Sequence
  chemically synthesized
gctgttagcaggcaattgtt

SEQ ID NO: 236884 - DNA, 20 bp, Artificial Sequence
  chemically synthesized
gccaaacaattgcctgctaa

SEQ ID NO: 236885 - DNA, 20 bp, Artificial Sequence
  chemically synthesized
tgtagacagtggctgttagc

SEQ ID NO: 236886 - DNA, 20 bp, Artificial Sequence
  chemically synthesized
atgtagacagtggctgttag

SEQ ID NO: 236887 - DNA, 20 bp, Artificial Sequence
  chemically synthesized
aggatgtagacagtggctgt

SEQ ID NO: 236888 - DNA, 20 bp, Artificial Sequence
  chemically synthesized
agaagacaggatgtagacag

SEQ ID NO: 236889 - DNA, 20 bp, Artificial Sequence
  chemically synthesized
tttagaagacaggatgtaga

SEQ ID NO: 236890 - DNA, 20 bp, Artificial Sequence
  chemically synthesized
ttattttagaagacaggatg

SEQ ID NO: 236891 - DNA, 20 bp, Artificial Sequence
  chemically synthesized
atgaaattattttagaagac

SEQ ID NO: 236892 - DNA, 20 bp, Artificial Sequence
  chemically synthesized
tatgaaattattttagaaga

SEQ ID NO: 236893 - DNA, 20 bp, Artificial Sequence
  chemically synthesized
ttactatgaaattattttag

SEQ ID NO: 236894 - DNA, 20 bp, Artificial Sequence
  chemically synthesized
tatttactatgaaattattt

SEQ ID NO: 236895 - DNA, 20 bp, Artificial Sequence
  chemically synthesized
tgtcttctaaaataatttca

SEQ ID NO: 236896 - DNA, 20 bp, Artificial Sequence
  chemically synthesized
ctaataatgaataagagaat

SEQ ID NO: 236897 - DNA, 20 bp, Artificial Sequence
  chemically synthesized
gattgactaataatgaataa

SEQ ID NO: 236898 - DNA, 20 bp, Artificial Sequence
  chemically synthesized
ttgattgactaataatgaat

SEQ ID NO: 236899 - DNA, 20 bp, Artificial Sequence
  chemically synthesized
ctcattctcttattcattat

SEQ ID NO: 236900 - DNA, 20 bp, Artificial Sequence
  chemically synthesized
tcattattagtcaatcaaca

SEQ ID NO: 236901 - DNA, 20 bp, Artificial Sequence
  chemically synthesized
cattattagtcaatcaacaa

SEQ ID NO: 236902 - DNA, 20 bp, Artificial Sequence
  chemically synthesized
ttagtcaatcaacaaaggcc

SEQ ID NO: 236903 - DNA, 20 bp, Artificial Sequence
  chemically synthesized
tcaatcaacaaaggccaaga

SEQ ID NO: 236904 - DNA, 20 bp, Artificial Sequence
  chemically synthesized
atcaacaaaggccaagatag

SEQ ID NO: 236905 - DNA, 20 bp, Artificial Sequence
  chemically synthesized
tttggtaatttctgctatct

SEQ ID NO: 236906 - DNA, 20 bp, Artificial Sequence
  chemically synthesized
caagatagcagaaattacca

SEQ ID NO: 236907 - DNA, 20 bp, Artificial Sequence
  chemically synthesized
gataaggcaaatcaaagctt

SEQ ID NO: 236908 - DNA, 20 bp, Artificial Sequence
  chemically synthesized
ttcatcgataaggcaaatca

SEQ ID NO: 236909 - DNA, 20 bp, Artificial Sequence
  chemically synthesized
gtaagataccttcatcgata

SEQ ID NO: 236910 - DNA, 20 bp, Artificial Sequence
  chemically synthesized
tttgatttgccttatcgatg

SEQ ID NO: 236911 - DNA, 20 bp, Artificial Sequence
  chemically synthesized
cgtaagataccttcatcgat

SEQ ID NO: 236912 - DNA, 20 bp, Artificial Sequence
  chemically synthesized
ttgatttgccttatcgatga

SEQ ID NO: 236913 - DNA, 20 bp, Artificial Sequence
  chemically synthesized
ttatcgatgaaggtatctta

SEQ ID NO: 236914 - DNA, 20 bp, Artificial Sequence
  chemically synthesized
tatcgatgaaggtatcttac

SEQ ID NO: 236915 - DNA, 20 bp, Artificial Sequence
  chemically synthesized
atcgatgaaggtatcttacg

SEQ ID NO: 236916 - DNA, 20 bp, Artificial Sequence
  chemically synthesized
atgggtaaaatcaaccccgt

SEQ ID NO: 236917 - DNA, 20 bp, Artificial Sequence
  chemically synthesized
ctgagtaattatcgtaaaat

SEQ ID NO: 236918 - DNA, 20 bp, Artificial Sequence
  chemically synthesized
tctgagtaattatcgtaaaa

SEQ ID NO: 236919 - DNA, 20 bp, Artificial Sequence
  chemically synthesized
cccattttacgataattact

SEQ ID NO: 236920 - DNA, 20 bp, Artificial Sequence
  chemically synthesized
tttacgataattactcagaa

SEQ ID NO: 236921 - DNA, 20 bp, Artificial Sequence
  chemically synthesized
ttaggttatctttccattct

SEQ ID NO: 236922 - DNA, 20 bp, Artificial Sequence
  chemically synthesized
cgataattactcagaatgga

SEQ ID NO: 236923 - DNA, 20 bp, Artificial Sequence
  chemically synthesized
tcagaatggaaagataacct

SEQ ID NO: 236924 - DNA, 20 bp, Artificial Sequence
  chemically synthesized
cagaatggaaagataaccta

SEQ ID NO: 236925 - DNA, 20 bp, Artificial Sequence
  chemically synthesized
acacgcacataatgtacctt

SEQ ID NO: 236926 - DNA, 20 bp, Artificial Sequence
  chemically synthesized
tacacgcacataatgtacct

SEQ ID NO: 236927 - DNA, 20 bp, Artificial Sequence
  chemically synthesized
atgaacatgtgcacacacat

SEQ ID NO: 236928 - DNA, 20 bp, Artificial Sequence
  chemically synthesized
catgttcatatgcatgattt

SEQ ID NO: 236929 - DNA, 20 bp, Artificial Sequence
  chemically synthesized
gattttggacataaaataac

SEQ ID NO: 236930 - DNA, 20 bp, Artificial Sequence
  chemically synthesized
attttggacataaaataacc

SEQ ID NO: 236931 - DNA, 20 bp, Artificial Sequence
  chemically synthesized
tggacataaaataaccagga

SEQ ID NO: 236932 - DNA, 20 bp, Artificial Sequence
  chemically synthesized
cagttaaggtatttctttcc

SEQ ID NO: 236933 - DNA, 20 bp, Artificial Sequence
  chemically synthesized
acaaaccccccaaacagtta

SEQ ID NO: 236934 - DNA, 20 bp, Artificial Sequence
  chemically synthesized
aaagaaataccttaactgtt

SEQ ID NO: 236935 - DNA, 20 bp, Artificial Sequence
  chemically synthesized
cacaaaccccccaaacagtt

SEQ ID NO: 236936 - DNA, 20 bp, Artificial Sequence
  chemically synthesized
aagaaataccttaactgttt

SEQ ID NO: 236937 - DNA, 20 bp, Artificial Sequence
  chemically synthesized
agaaataccttaactgtttg

SEQ ID NO: 236938 - DNA, 20 bp, Artificial Sequence
  chemically synthesized
gaaataccttaactgtttgg

SEQ ID NO: 236939 - DNA, 20 bp, Artificial Sequence
  chemically synthesized
aaataccttaactgtttggg

SEQ ID NO: 236940 - DNA, 20 bp, Artificial Sequence
  chemically synthesized
gatatcacaaaccccccaaa

SEQ ID NO: 236941 - DNA, 20 bp, Artificial Sequence
  chemically synthesized
ggggtttgtgatatcattca

SEQ ID NO: 236942 - DNA, 20 bp, Artificial Sequence
  chemically synthesized
ggaaaaattctttcagaaaa

SEQ ID NO: 236943 - DNA, 20 bp, Artificial Sequence
  chemically synthesized
cattcacagctcttttctga

SEQ ID NO: 236944 - DNA, 20 bp, Artificial Sequence
  chemically synthesized
aaggaaaaattctttcagaa

SEQ ID NO: 236945 - DNA, 20 bp, Artificial Sequence
  chemically synthesized
tgtccaaggaaaaattcttt

SEQ ID NO: 236946 - DNA, 20 bp, Artificial Sequence
  chemically synthesized
tttctgaaagaatttttcct

SEQ ID NO: 236947 - DNA, 20 bp, Artificial Sequence
  chemically synthesized
aaaatcattctagatgtcca

SEQ ID NO: 236948 - DNA, 20 bp, Artificial Sequence
  chemically synthesized
agaatttttccttggacatc

SEQ ID NO: 236949 - DNA, 20 bp, Artificial Sequence
  chemically synthesized
aaaaatcattctagatgtcc

SEQ ID NO: 236950 - DNA, 20 bp, Artificial Sequence
  chemically synthesized
tgagataagaaaaatcattc

SEQ ID NO: 236951 - DNA, 20 bp, Artificial Sequence
  chemically synthesized
tctcaatctatagatgagat

SEQ ID NO: 236952 - DNA, 20 bp, Artificial Sequence
  chemically synthesized
gatttttcttatctcatcta

SEQ ID NO: 236953 - DNA, 20 bp, Artificial Sequence
  chemically synthesized
ttttttctcaatctatagat

SEQ ID NO: 236954 - DNA, 20 bp, Artificial Sequence
  chemically synthesized
tcttatctcatctatagatt

SEQ ID NO: 236955 - DNA, 20 bp, Artificial Sequence
  chemically synthesized
gtctattttttctcaatcta

SEQ ID NO: 236956 - DNA, 20 bp, Artificial Sequence
  chemically synthesized
atctatagattgagaaaaaa

SEQ ID NO: 236957 - DNA, 20 bp, Artificial Sequence
  chemically synthesized
aaaaaatagactaaataaaa

SEQ ID NO: 236958 - DNA, 20 bp, Artificial Sequence
  chemically synthesized
tttaaaaagaccattttatt

SEQ ID NO: 236959 - DNA, 20 bp, Artificial Sequence
  chemically synthesized
gccaactggataattttaaa

SEQ ID NO: 236960 - DNA, 20 bp, Artificial Sequence
  chemically synthesized
atggtctttttaaaattatc

SEQ ID NO: 236961 - DNA, 20 bp, Artificial Sequence
  chemically synthesized
tctttttaaaattatccagt

SEQ ID NO: 236962 - DNA, 20 bp, Artificial Sequence
  chemically synthesized
tttaaaattatccagttggc

SEQ ID NO: 236963 - DNA, 20 bp, Artificial Sequence
  chemically synthesized
ttaaaattatccagttggcc

SEQ ID NO: 236964 - DNA, 20 bp, Artificial Sequence
  chemically synthesized
agccaccatgcctggccaac

SEQ ID NO: 236965 - DNA, 20 bp, Artificial Sequence
  chemically synthesized
attatccagttggccaggca

SEQ ID NO: 236966 - DNA, 20 bp, Artificial Sequence
  chemically synthesized
atccagttggccaggcatgg

SEQ ID NO: 236967 - DNA, 20 bp, Artificial Sequence
  chemically synthesized
cagacgtgagccaccatgcc

SEQ ID NO: 236968 - DNA, 20 bp, Artificial Sequence
  chemically synthesized
agtgctgggattgcagacgt

SEQ ID NO: 236969 - DNA, 20 bp, Artificial Sequence
  chemically synthesized
gtggctcacgtctgcaatcc

SEQ ID NO: 236970 - DNA, 20 bp, Artificial Sequence
  chemically synthesized
ctcccaaagtgctgggattg

SEQ ID NO: 236971 - DNA, 20 bp, Artificial Sequence
  chemically synthesized
cgtctgcaatcccagcactt

SEQ ID NO: 236972 - DNA, 20 bp, Artificial Sequence
  chemically synthesized
tctcagcctcccaaagtgct

SEQ ID NO: 236973 - DNA, 20 bp, Artificial Sequence
  chemically synthesized
gtctgcaatcccagcacttt

SEQ ID NO: 236974 - DNA, 20 bp, Artificial Sequence
  chemically synthesized
gtctcagcctcccaaagtgc

SEQ ID NO: 236975 - DNA, 20 bp, Artificial Sequence
  chemically synthesized
ctgcaatcccagcactttgg

SEQ ID NO: 236976 - DNA, 20 bp, Artificial Sequence
  chemically synthesized
tgcaatcccagcactttggg

SEQ ID NO: 236977 - DNA, 20 bp, Artificial Sequence
  chemically synthesized
ctgcctgtctcagcctccca

SEQ ID NO: 236978 - DNA, 20 bp, Artificial Sequence
  chemically synthesized
tcccagcactttgggaggct

SEQ ID NO: 236979 - DNA, 20 bp, Artificial Sequence
  chemically synthesized
agcactttgggaggctgaga

SEQ ID NO: 236980 - DNA, 20 bp, Artificial Sequence
  chemically synthesized
gcactttgggaggctgagac

SEQ ID NO: 236981 - DNA, 20 bp, Artificial Sequence
  chemically synthesized
ctttgggaggctgagacagg

SEQ ID NO: 236982 - DNA, 20 bp, Artificial Sequence
  chemically synthesized
ctcaggtggtctgcctgtct

SEQ ID NO: 236983 - DNA, 20 bp, Artificial Sequence
  chemically synthesized
ctgagacaggcagaccacct

SEQ ID NO: 236984 - DNA, 20 bp, Artificial Sequence
  chemically synthesized
tgagacaggcagaccacctg

SEQ ID NO: 236985 - DNA, 20 bp, Artificial Sequence
  chemically synthesized
tctagatctccgacctcagg

SEQ ID NO: 236986 - DNA, 20 bp, Artificial Sequence
  chemically synthesized
acaggcagaccacctgaggt

SEQ ID NO: 236987 - DNA, 20 bp, Artificial Sequence
  chemically synthesized
aggcagaccacctgaggtcg

SEQ ID NO: 236988 - DNA, 20 bp, Artificial Sequence
  chemically synthesized
tggtctagatctccgacctc

SEQ ID NO: 236989 - DNA, 20 bp, Artificial Sequence
  chemically synthesized
ctggtctagatctccgacct

SEQ ID NO: 236990 - DNA, 20 bp, Artificial Sequence
  chemically synthesized
accacctgaggtcggagatc

SEQ ID NO: 236991 - DNA, 20 bp, Artificial Sequence
  chemically synthesized
ctgaggtcggagatctagac

SEQ ID NO: 236992 - DNA, 20 bp, Artificial Sequence
  chemically synthesized
ccatgttggtcaggctggtc

SEQ ID NO: 236993 - DNA, 20 bp, Artificial Sequence
  chemically synthesized
tttcaccatgttggtcaggc

SEQ ID NO: 236994 - DNA, 20 bp, Artificial Sequence
  chemically synthesized
gagatttcaccatgttggtc

SEQ ID NO: 236995 - DNA, 20 bp, Artificial Sequence
  chemically synthesized
ctagaccagcctgaccaaca

SEQ ID NO: 236996 - DNA, 20 bp, Artificial Sequence
  chemically synthesized
cgagatttcaccatgttggt

SEQ ID NO: 236997 - DNA, 20 bp, Artificial Sequence
  chemically synthesized
gagacgagatttcaccatgt

SEQ ID NO: 236998 - DNA, 20 bp, Artificial Sequence
  chemically synthesized
tttgtatttttagtagagac

SEQ ID NO: 236999 - DNA, 20 bp, Artificial Sequence
  chemically synthesized
taatttttgtatttttagta

SEQ ID NO: 237000 - DNA, 20 bp, Artificial Sequence
  chemically synthesized
gctaatttttgtatttttag

SEQ ID NO: 237001 - DNA, 20 bp, Artificial Sequence
  chemically synthesized
ctggctaatttttgtatttt

SEQ ID NO: 237002 - DNA, 20 bp, Artificial Sequence
  chemically synthesized
tctactaaaaatacaaaaat

SEQ ID NO: 237003 - DNA, 20 bp, Artificial Sequence
  chemically synthesized
ctaaaaatacaaaaattagc

SEQ ID NO: 237004 - DNA, 20 bp, Artificial Sequence
  chemically synthesized
taaaaatacaaaaattagcc

SEQ ID NO: 237005 - DNA, 20 bp, Artificial Sequence
  chemically synthesized
atacaaaaattagccaggtg

SEQ ID NO: 237006 - DNA, 20 bp, Artificial Sequence
  chemically synthesized
tacaaaaattagccaggtgt

SEQ ID NO: 237007 - DNA, 20 bp, Artificial Sequence
  chemically synthesized
acaaaaattagccaggtgtg

SEQ ID NO: 237008 - DNA, 20 bp, Artificial Sequence
  chemically synthesized
caaaaattagccaggtgtgg

SEQ ID NO: 237009 - DNA, 20 bp, Artificial Sequence
  chemically synthesized
caggtgcccacccccacacc

SEQ ID NO: 237010 - DNA, 20 bp, Artificial Sequence
  chemically synthesized
aaattagccaggtgtggggg

SEQ ID NO: 237011 - DNA, 20 bp, Artificial Sequence
  chemically synthesized
aattagccaggtgtgggggt

SEQ ID NO: 237012 - DNA, 20 bp, Artificial Sequence
  chemically synthesized
ggggtgggcacctgtaatcc

SEQ ID NO: 237013 - DNA, 20 bp, Artificial Sequence
  chemically synthesized
tcccgagtagctgggattac

SEQ ID NO: 237014 - DNA, 20 bp, Artificial Sequence
  chemically synthesized
ctcccgagtagctgggatta

SEQ ID NO: 237015 - DNA, 20 bp, Artificial Sequence
  chemically synthesized
cacctgtaatcccagctact

SEQ ID NO: 237016 - DNA, 20 bp, Artificial Sequence
  chemically synthesized
ccttagcctcccgagtagct

SEQ ID NO: 237017 - DNA, 20 bp, Artificial Sequence
  chemically synthesized
acctgtaatcccagctactc

SEQ ID NO: 237018 - DNA, 20 bp, Artificial Sequence
  chemically synthesized
gccttagcctcccgagtagc

SEQ ID NO: 237019 - DNA, 20 bp, Artificial Sequence
  chemically synthesized
ctgtaatcccagctactcgg

SEQ ID NO: 237020 - DNA, 20 bp, Artificial Sequence
  chemically synthesized
tgtaatcccagctactcggg

SEQ ID NO: 237021 - DNA, 20 bp, Artificial Sequence
  chemically synthesized
tcctgccttagcctcccgag

SEQ ID NO: 237022 - DNA, 20 bp, Artificial Sequence
  chemically synthesized
ttctcctgccttagcctccc

SEQ ID NO: 237023 - DNA, 20 bp, Artificial Sequence
  chemically synthesized
tcccagctactcgggaggct

SEQ ID NO: 237024 - DNA, 20 bp, Artificial Sequence
  chemically synthesized
cccagctactcgggaggcta

SEQ ID NO: 237025 - DNA, 20 bp, Artificial Sequence
  chemically synthesized
agctactcgggaggctaagg

SEQ ID NO: 237026 - DNA, 20 bp, Artificial Sequence
  chemically synthesized
gctactcgggaggctaaggc

SEQ ID NO: 237027 - DNA, 20 bp, Artificial Sequence
  chemically synthesized
tactcgggaggctaaggcag

SEQ ID NO: 237028 - DNA, 20 bp, Artificial Sequence
  chemically synthesized
ttcaagcaattctcctgcct

SEQ ID NO: 237029 - DNA, 20 bp, Artificial Sequence
  chemically synthesized
taaggcaggagaattgcttg

SEQ ID NO: 237030 - DNA, 20 bp, Artificial Sequence
  chemically synthesized
caggagaattgcttgaagcc

SEQ ID NO: 237031 - DNA, 20 bp, Artificial Sequence
  chemically synthesized
aacctctgcctccaggcttc

SEQ ID NO: 237032 - DNA, 20 bp, Artificial Sequence
  chemically synthesized
ggagaattgcttgaagcctg

SEQ ID NO: 237033 - DNA, 20 bp, Artificial Sequence
  chemically synthesized
gagaattgcttgaagcctgg

SEQ ID NO: 237034 - DNA, 20 bp, Artificial Sequence
  chemically synthesized
aattgcttgaagcctggagg

SEQ ID NO: 237035 - DNA, 20 bp, Artificial Sequence
  chemically synthesized
ttgcttgaagcctggaggca

SEQ ID NO: 237036 - DNA, 20 bp, Artificial Sequence
  chemically synthesized
tcactgcaacctctgcctcc

SEQ ID NO: 237037 - DNA, 20 bp, Artificial Sequence
  chemically synthesized
tgcttgaagcctggaggcag

SEQ ID NO: 237038 - DNA, 20 bp, Artificial Sequence
  chemically synthesized
ctcactgcaacctctgcctc

SEQ ID NO: 237039 - DNA, 20 bp, Artificial Sequence
  chemically synthesized
aagcctggaggcagaggttg

SEQ ID NO: 237040 - DNA, 20 bp, Artificial Sequence
  chemically synthesized
ctggaggcagaggttgcagt

SEQ ID NO: 237041 - DNA, 20 bp, Artificial Sequence
  chemically synthesized
ggcagaggttgcagtgagct

SEQ ID NO: 237042 - DNA, 20 bp, Artificial Sequence
  chemically synthesized
aggctggagtggcatgatct

SEQ ID NO: 237043 - DNA, 20 bp, Artificial Sequence
  chemically synthesized
gagctgagatcatgccactc

SEQ ID NO: 237044 - DNA, 20 bp, Artificial Sequence
  chemically synthesized
ttttgtcacccaggctggag

SEQ ID NO: 237045 - DNA, 20 bp, Artificial Sequence
  chemically synthesized
gagatcatgccactccagcc

SEQ ID NO: 237046 - DNA, 20 bp, Artificial Sequence
  chemically synthesized
agatcatgccactccagcct

SEQ ID NO: 237047 - DNA, 20 bp, Artificial Sequence
  chemically synthesized
tgcttttgtcacccaggctg

SEQ ID NO: 237048 - DNA, 20 bp, Artificial Sequence
  chemically synthesized
tttgcttttgtcacccaggc

SEQ ID NO: 237049 - DNA, 20 bp, Artificial Sequence
  chemically synthesized
gaattttgcttttgtcaccc

SEQ ID NO: 237050 - DNA, 20 bp, Artificial Sequence
  chemically synthesized
ggaattttgcttttgtcacc

SEQ ID NO: 237051 - DNA, 20 bp, Artificial Sequence
  chemically synthesized
cactccagcctgggtgacaa

SEQ ID NO: 237052 - DNA, 20 bp, Artificial Sequence
  chemically synthesized
atacttttttttttttgaga

SEQ ID NO: 237053 - DNA, 20 bp, Artificial Sequence
  chemically synthesized
ttggatactttttttttttt

SEQ ID NO: 237054 - DNA, 20 bp, Artificial Sequence
  chemically synthesized
attccatctcaaaaaaaaaa

SEQ ID NO: 237055 - DNA, 20 bp, Artificial Sequence
  chemically synthesized
aaaaaaaaaagtatccaatt

SEQ ID NO: 237056 - DNA, 20 bp, Artificial Sequence
  chemically synthesized
aaaaaaaaagtatccaattg

SEQ ID NO: 237057 - DNA, 20 bp, Artificial Sequence
  chemically synthesized
aaaaaaaagtatccaattga

SEQ ID NO: 237058 - DNA, 20 bp, Artificial Sequence
  chemically synthesized
aaaaaaagtatccaattgag

SEQ ID NO: 237059 - DNA, 20 bp, Artificial Sequence
  chemically synthesized
tcaaaacttttcccctcaat

SEQ ID NO: 237060 - DNA, 20 bp, Artificial Sequence
  chemically synthesized
aagtatccaattgaggggaa

SEQ ID NO: 237061 - DNA, 20 bp, Artificial Sequence
  chemically synthesized
agttttgataaaatgttcat

SEQ ID NO: 237062 - DNA, 20 bp, Artificial Sequence
  chemically synthesized
catttcttgacagtgtggtt

SEQ ID NO: 237063 - DNA, 20 bp, Artificial Sequence
  chemically synthesized
ttcaactaaaccacactgtc

SEQ ID NO: 237064 - DNA, 20 bp, Artificial Sequence
  chemically synthesized
gtcctcatttcttgacagtg

SEQ ID NO: 237065 - DNA, 20 bp, Artificial Sequence
  chemically synthesized
taatggtcctcatttcttga

SEQ ID NO: 237066 - DNA, 20 bp, Artificial Sequence
  chemically synthesized
aaaccacactgtcaagaaat

SEQ ID NO: 237067 - DNA, 20 bp, Artificial Sequence
  chemically synthesized
aaccacactgtcaagaaatg

SEQ ID NO: 237068 - DNA, 20 bp, Artificial Sequence
  chemically synthesized
tgtcaagaaatgaggaccat

SEQ ID NO: 237069 - DNA, 20 bp, Artificial Sequence
  chemically synthesized
aattttcagagaatgtctaa

SEQ ID NO: 237070 - DNA, 20 bp, Artificial Sequence
  chemically synthesized
atcataatttaaaattttca

SEQ ID NO: 237071 - DNA, 20 bp, Artificial Sequence
  chemically synthesized
atatcataatttaaaatttt

SEQ ID NO: 237072 - DNA, 20 bp, Artificial Sequence
  chemically synthesized
gtgtaatgttaatgtattaa

SEQ ID NO: 237073 - DNA, 20 bp, Artificial Sequence
  chemically synthesized
aagatcaaattacatcaaaa

SEQ ID NO: 237074 - DNA, 20 bp, Artificial Sequence
  chemically synthesized
tacatcaaaatagtttgttt

SEQ ID NO: 237075 - DNA, 20 bp, Artificial Sequence
  chemically synthesized
tttgttttggacttgttttc

SEQ ID NO: 237076 - DNA, 20 bp, Artificial Sequence
  chemically synthesized
ctttactccaacttgaaaac

SEQ ID NO: 237077 - DNA, 20 bp, Artificial Sequence
  chemically synthesized
ttttggacttgttttcaagt

SEQ ID NO: 237078 - DNA, 20 bp, Artificial Sequence
  chemically synthesized
ttggacttgttttcaagttg

SEQ ID NO: 237079 - DNA, 20 bp, Artificial Sequence
  chemically synthesized
cttgttttcaagttggagta

SEQ ID NO: 237080 - DNA, 20 bp, Artificial Sequence
  chemically synthesized
ttgttttcaagttggagtaa

SEQ ID NO: 237081 - DNA, 20 bp, Artificial Sequence
  chemically synthesized
gttttcaagttggagtaaag

SEQ ID NO: 237082 - DNA, 20 bp, Artificial Sequence
  chemically synthesized
ttttcaagttggagtaaagg

SEQ ID NO: 237083 - DNA, 20 bp, Artificial Sequence
  chemically synthesized
ttcaggcaggagattaagtt

SEQ ID NO: 237084 - DNA, 20 bp, Artificial Sequence
  chemically synthesized
ggtgtttcaggcaggagatt

SEQ ID NO: 237085 - DNA, 20 bp, Artificial Sequence
  chemically synthesized
gtttcaggtgtttcaggcag

SEQ ID NO: 237086 - DNA, 20 bp, Artificial Sequence
  chemically synthesized
gtgtttcaggtgtttcaggc

SEQ ID NO: 237087 - DNA, 20 bp, Artificial Sequence
  chemically synthesized
agtgtttcaggtgtttcagg

SEQ ID NO: 237088 - DNA, 20 bp, Artificial Sequence
  chemically synthesized
ttaagtgtttcaggtgtttc

SEQ ID NO: 237089 - DNA, 20 bp, Artificial Sequence
  chemically synthesized
tttaagtgtttcaggtgttt

SEQ ID NO: 237090 - DNA, 20 bp, Artificial Sequence
  chemically synthesized
tttttttttttaagtgtttc

SEQ ID NO: 237091 - DNA, 20 bp, Artificial Sequence
  chemically synthesized
ttttttttttttaagtgttt

SEQ ID NO: 237092 - DNA, 20 bp, Artificial Sequence
  chemically synthesized
tttttttttttttttttttt

SEQ ID NO: 237093 - DNA, 20 bp, Artificial Sequence
  chemically synthesized
aaaaaaaaaaaaaaaaaaaa

SEQ ID NO: 237094 - DNA, 20 bp, Artificial Sequence
  chemically synthesized
agacaaaatatatgctacaa

SEQ ID NO: 237095 - DNA, 20 bp, Artificial Sequence
  chemically synthesized
caatgtgttgaaaaccgttg

SEQ ID NO: 237096 - DNA, 20 bp, Artificial Sequence
  chemically synthesized
gttttcaacacattgaacat

SEQ ID NO: 237097 - DNA, 20 bp, Artificial Sequence
  chemically synthesized
acattgaacatcagacattg

SEQ ID NO: 237098 - DNA, 20 bp, Artificial Sequence
  chemically synthesized
cattgaacatcagacattga

SEQ ID NO: 237099 - DNA, 20 bp, Artificial Sequence
  chemically synthesized
gaacatcagacattgaagga

SEQ ID NO: 237100 - DNA, 20 bp, Artificial Sequence
  chemically synthesized
tgaaggacagtgatccttgc

SEQ ID NO: 237101 - DNA, 20 bp, Artificial Sequence
  chemically synthesized
gaaggacagtgatccttgcc

SEQ ID NO: 237102 - DNA, 20 bp, Artificial Sequence
  chemically synthesized
aggacagtgatccttgccag

SEQ ID NO: 237103 - DNA, 20 bp, Artificial Sequence
  chemically synthesized
ggacagtgatccttgccagg

SEQ ID NO: 237104 - DNA, 20 bp, Artificial Sequence
  chemically synthesized
ttaacaaaagcctcctggca

SEQ ID NO: 237105 - DNA, 20 bp, Artificial Sequence
  chemically synthesized
tttaacaaaagcctcctggc

SEQ ID NO: 237106 - DNA, 20 bp, Artificial Sequence
  chemically synthesized
atcttttaacaaaagcctcc

SEQ ID NO: 237107 - DNA, 20 bp, Artificial Sequence
  chemically synthesized
tgccaggaggcttttgttaa

SEQ ID NO: 237108 - DNA, 20 bp, Artificial Sequence
  chemically synthesized
tcagcttcatcttttaacaa

SEQ ID NO: 237109 - DNA, 20 bp, Artificial Sequence
  chemically synthesized
gaggcttttgttaaaagatg

SEQ ID NO: 237110 - DNA, 20 bp, Artificial Sequence
  chemically synthesized
ttttgttaaaagatgaagct

SEQ ID NO: 237111 - DNA, 20 bp, Artificial Sequence
  chemically synthesized
ttgttaaaagatgaagctga

SEQ ID NO: 237112 - DNA, 20 bp, Artificial Sequence
  chemically synthesized
aaagatgaagctgagagttt

SEQ ID NO: 237113 - DNA, 20 bp, Artificial Sequence
  chemically synthesized
ccttgggctgctgaaactct

SEQ ID NO: 237114 - DNA, 20 bp, Artificial Sequence
  chemically synthesized
gatgaagctgagagtttcag

SEQ ID NO: 237115 - DNA, 20 bp, Artificial Sequence
  chemically synthesized
gctgagagtttcagcagccc

SEQ ID NO: 237116 - DNA, 20 bp, Artificial Sequence
  chemically synthesized
ctgagagtttcagcagccca

SEQ ID NO: 237117 - DNA, 20 bp, Artificial Sequence
  chemically synthesized
tgtgatcactagtcagcctt

SEQ ID NO: 237118 - DNA, 20 bp, Artificial Sequence
  chemically synthesized
ctgtgatcactagtcagcct

SEQ ID NO: 237119 - DNA, 20 bp, Artificial Sequence
  chemically synthesized
ttcagcagcccaaggctgac

SEQ ID NO: 237120 - DNA, 20 bp, Artificial Sequence
  chemically synthesized
tttgccctgtgatcactagt

SEQ ID NO: 237121 - DNA, 20 bp, Artificial Sequence
  chemically synthesized
ccaaggctgactagtgatca

SEQ ID NO: 237122 - DNA, 20 bp, Artificial Sequence
  chemically synthesized
gtattttgccctgtgatcac

SEQ ID NO: 237123 - DNA, 20 bp, Artificial Sequence
  chemically synthesized
caaggctgactagtgatcac

SEQ ID NO: 237124 - DNA, 20 bp, Artificial Sequence
  chemically synthesized
aaggctgactagtgatcaca

SEQ ID NO: 237125 - DNA, 20 bp, Artificial Sequence
  chemically synthesized
gtgatcacagggcaaaatac

SEQ ID NO: 237126 - DNA, 20 bp, Artificial Sequence
  chemically synthesized
gatcacagggcaaaatacca

SEQ ID NO: 237127 - DNA, 20 bp, Artificial Sequence
  chemically synthesized
tcacagggcaaaataccaga

SEQ ID NO: 237128 - DNA, 20 bp, Artificial Sequence
  chemically synthesized
cacagggcaaaataccagag

SEQ ID NO: 237129 - DNA, 20 bp, Artificial Sequence
  chemically synthesized
ctgtgtatatatcacctctc

SEQ ID NO: 237130 - DNA, 20 bp, Artificial Sequence
  chemically synthesized
ccagagaggtgatatataca

SEQ ID NO: 237131 - DNA, 20 bp, Artificial Sequence
  chemically synthesized
agagaggtgatatatacaca

SEQ ID NO: 237132 - DNA, 20 bp, Artificial Sequence
  chemically synthesized
gagaggtgatatatacacag

SEQ ID NO: 237133 - DNA, 20 bp, Artificial Sequence
  chemically synthesized
tatatacacagaggaaattt

SEQ ID NO: 237134 - DNA, 20 bp, Artificial Sequence
  chemically synthesized
tatacacagaggaaattttg

SEQ ID NO: 237135 - DNA, 20 bp, Artificial Sequence
  chemically synthesized
gaggaaattttggagatttg

SEQ ID NO: 237136 - DNA, 20 bp, Artificial Sequence
  chemically synthesized
aaattttggagatttgtaga

SEQ ID NO: 237137 - DNA, 20 bp, Artificial Sequence
  chemically synthesized
ctcagatgaagaataaaata

SEQ ID NO: 237138 - DNA, 20 bp, Artificial Sequence
  chemically synthesized
ctttattttattcttcatct

SEQ ID NO: 237139 - DNA, 20 bp, Artificial Sequence
  chemically synthesized
aactgatcaagactcagatg

SEQ ID NO: 237140 - DNA, 20 bp, Artificial Sequence
  chemically synthesized
tacatgaactgatcaagact

SEQ ID NO: 237141 - DNA, 20 bp, Artificial Sequence
  chemically synthesized
ttcttcatctgagtcttgat

SEQ ID NO: 237142 - DNA, 20 bp, Artificial Sequence
  chemically synthesized
cttgcatacatgaactgatc

SEQ ID NO: 237143 - DNA, 20 bp, Artificial Sequence
  chemically synthesized
cttgatcagttcatgtatgc

SEQ ID NO: 237144 - DNA, 20 bp, Artificial Sequence
  chemically synthesized
gtatgcaagaaaaccactca

SEQ ID NO: 237145 - DNA, 20 bp, Artificial Sequence
  chemically synthesized
gttctttccttagctttgag

SEQ ID NO: 237146 - DNA, 20 bp, Artificial Sequence
  chemically synthesized
caagaaaaccactcaaagct

SEQ ID NO: 237147 - DNA, 20 bp, Artificial Sequence
  chemically synthesized
aagaaaaccactcaaagcta

SEQ ID NO: 237148 - DNA, 20 bp, Artificial Sequence
  chemically synthesized
gaagttctttccttagcttt

SEQ ID NO: 237149 - DNA, 20 bp, Artificial Sequence
  chemically synthesized
aaaccactcaaagctaagga

SEQ ID NO: 237150 - DNA, 20 bp, Artificial Sequence
  chemically synthesized
cttttgtgaagttctttcct

SEQ ID NO: 237151 - DNA, 20 bp, Artificial Sequence
  chemically synthesized
ctaaggaaagaacttcacaa

SEQ ID NO: 237152 - DNA, 20 bp, Artificial Sequence
  chemically synthesized
tttcctttaattcttttgtg

SEQ ID NO: 237153 - DNA, 20 bp, Artificial Sequence
  chemically synthesized
agaacttcacaaaagaatta

SEQ ID NO: 237154 - DNA, 20 bp, Artificial Sequence
  chemically synthesized
gaacttcacaaaagaattaa

SEQ ID NO: 237155 - DNA, 20 bp, Artificial Sequence
  chemically synthesized
gaattaaaggaaacaatcac

SEQ ID NO: 237156 - DNA, 20 bp, Artificial Sequence
  chemically synthesized
attaaaggaaacaatcacca

SEQ ID NO: 237157 - DNA, 20 bp, Artificial Sequence
  chemically synthesized
tactagccacgtgtgagctc

SEQ ID NO: 237158 - DNA, 20 bp, Artificial Sequence
  chemically synthesized
caatcaccagagctcacacg

SEQ ID NO: 237159 - DNA, 20 bp, Artificial Sequence
  chemically synthesized
tggtattactagccacgtgt

SEQ ID NO: 237160 - DNA, 20 bp, Artificial Sequence
  chemically synthesized
caccagagctcacacgtggc

SEQ ID NO: 237161 - DNA, 20 bp, Artificial Sequence
  chemically synthesized
gtgggaacaggtggtattac

SEQ ID NO: 237162 - DNA, 20 bp, Artificial Sequence
  chemically synthesized
ctggggctcgtgggaacagg

SEQ ID NO: 237163 - DNA, 20 bp, Artificial Sequence
  chemically synthesized
tcactggggctcgtgggaac

SEQ ID NO: 237164 - DNA, 20 bp, Artificial Sequence
  chemically synthesized
gtaataccacctgttcccac

SEQ ID NO: 237165 - DNA, 20 bp, Artificial Sequence
  chemically synthesized
ttcactggggctcgtgggaa

SEQ ID NO: 237166 - DNA, 20 bp, Artificial Sequence
  chemically synthesized
aatttttcactggggctcgt

SEQ ID NO: 237167 - DNA, 20 bp, Artificial Sequence
  chemically synthesized
ccacctgttcccacgagccc

SEQ ID NO: 237168 - DNA, 20 bp, Artificial Sequence
  chemically synthesized
aaatttttcactggggctcg

SEQ ID NO: 237169 - DNA, 20 bp, Artificial Sequence
  chemically synthesized
aatgataaaatttttcactg

SEQ ID NO: 237170 - DNA, 20 bp, Artificial Sequence
  chemically synthesized
gaatgataaaatttttcact

SEQ ID NO: 237171 - DNA, 20 bp, Artificial Sequence
  chemically synthesized
tgaatgataaaatttttcac

SEQ ID NO: 237172 - DNA, 20 bp, Artificial Sequence
  chemically synthesized
gtgaaaaattttatcattca

SEQ ID NO: 237173 - DNA, 20 bp, Artificial Sequence
  chemically synthesized
tgaaaaattttatcattcac

SEQ ID NO: 237174 - DNA, 20 bp, Artificial Sequence
  chemically synthesized
ttttatcattcacaggacat

SEQ ID NO: 237175 - DNA, 20 bp, Artificial Sequence
  chemically synthesized
ttatcattcacaggacatca

SEQ ID NO: 237176 - DNA, 20 bp, Artificial Sequence
  chemically synthesized
atcattcacaggacatcaga

SEQ ID NO: 237177 - DNA, 20 bp, Artificial Sequence
  chemically synthesized
cattcacaggacatcagaga

SEQ ID NO: 237178 - DNA, 20 bp, Artificial Sequence
  chemically synthesized
aggacatcagagagagtact

SEQ ID NO: 237179 - DNA, 20 bp, Artificial Sequence
  chemically synthesized
acatcagagagagtactcag

SEQ ID NO: 237180 - DNA, 20 bp, Artificial Sequence
  chemically synthesized
catcagagagagtactcaga

SEQ ID NO: 237181 - DNA, 20 bp, Artificial Sequence
  chemically synthesized
atcagagagagtactcagaa

SEQ ID NO: 237182 - DNA, 20 bp, Artificial Sequence
  chemically synthesized
tactgaggcaaaacccttct

SEQ ID NO: 237183 - DNA, 20 bp, Artificial Sequence
  chemically synthesized
tactcagaagggttttgcct

SEQ ID NO: 237184 - DNA, 20 bp, Artificial Sequence
  chemically synthesized
tcagaagggttttgcctcag

SEQ ID NO: 237185 - DNA, 20 bp, Artificial Sequence
  chemically synthesized
gaagggttttgcctcagtag

SEQ ID NO: 237186 - DNA, 20 bp, Artificial Sequence
  chemically synthesized
aagggttttgcctcagtagt

SEQ ID NO: 237187 - DNA, 20 bp, Artificial Sequence
  chemically synthesized
ctactttttccccactactg

SEQ ID NO: 237188 - DNA, 20 bp, Artificial Sequence
  chemically synthesized
agggttttgcctcagtagtg

SEQ ID NO: 237189 - DNA, 20 bp, Artificial Sequence
  chemically synthesized
gctactttttccccactact

SEQ ID NO: 237190 - DNA, 20 bp, Artificial Sequence
  chemically synthesized
ttgcctcagtagtggggaaa

SEQ ID NO: 237191 - DNA, 20 bp, Artificial Sequence
  chemically synthesized
cctcagtagtggggaaaaag

SEQ ID NO: 237192 - DNA, 20 bp, Artificial Sequence
  chemically synthesized
accagaacagtgtaagttta

SEQ ID NO: 237193 - DNA, 20 bp, Artificial Sequence
  chemically synthesized
gaccagaacagtgtaagttt

SEQ ID NO: 237194 - DNA, 20 bp, Artificial Sequence
  chemically synthesized
tgaccagaacagtgtaagtt

SEQ ID NO: 237195 - DNA, 20 bp, Artificial Sequence
  chemically synthesized
tgttatgaccagaacagtgt

SEQ ID NO: 237196 - DNA, 20 bp, Artificial Sequence
  chemically synthesized
gccctaaacttacactgttc

SEQ ID NO: 237197 - DNA, 20 bp, Artificial Sequence
  chemically synthesized
atgctttgttatgaccagaa

SEQ ID NO: 237198 - DNA, 20 bp, Artificial Sequence
  chemically synthesized
cttttatgctttgttatgac

SEQ ID NO: 237199 - DNA, 20 bp, Artificial Sequence
  chemically synthesized
acactgttctggtcataaca

SEQ ID NO: 237200 - DNA, 20 bp, Artificial Sequence
  chemically synthesized
ctggtcataacaaagcataa

SEQ ID NO: 237201 - DNA, 20 bp, Artificial Sequence
  chemically synthesized
tggtcataacaaagcataaa

SEQ ID NO: 237202 - DNA, 20 bp, Artificial Sequence
  chemically synthesized
tcataacaaagcataaaagg

SEQ ID NO: 237203 - DNA, 20 bp, Artificial Sequence
  chemically synthesized
cataaaaggaagattctcaa

SEQ ID NO: 237204 - DNA, 20 bp, Artificial Sequence
  chemically synthesized
tggaaacaatttgatctttt

SEQ ID NO: 237205 - DNA, 20 bp, Artificial Sequence
  chemically synthesized
caaaagatcaaattgtttcc

SEQ ID NO: 237206 - DNA, 20 bp, Artificial Sequence
  chemically synthesized
tggaacacagttaattcact

SEQ ID NO: 237207 - DNA, 20 bp, Artificial Sequence
  chemically synthesized
caagtgaattaactgtgttc

SEQ ID NO: 237208 - DNA, 20 bp, Artificial Sequence
  chemically synthesized
tcaaacctcgttctggaaca

SEQ ID NO: 237209 - DNA, 20 bp, Artificial Sequence
  chemically synthesized
aattaactgtgttccagaac

SEQ ID NO: 237210 - DNA, 20 bp, Artificial Sequence
  chemically synthesized
attaactgtgttccagaacg

SEQ ID NO: 237211 - DNA, 20 bp, Artificial Sequence
  chemically synthesized
aatattctcaaacctcgttc

SEQ ID NO: 237212 - DNA, 20 bp, Artificial Sequence
  chemically synthesized
tgtgttccagaacgaggttt

SEQ ID NO: 237213 - DNA, 20 bp, Artificial Sequence
  chemically synthesized
aatatatttgaatttatttg

SEQ ID NO: 237214 - DNA, 20 bp, Artificial Sequence
  chemically synthesized
ttgaatttatttgaagtatc

SEQ ID NO: 237215 - DNA, 20 bp, Artificial Sequence
  chemically synthesized
tgaagtatcaagcacgcgct

SEQ ID NO: 237216 - DNA, 20 bp, Artificial Sequence
  chemically synthesized
agacattgtgaattttaact

SEQ ID NO: 237217 - DNA, 20 bp, Artificial Sequence
  chemically synthesized
aagttaaaattcacaatgtc

SEQ ID NO: 237218 - DNA, 20 bp, Artificial Sequence
  chemically synthesized
aattcacaatgtctggcata

SEQ ID NO: 237219 - DNA, 20 bp, Artificial Sequence
  chemically synthesized
ggtaatttttgactatatgc

SEQ ID NO: 237220 - DNA, 20 bp, Artificial Sequence
  chemically synthesized
ggcatatagtcaaaaattac

SEQ ID NO: 237221 - DNA, 20 bp, Artificial Sequence
  chemically synthesized
taactgcttctttggatgac

SEQ ID NO: 237222 - DNA, 20 bp, Artificial Sequence
  chemically synthesized
caaaaattaccagtcatcca

SEQ ID NO: 237223 - DNA, 20 bp, Artificial Sequence
  chemically synthesized
aaattaccagtcatccaaag

SEQ ID NO: 237224 - DNA, 20 bp, Artificial Sequence
  chemically synthesized
ttaccagtcatccaaagaag

SEQ ID NO: 237225 - DNA, 20 bp, Artificial Sequence
  chemically synthesized
gtgttgtttaactgcttctt

SEQ ID NO: 237226 - DNA, 20 bp, Artificial Sequence
  chemically synthesized
agttaaacaacacacttaat

SEQ ID NO: 237227 - DNA, 20 bp, Artificial Sequence
  chemically synthesized
gttaaacaacacacttaatg

SEQ ID NO: 237228 - DNA, 20 bp, Artificial Sequence
  chemically synthesized
taaacaacacacttaatgag

SEQ ID NO: 237229 - DNA, 20 bp, Artificial Sequence
  chemically synthesized
gatttatttttctcctcatt

SEQ ID NO: 237230 - DNA, 20 bp, Artificial Sequence
  chemically synthesized
taaatcaatttaaattaacc

SEQ ID NO: 237231 - DNA, 20 bp, Artificial Sequence
  chemically synthesized
caatttaaattaacccagaa

SEQ ID NO: 237232 - DNA, 20 bp, Artificial Sequence
  chemically synthesized
ttatcatctgtgtctattct

SEQ ID NO: 237233 - DNA, 20 bp, Artificial Sequence
  chemically synthesized
tttatcatctgtgtctattc

SEQ ID NO: 237234 - DNA, 20 bp, Artificial Sequence
  chemically synthesized
aaattaacccagaatagaca

SEQ ID NO: 237235 - DNA, 20 bp, Artificial Sequence
  chemically synthesized
atagacacagatgataaaat

SEQ ID NO: 237236 - DNA, 20 bp, Artificial Sequence
  chemically synthesized
gacacagatgataaaattag

SEQ ID NO: 237237 - DNA, 20 bp, Artificial Sequence
  chemically synthesized
cacagatgataaaattagta

SEQ ID NO: 237238 - DNA, 20 bp, Artificial Sequence
  chemically synthesized
agatgataaaattagtagag

SEQ ID NO: 237239 - DNA, 20 bp, Artificial Sequence
  chemically synthesized
agtagagaagaatattctaa

SEQ ID NO: 237240 - DNA, 20 bp, Artificial Sequence
  chemically synthesized
aatacagatataataactgt

SEQ ID NO: 237241 - DNA, 20 bp, Artificial Sequence
  chemically synthesized
tttcttgactatatggaata

SEQ ID NO: 237242 - DNA, 20 bp, Artificial Sequence
  chemically synthesized
tattatatctgtattccata

SEQ ID NO: 237243 - DNA, 20 bp, Artificial Sequence
  chemically synthesized
tatctgtattccatatagtc

SEQ ID NO: 237244 - DNA, 20 bp, Artificial Sequence
  chemically synthesized
tctttactttcttgactata

SEQ ID NO: 237245 - DNA, 20 bp, Artificial Sequence
  chemically synthesized
tgtattccatatagtcaaga

SEQ ID NO: 237246 - DNA, 20 bp, Artificial Sequence
  chemically synthesized
tccatatagtcaagaaagta

SEQ ID NO: 237247 - DNA, 20 bp, Artificial Sequence
  chemically synthesized
atgtgtctactcaacatgtt

SEQ ID NO: 237248 - DNA, 20 bp, Artificial Sequence
  chemically synthesized
aagtaaagactgaacatgtt

SEQ ID NO: 237249 - DNA, 20 bp, Artificial Sequence
  chemically synthesized
taaagactgaacatgttgag

SEQ ID NO: 237250 - DNA, 20 bp, Artificial Sequence
  chemically synthesized
gaacatgttgagtagacaca

SEQ ID NO: 237251 - DNA, 20 bp, Artificial Sequence
  chemically synthesized
catgttgagtagacacatgg

SEQ ID NO: 237252 - DNA, 20 bp, Artificial Sequence
  chemically synthesized
agacacatggaagaaataaa

SEQ ID NO: 237253 - DNA, 20 bp, Artificial Sequence
  chemically synthesized
atctcttagaagtaaaagtt

SEQ ID NO: 237254 - DNA, 20 bp, Artificial Sequence
  chemically synthesized
catctcttagaagtaaaagt

SEQ ID NO: 237255 - DNA, 20 bp, Artificial Sequence
  chemically synthesized
ttttcatctcttagaagtaa

SEQ ID NO: 237256 - DNA, 20 bp, Artificial Sequence
  chemically synthesized
aagacccaacttttacttct

SEQ ID NO: 237257 - DNA, 20 bp, Artificial Sequence
  chemically synthesized
gacccaacttttacttctaa

SEQ ID NO: 237258 - DNA, 20 bp, Artificial Sequence
  chemically synthesized
cagacattttcatctcttag

SEQ ID NO: 237259 - DNA, 20 bp, Artificial Sequence
  chemically synthesized
catcagacattttcatctct

SEQ ID NO: 237260 - DNA, 20 bp, Artificial Sequence
  chemically synthesized
gtagtatatatttttaacat

SEQ ID NO: 237261 - DNA, 20 bp, Artificial Sequence
  chemically synthesized
tgttaaaaatatatactaca

SEQ ID NO: 237262 - DNA, 20 bp, Artificial Sequence
  chemically synthesized
gttaaaaatatatactacat

SEQ ID NO: 237263 - DNA, 20 bp, Artificial Sequence
  chemically synthesized
aatctatggctaatcccatg

SEQ ID NO: 237264 - DNA, 20 bp, Artificial Sequence
  chemically synthesized
aaatatatactacatgggat

SEQ ID NO: 237265 - DNA, 20 bp, Artificial Sequence
  chemically synthesized
atactacatgggattagcca

SEQ ID NO: 237266 - DNA, 20 bp, Artificial Sequence
  chemically synthesized
acatgggattagccatagat

SEQ ID NO: 237267 - DNA, 20 bp, Artificial Sequence
  chemically synthesized
ctttttcaaagtctaatcta

SEQ ID NO: 237268 - DNA, 20 bp, Artificial Sequence
  chemically synthesized
ccatagattagactttgaaa

SEQ ID NO: 237269 - DNA, 20 bp, Artificial Sequence
  chemically synthesized
aaattgactaatctttttca

SEQ ID NO: 237270 - DNA, 20 bp, Artificial Sequence
  chemically synthesized
gattagactttgaaaaagat

SEQ ID NO: 237271 - DNA, 20 bp, Artificial Sequence
  chemically synthesized
aagattagtcaatttgacaa

SEQ ID NO: 237272 - DNA, 20 bp, Artificial Sequence
  chemically synthesized
gattagtcaatttgacaata

SEQ ID NO: 237273 - DNA, 20 bp, Artificial Sequence
  chemically synthesized
agattatataaaacaaatta

SEQ ID NO: 237274 - DNA, 20 bp, Artificial Sequence
  chemically synthesized
attatataaaacaaattaca

SEQ ID NO: 237275 - DNA, 20 bp, Artificial Sequence
  chemically synthesized
ataaaacaaattacagagaa

SEQ ID NO: 237276 - DNA, 20 bp, Artificial Sequence
  chemically synthesized
aaaacaaattacagagaaaa

SEQ ID NO: 237277 - DNA, 20 bp, Artificial Sequence
  chemically synthesized
aacaaattacagagaaaaga

SEQ ID NO: 237278 - DNA, 20 bp, Artificial Sequence
  chemically synthesized
cagagaaaagagagaccaaa

SEQ ID NO: 237279 - DNA, 20 bp, Artificial Sequence
  chemically synthesized
tgttatgttcattgtctgtt

SEQ ID NO: 237280 - DNA, 20 bp, Artificial Sequence
  chemically synthesized
acagacaatgaacataacat

SEQ ID NO: 237281 - DNA, 20 bp, Artificial Sequence
  chemically synthesized
acaatgaacataacatcagt

SEQ ID NO: 237282 - DNA, 20 bp, Artificial Sequence
  chemically synthesized
atgaacataacatcagtgag

SEQ ID NO: 237283 - DNA, 20 bp, Artificial Sequence
  chemically synthesized
aacataacatcagtgagtag

SEQ ID NO: 237284 - DNA, 20 bp, Artificial Sequence
  chemically synthesized
acataacatcagtgagtagt

SEQ ID NO: 237285 - DNA, 20 bp, Artificial Sequence
  chemically synthesized
cataacatcagtgagtagtg

SEQ ID NO: 237286 - DNA, 20 bp, Artificial Sequence
  chemically synthesized
agtgagtagtggggcacttt

SEQ ID NO: 237287 - DNA, 20 bp, Artificial Sequence
  chemically synthesized
gtgagtagtggggcacttta

SEQ ID NO: 237288 - DNA, 20 bp, Artificial Sequence
  chemically synthesized
gagtagtggggcactttaag

SEQ ID NO: 237289 - DNA, 20 bp, Artificial Sequence
  chemically synthesized
tacatttattaggctcctta

SEQ ID NO: 237290 - DNA, 20 bp, Artificial Sequence
  chemically synthesized
actccaattgtacatttatt

SEQ ID NO: 237291 - DNA, 20 bp, Artificial Sequence
  chemically synthesized
aactccaattgtacatttat

SEQ ID NO: 237292 - DNA, 20 bp, Artificial Sequence
  chemically synthesized
gagcctaataaatgtacaat

SEQ ID NO: 237293 - DNA, 20 bp, Artificial Sequence
  chemically synthesized
gcctaataaatgtacaattg

SEQ ID NO: 237294 - DNA, 20 bp, Artificial Sequence
  chemically synthesized
aaccatttttttaaaaaaaa

SEQ ID NO: 237295 - DNA, 20 bp, Artificial Sequence
  chemically synthesized
ttccattttttttaaaaaaa

SEQ ID NO: 237296 - DNA, 20 bp, Artificial Sequence
  chemically synthesized
ttttttaaaaaaatggttga

SEQ ID NO: 237297 - DNA, 20 bp, Artificial Sequence
  chemically synthesized
tttttaaaaaaatggttgaa

SEQ ID NO: 237298 - DNA, 20 bp, Artificial Sequence
  chemically synthesized
atttaacatttcatcaaatt

SEQ ID NO: 237299 - DNA, 20 bp, Artificial Sequence
  chemically synthesized
ttgatgaaatgttaaatgca

SEQ ID NO: 237300 - DNA, 20 bp, Artificial Sequence
  chemically synthesized
aatgttaaatgcacagattc

SEQ ID NO: 237301 - DNA, 20 bp, Artificial Sequence
  chemically synthesized
tgttaaatgcacagattcaa

SEQ ID NO: 237302 - DNA, 20 bp, Artificial Sequence
  chemically synthesized
tcttgttcttgaagtcagtt

SEQ ID NO: 237303 - DNA, 20 bp, Artificial Sequence
  chemically synthesized
tcaagagcttaactgacttc

SEQ ID NO: 237304 - DNA, 20 bp, Artificial Sequence
  chemically synthesized
atgtttcttgttcttgaagt

SEQ ID NO: 237305 - DNA, 20 bp, Artificial Sequence
  chemically synthesized
gcttaactgacttcaagaac

SEQ ID NO: 237306 - DNA, 20 bp, Artificial Sequence
  chemically synthesized
cttcatgtttcttgttcttg

SEQ ID NO: 237307 - DNA, 20 bp, Artificial Sequence
  chemically synthesized
cttcaagaacaagaaacatg

SEQ ID NO: 237308 - DNA, 20 bp, Artificial Sequence
  chemically synthesized
aacatgaagaaaactacacc

SEQ ID NO: 237309 - DNA, 20 bp, Artificial Sequence
  chemically synthesized
tgttttgatgtaacttggtg

SEQ ID NO: 237310 - DNA, 20 bp, Artificial Sequence
  chemically synthesized
caatttgttttgatgtaact

SEQ ID NO: 237311 - DNA, 20 bp, Artificial Sequence
  chemically synthesized
tagggagtacttttacgatg

SEQ ID NO: 237312 - DNA, 20 bp, Artificial Sequence
  chemically synthesized
aacaaattgcttcatcgtaa

SEQ ID NO: 237313 - DNA, 20 bp, Artificial Sequence
  chemically synthesized
ttcatcgtaaaagtactccc

SEQ ID NO: 237314 - DNA, 20 bp, Artificial Sequence
  chemically synthesized
tatgtagaaggttaactagg

SEQ ID NO: 237315 - DNA, 20 bp, Artificial Sequence
  chemically synthesized
tgtatgtagaaggttaacta

SEQ ID NO: 237316 - DNA, 20 bp, Artificial Sequence
  chemically synthesized
ttgtatgtagaaggttaact

SEQ ID NO: 237317 - DNA, 20 bp, Artificial Sequence
  chemically synthesized
tttgtatgtagaaggttaac

SEQ ID NO: 237318 - DNA, 20 bp, Artificial Sequence
  chemically synthesized
aatggagatttgtatgtaga

SEQ ID NO: 237319 - DNA, 20 bp, Artificial Sequence
  chemically synthesized
aaatggagatttgtatgtag

SEQ ID NO: 237320 - DNA, 20 bp, Artificial Sequence
  chemically synthesized
gtaaaatggagatttgtatg

SEQ ID NO: 237321 - DNA, 20 bp, Artificial Sequence
  chemically synthesized
tggaaagccattgtaaaatg

SEQ ID NO: 237322 - DNA, 20 bp, Artificial Sequence
  chemically synthesized
cttggaaagccattgtaaaa

SEQ ID NO: 237323 - DNA, 20 bp, Artificial Sequence
  chemically synthesized
tacaaatctccattttacaa

SEQ ID NO: 237324 - DNA, 20 bp, Artificial Sequence
  chemically synthesized
ccattttacaatggctttcc

SEQ ID NO: 237325 - DNA, 20 bp, Artificial Sequence
  chemically synthesized
ttcaggctgggtttcttgga

SEQ ID NO: 237326 - DNA, 20 bp, Artificial Sequence
  chemically synthesized
caatggctttccaagaaacc

SEQ ID NO: 237327 - DNA, 20 bp, Artificial Sequence
  chemically synthesized
atatttcaggctgggtttct

SEQ ID NO: 237328 - DNA, 20 bp, Artificial Sequence
  chemically synthesized
tttgctacatatttcaggct

SEQ ID NO: 237329 - DNA, 20 bp, Artificial Sequence
  chemically synthesized
ttttgctacatatttcaggc

SEQ ID NO: 237330 - DNA, 20 bp, Artificial Sequence
  chemically synthesized
tgaattttgctacatatttc

SEQ ID NO: 237331 - DNA, 20 bp, Artificial Sequence
  chemically synthesized
gaaacccagcctgaaatatg

SEQ ID NO: 237332 - DNA, 20 bp, Artificial Sequence
  chemically synthesized
atgaattttgctacatattt

SEQ ID NO: 237333 - DNA, 20 bp, Artificial Sequence
  chemically synthesized
ctctttggaggatagttgtt

SEQ ID NO: 237334 - DNA, 20 bp, Artificial Sequence
  chemically synthesized
tactgaacaactatcctcca

SEQ ID NO: 237335 - DNA, 20 bp, Artificial Sequence
  chemically synthesized
ccattctactctttggagga

SEQ ID NO: 237336 - DNA, 20 bp, Artificial Sequence
  chemically synthesized
ctgaacaactatcctccaaa

SEQ ID NO: 237337 - DNA, 20 bp, Artificial Sequence
  chemically synthesized
acctccattctactctttgg

SEQ ID NO: 237338 - DNA, 20 bp, Artificial Sequence
  chemically synthesized
aacaactatcctccaaagag

SEQ ID NO: 237339 - DNA, 20 bp, Artificial Sequence
  chemically synthesized
tacctccattctactctttg

SEQ ID NO: 237340 - DNA, 20 bp, Artificial Sequence
  chemically synthesized
agtacctccattctactctt

SEQ ID NO: 237341 - DNA, 20 bp, Artificial Sequence
  chemically synthesized
ctatcctccaaagagtagaa

SEQ ID NO: 237342 - DNA, 20 bp, Artificial Sequence
  chemically synthesized
atcctccaaagagtagaatg

SEQ ID NO: 237343 - DNA, 20 bp, Artificial Sequence
  chemically synthesized
tcctccaaagagtagaatgg

SEQ ID NO: 237344 - DNA, 20 bp, Artificial Sequence
  chemically synthesized
agtaacatagaaatttgtaa

SEQ ID NO: 237345 - DNA, 20 bp, Artificial Sequence
  chemically synthesized
gtgaaaaaaatcaagtaaca

SEQ ID NO: 237346 - DNA, 20 bp, Artificial Sequence
  chemically synthesized
tacttattgtgaaaaaaatc

SEQ ID NO: 237347 - DNA, 20 bp, Artificial Sequence
  chemically synthesized
tacttgatttttttcacaat

SEQ ID NO: 237348 - DNA, 20 bp, Artificial Sequence
  chemically synthesized
tttatattttattatcaaat

SEQ ID NO: 237349 - DNA, 20 bp, Artificial Sequence
  chemically synthesized
attgaaatatataactacct

SEQ ID NO: 237350 - DNA, 20 bp, Artificial Sequence
  chemically synthesized
ttgaaatatataactacctt

SEQ ID NO: 237351 - DNA, 20 bp, Artificial Sequence
  chemically synthesized
caatgatatccaacccaagg

SEQ ID NO: 237352 - DNA, 20 bp, Artificial Sequence
  chemically synthesized
aatatataactaccttgggt

SEQ ID NO: 237353 - DNA, 20 bp, Artificial Sequence
  chemically synthesized
tttcaatgatatccaaccca

SEQ ID NO: 237354 - DNA, 20 bp, Artificial Sequence
  chemically synthesized
ttttcaatgatatccaaccc

SEQ ID NO: 237355 - DNA, 20 bp, Artificial Sequence
  chemically synthesized
gggttggatatcattgaaaa

SEQ ID NO: 237356 - DNA, 20 bp, Artificial Sequence
  chemically synthesized
tggatatcattgaaaatggc

SEQ ID NO: 237357 - DNA, 20 bp, Artificial Sequence
  chemically synthesized
atatcattgaaaatggcaag

SEQ ID NO: 237358 - DNA, 20 bp, Artificial Sequence
  chemically synthesized
aaaatgttttggggtagata

SEQ ID NO: 237359 - DNA, 20 bp, Artificial Sequence
  chemically synthesized
ttatataaaatgttttgggg

SEQ ID NO: 237360 - DNA, 20 bp, Artificial Sequence
  chemically synthesized
gagttatataaaatgttttg

SEQ ID NO: 237361 - DNA, 20 bp, Artificial Sequence
  chemically synthesized
agagttatataaaatgtttt

SEQ ID NO: 237362 - DNA, 20 bp, Artificial Sequence
  chemically synthesized
tagagttatataaaatgttt

SEQ ID NO: 237363 - DNA, 20 bp, Artificial Sequence
  chemically synthesized
tgagaggcagaaacatatta

SEQ ID NO: 237364 - DNA, 20 bp, Artificial Sequence
  chemically synthesized
cctgagaggcagaaacatat

SEQ ID NO: 237365 - DNA, 20 bp, Artificial Sequence
  chemically synthesized
tctaatatgtttctgcctct

SEQ ID NO: 237366 - DNA, 20 bp, Artificial Sequence
  chemically synthesized
ctaatatgtttctgcctctc

SEQ ID NO: 237367 - DNA, 20 bp, Artificial Sequence
  chemically synthesized
tggggtttctgcctgagagg

SEQ ID NO: 237368 - DNA, 20 bp, Artificial Sequence
  chemically synthesized
atatgtttctgcctctcagg

SEQ ID NO: 237369 - DNA, 20 bp, Artificial Sequence
  chemically synthesized
taatggggtttctgcctgag

SEQ ID NO: 237370 - DNA, 20 bp, Artificial Sequence
  chemically synthesized
ataatggggtttctgcctga

SEQ ID NO: 237371 - DNA, 20 bp, Artificial Sequence
  chemically synthesized
gcataatggggtttctgcct

SEQ ID NO: 237372 - DNA, 20 bp, Artificial Sequence
  chemically synthesized
tgggctaatgtagcataatg

SEQ ID NO: 237373 - DNA, 20 bp, Artificial Sequence
  chemically synthesized
ttgggctaatgtagcataat

SEQ ID NO: 237374 - DNA, 20 bp, Artificial Sequence
  chemically synthesized
tttgggctaatgtagcataa

SEQ ID NO: 237375 - DNA, 20 bp, Artificial Sequence
  chemically synthesized
gaaaccccattatgctacat

SEQ ID NO: 237376 - DNA, 20 bp, Artificial Sequence
  chemically synthesized
aagtgaattttgggctaatg

SEQ ID NO: 237377 - DNA, 20 bp, Artificial Sequence
  chemically synthesized
atagcactgaagtgaatttt

SEQ ID NO: 237378 - DNA, 20 bp, Artificial Sequence
  chemically synthesized
aatagcactgaagtgaattt

SEQ ID NO: 237379 - DNA, 20 bp, Artificial Sequence
  chemically synthesized
cattagcccaaaattcactt

SEQ ID NO: 237380 - DNA, 20 bp, Artificial Sequence
  chemically synthesized
acattttaaaaatagcactg

SEQ ID NO: 237381 - DNA, 20 bp, Artificial Sequence
  chemically synthesized
tagaagatacattttaaaaa

SEQ ID NO: 237382 - DNA, 20 bp, Artificial Sequence
  chemically synthesized
cccaatctgctttaatatag

SEQ ID NO: 237383 - DNA, 20 bp, Artificial Sequence
  chemically synthesized
aaaatgtatcttctatatta

SEQ ID NO: 237384 - DNA, 20 bp, Artificial Sequence
  chemically synthesized
attcccaatctgctttaata

SEQ ID NO: 237385 - DNA, 20 bp, Artificial Sequence
  chemically synthesized
atgtatcttctatattaaag

SEQ ID NO: 237386 - DNA, 20 bp, Artificial Sequence
  chemically synthesized
tcttctatattaaagcagat

SEQ ID NO: 237387 - DNA, 20 bp, Artificial Sequence
  chemically synthesized
cttctatattaaagcagatt

SEQ ID NO: 237388 - DNA, 20 bp, Artificial Sequence
  chemically synthesized
ttgtatagagaggaaatgta

SEQ ID NO: 237389 - DNA, 20 bp, Artificial Sequence
  chemically synthesized
gcgttggcatttgtatagag

SEQ ID NO: 237390 - DNA, 20 bp, Artificial Sequence
  chemically synthesized
agcgttggcatttgtataga

SEQ ID NO: 237391 - DNA, 20 bp, Artificial Sequence
  chemically synthesized
ccagcgttggcatttgtata

SEQ ID NO: 237392 - DNA, 20 bp, Artificial Sequence
  chemically synthesized
caccagcgttggcatttgta

SEQ ID NO: 237393 - DNA, 20 bp, Artificial Sequence
  chemically synthesized
ctctatacaaatgccaacgc

SEQ ID NO: 237394 - DNA, 20 bp, Artificial Sequence
  chemically synthesized
acttgcatgcacaccagcgt

SEQ ID NO: 237395 - DNA, 20 bp, Artificial Sequence
  chemically synthesized
aatcaaacttgcatgcacac

SEQ ID NO: 237396 - DNA, 20 bp, Artificial Sequence
  chemically synthesized
gccaacgctggtgtgcatgc

SEQ ID NO: 237397 - DNA, 20 bp, Artificial Sequence
  chemically synthesized
tgatacacatataattacac

SEQ ID NO: 237398 - DNA, 20 bp, Artificial Sequence
  chemically synthesized
gatacacatataattacaca

SEQ ID NO: 237399 - DNA, 20 bp, Artificial Sequence
  chemically synthesized
tatgataagctatttaaaca

SEQ ID NO: 237400 - DNA, 20 bp, Artificial Sequence
  chemically synthesized
aaatattttctgtgtttaaa

SEQ ID NO: 237401 - DNA, 20 bp, Artificial Sequence
  chemically synthesized
taaacacctatttatatgat

SEQ ID NO: 237402 - DNA, 20 bp, Artificial Sequence
  chemically synthesized
taaatagcttatcatataaa

SEQ ID NO: 237403 - DNA, 20 bp, Artificial Sequence
  chemically synthesized
aaatagcttatcatataaat

SEQ ID NO: 237404 - DNA, 20 bp, Artificial Sequence
  chemically synthesized
ccctttaatattaaggagtt

SEQ ID NO: 237405 - DNA, 20 bp, Artificial Sequence
  chemically synthesized
atatgccctttaatattaag

SEQ ID NO: 237406 - DNA, 20 bp, Artificial Sequence
  chemically synthesized
aaatatgccctttaatatta

SEQ ID NO: 237407 - DNA, 20 bp, Artificial Sequence
  chemically synthesized
tgcttaactccttaatatta

SEQ ID NO: 237408 - DNA, 20 bp, Artificial Sequence
  chemically synthesized
taaatatgccctttaatatt

SEQ ID NO: 237409 - DNA, 20 bp, Artificial Sequence
  chemically synthesized
gcttaactccttaatattaa

SEQ ID NO: 237410 - DNA, 20 bp, Artificial Sequence
  chemically synthesized
cttaactccttaatattaaa

SEQ ID NO: 237411 - DNA, 20 bp, Artificial Sequence
  chemically synthesized
attaaagggcatatttacta

SEQ ID NO: 237412 - DNA, 20 bp, Artificial Sequence
  chemically synthesized
cattctcaaatatgtttcca

SEQ ID NO: 237413 - DNA, 20 bp, Artificial Sequence
  chemically synthesized
tttactatggaaacatattt

SEQ ID NO: 237414 - DNA, 20 bp, Artificial Sequence
  chemically synthesized
tggaaacatatttgagaatg

SEQ ID NO: 237415 - DNA, 20 bp, Artificial Sequence
  chemically synthesized
tttgagaatgaagacttgta

SEQ ID NO: 237416 - DNA, 20 bp, Artificial Sequence
  chemically synthesized
agtatcacatttgactttac

SEQ ID NO: 237417 - DNA, 20 bp, Artificial Sequence
  chemically synthesized
aaatgctggattcacaaaag

SEQ ID NO: 237418 - DNA, 20 bp, Artificial Sequence
  chemically synthesized
tcaaaatgctggattcacaa

SEQ ID NO: 237419 - DNA, 20 bp, Artificial Sequence
  chemically synthesized
tgatactgcttttgtgaatc

SEQ ID NO: 237420 - DNA, 20 bp, Artificial Sequence
  chemically synthesized
ctttagatatttcaaaatgc

SEQ ID NO: 237421 - DNA, 20 bp, Artificial Sequence
  chemically synthesized
ccagcattttgaaatatcta

SEQ ID NO: 237422 - DNA, 20 bp, Artificial Sequence
  chemically synthesized
cagtagtttattaaatactt

SEQ ID NO: 237423 - DNA, 20 bp, Artificial Sequence
  chemically synthesized
taaagtatttaataaactac

SEQ ID NO: 237424 - DNA, 20 bp, Artificial Sequence
  chemically synthesized
aaagtatttaataaactact

SEQ ID NO: 237425 - DNA, 20 bp, Artificial Sequence
  chemically synthesized
tgagggcaaaaaacacccag

SEQ ID NO: 237426 - DNA, 20 bp, Artificial Sequence
  chemically synthesized
agatgagggcaaaaaacacc

SEQ ID NO: 237427 - DNA, 20 bp, Artificial Sequence
  chemically synthesized
atactgattaagacagatga

SEQ ID NO: 237428 - DNA, 20 bp, Artificial Sequence
  chemically synthesized
aatactgattaagacagatg

SEQ ID NO: 237429 - DNA, 20 bp, Artificial Sequence
  chemically synthesized
aaatactgattaagacagat

SEQ ID NO: 237430 - DNA, 20 bp, Artificial Sequence
  chemically synthesized
ttgccctcatctgtcttaat

SEQ ID NO: 237431 - DNA, 20 bp, Artificial Sequence
  chemically synthesized
ccagaaaatactgattaaga

SEQ ID NO: 237432 - DNA, 20 bp, Artificial Sequence
  chemically synthesized
aatgccagaaaatactgatt

SEQ ID NO: 237433 - DNA, 20 bp, Artificial Sequence
  chemically synthesized
ctgtcttaatcagtattttc

SEQ ID NO: 237434 - DNA, 20 bp, Artificial Sequence
  chemically synthesized
ttgtagccaatttttaatgc

SEQ ID NO: 237435 - DNA, 20 bp, Artificial Sequence
  chemically synthesized
tattttctggcattaaaaat

SEQ ID NO: 237436 - DNA, 20 bp, Artificial Sequence
  chemically synthesized
aatcaagtggatttgaattg

SEQ ID NO: 237437 - DNA, 20 bp, Artificial Sequence
  chemically synthesized
tgttgcaatagtcaatcaag

SEQ ID NO: 237438 - DNA, 20 bp, Artificial Sequence
  chemically synthesized
tcatgttgcaatagtcaatc

SEQ ID NO: 237439 - DNA, 20 bp, Artificial Sequence
  chemically synthesized
tcaaattgttcatgttgcaa

SEQ ID NO: 237440 - DNA, 20 bp, Artificial Sequence
  chemically synthesized
tattgcaacatgaacaattt

SEQ ID NO: 237441 - DNA, 20 bp, Artificial Sequence
  chemically synthesized
atgaacaatttgagctaaaa

SEQ ID NO: 237442 - DNA, 20 bp, Artificial Sequence
  chemically synthesized
aattatttttgcatcttttt

SEQ ID NO: 237443 - DNA, 20 bp, Artificial Sequence
  chemically synthesized
aaaaagatgcaaaaataatt

SEQ ID NO: 237444 - DNA, 20 bp, Artificial Sequence
  chemically synthesized
aacactgtgtttattacacg

SEQ ID NO: 237445 - DNA, 20 bp, Artificial Sequence
  chemically synthesized
aagtcttcgtgtaataaaca

SEQ ID NO: 237446 - DNA, 20 bp, Artificial Sequence
  chemically synthesized
aaattacatagtttaggcat

SEQ ID NO: 237447 - DNA, 20 bp, Artificial Sequence
  chemically synthesized
gttgctaaattacatagttt

SEQ ID NO: 237448 - DNA, 20 bp, Artificial Sequence
  chemically synthesized
ggttgctaaattacatagtt

SEQ ID NO: 237449 - DNA, 20 bp, Artificial Sequence
  chemically synthesized
tatgcctaaactatgtaatt

SEQ ID NO: 237450 - DNA, 20 bp, Artificial Sequence
  chemically synthesized
aatttggttgctaaattaca

SEQ ID NO: 237451 - DNA, 20 bp, Artificial Sequence
  chemically synthesized
agattgtccaggatataatt

SEQ ID NO: 237452 - DNA, 20 bp, Artificial Sequence
  chemically synthesized
ttagcaaccaaattatatcc

SEQ ID NO: 237453 - DNA, 20 bp, Artificial Sequence
  chemically synthesized
aaagatagattagattgtcc

SEQ ID NO: 237454 - DNA, 20 bp, Artificial Sequence
  chemically synthesized
taaagatagattagattgtc

SEQ ID NO: 237455 - DNA, 20 bp, Artificial Sequence
  chemically synthesized
atatgcaggtaaagatagat

SEQ ID NO: 237456 - DNA, 20 bp, Artificial Sequence
  chemically synthesized
tttgaatatgcaggtaaaga

SEQ ID NO: 237457 - DNA, 20 bp, Artificial Sequence
  chemically synthesized
gtcctttgaatatgcaggta

SEQ ID NO: 237458 - DNA, 20 bp, Artificial Sequence
  chemically synthesized
gtggtgtcctttgaatatgc

SEQ ID NO: 237459 - DNA, 20 bp, Artificial Sequence
  chemically synthesized
tgtggtgtcctttgaatatg

SEQ ID NO: 237460 - DNA, 20 bp, Artificial Sequence
  chemically synthesized
tatctttacctgcatattca

SEQ ID NO: 237461 - DNA, 20 bp, Artificial Sequence
  chemically synthesized
atctttacctgcatattcaa

SEQ ID NO: 237462 - DNA, 20 bp, Artificial Sequence
  chemically synthesized
gcatattcaaaggacaccac

SEQ ID NO: 237463 - DNA, 20 bp, Artificial Sequence
  chemically synthesized
tgtagtttaatttcaacttg

SEQ ID NO: 237464 - DNA, 20 bp, Artificial Sequence
  chemically synthesized
gttgaaattaaactacacac

SEQ ID NO: 237465 - DNA, 20 bp, Artificial Sequence
  chemically synthesized
tatggatgataaccagtgtg

SEQ ID NO: 237466 - DNA, 20 bp, Artificial Sequence
  chemically synthesized
aacagcatatggatgataac

SEQ ID NO: 237467 - DNA, 20 bp, Artificial Sequence
  chemically synthesized
gttaatagggaaacagcata

SEQ ID NO: 237468 - DNA, 20 bp, Artificial Sequence
  chemically synthesized
ggtttatgttaatagggaaa

SEQ ID NO: 237469 - DNA, 20 bp, Artificial Sequence
  chemically synthesized
ttttatggtttatgttaata

SEQ ID NO: 237470 - DNA, 20 bp, Artificial Sequence
  chemically synthesized
attttatggtttatgttaat

SEQ ID NO: 237471 - DNA, 20 bp, Artificial Sequence
  chemically synthesized
cattttatggtttatgttaa

SEQ ID NO: 237472 - DNA, 20 bp, Artificial Sequence
  chemically synthesized
tggtacttattgacatttta

SEQ ID NO: 237473 - DNA, 20 bp, Artificial Sequence
  chemically synthesized
ataaaccataaaatgtcaat

SEQ ID NO: 237474 - DNA, 20 bp, Artificial Sequence
  chemically synthesized
aacaatgcagagttaattgt

SEQ ID NO: 237475 - DNA, 20 bp, Artificial Sequence
  chemically synthesized
ccagaggccaaaacaatgca

SEQ ID NO: 237476 - DNA, 20 bp, Artificial Sequence
  chemically synthesized
gtccagaggccaaaacaatg

SEQ ID NO: 237477 - DNA, 20 bp, Artificial Sequence
  chemically synthesized
caattaactctgcattgttt

SEQ ID NO: 237478 - DNA, 20 bp, Artificial Sequence
  chemically synthesized
ctctgcattgttttggcctc

SEQ ID NO: 237479 - DNA, 20 bp, Artificial Sequence
  chemically synthesized
tgccttctgaaatagtccag

SEQ ID NO: 237480 - DNA, 20 bp, Artificial Sequence
  chemically synthesized
atgccttctgaaatagtcca

SEQ ID NO: 237481 - DNA, 20 bp, Artificial Sequence
  chemically synthesized
aaatgccttctgaaatagtc

SEQ ID NO: 237482 - DNA, 20 bp, Artificial Sequence
  chemically synthesized
ttttggcctctggactattt

SEQ ID NO: 237483 - DNA, 20 bp, Artificial Sequence
  chemically synthesized
tggcctctggactatttcag

SEQ ID NO: 237484 - DNA, 20 bp, Artificial Sequence
  chemically synthesized
ggcctctggactatttcaga

SEQ ID NO: 237485 - DNA, 20 bp, Artificial Sequence
  chemically synthesized
tgacaaaatgccttctgaaa

SEQ ID NO: 237486 - DNA, 20 bp, Artificial Sequence
  chemically synthesized
ttcagaaggcattttgtcaa

SEQ ID NO: 237487 - DNA, 20 bp, Artificial Sequence
  chemically synthesized
cattttgtcaatagaatata

SEQ ID NO: 237488 - DNA, 20 bp, Artificial Sequence
  chemically synthesized
aatatatagaaatattgcta

SEQ ID NO: 237489 - DNA, 20 bp, Artificial Sequence
  chemically synthesized
aagacaattttgtagtgctg

SEQ ID NO: 237490 - DNA, 20 bp, Artificial Sequence
  chemically synthesized
ttttcctaaagacaattttg

SEQ ID NO: 237491 - DNA, 20 bp, Artificial Sequence
  chemically synthesized
cagcactacaaaattgtctt

SEQ ID NO: 237492 - DNA, 20 bp, Artificial Sequence
  chemically synthesized
agcactacaaaattgtcttt

SEQ ID NO: 237493 - DNA, 20 bp, Artificial Sequence
  chemically synthesized
attacagttctgttttccta

SEQ ID NO: 237494 - DNA, 20 bp, Artificial Sequence
  chemically synthesized
caaaattgtctttaggaaaa

SEQ ID NO: 237495 - DNA, 20 bp, Artificial Sequence
  chemically synthesized
tatccatcatgataaaatta

SEQ ID NO: 237496 - DNA, 20 bp, Artificial Sequence
  chemically synthesized
gaactgtaattttatcatga

SEQ ID NO: 237497 - DNA, 20 bp, Artificial Sequence
  chemically synthesized
tttatcatgatggatatttc

SEQ ID NO: 237498 - DNA, 20 bp, Artificial Sequence
  chemically synthesized
cttagctaaaatgaagttgc

SEQ ID NO: 237499 - DNA, 20 bp, Artificial Sequence
  chemically synthesized
tatttctagcaacttcattt

SEQ ID NO: 237500 - DNA, 20 bp, Artificial Sequence
  chemically synthesized
tggcatacttagctaaaatg

SEQ ID NO: 237501 - DNA, 20 bp, Artificial Sequence
  chemically synthesized
ctagcaacttcattttagct

SEQ ID NO: 237502 - DNA, 20 bp, Artificial Sequence
  chemically synthesized
aggagaacttgtggcatact

SEQ ID NO: 237503 - DNA, 20 bp, Artificial Sequence
  chemically synthesized
attttagctaagtatgccac

SEQ ID NO: 237504 - DNA, 20 bp, Artificial Sequence
  chemically synthesized
ctttccagaaggagaacttg

SEQ ID NO: 237505 - DNA, 20 bp, Artificial Sequence
  chemically synthesized
tatgccacaagttctccttc

SEQ ID NO: 237506 - DNA, 20 bp, Artificial Sequence
  chemically synthesized
tgttggaacctttccagaag

SEQ ID NO: 237507 - DNA, 20 bp, Artificial Sequence
  chemically synthesized
ccacaagttctccttctgga

SEQ ID NO: 237508 - DNA, 20 bp, Artificial Sequence
  chemically synthesized
cacaagttctccttctggaa

SEQ ID NO: 237509 - DNA, 20 bp, Artificial Sequence
  chemically synthesized
tatgttggaacctttccaga

SEQ ID NO: 237510 - DNA, 20 bp, Artificial Sequence
  chemically synthesized
ttatgttggaacctttccag

SEQ ID NO: 237511 - DNA, 20 bp, Artificial Sequence
  chemically synthesized
gctttatgttggaacctttc

SEQ ID NO: 237512 - DNA, 20 bp, Artificial Sequence
  chemically synthesized
tctggaaaggttccaacata

SEQ ID NO: 237513 - DNA, 20 bp, Artificial Sequence
  chemically synthesized
tgtgtatttcggctttatgt

SEQ ID NO: 237514 - DNA, 20 bp, Artificial Sequence
  chemically synthesized
ctttggggcagtgtgtattt

SEQ ID NO: 237515 - DNA, 20 bp, Artificial Sequence
  chemically synthesized
ccgaaatacacactgcccca

SEQ ID NO: 237516 - DNA, 20 bp, Artificial Sequence
  chemically synthesized
ggtgttttgtggctttgggg

SEQ ID NO: 237517 - DNA, 20 bp, Artificial Sequence
  chemically synthesized
caaggtgttttgtggctttg

SEQ ID NO: 237518 - DNA, 20 bp, Artificial Sequence
  chemically synthesized
gcaaggtgttttgtggcttt

SEQ ID NO: 237519 - DNA, 20 bp, Artificial Sequence
  chemically synthesized
agcaaggtgttttgtggctt

SEQ ID NO: 237520 - DNA, 20 bp, Artificial Sequence
  chemically synthesized
cgtaacagcaaggtgttttg

SEQ ID NO: 237521 - DNA, 20 bp, Artificial Sequence
  chemically synthesized
agggaagcatcgtaacagca

SEQ ID NO: 237522 - DNA, 20 bp, Artificial Sequence
  chemically synthesized
gagggaagcatcgtaacagc

SEQ ID NO: 237523 - DNA, 20 bp, Artificial Sequence
  chemically synthesized
gacagagggaagcatcgtaa

SEQ ID NO: 237524 - DNA, 20 bp, Artificial Sequence
  chemically synthesized
attgaatctgtgacagaggg

SEQ ID NO: 237525 - DNA, 20 bp, Artificial Sequence
  chemically synthesized
tacgatgcttccctctgtca

SEQ ID NO: 237526 - DNA, 20 bp, Artificial Sequence
  chemically synthesized
ataattgaatctgtgacaga

SEQ ID NO: 237527 - DNA, 20 bp, Artificial Sequence
  chemically synthesized
tataattgaatctgtgacag

SEQ ID NO: 237528 - DNA, 20 bp, Artificial Sequence
  chemically synthesized
atataattgaatctgtgaca

SEQ ID NO: 237529 - DNA, 20 bp, Artificial Sequence
  chemically synthesized
aaatataattgaatctgtga

SEQ ID NO: 237530 - DNA, 20 bp, Artificial Sequence
  chemically synthesized
acagattcaattatattttg

SEQ ID NO: 237531 - DNA, 20 bp, Artificial Sequence
  chemically synthesized
aattatattttgcagtttat

SEQ ID NO: 237532 - DNA, 20 bp, Artificial Sequence
  chemically synthesized
ttgcagtttatcagataaac

SEQ ID NO: 237533 - DNA, 20 bp, Artificial Sequence
  chemically synthesized
agagtttgcctggacggagc

SEQ ID NO: 237534 - DNA, 20 bp, Artificial Sequence
  chemically synthesized
tcagataaaccagctccgtc

SEQ ID NO: 237535 - DNA, 20 bp, Artificial Sequence
  chemically synthesized
cagataaaccagctccgtcc

SEQ ID NO: 237536 - DNA, 20 bp, Artificial Sequence
  chemically synthesized
tgagagagtttgcctggacg

SEQ ID NO: 237537 - DNA, 20 bp, Artificial Sequence
  chemically synthesized
gatgagagagtttgcctgga

SEQ ID NO: 237538 - DNA, 20 bp, Artificial Sequence
  chemically synthesized
tcaggatgagagagtttgcc

SEQ ID NO: 237539 - DNA, 20 bp, Artificial Sequence
  chemically synthesized
ctttttgtgtcaggatgaga

SEQ ID NO: 237540 - DNA, 20 bp, Artificial Sequence
  chemically synthesized
gactttttgtgtcaggatga

SEQ ID NO: 237541 - DNA, 20 bp, Artificial Sequence
  chemically synthesized
tggactttttgtgtcaggat

SEQ ID NO: 237542 - DNA, 20 bp, Artificial Sequence
  chemically synthesized
tgctatggactttttgtgtc

SEQ ID NO: 237543 - DNA, 20 bp, Artificial Sequence
  chemically synthesized
ctctctcatcctgacacaaa

SEQ ID NO: 237544 - DNA, 20 bp, Artificial Sequence
  chemically synthesized
gtgctatggactttttgtgt

SEQ ID NO: 237545 - DNA, 20 bp, Artificial Sequence
  chemically synthesized
atcctgacacaaaaagtcca

SEQ ID NO: 237546 - DNA, 20 bp, Artificial Sequence
  chemically synthesized
aatattagagcacggtgcta

SEQ ID NO: 237547 - DNA, 20 bp, Artificial Sequence
  chemically synthesized
ataatgataatattagagca

SEQ ID NO: 237548 - DNA, 20 bp, Artificial Sequence
  chemically synthesized
ttatcataatgataatatta

SEQ ID NO: 237549 - DNA, 20 bp, Artificial Sequence
  chemically synthesized
aattatcataatgataatat

SEQ ID NO: 237550 - DNA, 20 bp, Artificial Sequence
  chemically synthesized
cattatgataattttctttc

SEQ ID NO: 237551 - DNA, 20 bp, Artificial Sequence
  chemically synthesized
gtcatcattatattactaga

SEQ ID NO: 237552 - DNA, 20 bp, Artificial Sequence
  chemically synthesized
tgttgtcatcattatattac

SEQ ID NO: 237553 - DNA, 20 bp, Artificial Sequence
  chemically synthesized
taatataatgatgacaacaa

SEQ ID NO: 237554 - DNA, 20 bp, Artificial Sequence
  chemically synthesized
atgatgacaacaacagtcaa

SEQ ID NO: 237555 - DNA, 20 bp, Artificial Sequence
  chemically synthesized
gatcaggttctgaagggtga

SEQ ID NO: 237556 - DNA, 20 bp, Artificial Sequence
  chemically synthesized
aagtaatttccatcaccctt

SEQ ID NO: 237557 - DNA, 20 bp, Artificial Sequence
  chemically synthesized
cttaaagatcaggttctgaa

SEQ ID NO: 237558 - DNA, 20 bp, Artificial Sequence
  chemically synthesized
tcttaaagatcaggttctga

SEQ ID NO: 237559 - DNA, 20 bp, Artificial Sequence
  chemically synthesized
ttcttaaagatcaggttctg

SEQ ID NO: 237560 - DNA, 20 bp, Artificial Sequence
  chemically synthesized
cccttcagaacctgatcttt

SEQ ID NO: 237561 - DNA, 20 bp, Artificial Sequence
  chemically synthesized
tctttaacttcttaaagatc

SEQ ID NO: 237562 - DNA, 20 bp, Artificial Sequence
  chemically synthesized
ctctttaacttcttaaagat

SEQ ID NO: 237563 - DNA, 20 bp, Artificial Sequence
  chemically synthesized
ttcagaacctgatctttaag

SEQ ID NO: 237564 - DNA, 20 bp, Artificial Sequence
  chemically synthesized
ctggactctttaacttctta

SEQ ID NO: 237565 - DNA, 20 bp, Artificial Sequence
  chemically synthesized
acctgatctttaagaagtta

SEQ ID NO: 237566 - DNA, 20 bp, Artificial Sequence
  chemically synthesized
ctgatctttaagaagttaaa

SEQ ID NO: 237567 - DNA, 20 bp, Artificial Sequence
  chemically synthesized
ctttaagaagttaaagagtc

SEQ ID NO: 237568 - DNA, 20 bp, Artificial Sequence
  chemically synthesized
gtatttatcttcagcacatc

SEQ ID NO: 237569 - DNA, 20 bp, Artificial Sequence
  chemically synthesized
taaagagtccagatgtgctg

SEQ ID NO: 237570 - DNA, 20 bp, Artificial Sequence
  chemically synthesized
ttcgaaattgtatttatctt

SEQ ID NO: 237571 - DNA, 20 bp, Artificial Sequence
  chemically synthesized
aatttcgaaaaaacaaatca

SEQ ID NO: 237572 - DNA, 20 bp, Artificial Sequence
  chemically synthesized
acaaatcaaagacttacctt

SEQ ID NO: 237573 - DNA, 20 bp, Artificial Sequence
  chemically synthesized
tacaaatggtatcttaaggt

SEQ ID NO: 237574 - DNA, 20 bp, Artificial Sequence
  chemically synthesized
taaatacaaatggtatctta

SEQ ID NO: 237575 - DNA, 20 bp, Artificial Sequence
  chemically synthesized
ctaaatacaaatggtatctt

SEQ ID NO: 237576 - DNA, 20 bp, Artificial Sequence
  chemically synthesized
gggaacatgctaaatacaaa

SEQ ID NO: 237577 - DNA, 20 bp, Artificial Sequence
  chemically synthesized
cttaagataccatttgtatt

SEQ ID NO: 237578 - DNA, 20 bp, Artificial Sequence
  chemically synthesized
tttagcatgttcccaattct

SEQ ID NO: 237579 - DNA, 20 bp, Artificial Sequence
  chemically synthesized
ttagcatgttcccaattctc

SEQ ID NO: 237580 - DNA, 20 bp, Artificial Sequence
  chemically synthesized
gacacaaattcctgagaatt

SEQ ID NO: 237581 - DNA, 20 bp, Artificial Sequence
  chemically synthesized
agacacaaattcctgagaat

SEQ ID NO: 237582 - DNA, 20 bp, Artificial Sequence
  chemically synthesized
tcagaaagacacaaattcct

SEQ ID NO: 237583 - DNA, 20 bp, Artificial Sequence
  chemically synthesized
tcaggaatttgtgtctttct

SEQ ID NO: 237584 - DNA, 20 bp, Artificial Sequence
  chemically synthesized
aagctgaacagtttctcaga

SEQ ID NO: 237585 - DNA, 20 bp, Artificial Sequence
  chemically synthesized
acagaagctgaacagtttct

SEQ ID NO: 237586 - DNA, 20 bp, Artificial Sequence
  chemically synthesized
tgtctttctgagaaactgtt

SEQ ID NO: 237587 - DNA, 20 bp, Artificial Sequence
  chemically synthesized
agtggctaacagaagctgaa

SEQ ID NO: 237588 - DNA, 20 bp, Artificial Sequence
  chemically synthesized
agaaactgttcagcttctgt

SEQ ID NO: 237589 - DNA, 20 bp, Artificial Sequence
  chemically synthesized
atttaatcagtggctaacag

SEQ ID NO: 237590 - DNA, 20 bp, Artificial Sequence
  chemically synthesized
gatatttaatcagtggctaa

SEQ ID NO: 237591 - DNA, 20 bp, Artificial Sequence
  chemically synthesized
atataaagatatttaatcag

SEQ ID NO: 237592 - DNA, 20 bp, Artificial Sequence
  chemically synthesized
atgatataaagatatttaat

SEQ ID NO: 237593 - DNA, 20 bp, Artificial Sequence
  chemically synthesized
ggcgttttcattatgatata

SEQ ID NO: 237594 - DNA, 20 bp, Artificial Sequence
  chemically synthesized
acagatctgttgagaaatgg

SEQ ID NO: 237595 - DNA, 20 bp, Artificial Sequence
  chemically synthesized
ttgacagatctgttgagaaa

SEQ ID NO: 237596 - DNA, 20 bp, Artificial Sequence
  chemically synthesized
aaaacgccgccatttctcaa

SEQ ID NO: 237597 - DNA, 20 bp, Artificial Sequence
  chemically synthesized
ggcgatttgacagatctgtt

SEQ ID NO: 237598 - DNA, 20 bp, Artificial Sequence
  chemically synthesized
tttacctgcaggcgatttga

SEQ ID NO: 237599 - DNA, 20 bp, Artificial Sequence
  chemically synthesized
cagatctgtcaaatcgcctg

SEQ ID NO: 237600 - DNA, 20 bp, Artificial Sequence
  chemically synthesized
agatctgtcaaatcgcctgc

SEQ ID NO: 237601 - DNA, 20 bp, Artificial Sequence
  chemically synthesized
atccatatgcttttacctgc

SEQ ID NO: 237602 - DNA, 20 bp, Artificial Sequence
  chemically synthesized
gtcaaatcgcctgcaggtaa

SEQ ID NO: 237603 - DNA, 20 bp, Artificial Sequence
  chemically synthesized
gatccatatgcttttacctg

SEQ ID NO: 237604 - DNA, 20 bp, Artificial Sequence
  chemically synthesized
cgcctgcaggtaaaagcata

SEQ ID NO: 237605 - DNA, 20 bp, Artificial Sequence
  chemically synthesized
caggtaaaagcatatggatc

SEQ ID NO: 237606 - DNA, 20 bp, Artificial Sequence
  chemically synthesized
agcatatggatcaagaaaaa

SEQ ID NO: 237607 - DNA, 20 bp, Artificial Sequence
  chemically synthesized
tatggatcaagaaaaataga

SEQ ID NO: 237608 - DNA, 20 bp, Artificial Sequence
  chemically synthesized
aatagatggattatgtaaaa

SEQ ID NO: 237609 - DNA, 20 bp, Artificial Sequence
  chemically synthesized
ggattatgtaaaacagatta

SEQ ID NO: 237610 - DNA, 20 bp, Artificial Sequence
  chemically synthesized
attatgtaaaacagattata

SEQ ID NO: 237611 - DNA, 20 bp, Artificial Sequence
  chemically synthesized
taaaacagattatagagata

SEQ ID NO: 237612 - DNA, 20 bp, Artificial Sequence
  chemically synthesized
gagatatagcgtatattttt

SEQ ID NO: 237613 - DNA, 20 bp, Artificial Sequence
  chemically synthesized
attttttggttatactgaca

SEQ ID NO: 237614 - DNA, 20 bp, Artificial Sequence
  chemically synthesized
tatcagagtgatatctttgt

SEQ ID NO: 237615 - DNA, 20 bp, Artificial Sequence
  chemically synthesized
tgacaaagatatcactctga

SEQ ID NO: 237616 - DNA, 20 bp, Artificial Sequence
  chemically synthesized
gcaaatgcaggaaactatca

SEQ ID NO: 237617 - DNA, 20 bp, Artificial Sequence
  chemically synthesized
ctgcaaatgcaggaaactat

SEQ ID NO: 237618 - DNA, 20 bp, Artificial Sequence
  chemically synthesized
ctgatagtttcctgcatttg

SEQ ID NO: 237619 - DNA, 20 bp, Artificial Sequence
  chemically synthesized
aaactaaactctgcaaatgc

SEQ ID NO: 237620 - DNA, 20 bp, Artificial Sequence
  chemically synthesized
gaaactaaactctgcaaatg

SEQ ID NO: 237621 - DNA, 20 bp, Artificial Sequence
  chemically synthesized
gatagtttcctgcatttgca

SEQ ID NO: 237622 - DNA, 20 bp, Artificial Sequence
  chemically synthesized
tttcctgcatttgcagagtt

SEQ ID NO: 237623 - DNA, 20 bp, Artificial Sequence
  chemically synthesized
catttgcagagtttagtttc

SEQ ID NO: 237624 - DNA, 20 bp, Artificial Sequence
  chemically synthesized
taaaaattaatatacacacc

SEQ ID NO: 237625 - DNA, 20 bp, Artificial Sequence
  chemically synthesized
aaatgttgtgtgtacatgct

SEQ ID NO: 237626 - DNA, 20 bp, Artificial Sequence
  chemically synthesized
aaaatgttgtgtgtacatgc

SEQ ID NO: 237627 - DNA, 20 bp, Artificial Sequence
  chemically synthesized
taaaaaaatactcaatataa

SEQ ID NO: 237628 - DNA, 20 bp, Artificial Sequence
  chemically synthesized
ttaaaatcagcttttatatt

SEQ ID NO: 237629 - DNA, 20 bp, Artificial Sequence
  chemically synthesized
tgcaaccttccatttaaaat

SEQ ID NO: 237630 - DNA, 20 bp, Artificial Sequence
  chemically synthesized
atataaaagctgattttaaa

SEQ ID NO: 237631 - DNA, 20 bp, Artificial Sequence
  chemically synthesized
taaaagctgattttaaatgg

SEQ ID NO: 237632 - DNA, 20 bp, Artificial Sequence
  chemically synthesized
aaaagctgattttaaatgga

SEQ ID NO: 237633 - DNA, 20 bp, Artificial Sequence
  chemically synthesized
ataaatatattcattttaaa

SEQ ID NO: 237634 - DNA, 20 bp, Artificial Sequence
  chemically synthesized
aataaatatattcattttaa

SEQ ID NO: 237635 - DNA, 20 bp, Artificial Sequence
  chemically synthesized
caataaatatattcatttta

SEQ ID NO: 237636 - DNA, 20 bp, Artificial Sequence
  chemically synthesized
tgaatatatttattgattaa

SEQ ID NO: 237637 - DNA, 20 bp, Artificial Sequence
  chemically synthesized
tatatttattgattaaaaga

SEQ ID NO: 237638 - DNA, 20 bp, Artificial Sequence
  chemically synthesized
tattgattaaaagaaagata

SEQ ID NO: 237639 - DNA, 20 bp, Artificial Sequence
  chemically synthesized
gaaagataaagcaactattt

SEQ ID NO: 237640 - DNA, 20 bp, Artificial Sequence
  chemically synthesized
aaaatgccaatagtccaaaa

SEQ ID NO: 237641 - DNA, 20 bp, Artificial Sequence
  chemically synthesized
aagcaactattttggactat

SEQ ID NO: 237642 - DNA, 20 bp, Artificial Sequence
  chemically synthesized
tttaggaaagaaaatgccaa

SEQ ID NO: 237643 - DNA, 20 bp, Artificial Sequence
  chemically synthesized
aaaaaaatatatttttagga

SEQ ID NO: 237644 - DNA, 20 bp, Artificial Sequence
  chemically synthesized
aattaaaaaaatatattttt

SEQ ID NO: 237645 - DNA, 20 bp, Artificial Sequence
  chemically synthesized
gaattaaaaaaatatatttt

SEQ ID NO: 237646 - DNA, 20 bp, Artificial Sequence
  chemically synthesized
aaaatatatttttttaattc

SEQ ID NO: 237647 - DNA, 20 bp, Artificial Sequence
  chemically synthesized
ttaagatatttgtaaatttc

SEQ ID NO: 237648 - DNA, 20 bp, Artificial Sequence
  chemically synthesized
aaataatttattacaatgtt

SEQ ID NO: 237649 - DNA, 20 bp, Artificial Sequence
  chemically synthesized
taacattgtaataaattatt

SEQ ID NO: 237650 - DNA, 20 bp, Artificial Sequence
  chemically synthesized
cattgtaataaattatttgg

SEQ ID NO: 237651 - DNA, 20 bp, Artificial Sequence
  chemically synthesized
tatccaaaaatattttgaaa

SEQ ID NO: 237652 - DNA, 20 bp, Artificial Sequence
  chemically synthesized
ttatccaaaaatattttgaa

SEQ ID NO: 237653 - DNA, 20 bp, Artificial Sequence
  chemically synthesized
tttatccaaaaatattttga

SEQ ID NO: 237654 - DNA, 20 bp, Artificial Sequence
  chemically synthesized
attccctttcaaaatatttt

SEQ ID NO: 237655 - DNA, 20 bp, Artificial Sequence
  chemically synthesized
tgaaagtgatagaatttatg

SEQ ID NO: 237656 - DNA, 20 bp, Artificial Sequence
  chemically synthesized
aagaataatattgaaagtga

SEQ ID NO: 237657 - DNA, 20 bp, Artificial Sequence
  chemically synthesized
tggatcaagaataatattga

SEQ ID NO: 237658 - DNA, 20 bp, Artificial Sequence
  chemically synthesized
tgaacaggcagttttggatc

SEQ ID NO: 237659 - DNA, 20 bp, Artificial Sequence
  chemically synthesized
agttgatgaacaggcagttt

SEQ ID NO: 237660 - DNA, 20 bp, Artificial Sequence
  chemically synthesized
cctttcagttgatgaacagg

SEQ ID NO: 237661 - DNA, 20 bp, Artificial Sequence
  chemically synthesized
actcctttcagttgatgaac

SEQ ID NO: 237662 - DNA, 20 bp, Artificial Sequence
  chemically synthesized
tactcctttcagttgatgaa

SEQ ID NO: 237663 - DNA, 20 bp, Artificial Sequence
  chemically synthesized
actgcctgttcatcaactga

SEQ ID NO: 237664 - DNA, 20 bp, Artificial Sequence
  chemically synthesized
ctgcctgttcatcaactgaa

SEQ ID NO: 237665 - DNA, 20 bp, Artificial Sequence
  chemically synthesized
gcctgttcatcaactgaaag

SEQ ID NO: 237666 - DNA, 20 bp, Artificial Sequence
  chemically synthesized
ctagaacttattactccttt

SEQ ID NO: 237667 - DNA, 20 bp, Artificial Sequence
  chemically synthesized
catcaactgaaaggagtaat

SEQ ID NO: 237668 - DNA, 20 bp, Artificial Sequence
  chemically synthesized
ctgaaaggagtaataagttc

SEQ ID NO: 237669 - DNA, 20 bp, Artificial Sequence
  chemically synthesized
attactatgcaatagaacac

SEQ ID NO: 237670 - DNA, 20 bp, Artificial Sequence
  chemically synthesized
agttctagtgttctattgca

SEQ ID NO: 237671 - DNA, 20 bp, Artificial Sequence
  chemically synthesized
ttgttcatattactatgcaa

SEQ ID NO: 237672 - DNA, 20 bp, Artificial Sequence
  chemically synthesized
attgcatagtaatatgaaca

SEQ ID NO: 237673 - DNA, 20 bp, Artificial Sequence
  chemically synthesized
tgaaatatacagcacaatat

SEQ ID NO: 237674 - DNA, 20 bp, Artificial Sequence
  chemically synthesized
tttcactattttgaaatata

SEQ ID NO: 237675 - DNA, 20 bp, Artificial Sequence
  chemically synthesized
ttgtgctgtatatttcaaaa

SEQ ID NO: 237676 - DNA, 20 bp, Artificial Sequence
  chemically synthesized
tgtatatttcaaaatagtga

SEQ ID NO: 237677 - DNA, 20 bp, Artificial Sequence
  chemically synthesized
tatatttcaaaatagtgaaa

SEQ ID NO: 237678 - DNA, 20 bp, Artificial Sequence
  chemically synthesized
aattttaaattttctcacca

SEQ ID NO: 237679 - DNA, 20 bp, Artificial Sequence
  chemically synthesized
ttttaaattttctcaccaca

SEQ ID NO: 237680 - DNA, 20 bp, Artificial Sequence
  chemically synthesized
atttataatttctctgtggt

SEQ ID NO: 237681 - DNA, 20 bp, Artificial Sequence
  chemically synthesized
aaacatttataatttctctg

SEQ ID NO: 237682 - DNA, 20 bp, Artificial Sequence
  chemically synthesized
cagagaaattataaatgttt

SEQ ID NO: 237683 - DNA, 20 bp, Artificial Sequence
  chemically synthesized
agagaaattataaatgtttg

SEQ ID NO: 237684 - DNA, 20 bp, Artificial Sequence
  chemically synthesized
attataaatgtttgaggcta

SEQ ID NO: 237685 - DNA, 20 bp, Artificial Sequence
  chemically synthesized
caggtttcttggcagatcca

SEQ ID NO: 237686 - DNA, 20 bp, Artificial Sequence
  chemically synthesized
tttgaggctatggatctgcc

SEQ ID NO: 237687 - DNA, 20 bp, Artificial Sequence
  chemically synthesized
gatcaaatcaggtttcttgg

SEQ ID NO: 237688 - DNA, 20 bp, Artificial Sequence
  chemically synthesized
aatgatcaaatcaggtttct

SEQ ID NO: 237689 - DNA, 20 bp, Artificial Sequence
  chemically synthesized
cattgtgtaatgatcaaatc

SEQ ID NO: 237690 - DNA, 20 bp, Artificial Sequence
  chemically synthesized
tcattgtgtaatgatcaaat

SEQ ID NO: 237691 - DNA, 20 bp, Artificial Sequence
  chemically synthesized
tggggtacagtgtgacgttt

SEQ ID NO: 237692 - DNA, 20 bp, Artificial Sequence
  chemically synthesized
ctatatgtatttatggggta

SEQ ID NO: 237693 - DNA, 20 bp, Artificial Sequence
  chemically synthesized
aataactatatgtatttatg

SEQ ID NO: 237694 - DNA, 20 bp, Artificial Sequence
  chemically synthesized
taataactatatgtatttat

SEQ ID NO: 237695 - DNA, 20 bp, Artificial Sequence
  chemically synthesized
gtaataactatatgtattta

SEQ ID NO: 237696 - DNA, 20 bp, Artificial Sequence
  chemically synthesized
ctgtaccccataaatacata

SEQ ID NO: 237697 - DNA, 20 bp, Artificial Sequence
  chemically synthesized
gtattttagttatattttta

SEQ ID NO: 237698 - DNA, 20 bp, Artificial Sequence
  chemically synthesized
ttggtgtgataatggtattt

SEQ ID NO: 237699 - DNA, 20 bp, Artificial Sequence
  chemically synthesized
ttgatttattggtgtgataa

SEQ ID NO: 237700 - DNA, 20 bp, Artificial Sequence
  chemically synthesized
gtgacgaattattgatttat

SEQ ID NO: 237701 - DNA, 20 bp, Artificial Sequence
  chemically synthesized
ataattcgtcactatcatta

SEQ ID NO: 237702 - DNA, 20 bp, Artificial Sequence
  chemically synthesized
attgacagaatctttaatga

SEQ ID NO: 237703 - DNA, 20 bp, Artificial Sequence
  chemically synthesized
catcttattttaaatattga

SEQ ID NO: 237704 - DNA, 20 bp, Artificial Sequence
  chemically synthesized
attctgtcaatatttaaaat

SEQ ID NO: 237705 - DNA, 20 bp, Artificial Sequence
  chemically synthesized
caatatttaaaataagatga

SEQ ID NO: 237706 - DNA, 20 bp, Artificial Sequence
  chemically synthesized
gacagatataattcatattg

SEQ ID NO: 237707 - DNA, 20 bp, Artificial Sequence
  chemically synthesized
acagatataattcatattgt

SEQ ID NO: 237708 - DNA, 20 bp, Artificial Sequence
  chemically synthesized
catattgtaggctcacatgt

SEQ ID NO: 237709 - DNA, 20 bp, Artificial Sequence
  chemically synthesized
gttatttaatgcttacatgt

SEQ ID NO: 237710 - DNA, 20 bp, Artificial Sequence
  chemically synthesized
catcgcatagtttagtatat

SEQ ID NO: 237711 - DNA, 20 bp, Artificial Sequence
  chemically synthesized
aaagaaggcatcgcatagtt

SEQ ID NO: 237712 - DNA, 20 bp, Artificial Sequence
  chemically synthesized
ggattaaagaaggcatcgca

SEQ ID NO: 237713 - DNA, 20 bp, Artificial Sequence
  chemically synthesized
aaaataagaaggattaaaga

SEQ ID NO: 237714 - DNA, 20 bp, Artificial Sequence
  chemically synthesized
taaaataagaaggattaaag

SEQ ID NO: 237715 - DNA, 20 bp, Artificial Sequence
  chemically synthesized
caataaaataagaaggatta

SEQ ID NO: 237716 - DNA, 20 bp, Artificial Sequence
  chemically synthesized
gtgactacaataaaataaga

SEQ ID NO: 237717 - DNA, 20 bp, Artificial Sequence
  chemically synthesized
agtgactacaataaaataag

SEQ ID NO: 237718 - DNA, 20 bp, Artificial Sequence
  chemically synthesized
tttagtgactacaataaaat

SEQ ID NO: 237719 - DNA, 20 bp, Artificial Sequence
  chemically synthesized
taatccttcttattttattg

SEQ ID NO: 237720 - DNA, 20 bp, Artificial Sequence
  chemically synthesized
tattgtagtcactaaaattt

SEQ ID NO: 237721 - DNA, 20 bp, Artificial Sequence
  chemically synthesized
agtattccaatctaaaattt

SEQ ID NO: 237722 - DNA, 20 bp, Artificial Sequence
  chemically synthesized
tagtcactaaaattttagat

SEQ ID NO: 237723 - DNA, 20 bp, Artificial Sequence
  chemically synthesized
aattttagattggaatactg

SEQ ID NO: 237724 - DNA, 20 bp, Artificial Sequence
  chemically synthesized
attttagattggaatactgc

SEQ ID NO: 237725 - DNA, 20 bp, Artificial Sequence
  chemically synthesized
tgacttgtactaagttcctg

SEQ ID NO: 237726 - DNA, 20 bp, Artificial Sequence
  chemically synthesized
attggaatactgcaggaact

SEQ ID NO: 237727 - DNA, 20 bp, Artificial Sequence
  chemically synthesized
atactgcaggaacttagtac

SEQ ID NO: 237728 - DNA, 20 bp, Artificial Sequence
  chemically synthesized
taacacatttgacttgtact

SEQ ID NO: 237729 - DNA, 20 bp, Artificial Sequence
  chemically synthesized
aaatgtgttaatactacaca

SEQ ID NO: 237730 - DNA, 20 bp, Artificial Sequence
  chemically synthesized
cctaatattctttccatgtg

SEQ ID NO: 237731 - DNA, 20 bp, Artificial Sequence
  chemically synthesized
gtgttaatactacacatgga

SEQ ID NO: 237732 - DNA, 20 bp, Artificial Sequence
  chemically synthesized
actacacatggaaagaatat

SEQ ID NO: 237733 - DNA, 20 bp, Artificial Sequence
  chemically synthesized
ctacacatggaaagaatatt

SEQ ID NO: 237734 - DNA, 20 bp, Artificial Sequence
  chemically synthesized
tggaaagaatattaggaaac

SEQ ID NO: 237735 - DNA, 20 bp, Artificial Sequence
  chemically synthesized
aatattaggaaacaagcatt

SEQ ID NO: 237736 - DNA, 20 bp, Artificial Sequence
  chemically synthesized
acaagcatttggtcaccttc

SEQ ID NO: 237737 - DNA, 20 bp, Artificial Sequence
  chemically synthesized
cagtctcttttatgactgga

SEQ ID NO: 237738 - DNA, 20 bp, Artificial Sequence
  chemically synthesized
tcagtctcttttatgactgg

SEQ ID NO: 237739 - DNA, 20 bp, Artificial Sequence
  chemically synthesized
tggtcaccttccagtcataa

SEQ ID NO: 237740 - DNA, 20 bp, Artificial Sequence
  chemically synthesized
gcctcagtctcttttatgac

SEQ ID NO: 237741 - DNA, 20 bp, Artificial Sequence
  chemically synthesized
gtcaccttccagtcataaaa

SEQ ID NO: 237742 - DNA, 20 bp, Artificial Sequence
  chemically synthesized
ttccagtcataaaagagact

SEQ ID NO: 237743 - DNA, 20 bp, Artificial Sequence
  chemically synthesized
tccagtcataaaagagactg

SEQ ID NO: 237744 - DNA, 20 bp, Artificial Sequence
  chemically synthesized
agtcataaaagagactgagg

SEQ ID NO: 237745 - DNA, 20 bp, Artificial Sequence
  chemically synthesized
ggttcatattatttctgcct

SEQ ID NO: 237746 - DNA, 20 bp, Artificial Sequence
  chemically synthesized
gaggcagaaataatatgaac

SEQ ID NO: 237747 - DNA, 20 bp, Artificial Sequence
  chemically synthesized
aggcagaaataatatgaacc

SEQ ID NO: 237748 - DNA, 20 bp, Artificial Sequence
  chemically synthesized
ggcagaaataatatgaacca

SEQ ID NO: 237749 - DNA, 20 bp, Artificial Sequence
  chemically synthesized
cttaggtaaacatacagccc

SEQ ID NO: 237750 - DNA, 20 bp, Artificial Sequence
  chemically synthesized
aactgtcttaggtaaacata

SEQ ID NO: 237751 - DNA, 20 bp, Artificial Sequence
  chemically synthesized
ccagggctgtatgtttacct

SEQ ID NO: 237752 - DNA, 20 bp, Artificial Sequence
  chemically synthesized
ggctgtatgtttacctaaga

SEQ ID NO: 237753 - DNA, 20 bp, Artificial Sequence
  chemically synthesized
ttcttatgtgcaactgtctt

SEQ ID NO: 237754 - DNA, 20 bp, Artificial Sequence
  chemically synthesized
attcttatgtgcaactgtct

SEQ ID NO: 237755 - DNA, 20 bp, Artificial Sequence
  chemically synthesized
tacctaagacagttgcacat

SEQ ID NO: 237756 - DNA, 20 bp, Artificial Sequence
  chemically synthesized
agttgcacataagaatcaac

SEQ ID NO: 237757 - DNA, 20 bp, Artificial Sequence
  chemically synthesized
gttgcacataagaatcaact

SEQ ID NO: 237758 - DNA, 20 bp, Artificial Sequence
  chemically synthesized
ttgcacataagaatcaactg

SEQ ID NO: 237759 - DNA, 20 bp, Artificial Sequence
  chemically synthesized
ttgctgtgttttaaatgccc

SEQ ID NO: 237760 - DNA, 20 bp, Artificial Sequence
  chemically synthesized
caactggggcatttaaaaca

SEQ ID NO: 237761 - DNA, 20 bp, Artificial Sequence
  chemically synthesized
cagcaacaacaataaccaaa

SEQ ID NO: 237762 - DNA, 20 bp, Artificial Sequence
  chemically synthesized
ggagccccaggatcactgtt

SEQ ID NO: 237763 - DNA, 20 bp, Artificial Sequence
  chemically synthesized
caataaccaaacagtgatcc

SEQ ID NO: 237764 - DNA, 20 bp, Artificial Sequence
  chemically synthesized
aataaccaaacagtgatcct

SEQ ID NO: 237765 - DNA, 20 bp, Artificial Sequence
  chemically synthesized
ataaccaaacagtgatcctg

SEQ ID NO: 237766 - DNA, 20 bp, Artificial Sequence
  chemically synthesized
ttggtctggaatggagcccc

SEQ ID NO: 237767 - DNA, 20 bp, Artificial Sequence
  chemically synthesized
gttggtctggaatggagccc

SEQ ID NO: 237768 - DNA, 20 bp, Artificial Sequence
  chemically synthesized
gtgatcctggggctccattc

SEQ ID NO: 237769 - DNA, 20 bp, Artificial Sequence
  chemically synthesized
gattaagttggtctggaatg

SEQ ID NO: 237770 - DNA, 20 bp, Artificial Sequence
  chemically synthesized
ctgattaagttggtctggaa

SEQ ID NO: 237771 - DNA, 20 bp, Artificial Sequence
  chemically synthesized
aaatactgattaagttggtc

SEQ ID NO: 237772 - DNA, 20 bp, Artificial Sequence
  chemically synthesized
ccattccagaccaacttaat

SEQ ID NO: 237773 - DNA, 20 bp, Artificial Sequence
  chemically synthesized
tccagaaatactgattaagt

SEQ ID NO: 237774 - DNA, 20 bp, Artificial Sequence
  chemically synthesized
aacctccagaaatactgatt

SEQ ID NO: 237775 - DNA, 20 bp, Artificial Sequence
  chemically synthesized
accaacttaatcagtatttc

SEQ ID NO: 237776 - DNA, 20 bp, Artificial Sequence
  chemically synthesized
caacttaatcagtatttctg

SEQ ID NO: 237777 - DNA, 20 bp, Artificial Sequence
  chemically synthesized
aacttaatcagtatttctgg

SEQ ID NO: 237778 - DNA, 20 bp, Artificial Sequence
  chemically synthesized
taatcagtatttctggaggt

SEQ ID NO: 237779 - DNA, 20 bp, Artificial Sequence
  chemically synthesized
cagcgtcagtgtccaacctc

SEQ ID NO: 237780 - DNA, 20 bp, Artificial Sequence
  chemically synthesized
gctttgaaaaataacagcgt

SEQ ID NO: 237781 - DNA, 20 bp, Artificial Sequence
  chemically synthesized
ctggatgctttgaaaaataa

SEQ ID NO: 237782 - DNA, 20 bp, Artificial Sequence
  chemically synthesized
actgacgctgttatttttca

SEQ ID NO: 237783 - DNA, 20 bp, Artificial Sequence
  chemically synthesized
ctgttatttttcaaagcatc

SEQ ID NO: 237784 - DNA, 20 bp, Artificial Sequence
  chemically synthesized
tgttatttttcaaagcatcc

SEQ ID NO: 237785 - DNA, 20 bp, Artificial Sequence
  chemically synthesized
gactgtacattgaaatcacc

SEQ ID NO: 237786 - DNA, 20 bp, Artificial Sequence
  chemically synthesized
atccaggtgatttcaatgta

SEQ ID NO: 237787 - DNA, 20 bp, Artificial Sequence
  chemically synthesized
ggtgatttcaatgtacagtc

SEQ ID NO: 237788 - DNA, 20 bp, Artificial Sequence
  chemically synthesized
gtgatttcaatgtacagtca

SEQ ID NO: 237789 - DNA, 20 bp, Artificial Sequence
  chemically synthesized
aggtgaaaaacactgccgta

SEQ ID NO: 237790 - DNA, 20 bp, Artificial Sequence
  chemically synthesized
tttcaaatcttactttacgg

SEQ ID NO: 237791 - DNA, 20 bp, Artificial Sequence
  chemically synthesized
gaaaaacactgccgtaaagt

SEQ ID NO: 237792 - DNA, 20 bp, Artificial Sequence
  chemically synthesized
agatttcaaatcttacttta

SEQ ID NO: 237793 - DNA, 20 bp, Artificial Sequence
  chemically synthesized
agtaagatttgaaatcttac

SEQ ID NO: 237794 - DNA, 20 bp, Artificial Sequence
  chemically synthesized
gtaagatttgaaatcttact

SEQ ID NO: 237795 - DNA, 20 bp, Artificial Sequence
  chemically synthesized
tggtagactgtaagcccagt

SEQ ID NO: 237796 - DNA, 20 bp, Artificial Sequence
  chemically synthesized
ttgaaatcttactgggctta

SEQ ID NO: 237797 - DNA, 20 bp, Artificial Sequence
  chemically synthesized
aatctggtagactgtaagcc

SEQ ID NO: 237798 - DNA, 20 bp, Artificial Sequence
  chemically synthesized
caggaaatctggtagactgt

SEQ ID NO: 237799 - DNA, 20 bp, Artificial Sequence
  chemically synthesized
ttactgggcttacagtctac

SEQ ID NO: 237800 - DNA, 20 bp, Artificial Sequence
  chemically synthesized
gcaggccccaggaaatctgg

SEQ ID NO: 237801 - DNA, 20 bp, Artificial Sequence
  chemically synthesized
ttacagtctaccagatttcc

SEQ ID NO: 237802 - DNA, 20 bp, Artificial Sequence
  chemically synthesized
tgggcaggccccaggaaatc

SEQ ID NO: 237803 - DNA, 20 bp, Artificial Sequence
  chemically synthesized
tacagtctaccagatttcct

SEQ ID NO: 237804 - DNA, 20 bp, Artificial Sequence
  chemically synthesized
acagtctaccagatttcctg

SEQ ID NO: 237805 - DNA, 20 bp, Artificial Sequence
  chemically synthesized
tgcttgcttgggcaggcccc

SEQ ID NO: 237806 - DNA, 20 bp, Artificial Sequence
  chemically synthesized
atgcttgcttgggcaggccc

SEQ ID NO: 237807 - DNA, 20 bp, Artificial Sequence
  chemically synthesized
agatttcctggggcctgccc

SEQ ID NO: 237808 - DNA, 20 bp, Artificial Sequence
  chemically synthesized
tcacaaatgcttgcttgggc

SEQ ID NO: 237809 - DNA, 20 bp, Artificial Sequence
  chemically synthesized
ttcctggggcctgcccaagc

SEQ ID NO: 237810 - DNA, 20 bp, Artificial Sequence
  chemically synthesized
ctcacaaatgcttgcttggg

SEQ ID NO: 237811 - DNA, 20 bp, Artificial Sequence
  chemically synthesized
gtgctcacaaatgcttgctt

SEQ ID NO: 237812 - DNA, 20 bp, Artificial Sequence
  chemically synthesized
tgtgctcacaaatgcttgct

SEQ ID NO: 237813 - DNA, 20 bp, Artificial Sequence
  chemically synthesized
ctgcccaagcaagcatttgt

SEQ ID NO: 237814 - DNA, 20 bp, Artificial Sequence
  chemically synthesized
atttgtgagcacaaaaccaa

SEQ ID NO: 237815 - DNA, 20 bp, Artificial Sequence
  chemically synthesized
gtaatctgtaggatggctat

SEQ ID NO: 237816 - DNA, 20 bp, Artificial Sequence
  chemically synthesized
caaaaccaatagccatccta

SEQ ID NO: 237817 - DNA, 20 bp, Artificial Sequence
  chemically synthesized
atagccggtaatctgtagga

SEQ ID NO: 237818 - DNA, 20 bp, Artificial Sequence
  chemically synthesized
caccatagccggtaatctgt

SEQ ID NO: 237819 - DNA, 20 bp, Artificial Sequence
  chemically synthesized
gcaccatagccggtaatctg

SEQ ID NO: 237820 - DNA, 20 bp, Artificial Sequence
  chemically synthesized
atagccatcctacagattac

SEQ ID NO: 237821 - DNA, 20 bp, Artificial Sequence
  chemically synthesized
atcctacagattaccggcta

SEQ ID NO: 237822 - DNA, 20 bp, Artificial Sequence
  chemically synthesized
ctctgaggcagcaccatagc

SEQ ID NO: 237823 - DNA, 20 bp, Artificial Sequence
  chemically synthesized
tgtactctgaggcagcacca

SEQ ID NO: 237824 - DNA, 20 bp, Artificial Sequence
  chemically synthesized
taccggctatggtgctgcct

SEQ ID NO: 237825 - DNA, 20 bp, Artificial Sequence
  chemically synthesized
ccggctatggtgctgcctca

SEQ ID NO: 237826 - DNA, 20 bp, Artificial Sequence
  chemically synthesized
cagattcctgtactctgagg

SEQ ID NO: 237827 - DNA, 20 bp, Artificial Sequence
  chemically synthesized
tatggtgctgcctcagagta

SEQ ID NO: 237828 - DNA, 20 bp, Artificial Sequence
  chemically synthesized
tgacagattcctgtactctg

SEQ ID NO: 237829 - DNA, 20 bp, Artificial Sequence
  chemically synthesized
atggtgctgcctcagagtac

SEQ ID NO: 237830 - DNA, 20 bp, Artificial Sequence
  chemically synthesized
ttgacagattcctgtactct

SEQ ID NO: 237831 - DNA, 20 bp, Artificial Sequence
  chemically synthesized
tcagagtacaggaatctgtc

SEQ ID NO: 237832 - DNA, 20 bp, Artificial Sequence
  chemically synthesized
tagagttcagaaaagcttga

SEQ ID NO: 237833 - DNA, 20 bp, Artificial Sequence
  chemically synthesized
cttaagaatagagttcagaa

SEQ ID NO: 237834 - DNA, 20 bp, Artificial Sequence
  chemically synthesized
tgcttcttaagaatagagtt

SEQ ID NO: 237835 - DNA, 20 bp, Artificial Sequence
  chemically synthesized
cttttctgaactctattctt

SEQ ID NO: 237836 - DNA, 20 bp, Artificial Sequence
  chemically synthesized
tccattgcttcttaagaata

SEQ ID NO: 237837 - DNA, 20 bp, Artificial Sequence
  chemically synthesized
gatccattgcttcttaagaa

SEQ ID NO: 237838 - DNA, 20 bp, Artificial Sequence
  chemically synthesized
ttctgaactctattcttaag

SEQ ID NO: 237839 - DNA, 20 bp, Artificial Sequence
  chemically synthesized
agtatgatccattgcttctt

SEQ ID NO: 237840 - DNA, 20 bp, Artificial Sequence
  chemically synthesized
actctattcttaagaagcaa

SEQ ID NO: 237841 - DNA, 20 bp, Artificial Sequence
  chemically synthesized
aaagatatcatggtattcaa

SEQ ID NO: 237842 - DNA, 20 bp, Artificial Sequence
  chemically synthesized
agaggactgaaaagatatca

SEQ ID NO: 237843 - DNA, 20 bp, Artificial Sequence
  chemically synthesized
tgaataccatgatatctttt

SEQ ID NO: 237844 - DNA, 20 bp, Artificial Sequence
  chemically synthesized
aatgaaggtagaggactgaa

SEQ ID NO: 237845 - DNA, 20 bp, Artificial Sequence
  chemically synthesized
aaattcctgaatgaaggtag

SEQ ID NO: 237846 - DNA, 20 bp, Artificial Sequence
  chemically synthesized
taaattcctgaatgaaggta

SEQ ID NO: 237847 - DNA, 20 bp, Artificial Sequence
  chemically synthesized
tttaaattcctgaatgaagg

SEQ ID NO: 237848 - DNA, 20 bp, Artificial Sequence
  chemically synthesized
ttcagtcctctaccttcatt

SEQ ID NO: 237849 - DNA, 20 bp, Artificial Sequence
  chemically synthesized
tcagtcctctaccttcattc

SEQ ID NO: 237850 - DNA, 20 bp, Artificial Sequence
  chemically synthesized
tactttaaattcctgaatga

SEQ ID NO: 237851 - DNA, 20 bp, Artificial Sequence
  chemically synthesized
ttactttaaattcctgaatg

SEQ ID NO: 237852 - DNA, 20 bp, Artificial Sequence
  chemically synthesized
taccttcattcaggaattta

SEQ ID NO: 237853 - DNA, 20 bp, Artificial Sequence
  chemically synthesized
tcaggaatttaaagtaacac

SEQ ID NO: 237854 - DNA, 20 bp, Artificial Sequence
  chemically synthesized
ggaatttaaagtaacactag

SEQ ID NO: 237855 - DNA, 20 bp, Artificial Sequence
  chemically synthesized
atgtagcaatttaaaacttc

SEQ ID NO: 237856 - DNA, 20 bp, Artificial Sequence
  chemically synthesized
aggacatcagtaggcagatg

SEQ ID NO: 237857 - DNA, 20 bp, Artificial Sequence
  chemically synthesized
ctgcccaggacatcagtagg

SEQ ID NO: 237858 - DNA, 20 bp, Artificial Sequence
  chemically synthesized
tctctgcccaggacatcagt

SEQ ID NO: 237859 - DNA, 20 bp, Artificial Sequence
  chemically synthesized
ttctctgcccaggacatcag

SEQ ID NO: 237860 - DNA, 20 bp, Artificial Sequence
  chemically synthesized
acatctgcctactgatgtcc

SEQ ID NO: 237861 - DNA, 20 bp, Artificial Sequence
  chemically synthesized
catctgcctactgatgtcct

SEQ ID NO: 237862 - DNA, 20 bp, Artificial Sequence
  chemically synthesized
cctttctctgcccaggacat

SEQ ID NO: 237863 - DNA, 20 bp, Artificial Sequence
  chemically synthesized
ctgcctactgatgtcctggg

SEQ ID NO: 237864 - DNA, 20 bp, Artificial Sequence
  chemically synthesized
gcctactgatgtcctgggca

SEQ ID NO: 237865 - DNA, 20 bp, Artificial Sequence
  chemically synthesized
gttaattcctttctctgccc

SEQ ID NO: 237866 - DNA, 20 bp, Artificial Sequence
  chemically synthesized
tgttaattcctttctctgcc

SEQ ID NO: 237867 - DNA, 20 bp, Artificial Sequence
  chemically synthesized
actgatgtcctgggcagaga

SEQ ID NO: 237868 - DNA, 20 bp, Artificial Sequence
  chemically synthesized
ctgatgtcctgggcagagaa

SEQ ID NO: 237869 - DNA, 20 bp, Artificial Sequence
  chemically synthesized
aggaattaacatttattaaa

SEQ ID NO: 237870 - DNA, 20 bp, Artificial Sequence
  chemically synthesized
atttattaaacagttactaa

SEQ ID NO: 237871 - DNA, 20 bp, Artificial Sequence
  chemically synthesized
attaaacagttactaatagc

SEQ ID NO: 237872 - DNA, 20 bp, Artificial Sequence
  chemically synthesized
ttaaacagttactaatagcc

SEQ ID NO: 237873 - DNA, 20 bp, Artificial Sequence
  chemically synthesized
agagcccggtgcctggctat

SEQ ID NO: 237874 - DNA, 20 bp, Artificial Sequence
  chemically synthesized
agttactaatagccaggcac

SEQ ID NO: 237875 - DNA, 20 bp, Artificial Sequence
  chemically synthesized
gttactaatagccaggcacc

SEQ ID NO: 237876 - DNA, 20 bp, Artificial Sequence
  chemically synthesized
aaagcacagagcccggtgcc

SEQ ID NO: 237877 - DNA, 20 bp, Artificial Sequence
  chemically synthesized
cactataaaagcacagagcc

SEQ ID NO: 237878 - DNA, 20 bp, Artificial Sequence
  chemically synthesized
tctggcactataaaagcaca

SEQ ID NO: 237879 - DNA, 20 bp, Artificial Sequence
  chemically synthesized
tgtctggcactataaaagca

SEQ ID NO: 237880 - DNA, 20 bp, Artificial Sequence
  chemically synthesized
caccgggctctgtgctttta

SEQ ID NO: 237881 - DNA, 20 bp, Artificial Sequence
  chemically synthesized
tgatgtgtctggcactataa

SEQ ID NO: 237882 - DNA, 20 bp, Artificial Sequence
  chemically synthesized
gctctgtgcttttatagtgc

SEQ ID NO: 237883 - DNA, 20 bp, Artificial Sequence
  chemically synthesized
tgtcaatgaaatgatgtgtc

SEQ ID NO: 237884 - DNA, 20 bp, Artificial Sequence
  chemically synthesized
ttatgctgcagggttattgt

SEQ ID NO: 237885 - DNA, 20 bp, Artificial Sequence
  chemically synthesized
gttatgctgcagggttattg

SEQ ID NO: 237886 - DNA, 20 bp, Artificial Sequence
  chemically synthesized
tgacacctacaataaccctg

SEQ ID NO: 237887 - DNA, 20 bp, Artificial Sequence
  chemically synthesized
ataataattgttatgctgca

SEQ ID NO: 237888 - DNA, 20 bp, Artificial Sequence
  chemically synthesized
aataataattgttatgctgc

SEQ ID NO: 237889 - DNA, 20 bp, Artificial Sequence
  chemically synthesized
gaataataattgttatgctg

SEQ ID NO: 237890 - DNA, 20 bp, Artificial Sequence
  chemically synthesized
tgttttctccaatggaaaat

SEQ ID NO: 237891 - DNA, 20 bp, Artificial Sequence
  chemically synthesized
ctgttttctccaatggaaaa

SEQ ID NO: 237892 - DNA, 20 bp, Artificial Sequence
  chemically synthesized
ttattattcccattttccat

SEQ ID NO: 237893 - DNA, 20 bp, Artificial Sequence
  chemically synthesized
attattcccattttccattg

SEQ ID NO: 237894 - DNA, 20 bp, Artificial Sequence
  chemically synthesized
ttggcctctgttttctccaa

SEQ ID NO: 237895 - DNA, 20 bp, Artificial Sequence
  chemically synthesized
ccattttccattggagaaaa

SEQ ID NO: 237896 - DNA, 20 bp, Artificial Sequence
  chemically synthesized
attttccattggagaaaaca

SEQ ID NO: 237897 - DNA, 20 bp, Artificial Sequence
  chemically synthesized
ttttccattggagaaaacag

SEQ ID NO: 237898 - DNA, 20 bp, Artificial Sequence
  chemically synthesized
cattggagaaaacagaggcc

SEQ ID NO: 237899 - DNA, 20 bp, Artificial Sequence
  chemically synthesized
tcaccttttggcaaattact

SEQ ID NO: 237900 - DNA, 20 bp, Artificial Sequence
  chemically synthesized
gaggccaagtaatttgccaa

SEQ ID NO: 237901 - DNA, 20 bp, Artificial Sequence
  chemically synthesized
aggccaagtaatttgccaaa

SEQ ID NO: 237902 - DNA, 20 bp, Artificial Sequence
  chemically synthesized
ttaataccattttcaccttt

SEQ ID NO: 237903 - DNA, 20 bp, Artificial Sequence
  chemically synthesized
aatttgccaaaaggtgaaaa

SEQ ID NO: 237904 - DNA, 20 bp, Artificial Sequence
  chemically synthesized
aaggtgaaaatggtattaaa

SEQ ID NO: 237905 - DNA, 20 bp, Artificial Sequence
  chemically synthesized
gtgaaaatggtattaaatag

SEQ ID NO: 237906 - DNA, 20 bp, Artificial Sequence
  chemically synthesized
gaaaatggtattaaatagta

SEQ ID NO: 237907 - DNA, 20 bp, Artificial Sequence
  chemically synthesized
aaatggtattaaatagtaga

SEQ ID NO: 237908 - DNA, 20 bp, Artificial Sequence
  chemically synthesized
atggtattaaatagtagaga

SEQ ID NO: 237909 - DNA, 20 bp, Artificial Sequence
  chemically synthesized
tggtattaaatagtagagag

SEQ ID NO: 237910 - DNA, 20 bp, Artificial Sequence
  chemically synthesized
acaagagatatttgggttag

SEQ ID NO: 237911 - DNA, 20 bp, Artificial Sequence
  chemically synthesized
gaaacaagagatatttgggt

SEQ ID NO: 237912 - DNA, 20 bp, Artificial Sequence
  chemically synthesized
cattgaaacaagagatattt

SEQ ID NO: 237913 - DNA, 20 bp, Artificial Sequence
  chemically synthesized
ccattgaaacaagagatatt

SEQ ID NO: 237914 - DNA, 20 bp, Artificial Sequence
  chemically synthesized
gaaaagtgccattgaaacaa

SEQ ID NO: 237915 - DNA, 20 bp, Artificial Sequence
  chemically synthesized
ccaaatatctcttgtttcaa

SEQ ID NO: 237916 - DNA, 20 bp, Artificial Sequence
  chemically synthesized
tagaaaagtgccattgaaac

SEQ ID NO: 237917 - DNA, 20 bp, Artificial Sequence
  chemically synthesized
tttcaatggcacttttctac

SEQ ID NO: 237918 - DNA, 20 bp, Artificial Sequence
  chemically synthesized
gagcatgtgcactggtagaa

SEQ ID NO: 237919 - DNA, 20 bp, Artificial Sequence
  chemically synthesized
caagagagcatgtgcactgg

SEQ ID NO: 237920 - DNA, 20 bp, Artificial Sequence
  chemically synthesized
tcacaagagagcatgtgcac

SEQ ID NO: 237921 - DNA, 20 bp, Artificial Sequence
  chemically synthesized
ggaaaaataatttcacaaga

SEQ ID NO: 237922 - DNA, 20 bp, Artificial Sequence
  chemically synthesized
ttggaaaaataatttcacaa

SEQ ID NO: 237923 - DNA, 20 bp, Artificial Sequence
  chemically synthesized
tcttggaaaaataatttcac

SEQ ID NO: 237924 - DNA, 20 bp, Artificial Sequence
  chemically synthesized
tcttgtgaaattatttttcc

SEQ ID NO: 237925 - DNA, 20 bp, Artificial Sequence
  chemically synthesized
gaaattatttttccaagatg

SEQ ID NO: 237926 - DNA, 20 bp, Artificial Sequence
  chemically synthesized
gataaagtgaagcttcatct

SEQ ID NO: 237927 - DNA, 20 bp, Artificial Sequence
  chemically synthesized
attgtttaactgataaagtg

SEQ ID NO: 237928 - DNA, 20 bp, Artificial Sequence
  chemically synthesized
aagatgaagcttcactttat

SEQ ID NO: 237929 - DNA, 20 bp, Artificial Sequence
  chemically synthesized
ttttaattgtttaactgata

SEQ ID NO: 237930 - DNA, 20 bp, Artificial Sequence
  chemically synthesized
tttatcagttaaacaattaa

SEQ ID NO: 237931 - DNA, 20 bp, Artificial Sequence
  chemically synthesized
agttaaacaattaaaagtga

SEQ ID NO: 237932 - DNA, 20 bp, Artificial Sequence
  chemically synthesized
acaattaaaagtgatagttc

SEQ ID NO: 237933 - DNA, 20 bp, Artificial Sequence
  chemically synthesized
aattaaaagtgatagttcta

SEQ ID NO: 237934 - DNA, 20 bp, Artificial Sequence
  chemically synthesized
attaaaagtgatagttctag

SEQ ID NO: 237935 - DNA, 20 bp, Artificial Sequence
  chemically synthesized
aaataaggggaaaaaacctc

SEQ ID NO: 237936 - DNA, 20 bp, Artificial Sequence
  chemically synthesized
gggtagttaataaaaataag

SEQ ID NO: 237937 - DNA, 20 bp, Artificial Sequence
  chemically synthesized
tgggtagttaataaaaataa

SEQ ID NO: 237938 - DNA, 20 bp, Artificial Sequence
  chemically synthesized
ttgggtagttaataaaaata

SEQ ID NO: 237939 - DNA, 20 bp, Artificial Sequence
  chemically synthesized
tttgggtagttaataaaaat

SEQ ID NO: 237940 - DNA, 20 bp, Artificial Sequence
  chemically synthesized
atacattattaaattttggg

SEQ ID NO: 237941 - DNA, 20 bp, Artificial Sequence
  chemically synthesized
tagatacattattaaatttt

SEQ ID NO: 237942 - DNA, 20 bp, Artificial Sequence
  chemically synthesized
gtagatacattattaaattt

SEQ ID NO: 237943 - DNA, 20 bp, Artificial Sequence
  chemically synthesized
caatgagtgcaatgtacatg

SEQ ID NO: 237944 - DNA, 20 bp, Artificial Sequence
  chemically synthesized
aattattcattaaatacaat

SEQ ID NO: 237945 - DNA, 20 bp, Artificial Sequence
  chemically synthesized
tttacaagattttaaaggtt

SEQ ID NO: 237946 - DNA, 20 bp, Artificial Sequence
  chemically synthesized
tctgttttacaagattttaa

SEQ ID NO: 237947 - DNA, 20 bp, Artificial Sequence
  chemically synthesized
gtctgttttacaagatttta

SEQ ID NO: 237948 - DNA, 20 bp, Artificial Sequence
  chemically synthesized
acctttaaaatcttgtaaaa

SEQ ID NO: 237949 - DNA, 20 bp, Artificial Sequence
  chemically synthesized
caaaatgctgtctgttttac

SEQ ID NO: 237950 - DNA, 20 bp, Artificial Sequence
  chemically synthesized
ttaaaatcttgtaaaacaga

SEQ ID NO: 237951 - DNA, 20 bp, Artificial Sequence
  chemically synthesized
ttgtaaaacagacagcattt

SEQ ID NO: 237952 - DNA, 20 bp, Artificial Sequence
  chemically synthesized
taaaacagacagcattttgg

SEQ ID NO: 237953 - DNA, 20 bp, Artificial Sequence
  chemically synthesized
agcattttggtagcataaaa

SEQ ID NO: 237954 - DNA, 20 bp, Artificial Sequence
  chemically synthesized
gcattttggtagcataaaaa

SEQ ID NO: 237955 - DNA, 20 bp, Artificial Sequence
  chemically synthesized
tagcataaaaaaggcaaccg

SEQ ID NO: 237956 - DNA, 20 bp, Artificial Sequence
  chemically synthesized
agcataaaaaaggcaaccga

SEQ ID NO: 237957 - DNA, 20 bp, Artificial Sequence
  chemically synthesized
ataaaaaaggcaaccgaagg

SEQ ID NO: 237958 - DNA, 20 bp, Artificial Sequence
  chemically synthesized
aatacctcttcggctacctt

SEQ ID NO: 237959 - DNA, 20 bp, Artificial Sequence
  chemically synthesized
aaggcaaccgaaggtagccg

SEQ ID NO: 237960 - DNA, 20 bp, Artificial Sequence
  chemically synthesized
ggcaaccgaaggtagccgaa

SEQ ID NO: 237961 - DNA, 20 bp, Artificial Sequence
  chemically synthesized
gcaaccgaaggtagccgaag

SEQ ID NO: 237962 - DNA, 20 bp, Artificial Sequence
  chemically synthesized
acagttagagaatacctctt

SEQ ID NO: 237963 - DNA, 20 bp, Artificial Sequence
  chemically synthesized
gaagaggtattctctaactg

SEQ ID NO: 237964 - DNA, 20 bp, Artificial Sequence
  chemically synthesized
tttttcactaactacagtta

SEQ ID NO: 237965 - DNA, 20 bp, Artificial Sequence
  chemically synthesized
tatttttcactaactacagt

SEQ ID NO: 237966 - DNA, 20 bp, Artificial Sequence
  chemically synthesized
aggtattctctaactgtagt

SEQ ID NO: 237967 - DNA, 20 bp, Artificial Sequence
  chemically synthesized
ttcttatttttcactaacta

SEQ ID NO: 237968 - DNA, 20 bp, Artificial Sequence
  chemically synthesized
aactgtagttagtgaaaaat

SEQ ID NO: 237969 - DNA, 20 bp, Artificial Sequence
  chemically synthesized
agaataccataaatcatcaa

SEQ ID NO: 237970 - DNA, 20 bp, Artificial Sequence
  chemically synthesized
tagaataccataaatcatca

SEQ ID NO: 237971 - DNA, 20 bp, Artificial Sequence
  chemically synthesized
atgttgcctttgatgattta

SEQ ID NO: 237972 - DNA, 20 bp, Artificial Sequence
  chemically synthesized
tttgatgatttatggtattc

SEQ ID NO: 237973 - DNA, 20 bp, Artificial Sequence
  chemically synthesized
tgatgatttatggtattcta

SEQ ID NO: 237974 - DNA, 20 bp, Artificial Sequence
  chemically synthesized
atattgtatctgaataactc

SEQ ID NO: 237975 - DNA, 20 bp, Artificial Sequence
  chemically synthesized
tatggtattctagagttatt

SEQ ID NO: 237976 - DNA, 20 bp, Artificial Sequence
  chemically synthesized
caagatcattttgttgtgga

SEQ ID NO: 237977 - DNA, 20 bp, Artificial Sequence
  chemically synthesized
gcaagatcattttgttgtgg

SEQ ID NO: 237978 - DNA, 20 bp, Artificial Sequence
  chemically synthesized
ttggcaagatcattttgttg
